United States Patent 7,691,997 (FUNCTIONAL AND HYPERFUNCTIONAL SIRNA) - sequence listing, part 17

SEQ ID NO: 669666 - RNA, 19 nt, Homo sapiens
ggaacaggaaacuaaauua

SEQ ID NO: 669667 - RNA, 19 nt, Homo sapiens
gaacugaaaaggcaaauua

SEQ ID NO: 669668 - RNA, 19 nt, Homo sapiens
ccaugaagaugaagugaaa

SEQ ID NO: 669669 - RNA, 19 nt, Homo sapiens
gggaauuagucaaggauaa

SEQ ID NO: 669670 - RNA, 19 nt, Homo sapiens
caacuuaagagaacuguaa

SEQ ID NO: 669671 - RNA, 19 nt, Homo sapiens
gcuucaaguucuuagauua

SEQ ID NO: 669672 - RNA, 19 nt, Homo sapiens
gaacaacagauuaagauuc

SEQ ID NO: 669673 - RNA, 19 nt, Homo sapiens
agaaucugcuuuaagguua

SEQ ID NO: 669674 - RNA, 19 nt, Homo sapiens
caaauggccugggaucaaa

SEQ ID NO: 669675 - RNA, 19 nt, Homo sapiens
uaaagggccuggaagaguu

SEQ ID NO: 669676 - RNA, 19 nt, Homo sapiens
ucuccgaacuguaguauuu

SEQ ID NO: 669677 - RNA, 19 nt, Homo sapiens
gaagaagugaagaagaaua

SEQ ID NO: 669678 - RNA, 19 nt, Homo sapiens
aagaacaggcucucuauua

SEQ ID NO: 669679 - RNA, 19 nt, Homo sapiens
caaauacaaugaagaccuu

SEQ ID NO: 669680 - RNA, 19 nt, Homo sapiens
caaagccgauaaagagaaa

SEQ ID NO: 669681 - RNA, 19 nt, Homo sapiens
gagagagauuucugauauu

SEQ ID NO: 669682 - RNA, 19 nt, Homo sapiens
ggaaauccauugugguuac

SEQ ID NO: 669683 - RNA, 19 nt, Homo sapiens
ggaaguagaggauuuaaag

SEQ ID NO: 669684 - RNA, 19 nt, Homo sapiens
gagcaaagagaaauuguga

SEQ ID NO: 669685 - RNA, 19 nt, Homo sapiens
gaaaaguucuccaaaacaa

SEQ ID NO: 669686 - RNA, 19 nt, Homo sapiens
aaaguuaccugugauaaug

SEQ ID NO: 669687 - RNA, 19 nt, Homo sapiens
gagaaaucuugacuuagaa

SEQ ID NO: 669688 - RNA, 19 nt, Homo sapiens
gcaaaccccugacagauaa

SEQ ID NO: 669689 - RNA, 19 nt, Homo sapiens
gagaaauugugaagaaaca

SEQ ID NO: 669690 - RNA, 19 nt, Homo sapiens
gaauaugaacguacaauca

SEQ ID NO: 669691 - RNA, 19 nt, Homo sapiens
ucacuaccuuguaccuuua

SEQ ID NO: 669692 - RNA, 19 nt, Homo sapiens
ggaaacugauauugccaaa

SEQ ID NO: 669693 - RNA, 19 nt, Homo sapiens
gaaagacaaucccagaacu

SEQ ID NO: 669694 - RNA, 19 nt, Homo sapiens
caaauuacagcuucaagaa

SEQ ID NO: 669695 - RNA, 19 nt, Homo sapiens
ggacuucguuaaagcaaau

SEQ ID NO: 669696 - RNA, 19 nt, Homo sapiens
aacuagaacuggcuaauaa

SEQ ID NO: 669697 - RNA, 19 nt, Homo sapiens
gaaaguuaccugugauaau

SEQ ID NO: 669698 - RNA, 19 nt, Homo sapiens
gaaagcaccauaccugaug

SEQ ID NO: 669699 - RNA, 19 nt, Homo sapiens
ggaccaaaguggagcugaa

SEQ ID NO: 669700 - RNA, 19 nt, Homo sapiens
gcugaagaacguauuauuu

SEQ ID NO: 669701 - RNA, 19 nt, Homo sapiens
cauuggagauggaauuaaa

SEQ ID NO: 669702 - RNA, 19 nt, Homo sapiens
ugacaggaguuauuaaagu

SEQ ID NO: 669703 - RNA, 19 nt, Homo sapiens
ugaaaggcuucguaaagaa

SEQ ID NO: 669704 - RNA, 19 nt, Homo sapiens
gaagaaacaugaggaagac

SEQ ID NO: 669705 - RNA, 19 nt, Homo sapiens
caacagaacaaguuucaug

SEQ ID NO: 669706 - RNA, 19 nt, Homo sapiens
gaacaggcucucuauuaug

SEQ ID NO: 669707 - RNA, 19 nt, Homo sapiens
agaacaggcucucuauuau

SEQ ID NO: 669708 - RNA, 19 nt, Homo sapiens
ggaaguagagucccucaga

SEQ ID NO: 669709 - RNA, 19 nt, Homo sapiens
ugaaggaaaugugugaauu

SEQ ID NO: 669710 - RNA, 19 nt, Homo sapiens
cuagagagcuaaagacaca

SEQ ID NO: 669711 - RNA, 19 nt, Homo sapiens
gaagaaauugugcaacaga

SEQ ID NO: 669712 - RNA, 19 nt, Homo sapiens
cagcuuucaucauucuuua

SEQ ID NO: 669713 - RNA, 19 nt, Homo sapiens
uuacuguacuucagaauga

SEQ ID NO: 669714 - RNA, 19 nt, Homo sapiens
guuugaagaugaagaagaa

SEQ ID NO: 669715 - RNA, 19 nt, Homo sapiens
cugaagaguuugaagauga

SEQ ID NO: 669716 - RNA, 19 nt, Homo sapiens
ugaauuaacuagcccuguu

SEQ ID NO: 669717 - RNA, 19 nt, Homo sapiens
gaauuaauccaucagauag

SEQ ID NO: 669718 - RNA, 19 nt, Homo sapiens
acaaagcaguugaauacuu

SEQ ID NO: 669719 - RNA, 19 nt, Homo sapiens
caacaacuacaaugagaaa

SEQ ID NO: 669720 - RNA, 19 nt, Homo sapiens
gaacugaggcuucgauugc

SEQ ID NO: 669721 - RNA, 19 nt, Homo sapiens
gagcagaaacuugaugaaa

SEQ ID NO: 669722 - RNA, 19 nt, Homo sapiens
guuaagagaugaauuagcu

SEQ ID NO: 669723 - RNA, 19 nt, Homo sapiens
auaaagaacuggagauuac

SEQ ID NO: 669724 - RNA, 19 nt, Homo sapiens
cuucucagcuuucaucauu

SEQ ID NO: 669725 - RNA, 19 nt, Homo sapiens
gaagugaagaagaauauuc

SEQ ID NO: 669726 - RNA, 19 nt, Homo sapiens
agaagagacugguaagaga

SEQ ID NO: 669727 - RNA, 19 nt, Homo sapiens
aaagggagauucuuaagag

SEQ ID NO: 669728 - RNA, 19 nt, Homo sapiens
ggaauucgaaacaaguuaa

SEQ ID NO: 669729 - RNA, 19 nt, Homo sapiens
gaaagaagcacuuaaaaca

SEQ ID NO: 669730 - RNA, 19 nt, Homo sapiens
gcacuuagucgggcacuuu

SEQ ID NO: 669731 - RNA, 19 nt, Homo sapiens
ggucgaagaucuagaagua

SEQ ID NO: 669732 - RNA, 19 nt, Homo sapiens
gcaagaaacuaaauaagac

SEQ ID NO: 669733 - RNA, 19 nt, Homo sapiens
aaauauggguuuacggaua

SEQ ID NO: 669734 - RNA, 19 nt, Homo sapiens
gcacgcggcugcuuacugu

SEQ ID NO: 669735 - RNA, 19 nt, Homo sapiens
ccaaauguauugcagaaau

SEQ ID NO: 669736 - RNA, 19 nt, Homo sapiens
caaguggcauuuagaagaa

SEQ ID NO: 669737 - RNA, 19 nt, Homo sapiens
uguaugcgcugcaaucuuu

SEQ ID NO: 669738 - RNA, 19 nt, Homo sapiens
ccaagacucuggaaagaau

SEQ ID NO: 669739 - RNA, 19 nt, Homo sapiens
gaccaaauguauugcagaa

SEQ ID NO: 669740 - RNA, 19 nt, Homo sapiens
cgacaacccuccuacuuuc

SEQ ID NO: 669741 - RNA, 19 nt, Homo sapiens
ggaaagaauggucaaguug

SEQ ID NO: 669742 - RNA, 19 nt, Homo sapiens
gaccaagacucuggaaaga

SEQ ID NO: 669743 - RNA, 19 nt, Homo sapiens
gaucauuacgucuuuguuu

SEQ ID NO: 669744 - RNA, 19 nt, Homo sapiens
ucagugcaguaacuauuua

SEQ ID NO: 669745 - RNA, 19 nt, Homo sapiens
gcugcaaucuuucgacuau

SEQ ID NO: 669746 - RNA, 19 nt, Homo sapiens
gaaaaugucucuaucuaca

SEQ ID NO: 669747 - RNA, 19 nt, Homo sapiens
gacaguaauugccuucuug

SEQ ID NO: 669748 - RNA, 19 nt, Homo sapiens
ggacaguaauugccuucuu

SEQ ID NO: 669749 - RNA, 19 nt, Homo sapiens
caacaacucuauagaaagc

SEQ ID NO: 669750 - RNA, 19 nt, Homo sapiens
gaccagaagugaucauuac

SEQ ID NO: 669751 - RNA, 19 nt, Homo sapiens
cagcguauauccuagagaa

SEQ ID NO: 669752 - RNA, 19 nt, Homo sapiens
ggaaauacaagccgaagau

SEQ ID NO: 669753 - RNA, 19 nt, Homo sapiens
gaaaguccuugagaacaug

SEQ ID NO: 669754 - RNA, 19 nt, Homo sapiens
ucgaagaucuagaaguaaa

SEQ ID NO: 669755 - RNA, 19 nt, Homo sapiens
gaaagaauggucaaguugu

SEQ ID NO: 669756 - RNA, 19 nt, Homo sapiens
ugacaguguuggauacaaa

SEQ ID NO: 669757 - RNA, 19 nt, Homo sapiens
ggcaagaaacuaaauaaga

SEQ ID NO: 669758 - RNA, 19 nt, Homo sapiens
caaauguauugcagaaaug

SEQ ID NO: 669759 - RNA, 19 nt, Homo sapiens
gagugaaaguccuugagaa

SEQ ID NO: 669760 - RNA, 19 nt, Homo sapiens
gcuacaaucugaucauucu

SEQ ID NO: 669761 - RNA, 19 nt, Homo sapiens
gaagugaucauuacgucuu

SEQ ID NO: 669762 - RNA, 19 nt, Homo sapiens
gacaauagaccagaaguga

SEQ ID NO: 669763 - RNA, 19 nt, Homo sapiens
aauauggguuuacggauaa

SEQ ID NO: 669764 - RNA, 19 nt, Homo sapiens
uaagguguaucacagaguu

SEQ ID NO: 669765 - RNA, 19 nt, Homo sapiens
caggugaguuuaguucuuu

SEQ ID NO: 669766 - RNA, 19 nt, Homo sapiens
ggauuccgguggcagauug

SEQ ID NO: 669767 - RNA, 19 nt, Homo sapiens
uggaaagaauggucaaguu

SEQ ID NO: 669768 - RNA, 19 nt, Homo sapiens
guaauucaaguggcauuua

SEQ ID NO: 669769 - RNA, 19 nt, Homo sapiens
ugaaaguccuugagaacau

SEQ ID NO: 669770 - RNA, 19 nt, Homo sapiens
ugaacucccuccagagcua

SEQ ID NO: 669771 - RNA, 19 nt, Homo sapiens
agcaacaacucuauagaaa

SEQ ID NO: 669772 - RNA, 19 nt, Homo sapiens
agaaugcccaggucacuua

SEQ ID NO: 669773 - RNA, 19 nt, Homo sapiens
ucauaaaacugcaauggua

SEQ ID NO: 669774 - RNA, 19 nt, Homo sapiens
ccaccucuguccacugaaa

SEQ ID NO: 669775 - RNA, 19 nt, Homo sapiens
caucuguaccuuucaagua

SEQ ID NO: 669776 - RNA, 19 nt, Homo sapiens
ucaaguggcauuuagaaga

SEQ ID NO: 669777 - RNA, 19 nt, Homo sapiens
caccaccucuguccacuga

SEQ ID NO: 669778 - RNA, 19 nt, Homo sapiens
cguaucgucuccagaggua

SEQ ID NO: 669779 - RNA, 19 nt, Homo sapiens
guaauuuaauccgaugcua

SEQ ID NO: 669780 - RNA, 19 nt, Homo sapiens
ucacagaguuuuggguuua

SEQ ID NO: 669781 - RNA, 19 nt, Homo sapiens
uggcagacauuaacgacaa

SEQ ID NO: 669782 - RNA, 19 nt, Homo sapiens
gaaaaguggcauacaaauu

SEQ ID NO: 669783 - RNA, 19 nt, Homo sapiens
cuacucagcguauauccua

SEQ ID NO: 669784 - RNA, 19 nt, Homo sapiens
ccucguauaucuccaucaa

SEQ ID NO: 669785 - RNA, 19 nt, Homo sapiens
guuacacacgugauaauuu

SEQ ID NO: 669786 - RNA, 19 nt, Homo sapiens
ugaaaauacuggggaaaua

SEQ ID NO: 669787 - RNA, 19 nt, Homo sapiens
gcauacaaauuccggaaaa

SEQ ID NO: 669788 - RNA, 19 nt, Homo sapiens
uaauucaaguggcauuuag

SEQ ID NO: 669789 - RNA, 19 nt, Homo sapiens
gagaggauucugcagcaaa

SEQ ID NO: 669790 - RNA, 19 nt, Homo sapiens
ccgcagaugccacaaacua

SEQ ID NO: 669791 - RNA, 19 nt, Homo sapiens
cagacaugcucaucaguca

SEQ ID NO: 669792 - RNA, 19 nt, Homo sapiens
caauagaccagaagugauc

SEQ ID NO: 669793 - RNA, 19 nt, Homo sapiens
cgcggugucugauaaauau

SEQ ID NO: 669794 - RNA, 19 nt, Homo sapiens
guucuuugcuugcuuuuaa

SEQ ID NO: 669795 - RNA, 19 nt, Homo sapiens
gcacguggcagacauuaac

SEQ ID NO: 669796 - RNA, 19 nt, Homo sapiens
uggaagauguaaaugacaa

SEQ ID NO: 669797 - RNA, 19 nt, Homo sapiens
ucagucaucuccaguaggu

SEQ ID NO: 669798 - RNA, 19 nt, Homo sapiens
gcggcaagaaacuaaauaa

SEQ ID NO: 669799 - RNA, 19 nt, Homo sapiens
gagcccugcuggacagaga

SEQ ID NO: 669800 - RNA, 19 nt, Homo sapiens
ggccucagaucuaggaaca

SEQ ID NO: 669801 - RNA, 19 nt, Homo sapiens
gaaauacaagccgaagaug

SEQ ID NO: 669802 - RNA, 19 nt, Homo sapiens
cagaagagacggacaaagg

SEQ ID NO: 669803 - RNA, 19 nt, Homo sapiens
ucacauucuuuggcuguuu

SEQ ID NO: 669804 - RNA, 19 nt, Homo sapiens
gcggaagagucaccugauc

SEQ ID NO: 669805 - RNA, 19 nt, Homo sapiens
ugcaaucuuucgacuauga

SEQ ID NO: 669806 - RNA, 19 nt, Homo sapiens
aaagaauggucaaguuguc

SEQ ID NO: 669807 - RNA, 19 nt, Homo sapiens
ugaagauucugagaggauu

SEQ ID NO: 669808 - RNA, 19 nt, Homo sapiens
guaacuauuuaggacugua

SEQ ID NO: 669809 - RNA, 19 nt, Homo sapiens
ucaggugaguuuaguucuu

SEQ ID NO: 669810 - RNA, 19 nt, Homo sapiens
gcaacaacucuauagaaag

SEQ ID NO: 669811 - RNA, 19 nt, Homo sapiens
ccgaaguccugaccgaguu

SEQ ID NO: 669812 - RNA, 19 nt, Homo sapiens
aagcaacaacucuauagaa

SEQ ID NO: 669813 - RNA, 19 nt, Homo sapiens
gaaauauuuggaccgagaa

SEQ ID NO: 669814 - RNA, 19 nt, Homo sapiens
uuaguucuuugcuugcuuu

SEQ ID NO: 669815 - RNA, 19 nt, Homo sapiens
gaccugcagcuacugguaa

SEQ ID NO: 669816 - RNA, 19 nt, Homo sapiens
gauuagugacaaggaaaua

SEQ ID NO: 669817 - RNA, 19 nt, Homo sapiens
uggguaauaucuccaagga

SEQ ID NO: 669818 - RNA, 19 nt, Homo sapiens
uugaggagguacaggcuuu

SEQ ID NO: 669819 - RNA, 19 nt, Homo sapiens
auggucaaguugucuguua

SEQ ID NO: 669820 - RNA, 19 nt, Homo sapiens
gagcacaaugggaaaugaa

SEQ ID NO: 669821 - RNA, 19 nt, Homo sapiens
agaccagaagugaucauua

SEQ ID NO: 669822 - RNA, 19 nt, Homo sapiens
ccaggucgaagaucuagaa

SEQ ID NO: 669823 - RNA, 19 nt, Homo sapiens
cuccauagcugcggcaaga

SEQ ID NO: 669824 - RNA, 19 nt, Homo sapiens
uuaauccgaugcuacaauc

SEQ ID NO: 669825 - RNA, 19 nt, Homo sapiens
ucaggagggcugugagaaa

SEQ ID NO: 669826 - RNA, 19 nt, Homo sapiens
gauccgagaccugcagcua

SEQ ID NO: 669827 - RNA, 19 nt, Homo sapiens
gaaaauacuggggaaauau

SEQ ID NO: 669828 - RNA, 19 nt, Homo sapiens
acgcagcucuuugcucuga

SEQ ID NO: 669829 - RNA, 19 nt, Homo sapiens
aaaccuucaucucacauuc

SEQ ID NO: 669830 - RNA, 19 nt, Homo sapiens
ucauucugaucuaaucuga

SEQ ID NO: 669831 - RNA, 19 nt, Homo sapiens
ggacaaagcuugacacauc

SEQ ID NO: 669832 - RNA, 19 nt, Homo sapiens
ggucgaagaucuagaagua

SEQ ID NO: 669833 - RNA, 19 nt, Homo sapiens
guacugacuucuccuauaa

SEQ ID NO: 669834 - RNA, 19 nt, Homo sapiens
gcaagaaggagaagaagua

SEQ ID NO: 669835 - RNA, 19 nt, Homo sapiens
ggauuaaacuggcauuuca

SEQ ID NO: 669836 - RNA, 19 nt, Homo sapiens
uaacaggaccaauggauua

SEQ ID NO: 669837 - RNA, 19 nt, Homo sapiens
caagaucaaugcucaaguu

SEQ ID NO: 669838 - RNA, 19 nt, Homo sapiens
gcaagaaacuaaauaagac

SEQ ID NO: 669839 - RNA, 19 nt, Homo sapiens
aaauauggguuuacggaua

SEQ ID NO: 669840 - RNA, 19 nt, Homo sapiens
gcacgcggcugcuuacugu

SEQ ID NO: 669841 - RNA, 19 nt, Homo sapiens
ccaaauguauugcagaaau

SEQ ID NO: 669842 - RNA, 19 nt, Homo sapiens
caaguggcauuuagaagaa

SEQ ID NO: 669843 - RNA, 19 nt, Homo sapiens
uguaugcgcugcaaucuuu

SEQ ID NO: 669844 - RNA, 19 nt, Homo sapiens
ccaagacucuggaaagaau

SEQ ID NO: 669845 - RNA, 19 nt, Homo sapiens
gaccaaauguauugcagaa

SEQ ID NO: 669846 - RNA, 19 nt, Homo sapiens
cgacaacccuccuacuuuc

SEQ ID NO: 669847 - RNA, 19 nt, Homo sapiens
ggaaagaauggucaaguug

SEQ ID NO: 669848 - RNA, 19 nt, Homo sapiens
gaccaagacucuggaaaga

SEQ ID NO: 669849 - RNA, 19 nt, Homo sapiens
gaucauuacgucuuuguuu

SEQ ID NO: 669850 - RNA, 19 nt, Homo sapiens
ucagugcaguaacuauuua

SEQ ID NO: 669851 - RNA, 19 nt, Homo sapiens
gcugcaaucuuucgacuau

SEQ ID NO: 669852 - RNA, 19 nt, Homo sapiens
gaaaaugucucuaucuaca

SEQ ID NO: 669853 - RNA, 19 nt, Homo sapiens
gacaguaauugccuucuug

SEQ ID NO: 669854 - RNA, 19 nt, Homo sapiens
ggacaguaauugccuucuu

SEQ ID NO: 669855 - RNA, 19 nt, Homo sapiens
caacaacucuauagaaagc

SEQ ID NO: 669856 - RNA, 19 nt, Homo sapiens
gaccagaagugaucauuac

SEQ ID NO: 669857 - RNA, 19 nt, Homo sapiens
cagcguauauccuagagaa

SEQ ID NO: 669858 - RNA, 19 nt, Homo sapiens
ggaaauacaagccgaagau

SEQ ID NO: 669859 - RNA, 19 nt, Homo sapiens
gaagcucgaagcagguuua

SEQ ID NO: 669860 - RNA, 19 nt, Homo sapiens
gaucaaugcucaaguuuug

SEQ ID NO: 669861 - RNA, 19 nt, Homo sapiens
gaaaguccuugagaacaug

SEQ ID NO: 669862 - RNA, 19 nt, Homo sapiens
ucgaagaucuagaaguaaa

SEQ ID NO: 669863 - RNA, 19 nt, Homo sapiens
uagaauagccaguagugua

SEQ ID NO: 669864 - RNA, 19 nt, Homo sapiens
gaaagaauggucaaguugu

SEQ ID NO: 669865 - RNA, 19 nt, Homo sapiens
ugacaguguuggauacaaa

SEQ ID NO: 669866 - RNA, 19 nt, Homo sapiens
ggcaagaaacuaaauaaga

SEQ ID NO: 669867 - RNA, 19 nt, Homo sapiens
caaauguauugcagaaaug

SEQ ID NO: 669868 - RNA, 19 nt, Homo sapiens
gagugaaaguccuugagaa

SEQ ID NO: 669869 - RNA, 19 nt, Homo sapiens
gcuacaaucugaucauucu

SEQ ID NO: 669870 - RNA, 19 nt, Homo sapiens
gaagugaucauuacgucuu

SEQ ID NO: 669871 - RNA, 19 nt, Homo sapiens
gacaauagaccagaaguga

SEQ ID NO: 669872 - RNA, 19 nt, Homo sapiens
aauauggguuuacggauaa

SEQ ID NO: 669873 - RNA, 19 nt, Homo sapiens
gggaccaaaugaacagaaa

SEQ ID NO: 669874 - RNA, 19 nt, Homo sapiens
gcucgaagcagguuuagga

SEQ ID NO: 669875 - RNA, 19 nt, Homo sapiens
gcaauggcaacaagaagaa

SEQ ID NO: 669876 - RNA, 19 nt, Homo sapiens
ggauuccgguggcagauug

SEQ ID NO: 669877 - RNA, 19 nt, Homo sapiens
cguacugacuucuccuaua

SEQ ID NO: 669878 - RNA, 19 nt, Homo sapiens
gacaaagcuugacacauca

SEQ ID NO: 669879 - RNA, 19 nt, Homo sapiens
cagcugaacuccuccaucu

SEQ ID NO: 669880 - RNA, 19 nt, Homo sapiens
gacaacauccuccagauuc

SEQ ID NO: 669881 - RNA, 19 nt, Homo sapiens
guaauucaaguggcauuua

SEQ ID NO: 669882 - RNA, 19 nt, Homo sapiens
uggaaagaauggucaaguu

SEQ ID NO: 669883 - RNA, 19 nt, Homo sapiens
ugaaaguccuugagaacau

SEQ ID NO: 669884 - RNA, 19 nt, Homo sapiens
ugaacucccuccagagcua

SEQ ID NO: 669885 - RNA, 19 nt, Homo sapiens
gccauagccugguuaaagu

SEQ ID NO: 669886 - RNA, 19 nt, Homo sapiens
agaaacaagugcccaguca

SEQ ID NO: 669887 - RNA, 19 nt, Homo sapiens
gaagaagucgggcaagaag

SEQ ID NO: 669888 - RNA, 19 nt, Homo sapiens
agaaugcccaggucacuua

SEQ ID NO: 669889 - RNA, 19 nt, Homo sapiens
ccaccucuguccacugaaa

SEQ ID NO: 669890 - RNA, 19 nt, Homo sapiens
ucauaaaacugcaauggua

SEQ ID NO: 669891 - RNA, 19 nt, Homo sapiens
agcaacaacucuauagaaa

SEQ ID NO: 669892 - RNA, 19 nt, Homo sapiens
gaaagucucagcccaggau

SEQ ID NO: 669893 - RNA, 19 nt, Homo sapiens
ggaggaggcucuguauguc

SEQ ID NO: 669894 - RNA, 19 nt, Homo sapiens
caucuguaccuuucaagua

SEQ ID NO: 669895 - RNA, 19 nt, Homo sapiens
ggaccagucuucuguuuug

SEQ ID NO: 669896 - RNA, 19 nt, Homo sapiens
ucaaguggcauuuagaaga

SEQ ID NO: 669897 - RNA, 19 nt, Homo sapiens
caccaccucuguccacuga

SEQ ID NO: 669898 - RNA, 19 nt, Homo sapiens
cguaucgucuccagaggua

SEQ ID NO: 669899 - RNA, 19 nt, Homo sapiens
guaauuuaauccgaugcua

SEQ ID NO: 669900 - RNA, 19 nt, Homo sapiens
uggcagacauuaacgacaa

SEQ ID NO: 669901 - RNA, 19 nt, Homo sapiens
gaaaaguggcauacaaauu

SEQ ID NO: 669902 - RNA, 19 nt, Homo sapiens
ggacccuucccacuacaua

SEQ ID NO: 669903 - RNA, 19 nt, Homo sapiens
cuacaagccuccuaguucu

SEQ ID NO: 669904 - RNA, 19 nt, Homo sapiens
gaacuccuccaucuuccaa

SEQ ID NO: 669905 - RNA, 19 nt, Homo sapiens
cuacucagcguauauccua

SEQ ID NO: 669906 - RNA, 19 nt, Homo sapiens
guguugaaguaccaaguaa

SEQ ID NO: 669907 - RNA, 19 nt, Homo sapiens
ccucguauaucuccaucaa

SEQ ID NO: 669908 - RNA, 19 nt, Homo sapiens
guuacacacgugauaauuu

SEQ ID NO: 669909 - RNA, 19 nt, Homo sapiens
uaauucaaguggcauuuag

SEQ ID NO: 669910 - RNA, 19 nt, Homo sapiens
ugaaaauacuggggaaaua

SEQ ID NO: 669911 - RNA, 19 nt, Homo sapiens
gcauacaaauuccggaaaa

SEQ ID NO: 669912 - RNA, 19 nt, Homo sapiens
gagaggauucugcagcaaa

SEQ ID NO: 669913 - RNA, 19 nt, Homo sapiens
ccgcagaugccacaaacua

SEQ ID NO: 669914 - RNA, 19 nt, Homo sapiens
cagacaugcucaucaguca

SEQ ID NO: 669915 - RNA, 19 nt, Homo sapiens
caauagaccagaagugauc

SEQ ID NO: 669916 - RNA, 19 nt, Homo sapiens
cgcggugucugauaaauau

SEQ ID NO: 669917 - RNA, 19 nt, Homo sapiens
gaccugcccuuacaguagu

SEQ ID NO: 669918 - RNA, 19 nt, Homo sapiens
ugaaguaccaaguaaccua

SEQ ID NO: 669919 - RNA, 19 nt, Homo sapiens
gcugaacuccuccaucuuc

SEQ ID NO: 669920 - RNA, 19 nt, Homo sapiens
gcacccaggccucagaguu

SEQ ID NO: 669921 - RNA, 19 nt, Homo sapiens
caagaaggagaagaaguaa

SEQ ID NO: 669922 - RNA, 19 nt, Homo sapiens
ucagucaucuccaguaggu

SEQ ID NO: 669923 - RNA, 19 nt, Homo sapiens
gcacguggcagacauuaac

SEQ ID NO: 669924 - RNA, 19 nt, Homo sapiens
uggaagauguaaaugacaa

SEQ ID NO: 669925 - RNA, 19 nt, Homo sapiens
gcggcaagaaacuaaauaa

SEQ ID NO: 669926 - RNA, 19 nt, Homo sapiens
ccuauaagcgcuucucuuc

SEQ ID NO: 669927 - RNA, 19 nt, Homo sapiens
ggccauagccugguuaaag

SEQ ID NO: 669928 - RNA, 19 nt, Homo sapiens
ggagaagaaguaacaugga

SEQ ID NO: 669929 - RNA, 19 nt, Homo sapiens
gagcccugcuggacagaga

SEQ ID NO: 669930 - RNA, 19 nt, Homo sapiens
ggccucagaucuaggaaca

SEQ ID NO: 669931 - RNA, 19 nt, Homo sapiens
ggaagaagaugaugaaaua

SEQ ID NO: 669932 - RNA, 19 nt, Homo sapiens
gaccagagguuaauuuauu

SEQ ID NO: 669933 - RNA, 19 nt, Homo sapiens
gcacugauccugaaacuga

SEQ ID NO: 669934 - RNA, 19 nt, Homo sapiens
ggaaggcacugauccugaa

SEQ ID NO: 669935 - RNA, 19 nt, Homo sapiens
ucucaugucuuuauucuga

SEQ ID NO: 669936 - RNA, 19 nt, Homo sapiens
cagcauggcuugucuucaa

SEQ ID NO: 669937 - RNA, 19 nt, Homo sapiens
gaaauugcuagacauguuu

SEQ ID NO: 669938 - RNA, 19 nt, Homo sapiens
guacauagaagucauagau

SEQ ID NO: 669939 - RNA, 19 nt, Homo sapiens
ugaaauugcuagacauguu

SEQ ID NO: 669940 - RNA, 19 nt, Homo sapiens
caaggcuucucaugucuuu

SEQ ID NO: 669941 - RNA, 19 nt, Homo sapiens
gauacaaauuggugaacaa

SEQ ID NO: 669942 - RNA, 19 nt, Homo sapiens
agacagggauguacuagau

SEQ ID NO: 669943 - RNA, 19 nt, Homo sapiens
gcacaagguggcccuauug

SEQ ID NO: 669944 - RNA, 19 nt, Homo sapiens
guugggugguuuccauuua

SEQ ID NO: 669945 - RNA, 19 nt, Homo sapiens
ggccuuagguguugcaugu

SEQ ID NO: 669946 - RNA, 19 nt, Homo sapiens
gaaugcugcuccucaagug

SEQ ID NO: 669947 - RNA, 19 nt, Homo sapiens
agucauagaugcagaagug

SEQ ID NO: 669948 - RNA, 19 nt, Homo sapiens
gaaacgugaagccgugaua

SEQ ID NO: 669949 - RNA, 19 nt, Homo sapiens
guagaaggccuuagguguu

SEQ ID NO: 669950 - RNA, 19 nt, Homo sapiens
caucuggugugcaauguga

SEQ ID NO: 669951 - RNA, 19 nt, Homo sapiens
gaacuuugcggaggugaaa

SEQ ID NO: 669952 - RNA, 19 nt, Homo sapiens
augcagugcuuuacuuuaa

SEQ ID NO: 669953 - RNA, 19 nt, Homo sapiens
aauaagcacuguacguaga

SEQ ID NO: 669954 - RNA, 19 nt, Homo sapiens
gcagcuacauuuucuguuu

SEQ ID NO: 669955 - RNA, 19 nt, Homo sapiens
uagaaggccuuagguguug

SEQ ID NO: 669956 - RNA, 19 nt, Homo sapiens
gcccaaggcuucucauguc

SEQ ID NO: 669957 - RNA, 19 nt, Homo sapiens
caacaauaacuuacaggaa

SEQ ID NO: 669958 - RNA, 19 nt, Homo sapiens
gggccaccguuguuaugua

SEQ ID NO: 669959 - RNA, 19 nt, Homo sapiens
gugaagccgugauacaaau

SEQ ID NO: 669960 - RNA, 19 nt, Homo sapiens
ggaagcuguuguuggauca

SEQ ID NO: 669961 - RNA, 19 nt, Homo sapiens
ugacaggaauggacuggau

SEQ ID NO: 669962 - RNA, 19 nt, Homo sapiens
gacaguacuacaugcaaua

SEQ ID NO: 669963 - RNA, 19 nt, Homo sapiens
uuaauaagcacuguacgua

SEQ ID NO: 669964 - RNA, 19 nt, Homo sapiens
gcagauuccucauggucau

SEQ ID NO: 669965 - RNA, 19 nt, Homo sapiens
cgacaguacuacaugcaau

SEQ ID NO: 669966 - RNA, 19 nt, Homo sapiens
gaggaccagagguuaauuu

SEQ ID NO: 669967 - RNA, 19 nt, Homo sapiens
acauggcaaugaugaguuu

SEQ ID NO: 669968 - RNA, 19 nt, Homo sapiens
ucagaaugcugcuccucaa

SEQ ID NO: 669969 - RNA, 19 nt, Homo sapiens
ucagggacuugcuuccaaa

SEQ ID NO: 669970 - RNA, 19 nt, Homo sapiens
ccagaggaccagagguuaa

SEQ ID NO: 669971 - RNA, 19 nt, Homo sapiens
ggaccagagguuaauuuau

SEQ ID NO: 669972 - RNA, 19 nt, Homo sapiens
ggcuucagcuuuccugguu

SEQ ID NO: 669973 - RNA, 19 nt, Homo sapiens
ucaccugacuccagcuaga

SEQ ID NO: 669974 - RNA, 19 nt, Homo sapiens
gcggaugaaugcacaaggu

SEQ ID NO: 669975 - RNA, 19 nt, Homo sapiens
cugggaagcuguuguugga

SEQ ID NO: 669976 - RNA, 19 nt, Homo sapiens
gaagccgugauacaaauug

SEQ ID NO: 669977 - RNA, 19 nt, Homo sapiens
caguguggaugaugauaug

SEQ ID NO: 669978 - RNA, 19 nt, Homo sapiens
caaccaguuuccagcugaa

SEQ ID NO: 669979 - RNA, 19 nt, Homo sapiens
gaacuucccaaaugauggu

SEQ ID NO: 669980 - RNA, 19 nt, Homo sapiens
cuauucagcagcuacauuu

SEQ ID NO: 669981 - RNA, 19 nt, Homo sapiens
guccugguuucuccgguua

SEQ ID NO: 669982 - RNA, 19 nt, Homo sapiens
ggagccugcugguucuaau

SEQ ID NO: 669983 - RNA, 19 nt, Homo sapiens
ggacauggcaaugaugagu

SEQ ID NO: 669984 - RNA, 19 nt, Homo sapiens
cuccugacguuguaaauca

SEQ ID NO: 669985 - RNA, 19 nt, Homo sapiens
gauauaugcacgacaguac

SEQ ID NO: 669986 - RNA, 19 nt, Homo sapiens
gcaucacguugggugguuu

SEQ ID NO: 669987 - RNA, 19 nt, Homo sapiens
cgagauugguuggauugga

SEQ ID NO: 669988 - RNA, 19 nt, Homo sapiens
uuccucaagugaugguuua

SEQ ID NO: 669989 - RNA, 19 nt, Homo sapiens
gaucaccugacuccagcua

SEQ ID NO: 669990 - RNA, 19 nt, Homo sapiens
gaaggcacugauccugaaa

SEQ ID NO: 669991 - RNA, 19 nt, Homo sapiens
gcccuauuguggaagaaga

SEQ ID NO: 669992 - RNA, 19 nt, Homo sapiens
agugaugguuuaaggcaaa

SEQ ID NO: 669993 - RNA, 19 nt, Homo sapiens
cuaggaaagacuuauguau

SEQ ID NO: 669994 - RNA, 19 nt, Homo sapiens
guacguagaaggccuuagg

SEQ ID NO: 669995 - RNA, 19 nt, Homo sapiens
uucagaacuucccaaauga

SEQ ID NO: 669996 - RNA, 19 nt, Homo sapiens
aaaaugcagugcuuuacuu

SEQ ID NO: 669997 - RNA, 19 nt, Homo sapiens
cauagaugcagaagugguu

SEQ ID NO: 669998 - RNA, 19 nt, Homo sapiens
cgugaagccgugauacaaa

SEQ ID NO: 669999 - RNA, 19 nt, Homo sapiens
uauaugcacgacaguacua

SEQ ID NO: 670000 - RNA, 19 nt, Homo sapiens
aaaugcagugcuuuacuuu

SEQ ID NO: 670001 - RNA, 19 nt, Homo sapiens
ggccaccguuguuauguac

SEQ ID NO: 670002 - RNA, 19 nt, Homo sapiens
gaugguguuugugcuguag

SEQ ID NO: 670003 - RNA, 19 nt, Homo sapiens
gagcacagcauggcuuguc

SEQ ID NO: 670004 - RNA, 19 nt, Homo sapiens
cagaacuucccaaaugaug

SEQ ID NO: 670005 - RNA, 19 nt, Homo sapiens
cuccucaagugguuguuaa

SEQ ID NO: 670006 - RNA, 19 nt, Homo sapiens
ccaccaagugcacaagaga

SEQ ID NO: 670007 - RNA, 19 nt, Homo sapiens
aggaccagagguuaauuua

SEQ ID NO: 670008 - RNA, 19 nt, Homo sapiens
ugauacaaauuggugaaca

SEQ ID NO: 670009 - RNA, 19 nt, Homo sapiens
gacauggcaaugaugaguu

SEQ ID NO: 670010 - RNA, 19 nt, Homo sapiens
ugaugguguuugugcugua

SEQ ID NO: 670011 - RNA, 19 nt, Homo sapiens
gcacagcauggcuugucuu

SEQ ID NO: 670012 - RNA, 19 nt, Homo sapiens
uggaagaagaugaugaaau

SEQ ID NO: 670013 - RNA, 19 nt, Homo sapiens
ugcacaagguggcccuauu

SEQ ID NO: 670014 - RNA, 19 nt, Homo sapiens
gcuccucaagugguuguua

SEQ ID NO: 670015 - RNA, 19 nt, Homo sapiens
cuacaugcaauauuuagca

SEQ ID NO: 670016 - RNA, 19 nt, Homo sapiens
aaaacaguguggaugauga

SEQ ID NO: 670017 - RNA, 19 nt, Homo sapiens
aaaccagccugccaaucag

SEQ ID NO: 670018 - RNA, 19 nt, Homo sapiens
gauugccucuccuggacau

SEQ ID NO: 670019 - RNA, 19 nt, Homo sapiens
ucuaggaaagacuuaugua

SEQ ID NO: 670020 - RNA, 19 nt, Homo sapiens
cugcauguguguuuguaca

SEQ ID NO: 670021 - RNA, 19 nt, Homo sapiens
ugucuaugcuugaggaacu

SEQ ID NO: 670022 - RNA, 19 nt, Homo sapiens
cuucucaugucuuuauucu

SEQ ID NO: 670023 - RNA, 19 nt, Homo sapiens
aaucaggaccccaacaaua

SEQ ID NO: 670024 - RNA, 19 nt, Homo sapiens
accaagugcacaagagaua

SEQ ID NO: 670025 - RNA, 19 nt, Homo sapiens
aaugcagugcuuuacuuua

SEQ ID NO: 670026 - RNA, 19 nt, Homo sapiens
ccuguuggaauguuuaaau

SEQ ID NO: 670027 - RNA, 19 nt, Homo sapiens
guaguuuaauaagcacugu

SEQ ID NO: 670028 - RNA, 19 nt, Homo sapiens
cagcuacauuuucuguuuu

SEQ ID NO: 670029 - RNA, 19 nt, Homo sapiens
ucaagugguuguuaauccu

SEQ ID NO: 670030 - RNA, 19 nt, Homo sapiens
uggguuuucuguucaauaa

SEQ ID NO: 670031 - RNA, 19 nt, Homo sapiens
gcucagaauuccaguaaua

SEQ ID NO: 670032 - RNA, 19 nt, Homo sapiens
cagcacagauugagaauaa

SEQ ID NO: 670033 - RNA, 19 nt, Homo sapiens
gcaaguccauuuccaguuu

SEQ ID NO: 670034 - RNA, 19 nt, Homo sapiens
ggaagcaucucuuauuaau

SEQ ID NO: 670035 - RNA, 19 nt, Homo sapiens
gaaagaggcugugaugguu

SEQ ID NO: 670036 - RNA, 19 nt, Homo sapiens
gacauuguguguauaguua

SEQ ID NO: 670037 - RNA, 19 nt, Homo sapiens
gaaauugcauugacauugu

SEQ ID NO: 670038 - RNA, 19 nt, Homo sapiens
ggaggagacuuacaacaaa

SEQ ID NO: 670039 - RNA, 19 nt, Homo sapiens
gaaccugcaugccuaguaa

SEQ ID NO: 670040 - RNA, 19 nt, Homo sapiens
ccacacagcucaaagaugu

SEQ ID NO: 670041 - RNA, 19 nt, Homo sapiens
gaagacaaaccaauuaaga

SEQ ID NO: 670042 - RNA, 19 nt, Homo sapiens
gcaacaaccucaaguccaa

SEQ ID NO: 670043 - RNA, 19 nt, Homo sapiens
gaauggaggaggagacuua

SEQ ID NO: 670044 - RNA, 19 nt, Homo sapiens
uugcagaacuccacuauuu

SEQ ID NO: 670045 - RNA, 19 nt, Homo sapiens
cagaauggauccagaagaa

SEQ ID NO: 670046 - RNA, 19 nt, Homo sapiens
gcagcuauauggauaaugu

SEQ ID NO: 670047 - RNA, 19 nt, Homo sapiens
gcacacuaaucucuguuaa

SEQ ID NO: 670048 - RNA, 19 nt, Homo sapiens
cuuagaagccuuacaaaua

SEQ ID NO: 670049 - RNA, 19 nt, Homo sapiens
uaagacgcauacaauguua

SEQ ID NO: 670050 - RNA, 19 nt, Homo sapiens
agacauaucccacuguaua

SEQ ID NO: 670051 - RNA, 19 nt, Homo sapiens
gauacaagguuacaaagca

SEQ ID NO: 670052 - RNA, 19 nt, Homo sapiens
gggcauaacugaccauuuu

SEQ ID NO: 670053 - RNA, 19 nt, Homo sapiens
ugcaagaggugauagauuu

SEQ ID NO: 670054 - RNA, 19 nt, Homo sapiens
aaagggagaucugugauuu

SEQ ID NO: 670055 - RNA, 19 nt, Homo sapiens
gaggcgacaucuagacuaa

SEQ ID NO: 670056 - RNA, 19 nt, Homo sapiens
guaagagaguggaaugcua

SEQ ID NO: 670057 - RNA, 19 nt, Homo sapiens
gugagcagcuauauggaua

SEQ ID NO: 670058 - RNA, 19 nt, Homo sapiens
ccacagccauggugacuga

SEQ ID NO: 670059 - RNA, 19 nt, Homo sapiens
gaauggauccagaagaauu

SEQ ID NO: 670060 - RNA, 19 nt, Homo sapiens
ggacuuagaagccuuacaa

SEQ ID NO: 670061 - RNA, 19 nt, Homo sapiens
cagcaaagauuguaauaac

SEQ ID NO: 670062 - RNA, 19 nt, Homo sapiens
gcaggucugucuccucuug

SEQ ID NO: 670063 - RNA, 19 nt, Homo sapiens
ugagaaggguaugaacuua

SEQ ID NO: 670064 - RNA, 19 nt, Homo sapiens
gcauucaccucaccauguu

SEQ ID NO: 670065 - RNA, 19 nt, Homo sapiens
cuggaagcaucucuuauua

SEQ ID NO: 670066 - RNA, 19 nt, Homo sapiens
ggccucagguguugucuuu

SEQ ID NO: 670067 - RNA, 19 nt, Homo sapiens
ccgacaaucugaaacuuaa

SEQ ID NO: 670068 - RNA, 19 nt, Homo sapiens
ccacacaccugaaguagag

SEQ ID NO: 670069 - RNA, 19 nt, Homo sapiens
gauccugucuacacugaaa

SEQ ID NO: 670070 - RNA, 19 nt, Homo sapiens
ucagaagacaaaccaauua

SEQ ID NO: 670071 - RNA, 19 nt, Homo sapiens
agagacaccugcacuagaa

SEQ ID NO: 670072 - RNA, 19 nt, Homo sapiens
aguuugaucuuccuucuua

SEQ ID NO: 670073 - RNA, 19 nt, Homo sapiens
guaaacacacacacuaauu

SEQ ID NO: 670074 - RNA, 19 nt, Homo sapiens
uaaaacaucuccugccuaa

SEQ ID NO: 670075 - RNA, 19 nt, Homo sapiens
gaaauggaaacaaaucuuc

SEQ ID NO: 670076 - RNA, 19 nt, Homo sapiens
gaacguguguguccuuugc

SEQ ID NO: 670077 - RNA, 19 nt, Homo sapiens
agaauugaauggugcuuaa

SEQ ID NO: 670078 - RNA, 19 nt, Homo sapiens
uaagauagcucuggaaagc

SEQ ID NO: 670079 - RNA, 19 nt, Homo sapiens
gagauccugucuacacuga

SEQ ID NO: 670080 - RNA, 19 nt, Homo sapiens
guaugaaaguuugacagua

SEQ ID NO: 670081 - RNA, 19 nt, Homo sapiens
gaauggugcuuaaauugag

SEQ ID NO: 670082 - RNA, 19 nt, Homo sapiens
gcagaaugguggaacuugu

SEQ ID NO: 670083 - RNA, 19 nt, Homo sapiens
uaauugagguuacagaaag

SEQ ID NO: 670084 - RNA, 19 nt, Homo sapiens
ugggagagauucugccuuu

SEQ ID NO: 670085 - RNA, 19 nt, Homo sapiens
ggaaaugcaagaggugaua

SEQ ID NO: 670086 - RNA, 19 nt, Homo sapiens
guaauacaguggccaaugg

SEQ ID NO: 670087 - RNA, 19 nt, Homo sapiens
caaaauaccccuuccaaaa

SEQ ID NO: 670088 - RNA, 19 nt, Homo sapiens
acaaauacaucugugcauu

SEQ ID NO: 670089 - RNA, 19 nt, Homo sapiens
ccacaccaaucacuguauu

SEQ ID NO: 670090 - RNA, 19 nt, Homo sapiens
gcagggaccuagaaauaac

SEQ ID NO: 670091 - RNA, 19 nt, Homo sapiens
ccgcagggaccuagaaaua

SEQ ID NO: 670092 - RNA, 19 nt, Homo sapiens
caggaacucucacuacuca

SEQ ID NO: 670093 - RNA, 19 nt, Homo sapiens
acacuaaucucuguuaaag

SEQ ID NO: 670094 - RNA, 19 nt, Homo sapiens
agaagcagccuuacaggua

SEQ ID NO: 670095 - RNA, 19 nt, Homo sapiens
caacaaacgccauuuaaaa

SEQ ID NO: 670096 - RNA, 19 nt, Homo sapiens
aaacuggaacucuacauuu

SEQ ID NO: 670097 - RNA, 19 nt, Homo sapiens
ccauguaggugcuguguuc

SEQ ID NO: 670098 - RNA, 19 nt, Homo sapiens
ggaagacauuuucuaauug

SEQ ID NO: 670099 - RNA, 19 nt, Homo sapiens
gcagaagaaucgcuugaac

SEQ ID NO: 670100 - RNA, 19 nt, Homo sapiens
caguuaacaugugccauua

SEQ ID NO: 670101 - RNA, 19 nt, Homo sapiens
uuagaagccuuacaaauac

SEQ ID NO: 670102 - RNA, 19 nt, Homo sapiens
ggaacucucacuacucaaa

SEQ ID NO: 670103 - RNA, 19 nt, Homo sapiens
gcagugcccaggacaguaa

SEQ ID NO: 670104 - RNA, 19 nt, Homo sapiens
uaagagaguggaaugcuaa

SEQ ID NO: 670105 - RNA, 19 nt, Homo sapiens
uuacaaugcuuccaaacug

SEQ ID NO: 670106 - RNA, 19 nt, Homo sapiens
gcaggacauuguguguaua

SEQ ID NO: 670107 - RNA, 19 nt, Homo sapiens
aaacugacaucccgguuca

SEQ ID NO: 670108 - RNA, 19 nt, Homo sapiens
auacaucugugcauucuug

SEQ ID NO: 670109 - RNA, 19 nt, Homo sapiens
ggacauuguguguauaguu

SEQ ID NO: 670110 - RNA, 19 nt, Homo sapiens
gagguacacugcugaaggu

SEQ ID NO: 670111 - RNA, 19 nt, Homo sapiens
ggagaggcgugagaacuuc

SEQ ID NO: 670112 - RNA, 19 nt, Homo sapiens
ggaaauggaaacaaaucuu

SEQ ID NO: 670113 - RNA, 19 nt, Homo sapiens
ggcgacaucuagacuaaga

SEQ ID NO: 670114 - RNA, 19 nt, Homo sapiens
uuacaacaaacgccauuua

SEQ ID NO: 670115 - RNA, 19 nt, Homo sapiens
gggcucagacccagaguuu

SEQ ID NO: 670116 - RNA, 19 nt, Homo sapiens
gcaaggaugagaaggguau

SEQ ID NO: 670117 - RNA, 19 nt, Homo sapiens
cauggugccugaaagaaga

SEQ ID NO: 670118 - RNA, 19 nt, Homo sapiens
cggcugaccucggccauaa

SEQ ID NO: 670119 - RNA, 19 nt, Homo sapiens
guacuuuccucacagaucu

SEQ ID NO: 670120 - RNA, 19 nt, Homo sapiens
ugagaaagaagaaucagaa

SEQ ID NO: 670121 - RNA, 19 nt, Homo sapiens
uugaucagcuucuggguuu

SEQ ID NO: 670122 - RNA, 19 nt, Homo sapiens
caggaaacauuagaggaaa

SEQ ID NO: 670123 - RNA, 19 nt, Homo sapiens
uauacuggcuggagguuug

SEQ ID NO: 670124 - RNA, 19 nt, Homo sapiens
cuuuaaaccuggcuucuga

SEQ ID NO: 670125 - RNA, 19 nt, Homo sapiens
ggaaacauuagaggaaauu

SEQ ID NO: 670126 - RNA, 19 nt, Homo sapiens
gagaugacggcaaggauga

SEQ ID NO: 670127 - RNA, 19 nt, Homo sapiens
aauugucacuuuccaguuu

SEQ ID NO: 670128 - RNA, 19 nt, Homo sapiens
cgaguuccauuauacugaa

SEQ ID NO: 670129 - RNA, 19 nt, Homo sapiens
cagaagacaaaccaauuaa

SEQ ID NO: 670130 - RNA, 19 nt, Homo sapiens
uggauaaugugaugucaga

SEQ ID NO: 670131 - RNA, 19 nt, Homo sapiens
gagaaaggcuaaccacuua

SEQ ID NO: 670132 - RNA, 19 nt, Homo sapiens
ggaagaacuuguagaauuu

SEQ ID NO: 670133 - RNA, 19 nt, Homo sapiens
aaaccaagcuguacaauuu

SEQ ID NO: 670134 - RNA, 19 nt, Homo sapiens
ucacugaccuguagaauuu

SEQ ID NO: 670135 - RNA, 19 nt, Homo sapiens
caagggaccuguauaguaa

SEQ ID NO: 670136 - RNA, 19 nt, Homo sapiens
caagaaaucuacacaaguu

SEQ ID NO: 670137 - RNA, 19 nt, Homo sapiens
ggaccuguauaguaaauua

SEQ ID NO: 670138 - RNA, 19 nt, Homo sapiens
ggagcgagcugaaauaguu

SEQ ID NO: 670139 - RNA, 19 nt, Homo sapiens
ccagauccauggaauaaua

SEQ ID NO: 670140 - RNA, 19 nt, Homo sapiens
gguggaagcugagaaauaa

SEQ ID NO: 670141 - RNA, 19 nt, Homo sapiens
gcacaucucuccugucugu

SEQ ID NO: 670142 - RNA, 19 nt, Homo sapiens
gaacacagagcuaaagaaa

SEQ ID NO: 670143 - RNA, 19 nt, Homo sapiens
ccacguagaugcugcuuaa

SEQ ID NO: 670144 - RNA, 19 nt, Homo sapiens
gcuaaacacuacauugaaa

SEQ ID NO: 670145 - RNA, 19 nt, Homo sapiens
gcuuuaaacuuucaaggua

SEQ ID NO: 670146 - RNA, 19 nt, Homo sapiens
gcagugugguuacuucuuu

SEQ ID NO: 670147 - RNA, 19 nt, Homo sapiens
uggaagaacuuguagaauu

SEQ ID NO: 670148 - RNA, 19 nt, Homo sapiens
ggaagaugcugauuaccuu

SEQ ID NO: 670149 - RNA, 19 nt, Homo sapiens
gagcugaaauaguugcuaa

SEQ ID NO: 670150 - RNA, 19 nt, Homo sapiens
ugaaauaacugggcuguug

SEQ ID NO: 670151 - RNA, 19 nt, Homo sapiens
caggagaaguugcagcuua

SEQ ID NO: 670152 - RNA, 19 nt, Homo sapiens
gaguaugacuucguguuua

SEQ ID NO: 670153 - RNA, 19 nt, Homo sapiens
ugaaagaacuaccaaaugg

SEQ ID NO: 670154 - RNA, 19 nt, Homo sapiens
ggaauguagucgacggaua

SEQ ID NO: 670155 - RNA, 19 nt, Homo sapiens
guaaacaacucgcacaucu

SEQ ID NO: 670156 - RNA, 19 nt, Homo sapiens
aaacaagugcaguguauua

SEQ ID NO: 670157 - RNA, 19 nt, Homo sapiens
caaagucacagauagauuu

SEQ ID NO: 670158 - RNA, 19 nt, Homo sapiens
ggaaguaacguuuguuuag

SEQ ID NO: 670159 - RNA, 19 nt, Homo sapiens
caagaacacugaaaaguuu

SEQ ID NO: 670160 - RNA, 19 nt, Homo sapiens
uaaagacauuggagagaaa

SEQ ID NO: 670161 - RNA, 19 nt, Homo sapiens
gauagucccgugagauaua

SEQ ID NO: 670162 - RNA, 19 nt, Homo sapiens
gaaacaagggaccuguaua

SEQ ID NO: 670163 - RNA, 19 nt, Homo sapiens
aaacaucgcaauagcauuu

SEQ ID NO: 670164 - RNA, 19 nt, Homo sapiens
ucaauugcaucaucacuga

SEQ ID NO: 670165 - RNA, 19 nt, Homo sapiens
agagagaacugccaaauac

SEQ ID NO: 670166 - RNA, 19 nt, Homo sapiens
acacuaaaccucagaauau

SEQ ID NO: 670167 - RNA, 19 nt, Homo sapiens
uaacugggcuguugaugca

SEQ ID NO: 670168 - RNA, 19 nt, Homo sapiens
gcuagugaaugugacaaua

SEQ ID NO: 670169 - RNA, 19 nt, Homo sapiens
caucaucacugaccuguag

SEQ ID NO: 670170 - RNA, 19 nt, Homo sapiens
ccucaugguucuacucuuu

SEQ ID NO: 670171 - RNA, 19 nt, Homo sapiens
guggauuacuugccagaua

SEQ ID NO: 670172 - RNA, 19 nt, Homo sapiens
guacugaggacauguauuc

SEQ ID NO: 670173 - RNA, 19 nt, Homo sapiens
caacgccacuucaaauauc

SEQ ID NO: 670174 - RNA, 19 nt, Homo sapiens
gaaauuguccauggaagaa

SEQ ID NO: 670175 - RNA, 19 nt, Homo sapiens
aaauuucuguccaagcuua

SEQ ID NO: 670176 - RNA, 19 nt, Homo sapiens
ggucagaaguuaguuauac

SEQ ID NO: 670177 - RNA, 19 nt, Homo sapiens
caacuucagauuucuauga

SEQ ID NO: 670178 - RNA, 19 nt, Homo sapiens
caagugcaguguauuaaag

SEQ ID NO: 670179 - RNA, 19 nt, Homo sapiens
ucauaggagucuaggauuu

SEQ ID NO: 670180 - RNA, 19 nt, Homo sapiens
gaauguagucgacggauau

SEQ ID NO: 670181 - RNA, 19 nt, Homo sapiens
guacugccgucuagucgaa

SEQ ID NO: 670182 - RNA, 19 nt, Homo sapiens
cagcuuuacuccucaugua

SEQ ID NO: 670183 - RNA, 19 nt, Homo sapiens
agagacagauaugguguua

SEQ ID NO: 670184 - RNA, 19 nt, Homo sapiens
gaaauaacugggcuguuga

SEQ ID NO: 670185 - RNA, 19 nt, Homo sapiens
guccuaaacugacugaaga

SEQ ID NO: 670186 - RNA, 19 nt, Homo sapiens
gaaacucucccaaacacuu

SEQ ID NO: 670187 - RNA, 19 nt, Homo sapiens
ucacgcagcugccaaccaa

SEQ ID NO: 670188 - RNA, 19 nt, Homo sapiens
ggauguagcacucaaacuu

SEQ ID NO: 670189 - RNA, 19 nt, Homo sapiens
ugccaaagcaguauuuaua

SEQ ID NO: 670190 - RNA, 19 nt, Homo sapiens
cgugaaaccuacauugcua

SEQ ID NO: 670191 - RNA, 19 nt, Homo sapiens
cguacucccuuuacacuaa

SEQ ID NO: 670192 - RNA, 19 nt, Homo sapiens
agacagauaugguguuaag

SEQ ID NO: 670193 - RNA, 19 nt, Homo sapiens
guccugacuuuauuaauug

SEQ ID NO: 670194 - RNA, 19 nt, Homo sapiens
acacagagcuaaagaaacg

SEQ ID NO: 670195 - RNA, 19 nt, Homo sapiens
aagaugagcguuucaauug

SEQ ID NO: 670196 - RNA, 19 nt, Homo sapiens
uagagcaacuucagauuuc

SEQ ID NO: 670197 - RNA, 19 nt, Homo sapiens
aaauagaccuggaugucaa

SEQ ID NO: 670198 - RNA, 19 nt, Homo sapiens
acaagggaccuguauagua

SEQ ID NO: 670199 - RNA, 19 nt, Homo sapiens
gcaacgccacuucaaauau

SEQ ID NO: 670200 - RNA, 19 nt, Homo sapiens
gacagcagauuuugguuua

SEQ ID NO: 670201 - RNA, 19 nt, Homo sapiens
uaagaugagcguuucaauu

SEQ ID NO: 670202 - RNA, 19 nt, Homo sapiens
cagagagaacugccaaaua

SEQ ID NO: 670203 - RNA, 19 nt, Homo sapiens
gaggagcucccagaucaua

SEQ ID NO: 670204 - RNA, 19 nt, Homo sapiens
uaucaacagugguaaauac

SEQ ID NO: 670205 - RNA, 19 nt, Homo sapiens
uaucacauccacauacuaa

SEQ ID NO: 670206 - RNA, 19 nt, Homo sapiens
gaaaggcuaaccacuuaau

SEQ ID NO: 670207 - RNA, 19 nt, Homo sapiens
uuaaagacauuggagagaa

SEQ ID NO: 670208 - RNA, 19 nt, Homo sapiens
gacguguacuugcuaaaga

SEQ ID NO: 670209 - RNA, 19 nt, Homo sapiens
uggauuacuugccagauaa

SEQ ID NO: 670210 - RNA, 19 nt, Homo sapiens
gaacuaaagcgggcaaagu

SEQ ID NO: 670211 - RNA, 19 nt, Homo sapiens
gcaacaauccuuauuccau

SEQ ID NO: 670212 - RNA, 19 nt, Homo sapiens
caaaacaagugcaguguau

SEQ ID NO: 670213 - RNA, 19 nt, Homo sapiens
uagauagucccgugagaua

SEQ ID NO: 670214 - RNA, 19 nt, Homo sapiens
gaacauggucagaaguuag

SEQ ID NO: 670215 - RNA, 19 nt, Homo sapiens
uaacagaacauggucagaa

SEQ ID NO: 670216 - RNA, 19 nt, Homo sapiens
cuacaucuuugaaggagaa

SEQ ID NO: 670217 - RNA, 19 nt, Homo sapiens
gaauucagaccaggaugua

SEQ ID NO: 670218 - RNA, 19 nt, Homo sapiens
cauaauugccaaagcagua

SEQ ID NO: 670219 - RNA, 19 nt, Homo sapiens
ggacgggcuuuccauccaa

SEQ ID NO: 670220 - RNA, 19 nt, Homo sapiens
uuaaagaugaggcagauuu

SEQ ID NO: 670221 - RNA, 19 nt, Homo sapiens
aaaguuagaccuuccagaa

SEQ ID NO: 670222 - RNA, 19 nt, Homo sapiens
acgagaaggugcagagauu

SEQ ID NO: 670223 - RNA, 19 nt, Homo sapiens
gaaguaacguuuguuuagc

SEQ ID NO: 670224 - RNA, 19 nt, Homo sapiens
uaaccuggguccuaaacug

SEQ ID NO: 670225 - RNA, 19 nt, Homo sapiens
gcacgcacagugguaauuu

SEQ ID NO: 670226 - RNA, 19 nt, Homo sapiens
ggaaacaucgcaauagcau

SEQ ID NO: 670227 - RNA, 19 nt, Homo sapiens
gaugagcguuucaauugca

SEQ ID NO: 670228 - RNA, 19 nt, Homo sapiens
guucauaauugccaaagca

SEQ ID NO: 670229 - RNA, 19 nt, Homo sapiens
acacggaagucggguauug

SEQ ID NO: 670230 - RNA, 19 nt, Homo sapiens
gauugaaccuugggaagau

SEQ ID NO: 670231 - RNA, 19 nt, Homo sapiens
caagagagauucuaugaca

SEQ ID NO: 670232 - RNA, 19 nt, Homo sapiens
caacccagcuugcaugaaa

SEQ ID NO: 670233 - RNA, 19 nt, Homo sapiens
ccacacaccuuccuucuug

SEQ ID NO: 670234 - RNA, 19 nt, Homo sapiens
gcucugggaucuuuaauau

SEQ ID NO: 670235 - RNA, 19 nt, Homo sapiens
aaacugcucuugcuaaaug

SEQ ID NO: 670236 - RNA, 19 nt, Homo sapiens
ggacaccacuuccauucuu

SEQ ID NO: 670237 - RNA, 19 nt, Homo sapiens
ugagugcguucauucauua

SEQ ID NO: 670238 - RNA, 19 nt, Homo sapiens
gcacggaugugguucuuuc

SEQ ID NO: 670239 - RNA, 19 nt, Homo sapiens
gaaggugucugacgucaca

SEQ ID NO: 670240 - RNA, 19 nt, Homo sapiens
gugagaagguugagaguug

SEQ ID NO: 670241 - RNA, 19 nt, Homo sapiens
gggaaugaguuuauuaucu

SEQ ID NO: 670242 - RNA, 19 nt, Homo sapiens
gacaaaagaugacuaaaga

SEQ ID NO: 670243 - RNA, 19 nt, Homo sapiens
gacaaagccuccagugugu

SEQ ID NO: 670244 - RNA, 19 nt, Homo sapiens
gcauauugcugcagaugga

SEQ ID NO: 670245 - RNA, 19 nt, Homo sapiens
ugaaacugcucuugcuaaa

SEQ ID NO: 670246 - RNA, 19 nt, Homo sapiens
gcagucaccuaaccgaaug

SEQ ID NO: 670247 - RNA, 19 nt, Homo sapiens
ucaaguucauacucucuua

SEQ ID NO: 670248 - RNA, 19 nt, Homo sapiens
ccacaggccugggaacuga

SEQ ID NO: 670249 - RNA, 19 nt, Homo sapiens
gaaugaaacugcucuugcu

SEQ ID NO: 670250 - RNA, 19 nt, Homo sapiens
gcgaaacucuaacgccuau

SEQ ID NO: 670251 - RNA, 19 nt, Homo sapiens
uaacucugcugucugaaug

SEQ ID NO: 670252 - RNA, 19 nt, Homo sapiens
caacuacagugacaacuac

SEQ ID NO: 670253 - RNA, 19 nt, Homo sapiens
gcaacuacagugacaacua

SEQ ID NO: 670254 - RNA, 19 nt, Homo sapiens
guggacagcucaccuagug

SEQ ID NO: 670255 - RNA, 19 nt, Homo sapiens
ggacacccaucuuggauac

SEQ ID NO: 670256 - RNA, 19 nt, Homo sapiens
cugaagcuguuuacacuuu

SEQ ID NO: 670257 - RNA, 19 nt, Homo sapiens
gagaagacccugagauguc

SEQ ID NO: 670258 - RNA, 19 nt, Homo sapiens
ccaaccagcuucaggauac

SEQ ID NO: 670259 - RNA, 19 nt, Homo sapiens
caaugacacuaaacagaau

SEQ ID NO: 670260 - RNA, 19 nt, Homo sapiens
ccaaauggucccugacaaa

SEQ ID NO: 670261 - RNA, 19 nt, Homo sapiens
aaacugggcagacaacauu

SEQ ID NO: 670262 - RNA, 19 nt, Homo sapiens
ugaaggaccaugugacaaa

SEQ ID NO: 670263 - RNA, 19 nt, Homo sapiens
gcacuuucauuuucaauug

SEQ ID NO: 670264 - RNA, 19 nt, Homo sapiens
gugagugcguucauucauu

SEQ ID NO: 670265 - RNA, 19 nt, Homo sapiens
ucaaugacacuaaacagaa

SEQ ID NO: 670266 - RNA, 19 nt, Homo sapiens
ucacugaggagacuaagaa

SEQ ID NO: 670267 - RNA, 19 nt, Homo sapiens
uauccaggcuuacacucua

SEQ ID NO: 670268 - RNA, 19 nt, Homo sapiens
ggaccaggaugggauuuua

SEQ ID NO: 670269 - RNA, 19 nt, Homo sapiens
gggaugugaugcuggagaa

SEQ ID NO: 670270 - RNA, 19 nt, Homo sapiens
gaccacagcagcuuucguu

SEQ ID NO: 670271 - RNA, 19 nt, Homo sapiens
ucucagugcccauaucaua

SEQ ID NO: 670272 - RNA, 19 nt, Homo sapiens
ccccagaacuuauuauuuu

SEQ ID NO: 670273 - RNA, 19 nt, Homo sapiens
ggaaauggaggaccaggau

SEQ ID NO: 670274 - RNA, 19 nt, Homo sapiens
ggagagagaggccuaagag

SEQ ID NO: 670275 - RNA, 19 nt, Homo sapiens
uuuaauaucccauggcuaa

SEQ ID NO: 670276 - RNA, 19 nt, Homo sapiens
ucauuuggcuucugagauc

SEQ ID NO: 670277 - RNA, 19 nt, Homo sapiens
gaaggaccaugugacaaag

SEQ ID NO: 670278 - RNA, 19 nt, Homo sapiens
ggugggcacucggcacuuu

SEQ ID NO: 670279 - RNA, 19 nt, Homo sapiens
gccacaggauccuaucuug

SEQ ID NO: 670280 - RNA, 19 nt, Homo sapiens
gcgagaaggaggcacguuu

SEQ ID NO: 670281 - RNA, 19 nt, Homo sapiens
uuccgaagcuuaagcgaaa

SEQ ID NO: 670282 - RNA, 19 nt, Homo sapiens
ccguaacucugcugucuga

SEQ ID NO: 670283 - RNA, 19 nt, Homo sapiens
gcacucacguucucaaccu

SEQ ID NO: 670284 - RNA, 19 nt, Homo sapiens
ggaggacaccacuuccauu

SEQ ID NO: 670285 - RNA, 19 nt, Homo sapiens
caugugaccuuccuuccau

SEQ ID NO: 670286 - RNA, 19 nt, Homo sapiens
gaggcucacugcccuaucu

SEQ ID NO: 670287 - RNA, 19 nt, Homo sapiens
ggaugugguucuuucuauc

SEQ ID NO: 670288 - RNA, 19 nt, Homo sapiens
ggugugcaguccuuugaug

SEQ ID NO: 670289 - RNA, 19 nt, Homo sapiens
ggaagacaccagcuguuca

SEQ ID NO: 670290 - RNA, 19 nt, Homo sapiens
uugcuucccuuucagcuuu

SEQ ID NO: 670291 - RNA, 19 nt, Homo sapiens
ugaggagacuaagaacaaa

SEQ ID NO: 670292 - RNA, 19 nt, Homo sapiens
gagacaagagagucacuga

SEQ ID NO: 670293 - RNA, 19 nt, Homo sapiens
cggaugugguucuuucuau

SEQ ID NO: 670294 - RNA, 19 nt, Homo sapiens
gaggacaccacuuccauuc

SEQ ID NO: 670295 - RNA, 19 nt, Homo sapiens
ggugaggacaugaguguga

SEQ ID NO: 670296 - RNA, 19 nt, Homo sapiens
ggaagugggagggauguga

SEQ ID NO: 670297 - RNA, 19 nt, Homo sapiens
ccauugggcugcaacuaca

SEQ ID NO: 670298 - RNA, 19 nt, Homo sapiens
gccaaauggucccugacaa

SEQ ID NO: 670299 - RNA, 19 nt, Homo sapiens
ucugagagguggucuagca

SEQ ID NO: 670300 - RNA, 19 nt, Homo sapiens
acugagaccugggcaacua

SEQ ID NO: 670301 - RNA, 19 nt, Homo sapiens
auggauggccucacucuua

SEQ ID NO: 670302 - RNA, 19 nt, Homo sapiens
uuacagcaguccuggaaca

SEQ ID NO: 670303 - RNA, 19 nt, Homo sapiens
gguugcuuaucgucuauuu

SEQ ID NO: 670304 - RNA, 19 nt, Homo sapiens
ugacuaaagaucugaagga

SEQ ID NO: 670305 - RNA, 19 nt, Homo sapiens
gaaacucuaacgccuaugg

SEQ ID NO: 670306 - RNA, 19 nt, Homo sapiens
gaaacugggcagacaacau

SEQ ID NO: 670307 - RNA, 19 nt, Homo sapiens
ggccuggucuuccauggau

SEQ ID NO: 670308 - RNA, 19 nt, Homo sapiens
caaugguuauccugagguu

SEQ ID NO: 670309 - RNA, 19 nt, Homo sapiens
guucauacucucuuacuca

SEQ ID NO: 670310 - RNA, 19 nt, Homo sapiens
ggguguuucuguccaucua

SEQ ID NO: 670311 - RNA, 19 nt, Homo sapiens
caggucauuuggcuucuga

SEQ ID NO: 670312 - RNA, 19 nt, Homo sapiens
caacuaccaggaacugaug

SEQ ID NO: 670313 - RNA, 19 nt, Homo sapiens
cuagcaggguucauacaug

SEQ ID NO: 670314 - RNA, 19 nt, Homo sapiens
acucuuggcucuccaugga

SEQ ID NO: 670315 - RNA, 19 nt, Homo sapiens
gaugugguucuuucuauca

SEQ ID NO: 670316 - RNA, 19 nt, Homo sapiens
ccucagcgauggcgagaag

SEQ ID NO: 670317 - RNA, 19 nt, Homo sapiens
gaaggaggcacguuuucua

SEQ ID NO: 670318 - RNA, 19 nt, Homo sapiens
cccaagagagauucuauga

SEQ ID NO: 670319 - RNA, 19 nt, Homo sapiens
gaaacugcucuugcuaaau

SEQ ID NO: 670320 - RNA, 19 nt, Homo sapiens
gaagacaccagcuguucag

SEQ ID NO: 670321 - RNA, 19 nt, Homo sapiens
gcgcagcugugcucaagac

SEQ ID NO: 670322 - RNA, 19 nt, Homo sapiens
gccaucaaguucauacucu

SEQ ID NO: 670323 - RNA, 19 nt, Homo sapiens
ggaguccggugcugucacu

SEQ ID NO: 670324 - RNA, 19 nt, Homo sapiens
gggacacccaucuuggaua

SEQ ID NO: 670325 - RNA, 19 nt, Homo sapiens
ccacaacacagccaugagu

SEQ ID NO: 670326 - RNA, 19 nt, Homo sapiens
gaagugggagggaugugau

SEQ ID NO: 670327 - RNA, 19 nt, Homo sapiens
acaagggcaugggcucaaa

SEQ ID NO: 670328 - RNA, 19 nt, Homo sapiens
ggccagucuuagcauguuu

SEQ ID NO: 670329 - RNA, 19 nt, Homo sapiens
ggccaagucaucauucuca

SEQ ID NO: 670330 - RNA, 19 nt, Homo sapiens
ccucaggugugcaguccuu

SEQ ID NO: 670331 - RNA, 19 nt, Homo sapiens
ccaaagagcuggaugaugu

SEQ ID NO: 670332 - RNA, 19 nt, Homo sapiens
gagaagaucuaccacaaga

SEQ ID NO: 670333 - RNA, 19 nt, Homo sapiens
gcacaagccuuagcaaaug

SEQ ID NO: 670334 - RNA, 19 nt, Homo sapiens
caagcauccugaacaauua

SEQ ID NO: 670335 - RNA, 19 nt, Homo sapiens
caacuucucugccaagguu

SEQ ID NO: 670336 - RNA, 19 nt, Homo sapiens
gggcagcucuccugacaaa

SEQ ID NO: 670337 - RNA, 19 nt, Homo sapiens
ggaagaacagaguuuauuu

SEQ ID NO: 670338 - RNA, 19 nt, Homo sapiens
gcagcaacaugguggagua

SEQ ID NO: 670339 - RNA, 19 nt, Homo sapiens
acaauuaccugaucuggaa

SEQ ID NO: 670340 - RNA, 19 nt, Homo sapiens
uguaugggauggauuauuu

SEQ ID NO: 670341 - RNA, 19 nt, Homo sapiens
acacagcgcuucuaccuau

SEQ ID NO: 670342 - RNA, 19 nt, Homo sapiens
ccuacuaccuuccaacuaa

SEQ ID NO: 670343 - RNA, 19 nt, Homo sapiens
guacgaaauuucugaagau

SEQ ID NO: 670344 - RNA, 19 nt, Homo sapiens
aaacagaacugccaaugag

SEQ ID NO: 670345 - RNA, 19 nt, Homo sapiens
gaaccaagcauccugaaca

SEQ ID NO: 670346 - RNA, 19 nt, Homo sapiens
guacagacccuccucaauc

SEQ ID NO: 670347 - RNA, 19 nt, Homo sapiens
gcgcgaguaugacaaagaa

SEQ ID NO: 670348 - RNA, 19 nt, Homo sapiens
gguacgaaauuucugaaga

SEQ ID NO: 670349 - RNA, 19 nt, Homo sapiens
cgaaauuucugaagauucu

SEQ ID NO: 670350 - RNA, 19 nt, Homo sapiens
gcacuaagaaguccugugu

SEQ ID NO: 670351 - RNA, 19 nt, Homo sapiens
gcaacaugguggaguacaa

SEQ ID NO: 670352 - RNA, 19 nt, Homo sapiens
gggagaacauugcugacaa

SEQ ID NO: 670353 - RNA, 19 nt, Homo sapiens
ccaagcauccugaacaauu

SEQ ID NO: 670354 - RNA, 19 nt, Homo sapiens
ggaugacgcccuuggcuuu

SEQ ID NO: 670355 - RNA, 19 nt, Homo sapiens
gguguggucuuggcccuua

SEQ ID NO: 670356 - RNA, 19 nt, Homo sapiens
gaggaacaguacaaucaau

SEQ ID NO: 670357 - RNA, 19 nt, Homo sapiens
ggucuuggcccuuauagga

SEQ ID NO: 670358 - RNA, 19 nt, Homo sapiens
gcagugaagcugagcagaa

SEQ ID NO: 670359 - RNA, 19 nt, Homo sapiens
gaacugccaaugagaaagu

SEQ ID NO: 670360 - RNA, 19 nt, Homo sapiens
cgagaccaguggagcauga

SEQ ID NO: 670361 - RNA, 19 nt, Homo sapiens
ggcuugaguuccugucuuu

SEQ ID NO: 670362 - RNA, 19 nt, Homo sapiens
uaaacagaacugccaauga

SEQ ID NO: 670363 - RNA, 19 nt, Homo sapiens
aaaggaagaacagaguuua

SEQ ID NO: 670364 - RNA, 19 nt, Homo sapiens
uacagacccuccucaauca

SEQ ID NO: 670365 - RNA, 19 nt, Homo sapiens
ggagaacauugcugacaac

SEQ ID NO: 670366 - RNA, 19 nt, Homo sapiens
ugccaucuaugauaugauu

SEQ ID NO: 670367 - RNA, 19 nt, Homo sapiens
ggauuacuacuuaaacaga

SEQ ID NO: 670368 - RNA, 19 nt, Homo sapiens
gcucuuggguugggaggaa

SEQ ID NO: 670369 - RNA, 19 nt, Homo sapiens
cacaagccuuagcaaauga

SEQ ID NO: 670370 - RNA, 19 nt, Homo sapiens
ggacaagacagcuguuagg

SEQ ID NO: 670371 - RNA, 19 nt, Homo sapiens
ggaggaacaguacaaucaa

SEQ ID NO: 670372 - RNA, 19 nt, Homo sapiens
agagcuggaugauguuuau

SEQ ID NO: 670373 - RNA, 19 nt, Homo sapiens
agauacagcuggccaacau

SEQ ID NO: 670374 - RNA, 19 nt, Homo sapiens
caaagcaggaaagcagaua

SEQ ID NO: 670375 - RNA, 19 nt, Homo sapiens
ccacagcaccugccuuaca

SEQ ID NO: 670376 - RNA, 19 nt, Homo sapiens
uacaaagcauggcugagaa

SEQ ID NO: 670377 - RNA, 19 nt, Homo sapiens
gacagugaaugccuacuac

SEQ ID NO: 670378 - RNA, 19 nt, Homo sapiens
caacaugguggaguacaaa

SEQ ID NO: 670379 - RNA, 19 nt, Homo sapiens
aggagaagaucuaccacaa

SEQ ID NO: 670380 - RNA, 19 nt, Homo sapiens
gcauucgaguggcuggaaa

SEQ ID NO: 670381 - RNA, 19 nt, Homo sapiens
ggcacaagccuuagcaaau

SEQ ID NO: 670382 - RNA, 19 nt, Homo sapiens
gggcacaagccuuagcaaa

SEQ ID NO: 670383 - RNA, 19 nt, Homo sapiens
gagaaaugcccagcuguca

SEQ ID NO: 670384 - RNA, 19 nt, Homo sapiens
cggcaaagcaaagaaauug

SEQ ID NO: 670385 - RNA, 19 nt, Homo sapiens
ggaccaggacaacuuuaug

SEQ ID NO: 670386 - RNA, 19 nt, Homo sapiens
aagcauggcugagaaagca

SEQ ID NO: 670387 - RNA, 19 nt, Homo sapiens
uaugacggguacgaaauuu

SEQ ID NO: 670388 - RNA, 19 nt, Homo sapiens
ucacugccuaucuggauua

SEQ ID NO: 670389 - RNA, 19 nt, Homo sapiens
cuaccuaucuugccuacag

SEQ ID NO: 670390 - RNA, 19 nt, Homo sapiens
ccaauaaacagacaugcau

SEQ ID NO: 670391 - RNA, 19 nt, Homo sapiens
auaggacccugugccaaua

SEQ ID NO: 670392 - RNA, 19 nt, Homo sapiens
gggaagugcauauguguag

SEQ ID NO: 670393 - RNA, 19 nt, Homo sapiens
gaggccaguucccauagga

SEQ ID NO: 670394 - RNA, 19 nt, Homo sapiens
uuacaaagcauggcugaga

SEQ ID NO: 670395 - RNA, 19 nt, Homo sapiens
ugacgcaugccuuugauga

SEQ ID NO: 670396 - RNA, 19 nt, Homo sapiens
ugggacagcugguuuggau

SEQ ID NO: 670397 - RNA, 19 nt, Homo sapiens
cugcugaccuucacugaca

SEQ ID NO: 670398 - RNA, 19 nt, Homo sapiens
caacuaagaaugagaucgu

SEQ ID NO: 670399 - RNA, 19 nt, Homo sapiens
cuuagcaaaugauugauuc

SEQ ID NO: 670400 - RNA, 19 nt, Homo sapiens
auuggugguuggaacauua

SEQ ID NO: 670401 - RNA, 19 nt, Homo sapiens
caggugacaugaguacaga

SEQ ID NO: 670402 - RNA, 19 nt, Homo sapiens
gauuggugguuggaacauu

SEQ ID NO: 670403 - RNA, 19 nt, Homo sapiens
ccuccucaaucaccacauu

SEQ ID NO: 670404 - RNA, 19 nt, Homo sapiens
ugccuacaaugcuuacaaa

SEQ ID NO: 670405 - RNA, 19 nt, Homo sapiens
ggaacaguacaaucaauac

SEQ ID NO: 670406 - RNA, 19 nt, Homo sapiens
gcauggaggaacaguacaa

SEQ ID NO: 670407 - RNA, 19 nt, Homo sapiens
ggaccgacgcuuugagucu

SEQ ID NO: 670408 - RNA, 19 nt, Homo sapiens
ccugaacaauuaccugauc

SEQ ID NO: 670409 - RNA, 19 nt, Homo sapiens
aaccaagcauccugaacaa

SEQ ID NO: 670410 - RNA, 19 nt, Homo sapiens
gcgacgaggagaagaucua

SEQ ID NO: 670411 - RNA, 19 nt, Homo sapiens
gagcccagccacugagaga

SEQ ID NO: 670412 - RNA, 19 nt, Homo sapiens
agacagugaaugccuacua

SEQ ID NO: 670413 - RNA, 19 nt, Homo sapiens
ucccacagcaccugccuua

SEQ ID NO: 670414 - RNA, 19 nt, Homo sapiens
gcccuuggcuuugcuuugg

SEQ ID NO: 670415 - RNA, 19 nt, Homo sapiens
ggagaagaucuaccacaag

SEQ ID NO: 670416 - RNA, 19 nt, Homo sapiens
cagaacugccaaugagaaa

SEQ ID NO: 670417 - RNA, 19 nt, Homo sapiens
uggaggaacaguacaauca

SEQ ID NO: 670418 - RNA, 19 nt, Homo sapiens
ugaguugacgcaugccuuu

SEQ ID NO: 670419 - RNA, 19 nt, Homo sapiens
uauaggacccugugccaau

SEQ ID NO: 670420 - RNA, 19 nt, Homo sapiens
ucuuagggcacaagccuua

SEQ ID NO: 670421 - RNA, 19 nt, Homo sapiens
aggaacaguacaaucaaua

SEQ ID NO: 670422 - RNA, 19 nt, Homo sapiens
cgggauuacuacuuaaaca

SEQ ID NO: 670423 - RNA, 19 nt, Homo sapiens
cagugaagcugagcagaag

SEQ ID NO: 670424 - RNA, 19 nt, Homo sapiens
caaagagcuggaugauguu

SEQ ID NO: 670425 - RNA, 19 nt, Homo sapiens
gaccggcaaagcaaagaaa

SEQ ID NO: 670426 - RNA, 19 nt, Homo sapiens
cugccuaucuggauuacau

SEQ ID NO: 670427 - RNA, 19 nt, Homo sapiens
cuuagcaggugccucucua

SEQ ID NO: 670428 - RNA, 19 nt, Homo sapiens
gaauuuguacaacuucucu

SEQ ID NO: 670429 - RNA, 19 nt, Homo sapiens
gagacccucuauggcacua

SEQ ID NO: 670430 - RNA, 19 nt, Homo sapiens
gaccaggacaacuuuaugg

SEQ ID NO: 670431 - RNA, 19 nt, Homo sapiens
gaaguccgcugacgugcua

SEQ ID NO: 670432 - RNA, 19 nt, Homo sapiens
ggacaaggaugacgaagag

SEQ ID NO: 670433 - RNA, 19 nt, Homo sapiens
ggaaugcccaccuugguua

SEQ ID NO: 670434 - RNA, 19 nt, Homo sapiens
ucaaacugcugggauuaua

SEQ ID NO: 670435 - RNA, 19 nt, Homo sapiens
gauggcagauggcaauguu

SEQ ID NO: 670436 - RNA, 19 nt, Homo sapiens
gugcucaucuacguuaaua

SEQ ID NO: 670437 - RNA, 19 nt, Homo sapiens
gcucaucuacguuaauaaa

SEQ ID NO: 670438 - RNA, 19 nt, Homo sapiens
gacggaaucucacucuuuc

SEQ ID NO: 670439 - RNA, 19 nt, Homo sapiens
gagaggcccugcuucaagu

SEQ ID NO: 670440 - RNA, 19 nt, Homo sapiens
gcacaacggcucccucuac

SEQ ID NO: 670441 - RNA, 19 nt, Homo sapiens
gaccaacuagucccagaua

SEQ ID NO: 670442 - RNA, 19 nt, Homo sapiens
gcucugacuugaaggacuu

SEQ ID NO: 670443 - RNA, 19 nt, Homo sapiens
acaguggccuugcuuccua

SEQ ID NO: 670444 - RNA, 19 nt, Homo sapiens
cagcgucagugcucaucua

SEQ ID NO: 670445 - RNA, 19 nt, Homo sapiens
cugcguggauccuguguuu

SEQ ID NO: 670446 - RNA, 19 nt, Homo sapiens
caucuacguuaauaaagug

SEQ ID NO: 670447 - RNA, 19 nt, Homo sapiens
ucagugcucaucuacguua

SEQ ID NO: 670448 - RNA, 19 nt, Homo sapiens
agaugaagcuggcuacuac

SEQ ID NO: 670449 - RNA, 19 nt, Homo sapiens
gugggaaccuguccguguu

SEQ ID NO: 670450 - RNA, 19 nt, Homo sapiens
ccgaguagcugggauuaca

SEQ ID NO: 670451 - RNA, 19 nt, Homo sapiens
agacaaccacgaccaacua

SEQ ID NO: 670452 - RNA, 19 nt, Homo sapiens
ugaaugucaugguguggaa

SEQ ID NO: 670453 - RNA, 19 nt, Homo sapiens
agacggaaucucacucuuu

SEQ ID NO: 670454 - RNA, 19 nt, Homo sapiens
gcccauggaugucuaugag

SEQ ID NO: 670455 - RNA, 19 nt, Homo sapiens
cccgagggcucuucccaaa

SEQ ID NO: 670456 - RNA, 19 nt, Homo sapiens
ccaccacgcccagcuaauu

SEQ ID NO: 670457 - RNA, 19 nt, Homo sapiens
aaagugguccuauuuaugg

SEQ ID NO: 670458 - RNA, 19 nt, Homo sapiens
gaggagagcacguguuucg

SEQ ID NO: 670459 - RNA, 19 nt, Homo sapiens
ccgaggagagcacguguuu

SEQ ID NO: 670460 - RNA, 19 nt, Homo sapiens
cgugcuagcucuugcagau

SEQ ID NO: 670461 - RNA, 19 nt, Homo sapiens
gggaaugcccaccuugguu

SEQ ID NO: 670462 - RNA, 19 nt, Homo sapiens
ccacgugacgggcaacuau

SEQ ID NO: 670463 - RNA, 19 nt, Homo sapiens
gucgugcgcugcuggaaga

SEQ ID NO: 670464 - RNA, 19 nt, Homo sapiens
gcggagagggcuaccaguu

SEQ ID NO: 670465 - RNA, 19 nt, Homo sapiens
gagagcuucuucguggauu

SEQ ID NO: 670466 - RNA, 19 nt, Homo sapiens
gagcagugcgucuccuuca

SEQ ID NO: 670467 - RNA, 19 nt, Homo sapiens
ccauguguguccgcuauga

SEQ ID NO: 670468 - RNA, 19 nt, Homo sapiens
cgagacauccagauuguag

SEQ ID NO: 670469 - RNA, 19 nt, Homo sapiens
cgugugaccugcacuguac

SEQ ID NO: 670470 - RNA, 19 nt, Homo sapiens
caacagcccaacauccaau

SEQ ID NO: 670471 - RNA, 19 nt, Homo sapiens
gacaacagcccaacaucca

SEQ ID NO: 670472 - RNA, 19 nt, Homo sapiens
guacccuggucaucuggaa

SEQ ID NO: 670473 - RNA, 19 nt, Homo sapiens
cgucagugcucaucuacgu

SEQ ID NO: 670474 - RNA, 19 nt, Homo sapiens
ccaggcgugcucccucuua

SEQ ID NO: 670475 - RNA, 19 nt, Homo sapiens
caaggaugacgaagagguu

SEQ ID NO: 670476 - RNA, 19 nt, Homo sapiens
caaccacgaccaacuaguc

SEQ ID NO: 670477 - RNA, 19 nt, Homo sapiens
cagaugaagcuggcuacua

SEQ ID NO: 670478 - RNA, 19 nt, Homo sapiens
uggccaugcuggucucaaa

SEQ ID NO: 670479 - RNA, 19 nt, Homo sapiens
ggguuugcgugucuggaaa

SEQ ID NO: 670480 - RNA, 19 nt, Homo sapiens
cgagggcucuucccaaagc

SEQ ID NO: 670481 - RNA, 19 nt, Homo sapiens
ugcgagacgucaagugcua

SEQ ID NO: 670482 - RNA, 19 nt, Homo sapiens
ucaggcacguguacugcaa

SEQ ID NO: 670483 - RNA, 19 nt, Homo sapiens
gggacaaggaugacgaaga

SEQ ID NO: 670484 - RNA, 19 nt, Homo sapiens
caccacgcccagcuaauuu

SEQ ID NO: 670485 - RNA, 19 nt, Homo sapiens
guacccggaugacuauguc

SEQ ID NO: 670486 - RNA, 19 nt, Homo sapiens
agagcuucuucguggauua

SEQ ID NO: 670487 - RNA, 19 nt, Homo sapiens
cggcuaacgccaucucuga

SEQ ID NO: 670488 - RNA, 19 nt, Homo sapiens
cccgagacauccagauugu

SEQ ID NO: 670489 - RNA, 19 nt, Homo sapiens
guccacaucuccagcaaac

SEQ ID NO: 670490 - RNA, 19 nt, Homo sapiens
gcguggauccuguguuugu

SEQ ID NO: 670491 - RNA, 19 nt, Homo sapiens
gcuucuucguggauuauga

SEQ ID NO: 670492 - RNA, 19 nt, Homo sapiens
ugcuagcucuugcagauga

SEQ ID NO: 670493 - RNA, 19 nt, Homo sapiens
ggcccugcuucaaguggua

SEQ ID NO: 670494 - RNA, 19 nt, Homo sapiens
cgagaggcccugcuucaag

SEQ ID NO: 670495 - RNA, 19 nt, Homo sapiens
gcccuggccaucaaaguga

SEQ ID NO: 670496 - RNA, 19 nt, Homo sapiens
gacaggauuuuaccauguu

SEQ ID NO: 670497 - RNA, 19 nt, Homo sapiens
cgccauguguguccgcuau

SEQ ID NO: 670498 - RNA, 19 nt, Homo sapiens
gcgcaggcucugacuugaa

SEQ ID NO: 670499 - RNA, 19 nt, Homo sapiens
gcccgagacauccagauug

SEQ ID NO: 670500 - RNA, 19 nt, Homo sapiens
ugccucagccuuccgagua

SEQ ID NO: 670501 - RNA, 19 nt, Homo sapiens
caggcgugcucccucuuau

SEQ ID NO: 670502 - RNA, 19 nt, Homo sapiens
ccaagccucuggccaucca

SEQ ID NO: 670503 - RNA, 19 nt, Homo sapiens
ucucaaacugcugggauua

SEQ ID NO: 670504 - RNA, 19 nt, Homo sapiens
gcagcuggagcgaguguuc

SEQ ID NO: 670505 - RNA, 19 nt, Homo sapiens
gcuucagccucucaaacug

SEQ ID NO: 670506 - RNA, 19 nt, Homo sapiens
guuaauaaagugguccuau

SEQ ID NO: 670507 - RNA, 19 nt, Homo sapiens
cuccugaccucgugugauc

SEQ ID NO: 670508 - RNA, 19 nt, Homo sapiens
agugcgggcucgccaagaa

SEQ ID NO: 670509 - RNA, 19 nt, Homo sapiens
ggcaaaagccccuccauca

SEQ ID NO: 670510 - RNA, 19 nt, Homo sapiens
aggaugagaagcuguguga

SEQ ID NO: 670511 - RNA, 19 nt, Homo sapiens
gagcuucuucguggauuau

SEQ ID NO: 670512 - RNA, 19 nt, Homo sapiens
ccucccagguucaagcaau

SEQ ID NO: 670513 - RNA, 19 nt, Homo sapiens
uuuaguagagacaggauuu

SEQ ID NO: 670514 - RNA, 19 nt, Homo sapiens
caaacugcugggauuauag

SEQ ID NO: 670515 - RNA, 19 nt, Homo sapiens
cgcaggcucugacuugaag

SEQ ID NO: 670516 - RNA, 19 nt, Homo sapiens
ggcgcaggcucugacuuga

SEQ ID NO: 670517 - RNA, 19 nt, Homo sapiens
agaccggaaucgaguacau

SEQ ID NO: 670518 - RNA, 19 nt, Homo sapiens
gcuagcucuugcagaugaa

SEQ ID NO: 670519 - RNA, 19 nt, Homo sapiens
ucaacucccacguguacaa

SEQ ID NO: 670520 - RNA, 19 nt, Homo sapiens
ggucagagugcaccaagac

SEQ ID NO: 670521 - RNA, 19 nt, Homo sapiens
ggccaacaauccccuucua

SEQ ID NO: 670522 - RNA, 19 nt, Homo sapiens
ccaacaauccccuucuaaa

SEQ ID NO: 670523 - RNA, 19 nt, Homo sapiens
caacaauccccuucuaaag

SEQ ID NO: 670524 - RNA, 19 nt, Homo sapiens
gcagugcgucuccuucaac

SEQ ID NO: 670525 - RNA, 19 nt, Homo sapiens
cuaagagacguggcacuga

SEQ ID NO: 670526 - RNA, 19 nt, Homo sapiens
gcaccaucaggcacgugua

SEQ ID NO: 670527 - RNA, 19 nt, Homo sapiens
gagcagcuggagcgagugu

SEQ ID NO: 670528 - RNA, 19 nt, Homo sapiens
gagaugaccuugauuugaa

SEQ ID NO: 670529 - RNA, 19 nt, Homo sapiens
ggaacagccuggucagaua

SEQ ID NO: 670530 - RNA, 19 nt, Homo sapiens
gaggaaagcugauguuuac

SEQ ID NO: 670531 - RNA, 19 nt, Homo sapiens
gaaaucccaucucuacaaa

SEQ ID NO: 670532 - RNA, 19 nt, Homo sapiens
gaucuuaccuccuguguca

SEQ ID NO: 670533 - RNA, 19 nt, Homo sapiens
gcacaugucucacccgaau

SEQ ID NO: 670534 - RNA, 19 nt, Homo sapiens
gcugguaccuucccuauug

SEQ ID NO: 670535 - RNA, 19 nt, Homo sapiens
guuuaagucugaucuguua

SEQ ID NO: 670536 - RNA, 19 nt, Homo sapiens
gggaccagauuucaguuua

SEQ ID NO: 670537 - RNA, 19 nt, Homo sapiens
ggagugggcuuguguucuu

SEQ ID NO: 670538 - RNA, 19 nt, Homo sapiens
gagcauggccagcgguuua

SEQ ID NO: 670539 - RNA, 19 nt, Homo sapiens
ggcuaaagcuggaguuuga

SEQ ID NO: 670540 - RNA, 19 nt, Homo sapiens
ggaguucacuguugaugug

SEQ ID NO: 670541 - RNA, 19 nt, Homo sapiens
ugaagugucuggugucuug

SEQ ID NO: 670542 - RNA, 19 nt, Homo sapiens
gagauaauuugcaguguca

SEQ ID NO: 670543 - RNA, 19 nt, Homo sapiens
caugcuagauccuaacuuu

SEQ ID NO: 670544 - RNA, 19 nt, Homo sapiens
ucacugagaugaguauuug

SEQ ID NO: 670545 - RNA, 19 nt, Homo sapiens
ggaccauucucacccguaa

SEQ ID NO: 670546 - RNA, 19 nt, Homo sapiens
gggaggaugcugaccauua

SEQ ID NO: 670547 - RNA, 19 nt, Homo sapiens
gcugagaaauagugaauuc

SEQ ID NO: 670548 - RNA, 19 nt, Homo sapiens
gcauugcucugucucaguu

SEQ ID NO: 670549 - RNA, 19 nt, Homo sapiens
gggcagggcugguaugaag

SEQ ID NO: 670550 - RNA, 19 nt, Homo sapiens
aaagauguguggaccauga

SEQ ID NO: 670551 - RNA, 19 nt, Homo sapiens
gaagaacaccugaggaaag

SEQ ID NO: 670552 - RNA, 19 nt, Homo sapiens
agaaaggucugaaugaauc

SEQ ID NO: 670553 - RNA, 19 nt, Homo sapiens
gagagcaacggcaagcuua

SEQ ID NO: 670554 - RNA, 19 nt, Homo sapiens
gcaggcagcucacguucug

SEQ ID NO: 670555 - RNA, 19 nt, Homo sapiens
gagaugcuguggaaucaau

SEQ ID NO: 670556 - RNA, 19 nt, Homo sapiens
aagcagccuugguuaguua

SEQ ID NO: 670557 - RNA, 19 nt, Homo sapiens
guguggagauuaaauagaa

SEQ ID NO: 670558 - RNA, 19 nt, Homo sapiens
ugaagauccugauguaaau

SEQ ID NO: 670559 - RNA, 19 nt, Homo sapiens
ggucaucaugggcaaauua

SEQ ID NO: 670560 - RNA, 19 nt, Homo sapiens
gugaagauccugauguaaa

SEQ ID NO: 670561 - RNA, 19 nt, Homo sapiens
gcccaaagcugcugaacag

SEQ ID NO: 670562 - RNA, 19 nt, Homo sapiens
ggagccagauccuguuuca

SEQ ID NO: 670563 - RNA, 19 nt, Homo sapiens
ugaggaugcuggaguuauu

SEQ ID NO: 670564 - RNA, 19 nt, Homo sapiens
ggaggaugcugaccauuac

SEQ ID NO: 670565 - RNA, 19 nt, Homo sapiens
gggaaguugugcacagaaa

SEQ ID NO: 670566 - RNA, 19 nt, Homo sapiens
caaggugaauggcauguuc

SEQ ID NO: 670567 - RNA, 19 nt, Homo sapiens
ugaggaaagcugauguuua

SEQ ID NO: 670568 - RNA, 19 nt, Homo sapiens
uagaauaacccaaguagug

SEQ ID NO: 670569 - RNA, 19 nt, Homo sapiens
gcucuacucuguggcauga

SEQ ID NO: 670570 - RNA, 19 nt, Homo sapiens
ggaaguagcccaguauugg

SEQ ID NO: 670571 - RNA, 19 nt, Homo sapiens
gcagugagccgagauagug

SEQ ID NO: 670572 - RNA, 19 nt, Homo sapiens
guacugggugggcaucuua

SEQ ID NO: 670573 - RNA, 19 nt, Homo sapiens
ccacaucccacuuccuuaa

SEQ ID NO: 670574 - RNA, 19 nt, Homo sapiens
gaguuugaaucuggauaua

SEQ ID NO: 670575 - RNA, 19 nt, Homo sapiens
agaauuuacugagcucaua

SEQ ID NO: 670576 - RNA, 19 nt, Homo sapiens
ggaauaauaaagcagaaga

SEQ ID NO: 670577 - RNA, 19 nt, Homo sapiens
gcccuaaucucaguuacaa

SEQ ID NO: 670578 - RNA, 19 nt, Homo sapiens
gagacuuucuucuguguca

SEQ ID NO: 670579 - RNA, 19 nt, Homo sapiens
gaccagauuucaguuuaga

SEQ ID NO: 670580 - RNA, 19 nt, Homo sapiens
gaggggagauccugaguuu

SEQ ID NO: 670581 - RNA, 19 nt, Homo sapiens
gcugagguuuccaguuuga

SEQ ID NO: 670582 - RNA, 19 nt, Homo sapiens
ggaccagauuucaguuuag

SEQ ID NO: 670583 - RNA, 19 nt, Homo sapiens
uaaguagggucuugaggau

SEQ ID NO: 670584 - RNA, 19 nt, Homo sapiens
gaaagaaguauggacucua

SEQ ID NO: 670585 - RNA, 19 nt, Homo sapiens
cgaaaucccaucucuacaa

SEQ ID NO: 670586 - RNA, 19 nt, Homo sapiens
ugacuucauugcccaaaga

SEQ ID NO: 670587 - RNA, 19 nt, Homo sapiens
gauccuggccuuucccaaa

SEQ ID NO: 670588 - RNA, 19 nt, Homo sapiens
gagcagcacugugggcaau

SEQ ID NO: 670589 - RNA, 19 nt, Homo sapiens
gaaucuggauauauaggau

SEQ ID NO: 670590 - RNA, 19 nt, Homo sapiens
augcugagguuuccaguuu

SEQ ID NO: 670591 - RNA, 19 nt, Homo sapiens
gcacacacacgcauacaca

SEQ ID NO: 670592 - RNA, 19 nt, Homo sapiens
cagaagaacaccugaggaa

SEQ ID NO: 670593 - RNA, 19 nt, Homo sapiens
ccacuucccuuucucaacu

SEQ ID NO: 670594 - RNA, 19 nt, Homo sapiens
gggugaagauccacuguag

SEQ ID NO: 670595 - RNA, 19 nt, Homo sapiens
aaagaaguauggacucuac

SEQ ID NO: 670596 - RNA, 19 nt, Homo sapiens
guucacuguugauguguuu

SEQ ID NO: 670597 - RNA, 19 nt, Homo sapiens
acacaaaccagccaguaaa

SEQ ID NO: 670598 - RNA, 19 nt, Homo sapiens
caucaugggcaaauuaguu

SEQ ID NO: 670599 - RNA, 19 nt, Homo sapiens
guuaaauuccuucuccuuu

SEQ ID NO: 670600 - RNA, 19 nt, Homo sapiens
gugcacccauugacauuug

SEQ ID NO: 670601 - RNA, 19 nt, Homo sapiens
uuaaaugucaggcaggaua

SEQ ID NO: 670602 - RNA, 19 nt, Homo sapiens
ggccagcgguuuaguuuac

SEQ ID NO: 670603 - RNA, 19 nt, Homo sapiens
caacaggccacaaggacaa

SEQ ID NO: 670604 - RNA, 19 nt, Homo sapiens
ucaaggaccugguacucau

SEQ ID NO: 670605 - RNA, 19 nt, Homo sapiens
ucugucggcugaaggauuu

SEQ ID NO: 670606 - RNA, 19 nt, Homo sapiens
gaccucagccaaugacuug

SEQ ID NO: 670607 - RNA, 19 nt, Homo sapiens
caucuuguauuaugaaagg

SEQ ID NO: 670608 - RNA, 19 nt, Homo sapiens
ggacagggcaggaguuugc

SEQ ID NO: 670609 - RNA, 19 nt, Homo sapiens
cuugguggcuuuauuugaa

SEQ ID NO: 670610 - RNA, 19 nt, Homo sapiens
ggaggaaguagcccaguau

SEQ ID NO: 670611 - RNA, 19 nt, Homo sapiens
cuacuucuguuuaauaggu

SEQ ID NO: 670612 - RNA, 19 nt, Homo sapiens
gaggaugcuggaguuauua

SEQ ID NO: 670613 - RNA, 19 nt, Homo sapiens
gagcuggucugaggucaca

SEQ ID NO: 670614 - RNA, 19 nt, Homo sapiens
gaaggggacugauguuauc

SEQ ID NO: 670615 - RNA, 19 nt, Homo sapiens
ggacugcccaggucuuuag

SEQ ID NO: 670616 - RNA, 19 nt, Homo sapiens
ccauaggucugugagauuc

SEQ ID NO: 670617 - RNA, 19 nt, Homo sapiens
caggauaggucugauugau

SEQ ID NO: 670618 - RNA, 19 nt, Homo sapiens
ccugaugccugcagugguu

SEQ ID NO: 670619 - RNA, 19 nt, Homo sapiens
cuucauugcccaaagauuu

SEQ ID NO: 670620 - RNA, 19 nt, Homo sapiens
ccaaagauguguggaccau

SEQ ID NO: 670621 - RNA, 19 nt, Homo sapiens
ccuauugaacccuucuuua

SEQ ID NO: 670622 - RNA, 19 nt, Homo sapiens
uauggacucuaccuucuug

SEQ ID NO: 670623 - RNA, 19 nt, Homo sapiens
ggacaucccauaggucugu

SEQ ID NO: 670624 - RNA, 19 nt, Homo sapiens
uuaguuaaaugcagagcuu

SEQ ID NO: 670625 - RNA, 19 nt, Homo sapiens
gggccugccugucuugugu

SEQ ID NO: 670626 - RNA, 19 nt, Homo sapiens
uggaaucaaugaccagaug

SEQ ID NO: 670627 - RNA, 19 nt, Homo sapiens
ggaggaggcauuucaggau

SEQ ID NO: 670628 - RNA, 19 nt, Homo sapiens
gagcaaagcuaucaacuug

SEQ ID NO: 670629 - RNA, 19 nt, Homo sapiens
gaaagaaugucaaaucaga

SEQ ID NO: 670630 - RNA, 19 nt, Homo sapiens
gagcauagcuuuguccaua

SEQ ID NO: 670631 - RNA, 19 nt, Homo sapiens
gaacugugcuuucugauga

SEQ ID NO: 670632 - RNA, 19 nt, Homo sapiens
gcaagaggcugacuucuga

SEQ ID NO: 670633 - RNA, 19 nt, Homo sapiens
gaaagcagauuaucaguag

SEQ ID NO: 670634 - RNA, 19 nt, Homo sapiens
gcagggaccuuguauauuc

SEQ ID NO: 670635 - RNA, 19 nt, Homo sapiens
gaagagaaaugggaaagaa

SEQ ID NO: 670636 - RNA, 19 nt, Homo sapiens
ggagggaaguccuaaguaa

SEQ ID NO: 670637 - RNA, 19 nt, Homo sapiens
ucacuuaacuacugagaua

SEQ ID NO: 670638 - RNA, 19 nt, Homo sapiens
agacagagaugacaacaaa

SEQ ID NO: 670639 - RNA, 19 nt, Homo sapiens
ccacucaucuaauuucuaa

SEQ ID NO: 670640 - RNA, 19 nt, Homo sapiens
gcacauacuuagauaccua

SEQ ID NO: 670641 - RNA, 19 nt, Homo sapiens
gaaagucgaggauauguuu

SEQ ID NO: 670642 - RNA, 19 nt, Homo sapiens
gagauacacuggccgagua

SEQ ID NO: 670643 - RNA, 19 nt, Homo sapiens
aaacaaugcucacgcaauu

SEQ ID NO: 670644 - RNA, 19 nt, Homo sapiens
gcacugagcaugacgauga

SEQ ID NO: 670645 - RNA, 19 nt, Homo sapiens
gcaaagcuaucaacuugga

SEQ ID NO: 670646 - RNA, 19 nt, Homo sapiens
ggcaagagauccagauuug

SEQ ID NO: 670647 - RNA, 19 nt, Homo sapiens
cauaaccacucaucuaauu

SEQ ID NO: 670648 - RNA, 19 nt, Homo sapiens
aaucuucgcugaaaucuaa

SEQ ID NO: 670649 - RNA, 19 nt, Homo sapiens
gaaaggacgugagacaaga

SEQ ID NO: 670650 - RNA, 19 nt, Homo sapiens
gaacagcuuugcccaagug

SEQ ID NO: 670651 - RNA, 19 nt, Homo sapiens
gcaauaacacagacaagua

SEQ ID NO: 670652 - RNA, 19 nt, Homo sapiens
ugaauggaauugacacaua

SEQ ID NO: 670653 - RNA, 19 nt, Homo sapiens
guaaaagccugcucaauuu

SEQ ID NO: 670654 - RNA, 19 nt, Homo sapiens
gaauggaauugacacauau

SEQ ID NO: 670655 - RNA, 19 nt, Homo sapiens
cauaaucacuugcaauuuc

SEQ ID NO: 670656 - RNA, 19 nt, Homo sapiens
ggucauuacugccauuaaa

SEQ ID NO: 670657 - RNA, 19 nt, Homo sapiens
ggaagaauacugcgagaaa

SEQ ID NO: 670658 - RNA, 19 nt, Homo sapiens
ggaauugugcugaaaguaa

SEQ ID NO: 670659 - RNA, 19 nt, Homo sapiens
gaaaugcccaggcuuuaaa

SEQ ID NO: 670660 - RNA, 19 nt, Homo sapiens
gaagagcguuugauuaaaa

SEQ ID NO: 670661 - RNA, 19 nt, Homo sapiens
agagaauacuggugaauaa

SEQ ID NO: 670662 - RNA, 19 nt, Homo sapiens
uaagauggaccuugguuua

SEQ ID NO: 670663 - RNA, 19 nt, Homo sapiens
ccaaggauauguuucaugu

SEQ ID NO: 670664 - RNA, 19 nt, Homo sapiens
gguguaacuuguaaacuaa

SEQ ID NO: 670665 - RNA, 19 nt, Homo sapiens
gaagucauccacuaaugua

SEQ ID NO: 670666 - RNA, 19 nt, Homo sapiens
gcaagaagucauccacuaa

SEQ ID NO: 670667 - RNA, 19 nt, Homo sapiens
gaaaauugccuuccauuaa

SEQ ID NO: 670668 - RNA, 19 nt, Homo sapiens
cagaaagaaugucaaauca

SEQ ID NO: 670669 - RNA, 19 nt, Homo sapiens
aaacuaagguaacuucuca

SEQ ID NO: 670670 - RNA, 19 nt, Homo sapiens
ggauaagacugaagaacau

SEQ ID NO: 670671 - RNA, 19 nt, Homo sapiens
gaauugugcugaaaguaau

SEQ ID NO: 670672 - RNA, 19 nt, Homo sapiens
ggagaaccauuaugaacau

SEQ ID NO: 670673 - RNA, 19 nt, Homo sapiens
gagaaucagugacggcuau

SEQ ID NO: 670674 - RNA, 19 nt, Homo sapiens
gagaggaccuguggauaga

SEQ ID NO: 670675 - RNA, 19 nt, Homo sapiens
ucauaagaauccagugaua

SEQ ID NO: 670676 - RNA, 19 nt, Homo sapiens
gacaaguaguuaaugauga

SEQ ID NO: 670677 - RNA, 19 nt, Homo sapiens
caauaugacgucuuguuua

SEQ ID NO: 670678 - RNA, 19 nt, Homo sapiens
caaugcugcuggaugaaua

SEQ ID NO: 670679 - RNA, 19 nt, Homo sapiens
gagggcacauacuuagaua

SEQ ID NO: 670680 - RNA, 19 nt, Homo sapiens
guacauggauacaucaagu

SEQ ID NO: 670681 - RNA, 19 nt, Homo sapiens
gaaguuauaguuaggauuc

SEQ ID NO: 670682 - RNA, 19 nt, Homo sapiens
ggacauggcucugaagacu

SEQ ID NO: 670683 - RNA, 19 nt, Homo sapiens
caacuucuuugcauuacuu

SEQ ID NO: 670684 - RNA, 19 nt, Homo sapiens
aaaguauggugcacagaua

SEQ ID NO: 670685 - RNA, 19 nt, Homo sapiens
aaaguuaucugguuuguac

SEQ ID NO: 670686 - RNA, 19 nt, Homo sapiens
cuauggagauuucuucaaa

SEQ ID NO: 670687 - RNA, 19 nt, Homo sapiens
uaugacgucuuguuuauug

SEQ ID NO: 670688 - RNA, 19 nt, Homo sapiens
gagacucguuugcucagua

SEQ ID NO: 670689 - RNA, 19 nt, Homo sapiens
gaauacuggugaauaagug

SEQ ID NO: 670690 - RNA, 19 nt, Homo sapiens
gagaugacaacaaaguaua

SEQ ID NO: 670691 - RNA, 19 nt, Homo sapiens
ugacggcuauaaagagaua

SEQ ID NO: 670692 - RNA, 19 nt, Homo sapiens
caagagauccagauuuguu

SEQ ID NO: 670693 - RNA, 19 nt, Homo sapiens
gagaaaugcccaggcuuua

SEQ ID NO: 670694 - RNA, 19 nt, Homo sapiens
guuccaaaccugagcauua

SEQ ID NO: 670695 - RNA, 19 nt, Homo sapiens
caacaguacuuugcuggaa

SEQ ID NO: 670696 - RNA, 19 nt, Homo sapiens
ggcaacagcuguauauugg

SEQ ID NO: 670697 - RNA, 19 nt, Homo sapiens
uaccagagaucauaagaau

SEQ ID NO: 670698 - RNA, 19 nt, Homo sapiens
gauaucaaaucucagaaag

SEQ ID NO: 670699 - RNA, 19 nt, Homo sapiens
ugaacuuucuguacucuuu

SEQ ID NO: 670700 - RNA, 19 nt, Homo sapiens
gaaugacuaugaagguguu

SEQ ID NO: 670701 - RNA, 19 nt, Homo sapiens
aaacaacugucccgaggaa

SEQ ID NO: 670702 - RNA, 19 nt, Homo sapiens
gggcccaaguccacaauuu

SEQ ID NO: 670703 - RNA, 19 nt, Homo sapiens
uuugguaacugaagcaaua

SEQ ID NO: 670704 - RNA, 19 nt, Homo sapiens
aaauugacauccucugaaa

SEQ ID NO: 670705 - RNA, 19 nt, Homo sapiens
auacaaugcugcuggauga

SEQ ID NO: 670706 - RNA, 19 nt, Homo sapiens
ugucugagguuagaauuaa

SEQ ID NO: 670707 - RNA, 19 nt, Homo sapiens
gaaagcaaguggauuacac

SEQ ID NO: 670708 - RNA, 19 nt, Homo sapiens
guagguacauggauacauc

SEQ ID NO: 670709 - RNA, 19 nt, Homo sapiens
ggaccuugguuuacucuuc

SEQ ID NO: 670710 - RNA, 19 nt, Homo sapiens
caacagcuguauauuggau

SEQ ID NO: 670711 - RNA, 19 nt, Homo sapiens
ggaaucaauggaagaagua

SEQ ID NO: 670712 - RNA, 19 nt, Homo sapiens
gguuacgccugucacauaa

SEQ ID NO: 670713 - RNA, 19 nt, Homo sapiens
guaaugaguguucgauauu

SEQ ID NO: 670714 - RNA, 19 nt, Homo sapiens
ggauggaucuucucugaac

SEQ ID NO: 670715 - RNA, 19 nt, Homo sapiens
cugaagagcguuugauuaa

SEQ ID NO: 670716 - RNA, 19 nt, Homo sapiens
ccaaauacagccugacaaa

SEQ ID NO: 670717 - RNA, 19 nt, Homo sapiens
ggagaaauagaaccacaaa

SEQ ID NO: 670718 - RNA, 19 nt, Homo sapiens
uuacacaggagaaccauua

SEQ ID NO: 670719 - RNA, 19 nt, Homo sapiens
ggauaucuguuuaggaaag

SEQ ID NO: 670720 - RNA, 19 nt, Homo sapiens
gaacuuucuguacucuuua

SEQ ID NO: 670721 - RNA, 19 nt, Homo sapiens
gaagaauacugcgagaaag

SEQ ID NO: 670722 - RNA, 19 nt, Homo sapiens
cauaaaaccugcccauaaa

SEQ ID NO: 670723 - RNA, 19 nt, Homo sapiens
gaagagggagggagagaga

SEQ ID NO: 670724 - RNA, 19 nt, Homo sapiens
uaagaaguccauauacuga

SEQ ID NO: 670725 - RNA, 19 nt, Homo sapiens
acagacaaguaguuaauga

SEQ ID NO: 670726 - RNA, 19 nt, Homo sapiens
ggauacaucaaguucauuu

SEQ ID NO: 670727 - RNA, 19 nt, Homo sapiens
gcacagauagaaagaggaa

SEQ ID NO: 670728 - RNA, 19 nt, Homo sapiens
ucacaaagcuguuucauga

SEQ ID NO: 670729 - RNA, 19 nt, Homo sapiens
caaagucugugucuaaaua

SEQ ID NO: 670730 - RNA, 19 nt, Homo sapiens
gaaguaagauucaaacugu

SEQ ID NO: 670731 - RNA, 19 nt, Homo sapiens
gagcagauauggcuauaaa

SEQ ID NO: 670732 - RNA, 19 nt, Homo sapiens
gaaaggaacccuacagauu

SEQ ID NO: 670733 - RNA, 19 nt, Homo sapiens
ggaaugagauggaaaguag

SEQ ID NO: 670734 - RNA, 19 nt, Homo sapiens
caaagaaggugguggaguu

SEQ ID NO: 670735 - RNA, 19 nt, Homo sapiens
ugacagugaugauaugaua

SEQ ID NO: 670736 - RNA, 19 nt, Homo sapiens
acaaagaacugacacagaa

SEQ ID NO: 670737 - RNA, 19 nt, Homo sapiens
gaagaagacuaugcugaaa

SEQ ID NO: 670738 - RNA, 19 nt, Homo sapiens
uagaggagcuggaagauga

SEQ ID NO: 670739 - RNA, 19 nt, Homo sapiens
gcccaaagcuugacauugu

SEQ ID NO: 670740 - RNA, 19 nt, Homo sapiens
guggagauuuguauucuua

SEQ ID NO: 670741 - RNA, 19 nt, Homo sapiens
gagaugaucccauuuagaa

SEQ ID NO: 670742 - RNA, 19 nt, Homo sapiens
ggaaaugggccaagucaaa

SEQ ID NO: 670743 - RNA, 19 nt, Homo sapiens
aaaggaacccuacagauua

SEQ ID NO: 670744 - RNA, 19 nt, Homo sapiens
ggacagugauggagagaga

SEQ ID NO: 670745 - RNA, 19 nt, Homo sapiens
gcaggagaauugcuugaaa

SEQ ID NO: 670746 - RNA, 19 nt, Homo sapiens
gaagucagcuuuaagucau

SEQ ID NO: 670747 - RNA, 19 nt, Homo sapiens
gcccaguucucucuuauuu

SEQ ID NO: 670748 - RNA, 19 nt, Homo sapiens
gaaaggaaaggccaagaaa

SEQ ID NO: 670749 - RNA, 19 nt, Homo sapiens
gggacugacugaugcuuua

SEQ ID NO: 670750 - RNA, 19 nt, Homo sapiens
cgagauggguggaucauga

SEQ ID NO: 670751 - RNA, 19 nt, Homo sapiens
cgagauggguggaucauga

SEQ ID NO: 670752 - RNA, 19 nt, Homo sapiens
gcacagaaguggaagaacu

SEQ ID NO: 670753 - RNA, 19 nt, Homo sapiens
cgaaugaagugcagaugaa

SEQ ID NO: 670754 - RNA, 19 nt, Homo sapiens
gaacagauccacagagaag

SEQ ID NO: 670755 - RNA, 19 nt, Homo sapiens
gaagugacauuccuaucau

SEQ ID NO: 670756 - RNA, 19 nt, Homo sapiens
gaucaggaauuugaaguga

SEQ ID NO: 670757 - RNA, 19 nt, Homo sapiens
gaaauuggagugaaaggaa

SEQ ID NO: 670758 - RNA, 19 nt, Homo sapiens
gaaaagagacuccaaauca

SEQ ID NO: 670759 - RNA, 19 nt, Homo sapiens
gguagaaauuggagugaaa

SEQ ID NO: 670760 - RNA, 19 nt, Homo sapiens
gcagauauggcuauaaaga

SEQ ID NO: 670761 - RNA, 19 nt, Homo sapiens
gaccaaaggcagaugauaa

SEQ ID NO: 670762 - RNA, 19 nt, Homo sapiens
gaaagaauaggcggaaauu

SEQ ID NO: 670763 - RNA, 19 nt, Homo sapiens
gaaacuaucgcucacauuc

SEQ ID NO: 670764 - RNA, 19 nt, Homo sapiens
ccaauuauguuguugauac

SEQ ID NO: 670765 - RNA, 19 nt, Homo sapiens
gcuaggaauugguauaaau

SEQ ID NO: 670766 - RNA, 19 nt, Homo sapiens
gcaacugaauagagucaaa

SEQ ID NO: 670767 - RNA, 19 nt, Homo sapiens
uaaaguguguguuacauag

SEQ ID NO: 670768 - RNA, 19 nt, Homo sapiens
cauaaugcauuguaagaug

SEQ ID NO: 670769 - RNA, 19 nt, Homo sapiens
gaucagacauuagaacaca

SEQ ID NO: 670770 - RNA, 19 nt, Homo sapiens
gaauugaucagacauuaga

SEQ ID NO: 670771 - RNA, 19 nt, Homo sapiens
gaaguagcauucaguaaaa

SEQ ID NO: 670772 - RNA, 19 nt, Homo sapiens
aggaagaacuaguggauuu

SEQ ID NO: 670773 - RNA, 19 nt, Homo sapiens
caccuucuauccugaauaa

SEQ ID NO: 670774 - RNA, 19 nt, Homo sapiens
gaaacccugucuguacuaa

SEQ ID NO: 670775 - RNA, 19 nt, Homo sapiens
ggagagagaaagcaucaaa

SEQ ID NO: 670776 - RNA, 19 nt, Homo sapiens
guagauuccuucaguguca

SEQ ID NO: 670777 - RNA, 19 nt, Homo sapiens
gugcuuccauauccauuua

SEQ ID NO: 670778 - RNA, 19 nt, Homo sapiens
ucacagauauaucauugga

SEQ ID NO: 670779 - RNA, 19 nt, Homo sapiens
gacacaccauuguaacuuu

SEQ ID NO: 670780 - RNA, 19 nt, Homo sapiens
gcuuaucuacucccaauua

SEQ ID NO: 670781 - RNA, 19 nt, Homo sapiens
agacgccaguuucucauua

SEQ ID NO: 670782 - RNA, 19 nt, Homo sapiens
aaaggcagaugauaaagga

SEQ ID NO: 670783 - RNA, 19 nt, Homo sapiens
ucucagaaauugaaggaaa

SEQ ID NO: 670784 - RNA, 19 nt, Homo sapiens
gcaauuauggccaaauaug

SEQ ID NO: 670785 - RNA, 19 nt, Homo sapiens
guaaugccauaucuguaaa

SEQ ID NO: 670786 - RNA, 19 nt, Homo sapiens
gagcagcuacagaagguua

SEQ ID NO: 670787 - RNA, 19 nt, Homo sapiens
gugguggaguuaccucuua

SEQ ID NO: 670788 - RNA, 19 nt, Homo sapiens
gcaaacagagggucaguca

SEQ ID NO: 670789 - RNA, 19 nt, Homo sapiens
uauggcagcuggcacaauu

SEQ ID NO: 670790 - RNA, 19 nt, Homo sapiens
ggauuuaggaguucaagaa

SEQ ID NO: 670791 - RNA, 19 nt, Homo sapiens
ccacucaauugccuuauuc

SEQ ID NO: 670792 - RNA, 19 nt, Homo sapiens
gaugaugaacuuaggguaa

SEQ ID NO: 670793 - RNA, 19 nt, Homo sapiens
gcuuaaacuuguccucauu

SEQ ID NO: 670794 - RNA, 19 nt, Homo sapiens
ggcacuaucucagaaauug

SEQ ID NO: 670795 - RNA, 19 nt, Homo sapiens
ccagaaugauggaaagaau

SEQ ID NO: 670796 - RNA, 19 nt, Homo sapiens
ccacagagaaguagcauuc

SEQ ID NO: 670797 - RNA, 19 nt, Homo sapiens
auacaaagucugugucuaa

SEQ ID NO: 670798 - RNA, 19 nt, Homo sapiens
gauuauaaccuggauauuc

SEQ ID NO: 670799 - RNA, 19 nt, Homo sapiens
aagguaacaucacauacua

SEQ ID NO: 670800 - RNA, 19 nt, Homo sapiens
ggaagucagcuuuaaguca

SEQ ID NO: 670801 - RNA, 19 nt, Homo sapiens
agaaguagcauucaguaaa

SEQ ID NO: 670802 - RNA, 19 nt, Homo sapiens
gaggcuggcugcugagaug

SEQ ID NO: 670803 - RNA, 19 nt, Homo sapiens
guuaaacaccuucauaugu

SEQ ID NO: 670804 - RNA, 19 nt, Homo sapiens
cugaauaacuagcauggaa

SEQ ID NO: 670805 - RNA, 19 nt, Homo sapiens
gguaacaucacauacuaaa

SEQ ID NO: 670806 - RNA, 19 nt, Homo sapiens
caccacacgucacaauaaa

SEQ ID NO: 670807 - RNA, 19 nt, Homo sapiens
cgcagcagcucaucaggua

SEQ ID NO: 670808 - RNA, 19 nt, Homo sapiens
ccaaagaggcugcaacaca

SEQ ID NO: 670809 - RNA, 19 nt, Homo sapiens
uuagagaugaucccauuua

SEQ ID NO: 670810 - RNA, 19 nt, Homo sapiens
gcaauccuuuccauacuag

SEQ ID NO: 670811 - RNA, 19 nt, Homo sapiens
gcaguucccacaauaauag

SEQ ID NO: 670812 - RNA, 19 nt, Homo sapiens
gcuugcagcucaugagguu

SEQ ID NO: 670813 - RNA, 19 nt, Homo sapiens
gaacgagcauuuugggauu

SEQ ID NO: 670814 - RNA, 19 nt, Homo sapiens
ucacauagucuccuuguuc

SEQ ID NO: 670815 - RNA, 19 nt, Homo sapiens
gcaaaugaaacgguauauu

SEQ ID NO: 670816 - RNA, 19 nt, Homo sapiens
cucuguagauuguuaguua

SEQ ID NO: 670817 - RNA, 19 nt, Homo sapiens
caacugaucaaccuacaga

SEQ ID NO: 670818 - RNA, 19 nt, Homo sapiens
ggaggacccugagcaagug

SEQ ID NO: 670819 - RNA, 19 nt, Homo sapiens
ggaaagaauaggcggaaau

SEQ ID NO: 670820 - RNA, 19 nt, Homo sapiens
gauacaaagucugugucua

SEQ ID NO: 670821 - RNA, 19 nt, Homo sapiens
uaucaguguuccuaauuug

SEQ ID NO: 670822 - RNA, 19 nt, Homo sapiens
cagcuuaucuacucccaau

SEQ ID NO: 670823 - RNA, 19 nt, Homo sapiens
aggcaauuauggccaaaua

SEQ ID NO: 670824 - RNA, 19 nt, Homo sapiens
ugaauaagaagaugguuga

SEQ ID NO: 670825 - RNA, 19 nt, Homo sapiens
caaagaugaugaacuuagg

SEQ ID NO: 670826 - RNA, 19 nt, Homo sapiens
gaacuuucaggaugacuau

SEQ ID NO: 670827 - RNA, 19 nt, Homo sapiens
aaucaauccuuucuaguuc

SEQ ID NO: 670828 - RNA, 19 nt, Homo sapiens
ggaaugggaugcaacuuaa

SEQ ID NO: 670829 - RNA, 19 nt, Homo sapiens
gcaggaaagucuacaguuu

SEQ ID NO: 670830 - RNA, 19 nt, Homo sapiens
agaagagccugaccuauua

SEQ ID NO: 670831 - RNA, 19 nt, Homo sapiens
gagaauauauggagagaga

SEQ ID NO: 670832 - RNA, 19 nt, Homo sapiens
ggacaaggaccacucauaa

SEQ ID NO: 670833 - RNA, 19 nt, Homo sapiens
gagaagagccugaccuauu

SEQ ID NO: 670834 - RNA, 19 nt, Homo sapiens
gcaggaaugucaagcagaa

SEQ ID NO: 670835 - RNA, 19 nt, Homo sapiens
acaaagacccguauaguuu

SEQ ID NO: 670836 - RNA, 19 nt, Homo sapiens
cagaagagccugcaaguga

SEQ ID NO: 670837 - RNA, 19 nt, Homo sapiens
ggaagaaccucucuaucca

SEQ ID NO: 670838 - RNA, 19 nt, Homo sapiens
gaggacaucugcuggaaga

SEQ ID NO: 670839 - RNA, 19 nt, Homo sapiens
uagcaaaccuacagacuga

SEQ ID NO: 670840 - RNA, 19 nt, Homo sapiens
ggaugcaacuuaagacuuc

SEQ ID NO: 670841 - RNA, 19 nt, Homo sapiens
gaaagucuacaguuuggua

SEQ ID NO: 670842 - RNA, 19 nt, Homo sapiens
ggaaagcccugcaggacau

SEQ ID NO: 670843 - RNA, 19 nt, Homo sapiens
gggaaugggaugcaacuua

SEQ ID NO: 670844 - RNA, 19 nt, Homo sapiens
acaaggaccacucauaaua

SEQ ID NO: 670845 - RNA, 19 nt, Homo sapiens
gcacacacacaaccgauaa

SEQ ID NO: 670846 - RNA, 19 nt, Homo sapiens
ugaccaaagucuacauauu

SEQ ID NO: 670847 - RNA, 19 nt, Homo sapiens
ccaccuacauccugaaaga

SEQ ID NO: 670848 - RNA, 19 nt, Homo sapiens
gaccaaagucuacauauuc

SEQ ID NO: 670849 - RNA, 19 nt, Homo sapiens
gacaaagacccguauaguu

SEQ ID NO: 670850 - RNA, 19 nt, Homo sapiens
gcucacaccugcuuuggau

SEQ ID NO: 670851 - RNA, 19 nt, Homo sapiens
gcauugcccuggugucaga

SEQ ID NO: 670852 - RNA, 19 nt, Homo sapiens
ugaccagggugccuucuuu

SEQ ID NO: 670853 - RNA, 19 nt, Homo sapiens
gcacaucaucuuccuguug

SEQ ID NO: 670854 - RNA, 19 nt, Homo sapiens
gcaccacacucaguccauu

SEQ ID NO: 670855 - RNA, 19 nt, Homo sapiens
gaaccaggccuuccaguac

SEQ ID NO: 670856 - RNA, 19 nt, Homo sapiens
cagggugccuucuuuguga

SEQ ID NO: 670857 - RNA, 19 nt, Homo sapiens
caaguuuaaugucaccaaa

SEQ ID NO: 670858 - RNA, 19 nt, Homo sapiens
ggacaaagacccguauagu

SEQ ID NO: 670859 - RNA, 19 nt, Homo sapiens
caacaagacuuugaaaaug

SEQ ID NO: 670860 - RNA, 19 nt, Homo sapiens
caaggaccacucauaauau

SEQ ID NO: 670861 - RNA, 19 nt, Homo sapiens
ccacuguccugcucauaga

SEQ ID NO: 670862 - RNA, 19 nt, Homo sapiens
ccgcuagaguucuguguuu

SEQ ID NO: 670863 - RNA, 19 nt, Homo sapiens
gcuaucaggugcccaucuu

SEQ ID NO: 670864 - RNA, 19 nt, Homo sapiens
caaagucuacauauucuug

SEQ ID NO: 670865 - RNA, 19 nt, Homo sapiens
gaauauauggagagagaga

SEQ ID NO: 670866 - RNA, 19 nt, Homo sapiens
caucuuugcugucauuuac

SEQ ID NO: 670867 - RNA, 19 nt, Homo sapiens
gaagacaggcgcgaugaug

SEQ ID NO: 670868 - RNA, 19 nt, Homo sapiens
gggacaaggaccacucaua

SEQ ID NO: 670869 - RNA, 19 nt, Homo sapiens
cuacacugcuggagucuca

SEQ ID NO: 670870 - RNA, 19 nt, Homo sapiens
acacucaguccauuaagua

SEQ ID NO: 670871 - RNA, 19 nt, Homo sapiens
caggcuacauccaggagua

SEQ ID NO: 670872 - RNA, 19 nt, Homo sapiens
gaugaccaaagucuacaua

SEQ ID NO: 670873 - RNA, 19 nt, Homo sapiens
caaguggacagucaccuuu

SEQ ID NO: 670874 - RNA, 19 nt, Homo sapiens
ccuacauccugaaagauuu

SEQ ID NO: 670875 - RNA, 19 nt, Homo sapiens
gugaagugcugggcuguga

SEQ ID NO: 670876 - RNA, 19 nt, Homo sapiens
ggacaacaauagcaaaccu

SEQ ID NO: 670877 - RNA, 19 nt, Homo sapiens
agacagcgaguccagauuu

SEQ ID NO: 670878 - RNA, 19 nt, Homo sapiens
caacguggccaaacugauc

SEQ ID NO: 670879 - RNA, 19 nt, Homo sapiens
agaaguccauggccaccua

SEQ ID NO: 670880 - RNA, 19 nt, Homo sapiens
caccaucuuugcugucauu

SEQ ID NO: 670881 - RNA, 19 nt, Homo sapiens
cacaaccgauaaccaaaga

SEQ ID NO: 670882 - RNA, 19 nt, Homo sapiens
gggagaauauauggagaga

SEQ ID NO: 670883 - RNA, 19 nt, Homo sapiens
caagcccuguggccaguuu

SEQ ID NO: 670884 - RNA, 19 nt, Homo sapiens
cgugugaggugguugaugu

SEQ ID NO: 670885 - RNA, 19 nt, Homo sapiens
ggagagagagauguaacaa

SEQ ID NO: 670886 - RNA, 19 nt, Homo sapiens
gaugaguccgggagaauau

SEQ ID NO: 670887 - RNA, 19 nt, Homo sapiens
ggucucaccagucuagauu

SEQ ID NO: 670888 - RNA, 19 nt, Homo sapiens
cugcaggacaugaguguua

SEQ ID NO: 670889 - RNA, 19 nt, Homo sapiens
gaauggccuucgucaccuu

SEQ ID NO: 670890 - RNA, 19 nt, Homo sapiens
cagccucucucaccucuuc

SEQ ID NO: 670891 - RNA, 19 nt, Homo sapiens
gcccauuggaccacaguua

SEQ ID NO: 670892 - RNA, 19 nt, Homo sapiens
ccaggucucauccucuaua

SEQ ID NO: 670893 - RNA, 19 nt, Homo sapiens
caaccgauaaccaaagaga

SEQ ID NO: 670894 - RNA, 19 nt, Homo sapiens
acacacaaccgauaaccaa

SEQ ID NO: 670895 - RNA, 19 nt, Homo sapiens
gaaaagacacaaccagaau

SEQ ID NO: 670896 - RNA, 19 nt, Homo sapiens
gggucucacugcucugaaa

SEQ ID NO: 670897 - RNA, 19 nt, Homo sapiens
caggaaagucuacaguuug

SEQ ID NO: 670898 - RNA, 19 nt, Homo sapiens
uuucagagauugucaucga

SEQ ID NO: 670899 - RNA, 19 nt, Homo sapiens
ggaccacaguuaagaucca

SEQ ID NO: 670900 - RNA, 19 nt, Homo sapiens
gacaaggaccacucauaau

SEQ ID NO: 670901 - RNA, 19 nt, Homo sapiens
cugaauaacccgaucauca

SEQ ID NO: 670902 - RNA, 19 nt, Homo sapiens
gcuggaagaaccucucuau

SEQ ID NO: 670903 - RNA, 19 nt, Homo sapiens
cgccaucucuuacuacaca

SEQ ID NO: 670904 - RNA, 19 nt, Homo sapiens
gggaggacgccauccacua

SEQ ID NO: 670905 - RNA, 19 nt, Homo sapiens
gaccacacccuccaucauc

SEQ ID NO: 670906 - RNA, 19 nt, Homo sapiens
ggaggacaacaauagcaaa

SEQ ID NO: 670907 - RNA, 19 nt, Homo sapiens
gcagacagcgaguccagau

SEQ ID NO: 670908 - RNA, 19 nt, Homo sapiens
gaggaucacagaggaagaa

SEQ ID NO: 670909 - RNA, 19 nt, Homo sapiens
gcuacaacguggccaaacu

SEQ ID NO: 670910 - RNA, 19 nt, Homo sapiens
guccagauuucagagauug

SEQ ID NO: 670911 - RNA, 19 nt, Homo sapiens
gacagcgaguccagauuuc

SEQ ID NO: 670912 - RNA, 19 nt, Homo sapiens
gugcacacaucucuguauc

SEQ ID NO: 670913 - RNA, 19 nt, Homo sapiens
cucuauaccuuccgcauga

SEQ ID NO: 670914 - RNA, 19 nt, Homo sapiens
gaucaucagccaguucuuc

SEQ ID NO: 670915 - RNA, 19 nt, Homo sapiens
gggcuuaucugggccuucu

SEQ ID NO: 670916 - RNA, 19 nt, Homo sapiens
gagccugaccuauuacaca

SEQ ID NO: 670917 - RNA, 19 nt, Homo sapiens
ggaggacgccauccacuac

SEQ ID NO: 670918 - RNA, 19 nt, Homo sapiens
gaguccagauuucagagau

SEQ ID NO: 670919 - RNA, 19 nt, Homo sapiens
ugccaggucucauccucua

SEQ ID NO: 670920 - RNA, 19 nt, Homo sapiens
gucagagccuucagugcaa

SEQ ID NO: 670921 - RNA, 19 nt, Homo sapiens
ucacaggacuccccagaga

SEQ ID NO: 670922 - RNA, 19 nt, Homo sapiens
ccaacgacuccuauugcua

SEQ ID NO: 670923 - RNA, 19 nt, Homo sapiens
cagagacagcuccaacuga

SEQ ID NO: 670924 - RNA, 19 nt, Homo sapiens
gaagagccugcaagugaca

SEQ ID NO: 670925 - RNA, 19 nt, Homo sapiens
guucuuaaucuugguguuu

SEQ ID NO: 670926 - RNA, 19 nt, Homo sapiens
gcaaaccuacagacugaca

SEQ ID NO: 670927 - RNA, 19 nt, Homo sapiens
gacaacaauagcaaaccua

SEQ ID NO: 670928 - RNA, 19 nt, Homo sapiens
gcacauaucuguagcaucu

SEQ ID NO: 670929 - RNA, 19 nt, Homo sapiens
ggaauggucuuucuguuca

SEQ ID NO: 670930 - RNA, 19 nt, Homo sapiens
gaaccacccucgcugcaaa

SEQ ID NO: 670931 - RNA, 19 nt, Homo sapiens
guaaugacuuccagagaaa

SEQ ID NO: 670932 - RNA, 19 nt, Homo sapiens
agaaguagcuugaggaugu

SEQ ID NO: 670933 - RNA, 19 nt, Homo sapiens
gaacagagaccacaauguc

SEQ ID NO: 670934 - RNA, 19 nt, Homo sapiens
gcaucucucucaacuuuaa

SEQ ID NO: 670935 - RNA, 19 nt, Homo sapiens
uaccugggcuccuccauua

SEQ ID NO: 670936 - RNA, 19 nt, Homo sapiens
gggaaggacuggaaaggaa

SEQ ID NO: 670937 - RNA, 19 nt, Homo sapiens
ggucuagguuccauucuuu

SEQ ID NO: 670938 - RNA, 19 nt, Homo sapiens
ccugaaagcugaaggaaug

SEQ ID NO: 670939 - RNA, 19 nt, Homo sapiens
gcucccaucucuucucuaa

SEQ ID NO: 670940 - RNA, 19 nt, Homo sapiens
ggaaacugguucacugguu

SEQ ID NO: 670941 - RNA, 19 nt, Homo sapiens
gaaaauagcagaacagaga

SEQ ID NO: 670942 - RNA, 19 nt, Homo sapiens
ggaguucucuaaccucaug

SEQ ID NO: 670943 - RNA, 19 nt, Homo sapiens
aaggaaggaugccaguuua

SEQ ID NO: 670944 - RNA, 19 nt, Homo sapiens
gcacagggaagccuuaaau

SEQ ID NO: 670945 - RNA, 19 nt, Homo sapiens
caagucagguauaacaaau

SEQ ID NO: 670946 - RNA, 19 nt, Homo sapiens
acaguggccuggaggaaua

SEQ ID NO: 670947 - RNA, 19 nt, Homo sapiens
gaaccacucucgacugcau

SEQ ID NO: 670948 - RNA, 19 nt, Homo sapiens
ucgagaagcuccaggaaga

SEQ ID NO: 670949 - RNA, 19 nt, Homo sapiens
gaaggaauggcuuuaagga

SEQ ID NO: 670950 - RNA, 19 nt, Homo sapiens
uugcaucucucucaacuuu

SEQ ID NO: 670951 - RNA, 19 nt, Homo sapiens
gcaagucagguauaacaaa

SEQ ID NO: 670952 - RNA, 19 nt, Homo sapiens
caagacagaccgacacuau

SEQ ID NO: 670953 - RNA, 19 nt, Homo sapiens
ggacaucccaggugaggaa

SEQ ID NO: 670954 - RNA, 19 nt, Homo sapiens
caaugcggcugcccucaaa

SEQ ID NO: 670955 - RNA, 19 nt, Homo sapiens
gauaauuguuuccuugaag

SEQ ID NO: 670956 - RNA, 19 nt, Homo sapiens
ggacaaaugugggcuugag

SEQ ID NO: 670957 - RNA, 19 nt, Homo sapiens
gcagauuccuacuguucuu

SEQ ID NO: 670958 - RNA, 19 nt, Homo sapiens
cuaagcagcuguucaaugc

SEQ ID NO: 670959 - RNA, 19 nt, Homo sapiens
gcacacagaucaggaccau

SEQ ID NO: 670960 - RNA, 19 nt, Homo sapiens
gugcaaacaugaagaagag

SEQ ID NO: 670961 - RNA, 19 nt, Homo sapiens
gugcacagaugcugaaugg

SEQ ID NO: 670962 - RNA, 19 nt, Homo sapiens
agaaguagguugcaucucu

SEQ ID NO: 670963 - RNA, 19 nt, Homo sapiens
ccaaugggcacacagauga

SEQ ID NO: 670964 - RNA, 19 nt, Homo sapiens
gugagacgguguccacuga

SEQ ID NO: 670965 - RNA, 19 nt, Homo sapiens
ugagucagccaguaaagua

SEQ ID NO: 670966 - RNA, 19 nt, Homo sapiens
ggcacucacuucugcgaua

SEQ ID NO: 670967 - RNA, 19 nt, Homo sapiens
gaaggaugccaguuuacuu

SEQ ID NO: 670968 - RNA, 19 nt, Homo sapiens
ggcaaggacuucuccaauc

SEQ ID NO: 670969 - RNA, 19 nt, Homo sapiens
aguaaugacuuccagagaa

SEQ ID NO: 670970 - RNA, 19 nt, Homo sapiens
gucccaaacuucucccuaa

SEQ ID NO: 670971 - RNA, 19 nt, Homo sapiens
ccaaggaguucuuaaaucc

SEQ ID NO: 670972 - RNA, 19 nt, Homo sapiens
gaaaggcgacucgggaaga

SEQ ID NO: 670973 - RNA, 19 nt, Homo sapiens
caacuccucuucccacucu

SEQ ID NO: 670974 - RNA, 19 nt, Homo sapiens
aaaggaaggaugccaguuu

SEQ ID NO: 670975 - RNA, 19 nt, Homo sapiens
aaagagcuaucgccacuca

SEQ ID NO: 670976 - RNA, 19 nt, Homo sapiens
gcaaggacuucuccaaucc

SEQ ID NO: 670977 - RNA, 19 nt, Homo sapiens
gagccaagaggcgaaguua

SEQ ID NO: 670978 - RNA, 19 nt, Homo sapiens
cucaugaccucaagggaua

SEQ ID NO: 670979 - RNA, 19 nt, Homo sapiens
ccacagccacaaccacaua

SEQ ID NO: 670980 - RNA, 19 nt, Homo sapiens
ggaaguggccagggugaaa

SEQ ID NO: 670981 - RNA, 19 nt, Homo sapiens
gcagcaacaacagucauua

SEQ ID NO: 670982 - RNA, 19 nt, Homo sapiens
caucucuucucuaaccuuu

SEQ ID NO: 670983 - RNA, 19 nt, Homo sapiens
agacagaccgacacuauug

SEQ ID NO: 670984 - RNA, 19 nt, Homo sapiens
caagacagcagcacauauc

SEQ ID NO: 670985 - RNA, 19 nt, Homo sapiens
ccagccagcagccuucuua

SEQ ID NO: 670986 - RNA, 19 nt, Homo sapiens
agagacaccugacugugaa

SEQ ID NO: 670987 - RNA, 19 nt, Homo sapiens
gauggugccugcagauugg

SEQ ID NO: 670988 - RNA, 19 nt, Homo sapiens
ggacaguaaugccuuuuga

SEQ ID NO: 670989 - RNA, 19 nt, Homo sapiens
cggcuucccugcugacuug

SEQ ID NO: 670990 - RNA, 19 nt, Homo sapiens
ggagcuagaagacaaugaa

SEQ ID NO: 670991 - RNA, 19 nt, Homo sapiens
ucugugggcugcucuuuga

SEQ ID NO: 670992 - RNA, 19 nt, Homo sapiens
uggaaacccuccugaguca

SEQ ID NO: 670993 - RNA, 19 nt, Homo sapiens
gaaggcaaccuggaaagug

SEQ ID NO: 670994 - RNA, 19 nt, Homo sapiens
gccaagaggcgaaguuaau

SEQ ID NO: 670995 - RNA, 19 nt, Homo sapiens
ggugagagaaguagcuuga

SEQ ID NO: 670996 - RNA, 19 nt, Homo sapiens
gacaagcggugacguccau

SEQ ID NO: 670997 - RNA, 19 nt, Homo sapiens
gacaagacagcagcacaua

SEQ ID NO: 670998 - RNA, 19 nt, Homo sapiens
gaaaaccagacaaaacaua

SEQ ID NO: 670999 - RNA, 19 nt, Homo sapiens
gagcugagcacccgcaagu

SEQ ID NO: 671000 - RNA, 19 nt, Homo sapiens
aaggcaaccuggaaaguga

SEQ ID NO: 671001 - RNA, 19 nt, Homo sapiens
ucucuucucuaaccuuuau

SEQ ID NO: 671002 - RNA, 19 nt, Homo sapiens
acagggaagccuuaaauga

SEQ ID NO: 671003 - RNA, 19 nt, Homo sapiens
cuaaccugcugucucuuaa

SEQ ID NO: 671004 - RNA, 19 nt, Homo sapiens
cuucaagucuccaaagauc

SEQ ID NO: 671005 - RNA, 19 nt, Homo sapiens
ccaccagaccggccacuuu

SEQ ID NO: 671006 - RNA, 19 nt, Homo sapiens
guaaucaucugcggaacca

SEQ ID NO: 671007 - RNA, 19 nt, Homo sapiens
gcacucacuucugcgauag

SEQ ID NO: 671008 - RNA, 19 nt, Homo sapiens
gaccaucggcccuauaagu

SEQ ID NO: 671009 - RNA, 19 nt, Homo sapiens
ccacgugucugcuccuucu

SEQ ID NO: 671010 - RNA, 19 nt, Homo sapiens
gaaguagcuugaggaugug

SEQ ID NO: 671011 - RNA, 19 nt, Homo sapiens
ccuaaccugcugucucuua

SEQ ID NO: 671012 - RNA, 19 nt, Homo sapiens
gggaggagaccacugugaa

SEQ ID NO: 671013 - RNA, 19 nt, Homo sapiens
cagggaagccuuaaaugau

SEQ ID NO: 671014 - RNA, 19 nt, Homo sapiens
gacaggagacuucaguugu

SEQ ID NO: 671015 - RNA, 19 nt, Homo sapiens
gaagaggccacggacauca

SEQ ID NO: 671016 - RNA, 19 nt, Homo sapiens
acacagaucaggaccaugu

SEQ ID NO: 671017 - RNA, 19 nt, Homo sapiens
gaucagaaguagguugcau

SEQ ID NO: 671018 - RNA, 19 nt, Homo sapiens
ggaacaguaucuggcugaa

SEQ ID NO: 671019 - RNA, 19 nt, Homo sapiens
gaaagggagccagccaaug

SEQ ID NO: 671020 - RNA, 19 nt, Homo sapiens
cauagugaauucugucucu

SEQ ID NO: 671021 - RNA, 19 nt, Homo sapiens
uggaggacauagugaauuc

SEQ ID NO: 671022 - RNA, 19 nt, Homo sapiens
ccaagaggcgaaguuaauu

SEQ ID NO: 671023 - RNA, 19 nt, Homo sapiens
guucuaagcagcuguucaa

SEQ ID NO: 671024 - RNA, 19 nt, Homo sapiens
aacaguaucuggcugaauc

SEQ ID NO: 671025 - RNA, 19 nt, Homo sapiens
ccagcagccuucuuagcaa

SEQ ID NO: 671026 - RNA, 19 nt, Homo sapiens
uuccuuagcuauaccugua

SEQ ID NO: 671027 - RNA, 19 nt, Homo sapiens
gagcaugaggagacagaaa

SEQ ID NO: 671028 - RNA, 19 nt, Homo sapiens
gcaagaagguggcaaggua

SEQ ID NO: 671029 - RNA, 19 nt, Homo sapiens
ggacauugcugacaagguu

SEQ ID NO: 671030 - RNA, 19 nt, Homo sapiens
guaaaucaguguaaacuug

SEQ ID NO: 671031 - RNA, 19 nt, Homo sapiens
gggaaagccuuggguguaa

SEQ ID NO: 671032 - RNA, 19 nt, Homo sapiens
gcaugggccugcaggagua

SEQ ID NO: 671033 - RNA, 19 nt, Homo sapiens
caaagcggcucuccagcaa

SEQ ID NO: 671034 - RNA, 19 nt, Homo sapiens
gagucaagcuggccaugaa

SEQ ID NO: 671035 - RNA, 19 nt, Homo sapiens
ggaaagccuuggguguaaa

SEQ ID NO: 671036 - RNA, 19 nt, Homo sapiens
gcugagagccugcgagaug

SEQ ID NO: 671037 - RNA, 19 nt, Homo sapiens
gggcagagcaggugaagga

SEQ ID NO: 671038 - RNA, 19 nt, Homo sapiens
gggugugucucacuuagaa

SEQ ID NO: 671039 - RNA, 19 nt, Homo sapiens
agcagaagcuguuggauga

SEQ ID NO: 671040 - RNA, 19 nt, Homo sapiens
gugaagagcaggagaacaa

SEQ ID NO: 671041 - RNA, 19 nt, Homo sapiens
ccaacacccuggagugguu

SEQ ID NO: 671042 - RNA, 19 nt, Homo sapiens
gaagaugggcgaggacaga

SEQ ID NO: 671043 - RNA, 19 nt, Homo sapiens
gcaccuacagugaguguga

SEQ ID NO: 671044 - RNA, 19 nt, Homo sapiens
gagagcaccuacagugagu

SEQ ID NO: 671045 - RNA, 19 nt, Homo sapiens
gagcugaacgggcagauca

SEQ ID NO: 671046 - RNA, 19 nt, Homo sapiens
gcauugagaucgagaaccu

SEQ ID NO: 671047 - RNA, 19 nt, Homo sapiens
gaagcuguuggaugagaua

SEQ ID NO: 671048 - RNA, 19 nt, Homo sapiens
gcgagaugguccuggaaga

SEQ ID NO: 671049 - RNA, 19 nt, Homo sapiens
cagagcaggugaaggacuu

SEQ ID NO: 671050 - RNA, 19 nt, Homo sapiens
gcacuucccaggccagaau

SEQ ID NO: 671051 - RNA, 19 nt, Homo sapiens
gaagagcaggagaacaaga

SEQ ID NO: 671052 - RNA, 19 nt, Homo sapiens
gaucacagccaucagaaac

SEQ ID NO: 671053 - RNA, 19 nt, Homo sapiens
uaagccacccacauaagua

SEQ ID NO: 671054 - RNA, 19 nt, Homo sapiens
cagaagcuguuggaugaga

SEQ ID NO: 671055 - RNA, 19 nt, Homo sapiens
ggaggacauugcugacaag

SEQ ID NO: 671056 - RNA, 19 nt, Homo sapiens
gaacgcguacacuucaguu

SEQ ID NO: 671057 - RNA, 19 nt, Homo sapiens
ggacgaguucgaugacuuc

SEQ ID NO: 671058 - RNA, 19 nt, Homo sapiens
gaucaucguggccaucaug

SEQ ID NO: 671059 - RNA, 19 nt, Homo sapiens
aagcggcucuccagcaaga

SEQ ID NO: 671060 - RNA, 19 nt, Homo sapiens
aaacuuggaggagagauuu

SEQ ID NO: 671061 - RNA, 19 nt, Homo sapiens
gaaagccuuggguguaaau

SEQ ID NO: 671062 - RNA, 19 nt, Homo sapiens
gagaacaagaggagaaugg

SEQ ID NO: 671063 - RNA, 19 nt, Homo sapiens
ucauguagaguagguauuu

SEQ ID NO: 671064 - RNA, 19 nt, Homo sapiens
ggguguaaaucaguguaaa

SEQ ID NO: 671065 - RNA, 19 nt, Homo sapiens
guacgcuggugccguguca

SEQ ID NO: 671066 - RNA, 19 nt, Homo sapiens
gagaggagagggagaaagg

SEQ ID NO: 671067 - RNA, 19 nt, Homo sapiens
gagaugguccuggaagaga

SEQ ID NO: 671068 - RNA, 19 nt, Homo sapiens
ucacuuagaaaucgugguu

SEQ ID NO: 671069 - RNA, 19 nt, Homo sapiens
ugccuaagccacccacaua

SEQ ID NO: 671070 - RNA, 19 nt, Homo sapiens
ggagaagagcauugagauc

SEQ ID NO: 671071 - RNA, 19 nt, Homo sapiens
gggagaagagcauugagau

SEQ ID NO: 671072 - RNA, 19 nt, Homo sapiens
cgccuccuauuguacauuu

SEQ ID NO: 671073 - RNA, 19 nt, Homo sapiens
ggacaaccgcaaccugaag

SEQ ID NO: 671074 - RNA, 19 nt, Homo sapiens
ggacgaggagaacagugaa

SEQ ID NO: 671075 - RNA, 19 nt, Homo sapiens
agaagagcauugagaucga

SEQ ID NO: 671076 - RNA, 19 nt, Homo sapiens
ucgaggacuucauccaguu

SEQ ID NO: 671077 - RNA, 19 nt, Homo sapiens
gcaggaggagaucaacuuc

SEQ ID NO: 671078 - RNA, 19 nt, Homo sapiens
ucauggaggcgauucagaa

SEQ ID NO: 671079 - RNA, 19 nt, Homo sapiens
gugaucagcuuugaagacu

SEQ ID NO: 671080 - RNA, 19 nt, Homo sapiens
ggaucacagccaucagaaa

SEQ ID NO: 671081 - RNA, 19 nt, Homo sapiens
caagggaucacagccauca

SEQ ID NO: 671082 - RNA, 19 nt, Homo sapiens
cagauguggucaccucagu

SEQ ID NO: 671083 - RNA, 19 nt, Homo sapiens
gcagcccuguugggaagaa

SEQ ID NO: 671084 - RNA, 19 nt, Homo sapiens
caggagaacaagaggagaa

SEQ ID NO: 671085 - RNA, 19 nt, Homo sapiens
gcuguuggaugagauagag

SEQ ID NO: 671086 - RNA, 19 nt, Homo sapiens
uggaggcgauucagaagca

SEQ ID NO: 671087 - RNA, 19 nt, Homo sapiens
cugaacgggcagaucauua

SEQ ID NO: 671088 - RNA, 19 nt, Homo sapiens
aggaggacauugcugacaa

SEQ ID NO: 671089 - RNA, 19 nt, Homo sapiens
uaaacuuggaggagagauu

SEQ ID NO: 671090 - RNA, 19 nt, Homo sapiens
uggaggagcagcugaagga

SEQ ID NO: 671091 - RNA, 19 nt, Homo sapiens
cggacgaguucgaugacuu

SEQ ID NO: 671092 - RNA, 19 nt, Homo sapiens
cuuccacgcuaggauguaa

SEQ ID NO: 671093 - RNA, 19 nt, Homo sapiens
gccuaagccacccacauaa

SEQ ID NO: 671094 - RNA, 19 nt, Homo sapiens
gccaugaacgcguacacuu

SEQ ID NO: 671095 - RNA, 19 nt, Homo sapiens
gagagggagaagagcauug

SEQ ID NO: 671096 - RNA, 19 nt, Homo sapiens
ccaugaacgcguacacuuc

SEQ ID NO: 671097 - RNA, 19 nt, Homo sapiens
gucccuggcugcagagauc

SEQ ID NO: 671098 - RNA, 19 nt, Homo sapiens
ggagagggagaagagcauu

SEQ ID NO: 671099 - RNA, 19 nt, Homo sapiens
gagcuucccagcccugagu

SEQ ID NO: 671100 - RNA, 19 nt, Homo sapiens
gcccugagcgccuuugucu

SEQ ID NO: 671101 - RNA, 19 nt, Homo sapiens
gaaggagcaggagcugaga

SEQ ID NO: 671102 - RNA, 19 nt, Homo sapiens
gagcaggugaaggacuuaa

SEQ ID NO: 671103 - RNA, 19 nt, Homo sapiens
gcucccaggugcugcuucu

SEQ ID NO: 671104 - RNA, 19 nt, Homo sapiens
gcugaacgggcagaucauu

SEQ ID NO: 671105 - RNA, 19 nt, Homo sapiens
ucagugaagagcaggagaa

SEQ ID NO: 671106 - RNA, 19 nt, Homo sapiens
ggagaagcagaagcuguug

SEQ ID NO: 671107 - RNA, 19 nt, Homo sapiens
caggugaaggacuuaacua

SEQ ID NO: 671108 - RNA, 19 nt, Homo sapiens
gcaagauggagagggagaa

SEQ ID NO: 671109 - RNA, 19 nt, Homo sapiens
gcccggacgaguucgauga

SEQ ID NO: 671110 - RNA, 19 nt, Homo sapiens
gggaucacagccaucagaa

SEQ ID NO: 671111 - RNA, 19 nt, Homo sapiens
gagcaccuacagugagugu

SEQ ID NO: 671112 - RNA, 19 nt, Homo sapiens
cuaagccacccacauaagu

SEQ ID NO: 671113 - RNA, 19 nt, Homo sapiens
cgaggacuucauccaguuu

SEQ ID NO: 671114 - RNA, 19 nt, Homo sapiens
gcaggugaaggacuuaacu

SEQ ID NO: 671115 - RNA, 19 nt, Homo sapiens
gacuucauccaguuugcua

SEQ ID NO: 671116 - RNA, 19 nt, Homo sapiens
gaggacuucauccaguuug

SEQ ID NO: 671117 - RNA, 19 nt, Homo sapiens
gcagaccaggcuacagcaa

SEQ ID NO: 671118 - RNA, 19 nt, Homo sapiens
caagagaaaacuguguaua

SEQ ID NO: 671119 - RNA, 19 nt, Homo sapiens
ccgagagcaccuacaguga

SEQ ID NO: 671120 - RNA, 19 nt, Homo sapiens
ggagagggcagggaagacu

SEQ ID NO: 671121 - RNA, 19 nt, Homo sapiens
gucugaaggccaacauuga

SEQ ID NO: 671122 - RNA, 19 nt, Homo sapiens
ugucugaaggccaacauug

SEQ ID NO: 671123 - RNA, 19 nt, Homo sapiens
agaccaggcuacagcaacu

SEQ ID NO: 671124 - RNA, 19 nt, Homo sapiens
agagaaaacuguguauaca

SEQ ID NO: 671125 - RNA, 19 nt, Homo sapiens
ggccuccacuccgacauca

SEQ ID NO: 671126 - RNA, 19 nt, Homo sapiens
cuacgcugcucgggccauu

SEQ ID NO: 671127 - RNA, 19 nt, Homo sapiens
ugaacgggcagaucauuac

SEQ ID NO: 671128 - RNA, 19 nt, Homo sapiens
gaaggugagugaagaauua

SEQ ID NO: 671129 - RNA, 19 nt, Homo sapiens
gaacaacaguuucagcaaa

SEQ ID NO: 671130 - RNA, 19 nt, Homo sapiens
gaaauucacuucauuguac

SEQ ID NO: 671131 - RNA, 19 nt, Homo sapiens
caacuaagaucucauaaag

SEQ ID NO: 671132 - RNA, 19 nt, Homo sapiens
gaacuuugcucucuacugu

SEQ ID NO: 671133 - RNA, 19 nt, Homo sapiens
caaggaagaucaggaauaa

SEQ ID NO: 671134 - RNA, 19 nt, Homo sapiens
guacauguaucggaacuua

SEQ ID NO: 671135 - RNA, 19 nt, Homo sapiens
cgaaagcggucuaaccaua

SEQ ID NO: 671136 - RNA, 19 nt, Homo sapiens
gcagugaacuccaguaaag

SEQ ID NO: 671137 - RNA, 19 nt, Homo sapiens
ucacaaagauggucugaga

SEQ ID NO: 671138 - RNA, 19 nt, Homo sapiens
ucacauaaguucuccauau

SEQ ID NO: 671139 - RNA, 19 nt, Homo sapiens
uaacuaaggucuauacauc

SEQ ID NO: 671140 - RNA, 19 nt, Homo sapiens
gaaacugaaugauguugaa

SEQ ID NO: 671141 - RNA, 19 nt, Homo sapiens
ggugaugucuagauucaua

SEQ ID NO: 671142 - RNA, 19 nt, Homo sapiens
caucuggacuuaagaguuu

SEQ ID NO: 671143 - RNA, 19 nt, Homo sapiens
gguagcauaucacaaagua

SEQ ID NO: 671144 - RNA, 19 nt, Homo sapiens
gaacaagccuaugaaagau

SEQ ID NO: 671145 - RNA, 19 nt, Homo sapiens
ccauuuaacugcuaauuga

SEQ ID NO: 671146 - RNA, 19 nt, Homo sapiens
ggaaguauccuaguaugua

SEQ ID NO: 671147 - RNA, 19 nt, Homo sapiens
gaaaucaaauguguaagga

SEQ ID NO: 671148 - RNA, 19 nt, Homo sapiens
ggaaacaucuuuugacuga

SEQ ID NO: 671149 - RNA, 19 nt, Homo sapiens
gaaggaacuuugcucucua

SEQ ID NO: 671150 - RNA, 19 nt, Homo sapiens
gaaguauccuaguauguau

SEQ ID NO: 671151 - RNA, 19 nt, Homo sapiens
gaaaucuccuucagccauu

SEQ ID NO: 671152 - RNA, 19 nt, Homo sapiens
ugacggaccuguuaggaaa

SEQ ID NO: 671153 - RNA, 19 nt, Homo sapiens
ucaugagacugcauuauaa

SEQ ID NO: 671154 - RNA, 19 nt, Homo sapiens
caagagaugucuauguugu

SEQ ID NO: 671155 - RNA, 19 nt, Homo sapiens
gaagaccauuccagagaaa

SEQ ID NO: 671156 - RNA, 19 nt, Homo sapiens
agaagcaccucucgaaauu

SEQ ID NO: 671157 - RNA, 19 nt, Homo sapiens
gaggauuacugauauuaug

SEQ ID NO: 671158 - RNA, 19 nt, Homo sapiens
gaucugugguuccuuagaa

SEQ ID NO: 671159 - RNA, 19 nt, Homo sapiens
ggaaaaugcuguuguguga

SEQ ID NO: 671160 - RNA, 19 nt, Homo sapiens
acaggaagcuaucaaagaa

SEQ ID NO: 671161 - RNA, 19 nt, Homo sapiens
gaacagauagaaauuguca

SEQ ID NO: 671162 - RNA, 19 nt, Homo sapiens
uaugaaagauggaaggaaa

SEQ ID NO: 671163 - RNA, 19 nt, Homo sapiens
ggaagaaucugagcuguac

SEQ ID NO: 671164 - RNA, 19 nt, Homo sapiens
ggccuggauugcuauauua

SEQ ID NO: 671165 - RNA, 19 nt, Homo sapiens
gaggaaaucaaauguguaa

SEQ ID NO: 671166 - RNA, 19 nt, Homo sapiens
gacaaacaacuacuugaua

SEQ ID NO: 671167 - RNA, 19 nt, Homo sapiens
gcacacaucuaacauuggu

SEQ ID NO: 671168 - RNA, 19 nt, Homo sapiens
gaagaauuaugcacacauc

SEQ ID NO: 671169 - RNA, 19 nt, Homo sapiens
cagcaaagacugaugaauu

SEQ ID NO: 671170 - RNA, 19 nt, Homo sapiens
aaucugagcuguaccaaug

SEQ ID NO: 671171 - RNA, 19 nt, Homo sapiens
gaagaauuaugcagcuuuc

SEQ ID NO: 671172 - RNA, 19 nt, Homo sapiens
gaucaaagccuugcaguuc

SEQ ID NO: 671173 - RNA, 19 nt, Homo sapiens
gagaaaacaucuggacuua

SEQ ID NO: 671174 - RNA, 19 nt, Homo sapiens
cagcagaggauuacugaua

SEQ ID NO: 671175 - RNA, 19 nt, Homo sapiens
ggacuugccuuuguuaucu

SEQ ID NO: 671176 - RNA, 19 nt, Homo sapiens
caacaggccuaguaagaca

SEQ ID NO: 671177 - RNA, 19 nt, Homo sapiens
uagaauggcuauacuuuca

SEQ ID NO: 671178 - RNA, 19 nt, Homo sapiens
gaauuaugcacacaucuaa

SEQ ID NO: 671179 - RNA, 19 nt, Homo sapiens
ggaagugaagcaaggaaua

SEQ ID NO: 671180 - RNA, 19 nt, Homo sapiens
ccaaauggaacaacaguuu

SEQ ID NO: 671181 - RNA, 19 nt, Homo sapiens
cacauuaagucagcauuua

SEQ ID NO: 671182 - RNA, 19 nt, Homo sapiens
ucacacagguagcauauca

SEQ ID NO: 671183 - RNA, 19 nt, Homo sapiens
gcaguucuauuauaucaca

SEQ ID NO: 671184 - RNA, 19 nt, Homo sapiens
gauucuaccuuaauacaga

SEQ ID NO: 671185 - RNA, 19 nt, Homo sapiens
gaaaacaucuggacuuaag

SEQ ID NO: 671186 - RNA, 19 nt, Homo sapiens
gcagaggauuacugauauu

SEQ ID NO: 671187 - RNA, 19 nt, Homo sapiens
uaugaucugugguuccuua

SEQ ID NO: 671188 - RNA, 19 nt, Homo sapiens
caaguagucugguaugauc

SEQ ID NO: 671189 - RNA, 19 nt, Homo sapiens
uguauuggaugguaacuaa

SEQ ID NO: 671190 - RNA, 19 nt, Homo sapiens
caagagccaucuccuuaug

SEQ ID NO: 671191 - RNA, 19 nt, Homo sapiens
caucaggaauagaaaugua

SEQ ID NO: 671192 - RNA, 19 nt, Homo sapiens
gcaacaaacauuuccuaaa

SEQ ID NO: 671193 - RNA, 19 nt, Homo sapiens
uaauagaucagccuuguaa

SEQ ID NO: 671194 - RNA, 19 nt, Homo sapiens
aaacuuaugugcuaguguu

SEQ ID NO: 671195 - RNA, 19 nt, Homo sapiens
ugaacaagccuaugaaaga

SEQ ID NO: 671196 - RNA, 19 nt, Homo sapiens
gagaagaccauuccagaga

SEQ ID NO: 671197 - RNA, 19 nt, Homo sapiens
ucaagcauuuagacaguua

SEQ ID NO: 671198 - RNA, 19 nt, Homo sapiens
ggucuagagugauuuguau

SEQ ID NO: 671199 - RNA, 19 nt, Homo sapiens
uuaaaggucuagagugauu

SEQ ID NO: 671200 - RNA, 19 nt, Homo sapiens
ggagaacuacccacaacua

SEQ ID NO: 671201 - RNA, 19 nt, Homo sapiens
gaucccaggucaaauuaug

SEQ ID NO: 671202 - RNA, 19 nt, Homo sapiens
agcaaagacugaugaauuu

SEQ ID NO: 671203 - RNA, 19 nt, Homo sapiens
gaauauugaggaucucuuu

SEQ ID NO: 671204 - RNA, 19 nt, Homo sapiens
ggcuuuaacugaauauuug

SEQ ID NO: 671205 - RNA, 19 nt, Homo sapiens
gaacuacccacaacuauac

SEQ ID NO: 671206 - RNA, 19 nt, Homo sapiens
ucuaagugcuuccaggaua

SEQ ID NO: 671207 - RNA, 19 nt, Homo sapiens
gcaaagacugaugaauuua

SEQ ID NO: 671208 - RNA, 19 nt, Homo sapiens
cacauaaguucuccauauu

SEQ ID NO: 671209 - RNA, 19 nt, Homo sapiens
uaaacuagacaccaaguaa

SEQ ID NO: 671210 - RNA, 19 nt, Homo sapiens
gugguaagcuuuuaguuua

SEQ ID NO: 671211 - RNA, 19 nt, Homo sapiens
uaaugaagauguuggacuu

SEQ ID NO: 671212 - RNA, 19 nt, Homo sapiens
ccagagcaauucuacgaaa

SEQ ID NO: 671213 - RNA, 19 nt, Homo sapiens
gaauuagcauccauguguu

SEQ ID NO: 671214 - RNA, 19 nt, Homo sapiens
cauaggguauugucauauu

SEQ ID NO: 671215 - RNA, 19 nt, Homo sapiens
gaggaguacuugaguuugu

SEQ ID NO: 671216 - RNA, 19 nt, Homo sapiens
gagaggaguacuugaguuu

SEQ ID NO: 671217 - RNA, 19 nt, Homo sapiens
gcccuuggguggucacuuu

SEQ ID NO: 671218 - RNA, 19 nt, Homo sapiens
gaugguaacuaaggucuau

SEQ ID NO: 671219 - RNA, 19 nt, Homo sapiens
aauuaaaggucuagaguga

SEQ ID NO: 671220 - RNA, 19 nt, Homo sapiens
gcauggugaugucuagauu

SEQ ID NO: 671221 - RNA, 19 nt, Homo sapiens
gaucucaagcccugugaua

SEQ ID NO: 671222 - RNA, 19 nt, Homo sapiens
gauagcaagccuccaagua

SEQ ID NO: 671223 - RNA, 19 nt, Homo sapiens
gaauggcuauacuuucaga

SEQ ID NO: 671224 - RNA, 19 nt, Homo sapiens
cacaguagcaucaggaaua

SEQ ID NO: 671225 - RNA, 19 nt, Homo sapiens
aggaagaucaggaauaaua

SEQ ID NO: 671226 - RNA, 19 nt, Homo sapiens
uaguuuagcugcuuuaaca

SEQ ID NO: 671227 - RNA, 19 nt, Homo sapiens
cacauaggguauugucaua

SEQ ID NO: 671228 - RNA, 19 nt, Homo sapiens
ggagaaagcugccucagaa

SEQ ID NO: 671229 - RNA, 19 nt, Homo sapiens
ggaagaagaugaugaugaa

SEQ ID NO: 671230 - RNA, 19 nt, Homo sapiens
ggaaacugcugucgucuuu

SEQ ID NO: 671231 - RNA, 19 nt, Homo sapiens
gcaauuggaagaccuauua

SEQ ID NO: 671232 - RNA, 19 nt, Homo sapiens
guacagaaauuacuggaaa

SEQ ID NO: 671233 - RNA, 19 nt, Homo sapiens
caaauuugguugugaagua

SEQ ID NO: 671234 - RNA, 19 nt, Homo sapiens
cagaagcacuauagaauuu

SEQ ID NO: 671235 - RNA, 19 nt, Homo sapiens
gaucuugucuuaaaugaug

SEQ ID NO: 671236 - RNA, 19 nt, Homo sapiens
ggaaauaccucguccuucu

SEQ ID NO: 671237 - RNA, 19 nt, Homo sapiens
gaaaacagguuaacaauca

SEQ ID NO: 671238 - RNA, 19 nt, Homo sapiens
uagaugagcuugacacuga

SEQ ID NO: 671239 - RNA, 19 nt, Homo sapiens
caacugacuugcuuaggua

SEQ ID NO: 671240 - RNA, 19 nt, Homo sapiens
ggaaugaagucaguauuug

SEQ ID NO: 671241 - RNA, 19 nt, Homo sapiens
gaacaucuuugaccugugu

SEQ ID NO: 671242 - RNA, 19 nt, Homo sapiens
gacaucaucuuaucucuga

SEQ ID NO: 671243 - RNA, 19 nt, Homo sapiens
uaacaaauuugccacagaa

SEQ ID NO: 671244 - RNA, 19 nt, Homo sapiens
ugacaacucugauuuggaa

SEQ ID NO: 671245 - RNA, 19 nt, Homo sapiens
gcagaaagcagauguuguu

SEQ ID NO: 671246 - RNA, 19 nt, Homo sapiens
ggaaagaguuugcaugcau

SEQ ID NO: 671247 - RNA, 19 nt, Homo sapiens
gaagcucuauaauguguuu

SEQ ID NO: 671248 - RNA, 19 nt, Homo sapiens
guagguaucagcauuauuu

SEQ ID NO: 671249 - RNA, 19 nt, Homo sapiens
ggaaagagaaggaauguca

SEQ ID NO: 671250 - RNA, 19 nt, Homo sapiens
gggcaucauuuccaaagua

SEQ ID NO: 671251 - RNA, 19 nt, Homo sapiens
gcaacugacuacaaaccua

SEQ ID NO: 671252 - RNA, 19 nt, Homo sapiens
gauggcggaugcuuugaua

SEQ ID NO: 671253 - RNA, 19 nt, Homo sapiens
caggaugucucaauugauu

SEQ ID NO: 671254 - RNA, 19 nt, Homo sapiens
gcaaagccaugacuacagu

SEQ ID NO: 671255 - RNA, 19 nt, Homo sapiens
gcaggcagaugaugaagau

SEQ ID NO: 671256 - RNA, 19 nt, Homo sapiens
gacuggaggugaucauuaa

SEQ ID NO: 671257 - RNA, 19 nt, Homo sapiens
ggacuggaggugaucauua

SEQ ID NO: 671258 - RNA, 19 nt, Homo sapiens
gaacagauuguggaaauga

SEQ ID NO: 671259 - RNA, 19 nt, Homo sapiens
uaaugcaacugacuacaaa

SEQ ID NO: 671260 - RNA, 19 nt, Homo sapiens
guacaaggcaugcucauau

SEQ ID NO: 671261 - RNA, 19 nt, Homo sapiens
gaucaguacuuuggagauu

SEQ ID NO: 671262 - RNA, 19 nt, Homo sapiens
gaacuauacccugugguua

SEQ ID NO: 671263 - RNA, 19 nt, Homo sapiens
gaccacagcucaaguaaaa

SEQ ID NO: 671264 - RNA, 19 nt, Homo sapiens
ugaugaagaugacuuaaug

SEQ ID NO: 671265 - RNA, 19 nt, Homo sapiens
gaggaacugugccaccuuu

SEQ ID NO: 671266 - RNA, 19 nt, Homo sapiens
gaaugacacugugcgcuuu

SEQ ID NO: 671267 - RNA, 19 nt, Homo sapiens
ucaauuugcuucucauuuc

SEQ ID NO: 671268 - RNA, 19 nt, Homo sapiens
agacauugcugccaacuau

SEQ ID NO: 671269 - RNA, 19 nt, Homo sapiens
ugaaagcacuauauucuag

SEQ ID NO: 671270 - RNA, 19 nt, Homo sapiens
gaagcaaacuaaugauguc

SEQ ID NO: 671271 - RNA, 19 nt, Homo sapiens
ggaauugucgagaaucuuu

SEQ ID NO: 671272 - RNA, 19 nt, Homo sapiens
gaagaucacuauguugagu

SEQ ID NO: 671273 - RNA, 19 nt, Homo sapiens
ccaccuuucucccucuuua

SEQ ID NO: 671274 - RNA, 19 nt, Homo sapiens
ggaaugugguucaguccaa

SEQ ID NO: 671275 - RNA, 19 nt, Homo sapiens
guuaggaggugcuauggaa

SEQ ID NO: 671276 - RNA, 19 nt, Homo sapiens
ggacaccuuucucugaaga

SEQ ID NO: 671277 - RNA, 19 nt, Homo sapiens
caacacaccuuaggaacau

SEQ ID NO: 671278 - RNA, 19 nt, Homo sapiens
cacagaagaucacuauguu

SEQ ID NO: 671279 - RNA, 19 nt, Homo sapiens
ucugagugaugaugaaaua

SEQ ID NO: 671280 - RNA, 19 nt, Homo sapiens
ggagcuacuucccauauuc

SEQ ID NO: 671281 - RNA, 19 nt, Homo sapiens
ggagggaauugucgagaau

SEQ ID NO: 671282 - RNA, 19 nt, Homo sapiens
gggaaugaagucaguauuu

SEQ ID NO: 671283 - RNA, 19 nt, Homo sapiens
uacaaggcaugcucauaua

SEQ ID NO: 671284 - RNA, 19 nt, Homo sapiens
cugaugauguucuauauug

SEQ ID NO: 671285 - RNA, 19 nt, Homo sapiens
gagcugaugauguucuaua

SEQ ID NO: 671286 - RNA, 19 nt, Homo sapiens
ugacaccgaugauuuagau

SEQ ID NO: 671287 - RNA, 19 nt, Homo sapiens
caaauggacuggaggugau

SEQ ID NO: 671288 - RNA, 19 nt, Homo sapiens
ccacaaguuugacaaguuc

SEQ ID NO: 671289 - RNA, 19 nt, Homo sapiens
gaaugaagucaguauuuga

SEQ ID NO: 671290 - RNA, 19 nt, Homo sapiens
gaacauggacacaguaugc

SEQ ID NO: 671291 - RNA, 19 nt, Homo sapiens
gaaauaccucguccuucua

SEQ ID NO: 671292 - RNA, 19 nt, Homo sapiens
gcaccaauuauacccuuua

SEQ ID NO: 671293 - RNA, 19 nt, Homo sapiens
ggauggaggauuaaagaaa

SEQ ID NO: 671294 - RNA, 19 nt, Homo sapiens
ggaagcuucuggagacaug

SEQ ID NO: 671295 - RNA, 19 nt, Homo sapiens
ugacagcucugacaacucu

SEQ ID NO: 671296 - RNA, 19 nt, Homo sapiens
gaacugugccaccuuuaau

SEQ ID NO: 671297 - RNA, 19 nt, Homo sapiens
caccuacgcuggacaguau

SEQ ID NO: 671298 - RNA, 19 nt, Homo sapiens
gauacgaaaccaucuuauu

SEQ ID NO: 671299 - RNA, 19 nt, Homo sapiens
gagcugauccagaguguau

SEQ ID NO: 671300 - RNA, 19 nt, Homo sapiens
gaaguaaacaagaaacaca

SEQ ID NO: 671301 - RNA, 19 nt, Homo sapiens
ggaacugugccaccuuuaa

SEQ ID NO: 671302 - RNA, 19 nt, Homo sapiens
ggaugaggcuggaucuaca

SEQ ID NO: 671303 - RNA, 19 nt, Homo sapiens
ccagaucgcauguuuguug

SEQ ID NO: 671304 - RNA, 19 nt, Homo sapiens
guacccaacugacuugcuu

SEQ ID NO: 671305 - RNA, 19 nt, Homo sapiens
ggacuuaacaacauaccaa

SEQ ID NO: 671306 - RNA, 19 nt, Homo sapiens
cagaagaucacuauguuga

SEQ ID NO: 671307 - RNA, 19 nt, Homo sapiens
cuggugaacuugaucagua

SEQ ID NO: 671308 - RNA, 19 nt, Homo sapiens
ggaguguucucaugcuuca

SEQ ID NO: 671309 - RNA, 19 nt, Homo sapiens
ugucugauguggugaacua

SEQ ID NO: 671310 - RNA, 19 nt, Homo sapiens
cacgggagcugaugauguu

SEQ ID NO: 671311 - RNA, 19 nt, Homo sapiens
caucagcugucuuccuuau

SEQ ID NO: 671312 - RNA, 19 nt, Homo sapiens
ggcaucagcugucuuccuu

SEQ ID NO: 671313 - RNA, 19 nt, Homo sapiens
uaacagggaggcagaauuc

SEQ ID NO: 671314 - RNA, 19 nt, Homo sapiens
gagaagaggggacaaauuu

SEQ ID NO: 671315 - RNA, 19 nt, Homo sapiens
uaucaucaauugugugugu

SEQ ID NO: 671316 - RNA, 19 nt, Homo sapiens
caaacuuucuugugugcaa

SEQ ID NO: 671317 - RNA, 19 nt, Homo sapiens
gacaugguaccuauccuua

SEQ ID NO: 671318 - RNA, 19 nt, Homo sapiens
gaggauggaggauuaaaga

SEQ ID NO: 671319 - RNA, 19 nt, Homo sapiens
gcucagaagcacuauagaa

SEQ ID NO: 671320 - RNA, 19 nt, Homo sapiens
ugaugacaccgaugauuua

SEQ ID NO: 671321 - RNA, 19 nt, Homo sapiens
agucagcacuucagauuau

SEQ ID NO: 671322 - RNA, 19 nt, Homo sapiens
aaacugcugucgucuuuca

SEQ ID NO: 671323 - RNA, 19 nt, Homo sapiens
gcugggagguagaugauuc

SEQ ID NO: 671324 - RNA, 19 nt, Homo sapiens
ucagcugucuuccuuauuc

SEQ ID NO: 671325 - RNA, 19 nt, Homo sapiens
gaagaaaacagguuaacaa

SEQ ID NO: 671326 - RNA, 19 nt, Homo sapiens
gcucugacaacucugauuu

SEQ ID NO: 671327 - RNA, 19 nt, Homo sapiens
gaagucaguauuugauaug

SEQ ID NO: 671328 - RNA, 19 nt, Homo sapiens
ggaagucacuguuaaauga

SEQ ID NO: 671329 - RNA, 19 nt, Homo sapiens
gaaaugauccuaccaguga

SEQ ID NO: 671330 - RNA, 19 nt, Homo sapiens
ccaggaaccuuuaagaaua

SEQ ID NO: 671331 - RNA, 19 nt, Homo sapiens
gaaauggccuuguuuaaag

SEQ ID NO: 671332 - RNA, 19 nt, Homo sapiens
gcaaacggguucauuuaaa

SEQ ID NO: 671333 - RNA, 19 nt, Homo sapiens
gaauuaaucuccacguuug

SEQ ID NO: 671334 - RNA, 19 nt, Homo sapiens
gaaguuaagucucuccaaa

SEQ ID NO: 671335 - RNA, 19 nt, Homo sapiens
gaagaaagaggaacagaaa

SEQ ID NO: 671336 - RNA, 19 nt, Homo sapiens
guggagagaugucgaauaa

SEQ ID NO: 671337 - RNA, 19 nt, Homo sapiens
acacaugccuucuauauau

SEQ ID NO: 671338 - RNA, 19 nt, Homo sapiens
ggaaauggccuuguuuaaa

SEQ ID NO: 671339 - RNA, 19 nt, Homo sapiens
guaccaagauccagaaguu

SEQ ID NO: 671340 - RNA, 19 nt, Homo sapiens
aaagagauguuggccauua

SEQ ID NO: 671341 - RNA, 19 nt, Homo sapiens
gcaggaacauucucuacaa

SEQ ID NO: 671342 - RNA, 19 nt, Homo sapiens
gcaaacagguggucgagau

SEQ ID NO: 671343 - RNA, 19 nt, Homo sapiens
gaaauuguccuucaaaugg

SEQ ID NO: 671344 - RNA, 19 nt, Homo sapiens
gaguauagaugccaagaug

SEQ ID NO: 671345 - RNA, 19 nt, Homo sapiens
gcaguaggacaauuucuua

SEQ ID NO: 671346 - RNA, 19 nt, Homo sapiens
ggagagaugucgaauaagg

SEQ ID NO: 671347 - RNA, 19 nt, Homo sapiens
ggaugcagcuaaccaaaga

SEQ ID NO: 671348 - RNA, 19 nt, Homo sapiens
ggaaaagccuucaucauau

SEQ ID NO: 671349 - RNA, 19 nt, Homo sapiens
caagaugucuguaaaauga

SEQ ID NO: 671350 - RNA, 19 nt, Homo sapiens
gagaaggccuugagagaag

SEQ ID NO: 671351 - RNA, 19 nt, Homo sapiens
ccacagauccucauccaaa

SEQ ID NO: 671352 - RNA, 19 nt, Homo sapiens
ccaaagugcuggaauuaca

SEQ ID NO: 671353 - RNA, 19 nt, Homo sapiens
gaccaagaaucaaguacaa

SEQ ID NO: 671354 - RNA, 19 nt, Homo sapiens
caggaaaucugacuauauc

SEQ ID NO: 671355 - RNA, 19 nt, Homo sapiens
gugauuggauccauaaguu

SEQ ID NO: 671356 - RNA, 19 nt, Homo sapiens
gcauccgucuuucucguua

SEQ ID NO: 671357 - RNA, 19 nt, Homo sapiens
gaaaagccuucaucauauu

SEQ ID NO: 671358 - RNA, 19 nt, Homo sapiens
caccacgccuggcuaauuu

SEQ ID NO: 671359 - RNA, 19 nt, Homo sapiens
gauuggauccauaaguuua

SEQ ID NO: 671360 - RNA, 19 nt, Homo sapiens
gcugaggccuauuguaaga

SEQ ID NO: 671361 - RNA, 19 nt, Homo sapiens
gcgaagaccuuuugauuug

SEQ ID NO: 671362 - RNA, 19 nt, Homo sapiens
gugaaagcuugccugaaua

SEQ ID NO: 671363 - RNA, 19 nt, Homo sapiens
cgaggacccugcucuagaa

SEQ ID NO: 671364 - RNA, 19 nt, Homo sapiens
gcucaccaguauaugauuu

SEQ ID NO: 671365 - RNA, 19 nt, Homo sapiens
gaacuucagcccuggagaa

SEQ ID NO: 671366 - RNA, 19 nt, Homo sapiens
gagaggaccauucccguuu

SEQ ID NO: 671367 - RNA, 19 nt, Homo sapiens
ucucaggccuuccuuagaa

SEQ ID NO: 671368 - RNA, 19 nt, Homo sapiens
ggaagaaagaggaacagaa

SEQ ID NO: 671369 - RNA, 19 nt, Homo sapiens
ugacuuagcuuuugauaug

SEQ ID NO: 671370 - RNA, 19 nt, Homo sapiens
gcagagcgguuucgaagac

SEQ ID NO: 671371 - RNA, 19 nt, Homo sapiens
caagcaaacggguucauuu

SEQ ID NO: 671372 - RNA, 19 nt, Homo sapiens
gauggaguuugcauuaaug

SEQ ID NO: 671373 - RNA, 19 nt, Homo sapiens
ggacaauuucuuaaacuga

SEQ ID NO: 671374 - RNA, 19 nt, Homo sapiens
caggaaccuuuaagaauau

SEQ ID NO: 671375 - RNA, 19 nt, Homo sapiens
gagcugcccagacacauaa

SEQ ID NO: 671376 - RNA, 19 nt, Homo sapiens
gaagagccauaaaggacau

SEQ ID NO: 671377 - RNA, 19 nt, Homo sapiens
cagcucaucuggacacgaa

SEQ ID NO: 671378 - RNA, 19 nt, Homo sapiens
gaaguugauugaccacuac

SEQ ID NO: 671379 - RNA, 19 nt, Homo sapiens
guugauggaguuugcauua

SEQ ID NO: 671380 - RNA, 19 nt, Homo sapiens
gaugaaaccaacccucaaa

SEQ ID NO: 671381 - RNA, 19 nt, Homo sapiens
ggacccugcucuagaagga

SEQ ID NO: 671382 - RNA, 19 nt, Homo sapiens
caagaaauuguccuucaaa

SEQ ID NO: 671383 - RNA, 19 nt, Homo sapiens
agugaaagcuugccugaau

SEQ ID NO: 671384 - RNA, 19 nt, Homo sapiens
aagcaaacggguucauuua

SEQ ID NO: 671385 - RNA, 19 nt, Homo sapiens
ggaggaagucacuguuaaa

SEQ ID NO: 671386 - RNA, 19 nt, Homo sapiens
cuaaagacauguggaggaa

SEQ ID NO: 671387 - RNA, 19 nt, Homo sapiens
gagcgggucuccugauucu

SEQ ID NO: 671388 - RNA, 19 nt, Homo sapiens
aaacagaacaagaaugaga

SEQ ID NO: 671389 - RNA, 19 nt, Homo sapiens
gccaggaaaucugacuaua

SEQ ID NO: 671390 - RNA, 19 nt, Homo sapiens
gaacguacgccaggaaauc

SEQ ID NO: 671391 - RNA, 19 nt, Homo sapiens
ucaaguaccagaauuacaa

SEQ ID NO: 671392 - RNA, 19 nt, Homo sapiens
uggaggaagucacuguuaa

SEQ ID NO: 671393 - RNA, 19 nt, Homo sapiens
gagacggcgguucgaauua

SEQ ID NO: 671394 - RNA, 19 nt, Homo sapiens
cgucacagcugcaaauuuu

SEQ ID NO: 671395 - RNA, 19 nt, Homo sapiens
uuagaaagguuuggguuga

SEQ ID NO: 671396 - RNA, 19 nt, Homo sapiens
cagaggcgcuucacuuucu

SEQ ID NO: 671397 - RNA, 19 nt, Homo sapiens
gucgagauauccagucuga

SEQ ID NO: 671398 - RNA, 19 nt, Homo sapiens
caggaacauucucuacaaa

SEQ ID NO: 671399 - RNA, 19 nt, Homo sapiens
gaaggaagacuacgaucuc

SEQ ID NO: 671400 - RNA, 19 nt, Homo sapiens
aacaagccauugcugauuu

SEQ ID NO: 671401 - RNA, 19 nt, Homo sapiens
gcacagaucauacgaaaau

SEQ ID NO: 671402 - RNA, 19 nt, Homo sapiens
agaaguugauugaccacua

SEQ ID NO: 671403 - RNA, 19 nt, Homo sapiens
guaggacaauuucuuaaac

SEQ ID NO: 671404 - RNA, 19 nt, Homo sapiens
aaagcuugccugaauauuu

SEQ ID NO: 671405 - RNA, 19 nt, Homo sapiens
uggccuggauacauuaaua

SEQ ID NO: 671406 - RNA, 19 nt, Homo sapiens
aggaagagcugcccagaca

SEQ ID NO: 671407 - RNA, 19 nt, Homo sapiens
uggcagcacugaaagaaau

SEQ ID NO: 671408 - RNA, 19 nt, Homo sapiens
guuaagucucuccaaauua

SEQ ID NO: 671409 - RNA, 19 nt, Homo sapiens
caggaaauggccuuguuua

SEQ ID NO: 671410 - RNA, 19 nt, Homo sapiens
cacccagaguauauuaaua

SEQ ID NO: 671411 - RNA, 19 nt, Homo sapiens
uaaauuggcauuaggauac

SEQ ID NO: 671412 - RNA, 19 nt, Homo sapiens
guuaagggaccaagaauca

SEQ ID NO: 671413 - RNA, 19 nt, Homo sapiens
ucucaccaaucaacacuuu

SEQ ID NO: 671414 - RNA, 19 nt, Homo sapiens
gaacaagaaugagaaaagu

SEQ ID NO: 671415 - RNA, 19 nt, Homo sapiens
gaguugauaggauguuuaa

SEQ ID NO: 671416 - RNA, 19 nt, Homo sapiens
gcucagaggcgcuucacuu

SEQ ID NO: 671417 - RNA, 19 nt, Homo sapiens
gaaaagcggcuacagaaga

SEQ ID NO: 671418 - RNA, 19 nt, Homo sapiens
gagaugagggcacggagaa

SEQ ID NO: 671419 - RNA, 19 nt, Homo sapiens
cagcuauucguaagcauua

SEQ ID NO: 671420 - RNA, 19 nt, Homo sapiens
aaaaggaacgcuaugauua

SEQ ID NO: 671421 - RNA, 19 nt, Homo sapiens
acacacacauauacacaug

SEQ ID NO: 671422 - RNA, 19 nt, Homo sapiens
gagauguuggccauuauuu

SEQ ID NO: 671423 - RNA, 19 nt, Homo sapiens
ugaauuaaucuccacguuu

SEQ ID NO: 671424 - RNA, 19 nt, Homo sapiens
aguuaagucucuccaaauu

SEQ ID NO: 671425 - RNA, 19 nt, Homo sapiens
gauuaugccaagaaacuaa

SEQ ID NO: 671426 - RNA, 19 nt, Homo sapiens
ccaaaaccaugucaacaaa

SEQ ID NO: 671427 - RNA, 19 nt, Homo sapiens
ggaugcaguaggacaauuu

SEQ ID NO: 671428 - RNA, 19 nt, Homo sapiens
ccaaaggacuggacuguua

SEQ ID NO: 671429 - RNA, 19 nt, Homo sapiens
caaagggucuggagcauua

SEQ ID NO: 671430 - RNA, 19 nt, Homo sapiens
gcacagaacuuuacagaag

SEQ ID NO: 671431 - RNA, 19 nt, Homo sapiens
uaagagagcugaugcuuga

SEQ ID NO: 671432 - RNA, 19 nt, Homo sapiens
ggaaauagaugugauagug

SEQ ID NO: 671433 - RNA, 19 nt, Homo sapiens
caagacagaugcagaauau

SEQ ID NO: 671434 - RNA, 19 nt, Homo sapiens
gaucugggauuccuacuuu

SEQ ID NO: 671435 - RNA, 19 nt, Homo sapiens
ucaaagugcucaaauggua

SEQ ID NO: 671436 - RNA, 19 nt, Homo sapiens
gcucagagauaguaaaguu

SEQ ID NO: 671437 - RNA, 19 nt, Homo sapiens
aagauuggcugcacaguua

SEQ ID NO: 671438 - RNA, 19 nt, Homo sapiens
guacagaggauuugccuua

SEQ ID NO: 671439 - RNA, 19 nt, Homo sapiens
caaggucucucaguuauaa

SEQ ID NO: 671440 - RNA, 19 nt, Homo sapiens
gaacaaaucagaagggaau

SEQ ID NO: 671441 - RNA, 19 nt, Homo sapiens
auacagagaucucaucaaa

SEQ ID NO: 671442 - RNA, 19 nt, Homo sapiens
gccaaacccugaaggauuu

SEQ ID NO: 671443 - RNA, 19 nt, Homo sapiens
gaaaugaguccucuggaaa

SEQ ID NO: 671444 - RNA, 19 nt, Homo sapiens
gaaugcacguuauaacuug

SEQ ID NO: 671445 - RNA, 19 nt, Homo sapiens
ggagaaaauugcacgauua

SEQ ID NO: 671446 - RNA, 19 nt, Homo sapiens
ggaagagcguggccagaaa

SEQ ID NO: 671447 - RNA, 19 nt, Homo sapiens
agacagaugcagaauauua

SEQ ID NO: 671448 - RNA, 19 nt, Homo sapiens
gcaaaggugacgaaacaua

SEQ ID NO: 671449 - RNA, 19 nt, Homo sapiens
uuacugagcucuaccgauu

SEQ ID NO: 671450 - RNA, 19 nt, Homo sapiens
cuacggagcacgagaaaua

SEQ ID NO: 671451 - RNA, 19 nt, Homo sapiens
gauggaagccucuuuguau

SEQ ID NO: 671452 - RNA, 19 nt, Homo sapiens
gcagugagcuaagaaagga

SEQ ID NO: 671453 - RNA, 19 nt, Homo sapiens
gcugcaagauagcaaauuu

SEQ ID NO: 671454 - RNA, 19 nt, Homo sapiens
ggucuaaaguguuugauuc

SEQ ID NO: 671455 - RNA, 19 nt, Homo sapiens
cgacauugcucccucuuug

SEQ ID NO: 671456 - RNA, 19 nt, Homo sapiens
agacugaacugaacaagga

SEQ ID NO: 671457 - RNA, 19 nt, Homo sapiens
gcagauauuuacuguguuc

SEQ ID NO: 671458 - RNA, 19 nt, Homo sapiens
ccacaaaacucacacaaaa

SEQ ID NO: 671459 - RNA, 19 nt, Homo sapiens
acacaaaucuucaggauac

SEQ ID NO: 671460 - RNA, 19 nt, Homo sapiens
gaacaucgacaucggaaga

SEQ ID NO: 671461 - RNA, 19 nt, Homo sapiens
ggaguucucugcuuguaug

SEQ ID NO: 671462 - RNA, 19 nt, Homo sapiens
gaaaggacauuuauaucac

SEQ ID NO: 671463 - RNA, 19 nt, Homo sapiens
acagagaucucaucaaagu

SEQ ID NO: 671464 - RNA, 19 nt, Homo sapiens
gaaguuacgauguucauug

SEQ ID NO: 671465 - RNA, 19 nt, Homo sapiens
acacaaacauucccgagaa

SEQ ID NO: 671466 - RNA, 19 nt, Homo sapiens
gcagauauaugcugugacu

SEQ ID NO: 671467 - RNA, 19 nt, Homo sapiens
ggcagaagcucaguauuug

SEQ ID NO: 671468 - RNA, 19 nt, Homo sapiens
gcugaaguaagcaauauua

SEQ ID NO: 671469 - RNA, 19 nt, Homo sapiens
ggagagaacgucauuauac

SEQ ID NO: 671470 - RNA, 19 nt, Homo sapiens
cuucugaacuucuauaaga

SEQ ID NO: 671471 - RNA, 19 nt, Homo sapiens
ccaagaacaugucggauag

SEQ ID NO: 671472 - RNA, 19 nt, Homo sapiens
ccagaguucuucagaguug

SEQ ID NO: 671473 - RNA, 19 nt, Homo sapiens
gcauauacccuccucuuau

SEQ ID NO: 671474 - RNA, 19 nt, Homo sapiens
gcaguuuccuuacagcuau

SEQ ID NO: 671475 - RNA, 19 nt, Homo sapiens
gagagugagugguaccaaa

SEQ ID NO: 671476 - RNA, 19 nt, Homo sapiens
gaacaaggaggagauguau

SEQ ID NO: 671477 - RNA, 19 nt, Homo sapiens
uggagagguuguuagauua

SEQ ID NO: 671478 - RNA, 19 nt, Homo sapiens
ggucugaacugcugaaacu

SEQ ID NO: 671479 - RNA, 19 nt, Homo sapiens
gcacggagacauugaacaa

SEQ ID NO: 671480 - RNA, 19 nt, Homo sapiens
uaacuugacuggcuccaau

SEQ ID NO: 671481 - RNA, 19 nt, Homo sapiens
gagaggagcuggaggucau

SEQ ID NO: 671482 - RNA, 19 nt, Homo sapiens
gcagugggauuucuucucu

SEQ ID NO: 671483 - RNA, 19 nt, Homo sapiens
ggaaaagcgugaaguggua

SEQ ID NO: 671484 - RNA, 19 nt, Homo sapiens
gcccggagauguuuccaaa

SEQ ID NO: 671485 - RNA, 19 nt, Homo sapiens
ugaagagccucauguguuc

SEQ ID NO: 671486 - RNA, 19 nt, Homo sapiens
ggaggaaauagaugugaua

SEQ ID NO: 671487 - RNA, 19 nt, Homo sapiens
gaacagaaggaccugauca

SEQ ID NO: 671488 - RNA, 19 nt, Homo sapiens
gugcauaagugugaagaaa

SEQ ID NO: 671489 - RNA, 19 nt, Homo sapiens
gaaggaagccaagaacaug

SEQ ID NO: 671490 - RNA, 19 nt, Homo sapiens
agaaagcucugaugaaguc

SEQ ID NO: 671491 - RNA, 19 nt, Homo sapiens
gaacuucuauaagacugaa

SEQ ID NO: 671492 - RNA, 19 nt, Homo sapiens
acacuuacauugagaguca

SEQ ID NO: 671493 - RNA, 19 nt, Homo sapiens
caagauagcaaauuucauc

SEQ ID NO: 671494 - RNA, 19 nt, Homo sapiens
aaacacaaaucuucaggau

SEQ ID NO: 671495 - RNA, 19 nt, Homo sapiens
caaugcagguuuagcaguu

SEQ ID NO: 671496 - RNA, 19 nt, Homo sapiens
aaagagaaccggccaauca

SEQ ID NO: 671497 - RNA, 19 nt, Homo sapiens
gaagacaucagcauuacug

SEQ ID NO: 671498 - RNA, 19 nt, Homo sapiens
ugaagacucuguuaucaca

SEQ ID NO: 671499 - RNA, 19 nt, Homo sapiens
gaaauuggagauacaguuc

SEQ ID NO: 671500 - RNA, 19 nt, Homo sapiens
gcaauugaagugcuagaaa

SEQ ID NO: 671501 - RNA, 19 nt, Homo sapiens
gagagaacgucauuauacu

SEQ ID NO: 671502 - RNA, 19 nt, Homo sapiens
agaaggaccugaucaugug

SEQ ID NO: 671503 - RNA, 19 nt, Homo sapiens
gaaaggagagaagaaguug

SEQ ID NO: 671504 - RNA, 19 nt, Homo sapiens
ugccagagcuucuccuuug

SEQ ID NO: 671505 - RNA, 19 nt, Homo sapiens
ugaaucacaucuggaaauu

SEQ ID NO: 671506 - RNA, 19 nt, Homo sapiens
aaauaugggucuaaagugu

SEQ ID NO: 671507 - RNA, 19 nt, Homo sapiens
gaagaaguuguuuggguuu

SEQ ID NO: 671508 - RNA, 19 nt, Homo sapiens
ucacagaaaugacaucaac

SEQ ID NO: 671509 - RNA, 19 nt, Homo sapiens
gccaagaacaugucggaua

SEQ ID NO: 671510 - RNA, 19 nt, Homo sapiens
cagcugaagacucugauua

SEQ ID NO: 671511 - RNA, 19 nt, Homo sapiens
agaaaugaguccucuggaa

SEQ ID NO: 671512 - RNA, 19 nt, Homo sapiens
gagaacgucauuauacuug

SEQ ID NO: 671513 - RNA, 19 nt, Homo sapiens
ccucuuauaugacgagcua

SEQ ID NO: 671514 - RNA, 19 nt, Homo sapiens
gaucaugugugcacguauc

SEQ ID NO: 671515 - RNA, 19 nt, Homo sapiens
gaaggcacaagaauacauu

SEQ ID NO: 671516 - RNA, 19 nt, Homo sapiens
cuggauaccuuauuuggaa

SEQ ID NO: 671517 - RNA, 19 nt, Homo sapiens
ggcugucucucuaaauuaa

SEQ ID NO: 671518 - RNA, 19 nt, Homo sapiens
aagggaauauucaucagua

SEQ ID NO: 671519 - RNA, 19 nt, Homo sapiens
gcuaagaaaggacauuuau

SEQ ID NO: 671520 - RNA, 19 nt, Homo sapiens
gacgugaagcgccacauua

SEQ ID NO: 671521 - RNA, 19 nt, Homo sapiens
agaggaugcuguuuaauca

SEQ ID NO: 671522 - RNA, 19 nt, Homo sapiens
uggcaucucucgcugguuu

SEQ ID NO: 671523 - RNA, 19 nt, Homo sapiens
agagaaugcugaacgaguu

SEQ ID NO: 671524 - RNA, 19 nt, Homo sapiens
gcacuugcauacagagauc

SEQ ID NO: 671525 - RNA, 19 nt, Homo sapiens
acacagagagugaguggua

SEQ ID NO: 671526 - RNA, 19 nt, Homo sapiens
ggaaauuggagauacaguu

SEQ ID NO: 671527 - RNA, 19 nt, Homo sapiens
gaagucgagcuuagggaua

SEQ ID NO: 671528 - RNA, 19 nt, Homo sapiens
ggauauagcuguucagaaa

SEQ ID NO: 671529 - RNA, 19 nt, Homo sapiens
guaaagagcuggaggaguu

SEQ ID NO: 671530 - RNA, 19 nt, Homo sapiens
gauccaagcugcgugauua

SEQ ID NO: 671531 - RNA, 19 nt, Homo sapiens
guacauaaccgcgcuauua

SEQ ID NO: 671532 - RNA, 19 nt, Homo sapiens
gcacguguaugaccucuuu

SEQ ID NO: 671533 - RNA, 19 nt, Homo sapiens
gaaaugugcugccguagau

SEQ ID NO: 671534 - RNA, 19 nt, Homo sapiens
gaagagcguuucaaugaga

SEQ ID NO: 671535 - RNA, 19 nt, Homo sapiens
caccaaggcuggcagaaua

SEQ ID NO: 671536 - RNA, 19 nt, Homo sapiens
agaaagccgugaaggauua

SEQ ID NO: 671537 - RNA, 19 nt, Homo sapiens
ggagaaauauaaacccuau

SEQ ID NO: 671538 - RNA, 19 nt, Homo sapiens
ggaaaugccuuacuucacu

SEQ ID NO: 671539 - RNA, 19 nt, Homo sapiens
gcacgucugcgaaguguua

SEQ ID NO: 671540 - RNA, 19 nt, Homo sapiens
aaacaagacuccaguaaag

SEQ ID NO: 671541 - RNA, 19 nt, Homo sapiens
acauguggcuagaguauua

SEQ ID NO: 671542 - RNA, 19 nt, Homo sapiens
gaaaguaaaggauuugguu

SEQ ID NO: 671543 - RNA, 19 nt, Homo sapiens
ggacagagagcacguguau

SEQ ID NO: 671544 - RNA, 19 nt, Homo sapiens
gaugugguguccugagaua

SEQ ID NO: 671545 - RNA, 19 nt, Homo sapiens
gcacuucccuagagaaaca

SEQ ID NO: 671546 - RNA, 19 nt, Homo sapiens
ggagagacauggaguugau

SEQ ID NO: 671547 - RNA, 19 nt, Homo sapiens
gaagggaggccaauguuug

SEQ ID NO: 671548 - RNA, 19 nt, Homo sapiens
gcagaaagcucgggaacuc

SEQ ID NO: 671549 - RNA, 19 nt, Homo sapiens
gcaauaacaugcagaaagc

SEQ ID NO: 671550 - RNA, 19 nt, Homo sapiens
guacagcacuucccuagag

SEQ ID NO: 671551 - RNA, 19 nt, Homo sapiens
gcauucaguugaucuuuga

SEQ ID NO: 671552 - RNA, 19 nt, Homo sapiens
gaggagcaguugucuauca

SEQ ID NO: 671553 - RNA, 19 nt, Homo sapiens
gcagaauauuugcaacauu

SEQ ID NO: 671554 - RNA, 19 nt, Homo sapiens
ccgauuagcucgugucaau

SEQ ID NO: 671555 - RNA, 19 nt, Homo sapiens
gacaggaaaugccuuacuu

SEQ ID NO: 671556 - RNA, 19 nt, Homo sapiens
gaaugaaggcugcagagaa

SEQ ID NO: 671557 - RNA, 19 nt, Homo sapiens
gaucgacaacugaaaguaa

SEQ ID NO: 671558 - RNA, 19 nt, Homo sapiens
guaccuagaucgacaacug

SEQ ID NO: 671559 - RNA, 19 nt, Homo sapiens
gaaaguucgcuccguguuu

SEQ ID NO: 671560 - RNA, 19 nt, Homo sapiens
aaacugacguucucuucaa

SEQ ID NO: 671561 - RNA, 19 nt, Homo sapiens
ugagggaagucagcuauaa

SEQ ID NO: 671562 - RNA, 19 nt, Homo sapiens
ggagacaggaaaugccuua

SEQ ID NO: 671563 - RNA, 19 nt, Homo sapiens
gcaugacuaucaaagagaa

SEQ ID NO: 671564 - RNA, 19 nt, Homo sapiens
caaacaagacuccaguaaa

SEQ ID NO: 671565 - RNA, 19 nt, Homo sapiens
guacucaguuggugggauu

SEQ ID NO: 671566 - RNA, 19 nt, Homo sapiens
ggacgcagcugucucuacu

SEQ ID NO: 671567 - RNA, 19 nt, Homo sapiens
uggaagagcguuucaauga

SEQ ID NO: 671568 - RNA, 19 nt, Homo sapiens
gagaggaggaugagguuaa

SEQ ID NO: 671569 - RNA, 19 nt, Homo sapiens
uguaugaccucuuugagaa

SEQ ID NO: 671570 - RNA, 19 nt, Homo sapiens
acagagagcacguguauga

SEQ ID NO: 671571 - RNA, 19 nt, Homo sapiens
gcagaagggucgagaacag

SEQ ID NO: 671572 - RNA, 19 nt, Homo sapiens
guacucagaugugcauuca

SEQ ID NO: 671573 - RNA, 19 nt, Homo sapiens
gagcagaugaggacgauga

SEQ ID NO: 671574 - RNA, 19 nt, Homo sapiens
caacugaaaguaaaggauu

SEQ ID NO: 671575 - RNA, 19 nt, Homo sapiens
gaacuagaagaaaucugua

SEQ ID NO: 671576 - RNA, 19 nt, Homo sapiens
ggaacuagaagaaaucugu

SEQ ID NO: 671577 - RNA, 19 nt, Homo sapiens
gaacugggcuaggauugag

SEQ ID NO: 671578 - RNA, 19 nt, Homo sapiens
uaaagaggaacuagaagaa

SEQ ID NO: 671579 - RNA, 19 nt, Homo sapiens
ggaagagcguuucaaugag

SEQ ID NO: 671580 - RNA, 19 nt, Homo sapiens
caacugccauguggacuug

SEQ ID NO: 671581 - RNA, 19 nt, Homo sapiens
guaccuugcuuuaccuaau

SEQ ID NO: 671582 - RNA, 19 nt, Homo sapiens
gaucagaggcccagagaag

SEQ ID NO: 671583 - RNA, 19 nt, Homo sapiens
gagaaagccgugaaggauu

SEQ ID NO: 671584 - RNA, 19 nt, Homo sapiens
uaccuugcuuuaccuaaua

SEQ ID NO: 671585 - RNA, 19 nt, Homo sapiens
gauuagcucgugucaauga

SEQ ID NO: 671586 - RNA, 19 nt, Homo sapiens
ucucucgucuguugguuua

SEQ ID NO: 671587 - RNA, 19 nt, Homo sapiens
caaaugcaaacuucaauuc

SEQ ID NO: 671588 - RNA, 19 nt, Homo sapiens
caaagagaacaucaucaaa

SEQ ID NO: 671589 - RNA, 19 nt, Homo sapiens
ggacagcaucaccgucuuu

SEQ ID NO: 671590 - RNA, 19 nt, Homo sapiens
ggaaaugugcugccguaga

SEQ ID NO: 671591 - RNA, 19 nt, Homo sapiens
caacauguggcuagaguau

SEQ ID NO: 671592 - RNA, 19 nt, Homo sapiens
gcucgacugugcaauaaca

SEQ ID NO: 671593 - RNA, 19 nt, Homo sapiens
gaacuauaacaaagcacua

SEQ ID NO: 671594 - RNA, 19 nt, Homo sapiens
ugucagcccuuguuucaug

SEQ ID NO: 671595 - RNA, 19 nt, Homo sapiens
ucaaagagaacaucaucaa

SEQ ID NO: 671596 - RNA, 19 nt, Homo sapiens
caaccgggcuggcaaacca

SEQ ID NO: 671597 - RNA, 19 nt, Homo sapiens
caacgucuaugacuacaac

SEQ ID NO: 671598 - RNA, 19 nt, Homo sapiens
gaagucagcuauaaaacau

SEQ ID NO: 671599 - RNA, 19 nt, Homo sapiens
aagaggaacuagaagaaau

SEQ ID NO: 671600 - RNA, 19 nt, Homo sapiens
ucaaacaagacuccaguaa

SEQ ID NO: 671601 - RNA, 19 nt, Homo sapiens
cugauuauguggagauuug

SEQ ID NO: 671602 - RNA, 19 nt, Homo sapiens
aaaguucgcuccguguuug

SEQ ID NO: 671603 - RNA, 19 nt, Homo sapiens
gauuacauuuguccuaaca

SEQ ID NO: 671604 - RNA, 19 nt, Homo sapiens
cgugaaggauuacauuugu

SEQ ID NO: 671605 - RNA, 19 nt, Homo sapiens
gaaauggcagaugcuagua

SEQ ID NO: 671606 - RNA, 19 nt, Homo sapiens
aagagaacaucaucaaagu

SEQ ID NO: 671607 - RNA, 19 nt, Homo sapiens
aaagggcucucucgucugu

SEQ ID NO: 671608 - RNA, 19 nt, Homo sapiens
gaagauggacggcaugacu

SEQ ID NO: 671609 - RNA, 19 nt, Homo sapiens
gagcacgucugcgaagugu

SEQ ID NO: 671610 - RNA, 19 nt, Homo sapiens
gaggcucgacugugcaaua

SEQ ID NO: 671611 - RNA, 19 nt, Homo sapiens
cauaaccgcgcuauuagaa

SEQ ID NO: 671612 - RNA, 19 nt, Homo sapiens
gccagaagaugagugaaau

SEQ ID NO: 671613 - RNA, 19 nt, Homo sapiens
caccugcuguggacuguuu

SEQ ID NO: 671614 - RNA, 19 nt, Homo sapiens
ucagugcucccucauauug

SEQ ID NO: 671615 - RNA, 19 nt, Homo sapiens
ggaggccaauguuuguuuc

SEQ ID NO: 671616 - RNA, 19 nt, Homo sapiens
cagaggaaaugccaaguac

SEQ ID NO: 671617 - RNA, 19 nt, Homo sapiens
ucuguugguuuacauauga

SEQ ID NO: 671618 - RNA, 19 nt, Homo sapiens
gaaggacgcagcugucucu

SEQ ID NO: 671619 - RNA, 19 nt, Homo sapiens
ccagaggaaaugccaagua

SEQ ID NO: 671620 - RNA, 19 nt, Homo sapiens
ggccacauuugcagaguau

SEQ ID NO: 671621 - RNA, 19 nt, Homo sapiens
caugucaaaugcaaacuuc

SEQ ID NO: 671622 - RNA, 19 nt, Homo sapiens
acacaguuguccaaauguu

SEQ ID NO: 671623 - RNA, 19 nt, Homo sapiens
ggacaaggagaaagguguu

SEQ ID NO: 671624 - RNA, 19 nt, Homo sapiens
gagggaagucagcuauaaa

SEQ ID NO: 671625 - RNA, 19 nt, Homo sapiens
aaagagaacaucaucaaag

SEQ ID NO: 671626 - RNA, 19 nt, Homo sapiens
aaugaaggcugcagagaag

SEQ ID NO: 671627 - RNA, 19 nt, Homo sapiens
ucaaugagcagagaaugaa

SEQ ID NO: 671628 - RNA, 19 nt, Homo sapiens
ggaaauaccuguuauacua

SEQ ID NO: 671629 - RNA, 19 nt, Homo sapiens
cauaauaucugagcaguua

SEQ ID NO: 671630 - RNA, 19 nt, Homo sapiens
ggauagugcuuuacucuuu

SEQ ID NO: 671631 - RNA, 19 nt, Homo sapiens
gaaagacacuccaacuaau

SEQ ID NO: 671632 - RNA, 19 nt, Homo sapiens
cagcaggaauuacuucuua

SEQ ID NO: 671633 - RNA, 19 nt, Homo sapiens
gguaauaggcaaagauuua

SEQ ID NO: 671634 - RNA, 19 nt, Homo sapiens
gaacauuuccuucauauuc

SEQ ID NO: 671635 - RNA, 19 nt, Homo sapiens
gaacaaaugcgacagcaaa

SEQ ID NO: 671636 - RNA, 19 nt, Homo sapiens
caaaggagauauagcaguu

SEQ ID NO: 671637 - RNA, 19 nt, Homo sapiens
guaacauucuggcaaauaa

SEQ ID NO: 671638 - RNA, 19 nt, Homo sapiens
gaaaguccuucugauaauu

SEQ ID NO: 671639 - RNA, 19 nt, Homo sapiens
ugagagaguuucaucagua

SEQ ID NO: 671640 - RNA, 19 nt, Homo sapiens
gaaaauaacaccacaagua

SEQ ID NO: 671641 - RNA, 19 nt, Homo sapiens
gcaaaugguuucacagcaa

SEQ ID NO: 671642 - RNA, 19 nt, Homo sapiens
aaggaaagcuggacuuaaa

SEQ ID NO: 671643 - RNA, 19 nt, Homo sapiens
guacagaaguaaagcagaa

SEQ ID NO: 671644 - RNA, 19 nt, Homo sapiens
gcuccaggauuuguaauua

SEQ ID NO: 671645 - RNA, 19 nt, Homo sapiens
agauuuagcuccaggauuu

SEQ ID NO: 671646 - RNA, 19 nt, Homo sapiens
ggaaaugccuuguggaaac

SEQ ID NO: 671647 - RNA, 19 nt, Homo sapiens
ucacaucacuguacauaau

SEQ ID NO: 671648 - RNA, 19 nt, Homo sapiens
gaacaucuccauccuacaa

SEQ ID NO: 671649 - RNA, 19 nt, Homo sapiens
cgaaagacacuccaacuaa

SEQ ID NO: 671650 - RNA, 19 nt, Homo sapiens
ggacagaccucaggaugau

SEQ ID NO: 671651 - RNA, 19 nt, Homo sapiens
ggaaagcuggacuuaaaua

SEQ ID NO: 671652 - RNA, 19 nt, Homo sapiens
caaggaacuucuagccaua

SEQ ID NO: 671653 - RNA, 19 nt, Homo sapiens
gaacaaacugcuuucgaaa

SEQ ID NO: 671654 - RNA, 19 nt, Homo sapiens
gaaagcuggacuuaaauaa

SEQ ID NO: 671655 - RNA, 19 nt, Homo sapiens
ugaacaaacugcuuucgaa

SEQ ID NO: 671656 - RNA, 19 nt, Homo sapiens
aaagggcacucuaugaauu

SEQ ID NO: 671657 - RNA, 19 nt, Homo sapiens
gaaaagaagguguaucaua

SEQ ID NO: 671658 - RNA, 19 nt, Homo sapiens
cuacaccaauuacuucuaa

SEQ ID NO: 671659 - RNA, 19 nt, Homo sapiens
caacaagaacuccuagaaa

SEQ ID NO: 671660 - RNA, 19 nt, Homo sapiens
ugaaggugaucucuuguuu

SEQ ID NO: 671661 - RNA, 19 nt, Homo sapiens
guaaggaaauaccuguuau

SEQ ID NO: 671662 - RNA, 19 nt, Homo sapiens
gauuugaguucaguguuua

SEQ ID NO: 671663 - RNA, 19 nt, Homo sapiens
gaaacagcaugagaacuug

SEQ ID NO: 671664 - RNA, 19 nt, Homo sapiens
caaagaaugcacaguauga

SEQ ID NO: 671665 - RNA, 19 nt, Homo sapiens
ggacguuaauuguuugaau

SEQ ID NO: 671666 - RNA, 19 nt, Homo sapiens
caucucaccuuuagaccua

SEQ ID NO: 671667 - RNA, 19 nt, Homo sapiens
ugaagcagaugcaaauguu

SEQ ID NO: 671668 - RNA, 19 nt, Homo sapiens
gaauacaggugguuuuaaa

SEQ ID NO: 671669 - RNA, 19 nt, Homo sapiens
gcagaagcuucaagaguuc

SEQ ID NO: 671670 - RNA, 19 nt, Homo sapiens
gcaacaagaacuccuagaa

SEQ ID NO: 671671 - RNA, 19 nt, Homo sapiens
agaagacacuguuuauuca

SEQ ID NO: 671672 - RNA, 19 nt, Homo sapiens
gggcauauaccguaacauu

SEQ ID NO: 671673 - RNA, 19 nt, Homo sapiens
gcggaaggauggaaauguu

SEQ ID NO: 671674 - RNA, 19 nt, Homo sapiens
cuucuugccuucuguuaua

SEQ ID NO: 671675 - RNA, 19 nt, Homo sapiens
ugaaaguccuucugauaau

SEQ ID NO: 671676 - RNA, 19 nt, Homo sapiens
gguccaaucagauacaaua

SEQ ID NO: 671677 - RNA, 19 nt, Homo sapiens
cagcaaagaaugcacagua

SEQ ID NO: 671678 - RNA, 19 nt, Homo sapiens
gaagaacucuaagccagau

SEQ ID NO: 671679 - RNA, 19 nt, Homo sapiens
guuaaagguucguuguauu

SEQ ID NO: 671680 - RNA, 19 nt, Homo sapiens
gaagagaggcacagacaca

SEQ ID NO: 671681 - RNA, 19 nt, Homo sapiens
guuuaaggauucuaccuaa

SEQ ID NO: 671682 - RNA, 19 nt, Homo sapiens
gaaaugccuuguggaaaca

SEQ ID NO: 671683 - RNA, 19 nt, Homo sapiens
cagaagacacuguuuauuc

SEQ ID NO: 671684 - RNA, 19 nt, Homo sapiens
cgagguauuucaaggugua

SEQ ID NO: 671685 - RNA, 19 nt, Homo sapiens
caaauugcagcacuacuuu

SEQ ID NO: 671686 - RNA, 19 nt, Homo sapiens
gcucaaugcuucgaauuca

SEQ ID NO: 671687 - RNA, 19 nt, Homo sapiens
gaaggugcgguccagguua

SEQ ID NO: 671688 - RNA, 19 nt, Homo sapiens
aaagauagaggacgagaaa

SEQ ID NO: 671689 - RNA, 19 nt, Homo sapiens
gaagcagaugcaaauguua

SEQ ID NO: 671690 - RNA, 19 nt, Homo sapiens
cauuagagguacccacaaa

SEQ ID NO: 671691 - RNA, 19 nt, Homo sapiens
gagcccaucucaccuuuag

SEQ ID NO: 671692 - RNA, 19 nt, Homo sapiens
cagcaacgcauucuaauuc

SEQ ID NO: 671693 - RNA, 19 nt, Homo sapiens
ucacagcaacgcauucuaa

SEQ ID NO: 671694 - RNA, 19 nt, Homo sapiens
ucucuuccuuucucaaaua

SEQ ID NO: 671695 - RNA, 19 nt, Homo sapiens
gcacguguuguuuacauuu

SEQ ID NO: 671696 - RNA, 19 nt, Homo sapiens
ucaagucaguucuuuguca

SEQ ID NO: 671697 - RNA, 19 nt, Homo sapiens
ucacuagaaucucuuaagu

SEQ ID NO: 671698 - RNA, 19 nt, Homo sapiens
gcauuaugguccaaucaga

SEQ ID NO: 671699 - RNA, 19 nt, Homo sapiens
cgaaaucuauugaacaacu

SEQ ID NO: 671700 - RNA, 19 nt, Homo sapiens
aaacugcuuucgaaaucua

SEQ ID NO: 671701 - RNA, 19 nt, Homo sapiens
acaaacugcuuucgaaauc

SEQ ID NO: 671702 - RNA, 19 nt, Homo sapiens
gaacccagucugcaccuuu

SEQ ID NO: 671703 - RNA, 19 nt, Homo sapiens
auaaugacaugggcauaua

SEQ ID NO: 671704 - RNA, 19 nt, Homo sapiens
caggaugaauauuaucuga

SEQ ID NO: 671705 - RNA, 19 nt, Homo sapiens
ugauuugaguucaguguuu

SEQ ID NO: 671706 - RNA, 19 nt, Homo sapiens
uggagaagcagaagcaaua

SEQ ID NO: 671707 - RNA, 19 nt, Homo sapiens
cgaauucacucaaagaaaa

SEQ ID NO: 671708 - RNA, 19 nt, Homo sapiens
aagcuggacuuaaauaauc

SEQ ID NO: 671709 - RNA, 19 nt, Homo sapiens
gaacaggaaaugccuugug

SEQ ID NO: 671710 - RNA, 19 nt, Homo sapiens
cacaguaacaggaugaaua

SEQ ID NO: 671711 - RNA, 19 nt, Homo sapiens
caaaugaagcagaugcaaa

SEQ ID NO: 671712 - RNA, 19 nt, Homo sapiens
gcagcacuacuuuaaauau

SEQ ID NO: 671713 - RNA, 19 nt, Homo sapiens
gaugugaagucagaaguuc

SEQ ID NO: 671714 - RNA, 19 nt, Homo sapiens
gcaauugaacauauuagga

SEQ ID NO: 671715 - RNA, 19 nt, Homo sapiens
gaguuuauguguugagauc

SEQ ID NO: 671716 - RNA, 19 nt, Homo sapiens
guaaaucagcaacgaaaga

SEQ ID NO: 671717 - RNA, 19 nt, Homo sapiens
gaaagggcaguggcaagua

SEQ ID NO: 671718 - RNA, 19 nt, Homo sapiens
gaacacucccuaucaccaa

SEQ ID NO: 671719 - RNA, 19 nt, Homo sapiens
agacauuguucaacuguau

SEQ ID NO: 671720 - RNA, 19 nt, Homo sapiens
gauagugcuuuacucuuuc

SEQ ID NO: 671721 - RNA, 19 nt, Homo sapiens
caaauguuagugagaagua

SEQ ID NO: 671722 - RNA, 19 nt, Homo sapiens
gaguaaaucagcaacgaaa

SEQ ID NO: 671723 - RNA, 19 nt, Homo sapiens
aaugaaaguccuucugaua

SEQ ID NO: 671724 - RNA, 19 nt, Homo sapiens
gaaacaggaaguccaagug

SEQ ID NO: 671725 - RNA, 19 nt, Homo sapiens
ggacagugaugaagaugcu

SEQ ID NO: 671726 - RNA, 19 nt, Homo sapiens
gaaaucuauugaacaacug

SEQ ID NO: 671727 - RNA, 19 nt, Homo sapiens
guuauaagucucuuccuuu

SEQ ID NO: 671728 - RNA, 19 nt, Homo sapiens
aaacugggcugcuaaauaa

SEQ ID NO: 671729 - RNA, 19 nt, Homo sapiens
ggagaaggguacaauauaa

SEQ ID NO: 671730 - RNA, 19 nt, Homo sapiens
gaaacugggcugcuaaaua

SEQ ID NO: 671731 - RNA, 19 nt, Homo sapiens
gaaagacacuccaacuaau

SEQ ID NO: 671732 - RNA, 19 nt, Homo sapiens
cagcaggaauuacuucuua

SEQ ID NO: 671733 - RNA, 19 nt, Homo sapiens
gaacaaaugcgacagcaaa

SEQ ID NO: 671734 - RNA, 19 nt, Homo sapiens
caacuggaauugccuauga

SEQ ID NO: 671735 - RNA, 19 nt, Homo sapiens
gcaagaaacugggcugcua

SEQ ID NO: 671736 - RNA, 19 nt, Homo sapiens
gcaaaugguuucacagcaa

SEQ ID NO: 671737 - RNA, 19 nt, Homo sapiens
uaaaugcccuucuaggaaa

SEQ ID NO: 671738 - RNA, 19 nt, Homo sapiens
guacagaaguaaagcagaa

SEQ ID NO: 671739 - RNA, 19 nt, Homo sapiens
gaacaucuccauccuacaa

SEQ ID NO: 671740 - RNA, 19 nt, Homo sapiens
cgaaagacacuccaacuaa

SEQ ID NO: 671741 - RNA, 19 nt, Homo sapiens
ggacagaccucaggaugau

SEQ ID NO: 671742 - RNA, 19 nt, Homo sapiens
caaggaacuucuagccaua

SEQ ID NO: 671743 - RNA, 19 nt, Homo sapiens
caggagagcugaagaaugg

SEQ ID NO: 671744 - RNA, 19 nt, Homo sapiens
aaauacagcuuguucauuc

SEQ ID NO: 671745 - RNA, 19 nt, Homo sapiens
caccaaagcccgaauauga

SEQ ID NO: 671746 - RNA, 19 nt, Homo sapiens
gaagauauucuccaccaaa

SEQ ID NO: 671747 - RNA, 19 nt, Homo sapiens
gaacaaacugcuuucgaaa

SEQ ID NO: 671748 - RNA, 19 nt, Homo sapiens
cuuaguaucugcuggauuu

SEQ ID NO: 671749 - RNA, 19 nt, Homo sapiens
ugaacaaacugcuuucgaa

SEQ ID NO: 671750 - RNA, 19 nt, Homo sapiens
caacaagaacuccuagaaa

SEQ ID NO: 671751 - RNA, 19 nt, Homo sapiens
gaaacagcaugagaacuug

SEQ ID NO: 671752 - RNA, 19 nt, Homo sapiens
caaagaaugcacaguauga

SEQ ID NO: 671753 - RNA, 19 nt, Homo sapiens
guaaaugcccuucuaggaa

SEQ ID NO: 671754 - RNA, 19 nt, Homo sapiens
caucucaccuuuagaccua

SEQ ID NO: 671755 - RNA, 19 nt, Homo sapiens
gguguuggcucuagaagga

SEQ ID NO: 671756 - RNA, 19 nt, Homo sapiens
gcagaagcuucaagaguuc

SEQ ID NO: 671757 - RNA, 19 nt, Homo sapiens
gcaacaagaacuccuagaa

SEQ ID NO: 671758 - RNA, 19 nt, Homo sapiens
gaaauacagcuuguucauu

SEQ ID NO: 671759 - RNA, 19 nt, Homo sapiens
gcggaaggauggaaauguu

SEQ ID NO: 671760 - RNA, 19 nt, Homo sapiens
gaagaacucuaagccagau

SEQ ID NO: 671761 - RNA, 19 nt, Homo sapiens
cgaagcaauugaugacauu

SEQ ID NO: 671762 - RNA, 19 nt, Homo sapiens
cagcaaagaaugcacagua

SEQ ID NO: 671763 - RNA, 19 nt, Homo sapiens
gagagaccaacuaaauaua

SEQ ID NO: 671764 - RNA, 19 nt, Homo sapiens
gaagagaggcacagacaca

SEQ ID NO: 671765 - RNA, 19 nt, Homo sapiens
gagaaggguacaauauaaa

SEQ ID NO: 671766 - RNA, 19 nt, Homo sapiens
ugagcaugcuggacgaaua

SEQ ID NO: 671767 - RNA, 19 nt, Homo sapiens
gcucaaugcuucgaauuca

SEQ ID NO: 671768 - RNA, 19 nt, Homo sapiens
gaaggugcgguccagguua

SEQ ID NO: 671769 - RNA, 19 nt, Homo sapiens
aaagauagaggacgagaaa

SEQ ID NO: 671770 - RNA, 19 nt, Homo sapiens
ucagaagccuguguaaaug

SEQ ID NO: 671771 - RNA, 19 nt, Homo sapiens
cauuagagguacccacaaa

SEQ ID NO: 671772 - RNA, 19 nt, Homo sapiens
cagcaacgcauucuaauuc

SEQ ID NO: 671773 - RNA, 19 nt, Homo sapiens
ucacagcaacgcauucuaa

SEQ ID NO: 671774 - RNA, 19 nt, Homo sapiens
gagcccaucucaccuuuag

SEQ ID NO: 671775 - RNA, 19 nt, Homo sapiens
gguacaaagugacggcaaa

SEQ ID NO: 671776 - RNA, 19 nt, Homo sapiens
cgaaaucuauugaacaacu

SEQ ID NO: 671777 - RNA, 19 nt, Homo sapiens
aaacugcuuucgaaaucua

SEQ ID NO: 671778 - RNA, 19 nt, Homo sapiens
acaaacugcuuucgaaauc

SEQ ID NO: 671779 - RNA, 19 nt, Homo sapiens
gaacccagucugcaccuuu

SEQ ID NO: 671780 - RNA, 19 nt, Homo sapiens
gauuguagaucuggauguu

SEQ ID NO: 671781 - RNA, 19 nt, Homo sapiens
gcaagauauugauuguaga

SEQ ID NO: 671782 - RNA, 19 nt, Homo sapiens
uggagaagcagaagcaaua

SEQ ID NO: 671783 - RNA, 19 nt, Homo sapiens
cgaauucacucaaagaaaa

SEQ ID NO: 671784 - RNA, 19 nt, Homo sapiens
cgagcuggcuuccaaagug

SEQ ID NO: 671785 - RNA, 19 nt, Homo sapiens
guaaaucagcaacgaaaga

SEQ ID NO: 671786 - RNA, 19 nt, Homo sapiens
gaugugaagucagaaguuc

SEQ ID NO: 671787 - RNA, 19 nt, Homo sapiens
gaaagggcaguggcaagua

SEQ ID NO: 671788 - RNA, 19 nt, Homo sapiens
gaguaaaucagcaacgaaa

SEQ ID NO: 671789 - RNA, 19 nt, Homo sapiens
gagaccaacuaaauauaag

SEQ ID NO: 671790 - RNA, 19 nt, Homo sapiens
ugagagaccaacuaaauau

SEQ ID NO: 671791 - RNA, 19 nt, Homo sapiens
ggaaauacagcuuguucau

SEQ ID NO: 671792 - RNA, 19 nt, Homo sapiens
ggacagugaugaagaugcu

SEQ ID NO: 671793 - RNA, 19 nt, Homo sapiens
gaaaucuauugaacaacug

SEQ ID NO: 671794 - RNA, 19 nt, Homo sapiens
gcaaagaaugcacaguaug

SEQ ID NO: 671795 - RNA, 19 nt, Homo sapiens
cagaagaucauugaaauuc

SEQ ID NO: 671796 - RNA, 19 nt, Homo sapiens
gcaauuaccgccaaauacu

SEQ ID NO: 671797 - RNA, 19 nt, Homo sapiens
caacuggaaguguuacuga

SEQ ID NO: 671798 - RNA, 19 nt, Homo sapiens
agcagaagcuucaagaguu

SEQ ID NO: 671799 - RNA, 19 nt, Homo sapiens
agaaacagcaugagaacuu

SEQ ID NO: 671800 - RNA, 19 nt, Homo sapiens
uugaguaccuugaagcauu

SEQ ID NO: 671801 - RNA, 19 nt, Homo sapiens
caugggagauguugaguac

SEQ ID NO: 671802 - RNA, 19 nt, Homo sapiens
gauauugauuguagaucug

SEQ ID NO: 671803 - RNA, 19 nt, Homo sapiens
ccaugaaccugcuaagucu

SEQ ID NO: 671804 - RNA, 19 nt, Homo sapiens
ggauggaaauguugucacu

SEQ ID NO: 671805 - RNA, 19 nt, Homo sapiens
gcagcuuccuccucucaga

SEQ ID NO: 671806 - RNA, 19 nt, Homo sapiens
aagaauggguuugcuguug

SEQ ID NO: 671807 - RNA, 19 nt, Homo sapiens
caagaaacugggcugcuaa

SEQ ID NO: 671808 - RNA, 19 nt, Homo sapiens
ugaugaagaugcucagauc

SEQ ID NO: 671809 - RNA, 19 nt, Homo sapiens
uggcucagcuggucauuca

SEQ ID NO: 671810 - RNA, 19 nt, Homo sapiens
ccucugagcccaacuugaa

SEQ ID NO: 671811 - RNA, 19 nt, Homo sapiens
cuucaagaguuccuacuga

SEQ ID NO: 671812 - RNA, 19 nt, Homo sapiens
uggagaaggguacaauaua

SEQ ID NO: 671813 - RNA, 19 nt, Homo sapiens
gaauggguuugcuguugug

SEQ ID NO: 671814 - RNA, 19 nt, Homo sapiens
gaagaauggguuugcuguu

SEQ ID NO: 671815 - RNA, 19 nt, Homo sapiens
gaggaaauacagcuuguuc

SEQ ID NO: 671816 - RNA, 19 nt, Homo sapiens
cuaggaggguacaaaguga

SEQ ID NO: 671817 - RNA, 19 nt, Homo sapiens
ccacccucauguuacuuua

SEQ ID NO: 671818 - RNA, 19 nt, Homo sapiens
gcaagaacaggaaguagag

SEQ ID NO: 671819 - RNA, 19 nt, Homo sapiens
ugaagccuguggccaaaga

SEQ ID NO: 671820 - RNA, 19 nt, Homo sapiens
gagaauuucaccuggcauu

SEQ ID NO: 671821 - RNA, 19 nt, Homo sapiens
ucuuguagcugguggaguu

SEQ ID NO: 671822 - RNA, 19 nt, Homo sapiens
gacagaauccucagucagu

SEQ ID NO: 671823 - RNA, 19 nt, Homo sapiens
gcauaucaaggaacuucua

SEQ ID NO: 671824 - RNA, 19 nt, Homo sapiens
ucaucgagcuggcuuccaa

SEQ ID NO: 671825 - RNA, 19 nt, Homo sapiens
ggucacgacugcaagaaac

SEQ ID NO: 671826 - RNA, 19 nt, Homo sapiens
cugcagcauuuauuauuga

SEQ ID NO: 671827 - RNA, 19 nt, Homo sapiens
caacgcauucuaauucaug

SEQ ID NO: 671828 - RNA, 19 nt, Homo sapiens
aaacugggcugcuaaauaa

SEQ ID NO: 671829 - RNA, 19 nt, Homo sapiens
gaaacugggcugcuaaaua

SEQ ID NO: 671830 - RNA, 19 nt, Homo sapiens
gaaagacacuccaacuaau

SEQ ID NO: 671831 - RNA, 19 nt, Homo sapiens
cagcaggaauuacuucuua

SEQ ID NO: 671832 - RNA, 19 nt, Homo sapiens
gaacaaaugcgacagcaaa

SEQ ID NO: 671833 - RNA, 19 nt, Homo sapiens
caacuggaauugccuauga

SEQ ID NO: 671834 - RNA, 19 nt, Homo sapiens
gcaagaaacugggcugcua

SEQ ID NO: 671835 - RNA, 19 nt, Homo sapiens
caaaugagguucgguuuau

SEQ ID NO: 671836 - RNA, 19 nt, Homo sapiens
gcaaaugguuucacagcaa

SEQ ID NO: 671837 - RNA, 19 nt, Homo sapiens
guacagaaguaaagcagaa

SEQ ID NO: 671838 - RNA, 19 nt, Homo sapiens
gaacaucuccauccuacaa

SEQ ID NO: 671839 - RNA, 19 nt, Homo sapiens
cgaaagacacuccaacuaa

SEQ ID NO: 671840 - RNA, 19 nt, Homo sapiens
ggacagaccucaggaugau

SEQ ID NO: 671841 - RNA, 19 nt, Homo sapiens
caaggaacuucuagccaua

SEQ ID NO: 671842 - RNA, 19 nt, Homo sapiens
caggagagcugaagaaugg

SEQ ID NO: 671843 - RNA, 19 nt, Homo sapiens
aaauacagcuuguucauuc

SEQ ID NO: 671844 - RNA, 19 nt, Homo sapiens
gaacaaacugcuuucgaaa

SEQ ID NO: 671845 - RNA, 19 nt, Homo sapiens
ugaacaaacugcuuucgaa

SEQ ID NO: 671846 - RNA, 19 nt, Homo sapiens
caacaagaacuccuagaaa

SEQ ID NO: 671847 - RNA, 19 nt, Homo sapiens
gaaacagcaugagaacuug

SEQ ID NO: 671848 - RNA, 19 nt, Homo sapiens
caaagaaugcacaguauga

SEQ ID NO: 671849 - RNA, 19 nt, Homo sapiens
caucucaccuuuagaccua

SEQ ID NO: 671850 - RNA, 19 nt, Homo sapiens
gcagaagcuucaagaguuc

SEQ ID NO: 671851 - RNA, 19 nt, Homo sapiens
gcaacaagaacuccuagaa

SEQ ID NO: 671852 - RNA, 19 nt, Homo sapiens
gaaauacagcuuguucauu

SEQ ID NO: 671853 - RNA, 19 nt, Homo sapiens
gcggaaggauggaaauguu

SEQ ID NO: 671854 - RNA, 19 nt, Homo sapiens
gagguucgguuuauuucuu

SEQ ID NO: 671855 - RNA, 19 nt, Homo sapiens
gaagaacucuaagccagau

SEQ ID NO: 671856 - RNA, 19 nt, Homo sapiens
cagcaaagaaugcacagua

SEQ ID NO: 671857 - RNA, 19 nt, Homo sapiens
gagagaccaacuaaauaua

SEQ ID NO: 671858 - RNA, 19 nt, Homo sapiens
gaagagaggcacagacaca

SEQ ID NO: 671859 - RNA, 19 nt, Homo sapiens
ccaaaugagguucgguuua

SEQ ID NO: 671860 - RNA, 19 nt, Homo sapiens
ugagcaugcuggacgaaua

SEQ ID NO: 671861 - RNA, 19 nt, Homo sapiens
gcucaaugcuucgaauuca

SEQ ID NO: 671862 - RNA, 19 nt, Homo sapiens
gaaggugcgguccagguua

SEQ ID NO: 671863 - RNA, 19 nt, Homo sapiens
aaagauagaggacgagaaa

SEQ ID NO: 671864 - RNA, 19 nt, Homo sapiens
cauuagagguacccacaaa

SEQ ID NO: 671865 - RNA, 19 nt, Homo sapiens
cagcaacgcauucuaauuc

SEQ ID NO: 671866 - RNA, 19 nt, Homo sapiens
ucacagcaacgcauucuaa

SEQ ID NO: 671867 - RNA, 19 nt, Homo sapiens
gagcccaucucaccuuuag

SEQ ID NO: 671868 - RNA, 19 nt, Homo sapiens
cgaaaucuauugaacaacu

SEQ ID NO: 671869 - RNA, 19 nt, Homo sapiens
aaacugcuuucgaaaucua

SEQ ID NO: 671870 - RNA, 19 nt, Homo sapiens
acaaacugcuuucgaaauc

SEQ ID NO: 671871 - RNA, 19 nt, Homo sapiens
gaacccagucugcaccuuu

SEQ ID NO: 671872 - RNA, 19 nt, Homo sapiens
gauuguagaucuggauguu

SEQ ID NO: 671873 - RNA, 19 nt, Homo sapiens
gcaagauauugauuguaga

SEQ ID NO: 671874 - RNA, 19 nt, Homo sapiens
uggagaagcagaagcaaua

SEQ ID NO: 671875 - RNA, 19 nt, Homo sapiens
cgaauucacucaaagaaaa

SEQ ID NO: 671876 - RNA, 19 nt, Homo sapiens
cgagcuggcuuccaaagug

SEQ ID NO: 671877 - RNA, 19 nt, Homo sapiens
guaaaucagcaacgaaaga

SEQ ID NO: 671878 - RNA, 19 nt, Homo sapiens
gaaagggcaguggcaagua

SEQ ID NO: 671879 - RNA, 19 nt, Homo sapiens
gaugugaagucagaaguuc

SEQ ID NO: 671880 - RNA, 19 nt, Homo sapiens
gaguaaaucagcaacgaaa

SEQ ID NO: 671881 - RNA, 19 nt, Homo sapiens
gagaccaacuaaauauaag

SEQ ID NO: 671882 - RNA, 19 nt, Homo sapiens
ugagagaccaacuaaauau

SEQ ID NO: 671883 - RNA, 19 nt, Homo sapiens
ggaaauacagcuuguucau

SEQ ID NO: 671884 - RNA, 19 nt, Homo sapiens
ggacagugaugaagaugcu

SEQ ID NO: 671885 - RNA, 19 nt, Homo sapiens
gaaaucuauugaacaacug

SEQ ID NO: 671886 - RNA, 19 nt, Homo sapiens
gcaaagaaugcacaguaug

SEQ ID NO: 671887 - RNA, 19 nt, Homo sapiens
gcaauuaccgccaaauacu

SEQ ID NO: 671888 - RNA, 19 nt, Homo sapiens
caacuggaaguguuacuga

SEQ ID NO: 671889 - RNA, 19 nt, Homo sapiens
agcagaagcuucaagaguu

SEQ ID NO: 671890 - RNA, 19 nt, Homo sapiens
agaaacagcaugagaacuu

SEQ ID NO: 671891 - RNA, 19 nt, Homo sapiens
gauauugauuguagaucug

SEQ ID NO: 671892 - RNA, 19 nt, Homo sapiens
ccaugaaccugcuaagucu

SEQ ID NO: 671893 - RNA, 19 nt, Homo sapiens
ggauggaaauguugucacu

SEQ ID NO: 671894 - RNA, 19 nt, Homo sapiens
gcagcuuccuccucucaga

SEQ ID NO: 671895 - RNA, 19 nt, Homo sapiens
aagaauggguuugcuguug

SEQ ID NO: 671896 - RNA, 19 nt, Homo sapiens
caagaaacugggcugcuaa

SEQ ID NO: 671897 - RNA, 19 nt, Homo sapiens
ugaugaagaugcucagauc

SEQ ID NO: 671898 - RNA, 19 nt, Homo sapiens
uggcucagcuggucauuca

SEQ ID NO: 671899 - RNA, 19 nt, Homo sapiens
ccucugagcccaacuugaa

SEQ ID NO: 671900 - RNA, 19 nt, Homo sapiens
cuucaagaguuccuacuga

SEQ ID NO: 671901 - RNA, 19 nt, Homo sapiens
gaauggguuugcuguugug

SEQ ID NO: 671902 - RNA, 19 nt, Homo sapiens
gaagaauggguuugcuguu

SEQ ID NO: 671903 - RNA, 19 nt, Homo sapiens
gaggaaauacagcuuguuc

SEQ ID NO: 671904 - RNA, 19 nt, Homo sapiens
ccacccucauguuacuuua

SEQ ID NO: 671905 - RNA, 19 nt, Homo sapiens
gcaagaacaggaaguagag

SEQ ID NO: 671906 - RNA, 19 nt, Homo sapiens
gagaauuucaccuggcauu

SEQ ID NO: 671907 - RNA, 19 nt, Homo sapiens
ucuuguagcugguggaguu

SEQ ID NO: 671908 - RNA, 19 nt, Homo sapiens
gacagaauccucagucagu

SEQ ID NO: 671909 - RNA, 19 nt, Homo sapiens
gcauaucaaggaacuucua

SEQ ID NO: 671910 - RNA, 19 nt, Homo sapiens
ucaucgagcuggcuuccaa

SEQ ID NO: 671911 - RNA, 19 nt, Homo sapiens
ggucacgacugcaagaaac

SEQ ID NO: 671912 - RNA, 19 nt, Homo sapiens
cugcagcauuuauuauuga

SEQ ID NO: 671913 - RNA, 19 nt, Homo sapiens
caacgcauucuaauucaug

SEQ ID NO: 671914 - RNA, 19 nt, Homo sapiens
gaaaaugagacuucgguuu

SEQ ID NO: 671915 - RNA, 19 nt, Homo sapiens
acagaauccucagucagua

SEQ ID NO: 671916 - RNA, 19 nt, Homo sapiens
gagcacaagaugcaaagga

SEQ ID NO: 671917 - RNA, 19 nt, Homo sapiens
gcaacaccagcaauucuug

SEQ ID NO: 671918 - RNA, 19 nt, Homo sapiens
gcauucuaauucaugaaga

SEQ ID NO: 671919 - RNA, 19 nt, Homo sapiens
agagaggcaucgcagagaa

SEQ ID NO: 671920 - RNA, 19 nt, Homo sapiens
gcagaggcaagaacaggaa

SEQ ID NO: 671921 - RNA, 19 nt, Homo sapiens
gagcauaucaaggaacuuc

SEQ ID NO: 671922 - RNA, 19 nt, Homo sapiens
gcaacgcauucuaauucau

SEQ ID NO: 671923 - RNA, 19 nt, Homo sapiens
agcaagauauugauuguag

SEQ ID NO: 671924 - RNA, 19 nt, Homo sapiens
ccugcagcauuuauuauug

SEQ ID NO: 671925 - RNA, 19 nt, Homo sapiens
caguggaugugaagucaga

SEQ ID NO: 671926 - RNA, 19 nt, Homo sapiens
uggcauggauggauuagag

SEQ ID NO: 671927 - RNA, 19 nt, Homo sapiens
gcagauccacaugaacaaa

SEQ ID NO: 671928 - RNA, 19 nt, Homo sapiens
gaaguugucuugaaaguua

SEQ ID NO: 671929 - RNA, 19 nt, Homo sapiens
caagauaucugcuuugaaa

SEQ ID NO: 671930 - RNA, 19 nt, Homo sapiens
gcaaaugacuuaaguuuag

SEQ ID NO: 671931 - RNA, 19 nt, Homo sapiens
gaacugauuucaucucuug

SEQ ID NO: 671932 - RNA, 19 nt, Homo sapiens
gaugagaucuacagucuaa

SEQ ID NO: 671933 - RNA, 19 nt, Homo sapiens
gaaguacaacugcaaauua

SEQ ID NO: 671934 - RNA, 19 nt, Homo sapiens
ggacgaaugugaagaaaug

SEQ ID NO: 671935 - RNA, 19 nt, Homo sapiens
caacauugcucuuaauuuc

SEQ ID NO: 671936 - RNA, 19 nt, Homo sapiens
gaaagcagauuugauguga

SEQ ID NO: 671937 - RNA, 19 nt, Homo sapiens
caaaugaagguaccuauua

SEQ ID NO: 671938 - RNA, 19 nt, Homo sapiens
guaaauaacuugcgagagu

SEQ ID NO: 671939 - RNA, 19 nt, Homo sapiens
gauaaagcauggcagaauu

SEQ ID NO: 671940 - RNA, 19 nt, Homo sapiens
uaaagagguugcuagcuua

SEQ ID NO: 671941 - RNA, 19 nt, Homo sapiens
caagaaugcuguuuguauu

SEQ ID NO: 671942 - RNA, 19 nt, Homo sapiens
cucaagagaugcugaauua

SEQ ID NO: 671943 - RNA, 19 nt, Homo sapiens
gaacacugaggaauauuua

SEQ ID NO: 671944 - RNA, 19 nt, Homo sapiens
caagaaagaccucauuaaa

SEQ ID NO: 671945 - RNA, 19 nt, Homo sapiens
ccucaugguuuauucauua

SEQ ID NO: 671946 - RNA, 19 nt, Homo sapiens
cagauaauauggugucuaa

SEQ ID NO: 671947 - RNA, 19 nt, Homo sapiens
cauuaaagcucacgaaguu

SEQ ID NO: 671948 - RNA, 19 nt, Homo sapiens
gaacuucucuugcuguaca

SEQ ID NO: 671949 - RNA, 19 nt, Homo sapiens
gaagguaccuauuauaugc

SEQ ID NO: 671950 - RNA, 19 nt, Homo sapiens
ggagcuagcccuaagauuu

SEQ ID NO: 671951 - RNA, 19 nt, Homo sapiens
aaacugcucucauuuauuc

SEQ ID NO: 671952 - RNA, 19 nt, Homo sapiens
agaaacauguggaaugaua

SEQ ID NO: 671953 - RNA, 19 nt, Homo sapiens
ggaaagccagcacaucuua

SEQ ID NO: 671954 - RNA, 19 nt, Homo sapiens
gcaagucucuaucaggaaa

SEQ ID NO: 671955 - RNA, 19 nt, Homo sapiens
gaucuacagucuaagaauu

SEQ ID NO: 671956 - RNA, 19 nt, Homo sapiens
gaacacagaggaaguaugu

SEQ ID NO: 671957 - RNA, 19 nt, Homo sapiens
ggaaguaucuaguguuucu

SEQ ID NO: 671958 - RNA, 19 nt, Homo sapiens
ucagaaagcuaacgaugaa

SEQ ID NO: 671959 - RNA, 19 nt, Homo sapiens
gaaauaaugagagugguua

SEQ ID NO: 671960 - RNA, 19 nt, Homo sapiens
acacggaccucauauuuga

SEQ ID NO: 671961 - RNA, 19 nt, Homo sapiens
gaaguuaacacaagcuaaa

SEQ ID NO: 671962 - RNA, 19 nt, Homo sapiens
ucuggaagcucauagauaa

SEQ ID NO: 671963 - RNA, 19 nt, Homo sapiens
gaaucuuccuuccaugaua

SEQ ID NO: 671964 - RNA, 19 nt, Homo sapiens
gcaugcagcuuaagugaug

SEQ ID NO: 671965 - RNA, 19 nt, Homo sapiens
gaaaaggccucauuaaauc

SEQ ID NO: 671966 - RNA, 19 nt, Homo sapiens
gcagaaagagucaucauau

SEQ ID NO: 671967 - RNA, 19 nt, Homo sapiens
gaggaaguaugucagcuaa

SEQ ID NO: 671968 - RNA, 19 nt, Homo sapiens
gcuaaauccucaacacuga

SEQ ID NO: 671969 - RNA, 19 nt, Homo sapiens
agaagaugcuuuaaaggua

SEQ ID NO: 671970 - RNA, 19 nt, Homo sapiens
gcuaagagcucaugcaaaa

SEQ ID NO: 671971 - RNA, 19 nt, Homo sapiens
ucaauugcaucuugucuuu

SEQ ID NO: 671972 - RNA, 19 nt, Homo sapiens
caaggaaacuauagaaucu

SEQ ID NO: 671973 - RNA, 19 nt, Homo sapiens
gcugagagauggcuacaga

SEQ ID NO: 671974 - RNA, 19 nt, Homo sapiens
gauugaaguugucuugaaa

SEQ ID NO: 671975 - RNA, 19 nt, Homo sapiens
ucaagaaggacaagaauuu

SEQ ID NO: 671976 - RNA, 19 nt, Homo sapiens
ugacugagcuguguuuaga

SEQ ID NO: 671977 - RNA, 19 nt, Homo sapiens
agagauggcuacagaauau

SEQ ID NO: 671978 - RNA, 19 nt, Homo sapiens
gagagaacaugacuugcaa

SEQ ID NO: 671979 - RNA, 19 nt, Homo sapiens
agaaaggaaugacaguuaa

SEQ ID NO: 671980 - RNA, 19 nt, Homo sapiens
cgagagaaguggcaaccua

SEQ ID NO: 671981 - RNA, 19 nt, Homo sapiens
caacacugauuaacaagga

SEQ ID NO: 671982 - RNA, 19 nt, Homo sapiens
ccaaagcuccugaaguuaa

SEQ ID NO: 671983 - RNA, 19 nt, Homo sapiens
aaucaaagcugcacagaca

SEQ ID NO: 671984 - RNA, 19 nt, Homo sapiens
gaagaaggacgaaugugaa

SEQ ID NO: 671985 - RNA, 19 nt, Homo sapiens
ggacuuugguaaauaacuu

SEQ ID NO: 671986 - RNA, 19 nt, Homo sapiens
gcuaaggacuuugguaaau

SEQ ID NO: 671987 - RNA, 19 nt, Homo sapiens
gugcugaguuuaugggaua

SEQ ID NO: 671988 - RNA, 19 nt, Homo sapiens
caaaucaaguccaguuuua

SEQ ID NO: 671989 - RNA, 19 nt, Homo sapiens
cagcuuaagugauggguuu

SEQ ID NO: 671990 - RNA, 19 nt, Homo sapiens
gaccaaauacuuucaaaug

SEQ ID NO: 671991 - RNA, 19 nt, Homo sapiens
ucagaaacauguggaauga

SEQ ID NO: 671992 - RNA, 19 nt, Homo sapiens
uaaugagagugguuagaua

SEQ ID NO: 671993 - RNA, 19 nt, Homo sapiens
guaaaucacugaaccuuuu

SEQ ID NO: 671994 - RNA, 19 nt, Homo sapiens
gaagaugcaugcgaugaau

SEQ ID NO: 671995 - RNA, 19 nt, Homo sapiens
cuucugggcuucaauauga

SEQ ID NO: 671996 - RNA, 19 nt, Homo sapiens
agaaauagccgaagucaau

SEQ ID NO: 671997 - RNA, 19 nt, Homo sapiens
cuacagaacucagugaaga

SEQ ID NO: 671998 - RNA, 19 nt, Homo sapiens
uuaaagcucuuguggagaa

SEQ ID NO: 671999 - RNA, 19 nt, Homo sapiens
ggagaacuuugaggucuuu

SEQ ID NO: 672000 - RNA, 19 nt, Homo sapiens
uuaaagagguugcuagcuu

SEQ ID NO: 672001 - RNA, 19 nt, Homo sapiens
cuaaggacuuugguaaaua

SEQ ID NO: 672002 - RNA, 19 nt, Homo sapiens
acauggaacugcuuuauau

SEQ ID NO: 672003 - RNA, 19 nt, Homo sapiens
ccucaacacugauuaacaa

SEQ ID NO: 672004 - RNA, 19 nt, Homo sapiens
gaagacauccguggacauu

SEQ ID NO: 672005 - RNA, 19 nt, Homo sapiens
gagagugguuagauacauu

SEQ ID NO: 672006 - RNA, 19 nt, Homo sapiens
aaacaaacacuacucacua

SEQ ID NO: 672007 - RNA, 19 nt, Homo sapiens
gcuucaauaugauuccuua

SEQ ID NO: 672008 - RNA, 19 nt, Homo sapiens
ggaauggacucuugcaaaa

SEQ ID NO: 672009 - RNA, 19 nt, Homo sapiens
gcugaacacugaggaauau

SEQ ID NO: 672010 - RNA, 19 nt, Homo sapiens
gauguuggcugauaauguc

SEQ ID NO: 672011 - RNA, 19 nt, Homo sapiens
gaaggacgaaugugaagaa

SEQ ID NO: 672012 - RNA, 19 nt, Homo sapiens
ucacuucaauugcaucuug

SEQ ID NO: 672013 - RNA, 19 nt, Homo sapiens
guagaucacuucaauugca

SEQ ID NO: 672014 - RNA, 19 nt, Homo sapiens
gaacauggaacugcuuuau

SEQ ID NO: 672015 - RNA, 19 nt, Homo sapiens
uggaacaugucauaacuuu

SEQ ID NO: 672016 - RNA, 19 nt, Homo sapiens
agaaagaccucauuaaagc

SEQ ID NO: 672017 - RNA, 19 nt, Homo sapiens
aaagguagcccaagcguuu

SEQ ID NO: 672018 - RNA, 19 nt, Homo sapiens
ccacaucacucuuugaaac

SEQ ID NO: 672019 - RNA, 19 nt, Homo sapiens
caaauuagcccucucugau

SEQ ID NO: 672020 - RNA, 19 nt, Homo sapiens
uaacugauaaggcaaauug

SEQ ID NO: 672021 - RNA, 19 nt, Homo sapiens
ggacagauaauucuugcaa

SEQ ID NO: 672022 - RNA, 19 nt, Homo sapiens
gaguguuccucuuuaguuu

SEQ ID NO: 672023 - RNA, 19 nt, Homo sapiens
ugaaaccacucaagagaug

SEQ ID NO: 672024 - RNA, 19 nt, Homo sapiens
gauacaggcaugcagcuua

SEQ ID NO: 672025 - RNA, 19 nt, Homo sapiens
caaguagauuugcuaguga

SEQ ID NO: 672026 - RNA, 19 nt, Homo sapiens
auauugagcugcuaacaaa

SEQ ID NO: 672027 - RNA, 19 nt, Homo sapiens
gauuauaguucaagaaugc

SEQ ID NO: 672028 - RNA, 19 nt, Homo sapiens
gaaagaagaugaagccauu

SEQ ID NO: 672029 - RNA, 19 nt, Homo sapiens
gaacagcugucuggaauaa

SEQ ID NO: 672030 - RNA, 19 nt, Homo sapiens
caagaagccucuccuaauu

SEQ ID NO: 672031 - RNA, 19 nt, Homo sapiens
ccacaaaguugagaaauuu

SEQ ID NO: 672032 - RNA, 19 nt, Homo sapiens
guacuggacuuucuuugua

SEQ ID NO: 672033 - RNA, 19 nt, Homo sapiens
gcugaaagauugucuaaga

SEQ ID NO: 672034 - RNA, 19 nt, Homo sapiens
gacauuagcugaugaagau

SEQ ID NO: 672035 - RNA, 19 nt, Homo sapiens
gaacugagcaaucauaaau

SEQ ID NO: 672036 - RNA, 19 nt, Homo sapiens
gaaauucgagagcaucuua

SEQ ID NO: 672037 - RNA, 19 nt, Homo sapiens
gagaugaggucacugcaaa

SEQ ID NO: 672038 - RNA, 19 nt, Homo sapiens
ggugucagaugcagauuua

SEQ ID NO: 672039 - RNA, 19 nt, Homo sapiens
gaauaaggaugauuagaca

SEQ ID NO: 672040 - RNA, 19 nt, Homo sapiens
gaaagaagucuauguugaa

SEQ ID NO: 672041 - RNA, 19 nt, Homo sapiens
gagaacaaguugauauaga

SEQ ID NO: 672042 - RNA, 19 nt, Homo sapiens
aagaauaaguccaagguua

SEQ ID NO: 672043 - RNA, 19 nt, Homo sapiens
gaucugugguugagguuua

SEQ ID NO: 672044 - RNA, 19 nt, Homo sapiens
gaaggaggcugagugacua

SEQ ID NO: 672045 - RNA, 19 nt, Homo sapiens
gaggaugaguccauaauug

SEQ ID NO: 672046 - RNA, 19 nt, Homo sapiens
gaagcagugucagaauuua

SEQ ID NO: 672047 - RNA, 19 nt, Homo sapiens
guacagagccugagaguuc

SEQ ID NO: 672048 - RNA, 19 nt, Homo sapiens
gaacaggucauuauugguu

SEQ ID NO: 672049 - RNA, 19 nt, Homo sapiens
gggcugagauagagaauga

SEQ ID NO: 672050 - RNA, 19 nt, Homo sapiens
uaacaggacugacaaugga

SEQ ID NO: 672051 - RNA, 19 nt, Homo sapiens
gguguugucucacuuauug

SEQ ID NO: 672052 - RNA, 19 nt, Homo sapiens
gcgagaagcuugcauugau

SEQ ID NO: 672053 - RNA, 19 nt, Homo sapiens
acacacugguugccaauua

SEQ ID NO: 672054 - RNA, 19 nt, Homo sapiens
agaaagaagucuauguuga

SEQ ID NO: 672055 - RNA, 19 nt, Homo sapiens
gcacgaauauucccuggau

SEQ ID NO: 672056 - RNA, 19 nt, Homo sapiens
gaauuuauaggccucuuua

SEQ ID NO: 672057 - RNA, 19 nt, Homo sapiens
ggaggaaguuggaagucua

SEQ ID NO: 672058 - RNA, 19 nt, Homo sapiens
gugaagaggucaaccaaga

SEQ ID NO: 672059 - RNA, 19 nt, Homo sapiens
gaggagaggcuugaaauaa

SEQ ID NO: 672060 - RNA, 19 nt, Homo sapiens
ucuguaagcuggagcauuu

SEQ ID NO: 672061 - RNA, 19 nt, Homo sapiens
gaggaaacccuugcuuaua

SEQ ID NO: 672062 - RNA, 19 nt, Homo sapiens
uaaaggaggagcacgaaua

SEQ ID NO: 672063 - RNA, 19 nt, Homo sapiens
caaaggaggagaccaauau

SEQ ID NO: 672064 - RNA, 19 nt, Homo sapiens
gauauugacucuaacucuu

SEQ ID NO: 672065 - RNA, 19 nt, Homo sapiens
gcuagcagcugagaaagaa

SEQ ID NO: 672066 - RNA, 19 nt, Homo sapiens
gaggagaccauaaucaauu

SEQ ID NO: 672067 - RNA, 19 nt, Homo sapiens
gaaaagaccaguaugaaaa

SEQ ID NO: 672068 - RNA, 19 nt, Homo sapiens
cuacuggacuggauauuga

SEQ ID NO: 672069 - RNA, 19 nt, Homo sapiens
gaagagaccauuagaagag

SEQ ID NO: 672070 - RNA, 19 nt, Homo sapiens
caaggaagaggccaugaua

SEQ ID NO: 672071 - RNA, 19 nt, Homo sapiens
acugagagcuuuccuagaa

SEQ ID NO: 672072 - RNA, 19 nt, Homo sapiens
gaggauagagaacugguua

SEQ ID NO: 672073 - RNA, 19 nt, Homo sapiens
gaaacucccagaccaauau

SEQ ID NO: 672074 - RNA, 19 nt, Homo sapiens
gaagagacaaaugacaaua

SEQ ID NO: 672075 - RNA, 19 nt, Homo sapiens
gcaggaccaugcuguguau

SEQ ID NO: 672076 - RNA, 19 nt, Homo sapiens
gacaaggucugaggaagaa

SEQ ID NO: 672077 - RNA, 19 nt, Homo sapiens
gagaacugguuaauacaga

SEQ ID NO: 672078 - RNA, 19 nt, Homo sapiens
ggacuuucuuuguaacuug

SEQ ID NO: 672079 - RNA, 19 nt, Homo sapiens
gacuggauauugacucuaa

SEQ ID NO: 672080 - RNA, 19 nt, Homo sapiens
gaugccagcugaauauuag

SEQ ID NO: 672081 - RNA, 19 nt, Homo sapiens
gaaauuugcuaaggaacug

SEQ ID NO: 672082 - RNA, 19 nt, Homo sapiens
cuacugaauuugucugaaa

SEQ ID NO: 672083 - RNA, 19 nt, Homo sapiens
gagaagagaccauuagaag

SEQ ID NO: 672084 - RNA, 19 nt, Homo sapiens
ggucauuggucccugguuu

SEQ ID NO: 672085 - RNA, 19 nt, Homo sapiens
ggccaccucugaaucuaua

SEQ ID NO: 672086 - RNA, 19 nt, Homo sapiens
aauagcagguccagguuua

SEQ ID NO: 672087 - RNA, 19 nt, Homo sapiens
gggcugaggagaccaauaa

SEQ ID NO: 672088 - RNA, 19 nt, Homo sapiens
gcguauuggugauuccuua

SEQ ID NO: 672089 - RNA, 19 nt, Homo sapiens
ggagaggcuugaaauaaag

SEQ ID NO: 672090 - RNA, 19 nt, Homo sapiens
ucaaauggguagacaaauc

SEQ ID NO: 672091 - RNA, 19 nt, Homo sapiens
gcaccaaaguugagacaag

SEQ ID NO: 672092 - RNA, 19 nt, Homo sapiens
ugagaaauuugcuaaggaa

SEQ ID NO: 672093 - RNA, 19 nt, Homo sapiens
gaaaagaagucagugaaga

SEQ ID NO: 672094 - RNA, 19 nt, Homo sapiens
gaagagaguaauauagaug

SEQ ID NO: 672095 - RNA, 19 nt, Homo sapiens
gauagagaacugguuaaua

SEQ ID NO: 672096 - RNA, 19 nt, Homo sapiens
guuaauugcuggccucaga

SEQ ID NO: 672097 - RNA, 19 nt, Homo sapiens
gaacuguggccaccuguga

SEQ ID NO: 672098 - RNA, 19 nt, Homo sapiens
agacaaagccauuaaggaa

SEQ ID NO: 672099 - RNA, 19 nt, Homo sapiens
gaagaggagaccauaauca

SEQ ID NO: 672100 - RNA, 19 nt, Homo sapiens
ccaaguuacugacugaaga

SEQ ID NO: 672101 - RNA, 19 nt, Homo sapiens
gcaugggacuggugucaga

SEQ ID NO: 672102 - RNA, 19 nt, Homo sapiens
ggagcaagcaccaaaguug

SEQ ID NO: 672103 - RNA, 19 nt, Homo sapiens
gggaggaggucacuguuca

SEQ ID NO: 672104 - RNA, 19 nt, Homo sapiens
ggacugaggaggaagaaau

SEQ ID NO: 672105 - RNA, 19 nt, Homo sapiens
gaagaggaagaagucauua

SEQ ID NO: 672106 - RNA, 19 nt, Homo sapiens
ggacaaggucugaggaaga

SEQ ID NO: 672107 - RNA, 19 nt, Homo sapiens
auagagaacugguuaauac

SEQ ID NO: 672108 - RNA, 19 nt, Homo sapiens
gaguuaugauccuugagua

SEQ ID NO: 672109 - RNA, 19 nt, Homo sapiens
aggagaggcuugaaauaaa

SEQ ID NO: 672110 - RNA, 19 nt, Homo sapiens
gccaggagcugaagaagag

SEQ ID NO: 672111 - RNA, 19 nt, Homo sapiens
ccagagcaaugacaaagga

SEQ ID NO: 672112 - RNA, 19 nt, Homo sapiens
agaagucuauguugaauca

SEQ ID NO: 672113 - RNA, 19 nt, Homo sapiens
gaggaugagucuguuaaga

SEQ ID NO: 672114 - RNA, 19 nt, Homo sapiens
gcacauggccaaucaagag

SEQ ID NO: 672115 - RNA, 19 nt, Homo sapiens
aagcuuauauccucaauca

SEQ ID NO: 672116 - RNA, 19 nt, Homo sapiens
ugaagaagaagccaguaua

SEQ ID NO: 672117 - RNA, 19 nt, Homo sapiens
cgagaagcuugcauugauu

SEQ ID NO: 672118 - RNA, 19 nt, Homo sapiens
ccacauaagugaagaucca

SEQ ID NO: 672119 - RNA, 19 nt, Homo sapiens
gagaaagaagguauuguug

SEQ ID NO: 672120 - RNA, 19 nt, Homo sapiens
cagaagagaguaauauaga

SEQ ID NO: 672121 - RNA, 19 nt, Homo sapiens
aaacaaaguaccugucuga

SEQ ID NO: 672122 - RNA, 19 nt, Homo sapiens
guaacugcauacaauguga

SEQ ID NO: 672123 - RNA, 19 nt, Homo sapiens
ggcagcaucuuuauucugu

SEQ ID NO: 672124 - RNA, 19 nt, Homo sapiens
aaagaacccuguauguauc

SEQ ID NO: 672125 - RNA, 19 nt, Homo sapiens
ggaguugguucuggacuga

SEQ ID NO: 672126 - RNA, 19 nt, Homo sapiens
uaucauagccucuccacuu

SEQ ID NO: 672127 - RNA, 19 nt, Homo sapiens
cggaacagcugucuggaau

SEQ ID NO: 672128 - RNA, 19 nt, Homo sapiens
gcacuuaucuggaucauuu

SEQ ID NO: 672129 - RNA, 19 nt, Homo sapiens
gcaauggacuuaauuauuc

SEQ ID NO: 672130 - RNA, 19 nt, Homo sapiens
gaagaaagcuuuacugacu

SEQ ID NO: 672131 - RNA, 19 nt, Homo sapiens
gaaaggaaaugcaacaaga

SEQ ID NO: 672132 - RNA, 19 nt, Homo sapiens
gaaagcagguuaacaggaa

SEQ ID NO: 672133 - RNA, 19 nt, Homo sapiens
gcaauuaucacuacucaua

SEQ ID NO: 672134 - RNA, 19 nt, Homo sapiens
gaaaugggaaugccaaaua

SEQ ID NO: 672135 - RNA, 19 nt, Homo sapiens
cagcaaagcuugauaagau

SEQ ID NO: 672136 - RNA, 19 nt, Homo sapiens
gcagaaagcacuugaugua

SEQ ID NO: 672137 - RNA, 19 nt, Homo sapiens
caugaaagcugcugaaaug

SEQ ID NO: 672138 - RNA, 19 nt, Homo sapiens
gaacaagacugaaaaggua

SEQ ID NO: 672139 - RNA, 19 nt, Homo sapiens
ggauacagcuuauucauag

SEQ ID NO: 672140 - RNA, 19 nt, Homo sapiens
gaauguagcucuugggaau

SEQ ID NO: 672141 - RNA, 19 nt, Homo sapiens
acacagaagucucuugaua

SEQ ID NO: 672142 - RNA, 19 nt, Homo sapiens
gaaagcacuugauguagaa

SEQ ID NO: 672143 - RNA, 19 nt, Homo sapiens
gggagaaugucacuauuaa

SEQ ID NO: 672144 - RNA, 19 nt, Homo sapiens
aaacagaacugaauaaguc

SEQ ID NO: 672145 - RNA, 19 nt, Homo sapiens
gaauuaagcccuaaaggaa

SEQ ID NO: 672146 - RNA, 19 nt, Homo sapiens
gauggucccuucucaguaa

SEQ ID NO: 672147 - RNA, 19 nt, Homo sapiens
gagaauaaagggcuauaua

SEQ ID NO: 672148 - RNA, 19 nt, Homo sapiens
ucaaggacauuuggauuua

SEQ ID NO: 672149 - RNA, 19 nt, Homo sapiens
uggaauaacugaacaagaa

SEQ ID NO: 672150 - RNA, 19 nt, Homo sapiens
gaaaguggacauaccuaua

SEQ ID NO: 672151 - RNA, 19 nt, Homo sapiens
ggaaauuauugcagaagaa

SEQ ID NO: 672152 - RNA, 19 nt, Homo sapiens
ggacauaccuauacgaacu

SEQ ID NO: 672153 - RNA, 19 nt, Homo sapiens
ggaugcagcugaaagaaug

SEQ ID NO: 672154 - RNA, 19 nt, Homo sapiens
ugaaguggcugacugugua

SEQ ID NO: 672155 - RNA, 19 nt, Homo sapiens
ugagauguaucauguauug

SEQ ID NO: 672156 - RNA, 19 nt, Homo sapiens
gaacaagaaaggcaacauu

SEQ ID NO: 672157 - RNA, 19 nt, Homo sapiens
caaagaagaugugguuuua

SEQ ID NO: 672158 - RNA, 19 nt, Homo sapiens
uaacaaugcaguggaauua

SEQ ID NO: 672159 - RNA, 19 nt, Homo sapiens
ggaaagggaacaagaaaga

SEQ ID NO: 672160 - RNA, 19 nt, Homo sapiens
uaagggaucuggcuucguu

SEQ ID NO: 672161 - RNA, 19 nt, Homo sapiens
gauguuagcuuuugaagaa

SEQ ID NO: 672162 - RNA, 19 nt, Homo sapiens
aaacugugcuuuaucauuc

SEQ ID NO: 672163 - RNA, 19 nt, Homo sapiens
caaagaaagcgaggaguua

SEQ ID NO: 672164 - RNA, 19 nt, Homo sapiens
gcacacauaaugaacagua

SEQ ID NO: 672165 - RNA, 19 nt, Homo sapiens
gcacaaucuucuugaaugu

SEQ ID NO: 672166 - RNA, 19 nt, Homo sapiens
ggaagagacuagaagaaca

SEQ ID NO: 672167 - RNA, 19 nt, Homo sapiens
agacuuagcuagagauuca

SEQ ID NO: 672168 - RNA, 19 nt, Homo sapiens
gaauagacuuagcuagaga

SEQ ID NO: 672169 - RNA, 19 nt, Homo sapiens
gaacaagaaagacugcaaa

SEQ ID NO: 672170 - RNA, 19 nt, Homo sapiens
caauauagcuuuguuucug

SEQ ID NO: 672171 - RNA, 19 nt, Homo sapiens
caagcggacucacuccaua

SEQ ID NO: 672172 - RNA, 19 nt, Homo sapiens
gagagaggcgcacacauaa

SEQ ID NO: 672173 - RNA, 19 nt, Homo sapiens
caagaguccuucagccaaa

SEQ ID NO: 672174 - RNA, 19 nt, Homo sapiens
caacuucgacaaacuguaa

SEQ ID NO: 672175 - RNA, 19 nt, Homo sapiens
ccucugaguuggacauuaa

SEQ ID NO: 672176 - RNA, 19 nt, Homo sapiens
uaagaauauugccugguua

SEQ ID NO: 672177 - RNA, 19 nt, Homo sapiens
guaauugcaucaucucugu

SEQ ID NO: 672178 - RNA, 19 nt, Homo sapiens
ugagagaggcgcacacaua

SEQ ID NO: 672179 - RNA, 19 nt, Homo sapiens
caucugaagucaaagaaga

SEQ ID NO: 672180 - RNA, 19 nt, Homo sapiens
gaagcaagaaagcagguua

SEQ ID NO: 672181 - RNA, 19 nt, Homo sapiens
aaaugggaaugccaaauaa

SEQ ID NO: 672182 - RNA, 19 nt, Homo sapiens
guacgguauucaugacaua

SEQ ID NO: 672183 - RNA, 19 nt, Homo sapiens
gaaauuaugccaaaguuac

SEQ ID NO: 672184 - RNA, 19 nt, Homo sapiens
agaaagcacuugauguaga

SEQ ID NO: 672185 - RNA, 19 nt, Homo sapiens
caaagaaagcggccaaaug

SEQ ID NO: 672186 - RNA, 19 nt, Homo sapiens
agaagucucuugauaggaa

SEQ ID NO: 672187 - RNA, 19 nt, Homo sapiens
caagccagccaguauguua

SEQ ID NO: 672188 - RNA, 19 nt, Homo sapiens
caaaugugcccgaaauuau

SEQ ID NO: 672189 - RNA, 19 nt, Homo sapiens
ggaauagacuuagcuagag

SEQ ID NO: 672190 - RNA, 19 nt, Homo sapiens
gugggaagauggaggagua

SEQ ID NO: 672191 - RNA, 19 nt, Homo sapiens
gggaaugcauuauuacauc

SEQ ID NO: 672192 - RNA, 19 nt, Homo sapiens
aaagaaagcggccaaaugu

SEQ ID NO: 672193 - RNA, 19 nt, Homo sapiens
uuaaagagaggcauuguuu

SEQ ID NO: 672194 - RNA, 19 nt, Homo sapiens
cagauaagcugaagcaacu

SEQ ID NO: 672195 - RNA, 19 nt, Homo sapiens
ucaaauaguucugguuuca

SEQ ID NO: 672196 - RNA, 19 nt, Homo sapiens
gacaaaccaagccuuaaua

SEQ ID NO: 672197 - RNA, 19 nt, Homo sapiens
ccagaucccuauguaauga

SEQ ID NO: 672198 - RNA, 19 nt, Homo sapiens
caacaggaucuaccacuuu

SEQ ID NO: 672199 - RNA, 19 nt, Homo sapiens
gcccagaugucuacagaga

SEQ ID NO: 672200 - RNA, 19 nt, Homo sapiens
caagcaagcagcaugagua

SEQ ID NO: 672201 - RNA, 19 nt, Homo sapiens
gucagaaacuugaauguuc

SEQ ID NO: 672202 - RNA, 19 nt, Homo sapiens
gagcugagacugugccauu

SEQ ID NO: 672203 - RNA, 19 nt, Homo sapiens
ugugacagguaacaaauuu

SEQ ID NO: 672204 - RNA, 19 nt, Homo sapiens
gaaagaguguuagcucagu

SEQ ID NO: 672205 - RNA, 19 nt, Homo sapiens
guuauucccacuauuguua

SEQ ID NO: 672206 - RNA, 19 nt, Homo sapiens
gugcuuaccuauacaaaca

SEQ ID NO: 672207 - RNA, 19 nt, Homo sapiens
ggccaaauguugcgacaau

SEQ ID NO: 672208 - RNA, 19 nt, Homo sapiens
caacacagaagucucuuga

SEQ ID NO: 672209 - RNA, 19 nt, Homo sapiens
ccaauucugccaugcaaua

SEQ ID NO: 672210 - RNA, 19 nt, Homo sapiens
gauaagauagcugggauuu

SEQ ID NO: 672211 - RNA, 19 nt, Homo sapiens
aaacucaggauacagcuua

SEQ ID NO: 672212 - RNA, 19 nt, Homo sapiens
uauguugcaugcaguuaua

SEQ ID NO: 672213 - RNA, 19 nt, Homo sapiens
gggaaauuauugcagaaga

SEQ ID NO: 672214 - RNA, 19 nt, Homo sapiens
gagaggcgcacacauaaug

SEQ ID NO: 672215 - RNA, 19 nt, Homo sapiens
gagggagaaugucacuauu

SEQ ID NO: 672216 - RNA, 19 nt, Homo sapiens
acacccauguuuaagauuu

SEQ ID NO: 672217 - RNA, 19 nt, Homo sapiens
gaaugcaccuguucauagg

SEQ ID NO: 672218 - RNA, 19 nt, Homo sapiens
gaacagcacgcccagcaau

SEQ ID NO: 672219 - RNA, 19 nt, Homo sapiens
gaucuggcuucguuaacaa

SEQ ID NO: 672220 - RNA, 19 nt, Homo sapiens
ggcaauggacuuaauuauu

SEQ ID NO: 672221 - RNA, 19 nt, Homo sapiens
gaacaggcaauggacuuaa

SEQ ID NO: 672222 - RNA, 19 nt, Homo sapiens
caucccagaucccuaugua

SEQ ID NO: 672223 - RNA, 19 nt, Homo sapiens
uaagauagcugggauuuug

SEQ ID NO: 672224 - RNA, 19 nt, Homo sapiens
ggagauucuugacaauguu

SEQ ID NO: 672225 - RNA, 19 nt, Homo sapiens
gcugagcacuuaucuggau

SEQ ID NO: 672226 - RNA, 19 nt, Homo sapiens
gccauucgcuuccugacaa

SEQ ID NO: 672227 - RNA, 19 nt, Homo sapiens
ggaagauggaggaguauga

SEQ ID NO: 672228 - RNA, 19 nt, Homo sapiens
gauaaugccuguguucuuu

SEQ ID NO: 672229 - RNA, 19 nt, Homo sapiens
gguauaagaucugaacuuu

SEQ ID NO: 672230 - RNA, 19 nt, Homo sapiens
gaacugcuauaaauacauc

SEQ ID NO: 672231 - RNA, 19 nt, Homo sapiens
uuaguucucucaccuauuu

SEQ ID NO: 672232 - RNA, 19 nt, Homo sapiens
gagcaaagugccauuguuu

SEQ ID NO: 672233 - RNA, 19 nt, Homo sapiens
caggaagacugacuuaaau

SEQ ID NO: 672234 - RNA, 19 nt, Homo sapiens
ugaagacaaucuagguuaa

SEQ ID NO: 672235 - RNA, 19 nt, Homo sapiens
ggaagugacucauccaaac

SEQ ID NO: 672236 - RNA, 19 nt, Homo sapiens
ucaguucaaugcugguuua

SEQ ID NO: 672237 - RNA, 19 nt, Homo sapiens
gacaauaaauccuauacca

SEQ ID NO: 672238 - RNA, 19 nt, Homo sapiens
uuacuuaccugccugaaga

SEQ ID NO: 672239 - RNA, 19 nt, Homo sapiens
caaucuagguuaagcaaga

SEQ ID NO: 672240 - RNA, 19 nt, Homo sapiens
caaagaauaucuggaucaa

SEQ ID NO: 672241 - RNA, 19 nt, Homo sapiens
ggaagacugacuuaaauau

SEQ ID NO: 672242 - RNA, 19 nt, Homo sapiens
gaaauucugccuuugacaa

SEQ ID NO: 672243 - RNA, 19 nt, Homo sapiens
ucagggcucuucaaacuug

SEQ ID NO: 672244 - RNA, 19 nt, Homo sapiens
guucaaugcugguuuaugg

SEQ ID NO: 672245 - RNA, 19 nt, Homo sapiens
gaugaugguugcauguuuc

SEQ ID NO: 672246 - RNA, 19 nt, Homo sapiens
uuaccugccugaagaaauu

SEQ ID NO: 672247 - RNA, 19 nt, Homo sapiens
guuuggaacugcuauaaau

SEQ ID NO: 672248 - RNA, 19 nt, Homo sapiens
cuaauuaacuguguuugga

SEQ ID NO: 672249 - RNA, 19 nt, Homo sapiens
ugccaagaaucaaagaaua

SEQ ID NO: 672250 - RNA, 19 nt, Homo sapiens
gcauguuucuaguuuguau

SEQ ID NO: 672251 - RNA, 19 nt, Homo sapiens
gguugcauguuucuaguuu

SEQ ID NO: 672252 - RNA, 19 nt, Homo sapiens
caugccagcugucaacauu

SEQ ID NO: 672253 - RNA, 19 nt, Homo sapiens
uaaauccuauaccagcuuu

SEQ ID NO: 672254 - RNA, 19 nt, Homo sapiens
caaguggguuggcugauuc

SEQ ID NO: 672255 - RNA, 19 nt, Homo sapiens
aagaauaucuggaucaacu

SEQ ID NO: 672256 - RNA, 19 nt, Homo sapiens
guaaguaguuggguauaag

SEQ ID NO: 672257 - RNA, 19 nt, Homo sapiens
agaggguacuugccacaua

SEQ ID NO: 672258 - RNA, 19 nt, Homo sapiens
guauauguuuccaucuuug

SEQ ID NO: 672259 - RNA, 19 nt, Homo sapiens
ucaaguggguuggcugauu

SEQ ID NO: 672260 - RNA, 19 nt, Homo sapiens
guaauuacuauucgucuga

SEQ ID NO: 672261 - RNA, 19 nt, Homo sapiens
gguaguaaaccuauugaug

SEQ ID NO: 672262 - RNA, 19 nt, Homo sapiens
guacaugguaguaaaccua

SEQ ID NO: 672263 - RNA, 19 nt, Homo sapiens
ucaguugccugguugcuau

SEQ ID NO: 672264 - RNA, 19 nt, Homo sapiens
gaggguacuugccacauag

SEQ ID NO: 672265 - RNA, 19 nt, Homo sapiens
uauuugacauugugacuug

SEQ ID NO: 672266 - RNA, 19 nt, Homo sapiens
ugaagcaccuccucaguac

SEQ ID NO: 672267 - RNA, 19 nt, Homo sapiens
guaguuggguauaagaucu

SEQ ID NO: 672268 - RNA, 19 nt, Homo sapiens
ugauuccauucuucuguua

SEQ ID NO: 672269 - RNA, 19 nt, Homo sapiens
guuacagaaugcugcaauu

SEQ ID NO: 672270 - RNA, 19 nt, Homo sapiens
guucauuguucuuguguuc

SEQ ID NO: 672271 - RNA, 19 nt, Homo sapiens
cugagagaauggcugauaa

SEQ ID NO: 672272 - RNA, 19 nt, Homo sapiens
agucaucgguaauuacuau

SEQ ID NO: 672273 - RNA, 19 nt, Homo sapiens
gaagaugaugguugcaugu

SEQ ID NO: 672274 - RNA, 19 nt, Homo sapiens
ccugguacaugguaguaaa

SEQ ID NO: 672275 - RNA, 19 nt, Homo sapiens
uggguuggcugauuccauu

SEQ ID NO: 672276 - RNA, 19 nt, Homo sapiens
ccuaugaaauggccgugaa

SEQ ID NO: 672277 - RNA, 19 nt, Homo sapiens
ucaccuauuugccaagaau

SEQ ID NO: 672278 - RNA, 19 nt, Homo sapiens
agaugaugguugcauguuu

SEQ ID NO: 672279 - RNA, 19 nt, Homo sapiens
ugccggagauugcugugua

SEQ ID NO: 672280 - RNA, 19 nt, Homo sapiens
gccaagaaucaaagaauau

SEQ ID NO: 672281 - RNA, 19 nt, Homo sapiens
gaagucaucgguaauuacu

SEQ ID NO: 672282 - RNA, 19 nt, Homo sapiens
accaccaccuccuuacuua

SEQ ID NO: 672283 - RNA, 19 nt, Homo sapiens
guacuugccacauaguuuc

SEQ ID NO: 672284 - RNA, 19 nt, Homo sapiens
gagagaauggcugauaaug

SEQ ID NO: 672285 - RNA, 19 nt, Homo sapiens
gguacuugccacauaguuu

SEQ ID NO: 672286 - RNA, 19 nt, Homo sapiens
caauucagggcucuucaaa

SEQ ID NO: 672287 - RNA, 19 nt, Homo sapiens
aggcuuaucuaauuaacug

SEQ ID NO: 672288 - RNA, 19 nt, Homo sapiens
ucaaagaauaucuggauca

SEQ ID NO: 672289 - RNA, 19 nt, Homo sapiens
agagcaaagugccauuguu

SEQ ID NO: 672290 - RNA, 19 nt, Homo sapiens
uugaagacaaucuagguua

SEQ ID NO: 672291 - RNA, 19 nt, Homo sapiens
gcaauucagggcucuucaa

SEQ ID NO: 672292 - RNA, 19 nt, Homo sapiens
aguaaguaguuggguauaa

SEQ ID NO: 672293 - RNA, 19 nt, Homo sapiens
ugccauuguuugccuuuaa

SEQ ID NO: 672294 - RNA, 19 nt, Homo sapiens
gccauuguuugccuuuaau

SEQ ID NO: 672295 - RNA, 19 nt, Homo sapiens
gaaacgugccggagauugc

SEQ ID NO: 672296 - RNA, 19 nt, Homo sapiens
cgucucuguucuuauguuu

SEQ ID NO: 672297 - RNA, 19 nt, Homo sapiens
guuuccaucuuugugauaa

SEQ ID NO: 672298 - RNA, 19 nt, Homo sapiens
gcagugaccgguucuacag

SEQ ID NO: 672299 - RNA, 19 nt, Homo sapiens
auucugccuuugacaauaa

SEQ ID NO: 672300 - RNA, 19 nt, Homo sapiens
uguguacccugccuuugaa

SEQ ID NO: 672301 - RNA, 19 nt, Homo sapiens
uauuaguucucucaccuau

SEQ ID NO: 672302 - RNA, 19 nt, Homo sapiens
gaugguugcauguuucuag

SEQ ID NO: 672303 - RNA, 19 nt, Homo sapiens
uugcuacccugaguacuuu

SEQ ID NO: 672304 - RNA, 19 nt, Homo sapiens
gaagugacucauccaaacu

SEQ ID NO: 672305 - RNA, 19 nt, Homo sapiens
gcaagagcaaagugccauu

SEQ ID NO: 672306 - RNA, 19 nt, Homo sapiens
gacaaucuagguuaagcaa

SEQ ID NO: 672307 - RNA, 19 nt, Homo sapiens
gaagacaaucuagguuaag

SEQ ID NO: 672308 - RNA, 19 nt, Homo sapiens
auucagggcucuucaaacu

SEQ ID NO: 672309 - RNA, 19 nt, Homo sapiens
aagaaccaccaccuccuua

SEQ ID NO: 672310 - RNA, 19 nt, Homo sapiens
uugaagcaccuccucagua

SEQ ID NO: 672311 - RNA, 19 nt, Homo sapiens
ucauuguucuuguguucuu

SEQ ID NO: 672312 - RNA, 19 nt, Homo sapiens
ugccgucucuguucuuaug

SEQ ID NO: 672313 - RNA, 19 nt, Homo sapiens
ggguauaagaucugaacuu

SEQ ID NO: 672314 - RNA, 19 nt, Homo sapiens
guucuuugccuuauucauc

SEQ ID NO: 672315 - RNA, 19 nt, Homo sapiens
uaaguaguuggguauaaga

SEQ ID NO: 672316 - RNA, 19 nt, Homo sapiens
aggaagacugacuuaaaua

SEQ ID NO: 672317 - RNA, 19 nt, Homo sapiens
caagagcaaagugccauug

SEQ ID NO: 672318 - RNA, 19 nt, Homo sapiens
caugguaguaaaccuauug

SEQ ID NO: 672319 - RNA, 19 nt, Homo sapiens
cugucaacauucaguauga

SEQ ID NO: 672320 - RNA, 19 nt, Homo sapiens
ucugagagaauggcugaua

SEQ ID NO: 672321 - RNA, 19 nt, Homo sapiens
aauucugccuuugacaaua

SEQ ID NO: 672322 - RNA, 19 nt, Homo sapiens
gaauaucuggaucaacuac

SEQ ID NO: 672323 - RNA, 19 nt, Homo sapiens
gaaccaccaccuccuuacu

SEQ ID NO: 672324 - RNA, 19 nt, Homo sapiens
gcaccuccucaguacguuu

SEQ ID NO: 672325 - RNA, 19 nt, Homo sapiens
ugccagcugucaacauuca

SEQ ID NO: 672326 - RNA, 19 nt, Homo sapiens
uggaacugcuauaaauaca

SEQ ID NO: 672327 - RNA, 19 nt, Homo sapiens
gcugauaaugccuguguuc

SEQ ID NO: 672328 - RNA, 19 nt, Homo sapiens
ggauggaagugccuuauua

SEQ ID NO: 672329 - RNA, 19 nt, Homo sapiens
gagagacgcuguccuuuaa

SEQ ID NO: 672330 - RNA, 19 nt, Homo sapiens
gcacaucaguggaguguuu

SEQ ID NO: 672331 - RNA, 19 nt, Homo sapiens
gcacaggccuucaagaaug

SEQ ID NO: 672332 - RNA, 19 nt, Homo sapiens
caacagcccugauuccaaa

SEQ ID NO: 672333 - RNA, 19 nt, Homo sapiens
ccagaaggcugcgcaaaua

SEQ ID NO: 672334 - RNA, 19 nt, Homo sapiens
ggagagaauuauauacuga

SEQ ID NO: 672335 - RNA, 19 nt, Homo sapiens
ccacaaggcuggccacuuc

SEQ ID NO: 672336 - RNA, 19 nt, Homo sapiens
ggaagugccuuauuacuac

SEQ ID NO: 672337 - RNA, 19 nt, Homo sapiens
agacuuggcucucuuuaaa

SEQ ID NO: 672338 - RNA, 19 nt, Homo sapiens
gagagaauaugaacugugu

SEQ ID NO: 672339 - RNA, 19 nt, Homo sapiens
gaacgaggagagaauuaua

SEQ ID NO: 672340 - RNA, 19 nt, Homo sapiens
cgacagagcugggcgagaa

SEQ ID NO: 672341 - RNA, 19 nt, Homo sapiens
gcaaauagccaacgagaca

SEQ ID NO: 672342 - RNA, 19 nt, Homo sapiens
caccaacacuccuguaauu

SEQ ID NO: 672343 - RNA, 19 nt, Homo sapiens
gaagagcaguucuggaagu

SEQ ID NO: 672344 - RNA, 19 nt, Homo sapiens
gagcaguucuggaaguuug

SEQ ID NO: 672345 - RNA, 19 nt, Homo sapiens
gcgaggaccugguucaguu

SEQ ID NO: 672346 - RNA, 19 nt, Homo sapiens
aaaggcaucuucuggaauu

SEQ ID NO: 672347 - RNA, 19 nt, Homo sapiens
gaaggcagguggcgaucuu

SEQ ID NO: 672348 - RNA, 19 nt, Homo sapiens
caucauggcugcuaacuac

SEQ ID NO: 672349 - RNA, 19 nt, Homo sapiens
cuucaagacuggacaaauu

SEQ ID NO: 672350 - RNA, 19 nt, Homo sapiens
ggacaucugugggaauuuc

SEQ ID NO: 672351 - RNA, 19 nt, Homo sapiens
ggacgccucugcugaaaca

SEQ ID NO: 672352 - RNA, 19 nt, Homo sapiens
ggacagacuuggcucucuu

SEQ ID NO: 672353 - RNA, 19 nt, Homo sapiens
cuaccgagcuccaaggaaa

SEQ ID NO: 672354 - RNA, 19 nt, Homo sapiens
agacaucgcuuugauugaa

SEQ ID NO: 672355 - RNA, 19 nt, Homo sapiens
gagaagugacgguguuuaa

SEQ ID NO: 672356 - RNA, 19 nt, Homo sapiens
gaaguuuggcuuugagaaa

SEQ ID NO: 672357 - RNA, 19 nt, Homo sapiens
gcagacaucgcuuugauug

SEQ ID NO: 672358 - RNA, 19 nt, Homo sapiens
gagaaaggagagaauauga

SEQ ID NO: 672359 - RNA, 19 nt, Homo sapiens
gcagacagcacgauucaga

SEQ ID NO: 672360 - RNA, 19 nt, Homo sapiens
agaaagcccuggacauguu

SEQ ID NO: 672361 - RNA, 19 nt, Homo sapiens
gaugagaaguuuggcuuug

SEQ ID NO: 672362 - RNA, 19 nt, Homo sapiens
gggcaaagcagaagaagug

SEQ ID NO: 672363 - RNA, 19 nt, Homo sapiens
gaaggaaaucuacaucaug

SEQ ID NO: 672364 - RNA, 19 nt, Homo sapiens
cgaagaagcagacagagaa

SEQ ID NO: 672365 - RNA, 19 nt, Homo sapiens
ggaaggagccggagaucau

SEQ ID NO: 672366 - RNA, 19 nt, Homo sapiens
ggagagagacgcuguccuu

SEQ ID NO: 672367 - RNA, 19 nt, Homo sapiens
gagacgcuguccuuuaaug

SEQ ID NO: 672368 - RNA, 19 nt, Homo sapiens
gggcagacaucgcuuugau

SEQ ID NO: 672369 - RNA, 19 nt, Homo sapiens
cagaagaagugaugaaggu

SEQ ID NO: 672370 - RNA, 19 nt, Homo sapiens
gaaacacgaguaugggaaa

SEQ ID NO: 672371 - RNA, 19 nt, Homo sapiens
gagcaagagacuaauaaga

SEQ ID NO: 672372 - RNA, 19 nt, Homo sapiens
ccgagcagcuguacaggaa

SEQ ID NO: 672373 - RNA, 19 nt, Homo sapiens
uuaaugagcaagagacuaa

SEQ ID NO: 672374 - RNA, 19 nt, Homo sapiens
caaggaaacaucacgcaaa

SEQ ID NO: 672375 - RNA, 19 nt, Homo sapiens
gaauaugaacugugugugu

SEQ ID NO: 672376 - RNA, 19 nt, Homo sapiens
cgauucagaugcuguucua

SEQ ID NO: 672377 - RNA, 19 nt, Homo sapiens
gggcacaggccuucaagaa

SEQ ID NO: 672378 - RNA, 19 nt, Homo sapiens
gauccuguccuucuucauu

SEQ ID NO: 672379 - RNA, 19 nt, Homo sapiens
ggacacagugaccgucuuu

SEQ ID NO: 672380 - RNA, 19 nt, Homo sapiens
cagcuucuuugucaccaua

SEQ ID NO: 672381 - RNA, 19 nt, Homo sapiens
caggcagcguggauauuua

SEQ ID NO: 672382 - RNA, 19 nt, Homo sapiens
agagagacgcuguccuuua

SEQ ID NO: 672383 - RNA, 19 nt, Homo sapiens
gggcagaacaugagcauca

SEQ ID NO: 672384 - RNA, 19 nt, Homo sapiens
ucaaacaacuccuccuuuu

SEQ ID NO: 672385 - RNA, 19 nt, Homo sapiens
gaaaggagagaauaugaac

SEQ ID NO: 672386 - RNA, 19 nt, Homo sapiens
agguggagauugaugaaua

SEQ ID NO: 672387 - RNA, 19 nt, Homo sapiens
gaacaucaucggcuucuac

SEQ ID NO: 672388 - RNA, 19 nt, Homo sapiens
cgucauggcccucuauuau

SEQ ID NO: 672389 - RNA, 19 nt, Homo sapiens
acaugucuguguuggaaua

SEQ ID NO: 672390 - RNA, 19 nt, Homo sapiens
ggauggcacuggugaagag

SEQ ID NO: 672391 - RNA, 19 nt, Homo sapiens
gccacgaccuccugaacaa

SEQ ID NO: 672392 - RNA, 19 nt, Homo sapiens
cuucuacgauguugaaaug

SEQ ID NO: 672393 - RNA, 19 nt, Homo sapiens
caaagcagaagaagugaug

SEQ ID NO: 672394 - RNA, 19 nt, Homo sapiens
ugugagcggugaugagaaa

SEQ ID NO: 672395 - RNA, 19 nt, Homo sapiens
ggcaggcggugcacuucua

SEQ ID NO: 672396 - RNA, 19 nt, Homo sapiens
gagcagcuguacaggaagu

SEQ ID NO: 672397 - RNA, 19 nt, Homo sapiens
gaaagcccuggacauguuu

SEQ ID NO: 672398 - RNA, 19 nt, Homo sapiens
ggagaagugacgguguuua

SEQ ID NO: 672399 - RNA, 19 nt, Homo sapiens
aaggaaacaucacgcaaau

SEQ ID NO: 672400 - RNA, 19 nt, Homo sapiens
caacaggcagcguggauau

SEQ ID NO: 672401 - RNA, 19 nt, Homo sapiens
gguucacccuuccaucgua

SEQ ID NO: 672402 - RNA, 19 nt, Homo sapiens
gaaaggcaucuucuggaau

SEQ ID NO: 672403 - RNA, 19 nt, Homo sapiens
gagcagguccgccacaaca

SEQ ID NO: 672404 - RNA, 19 nt, Homo sapiens
agaaggaaaucuacaucau

SEQ ID NO: 672405 - RNA, 19 nt, Homo sapiens
gcagaggaccuggaugaga

SEQ ID NO: 672406 - RNA, 19 nt, Homo sapiens
uggaagugccuuauuacua

SEQ ID NO: 672407 - RNA, 19 nt, Homo sapiens
gagaauaugaacugugugu

SEQ ID NO: 672408 - RNA, 19 nt, Homo sapiens
gaguccagaugagaaguuu

SEQ ID NO: 672409 - RNA, 19 nt, Homo sapiens
uagcagaggaccuggauga

SEQ ID NO: 672410 - RNA, 19 nt, Homo sapiens
ggaaacaucacgcaaaucc

SEQ ID NO: 672411 - RNA, 19 nt, Homo sapiens
ugagaaagcccuggacaug

SEQ ID NO: 672412 - RNA, 19 nt, Homo sapiens
caacacuccuguaauucca

SEQ ID NO: 672413 - RNA, 19 nt, Homo sapiens
gugcccagguggagauuga

SEQ ID NO: 672414 - RNA, 19 nt, Homo sapiens
aauaugaacuguguguguu

SEQ ID NO: 672415 - RNA, 19 nt, Homo sapiens
uguaaagccugagaaacuu

SEQ ID NO: 672416 - RNA, 19 nt, Homo sapiens
caucguauucucccaacua

SEQ ID NO: 672417 - RNA, 19 nt, Homo sapiens
uggccaacauguccuacua

SEQ ID NO: 672418 - RNA, 19 nt, Homo sapiens
ccagacggccuacagauuc

SEQ ID NO: 672419 - RNA, 19 nt, Homo sapiens
agccggagaucaugaagaa

SEQ ID NO: 672420 - RNA, 19 nt, Homo sapiens
gcaggggacugucaaacaa

SEQ ID NO: 672421 - RNA, 19 nt, Homo sapiens
aaaccgaguucaaguucga

SEQ ID NO: 672422 - RNA, 19 nt, Homo sapiens
gcaccgacaugcacaucag

SEQ ID NO: 672423 - RNA, 19 nt, Homo sapiens
gaggagagaauuauauacu

SEQ ID NO: 672424 - RNA, 19 nt, Homo sapiens
gagaaagcccuggacaugu

SEQ ID NO: 672425 - RNA, 19 nt, Homo sapiens
cacuucagcuucuuuguca

SEQ ID NO: 672426 - RNA, 19 nt, Homo sapiens
caaauugaucggagagaga

SEQ ID NO: 672427 - RNA, 19 nt, Homo sapiens
gaacuguguguguuacugu

SEQ ID NO: 672428 - RNA, 19 nt, Homo sapiens
cuaaauacguggagaagaa

SEQ ID NO: 672429 - RNA, 19 nt, Homo sapiens
gcacuggucuccuggaaag

SEQ ID NO: 672430 - RNA, 19 nt, Homo sapiens
agacguaucuugacaucuu

SEQ ID NO: 672431 - RNA, 19 nt, Homo sapiens
uagugaagcucauguguga

SEQ ID NO: 672432 - RNA, 19 nt, Homo sapiens
gaaaugucaucaucaacca

SEQ ID NO: 672433 - RNA, 19 nt, Homo sapiens
gaugagacguaucuugaca

SEQ ID NO: 672434 - RNA, 19 nt, Homo sapiens
ugaccaagcugccugagau

SEQ ID NO: 672435 - RNA, 19 nt, Homo sapiens
ggccacagcugcuaauucu

SEQ ID NO: 672436 - RNA, 19 nt, Homo sapiens
gaggaaguuugacaucaug

SEQ ID NO: 672437 - RNA, 19 nt, Homo sapiens
ugacuguggugguggauga

SEQ ID NO: 672438 - RNA, 19 nt, Homo sapiens
gaugucaacugggucaaug

SEQ ID NO: 672439 - RNA, 19 nt, Homo sapiens
ccagggagcuugagaucca

SEQ ID NO: 672440 - RNA, 19 nt, Homo sapiens
agaagaaguuccugaccaa

SEQ ID NO: 672441 - RNA, 19 nt, Homo sapiens
ggagccagaaccaagcuua

SEQ ID NO: 672442 - RNA, 19 nt, Homo sapiens
ggacagccaugcggagcuu

SEQ ID NO: 672443 - RNA, 19 nt, Homo sapiens
gguggaagccgaaguguca

SEQ ID NO: 672444 - RNA, 19 nt, Homo sapiens
ccauggagcugaugucaac

SEQ ID NO: 672445 - RNA, 19 nt, Homo sapiens
gcugggaaaugucaucauc

SEQ ID NO: 672446 - RNA, 19 nt, Homo sapiens
ggagaaggaggccuggauu

SEQ ID NO: 672447 - RNA, 19 nt, Homo sapiens
gguguucacuucuccaaag

SEQ ID NO: 672448 - RNA, 19 nt, Homo sapiens
gaaacucugcccugacuca

SEQ ID NO: 672449 - RNA, 19 nt, Homo sapiens
gagccuugguguucacuuc

SEQ ID NO: 672450 - RNA, 19 nt, Homo sapiens
gacacgugcugcugaaaca

SEQ ID NO: 672451 - RNA, 19 nt, Homo sapiens
gagagaagagggacaugga

SEQ ID NO: 672452 - RNA, 19 nt, Homo sapiens
cuucgucucugcacaguga

SEQ ID NO: 672453 - RNA, 19 nt, Homo sapiens
gaauucagcacgagagaag

SEQ ID NO: 672454 - RNA, 19 nt, Homo sapiens
ugagccggcugucccagua

SEQ ID NO: 672455 - RNA, 19 nt, Homo sapiens
ggcaggagaugagacguau

SEQ ID NO: 672456 - RNA, 19 nt, Homo sapiens
ugugugagcugggaaaugu

SEQ ID NO: 672457 - RNA, 19 nt, Homo sapiens
gauuaugcccugcagauca

SEQ ID NO: 672458 - RNA, 19 nt, Homo sapiens
aagccgaagugucagaauu

SEQ ID NO: 672459 - RNA, 19 nt, Homo sapiens
gaacuagugaagcucaugu

SEQ ID NO: 672460 - RNA, 19 nt, Homo sapiens
ugggaaaugucaucaucaa

SEQ ID NO: 672461 - RNA, 19 nt, Homo sapiens
gggcacuggucuccuggaa

SEQ ID NO: 672462 - RNA, 19 nt, Homo sapiens
gugaaacucugcccugacu

SEQ ID NO: 672463 - RNA, 19 nt, Homo sapiens
acaaggacccugugacugu

SEQ ID NO: 672464 - RNA, 19 nt, Homo sapiens
gagccagaaccaagcuuaa

SEQ ID NO: 672465 - RNA, 19 nt, Homo sapiens
gacgggcacuggauuaugc

SEQ ID NO: 672466 - RNA, 19 nt, Homo sapiens
gagaaggaggccuggauuc

SEQ ID NO: 672467 - RNA, 19 nt, Homo sapiens
guacaaggacccugugacu

SEQ ID NO: 672468 - RNA, 19 nt, Homo sapiens
ugagacguaucuugacauc

SEQ ID NO: 672469 - RNA, 19 nt, Homo sapiens
gacaagaggaaguuugaca

SEQ ID NO: 672470 - RNA, 19 nt, Homo sapiens
gccagcaacgcauuuaaga

SEQ ID NO: 672471 - RNA, 19 nt, Homo sapiens
agagacacgugcugcugaa

SEQ ID NO: 672472 - RNA, 19 nt, Homo sapiens
aagaggaaguuugacauca

SEQ ID NO: 672473 - RNA, 19 nt, Homo sapiens
ccacagcugcuaauucucu

SEQ ID NO: 672474 - RNA, 19 nt, Homo sapiens
ggccauggcagugaagaaa

SEQ ID NO: 672475 - RNA, 19 nt, Homo sapiens
gccagaaccaagcuuaaga

SEQ ID NO: 672476 - RNA, 19 nt, Homo sapiens
cagcuggucuugaauucag

SEQ ID NO: 672477 - RNA, 19 nt, Homo sapiens
ggcccaggcuacccauuuc

SEQ ID NO: 672478 - RNA, 19 nt, Homo sapiens
agaggaaguuugacaucau

SEQ ID NO: 672479 - RNA, 19 nt, Homo sapiens
caagaggaaguuugacauc

SEQ ID NO: 672480 - RNA, 19 nt, Homo sapiens
gaggacaagaggaaguuug

SEQ ID NO: 672481 - RNA, 19 nt, Homo sapiens
gcaccacgcaaccauucuu

SEQ ID NO: 672482 - RNA, 19 nt, Homo sapiens
ccacaggagccuugguguu

SEQ ID NO: 672483 - RNA, 19 nt, Homo sapiens
ccugggcucugguggaaug

SEQ ID NO: 672484 - RNA, 19 nt, Homo sapiens
ggccuggauucacgcuaaa

SEQ ID NO: 672485 - RNA, 19 nt, Homo sapiens
caacgugauugaggacaag

SEQ ID NO: 672486 - RNA, 19 nt, Homo sapiens
ggacgggcacuggauuaug

SEQ ID NO: 672487 - RNA, 19 nt, Homo sapiens
caucaucaaccagaucuau

SEQ ID NO: 672488 - RNA, 19 nt, Homo sapiens
aggccuggauucacgcuaa

SEQ ID NO: 672489 - RNA, 19 nt, Homo sapiens
uggaaaagcuccugaaacu

SEQ ID NO: 672490 - RNA, 19 nt, Homo sapiens
ggagugggccagcaucaac

SEQ ID NO: 672491 - RNA, 19 nt, Homo sapiens
aaggacaucucuucaaacg

SEQ ID NO: 672492 - RNA, 19 nt, Homo sapiens
ggaaguuugacaucaugga

SEQ ID NO: 672493 - RNA, 19 nt, Homo sapiens
gggcauccuccaucucuuc

SEQ ID NO: 672494 - RNA, 19 nt, Homo sapiens
caagcugccugagauucga

SEQ ID NO: 672495 - RNA, 19 nt, Homo sapiens
ccuggauucacgcuaaaua

SEQ ID NO: 672496 - RNA, 19 nt, Homo sapiens
cacaggagccuugguguuc

SEQ ID NO: 672497 - RNA, 19 nt, Homo sapiens
ugacaucuuccgcgacuuc

SEQ ID NO: 672498 - RNA, 19 nt, Homo sapiens
cuacgacuggcaaagauga

SEQ ID NO: 672499 - RNA, 19 nt, Homo sapiens
gaccaagcugccugagauu

SEQ ID NO: 672500 - RNA, 19 nt, Homo sapiens
uccaaaguccggucucuga

SEQ ID NO: 672501 - RNA, 19 nt, Homo sapiens
ggaagccgaagugucagaa

SEQ ID NO: 672502 - RNA, 19 nt, Homo sapiens
uggaguuugugcugcguuu

SEQ ID NO: 672503 - RNA, 19 nt, Homo sapiens
ugauugaggacaagaggaa

SEQ ID NO: 672504 - RNA, 19 nt, Homo sapiens
gacguaucuugacaucuuc

SEQ ID NO: 672505 - RNA, 19 nt, Homo sapiens
gggccagcaacgcauuuaa

SEQ ID NO: 672506 - RNA, 19 nt, Homo sapiens
agaaggaggccuggauuca

SEQ ID NO: 672507 - RNA, 19 nt, Homo sapiens
ggugguggaugaccuucgu

SEQ ID NO: 672508 - RNA, 19 nt, Homo sapiens
cggucaagcuggauuucga

SEQ ID NO: 672509 - RNA, 19 nt, Homo sapiens
agaaguuccugaccaagcu

SEQ ID NO: 672510 - RNA, 19 nt, Homo sapiens
gcuaaauacguggagaaga

SEQ ID NO: 672511 - RNA, 19 nt, Homo sapiens
aguuugacaucauggaguu

SEQ ID NO: 672512 - RNA, 19 nt, Homo sapiens
cgccuucguugucggcauu

SEQ ID NO: 672513 - RNA, 19 nt, Homo sapiens
aggcugcccugacccacaa

SEQ ID NO: 672514 - RNA, 19 nt, Homo sapiens
gaaggaggccuggauucac

SEQ ID NO: 672515 - RNA, 19 nt, Homo sapiens
ggagccagaacuagugaag

SEQ ID NO: 672516 - RNA, 19 nt, Homo sapiens
acaggagccuugguguuca

SEQ ID NO: 672517 - RNA, 19 nt, Homo sapiens
cagaaccaagcuuaagaga

SEQ ID NO: 672518 - RNA, 19 nt, Homo sapiens
auuaugcccugcagaucaa

SEQ ID NO: 672519 - RNA, 19 nt, Homo sapiens
gcugagccgucgcagucau

SEQ ID NO: 672520 - RNA, 19 nt, Homo sapiens
ucgccugccuguuccugaa

SEQ ID NO: 672521 - RNA, 19 nt, Homo sapiens
ggauucacgcuaaauacgu

SEQ ID NO: 672522 - RNA, 19 nt, Homo sapiens
gauggcggagugucuggaa

SEQ ID NO: 672523 - RNA, 19 nt, Homo sapiens
gaagccgaagugucagaau

SEQ ID NO: 672524 - RNA, 19 nt, Homo sapiens
gaacauggcuucuugucua

SEQ ID NO: 672525 - RNA, 19 nt, Homo sapiens
gcagaaauauugcuaguuu

SEQ ID NO: 672526 - RNA, 19 nt, Homo sapiens
caaguaagcucgacccuuu

SEQ ID NO: 672527 - RNA, 19 nt, Homo sapiens
guaauucucuuucuccaua

SEQ ID NO: 672528 - RNA, 19 nt, Homo sapiens
gaacaacgaugaagaggau

SEQ ID NO: 672529 - RNA, 19 nt, Homo sapiens
ggacuggucucaccuuuau

SEQ ID NO: 672530 - RNA, 19 nt, Homo sapiens
gcacugaccuuccuuccaa

SEQ ID NO: 672531 - RNA, 19 nt, Homo sapiens
agagagaccugccaaguaa

SEQ ID NO: 672532 - RNA, 19 nt, Homo sapiens
gaaggcauguaaguuauaa

SEQ ID NO: 672533 - RNA, 19 nt, Homo sapiens
gcaaguagcacagcaaauu

SEQ ID NO: 672534 - RNA, 19 nt, Homo sapiens
cuacaguucugauggcuua

SEQ ID NO: 672535 - RNA, 19 nt, Homo sapiens
gcaaaggcuuaguaacuug

SEQ ID NO: 672536 - RNA, 19 nt, Homo sapiens
ggacaucccaucaccuuaa

SEQ ID NO: 672537 - RNA, 19 nt, Homo sapiens
gaucagcucucuagacucu

SEQ ID NO: 672538 - RNA, 19 nt, Homo sapiens
gaugaaguuugucuugaaa

SEQ ID NO: 672539 - RNA, 19 nt, Homo sapiens
gcaguggucucguggguau

SEQ ID NO: 672540 - RNA, 19 nt, Homo sapiens
guaagaacacuacugauga

SEQ ID NO: 672541 - RNA, 19 nt, Homo sapiens
cugaauaagugucaaacua

SEQ ID NO: 672542 - RNA, 19 nt, Homo sapiens
gaugagaugucaagcaaag

SEQ ID NO: 672543 - RNA, 19 nt, Homo sapiens
gaagcgggaguacguguua

SEQ ID NO: 672544 - RNA, 19 nt, Homo sapiens
gaccugggccucuccaaua

SEQ ID NO: 672545 - RNA, 19 nt, Homo sapiens
gagcaacggugugaauuuc

SEQ ID NO: 672546 - RNA, 19 nt, Homo sapiens
ucaacaagcugucggugaa

SEQ ID NO: 672547 - RNA, 19 nt, Homo sapiens
gacaacugcugcuggauga

SEQ ID NO: 672548 - RNA, 19 nt, Homo sapiens
gaaaggcccacucugaaga

SEQ ID NO: 672549 - RNA, 19 nt, Homo sapiens
aaugaaggcauguaaguua

SEQ ID NO: 672550 - RNA, 19 nt, Homo sapiens
ccacaaggaugagauguca

SEQ ID NO: 672551 - RNA, 19 nt, Homo sapiens
cauaggaucuggacucaag

SEQ ID NO: 672552 - RNA, 19 nt, Homo sapiens
agucauaaauccugaguga

SEQ ID NO: 672553 - RNA, 19 nt, Homo sapiens
uaacuuaucuugguauugc

SEQ ID NO: 672554 - RNA, 19 nt, Homo sapiens
gaugaccucucugacauug

SEQ ID NO: 672555 - RNA, 19 nt, Homo sapiens
acaaggagccugauggaaa

SEQ ID NO: 672556 - RNA, 19 nt, Homo sapiens
uaugcugaguuacaaguua

SEQ ID NO: 672557 - RNA, 19 nt, Homo sapiens
caaggagccugauggaaag

SEQ ID NO: 672558 - RNA, 19 nt, Homo sapiens
aauagcaccuugacaucua

SEQ ID NO: 672559 - RNA, 19 nt, Homo sapiens
ccacguggacccugcauuu

SEQ ID NO: 672560 - RNA, 19 nt, Homo sapiens
gcagaugacaguaaaauuu

SEQ ID NO: 672561 - RNA, 19 nt, Homo sapiens
cccauauguuccaguauua

SEQ ID NO: 672562 - RNA, 19 nt, Homo sapiens
acaagcaguuugguguuua

SEQ ID NO: 672563 - RNA, 19 nt, Homo sapiens
gggcaaagcgaaacgcaaa

SEQ ID NO: 672564 - RNA, 19 nt, Homo sapiens
cagagagaccugccaagua

SEQ ID NO: 672565 - RNA, 19 nt, Homo sapiens
gcagagaaucagaggcuaa

SEQ ID NO: 672566 - RNA, 19 nt, Homo sapiens
ugagaaacccuacaagugu

SEQ ID NO: 672567 - RNA, 19 nt, Homo sapiens
gucaagagaagaauguaua

SEQ ID NO: 672568 - RNA, 19 nt, Homo sapiens
ugaugaaguuugucuugaa

SEQ ID NO: 672569 - RNA, 19 nt, Homo sapiens
caucagacuucuacaagca

SEQ ID NO: 672570 - RNA, 19 nt, Homo sapiens
agaaggacaugaaggacaa

SEQ ID NO: 672571 - RNA, 19 nt, Homo sapiens
gcaagggcaaguucaagaa

SEQ ID NO: 672572 - RNA, 19 nt, Homo sapiens
ccgcaucccuggaggagaa

SEQ ID NO: 672573 - RNA, 19 nt, Homo sapiens
gucagaagcugcaccagau

SEQ ID NO: 672574 - RNA, 19 nt, Homo sapiens
acagaguauuguugaagua

SEQ ID NO: 672575 - RNA, 19 nt, Homo sapiens
guagcuuucugaauaagug

SEQ ID NO: 672576 - RNA, 19 nt, Homo sapiens
aagcgaaacgcaaagauaa

SEQ ID NO: 672577 - RNA, 19 nt, Homo sapiens
aaagcgaaacgcaaagaua

SEQ ID NO: 672578 - RNA, 19 nt, Homo sapiens
caguauauauagcagagaa

SEQ ID NO: 672579 - RNA, 19 nt, Homo sapiens
agaagagaguuuccacguu

SEQ ID NO: 672580 - RNA, 19 nt, Homo sapiens
guaaugaaggcauguaagu

SEQ ID NO: 672581 - RNA, 19 nt, Homo sapiens
ggauugcaaaggcuuagua

SEQ ID NO: 672582 - RNA, 19 nt, Homo sapiens
gugguuaucugcagcuugu

SEQ ID NO: 672583 - RNA, 19 nt, Homo sapiens
ggaaaggcccacucugaag

SEQ ID NO: 672584 - RNA, 19 nt, Homo sapiens
caacaaggagccugaugga

SEQ ID NO: 672585 - RNA, 19 nt, Homo sapiens
cuugacaucuacaacuuaa

SEQ ID NO: 672586 - RNA, 19 nt, Homo sapiens
acagaaaagugcaguaauu

SEQ ID NO: 672587 - RNA, 19 nt, Homo sapiens
agagaagaauguauacaca

SEQ ID NO: 672588 - RNA, 19 nt, Homo sapiens
gugagaaacccuacaagug

SEQ ID NO: 672589 - RNA, 19 nt, Homo sapiens
gauacacacaggugagaaa

SEQ ID NO: 672590 - RNA, 19 nt, Homo sapiens
ggccagacuugugugguaa

SEQ ID NO: 672591 - RNA, 19 nt, Homo sapiens
uaacuucccaucagacuuc

SEQ ID NO: 672592 - RNA, 19 nt, Homo sapiens
gcaaagcgaaacgcaaaga

SEQ ID NO: 672593 - RNA, 19 nt, Homo sapiens
gaggaggcccugcaucuca

SEQ ID NO: 672594 - RNA, 19 nt, Homo sapiens
uuagaaagcagucgggauu

SEQ ID NO: 672595 - RNA, 19 nt, Homo sapiens
gcaaauucuggauguauca

SEQ ID NO: 672596 - RNA, 19 nt, Homo sapiens
ggagaacaacgaugaagag

SEQ ID NO: 672597 - RNA, 19 nt, Homo sapiens
uacaagcaguuugguguuu

SEQ ID NO: 672598 - RNA, 19 nt, Homo sapiens
gcacucccguguccacaag

SEQ ID NO: 672599 - RNA, 19 nt, Homo sapiens
uauuacugcuugugucuga

SEQ ID NO: 672600 - RNA, 19 nt, Homo sapiens
gguuaucugcagcuuguua

SEQ ID NO: 672601 - RNA, 19 nt, Homo sapiens
gacuugcccuugucuguuc

SEQ ID NO: 672602 - RNA, 19 nt, Homo sapiens
aggaugagaugucaagcaa

SEQ ID NO: 672603 - RNA, 19 nt, Homo sapiens
gcagucagcauccuuaaaa

SEQ ID NO: 672604 - RNA, 19 nt, Homo sapiens
guuacaaguuaggucauuu

SEQ ID NO: 672605 - RNA, 19 nt, Homo sapiens
ugugcuguaugcugaguua

SEQ ID NO: 672606 - RNA, 19 nt, Homo sapiens
aaauggugauugaagcaaa

SEQ ID NO: 672607 - RNA, 19 nt, Homo sapiens
ugcaaaggcuuaguaacuu

SEQ ID NO: 672608 - RNA, 19 nt, Homo sapiens
uaucuggacuugcccuugu

SEQ ID NO: 672609 - RNA, 19 nt, Homo sapiens
gaaaccgaaccggaaauga

SEQ ID NO: 672610 - RNA, 19 nt, Homo sapiens
uaagaacacuacugaugac

SEQ ID NO: 672611 - RNA, 19 nt, Homo sapiens
ggaugguggugaggagaaa

SEQ ID NO: 672612 - RNA, 19 nt, Homo sapiens
aagcuuucauggacaguuu

SEQ ID NO: 672613 - RNA, 19 nt, Homo sapiens
caaaucaagaccacaagga

SEQ ID NO: 672614 - RNA, 19 nt, Homo sapiens
ugucaggucguccuauuaa

SEQ ID NO: 672615 - RNA, 19 nt, Homo sapiens
cauaaauccugagugacaa

SEQ ID NO: 672616 - RNA, 19 nt, Homo sapiens
ucauaaauccugagugaca

SEQ ID NO: 672617 - RNA, 19 nt, Homo sapiens
ggacuugcccuugucuguu

SEQ ID NO: 672618 - RNA, 19 nt, Homo sapiens
gcaacggugugaauuucca

SEQ ID NO: 672619 - RNA, 19 nt, Homo sapiens
gaucggaagagcuuaucaa

SEQ ID NO: 672620 - RNA, 19 nt, Homo sapiens
uaagcucgacccuuuagaa

SEQ ID NO: 672621 - RNA, 19 nt, Homo sapiens
gggcagaaccugggcauca

SEQ ID NO: 672622 - RNA, 19 nt, Homo sapiens
ugaaggcauguaaguuaua

SEQ ID NO: 672623 - RNA, 19 nt, Homo sapiens
gaauagcaccuugacaucu

SEQ ID NO: 672624 - RNA, 19 nt, Homo sapiens
gaaguucccugucuccauu

SEQ ID NO: 672625 - RNA, 19 nt, Homo sapiens
gaaccacucuggaacauuc

SEQ ID NO: 672626 - RNA, 19 nt, Homo sapiens
ccacagaaacuccaugaua

SEQ ID NO: 672627 - RNA, 19 nt, Homo sapiens
gagcaucacuguguaugaa

SEQ ID NO: 672628 - RNA, 19 nt, Homo sapiens
guaacacuguccagaauga

SEQ ID NO: 672629 - RNA, 19 nt, Homo sapiens
uuuaguagcugauuucuug

SEQ ID NO: 672630 - RNA, 19 nt, Homo sapiens
caacuuccuuccuuucuug

SEQ ID NO: 672631 - RNA, 19 nt, Homo sapiens
ugaaaucgcuaaagaacau

SEQ ID NO: 672632 - RNA, 19 nt, Homo sapiens
gagagaggcuucagaacca

SEQ ID NO: 672633 - RNA, 19 nt, Homo sapiens
gcaugaagguccacgugaa

SEQ ID NO: 672634 - RNA, 19 nt, Homo sapiens
gagcaggucugugaugaug

SEQ ID NO: 672635 - RNA, 19 nt, Homo sapiens
ggaacugucuacccugcua

SEQ ID NO: 672636 - RNA, 19 nt, Homo sapiens
ggaaaugaauggccguuac

SEQ ID NO: 672637 - RNA, 19 nt, Homo sapiens
ggacugaggagaagaacaa

SEQ ID NO: 672638 - RNA, 19 nt, Homo sapiens
gaacauucaggccaccaua

SEQ ID NO: 672639 - RNA, 19 nt, Homo sapiens
ccuguaaggugcuccuaua

SEQ ID NO: 672640 - RNA, 19 nt, Homo sapiens
gaaaccaucguauguaaca

SEQ ID NO: 672641 - RNA, 19 nt, Homo sapiens
gacuucagcugccuuucua

SEQ ID NO: 672642 - RNA, 19 nt, Homo sapiens
cagagaagcugcaguacag

SEQ ID NO: 672643 - RNA, 19 nt, Homo sapiens
ucaggaaacuucuagaucu

SEQ ID NO: 672644 - RNA, 19 nt, Homo sapiens
cuggauggcugugaaauuu

SEQ ID NO: 672645 - RNA, 19 nt, Homo sapiens
acacggagcugcccucuac

SEQ ID NO: 672646 - RNA, 19 nt, Homo sapiens
caaccuggauggcugugaa

SEQ ID NO: 672647 - RNA, 19 nt, Homo sapiens
gaaccaacggcgucccuuu

SEQ ID NO: 672648 - RNA, 19 nt, Homo sapiens
gggaugauguggagaccuu

SEQ ID NO: 672649 - RNA, 19 nt, Homo sapiens
aggaaaccaucguauguaa

SEQ ID NO: 672650 - RNA, 19 nt, Homo sapiens
gaggaaaccaucguaugua

SEQ ID NO: 672651 - RNA, 19 nt, Homo sapiens
ggaagaggaaaccaucgua

SEQ ID NO: 672652 - RNA, 19 nt, Homo sapiens
acacagagaagcugcagua

SEQ ID NO: 672653 - RNA, 19 nt, Homo sapiens
gcaaucaggaucucaggaa

SEQ ID NO: 672654 - RNA, 19 nt, Homo sapiens
ggaggaggauaagcaauca

SEQ ID NO: 672655 - RNA, 19 nt, Homo sapiens
ucaaaucaccugcuccauu

SEQ ID NO: 672656 - RNA, 19 nt, Homo sapiens
gcccagcuguggacuuuga

SEQ ID NO: 672657 - RNA, 19 nt, Homo sapiens
ucaacgaugugaacgaguu

SEQ ID NO: 672658 - RNA, 19 nt, Homo sapiens
gggcuggacuauagggauu

SEQ ID NO: 672659 - RNA, 19 nt, Homo sapiens
guccacggcuguaggauug

SEQ ID NO: 672660 - RNA, 19 nt, Homo sapiens
gaagaggaaaccaucguau

SEQ ID NO: 672661 - RNA, 19 nt, Homo sapiens
gcugggagcuuggcuuugu

SEQ ID NO: 672662 - RNA, 19 nt, Homo sapiens
ccgcaacccucaucauugu

SEQ ID NO: 672663 - RNA, 19 nt, Homo sapiens
cacagaaacuccaugauac

SEQ ID NO: 672664 - RNA, 19 nt, Homo sapiens
caugaacacucugcgcuuu

SEQ ID NO: 672665 - RNA, 19 nt, Homo sapiens
ggagaguggccucaaguug

SEQ ID NO: 672666 - RNA, 19 nt, Homo sapiens
uaucuucacuucucuccuu

SEQ ID NO: 672667 - RNA, 19 nt, Homo sapiens
caacaccccuuuccucauu

SEQ ID NO: 672668 - RNA, 19 nt, Homo sapiens
caaucaggaucucaggaaa

SEQ ID NO: 672669 - RNA, 19 nt, Homo sapiens
gaugaagcauggcguaacu

SEQ ID NO: 672670 - RNA, 19 nt, Homo sapiens
gaacaaaaggaucgaauau

SEQ ID NO: 672671 - RNA, 19 nt, Homo sapiens
cacgugaaaucgcuaaaga

SEQ ID NO: 672672 - RNA, 19 nt, Homo sapiens
gcaucacuguguaugaaga

SEQ ID NO: 672673 - RNA, 19 nt, Homo sapiens
ugggagaagugcagaguga

SEQ ID NO: 672674 - RNA, 19 nt, Homo sapiens
acacacgcaugucggauga

SEQ ID NO: 672675 - RNA, 19 nt, Homo sapiens
ggagacaacaguacagaca

SEQ ID NO: 672676 - RNA, 19 nt, Homo sapiens
gaggacggcuucucucacu

SEQ ID NO: 672677 - RNA, 19 nt, Homo sapiens
gcugugaccgugacaacua

SEQ ID NO: 672678 - RNA, 19 nt, Homo sapiens
caggaaacuucuagaucuu

SEQ ID NO: 672679 - RNA, 19 nt, Homo sapiens
gaaacagacacuccagaca

SEQ ID NO: 672680 - RNA, 19 nt, Homo sapiens
cuauauaucuucacuucuc

SEQ ID NO: 672681 - RNA, 19 nt, Homo sapiens
gaagaacaaagagaaggaa

SEQ ID NO: 672682 - RNA, 19 nt, Homo sapiens
uaaucuaucccuucccuuu

SEQ ID NO: 672683 - RNA, 19 nt, Homo sapiens
gaaccaguccuccuuucau

SEQ ID NO: 672684 - RNA, 19 nt, Homo sapiens
ggaauucugcccuggugaa

SEQ ID NO: 672685 - RNA, 19 nt, Homo sapiens
ggauggcugugaaauuucu

SEQ ID NO: 672686 - RNA, 19 nt, Homo sapiens
ggucaucgagugccucuau

SEQ ID NO: 672687 - RNA, 19 nt, Homo sapiens
gaaaagggagacaacagua

SEQ ID NO: 672688 - RNA, 19 nt, Homo sapiens
gcaggucugugaugaugag

SEQ ID NO: 672689 - RNA, 19 nt, Homo sapiens
ggagaccugugaugaacca

SEQ ID NO: 672690 - RNA, 19 nt, Homo sapiens
ugucuacccugcuauagga

SEQ ID NO: 672691 - RNA, 19 nt, Homo sapiens
ggaaacuucuagaucuuuu

SEQ ID NO: 672692 - RNA, 19 nt, Homo sapiens
cuagccagcucccacagaa

SEQ ID NO: 672693 - RNA, 19 nt, Homo sapiens
gcugauuucuuguccucaa

SEQ ID NO: 672694 - RNA, 19 nt, Homo sapiens
gcuuaugacugugggaaga

SEQ ID NO: 672695 - RNA, 19 nt, Homo sapiens
ccaacuuccuuccuuucuu

SEQ ID NO: 672696 - RNA, 19 nt, Homo sapiens
caucgucccugcuucucuu

SEQ ID NO: 672697 - RNA, 19 nt, Homo sapiens
gaaggacuuucugggaaca

SEQ ID NO: 672698 - RNA, 19 nt, Homo sapiens
gggcuuggcugggagaagu

SEQ ID NO: 672699 - RNA, 19 nt, Homo sapiens
aaccaguccuccuuucauu

SEQ ID NO: 672700 - RNA, 19 nt, Homo sapiens
caacggcgucccuuuguuc

SEQ ID NO: 672701 - RNA, 19 nt, Homo sapiens
ccaacggcgucccuuuguu

SEQ ID NO: 672702 - RNA, 19 nt, Homo sapiens
caacaagggcaagaaggaa

SEQ ID NO: 672703 - RNA, 19 nt, Homo sapiens
uggcguaacucccaacaag

SEQ ID NO: 672704 - RNA, 19 nt, Homo sapiens
caacacgguccuacugaau

SEQ ID NO: 672705 - RNA, 19 nt, Homo sapiens
ccaccucauuuccauuuca

SEQ ID NO: 672706 - RNA, 19 nt, Homo sapiens
aaucggcaguccuguguga

SEQ ID NO: 672707 - RNA, 19 nt, Homo sapiens
guggagagcaucacugugu

SEQ ID NO: 672708 - RNA, 19 nt, Homo sapiens
ccgcccagcuguggacuuu

SEQ ID NO: 672709 - RNA, 19 nt, Homo sapiens
cagaucugcuacuaugaga

SEQ ID NO: 672710 - RNA, 19 nt, Homo sapiens
gauaagcaaucaggaucuc

SEQ ID NO: 672711 - RNA, 19 nt, Homo sapiens
gggaggggcuggacuauag

SEQ ID NO: 672712 - RNA, 19 nt, Homo sapiens
gaggagaagaacaaagaga

SEQ ID NO: 672713 - RNA, 19 nt, Homo sapiens
gcagccugaucuacugguu

SEQ ID NO: 672714 - RNA, 19 nt, Homo sapiens
ggaacaaaaggaucgaaua

SEQ ID NO: 672715 - RNA, 19 nt, Homo sapiens
agccagaucugcuacuaug

SEQ ID NO: 672716 - RNA, 19 nt, Homo sapiens
gacaacacgguccuacuga

SEQ ID NO: 672717 - RNA, 19 nt, Homo sapiens
gcucacggccuugugugua

SEQ ID NO: 672718 - RNA, 19 nt, Homo sapiens
gggagagggugacgauugc

SEQ ID NO: 672719 - RNA, 19 nt, Homo sapiens
ggacuucagcugccuuucu

SEQ ID NO: 672720 - RNA, 19 nt, Homo sapiens
aaacagacacuccagacau

SEQ ID NO: 672721 - RNA, 19 nt, Homo sapiens
ggccguuacuccagcaaug

SEQ ID NO: 672722 - RNA, 19 nt, Homo sapiens
gaaaugaauggccguuacu

SEQ ID NO: 672723 - RNA, 19 nt, Homo sapiens
ugaguugggaggaggauaa

SEQ ID NO: 672724 - RNA, 19 nt, Homo sapiens
gaaaguggaugaagcauga

SEQ ID NO: 672725 - RNA, 19 nt, Homo sapiens
gaagaaccuuucagauaaa

SEQ ID NO: 672726 - RNA, 19 nt, Homo sapiens
ggacuccucuauauaauug

SEQ ID NO: 672727 - RNA, 19 nt, Homo sapiens
ggacacgaguuucuuuaaa

SEQ ID NO: 672728 - RNA, 19 nt, Homo sapiens
gaagagguuuccugaagaa

SEQ ID NO: 672729 - RNA, 19 nt, Homo sapiens
ggaccgcacuggaaacgua

SEQ ID NO: 672730 - RNA, 19 nt, Homo sapiens
ggaugaagcaugauaauga

SEQ ID NO: 672731 - RNA, 19 nt, Homo sapiens
gaagauagaaaguggauga

SEQ ID NO: 672732 - RNA, 19 nt, Homo sapiens
gagcugagcccuucccuuu

SEQ ID NO: 672733 - RNA, 19 nt, Homo sapiens
gaagcgaccucucucuguu

SEQ ID NO: 672734 - RNA, 19 nt, Homo sapiens
gcaagugucuacugcuuug

SEQ ID NO: 672735 - RNA, 19 nt, Homo sapiens
ccaagaagaugcccaagau

SEQ ID NO: 672736 - RNA, 19 nt, Homo sapiens
gaugaagcaugauaaugaa

SEQ ID NO: 672737 - RNA, 19 nt, Homo sapiens
gaaggcaaauuauagaagu

SEQ ID NO: 672738 - RNA, 19 nt, Homo sapiens
gaagggauuugguuauaag

SEQ ID NO: 672739 - RNA, 19 nt, Homo sapiens
gagcaagggucccaaugug

SEQ ID NO: 672740 - RNA, 19 nt, Homo sapiens
gaagcaugauaaugaaaga

SEQ ID NO: 672741 - RNA, 19 nt, Homo sapiens
ugacacaucucagcaaaga

SEQ ID NO: 672742 - RNA, 19 nt, Homo sapiens
gaagagaggaaauguggaa

SEQ ID NO: 672743 - RNA, 19 nt, Homo sapiens
caaagacaauguggaaaga

SEQ ID NO: 672744 - RNA, 19 nt, Homo sapiens
aaaugggaauggugaguua

SEQ ID NO: 672745 - RNA, 19 nt, Homo sapiens
ggaaacccaugccaacugu

SEQ ID NO: 672746 - RNA, 19 nt, Homo sapiens
gcauauuucuggaagauag

SEQ ID NO: 672747 - RNA, 19 nt, Homo sapiens
cagaaaagcuggucaaguu

SEQ ID NO: 672748 - RNA, 19 nt, Homo sapiens
aagagaagacugagaauaa

SEQ ID NO: 672749 - RNA, 19 nt, Homo sapiens
caugugaacugcuucuuau

SEQ ID NO: 672750 - RNA, 19 nt, Homo sapiens
cgaagaugcuguuccaugu

SEQ ID NO: 672751 - RNA, 19 nt, Homo sapiens
gauuugagguguauuuaag

SEQ ID NO: 672752 - RNA, 19 nt, Homo sapiens
gguggacuccucuauauaa

SEQ ID NO: 672753 - RNA, 19 nt, Homo sapiens
aaacaaagacaauguggaa

SEQ ID NO: 672754 - RNA, 19 nt, Homo sapiens
uagaagagguuuccugaag

SEQ ID NO: 672755 - RNA, 19 nt, Homo sapiens
aagaauuacuccaguugua

SEQ ID NO: 672756 - RNA, 19 nt, Homo sapiens
gagagaacccuguuaucaa

SEQ ID NO: 672757 - RNA, 19 nt, Homo sapiens
gagaagagagucagaaucu

SEQ ID NO: 672758 - RNA, 19 nt, Homo sapiens
agauauugcuggaugagua

SEQ ID NO: 672759 - RNA, 19 nt, Homo sapiens
uaagaaaaguuacgaggua

SEQ ID NO: 672760 - RNA, 19 nt, Homo sapiens
gaggcccacucguaauuaa

SEQ ID NO: 672761 - RNA, 19 nt, Homo sapiens
gcauuuacuuuacugacaa

SEQ ID NO: 672762 - RNA, 19 nt, Homo sapiens
caacaucccgucucuacaa

SEQ ID NO: 672763 - RNA, 19 nt, Homo sapiens
agagaacccuguuaucaau

SEQ ID NO: 672764 - RNA, 19 nt, Homo sapiens
ggaagcugcuaagucgaua

SEQ ID NO: 672765 - RNA, 19 nt, Homo sapiens
gagggaagaggaauaagaa

SEQ ID NO: 672766 - RNA, 19 nt, Homo sapiens
ugaagggauuugguuauaa

SEQ ID NO: 672767 - RNA, 19 nt, Homo sapiens
gaaauuguaccuccucaca

SEQ ID NO: 672768 - RNA, 19 nt, Homo sapiens
gcaagggucccaaugugaa

SEQ ID NO: 672769 - RNA, 19 nt, Homo sapiens
gaggucaacugcaccaauc

SEQ ID NO: 672770 - RNA, 19 nt, Homo sapiens
gaagagagucagaaucuac

SEQ ID NO: 672771 - RNA, 19 nt, Homo sapiens
gacacgaguuucuuuaaag

SEQ ID NO: 672772 - RNA, 19 nt, Homo sapiens
ggagggaagaggaauaaga

SEQ ID NO: 672773 - RNA, 19 nt, Homo sapiens
gaauggugaguuagaaauu

SEQ ID NO: 672774 - RNA, 19 nt, Homo sapiens
cugaagggauuugguuaua

SEQ ID NO: 672775 - RNA, 19 nt, Homo sapiens
gacaauguggaaagaauaa

SEQ ID NO: 672776 - RNA, 19 nt, Homo sapiens
aaagaaaacugaagggauu

SEQ ID NO: 672777 - RNA, 19 nt, Homo sapiens
ucccagaaauugaagauau

SEQ ID NO: 672778 - RNA, 19 nt, Homo sapiens
agagaucccugccuacaug

SEQ ID NO: 672779 - RNA, 19 nt, Homo sapiens
gcucuggaguggaugcaaa

SEQ ID NO: 672780 - RNA, 19 nt, Homo sapiens
agaaagagaagacugagaa

SEQ ID NO: 672781 - RNA, 19 nt, Homo sapiens
gagauuugagguguauuua

SEQ ID NO: 672782 - RNA, 19 nt, Homo sapiens
aaacccaugccaacuguua

SEQ ID NO: 672783 - RNA, 19 nt, Homo sapiens
caggcagucuccacuauug

SEQ ID NO: 672784 - RNA, 19 nt, Homo sapiens
aagcugaucugaacaacau

SEQ ID NO: 672785 - RNA, 19 nt, Homo sapiens
cgagagaacccuguuauca

SEQ ID NO: 672786 - RNA, 19 nt, Homo sapiens
gaagagaucccugccuaca

SEQ ID NO: 672787 - RNA, 19 nt, Homo sapiens
uaccauggcuguguuauag

SEQ ID NO: 672788 - RNA, 19 nt, Homo sapiens
uuuaaagucuccaagaaga

SEQ ID NO: 672789 - RNA, 19 nt, Homo sapiens
gcaugugccugugguccua

SEQ ID NO: 672790 - RNA, 19 nt, Homo sapiens
gaagaaacagaccuaacug

SEQ ID NO: 672791 - RNA, 19 nt, Homo sapiens
caacauaaccccaaagaga

SEQ ID NO: 672792 - RNA, 19 nt, Homo sapiens
agaagagguuuccugaaga

SEQ ID NO: 672793 - RNA, 19 nt, Homo sapiens
cuugucuacugaagaauua

SEQ ID NO: 672794 - RNA, 19 nt, Homo sapiens
aagcuugucuacugaagaa

SEQ ID NO: 672795 - RNA, 19 nt, Homo sapiens
acacaucucagcaaagaaa

SEQ ID NO: 672796 - RNA, 19 nt, Homo sapiens
gagaagacugagaauaaga

SEQ ID NO: 672797 - RNA, 19 nt, Homo sapiens
ccacuauugauaccaguua

SEQ ID NO: 672798 - RNA, 19 nt, Homo sapiens
gaggaucucagcauauuuc

SEQ ID NO: 672799 - RNA, 19 nt, Homo sapiens
gguuauaaguggagaggau

SEQ ID NO: 672800 - RNA, 19 nt, Homo sapiens
ccucgaagccgugccaaua

SEQ ID NO: 672801 - RNA, 19 nt, Homo sapiens
ccaugugaacugcuucuua

SEQ ID NO: 672802 - RNA, 19 nt, Homo sapiens
aaagagaagacugagaaua

SEQ ID NO: 672803 - RNA, 19 nt, Homo sapiens
ggaauggugaguuagaaau

SEQ ID NO: 672804 - RNA, 19 nt, Homo sapiens
caugccaacuguuauacaa

SEQ ID NO: 672805 - RNA, 19 nt, Homo sapiens
aaaggguucuguucacguu

SEQ ID NO: 672806 - RNA, 19 nt, Homo sapiens
gaaagagaagacugagaau

SEQ ID NO: 672807 - RNA, 19 nt, Homo sapiens
cagagagauuugaggugua

SEQ ID NO: 672808 - RNA, 19 nt, Homo sapiens
aagaugcuguuccauguga

SEQ ID NO: 672809 - RNA, 19 nt, Homo sapiens
gcagucuccacuauugaua

SEQ ID NO: 672810 - RNA, 19 nt, Homo sapiens
gaagaauuacuccaguugu

SEQ ID NO: 672811 - RNA, 19 nt, Homo sapiens
aauguaagcugaucugaac

SEQ ID NO: 672812 - RNA, 19 nt, Homo sapiens
ucgaagccgugccaauauu

SEQ ID NO: 672813 - RNA, 19 nt, Homo sapiens
guacugggcucuacauacc

SEQ ID NO: 672814 - RNA, 19 nt, Homo sapiens
ggaagcgaccucucucugu

SEQ ID NO: 672815 - RNA, 19 nt, Homo sapiens
cugcagaggugcuaugcuu

SEQ ID NO: 672816 - RNA, 19 nt, Homo sapiens
ugacaaacucugagggaaa

SEQ ID NO: 672817 - RNA, 19 nt, Homo sapiens
cagcauauuucuggaagau

SEQ ID NO: 672818 - RNA, 19 nt, Homo sapiens
gaccugaagauacagauug

SEQ ID NO: 672819 - RNA, 19 nt, Homo sapiens
agaacccuguuaucaauga

SEQ ID NO: 672820 - RNA, 19 nt, Homo sapiens
gcuuuagccuuuccucuag

SEQ ID NO: 672821 - RNA, 19 nt, Homo sapiens
gguggcggcuugcucauag

SEQ ID NO: 672822 - RNA, 19 nt, Homo sapiens
gauguucucccaccaagug

SEQ ID NO: 672823 - RNA, 19 nt, Homo sapiens
gcauggaccgcacuggaaa

SEQ ID NO: 672824 - RNA, 19 nt, Homo sapiens
gaacgacacuuacaagaaa

SEQ ID NO: 672825 - RNA, 19 nt, Homo sapiens
gaaacaacagcaagaauua

SEQ ID NO: 672826 - RNA, 19 nt, Homo sapiens
gaaaugaggcuacuuaugu

SEQ ID NO: 672827 - RNA, 19 nt, Homo sapiens
gaacaggaaguauucuuua

SEQ ID NO: 672828 - RNA, 19 nt, Homo sapiens
ugacuaaggugacuuugua

SEQ ID NO: 672829 - RNA, 19 nt, Homo sapiens
uaaagucacuacucagaua

SEQ ID NO: 672830 - RNA, 19 nt, Homo sapiens
gguagagauugacauauua

SEQ ID NO: 672831 - RNA, 19 nt, Homo sapiens
gaagagaaacuuugccuuu

SEQ ID NO: 672832 - RNA, 19 nt, Homo sapiens
gcagagaguugggauaauu

SEQ ID NO: 672833 - RNA, 19 nt, Homo sapiens
agaaagaguuguccaaauu

SEQ ID NO: 672834 - RNA, 19 nt, Homo sapiens
gaaagaaguggucgaagua

SEQ ID NO: 672835 - RNA, 19 nt, Homo sapiens
gaaguaggccagaaauuaa

SEQ ID NO: 672836 - RNA, 19 nt, Homo sapiens
gaaaguggaugaagacagu

SEQ ID NO: 672837 - RNA, 19 nt, Homo sapiens
gaacagcaguaaucaagga

SEQ ID NO: 672838 - RNA, 19 nt, Homo sapiens
caauacaagugaugugaua

SEQ ID NO: 672839 - RNA, 19 nt, Homo sapiens
ggaaagaaguggucgaagu

SEQ ID NO: 672840 - RNA, 19 nt, Homo sapiens
guaaaugucuguagcacuu

SEQ ID NO: 672841 - RNA, 19 nt, Homo sapiens
gagagagagugccugaaua

SEQ ID NO: 672842 - RNA, 19 nt, Homo sapiens
caaauaugcuguugacuca

SEQ ID NO: 672843 - RNA, 19 nt, Homo sapiens
gcaaagacaucagcuacuu

SEQ ID NO: 672844 - RNA, 19 nt, Homo sapiens
ggcaugagcuaauaauuga

SEQ ID NO: 672845 - RNA, 19 nt, Homo sapiens
gagagugccugaauaacaa

SEQ ID NO: 672846 - RNA, 19 nt, Homo sapiens
cgaaguaggccagaaauua

SEQ ID NO: 672847 - RNA, 19 nt, Homo sapiens
ggaacaaccucuuuuaaaa

SEQ ID NO: 672848 - RNA, 19 nt, Homo sapiens
gaauggccauguuuaagaa

SEQ ID NO: 672849 - RNA, 19 nt, Homo sapiens
gaaagaaggaggaacaaga

SEQ ID NO: 672850 - RNA, 19 nt, Homo sapiens
uaaagacaguggaucgaua

SEQ ID NO: 672851 - RNA, 19 nt, Homo sapiens
gagcaagacugcccaagau

SEQ ID NO: 672852 - RNA, 19 nt, Homo sapiens
caucaaagauaguuacaga

SEQ ID NO: 672853 - RNA, 19 nt, Homo sapiens
caacaacgagaacaaauuu

SEQ ID NO: 672854 - RNA, 19 nt, Homo sapiens
ccaagaaacuguggacauu

SEQ ID NO: 672855 - RNA, 19 nt, Homo sapiens
gaaagaguuguccaaauuu

SEQ ID NO: 672856 - RNA, 19 nt, Homo sapiens
gagaaagaguuguccaaau

SEQ ID NO: 672857 - RNA, 19 nt, Homo sapiens
gcaauaaacaguucagaga

SEQ ID NO: 672858 - RNA, 19 nt, Homo sapiens
gcaaagagcccaacaacag

SEQ ID NO: 672859 - RNA, 19 nt, Homo sapiens
gaagaaaacacgcaaauuu

SEQ ID NO: 672860 - RNA, 19 nt, Homo sapiens
ggaagacacccaagagaaa

SEQ ID NO: 672861 - RNA, 19 nt, Homo sapiens
agaaauggcugagauagaa

SEQ ID NO: 672862 - RNA, 19 nt, Homo sapiens
ggguaucacuuuaauagaa

SEQ ID NO: 672863 - RNA, 19 nt, Homo sapiens
gcauugaacuacuuacaug

SEQ ID NO: 672864 - RNA, 19 nt, Homo sapiens
gaacuugagagaccauuaa

SEQ ID NO: 672865 - RNA, 19 nt, Homo sapiens
gaaccuuguuugucaguga

SEQ ID NO: 672866 - RNA, 19 nt, Homo sapiens
caucuuagcuaauucuguu

SEQ ID NO: 672867 - RNA, 19 nt, Homo sapiens
uaccugagcugguuaaaug

SEQ ID NO: 672868 - RNA, 19 nt, Homo sapiens
gcucgaagaacgacacuua

SEQ ID NO: 672869 - RNA, 19 nt, Homo sapiens
gaaggaggaacaagaguuu

SEQ ID NO: 672870 - RNA, 19 nt, Homo sapiens
caaaggagaacaagagaaa

SEQ ID NO: 672871 - RNA, 19 nt, Homo sapiens
gaacaagcaauaaacaguu

SEQ ID NO: 672872 - RNA, 19 nt, Homo sapiens
cguaguaacucugaagaua

SEQ ID NO: 672873 - RNA, 19 nt, Homo sapiens
ggacagacccuaugacuac

SEQ ID NO: 672874 - RNA, 19 nt, Homo sapiens
gaaaacuguuggagaaaua

SEQ ID NO: 672875 - RNA, 19 nt, Homo sapiens
aagcaaagaugaagggaaa

SEQ ID NO: 672876 - RNA, 19 nt, Homo sapiens
gaaguagucaugugugaaa

SEQ ID NO: 672877 - RNA, 19 nt, Homo sapiens
ggguuuggcucuuucagua

SEQ ID NO: 672878 - RNA, 19 nt, Homo sapiens
guaacaacaucaaagauag

SEQ ID NO: 672879 - RNA, 19 nt, Homo sapiens
gaacauaauggacaucaau

SEQ ID NO: 672880 - RNA, 19 nt, Homo sapiens
gcaaacaguagauuuaguu

SEQ ID NO: 672881 - RNA, 19 nt, Homo sapiens
ucagauagcucaugaagac

SEQ ID NO: 672882 - RNA, 19 nt, Homo sapiens
caacaaacccauccgagaa

SEQ ID NO: 672883 - RNA, 19 nt, Homo sapiens
cagagcaaaugcagcguua

SEQ ID NO: 672884 - RNA, 19 nt, Homo sapiens
gcaaagaggaagaugaaga

SEQ ID NO: 672885 - RNA, 19 nt, Homo sapiens
guacaaggcccagaauaaa

SEQ ID NO: 672886 - RNA, 19 nt, Homo sapiens
ugacguaacuucucaaugc

SEQ ID NO: 672887 - RNA, 19 nt, Homo sapiens
agagagaaauugagaccua

SEQ ID NO: 672888 - RNA, 19 nt, Homo sapiens
gaggaacauacaagaauua

SEQ ID NO: 672889 - RNA, 19 nt, Homo sapiens
gcagaguaaugaugggaaa

SEQ ID NO: 672890 - RNA, 19 nt, Homo sapiens
ggacauuaauucagucagu

SEQ ID NO: 672891 - RNA, 19 nt, Homo sapiens
aagaaacuguggacauuaa

SEQ ID NO: 672892 - RNA, 19 nt, Homo sapiens
cacuaaaucugaagaagaa

SEQ ID NO: 672893 - RNA, 19 nt, Homo sapiens
ucaaacagcagcuuaaaga

SEQ ID NO: 672894 - RNA, 19 nt, Homo sapiens
caagaaacaagaagacaaa

SEQ ID NO: 672895 - RNA, 19 nt, Homo sapiens
cagcagauguggcucagaa

SEQ ID NO: 672896 - RNA, 19 nt, Homo sapiens
ccagauggucuucaaauuu

SEQ ID NO: 672897 - RNA, 19 nt, Homo sapiens
agagauuccuuuauuggua

SEQ ID NO: 672898 - RNA, 19 nt, Homo sapiens
cgacggagccuuugggaaa

SEQ ID NO: 672899 - RNA, 19 nt, Homo sapiens
ggaacacugauucauauuu

SEQ ID NO: 672900 - RNA, 19 nt, Homo sapiens
ggaacaggaaguauucuuu

SEQ ID NO: 672901 - RNA, 19 nt, Homo sapiens
gcaacaacgagaacaaauu

SEQ ID NO: 672902 - RNA, 19 nt, Homo sapiens
ucaggaacuucgggaauua

SEQ ID NO: 672903 - RNA, 19 nt, Homo sapiens
gaagaagaacuugaagauu

SEQ ID NO: 672904 - RNA, 19 nt, Homo sapiens
ggaguuagaugaggaacau

SEQ ID NO: 672905 - RNA, 19 nt, Homo sapiens
gaacaagagcacacaaauc

SEQ ID NO: 672906 - RNA, 19 nt, Homo sapiens
cuacucagauagauaaaga

SEQ ID NO: 672907 - RNA, 19 nt, Homo sapiens
ggucagacaguauuauaaa

SEQ ID NO: 672908 - RNA, 19 nt, Homo sapiens
gaaggaaacagagcaaaug

SEQ ID NO: 672909 - RNA, 19 nt, Homo sapiens
uagcuaauauugagagaga

SEQ ID NO: 672910 - RNA, 19 nt, Homo sapiens
acacgcaaauuuauuguug

SEQ ID NO: 672911 - RNA, 19 nt, Homo sapiens
caaguaagcgugcaucuuc

SEQ ID NO: 672912 - RNA, 19 nt, Homo sapiens
gaggacaauucaaagaaga

SEQ ID NO: 672913 - RNA, 19 nt, Homo sapiens
caacauucucuuuaccuua

SEQ ID NO: 672914 - RNA, 19 nt, Homo sapiens
gcaacauucucuuuaccuu

SEQ ID NO: 672915 - RNA, 19 nt, Homo sapiens
gaaauugagaccuaggaaa

SEQ ID NO: 672916 - RNA, 19 nt, Homo sapiens
gaucaguauuucaugcaaa

SEQ ID NO: 672917 - RNA, 19 nt, Homo sapiens
caaagauaguuacagauag

SEQ ID NO: 672918 - RNA, 19 nt, Homo sapiens
uauuaccgaugcucaguua

SEQ ID NO: 672919 - RNA, 19 nt, Homo sapiens
ggcgaaggcugaaguaaca

SEQ ID NO: 672920 - RNA, 19 nt, Homo sapiens
cagacagacucaagaaaga

SEQ ID NO: 672921 - RNA, 19 nt, Homo sapiens
aagauaaacucaacagcaa

SEQ ID NO: 672922 - RNA, 19 nt, Homo sapiens
guaguaacucugaagauaa

SEQ ID NO: 672923 - RNA, 19 nt, Homo sapiens
ugaaguaacagaagaaguu

SEQ ID NO: 672924 - RNA, 19 nt, Homo sapiens
ggacaaagcuucuauagca

SEQ ID NO: 672925 - RNA, 19 nt, Homo sapiens
guagcaagcuucagaaaua

SEQ ID NO: 672926 - RNA, 19 nt, Homo sapiens
gcccacaacugaagaauua

SEQ ID NO: 672927 - RNA, 19 nt, Homo sapiens
ggaauaaagucagauguaa

SEQ ID NO: 672928 - RNA, 19 nt, Homo sapiens
gaagagagucgacaguuua

SEQ ID NO: 672929 - RNA, 19 nt, Homo sapiens
gcacagcgaugguaagaga

SEQ ID NO: 672930 - RNA, 19 nt, Homo sapiens
gcacagaaauggaaguuca

SEQ ID NO: 672931 - RNA, 19 nt, Homo sapiens
ccacaaaggugaugaagug

SEQ ID NO: 672932 - RNA, 19 nt, Homo sapiens
ccaaacaccucccuucaaa

SEQ ID NO: 672933 - RNA, 19 nt, Homo sapiens
cgaaggauccugcgauuua

SEQ ID NO: 672934 - RNA, 19 nt, Homo sapiens
ggaauugccugaucaagau

SEQ ID NO: 672935 - RNA, 19 nt, Homo sapiens
gagaggagcugauaagaag

SEQ ID NO: 672936 - RNA, 19 nt, Homo sapiens
ccacaagaccucucuauaa

SEQ ID NO: 672937 - RNA, 19 nt, Homo sapiens
caacagaccaucuaagaaa

SEQ ID NO: 672938 - RNA, 19 nt, Homo sapiens
ggagacaguuucuagcaaa

SEQ ID NO: 672939 - RNA, 19 nt, Homo sapiens
gagauacacuuaguacaaa

SEQ ID NO: 672940 - RNA, 19 nt, Homo sapiens
ggagaauacucuuguuuca

SEQ ID NO: 672941 - RNA, 19 nt, Homo sapiens
gaaacucucuauuauugug

SEQ ID NO: 672942 - RNA, 19 nt, Homo sapiens
gaaggauccugcgauuuaa

SEQ ID NO: 672943 - RNA, 19 nt, Homo sapiens
gaacuuaaacgcagacuca

SEQ ID NO: 672944 - RNA, 19 nt, Homo sapiens
gaagaccagcgacaaauuu

SEQ ID NO: 672945 - RNA, 19 nt, Homo sapiens
aaagucagauguaauguga

SEQ ID NO: 672946 - RNA, 19 nt, Homo sapiens
gagcuucuacugacucuua

SEQ ID NO: 672947 - RNA, 19 nt, Homo sapiens
ggaaauccgacaacaaauu

SEQ ID NO: 672948 - RNA, 19 nt, Homo sapiens
gaacagaaccacucucuac

SEQ ID NO: 672949 - RNA, 19 nt, Homo sapiens
ugaagugccucccauuaaa

SEQ ID NO: 672950 - RNA, 19 nt, Homo sapiens
gaaauccgacaacaaauug

SEQ ID NO: 672951 - RNA, 19 nt, Homo sapiens
gaagauauccacacgacaa

SEQ ID NO: 672952 - RNA, 19 nt, Homo sapiens
gggaaacuauccaccauug

SEQ ID NO: 672953 - RNA, 19 nt, Homo sapiens
guaaauaccaccuugcauu

SEQ ID NO: 672954 - RNA, 19 nt, Homo sapiens
cacaagaccucucuauaau

SEQ ID NO: 672955 - RNA, 19 nt, Homo sapiens
uaagaggacugggaauaaa

SEQ ID NO: 672956 - RNA, 19 nt, Homo sapiens
gauaagaggacugggaaua

SEQ ID NO: 672957 - RNA, 19 nt, Homo sapiens
gaauuuaaccuccugaugu

SEQ ID NO: 672958 - RNA, 19 nt, Homo sapiens
gaugaagugccucccauua

SEQ ID NO: 672959 - RNA, 19 nt, Homo sapiens
caagaccucucuauaaugg

SEQ ID NO: 672960 - RNA, 19 nt, Homo sapiens
ugaagagagucgacaguuu

SEQ ID NO: 672961 - RNA, 19 nt, Homo sapiens
gagcaaagaaacauccuaa

SEQ ID NO: 672962 - RNA, 19 nt, Homo sapiens
caaagaagaugagcagaag

SEQ ID NO: 672963 - RNA, 19 nt, Homo sapiens
agaaagaacuagaggacaa

SEQ ID NO: 672964 - RNA, 19 nt, Homo sapiens
uagacucugugcauuaaua

SEQ ID NO: 672965 - RNA, 19 nt, Homo sapiens
gcauuuaacccggugaaua

SEQ ID NO: 672966 - RNA, 19 nt, Homo sapiens
gcaauaaggaaagaacuaa

SEQ ID NO: 672967 - RNA, 19 nt, Homo sapiens
aaacacaccuagagucugu

SEQ ID NO: 672968 - RNA, 19 nt, Homo sapiens
gaaauccucaucuuguauu

SEQ ID NO: 672969 - RNA, 19 nt, Homo sapiens
gcaaucaugacaccuguaa

SEQ ID NO: 672970 - RNA, 19 nt, Homo sapiens
gauguaaugugacccuaga

SEQ ID NO: 672971 - RNA, 19 nt, Homo sapiens
gggaauaaagucagaugua

SEQ ID NO: 672972 - RNA, 19 nt, Homo sapiens
gaaaucagaaagaaagaga

SEQ ID NO: 672973 - RNA, 19 nt, Homo sapiens
gaacacaggcaaauucaag

SEQ ID NO: 672974 - RNA, 19 nt, Homo sapiens
gcagaacacaggcaaauuc

SEQ ID NO: 672975 - RNA, 19 nt, Homo sapiens
gaaaguucccacuaaguug

SEQ ID NO: 672976 - RNA, 19 nt, Homo sapiens
uaacagaacauggaaaguu

SEQ ID NO: 672977 - RNA, 19 nt, Homo sapiens
gauuagauccaaagucaaa

SEQ ID NO: 672978 - RNA, 19 nt, Homo sapiens
gcacugggauuugaaugug

SEQ ID NO: 672979 - RNA, 19 nt, Homo sapiens
gagacuauuuggaaacaga

SEQ ID NO: 672980 - RNA, 19 nt, Homo sapiens
ccuagagucuguugucauu

SEQ ID NO: 672981 - RNA, 19 nt, Homo sapiens
guuagacucugugcauuaa

SEQ ID NO: 672982 - RNA, 19 nt, Homo sapiens
ccaguuggccuacuauaaa

SEQ ID NO: 672983 - RNA, 19 nt, Homo sapiens
uaaagaaccacuugaaauc

SEQ ID NO: 672984 - RNA, 19 nt, Homo sapiens
aaauaucccuuuccuagug

SEQ ID NO: 672985 - RNA, 19 nt, Homo sapiens
uaacgaagagugagacuau

SEQ ID NO: 672986 - RNA, 19 nt, Homo sapiens
caggaaauccgacaacaaa

SEQ ID NO: 672987 - RNA, 19 nt, Homo sapiens
gggaauaccaagccaauga

SEQ ID NO: 672988 - RNA, 19 nt, Homo sapiens
agaaaccucggcaguauua

SEQ ID NO: 672989 - RNA, 19 nt, Homo sapiens
ccaggaccauguuagaauu

SEQ ID NO: 672990 - RNA, 19 nt, Homo sapiens
ggacuacaauuuucuaaga

SEQ ID NO: 672991 - RNA, 19 nt, Homo sapiens
cauuuaacccggugaauaa

SEQ ID NO: 672992 - RNA, 19 nt, Homo sapiens
ugacuucugcucccaaaua

SEQ ID NO: 672993 - RNA, 19 nt, Homo sapiens
aaucaugacaccuguaaua

SEQ ID NO: 672994 - RNA, 19 nt, Homo sapiens
uaacgaguauguagaaguc

SEQ ID NO: 672995 - RNA, 19 nt, Homo sapiens
ugaucaagauggagaugua

SEQ ID NO: 672996 - RNA, 19 nt, Homo sapiens
aaaguuggauugcugcuau

SEQ ID NO: 672997 - RNA, 19 nt, Homo sapiens
uaucaaacuuggcaacaga

SEQ ID NO: 672998 - RNA, 19 nt, Homo sapiens
gcugcuggcuccucucauu

SEQ ID NO: 672999 - RNA, 19 nt, Homo sapiens
gauguggauuccucaaaga

SEQ ID NO: 673000 - RNA, 19 nt, Homo sapiens
uaagagacaccguggauau

SEQ ID NO: 673001 - RNA, 19 nt, Homo sapiens
ugaagaagaggaacaagaa

SEQ ID NO: 673002 - RNA, 19 nt, Homo sapiens
cagaaccacucucuacuca

SEQ ID NO: 673003 - RNA, 19 nt, Homo sapiens
caaaggagacaguuucuag

SEQ ID NO: 673004 - RNA, 19 nt, Homo sapiens
caaagucaaagcaaccaua

SEQ ID NO: 673005 - RNA, 19 nt, Homo sapiens
uagcaagcuucagaaauaa

SEQ ID NO: 673006 - RNA, 19 nt, Homo sapiens
gaaggaagugugugacuca

SEQ ID NO: 673007 - RNA, 19 nt, Homo sapiens
aaacagagacugaucaucu

SEQ ID NO: 673008 - RNA, 19 nt, Homo sapiens
agagaaaccucggcaguau

SEQ ID NO: 673009 - RNA, 19 nt, Homo sapiens
aaauggaaguucaugaaga

SEQ ID NO: 673010 - RNA, 19 nt, Homo sapiens
gcaacagaccaucuaagaa

SEQ ID NO: 673011 - RNA, 19 nt, Homo sapiens
gaagacagugccucagcua

SEQ ID NO: 673012 - RNA, 19 nt, Homo sapiens
gguaauggcucuguaucug

SEQ ID NO: 673013 - RNA, 19 nt, Homo sapiens
ggaaguucaugaagagagu

SEQ ID NO: 673014 - RNA, 19 nt, Homo sapiens
gcaaagaaacauccuaaaa

SEQ ID NO: 673015 - RNA, 19 nt, Homo sapiens
gaagaagagaggcaggaaa

SEQ ID NO: 673016 - RNA, 19 nt, Homo sapiens
gggcgaaucuucagaaucc

SEQ ID NO: 673017 - RNA, 19 nt, Homo sapiens
ggucagauuuauuaacuac

SEQ ID NO: 673018 - RNA, 19 nt, Homo sapiens
agaccucucuauaauggua

SEQ ID NO: 673019 - RNA, 19 nt, Homo sapiens
ggaaaaguaaccagcauua

SEQ ID NO: 673020 - RNA, 19 nt, Homo sapiens
gagugagacuauuuggaaa

SEQ ID NO: 673021 - RNA, 19 nt, Homo sapiens
guuaacaccugcagacaag

SEQ ID NO: 673022 - RNA, 19 nt, Homo sapiens
gaaagaacuagaggacaaa

SEQ ID NO: 673023 - RNA, 19 nt, Homo sapiens
ggagggauacucuugcuau

SEQ ID NO: 673024 - RNA, 19 nt, Homo sapiens
gagaauaugugcaccauug

SEQ ID NO: 673025 - RNA, 19 nt, Homo sapiens
gaaaggcgauccaggugua

SEQ ID NO: 673026 - RNA, 19 nt, Homo sapiens
ccaaagagccucagccuaa

SEQ ID NO: 673027 - RNA, 19 nt, Homo sapiens
gaaaucaccugguauccau

SEQ ID NO: 673028 - RNA, 19 nt, Homo sapiens
agacggagcuggacaaguu

SEQ ID NO: 673029 - RNA, 19 nt, Homo sapiens
ggaaguaacucgcucaaac

SEQ ID NO: 673030 - RNA, 19 nt, Homo sapiens
gagcugggauggagaagaa

SEQ ID NO: 673031 - RNA, 19 nt, Homo sapiens
gaagucaccugcuaagaca

SEQ ID NO: 673032 - RNA, 19 nt, Homo sapiens
caaagcagcuggucaagag

SEQ ID NO: 673033 - RNA, 19 nt, Homo sapiens
ugaggaaggucuagugaaa

SEQ ID NO: 673034 - RNA, 19 nt, Homo sapiens
gagaagauccucuaaugga

SEQ ID NO: 673035 - RNA, 19 nt, Homo sapiens
ggauugaagucaccugcua

SEQ ID NO: 673036 - RNA, 19 nt, Homo sapiens
ucaaagggcuagcaacuca

SEQ ID NO: 673037 - RNA, 19 nt, Homo sapiens
caaguugacagcucaguua

SEQ ID NO: 673038 - RNA, 19 nt, Homo sapiens
gaaccaagaagucaugaau

SEQ ID NO: 673039 - RNA, 19 nt, Homo sapiens
caacaaauccagaaauuac

SEQ ID NO: 673040 - RNA, 19 nt, Homo sapiens
accaagaagucaugaauuu

SEQ ID NO: 673041 - RNA, 19 nt, Homo sapiens
caaagagccucagccuaaa

SEQ ID NO: 673042 - RNA, 19 nt, Homo sapiens
gaaaucauguugguaggau

SEQ ID NO: 673043 - RNA, 19 nt, Homo sapiens
gguaguggcugucgacauc

SEQ ID NO: 673044 - RNA, 19 nt, Homo sapiens
gaccuagacaagcaaauua

SEQ ID NO: 673045 - RNA, 19 nt, Homo sapiens
gagcaccuguuccuugaga

SEQ ID NO: 673046 - RNA, 19 nt, Homo sapiens
uuucaaaucuaccugauga

SEQ ID NO: 673047 - RNA, 19 nt, Homo sapiens
gaaaggcagccgaggagaa

SEQ ID NO: 673048 - RNA, 19 nt, Homo sapiens
ggaaacgcccaccuucaaa

SEQ ID NO: 673049 - RNA, 19 nt, Homo sapiens
cggcagcgguggaaacuga

SEQ ID NO: 673050 - RNA, 19 nt, Homo sapiens
ccacauaaagagcaguaua

SEQ ID NO: 673051 - RNA, 19 nt, Homo sapiens
ugagaaugauguugcagaa

SEQ ID NO: 673052 - RNA, 19 nt, Homo sapiens
cuaugaagcuuauuguauc

SEQ ID NO: 673053 - RNA, 19 nt, Homo sapiens
ucgacacucugcaaacaua

SEQ ID NO: 673054 - RNA, 19 nt, Homo sapiens
aggaaggucuagugaaauu

SEQ ID NO: 673055 - RNA, 19 nt, Homo sapiens
cgccuggaguuucauauaa

SEQ ID NO: 673056 - RNA, 19 nt, Homo sapiens
gaaggaaacaucacaaagc

SEQ ID NO: 673057 - RNA, 19 nt, Homo sapiens
aaacugaaccuggaaauca

SEQ ID NO: 673058 - RNA, 19 nt, Homo sapiens
uggccaaucuuguuuccua

SEQ ID NO: 673059 - RNA, 19 nt, Homo sapiens
caaagucacaccugaagga

SEQ ID NO: 673060 - RNA, 19 nt, Homo sapiens
agaggagaauguccaugua

SEQ ID NO: 673061 - RNA, 19 nt, Homo sapiens
uaaguaagguagaugaacu

SEQ ID NO: 673062 - RNA, 19 nt, Homo sapiens
gcaaccagucccagauauu

SEQ ID NO: 673063 - RNA, 19 nt, Homo sapiens
auaaagaguuucaggaucu

SEQ ID NO: 673064 - RNA, 19 nt, Homo sapiens
cacauaaagagcaguauaa

SEQ ID NO: 673065 - RNA, 19 nt, Homo sapiens
cgacaucaaugaccuuggu

SEQ ID NO: 673066 - RNA, 19 nt, Homo sapiens
ggauggagaagaaacaguu

SEQ ID NO: 673067 - RNA, 19 nt, Homo sapiens
gaugaacucuaugaagcuu

SEQ ID NO: 673068 - RNA, 19 nt, Homo sapiens
cgaccagacucccggaaau

SEQ ID NO: 673069 - RNA, 19 nt, Homo sapiens
ccaaucuuguuuccuauuc

SEQ ID NO: 673070 - RNA, 19 nt, Homo sapiens
ucacaaagcagcuggucaa

SEQ ID NO: 673071 - RNA, 19 nt, Homo sapiens
agaaugaggguauggauga

SEQ ID NO: 673072 - RNA, 19 nt, Homo sapiens
cucaacaaauccagaaauu

SEQ ID NO: 673073 - RNA, 19 nt, Homo sapiens
gaauaugugcaccauugaa

SEQ ID NO: 673074 - RNA, 19 nt, Homo sapiens
caaccagucccagauauug

SEQ ID NO: 673075 - RNA, 19 nt, Homo sapiens
ggaaggaaacaucacaaag

SEQ ID NO: 673076 - RNA, 19 nt, Homo sapiens
gcucaagccuguggaacug

SEQ ID NO: 673077 - RNA, 19 nt, Homo sapiens
ugagacgccuggaguuuca

SEQ ID NO: 673078 - RNA, 19 nt, Homo sapiens
caacucauggccaaucuug

SEQ ID NO: 673079 - RNA, 19 nt, Homo sapiens
cauuagaaccacauaaaga

SEQ ID NO: 673080 - RNA, 19 nt, Homo sapiens
gaaugauguugcagaagca

SEQ ID NO: 673081 - RNA, 19 nt, Homo sapiens
caacucaacaaauccagaa

SEQ ID NO: 673082 - RNA, 19 nt, Homo sapiens
ugaacucuaugaagcuuau

SEQ ID NO: 673083 - RNA, 19 nt, Homo sapiens
ccucagugaucaacucaug

SEQ ID NO: 673084 - RNA, 19 nt, Homo sapiens
caagaagucaugaauuugg

SEQ ID NO: 673085 - RNA, 19 nt, Homo sapiens
gaaguaacucgcucaaacu

SEQ ID NO: 673086 - RNA, 19 nt, Homo sapiens
gaaacugaaaggcaaaaua

SEQ ID NO: 673087 - RNA, 19 nt, Homo sapiens
ucccagauauugugccauu

SEQ ID NO: 673088 - RNA, 19 nt, Homo sapiens
cuuucuagauggaagcuua

SEQ ID NO: 673089 - RNA, 19 nt, Homo sapiens
aaauuggucuuuccauuac

SEQ ID NO: 673090 - RNA, 19 nt, Homo sapiens
ucaaugaccuugguaccau

SEQ ID NO: 673091 - RNA, 19 nt, Homo sapiens
ccauugaaguggagcuaga

SEQ ID NO: 673092 - RNA, 19 nt, Homo sapiens
ucugggcaguaacuauuua

SEQ ID NO: 673093 - RNA, 19 nt, Homo sapiens
gaucugaaccaagaaguca

SEQ ID NO: 673094 - RNA, 19 nt, Homo sapiens
guauaaagaguuucaggau

SEQ ID NO: 673095 - RNA, 19 nt, Homo sapiens
aaggaaacaucacaaagca

SEQ ID NO: 673096 - RNA, 19 nt, Homo sapiens
gccaagagccaaagucaca

SEQ ID NO: 673097 - RNA, 19 nt, Homo sapiens
gaaaauuccuccgcucuca

SEQ ID NO: 673098 - RNA, 19 nt, Homo sapiens
gaguucugcugcuguuguu

SEQ ID NO: 673099 - RNA, 19 nt, Homo sapiens
aaagagcaguauaaagagu

SEQ ID NO: 673100 - RNA, 19 nt, Homo sapiens
gagaaggccaagagccaaa

SEQ ID NO: 673101 - RNA, 19 nt, Homo sapiens
ccaggauggugccagcaaa

SEQ ID NO: 673102 - RNA, 19 nt, Homo sapiens
gcacaauuuaggccacaaa

SEQ ID NO: 673103 - RNA, 19 nt, Homo sapiens
gaaacgcccaccuucaaag

SEQ ID NO: 673104 - RNA, 19 nt, Homo sapiens
gcagagcugggauggagaa

SEQ ID NO: 673105 - RNA, 19 nt, Homo sapiens
uuuguugucugcccacuuu

SEQ ID NO: 673106 - RNA, 19 nt, Homo sapiens
agguguaacuccuucauug

SEQ ID NO: 673107 - RNA, 19 nt, Homo sapiens
ggagggaggggauuuaaaa

SEQ ID NO: 673108 - RNA, 19 nt, Homo sapiens
agagcaguauaaagaguuu

SEQ ID NO: 673109 - RNA, 19 nt, Homo sapiens
cagcuuggccucccagaau

SEQ ID NO: 673110 - RNA, 19 nt, Homo sapiens
gaaaggcaaaauagaagua

SEQ ID NO: 673111 - RNA, 19 nt, Homo sapiens
gaaggucuagugaaauugg

SEQ ID NO: 673112 - RNA, 19 nt, Homo sapiens
uguaugaccuagacaagca

SEQ ID NO: 673113 - RNA, 19 nt, Homo sapiens
guugacagcucaguuaaaa

SEQ ID NO: 673114 - RNA, 19 nt, Homo sapiens
gguguaacuccuucauuga

SEQ ID NO: 673115 - RNA, 19 nt, Homo sapiens
cagauauugugccauuuua

SEQ ID NO: 673116 - RNA, 19 nt, Homo sapiens
gcauuagaaccacauaaag

SEQ ID NO: 673117 - RNA, 19 nt, Homo sapiens
cugcagauccuuucuagau

SEQ ID NO: 673118 - RNA, 19 nt, Homo sapiens
cugagcaccuguuccuuga

SEQ ID NO: 673119 - RNA, 19 nt, Homo sapiens
gacaccagcucagcaucuu

SEQ ID NO: 673120 - RNA, 19 nt, Homo sapiens
ugaccuugguaccaucaaa

SEQ ID NO: 673121 - RNA, 19 nt, Homo sapiens
agaaucugcugggagaauu

SEQ ID NO: 673122 - RNA, 19 nt, Homo sapiens
caagaaugcauacaaacuc

SEQ ID NO: 673123 - RNA, 19 nt, Homo sapiens
ccaagaagucaugaauuug

SEQ ID NO: 673124 - RNA, 19 nt, Homo sapiens
ucacuuagcuucucacuga

SEQ ID NO: 673125 - RNA, 19 nt, Homo sapiens
caaguaaacucacuccuuu

SEQ ID NO: 673126 - RNA, 19 nt, Homo sapiens
ggagggaucuugacucuug

SEQ ID NO: 673127 - RNA, 19 nt, Homo sapiens
ccaaggcgcuccaugaaau

SEQ ID NO: 673128 - RNA, 19 nt, Homo sapiens
agacaacucugaauuaaag

SEQ ID NO: 673129 - RNA, 19 nt, Homo sapiens
ggaagucucuggcugucuu

SEQ ID NO: 673130 - RNA, 19 nt, Homo sapiens
gcauggagguggcccagaa

SEQ ID NO: 673131 - RNA, 19 nt, Homo sapiens
ccagugcucucuccucaaa

SEQ ID NO: 673132 - RNA, 19 nt, Homo sapiens
agacagacuucgugcagua

SEQ ID NO: 673133 - RNA, 19 nt, Homo sapiens
acagugcauucccauauua

SEQ ID NO: 673134 - RNA, 19 nt, Homo sapiens
gacacacccuucccaauug

SEQ ID NO: 673135 - RNA, 19 nt, Homo sapiens
ggguuggacugauuacuuu

SEQ ID NO: 673136 - RNA, 19 nt, Homo sapiens
cgucaucccuuuccucuug

SEQ ID NO: 673137 - RNA, 19 nt, Homo sapiens
gacagugggugaugagcua

SEQ ID NO: 673138 - RNA, 19 nt, Homo sapiens
gaccagcccauccuaauuu

SEQ ID NO: 673139 - RNA, 19 nt, Homo sapiens
gaacacaggguuggacuga

SEQ ID NO: 673140 - RNA, 19 nt, Homo sapiens
caacagccauugccuaacu

SEQ ID NO: 673141 - RNA, 19 nt, Homo sapiens
gcaccagcccuauucaauu

SEQ ID NO: 673142 - RNA, 19 nt, Homo sapiens
ccuauugugucuuguguuu

SEQ ID NO: 673143 - RNA, 19 nt, Homo sapiens
ggaauuuagucaagcuuca

SEQ ID NO: 673144 - RNA, 19 nt, Homo sapiens
acacaggguuggacugauu

SEQ ID NO: 673145 - RNA, 19 nt, Homo sapiens
ugacacacccuucccaauu

SEQ ID NO: 673146 - RNA, 19 nt, Homo sapiens
gggcuugaguggaguuuau

SEQ ID NO: 673147 - RNA, 19 nt, Homo sapiens
gcugacauuaccauuauua

SEQ ID NO: 673148 - RNA, 19 nt, Homo sapiens
agaaggagcccaagagcua

SEQ ID NO: 673149 - RNA, 19 nt, Homo sapiens
aggagucaauggcauaaua

SEQ ID NO: 673150 - RNA, 19 nt, Homo sapiens
uacaccagcuggacaaauu

SEQ ID NO: 673151 - RNA, 19 nt, Homo sapiens
agaacaaccugauugacaa

SEQ ID NO: 673152 - RNA, 19 nt, Homo sapiens
gagaggagucaauggcaua

SEQ ID NO: 673153 - RNA, 19 nt, Homo sapiens
gaguggaguuuauuguaga

SEQ ID NO: 673154 - RNA, 19 nt, Homo sapiens
caacuucugcuuugcacua

SEQ ID NO: 673155 - RNA, 19 nt, Homo sapiens
caccagcccuauucaauuc

SEQ ID NO: 673156 - RNA, 19 nt, Homo sapiens
ggaguuuauuguagauuuc

SEQ ID NO: 673157 - RNA, 19 nt, Homo sapiens
guacugaagccacgauguu

SEQ ID NO: 673158 - RNA, 19 nt, Homo sapiens
gaagcaggccuggcucgua

SEQ ID NO: 673159 - RNA, 19 nt, Homo sapiens
ccacuggaauuuagucaag

SEQ ID NO: 673160 - RNA, 19 nt, Homo sapiens
gggcccaacuucugcuuug

SEQ ID NO: 673161 - RNA, 19 nt, Homo sapiens
ggagaaaggcaucccaaag

SEQ ID NO: 673162 - RNA, 19 nt, Homo sapiens
ucacggagcugcguagucu

SEQ ID NO: 673163 - RNA, 19 nt, Homo sapiens
gggcaucaucuuauuuauu

SEQ ID NO: 673164 - RNA, 19 nt, Homo sapiens
acaaggggcugcagaagua

SEQ ID NO: 673165 - RNA, 19 nt, Homo sapiens
ugacaaccauggcaucaag

SEQ ID NO: 673166 - RNA, 19 nt, Homo sapiens
ccaugggcaucaucuuauu

SEQ ID NO: 673167 - RNA, 19 nt, Homo sapiens
cugcugacauuaccauuau

SEQ ID NO: 673168 - RNA, 19 nt, Homo sapiens
gcugcugacauuaccauua

SEQ ID NO: 673169 - RNA, 19 nt, Homo sapiens
cacagugcauucccauauu

SEQ ID NO: 673170 - RNA, 19 nt, Homo sapiens
ugaguggaguuuauuguag

SEQ ID NO: 673171 - RNA, 19 nt, Homo sapiens
gaaaggcaucccaaagcuu

SEQ ID NO: 673172 - RNA, 19 nt, Homo sapiens
gcaauucuggcuccuacaa

SEQ ID NO: 673173 - RNA, 19 nt, Homo sapiens
ucacagugcauucccauau

SEQ ID NO: 673174 - RNA, 19 nt, Homo sapiens
ccaaguaaacucacuccuu

SEQ ID NO: 673175 - RNA, 19 nt, Homo sapiens
gagaugaggguuccuaaac

SEQ ID NO: 673176 - RNA, 19 nt, Homo sapiens
gguguggaacuguuucuuu

SEQ ID NO: 673177 - RNA, 19 nt, Homo sapiens
gccaaccuuuguggaauaa

SEQ ID NO: 673178 - RNA, 19 nt, Homo sapiens
gaauccaccagcacaagaa

SEQ ID NO: 673179 - RNA, 19 nt, Homo sapiens
gagaaaggcaucccaaagc

SEQ ID NO: 673180 - RNA, 19 nt, Homo sapiens
ggaccgggacacagagauu

SEQ ID NO: 673181 - RNA, 19 nt, Homo sapiens
caaggcgcuccaugaaaua

SEQ ID NO: 673182 - RNA, 19 nt, Homo sapiens
aggccuggcucguagagua

SEQ ID NO: 673183 - RNA, 19 nt, Homo sapiens
ggaacccacagcuuacuga

SEQ ID NO: 673184 - RNA, 19 nt, Homo sapiens
gagaccagcccauccuaau

SEQ ID NO: 673185 - RNA, 19 nt, Homo sapiens
ccagacugcugcccaccuu

SEQ ID NO: 673186 - RNA, 19 nt, Homo sapiens
gcaugugugugugcucaga

SEQ ID NO: 673187 - RNA, 19 nt, Homo sapiens
cagacauagucaaagcuuu

SEQ ID NO: 673188 - RNA, 19 nt, Homo sapiens
aauacacgcugugcaguga

SEQ ID NO: 673189 - RNA, 19 nt, Homo sapiens
gaacccacagcuuacugaa

SEQ ID NO: 673190 - RNA, 19 nt, Homo sapiens
cagcccaucuacaacauca

SEQ ID NO: 673191 - RNA, 19 nt, Homo sapiens
cagcaacaccuaugagaag

SEQ ID NO: 673192 - RNA, 19 nt, Homo sapiens
ucacucaucuggagaacac

SEQ ID NO: 673193 - RNA, 19 nt, Homo sapiens
ggacaaacugcaagguucu

SEQ ID NO: 673194 - RNA, 19 nt, Homo sapiens
ggacaaaaccaauccaaag

SEQ ID NO: 673195 - RNA, 19 nt, Homo sapiens
agccaaccuuuguggaaua

SEQ ID NO: 673196 - RNA, 19 nt, Homo sapiens
cucaggaacccacagcuua

SEQ ID NO: 673197 - RNA, 19 nt, Homo sapiens
gaacaaccugauugacaag

SEQ ID NO: 673198 - RNA, 19 nt, Homo sapiens
agacggaccucugcuggau

SEQ ID NO: 673199 - RNA, 19 nt, Homo sapiens
acucugaauuaaagcauga

SEQ ID NO: 673200 - RNA, 19 nt, Homo sapiens
gggaucacuuagcuucuca

SEQ ID NO: 673201 - RNA, 19 nt, Homo sapiens
cagccaaccuuuguggaau

SEQ ID NO: 673202 - RNA, 19 nt, Homo sapiens
ggagaauccaccagcacaa

SEQ ID NO: 673203 - RNA, 19 nt, Homo sapiens
ucccaugggcaucaucuua

SEQ ID NO: 673204 - RNA, 19 nt, Homo sapiens
ggacaucaacauccagaac

SEQ ID NO: 673205 - RNA, 19 nt, Homo sapiens
gucaagaacaaccugauug

SEQ ID NO: 673206 - RNA, 19 nt, Homo sapiens
agagauugaugaccugaag

SEQ ID NO: 673207 - RNA, 19 nt, Homo sapiens
gccaaggcgcuccaugaaa

SEQ ID NO: 673208 - RNA, 19 nt, Homo sapiens
gccgaagggugagaagaga

SEQ ID NO: 673209 - RNA, 19 nt, Homo sapiens
gaagaggcaggguacacau

SEQ ID NO: 673210 - RNA, 19 nt, Homo sapiens
ggcacggccuucacucugu

SEQ ID NO: 673211 - RNA, 19 nt, Homo sapiens
agaaaggcaucccaaagcu

SEQ ID NO: 673212 - RNA, 19 nt, Homo sapiens
aaacaggucacagugcauu

SEQ ID NO: 673213 - RNA, 19 nt, Homo sapiens
uuucaccacuggaauuuag

SEQ ID NO: 673214 - RNA, 19 nt, Homo sapiens
guaccagccugaccuugac

SEQ ID NO: 673215 - RNA, 19 nt, Homo sapiens
acaucaacauccagaacaa

SEQ ID NO: 673216 - RNA, 19 nt, Homo sapiens
aagaacaaccugauugaca

SEQ ID NO: 673217 - RNA, 19 nt, Homo sapiens
ucuguggccuuccuauugu

SEQ ID NO: 673218 - RNA, 19 nt, Homo sapiens
gcugcuugcugucugagau

SEQ ID NO: 673219 - RNA, 19 nt, Homo sapiens
ccagcaacaccuaugagaa

SEQ ID NO: 673220 - RNA, 19 nt, Homo sapiens
ugaaggaggcccgaaagga

SEQ ID NO: 673221 - RNA, 19 nt, Homo sapiens
ccaguggacucaggguugu

SEQ ID NO: 673222 - RNA, 19 nt, Homo sapiens
ccucagacauagucaaagc

SEQ ID NO: 673223 - RNA, 19 nt, Homo sapiens
cugggugugucagucauua

SEQ ID NO: 673224 - RNA, 19 nt, Homo sapiens
caagaaauguugacugaaa

SEQ ID NO: 673225 - RNA, 19 nt, Homo sapiens
gaagaagacugaguauuug

SEQ ID NO: 673226 - RNA, 19 nt, Homo sapiens
ggacccagguaucugauua

SEQ ID NO: 673227 - RNA, 19 nt, Homo sapiens
caacucaccuugaauauag

SEQ ID NO: 673228 - RNA, 19 nt, Homo sapiens
gcacaacucaccuugaaua

SEQ ID NO: 673229 - RNA, 19 nt, Homo sapiens
ccagguaucugauuauuug

SEQ ID NO: 673230 - RNA, 19 nt, Homo sapiens
gcaccuaaguccucauuga

SEQ ID NO: 673231 - RNA, 19 nt, Homo sapiens
uaagaaggcuccagcaaga

SEQ ID NO: 673232 - RNA, 19 nt, Homo sapiens
gugaacaccuuaguaauaa

SEQ ID NO: 673233 - RNA, 19 nt, Homo sapiens
gaaagaaacuuccccuaaa

SEQ ID NO: 673234 - RNA, 19 nt, Homo sapiens
gaagagacacuuuccuauu

SEQ ID NO: 673235 - RNA, 19 nt, Homo sapiens
ccucucagcucauacauaa

SEQ ID NO: 673236 - RNA, 19 nt, Homo sapiens
gaaaguagagcacacaaga

SEQ ID NO: 673237 - RNA, 19 nt, Homo sapiens
gaucacagaccuaaauuga

SEQ ID NO: 673238 - RNA, 19 nt, Homo sapiens
aagagacacuuuccuauuu

SEQ ID NO: 673239 - RNA, 19 nt, Homo sapiens
ugacaaugcuccacaguug

SEQ ID NO: 673240 - RNA, 19 nt, Homo sapiens
agaagaagacugaguauuu

SEQ ID NO: 673241 - RNA, 19 nt, Homo sapiens
gaaugggacugacgaaauc

SEQ ID NO: 673242 - RNA, 19 nt, Homo sapiens
gcuaaaugaugcauaguau

SEQ ID NO: 673243 - RNA, 19 nt, Homo sapiens
gauugcaacuccuggauuu

SEQ ID NO: 673244 - RNA, 19 nt, Homo sapiens
cgacaacccuccaguguuc

SEQ ID NO: 673245 - RNA, 19 nt, Homo sapiens
aguacaagcucucaucaua

SEQ ID NO: 673246 - RNA, 19 nt, Homo sapiens
gaugagaauucacuuguuc

SEQ ID NO: 673247 - RNA, 19 nt, Homo sapiens
ucucugagcuccugucauu

SEQ ID NO: 673248 - RNA, 19 nt, Homo sapiens
ccaaagugcugggauuaaa

SEQ ID NO: 673249 - RNA, 19 nt, Homo sapiens
uaauaggucuccuuauaug

SEQ ID NO: 673250 - RNA, 19 nt, Homo sapiens
uaugagauuugccucuuua

SEQ ID NO: 673251 - RNA, 19 nt, Homo sapiens
uaaugaagcuccuccuaug

SEQ ID NO: 673252 - RNA, 19 nt, Homo sapiens
ucaaguaucuuugucuuug

SEQ ID NO: 673253 - RNA, 19 nt, Homo sapiens
cagcacaacucaccuugaa

SEQ ID NO: 673254 - RNA, 19 nt, Homo sapiens
uaaaaugccugacaaugua

SEQ ID NO: 673255 - RNA, 19 nt, Homo sapiens
agaacgcccugcucacuua

SEQ ID NO: 673256 - RNA, 19 nt, Homo sapiens
gaucagccaugugaagauu

SEQ ID NO: 673257 - RNA, 19 nt, Homo sapiens
aaacacagccuucauuuca

SEQ ID NO: 673258 - RNA, 19 nt, Homo sapiens
ggauuucucuuacacuaga

SEQ ID NO: 673259 - RNA, 19 nt, Homo sapiens
uaacauuccucaauucaag

SEQ ID NO: 673260 - RNA, 19 nt, Homo sapiens
ucacagggauccagagaug

SEQ ID NO: 673261 - RNA, 19 nt, Homo sapiens
aaacuugaguggucucuga

SEQ ID NO: 673262 - RNA, 19 nt, Homo sapiens
cugaguagcugggauuaua

SEQ ID NO: 673263 - RNA, 19 nt, Homo sapiens
gcaagcuauuuguuuguuu

SEQ ID NO: 673264 - RNA, 19 nt, Homo sapiens
gagauuugccucuuuaaug

SEQ ID NO: 673265 - RNA, 19 nt, Homo sapiens
cagaauggccuugagaaua

SEQ ID NO: 673266 - RNA, 19 nt, Homo sapiens
cuacugcucucgcuucuga

SEQ ID NO: 673267 - RNA, 19 nt, Homo sapiens
gcagaauaacugugaaauu

SEQ ID NO: 673268 - RNA, 19 nt, Homo sapiens
agaauggccuugagaauag

SEQ ID NO: 673269 - RNA, 19 nt, Homo sapiens
uaccagacaugacuaaguu

SEQ ID NO: 673270 - RNA, 19 nt, Homo sapiens
caccuugaauauagucuua

SEQ ID NO: 673271 - RNA, 19 nt, Homo sapiens
gccaguaacguuuauuuaa

SEQ ID NO: 673272 - RNA, 19 nt, Homo sapiens
ugaaggacauuaacgacaa

SEQ ID NO: 673273 - RNA, 19 nt, Homo sapiens
gaaauguuauacucaaguc

SEQ ID NO: 673274 - RNA, 19 nt, Homo sapiens
gauaugagauuugccucuu

SEQ ID NO: 673275 - RNA, 19 nt, Homo sapiens
ggagguaaaucugcagaau

SEQ ID NO: 673276 - RNA, 19 nt, Homo sapiens
cuacagaugucauuugucu

SEQ ID NO: 673277 - RNA, 19 nt, Homo sapiens
gaauucacuuguucuguca

SEQ ID NO: 673278 - RNA, 19 nt, Homo sapiens
gcagaagaccgaccucaug

SEQ ID NO: 673279 - RNA, 19 nt, Homo sapiens
ggacuuguauuacggaaac

SEQ ID NO: 673280 - RNA, 19 nt, Homo sapiens
gugcaaguuucuguaauuu

SEQ ID NO: 673281 - RNA, 19 nt, Homo sapiens
caagaucacagaccuaaau

SEQ ID NO: 673282 - RNA, 19 nt, Homo sapiens
uagcaaacaugaacucaca

SEQ ID NO: 673283 - RNA, 19 nt, Homo sapiens
ugugaacaccuuaguaaua

SEQ ID NO: 673284 - RNA, 19 nt, Homo sapiens
gcugugaacaccuuaguaa

SEQ ID NO: 673285 - RNA, 19 nt, Homo sapiens
ugauguuucuccagauaua

SEQ ID NO: 673286 - RNA, 19 nt, Homo sapiens
gacuggcaccguucaauua

SEQ ID NO: 673287 - RNA, 19 nt, Homo sapiens
cuccggagcuucauuuauu

SEQ ID NO: 673288 - RNA, 19 nt, Homo sapiens
gaagacugaguauuugaaa

SEQ ID NO: 673289 - RNA, 19 nt, Homo sapiens
ugaugggauugguaauuua

SEQ ID NO: 673290 - RNA, 19 nt, Homo sapiens
cagccuucauuucaacuua

SEQ ID NO: 673291 - RNA, 19 nt, Homo sapiens
caaccuucaguaucuauua

SEQ ID NO: 673292 - RNA, 19 nt, Homo sapiens
uacaagcucucaucauaug

SEQ ID NO: 673293 - RNA, 19 nt, Homo sapiens
ggaguacaguggcaugauc

SEQ ID NO: 673294 - RNA, 19 nt, Homo sapiens
gaaaaugccaguaacguuu

SEQ ID NO: 673295 - RNA, 19 nt, Homo sapiens
cauguuauguuuccugaau

SEQ ID NO: 673296 - RNA, 19 nt, Homo sapiens
gaaaacaguugcuccacuu

SEQ ID NO: 673297 - RNA, 19 nt, Homo sapiens
gacuuugucuugacuucua

SEQ ID NO: 673298 - RNA, 19 nt, Homo sapiens
cuaauuagaagaagacuga

SEQ ID NO: 673299 - RNA, 19 nt, Homo sapiens
ccaauuuaguuguuaguca

SEQ ID NO: 673300 - RNA, 19 nt, Homo sapiens
cagaagagacacuuuccua

SEQ ID NO: 673301 - RNA, 19 nt, Homo sapiens
caugugccauuuaaacuug

SEQ ID NO: 673302 - RNA, 19 nt, Homo sapiens
aaacaguugcuccacuuua

SEQ ID NO: 673303 - RNA, 19 nt, Homo sapiens
gaaauuaccagaaaacguu

SEQ ID NO: 673304 - RNA, 19 nt, Homo sapiens
guaguuaacauuccucaau

SEQ ID NO: 673305 - RNA, 19 nt, Homo sapiens
gcaauuguuaccuuguuaa

SEQ ID NO: 673306 - RNA, 19 nt, Homo sapiens
uaacauuggagccgacuuu

SEQ ID NO: 673307 - RNA, 19 nt, Homo sapiens
ggacaguuauugcccugau

SEQ ID NO: 673308 - RNA, 19 nt, Homo sapiens
guacaagcucucaucauau

SEQ ID NO: 673309 - RNA, 19 nt, Homo sapiens
gguaucugauuauuugaug

SEQ ID NO: 673310 - RNA, 19 nt, Homo sapiens
caaguuucaugugccauuu

SEQ ID NO: 673311 - RNA, 19 nt, Homo sapiens
guagauuucugggcuccua

SEQ ID NO: 673312 - RNA, 19 nt, Homo sapiens
uuucugggcuccuauauuc

SEQ ID NO: 673313 - RNA, 19 nt, Homo sapiens
ucagcaaccuucaguaucu

SEQ ID NO: 673314 - RNA, 19 nt, Homo sapiens
caacugggaagguggguuu

SEQ ID NO: 673315 - RNA, 19 nt, Homo sapiens
gguaauuuaguccuucaua

SEQ ID NO: 673316 - RNA, 19 nt, Homo sapiens
cuucauuucugucguuauu

SEQ ID NO: 673317 - RNA, 19 nt, Homo sapiens
gugcaguggugccaucuug

SEQ ID NO: 673318 - RNA, 19 nt, Homo sapiens
agauuugccucuuuaaugu

SEQ ID NO: 673319 - RNA, 19 nt, Homo sapiens
uauaagaaacccaagcaaa

SEQ ID NO: 673320 - RNA, 19 nt, Homo sapiens
gcuccacaguugacuauca

SEQ ID NO: 673321 - RNA, 19 nt, Homo sapiens
ucacgguacuggacaacaa

SEQ ID NO: 673322 - RNA, 19 nt, Homo sapiens
gguaaaaccucuuggacuu

SEQ ID NO: 673323 - RNA, 19 nt, Homo sapiens
aagcacaccugagaugauu

SEQ ID NO: 673324 - RNA, 19 nt, Homo sapiens
gaagaagacugaguauuug

SEQ ID NO: 673325 - RNA, 19 nt, Homo sapiens
gcaaaucucucccauguag

SEQ ID NO: 673326 - RNA, 19 nt, Homo sapiens
guaggagucuguuauuuaa

SEQ ID NO: 673327 - RNA, 19 nt, Homo sapiens
aaucacagcuuuacucuuu

SEQ ID NO: 673328 - RNA, 19 nt, Homo sapiens
caacacaugugaaccauug

SEQ ID NO: 673329 - RNA, 19 nt, Homo sapiens
gaucauugcugcuacagaa

SEQ ID NO: 673330 - RNA, 19 nt, Homo sapiens
aagcagaucugauguguuu

SEQ ID NO: 673331 - RNA, 19 nt, Homo sapiens
gauguuaccugaaaucaau

SEQ ID NO: 673332 - RNA, 19 nt, Homo sapiens
uaagaaggcuccagcaaga

SEQ ID NO: 673333 - RNA, 19 nt, Homo sapiens
cuacagaagugcuuuaaga

SEQ ID NO: 673334 - RNA, 19 nt, Homo sapiens
gaaaguagagcacacaaga

SEQ ID NO: 673335 - RNA, 19 nt, Homo sapiens
gaucugauguguuuccuau

SEQ ID NO: 673336 - RNA, 19 nt, Homo sapiens
ggaccagacuuucuaaauc

SEQ ID NO: 673337 - RNA, 19 nt, Homo sapiens
gguaggagucuguuauuua

SEQ ID NO: 673338 - RNA, 19 nt, Homo sapiens
gaacgcauuuaacagguuu

SEQ ID NO: 673339 - RNA, 19 nt, Homo sapiens
agagugaacuuuaagcuuu

SEQ ID NO: 673340 - RNA, 19 nt, Homo sapiens
ugacaaugcuccacaguug

SEQ ID NO: 673341 - RNA, 19 nt, Homo sapiens
agaagaagacugaguauuu

SEQ ID NO: 673342 - RNA, 19 nt, Homo sapiens
gaaugggacugacgaaauc

SEQ ID NO: 673343 - RNA, 19 nt, Homo sapiens
gagugaacuuuaagcuuua

SEQ ID NO: 673344 - RNA, 19 nt, Homo sapiens
gauugcaacuccuggauuu

SEQ ID NO: 673345 - RNA, 19 nt, Homo sapiens
ugaaaucaaucucccauau

SEQ ID NO: 673346 - RNA, 19 nt, Homo sapiens
acaauuaugugcacuuuga

SEQ ID NO: 673347 - RNA, 19 nt, Homo sapiens
cagaagugcuuuaagagaa

SEQ ID NO: 673348 - RNA, 19 nt, Homo sapiens
cgacaacccuccaguguuc

SEQ ID NO: 673349 - RNA, 19 nt, Homo sapiens
uuaccaaucugaccucuuu

SEQ ID NO: 673350 - RNA, 19 nt, Homo sapiens
ggauaaagcuguuuuguuc

SEQ ID NO: 673351 - RNA, 19 nt, Homo sapiens
ugacaacagugaccaguga

SEQ ID NO: 673352 - RNA, 19 nt, Homo sapiens
agaacgcccugcucacuua

SEQ ID NO: 673353 - RNA, 19 nt, Homo sapiens
ggauuucucuuacacuaga

SEQ ID NO: 673354 - RNA, 19 nt, Homo sapiens
cuaagacuccugaaauaua

SEQ ID NO: 673355 - RNA, 19 nt, Homo sapiens
cagcggaaguuaucaguau

SEQ ID NO: 673356 - RNA, 19 nt, Homo sapiens
ccuaugauguuaccugaaa

SEQ ID NO: 673357 - RNA, 19 nt, Homo sapiens
cuacugcucucgcuucuga

SEQ ID NO: 673358 - RNA, 19 nt, Homo sapiens
gcagaauaacugugaaauu

SEQ ID NO: 673359 - RNA, 19 nt, Homo sapiens
gaccagacuuucuaaaucu

SEQ ID NO: 673360 - RNA, 19 nt, Homo sapiens
agcaacagcuggaccuuua

SEQ ID NO: 673361 - RNA, 19 nt, Homo sapiens
gagaaucgggcuaauuuau

SEQ ID NO: 673362 - RNA, 19 nt, Homo sapiens
ugaaauaucagcucauaga

SEQ ID NO: 673363 - RNA, 19 nt, Homo sapiens
uaccagacaugacuaaguu

SEQ ID NO: 673364 - RNA, 19 nt, Homo sapiens
gcacacaauguuuaugaaa

SEQ ID NO: 673365 - RNA, 19 nt, Homo sapiens
guacaaggaaggcaagaaa

SEQ ID NO: 673366 - RNA, 19 nt, Homo sapiens
ugaaggacauuaacgacaa

SEQ ID NO: 673367 - RNA, 19 nt, Homo sapiens
gaaauguuauacucaaguc

SEQ ID NO: 673368 - RNA, 19 nt, Homo sapiens
ggagaaucgggcuaauuua

SEQ ID NO: 673369 - RNA, 19 nt, Homo sapiens
gcucauagaaaguaacaaa

SEQ ID NO: 673370 - RNA, 19 nt, Homo sapiens
gcaauucccugcuccuuuu

SEQ ID NO: 673371 - RNA, 19 nt, Homo sapiens
ggagguaaaucugcagaau

SEQ ID NO: 673372 - RNA, 19 nt, Homo sapiens
gguauuuccucuguuauug

SEQ ID NO: 673373 - RNA, 19 nt, Homo sapiens
uggcaaaucucucccaugu

SEQ ID NO: 673374 - RNA, 19 nt, Homo sapiens
gcagaagaccgaccucaug

SEQ ID NO: 673375 - RNA, 19 nt, Homo sapiens
ggacuuguauuacggaaac

SEQ ID NO: 673376 - RNA, 19 nt, Homo sapiens
aaaauuugcugucaccuua

SEQ ID NO: 673377 - RNA, 19 nt, Homo sapiens
gaaauaucagcucauagaa

SEQ ID NO: 673378 - RNA, 19 nt, Homo sapiens
ggaaugaauacugacaaua

SEQ ID NO: 673379 - RNA, 19 nt, Homo sapiens
gggaauggauaaagcuguu

SEQ ID NO: 673380 - RNA, 19 nt, Homo sapiens
aaaucaaucucccauaugu

SEQ ID NO: 673381 - RNA, 19 nt, Homo sapiens
gaaaucaaucucccauaug

SEQ ID NO: 673382 - RNA, 19 nt, Homo sapiens
aagagaaagucuauagcua

SEQ ID NO: 673383 - RNA, 19 nt, Homo sapiens
gaaaguucccugugucugu

SEQ ID NO: 673384 - RNA, 19 nt, Homo sapiens
gcccauguaucugaccuua

SEQ ID NO: 673385 - RNA, 19 nt, Homo sapiens
caaauaaacagcggaaguu

SEQ ID NO: 673386 - RNA, 19 nt, Homo sapiens
agaggaggcuggcauucua

SEQ ID NO: 673387 - RNA, 19 nt, Homo sapiens
ugauguuucuccagauaua

SEQ ID NO: 673388 - RNA, 19 nt, Homo sapiens
gacuggcaccguucaauua

SEQ ID NO: 673389 - RNA, 19 nt, Homo sapiens
cuccggagcuucauuuauu

SEQ ID NO: 673390 - RNA, 19 nt, Homo sapiens
gaagacugaguauuugaaa

SEQ ID NO: 673391 - RNA, 19 nt, Homo sapiens
gcaagggaauggauaaagc

SEQ ID NO: 673392 - RNA, 19 nt, Homo sapiens
ccucuugcauguauuacua

SEQ ID NO: 673393 - RNA, 19 nt, Homo sapiens
gccugaaacaucuguauua

SEQ ID NO: 673394 - RNA, 19 nt, Homo sapiens
gagaauugccugaaacauc

SEQ ID NO: 673395 - RNA, 19 nt, Homo sapiens
uuaagagaauugccugaaa

SEQ ID NO: 673396 - RNA, 19 nt, Homo sapiens
uaaagucuguuggcuguga

SEQ ID NO: 673397 - RNA, 19 nt, Homo sapiens
gcacaaauuuuaccaaucu

SEQ ID NO: 673398 - RNA, 19 nt, Homo sapiens
gaagugcuuuaagagaauu

SEQ ID NO: 673399 - RNA, 19 nt, Homo sapiens
uaacaagacccaggagaaa

SEQ ID NO: 673400 - RNA, 19 nt, Homo sapiens
cuaauuagaagaagacuga

SEQ ID NO: 673401 - RNA, 19 nt, Homo sapiens
aaacugucuugucuacuuu

SEQ ID NO: 673402 - RNA, 19 nt, Homo sapiens
aauaucagcucauagaaag

SEQ ID NO: 673403 - RNA, 19 nt, Homo sapiens
ucaagauacuggugauuca

SEQ ID NO: 673404 - RNA, 19 nt, Homo sapiens
gauacacaaccuucucuaa

SEQ ID NO: 673405 - RNA, 19 nt, Homo sapiens
uaccuagagugaacuuuaa

SEQ ID NO: 673406 - RNA, 19 nt, Homo sapiens
uaagacuccugaaauauac

SEQ ID NO: 673407 - RNA, 19 nt, Homo sapiens
ugcuaagacuccugaaaua

SEQ ID NO: 673408 - RNA, 19 nt, Homo sapiens
guaacaagacccaggagaa

SEQ ID NO: 673409 - RNA, 19 nt, Homo sapiens
gaaauuaccagaaaacguu

SEQ ID NO: 673410 - RNA, 19 nt, Homo sapiens
cuucagcucugcaggauug

SEQ ID NO: 673411 - RNA, 19 nt, Homo sapiens
aaucugaccucuuugaagu

SEQ ID NO: 673412 - RNA, 19 nt, Homo sapiens
ggacaguuauugcccugau

SEQ ID NO: 673413 - RNA, 19 nt, Homo sapiens
gcuucauucucccauauuu

SEQ ID NO: 673414 - RNA, 19 nt, Homo sapiens
gguaugcgagugccagaua

SEQ ID NO: 673415 - RNA, 19 nt, Homo sapiens
guagauuucugggcuccua

SEQ ID NO: 673416 - RNA, 19 nt, Homo sapiens
uuucugggcuccuauauuc

SEQ ID NO: 673417 - RNA, 19 nt, Homo sapiens
gaagugcuuuccaauccau

SEQ ID NO: 673418 - RNA, 19 nt, Homo sapiens
agaauugccugaaacaucu

SEQ ID NO: 673419 - RNA, 19 nt, Homo sapiens
guccugugcucacuuuauu

SEQ ID NO: 673420 - RNA, 19 nt, Homo sapiens
gcuccacaguugacuauca

SEQ ID NO: 673421 - RNA, 19 nt, Homo sapiens
ucacgguacuggacaacaa

SEQ ID NO: 673422 - RNA, 19 nt, Homo sapiens
gguaaaaccucuuggacuu

SEQ ID NO: 673423 - RNA, 19 nt, Homo sapiens
cuucauuucugucguuauu

SEQ ID NO: 673424 - RNA, 19 nt, Homo sapiens
gaucauaucccguuguuua

SEQ ID NO: 673425 - RNA, 19 nt, Homo sapiens
gaagagagaguuugaauga

SEQ ID NO: 673426 - RNA, 19 nt, Homo sapiens
gaagacauccaguaaauuu

SEQ ID NO: 673427 - RNA, 19 nt, Homo sapiens
uagcuuggcuucuuuauuu

SEQ ID NO: 673428 - RNA, 19 nt, Homo sapiens
ggugagaucuuacuugaaa

SEQ ID NO: 673429 - RNA, 19 nt, Homo sapiens
ggacaagucuuacagaaca

SEQ ID NO: 673430 - RNA, 19 nt, Homo sapiens
gcucuagucucaucucaua

SEQ ID NO: 673431 - RNA, 19 nt, Homo sapiens
gagagagacugcauaaaug

SEQ ID NO: 673432 - RNA, 19 nt, Homo sapiens
ggaugaaccuuuggaagua

SEQ ID NO: 673433 - RNA, 19 nt, Homo sapiens
gaaagaauguuuagaagcu

SEQ ID NO: 673434 - RNA, 19 nt, Homo sapiens
gcaaagaaaccuuauacaa

SEQ ID NO: 673435 - RNA, 19 nt, Homo sapiens
gaaagacccuauaaaugug

SEQ ID NO: 673436 - RNA, 19 nt, Homo sapiens
ggagaaagacccuauaaau

SEQ ID NO: 673437 - RNA, 19 nt, Homo sapiens
gcaaguauacacaauagua

SEQ ID NO: 673438 - RNA, 19 nt, Homo sapiens
gaaggaaacuaaggacuug

SEQ ID NO: 673439 - RNA, 19 nt, Homo sapiens
ucacaggucuuuccucaaa

SEQ ID NO: 673440 - RNA, 19 nt, Homo sapiens
gaaucaggcuggcaaagaa

SEQ ID NO: 673441 - RNA, 19 nt, Homo sapiens
gcagauauagguaagauaa

SEQ ID NO: 673442 - RNA, 19 nt, Homo sapiens
gggaagacauccaguaaau

SEQ ID NO: 673443 - RNA, 19 nt, Homo sapiens
gcagcaaaccugaacuuua

SEQ ID NO: 673444 - RNA, 19 nt, Homo sapiens
ggucuuuccucaaacuuua

SEQ ID NO: 673445 - RNA, 19 nt, Homo sapiens
caacaucaaugcaguaagu

SEQ ID NO: 673446 - RNA, 19 nt, Homo sapiens
gauaguaccuuggaaugaa

SEQ ID NO: 673447 - RNA, 19 nt, Homo sapiens
cagcaaaccugaacuuuag

SEQ ID NO: 673448 - RNA, 19 nt, Homo sapiens
gagaaagacccuauaaaug

SEQ ID NO: 673449 - RNA, 19 nt, Homo sapiens
cuacaaaugugacguaugu

SEQ ID NO: 673450 - RNA, 19 nt, Homo sapiens
gcaggccucuuucaccaua

SEQ ID NO: 673451 - RNA, 19 nt, Homo sapiens
ggaguaagccugacugaga

SEQ ID NO: 673452 - RNA, 19 nt, Homo sapiens
caaccuaccugugaugaaa

SEQ ID NO: 673453 - RNA, 19 nt, Homo sapiens
ggaaauccaccacaaagaa

SEQ ID NO: 673454 - RNA, 19 nt, Homo sapiens
gagaaucuguccaggagaa

SEQ ID NO: 673455 - RNA, 19 nt, Homo sapiens
ugacugugcuggaggauuu

SEQ ID NO: 673456 - RNA, 19 nt, Homo sapiens
gagacuaccuuuauauucu

SEQ ID NO: 673457 - RNA, 19 nt, Homo sapiens
gggaaggcguuuacucaaa

SEQ ID NO: 673458 - RNA, 19 nt, Homo sapiens
guaugaaucuccagaacuu

SEQ ID NO: 673459 - RNA, 19 nt, Homo sapiens
agagacaacugacauuuga

SEQ ID NO: 673460 - RNA, 19 nt, Homo sapiens
ggaaaugaguaugggaauu

SEQ ID NO: 673461 - RNA, 19 nt, Homo sapiens
ggaccaggaugaaccuuug

SEQ ID NO: 673462 - RNA, 19 nt, Homo sapiens
gaagagacaacugacauuu

SEQ ID NO: 673463 - RNA, 19 nt, Homo sapiens
ucaaacugaucuucucuuu

SEQ ID NO: 673464 - RNA, 19 nt, Homo sapiens
ugacagauaaugacugaua

SEQ ID NO: 673465 - RNA, 19 nt, Homo sapiens
gggaauggguagucuaaau

SEQ ID NO: 673466 - RNA, 19 nt, Homo sapiens
gggaaugucuguagaacug

SEQ ID NO: 673467 - RNA, 19 nt, Homo sapiens
caacugacauuugaauugu

SEQ ID NO: 673468 - RNA, 19 nt, Homo sapiens
gaauggcaaucuuguuuca

SEQ ID NO: 673469 - RNA, 19 nt, Homo sapiens
agaaagacccuauaaaugu

SEQ ID NO: 673470 - RNA, 19 nt, Homo sapiens
ugaaauaaguugcaucucu

SEQ ID NO: 673471 - RNA, 19 nt, Homo sapiens
ugaacauucuguagguuua

SEQ ID NO: 673472 - RNA, 19 nt, Homo sapiens
gaaauccaccacaaagaaa

SEQ ID NO: 673473 - RNA, 19 nt, Homo sapiens
ggaaaagucuucagagguu

SEQ ID NO: 673474 - RNA, 19 nt, Homo sapiens
ggucucaggcuaaaugaua

SEQ ID NO: 673475 - RNA, 19 nt, Homo sapiens
gaccuccucuuucuauauu

SEQ ID NO: 673476 - RNA, 19 nt, Homo sapiens
ggagaagcccuaccaaugu

SEQ ID NO: 673477 - RNA, 19 nt, Homo sapiens
gaacaucagcgaauucaca

SEQ ID NO: 673478 - RNA, 19 nt, Homo sapiens
gaguaagccugacugagaa

SEQ ID NO: 673479 - RNA, 19 nt, Homo sapiens
ucgugaaccugaagaaaua

SEQ ID NO: 673480 - RNA, 19 nt, Homo sapiens
caggaaccauguauuuaaa

SEQ ID NO: 673481 - RNA, 19 nt, Homo sapiens
gcagugaaaggaacuauau

SEQ ID NO: 673482 - RNA, 19 nt, Homo sapiens
ggaauggguagucuaaauu

SEQ ID NO: 673483 - RNA, 19 nt, Homo sapiens
ccacuuaacuccuuuagcu

SEQ ID NO: 673484 - RNA, 19 nt, Homo sapiens
aaacuugucucuacucauc

SEQ ID NO: 673485 - RNA, 19 nt, Homo sapiens
caggugagaucuuacuuga

SEQ ID NO: 673486 - RNA, 19 nt, Homo sapiens
ggaaaagccuucagacaga

SEQ ID NO: 673487 - RNA, 19 nt, Homo sapiens
ggaaggcguuuacucaaag

SEQ ID NO: 673488 - RNA, 19 nt, Homo sapiens
gggaaauccuucagucaga

SEQ ID NO: 673489 - RNA, 19 nt, Homo sapiens
uuaggaagcuuugccagua

SEQ ID NO: 673490 - RNA, 19 nt, Homo sapiens
gagaagcccuaccaaugug

SEQ ID NO: 673491 - RNA, 19 nt, Homo sapiens
gggaggagguggugacugu

SEQ ID NO: 673492 - RNA, 19 nt, Homo sapiens
uagaagcugucaacaaguu

SEQ ID NO: 673493 - RNA, 19 nt, Homo sapiens
gcaaagauaguaccuugga

SEQ ID NO: 673494 - RNA, 19 nt, Homo sapiens
aaagauagaggaagagaaa

SEQ ID NO: 673495 - RNA, 19 nt, Homo sapiens
gcacucacaccucauagaa

SEQ ID NO: 673496 - RNA, 19 nt, Homo sapiens
agucucaucucauaucuuu

SEQ ID NO: 673497 - RNA, 19 nt, Homo sapiens
uuaucuaccugauucguua

SEQ ID NO: 673498 - RNA, 19 nt, Homo sapiens
gggagaagcccuaccaaug

SEQ ID NO: 673499 - RNA, 19 nt, Homo sapiens
gaugaaccuuuggaaguaa

SEQ ID NO: 673500 - RNA, 19 nt, Homo sapiens
uaaggaaugugggaaaguu

SEQ ID NO: 673501 - RNA, 19 nt, Homo sapiens
cugauccacucaacaaaua

SEQ ID NO: 673502 - RNA, 19 nt, Homo sapiens
ggaagaagaccagcuacaa

SEQ ID NO: 673503 - RNA, 19 nt, Homo sapiens
gaucaguccucacggaaca

SEQ ID NO: 673504 - RNA, 19 nt, Homo sapiens
ggagacagacccuacaaau

SEQ ID NO: 673505 - RNA, 19 nt, Homo sapiens
ugaaagcccagccaaagua

SEQ ID NO: 673506 - RNA, 19 nt, Homo sapiens
gaguaggcuuguauuggua

SEQ ID NO: 673507 - RNA, 19 nt, Homo sapiens
gagagaggcccuacaagug

SEQ ID NO: 673508 - RNA, 19 nt, Homo sapiens
uaaguugcaucucuggauu

SEQ ID NO: 673509 - RNA, 19 nt, Homo sapiens
uaggaaaucucagccauau

SEQ ID NO: 673510 - RNA, 19 nt, Homo sapiens
acucaucuccuucucauua

SEQ ID NO: 673511 - RNA, 19 nt, Homo sapiens
cagaauggcaaucuuguuu

SEQ ID NO: 673512 - RNA, 19 nt, Homo sapiens
ggagagaggcccuacaagu

SEQ ID NO: 673513 - RNA, 19 nt, Homo sapiens
gaagaaauggaaccacaug

SEQ ID NO: 673514 - RNA, 19 nt, Homo sapiens
gaaggagaacccaguaugu

SEQ ID NO: 673515 - RNA, 19 nt, Homo sapiens
gcuggaggauuuagagaga

SEQ ID NO: 673516 - RNA, 19 nt, Homo sapiens
ggaaacuuguauagacaga

SEQ ID NO: 673517 - RNA, 19 nt, Homo sapiens
uugugaagcugcagauaua

SEQ ID NO: 673518 - RNA, 19 nt, Homo sapiens
cagcaaguauacacaauag

SEQ ID NO: 673519 - RNA, 19 nt, Homo sapiens
gaauggguagucuaaauug

SEQ ID NO: 673520 - RNA, 19 nt, Homo sapiens
aauagugacugaugguaaa

SEQ ID NO: 673521 - RNA, 19 nt, Homo sapiens
cuacaagugugaugagugu

SEQ ID NO: 673522 - RNA, 19 nt, Homo sapiens
cuacaaaugcgaagaaugu

SEQ ID NO: 673523 - RNA, 19 nt, Homo sapiens
guauuaucgucuacuguuu

SEQ ID NO: 673524 - RNA, 19 nt, Homo sapiens
gcaaagaggucgacagcaa

SEQ ID NO: 673525 - RNA, 19 nt, Homo sapiens
gcacagacacacacauaua

SEQ ID NO: 673526 - RNA, 19 nt, Homo sapiens
gaagagcaguguaccauca

SEQ ID NO: 673527 - RNA, 19 nt, Homo sapiens
gaagagaaucgcaugagua

SEQ ID NO: 673528 - RNA, 19 nt, Homo sapiens
gaagaaggacacuccauuu

SEQ ID NO: 673529 - RNA, 19 nt, Homo sapiens
caacaggauucccucagua

SEQ ID NO: 673530 - RNA, 19 nt, Homo sapiens
ugaguaaacugaaaugaga

SEQ ID NO: 673531 - RNA, 19 nt, Homo sapiens
ggaggccacuucaucagua

SEQ ID NO: 673532 - RNA, 19 nt, Homo sapiens
gaauuggacuggagugaau

SEQ ID NO: 673533 - RNA, 19 nt, Homo sapiens
cgacguggcugaccugcua

SEQ ID NO: 673534 - RNA, 19 nt, Homo sapiens
gauauuggcucugugaaga

SEQ ID NO: 673535 - RNA, 19 nt, Homo sapiens
gauggaagggccuaucuua

SEQ ID NO: 673536 - RNA, 19 nt, Homo sapiens
cugaugaccuugaauaauu

SEQ ID NO: 673537 - RNA, 19 nt, Homo sapiens
gaaccugcgucaaaugaau

SEQ ID NO: 673538 - RNA, 19 nt, Homo sapiens
gaaggacacuccauuucug

SEQ ID NO: 673539 - RNA, 19 nt, Homo sapiens
guaaauacgaugcugaauu

SEQ ID NO: 673540 - RNA, 19 nt, Homo sapiens
ccaagaagcgccaucguaa

SEQ ID NO: 673541 - RNA, 19 nt, Homo sapiens
guagugggcuaacauaaca

SEQ ID NO: 673542 - RNA, 19 nt, Homo sapiens
gagauacacacacauauau

SEQ ID NO: 673543 - RNA, 19 nt, Homo sapiens
ggaagaaggacacuccauu

SEQ ID NO: 673544 - RNA, 19 nt, Homo sapiens
guaggaggcugaugaccuu

SEQ ID NO: 673545 - RNA, 19 nt, Homo sapiens
gaacccaccuuugccucua

SEQ ID NO: 673546 - RNA, 19 nt, Homo sapiens
guaaauacuguacagcuaa

SEQ ID NO: 673547 - RNA, 19 nt, Homo sapiens
gggcagcuaugcucaccua

SEQ ID NO: 673548 - RNA, 19 nt, Homo sapiens
caucuuugcucacauggaa

SEQ ID NO: 673549 - RNA, 19 nt, Homo sapiens
ggaccugagugacaacaug

SEQ ID NO: 673550 - RNA, 19 nt, Homo sapiens
ccacuuuccuccagaucua

SEQ ID NO: 673551 - RNA, 19 nt, Homo sapiens
ggccacuggugcuuuauuu

SEQ ID NO: 673552 - RNA, 19 nt, Homo sapiens
gcaacaggauucccucagu

SEQ ID NO: 673553 - RNA, 19 nt, Homo sapiens
caggaucccucaaaucaau

SEQ ID NO: 673554 - RNA, 19 nt, Homo sapiens
cagagucgcuggagaucaa

SEQ ID NO: 673555 - RNA, 19 nt, Homo sapiens
gcagcaggaucccucaaau

SEQ ID NO: 673556 - RNA, 19 nt, Homo sapiens
ggaacaagaccccagauua

SEQ ID NO: 673557 - RNA, 19 nt, Homo sapiens
gggcugaggcugaagauga

SEQ ID NO: 673558 - RNA, 19 nt, Homo sapiens
ugacuuggguuucacacuu

SEQ ID NO: 673559 - RNA, 19 nt, Homo sapiens
guacccagcugagccugua

SEQ ID NO: 673560 - RNA, 19 nt, Homo sapiens
ccacaaaccaggcacauuc

SEQ ID NO: 673561 - RNA, 19 nt, Homo sapiens
gaaugaagacucagaagag

SEQ ID NO: 673562 - RNA, 19 nt, Homo sapiens
ggaguaccuuccuuucuca

SEQ ID NO: 673563 - RNA, 19 nt, Homo sapiens
gagaaucgcaugaguagca

SEQ ID NO: 673564 - RNA, 19 nt, Homo sapiens
gagcaaacgcagccucauu

SEQ ID NO: 673565 - RNA, 19 nt, Homo sapiens
ccagcgaacuugacaguag

SEQ ID NO: 673566 - RNA, 19 nt, Homo sapiens
guagaaauagccacaguug

SEQ ID NO: 673567 - RNA, 19 nt, Homo sapiens
uaucaauucucaugagugu

SEQ ID NO: 673568 - RNA, 19 nt, Homo sapiens
guauguguguuuauagaga

SEQ ID NO: 673569 - RNA, 19 nt, Homo sapiens
uaaagcuccucugcacaua

SEQ ID NO: 673570 - RNA, 19 nt, Homo sapiens
aauaaagcauuaccagaga

SEQ ID NO: 673571 - RNA, 19 nt, Homo sapiens
accacgagcuguuucauuu

SEQ ID NO: 673572 - RNA, 19 nt, Homo sapiens
cagcacguaugacaacuug

SEQ ID NO: 673573 - RNA, 19 nt, Homo sapiens
guaggcaucuuccgcaagu

SEQ ID NO: 673574 - RNA, 19 nt, Homo sapiens
gagaucaaccggcaguuug

SEQ ID NO: 673575 - RNA, 19 nt, Homo sapiens
uggcauagcuuccagaacu

SEQ ID NO: 673576 - RNA, 19 nt, Homo sapiens
agagauacacacacauaua

SEQ ID NO: 673577 - RNA, 19 nt, Homo sapiens
gacuuggguuucacacuuu

SEQ ID NO: 673578 - RNA, 19 nt, Homo sapiens
ggagaucaaccggcaguuu

SEQ ID NO: 673579 - RNA, 19 nt, Homo sapiens
caacuugccugagcuguac

SEQ ID NO: 673580 - RNA, 19 nt, Homo sapiens
caagcagaaugaagacuca

SEQ ID NO: 673581 - RNA, 19 nt, Homo sapiens
gacaugacgauuuggcaua

SEQ ID NO: 673582 - RNA, 19 nt, Homo sapiens
ggaggcugaugaccuugaa

SEQ ID NO: 673583 - RNA, 19 nt, Homo sapiens
ggaggaggccacuucauca

SEQ ID NO: 673584 - RNA, 19 nt, Homo sapiens
gccaagaagcgccaucgua

SEQ ID NO: 673585 - RNA, 19 nt, Homo sapiens
aagcagagcccaagcauag

SEQ ID NO: 673586 - RNA, 19 nt, Homo sapiens
gaagaggaagagcagugua

SEQ ID NO: 673587 - RNA, 19 nt, Homo sapiens
guguguauguguguuuaua

SEQ ID NO: 673588 - RNA, 19 nt, Homo sapiens
aguaagugcuggucuccua

SEQ ID NO: 673589 - RNA, 19 nt, Homo sapiens
ucaauucucaugaguguau

SEQ ID NO: 673590 - RNA, 19 nt, Homo sapiens
uauauacacacacgcauuu

SEQ ID NO: 673591 - RNA, 19 nt, Homo sapiens
ugaugaccuugaauaauug

SEQ ID NO: 673592 - RNA, 19 nt, Homo sapiens
ccauggaaguggcaaagau

SEQ ID NO: 673593 - RNA, 19 nt, Homo sapiens
gcagaaugaagacucagaa

SEQ ID NO: 673594 - RNA, 19 nt, Homo sapiens
ucacauggaaauucaaaug

SEQ ID NO: 673595 - RNA, 19 nt, Homo sapiens
aaugagaccucgccugaca

SEQ ID NO: 673596 - RNA, 19 nt, Homo sapiens
guaccuuccuuucucaagu

SEQ ID NO: 673597 - RNA, 19 nt, Homo sapiens
ggcugaggcugaagaugaa

SEQ ID NO: 673598 - RNA, 19 nt, Homo sapiens
aaagcaagcagaaugaaga

SEQ ID NO: 673599 - RNA, 19 nt, Homo sapiens
guguauguguguuuauaga

SEQ ID NO: 673600 - RNA, 19 nt, Homo sapiens
ggaauuggacuggagugaa

SEQ ID NO: 673601 - RNA, 19 nt, Homo sapiens
gcacuucagaugagaaugg

SEQ ID NO: 673602 - RNA, 19 nt, Homo sapiens
gcucucggcucacacacau

SEQ ID NO: 673603 - RNA, 19 nt, Homo sapiens
gcaagcucaccaccacuuu

SEQ ID NO: 673604 - RNA, 19 nt, Homo sapiens
ggaccaaguaggcaucuuc

SEQ ID NO: 673605 - RNA, 19 nt, Homo sapiens
ccgcguucauggagaagua

SEQ ID NO: 673606 - RNA, 19 nt, Homo sapiens
gagcaguguaccaucagua

SEQ ID NO: 673607 - RNA, 19 nt, Homo sapiens
gcaugugaguggcuucaag

SEQ ID NO: 673608 - RNA, 19 nt, Homo sapiens
agaugagaauggagaggua

SEQ ID NO: 673609 - RNA, 19 nt, Homo sapiens
auagagauacacacacaua

SEQ ID NO: 673610 - RNA, 19 nt, Homo sapiens
uuaugaggcugaguuaaga

SEQ ID NO: 673611 - RNA, 19 nt, Homo sapiens
gaaacuggagguucauuuu

SEQ ID NO: 673612 - RNA, 19 nt, Homo sapiens
ugucgcacaugaucaguga

SEQ ID NO: 673613 - RNA, 19 nt, Homo sapiens
uacagacccugcucuacuu

SEQ ID NO: 673614 - RNA, 19 nt, Homo sapiens
cagaaccugcgucaaauga

SEQ ID NO: 673615 - RNA, 19 nt, Homo sapiens
uuauagagauacacacaca

SEQ ID NO: 673616 - RNA, 19 nt, Homo sapiens
gaacaaccugugccagagu

SEQ ID NO: 673617 - RNA, 19 nt, Homo sapiens
gaacaagaccccagauuac

SEQ ID NO: 673618 - RNA, 19 nt, Homo sapiens
agugggaacuccaugaaug

SEQ ID NO: 673619 - RNA, 19 nt, Homo sapiens
agaaauagccacaguugag

SEQ ID NO: 673620 - RNA, 19 nt, Homo sapiens
ccaaccaccacuguaauuu

SEQ ID NO: 673621 - RNA, 19 nt, Homo sapiens
gcucacauggaaauucaaa

SEQ ID NO: 673622 - RNA, 19 nt, Homo sapiens
caucaucccuuuugcuuau

SEQ ID NO: 673623 - RNA, 19 nt, Homo sapiens
caaggaugcuuuugagguu

SEQ ID NO: 673624 - RNA, 19 nt, Homo sapiens
ggaggcaucuuguuucuug

SEQ ID NO: 673625 - RNA, 19 nt, Homo sapiens
gggaagaucuagccuaaag

SEQ ID NO: 673626 - RNA, 19 nt, Homo sapiens
gggaugaucaggugaauuu

SEQ ID NO: 673627 - RNA, 19 nt, Homo sapiens
ggagggaggcaucuuguuu

SEQ ID NO: 673628 - RNA, 19 nt, Homo sapiens
gaacaaggagcaggaagaa

SEQ ID NO: 673629 - RNA, 19 nt, Homo sapiens
caacgugugugccaucuuc

SEQ ID NO: 673630 - RNA, 19 nt, Homo sapiens
caaguugaaaguccaaaua

SEQ ID NO: 673631 - RNA, 19 nt, Homo sapiens
ggaucuggcuugagucaug

SEQ ID NO: 673632 - RNA, 19 nt, Homo sapiens
gaaaucuaccucagaguug

SEQ ID NO: 673633 - RNA, 19 nt, Homo sapiens
gagaucaaguacccacuga

SEQ ID NO: 673634 - RNA, 19 nt, Homo sapiens
cagcaugaguuacagaaga

SEQ ID NO: 673635 - RNA, 19 nt, Homo sapiens
ccaaggacacgucauugua

SEQ ID NO: 673636 - RNA, 19 nt, Homo sapiens
gauccaggccuacgagaaa

SEQ ID NO: 673637 - RNA, 19 nt, Homo sapiens
gagcauggcuuuucucugu

SEQ ID NO: 673638 - RNA, 19 nt, Homo sapiens
agacagagcugagggagau

SEQ ID NO: 673639 - RNA, 19 nt, Homo sapiens
ccaccuacauuuccucugu

SEQ ID NO: 673640 - RNA, 19 nt, Homo sapiens
gagacagccuugggaauuc

SEQ ID NO: 673641 - RNA, 19 nt, Homo sapiens
guuucuggguugcaucuua

SEQ ID NO: 673642 - RNA, 19 nt, Homo sapiens
ccagauaccuccacuugcu

SEQ ID NO: 673643 - RNA, 19 nt, Homo sapiens
gaagaacagcuuggagaga

SEQ ID NO: 673644 - RNA, 19 nt, Homo sapiens
ucaaccaguuccagcauga

SEQ ID NO: 673645 - RNA, 19 nt, Homo sapiens
cugggaagaucuagccuaa

SEQ ID NO: 673646 - RNA, 19 nt, Homo sapiens
gaagaucuagccuaaagag

SEQ ID NO: 673647 - RNA, 19 nt, Homo sapiens
gaaaagaguuggggaugau

SEQ ID NO: 673648 - RNA, 19 nt, Homo sapiens
gaacagcuuggagagauga

SEQ ID NO: 673649 - RNA, 19 nt, Homo sapiens
ccaguuccagcaugaguua

SEQ ID NO: 673650 - RNA, 19 nt, Homo sapiens
ugaaaucuaccucagaguu

SEQ ID NO: 673651 - RNA, 19 nt, Homo sapiens
gcgcaugucccgcucuuau

SEQ ID NO: 673652 - RNA, 19 nt, Homo sapiens
caucuuguuucuugugguu

SEQ ID NO: 673653 - RNA, 19 nt, Homo sapiens
ggaguugaguucccuacag

SEQ ID NO: 673654 - RNA, 19 nt, Homo sapiens
gggacaaacccuagacaga

SEQ ID NO: 673655 - RNA, 19 nt, Homo sapiens
ggagaagcgcggaggaaug

SEQ ID NO: 673656 - RNA, 19 nt, Homo sapiens
ccacucagcucuggcucuu

SEQ ID NO: 673657 - RNA, 19 nt, Homo sapiens
ugagacagccuugggaauu

SEQ ID NO: 673658 - RNA, 19 nt, Homo sapiens
gaacaaguugaaaguccaa

SEQ ID NO: 673659 - RNA, 19 nt, Homo sapiens
caaauguccaucuuucuca

SEQ ID NO: 673660 - RNA, 19 nt, Homo sapiens
cgucagaucugugguuugg

SEQ ID NO: 673661 - RNA, 19 nt, Homo sapiens
aagaacagcuuggagagau

SEQ ID NO: 673662 - RNA, 19 nt, Homo sapiens
gaagaacaaggagcaggaa

SEQ ID NO: 673663 - RNA, 19 nt, Homo sapiens
ggaaguuucuggguugcau

SEQ ID NO: 673664 - RNA, 19 nt, Homo sapiens
gagaucaacuucaaaagag

SEQ ID NO: 673665 - RNA, 19 nt, Homo sapiens
gcaccugcgucagaucugu

SEQ ID NO: 673666 - RNA, 19 nt, Homo sapiens
agagugacuuggagacaga

SEQ ID NO: 673667 - RNA, 19 nt, Homo sapiens
acaaggagcaggaagaaca

SEQ ID NO: 673668 - RNA, 19 nt, Homo sapiens
gugcuccgccucccacuuu

SEQ ID NO: 673669 - RNA, 19 nt, Homo sapiens
ggaggacugggaagaucua

SEQ ID NO: 673670 - RNA, 19 nt, Homo sapiens
gccuuucuguucuuaauca

SEQ ID NO: 673671 - RNA, 19 nt, Homo sapiens
gagaagcgcggaggaaugg

SEQ ID NO: 673672 - RNA, 19 nt, Homo sapiens
ggagaucaacuucaaaaga

SEQ ID NO: 673673 - RNA, 19 nt, Homo sapiens
gagggaggcaucuuguuuc

SEQ ID NO: 673674 - RNA, 19 nt, Homo sapiens
gaagagugacuuggagaca

SEQ ID NO: 673675 - RNA, 19 nt, Homo sapiens
gggccaaggacacgucauu

SEQ ID NO: 673676 - RNA, 19 nt, Homo sapiens
ggccaguccuguccuccuu

SEQ ID NO: 673677 - RNA, 19 nt, Homo sapiens
aagaagguguccagugcuu

SEQ ID NO: 673678 - RNA, 19 nt, Homo sapiens
agacauggcgugggugaaa

SEQ ID NO: 673679 - RNA, 19 nt, Homo sapiens
ugugcucucugaacaaguu

SEQ ID NO: 673680 - RNA, 19 nt, Homo sapiens
ggaagaucuagccuaaaga

SEQ ID NO: 673681 - RNA, 19 nt, Homo sapiens
uuacggagacaucaaggaa

SEQ ID NO: 673682 - RNA, 19 nt, Homo sapiens
gcacugaggcacagaucgu

SEQ ID NO: 673683 - RNA, 19 nt, Homo sapiens
gcaggaagaacagcuugga

SEQ ID NO: 673684 - RNA, 19 nt, Homo sapiens
caaggacacgucauuguac

SEQ ID NO: 673685 - RNA, 19 nt, Homo sapiens
gcuccugguuucugcuuag

SEQ ID NO: 673686 - RNA, 19 nt, Homo sapiens
gcacuaccuggcacugaga

SEQ ID NO: 673687 - RNA, 19 nt, Homo sapiens
agcaacggcucaaccaguu

SEQ ID NO: 673688 - RNA, 19 nt, Homo sapiens
ccucaaagucuacgagauc

SEQ ID NO: 673689 - RNA, 19 nt, Homo sapiens
gcuuacuugucccuacuug

SEQ ID NO: 673690 - RNA, 19 nt, Homo sapiens
ucagaguuguacccucaga

SEQ ID NO: 673691 - RNA, 19 nt, Homo sapiens
ccacccacccaccuacauu

SEQ ID NO: 673692 - RNA, 19 nt, Homo sapiens
ccaaauguccaucuuucuc

SEQ ID NO: 673693 - RNA, 19 nt, Homo sapiens
agcaugaguuacagaagaa

SEQ ID NO: 673694 - RNA, 19 nt, Homo sapiens
gccaaggacacgucauugu

SEQ ID NO: 673695 - RNA, 19 nt, Homo sapiens
gaugaucaggugaauuugg

SEQ ID NO: 673696 - RNA, 19 nt, Homo sapiens
aaaucuaccucagaguugu

SEQ ID NO: 673697 - RNA, 19 nt, Homo sapiens
ccagggugcuguggagauc

SEQ ID NO: 673698 - RNA, 19 nt, Homo sapiens
gaaggucagccugcagcaa

SEQ ID NO: 673699 - RNA, 19 nt, Homo sapiens
ccaguccuguccuccuuuc

SEQ ID NO: 673700 - RNA, 19 nt, Homo sapiens
ggagaacagcaagaucuag

SEQ ID NO: 673701 - RNA, 19 nt, Homo sapiens
agaacaaggagcaggaaga

SEQ ID NO: 673702 - RNA, 19 nt, Homo sapiens
cuguggagaucaacuucaa

SEQ ID NO: 673703 - RNA, 19 nt, Homo sapiens
ggagaaucuugaggacucu

SEQ ID NO: 673704 - RNA, 19 nt, Homo sapiens
ugaaaagaguuggggauga

SEQ ID NO: 673705 - RNA, 19 nt, Homo sapiens
agaacagcuuggagagaug

SEQ ID NO: 673706 - RNA, 19 nt, Homo sapiens
ggagcaggaagaacagcuu

SEQ ID NO: 673707 - RNA, 19 nt, Homo sapiens
caaagucuacgagaucaag

SEQ ID NO: 673708 - RNA, 19 nt, Homo sapiens
ugacucagccucuguuagc

SEQ ID NO: 673709 - RNA, 19 nt, Homo sapiens
gcccucaucaaacacauug

SEQ ID NO: 673710 - RNA, 19 nt, Homo sapiens
gaaacucugcguggagaag

SEQ ID NO: 673711 - RNA, 19 nt, Homo sapiens
ccacuuugcccucaucacu

SEQ ID NO: 673712 - RNA, 19 nt, Homo sapiens
cagauaccuccacuugcua

SEQ ID NO: 673713 - RNA, 19 nt, Homo sapiens
ucuccguccucuccuauca

SEQ ID NO: 673714 - RNA, 19 nt, Homo sapiens
cgagguauuuggggaagua

SEQ ID NO: 673715 - RNA, 19 nt, Homo sapiens
gguugcuccugcucuccua

SEQ ID NO: 673716 - RNA, 19 nt, Homo sapiens
ccucugccuuucuguucuu

SEQ ID NO: 673717 - RNA, 19 nt, Homo sapiens
cccuggagcccuuguguga

SEQ ID NO: 673718 - RNA, 19 nt, Homo sapiens
uggagaacagcaagaucua

SEQ ID NO: 673719 - RNA, 19 nt, Homo sapiens
gcauggcuuuucucuguau

SEQ ID NO: 673720 - RNA, 19 nt, Homo sapiens
guacaaagguuucuaaauc

SEQ ID NO: 673721 - RNA, 19 nt, Homo sapiens
uaaggaggauugugauuua

SEQ ID NO: 673722 - RNA, 19 nt, Homo sapiens
gaagaaagaagaagaagaa

SEQ ID NO: 673723 - RNA, 19 nt, Homo sapiens
ggagaacucugaucgagaa

SEQ ID NO: 673724 - RNA, 19 nt, Homo sapiens
gcaacaagcugcccugcaa

SEQ ID NO: 673725 - RNA, 19 nt, Homo sapiens
gaaucaaagugcccaacua

SEQ ID NO: 673726 - RNA, 19 nt, Homo sapiens
gcacccagcuauaugagaa

SEQ ID NO: 673727 - RNA, 19 nt, Homo sapiens
ucaagaggguguccacuuu

SEQ ID NO: 673728 - RNA, 19 nt, Homo sapiens
cagcgacccuccuaugaua

SEQ ID NO: 673729 - RNA, 19 nt, Homo sapiens
gaagcuggaugacgaggaa

SEQ ID NO: 673730 - RNA, 19 nt, Homo sapiens
uaaagucugucaauguuug

SEQ ID NO: 673731 - RNA, 19 nt, Homo sapiens
aagaauauccggcaguuua

SEQ ID NO: 673732 - RNA, 19 nt, Homo sapiens
agacaucucuccuuuagug

SEQ ID NO: 673733 - RNA, 19 nt, Homo sapiens
gaacucugaucgagaaagu

SEQ ID NO: 673734 - RNA, 19 nt, Homo sapiens
gcaaguauuugugaagaug

SEQ ID NO: 673735 - RNA, 19 nt, Homo sapiens
gaaggcgccuggacaagga

SEQ ID NO: 673736 - RNA, 19 nt, Homo sapiens
gaagugcaccuuugacaug

SEQ ID NO: 673737 - RNA, 19 nt, Homo sapiens
gaagagacgguccauccua

SEQ ID NO: 673738 - RNA, 19 nt, Homo sapiens
ggcgaggccuguucuguaa

SEQ ID NO: 673739 - RNA, 19 nt, Homo sapiens
gagccaaagugcagcuauu

SEQ ID NO: 673740 - RNA, 19 nt, Homo sapiens
ucagacaucucuccuuuag

SEQ ID NO: 673741 - RNA, 19 nt, Homo sapiens
gcagaagucucccgauggu

SEQ ID NO: 673742 - RNA, 19 nt, Homo sapiens
gaaggaagaaagagcugua

SEQ ID NO: 673743 - RNA, 19 nt, Homo sapiens
caauaaagucugucaaugu

SEQ ID NO: 673744 - RNA, 19 nt, Homo sapiens
gaggagaaccagaccauug

SEQ ID NO: 673745 - RNA, 19 nt, Homo sapiens
gaagacaacgacuaugaga

SEQ ID NO: 673746 - RNA, 19 nt, Homo sapiens
uaugauaucuucgaggauu

SEQ ID NO: 673747 - RNA, 19 nt, Homo sapiens
uaagaagacguccaaagaa

SEQ ID NO: 673748 - RNA, 19 nt, Homo sapiens
acucagacaucucuccuuu

SEQ ID NO: 673749 - RNA, 19 nt, Homo sapiens
ggaaacuacugcccgaucu

SEQ ID NO: 673750 - RNA, 19 nt, Homo sapiens
gagaagagaaggaagaaag

SEQ ID NO: 673751 - RNA, 19 nt, Homo sapiens
guaaagaugggacaauugu

SEQ ID NO: 673752 - RNA, 19 nt, Homo sapiens
ggaagggcaucgggugcua

SEQ ID NO: 673753 - RNA, 19 nt, Homo sapiens
gcucucagaugaagacuac

SEQ ID NO: 673754 - RNA, 19 nt, Homo sapiens
ggaagaagagaagaaagaa

SEQ ID NO: 673755 - RNA, 19 nt, Homo sapiens
cgaaucaggucaaggucaa

SEQ ID NO: 673756 - RNA, 19 nt, Homo sapiens
uuaagaagacguccaaaga

SEQ ID NO: 673757 - RNA, 19 nt, Homo sapiens
gggcaaguauuugugaaga

SEQ ID NO: 673758 - RNA, 19 nt, Homo sapiens
cccaauggcuggacuggaa

SEQ ID NO: 673759 - RNA, 19 nt, Homo sapiens
ggacggcucuuccccauug

SEQ ID NO: 673760 - RNA, 19 nt, Homo sapiens
gaacgacggcucccucaag

SEQ ID NO: 673761 - RNA, 19 nt, Homo sapiens
aagagacgguccauccuaa

SEQ ID NO: 673762 - RNA, 19 nt, Homo sapiens
gggcgaggccuguucugua

SEQ ID NO: 673763 - RNA, 19 nt, Homo sapiens
gagcugguguucugucaag

SEQ ID NO: 673764 - RNA, 19 nt, Homo sapiens
ccacagaggauacaucauc

SEQ ID NO: 673765 - RNA, 19 nt, Homo sapiens
ggucaccacuccuguuaag

SEQ ID NO: 673766 - RNA, 19 nt, Homo sapiens
ugaagaauauccggcaguu

SEQ ID NO: 673767 - RNA, 19 nt, Homo sapiens
ggcccaggauguagauauu

SEQ ID NO: 673768 - RNA, 19 nt, Homo sapiens
ggaugacuuugauguagug

SEQ ID NO: 673769 - RNA, 19 nt, Homo sapiens
gaccugccaucggaaauug

SEQ ID NO: 673770 - RNA, 19 nt, Homo sapiens
cuaaaucccuucuuuucua

SEQ ID NO: 673771 - RNA, 19 nt, Homo sapiens
guuucuaaaucccuucuuu

SEQ ID NO: 673772 - RNA, 19 nt, Homo sapiens
gcccugggauuccgaugaa

SEQ ID NO: 673773 - RNA, 19 nt, Homo sapiens
gcuacgugcuccaggaaga

SEQ ID NO: 673774 - RNA, 19 nt, Homo sapiens
caacuuccacuucaugugu

SEQ ID NO: 673775 - RNA, 19 nt, Homo sapiens
cgaguggucuggagauuac

SEQ ID NO: 673776 - RNA, 19 nt, Homo sapiens
ccgcauggaugacuuugau

SEQ ID NO: 673777 - RNA, 19 nt, Homo sapiens
aagaagacguccaaagaag

SEQ ID NO: 673778 - RNA, 19 nt, Homo sapiens
ggaggauugugauuuagag

SEQ ID NO: 673779 - RNA, 19 nt, Homo sapiens
gcagaugccuccccuggaa

SEQ ID NO: 673780 - RNA, 19 nt, Homo sapiens
ggauccggcugccuucuca

SEQ ID NO: 673781 - RNA, 19 nt, Homo sapiens
aaguaaagaugggacaauu

SEQ ID NO: 673782 - RNA, 19 nt, Homo sapiens
aggaggaguuucaggguuu

SEQ ID NO: 673783 - RNA, 19 nt, Homo sapiens
gaggaagcagcaagcagua

SEQ ID NO: 673784 - RNA, 19 nt, Homo sapiens
ggcaucgggugcuauaugu

SEQ ID NO: 673785 - RNA, 19 nt, Homo sapiens
cgaguacucuggcauuguc

SEQ ID NO: 673786 - RNA, 19 nt, Homo sapiens
gcgaggggcucucagauga

SEQ ID NO: 673787 - RNA, 19 nt, Homo sapiens
gcuaugaagacaacgacua

SEQ ID NO: 673788 - RNA, 19 nt, Homo sapiens
caaauucugccacgucugu

SEQ ID NO: 673789 - RNA, 19 nt, Homo sapiens
agaagcagcugugacaauc

SEQ ID NO: 673790 - RNA, 19 nt, Homo sapiens
aagaagagaagaaagaaga

SEQ ID NO: 673791 - RNA, 19 nt, Homo sapiens
gaagacuacgagauccuuu

SEQ ID NO: 673792 - RNA, 19 nt, Homo sapiens
ucaaacagcgacccuccua

SEQ ID NO: 673793 - RNA, 19 nt, Homo sapiens
gaagaauauccggcaguuu

SEQ ID NO: 673794 - RNA, 19 nt, Homo sapiens
gcaaaggucguggauccaa

SEQ ID NO: 673795 - RNA, 19 nt, Homo sapiens
ccaaagugcagcuauucaa

SEQ ID NO: 673796 - RNA, 19 nt, Homo sapiens
ccuaagggaacccacauuu

SEQ ID NO: 673797 - RNA, 19 nt, Homo sapiens
guccugcgaccucccauua

SEQ ID NO: 673798 - RNA, 19 nt, Homo sapiens
ugccgucgcugccaucuug

SEQ ID NO: 673799 - RNA, 19 nt, Homo sapiens
caucucuccuuuaguggaa

SEQ ID NO: 673800 - RNA, 19 nt, Homo sapiens
ggaccugccaucggaaauu

SEQ ID NO: 673801 - RNA, 19 nt, Homo sapiens
ggaguacccggcugccaaa

SEQ ID NO: 673802 - RNA, 19 nt, Homo sapiens
gaggauggccacuacaagu

SEQ ID NO: 673803 - RNA, 19 nt, Homo sapiens
ggauugugauuuagagaac

SEQ ID NO: 673804 - RNA, 19 nt, Homo sapiens
aaacagcgacccuccuaug

SEQ ID NO: 673805 - RNA, 19 nt, Homo sapiens
aauagaggcucggaagaug

SEQ ID NO: 673806 - RNA, 19 nt, Homo sapiens
uacauccacuucccuguga

SEQ ID NO: 673807 - RNA, 19 nt, Homo sapiens
cgacggcucccucaagaau

SEQ ID NO: 673808 - RNA, 19 nt, Homo sapiens
ccagcuauaugagaaagga

SEQ ID NO: 673809 - RNA, 19 nt, Homo sapiens
ggagggagaagagaaggaa

SEQ ID NO: 673810 - RNA, 19 nt, Homo sapiens
uuaaggaggauugugauuu

SEQ ID NO: 673811 - RNA, 19 nt, Homo sapiens
aagcccaccugaagaucua

SEQ ID NO: 673812 - RNA, 19 nt, Homo sapiens
gaagaagagaagaaagaag

SEQ ID NO: 673813 - RNA, 19 nt, Homo sapiens
ccacguggagggccagaaa

SEQ ID NO: 673814 - RNA, 19 nt, Homo sapiens
gggcaucgggugcuauaug

SEQ ID NO: 673815 - RNA, 19 nt, Homo sapiens
ggccaccugugaugaggaa

SEQ ID NO: 673816 - RNA, 19 nt, Homo sapiens
uaccagugcucccgucugu

SEQ ID NO: 673817 - RNA, 19 nt, Homo sapiens
cuuccaggaugacaagaaa

SEQ ID NO: 673818 - RNA, 19 nt, Homo sapiens
gcugcgagcucugccugaa

SEQ ID NO: 673819 - RNA, 19 nt, Homo sapiens
gcauggaugacuuugaugu

SEQ ID NO: 673820 - RNA, 19 nt, Homo sapiens
gcacugugguuuacaauua

SEQ ID NO: 673821 - RNA, 19 nt, Homo sapiens
gcacauauguaccuaauga

SEQ ID NO: 673822 - RNA, 19 nt, Homo sapiens
gcaaauggauggcuuguga

SEQ ID NO: 673823 - RNA, 19 nt, Homo sapiens
ggaaagggauccugauuga

SEQ ID NO: 673824 - RNA, 19 nt, Homo sapiens
gcacagaagugaagaugaa

SEQ ID NO: 673825 - RNA, 19 nt, Homo sapiens
cgacucaucuuguagcuua

SEQ ID NO: 673826 - RNA, 19 nt, Homo sapiens
gcaauggacuuuguuguuu

SEQ ID NO: 673827 - RNA, 19 nt, Homo sapiens
gaacauuccuucuuuacug

SEQ ID NO: 673828 - RNA, 19 nt, Homo sapiens
caggguagcuucugaaauu

SEQ ID NO: 673829 - RNA, 19 nt, Homo sapiens
cgacaggccucguguauga

SEQ ID NO: 673830 - RNA, 19 nt, Homo sapiens
ggacuuaauucuaaucuca

SEQ ID NO: 673831 - RNA, 19 nt, Homo sapiens
ccuaggagcuguauaaaga

SEQ ID NO: 673832 - RNA, 19 nt, Homo sapiens
gcaaguagcaugaaguauu

SEQ ID NO: 673833 - RNA, 19 nt, Homo sapiens
uggcuaagauuucacuuua

SEQ ID NO: 673834 - RNA, 19 nt, Homo sapiens
caaguagcaugaaguauug

SEQ ID NO: 673835 - RNA, 19 nt, Homo sapiens
gggcauugauacauauaua

SEQ ID NO: 673836 - RNA, 19 nt, Homo sapiens
gaaggucccugcaaaugga

SEQ ID NO: 673837 - RNA, 19 nt, Homo sapiens
gaggaacaaugccuuaaga

SEQ ID NO: 673838 - RNA, 19 nt, Homo sapiens
caccaacgauugugucuuu

SEQ ID NO: 673839 - RNA, 19 nt, Homo sapiens
agagggaccuuuaaagaaa

SEQ ID NO: 673840 - RNA, 19 nt, Homo sapiens
ggacgccucuguucaacuu

SEQ ID NO: 673841 - RNA, 19 nt, Homo sapiens
gcagucagcauuaaugaaa

SEQ ID NO: 673842 - RNA, 19 nt, Homo sapiens
gaagaugaaguuacaagaa

SEQ ID NO: 673843 - RNA, 19 nt, Homo sapiens
ggacagagggaccuuuaaa

SEQ ID NO: 673844 - RNA, 19 nt, Homo sapiens
ccacucgacucaucuugua

SEQ ID NO: 673845 - RNA, 19 nt, Homo sapiens
uaacgaagcugagcguguu

SEQ ID NO: 673846 - RNA, 19 nt, Homo sapiens
aaacaaaacuggacagaaa

SEQ ID NO: 673847 - RNA, 19 nt, Homo sapiens
gaaguuugcgucuuauuga

SEQ ID NO: 673848 - RNA, 19 nt, Homo sapiens
ggaacaaugccuuaagaaa

SEQ ID NO: 673849 - RNA, 19 nt, Homo sapiens
uuaagcagaugaugggaua

SEQ ID NO: 673850 - RNA, 19 nt, Homo sapiens
ggacccagcucacccaaca

SEQ ID NO: 673851 - RNA, 19 nt, Homo sapiens
ggcaugacuuuauauugua

SEQ ID NO: 673852 - RNA, 19 nt, Homo sapiens
gcauuacuguguagccuuu

SEQ ID NO: 673853 - RNA, 19 nt, Homo sapiens
gaaugcaucaucucacuuu

SEQ ID NO: 673854 - RNA, 19 nt, Homo sapiens
cagccagucuuuacucuuu

SEQ ID NO: 673855 - RNA, 19 nt, Homo sapiens
cgaccggcaugacuuuaua

SEQ ID NO: 673856 - RNA, 19 nt, Homo sapiens
gaacaaugccuuaagaaaa

SEQ ID NO: 673857 - RNA, 19 nt, Homo sapiens
guaaaccacucgacucauc

SEQ ID NO: 673858 - RNA, 19 nt, Homo sapiens
uauauuggguucagacuug

SEQ ID NO: 673859 - RNA, 19 nt, Homo sapiens
gcuaagauuucacuuuaag

SEQ ID NO: 673860 - RNA, 19 nt, Homo sapiens
aagaggagcugguccauuc

SEQ ID NO: 673861 - RNA, 19 nt, Homo sapiens
gggcagaaguucagacaca

SEQ ID NO: 673862 - RNA, 19 nt, Homo sapiens
gaaugcagauugcgaaggu

SEQ ID NO: 673863 - RNA, 19 nt, Homo sapiens
gaugcgaguuugugccuuu

SEQ ID NO: 673864 - RNA, 19 nt, Homo sapiens
gggagacgcugaguacuug

SEQ ID NO: 673865 - RNA, 19 nt, Homo sapiens
cggcaugacuuuauauugu

SEQ ID NO: 673866 - RNA, 19 nt, Homo sapiens
auggauggcuugugaauuu

SEQ ID NO: 673867 - RNA, 19 nt, Homo sapiens
ggaaacuacucagaauuca

SEQ ID NO: 673868 - RNA, 19 nt, Homo sapiens
aaacuucucugaccacauc

SEQ ID NO: 673869 - RNA, 19 nt, Homo sapiens
ggagugacaccaacgauug

SEQ ID NO: 673870 - RNA, 19 nt, Homo sapiens
cgaagcugcuguucucuug

SEQ ID NO: 673871 - RNA, 19 nt, Homo sapiens
gcagaaaguggccgaaaga

SEQ ID NO: 673872 - RNA, 19 nt, Homo sapiens
gcaauuuucugaaugguaa

SEQ ID NO: 673873 - RNA, 19 nt, Homo sapiens
aaagggauccugauugauu

SEQ ID NO: 673874 - RNA, 19 nt, Homo sapiens
ggagcuggcuugaguuucu

SEQ ID NO: 673875 - RNA, 19 nt, Homo sapiens
gaguugauuuggaggaauu

SEQ ID NO: 673876 - RNA, 19 nt, Homo sapiens
ggaaguuugcgucuuauug

SEQ ID NO: 673877 - RNA, 19 nt, Homo sapiens
ggaaggaccauuucguaau

SEQ ID NO: 673878 - RNA, 19 nt, Homo sapiens
gagugcagauucuuggauu

SEQ ID NO: 673879 - RNA, 19 nt, Homo sapiens
gacagaaacaggaauguga

SEQ ID NO: 673880 - RNA, 19 nt, Homo sapiens
guaauggucugacacaaaa

SEQ ID NO: 673881 - RNA, 19 nt, Homo sapiens
ccaaaugagugcagauucu

SEQ ID NO: 673882 - RNA, 19 nt, Homo sapiens
gcaaagacccaaugcaaac

SEQ ID NO: 673883 - RNA, 19 nt, Homo sapiens
ugaaccgaaucugaaauua

SEQ ID NO: 673884 - RNA, 19 nt, Homo sapiens
aaauuacgguccaggcuaa

SEQ ID NO: 673885 - RNA, 19 nt, Homo sapiens
gagugucgaccuccuauaa

SEQ ID NO: 673886 - RNA, 19 nt, Homo sapiens
gaagcugagcguguucuua

SEQ ID NO: 673887 - RNA, 19 nt, Homo sapiens
ggugauguauggcuaagau

SEQ ID NO: 673888 - RNA, 19 nt, Homo sapiens
gcugagagcauuacugugu

SEQ ID NO: 673889 - RNA, 19 nt, Homo sapiens
gggcagggaggguugcuua

SEQ ID NO: 673890 - RNA, 19 nt, Homo sapiens
gggaaacuacucagaauuc

SEQ ID NO: 673891 - RNA, 19 nt, Homo sapiens
guauuuauguggaaacagu

SEQ ID NO: 673892 - RNA, 19 nt, Homo sapiens
gcucauuccauucuucuuu

SEQ ID NO: 673893 - RNA, 19 nt, Homo sapiens
gggaaggaccauuucguaa

SEQ ID NO: 673894 - RNA, 19 nt, Homo sapiens
gguccaggcuaaagcagaa

SEQ ID NO: 673895 - RNA, 19 nt, Homo sapiens
ucaaggugcuuauggaaag

SEQ ID NO: 673896 - RNA, 19 nt, Homo sapiens
uuauugcucugguggauuu

SEQ ID NO: 673897 - RNA, 19 nt, Homo sapiens
ggacccagcaggcuuucua

SEQ ID NO: 673898 - RNA, 19 nt, Homo sapiens
gaauguacgacgccaaaga

SEQ ID NO: 673899 - RNA, 19 nt, Homo sapiens
gcacaugaagccaccaguu

SEQ ID NO: 673900 - RNA, 19 nt, Homo sapiens
ccaauguauuccaagcuaa

SEQ ID NO: 673901 - RNA, 19 nt, Homo sapiens
aaacgaauccaaaguguuc

SEQ ID NO: 673902 - RNA, 19 nt, Homo sapiens
uggguuaccuggcucauga

SEQ ID NO: 673903 - RNA, 19 nt, Homo sapiens
gcagcagcaucagcaguuu

SEQ ID NO: 673904 - RNA, 19 nt, Homo sapiens
ccuuggaccuuuagccuuu

SEQ ID NO: 673905 - RNA, 19 nt, Homo sapiens
cagagggaccuuuaaagaa

SEQ ID NO: 673906 - RNA, 19 nt, Homo sapiens
cagcaaagacccaaugcaa

SEQ ID NO: 673907 - RNA, 19 nt, Homo sapiens
aaagucugcuauugaaaga

SEQ ID NO: 673908 - RNA, 19 nt, Homo sapiens
gauccugauugauugaaau

SEQ ID NO: 673909 - RNA, 19 nt, Homo sapiens
caaaucccguuggagguuu

SEQ ID NO: 673910 - RNA, 19 nt, Homo sapiens
ggcuaagauuucacuuuaa

SEQ ID NO: 673911 - RNA, 19 nt, Homo sapiens
ccugccaccugcccucuua

SEQ ID NO: 673912 - RNA, 19 nt, Homo sapiens
ucacugggcugcugauggu

SEQ ID NO: 673913 - RNA, 19 nt, Homo sapiens
cagaauuguugcugucaga

SEQ ID NO: 673914 - RNA, 19 nt, Homo sapiens
gaaccgcucccgucuccaa

SEQ ID NO: 673915 - RNA, 19 nt, Homo sapiens
gcaaaucccguuggagguu

SEQ ID NO: 673916 - RNA, 19 nt, Homo sapiens
gaaccgaaucugaaauuac

SEQ ID NO: 673917 - RNA, 19 nt, Homo sapiens
gaacaaggagaagggcaaa

SEQ ID NO: 673918 - RNA, 19 nt, Homo sapiens
gaggguuccuucauguguu

SEQ ID NO: 673919 - RNA, 19 nt, Homo sapiens
gcacagaaaacaaauauca

SEQ ID NO: 673920 - RNA, 19 nt, Homo sapiens
ggaaacagcuaaauuacaa

SEQ ID NO: 673921 - RNA, 19 nt, Homo sapiens
gaacacugcuuucuaauuc

SEQ ID NO: 673922 - RNA, 19 nt, Homo sapiens
uugcauagcuuucacauua

SEQ ID NO: 673923 - RNA, 19 nt, Homo sapiens
ggaaagccauccaaauuug

SEQ ID NO: 673924 - RNA, 19 nt, Homo sapiens
gaaauagucaugcuucuuu

SEQ ID NO: 673925 - RNA, 19 nt, Homo sapiens
gaaaucacagucuccaaua

SEQ ID NO: 673926 - RNA, 19 nt, Homo sapiens
ugaaagcuguugauagaaa

SEQ ID NO: 673927 - RNA, 19 nt, Homo sapiens
gaaggaagguguuucuuuu

SEQ ID NO: 673928 - RNA, 19 nt, Homo sapiens
gguagagaguguugaaauu

SEQ ID NO: 673929 - RNA, 19 nt, Homo sapiens
ugaagcaacucgcagcaua

SEQ ID NO: 673930 - RNA, 19 nt, Homo sapiens
gaagaaggaucccaaugag

SEQ ID NO: 673931 - RNA, 19 nt, Homo sapiens
caagaaaguuagucugguu

SEQ ID NO: 673932 - RNA, 19 nt, Homo sapiens
ggaaggaagguguuucuuu

SEQ ID NO: 673933 - RNA, 19 nt, Homo sapiens
gcagauccaugugauuauu

SEQ ID NO: 673934 - RNA, 19 nt, Homo sapiens
gcauagcuuucacauuaaa

SEQ ID NO: 673935 - RNA, 19 nt, Homo sapiens
caacuugguuugaauaugg

SEQ ID NO: 673936 - RNA, 19 nt, Homo sapiens
gggaaagccauccaaauuu

SEQ ID NO: 673937 - RNA, 19 nt, Homo sapiens
gaagugcugcgcucuagua

SEQ ID NO: 673938 - RNA, 19 nt, Homo sapiens
caccauggauugcuuugua

SEQ ID NO: 673939 - RNA, 19 nt, Homo sapiens
cagcaaggauuuacucuuc

SEQ ID NO: 673940 - RNA, 19 nt, Homo sapiens
guaccuaaguucccacuau

SEQ ID NO: 673941 - RNA, 19 nt, Homo sapiens
ggugagaacauguauauga

SEQ ID NO: 673942 - RNA, 19 nt, Homo sapiens
ucaaggcaguucuccauuu

SEQ ID NO: 673943 - RNA, 19 nt, Homo sapiens
gggaaugaauccucaccua

SEQ ID NO: 673944 - RNA, 19 nt, Homo sapiens
gaaggaaauuuggaccauu

SEQ ID NO: 673945 - RNA, 19 nt, Homo sapiens
ggaaugaauccucaccuaa

SEQ ID NO: 673946 - RNA, 19 nt, Homo sapiens
ccagaaagcauuuaagaau

SEQ ID NO: 673947 - RNA, 19 nt, Homo sapiens
uaacagaauugcccuccaa

SEQ ID NO: 673948 - RNA, 19 nt, Homo sapiens
gaaagcuguugauagaaau

SEQ ID NO: 673949 - RNA, 19 nt, Homo sapiens
gacaaagcacuguaccuua

SEQ ID NO: 673950 - RNA, 19 nt, Homo sapiens
gcaaggauuuacucuucaa

SEQ ID NO: 673951 - RNA, 19 nt, Homo sapiens
ggaccucccugaaaucaca

SEQ ID NO: 673952 - RNA, 19 nt, Homo sapiens
uaccagcacuacuaauuaa

SEQ ID NO: 673953 - RNA, 19 nt, Homo sapiens
cacacaagcuccaagacua

SEQ ID NO: 673954 - RNA, 19 nt, Homo sapiens
ggauaaaaguccuggauuu

SEQ ID NO: 673955 - RNA, 19 nt, Homo sapiens
ggaauucagggaaguguuu

SEQ ID NO: 673956 - RNA, 19 nt, Homo sapiens
ggacaaagcacuguaccuu

SEQ ID NO: 673957 - RNA, 19 nt, Homo sapiens
ggaacacugcuuucuaauu

SEQ ID NO: 673958 - RNA, 19 nt, Homo sapiens
gaaaaggaguugcuugaug

SEQ ID NO: 673959 - RNA, 19 nt, Homo sapiens
guucacaguuuauuguuug

SEQ ID NO: 673960 - RNA, 19 nt, Homo sapiens
uuugaaagcuguugauaga

SEQ ID NO: 673961 - RNA, 19 nt, Homo sapiens
guacaaccuugaaucacuu

SEQ ID NO: 673962 - RNA, 19 nt, Homo sapiens
gcuagcagauuuacuccuu

SEQ ID NO: 673963 - RNA, 19 nt, Homo sapiens
gaagaugaaggcgaugaua

SEQ ID NO: 673964 - RNA, 19 nt, Homo sapiens
gcguuauucuuucgugaua

SEQ ID NO: 673965 - RNA, 19 nt, Homo sapiens
aaaggugaguaaccagaua

SEQ ID NO: 673966 - RNA, 19 nt, Homo sapiens
gggaagcgcaaacacauuu

SEQ ID NO: 673967 - RNA, 19 nt, Homo sapiens
gaucaaugguggagagaag

SEQ ID NO: 673968 - RNA, 19 nt, Homo sapiens
gcugagagcucuaauuuuc

SEQ ID NO: 673969 - RNA, 19 nt, Homo sapiens
gggaucauaucaagaaagu

SEQ ID NO: 673970 - RNA, 19 nt, Homo sapiens
gaaauuuggaccauucaga

SEQ ID NO: 673971 - RNA, 19 nt, Homo sapiens
ggaguugcuugaugugaga

SEQ ID NO: 673972 - RNA, 19 nt, Homo sapiens
gaaagccauccaaauuuga

SEQ ID NO: 673973 - RNA, 19 nt, Homo sapiens
uaaaguaaccaguccuuau

SEQ ID NO: 673974 - RNA, 19 nt, Homo sapiens
caaaccugcuuuucauuua

SEQ ID NO: 673975 - RNA, 19 nt, Homo sapiens
gcaguucuccauuuuauua

SEQ ID NO: 673976 - RNA, 19 nt, Homo sapiens
aaauauaccagcacuacua

SEQ ID NO: 673977 - RNA, 19 nt, Homo sapiens
gaaacuguauaagaacuca

SEQ ID NO: 673978 - RNA, 19 nt, Homo sapiens
ccaagagaauggcugaugu

SEQ ID NO: 673979 - RNA, 19 nt, Homo sapiens
gagccagccuuguauccaa

SEQ ID NO: 673980 - RNA, 19 nt, Homo sapiens
ccacauggccagcugacua

SEQ ID NO: 673981 - RNA, 19 nt, Homo sapiens
cagcacuacuaauuaacua

SEQ ID NO: 673982 - RNA, 19 nt, Homo sapiens
gaaccuguugcgccuauuu

SEQ ID NO: 673983 - RNA, 19 nt, Homo sapiens
uaaaacaacugacugauag

SEQ ID NO: 673984 - RNA, 19 nt, Homo sapiens
cauacgacauaacagaauu

SEQ ID NO: 673985 - RNA, 19 nt, Homo sapiens
ggacuggaauaacgacuac

SEQ ID NO: 673986 - RNA, 19 nt, Homo sapiens
gcaacucgcagcauacaga

SEQ ID NO: 673987 - RNA, 19 nt, Homo sapiens
gaagaaggaguaccugaag

SEQ ID NO: 673988 - RNA, 19 nt, Homo sapiens
agaagaaggaucccaauga

SEQ ID NO: 673989 - RNA, 19 nt, Homo sapiens
gaaaguuagucugguugga

SEQ ID NO: 673990 - RNA, 19 nt, Homo sapiens
caaaagugcuugagaaucu

SEQ ID NO: 673991 - RNA, 19 nt, Homo sapiens
aaaguaaccaguccuuauu

SEQ ID NO: 673992 - RNA, 19 nt, Homo sapiens
gauggaacacugcuuucua

SEQ ID NO: 673993 - RNA, 19 nt, Homo sapiens
agucuaaacugagaaggua

SEQ ID NO: 673994 - RNA, 19 nt, Homo sapiens
ugaugucucuuucuuggaa

SEQ ID NO: 673995 - RNA, 19 nt, Homo sapiens
gaauggcugaugucucuuu

SEQ ID NO: 673996 - RNA, 19 nt, Homo sapiens
ggaagcgcaaacacauuua

SEQ ID NO: 673997 - RNA, 19 nt, Homo sapiens
guaccuuacuugagaaucu

SEQ ID NO: 673998 - RNA, 19 nt, Homo sapiens
caacccgacuaucagacua

SEQ ID NO: 673999 - RNA, 19 nt, Homo sapiens
ugcauuaagucuaaacuga

SEQ ID NO: 674000 - RNA, 19 nt, Homo sapiens
agucauagcaaguuuguaa

SEQ ID NO: 674001 - RNA, 19 nt, Homo sapiens
acaaagcacuguaccuuac

SEQ ID NO: 674002 - RNA, 19 nt, Homo sapiens
cauuaagucuaaacugaga

SEQ ID NO: 674003 - RNA, 19 nt, Homo sapiens
ugagauucuugcugucuuu

SEQ ID NO: 674004 - RNA, 19 nt, Homo sapiens
ucuaguaacugccuuagca

SEQ ID NO: 674005 - RNA, 19 nt, Homo sapiens
uaaauggcuugauguagca

SEQ ID NO: 674006 - RNA, 19 nt, Homo sapiens
guagaugucucggauaaaa

SEQ ID NO: 674007 - RNA, 19 nt, Homo sapiens
gugcugcgcucuaguaacu

SEQ ID NO: 674008 - RNA, 19 nt, Homo sapiens
ggauugcuuuguacaguca

SEQ ID NO: 674009 - RNA, 19 nt, Homo sapiens
gaagcggccugccucugau

SEQ ID NO: 674010 - RNA, 19 nt, Homo sapiens
guucucagcugguucuagu

SEQ ID NO: 674011 - RNA, 19 nt, Homo sapiens
gauuggaaacagcuaaauu

SEQ ID NO: 674012 - RNA, 19 nt, Homo sapiens
gcucauuccaguuuauuga

SEQ ID NO: 674013 - RNA, 19 nt, Homo sapiens
gcacuuaggaccauuugag

SEQ ID NO: 674014 - RNA, 19 nt, Homo sapiens
aaaccgaggcugcgaagaa

SEQ ID NO: 674015 - RNA, 19 nt, Homo sapiens
gaagaagaaggaucccaau

SEQ ID NO: 674016 - RNA, 19 nt, Homo sapiens
auggaacacugcuuucuaa

SEQ ID NO: 674017 - RNA, 19 nt, Homo sapiens
ccacucagaauuaaacaga

SEQ ID NO: 674018 - RNA, 19 nt, Homo sapiens
ugaaagggaagcaucuaaa

SEQ ID NO: 674019 - RNA, 19 nt, Homo sapiens
auauggcucugucuuauug

SEQ ID NO: 674020 - RNA, 19 nt, Homo sapiens
gcagggaaaugccaucuua

SEQ ID NO: 674021 - RNA, 19 nt, Homo sapiens
gaacuagacuaauuagcua

SEQ ID NO: 674022 - RNA, 19 nt, Homo sapiens
gagcuucagugcuuuauuu

SEQ ID NO: 674023 - RNA, 19 nt, Homo sapiens
gaucgccucugacuuguua

SEQ ID NO: 674024 - RNA, 19 nt, Homo sapiens
gaaagaaaaugcuuccuua

SEQ ID NO: 674025 - RNA, 19 nt, Homo sapiens
gaaagaagaggaagaagaa

SEQ ID NO: 674026 - RNA, 19 nt, Homo sapiens
ggucacagcuggcucauga

SEQ ID NO: 674027 - RNA, 19 nt, Homo sapiens
uaagagcucuguauauuug

SEQ ID NO: 674028 - RNA, 19 nt, Homo sapiens
gaaagaaaccagccauauu

SEQ ID NO: 674029 - RNA, 19 nt, Homo sapiens
caaagaagccuuaauguuc

SEQ ID NO: 674030 - RNA, 19 nt, Homo sapiens
ucaaggaacuagacuaauu

SEQ ID NO: 674031 - RNA, 19 nt, Homo sapiens
gauaagagcaggugauuug

SEQ ID NO: 674032 - RNA, 19 nt, Homo sapiens
gaaggaacaucuuucuaug

SEQ ID NO: 674033 - RNA, 19 nt, Homo sapiens
gaaauuaacagcagggaaa

SEQ ID NO: 674034 - RNA, 19 nt, Homo sapiens
gaauuucucuuccuucuuc

SEQ ID NO: 674035 - RNA, 19 nt, Homo sapiens
uagcauagcuuaagagcaa

SEQ ID NO: 674036 - RNA, 19 nt, Homo sapiens
gggaaaugccaucuuauua

SEQ ID NO: 674037 - RNA, 19 nt, Homo sapiens
gcucaaggauccucauuug

SEQ ID NO: 674038 - RNA, 19 nt, Homo sapiens
gagggcagguuucuucuuu

SEQ ID NO: 674039 - RNA, 19 nt, Homo sapiens
gcaaagaagccuuaauguu

SEQ ID NO: 674040 - RNA, 19 nt, Homo sapiens
ggaaaggacucugaacuca

SEQ ID NO: 674041 - RNA, 19 nt, Homo sapiens
ggaagaagaagaagaagaa

SEQ ID NO: 674042 - RNA, 19 nt, Homo sapiens
cuaagacucucuguauuua

SEQ ID NO: 674043 - RNA, 19 nt, Homo sapiens
gaucaaagagcucuaagaa

SEQ ID NO: 674044 - RNA, 19 nt, Homo sapiens
gaaaacagcagcaguauuu

SEQ ID NO: 674045 - RNA, 19 nt, Homo sapiens
gaucuugaauucccugaaa

SEQ ID NO: 674046 - RNA, 19 nt, Homo sapiens
ucaaagagcucuaagaaaa

SEQ ID NO: 674047 - RNA, 19 nt, Homo sapiens
ggaaggaacaucuuucuau

SEQ ID NO: 674048 - RNA, 19 nt, Homo sapiens
ucagaaaucucagaagaaa

SEQ ID NO: 674049 - RNA, 19 nt, Homo sapiens
caacacaucccuucaguga

SEQ ID NO: 674050 - RNA, 19 nt, Homo sapiens
gguaucugauguucauuua

SEQ ID NO: 674051 - RNA, 19 nt, Homo sapiens
gaugaagggucuaaucuca

SEQ ID NO: 674052 - RNA, 19 nt, Homo sapiens
gaccagauccuguaucaaa

SEQ ID NO: 674053 - RNA, 19 nt, Homo sapiens
aaacugagcgguacaauga

SEQ ID NO: 674054 - RNA, 19 nt, Homo sapiens
ggucuaaccuggcuuguca

SEQ ID NO: 674055 - RNA, 19 nt, Homo sapiens
ggaaaggccuggauauggu

SEQ ID NO: 674056 - RNA, 19 nt, Homo sapiens
gaaacauugugccaagaaa

SEQ ID NO: 674057 - RNA, 19 nt, Homo sapiens
gaagaaagaagaggaagaa

SEQ ID NO: 674058 - RNA, 19 nt, Homo sapiens
cagggaaacucuacauuga

SEQ ID NO: 674059 - RNA, 19 nt, Homo sapiens
guacaugaaguuuagguua

SEQ ID NO: 674060 - RNA, 19 nt, Homo sapiens
caaggaacuagacuaauua

SEQ ID NO: 674061 - RNA, 19 nt, Homo sapiens
gaaauuugacccuggauug

SEQ ID NO: 674062 - RNA, 19 nt, Homo sapiens
gaaaucugcuucucuucga

SEQ ID NO: 674063 - RNA, 19 nt, Homo sapiens
guucagaaaucucagaaga

SEQ ID NO: 674064 - RNA, 19 nt, Homo sapiens
acagaacacuugaccuuaa

SEQ ID NO: 674065 - RNA, 19 nt, Homo sapiens
ggucccaccuuuaguguuu

SEQ ID NO: 674066 - RNA, 19 nt, Homo sapiens
ucaaggauccucauuugua

SEQ ID NO: 674067 - RNA, 19 nt, Homo sapiens
uagcacagcucacgaugaa

SEQ ID NO: 674068 - RNA, 19 nt, Homo sapiens
ggccuacucuggcauaauu

SEQ ID NO: 674069 - RNA, 19 nt, Homo sapiens
agacgaaucuuucuuucuu

SEQ ID NO: 674070 - RNA, 19 nt, Homo sapiens
uugaaugucuucuccuuua

SEQ ID NO: 674071 - RNA, 19 nt, Homo sapiens
uaaucuggcucauuugaaa

SEQ ID NO: 674072 - RNA, 19 nt, Homo sapiens
guagagagcagcccucauu

SEQ ID NO: 674073 - RNA, 19 nt, Homo sapiens
ggacuuggauaucuuugau

SEQ ID NO: 674074 - RNA, 19 nt, Homo sapiens
gggacuagcuggguuggua

SEQ ID NO: 674075 - RNA, 19 nt, Homo sapiens
gaggaaacaggaagaagua

SEQ ID NO: 674076 - RNA, 19 nt, Homo sapiens
cagcgaugcuucuuauuga

SEQ ID NO: 674077 - RNA, 19 nt, Homo sapiens
caaggauccucauuuguau

SEQ ID NO: 674078 - RNA, 19 nt, Homo sapiens
aaacuaagacucucuguau

SEQ ID NO: 674079 - RNA, 19 nt, Homo sapiens
aaagaagccuuaauguuca

SEQ ID NO: 674080 - RNA, 19 nt, Homo sapiens
ggucugaaguuaugucuag

SEQ ID NO: 674081 - RNA, 19 nt, Homo sapiens
ggaguuagguacggucuga

SEQ ID NO: 674082 - RNA, 19 nt, Homo sapiens
aaagaaaccagccauauug

SEQ ID NO: 674083 - RNA, 19 nt, Homo sapiens
ugaagggucuaaucucaaa

SEQ ID NO: 674084 - RNA, 19 nt, Homo sapiens
gguauuugauguacgauug

SEQ ID NO: 674085 - RNA, 19 nt, Homo sapiens
gugcuggucuugaaauuug

SEQ ID NO: 674086 - RNA, 19 nt, Homo sapiens
ggaaagaaaccagccauau

SEQ ID NO: 674087 - RNA, 19 nt, Homo sapiens
gagagacgaaucuuucuuu

SEQ ID NO: 674088 - RNA, 19 nt, Homo sapiens
uagagugucugguaucuga

SEQ ID NO: 674089 - RNA, 19 nt, Homo sapiens
caacagaacacuugaccuu

SEQ ID NO: 674090 - RNA, 19 nt, Homo sapiens
gggccuggcugcucuauuc

SEQ ID NO: 674091 - RNA, 19 nt, Homo sapiens
caaauggcaacauggaaua

SEQ ID NO: 674092 - RNA, 19 nt, Homo sapiens
agaaagaucagagcaauuu

SEQ ID NO: 674093 - RNA, 19 nt, Homo sapiens
ucauuucucuauccaagua

SEQ ID NO: 674094 - RNA, 19 nt, Homo sapiens
gcacagcucacgaugaaau

SEQ ID NO: 674095 - RNA, 19 nt, Homo sapiens
aagaaacucugugggauuu

SEQ ID NO: 674096 - RNA, 19 nt, Homo sapiens
cagaacacuugaccuuaaa

SEQ ID NO: 674097 - RNA, 19 nt, Homo sapiens
uggaagccuuucuggauua

SEQ ID NO: 674098 - RNA, 19 nt, Homo sapiens
ggaaaugccaucuuauuac

SEQ ID NO: 674099 - RNA, 19 nt, Homo sapiens
ucucaugacugggaagaua

SEQ ID NO: 674100 - RNA, 19 nt, Homo sapiens
caagauauagguacaugaa

SEQ ID NO: 674101 - RNA, 19 nt, Homo sapiens
gcaguggacauccuaacua

SEQ ID NO: 674102 - RNA, 19 nt, Homo sapiens
gaugggcgcuuuccucucu

SEQ ID NO: 674103 - RNA, 19 nt, Homo sapiens
caguggacauccuaacuaa

SEQ ID NO: 674104 - RNA, 19 nt, Homo sapiens
gaaacucugugggauuugu

SEQ ID NO: 674105 - RNA, 19 nt, Homo sapiens
gggcucauguccuggguuu

SEQ ID NO: 674106 - RNA, 19 nt, Homo sapiens
ccaguuagggcaacaauga

SEQ ID NO: 674107 - RNA, 19 nt, Homo sapiens
ugaugggacugaaagaauu

SEQ ID NO: 674108 - RNA, 19 nt, Homo sapiens
ggaagccuuucuggauuaa

SEQ ID NO: 674109 - RNA, 19 nt, Homo sapiens
gaagaagaauaugaugaag

SEQ ID NO: 674110 - RNA, 19 nt, Homo sapiens
gaaggacuuggauaucuuu

SEQ ID NO: 674111 - RNA, 19 nt, Homo sapiens
gcccagcgaugcuucuuau

SEQ ID NO: 674112 - RNA, 19 nt, Homo sapiens
gguacggucugaaguuaug

SEQ ID NO: 674113 - RNA, 19 nt, Homo sapiens
uagguacggucugaaguua

SEQ ID NO: 674114 - RNA, 19 nt, Homo sapiens
gacgaaucuuucuuucuuu

SEQ ID NO: 674115 - RNA, 19 nt, Homo sapiens
ggcauucccucuagauuca

SEQ ID NO: 674116 - RNA, 19 nt, Homo sapiens
gccuggauaugguuucuaa

SEQ ID NO: 674117 - RNA, 19 nt, Homo sapiens
uaaaggauaagguacugua

SEQ ID NO: 674118 - RNA, 19 nt, Homo sapiens
gaaaugccaucuuauuacc

SEQ ID NO: 674119 - RNA, 19 nt, Homo sapiens
agaaggaccuaggagagua

SEQ ID NO: 674120 - RNA, 19 nt, Homo sapiens
gaacaaggcugaccugaga

SEQ ID NO: 674121 - RNA, 19 nt, Homo sapiens
ggagagagcuggcaacuac

SEQ ID NO: 674122 - RNA, 19 nt, Homo sapiens
gaagagaaggcauuaguaa

SEQ ID NO: 674123 - RNA, 19 nt, Homo sapiens
gggaagagcuggaggacaa

SEQ ID NO: 674124 - RNA, 19 nt, Homo sapiens
ucagagggcuucacgguaa

SEQ ID NO: 674125 - RNA, 19 nt, Homo sapiens
gaagaucuguccuccuguu

SEQ ID NO: 674126 - RNA, 19 nt, Homo sapiens
gaauaggaguagggucuua

SEQ ID NO: 674127 - RNA, 19 nt, Homo sapiens
gagaaggcauuaguaagaa

SEQ ID NO: 674128 - RNA, 19 nt, Homo sapiens
ucacaagccugcccaccua

SEQ ID NO: 674129 - RNA, 19 nt, Homo sapiens
acacagcuauuaagugcua

SEQ ID NO: 674130 - RNA, 19 nt, Homo sapiens
gggcuaaggcagaaguuua

SEQ ID NO: 674131 - RNA, 19 nt, Homo sapiens
ccaugagguugggauauua

SEQ ID NO: 674132 - RNA, 19 nt, Homo sapiens
aggagaaggugaucgagua

SEQ ID NO: 674133 - RNA, 19 nt, Homo sapiens
caugacuggugacuguuua

SEQ ID NO: 674134 - RNA, 19 nt, Homo sapiens
gcucuaacacagcuauuaa

SEQ ID NO: 674135 - RNA, 19 nt, Homo sapiens
gagaagagaaggcauuagu

SEQ ID NO: 674136 - RNA, 19 nt, Homo sapiens
gaucuguccuccuguucuu

SEQ ID NO: 674137 - RNA, 19 nt, Homo sapiens
gcacucuccucgcccaguu

SEQ ID NO: 674138 - RNA, 19 nt, Homo sapiens
ugagcuacguggagaugua

SEQ ID NO: 674139 - RNA, 19 nt, Homo sapiens
ucgcagaaguugagugaga

SEQ ID NO: 674140 - RNA, 19 nt, Homo sapiens
ggccggaacucccucacaa

SEQ ID NO: 674141 - RNA, 19 nt, Homo sapiens
agagaaggcauuaguaaga

SEQ ID NO: 674142 - RNA, 19 nt, Homo sapiens
acuggugacuguuuaauga

SEQ ID NO: 674143 - RNA, 19 nt, Homo sapiens
ggccugggcugcuacuguu

SEQ ID NO: 674144 - RNA, 19 nt, Homo sapiens
gcguguggcuggaggagaa

SEQ ID NO: 674145 - RNA, 19 nt, Homo sapiens
gcagugaccacaccgaugu

SEQ ID NO: 674146 - RNA, 19 nt, Homo sapiens
aaauuccgcuugaccuuug

SEQ ID NO: 674147 - RNA, 19 nt, Homo sapiens
aggcagaaguuuaggaaug

SEQ ID NO: 674148 - RNA, 19 nt, Homo sapiens
gggagaagagaaggcauua

SEQ ID NO: 674149 - RNA, 19 nt, Homo sapiens
ccucagcccuuauaucucu

SEQ ID NO: 674150 - RNA, 19 nt, Homo sapiens
ggauagaggaaacuaagug

SEQ ID NO: 674151 - RNA, 19 nt, Homo sapiens
agagaagccugcgcuggua

SEQ ID NO: 674152 - RNA, 19 nt, Homo sapiens
ggaugugauugcccuugaa

SEQ ID NO: 674153 - RNA, 19 nt, Homo sapiens
cacuguaccugcccuagaa

SEQ ID NO: 674154 - RNA, 19 nt, Homo sapiens
caacuacugugagcaaguc

SEQ ID NO: 674155 - RNA, 19 nt, Homo sapiens
gcauugaguccacagaaau

SEQ ID NO: 674156 - RNA, 19 nt, Homo sapiens
ccaagaauuuccacuccau

SEQ ID NO: 674157 - RNA, 19 nt, Homo sapiens
gcccuuauaucucucucuu

SEQ ID NO: 674158 - RNA, 19 nt, Homo sapiens
cuaauucaccagcaauaaa

SEQ ID NO: 674159 - RNA, 19 nt, Homo sapiens
ugagguugguucccuguug

SEQ ID NO: 674160 - RNA, 19 nt, Homo sapiens
gcuuggcccucagcccuua

SEQ ID NO: 674161 - RNA, 19 nt, Homo sapiens
ccaacucccucuaccucaa

SEQ ID NO: 674162 - RNA, 19 nt, Homo sapiens
gauaaagaaccccaaaauu

SEQ ID NO: 674163 - RNA, 19 nt, Homo sapiens
agaaggcauuaguaagaaa

SEQ ID NO: 674164 - RNA, 19 nt, Homo sapiens
ucucugugcucaccuccua

SEQ ID NO: 674165 - RNA, 19 nt, Homo sapiens
gccuacagcugcagguguu

SEQ ID NO: 674166 - RNA, 19 nt, Homo sapiens
gaguugagagggucacuga

SEQ ID NO: 674167 - RNA, 19 nt, Homo sapiens
agaagagaaggcauuagua

SEQ ID NO: 674168 - RNA, 19 nt, Homo sapiens
gcucuacccucacccuucu

SEQ ID NO: 674169 - RNA, 19 nt, Homo sapiens
gcccaggaguuugccauga

SEQ ID NO: 674170 - RNA, 19 nt, Homo sapiens
gagcuggcaacuacuguga

SEQ ID NO: 674171 - RNA, 19 nt, Homo sapiens
aagcagcugugaccagguu

SEQ ID NO: 674172 - RNA, 19 nt, Homo sapiens
ggaaaggcaaggagagaag

SEQ ID NO: 674173 - RNA, 19 nt, Homo sapiens
gcccugacugcaacacuua

SEQ ID NO: 674174 - RNA, 19 nt, Homo sapiens
ugauugcccuugaagaaca

SEQ ID NO: 674175 - RNA, 19 nt, Homo sapiens
gcagacgugcagugccaua

SEQ ID NO: 674176 - RNA, 19 nt, Homo sapiens
gagcgacgaggcuaagaug

SEQ ID NO: 674177 - RNA, 19 nt, Homo sapiens
gcggaugugucgcagaagu

SEQ ID NO: 674178 - RNA, 19 nt, Homo sapiens
caaagucgcgcagcugguu

SEQ ID NO: 674179 - RNA, 19 nt, Homo sapiens
uaaggcagaaguuuaggaa

SEQ ID NO: 674180 - RNA, 19 nt, Homo sapiens
gacugcaacacuuagguua

SEQ ID NO: 674181 - RNA, 19 nt, Homo sapiens
ggcagaaguuuaggaaugg

SEQ ID NO: 674182 - RNA, 19 nt, Homo sapiens
gaccacugcccauuccauu

SEQ ID NO: 674183 - RNA, 19 nt, Homo sapiens
gcccucagcccuuauaucu

SEQ ID NO: 674184 - RNA, 19 nt, Homo sapiens
cagauuggcaggacaagug

SEQ ID NO: 674185 - RNA, 19 nt, Homo sapiens
cgcauugaguccacagaaa

SEQ ID NO: 674186 - RNA, 19 nt, Homo sapiens
cccaggaguuugccaugaa

SEQ ID NO: 674187 - RNA, 19 nt, Homo sapiens
gcagaaguuuaggaaugga

SEQ ID NO: 674188 - RNA, 19 nt, Homo sapiens
ccacugcccauuccauuca

SEQ ID NO: 674189 - RNA, 19 nt, Homo sapiens
ucccaugacuggugacugu

SEQ ID NO: 674190 - RNA, 19 nt, Homo sapiens
ccuuauaucucucucuuuu

SEQ ID NO: 674191 - RNA, 19 nt, Homo sapiens
aaugucagcugcuucucuu

SEQ ID NO: 674192 - RNA, 19 nt, Homo sapiens
gaccugggcacucggcauu

SEQ ID NO: 674193 - RNA, 19 nt, Homo sapiens
gcugccgccuccuugguuu

SEQ ID NO: 674194 - RNA, 19 nt, Homo sapiens
acaagggucucgccaacuc

SEQ ID NO: 674195 - RNA, 19 nt, Homo sapiens
ugagagaggcuccgucagu

SEQ ID NO: 674196 - RNA, 19 nt, Homo sapiens
cccagccucuuucugcuuu

SEQ ID NO: 674197 - RNA, 19 nt, Homo sapiens
gagugggaguggccucuca

SEQ ID NO: 674198 - RNA, 19 nt, Homo sapiens
uccacuccaugcagaauuu

SEQ ID NO: 674199 - RNA, 19 nt, Homo sapiens
ggacaagugggagcagaug

SEQ ID NO: 674200 - RNA, 19 nt, Homo sapiens
cgagaucucccuccugaag

SEQ ID NO: 674201 - RNA, 19 nt, Homo sapiens
agaaggagcaggccgacuu

SEQ ID NO: 674202 - RNA, 19 nt, Homo sapiens
cauaugugauggaaagacu

SEQ ID NO: 674203 - RNA, 19 nt, Homo sapiens
gaccagccuccucccauga

SEQ ID NO: 674204 - RNA, 19 nt, Homo sapiens
ugugauugcccuugaagaa

SEQ ID NO: 674205 - RNA, 19 nt, Homo sapiens
aggcggaugugucgcagaa

SEQ ID NO: 674206 - RNA, 19 nt, Homo sapiens
uuggaugccugggaacuuu

SEQ ID NO: 674207 - RNA, 19 nt, Homo sapiens
uggaugugauugcccuuga

SEQ ID NO: 674208 - RNA, 19 nt, Homo sapiens
ugguggcagugaauucuuu

SEQ ID NO: 674209 - RNA, 19 nt, Homo sapiens
gcgcauugaguccacagaa

SEQ ID NO: 674210 - RNA, 19 nt, Homo sapiens
gugcucagaaccacuaguu

SEQ ID NO: 674211 - RNA, 19 nt, Homo sapiens
ggaagggaaaagcaaauuu

SEQ ID NO: 674212 - RNA, 19 nt, Homo sapiens
gagccggaggcccuuguuu

SEQ ID NO: 674213 - RNA, 19 nt, Homo sapiens
cagcuccacuggcccaagu

SEQ ID NO: 674214 - RNA, 19 nt, Homo sapiens
guaguaauccgggaagucu

SEQ ID NO: 674215 - RNA, 19 nt, Homo sapiens
ccagacccaagauaaagaa

SEQ ID NO: 674216 - RNA, 19 nt, Homo sapiens
gauugcccuugaagaacaa

SEQ ID NO: 674217 - RNA, 19 nt, Homo sapiens
ggcucuaacacagcuauua

SEQ ID NO: 674218 - RNA, 19 nt, Homo sapiens
gacgugcagugccauaagg

SEQ ID NO: 674219 - RNA, 19 nt, Homo sapiens
ggaugugucgcagaaguug

SEQ ID NO: 674220 - RNA, 19 nt, Homo sapiens
gaaauggucuugacacuuu

SEQ ID NO: 674221 - RNA, 19 nt, Homo sapiens
ccaaacagcucugaaauuu

SEQ ID NO: 674222 - RNA, 19 nt, Homo sapiens
gaagguagaaacugaaaua

SEQ ID NO: 674223 - RNA, 19 nt, Homo sapiens
gcaaacaacucacacaagu

SEQ ID NO: 674224 - RNA, 19 nt, Homo sapiens
gaggaaggcugacagagaa

SEQ ID NO: 674225 - RNA, 19 nt, Homo sapiens
cacauagacucuugaaaua

SEQ ID NO: 674226 - RNA, 19 nt, Homo sapiens
ggaggaaacgccuguguua

SEQ ID NO: 674227 - RNA, 19 nt, Homo sapiens
acaagaagcugugcaauga

SEQ ID NO: 674228 - RNA, 19 nt, Homo sapiens
gggagaagaucuaccugua

SEQ ID NO: 674229 - RNA, 19 nt, Homo sapiens
aaacagugcugcucuuuau

SEQ ID NO: 674230 - RNA, 19 nt, Homo sapiens
guaaagaguuugugaaagg

SEQ ID NO: 674231 - RNA, 19 nt, Homo sapiens
gaaacguggugucaucuga

SEQ ID NO: 674232 - RNA, 19 nt, Homo sapiens
uaagggacuuugcacuuua

SEQ ID NO: 674233 - RNA, 19 nt, Homo sapiens
gguagaaacugaaauaaac

SEQ ID NO: 674234 - RNA, 19 nt, Homo sapiens
uaucuucucuguugcauuu

SEQ ID NO: 674235 - RNA, 19 nt, Homo sapiens
ggagauagguuucacuuuu

SEQ ID NO: 674236 - RNA, 19 nt, Homo sapiens
gcggacagcucccuucuga

SEQ ID NO: 674237 - RNA, 19 nt, Homo sapiens
gagaagaucuaccuguaca

SEQ ID NO: 674238 - RNA, 19 nt, Homo sapiens
gaaggacucauucuuggua

SEQ ID NO: 674239 - RNA, 19 nt, Homo sapiens
gaaugcagguucacacugu

SEQ ID NO: 674240 - RNA, 19 nt, Homo sapiens
gaacccagcuccccacuuu

SEQ ID NO: 674241 - RNA, 19 nt, Homo sapiens
gguuagaucagcuuuguua

SEQ ID NO: 674242 - RNA, 19 nt, Homo sapiens
ccacauagacucuugaaau

SEQ ID NO: 674243 - RNA, 19 nt, Homo sapiens
ucagauaagucccgucuug

SEQ ID NO: 674244 - RNA, 19 nt, Homo sapiens
gcaagaagcacaggaaaga

SEQ ID NO: 674245 - RNA, 19 nt, Homo sapiens
ggaaagggacggaaucaau

SEQ ID NO: 674246 - RNA, 19 nt, Homo sapiens
gauaagucccgucuuguuu

SEQ ID NO: 674247 - RNA, 19 nt, Homo sapiens
ggaguucaguugugaggaa

SEQ ID NO: 674248 - RNA, 19 nt, Homo sapiens
caacacgcauuggguuuaa

SEQ ID NO: 674249 - RNA, 19 nt, Homo sapiens
gcaaauggccacugaguag

SEQ ID NO: 674250 - RNA, 19 nt, Homo sapiens
acaaagcgaucucccacua

SEQ ID NO: 674251 - RNA, 19 nt, Homo sapiens
gauggagucucgcuguauu

SEQ ID NO: 674252 - RNA, 19 nt, Homo sapiens
gcuggucccuccucaguuu

SEQ ID NO: 674253 - RNA, 19 nt, Homo sapiens
cagcuuuguuacugaauua

SEQ ID NO: 674254 - RNA, 19 nt, Homo sapiens
uaaguucucuguaagugaa

SEQ ID NO: 674255 - RNA, 19 nt, Homo sapiens
gaucagaaauagccacgau

SEQ ID NO: 674256 - RNA, 19 nt, Homo sapiens
gaaaugcauucagacuuug

SEQ ID NO: 674257 - RNA, 19 nt, Homo sapiens
gaacuagcgguuagaagaa

SEQ ID NO: 674258 - RNA, 19 nt, Homo sapiens
guguggagcuugagaaaga

SEQ ID NO: 674259 - RNA, 19 nt, Homo sapiens
ugucguaaguucucuguaa

SEQ ID NO: 674260 - RNA, 19 nt, Homo sapiens
gggagugguuugcucgaua

SEQ ID NO: 674261 - RNA, 19 nt, Homo sapiens
ucacagacaucaccaaguc

SEQ ID NO: 674262 - RNA, 19 nt, Homo sapiens
ccaagaaccucaugaccau

SEQ ID NO: 674263 - RNA, 19 nt, Homo sapiens
gaagagacccuggcacuca

SEQ ID NO: 674264 - RNA, 19 nt, Homo sapiens
ccaguuugauugauugauu

SEQ ID NO: 674265 - RNA, 19 nt, Homo sapiens
ccgaauccauuuagagaaa

SEQ ID NO: 674266 - RNA, 19 nt, Homo sapiens
ccaguaguguuuccaagaa

SEQ ID NO: 674267 - RNA, 19 nt, Homo sapiens
ggaggaaggcugacagaga

SEQ ID NO: 674268 - RNA, 19 nt, Homo sapiens
gaagaagcaggcugugauu

SEQ ID NO: 674269 - RNA, 19 nt, Homo sapiens
gacagugacuuguuuccuu

SEQ ID NO: 674270 - RNA, 19 nt, Homo sapiens
caaccuggaugaagagcaa

SEQ ID NO: 674271 - RNA, 19 nt, Homo sapiens
gaaagggacggaaucaauc

SEQ ID NO: 674272 - RNA, 19 nt, Homo sapiens
ggaagaagcacaucaagac

SEQ ID NO: 674273 - RNA, 19 nt, Homo sapiens
gcaacacgcauuggguuua

SEQ ID NO: 674274 - RNA, 19 nt, Homo sapiens
gggcaugucuccaccgaau

SEQ ID NO: 674275 - RNA, 19 nt, Homo sapiens
ggcaaacguuggaacacua

SEQ ID NO: 674276 - RNA, 19 nt, Homo sapiens
gaaagagaaggcaaacguu

SEQ ID NO: 674277 - RNA, 19 nt, Homo sapiens
caucacaccugccucuguu

SEQ ID NO: 674278 - RNA, 19 nt, Homo sapiens
gacaguggcuggagagaag

SEQ ID NO: 674279 - RNA, 19 nt, Homo sapiens
caaacagugcugcucuuua

SEQ ID NO: 674280 - RNA, 19 nt, Homo sapiens
ccacugagccauucacuuc

SEQ ID NO: 674281 - RNA, 19 nt, Homo sapiens
gaaaugggguagacuguau

SEQ ID NO: 674282 - RNA, 19 nt, Homo sapiens
cacuuuaacuucagaaaug

SEQ ID NO: 674283 - RNA, 19 nt, Homo sapiens
gaaaggcagcgcugacuuc

SEQ ID NO: 674284 - RNA, 19 nt, Homo sapiens
ggagugcagugacacaauc

SEQ ID NO: 674285 - RNA, 19 nt, Homo sapiens
ggaagugucaggugauuuc

SEQ ID NO: 674286 - RNA, 19 nt, Homo sapiens
gcacaggaaagagaaguuu

SEQ ID NO: 674287 - RNA, 19 nt, Homo sapiens
gaugccaacugcagauaau

SEQ ID NO: 674288 - RNA, 19 nt, Homo sapiens
gaagugacgggaaccuuga

SEQ ID NO: 674289 - RNA, 19 nt, Homo sapiens
caggugagcugcugugaag

SEQ ID NO: 674290 - RNA, 19 nt, Homo sapiens
cagaaacgccugagaguca

SEQ ID NO: 674291 - RNA, 19 nt, Homo sapiens
gcaaacagugcugcucuuu

SEQ ID NO: 674292 - RNA, 19 nt, Homo sapiens
cggagacagugacuuguuu

SEQ ID NO: 674293 - RNA, 19 nt, Homo sapiens
gcucggugauguucuacaa

SEQ ID NO: 674294 - RNA, 19 nt, Homo sapiens
aaacagcucugaaauuucc

SEQ ID NO: 674295 - RNA, 19 nt, Homo sapiens
ccaccaagguuuccucucu

SEQ ID NO: 674296 - RNA, 19 nt, Homo sapiens
uuuacuaccuguucuugua

SEQ ID NO: 674297 - RNA, 19 nt, Homo sapiens
gguguuugcugugaagaaa

SEQ ID NO: 674298 - RNA, 19 nt, Homo sapiens
gaaauucagacaacacaca

SEQ ID NO: 674299 - RNA, 19 nt, Homo sapiens
ccaaagugcugggauuaca

SEQ ID NO: 674300 - RNA, 19 nt, Homo sapiens
acucaauucugaugucgua

SEQ ID NO: 674301 - RNA, 19 nt, Homo sapiens
guucuggaaugcagccuuu

SEQ ID NO: 674302 - RNA, 19 nt, Homo sapiens
acagugacuuguuuccuuu

SEQ ID NO: 674303 - RNA, 19 nt, Homo sapiens
gugcucacauccagacauu

SEQ ID NO: 674304 - RNA, 19 nt, Homo sapiens
auaagggacuuugcacuuu

SEQ ID NO: 674305 - RNA, 19 nt, Homo sapiens
ccacgaucguccaguuuga

SEQ ID NO: 674306 - RNA, 19 nt, Homo sapiens
ggaggagaaagccaaguuu

SEQ ID NO: 674307 - RNA, 19 nt, Homo sapiens
guaaaucguguauucaugu

SEQ ID NO: 674308 - RNA, 19 nt, Homo sapiens
caccaagucucgucuucuu

SEQ ID NO: 674309 - RNA, 19 nt, Homo sapiens
gccaaacagcucugaaauu

SEQ ID NO: 674310 - RNA, 19 nt, Homo sapiens
aggcagcgcugacuucguu

SEQ ID NO: 674311 - RNA, 19 nt, Homo sapiens
accaguaucuucucuguug

SEQ ID NO: 674312 - RNA, 19 nt, Homo sapiens
guggacacguggagaaaga

SEQ ID NO: 674313 - RNA, 19 nt, Homo sapiens
gacacaaucucuacucacu

SEQ ID NO: 674314 - RNA, 19 nt, Homo sapiens
cguguuagcugaaaugcau

SEQ ID NO: 674315 - RNA, 19 nt, Homo sapiens
gcagauugguuggaucaca

SEQ ID NO: 674316 - RNA, 19 nt, Homo sapiens
gugccaggcuugugagaug

SEQ ID NO: 674317 - RNA, 19 nt, Homo sapiens
ccgagcggcugcugaagaa

SEQ ID NO: 674318 - RNA, 19 nt, Homo sapiens
gcacacgcccucugcuuuc

SEQ ID NO: 674319 - RNA, 19 nt, Homo sapiens
gcucuguacccaaauuaaa

SEQ ID NO: 674320 - RNA, 19 nt, Homo sapiens
gaaagaaugugccauauua

SEQ ID NO: 674321 - RNA, 19 nt, Homo sapiens
ggaaauaucugcuuugugu

SEQ ID NO: 674322 - RNA, 19 nt, Homo sapiens
gaggugaucucauccauua

SEQ ID NO: 674323 - RNA, 19 nt, Homo sapiens
agaccuaccuccauaauua

SEQ ID NO: 674324 - RNA, 19 nt, Homo sapiens
caguauaccuugcauaaua

SEQ ID NO: 674325 - RNA, 19 nt, Homo sapiens
ggacuuacuucuauacaaa

SEQ ID NO: 674326 - RNA, 19 nt, Homo sapiens
gaagaaccaucuaguccua

SEQ ID NO: 674327 - RNA, 19 nt, Homo sapiens
guagagggcuguuccauga

SEQ ID NO: 674328 - RNA, 19 nt, Homo sapiens
gaagaucaagucaaaguua

SEQ ID NO: 674329 - RNA, 19 nt, Homo sapiens
gagauugggugcagaauau

SEQ ID NO: 674330 - RNA, 19 nt, Homo sapiens
gaaacaagcuauggaacaa

SEQ ID NO: 674331 - RNA, 19 nt, Homo sapiens
gaacuuacuuguugaccuu

SEQ ID NO: 674332 - RNA, 19 nt, Homo sapiens
ggauuuaucuucaguguca

SEQ ID NO: 674333 - RNA, 19 nt, Homo sapiens
gaccaggauuuaucuauuu

SEQ ID NO: 674334 - RNA, 19 nt, Homo sapiens
ggacaggcagaaauuauua

SEQ ID NO: 674335 - RNA, 19 nt, Homo sapiens
gaaccaaacauccaguaua

SEQ ID NO: 674336 - RNA, 19 nt, Homo sapiens
gaacccagaugaacaagau

SEQ ID NO: 674337 - RNA, 19 nt, Homo sapiens
ccaacugguucuaaucuua

SEQ ID NO: 674338 - RNA, 19 nt, Homo sapiens
gaacugccaagucaaauuu

SEQ ID NO: 674339 - RNA, 19 nt, Homo sapiens
guuuagaccuuaaggauaa

SEQ ID NO: 674340 - RNA, 19 nt, Homo sapiens
caacagaccaugauaguga

SEQ ID NO: 674341 - RNA, 19 nt, Homo sapiens
ggaccaggauuuaucuauu

SEQ ID NO: 674342 - RNA, 19 nt, Homo sapiens
ggaauuaugugccugaagu

SEQ ID NO: 674343 - RNA, 19 nt, Homo sapiens
gaaauuaccaguauaccuu

SEQ ID NO: 674344 - RNA, 19 nt, Homo sapiens
gaacuucauugcucccaaa

SEQ ID NO: 674345 - RNA, 19 nt, Homo sapiens
ggacagcuuuggauuuguu

SEQ ID NO: 674346 - RNA, 19 nt, Homo sapiens
ucuaaagucugucaaauug

SEQ ID NO: 674347 - RNA, 19 nt, Homo sapiens
caggagauauuacaagaaa

SEQ ID NO: 674348 - RNA, 19 nt, Homo sapiens
gaaauccagccguuauaua

SEQ ID NO: 674349 - RNA, 19 nt, Homo sapiens
gaaaugguguaagaugaaa

SEQ ID NO: 674350 - RNA, 19 nt, Homo sapiens
cacauaagcuuugcucuuu

SEQ ID NO: 674351 - RNA, 19 nt, Homo sapiens
gaaacuugaugaucucuca

SEQ ID NO: 674352 - RNA, 19 nt, Homo sapiens
ggaaagucaugguauuaau

SEQ ID NO: 674353 - RNA, 19 nt, Homo sapiens
gaccaagagugcguuaaua

SEQ ID NO: 674354 - RNA, 19 nt, Homo sapiens
cagguaggauggacaguua

SEQ ID NO: 674355 - RNA, 19 nt, Homo sapiens
ggaaugaucuuuucaaauc

SEQ ID NO: 674356 - RNA, 19 nt, Homo sapiens
gaaaugccacaaacacuaa

SEQ ID NO: 674357 - RNA, 19 nt, Homo sapiens
guacuaaauucuuccaaug

SEQ ID NO: 674358 - RNA, 19 nt, Homo sapiens
gcaaaugaaucagauagau

SEQ ID NO: 674359 - RNA, 19 nt, Homo sapiens
ucaagggacuuacuucuau

SEQ ID NO: 674360 - RNA, 19 nt, Homo sapiens
acacugauaugguugaauu

SEQ ID NO: 674361 - RNA, 19 nt, Homo sapiens
guaccgagguguucuacuu

SEQ ID NO: 674362 - RNA, 19 nt, Homo sapiens
gagaauacguggauaucug

SEQ ID NO: 674363 - RNA, 19 nt, Homo sapiens
acaaguaugucugcaauaa

SEQ ID NO: 674364 - RNA, 19 nt, Homo sapiens
cagguuagcuucaacucua

SEQ ID NO: 674365 - RNA, 19 nt, Homo sapiens
guaguaaaccuaucuguga

SEQ ID NO: 674366 - RNA, 19 nt, Homo sapiens
gacaggagauauuacaaga

SEQ ID NO: 674367 - RNA, 19 nt, Homo sapiens
ggacaucuucagacuauuu

SEQ ID NO: 674368 - RNA, 19 nt, Homo sapiens
caacaaggguuaccuacca

SEQ ID NO: 674369 - RNA, 19 nt, Homo sapiens
gauggaagacagaaagaua

SEQ ID NO: 674370 - RNA, 19 nt, Homo sapiens
gcauaucaaacccaauuua

SEQ ID NO: 674371 - RNA, 19 nt, Homo sapiens
ccagaugacccuugaagua

SEQ ID NO: 674372 - RNA, 19 nt, Homo sapiens
ugaaggaaauaucugcuuu

SEQ ID NO: 674373 - RNA, 19 nt, Homo sapiens
uaggagagacugagaauuu

SEQ ID NO: 674374 - RNA, 19 nt, Homo sapiens
gaaauuucuuggcaacuuc

SEQ ID NO: 674375 - RNA, 19 nt, Homo sapiens
uaacaaguaugucugcaau

SEQ ID NO: 674376 - RNA, 19 nt, Homo sapiens
gaaggacuauguuccaaag

SEQ ID NO: 674377 - RNA, 19 nt, Homo sapiens
uaguaaagcucaggcauuu

SEQ ID NO: 674378 - RNA, 19 nt, Homo sapiens
guacuuagccaaagacaau

SEQ ID NO: 674379 - RNA, 19 nt, Homo sapiens
gagcuuuccucuuuacuuc

SEQ ID NO: 674380 - RNA, 19 nt, Homo sapiens
caguagaccugagagaaua

SEQ ID NO: 674381 - RNA, 19 nt, Homo sapiens
gcggcuagcuuuacgagaa

SEQ ID NO: 674382 - RNA, 19 nt, Homo sapiens
uguggugucuguuguaaua

SEQ ID NO: 674383 - RNA, 19 nt, Homo sapiens
gcagauuccuugauuggau

SEQ ID NO: 674384 - RNA, 19 nt, Homo sapiens
uaaugcagauuccuugauu

SEQ ID NO: 674385 - RNA, 19 nt, Homo sapiens
uaacaggacuugaucuucu

SEQ ID NO: 674386 - RNA, 19 nt, Homo sapiens
caagggacuuacuucuaua

SEQ ID NO: 674387 - RNA, 19 nt, Homo sapiens
gagguguucuacuuucuaa

SEQ ID NO: 674388 - RNA, 19 nt, Homo sapiens
gauggaauaucauuacaag

SEQ ID NO: 674389 - RNA, 19 nt, Homo sapiens
caaaggaguuaucaguuca

SEQ ID NO: 674390 - RNA, 19 nt, Homo sapiens
gaaaguugaugcaguagac

SEQ ID NO: 674391 - RNA, 19 nt, Homo sapiens
gagcaugucauuagcauug

SEQ ID NO: 674392 - RNA, 19 nt, Homo sapiens
gaucucucauuaccaagua

SEQ ID NO: 674393 - RNA, 19 nt, Homo sapiens
aaaccuaucugugaucuga

SEQ ID NO: 674394 - RNA, 19 nt, Homo sapiens
acaaacuccuugaugauuu

SEQ ID NO: 674395 - RNA, 19 nt, Homo sapiens
gaauacugguuucuaaagu

SEQ ID NO: 674396 - RNA, 19 nt, Homo sapiens
cauacuuucuguagcuuua

SEQ ID NO: 674397 - RNA, 19 nt, Homo sapiens
uuacaaggauuuccaagug

SEQ ID NO: 674398 - RNA, 19 nt, Homo sapiens
ggagaaauaggacacacua

SEQ ID NO: 674399 - RNA, 19 nt, Homo sapiens
guagggaggugaucucauc

SEQ ID NO: 674400 - RNA, 19 nt, Homo sapiens
guaaagcucaggcauuuga

SEQ ID NO: 674401 - RNA, 19 nt, Homo sapiens
gaagguggaucuaguuucg

SEQ ID NO: 674402 - RNA, 19 nt, Homo sapiens
gaacccagcacagcagaua

SEQ ID NO: 674403 - RNA, 19 nt, Homo sapiens
aaucacaucuguaguacuu

SEQ ID NO: 674404 - RNA, 19 nt, Homo sapiens
ccacuuuaauccuuagaaa

SEQ ID NO: 674405 - RNA, 19 nt, Homo sapiens
auacaacacuuucagauuc

SEQ ID NO: 674406 - RNA, 19 nt, Homo sapiens
gacuugaucuucuuucuuc

SEQ ID NO: 674407 - RNA, 19 nt, Homo sapiens
guauaugccaguuagaaua

SEQ ID NO: 674408 - RNA, 19 nt, Homo sapiens
ggagauauuacaagaaaug

SEQ ID NO: 674409 - RNA, 19 nt, Homo sapiens
gcauacuccuucagucauu

SEQ ID NO: 674410 - RNA, 19 nt, Homo sapiens
guaaguaauugaacagucu

SEQ ID NO: 674411 - RNA, 19 nt, Homo sapiens
ggaauaucauuacaaggau

SEQ ID NO: 674412 - RNA, 19 nt, Homo sapiens
cuacuggugucuuaguuaa

SEQ ID NO: 674413 - RNA, 19 nt, Homo sapiens
gaaaggaugaugaguccaa

SEQ ID NO: 674414 - RNA, 19 nt, Homo sapiens
ggccagaccuaagcaauug

SEQ ID NO: 674415 - RNA, 19 nt, Homo sapiens
gaagagggcaagacaagug

SEQ ID NO: 674416 - RNA, 19 nt, Homo sapiens
ucugugaucugauaaguga

SEQ ID NO: 674417 - RNA, 19 nt, Homo sapiens
gaacagaacccagaugaac

SEQ ID NO: 674418 - RNA, 19 nt, Homo sapiens
gcauauaguuuggacugaa

SEQ ID NO: 674419 - RNA, 19 nt, Homo sapiens
ggugggaccuccaacucua

SEQ ID NO: 674420 - RNA, 19 nt, Homo sapiens
gaagauagaugcagcagua

SEQ ID NO: 674421 - RNA, 19 nt, Homo sapiens
gaaauaugcugcaaucauu

SEQ ID NO: 674422 - RNA, 19 nt, Homo sapiens
gcaaacagaucuuaagcua

SEQ ID NO: 674423 - RNA, 19 nt, Homo sapiens
acaaauaccugacguguaa

SEQ ID NO: 674424 - RNA, 19 nt, Homo sapiens
caaagaaacugcagauuca

SEQ ID NO: 674425 - RNA, 19 nt, Homo sapiens
gcagaaugguacucauaua

SEQ ID NO: 674426 - RNA, 19 nt, Homo sapiens
gaagggcgauuacaaauac

SEQ ID NO: 674427 - RNA, 19 nt, Homo sapiens
gcagguaggcucuaucuuu

SEQ ID NO: 674428 - RNA, 19 nt, Homo sapiens
gaaugguacucauauaaug

SEQ ID NO: 674429 - RNA, 19 nt, Homo sapiens
gaaaauggcugauaaugau

SEQ ID NO: 674430 - RNA, 19 nt, Homo sapiens
gccaacugcugucaucuua

SEQ ID NO: 674431 - RNA, 19 nt, Homo sapiens
gauaaugauugucuuccua

SEQ ID NO: 674432 - RNA, 19 nt, Homo sapiens
gaaggagacuugcugagau

SEQ ID NO: 674433 - RNA, 19 nt, Homo sapiens
ggaaacagguggaagaaac

SEQ ID NO: 674434 - RNA, 19 nt, Homo sapiens
ggaagaaauuagaacaaug

SEQ ID NO: 674435 - RNA, 19 nt, Homo sapiens
gaaggaaaauggcugauaa

SEQ ID NO: 674436 - RNA, 19 nt, Homo sapiens
ggaugucacucaaucaguu

SEQ ID NO: 674437 - RNA, 19 nt, Homo sapiens
aaucauuucugcauccuua

SEQ ID NO: 674438 - RNA, 19 nt, Homo sapiens
caacugcugucaucuuaga

SEQ ID NO: 674439 - RNA, 19 nt, Homo sapiens
gcuggaaacucaaggaaga

SEQ ID NO: 674440 - RNA, 19 nt, Homo sapiens
agacaaagguauacucuuc

SEQ ID NO: 674441 - RNA, 19 nt, Homo sapiens
gaacauccuugcguagaga

SEQ ID NO: 674442 - RNA, 19 nt, Homo sapiens
gcugaaggcuacauguuga

SEQ ID NO: 674443 - RNA, 19 nt, Homo sapiens
gggaggagcccacugauga

SEQ ID NO: 674444 - RNA, 19 nt, Homo sapiens
caagaagcauccagaagau

SEQ ID NO: 674445 - RNA, 19 nt, Homo sapiens
gcugggaaauggcucuuaa

SEQ ID NO: 674446 - RNA, 19 nt, Homo sapiens
ggccgaggauggaagauuu

SEQ ID NO: 674447 - RNA, 19 nt, Homo sapiens
gcucuuaauuuccaguuga

SEQ ID NO: 674448 - RNA, 19 nt, Homo sapiens
ccacuugcuucccacauaa

SEQ ID NO: 674449 - RNA, 19 nt, Homo sapiens
guacacagaugauauucca

SEQ ID NO: 674450 - RNA, 19 nt, Homo sapiens
cuaguagaauugugaauga

SEQ ID NO: 674451 - RNA, 19 nt, Homo sapiens
ccaaagagcaccucagugu

SEQ ID NO: 674452 - RNA, 19 nt, Homo sapiens
ucugucagcucucggaaua

SEQ ID NO: 674453 - RNA, 19 nt, Homo sapiens
gggaauagauagcccuuag

SEQ ID NO: 674454 - RNA, 19 nt, Homo sapiens
aauggaagaucuuaccuuu

SEQ ID NO: 674455 - RNA, 19 nt, Homo sapiens
gauggaagauuuggagaau

SEQ ID NO: 674456 - RNA, 19 nt, Homo sapiens
ugugagagcucuugaguca

SEQ ID NO: 674457 - RNA, 19 nt, Homo sapiens
aaagagcaccucaguguuu

SEQ ID NO: 674458 - RNA, 19 nt, Homo sapiens
ggucuguccuguuuccuuu

SEQ ID NO: 674459 - RNA, 19 nt, Homo sapiens
gagaauggccagcaccaaa

SEQ ID NO: 674460 - RNA, 19 nt, Homo sapiens
gaagaaauuagaacaaugg

SEQ ID NO: 674461 - RNA, 19 nt, Homo sapiens
ggaaaggaagaaauuagaa

SEQ ID NO: 674462 - RNA, 19 nt, Homo sapiens
ucagagacauauuugaaug

SEQ ID NO: 674463 - RNA, 19 nt, Homo sapiens
gugguaaucugaagucuca

SEQ ID NO: 674464 - RNA, 19 nt, Homo sapiens
gcagaaguggcucuaauug

SEQ ID NO: 674465 - RNA, 19 nt, Homo sapiens
ggaguacacagaugauauu

SEQ ID NO: 674466 - RNA, 19 nt, Homo sapiens
gcagguggcaggcuguuaa

SEQ ID NO: 674467 - RNA, 19 nt, Homo sapiens
ccugagugcugcuguguuu

SEQ ID NO: 674468 - RNA, 19 nt, Homo sapiens
cagaaugguacucauauaa

SEQ ID NO: 674469 - RNA, 19 nt, Homo sapiens
ggugggacuuggagaauau

SEQ ID NO: 674470 - RNA, 19 nt, Homo sapiens
ggaaggagacuugcugaga

SEQ ID NO: 674471 - RNA, 19 nt, Homo sapiens
cagaugauauuccacuguu

SEQ ID NO: 674472 - RNA, 19 nt, Homo sapiens
gcaccacuauggaauccuu

SEQ ID NO: 674473 - RNA, 19 nt, Homo sapiens
gcauauguuuggucugaau

SEQ ID NO: 674474 - RNA, 19 nt, Homo sapiens
gguaggaaaggaagaaauu

SEQ ID NO: 674475 - RNA, 19 nt, Homo sapiens
ggagaaggugcuagaacua

SEQ ID NO: 674476 - RNA, 19 nt, Homo sapiens
gaaaccagccauggagauu

SEQ ID NO: 674477 - RNA, 19 nt, Homo sapiens
uuaggauucuucuggauuu

SEQ ID NO: 674478 - RNA, 19 nt, Homo sapiens
uaaagacacccacacauca

SEQ ID NO: 674479 - RNA, 19 nt, Homo sapiens
uuaauauccuggugacuug

SEQ ID NO: 674480 - RNA, 19 nt, Homo sapiens
ccacagcugccuugaggua

SEQ ID NO: 674481 - RNA, 19 nt, Homo sapiens
guaggaaaggaagaaauua

SEQ ID NO: 674482 - RNA, 19 nt, Homo sapiens
ccaccuugcuggaaacuca

SEQ ID NO: 674483 - RNA, 19 nt, Homo sapiens
gaugauauuccacuguuga

SEQ ID NO: 674484 - RNA, 19 nt, Homo sapiens
ugaagggcgauuacaaaua

SEQ ID NO: 674485 - RNA, 19 nt, Homo sapiens
ggaauccuuugcagaaugg

SEQ ID NO: 674486 - RNA, 19 nt, Homo sapiens
caaagcaauuucuuaacca

SEQ ID NO: 674487 - RNA, 19 nt, Homo sapiens
gugcugcuguguuuacuug

SEQ ID NO: 674488 - RNA, 19 nt, Homo sapiens
agagaacagugacauacaa

SEQ ID NO: 674489 - RNA, 19 nt, Homo sapiens
gcugaagucuuuccaucau

SEQ ID NO: 674490 - RNA, 19 nt, Homo sapiens
ccaagcagcagagcuagua

SEQ ID NO: 674491 - RNA, 19 nt, Homo sapiens
gaucccuggugaaaugaaa

SEQ ID NO: 674492 - RNA, 19 nt, Homo sapiens
acaaagaaacugcagauuc

SEQ ID NO: 674493 - RNA, 19 nt, Homo sapiens
ggaacauccuugcguagag

SEQ ID NO: 674494 - RNA, 19 nt, Homo sapiens
cugcauagaugaccagcuu

SEQ ID NO: 674495 - RNA, 19 nt, Homo sapiens
ccuaagagauugcacuuuu

SEQ ID NO: 674496 - RNA, 19 nt, Homo sapiens
ggaguauaaugggaaguug

SEQ ID NO: 674497 - RNA, 19 nt, Homo sapiens
ggaaaauggcugauaauga

SEQ ID NO: 674498 - RNA, 19 nt, Homo sapiens
uggcauauguuuggucuga

SEQ ID NO: 674499 - RNA, 19 nt, Homo sapiens
gcaauucagacaaagguau

SEQ ID NO: 674500 - RNA, 19 nt, Homo sapiens
gcaccaaaggacauuuaaa

SEQ ID NO: 674501 - RNA, 19 nt, Homo sapiens
uuauucagcugcauagaug

SEQ ID NO: 674502 - RNA, 19 nt, Homo sapiens
ccuguugaguugagaguuu

SEQ ID NO: 674503 - RNA, 19 nt, Homo sapiens
aaugaaauaugcugcaauc

SEQ ID NO: 674504 - RNA, 19 nt, Homo sapiens
caauucagacaaagguaua

SEQ ID NO: 674505 - RNA, 19 nt, Homo sapiens
caggcagugucaucgaaua

SEQ ID NO: 674506 - RNA, 19 nt, Homo sapiens
gagaacagugacauacaaa

SEQ ID NO: 674507 - RNA, 19 nt, Homo sapiens
caacuggcacacaaagaaa

SEQ ID NO: 674508 - RNA, 19 nt, Homo sapiens
ccaacuggcacacaaagaa

SEQ ID NO: 674509 - RNA, 19 nt, Homo sapiens
uugaaacccuaguagaauu

SEQ ID NO: 674510 - RNA, 19 nt, Homo sapiens
ccaaagcaauuucuuaacc

SEQ ID NO: 674511 - RNA, 19 nt, Homo sapiens
cuugaucccuggugaaaug

SEQ ID NO: 674512 - RNA, 19 nt, Homo sapiens
gcauagaugaccagcuuga

SEQ ID NO: 674513 - RNA, 19 nt, Homo sapiens
gucauucccuggccucuug

SEQ ID NO: 674514 - RNA, 19 nt, Homo sapiens
gggaagggcugagaaacag

SEQ ID NO: 674515 - RNA, 19 nt, Homo sapiens
guaagaauggcgaguggaa

SEQ ID NO: 674516 - RNA, 19 nt, Homo sapiens
guuuggguuugcuuuauuu

SEQ ID NO: 674517 - RNA, 19 nt, Homo sapiens
caaacagaucuuaagcuaa

SEQ ID NO: 674518 - RNA, 19 nt, Homo sapiens
caaaggacauuuaaaagag

SEQ ID NO: 674519 - RNA, 19 nt, Homo sapiens
gaaaggaagaaauuagaac

SEQ ID NO: 674520 - RNA, 19 nt, Homo sapiens
gcacagagguuaaguauuc

SEQ ID NO: 674521 - RNA, 19 nt, Homo sapiens
cgaaaucugugcuauauga

SEQ ID NO: 674522 - RNA, 19 nt, Homo sapiens
gauaugguguucugugaua

SEQ ID NO: 674523 - RNA, 19 nt, Homo sapiens
gauuauagcugagaaggua

SEQ ID NO: 674524 - RNA, 19 nt, Homo sapiens
gaaggaugcuccaggauga

SEQ ID NO: 674525 - RNA, 19 nt, Homo sapiens
agaaacagcuccacagaaa

SEQ ID NO: 674526 - RNA, 19 nt, Homo sapiens
gaacagaucuucgguuugc

SEQ ID NO: 674527 - RNA, 19 nt, Homo sapiens
ggaguucuauuccuuggua

SEQ ID NO: 674528 - RNA, 19 nt, Homo sapiens
cgagugagauguucuguga

SEQ ID NO: 674529 - RNA, 19 nt, Homo sapiens
ugauggagcuguguuauaa

SEQ ID NO: 674530 - RNA, 19 nt, Homo sapiens
aaagacagcucgagugaga

SEQ ID NO: 674531 - RNA, 19 nt, Homo sapiens
gcuguggacuuuaucuaua

SEQ ID NO: 674532 - RNA, 19 nt, Homo sapiens
aaacagugcuucagccaaa

SEQ ID NO: 674533 - RNA, 19 nt, Homo sapiens
ggaaugauaugguguucug

SEQ ID NO: 674534 - RNA, 19 nt, Homo sapiens
gaaagccucugguccuuca

SEQ ID NO: 674535 - RNA, 19 nt, Homo sapiens
uagcauauguuaagaggaa

SEQ ID NO: 674536 - RNA, 19 nt, Homo sapiens
guagaacacuuuaguaggu

SEQ ID NO: 674537 - RNA, 19 nt, Homo sapiens
gaacgccauugccaugaaa

SEQ ID NO: 674538 - RNA, 19 nt, Homo sapiens
gguaaaggacguucuguuu

SEQ ID NO: 674539 - RNA, 19 nt, Homo sapiens
ggagcuguguuauaaauuc

SEQ ID NO: 674540 - RNA, 19 nt, Homo sapiens
caugucugcuucucauuua

SEQ ID NO: 674541 - RNA, 19 nt, Homo sapiens
ucaauacuccucaugcuua

SEQ ID NO: 674542 - RNA, 19 nt, Homo sapiens
aagauaagcucaguccuuu

SEQ ID NO: 674543 - RNA, 19 nt, Homo sapiens
aaacagcccaguuguagua

SEQ ID NO: 674544 - RNA, 19 nt, Homo sapiens
gagcaagaauaaccguuug

SEQ ID NO: 674545 - RNA, 19 nt, Homo sapiens
gaaccaugcuauugagaca

SEQ ID NO: 674546 - RNA, 19 nt, Homo sapiens
ccaugaaacuuccagauuc

SEQ ID NO: 674547 - RNA, 19 nt, Homo sapiens
uaagaguccuugcauuguu

SEQ ID NO: 674548 - RNA, 19 nt, Homo sapiens
ggacucacccggcacauug

SEQ ID NO: 674549 - RNA, 19 nt, Homo sapiens
ugauagcuauuaccucuuu

SEQ ID NO: 674550 - RNA, 19 nt, Homo sapiens
ucagggaaauauaguugua

SEQ ID NO: 674551 - RNA, 19 nt, Homo sapiens
gggacacacucauaacuau

SEQ ID NO: 674552 - RNA, 19 nt, Homo sapiens
gcacaagguugaguuucuu

SEQ ID NO: 674553 - RNA, 19 nt, Homo sapiens
uguauucagugcucuauaa

SEQ ID NO: 674554 - RNA, 19 nt, Homo sapiens
gaugugaucugugaugugu

SEQ ID NO: 674555 - RNA, 19 nt, Homo sapiens
gaagaaagcgagcgguuag

SEQ ID NO: 674556 - RNA, 19 nt, Homo sapiens
caaacucacuacugucuuc

SEQ ID NO: 674557 - RNA, 19 nt, Homo sapiens
ggaacgccauugccaugaa

SEQ ID NO: 674558 - RNA, 19 nt, Homo sapiens
gugggaauauucagacaaa

SEQ ID NO: 674559 - RNA, 19 nt, Homo sapiens
uaagaggaauugcagugaa

SEQ ID NO: 674560 - RNA, 19 nt, Homo sapiens
augcaaaggugauuagaaa

SEQ ID NO: 674561 - RNA, 19 nt, Homo sapiens
cauauugccucaagcauag

SEQ ID NO: 674562 - RNA, 19 nt, Homo sapiens
ggaacucaaugaagaccuu

SEQ ID NO: 674563 - RNA, 19 nt, Homo sapiens
uguaggaaguuucuaauuc

SEQ ID NO: 674564 - RNA, 19 nt, Homo sapiens
caggguauuugcucaguaa

SEQ ID NO: 674565 - RNA, 19 nt, Homo sapiens
uguauaggaucaagucaaa

SEQ ID NO: 674566 - RNA, 19 nt, Homo sapiens
gaagagaauuuccccuauu

SEQ ID NO: 674567 - RNA, 19 nt, Homo sapiens
caaaggugauuagaaacuu

SEQ ID NO: 674568 - RNA, 19 nt, Homo sapiens
uuaaagagaccaccaauag

SEQ ID NO: 674569 - RNA, 19 nt, Homo sapiens
gaaugagaauguuuaugca

SEQ ID NO: 674570 - RNA, 19 nt, Homo sapiens
aagaguccuugcauuguua

SEQ ID NO: 674571 - RNA, 19 nt, Homo sapiens
gaagcugucacacaacaaa

SEQ ID NO: 674572 - RNA, 19 nt, Homo sapiens
cagccaaauuccauaugua

SEQ ID NO: 674573 - RNA, 19 nt, Homo sapiens
gaaaguguagugggaauau

SEQ ID NO: 674574 - RNA, 19 nt, Homo sapiens
ccucaggagucacuagaaa

SEQ ID NO: 674575 - RNA, 19 nt, Homo sapiens
uauaacuacuggaaacuga

SEQ ID NO: 674576 - RNA, 19 nt, Homo sapiens
gcagaaacuuggagaagcu

SEQ ID NO: 674577 - RNA, 19 nt, Homo sapiens
ggauggaaccgaucacgaa

SEQ ID NO: 674578 - RNA, 19 nt, Homo sapiens
gaugagaaucuuauggaaa

SEQ ID NO: 674579 - RNA, 19 nt, Homo sapiens
aaacaugucugcuucucau

SEQ ID NO: 674580 - RNA, 19 nt, Homo sapiens
gacacacucauaacuauuu

SEQ ID NO: 674581 - RNA, 19 nt, Homo sapiens
ucacuacugucuuccuuug

SEQ ID NO: 674582 - RNA, 19 nt, Homo sapiens
uaauuccacugguaucuau

SEQ ID NO: 674583 - RNA, 19 nt, Homo sapiens
gcagcuuuccgguuauaua

SEQ ID NO: 674584 - RNA, 19 nt, Homo sapiens
aggaacagaucuucgguuu

SEQ ID NO: 674585 - RNA, 19 nt, Homo sapiens
caagauaagcucaguccuu

SEQ ID NO: 674586 - RNA, 19 nt, Homo sapiens
ugaguucucuggaguagau

SEQ ID NO: 674587 - RNA, 19 nt, Homo sapiens
ccaggagaccaccaucuua

SEQ ID NO: 674588 - RNA, 19 nt, Homo sapiens
gggcagcuuuccgguuaua

SEQ ID NO: 674589 - RNA, 19 nt, Homo sapiens
ucacgaagaucucccacau

SEQ ID NO: 674590 - RNA, 19 nt, Homo sapiens
ccaaauuccauauguaaug

SEQ ID NO: 674591 - RNA, 19 nt, Homo sapiens
cauaguaaauugucuugca

SEQ ID NO: 674592 - RNA, 19 nt, Homo sapiens
gaaaacccauacaccaaaa

SEQ ID NO: 674593 - RNA, 19 nt, Homo sapiens
gcagaaagugaugggaaua

SEQ ID NO: 674594 - RNA, 19 nt, Homo sapiens
gcaggugccucaggaguca

SEQ ID NO: 674595 - RNA, 19 nt, Homo sapiens
caaugaagaccuugcagaa

SEQ ID NO: 674596 - RNA, 19 nt, Homo sapiens
gcuaugaccuagaugacau

SEQ ID NO: 674597 - RNA, 19 nt, Homo sapiens
gauuagaaacuuccaagga

SEQ ID NO: 674598 - RNA, 19 nt, Homo sapiens
agaaagugaugggaauaaa

SEQ ID NO: 674599 - RNA, 19 nt, Homo sapiens
gaucuucgguuugcaaguc

SEQ ID NO: 674600 - RNA, 19 nt, Homo sapiens
caagucauauugccucaag

SEQ ID NO: 674601 - RNA, 19 nt, Homo sapiens
ccacgucaccugugccuuu

SEQ ID NO: 674602 - RNA, 19 nt, Homo sapiens
uguguuauguccaaagaaa

SEQ ID NO: 674603 - RNA, 19 nt, Homo sapiens
ugaagaccuugcagaaaug

SEQ ID NO: 674604 - RNA, 19 nt, Homo sapiens
aguauuaccucuuaaccuu

SEQ ID NO: 674605 - RNA, 19 nt, Homo sapiens
ggauauuccuagguaaaug

SEQ ID NO: 674606 - RNA, 19 nt, Homo sapiens
caaggaaaaugcucugauu

SEQ ID NO: 674607 - RNA, 19 nt, Homo sapiens
ccacuagagagcaagaaua

SEQ ID NO: 674608 - RNA, 19 nt, Homo sapiens
gagaauguuuaugcaucua

SEQ ID NO: 674609 - RNA, 19 nt, Homo sapiens
gagcacggccuagagauga

SEQ ID NO: 674610 - RNA, 19 nt, Homo sapiens
cagauucucaccacauuaa

SEQ ID NO: 674611 - RNA, 19 nt, Homo sapiens
gauauuccuagguaaauga

SEQ ID NO: 674612 - RNA, 19 nt, Homo sapiens
gaagcagacuauaauucuc

SEQ ID NO: 674613 - RNA, 19 nt, Homo sapiens
aagaggaauugcagugaaa

SEQ ID NO: 674614 - RNA, 19 nt, Homo sapiens
gagaggguccgaaaucugu

SEQ ID NO: 674615 - RNA, 19 nt, Homo sapiens
uuguauaccugcuuuaaug

SEQ ID NO: 674616 - RNA, 19 nt, Homo sapiens
uaaguuuggcugacaguuu

SEQ ID NO: 674617 - RNA, 19 nt, Homo sapiens
ggacacacucauaacuauu

SEQ ID NO: 674618 - RNA, 19 nt, Homo sapiens
gaccuccagugcuauguga

SEQ ID NO: 674619 - RNA, 19 nt, Homo sapiens
caauguguguuauguccaa

SEQ ID NO: 674620 - RNA, 19 nt, Homo sapiens
caaauuaagugucuaguuc

SEQ ID NO: 674621 - RNA, 19 nt, Homo sapiens
gaggaaagcugaaaauaaa

SEQ ID NO: 674622 - RNA, 19 nt, Homo sapiens
gaaaggugcuugguucuuc

SEQ ID NO: 674623 - RNA, 19 nt, Homo sapiens
gaauaacgucuccuuguuu

SEQ ID NO: 674624 - RNA, 19 nt, Homo sapiens
aauaacgucuccuuguuua

SEQ ID NO: 674625 - RNA, 19 nt, Homo sapiens
ggagaauucuuuagguugu

SEQ ID NO: 674626 - RNA, 19 nt, Homo sapiens
ugaauaacgucuccuuguu

SEQ ID NO: 674627 - RNA, 19 nt, Homo sapiens
gagauuugcuuagauuguu

SEQ ID NO: 674628 - RNA, 19 nt, Homo sapiens
ccaauuagcuuuguugaac

SEQ ID NO: 674629 - RNA, 19 nt, Homo sapiens
ggacuaaagcagacagugu

SEQ ID NO: 674630 - RNA, 19 nt, Homo sapiens
gcaaccugaucacacaaau

SEQ ID NO: 674631 - RNA, 19 nt, Homo sapiens
gaacauggugcggacuaaa

SEQ ID NO: 674632 - RNA, 19 nt, Homo sapiens
ggaagucaguucguucucu

SEQ ID NO: 674633 - RNA, 19 nt, Homo sapiens
ucaagucauugcauugugu

SEQ ID NO: 674634 - RNA, 19 nt, Homo sapiens
gguguuugauuauuggaau

SEQ ID NO: 674635 - RNA, 19 nt, Homo sapiens
gcauuguguucuaauuaca

SEQ ID NO: 674636 - RNA, 19 nt, Homo sapiens
gucauugcauuguguucua

SEQ ID NO: 674637 - RNA, 19 nt, Homo sapiens
ccaaauuaagugucuaguu

SEQ ID NO: 674638 - RNA, 19 nt, Homo sapiens
gacuaaagcagacaguguu

SEQ ID NO: 674639 - RNA, 19 nt, Homo sapiens
ccucuccucucuucuuguu

SEQ ID NO: 674640 - RNA, 19 nt, Homo sapiens
gcugggaagucaguucguu

SEQ ID NO: 674641 - RNA, 19 nt, Homo sapiens
caaguauguuguauuugag

SEQ ID NO: 674642 - RNA, 19 nt, Homo sapiens
uaugguaacuuagcuuagu

SEQ ID NO: 674643 - RNA, 19 nt, Homo sapiens
guugaacaggcauuuaauu

SEQ ID NO: 674644 - RNA, 19 nt, Homo sapiens
aaccugaucacacaaauga

SEQ ID NO: 674645 - RNA, 19 nt, Homo sapiens
ugaacauggugcggacuaa

SEQ ID NO: 674646 - RNA, 19 nt, Homo sapiens
ucuccucucuucuuguuug

SEQ ID NO: 674647 - RNA, 19 nt, Homo sapiens
cgaggaaagcugaaaauaa

SEQ ID NO: 674648 - RNA, 19 nt, Homo sapiens
ugcauuguuugguuucuuu

SEQ ID NO: 674649 - RNA, 19 nt, Homo sapiens
guaacuuagcuuaguauuc

SEQ ID NO: 674650 - RNA, 19 nt, Homo sapiens
ucauugcauuguguucuaa

SEQ ID NO: 674651 - RNA, 19 nt, Homo sapiens
ccacuaauucgacaucagu

SEQ ID NO: 674652 - RNA, 19 nt, Homo sapiens
gugucuaguucuugcuaaa

SEQ ID NO: 674653 - RNA, 19 nt, Homo sapiens
gaacuuucucauucaucuu

SEQ ID NO: 674654 - RNA, 19 nt, Homo sapiens
uuggagaauucuuuagguu

SEQ ID NO: 674655 - RNA, 19 nt, Homo sapiens
ccaccucugccacuaauuc

SEQ ID NO: 674656 - RNA, 19 nt, Homo sapiens
ucucuccucuccucucuuc

SEQ ID NO: 674657 - RNA, 19 nt, Homo sapiens
gagaauucuuuagguuguc

SEQ ID NO: 674658 - RNA, 19 nt, Homo sapiens
caaccugaucacacaaaug

SEQ ID NO: 674659 - RNA, 19 nt, Homo sapiens
guuccaggcacuuacagaa

SEQ ID NO: 674660 - RNA, 19 nt, Homo sapiens
guaguugugaaauuugaga

SEQ ID NO: 674661 - RNA, 19 nt, Homo sapiens
cuaauucgacaucaguuuc

SEQ ID NO: 674662 - RNA, 19 nt, Homo sapiens
ugagauuugcuuagauugu

SEQ ID NO: 674663 - RNA, 19 nt, Homo sapiens
augguaacuuagcuuagua

SEQ ID NO: 674664 - RNA, 19 nt, Homo sapiens
uugcuuagauuguuguacu

SEQ ID NO: 674665 - RNA, 19 nt, Homo sapiens
agauuugcuuagauuguug

SEQ ID NO: 674666 - RNA, 19 nt, Homo sapiens
aaaucaagucauugcauug

SEQ ID NO: 674667 - RNA, 19 nt, Homo sapiens
gguaacuuagcuuaguauu

SEQ ID NO: 674668 - RNA, 19 nt, Homo sapiens
gaacuucucuugcaucuga

SEQ ID NO: 674669 - RNA, 19 nt, Homo sapiens
gagggaaggugaugacuua

SEQ ID NO: 674670 - RNA, 19 nt, Homo sapiens
gcaagaggauuucuggaua

SEQ ID NO: 674671 - RNA, 19 nt, Homo sapiens
ggaaaugucucaagaaaca

SEQ ID NO: 674672 - RNA, 19 nt, Homo sapiens
guaagagccuuggaaauua

SEQ ID NO: 674673 - RNA, 19 nt, Homo sapiens
ggaagaagaucgggaagua

SEQ ID NO: 674674 - RNA, 19 nt, Homo sapiens
gagaagauccuguguguuu

SEQ ID NO: 674675 - RNA, 19 nt, Homo sapiens
gagcagaucuccaaagugu

SEQ ID NO: 674676 - RNA, 19 nt, Homo sapiens
ggagaggcuuccuuuguua

SEQ ID NO: 674677 - RNA, 19 nt, Homo sapiens
gaacuucucuucugguaau

SEQ ID NO: 674678 - RNA, 19 nt, Homo sapiens
ggaaggaaaugucucaaga

SEQ ID NO: 674679 - RNA, 19 nt, Homo sapiens
gaugagauaugauuuccua

SEQ ID NO: 674680 - RNA, 19 nt, Homo sapiens
ggagaagaauuuccacaaa

SEQ ID NO: 674681 - RNA, 19 nt, Homo sapiens
ccaaguagcuggaauuaca

SEQ ID NO: 674682 - RNA, 19 nt, Homo sapiens
gagagagguuucuuucuuu

SEQ ID NO: 674683 - RNA, 19 nt, Homo sapiens
gaaccgccauugcccauaa

SEQ ID NO: 674684 - RNA, 19 nt, Homo sapiens
cuaagaaccugaucagaaa

SEQ ID NO: 674685 - RNA, 19 nt, Homo sapiens
ggaaggugaugacuuaaau

SEQ ID NO: 674686 - RNA, 19 nt, Homo sapiens
ccacaaagcaaacuacuaa

SEQ ID NO: 674687 - RNA, 19 nt, Homo sapiens
gaagaggguucuccagguu

SEQ ID NO: 674688 - RNA, 19 nt, Homo sapiens
ggaaacauuuagacacaaa

SEQ ID NO: 674689 - RNA, 19 nt, Homo sapiens
gcaacaaucugagccauga

SEQ ID NO: 674690 - RNA, 19 nt, Homo sapiens
gaugguacaugacuugauu

SEQ ID NO: 674691 - RNA, 19 nt, Homo sapiens
ccaccuaugugaucuuuaa

SEQ ID NO: 674692 - RNA, 19 nt, Homo sapiens
ggacuugggagaagaauuu

SEQ ID NO: 674693 - RNA, 19 nt, Homo sapiens
gcagaucgcagaccuguuu

SEQ ID NO: 674694 - RNA, 19 nt, Homo sapiens
ggaaggguucuuugaaaua

SEQ ID NO: 674695 - RNA, 19 nt, Homo sapiens
ugacuuagaucuuacugaa

SEQ ID NO: 674696 - RNA, 19 nt, Homo sapiens
cagaugagaugagauauga

SEQ ID NO: 674697 - RNA, 19 nt, Homo sapiens
guauuuagguugaaggaaa

SEQ ID NO: 674698 - RNA, 19 nt, Homo sapiens
cgagagagguuucuuucuu

SEQ ID NO: 674699 - RNA, 19 nt, Homo sapiens
uaagagccuuggaaauuaa

SEQ ID NO: 674700 - RNA, 19 nt, Homo sapiens
gggagaggcuuccuuuguu

SEQ ID NO: 674701 - RNA, 19 nt, Homo sapiens
caagaagucuguggaguug

SEQ ID NO: 674702 - RNA, 19 nt, Homo sapiens
agaaagcucugcccuauca

SEQ ID NO: 674703 - RNA, 19 nt, Homo sapiens
gaagcuaggcacuuucuuu

SEQ ID NO: 674704 - RNA, 19 nt, Homo sapiens
gagaagaauuuccacaaag

SEQ ID NO: 674705 - RNA, 19 nt, Homo sapiens
cagaggaguuugccuugua

SEQ ID NO: 674706 - RNA, 19 nt, Homo sapiens
ggaagaagacgaguucauu

SEQ ID NO: 674707 - RNA, 19 nt, Homo sapiens
gcaagggagccauacauuu

SEQ ID NO: 674708 - RNA, 19 nt, Homo sapiens
ugaaauagcagcaguugaa

SEQ ID NO: 674709 - RNA, 19 nt, Homo sapiens
gaaggguucuuugaaauag

SEQ ID NO: 674710 - RNA, 19 nt, Homo sapiens
ccauuuggguuguuuauau

SEQ ID NO: 674711 - RNA, 19 nt, Homo sapiens
caagaggauuucuggauau

SEQ ID NO: 674712 - RNA, 19 nt, Homo sapiens
ggucauuucucacguccua

SEQ ID NO: 674713 - RNA, 19 nt, Homo sapiens
ccaggaagcuaggcacuuu

SEQ ID NO: 674714 - RNA, 19 nt, Homo sapiens
ggaguugagugguuacuuc

SEQ ID NO: 674715 - RNA, 19 nt, Homo sapiens
gaagaagacgaguucauug

SEQ ID NO: 674716 - RNA, 19 nt, Homo sapiens
gaggauuucuggauauuag

SEQ ID NO: 674717 - RNA, 19 nt, Homo sapiens
cagagaagauccugugugu

SEQ ID NO: 674718 - RNA, 19 nt, Homo sapiens
gauaugauuuccuagagau

SEQ ID NO: 674719 - RNA, 19 nt, Homo sapiens
gaaauuggccacagaagag

SEQ ID NO: 674720 - RNA, 19 nt, Homo sapiens
gggaaauacugcaacaugu

SEQ ID NO: 674721 - RNA, 19 nt, Homo sapiens
gguaagaagacaaagagua

SEQ ID NO: 674722 - RNA, 19 nt, Homo sapiens
gcacagaacugggguaaga

SEQ ID NO: 674723 - RNA, 19 nt, Homo sapiens
gaggcuaccugcagauaug

SEQ ID NO: 674724 - RNA, 19 nt, Homo sapiens
gacaggagaucaccauaag

SEQ ID NO: 674725 - RNA, 19 nt, Homo sapiens
ucaggagagugaagaaauu

SEQ ID NO: 674726 - RNA, 19 nt, Homo sapiens
gaacgcagcccaucuucau

SEQ ID NO: 674727 - RNA, 19 nt, Homo sapiens
ccaggaaguuucagguuga

SEQ ID NO: 674728 - RNA, 19 nt, Homo sapiens
aaggaaaugucucaagaaa

SEQ ID NO: 674729 - RNA, 19 nt, Homo sapiens
gaugagaugagauaugauu

SEQ ID NO: 674730 - RNA, 19 nt, Homo sapiens
gcaaacuacuaaccacuag

SEQ ID NO: 674731 - RNA, 19 nt, Homo sapiens
gaaggaaaugucucaagaa

SEQ ID NO: 674732 - RNA, 19 nt, Homo sapiens
caaaauaacagccacauaa

SEQ ID NO: 674733 - RNA, 19 nt, Homo sapiens
gaagaaauuggccacagaa

SEQ ID NO: 674734 - RNA, 19 nt, Homo sapiens
gagcaaaggcugugucuac

SEQ ID NO: 674735 - RNA, 19 nt, Homo sapiens
acaguacucucuccuagaa

SEQ ID NO: 674736 - RNA, 19 nt, Homo sapiens
caagucuccuuccuccaua

SEQ ID NO: 674737 - RNA, 19 nt, Homo sapiens
cgacguggcccaguauaua

SEQ ID NO: 674738 - RNA, 19 nt, Homo sapiens
caaagugucaggagaguga

SEQ ID NO: 674739 - RNA, 19 nt, Homo sapiens
caacacacuuccacguaau

SEQ ID NO: 674740 - RNA, 19 nt, Homo sapiens
acaacacacuuccacguaa

SEQ ID NO: 674741 - RNA, 19 nt, Homo sapiens
ccugauacuuucacaugua

SEQ ID NO: 674742 - RNA, 19 nt, Homo sapiens
gccaagccaucauuugcua

SEQ ID NO: 674743 - RNA, 19 nt, Homo sapiens
gacagaggcuggaggagau

SEQ ID NO: 674744 - RNA, 19 nt, Homo sapiens
gaauucagcagaggaguuu

SEQ ID NO: 674745 - RNA, 19 nt, Homo sapiens
gagauaugauuuccuagag

SEQ ID NO: 674746 - RNA, 19 nt, Homo sapiens
cauaagcgucccugauaua

SEQ ID NO: 674747 - RNA, 19 nt, Homo sapiens
gagguuucuuucuuucuuu

SEQ ID NO: 674748 - RNA, 19 nt, Homo sapiens
ugaagaaauuggccacaga

SEQ ID NO: 674749 - RNA, 19 nt, Homo sapiens
guuacaaggugaucaagug

SEQ ID NO: 674750 - RNA, 19 nt, Homo sapiens
ugugggaguuuauguaauu

SEQ ID NO: 674751 - RNA, 19 nt, Homo sapiens
gaucccaucucacacaaca

SEQ ID NO: 674752 - RNA, 19 nt, Homo sapiens
cagcuguggucuuaacgua

SEQ ID NO: 674753 - RNA, 19 nt, Homo sapiens
uguaagagccuuggaaauu

SEQ ID NO: 674754 - RNA, 19 nt, Homo sapiens
gaagaagaucgggaaguaa

SEQ ID NO: 674755 - RNA, 19 nt, Homo sapiens
ggccauuucuacaaccaua

SEQ ID NO: 674756 - RNA, 19 nt, Homo sapiens
gauauagcagcacacauuu

SEQ ID NO: 674757 - RNA, 19 nt, Homo sapiens
ugauauagcagcacacauu

SEQ ID NO: 674758 - RNA, 19 nt, Homo sapiens
guaagaagacaaagaguag

SEQ ID NO: 674759 - RNA, 19 nt, Homo sapiens
gcagaucuccaaaguguuc

SEQ ID NO: 674760 - RNA, 19 nt, Homo sapiens
gaugcaggaugacaacgaa

SEQ ID NO: 674761 - RNA, 19 nt, Homo sapiens
ccuaagaaccugaucagaa

SEQ ID NO: 674762 - RNA, 19 nt, Homo sapiens
gaaggaucagugaauguaa

SEQ ID NO: 674763 - RNA, 19 nt, Homo sapiens
ggagcuggauguagaaguc

SEQ ID NO: 674764 - RNA, 19 nt, Homo sapiens
gagacaugcugaugcuuca

SEQ ID NO: 674765 - RNA, 19 nt, Homo sapiens
uagcagcaguugaaacaga

SEQ ID NO: 674766 - RNA, 19 nt, Homo sapiens
gaaauagcagcaguugaaa

SEQ ID NO: 674767 - RNA, 19 nt, Homo sapiens
ggaggaagaagacgaguuc

SEQ ID NO: 674768 - RNA, 19 nt, Homo sapiens
gagggaaggugaugacuua

SEQ ID NO: 674769 - RNA, 19 nt, Homo sapiens
gcaagaggauuucuggaua

SEQ ID NO: 674770 - RNA, 19 nt, Homo sapiens
ggaaaugucucaagaaaca

SEQ ID NO: 674771 - RNA, 19 nt, Homo sapiens
guaagagccuuggaaauua

SEQ ID NO: 674772 - RNA, 19 nt, Homo sapiens
ggaagaagaucgggaagua

SEQ ID NO: 674773 - RNA, 19 nt, Homo sapiens
gagaagauccuguguguuu

SEQ ID NO: 674774 - RNA, 19 nt, Homo sapiens
gagcagaucuccaaagugu

SEQ ID NO: 674775 - RNA, 19 nt, Homo sapiens
ggagaggcuuccuuuguua

SEQ ID NO: 674776 - RNA, 19 nt, Homo sapiens
gaacuucucuucugguaau

SEQ ID NO: 674777 - RNA, 19 nt, Homo sapiens
ggaaggaaaugucucaaga

SEQ ID NO: 674778 - RNA, 19 nt, Homo sapiens
gaugagauaugauuuccua

SEQ ID NO: 674779 - RNA, 19 nt, Homo sapiens
ggagaagaauuuccacaaa

SEQ ID NO: 674780 - RNA, 19 nt, Homo sapiens
gaccaaagcucucugaauc

SEQ ID NO: 674781 - RNA, 19 nt, Homo sapiens
ccaaguagcuggaauuaca

SEQ ID NO: 674782 - RNA, 19 nt, Homo sapiens
gagagagguuucuuucuuu

SEQ ID NO: 674783 - RNA, 19 nt, Homo sapiens
gaaccgccauugcccauaa

SEQ ID NO: 674784 - RNA, 19 nt, Homo sapiens
cuaagaaccugaucagaaa

SEQ ID NO: 674785 - RNA, 19 nt, Homo sapiens
agucuaaacuggaaucuua

SEQ ID NO: 674786 - RNA, 19 nt, Homo sapiens
ggaaggugaugacuuaaau

SEQ ID NO: 674787 - RNA, 19 nt, Homo sapiens
ccacaaagcaaacuacuaa

SEQ ID NO: 674788 - RNA, 19 nt, Homo sapiens
gaagaggguucuccagguu

SEQ ID NO: 674789 - RNA, 19 nt, Homo sapiens
ggaaacauuuagacacaaa

SEQ ID NO: 674790 - RNA, 19 nt, Homo sapiens
gcaacaaucugagccauga

SEQ ID NO: 674791 - RNA, 19 nt, Homo sapiens
gaugguacaugacuugauu

SEQ ID NO: 674792 - RNA, 19 nt, Homo sapiens
ccaccuaugugaucuuuaa

SEQ ID NO: 674793 - RNA, 19 nt, Homo sapiens
ggacuugggagaagaauuu

SEQ ID NO: 674794 - RNA, 19 nt, Homo sapiens
gcagaucgcagaccuguuu

SEQ ID NO: 674795 - RNA, 19 nt, Homo sapiens
ggaaggguucuuugaaaua

SEQ ID NO: 674796 - RNA, 19 nt, Homo sapiens
ugacuuagaucuuacugaa

SEQ ID NO: 674797 - RNA, 19 nt, Homo sapiens
cagaugagaugagauauga

SEQ ID NO: 674798 - RNA, 19 nt, Homo sapiens
guauuuagguugaaggaaa

SEQ ID NO: 674799 - RNA, 19 nt, Homo sapiens
cgagagagguuucuuucuu

SEQ ID NO: 674800 - RNA, 19 nt, Homo sapiens
uaagagccuuggaaauuaa

SEQ ID NO: 674801 - RNA, 19 nt, Homo sapiens
aaacgaauggccacuauua

SEQ ID NO: 674802 - RNA, 19 nt, Homo sapiens
gggagaggcuuccuuuguu

SEQ ID NO: 674803 - RNA, 19 nt, Homo sapiens
caagaagucuguggaguug

SEQ ID NO: 674804 - RNA, 19 nt, Homo sapiens
ccaaagcauuuaugacuug

SEQ ID NO: 674805 - RNA, 19 nt, Homo sapiens
gaccacuccucauagaaua

SEQ ID NO: 674806 - RNA, 19 nt, Homo sapiens
agaaagcucugcccuauca

SEQ ID NO: 674807 - RNA, 19 nt, Homo sapiens
gaagcuaggcacuuucuuu

SEQ ID NO: 674808 - RNA, 19 nt, Homo sapiens
gagaagaauuuccacaaag

SEQ ID NO: 674809 - RNA, 19 nt, Homo sapiens
cagaggaguuugccuugua

SEQ ID NO: 674810 - RNA, 19 nt, Homo sapiens
gcaagggagccauacauuu

SEQ ID NO: 674811 - RNA, 19 nt, Homo sapiens
ugaaauagcagcaguugaa

SEQ ID NO: 674812 - RNA, 19 nt, Homo sapiens
gaaggguucuuugaaauag

SEQ ID NO: 674813 - RNA, 19 nt, Homo sapiens
ccauuuggguuguuuauau

SEQ ID NO: 674814 - RNA, 19 nt, Homo sapiens
caagaggauuucuggauau

SEQ ID NO: 674815 - RNA, 19 nt, Homo sapiens
ggucauuucucacguccua

SEQ ID NO: 674816 - RNA, 19 nt, Homo sapiens
ccaggaagcuaggcacuuu

SEQ ID NO: 674817 - RNA, 19 nt, Homo sapiens
ggaguugagugguuacuuc

SEQ ID NO: 674818 - RNA, 19 nt, Homo sapiens
gaggauuucuggauauuag

SEQ ID NO: 674819 - RNA, 19 nt, Homo sapiens
cagagaagauccugugugu

SEQ ID NO: 674820 - RNA, 19 nt, Homo sapiens
gauaugauuuccuagagau

SEQ ID NO: 674821 - RNA, 19 nt, Homo sapiens
gaaauuggccacagaagag

SEQ ID NO: 674822 - RNA, 19 nt, Homo sapiens
gggaaauacugcaacaugu

SEQ ID NO: 674823 - RNA, 19 nt, Homo sapiens
gguaagaagacaaagagua

SEQ ID NO: 674824 - RNA, 19 nt, Homo sapiens
gcacagaacugggguaaga

SEQ ID NO: 674825 - RNA, 19 nt, Homo sapiens
gaggcuaccugcagauaug

SEQ ID NO: 674826 - RNA, 19 nt, Homo sapiens
gacaggagaucaccauaag

SEQ ID NO: 674827 - RNA, 19 nt, Homo sapiens
ucaggagagugaagaaauu

SEQ ID NO: 674828 - RNA, 19 nt, Homo sapiens
gaacgcagcccaucuucau

SEQ ID NO: 674829 - RNA, 19 nt, Homo sapiens
ccaggaaguuucagguuga

SEQ ID NO: 674830 - RNA, 19 nt, Homo sapiens
aaggaaaugucucaagaaa

SEQ ID NO: 674831 - RNA, 19 nt, Homo sapiens
gaugagaugagauaugauu

SEQ ID NO: 674832 - RNA, 19 nt, Homo sapiens
gcaaacuacuaaccacuag

SEQ ID NO: 674833 - RNA, 19 nt, Homo sapiens
gaaggaaaugucucaagaa

SEQ ID NO: 674834 - RNA, 19 nt, Homo sapiens
caaaauaacagccacauaa

SEQ ID NO: 674835 - RNA, 19 nt, Homo sapiens
gaagaaauuggccacagaa

SEQ ID NO: 674836 - RNA, 19 nt, Homo sapiens
gagccaggguuugcaauga

SEQ ID NO: 674837 - RNA, 19 nt, Homo sapiens
ccaaagcucucugaaucuu

SEQ ID NO: 674838 - RNA, 19 nt, Homo sapiens
acaguacucucuccuagaa

SEQ ID NO: 674839 - RNA, 19 nt, Homo sapiens
caagucuccuuccuccaua

SEQ ID NO: 674840 - RNA, 19 nt, Homo sapiens
cgacguggcccaguauaua

SEQ ID NO: 674841 - RNA, 19 nt, Homo sapiens
caaagugucaggagaguga

SEQ ID NO: 674842 - RNA, 19 nt, Homo sapiens
caacacacuuccacguaau

SEQ ID NO: 674843 - RNA, 19 nt, Homo sapiens
acaacacacuuccacguaa

SEQ ID NO: 674844 - RNA, 19 nt, Homo sapiens
ccugauacuuucacaugua

SEQ ID NO: 674845 - RNA, 19 nt, Homo sapiens
gccaagccaucauuugcua

SEQ ID NO: 674846 - RNA, 19 nt, Homo sapiens
gacagaggcuggaggagau

SEQ ID NO: 674847 - RNA, 19 nt, Homo sapiens
gaauucagcagaggaguuu

SEQ ID NO: 674848 - RNA, 19 nt, Homo sapiens
gagauaugauuuccuagag

SEQ ID NO: 674849 - RNA, 19 nt, Homo sapiens
cauaagcgucccugauaua

SEQ ID NO: 674850 - RNA, 19 nt, Homo sapiens
gagguuucuuucuuucuuu

SEQ ID NO: 674851 - RNA, 19 nt, Homo sapiens
ugaagaaauuggccacaga

SEQ ID NO: 674852 - RNA, 19 nt, Homo sapiens
guuacaaggugaucaagug

SEQ ID NO: 674853 - RNA, 19 nt, Homo sapiens
ugugggaguuuauguaauu

SEQ ID NO: 674854 - RNA, 19 nt, Homo sapiens
caaugagucuaaacuggaa

SEQ ID NO: 674855 - RNA, 19 nt, Homo sapiens
gaucccaucucacacaaca

SEQ ID NO: 674856 - RNA, 19 nt, Homo sapiens
cagcuguggucuuaacgua

SEQ ID NO: 674857 - RNA, 19 nt, Homo sapiens
uguaagagccuuggaaauu

SEQ ID NO: 674858 - RNA, 19 nt, Homo sapiens
gaagaagaucgggaaguaa

SEQ ID NO: 674859 - RNA, 19 nt, Homo sapiens
ggccauuucuacaaccaua

SEQ ID NO: 674860 - RNA, 19 nt, Homo sapiens
gauauagcagcacacauuu

SEQ ID NO: 674861 - RNA, 19 nt, Homo sapiens
ugauauagcagcacacauu

SEQ ID NO: 674862 - RNA, 19 nt, Homo sapiens
guaagaagacaaagaguag

SEQ ID NO: 674863 - RNA, 19 nt, Homo sapiens
gcagaucuccaaaguguuc

SEQ ID NO: 674864 - RNA, 19 nt, Homo sapiens
ccuaagaaccugaucagaa

SEQ ID NO: 674865 - RNA, 19 nt, Homo sapiens
gaaggaucagugaauguaa

SEQ ID NO: 674866 - RNA, 19 nt, Homo sapiens
ggagcuggauguagaaguc

SEQ ID NO: 674867 - RNA, 19 nt, Homo sapiens
gagacaugcugaugcuuca

SEQ ID NO: 674868 - RNA, 19 nt, Homo sapiens
gaacuucucuugcaucuga

SEQ ID NO: 674869 - RNA, 19 nt, Homo sapiens
gagggaaggugaugacuua

SEQ ID NO: 674870 - RNA, 19 nt, Homo sapiens
gcaagaggauuucuggaua

SEQ ID NO: 674871 - RNA, 19 nt, Homo sapiens
ggaaaugucucaagaaaca

SEQ ID NO: 674872 - RNA, 19 nt, Homo sapiens
guaagagccuuggaaauua

SEQ ID NO: 674873 - RNA, 19 nt, Homo sapiens
ggaagaagaucgggaagua

SEQ ID NO: 674874 - RNA, 19 nt, Homo sapiens
gagaagauccuguguguuu

SEQ ID NO: 674875 - RNA, 19 nt, Homo sapiens
gagcagaucuccaaagugu

SEQ ID NO: 674876 - RNA, 19 nt, Homo sapiens
ggagaggcuuccuuuguua

SEQ ID NO: 674877 - RNA, 19 nt, Homo sapiens
gaacuucucuucugguaau

SEQ ID NO: 674878 - RNA, 19 nt, Homo sapiens
ggaaggaaaugucucaaga

SEQ ID NO: 674879 - RNA, 19 nt, Homo sapiens
gaugagauaugauuuccua

SEQ ID NO: 674880 - RNA, 19 nt, Homo sapiens
ggagaagaauuuccacaaa

SEQ ID NO: 674881 - RNA, 19 nt, Homo sapiens
ccaaguagcuggaauuaca

SEQ ID NO: 674882 - RNA, 19 nt, Homo sapiens
gagagagguuucuuucuuu

SEQ ID NO: 674883 - RNA, 19 nt, Homo sapiens
gaaccgccauugcccauaa

SEQ ID NO: 674884 - RNA, 19 nt, Homo sapiens
cuaagaaccugaucagaaa

SEQ ID NO: 674885 - RNA, 19 nt, Homo sapiens
ggaaggugaugacuuaaau

SEQ ID NO: 674886 - RNA, 19 nt, Homo sapiens
ccacaaagcaaacuacuaa

SEQ ID NO: 674887 - RNA, 19 nt, Homo sapiens
gaagaggguucuccagguu

SEQ ID NO: 674888 - RNA, 19 nt, Homo sapiens
ggaaacauuuagacacaaa

SEQ ID NO: 674889 - RNA, 19 nt, Homo sapiens
gcaacaaucugagccauga

SEQ ID NO: 674890 - RNA, 19 nt, Homo sapiens
gaugguacaugacuugauu

SEQ ID NO: 674891 - RNA, 19 nt, Homo sapiens
ccaccuaugugaucuuuaa

SEQ ID NO: 674892 - RNA, 19 nt, Homo sapiens
ggacuugggagaagaauuu

SEQ ID NO: 674893 - RNA, 19 nt, Homo sapiens
gcagaucgcagaccuguuu

SEQ ID NO: 674894 - RNA, 19 nt, Homo sapiens
ggaaggguucuuugaaaua

SEQ ID NO: 674895 - RNA, 19 nt, Homo sapiens
ugacuuagaucuuacugaa

SEQ ID NO: 674896 - RNA, 19 nt, Homo sapiens
cagaugagaugagauauga

SEQ ID NO: 674897 - RNA, 19 nt, Homo sapiens
guauuuagguugaaggaaa

SEQ ID NO: 674898 - RNA, 19 nt, Homo sapiens
cgagagagguuucuuucuu

SEQ ID NO: 674899 - RNA, 19 nt, Homo sapiens
uaagagccuuggaaauuaa

SEQ ID NO: 674900 - RNA, 19 nt, Homo sapiens
gggagaggcuuccuuuguu

SEQ ID NO: 674901 - RNA, 19 nt, Homo sapiens
caagaagucuguggaguug

SEQ ID NO: 674902 - RNA, 19 nt, Homo sapiens
agaaagcucugcccuauca

SEQ ID NO: 674903 - RNA, 19 nt, Homo sapiens
gaagcuaggcacuuucuuu

SEQ ID NO: 674904 - RNA, 19 nt, Homo sapiens
gagaagaauuuccacaaag

SEQ ID NO: 674905 - RNA, 19 nt, Homo sapiens
cagaggaguuugccuugua

SEQ ID NO: 674906 - RNA, 19 nt, Homo sapiens
ggaagaagacgaguucauu

SEQ ID NO: 674907 - RNA, 19 nt, Homo sapiens
gcaagggagccauacauuu

SEQ ID NO: 674908 - RNA, 19 nt, Homo sapiens
ugaaauagcagcaguugaa

SEQ ID NO: 674909 - RNA, 19 nt, Homo sapiens
gaaggguucuuugaaauag

SEQ ID NO: 674910 - RNA, 19 nt, Homo sapiens
ccauuuggguuguuuauau

SEQ ID NO: 674911 - RNA, 19 nt, Homo sapiens
caagaggauuucuggauau

SEQ ID NO: 674912 - RNA, 19 nt, Homo sapiens
ggucauuucucacguccua

SEQ ID NO: 674913 - RNA, 19 nt, Homo sapiens
ccaggaagcuaggcacuuu

SEQ ID NO: 674914 - RNA, 19 nt, Homo sapiens
ggaguugagugguuacuuc

SEQ ID NO: 674915 - RNA, 19 nt, Homo sapiens
gaagaagacgaguucauug

SEQ ID NO: 674916 - RNA, 19 nt, Homo sapiens
gaggauuucuggauauuag

SEQ ID NO: 674917 - RNA, 19 nt, Homo sapiens
cagagaagauccugugugu

SEQ ID NO: 674918 - RNA, 19 nt, Homo sapiens
gauaugauuuccuagagau

SEQ ID NO: 674919 - RNA, 19 nt, Homo sapiens
gaaauuggccacagaagag

SEQ ID NO: 674920 - RNA, 19 nt, Homo sapiens
gggaaauacugcaacaugu

SEQ ID NO: 674921 - RNA, 19 nt, Homo sapiens
gguaagaagacaaagagua

SEQ ID NO: 674922 - RNA, 19 nt, Homo sapiens
gcacagaacugggguaaga

SEQ ID NO: 674923 - RNA, 19 nt, Homo sapiens
gaggcuaccugcagauaug

SEQ ID NO: 674924 - RNA, 19 nt, Homo sapiens
gacaggagaucaccauaag

SEQ ID NO: 674925 - RNA, 19 nt, Homo sapiens
ucaggagagugaagaaauu

SEQ ID NO: 674926 - RNA, 19 nt, Homo sapiens
gaacgcagcccaucuucau

SEQ ID NO: 674927 - RNA, 19 nt, Homo sapiens
ccaggaaguuucagguuga

SEQ ID NO: 674928 - RNA, 19 nt, Homo sapiens
aaggaaaugucucaagaaa

SEQ ID NO: 674929 - RNA, 19 nt, Homo sapiens
gaugagaugagauaugauu

SEQ ID NO: 674930 - RNA, 19 nt, Homo sapiens
gcaaacuacuaaccacuag

SEQ ID NO: 674931 - RNA, 19 nt, Homo sapiens
gaaggaaaugucucaagaa

SEQ ID NO: 674932 - RNA, 19 nt, Homo sapiens
caaaauaacagccacauaa

SEQ ID NO: 674933 - RNA, 19 nt, Homo sapiens
gaagaaauuggccacagaa

SEQ ID NO: 674934 - RNA, 19 nt, Homo sapiens
acaguacucucuccuagaa

SEQ ID NO: 674935 - RNA, 19 nt, Homo sapiens
caagucuccuuccuccaua

SEQ ID NO: 674936 - RNA, 19 nt, Homo sapiens
cgacguggcccaguauaua

SEQ ID NO: 674937 - RNA, 19 nt, Homo sapiens
caaagugucaggagaguga

SEQ ID NO: 674938 - RNA, 19 nt, Homo sapiens
caacacacuuccacguaau

SEQ ID NO: 674939 - RNA, 19 nt, Homo sapiens
acaacacacuuccacguaa

SEQ ID NO: 674940 - RNA, 19 nt, Homo sapiens
ccugauacuuucacaugua

SEQ ID NO: 674941 - RNA, 19 nt, Homo sapiens
gccaagccaucauuugcua

SEQ ID NO: 674942 - RNA, 19 nt, Homo sapiens
gacagaggcuggaggagau

SEQ ID NO: 674943 - RNA, 19 nt, Homo sapiens
gaauucagcagaggaguuu

SEQ ID NO: 674944 - RNA, 19 nt, Homo sapiens
gagauaugauuuccuagag

SEQ ID NO: 674945 - RNA, 19 nt, Homo sapiens
cauaagcgucccugauaua

SEQ ID NO: 674946 - RNA, 19 nt, Homo sapiens
gagguuucuuucuuucuuu

SEQ ID NO: 674947 - RNA, 19 nt, Homo sapiens
ugaagaaauuggccacaga

SEQ ID NO: 674948 - RNA, 19 nt, Homo sapiens
guuacaaggugaucaagug

SEQ ID NO: 674949 - RNA, 19 nt, Homo sapiens
ugugggaguuuauguaauu

SEQ ID NO: 674950 - RNA, 19 nt, Homo sapiens
gaucccaucucacacaaca

SEQ ID NO: 674951 - RNA, 19 nt, Homo sapiens
cagcuguggucuuaacgua

SEQ ID NO: 674952 - RNA, 19 nt, Homo sapiens
uguaagagccuuggaaauu

SEQ ID NO: 674953 - RNA, 19 nt, Homo sapiens
gaagaagaucgggaaguaa

SEQ ID NO: 674954 - RNA, 19 nt, Homo sapiens
ggccauuucuacaaccaua

SEQ ID NO: 674955 - RNA, 19 nt, Homo sapiens
gauauagcagcacacauuu

SEQ ID NO: 674956 - RNA, 19 nt, Homo sapiens
ugauauagcagcacacauu

SEQ ID NO: 674957 - RNA, 19 nt, Homo sapiens
guaagaagacaaagaguag

SEQ ID NO: 674958 - RNA, 19 nt, Homo sapiens
gaugcaggaugacaacgaa

SEQ ID NO: 674959 - RNA, 19 nt, Homo sapiens
gcagaucuccaaaguguuc

SEQ ID NO: 674960 - RNA, 19 nt, Homo sapiens
ccuaagaaccugaucagaa

SEQ ID NO: 674961 - RNA, 19 nt, Homo sapiens
gaaggaucagugaauguaa

SEQ ID NO: 674962 - RNA, 19 nt, Homo sapiens
ggagcuggauguagaaguc

SEQ ID NO: 674963 - RNA, 19 nt, Homo sapiens
gagacaugcugaugcuuca

SEQ ID NO: 674964 - RNA, 19 nt, Homo sapiens
uagcagcaguugaaacaga

SEQ ID NO: 674965 - RNA, 19 nt, Homo sapiens
gaaauagcagcaguugaaa

SEQ ID NO: 674966 - RNA, 19 nt, Homo sapiens
ggaggaagaagacgaguuc

SEQ ID NO: 674967 - RNA, 19 nt, Homo sapiens
ugauguuucugguguguaa

SEQ ID NO: 674968 - RNA, 19 nt, Homo sapiens
gcagggagccuuucuauaa

SEQ ID NO: 674969 - RNA, 19 nt, Homo sapiens
gcaaagcuguauauacuaa

SEQ ID NO: 674970 - RNA, 19 nt, Homo sapiens
ggagaacuauuucagcaua

SEQ ID NO: 674971 - RNA, 19 nt, Homo sapiens
ccaaaugucugauuaaugu

SEQ ID NO: 674972 - RNA, 19 nt, Homo sapiens
gcaaugagguccagcuuug

SEQ ID NO: 674973 - RNA, 19 nt, Homo sapiens
gaguuaaaguccuauguua

SEQ ID NO: 674974 - RNA, 19 nt, Homo sapiens
cagcuugcauuaacaauua

SEQ ID NO: 674975 - RNA, 19 nt, Homo sapiens
cuacagagaugcauucaaa

SEQ ID NO: 674976 - RNA, 19 nt, Homo sapiens
gcacguugcuuuccuguga

SEQ ID NO: 674977 - RNA, 19 nt, Homo sapiens
caacugauuugcagcuaua

SEQ ID NO: 674978 - RNA, 19 nt, Homo sapiens
gaggagagguuucuguuga

SEQ ID NO: 674979 - RNA, 19 nt, Homo sapiens
gacaugcaaugaccaaaua

SEQ ID NO: 674980 - RNA, 19 nt, Homo sapiens
gaaguugcuuugccaguaa

SEQ ID NO: 674981 - RNA, 19 nt, Homo sapiens
gaaggcugguuucuuauga

SEQ ID NO: 674982 - RNA, 19 nt, Homo sapiens
ggauugcucuguacaaaga

SEQ ID NO: 674983 - RNA, 19 nt, Homo sapiens
gcaagggccugguccauuc

SEQ ID NO: 674984 - RNA, 19 nt, Homo sapiens
gaaaagaaguugcugaguu

SEQ ID NO: 674985 - RNA, 19 nt, Homo sapiens
uaacagauccuucccuaaa

SEQ ID NO: 674986 - RNA, 19 nt, Homo sapiens
cgaggcaucuggucgaaua

SEQ ID NO: 674987 - RNA, 19 nt, Homo sapiens
uaacagagcacuccuaugu

SEQ ID NO: 674988 - RNA, 19 nt, Homo sapiens
ugacugugcuguguauuua

SEQ ID NO: 674989 - RNA, 19 nt, Homo sapiens
gcagggagguuaagugaca

SEQ ID NO: 674990 - RNA, 19 nt, Homo sapiens
ggaucuugcucuggaauua

SEQ ID NO: 674991 - RNA, 19 nt, Homo sapiens
ggaauguacuggaugaugu

SEQ ID NO: 674992 - RNA, 19 nt, Homo sapiens
gaacuuugagagagacuua

SEQ ID NO: 674993 - RNA, 19 nt, Homo sapiens
ggagagguuucuguugaua

SEQ ID NO: 674994 - RNA, 19 nt, Homo sapiens
gagaaaucguggcaugaaa

SEQ ID NO: 674995 - RNA, 19 nt, Homo sapiens
ugacauuguuucuguguuu

SEQ ID NO: 674996 - RNA, 19 nt, Homo sapiens
gagagaagguuugggagaa

SEQ ID NO: 674997 - RNA, 19 nt, Homo sapiens
cguaaagucuugcaucuug

SEQ ID NO: 674998 - RNA, 19 nt, Homo sapiens
uaagaaguaucaaggcaaa

SEQ ID NO: 674999 - RNA, 19 nt, Homo sapiens
caugacaacugaugacuug

SEQ ID NO: 675000 - RNA, 19 nt, Homo sapiens
gaaauagccaaaugucuga

SEQ ID NO: 675001 - RNA, 19 nt, Homo sapiens
gccaagcaauauaagguua

SEQ ID NO: 675002 - RNA, 19 nt, Homo sapiens
gaauugccauuaacagugu

SEQ ID NO: 675003 - RNA, 19 nt, Homo sapiens
uaccagugaugacuucuua

SEQ ID NO: 675004 - RNA, 19 nt, Homo sapiens
cagcagcucucagaaguuu

SEQ ID NO: 675005 - RNA, 19 nt, Homo sapiens
gcaucuuucugaaguuuaa

SEQ ID NO: 675006 - RNA, 19 nt, Homo sapiens
uccauaagcugucaaagaa

SEQ ID NO: 675007 - RNA, 19 nt, Homo sapiens
gaccauauauaggaaugua

SEQ ID NO: 675008 - RNA, 19 nt, Homo sapiens
aauuagggcugcugugaua

SEQ ID NO: 675009 - RNA, 19 nt, Homo sapiens
ucacaaccuugcuauuaaa

SEQ ID NO: 675010 - RNA, 19 nt, Homo sapiens
cagaguaucucacaugaca

SEQ ID NO: 675011 - RNA, 19 nt, Homo sapiens
cgaugugccuuauuucaaa

SEQ ID NO: 675012 - RNA, 19 nt, Homo sapiens
cugcaaaucuuacguaauc

SEQ ID NO: 675013 - RNA, 19 nt, Homo sapiens
gcaaugaccaaauauuuca

SEQ ID NO: 675014 - RNA, 19 nt, Homo sapiens
gggaugccuuuguuaguaa

SEQ ID NO: 675015 - RNA, 19 nt, Homo sapiens
ucacaaagccuacagagau

SEQ ID NO: 675016 - RNA, 19 nt, Homo sapiens
aagcaaagcuguauauacu

SEQ ID NO: 675017 - RNA, 19 nt, Homo sapiens
caaggccucuucagaauag

SEQ ID NO: 675018 - RNA, 19 nt, Homo sapiens
guacagugacuucagagua

SEQ ID NO: 675019 - RNA, 19 nt, Homo sapiens
gauacaaccugugacauca

SEQ ID NO: 675020 - RNA, 19 nt, Homo sapiens
uaucgaagcuaguaagcaa

SEQ ID NO: 675021 - RNA, 19 nt, Homo sapiens
gagcauacaccgaauuuag

SEQ ID NO: 675022 - RNA, 19 nt, Homo sapiens
uaaggaaucugagcuguuc

SEQ ID NO: 675023 - RNA, 19 nt, Homo sapiens
gaggauuucuuucaaccuu

SEQ ID NO: 675024 - RNA, 19 nt, Homo sapiens
gggagccuuucuauaauuu

SEQ ID NO: 675025 - RNA, 19 nt, Homo sapiens
cagagacccuccuggauga

SEQ ID NO: 675026 - RNA, 19 nt, Homo sapiens
aaucacaaccuugcuauua

SEQ ID NO: 675027 - RNA, 19 nt, Homo sapiens
agaugaagcuacacaaaug

SEQ ID NO: 675028 - RNA, 19 nt, Homo sapiens
ugaaguugcuuugccagua

SEQ ID NO: 675029 - RNA, 19 nt, Homo sapiens
gaagcauucuugagaugga

SEQ ID NO: 675030 - RNA, 19 nt, Homo sapiens
acacugagcuugagauacu

SEQ ID NO: 675031 - RNA, 19 nt, Homo sapiens
caacacaggauuucuuuua

SEQ ID NO: 675032 - RNA, 19 nt, Homo sapiens
gggagaacuuugagagaga

SEQ ID NO: 675033 - RNA, 19 nt, Homo sapiens
agcaagagcugaucuacuu

SEQ ID NO: 675034 - RNA, 19 nt, Homo sapiens
ccaaauaugagacuauguu

SEQ ID NO: 675035 - RNA, 19 nt, Homo sapiens
aaagagagaguaccaguga

SEQ ID NO: 675036 - RNA, 19 nt, Homo sapiens
gaagcguggucuagaagau

SEQ ID NO: 675037 - RNA, 19 nt, Homo sapiens
aaaagagcaucaagaguua

SEQ ID NO: 675038 - RNA, 19 nt, Homo sapiens
cagcauagaggaacuguga

SEQ ID NO: 675039 - RNA, 19 nt, Homo sapiens
aaacuagcccugcuuagaa

SEQ ID NO: 675040 - RNA, 19 nt, Homo sapiens
guuagaggauuucuuucaa

SEQ ID NO: 675041 - RNA, 19 nt, Homo sapiens
ggagguuaagugacauuua

SEQ ID NO: 675042 - RNA, 19 nt, Homo sapiens
aaaagaaguugcugaguuu

SEQ ID NO: 675043 - RNA, 19 nt, Homo sapiens
gaacacacugcaaaucuca

SEQ ID NO: 675044 - RNA, 19 nt, Homo sapiens
acagagcacuccuauguca

SEQ ID NO: 675045 - RNA, 19 nt, Homo sapiens
acccuuaccuuaucuugua

SEQ ID NO: 675046 - RNA, 19 nt, Homo sapiens
gaaaucguggcaugaaaga

SEQ ID NO: 675047 - RNA, 19 nt, Homo sapiens
gcugguccauucagagaaa

SEQ ID NO: 675048 - RNA, 19 nt, Homo sapiens
caagguagaugaaguugcu

SEQ ID NO: 675049 - RNA, 19 nt, Homo sapiens
uaggaaacguaaagucuug

SEQ ID NO: 675050 - RNA, 19 nt, Homo sapiens
ggagaaaucguggcaugaa

SEQ ID NO: 675051 - RNA, 19 nt, Homo sapiens
caaacuagcccugcuuaga

SEQ ID NO: 675052 - RNA, 19 nt, Homo sapiens
gaacuauuucagcauauug

SEQ ID NO: 675053 - RNA, 19 nt, Homo sapiens
cacagugccugacacauug

SEQ ID NO: 675054 - RNA, 19 nt, Homo sapiens
ccaagacauucacaggaaa

SEQ ID NO: 675055 - RNA, 19 nt, Homo sapiens
ggaacacacugcaaaucuc

SEQ ID NO: 675056 - RNA, 19 nt, Homo sapiens
uuaccagaauugccauuaa

SEQ ID NO: 675057 - RNA, 19 nt, Homo sapiens
gauauugucagcuugcauu

SEQ ID NO: 675058 - RNA, 19 nt, Homo sapiens
gagaacuauuucagcauau

SEQ ID NO: 675059 - RNA, 19 nt, Homo sapiens
gaacaccugaugacagaga

SEQ ID NO: 675060 - RNA, 19 nt, Homo sapiens
cauaagcugucaaagaagu

SEQ ID NO: 675061 - RNA, 19 nt, Homo sapiens
ggacaagaaggcagaagga

SEQ ID NO: 675062 - RNA, 19 nt, Homo sapiens
caguauaacccaagacauu

SEQ ID NO: 675063 - RNA, 19 nt, Homo sapiens
caaaagagcaucaagaguu

SEQ ID NO: 675064 - RNA, 19 nt, Homo sapiens
aauauauacuugccucuga

SEQ ID NO: 675065 - RNA, 19 nt, Homo sapiens
uacagugacuucagaguau

SEQ ID NO: 675066 - RNA, 19 nt, Homo sapiens
gcccugaaauagccaaaug

SEQ ID NO: 675067 - RNA, 19 nt, Homo sapiens
gccaaagcguguucaggaa

SEQ ID NO: 675068 - RNA, 19 nt, Homo sapiens
gacagaagcugcaguuuga

SEQ ID NO: 675069 - RNA, 19 nt, Homo sapiens
ggacggagcugacaucuac

SEQ ID NO: 675070 - RNA, 19 nt, Homo sapiens
ucacugcccuggacaauga

SEQ ID NO: 675071 - RNA, 19 nt, Homo sapiens
aaacuaagcugggcaugaa

SEQ ID NO: 675072 - RNA, 19 nt, Homo sapiens
gaaugaauguagacugguu

SEQ ID NO: 675073 - RNA, 19 nt, Homo sapiens
gaaaugagccuuuuaggaa

SEQ ID NO: 675074 - RNA, 19 nt, Homo sapiens
caugaacucucccuucuga

SEQ ID NO: 675075 - RNA, 19 nt, Homo sapiens
uaaagaucaugcaagagua

SEQ ID NO: 675076 - RNA, 19 nt, Homo sapiens
gaccaugugugagaugaua

SEQ ID NO: 675077 - RNA, 19 nt, Homo sapiens
gaauguagacugguuugua

SEQ ID NO: 675078 - RNA, 19 nt, Homo sapiens
gggacacucuugaauguau

SEQ ID NO: 675079 - RNA, 19 nt, Homo sapiens
gcuaaguucucagaggaua

SEQ ID NO: 675080 - RNA, 19 nt, Homo sapiens
ggaaggagguguggagaag

SEQ ID NO: 675081 - RNA, 19 nt, Homo sapiens
gaagaagagcccagcaaga

SEQ ID NO: 675082 - RNA, 19 nt, Homo sapiens
gcuaaagccagacccauuu

SEQ ID NO: 675083 - RNA, 19 nt, Homo sapiens
ccaagaagacccagcacua

SEQ ID NO: 675084 - RNA, 19 nt, Homo sapiens
ccauggaccugaaggagaa

SEQ ID NO: 675085 - RNA, 19 nt, Homo sapiens
ccaaugagaucgugaagcu

SEQ ID NO: 675086 - RNA, 19 nt, Homo sapiens
aaggagacaucauagcuuu

SEQ ID NO: 675087 - RNA, 19 nt, Homo sapiens
guagacugguuuguauuaa

SEQ ID NO: 675088 - RNA, 19 nt, Homo sapiens
gaguuuguaucaugaaugu

SEQ ID NO: 675089 - RNA, 19 nt, Homo sapiens
cagaggacuuuguguguga

SEQ ID NO: 675090 - RNA, 19 nt, Homo sapiens
gaacaacacccugcaccuu

SEQ ID NO: 675091 - RNA, 19 nt, Homo sapiens
agaagugucugacguggaa

SEQ ID NO: 675092 - RNA, 19 nt, Homo sapiens
gaaacuaagcugggcauga

SEQ ID NO: 675093 - RNA, 19 nt, Homo sapiens
gcaccucaccucccucaaa

SEQ ID NO: 675094 - RNA, 19 nt, Homo sapiens
gggaggugcuggagaagga

SEQ ID NO: 675095 - RNA, 19 nt, Homo sapiens
gaucagccucuucauuaaa

SEQ ID NO: 675096 - RNA, 19 nt, Homo sapiens
gaccaccugugcaacauug

SEQ ID NO: 675097 - RNA, 19 nt, Homo sapiens
cagggacacucuugaaugu

SEQ ID NO: 675098 - RNA, 19 nt, Homo sapiens
cgacagaagcugcaguuug

SEQ ID NO: 675099 - RNA, 19 nt, Homo sapiens
ggacaucgugcgccucauu

SEQ ID NO: 675100 - RNA, 19 nt, Homo sapiens
ugaucagccucuucauuaa

SEQ ID NO: 675101 - RNA, 19 nt, Homo sapiens
caacugcuccuccgucaug

SEQ ID NO: 675102 - RNA, 19 nt, Homo sapiens
gaggagaccaucagcauca

SEQ ID NO: 675103 - RNA, 19 nt, Homo sapiens
ggagacaucauagcuuuga

SEQ ID NO: 675104 - RNA, 19 nt, Homo sapiens
gaaggagacaucauagcuu

SEQ ID NO: 675105 - RNA, 19 nt, Homo sapiens
ggacugcugucggcucaga

SEQ ID NO: 675106 - RNA, 19 nt, Homo sapiens
gggcaugccugcaguacuc

SEQ ID NO: 675107 - RNA, 19 nt, Homo sapiens
gcccugcgcuucaucuuca

SEQ ID NO: 675108 - RNA, 19 nt, Homo sapiens
aauguagacugguuuguau

SEQ ID NO: 675109 - RNA, 19 nt, Homo sapiens
caugaauguuuccagguuu

SEQ ID NO: 675110 - RNA, 19 nt, Homo sapiens
ucaugaauguuuccagguu

SEQ ID NO: 675111 - RNA, 19 nt, Homo sapiens
ugugugagaugauaaagau

SEQ ID NO: 675112 - RNA, 19 nt, Homo sapiens
ccagagaccaugugugaga

SEQ ID NO: 675113 - RNA, 19 nt, Homo sapiens
gauacucucagcagcuaua

SEQ ID NO: 675114 - RNA, 19 nt, Homo sapiens
gaucauugaccaaauccaa

SEQ ID NO: 675115 - RNA, 19 nt, Homo sapiens
cuacgaagcagaggacuuu

SEQ ID NO: 675116 - RNA, 19 nt, Homo sapiens
gguugaaggagacaucaua

SEQ ID NO: 675117 - RNA, 19 nt, Homo sapiens
gagaccaugugugagauga

SEQ ID NO: 675118 - RNA, 19 nt, Homo sapiens
ccgcugauguggucuuaga

SEQ ID NO: 675119 - RNA, 19 nt, Homo sapiens
agaaccaucuggcgcugua

SEQ ID NO: 675120 - RNA, 19 nt, Homo sapiens
ggacacucuugaauguaug

SEQ ID NO: 675121 - RNA, 19 nt, Homo sapiens
cagaagggcuccuccucau

SEQ ID NO: 675122 - RNA, 19 nt, Homo sapiens
uguagacugguuuguauua

SEQ ID NO: 675123 - RNA, 19 nt, Homo sapiens
ggcaugaacucucccuucu

SEQ ID NO: 675124 - RNA, 19 nt, Homo sapiens
ggccaaagcagcaucuuca

SEQ ID NO: 675125 - RNA, 19 nt, Homo sapiens
ccaaaucccagcccagaga

SEQ ID NO: 675126 - RNA, 19 nt, Homo sapiens
gcuccugccucaucugcuu

SEQ ID NO: 675127 - RNA, 19 nt, Homo sapiens
gcccagagacuguacuguu

SEQ ID NO: 675128 - RNA, 19 nt, Homo sapiens
gcucccugcuggcuaaguu

SEQ ID NO: 675129 - RNA, 19 nt, Homo sapiens
ggccaggaaucguuugcuu

SEQ ID NO: 675130 - RNA, 19 nt, Homo sapiens
gcugaagcgucgggaggua

SEQ ID NO: 675131 - RNA, 19 nt, Homo sapiens
gagggaucauugaccaaau

SEQ ID NO: 675132 - RNA, 19 nt, Homo sapiens
gucccgagaugaugcagaa

SEQ ID NO: 675133 - RNA, 19 nt, Homo sapiens
gcugacaucuacccucucu

SEQ ID NO: 675134 - RNA, 19 nt, Homo sapiens
aaucaggugucccgagaug

SEQ ID NO: 675135 - RNA, 19 nt, Homo sapiens
gcucugccuucgccuacaa

SEQ ID NO: 675136 - RNA, 19 nt, Homo sapiens
gagcggaagaagugucuga

SEQ ID NO: 675137 - RNA, 19 nt, Homo sapiens
ucagggagcggaagaagug

SEQ ID NO: 675138 - RNA, 19 nt, Homo sapiens
gccugaaccugaagaugga

SEQ ID NO: 675139 - RNA, 19 nt, Homo sapiens
ccugcacacugucuucauu

SEQ ID NO: 675140 - RNA, 19 nt, Homo sapiens
ccagggacacucuugaaug

SEQ ID NO: 675141 - RNA, 19 nt, Homo sapiens
acucggaccucaucagcuu

SEQ ID NO: 675142 - RNA, 19 nt, Homo sapiens
cccagagacuguacuguuc

SEQ ID NO: 675143 - RNA, 19 nt, Homo sapiens
acaaugagcgguucacagu

SEQ ID NO: 675144 - RNA, 19 nt, Homo sapiens
cagaagcugcaguuugaaa

SEQ ID NO: 675145 - RNA, 19 nt, Homo sapiens
cuacuucucuuuggaggau

SEQ ID NO: 675146 - RNA, 19 nt, Homo sapiens
ggaaaugagccuuuuagga

SEQ ID NO: 675147 - RNA, 19 nt, Homo sapiens
ccaccuauggcauccguaa

SEQ ID NO: 675148 - RNA, 19 nt, Homo sapiens
acaacacccugcaccuuuc

SEQ ID NO: 675149 - RNA, 19 nt, Homo sapiens
gggaguuuguaucaugaau

SEQ ID NO: 675150 - RNA, 19 nt, Homo sapiens
caucagcuccugccucauc

SEQ ID NO: 675151 - RNA, 19 nt, Homo sapiens
ccagagcgacaucagcauu

SEQ ID NO: 675152 - RNA, 19 nt, Homo sapiens
gaaagagccccuugaccaa

SEQ ID NO: 675153 - RNA, 19 nt, Homo sapiens
caucagcauugcccuggau

SEQ ID NO: 675154 - RNA, 19 nt, Homo sapiens
auaaagaucaugcaagagu

SEQ ID NO: 675155 - RNA, 19 nt, Homo sapiens
ccuccugcauccaguuuga

SEQ ID NO: 675156 - RNA, 19 nt, Homo sapiens
cccugcaccuuuccaauga

SEQ ID NO: 675157 - RNA, 19 nt, Homo sapiens
ucauuuccaucacccaugu

SEQ ID NO: 675158 - RNA, 19 nt, Homo sapiens
ucauccaguuccuuucuug

SEQ ID NO: 675159 - RNA, 19 nt, Homo sapiens
gugaaugccucggccuugu

SEQ ID NO: 675160 - RNA, 19 nt, Homo sapiens
ucaaugugcugcugaaccu

SEQ ID NO: 675161 - RNA, 19 nt, Homo sapiens
cagagacuguacuguucuu

SEQ ID NO: 675162 - RNA, 19 nt, Homo sapiens
ccccauagcuccaucaugu

SEQ ID NO: 675163 - RNA, 19 nt, Homo sapiens
caccgcugauguggucuua

SEQ ID NO: 675164 - RNA, 19 nt, Homo sapiens
aacaacacccugcaccuuu

SEQ ID NO: 675165 - RNA, 19 nt, Homo sapiens
ggaguuuguaucaugaaug

SEQ ID NO: 675166 - RNA, 19 nt, Homo sapiens
caucugcuuuggcuucaca

SEQ ID NO: 675167 - RNA, 19 nt, Homo sapiens
caagaagacccagcacuac

SEQ ID NO: 675168 - RNA, 19 nt, Homo sapiens
gaagguagcucuaugguuu

SEQ ID NO: 675169 - RNA, 19 nt, Homo sapiens
ggaaguauguauugcauua

SEQ ID NO: 675170 - RNA, 19 nt, Homo sapiens
ggaaauaccugccaaagga

SEQ ID NO: 675171 - RNA, 19 nt, Homo sapiens
ggaaagagaagaagaauuu

SEQ ID NO: 675172 - RNA, 19 nt, Homo sapiens
ggaaauaacucacugauac

SEQ ID NO: 675173 - RNA, 19 nt, Homo sapiens
ccaaacaacucaaauacua

SEQ ID NO: 675174 - RNA, 19 nt, Homo sapiens
ggaaugggauccagaauau

SEQ ID NO: 675175 - RNA, 19 nt, Homo sapiens
gcaaaucuccuguuucuaa

SEQ ID NO: 675176 - RNA, 19 nt, Homo sapiens
uaaagagacuggauaugua

SEQ ID NO: 675177 - RNA, 19 nt, Homo sapiens
guauugcucuuucaucuua

SEQ ID NO: 675178 - RNA, 19 nt, Homo sapiens
uaaauggacucaugacaaa

SEQ ID NO: 675179 - RNA, 19 nt, Homo sapiens
gaacauugguuaagaacug

SEQ ID NO: 675180 - RNA, 19 nt, Homo sapiens
gcacaaagaagaagacaaa

SEQ ID NO: 675181 - RNA, 19 nt, Homo sapiens
gaaauacacaggagaauug

SEQ ID NO: 675182 - RNA, 19 nt, Homo sapiens
ggaaauggaucuagucgau

SEQ ID NO: 675183 - RNA, 19 nt, Homo sapiens
caucuuaacuccacgcuuu

SEQ ID NO: 675184 - RNA, 19 nt, Homo sapiens
gcuaaacgauucuuacuca

SEQ ID NO: 675185 - RNA, 19 nt, Homo sapiens
gcuaaugcuuauucuguua

SEQ ID NO: 675186 - RNA, 19 nt, Homo sapiens
ggucuauccugcagaauaa

SEQ ID NO: 675187 - RNA, 19 nt, Homo sapiens
gaaagaagcgauacaguuc

SEQ ID NO: 675188 - RNA, 19 nt, Homo sapiens
guagauggcuaaacgauuc

SEQ ID NO: 675189 - RNA, 19 nt, Homo sapiens
gaacuugcacccaccauuu

SEQ ID NO: 675190 - RNA, 19 nt, Homo sapiens
gaacauaguacucggcaaa

SEQ ID NO: 675191 - RNA, 19 nt, Homo sapiens
gaaagccacugaagaacau

SEQ ID NO: 675192 - RNA, 19 nt, Homo sapiens
gagaugaugguguggauua

SEQ ID NO: 675193 - RNA, 19 nt, Homo sapiens
uagagaaagugauggauuu

SEQ ID NO: 675194 - RNA, 19 nt, Homo sapiens
gaaaggcaauagagaaagu

SEQ ID NO: 675195 - RNA, 19 nt, Homo sapiens
aacguuagcucuacauaua

SEQ ID NO: 675196 - RNA, 19 nt, Homo sapiens
gaggaaagcccacuuagga

SEQ ID NO: 675197 - RNA, 19 nt, Homo sapiens
cuagauuacuucagugaua

SEQ ID NO: 675198 - RNA, 19 nt, Homo sapiens
gaugaagagucuagaguau

SEQ ID NO: 675199 - RNA, 19 nt, Homo sapiens
ggaaugagacgaccuuaug

SEQ ID NO: 675200 - RNA, 19 nt, Homo sapiens
gaacaugacccaucugagu

SEQ ID NO: 675201 - RNA, 19 nt, Homo sapiens
ggucuuagauauuagcuau

SEQ ID NO: 675202 - RNA, 19 nt, Homo sapiens
gucauggucuuagauauua

SEQ ID NO: 675203 - RNA, 19 nt, Homo sapiens
gaaguaaacguuagcucua

SEQ ID NO: 675204 - RNA, 19 nt, Homo sapiens
gaggaagcauacccguuua

SEQ ID NO: 675205 - RNA, 19 nt, Homo sapiens
gaacauuaguuuguagugu

SEQ ID NO: 675206 - RNA, 19 nt, Homo sapiens
gcaaguagucuauagaaau

SEQ ID NO: 675207 - RNA, 19 nt, Homo sapiens
gaaggaaagagaagaagaa

SEQ ID NO: 675208 - RNA, 19 nt, Homo sapiens
guagagaucguauguauuc

SEQ ID NO: 675209 - RNA, 19 nt, Homo sapiens
gaaaugggucgcuccaauu

SEQ ID NO: 675210 - RNA, 19 nt, Homo sapiens
aaucagggcauaacuaaua

SEQ ID NO: 675211 - RNA, 19 nt, Homo sapiens
guagacacauuucauuugu

SEQ ID NO: 675212 - RNA, 19 nt, Homo sapiens
uaagcuaguuuaacacuug

SEQ ID NO: 675213 - RNA, 19 nt, Homo sapiens
gaauguagauggcuaaacg

SEQ ID NO: 675214 - RNA, 19 nt, Homo sapiens
ccucagauccuuaguauug

SEQ ID NO: 675215 - RNA, 19 nt, Homo sapiens
agaaggccaugacucuuua

SEQ ID NO: 675216 - RNA, 19 nt, Homo sapiens
gggaugggauuguugaaga

SEQ ID NO: 675217 - RNA, 19 nt, Homo sapiens
gaauuccgauccaucuuug

SEQ ID NO: 675218 - RNA, 19 nt, Homo sapiens
ucaggaagcucuagauuac

SEQ ID NO: 675219 - RNA, 19 nt, Homo sapiens
caagaucucauucuagaaa

SEQ ID NO: 675220 - RNA, 19 nt, Homo sapiens
aaagcaaacucaacauaug

SEQ ID NO: 675221 - RNA, 19 nt, Homo sapiens
gaagaggucgugguacuuu

SEQ ID NO: 675222 - RNA, 19 nt, Homo sapiens
ggaaaggccuagcacuaca

SEQ ID NO: 675223 - RNA, 19 nt, Homo sapiens
ugaagagucuagaguauuc

SEQ ID NO: 675224 - RNA, 19 nt, Homo sapiens
caaaucuccuguuucuaaa

SEQ ID NO: 675225 - RNA, 19 nt, Homo sapiens
ucagugugauguauaauga

SEQ ID NO: 675226 - RNA, 19 nt, Homo sapiens
ggaggucuauccugcagaa

SEQ ID NO: 675227 - RNA, 19 nt, Homo sapiens
gaaucuggaugcacgagaa

SEQ ID NO: 675228 - RNA, 19 nt, Homo sapiens
uagcaaaucuccuguuucu

SEQ ID NO: 675229 - RNA, 19 nt, Homo sapiens
uauagcaaaucuccuguuu

SEQ ID NO: 675230 - RNA, 19 nt, Homo sapiens
ggauuaagaaagcuguuua

SEQ ID NO: 675231 - RNA, 19 nt, Homo sapiens
guuaagaacuguuggaaac

SEQ ID NO: 675232 - RNA, 19 nt, Homo sapiens
uaaacacuuucgaggauuu

SEQ ID NO: 675233 - RNA, 19 nt, Homo sapiens
gcagagggcgcuuuaacuu

SEQ ID NO: 675234 - RNA, 19 nt, Homo sapiens
cagaggagacagaggauua

SEQ ID NO: 675235 - RNA, 19 nt, Homo sapiens
uaguagagaucguauguau

SEQ ID NO: 675236 - RNA, 19 nt, Homo sapiens
gagaaauaguagacuguau

SEQ ID NO: 675237 - RNA, 19 nt, Homo sapiens
caacagagcagaacuugca

SEQ ID NO: 675238 - RNA, 19 nt, Homo sapiens
uguaagaacucuguaauag

SEQ ID NO: 675239 - RNA, 19 nt, Homo sapiens
gugcaugacuaugugcuua

SEQ ID NO: 675240 - RNA, 19 nt, Homo sapiens
guucaaaugcauugcuuua

SEQ ID NO: 675241 - RNA, 19 nt, Homo sapiens
gggcauaacuaauauucuc

SEQ ID NO: 675242 - RNA, 19 nt, Homo sapiens
cuacugaacauccuaguuu

SEQ ID NO: 675243 - RNA, 19 nt, Homo sapiens
gaagagaccauggaaaaua

SEQ ID NO: 675244 - RNA, 19 nt, Homo sapiens
agaaagugauggauuuaga

SEQ ID NO: 675245 - RNA, 19 nt, Homo sapiens
gagaaaggaucagagaaag

SEQ ID NO: 675246 - RNA, 19 nt, Homo sapiens
gaucguauguauucuagag

SEQ ID NO: 675247 - RNA, 19 nt, Homo sapiens
gguuagacaucaaaucugu

SEQ ID NO: 675248 - RNA, 19 nt, Homo sapiens
ccaaaggaaguauguauug

SEQ ID NO: 675249 - RNA, 19 nt, Homo sapiens
gagcugaacauuaguuugu

SEQ ID NO: 675250 - RNA, 19 nt, Homo sapiens
uauuugagcugaacauuag

SEQ ID NO: 675251 - RNA, 19 nt, Homo sapiens
uauaaauccuggaacagaa

SEQ ID NO: 675252 - RNA, 19 nt, Homo sapiens
gcaaaagagcccugaaaua

SEQ ID NO: 675253 - RNA, 19 nt, Homo sapiens
ggagacagaggauuauaga

SEQ ID NO: 675254 - RNA, 19 nt, Homo sapiens
ccacuuaagacaauaggua

SEQ ID NO: 675255 - RNA, 19 nt, Homo sapiens
gcccucagauccuuaguau

SEQ ID NO: 675256 - RNA, 19 nt, Homo sapiens
gagcuaaugcuuauucugu

SEQ ID NO: 675257 - RNA, 19 nt, Homo sapiens
gaagaagagaccauggaaa

SEQ ID NO: 675258 - RNA, 19 nt, Homo sapiens
gguccaaacaacucaaaua

SEQ ID NO: 675259 - RNA, 19 nt, Homo sapiens
caaaagcacuucagaguca

SEQ ID NO: 675260 - RNA, 19 nt, Homo sapiens
caagaaggagcaagaauuc

SEQ ID NO: 675261 - RNA, 19 nt, Homo sapiens
guaguaggcuagggugauu

SEQ ID NO: 675262 - RNA, 19 nt, Homo sapiens
ccaggaacauugguuaaga

SEQ ID NO: 675263 - RNA, 19 nt, Homo sapiens
gaagaucuuaaguguauug

SEQ ID NO: 675264 - RNA, 19 nt, Homo sapiens
auugauagcucuuaaagga

SEQ ID NO: 675265 - RNA, 19 nt, Homo sapiens
gaaguauaccacagacaaa

SEQ ID NO: 675266 - RNA, 19 nt, Homo sapiens
gaaauaguagacuguaugu

SEQ ID NO: 675267 - RNA, 19 nt, Homo sapiens
guacaaguccaaaguuuca

SEQ ID NO: 675268 - RNA, 19 nt, Homo sapiens
gaaaggaccuggacaaguu

SEQ ID NO: 675269 - RNA, 19 nt, Homo sapiens
gaaauauggugucuugaaa

SEQ ID NO: 675270 - RNA, 19 nt, Homo sapiens
ggaaugagcccuagacuga

SEQ ID NO: 675271 - RNA, 19 nt, Homo sapiens
ugaggacacuggaguaaua

SEQ ID NO: 675272 - RNA, 19 nt, Homo sapiens
gaaacaagggcaugaauau

SEQ ID NO: 675273 - RNA, 19 nt, Homo sapiens
ggaaaggccuagccauugu

SEQ ID NO: 675274 - RNA, 19 nt, Homo sapiens
ggaaacaagggcaugaaua

SEQ ID NO: 675275 - RNA, 19 nt, Homo sapiens
ccucagaccugccaugaaa

SEQ ID NO: 675276 - RNA, 19 nt, Homo sapiens
auacaaggcugacuucuga

SEQ ID NO: 675277 - RNA, 19 nt, Homo sapiens
gaaguaaagcaacuguuaa

SEQ ID NO: 675278 - RNA, 19 nt, Homo sapiens
ucaaggagaucuaggucua

SEQ ID NO: 675279 - RNA, 19 nt, Homo sapiens
ggaaauauggugucuugaa

SEQ ID NO: 675280 - RNA, 19 nt, Homo sapiens
gcaaaguucucuuccucuu

SEQ ID NO: 675281 - RNA, 19 nt, Homo sapiens
ccauggagcuggaaauaug

SEQ ID NO: 675282 - RNA, 19 nt, Homo sapiens
caugaugacuuuguuauga

SEQ ID NO: 675283 - RNA, 19 nt, Homo sapiens
ugacuuaacccuucaggua

SEQ ID NO: 675284 - RNA, 19 nt, Homo sapiens
guccauggcugaagacuug

SEQ ID NO: 675285 - RNA, 19 nt, Homo sapiens
guagaagacucucaagaag

SEQ ID NO: 675286 - RNA, 19 nt, Homo sapiens
gaaaagauuugcacucguu

SEQ ID NO: 675287 - RNA, 19 nt, Homo sapiens
caauacccaugaugacuuu

SEQ ID NO: 675288 - RNA, 19 nt, Homo sapiens
caaccuacuuuguuuggaa

SEQ ID NO: 675289 - RNA, 19 nt, Homo sapiens
gaagaauguccgcgaguuu

SEQ ID NO: 675290 - RNA, 19 nt, Homo sapiens
ucccuuagcucucuucauu

SEQ ID NO: 675291 - RNA, 19 nt, Homo sapiens
gaccuggacaaguuuauua

SEQ ID NO: 675292 - RNA, 19 nt, Homo sapiens
agaaguaaagcaacuguua

SEQ ID NO: 675293 - RNA, 19 nt, Homo sapiens
gcugcuggcuuaaaugcua

SEQ ID NO: 675294 - RNA, 19 nt, Homo sapiens
gauauacccuuugccaugu

SEQ ID NO: 675295 - RNA, 19 nt, Homo sapiens
agaagacucucaagaagug

SEQ ID NO: 675296 - RNA, 19 nt, Homo sapiens
uucaagggauuuccaauaa

SEQ ID NO: 675297 - RNA, 19 nt, Homo sapiens
gaucagcugaccuggcuua

SEQ ID NO: 675298 - RNA, 19 nt, Homo sapiens
gcucucgccuuuccuauca

SEQ ID NO: 675299 - RNA, 19 nt, Homo sapiens
ccuauaggcucuccaggaa

SEQ ID NO: 675300 - RNA, 19 nt, Homo sapiens
guggagauuucacuuaaga

SEQ ID NO: 675301 - RNA, 19 nt, Homo sapiens
guguggagauuucacuuaa

SEQ ID NO: 675302 - RNA, 19 nt, Homo sapiens
ucccagagguuacacauga

SEQ ID NO: 675303 - RNA, 19 nt, Homo sapiens
gauuugcacucguucauca

SEQ ID NO: 675304 - RNA, 19 nt, Homo sapiens
ucaagggauuuccaauaaa

SEQ ID NO: 675305 - RNA, 19 nt, Homo sapiens
gaguuuggauauacccuuu

SEQ ID NO: 675306 - RNA, 19 nt, Homo sapiens
ugaagagucucagccauga

SEQ ID NO: 675307 - RNA, 19 nt, Homo sapiens
ucagagaaaccagauauuu

SEQ ID NO: 675308 - RNA, 19 nt, Homo sapiens
ccucaagacuguccaagug

SEQ ID NO: 675309 - RNA, 19 nt, Homo sapiens
uauaggcaauggaaacuga

SEQ ID NO: 675310 - RNA, 19 nt, Homo sapiens
gcagauuccuauaggcaau

SEQ ID NO: 675311 - RNA, 19 nt, Homo sapiens
uggauuggcuucugguuga

SEQ ID NO: 675312 - RNA, 19 nt, Homo sapiens
ccagaagucccuacucuug

SEQ ID NO: 675313 - RNA, 19 nt, Homo sapiens
gagcuacacuucaaaaugu

SEQ ID NO: 675314 - RNA, 19 nt, Homo sapiens
ucuccaaccuacuuuguuu

SEQ ID NO: 675315 - RNA, 19 nt, Homo sapiens
uauggugucuugaaaugaa

SEQ ID NO: 675316 - RNA, 19 nt, Homo sapiens
aauggaaacugaucucaau

SEQ ID NO: 675317 - RNA, 19 nt, Homo sapiens
aaucaaagcugggcguaug

SEQ ID NO: 675318 - RNA, 19 nt, Homo sapiens
caaagucaccucccagugu

SEQ ID NO: 675319 - RNA, 19 nt, Homo sapiens
aaaguucucuuccucuugu

SEQ ID NO: 675320 - RNA, 19 nt, Homo sapiens
gaaagaggaaggagacagu

SEQ ID NO: 675321 - RNA, 19 nt, Homo sapiens
gaccuucuaucgggaguuu

SEQ ID NO: 675322 - RNA, 19 nt, Homo sapiens
gcaauacccaugaugacuu

SEQ ID NO: 675323 - RNA, 19 nt, Homo sapiens
aaagacaucccagagguua

SEQ ID NO: 675324 - RNA, 19 nt, Homo sapiens
gugacacuguucccacaua

SEQ ID NO: 675325 - RNA, 19 nt, Homo sapiens
uaauauacccgucuguaga

SEQ ID NO: 675326 - RNA, 19 nt, Homo sapiens
gcagcaaucuuuggcaucu

SEQ ID NO: 675327 - RNA, 19 nt, Homo sapiens
cuucagguauuguuacuug

SEQ ID NO: 675328 - RNA, 19 nt, Homo sapiens
gcacuggaacugacuaaag

SEQ ID NO: 675329 - RNA, 19 nt, Homo sapiens
gaucagaacuccaaaacca

SEQ ID NO: 675330 - RNA, 19 nt, Homo sapiens
caccaucacucuuucuugu

SEQ ID NO: 675331 - RNA, 19 nt, Homo sapiens
aauauggugucuugaaaug

SEQ ID NO: 675332 - RNA, 19 nt, Homo sapiens
gaaauaccgagcuacacuu

SEQ ID NO: 675333 - RNA, 19 nt, Homo sapiens
guuaguauacugcauguga

SEQ ID NO: 675334 - RNA, 19 nt, Homo sapiens
cuggaaauauggugucuug

SEQ ID NO: 675335 - RNA, 19 nt, Homo sapiens
ccaagggugucauccuguu

SEQ ID NO: 675336 - RNA, 19 nt, Homo sapiens
gaucuaggucuacuccauu

SEQ ID NO: 675337 - RNA, 19 nt, Homo sapiens
acagcgagauccaagaaga

SEQ ID NO: 675338 - RNA, 19 nt, Homo sapiens
gaucuucccaccauacaga

SEQ ID NO: 675339 - RNA, 19 nt, Homo sapiens
cugaagacuuggacucauu

SEQ ID NO: 675340 - RNA, 19 nt, Homo sapiens
cauguuugcucccaagaau

SEQ ID NO: 675341 - RNA, 19 nt, Homo sapiens
agauuucacuuaagacuuc

SEQ ID NO: 675342 - RNA, 19 nt, Homo sapiens
caacuuagcaaucaaagac

SEQ ID NO: 675343 - RNA, 19 nt, Homo sapiens
ggaaauaccgagcuacacu

SEQ ID NO: 675344 - RNA, 19 nt, Homo sapiens
ccaacugccuggguacuug

SEQ ID NO: 675345 - RNA, 19 nt, Homo sapiens
guggaaacccugcaguaaa

SEQ ID NO: 675346 - RNA, 19 nt, Homo sapiens
gaagcuggcugugcaugag

SEQ ID NO: 675347 - RNA, 19 nt, Homo sapiens
uguagaagacucucaagaa

SEQ ID NO: 675348 - RNA, 19 nt, Homo sapiens
caacuggcccuccugacuu

SEQ ID NO: 675349 - RNA, 19 nt, Homo sapiens
caagaaguguuagcagaag

SEQ ID NO: 675350 - RNA, 19 nt, Homo sapiens
ccaagaaguguuagcagaa

SEQ ID NO: 675351 - RNA, 19 nt, Homo sapiens
gcuaccaucucccucuaau

SEQ ID NO: 675352 - RNA, 19 nt, Homo sapiens
cacaguuucugcagaguga

SEQ ID NO: 675353 - RNA, 19 nt, Homo sapiens
gguuauagaacaugguaaa

SEQ ID NO: 675354 - RNA, 19 nt, Homo sapiens
ugaagacuuggacucauua

SEQ ID NO: 675355 - RNA, 19 nt, Homo sapiens
aguguuugcugcuggcuua

SEQ ID NO: 675356 - RNA, 19 nt, Homo sapiens
uaacuuggcauucaugucu

SEQ ID NO: 675357 - RNA, 19 nt, Homo sapiens
ucaauucccaggacagaaa

SEQ ID NO: 675358 - RNA, 19 nt, Homo sapiens
cagcugaccuggcuuaucc

SEQ ID NO: 675359 - RNA, 19 nt, Homo sapiens
ucagauugguucaacuuag

SEQ ID NO: 675360 - RNA, 19 nt, Homo sapiens
gaccugccaugaaaggaau

SEQ ID NO: 675361 - RNA, 19 nt, Homo sapiens
ggcuuuaccuuggauaguu

SEQ ID NO: 675362 - RNA, 19 nt, Homo sapiens
ucagcuccaugggaaauaa

SEQ ID NO: 675363 - RNA, 19 nt, Homo sapiens
gcaguggcaauacccauga

SEQ ID NO: 675364 - RNA, 19 nt, Homo sapiens
guaauauacccgucuguag

SEQ ID NO: 675365 - RNA, 19 nt, Homo sapiens
ugucauugcugcugaaguc

SEQ ID NO: 675366 - RNA, 19 nt, Homo sapiens
ccacauacaaggcugacuu

SEQ ID NO: 675367 - RNA, 19 nt, Homo sapiens
ccuuacaucucccacaguu

SEQ ID NO: 675368 - RNA, 19 nt, Homo sapiens
gaaggaagauggaagguaa

SEQ ID NO: 675369 - RNA, 19 nt, Homo sapiens
gaacccagcuaccuuauga

SEQ ID NO: 675370 - RNA, 19 nt, Homo sapiens
ggaaggacauugccaacua

SEQ ID NO: 675371 - RNA, 19 nt, Homo sapiens
ggaggaaagugauaucaaa

SEQ ID NO: 675372 - RNA, 19 nt, Homo sapiens
ggaacucucugaccuguuu

SEQ ID NO: 675373 - RNA, 19 nt, Homo sapiens
gaagguaaguucugucguu

SEQ ID NO: 675374 - RNA, 19 nt, Homo sapiens
gagcagcggugguacauga

SEQ ID NO: 675375 - RNA, 19 nt, Homo sapiens
ggagcaaacccaagucuua

SEQ ID NO: 675376 - RNA, 19 nt, Homo sapiens
gcauucagcuguucuguau

SEQ ID NO: 675377 - RNA, 19 nt, Homo sapiens
gaagccaacuuagaaagaa

SEQ ID NO: 675378 - RNA, 19 nt, Homo sapiens
ggaaagugauaucaaaugg

SEQ ID NO: 675379 - RNA, 19 nt, Homo sapiens
ucacagaugucaacaagau

SEQ ID NO: 675380 - RNA, 19 nt, Homo sapiens
ccagaacgaucccguagaa

SEQ ID NO: 675381 - RNA, 19 nt, Homo sapiens
caaggaggaugacauugaa

SEQ ID NO: 675382 - RNA, 19 nt, Homo sapiens
gagaagaagugugaaguuc

SEQ ID NO: 675383 - RNA, 19 nt, Homo sapiens
gaaagcagccauaugacaa

SEQ ID NO: 675384 - RNA, 19 nt, Homo sapiens
gaaacaagcgccuucuaug

SEQ ID NO: 675385 - RNA, 19 nt, Homo sapiens
cgacggcgauggugaguga

SEQ ID NO: 675386 - RNA, 19 nt, Homo sapiens
ggaaacggacaccucauaa

SEQ ID NO: 675387 - RNA, 19 nt, Homo sapiens
gaagauggaagguaaguuc

SEQ ID NO: 675388 - RNA, 19 nt, Homo sapiens
gaagagacuugcagugaac

SEQ ID NO: 675389 - RNA, 19 nt, Homo sapiens
gagaagagacuugcaguga

SEQ ID NO: 675390 - RNA, 19 nt, Homo sapiens
ucaguucuauuaccucuuu

SEQ ID NO: 675391 - RNA, 19 nt, Homo sapiens
caacaaggaggaugacauu

SEQ ID NO: 675392 - RNA, 19 nt, Homo sapiens
cauaaaggguucaaagauc

SEQ ID NO: 675393 - RNA, 19 nt, Homo sapiens
ggaguuugcuggaccacaa

SEQ ID NO: 675394 - RNA, 19 nt, Homo sapiens
gaaacggacaccucauaaa

SEQ ID NO: 675395 - RNA, 19 nt, Homo sapiens
gaucuaugcugcugugaag

SEQ ID NO: 675396 - RNA, 19 nt, Homo sapiens
ccagcuaccuuaugaauac

SEQ ID NO: 675397 - RNA, 19 nt, Homo sapiens
gaacgaucccguagaaauc

SEQ ID NO: 675398 - RNA, 19 nt, Homo sapiens
acaagaagccaacuuagaa

SEQ ID NO: 675399 - RNA, 19 nt, Homo sapiens
ccacugaggccacgacaaa

SEQ ID NO: 675400 - RNA, 19 nt, Homo sapiens
gcacaaccaccucucauuc

SEQ ID NO: 675401 - RNA, 19 nt, Homo sapiens
gggaaacggacaccucaua

SEQ ID NO: 675402 - RNA, 19 nt, Homo sapiens
gagcgauauuggagucuuu

SEQ ID NO: 675403 - RNA, 19 nt, Homo sapiens
aaagggaacccaagcagua

SEQ ID NO: 675404 - RNA, 19 nt, Homo sapiens
ggucauacucacuucuuua

SEQ ID NO: 675405 - RNA, 19 nt, Homo sapiens
ucucugaccuguuuauuca

SEQ ID NO: 675406 - RNA, 19 nt, Homo sapiens
gggagggccuguagauaau

SEQ ID NO: 675407 - RNA, 19 nt, Homo sapiens
gguaaguucugucguucuu

SEQ ID NO: 675408 - RNA, 19 nt, Homo sapiens
ggugguacaugaaccgauu

SEQ ID NO: 675409 - RNA, 19 nt, Homo sapiens
ucagguguauuucugguuu

SEQ ID NO: 675410 - RNA, 19 nt, Homo sapiens
gacaagaagccaacuuaga

SEQ ID NO: 675411 - RNA, 19 nt, Homo sapiens
ccucauggcugggaucuug

SEQ ID NO: 675412 - RNA, 19 nt, Homo sapiens
cuaagaaaguucccuccaa

SEQ ID NO: 675413 - RNA, 19 nt, Homo sapiens
gaaggacauugccaacuac

SEQ ID NO: 675414 - RNA, 19 nt, Homo sapiens
caaagcagaugagaagagu

SEQ ID NO: 675415 - RNA, 19 nt, Homo sapiens
agaagagacuugcagugaa

SEQ ID NO: 675416 - RNA, 19 nt, Homo sapiens
gaagaagagaagagacuug

SEQ ID NO: 675417 - RNA, 19 nt, Homo sapiens
gcucaggcauucagcuguu

SEQ ID NO: 675418 - RNA, 19 nt, Homo sapiens
ccaaggagaaucagcugua

SEQ ID NO: 675419 - RNA, 19 nt, Homo sapiens
caagaagccaacuuagaaa

SEQ ID NO: 675420 - RNA, 19 nt, Homo sapiens
aaacacugcuugugagaag

SEQ ID NO: 675421 - RNA, 19 nt, Homo sapiens
gcaaacccaagucuuaguu

SEQ ID NO: 675422 - RNA, 19 nt, Homo sapiens
agacagcgaugacaagaag

SEQ ID NO: 675423 - RNA, 19 nt, Homo sapiens
ccagcaagauaaccuacaa

SEQ ID NO: 675424 - RNA, 19 nt, Homo sapiens
ccagugaauuucucaaucu

SEQ ID NO: 675425 - RNA, 19 nt, Homo sapiens
auaaaggguucaaagauca

SEQ ID NO: 675426 - RNA, 19 nt, Homo sapiens
uaaguucugucguucuuuc

SEQ ID NO: 675427 - RNA, 19 nt, Homo sapiens
gauggaagguaaguucugu

SEQ ID NO: 675428 - RNA, 19 nt, Homo sapiens
cauucuacguccugguuua

SEQ ID NO: 675429 - RNA, 19 nt, Homo sapiens
guggagaaauuuccuaguc

SEQ ID NO: 675430 - RNA, 19 nt, Homo sapiens
cgggagggccuguagauaa

SEQ ID NO: 675431 - RNA, 19 nt, Homo sapiens
acacuuaccugaccaugag

SEQ ID NO: 675432 - RNA, 19 nt, Homo sapiens
gauuaggguucaaguagca

SEQ ID NO: 675433 - RNA, 19 nt, Homo sapiens
guucagagcagccggaguu

SEQ ID NO: 675434 - RNA, 19 nt, Homo sapiens
gauaaauccaccgagauaa

SEQ ID NO: 675435 - RNA, 19 nt, Homo sapiens
aaauaacuccugcucguuu

SEQ ID NO: 675436 - RNA, 19 nt, Homo sapiens
aaacaagcgccuucuaugu

SEQ ID NO: 675437 - RNA, 19 nt, Homo sapiens
ucucauucauccuuuacua

SEQ ID NO: 675438 - RNA, 19 nt, Homo sapiens
ccaucaaaccagugaauuu

SEQ ID NO: 675439 - RNA, 19 nt, Homo sapiens
gguauccuguucacaaauc

SEQ ID NO: 675440 - RNA, 19 nt, Homo sapiens
gagcucuucuucaucuuca

SEQ ID NO: 675441 - RNA, 19 nt, Homo sapiens
guacaugaaccgauuugug

SEQ ID NO: 675442 - RNA, 19 nt, Homo sapiens
gagaaucagcuguacuuca

SEQ ID NO: 675443 - RNA, 19 nt, Homo sapiens
ugaaacaagcgccuucuau

SEQ ID NO: 675444 - RNA, 19 nt, Homo sapiens
gcuguuggccacccuauga

SEQ ID NO: 675445 - RNA, 19 nt, Homo sapiens
cuaugcagccuacauguuu

SEQ ID NO: 675446 - RNA, 19 nt, Homo sapiens
ggccaucgguggaagaaag

SEQ ID NO: 675447 - RNA, 19 nt, Homo sapiens
acaaggaggaugacauuga

SEQ ID NO: 675448 - RNA, 19 nt, Homo sapiens
gugguauccuguucacaaa

SEQ ID NO: 675449 - RNA, 19 nt, Homo sapiens
gaucacagaagacuacuac

SEQ ID NO: 675450 - RNA, 19 nt, Homo sapiens
ggucuccgcccacugauug

SEQ ID NO: 675451 - RNA, 19 nt, Homo sapiens
gggauuaggguucaaguag

SEQ ID NO: 675452 - RNA, 19 nt, Homo sapiens
ggacaagaagccaacuuag

SEQ ID NO: 675453 - RNA, 19 nt, Homo sapiens
auucagcuguucuguauga

SEQ ID NO: 675454 - RNA, 19 nt, Homo sapiens
gguauccugagcaugauua

SEQ ID NO: 675455 - RNA, 19 nt, Homo sapiens
gaacagcgagaagaagugu

SEQ ID NO: 675456 - RNA, 19 nt, Homo sapiens
aaacggacaccucauaaag

SEQ ID NO: 675457 - RNA, 19 nt, Homo sapiens
agacaaagcucaggaugcu

SEQ ID NO: 675458 - RNA, 19 nt, Homo sapiens
ggugguauccuguucacaa

SEQ ID NO: 675459 - RNA, 19 nt, Homo sapiens
ggacauugccaacuacaac

SEQ ID NO: 675460 - RNA, 19 nt, Homo sapiens
uuggucggauuguaaauaa

SEQ ID NO: 675461 - RNA, 19 nt, Homo sapiens
gggucauacucacuucuuu

SEQ ID NO: 675462 - RNA, 19 nt, Homo sapiens
guagaaaucaaggcuguga

SEQ ID NO: 675463 - RNA, 19 nt, Homo sapiens
caacaccccuuuccagguu

SEQ ID NO: 675464 - RNA, 19 nt, Homo sapiens
cuaccagccucacccauca

SEQ ID NO: 675465 - RNA, 19 nt, Homo sapiens
cauuugcucuuaaguuaca

SEQ ID NO: 675466 - RNA, 19 nt, Homo sapiens
uggacaagaagccaacuua

SEQ ID NO: 675467 - RNA, 19 nt, Homo sapiens
gauccucaucgucaucuuu

SEQ ID NO: 675468 - RNA, 19 nt, Homo sapiens
gagcagaccucaugaauaa

SEQ ID NO: 675469 - RNA, 19 nt, Homo sapiens
gcagggaacucuccucuua

SEQ ID NO: 675470 - RNA, 19 nt, Homo sapiens
gcaguguucucacaacuua

SEQ ID NO: 675471 - RNA, 19 nt, Homo sapiens
caaacaggaucuaagcuua

SEQ ID NO: 675472 - RNA, 19 nt, Homo sapiens
guauauaccugucaacuga

SEQ ID NO: 675473 - RNA, 19 nt, Homo sapiens
gcaguuggcuggguguuua

SEQ ID NO: 675474 - RNA, 19 nt, Homo sapiens
uaaagaagaucccuggaaa

SEQ ID NO: 675475 - RNA, 19 nt, Homo sapiens
gggaagaacuauuuguaaa

SEQ ID NO: 675476 - RNA, 19 nt, Homo sapiens
aaacaggccucuucagaaa

SEQ ID NO: 675477 - RNA, 19 nt, Homo sapiens
cguaguagauuuaguguuu

SEQ ID NO: 675478 - RNA, 19 nt, Homo sapiens
ccaagaggaugcaggauuu

SEQ ID NO: 675479 - RNA, 19 nt, Homo sapiens
gcaauagaaugaaccagaa

SEQ ID NO: 675480 - RNA, 19 nt, Homo sapiens
gaaagaaugggaagaacua

SEQ ID NO: 675481 - RNA, 19 nt, Homo sapiens
gcacagaggcuuagguuug

SEQ ID NO: 675482 - RNA, 19 nt, Homo sapiens
gaauaaggauaccuagaga

SEQ ID NO: 675483 - RNA, 19 nt, Homo sapiens
caauaucucuccuuaaaca

SEQ ID NO: 675484 - RNA, 19 nt, Homo sapiens
ggucugggaugccuuguuu

SEQ ID NO: 675485 - RNA, 19 nt, Homo sapiens
gaauuaagagcaugguaua

SEQ ID NO: 675486 - RNA, 19 nt, Homo sapiens
uuacugaccucucaaaguu

SEQ ID NO: 675487 - RNA, 19 nt, Homo sapiens
ugagugagauacugaaauu

SEQ ID NO: 675488 - RNA, 19 nt, Homo sapiens
cugcugaccucuaguauuu

SEQ ID NO: 675489 - RNA, 19 nt, Homo sapiens
gaaauugcaccacagauau

SEQ ID NO: 675490 - RNA, 19 nt, Homo sapiens
uaacaagucuggaggagau

SEQ ID NO: 675491 - RNA, 19 nt, Homo sapiens
gagcagagguuguacuucu

SEQ ID NO: 675492 - RNA, 19 nt, Homo sapiens
gcauguaaggugaauaaua

SEQ ID NO: 675493 - RNA, 19 nt, Homo sapiens
gaagcuuggugugcuguua

SEQ ID NO: 675494 - RNA, 19 nt, Homo sapiens
gcacugauuucaaaagaua

SEQ ID NO: 675495 - RNA, 19 nt, Homo sapiens
gaaugcaucuccaauccuu

SEQ ID NO: 675496 - RNA, 19 nt, Homo sapiens
gaagaagcaugauauugag

SEQ ID NO: 675497 - RNA, 19 nt, Homo sapiens
gcuggaagcuauuucuuug

SEQ ID NO: 675498 - RNA, 19 nt, Homo sapiens
gaacugcugaccucaagua

SEQ ID NO: 675499 - RNA, 19 nt, Homo sapiens
gaucucagcucaccgcaau

SEQ ID NO: 675500 - RNA, 19 nt, Homo sapiens
gaagaucaaauucugguuu

SEQ ID NO: 675501 - RNA, 19 nt, Homo sapiens
acaaagggcuaaguucuaa

SEQ ID NO: 675502 - RNA, 19 nt, Homo sapiens
gauguacacucacugauuc

SEQ ID NO: 675503 - RNA, 19 nt, Homo sapiens
ugaagaagcaugauauuga

SEQ ID NO: 675504 - RNA, 19 nt, Homo sapiens
uaaagaacuucgaucaaug

SEQ ID NO: 675505 - RNA, 19 nt, Homo sapiens
caaaugaaagcucaguaua

SEQ ID NO: 675506 - RNA, 19 nt, Homo sapiens
gagguuguacuucuaaaua

SEQ ID NO: 675507 - RNA, 19 nt, Homo sapiens
ugaaagacuugcucagcua

SEQ ID NO: 675508 - RNA, 19 nt, Homo sapiens
gaagagaacgaacagauca

SEQ ID NO: 675509 - RNA, 19 nt, Homo sapiens
ggacacucaucuuguaaau

SEQ ID NO: 675510 - RNA, 19 nt, Homo sapiens
uggaggagauucaaauaaa

SEQ ID NO: 675511 - RNA, 19 nt, Homo sapiens
ugacuggguuucugacuuu

SEQ ID NO: 675512 - RNA, 19 nt, Homo sapiens
uaagguagcagucauaaga

SEQ ID NO: 675513 - RNA, 19 nt, Homo sapiens
gaaggagcagaaauaguua

SEQ ID NO: 675514 - RNA, 19 nt, Homo sapiens
aagcauauauggccacaaa

SEQ ID NO: 675515 - RNA, 19 nt, Homo sapiens
gaucaauaauccucuuuca

SEQ ID NO: 675516 - RNA, 19 nt, Homo sapiens
gaagcuauuucuuuguguu

SEQ ID NO: 675517 - RNA, 19 nt, Homo sapiens
cgagugaccuugcaacugu

SEQ ID NO: 675518 - RNA, 19 nt, Homo sapiens
uagcugcacugauuucaaa

SEQ ID NO: 675519 - RNA, 19 nt, Homo sapiens
ccacagauauauggguuaa

SEQ ID NO: 675520 - RNA, 19 nt, Homo sapiens
gggcaugcacgaacuguua

SEQ ID NO: 675521 - RNA, 19 nt, Homo sapiens
ucucaaagccugaaagaaa

SEQ ID NO: 675522 - RNA, 19 nt, Homo sapiens
ggagagagacauacaagga

SEQ ID NO: 675523 - RNA, 19 nt, Homo sapiens
ccaucaauaucucuccuua

SEQ ID NO: 675524 - RNA, 19 nt, Homo sapiens
ggagcagaccucaugaaua

SEQ ID NO: 675525 - RNA, 19 nt, Homo sapiens
caagaccagugacuuauca

SEQ ID NO: 675526 - RNA, 19 nt, Homo sapiens
guuagcaccuauagucuuu

SEQ ID NO: 675527 - RNA, 19 nt, Homo sapiens
gcacccaccaugccaauaa

SEQ ID NO: 675528 - RNA, 19 nt, Homo sapiens
gcacagagcaucacaugag

SEQ ID NO: 675529 - RNA, 19 nt, Homo sapiens
gaggaaguauugagugugu

SEQ ID NO: 675530 - RNA, 19 nt, Homo sapiens
gcuguuaggugaaagacuu

SEQ ID NO: 675531 - RNA, 19 nt, Homo sapiens
caaaggugauggacacuca

SEQ ID NO: 675532 - RNA, 19 nt, Homo sapiens
caaauuuccuuccuucaag

SEQ ID NO: 675533 - RNA, 19 nt, Homo sapiens
cugaguaucuggaacauga

SEQ ID NO: 675534 - RNA, 19 nt, Homo sapiens
ggagaaaugguuguacuuu

SEQ ID NO: 675535 - RNA, 19 nt, Homo sapiens
guagugcauuccugaguuu

SEQ ID NO: 675536 - RNA, 19 nt, Homo sapiens
aaugaaagcucaguauaga

SEQ ID NO: 675537 - RNA, 19 nt, Homo sapiens
guggaggccuucaugguaa

SEQ ID NO: 675538 - RNA, 19 nt, Homo sapiens
caacuuuggccaucaauau

SEQ ID NO: 675539 - RNA, 19 nt, Homo sapiens
gaaugaaccagaacuagug

SEQ ID NO: 675540 - RNA, 19 nt, Homo sapiens
agaaggagcagaaauaguu

SEQ ID NO: 675541 - RNA, 19 nt, Homo sapiens
guacacucacugauucuua

SEQ ID NO: 675542 - RNA, 19 nt, Homo sapiens
acacauaacuucauaacac

SEQ ID NO: 675543 - RNA, 19 nt, Homo sapiens
gcaaacaggaucuaagcuu

SEQ ID NO: 675544 - RNA, 19 nt, Homo sapiens
gaacaagaaguaggcauug

SEQ ID NO: 675545 - RNA, 19 nt, Homo sapiens
uaaagaauaugugcuccuu

SEQ ID NO: 675546 - RNA, 19 nt, Homo sapiens
ggaauaaggauaccuagag

SEQ ID NO: 675547 - RNA, 19 nt, Homo sapiens
ccagagcguucaaauguca

SEQ ID NO: 675548 - RNA, 19 nt, Homo sapiens
gaacgaacagaucaccauu

SEQ ID NO: 675549 - RNA, 19 nt, Homo sapiens
ccaaggugcuggaauuaca

SEQ ID NO: 675550 - RNA, 19 nt, Homo sapiens
ugucacacauaacuucaua

SEQ ID NO: 675551 - RNA, 19 nt, Homo sapiens
gcuaaaugcaauagaauga

SEQ ID NO: 675552 - RNA, 19 nt, Homo sapiens
ggccagagcguucaaaugu

SEQ ID NO: 675553 - RNA, 19 nt, Homo sapiens
agaaauugcaccacagaua

SEQ ID NO: 675554 - RNA, 19 nt, Homo sapiens
gaagggagucuuuggaaca

SEQ ID NO: 675555 - RNA, 19 nt, Homo sapiens
gccagaagaacaagaagua

SEQ ID NO: 675556 - RNA, 19 nt, Homo sapiens
ggacaaccccggaauaaaa

SEQ ID NO: 675557 - RNA, 19 nt, Homo sapiens
gggauaaacaucuuucaga

SEQ ID NO: 675558 - RNA, 19 nt, Homo sapiens
gcaguugaaugaccuggau

SEQ ID NO: 675559 - RNA, 19 nt, Homo sapiens
ggauguacacucacugauu

SEQ ID NO: 675560 - RNA, 19 nt, Homo sapiens
gcaagaaaaugugagaaaa

SEQ ID NO: 675561 - RNA, 19 nt, Homo sapiens
ggaggaguuucaccauguu

SEQ ID NO: 675562 - RNA, 19 nt, Homo sapiens
cagcauguaaggugaauaa

SEQ ID NO: 675563 - RNA, 19 nt, Homo sapiens
ucgcagagcuaaaugcaau

SEQ ID NO: 675564 - RNA, 19 nt, Homo sapiens
uaaacaggccucuucagaa

SEQ ID NO: 675565 - RNA, 19 nt, Homo sapiens
caaaugcggccucaguuga

SEQ ID NO: 675566 - RNA, 19 nt, Homo sapiens
gaguuugccuggaggaaga

SEQ ID NO: 675567 - RNA, 19 nt, Homo sapiens
gcacuugaacagacuagaa

SEQ ID NO: 675568 - RNA, 19 nt, Homo sapiens
agaagaagaucgucaagua

SEQ ID NO: 675569 - RNA, 19 nt, Homo sapiens
ucaaguaccuguuccaguu

SEQ ID NO: 675570 - RNA, 19 nt, Homo sapiens
ggacaucuaugccaacauc

SEQ ID NO: 675571 - RNA, 19 nt, Homo sapiens
ggaggaggcuggcaucauc

SEQ ID NO: 675572 - RNA, 19 nt, Homo sapiens
gccaacaucuucaucauca

SEQ ID NO: 675573 - RNA, 19 nt, Homo sapiens
ccaaagggcagaagaagaa

SEQ ID NO: 675574 - RNA, 19 nt, Homo sapiens
aagagaagcugcugaagug

SEQ ID NO: 675575 - RNA, 19 nt, Homo sapiens
gagagacagagaagaaaua

SEQ ID NO: 675576 - RNA, 19 nt, Homo sapiens
guaccugccugauuucuuc

SEQ ID NO: 675577 - RNA, 19 nt, Homo sapiens
aaagacagauggagcguau

SEQ ID NO: 675578 - RNA, 19 nt, Homo sapiens
ggaccuuggugccauguug

SEQ ID NO: 675579 - RNA, 19 nt, Homo sapiens
ggcuguaccugccugauuu

SEQ ID NO: 675580 - RNA, 19 nt, Homo sapiens
gggacugccucauucugua

SEQ ID NO: 675581 - RNA, 19 nt, Homo sapiens
caaguggacucgugagaag

SEQ ID NO: 675582 - RNA, 19 nt, Homo sapiens
ggacagcgucugcuucuuc

SEQ ID NO: 675583 - RNA, 19 nt, Homo sapiens
gagccgcuguucaccauga

SEQ ID NO: 675584 - RNA, 19 nt, Homo sapiens
ggcaggcgcuaguggauga

SEQ ID NO: 675585 - RNA, 19 nt, Homo sapiens
caacuucuucuucuacaaa

SEQ ID NO: 675586 - RNA, 19 nt, Homo sapiens
ggaacaggcaggacagcua

SEQ ID NO: 675587 - RNA, 19 nt, Homo sapiens
gggacuacuuccuguuuga

SEQ ID NO: 675588 - RNA, 19 nt, Homo sapiens
caacaucuucaucaucaaa

SEQ ID NO: 675589 - RNA, 19 nt, Homo sapiens
cgacgucuaugcccucaug

SEQ ID NO: 675590 - RNA, 19 nt, Homo sapiens
ggagaucugcuuccugaug

SEQ ID NO: 675591 - RNA, 19 nt, Homo sapiens
agcaagcgcuucuggauga

SEQ ID NO: 675592 - RNA, 19 nt, Homo sapiens
ggaggaggcagagcuguuu

SEQ ID NO: 675593 - RNA, 19 nt, Homo sapiens
gaacuccgcacucaucaag

SEQ ID NO: 675594 - RNA, 19 nt, Homo sapiens
ugaaggaggugucggugau

SEQ ID NO: 675595 - RNA, 19 nt, Homo sapiens
gggaggcacuguggaguau

SEQ ID NO: 675596 - RNA, 19 nt, Homo sapiens
gaaauacccgcagcccaaa

SEQ ID NO: 675597 - RNA, 19 nt, Homo sapiens
acaaucaucucaaccucuu

SEQ ID NO: 675598 - RNA, 19 nt, Homo sapiens
caacgucaccgucaucauc

SEQ ID NO: 675599 - RNA, 19 nt, Homo sapiens
ccaaugaggaggccgacua

SEQ ID NO: 675600 - RNA, 19 nt, Homo sapiens
ugaaagagaagcugcugaa

SEQ ID NO: 675601 - RNA, 19 nt, Homo sapiens
gacaucacguccucccuau

SEQ ID NO: 675602 - RNA, 19 nt, Homo sapiens
ggacagggaggaagaagag

SEQ ID NO: 675603 - RNA, 19 nt, Homo sapiens
ccaaggagcaugacaagag

SEQ ID NO: 675604 - RNA, 19 nt, Homo sapiens
gaagaagaucgucaaguac

SEQ ID NO: 675605 - RNA, 19 nt, Homo sapiens
ccaagccgcucuggaggaa

SEQ ID NO: 675606 - RNA, 19 nt, Homo sapiens
gaggaggacucaccaucca

SEQ ID NO: 675607 - RNA, 19 nt, Homo sapiens
cacguguacuguagaguuu

SEQ ID NO: 675608 - RNA, 19 nt, Homo sapiens
gccaaguacuggaucuaug

SEQ ID NO: 675609 - RNA, 19 nt, Homo sapiens
uggaucagcuguacacaag

SEQ ID NO: 675610 - RNA, 19 nt, Homo sapiens
gaggacaucuaugccaaca

SEQ ID NO: 675611 - RNA, 19 nt, Homo sapiens
gggcagcgcaugaacuuuc

SEQ ID NO: 675612 - RNA, 19 nt, Homo sapiens
gcaaguucgugcgcggauu

SEQ ID NO: 675613 - RNA, 19 nt, Homo sapiens
ucgcgguggucgucaagua

SEQ ID NO: 675614 - RNA, 19 nt, Homo sapiens
caagauugucuacauguuc

SEQ ID NO: 675615 - RNA, 19 nt, Homo sapiens
caucacguccucccuauca

SEQ ID NO: 675616 - RNA, 19 nt, Homo sapiens
gacuucaucaucaucauuu

SEQ ID NO: 675617 - RNA, 19 nt, Homo sapiens
ugacuuccaccgcaggaua

SEQ ID NO: 675618 - RNA, 19 nt, Homo sapiens
gucaucaucuccaagaaca

SEQ ID NO: 675619 - RNA, 19 nt, Homo sapiens
ccacguguacuguagaguu

SEQ ID NO: 675620 - RNA, 19 nt, Homo sapiens
ggacgcagacgcuguugca

SEQ ID NO: 675621 - RNA, 19 nt, Homo sapiens
gccgagagacagagaagaa

SEQ ID NO: 675622 - RNA, 19 nt, Homo sapiens
ucacugagaggauguucaa

SEQ ID NO: 675623 - RNA, 19 nt, Homo sapiens
guugucgacuucaucauca

SEQ ID NO: 675624 - RNA, 19 nt, Homo sapiens
gcgcaucagucuacguuuu

SEQ ID NO: 675625 - RNA, 19 nt, Homo sapiens
gaagacugacggcuacauc

SEQ ID NO: 675626 - RNA, 19 nt, Homo sapiens
gcuaguggaugagcugaca

SEQ ID NO: 675627 - RNA, 19 nt, Homo sapiens
ccuaucagacgaccaggua

SEQ ID NO: 675628 - RNA, 19 nt, Homo sapiens
caaguaccuguuccaguuu

SEQ ID NO: 675629 - RNA, 19 nt, Homo sapiens
gagccacucagcagcauga

SEQ ID NO: 675630 - RNA, 19 nt, Homo sapiens
ggaccacgccacagucauc

SEQ ID NO: 675631 - RNA, 19 nt, Homo sapiens
ccaaguacuggaucuaugu

SEQ ID NO: 675632 - RNA, 19 nt, Homo sapiens
cggagaccaugaucaagug

SEQ ID NO: 675633 - RNA, 19 nt, Homo sapiens
ggagcugucccggcaguuu

SEQ ID NO: 675634 - RNA, 19 nt, Homo sapiens
gaagaagaagaucgucaag

SEQ ID NO: 675635 - RNA, 19 nt, Homo sapiens
guuccuggcugauguuguc

SEQ ID NO: 675636 - RNA, 19 nt, Homo sapiens
aaagagaagcugcugaagu

SEQ ID NO: 675637 - RNA, 19 nt, Homo sapiens
gcugugggacugccucauu

SEQ ID NO: 675638 - RNA, 19 nt, Homo sapiens
gguccuaccuugacaugcu

SEQ ID NO: 675639 - RNA, 19 nt, Homo sapiens
gccaguuugugaaagagaa

SEQ ID NO: 675640 - RNA, 19 nt, Homo sapiens
gagaucucgcacuccauua

SEQ ID NO: 675641 - RNA, 19 nt, Homo sapiens
ucaaccagcccaucgaugu

SEQ ID NO: 675642 - RNA, 19 nt, Homo sapiens
gggcagaagaagaagaaga

SEQ ID NO: 675643 - RNA, 19 nt, Homo sapiens
caaaugcagccgagagaca

SEQ ID NO: 675644 - RNA, 19 nt, Homo sapiens
uggcugauguugucgacuu

SEQ ID NO: 675645 - RNA, 19 nt, Homo sapiens
gcgucuuccuuagccauua

SEQ ID NO: 675646 - RNA, 19 nt, Homo sapiens
ucaucaacuucuucuucua

SEQ ID NO: 675647 - RNA, 19 nt, Homo sapiens
ucaagcugguggcccugua

SEQ ID NO: 675648 - RNA, 19 nt, Homo sapiens
gcaaccugcugcccauggu

SEQ ID NO: 675649 - RNA, 19 nt, Homo sapiens
ggcagaagaagaagaagau

SEQ ID NO: 675650 - RNA, 19 nt, Homo sapiens
gagcugucccggcaguuug

SEQ ID NO: 675651 - RNA, 19 nt, Homo sapiens
guacuggaucuaugugugu

SEQ ID NO: 675652 - RNA, 19 nt, Homo sapiens
ccaagcucaucuuccucua

SEQ ID NO: 675653 - RNA, 19 nt, Homo sapiens
gaucucgcacuccauuaug

SEQ ID NO: 675654 - RNA, 19 nt, Homo sapiens
ggacccugccaacugguuu

SEQ ID NO: 675655 - RNA, 19 nt, Homo sapiens
uguaccagcucaagguugu

SEQ ID NO: 675656 - RNA, 19 nt, Homo sapiens
ggaccugcgucaucaucgu

SEQ ID NO: 675657 - RNA, 19 nt, Homo sapiens
ucaugcagcucaccgacau

SEQ ID NO: 675658 - RNA, 19 nt, Homo sapiens
ugaugcugcugucagagaa

SEQ ID NO: 675659 - RNA, 19 nt, Homo sapiens
gcaccucggaccagucugu

SEQ ID NO: 675660 - RNA, 19 nt, Homo sapiens
cgacuucaucaucaucauu

SEQ ID NO: 675661 - RNA, 19 nt, Homo sapiens
gacagcgucugcuucuucu

SEQ ID NO: 675662 - RNA, 19 nt, Homo sapiens
uguguaagaugcuguacca

SEQ ID NO: 675663 - RNA, 19 nt, Homo sapiens
ggaguaugccaacgagaag

SEQ ID NO: 675664 - RNA, 19 nt, Homo sapiens
gacaucacccugcgcuuca

SEQ ID NO: 675665 - RNA, 19 nt, Homo sapiens
ucaugcugcugauccaguu

SEQ ID NO: 675666 - RNA, 19 nt, Homo sapiens
aagccgcucuggaggaaga

SEQ ID NO: 675667 - RNA, 19 nt, Homo sapiens
gcucauggcccuuuucuuc

SEQ ID NO: 675668 - RNA, 19 nt, Homo sapiens
gaacaucucaucuccauua

SEQ ID NO: 675669 - RNA, 19 nt, Homo sapiens
gcaauuagcugcccagaug

SEQ ID NO: 675670 - RNA, 19 nt, Homo sapiens
ggaagagccugccagauuu

SEQ ID NO: 675671 - RNA, 19 nt, Homo sapiens
gaagaaagcagccucauug

SEQ ID NO: 675672 - RNA, 19 nt, Homo sapiens
ggaaaugccugaccucuca

SEQ ID NO: 675673 - RNA, 19 nt, Homo sapiens
ggaauaacuguccaaauua

SEQ ID NO: 675674 - RNA, 19 nt, Homo sapiens
caaaugaucuugacaacau

SEQ ID NO: 675675 - RNA, 19 nt, Homo sapiens
aaagagaggugcuguuuga

SEQ ID NO: 675676 - RNA, 19 nt, Homo sapiens
gagcucagaugaccuuauu

SEQ ID NO: 675677 - RNA, 19 nt, Homo sapiens
ggacacgccuccaccauau

SEQ ID NO: 675678 - RNA, 19 nt, Homo sapiens
aaacaucuuucuugccuua

SEQ ID NO: 675679 - RNA, 19 nt, Homo sapiens
gaucaaagaaggauuagaa

SEQ ID NO: 675680 - RNA, 19 nt, Homo sapiens
aggaauaacuguccaaauu

SEQ ID NO: 675681 - RNA, 19 nt, Homo sapiens
uaaaagagcuguuugaaug

SEQ ID NO: 675682 - RNA, 19 nt, Homo sapiens
gaauaacuguccaaauuag

SEQ ID NO: 675683 - RNA, 19 nt, Homo sapiens
caccauagauguccacgua

SEQ ID NO: 675684 - RNA, 19 nt, Homo sapiens
gaccagugcugcuuucaaa

SEQ ID NO: 675685 - RNA, 19 nt, Homo sapiens
gaaagcagccucauugauc

SEQ ID NO: 675686 - RNA, 19 nt, Homo sapiens
ucaacaaggugcauauaaa

SEQ ID NO: 675687 - RNA, 19 nt, Homo sapiens
ggaccuaugucacaauguu

SEQ ID NO: 675688 - RNA, 19 nt, Homo sapiens
ugucucagauucucauuua

SEQ ID NO: 675689 - RNA, 19 nt, Homo sapiens
gaacaaaugaucuugacaa

SEQ ID NO: 675690 - RNA, 19 nt, Homo sapiens
gggaagagccugccagauu

SEQ ID NO: 675691 - RNA, 19 nt, Homo sapiens
uaagugugcuuccuauauu

SEQ ID NO: 675692 - RNA, 19 nt, Homo sapiens
gaacccugcuugauguaaa

SEQ ID NO: 675693 - RNA, 19 nt, Homo sapiens
cagaugaccuuauuucuag

SEQ ID NO: 675694 - RNA, 19 nt, Homo sapiens
gaaacuugcuguaguaacu

SEQ ID NO: 675695 - RNA, 19 nt, Homo sapiens
gugauggugucuacuguua

SEQ ID NO: 675696 - RNA, 19 nt, Homo sapiens
uguaagcuguguacuguua

SEQ ID NO: 675697 - RNA, 19 nt, Homo sapiens
gagaagcacucuguuuaug

SEQ ID NO: 675698 - RNA, 19 nt, Homo sapiens
gcaaacugcauugaauuua

SEQ ID NO: 675699 - RNA, 19 nt, Homo sapiens
ccaaagugcuggaauuaca

SEQ ID NO: 675700 - RNA, 19 nt, Homo sapiens
gaccuggccugaagacauu

SEQ ID NO: 675701 - RNA, 19 nt, Homo sapiens
uaaggacacauacacauua

SEQ ID NO: 675702 - RNA, 19 nt, Homo sapiens
ccauugagcuucacagugu

SEQ ID NO: 675703 - RNA, 19 nt, Homo sapiens
cuaacacugugauguauaa

SEQ ID NO: 675704 - RNA, 19 nt, Homo sapiens
ccaaguagcugggauuaca

SEQ ID NO: 675705 - RNA, 19 nt, Homo sapiens
ggacacauacacauuauuc

SEQ ID NO: 675706 - RNA, 19 nt, Homo sapiens
ggauuaauaaggacacaua

SEQ ID NO: 675707 - RNA, 19 nt, Homo sapiens
ccacuaacacugugaugua

SEQ ID NO: 675708 - RNA, 19 nt, Homo sapiens
gcaagaucacucugagaua

SEQ ID NO: 675709 - RNA, 19 nt, Homo sapiens
aaagcaaacugcauugaau

SEQ ID NO: 675710 - RNA, 19 nt, Homo sapiens
caaagaugcagucaccaua

SEQ ID NO: 675711 - RNA, 19 nt, Homo sapiens
cauaauuugucuccauuga

SEQ ID NO: 675712 - RNA, 19 nt, Homo sapiens
gcuguaagcuguguacugu

SEQ ID NO: 675713 - RNA, 19 nt, Homo sapiens
ucacuaaacaucuuucuug

SEQ ID NO: 675714 - RNA, 19 nt, Homo sapiens
gguugcagcugaaauuaug

SEQ ID NO: 675715 - RNA, 19 nt, Homo sapiens
gcagcaggaugcagggauu

SEQ ID NO: 675716 - RNA, 19 nt, Homo sapiens
gaagcgcgaugcuggaaca

SEQ ID NO: 675717 - RNA, 19 nt, Homo sapiens
gacaagugguggugaaaca

SEQ ID NO: 675718 - RNA, 19 nt, Homo sapiens
caagaucacucugagauac

SEQ ID NO: 675719 - RNA, 19 nt, Homo sapiens
agucucagguccuaguuua

SEQ ID NO: 675720 - RNA, 19 nt, Homo sapiens
guguuugacuucugcauuu

SEQ ID NO: 675721 - RNA, 19 nt, Homo sapiens
uaagcuguguacuguuaua

SEQ ID NO: 675722 - RNA, 19 nt, Homo sapiens
ggacgaugauuuccuucug

SEQ ID NO: 675723 - RNA, 19 nt, Homo sapiens
uugaguaacugaccacauu

SEQ ID NO: 675724 - RNA, 19 nt, Homo sapiens
gugccagacuuaucuuuga

SEQ ID NO: 675725 - RNA, 19 nt, Homo sapiens
ucagaugaccuuauuucua

SEQ ID NO: 675726 - RNA, 19 nt, Homo sapiens
gauagacaguaagaagaaa

SEQ ID NO: 675727 - RNA, 19 nt, Homo sapiens
gacgaugauuuccuucuga

SEQ ID NO: 675728 - RNA, 19 nt, Homo sapiens
gcuaaugcuucacaacuag

SEQ ID NO: 675729 - RNA, 19 nt, Homo sapiens
gagauaaagcaucggauug

SEQ ID NO: 675730 - RNA, 19 nt, Homo sapiens
cuucaccucugauguguuu

SEQ ID NO: 675731 - RNA, 19 nt, Homo sapiens
gaaccucccauuucacuuc

SEQ ID NO: 675732 - RNA, 19 nt, Homo sapiens
uaaaccauccuaugccuuu

SEQ ID NO: 675733 - RNA, 19 nt, Homo sapiens
gaaagagaggugcuguuug

SEQ ID NO: 675734 - RNA, 19 nt, Homo sapiens
cagcugaaauuaugcaaag

SEQ ID NO: 675735 - RNA, 19 nt, Homo sapiens
gcaucggauugcaggaaua

SEQ ID NO: 675736 - RNA, 19 nt, Homo sapiens
uauggcauguguucacuaa

SEQ ID NO: 675737 - RNA, 19 nt, Homo sapiens
caaagcaaacugcauugaa

SEQ ID NO: 675738 - RNA, 19 nt, Homo sapiens
cuugaaacuugcuguagua

SEQ ID NO: 675739 - RNA, 19 nt, Homo sapiens
gaagcacucuguuuaugac

SEQ ID NO: 675740 - RNA, 19 nt, Homo sapiens
ugaaagagaggugcuguuu

SEQ ID NO: 675741 - RNA, 19 nt, Homo sapiens
ggacagaggaaccaacauc

SEQ ID NO: 675742 - RNA, 19 nt, Homo sapiens
ggcauaauuugucuccauu

SEQ ID NO: 675743 - RNA, 19 nt, Homo sapiens
uaugaacccugcuugaugu

SEQ ID NO: 675744 - RNA, 19 nt, Homo sapiens
gcaccauguugucagagaa

SEQ ID NO: 675745 - RNA, 19 nt, Homo sapiens
gcgcgcagaugaugugcaa

SEQ ID NO: 675746 - RNA, 19 nt, Homo sapiens
uuuguacucuggaaucaua

SEQ ID NO: 675747 - RNA, 19 nt, Homo sapiens
caugccgucuugauguuua

SEQ ID NO: 675748 - RNA, 19 nt, Homo sapiens
uggcauguguucacuaaga

SEQ ID NO: 675749 - RNA, 19 nt, Homo sapiens
gcagauggcccuggguuug

SEQ ID NO: 675750 - RNA, 19 nt, Homo sapiens
gauagggaccacagagauu

SEQ ID NO: 675751 - RNA, 19 nt, Homo sapiens
gaugagagucagagccuuu

SEQ ID NO: 675752 - RNA, 19 nt, Homo sapiens
ggcaaauauuguagcuaua

SEQ ID NO: 675753 - RNA, 19 nt, Homo sapiens
aggcaaauauuguagcuau

SEQ ID NO: 675754 - RNA, 19 nt, Homo sapiens
gagcagaugacaaccauag

SEQ ID NO: 675755 - RNA, 19 nt, Homo sapiens
ggagaccagugcugcuuuc

SEQ ID NO: 675756 - RNA, 19 nt, Homo sapiens
gugcaaagccugccguaug

SEQ ID NO: 675757 - RNA, 19 nt, Homo sapiens
gagcaugccgucuugaugu

SEQ ID NO: 675758 - RNA, 19 nt, Homo sapiens
ggcauucacucuuacagau

SEQ ID NO: 675759 - RNA, 19 nt, Homo sapiens
uuacaaagcaaacugcauu

SEQ ID NO: 675760 - RNA, 19 nt, Homo sapiens
uggagucucuggacgauga

SEQ ID NO: 675761 - RNA, 19 nt, Homo sapiens
agagacaucugagugugua

SEQ ID NO: 675762 - RNA, 19 nt, Homo sapiens
ggauuagaaaccgcaauua

SEQ ID NO: 675763 - RNA, 19 nt, Homo sapiens
caaugcaucuucuguacuc

SEQ ID NO: 675764 - RNA, 19 nt, Homo sapiens
aaaagaaccucccauuuca

SEQ ID NO: 675765 - RNA, 19 nt, Homo sapiens
ggaaaagaaccucccauuu

SEQ ID NO: 675766 - RNA, 19 nt, Homo sapiens
ucauugauccgcagaugua

SEQ ID NO: 675767 - RNA, 19 nt, Homo sapiens
gcuguguacuguuauaagu

SEQ ID NO: 675768 - RNA, 19 nt, Homo sapiens
gcaaggagauuuaaugauu

SEQ ID NO: 675769 - RNA, 19 nt, Homo sapiens
gaacagaaauuugcaugua

SEQ ID NO: 675770 - RNA, 19 nt, Homo sapiens
gaaggaaacuuaagaugug

SEQ ID NO: 675771 - RNA, 19 nt, Homo sapiens
gcagcagccuuccucauua

SEQ ID NO: 675772 - RNA, 19 nt, Homo sapiens
caacaaagauacaagugaa

SEQ ID NO: 675773 - RNA, 19 nt, Homo sapiens
guucauguguuaaguguua

SEQ ID NO: 675774 - RNA, 19 nt, Homo sapiens
aaacagaggcauugauuua

SEQ ID NO: 675775 - RNA, 19 nt, Homo sapiens
gaacuuaauuaacgugaga

SEQ ID NO: 675776 - RNA, 19 nt, Homo sapiens
agaccgaucuugcuaauuu

SEQ ID NO: 675777 - RNA, 19 nt, Homo sapiens
gcaaggaccuagacacaug

SEQ ID NO: 675778 - RNA, 19 nt, Homo sapiens
gaaguacuuuguagagauu

SEQ ID NO: 675779 - RNA, 19 nt, Homo sapiens
gaugacagauuaagagaug

SEQ ID NO: 675780 - RNA, 19 nt, Homo sapiens
caaagaaucuccaagugau

SEQ ID NO: 675781 - RNA, 19 nt, Homo sapiens
gacagaagaaggaaacuua

SEQ ID NO: 675782 - RNA, 19 nt, Homo sapiens
gaagaacgcagacagaaga

SEQ ID NO: 675783 - RNA, 19 nt, Homo sapiens
gcaaagaaucuccaaguga

SEQ ID NO: 675784 - RNA, 19 nt, Homo sapiens
ggagaugugugaagguuga

SEQ ID NO: 675785 - RNA, 19 nt, Homo sapiens
gaacaaggacgacuauaca

SEQ ID NO: 675786 - RNA, 19 nt, Homo sapiens
gcaggaaccuaauaugcuu

SEQ ID NO: 675787 - RNA, 19 nt, Homo sapiens
agacuuccauggacucuua

SEQ ID NO: 675788 - RNA, 19 nt, Homo sapiens
uagaugaacugagucguua

SEQ ID NO: 675789 - RNA, 19 nt, Homo sapiens
gaagaaguugcaaagaaua

SEQ ID NO: 675790 - RNA, 19 nt, Homo sapiens
uaaagaaaccugaaggaaa

SEQ ID NO: 675791 - RNA, 19 nt, Homo sapiens
aaagaaaccugaaggaaag

SEQ ID NO: 675792 - RNA, 19 nt, Homo sapiens
cagaauggauuaugaagau

SEQ ID NO: 675793 - RNA, 19 nt, Homo sapiens
gcuaguacuucuucccaua

SEQ ID NO: 675794 - RNA, 19 nt, Homo sapiens
gacaagagcuaguucuaca

SEQ ID NO: 675795 - RNA, 19 nt, Homo sapiens
ccagaugaguauagaauug

SEQ ID NO: 675796 - RNA, 19 nt, Homo sapiens
caagauuacuccugagaau

SEQ ID NO: 675797 - RNA, 19 nt, Homo sapiens
gaugcacgcuucuaauuca

SEQ ID NO: 675798 - RNA, 19 nt, Homo sapiens
ugaagaaguugcaaagaau

SEQ ID NO: 675799 - RNA, 19 nt, Homo sapiens
ugauacaucucagcaauuu

SEQ ID NO: 675800 - RNA, 19 nt, Homo sapiens
gaugccagcuucuucuuga

SEQ ID NO: 675801 - RNA, 19 nt, Homo sapiens
guauagaauuggaccauau

SEQ ID NO: 675802 - RNA, 19 nt, Homo sapiens
gaagagaaguccggugaag

SEQ ID NO: 675803 - RNA, 19 nt, Homo sapiens
gaccaucucuucauauuuu

SEQ ID NO: 675804 - RNA, 19 nt, Homo sapiens
gaugucuguucauguguua

SEQ ID NO: 675805 - RNA, 19 nt, Homo sapiens
caauguuccuguugguaua

SEQ ID NO: 675806 - RNA, 19 nt, Homo sapiens
agacagagcaggaaccuaa

SEQ ID NO: 675807 - RNA, 19 nt, Homo sapiens
guaaagaacaagaagagaa

SEQ ID NO: 675808 - RNA, 19 nt, Homo sapiens
ugaauaaauuggcagaaga

SEQ ID NO: 675809 - RNA, 19 nt, Homo sapiens
guacuucuucccauaauuu

SEQ ID NO: 675810 - RNA, 19 nt, Homo sapiens
gaauaaauuggcagaagaa

SEQ ID NO: 675811 - RNA, 19 nt, Homo sapiens
aaacgcagauggucaaagu

SEQ ID NO: 675812 - RNA, 19 nt, Homo sapiens
gaccgaucuugcuaauuua

SEQ ID NO: 675813 - RNA, 19 nt, Homo sapiens
gcagaaaggcagaguggaa

SEQ ID NO: 675814 - RNA, 19 nt, Homo sapiens
uaagcuguguucacucuuu

SEQ ID NO: 675815 - RNA, 19 nt, Homo sapiens
ggugagaccucgcauaacu

SEQ ID NO: 675816 - RNA, 19 nt, Homo sapiens
gaagaugacagauuaagag

SEQ ID NO: 675817 - RNA, 19 nt, Homo sapiens
agacuuagaugaacugagu

SEQ ID NO: 675818 - RNA, 19 nt, Homo sapiens
gaugaucccaacaaagaua

SEQ ID NO: 675819 - RNA, 19 nt, Homo sapiens
gagauugacuuccuaagcu

SEQ ID NO: 675820 - RNA, 19 nt, Homo sapiens
uagacuaugugauaccuaa

SEQ ID NO: 675821 - RNA, 19 nt, Homo sapiens
caacuugcaccacuaagaa

SEQ ID NO: 675822 - RNA, 19 nt, Homo sapiens
gaagaaaacuauuguacuc

SEQ ID NO: 675823 - RNA, 19 nt, Homo sapiens
gaagaaggaaacuuaagau

SEQ ID NO: 675824 - RNA, 19 nt, Homo sapiens
gaccauaucagcccaaugu

SEQ ID NO: 675825 - RNA, 19 nt, Homo sapiens
gcuagaaaguggcaguuca

SEQ ID NO: 675826 - RNA, 19 nt, Homo sapiens
cuaauaugcuucuugaauc

SEQ ID NO: 675827 - RNA, 19 nt, Homo sapiens
gaaccuaauaugcuucuug

SEQ ID NO: 675828 - RNA, 19 nt, Homo sapiens
ccaaacagaggcauugauu

SEQ ID NO: 675829 - RNA, 19 nt, Homo sapiens
ggaguggagucaacauauc

SEQ ID NO: 675830 - RNA, 19 nt, Homo sapiens
gaccaggccaguaacauuu

SEQ ID NO: 675831 - RNA, 19 nt, Homo sapiens
gcuuauaucuguggauuca

SEQ ID NO: 675832 - RNA, 19 nt, Homo sapiens
agacagaaguacuuuguag

SEQ ID NO: 675833 - RNA, 19 nt, Homo sapiens
guagcaauauugaagacuu

SEQ ID NO: 675834 - RNA, 19 nt, Homo sapiens
caacaaggagcucauagug

SEQ ID NO: 675835 - RNA, 19 nt, Homo sapiens
ucaaguuacugaagugaau

SEQ ID NO: 675836 - RNA, 19 nt, Homo sapiens
cagcagucaucucucagua

SEQ ID NO: 675837 - RNA, 19 nt, Homo sapiens
gacaagagaagaugcaaug

SEQ ID NO: 675838 - RNA, 19 nt, Homo sapiens
uagcagaguuguucacauc

SEQ ID NO: 675839 - RNA, 19 nt, Homo sapiens
gcacugucuucugcuagua

SEQ ID NO: 675840 - RNA, 19 nt, Homo sapiens
gcuacccagucuuuaagua

SEQ ID NO: 675841 - RNA, 19 nt, Homo sapiens
gguuauacauguuuggaau

SEQ ID NO: 675842 - RNA, 19 nt, Homo sapiens
uaauagaugucuguucaug

SEQ ID NO: 675843 - RNA, 19 nt, Homo sapiens
uuacugaagugaauaccaa

SEQ ID NO: 675844 - RNA, 19 nt, Homo sapiens
aaaggaaccaucagauaaa

SEQ ID NO: 675845 - RNA, 19 nt, Homo sapiens
gauaagaaauccaaaacug

SEQ ID NO: 675846 - RNA, 19 nt, Homo sapiens
ggcaaagaaucuccaagug

SEQ ID NO: 675847 - RNA, 19 nt, Homo sapiens
ugaccugucugagaaauau

SEQ ID NO: 675848 - RNA, 19 nt, Homo sapiens
cauucuggcuauucugaua

SEQ ID NO: 675849 - RNA, 19 nt, Homo sapiens
gaauggauuaugaagauga

SEQ ID NO: 675850 - RNA, 19 nt, Homo sapiens
ccaaauccuucuacagcuu

SEQ ID NO: 675851 - RNA, 19 nt, Homo sapiens
gcacgcuucuaauucaugu

SEQ ID NO: 675852 - RNA, 19 nt, Homo sapiens
caacagacagaaguacuuu

SEQ ID NO: 675853 - RNA, 19 nt, Homo sapiens
gcagaagaacgcagacaga

SEQ ID NO: 675854 - RNA, 19 nt, Homo sapiens
gcaggaauaggccuucuug

SEQ ID NO: 675855 - RNA, 19 nt, Homo sapiens
gaaguccggugaagauggu

SEQ ID NO: 675856 - RNA, 19 nt, Homo sapiens
gaaagccagaucagaaguu

SEQ ID NO: 675857 - RNA, 19 nt, Homo sapiens
caucugugcucuauaugug

SEQ ID NO: 675858 - RNA, 19 nt, Homo sapiens
ggcccuaccuugaguuaug

SEQ ID NO: 675859 - RNA, 19 nt, Homo sapiens
caaauccuucuacagcuua

SEQ ID NO: 675860 - RNA, 19 nt, Homo sapiens
uaggugauguggcuucuga

SEQ ID NO: 675861 - RNA, 19 nt, Homo sapiens
gaaggaaagccagaucaga

SEQ ID NO: 675862 - RNA, 19 nt, Homo sapiens
gaagagauaguuuugauga

SEQ ID NO: 675863 - RNA, 19 nt, Homo sapiens
ccugcuagauuucguauuc

SEQ ID NO: 675864 - RNA, 19 nt, Homo sapiens
guggagaaauaauagaugu

SEQ ID NO: 675865 - RNA, 19 nt, Homo sapiens
augaagaaguugcaaagaa

SEQ ID NO: 675866 - RNA, 19 nt, Homo sapiens
gguugaccauuguuugaaa

SEQ ID NO: 675867 - RNA, 19 nt, Homo sapiens
ccagugagaguucauuuau

SEQ ID NO: 675868 - RNA, 19 nt, Homo sapiens
gaacuuauuucccuucaaa

SEQ ID NO: 675869 - RNA, 19 nt, Homo sapiens
gaaaugaaauguagcacaa

SEQ ID NO: 675870 - RNA, 19 nt, Homo sapiens
uaaaggaaauguucucuga

SEQ ID NO: 675871 - RNA, 19 nt, Homo sapiens
agacaaagaugaccaagaa

SEQ ID NO: 675872 - RNA, 19 nt, Homo sapiens
caagcacacuguuuagaua

SEQ ID NO: 675873 - RNA, 19 nt, Homo sapiens
gcacaaacguggcucagau

SEQ ID NO: 675874 - RNA, 19 nt, Homo sapiens
ggagagagggaacuuauuu

SEQ ID NO: 675875 - RNA, 19 nt, Homo sapiens
gaagaucugagaauucuaa

SEQ ID NO: 675876 - RNA, 19 nt, Homo sapiens
caucuacaauggacaauuu

SEQ ID NO: 675877 - RNA, 19 nt, Homo sapiens
ggguaaggcuccucacuuu

SEQ ID NO: 675878 - RNA, 19 nt, Homo sapiens
gaaggaaacuccguugcaa

SEQ ID NO: 675879 - RNA, 19 nt, Homo sapiens
gauaugggcugaaaugucu

SEQ ID NO: 675880 - RNA, 19 nt, Homo sapiens
gaaauguagcacaaucuua

SEQ ID NO: 675881 - RNA, 19 nt, Homo sapiens
uauaacaccucccaagaaa

SEQ ID NO: 675882 - RNA, 19 nt, Homo sapiens
gaauggagcucuuugucau

SEQ ID NO: 675883 - RNA, 19 nt, Homo sapiens
gugcggagcuccagcauug

SEQ ID NO: 675884 - RNA, 19 nt, Homo sapiens
aaacaagcaugauugaaga

SEQ ID NO: 675885 - RNA, 19 nt, Homo sapiens
gguggucucugcuuuguuu

SEQ ID NO: 675886 - RNA, 19 nt, Homo sapiens
gaaagccaguucagcgauu

SEQ ID NO: 675887 - RNA, 19 nt, Homo sapiens
ccaauucccuugaggagaa

SEQ ID NO: 675888 - RNA, 19 nt, Homo sapiens
ggagaaugcacaaguguaa

SEQ ID NO: 675889 - RNA, 19 nt, Homo sapiens
ggaccuuguucucugauaa

SEQ ID NO: 675890 - RNA, 19 nt, Homo sapiens
gagccucuauucuuauauu

SEQ ID NO: 675891 - RNA, 19 nt, Homo sapiens
aaacguggcucagauguug

SEQ ID NO: 675892 - RNA, 19 nt, Homo sapiens
ccaguauccugacauguaa

SEQ ID NO: 675893 - RNA, 19 nt, Homo sapiens
gcaugaguguuucugcuuu

SEQ ID NO: 675894 - RNA, 19 nt, Homo sapiens
gagcgucugucuuuguauu

SEQ ID NO: 675895 - RNA, 19 nt, Homo sapiens
gggcagagccuguguguuc

SEQ ID NO: 675896 - RNA, 19 nt, Homo sapiens
uaucugugcucuauacauu

SEQ ID NO: 675897 - RNA, 19 nt, Homo sapiens
ggcuuaaucuuuccaugua

SEQ ID NO: 675898 - RNA, 19 nt, Homo sapiens
guacuucuuuggaaaugaa

SEQ ID NO: 675899 - RNA, 19 nt, Homo sapiens
gaacaugaucccuccagaa

SEQ ID NO: 675900 - RNA, 19 nt, Homo sapiens
gccugagccucuauucuua

SEQ ID NO: 675901 - RNA, 19 nt, Homo sapiens
gacaagaacucugggaauc

SEQ ID NO: 675902 - RNA, 19 nt, Homo sapiens
gcagggagauggaaaagaa

SEQ ID NO: 675903 - RNA, 19 nt, Homo sapiens
caaggguacuucuuuggaa

SEQ ID NO: 675904 - RNA, 19 nt, Homo sapiens
ggacugagggcuuagaaau

SEQ ID NO: 675905 - RNA, 19 nt, Homo sapiens
ccaaggaguucacaaugau

SEQ ID NO: 675906 - RNA, 19 nt, Homo sapiens
caagaaaggccacccauag

SEQ ID NO: 675907 - RNA, 19 nt, Homo sapiens
ucaaggugcugaugugaug

SEQ ID NO: 675908 - RNA, 19 nt, Homo sapiens
ccaccuggcuggagagaug

SEQ ID NO: 675909 - RNA, 19 nt, Homo sapiens
gaccuagccugucccagaa

SEQ ID NO: 675910 - RNA, 19 nt, Homo sapiens
uaacaccucccaagaaaga

SEQ ID NO: 675911 - RNA, 19 nt, Homo sapiens
gagggcauguuaucugcua

SEQ ID NO: 675912 - RNA, 19 nt, Homo sapiens
gcacacuguuuagauaaga

SEQ ID NO: 675913 - RNA, 19 nt, Homo sapiens
cagcuuggcuaacagaaug

SEQ ID NO: 675914 - RNA, 19 nt, Homo sapiens
gagcagcccuuggguuugu

SEQ ID NO: 675915 - RNA, 19 nt, Homo sapiens
gcaaggugcugcaggugau

SEQ ID NO: 675916 - RNA, 19 nt, Homo sapiens
guacaacauucuugccaau

SEQ ID NO: 675917 - RNA, 19 nt, Homo sapiens
cagcaucuuuccuaacuug

SEQ ID NO: 675918 - RNA, 19 nt, Homo sapiens
caacuccuuuagcauguaa

SEQ ID NO: 675919 - RNA, 19 nt, Homo sapiens
gaaaauacucuacaccuuu

SEQ ID NO: 675920 - RNA, 19 nt, Homo sapiens
ccaacucacugccauguuc

SEQ ID NO: 675921 - RNA, 19 nt, Homo sapiens
gaacuggacccugugaaau

SEQ ID NO: 675922 - RNA, 19 nt, Homo sapiens
gggcaugacucgguaagga

SEQ ID NO: 675923 - RNA, 19 nt, Homo sapiens
gaugauaugggcugaaaug

SEQ ID NO: 675924 - RNA, 19 nt, Homo sapiens
agagagagauagcugauag

SEQ ID NO: 675925 - RNA, 19 nt, Homo sapiens
guuggaaacuuggccagua

SEQ ID NO: 675926 - RNA, 19 nt, Homo sapiens
aagcaugccugaucucuuc

SEQ ID NO: 675927 - RNA, 19 nt, Homo sapiens
gaucccaucugacauuugg

SEQ ID NO: 675928 - RNA, 19 nt, Homo sapiens
aaucaaaggcuguucugua

SEQ ID NO: 675929 - RNA, 19 nt, Homo sapiens
gagcucauccucuguggaa

SEQ ID NO: 675930 - RNA, 19 nt, Homo sapiens
ggaauggagcucuuuguca

SEQ ID NO: 675931 - RNA, 19 nt, Homo sapiens
gguaagggcaggaaggaaa

SEQ ID NO: 675932 - RNA, 19 nt, Homo sapiens
ccaccucucuccaggcauu

SEQ ID NO: 675933 - RNA, 19 nt, Homo sapiens
cccaaggaguucacaauga

SEQ ID NO: 675934 - RNA, 19 nt, Homo sapiens
caaugucagugaugccaaa

SEQ ID NO: 675935 - RNA, 19 nt, Homo sapiens
gaggaucccaucugacauu

SEQ ID NO: 675936 - RNA, 19 nt, Homo sapiens
guacauagucuucgugucu

SEQ ID NO: 675937 - RNA, 19 nt, Homo sapiens
ccugauagcucaaccaacu

SEQ ID NO: 675938 - RNA, 19 nt, Homo sapiens
guaguuugcuucuuaagac

SEQ ID NO: 675939 - RNA, 19 nt, Homo sapiens
gaggagagagggaacuuau

SEQ ID NO: 675940 - RNA, 19 nt, Homo sapiens
aaggaaauguucucugaug

SEQ ID NO: 675941 - RNA, 19 nt, Homo sapiens
ccagucagcuuggcuaaca

SEQ ID NO: 675942 - RNA, 19 nt, Homo sapiens
gcagugauguuggguugug

SEQ ID NO: 675943 - RNA, 19 nt, Homo sapiens
gagguucacugugcauaug

SEQ ID NO: 675944 - RNA, 19 nt, Homo sapiens
ccaagaagaagacaaagau

SEQ ID NO: 675945 - RNA, 19 nt, Homo sapiens
guucagcgauuuccuggau

SEQ ID NO: 675946 - RNA, 19 nt, Homo sapiens
caucuuuccuaacuuguug

SEQ ID NO: 675947 - RNA, 19 nt, Homo sapiens
aaccagacaucauuucaga

SEQ ID NO: 675948 - RNA, 19 nt, Homo sapiens
gaucugagaauucuaaagg

SEQ ID NO: 675949 - RNA, 19 nt, Homo sapiens
gaagaaucaucuccaaaau

SEQ ID NO: 675950 - RNA, 19 nt, Homo sapiens
gggcugaccuaccuacagu

SEQ ID NO: 675951 - RNA, 19 nt, Homo sapiens
cagagcagcccuuggguuu

SEQ ID NO: 675952 - RNA, 19 nt, Homo sapiens
acugagggcuuagaaauga

SEQ ID NO: 675953 - RNA, 19 nt, Homo sapiens
gugaugauaugggcugaaa

SEQ ID NO: 675954 - RNA, 19 nt, Homo sapiens
ggacugacaagcacacugu

SEQ ID NO: 675955 - RNA, 19 nt, Homo sapiens
ccaagaaaggccacccaua

SEQ ID NO: 675956 - RNA, 19 nt, Homo sapiens
ggaagaaucaucuccaaaa

SEQ ID NO: 675957 - RNA, 19 nt, Homo sapiens
caugaucccuccagaaguc

SEQ ID NO: 675958 - RNA, 19 nt, Homo sapiens
gcacuuaagggucuguuuc

SEQ ID NO: 675959 - RNA, 19 nt, Homo sapiens
ccacaggacaguauagaug

SEQ ID NO: 675960 - RNA, 19 nt, Homo sapiens
gggcugaauuuucucuuua

SEQ ID NO: 675961 - RNA, 19 nt, Homo sapiens
gaacaccaggcucagauuc

SEQ ID NO: 675962 - RNA, 19 nt, Homo sapiens
gguuccagcccuccuaaua

SEQ ID NO: 675963 - RNA, 19 nt, Homo sapiens
gggcugaggcugaguuguu

SEQ ID NO: 675964 - RNA, 19 nt, Homo sapiens
uaagaagcaauuacccuuu

SEQ ID NO: 675965 - RNA, 19 nt, Homo sapiens
ucaaccaacuccuuuagca

SEQ ID NO: 675966 - RNA, 19 nt, Homo sapiens
ccugaucucuucuuuacug

SEQ ID NO: 675967 - RNA, 19 nt, Homo sapiens
gaacccaggagcuccaaga

SEQ ID NO: 675968 - RNA, 19 nt, Homo sapiens
ggagagagcaguuagagaa

SEQ ID NO: 675969 - RNA, 19 nt, Homo sapiens
gaacagcaccggcaacuca

SEQ ID NO: 675970 - RNA, 19 nt, Homo sapiens
gagagcaguuagagaagua

SEQ ID NO: 675971 - RNA, 19 nt, Homo sapiens
ggcccucgaugccaaauua

SEQ ID NO: 675972 - RNA, 19 nt, Homo sapiens
ccagaggaauuuacagaaa

SEQ ID NO: 675973 - RNA, 19 nt, Homo sapiens
gaacugauggugaagaaau

SEQ ID NO: 675974 - RNA, 19 nt, Homo sapiens
cagaugacuugauuggaua

SEQ ID NO: 675975 - RNA, 19 nt, Homo sapiens
ugacuugauuggauacuuu

SEQ ID NO: 675976 - RNA, 19 nt, Homo sapiens
guacggaaguugcaagagu

SEQ ID NO: 675977 - RNA, 19 nt, Homo sapiens
ccagaugacuugauuggau

SEQ ID NO: 675978 - RNA, 19 nt, Homo sapiens
gcgagacuuucaacaguuu

SEQ ID NO: 675979 - RNA, 19 nt, Homo sapiens
cuacguggccuauaacauu

SEQ ID NO: 675980 - RNA, 19 nt, Homo sapiens
ccgccuacguggccuauaa

SEQ ID NO: 675981 - RNA, 19 nt, Homo sapiens
ggaaguugcaagaguuuga

SEQ ID NO: 675982 - RNA, 19 nt, Homo sapiens
ggaacuggcuuuugaauac

SEQ ID NO: 675983 - RNA, 19 nt, Homo sapiens
uugaauaccucaugagcaa

SEQ ID NO: 675984 - RNA, 19 nt, Homo sapiens
gcucuugcccuuuagacua

SEQ ID NO: 675985 - RNA, 19 nt, Homo sapiens
cagcgagacuuucaacagu

SEQ ID NO: 675986 - RNA, 19 nt, Homo sapiens
ggaaguguccuuggaagug

SEQ ID NO: 675987 - RNA, 19 nt, Homo sapiens
uggucaaacucucaaguaa

SEQ ID NO: 675988 - RNA, 19 nt, Homo sapiens
gaacaugcacuuuuccauu

SEQ ID NO: 675989 - RNA, 19 nt, Homo sapiens
aguuugagcugccuuaugu

SEQ ID NO: 675990 - RNA, 19 nt, Homo sapiens
gauggagccuuuucuuuug

SEQ ID NO: 675991 - RNA, 19 nt, Homo sapiens
ggauggagccuuuucuuuu

SEQ ID NO: 675992 - RNA, 19 nt, Homo sapiens
uugaugaacugauggugaa

SEQ ID NO: 675993 - RNA, 19 nt, Homo sapiens
caccuccucuguaccauug

SEQ ID NO: 675994 - RNA, 19 nt, Homo sapiens
ggccugaaccugcuuuaug

SEQ ID NO: 675995 - RNA, 19 nt, Homo sapiens
ucaacgugcuaacuucaga

SEQ ID NO: 675996 - RNA, 19 nt, Homo sapiens
ucuguaaucuccacugcuu

SEQ ID NO: 675997 - RNA, 19 nt, Homo sapiens
gggagucuauggucaaacu

SEQ ID NO: 675998 - RNA, 19 nt, Homo sapiens
gagucaagaguauaagauu

SEQ ID NO: 675999 - RNA, 19 nt, Homo sapiens
gauuggauacuuuagucua

SEQ ID NO: 676000 - RNA, 19 nt, Homo sapiens
uauccuaccuuuccuuguc

SEQ ID NO: 676001 - RNA, 19 nt, Homo sapiens
guggcugacuucccagaaa

SEQ ID NO: 676002 - RNA, 19 nt, Homo sapiens
agucaagaguauaagauug

SEQ ID NO: 676003 - RNA, 19 nt, Homo sapiens
caugguugaugaacugaug

SEQ ID NO: 676004 - RNA, 19 nt, Homo sapiens
gucaaacucucaaguaagc

SEQ ID NO: 676005 - RNA, 19 nt, Homo sapiens
ggagucaagaguauaagau

SEQ ID NO: 676006 - RNA, 19 nt, Homo sapiens
cagaggaauuuacagaaac

SEQ ID NO: 676007 - RNA, 19 nt, Homo sapiens
gcggcacuauggcuacuug

SEQ ID NO: 676008 - RNA, 19 nt, Homo sapiens
aguauaagauugugcuaag

SEQ ID NO: 676009 - RNA, 19 nt, Homo sapiens
gaguauaagauugugcuaa

SEQ ID NO: 676010 - RNA, 19 nt, Homo sapiens
gugcuaaggaagaguuauu

SEQ ID NO: 676011 - RNA, 19 nt, Homo sapiens
uacggaaguugcaagaguu

SEQ ID NO: 676012 - RNA, 19 nt, Homo sapiens
gcaguuagagaaguacaug

SEQ ID NO: 676013 - RNA, 19 nt, Homo sapiens
guccaugguugaugaacug

SEQ ID NO: 676014 - RNA, 19 nt, Homo sapiens
gccugaaccugcuuuaugc

SEQ ID NO: 676015 - RNA, 19 nt, Homo sapiens
gacuugauuggauacuuua

SEQ ID NO: 676016 - RNA, 19 nt, Homo sapiens
gugcuaacuucagaucaga

SEQ ID NO: 676017 - RNA, 19 nt, Homo sapiens
gcagcgagacuuucaacag

SEQ ID NO: 676018 - RNA, 19 nt, Homo sapiens
agguggcucuugcccuuua

SEQ ID NO: 676019 - RNA, 19 nt, Homo sapiens
gcgggucaccuccucugua

SEQ ID NO: 676020 - RNA, 19 nt, Homo sapiens
gaauggaguccugcacugu

SEQ ID NO: 676021 - RNA, 19 nt, Homo sapiens
uauaagauugugcuaagga

SEQ ID NO: 676022 - RNA, 19 nt, Homo sapiens
gaaguacaugcaagcuguu

SEQ ID NO: 676023 - RNA, 19 nt, Homo sapiens
gaaaucuggcggcaguauc

SEQ ID NO: 676024 - RNA, 19 nt, Homo sapiens
gcaacucaaaucucugcaa

SEQ ID NO: 676025 - RNA, 19 nt, Homo sapiens
auaagauugugcuaaggaa

SEQ ID NO: 676026 - RNA, 19 nt, Homo sapiens
ugagcugccuuaugugucu

SEQ ID NO: 676027 - RNA, 19 nt, Homo sapiens
gggcacaacaggagacaca

SEQ ID NO: 676028 - RNA, 19 nt, Homo sapiens
ggucaaacucucaaguaag

SEQ ID NO: 676029 - RNA, 19 nt, Homo sapiens
ugcaguccaugguugauga

SEQ ID NO: 676030 - RNA, 19 nt, Homo sapiens
ucgcagggcucccaaaaug

SEQ ID NO: 676031 - RNA, 19 nt, Homo sapiens
gggacucugccuaugauga

SEQ ID NO: 676032 - RNA, 19 nt, Homo sapiens
ucaccagccuucggaguca

SEQ ID NO: 676033 - RNA, 19 nt, Homo sapiens
gcucagcaacgggcagaaa

SEQ ID NO: 676034 - RNA, 19 nt, Homo sapiens
ucugacuccugcugaggua

SEQ ID NO: 676035 - RNA, 19 nt, Homo sapiens
gggagcagcgagacuuuca

SEQ ID NO: 676036 - RNA, 19 nt, Homo sapiens
ucaagaguauaagauugug

SEQ ID NO: 676037 - RNA, 19 nt, Homo sapiens
gucaagaguauaagauugu

SEQ ID NO: 676038 - RNA, 19 nt, Homo sapiens
uggauacuuuagucuauuc

SEQ ID NO: 676039 - RNA, 19 nt, Homo sapiens
agacuacaguucccagcau

SEQ ID NO: 676040 - RNA, 19 nt, Homo sapiens
gaggagagagcaguuagag

SEQ ID NO: 676041 - RNA, 19 nt, Homo sapiens
ggucaacgugcuaacuuca

SEQ ID NO: 676042 - RNA, 19 nt, Homo sapiens
uacguggccuauaacauuc

SEQ ID NO: 676043 - RNA, 19 nt, Homo sapiens
acagaggagagagcaguua

SEQ ID NO: 676044 - RNA, 19 nt, Homo sapiens
cagcaacgggcagaaaguu

SEQ ID NO: 676045 - RNA, 19 nt, Homo sapiens
cugcuugagucaccugaug

SEQ ID NO: 676046 - RNA, 19 nt, Homo sapiens
gcaccggcaacucaaaucu

SEQ ID NO: 676047 - RNA, 19 nt, Homo sapiens
gagagagcaguuagagaag

SEQ ID NO: 676048 - RNA, 19 nt, Homo sapiens
guagggaacaugcacuuuu

SEQ ID NO: 676049 - RNA, 19 nt, Homo sapiens
ucuuccagaugacuugauu

SEQ ID NO: 676050 - RNA, 19 nt, Homo sapiens
gaugaacugauggugaaga

SEQ ID NO: 676051 - RNA, 19 nt, Homo sapiens
ggacucugccuaugaugac

SEQ ID NO: 676052 - RNA, 19 nt, Homo sapiens
guauaagauugugcuaagg

SEQ ID NO: 676053 - RNA, 19 nt, Homo sapiens
gaguuugagcugccuuaug

SEQ ID NO: 676054 - RNA, 19 nt, Homo sapiens
gcccaguuccccaucauua

SEQ ID NO: 676055 - RNA, 19 nt, Homo sapiens
ggucuuuuccuucuucuuu

SEQ ID NO: 676056 - RNA, 19 nt, Homo sapiens
ggaggggucuuuuccuucu

SEQ ID NO: 676057 - RNA, 19 nt, Homo sapiens
agaggaauuuacagaaacu

SEQ ID NO: 676058 - RNA, 19 nt, Homo sapiens
ucgagggcauuggagauga

SEQ ID NO: 676059 - RNA, 19 nt, Homo sapiens
augaacugauggugaagaa

SEQ ID NO: 676060 - RNA, 19 nt, Homo sapiens
ggucaccuccucuguacca

SEQ ID NO: 676061 - RNA, 19 nt, Homo sapiens
cgggucaccuccucuguac

SEQ ID NO: 676062 - RNA, 19 nt, Homo sapiens
agagagcaguuagagaagu

SEQ ID NO: 676063 - RNA, 19 nt, Homo sapiens
ggauugccccuucucuuuu

SEQ ID NO: 676064 - RNA, 19 nt, Homo sapiens
cagaugccagugccaguga

SEQ ID NO: 676065 - RNA, 19 nt, Homo sapiens
gagcagcgagacuuucaac

SEQ ID NO: 676066 - RNA, 19 nt, Homo sapiens
ccgggagucuauggucaaa

SEQ ID NO: 676067 - RNA, 19 nt, Homo sapiens
aaaucuggcggcaguauca

SEQ ID NO: 676068 - RNA, 19 nt, Homo sapiens
gcacugaucuggacuguca

SEQ ID NO: 676069 - RNA, 19 nt, Homo sapiens
ugaccuaccugaauguuua

SEQ ID NO: 676070 - RNA, 19 nt, Homo sapiens
gagaacaccuugaucaaau

SEQ ID NO: 676071 - RNA, 19 nt, Homo sapiens
ccacucagcugacgcagua

SEQ ID NO: 676072 - RNA, 19 nt, Homo sapiens
gcagugaauuugcaaagaa

SEQ ID NO: 676073 - RNA, 19 nt, Homo sapiens
caagaaggcucagcacaaa

SEQ ID NO: 676074 - RNA, 19 nt, Homo sapiens
gaagaaggaauuucauuug

SEQ ID NO: 676075 - RNA, 19 nt, Homo sapiens
cugcagaucuaucccauua

SEQ ID NO: 676076 - RNA, 19 nt, Homo sapiens
gaaggaauuucauuugaca

SEQ ID NO: 676077 - RNA, 19 nt, Homo sapiens
ggaccaaacugggagauau

SEQ ID NO: 676078 - RNA, 19 nt, Homo sapiens
ggacuaaccuggccaacgu

SEQ ID NO: 676079 - RNA, 19 nt, Homo sapiens
ggagaaguuugcugccuuu

SEQ ID NO: 676080 - RNA, 19 nt, Homo sapiens
ggagguggaugaggacuuu

SEQ ID NO: 676081 - RNA, 19 nt, Homo sapiens
gagcguagcagcagaagaa

SEQ ID NO: 676082 - RNA, 19 nt, Homo sapiens
gagggaacauggugucuau

SEQ ID NO: 676083 - RNA, 19 nt, Homo sapiens
gagcaaggaugaccagaag

SEQ ID NO: 676084 - RNA, 19 nt, Homo sapiens
ccagaaggaugcugaggaa

SEQ ID NO: 676085 - RNA, 19 nt, Homo sapiens
ggaggagagugaucaaauc

SEQ ID NO: 676086 - RNA, 19 nt, Homo sapiens
ggccguaccuucccuguug

SEQ ID NO: 676087 - RNA, 19 nt, Homo sapiens
gcaagaaggcucagcacaa

SEQ ID NO: 676088 - RNA, 19 nt, Homo sapiens
gagagucagugaagagaug

SEQ ID NO: 676089 - RNA, 19 nt, Homo sapiens
ggacagagcagaaguuugc

SEQ ID NO: 676090 - RNA, 19 nt, Homo sapiens
ggaggaagagccagauaaa

SEQ ID NO: 676091 - RNA, 19 nt, Homo sapiens
gaucgggauugguacauga

SEQ ID NO: 676092 - RNA, 19 nt, Homo sapiens
ggacuuucaucugugcaua

SEQ ID NO: 676093 - RNA, 19 nt, Homo sapiens
cagaucacaugaagagaaa

SEQ ID NO: 676094 - RNA, 19 nt, Homo sapiens
cgaagaaggaauuucauuu

SEQ ID NO: 676095 - RNA, 19 nt, Homo sapiens
ggagagagcgagaggagaa

SEQ ID NO: 676096 - RNA, 19 nt, Homo sapiens
ggagacauccuuaucuuca

SEQ ID NO: 676097 - RNA, 19 nt, Homo sapiens
gcguguagcugccauguca

SEQ ID NO: 676098 - RNA, 19 nt, Homo sapiens
gcagaucacaugaagagaa

SEQ ID NO: 676099 - RNA, 19 nt, Homo sapiens
gagcagaaguuugcagauc

SEQ ID NO: 676100 - RNA, 19 nt, Homo sapiens
gggaagagagcaaggauga

SEQ ID NO: 676101 - RNA, 19 nt, Homo sapiens
cauaguguaucacgaguug

SEQ ID NO: 676102 - RNA, 19 nt, Homo sapiens
agaacaccuugaucaaaua

SEQ ID NO: 676103 - RNA, 19 nt, Homo sapiens
gagcucaacucaaggacau

SEQ ID NO: 676104 - RNA, 19 nt, Homo sapiens
agacgucucucacuguuga

SEQ ID NO: 676105 - RNA, 19 nt, Homo sapiens
gaccuaaagggaauuguaa

SEQ ID NO: 676106 - RNA, 19 nt, Homo sapiens
gaaguuugcagaucacaug

SEQ ID NO: 676107 - RNA, 19 nt, Homo sapiens
cagccaagcucaagggaau

SEQ ID NO: 676108 - RNA, 19 nt, Homo sapiens
caucugugcugccuauuuc

SEQ ID NO: 676109 - RNA, 19 nt, Homo sapiens
gacggcaucauguuuguua

SEQ ID NO: 676110 - RNA, 19 nt, Homo sapiens
ccaacucccuccuacaaau

SEQ ID NO: 676111 - RNA, 19 nt, Homo sapiens
gaccaaacugggagauaua

SEQ ID NO: 676112 - RNA, 19 nt, Homo sapiens
caacucccuccuacaaaua

SEQ ID NO: 676113 - RNA, 19 nt, Homo sapiens
gaaggaugcugaggaagag

SEQ ID NO: 676114 - RNA, 19 nt, Homo sapiens
gagaugagcgggauagaag

SEQ ID NO: 676115 - RNA, 19 nt, Homo sapiens
gcaaggaugaccagaagga

SEQ ID NO: 676116 - RNA, 19 nt, Homo sapiens
gcaagucacggcaggagaa

SEQ ID NO: 676117 - RNA, 19 nt, Homo sapiens
gaucauuucauccaugcua

SEQ ID NO: 676118 - RNA, 19 nt, Homo sapiens
acaacaugcucaacucuau

SEQ ID NO: 676119 - RNA, 19 nt, Homo sapiens
ccagagcgccuacaagaau

SEQ ID NO: 676120 - RNA, 19 nt, Homo sapiens
gagcgaagccagcagugaa

SEQ ID NO: 676121 - RNA, 19 nt, Homo sapiens
gaugagcgggauagaagua

SEQ ID NO: 676122 - RNA, 19 nt, Homo sapiens
gaggauggcagcagguauu

SEQ ID NO: 676123 - RNA, 19 nt, Homo sapiens
ggugcgagcucaacucaag

SEQ ID NO: 676124 - RNA, 19 nt, Homo sapiens
ggaagaacaauaauuacuc

SEQ ID NO: 676125 - RNA, 19 nt, Homo sapiens
gaucaaauccgggagaagu

SEQ ID NO: 676126 - RNA, 19 nt, Homo sapiens
gcagaucuaucccauuagc

SEQ ID NO: 676127 - RNA, 19 nt, Homo sapiens
caaacugggagauauaaug

SEQ ID NO: 676128 - RNA, 19 nt, Homo sapiens
ggagggcgaagaaggaauu

SEQ ID NO: 676129 - RNA, 19 nt, Homo sapiens
ucagguugguggucuuauu

SEQ ID NO: 676130 - RNA, 19 nt, Homo sapiens
gcacaaacacugggaacug

SEQ ID NO: 676131 - RNA, 19 nt, Homo sapiens
gcgaagaaggaauuucauu

SEQ ID NO: 676132 - RNA, 19 nt, Homo sapiens
caaagucuccuccuacaag

SEQ ID NO: 676133 - RNA, 19 nt, Homo sapiens
gguuauaauucaggauuug

SEQ ID NO: 676134 - RNA, 19 nt, Homo sapiens
uggaugcucugcagaucua

SEQ ID NO: 676135 - RNA, 19 nt, Homo sapiens
aagccgaccuggaucacua

SEQ ID NO: 676136 - RNA, 19 nt, Homo sapiens
gaagccagcagugaauuug

SEQ ID NO: 676137 - RNA, 19 nt, Homo sapiens
ggaagaggacaguggcuau

SEQ ID NO: 676138 - RNA, 19 nt, Homo sapiens
aagaagaaguccaaagucu

SEQ ID NO: 676139 - RNA, 19 nt, Homo sapiens
gugcaucugugcugccuau

SEQ ID NO: 676140 - RNA, 19 nt, Homo sapiens
caucauguuuguuaucgau

SEQ ID NO: 676141 - RNA, 19 nt, Homo sapiens
ucagagaacaccuugauca

SEQ ID NO: 676142 - RNA, 19 nt, Homo sapiens
gaucacaugaagagaaaga

SEQ ID NO: 676143 - RNA, 19 nt, Homo sapiens
gaguauaugcaguguguga

SEQ ID NO: 676144 - RNA, 19 nt, Homo sapiens
gcaucugugcugccuauuu

SEQ ID NO: 676145 - RNA, 19 nt, Homo sapiens
gcuaugccauccgcuuuga

SEQ ID NO: 676146 - RNA, 19 nt, Homo sapiens
ccaagagagucagugaaga

SEQ ID NO: 676147 - RNA, 19 nt, Homo sapiens
gcaagagggacagagauga

SEQ ID NO: 676148 - RNA, 19 nt, Homo sapiens
ggaaagacagacauuaucg

SEQ ID NO: 676149 - RNA, 19 nt, Homo sapiens
ucugaggacuuucaucugu

SEQ ID NO: 676150 - RNA, 19 nt, Homo sapiens
cgaccuggaucacuacagu

SEQ ID NO: 676151 - RNA, 19 nt, Homo sapiens
cgagggcuaugacgaguuc

SEQ ID NO: 676152 - RNA, 19 nt, Homo sapiens
gggcgaagaaggaauuuca

SEQ ID NO: 676153 - RNA, 19 nt, Homo sapiens
caaaauauccggaaagaca

SEQ ID NO: 676154 - RNA, 19 nt, Homo sapiens
cauguucuauagcgugaaa

SEQ ID NO: 676155 - RNA, 19 nt, Homo sapiens
gcaaauuaaaggucuucaa

SEQ ID NO: 676156 - RNA, 19 nt, Homo sapiens
gcaccugcauaaacagaag

SEQ ID NO: 676157 - RNA, 19 nt, Homo sapiens
cgagugggccgaugacaga

SEQ ID NO: 676158 - RNA, 19 nt, Homo sapiens
gaaaucccagauccuguga

SEQ ID NO: 676159 - RNA, 19 nt, Homo sapiens
guguaacgaucauuucauc

SEQ ID NO: 676160 - RNA, 19 nt, Homo sapiens
gacaacaugcucaacucua

SEQ ID NO: 676161 - RNA, 19 nt, Homo sapiens
acacugacgugcucuuugg

SEQ ID NO: 676162 - RNA, 19 nt, Homo sapiens
gcugcucacuauuaucaga

SEQ ID NO: 676163 - RNA, 19 nt, Homo sapiens
uaaugggcgucaagaagga

SEQ ID NO: 676164 - RNA, 19 nt, Homo sapiens
ggccaucauugcucggaaa

SEQ ID NO: 676165 - RNA, 19 nt, Homo sapiens
gagauccugcucaucguuu

SEQ ID NO: 676166 - RNA, 19 nt, Homo sapiens
caaauuaaaggucuucaac

SEQ ID NO: 676167 - RNA, 19 nt, Homo sapiens
caacacugacgugcucuuu

SEQ ID NO: 676168 - RNA, 19 nt, Homo sapiens
gauaaagacuccagaaauu

SEQ ID NO: 676169 - RNA, 19 nt, Homo sapiens
ggacaaacccaaaguaaua

SEQ ID NO: 676170 - RNA, 19 nt, Homo sapiens
gaaagcaaccacaguaaua

SEQ ID NO: 676171 - RNA, 19 nt, Homo sapiens
gagagcacauugaguguua

SEQ ID NO: 676172 - RNA, 19 nt, Homo sapiens
gaaagaugcugagaagauu

SEQ ID NO: 676173 - RNA, 19 nt, Homo sapiens
gaaagaugcucuaagaaca

SEQ ID NO: 676174 - RNA, 19 nt, Homo sapiens
ugacaaaccuuaaugauag

SEQ ID NO: 676175 - RNA, 19 nt, Homo sapiens
ggaacuaacuuugaugaaa

SEQ ID NO: 676176 - RNA, 19 nt, Homo sapiens
gaagguagaugaagaagag

SEQ ID NO: 676177 - RNA, 19 nt, Homo sapiens
gaacacagacugacuucua

SEQ ID NO: 676178 - RNA, 19 nt, Homo sapiens
uaacauagccauuguagaa

SEQ ID NO: 676179 - RNA, 19 nt, Homo sapiens
gcacuaagguaaagucaau

SEQ ID NO: 676180 - RNA, 19 nt, Homo sapiens
gaaagacaguggaugaaug

SEQ ID NO: 676181 - RNA, 19 nt, Homo sapiens
gaacacaaaccaucacaaa

SEQ ID NO: 676182 - RNA, 19 nt, Homo sapiens
uaacucaccucaagaagaa

SEQ ID NO: 676183 - RNA, 19 nt, Homo sapiens
caacaaaucuguaauucca

SEQ ID NO: 676184 - RNA, 19 nt, Homo sapiens
gcucaaagcaugccuguuu

SEQ ID NO: 676185 - RNA, 19 nt, Homo sapiens
acagaaagaugcucuaaga

SEQ ID NO: 676186 - RNA, 19 nt, Homo sapiens
caaaguuaccuacguguua

SEQ ID NO: 676187 - RNA, 19 nt, Homo sapiens
caagaaaggucagaauaug

SEQ ID NO: 676188 - RNA, 19 nt, Homo sapiens
gaagauggauucuaaaaug

SEQ ID NO: 676189 - RNA, 19 nt, Homo sapiens
gcaaaugaauguguuuaug

SEQ ID NO: 676190 - RNA, 19 nt, Homo sapiens
gaaccaacacacaagauaa

SEQ ID NO: 676191 - RNA, 19 nt, Homo sapiens
caagaucuguauugaaaga

SEQ ID NO: 676192 - RNA, 19 nt, Homo sapiens
caagagaaauuacauuguc

SEQ ID NO: 676193 - RNA, 19 nt, Homo sapiens
ugauaaaggugcagaguga

SEQ ID NO: 676194 - RNA, 19 nt, Homo sapiens
gaagagaacaacaagcaaa

SEQ ID NO: 676195 - RNA, 19 nt, Homo sapiens
gaggaaacaagagaaauua

SEQ ID NO: 676196 - RNA, 19 nt, Homo sapiens
caacagauugcaccuagua

SEQ ID NO: 676197 - RNA, 19 nt, Homo sapiens
acagagagaugucagagaa

SEQ ID NO: 676198 - RNA, 19 nt, Homo sapiens
cagaggaaauguaagacua

SEQ ID NO: 676199 - RNA, 19 nt, Homo sapiens
aaacaagcauucagaggaa

SEQ ID NO: 676200 - RNA, 19 nt, Homo sapiens
ggcauugucugcaaauaaa

SEQ ID NO: 676201 - RNA, 19 nt, Homo sapiens
uaagcaaguugaacacaaa

SEQ ID NO: 676202 - RNA, 19 nt, Homo sapiens
cacugaaacugaaacuuua

SEQ ID NO: 676203 - RNA, 19 nt, Homo sapiens
ugucagauauuuccauuga

SEQ ID NO: 676204 - RNA, 19 nt, Homo sapiens
guuaauacuccaacaguua

SEQ ID NO: 676205 - RNA, 19 nt, Homo sapiens
guaaagaaaccuaacauag

SEQ ID NO: 676206 - RNA, 19 nt, Homo sapiens
caacuaaagugacuaugca

SEQ ID NO: 676207 - RNA, 19 nt, Homo sapiens
aaacagaaaucuccuuugg

SEQ ID NO: 676208 - RNA, 19 nt, Homo sapiens
gcacauaaggcaucuugaa

SEQ ID NO: 676209 - RNA, 19 nt, Homo sapiens
gcagagaacaucuuaaugg

SEQ ID NO: 676210 - RNA, 19 nt, Homo sapiens
gugcaaacuuggauaaaga

SEQ ID NO: 676211 - RNA, 19 nt, Homo sapiens
agacuuaacuucugcuaga

SEQ ID NO: 676212 - RNA, 19 nt, Homo sapiens
ggauaaagacuccagaaau

SEQ ID NO: 676213 - RNA, 19 nt, Homo sapiens
gacaguggaugaauggauu

SEQ ID NO: 676214 - RNA, 19 nt, Homo sapiens
ccagagagcgcuuagcuuu

SEQ ID NO: 676215 - RNA, 19 nt, Homo sapiens
ucacugaaacugaaacuuu

SEQ ID NO: 676216 - RNA, 19 nt, Homo sapiens
gguaaagacuccagauucu

SEQ ID NO: 676217 - RNA, 19 nt, Homo sapiens
ccugugaacucaaauguga

SEQ ID NO: 676218 - RNA, 19 nt, Homo sapiens
guaagacuauuggaacaaa

SEQ ID NO: 676219 - RNA, 19 nt, Homo sapiens
gcuguaauccaucuuuaua

SEQ ID NO: 676220 - RNA, 19 nt, Homo sapiens
uccaagagcuauuguaaug

SEQ ID NO: 676221 - RNA, 19 nt, Homo sapiens
gauguuaauuuaccaguag

SEQ ID NO: 676222 - RNA, 19 nt, Homo sapiens
ugauuaggaugucccauaa

SEQ ID NO: 676223 - RNA, 19 nt, Homo sapiens
gaaccaauucuggaguuua

SEQ ID NO: 676224 - RNA, 19 nt, Homo sapiens
gaucagcaauauuuguuca

SEQ ID NO: 676225 - RNA, 19 nt, Homo sapiens
gcggcaaugugcuaccuua

SEQ ID NO: 676226 - RNA, 19 nt, Homo sapiens
gugaaccacugacuucuga

SEQ ID NO: 676227 - RNA, 19 nt, Homo sapiens
gcaccuaguaucaguguuu

SEQ ID NO: 676228 - RNA, 19 nt, Homo sapiens
guaccucacauguguauuu

SEQ ID NO: 676229 - RNA, 19 nt, Homo sapiens
ucaacaaugugauccuaaa

SEQ ID NO: 676230 - RNA, 19 nt, Homo sapiens
gaacuucauccaagagcua

SEQ ID NO: 676231 - RNA, 19 nt, Homo sapiens
gcaaugugcuaccuuaaaa

SEQ ID NO: 676232 - RNA, 19 nt, Homo sapiens
gaagagcuagaaacaacua

SEQ ID NO: 676233 - RNA, 19 nt, Homo sapiens
cugcugauauucuggauaa

SEQ ID NO: 676234 - RNA, 19 nt, Homo sapiens
ucaaacaccaccucacuaa

SEQ ID NO: 676235 - RNA, 19 nt, Homo sapiens
gaagauacgaguuuugaua

SEQ ID NO: 676236 - RNA, 19 nt, Homo sapiens
gaaguaaagguacaucugu

SEQ ID NO: 676237 - RNA, 19 nt, Homo sapiens
gggacuaguuugaauggaa

SEQ ID NO: 676238 - RNA, 19 nt, Homo sapiens
gaggucagcuuggagaaga

SEQ ID NO: 676239 - RNA, 19 nt, Homo sapiens
cacaaaccaucacaaaguu

SEQ ID NO: 676240 - RNA, 19 nt, Homo sapiens
caagagcuauuguaauguc

SEQ ID NO: 676241 - RNA, 19 nt, Homo sapiens
guuaaaggcacuaagguaa

SEQ ID NO: 676242 - RNA, 19 nt, Homo sapiens
ccacaguaauacaagauga

SEQ ID NO: 676243 - RNA, 19 nt, Homo sapiens
gggcaugccugcuucaagu

SEQ ID NO: 676244 - RNA, 19 nt, Homo sapiens
cugcagaaauucaggauga

SEQ ID NO: 676245 - RNA, 19 nt, Homo sapiens
gaagucugaugauguucuu

SEQ ID NO: 676246 - RNA, 19 nt, Homo sapiens
gugaagagcuagaaacaac

SEQ ID NO: 676247 - RNA, 19 nt, Homo sapiens
ucauggagaucauuugguu

SEQ ID NO: 676248 - RNA, 19 nt, Homo sapiens
gaaagaaauaugugcugaa

SEQ ID NO: 676249 - RNA, 19 nt, Homo sapiens
gaggaaauguaagacuauu

SEQ ID NO: 676250 - RNA, 19 nt, Homo sapiens
ggaagugucaugucacaga

SEQ ID NO: 676251 - RNA, 19 nt, Homo sapiens
ccagaacacccuaaucuug

SEQ ID NO: 676252 - RNA, 19 nt, Homo sapiens
gcaaaagucaauucuguua

SEQ ID NO: 676253 - RNA, 19 nt, Homo sapiens
aaagguacaucuguuagaa

SEQ ID NO: 676254 - RNA, 19 nt, Homo sapiens
ggacagaaagaugcucuaa

SEQ ID NO: 676255 - RNA, 19 nt, Homo sapiens
ggacaaagaccccagcuaa

SEQ ID NO: 676256 - RNA, 19 nt, Homo sapiens
gaaaagaaacacuggaaaa

SEQ ID NO: 676257 - RNA, 19 nt, Homo sapiens
ccaagaaaggucagaauau

SEQ ID NO: 676258 - RNA, 19 nt, Homo sapiens
acaacaagaucuguauuga

SEQ ID NO: 676259 - RNA, 19 nt, Homo sapiens
gacauucucucuauaugca

SEQ ID NO: 676260 - RNA, 19 nt, Homo sapiens
gcaagcagucuaucauuca

SEQ ID NO: 676261 - RNA, 19 nt, Homo sapiens
ggccaucgaagcacucuua

SEQ ID NO: 676262 - RNA, 19 nt, Homo sapiens
caacaagaucuguauugaa

SEQ ID NO: 676263 - RNA, 19 nt, Homo sapiens
uagcuguaauccaucuuua

SEQ ID NO: 676264 - RNA, 19 nt, Homo sapiens
aaauaaacgucuuccuguu

SEQ ID NO: 676265 - RNA, 19 nt, Homo sapiens
ucacuaauacacagucuuu

SEQ ID NO: 676266 - RNA, 19 nt, Homo sapiens
uuauuuagcuguggucaaa

SEQ ID NO: 676267 - RNA, 19 nt, Homo sapiens
aaccaauucuggaguuuaa

SEQ ID NO: 676268 - RNA, 19 nt, Homo sapiens
ggaaaucacugucucagaa

SEQ ID NO: 676269 - RNA, 19 nt, Homo sapiens
guacagaucuggauggauu

SEQ ID NO: 676270 - RNA, 19 nt, Homo sapiens
gaaauuaacuucacauugc

SEQ ID NO: 676271 - RNA, 19 nt, Homo sapiens
gcaaugagagagagaauua

SEQ ID NO: 676272 - RNA, 19 nt, Homo sapiens
gaacaugccagacacauuu

SEQ ID NO: 676273 - RNA, 19 nt, Homo sapiens
uaaauggccuuccaauaaa

SEQ ID NO: 676274 - RNA, 19 nt, Homo sapiens
ggaagaaugugcugaaaca

SEQ ID NO: 676275 - RNA, 19 nt, Homo sapiens
gaaauauccuccagucaga

SEQ ID NO: 676276 - RNA, 19 nt, Homo sapiens
aaacaagacuccuuaugaa

SEQ ID NO: 676277 - RNA, 19 nt, Homo sapiens
gaaaacagaugcuccaaaa

SEQ ID NO: 676278 - RNA, 19 nt, Homo sapiens
gaaauagacacuuugguuu

SEQ ID NO: 676279 - RNA, 19 nt, Homo sapiens
caaacuacaucaccagaaa

SEQ ID NO: 676280 - RNA, 19 nt, Homo sapiens
cacaagagcugcuaaugaa

SEQ ID NO: 676281 - RNA, 19 nt, Homo sapiens
gaccugauaugccuuguuu

SEQ ID NO: 676282 - RNA, 19 nt, Homo sapiens
ggucuaaacugcaguaauc

SEQ ID NO: 676283 - RNA, 19 nt, Homo sapiens
uuaaauggccuuccaauaa

SEQ ID NO: 676284 - RNA, 19 nt, Homo sapiens
ggauauaaguacugaaaug

SEQ ID NO: 676285 - RNA, 19 nt, Homo sapiens
gaagguagaauucuuguug

SEQ ID NO: 676286 - RNA, 19 nt, Homo sapiens
caaacaagacuccuuauga

SEQ ID NO: 676287 - RNA, 19 nt, Homo sapiens
gaagaccuaucaaguaaca

SEQ ID NO: 676288 - RNA, 19 nt, Homo sapiens
uaaagucgauagugaagaa

SEQ ID NO: 676289 - RNA, 19 nt, Homo sapiens
uaaagugggucguuauaga

SEQ ID NO: 676290 - RNA, 19 nt, Homo sapiens
gaaggaauuucagauguug

SEQ ID NO: 676291 - RNA, 19 nt, Homo sapiens
gguggcaagucaauaauaa

SEQ ID NO: 676292 - RNA, 19 nt, Homo sapiens
gaaggaaaggugccaagua

SEQ ID NO: 676293 - RNA, 19 nt, Homo sapiens
ggaaggauauaaguacuga

SEQ ID NO: 676294 - RNA, 19 nt, Homo sapiens
ggaugaugcuggaagaauu

SEQ ID NO: 676295 - RNA, 19 nt, Homo sapiens
aaggaaaggugccaaguaa

SEQ ID NO: 676296 - RNA, 19 nt, Homo sapiens
ggacaggaaacuugaauug

SEQ ID NO: 676297 - RNA, 19 nt, Homo sapiens
cugaagaccuaucaaguaa

SEQ ID NO: 676298 - RNA, 19 nt, Homo sapiens
cauagaagaugcucagugu

SEQ ID NO: 676299 - RNA, 19 nt, Homo sapiens
gagacuaccuguacagauc

SEQ ID NO: 676300 - RNA, 19 nt, Homo sapiens
agacuaagauugauaacga

SEQ ID NO: 676301 - RNA, 19 nt, Homo sapiens
cgaacgaaauagacacuuu

SEQ ID NO: 676302 - RNA, 19 nt, Homo sapiens
gaacuaaaauugcucauag

SEQ ID NO: 676303 - RNA, 19 nt, Homo sapiens
ggucaaacaagacuccuua

SEQ ID NO: 676304 - RNA, 19 nt, Homo sapiens
gaggagacaucaagaacau

SEQ ID NO: 676305 - RNA, 19 nt, Homo sapiens
aaacugcaguaauccauuu

SEQ ID NO: 676306 - RNA, 19 nt, Homo sapiens
ucaaauaaauugccauguc

SEQ ID NO: 676307 - RNA, 19 nt, Homo sapiens
guacugaaaugauuagaac

SEQ ID NO: 676308 - RNA, 19 nt, Homo sapiens
cgaaauagacacuuugguu

SEQ ID NO: 676309 - RNA, 19 nt, Homo sapiens
cagauggagucuuaucaaa

SEQ ID NO: 676310 - RNA, 19 nt, Homo sapiens
gaacgaaauagacacuuug

SEQ ID NO: 676311 - RNA, 19 nt, Homo sapiens
ggaauacgaacgaaauaga

SEQ ID NO: 676312 - RNA, 19 nt, Homo sapiens
gaagguggcucaggauguc

SEQ ID NO: 676313 - RNA, 19 nt, Homo sapiens
gaaggaauggaacugaauu

SEQ ID NO: 676314 - RNA, 19 nt, Homo sapiens
agaaugaguuugccucuuc

SEQ ID NO: 676315 - RNA, 19 nt, Homo sapiens
gaauuaggcaggaagaaug

SEQ ID NO: 676316 - RNA, 19 nt, Homo sapiens
gaaucuggguggcaaguca

SEQ ID NO: 676317 - RNA, 19 nt, Homo sapiens
ucaacaaucugaucaaacu

SEQ ID NO: 676318 - RNA, 19 nt, Homo sapiens
gaagauguaauccacaaau

SEQ ID NO: 676319 - RNA, 19 nt, Homo sapiens
acaggaaacuugaauugga

SEQ ID NO: 676320 - RNA, 19 nt, Homo sapiens
ggaaaggugccaaguaaag

SEQ ID NO: 676321 - RNA, 19 nt, Homo sapiens
gcagagagagaaagcuaaa

SEQ ID NO: 676322 - RNA, 19 nt, Homo sapiens
gaaaucacugucucagaaa

SEQ ID NO: 676323 - RNA, 19 nt, Homo sapiens
ucacaagagcugcuaauga

SEQ ID NO: 676324 - RNA, 19 nt, Homo sapiens
caagaaagccagucacaag

SEQ ID NO: 676325 - RNA, 19 nt, Homo sapiens
gagcagacuaagauugaua

SEQ ID NO: 676326 - RNA, 19 nt, Homo sapiens
gagcagagagagaaagcua

SEQ ID NO: 676327 - RNA, 19 nt, Homo sapiens
guauuuguguucacuucua

SEQ ID NO: 676328 - RNA, 19 nt, Homo sapiens
gaaagcaggagcagcauag

SEQ ID NO: 676329 - RNA, 19 nt, Homo sapiens
aaaccagaaugcugugaaa

SEQ ID NO: 676330 - RNA, 19 nt, Homo sapiens
ucccaucacuugaaagaaa

SEQ ID NO: 676331 - RNA, 19 nt, Homo sapiens
gaccgaguguucuuuacuu

SEQ ID NO: 676332 - RNA, 19 nt, Homo sapiens
gaaugccaccuucuugauu

SEQ ID NO: 676333 - RNA, 19 nt, Homo sapiens
agaaggaauuucagauguu

SEQ ID NO: 676334 - RNA, 19 nt, Homo sapiens
aaagugaacaugugaagaa

SEQ ID NO: 676335 - RNA, 19 nt, Homo sapiens
gauguaauccacaaauuca

SEQ ID NO: 676336 - RNA, 19 nt, Homo sapiens
caauacagcaagauucaaa

SEQ ID NO: 676337 - RNA, 19 nt, Homo sapiens
gaaagcuaaacgaggaaua

SEQ ID NO: 676338 - RNA, 19 nt, Homo sapiens
gaaagagcagagagagaaa

SEQ ID NO: 676339 - RNA, 19 nt, Homo sapiens
ccaaacauuuuccuucaua

SEQ ID NO: 676340 - RNA, 19 nt, Homo sapiens
aaggaaagguuuaaacagu

SEQ ID NO: 676341 - RNA, 19 nt, Homo sapiens
ggagaggagacaucaagaa

SEQ ID NO: 676342 - RNA, 19 nt, Homo sapiens
aaagcuguaucucagagua

SEQ ID NO: 676343 - RNA, 19 nt, Homo sapiens
uagaagauguaauccacaa

SEQ ID NO: 676344 - RNA, 19 nt, Homo sapiens
uaaaggagacuaccuguac

SEQ ID NO: 676345 - RNA, 19 nt, Homo sapiens
gguugaugauugugaauau

SEQ ID NO: 676346 - RNA, 19 nt, Homo sapiens
uugaaggacugguugauga

SEQ ID NO: 676347 - RNA, 19 nt, Homo sapiens
ccaagacaauacagcaaga

SEQ ID NO: 676348 - RNA, 19 nt, Homo sapiens
gcaaagcagguucccagaa

SEQ ID NO: 676349 - RNA, 19 nt, Homo sapiens
ucucagguauagcaaguaa

SEQ ID NO: 676350 - RNA, 19 nt, Homo sapiens
aaaguugucucagguauag

SEQ ID NO: 676351 - RNA, 19 nt, Homo sapiens
ugaaagagcagagagagaa

SEQ ID NO: 676352 - RNA, 19 nt, Homo sapiens
ggaguagcagaugauauua

SEQ ID NO: 676353 - RNA, 19 nt, Homo sapiens
gaacaugugaagaagacuu

SEQ ID NO: 676354 - RNA, 19 nt, Homo sapiens
gcaggaagaaugugcugaa

SEQ ID NO: 676355 - RNA, 19 nt, Homo sapiens
gaagaauugcagcgagaaa

SEQ ID NO: 676356 - RNA, 19 nt, Homo sapiens
ucagauagaagauguaauc

SEQ ID NO: 676357 - RNA, 19 nt, Homo sapiens
aagaaggaauuucagaugu

SEQ ID NO: 676358 - RNA, 19 nt, Homo sapiens
uaacgagagugauguucga

SEQ ID NO: 676359 - RNA, 19 nt, Homo sapiens
ggggauauuuuguacauuu

SEQ ID NO: 676360 - RNA, 19 nt, Homo sapiens
ccagugagagaaugaguuu

SEQ ID NO: 676361 - RNA, 19 nt, Homo sapiens
guaaauaagacagacuuga

SEQ ID NO: 676362 - RNA, 19 nt, Homo sapiens
uaaauugccauguccuuug

SEQ ID NO: 676363 - RNA, 19 nt, Homo sapiens
gacaauacagcaagauuca

SEQ ID NO: 676364 - RNA, 19 nt, Homo sapiens
ucugaagaccuaucaagua

SEQ ID NO: 676365 - RNA, 19 nt, Homo sapiens
ccagaacagucucaucuac

SEQ ID NO: 676366 - RNA, 19 nt, Homo sapiens
gcuauuccaucuucuguac

SEQ ID NO: 676367 - RNA, 19 nt, Homo sapiens
aauagacacuuugguuuga

SEQ ID NO: 676368 - RNA, 19 nt, Homo sapiens
gcagggaauucuuagauua

SEQ ID NO: 676369 - RNA, 19 nt, Homo sapiens
caacagagauuuguagauu

SEQ ID NO: 676370 - RNA, 19 nt, Homo sapiens
agaaaucgcugcaagguaa

SEQ ID NO: 676371 - RNA, 19 nt, Homo sapiens
gcaaaggcaugauuauuag

SEQ ID NO: 676372 - RNA, 19 nt, Homo sapiens
gaacguggccgauucugua

SEQ ID NO: 676373 - RNA, 19 nt, Homo sapiens
ggacagugcucuccaagau

SEQ ID NO: 676374 - RNA, 19 nt, Homo sapiens
caacacaccuuggguaguu

SEQ ID NO: 676375 - RNA, 19 nt, Homo sapiens
gaaauaacccaccuucaga

SEQ ID NO: 676376 - RNA, 19 nt, Homo sapiens
ccaccaaucuugaugacua

SEQ ID NO: 676377 - RNA, 19 nt, Homo sapiens
ccaaccagcuggauaaaga

SEQ ID NO: 676378 - RNA, 19 nt, Homo sapiens
gaagagaggaggauuuguu

SEQ ID NO: 676379 - RNA, 19 nt, Homo sapiens
uuaaagggaucacauuuga

SEQ ID NO: 676380 - RNA, 19 nt, Homo sapiens
gaggaggauuuguuuauug

SEQ ID NO: 676381 - RNA, 19 nt, Homo sapiens
gggaagauuucauaaacaa

SEQ ID NO: 676382 - RNA, 19 nt, Homo sapiens
gagcaggaguaacaauuga

SEQ ID NO: 676383 - RNA, 19 nt, Homo sapiens
acacauaacugcauuggau

SEQ ID NO: 676384 - RNA, 19 nt, Homo sapiens
uaacagggcacauuucuga

SEQ ID NO: 676385 - RNA, 19 nt, Homo sapiens
guaggcaacucggaauaua

SEQ ID NO: 676386 - RNA, 19 nt, Homo sapiens
ccauuccacucuauaauaa

SEQ ID NO: 676387 - RNA, 19 nt, Homo sapiens
guacucaccuuuauggaau

SEQ ID NO: 676388 - RNA, 19 nt, Homo sapiens
gguaaaugcauccgaauaa

SEQ ID NO: 676389 - RNA, 19 nt, Homo sapiens
ggaaggcuuugauugaaga

SEQ ID NO: 676390 - RNA, 19 nt, Homo sapiens
gcaagguaaucacaauaga

SEQ ID NO: 676391 - RNA, 19 nt, Homo sapiens
gaucacauuugaagacaau

SEQ ID NO: 676392 - RNA, 19 nt, Homo sapiens
gcaccaccauguccagaaa

SEQ ID NO: 676393 - RNA, 19 nt, Homo sapiens
gauaaacccacuucaagaa

SEQ ID NO: 676394 - RNA, 19 nt, Homo sapiens
aaaaguagcugaugcauug

SEQ ID NO: 676395 - RNA, 19 nt, Homo sapiens
gcaagucccuuagcaguca

SEQ ID NO: 676396 - RNA, 19 nt, Homo sapiens
ucugguagcuucaugguaa

SEQ ID NO: 676397 - RNA, 19 nt, Homo sapiens
uaaagcaaaggcaugauua

SEQ ID NO: 676398 - RNA, 19 nt, Homo sapiens
cagacuacgcucauuauua

SEQ ID NO: 676399 - RNA, 19 nt, Homo sapiens
ggaagaaaguggccaacca

SEQ ID NO: 676400 - RNA, 19 nt, Homo sapiens
uccaagaugucaaugauaa

SEQ ID NO: 676401 - RNA, 19 nt, Homo sapiens
ggacuugacuuccuuucuc

SEQ ID NO: 676402 - RNA, 19 nt, Homo sapiens
gcaagcaagucccuuagca

SEQ ID NO: 676403 - RNA, 19 nt, Homo sapiens
gagaggaggauuuguuuau

SEQ ID NO: 676404 - RNA, 19 nt, Homo sapiens
ccuguuacauuuaagagua

SEQ ID NO: 676405 - RNA, 19 nt, Homo sapiens
ugaaguaaaucuggaaaug

SEQ ID NO: 676406 - RNA, 19 nt, Homo sapiens
gaaaagagcaggaguaaca

SEQ ID NO: 676407 - RNA, 19 nt, Homo sapiens
ugaagaagaccacgacaaa

SEQ ID NO: 676408 - RNA, 19 nt, Homo sapiens
aaacugcccuccucaagug

SEQ ID NO: 676409 - RNA, 19 nt, Homo sapiens
gaucugcucucaccaggau

SEQ ID NO: 676410 - RNA, 19 nt, Homo sapiens
gaauaagccauacuggauu

SEQ ID NO: 676411 - RNA, 19 nt, Homo sapiens
caccaucccuucccaaguu

SEQ ID NO: 676412 - RNA, 19 nt, Homo sapiens
ccacggagcaugacuguau

SEQ ID NO: 676413 - RNA, 19 nt, Homo sapiens
agacuacgcucauuauuac

SEQ ID NO: 676414 - RNA, 19 nt, Homo sapiens
gaggauuuguuuauuguca

SEQ ID NO: 676415 - RNA, 19 nt, Homo sapiens
gauuacagcuggucguauc

SEQ ID NO: 676416 - RNA, 19 nt, Homo sapiens
ggaaauaacccaccuucag

SEQ ID NO: 676417 - RNA, 19 nt, Homo sapiens
uauacuauguucuggauga

SEQ ID NO: 676418 - RNA, 19 nt, Homo sapiens
ccaguugucuaacggguuu

SEQ ID NO: 676419 - RNA, 19 nt, Homo sapiens
ugaagaacguggccgauuc

SEQ ID NO: 676420 - RNA, 19 nt, Homo sapiens
aagaacagauggaagaaug

SEQ ID NO: 676421 - RNA, 19 nt, Homo sapiens
ugagcaauauucagaguga

SEQ ID NO: 676422 - RNA, 19 nt, Homo sapiens
gacaaguccuccaccauuc

SEQ ID NO: 676423 - RNA, 19 nt, Homo sapiens
gcagcagccugaacagugu

SEQ ID NO: 676424 - RNA, 19 nt, Homo sapiens
agcaaaggcaugauuauua

SEQ ID NO: 676425 - RNA, 19 nt, Homo sapiens
uaauagcagggaauucuua

SEQ ID NO: 676426 - RNA, 19 nt, Homo sapiens
gguugaauuucuucuggua

SEQ ID NO: 676427 - RNA, 19 nt, Homo sapiens
gguagacuguguugggauu

SEQ ID NO: 676428 - RNA, 19 nt, Homo sapiens
cgacaaguccuccaccauu

SEQ ID NO: 676429 - RNA, 19 nt, Homo sapiens
gaccauggacccucacaaa

SEQ ID NO: 676430 - RNA, 19 nt, Homo sapiens
gaaaugguagacuguguug

SEQ ID NO: 676431 - RNA, 19 nt, Homo sapiens
cuaaauggguaagagguaa

SEQ ID NO: 676432 - RNA, 19 nt, Homo sapiens
uagaagcaaaugcaaguua

SEQ ID NO: 676433 - RNA, 19 nt, Homo sapiens
ugaaaguacucgacaccuu

SEQ ID NO: 676434 - RNA, 19 nt, Homo sapiens
gaauccaaauacauccaaa

SEQ ID NO: 676435 - RNA, 19 nt, Homo sapiens
cguagaaucucccacuuca

SEQ ID NO: 676436 - RNA, 19 nt, Homo sapiens
gaaccacgaaguaguuaau

SEQ ID NO: 676437 - RNA, 19 nt, Homo sapiens
gauaauagcagggaauucu

SEQ ID NO: 676438 - RNA, 19 nt, Homo sapiens
gaaucucccacuucaguuu

SEQ ID NO: 676439 - RNA, 19 nt, Homo sapiens
cgaauaagccauacuggau

SEQ ID NO: 676440 - RNA, 19 nt, Homo sapiens
gugcuuuaguugcuaguuu

SEQ ID NO: 676441 - RNA, 19 nt, Homo sapiens
guauggucauuguucuaua

SEQ ID NO: 676442 - RNA, 19 nt, Homo sapiens
ggauugcaguguuuguuuc

SEQ ID NO: 676443 - RNA, 19 nt, Homo sapiens
guaaaugcauccgaauaag

SEQ ID NO: 676444 - RNA, 19 nt, Homo sapiens
gaagcaaaugcaaguuauu

SEQ ID NO: 676445 - RNA, 19 nt, Homo sapiens
guagaugcauuguaguagu

SEQ ID NO: 676446 - RNA, 19 nt, Homo sapiens
ggucaccucuguccaccuu

SEQ ID NO: 676447 - RNA, 19 nt, Homo sapiens
ggccagugauugaagaaga

SEQ ID NO: 676448 - RNA, 19 nt, Homo sapiens
gagaguaacguaccguaug

SEQ ID NO: 676449 - RNA, 19 nt, Homo sapiens
guacaaacuaaauggguaa

SEQ ID NO: 676450 - RNA, 19 nt, Homo sapiens
agaagcaaaugcaaguuau

SEQ ID NO: 676451 - RNA, 19 nt, Homo sapiens
cgacaccuuuagauaagaa

SEQ ID NO: 676452 - RNA, 19 nt, Homo sapiens
gaaaauggaggcugugauu

SEQ ID NO: 676453 - RNA, 19 nt, Homo sapiens
gccaauguguuuaccaauc

SEQ ID NO: 676454 - RNA, 19 nt, Homo sapiens
ccucguagguugaauuucu

SEQ ID NO: 676455 - RNA, 19 nt, Homo sapiens
ccgauccuguuacauuuaa

SEQ ID NO: 676456 - RNA, 19 nt, Homo sapiens
ggaaaugguagacuguguu

SEQ ID NO: 676457 - RNA, 19 nt, Homo sapiens
gaugagcaauauucagagu

SEQ ID NO: 676458 - RNA, 19 nt, Homo sapiens
gaaggugccaaauuccauu

SEQ ID NO: 676459 - RNA, 19 nt, Homo sapiens
gauccauuccacucuauaa

SEQ ID NO: 676460 - RNA, 19 nt, Homo sapiens
cuucccaaguuucagauua

SEQ ID NO: 676461 - RNA, 19 nt, Homo sapiens
gaagaagaaaucucaaugc

SEQ ID NO: 676462 - RNA, 19 nt, Homo sapiens
ggucauaacagggcacauu

SEQ ID NO: 676463 - RNA, 19 nt, Homo sapiens
aaagcaagcaagucccuua

SEQ ID NO: 676464 - RNA, 19 nt, Homo sapiens
aagaugggcuuugccguuu

SEQ ID NO: 676465 - RNA, 19 nt, Homo sapiens
caacuugccaauguguuua

SEQ ID NO: 676466 - RNA, 19 nt, Homo sapiens
ugacaaggguagccagcuu

SEQ ID NO: 676467 - RNA, 19 nt, Homo sapiens
caaacuaaauggguaagag

SEQ ID NO: 676468 - RNA, 19 nt, Homo sapiens
caaaguccauugcuaaguu

SEQ ID NO: 676469 - RNA, 19 nt, Homo sapiens
guauaucccuguugauuug

SEQ ID NO: 676470 - RNA, 19 nt, Homo sapiens
gaauggauccugaugauau

SEQ ID NO: 676471 - RNA, 19 nt, Homo sapiens
gcucugaugucuagcugua

SEQ ID NO: 676472 - RNA, 19 nt, Homo sapiens
cagcuguccuccagucuua

SEQ ID NO: 676473 - RNA, 19 nt, Homo sapiens
caauauguguuuccuugaa

SEQ ID NO: 676474 - RNA, 19 nt, Homo sapiens
ucacaaaguccauugcuaa

SEQ ID NO: 676475 - RNA, 19 nt, Homo sapiens
acacagauaugagaaguug

SEQ ID NO: 676476 - RNA, 19 nt, Homo sapiens
gaugacaaauacaccuuga

SEQ ID NO: 676477 - RNA, 19 nt, Homo sapiens
cguagcggcuuguuggaua

SEQ ID NO: 676478 - RNA, 19 nt, Homo sapiens
ggaucuugcugaauuagug

SEQ ID NO: 676479 - RNA, 19 nt, Homo sapiens
ggauggaucagcugugaaa

SEQ ID NO: 676480 - RNA, 19 nt, Homo sapiens
uacaaucuccuguuucuuu

SEQ ID NO: 676481 - RNA, 19 nt, Homo sapiens
ccaugacagucuugccaua

SEQ ID NO: 676482 - RNA, 19 nt, Homo sapiens
ggaauggauccugaugaua

SEQ ID NO: 676483 - RNA, 19 nt, Homo sapiens
gaccauuuauaccucauau

SEQ ID NO: 676484 - RNA, 19 nt, Homo sapiens
aguggaagauagaugauaa

SEQ ID NO: 676485 - RNA, 19 nt, Homo sapiens
gaauucaggauacaacuuc

SEQ ID NO: 676486 - RNA, 19 nt, Homo sapiens
guagcggcuuguuggauaa

SEQ ID NO: 676487 - RNA, 19 nt, Homo sapiens
gaagccgaguucacaaagu

SEQ ID NO: 676488 - RNA, 19 nt, Homo sapiens
gggauucugaccauuuaua

SEQ ID NO: 676489 - RNA, 19 nt, Homo sapiens
gcuuugauuugggauuaua

SEQ ID NO: 676490 - RNA, 19 nt, Homo sapiens
ugacagucuugccauagaa

SEQ ID NO: 676491 - RNA, 19 nt, Homo sapiens
aaaguccauugcuaaguuu

SEQ ID NO: 676492 - RNA, 19 nt, Homo sapiens
gcuaaaagcuguacagacu

SEQ ID NO: 676493 - RNA, 19 nt, Homo sapiens
cauaguggcuuugauuugg

SEQ ID NO: 676494 - RNA, 19 nt, Homo sapiens
gcuguagucuccuugaucu

SEQ ID NO: 676495 - RNA, 19 nt, Homo sapiens
gaaguuguagcucugaugu

SEQ ID NO: 676496 - RNA, 19 nt, Homo sapiens
acagauaugagaaguugua

SEQ ID NO: 676497 - RNA, 19 nt, Homo sapiens
uggcuuugauuugggauua

SEQ ID NO: 676498 - RNA, 19 nt, Homo sapiens
gauagaugauaagccugua

SEQ ID NO: 676499 - RNA, 19 nt, Homo sapiens
acuaguauaucccuguuga

SEQ ID NO: 676500 - RNA, 19 nt, Homo sapiens
ccacuaguauaucccuguu

SEQ ID NO: 676501 - RNA, 19 nt, Homo sapiens
ccuggaucuugcugaauua

SEQ ID NO: 676502 - RNA, 19 nt, Homo sapiens
ucuguacaaucuccuguuu

SEQ ID NO: 676503 - RNA, 19 nt, Homo sapiens
gaagaauucaggauacaac

SEQ ID NO: 676504 - RNA, 19 nt, Homo sapiens
gauaugagaaguuguagcu

SEQ ID NO: 676505 - RNA, 19 nt, Homo sapiens
ugacacagauaugagaagu

SEQ ID NO: 676506 - RNA, 19 nt, Homo sapiens
aauggauccugaugauauu

SEQ ID NO: 676507 - RNA, 19 nt, Homo sapiens
acaaucuccuguuucuuug

SEQ ID NO: 676508 - RNA, 19 nt, Homo sapiens
uguguuuccuugaagaauu

SEQ ID NO: 676509 - RNA, 19 nt, Homo sapiens
gggaagccgaguucacaaa

SEQ ID NO: 676510 - RNA, 19 nt, Homo sapiens
aaaagguacuucuggaaaa

SEQ ID NO: 676511 - RNA, 19 nt, Homo sapiens
ccuagcaguacuuuauaua

SEQ ID NO: 676512 - RNA, 19 nt, Homo sapiens
uguacaaucuccuguuucu

SEQ ID NO: 676513 - RNA, 19 nt, Homo sapiens
gauaaguggaagauagaug

SEQ ID NO: 676514 - RNA, 19 nt, Homo sapiens
ugacaaauacaccuugaag

SEQ ID NO: 676515 - RNA, 19 nt, Homo sapiens
gagaaguuguagcucugau

SEQ ID NO: 676516 - RNA, 19 nt, Homo sapiens
uccuggaucuugcugaauu

SEQ ID NO: 676517 - RNA, 19 nt, Homo sapiens
gugggacacuggucaugga

SEQ ID NO: 676518 - RNA, 19 nt, Homo sapiens
uuggauaaguggaagauag

SEQ ID NO: 676519 - RNA, 19 nt, Homo sapiens
ccauaguggcuuugauuug

SEQ ID NO: 676520 - RNA, 19 nt, Homo sapiens
uaguauaucccuguugauu

SEQ ID NO: 676521 - RNA, 19 nt, Homo sapiens
aaucuguugcugacucuua

SEQ ID NO: 676522 - RNA, 19 nt, Homo sapiens
ucugcugauugcauuauuu

SEQ ID NO: 676523 - RNA, 19 nt, Homo sapiens
uaucugauuugggaagaau

SEQ ID NO: 676524 - RNA, 19 nt, Homo sapiens
uaugacagcuuuccuucac

SEQ ID NO: 676525 - RNA, 19 nt, Homo sapiens
ugggauggaucagcuguga

SEQ ID NO: 676526 - RNA, 19 nt, Homo sapiens
uagaugauaagccuguaaa

SEQ ID NO: 676527 - RNA, 19 nt, Homo sapiens
ggaagccgaguucacaaag

SEQ ID NO: 676528 - RNA, 19 nt, Homo sapiens
auaaguggaagauagauga

SEQ ID NO: 676529 - RNA, 19 nt, Homo sapiens
uaucccuguugauuuguuu

SEQ ID NO: 676530 - RNA, 19 nt, Homo sapiens
cuuucugccuguuacauuu

SEQ ID NO: 676531 - RNA, 19 nt, Homo sapiens
ugacaagugggauggauca

SEQ ID NO: 676532 - RNA, 19 nt, Homo sapiens
guagccaauucuaaaagua

SEQ ID NO: 676533 - RNA, 19 nt, Homo sapiens
ggugguagcggaggcugua

SEQ ID NO: 676534 - RNA, 19 nt, Homo sapiens
acaaauacaccuugaagcu

SEQ ID NO: 676535 - RNA, 19 nt, Homo sapiens
ugugugucauauccuauuu

SEQ ID NO: 676536 - RNA, 19 nt, Homo sapiens
uuugggccauguagcauuu

SEQ ID NO: 676537 - RNA, 19 nt, Homo sapiens
aguauaucccuguugauuu

SEQ ID NO: 676538 - RNA, 19 nt, Homo sapiens
guguuuccuugaagaauuc

SEQ ID NO: 676539 - RNA, 19 nt, Homo sapiens
uaccuagcaguacuuuaua

SEQ ID NO: 676540 - RNA, 19 nt, Homo sapiens
gaucugcugauugcauuau

SEQ ID NO: 676541 - RNA, 19 nt, Homo sapiens
cagcuuuccuucacacacu

SEQ ID NO: 676542 - RNA, 19 nt, Homo sapiens
ucuuguguaugacagcuuu

SEQ ID NO: 676543 - RNA, 19 nt, Homo sapiens
caacuucuuguguaugaca

SEQ ID NO: 676544 - RNA, 19 nt, Homo sapiens
aagccgaguucacaaaguc

SEQ ID NO: 676545 - RNA, 19 nt, Homo sapiens
gacagucuugccauagaaa

SEQ ID NO: 676546 - RNA, 19 nt, Homo sapiens
gcgggaagccgaguucaca

SEQ ID NO: 676547 - RNA, 19 nt, Homo sapiens
gcagcuguccuccagucuu

SEQ ID NO: 676548 - RNA, 19 nt, Homo sapiens
uugauuuguuugugccuuu

SEQ ID NO: 676549 - RNA, 19 nt, Homo sapiens
ugcugacucuuaauuccua

SEQ ID NO: 676550 - RNA, 19 nt, Homo sapiens
ggucgccucaccaucugua

SEQ ID NO: 676551 - RNA, 19 nt, Homo sapiens
guauagcuuugggccaugu

SEQ ID NO: 676552 - RNA, 19 nt, Homo sapiens
uugaucugcugauugcauu

SEQ ID NO: 676553 - RNA, 19 nt, Homo sapiens
ucuccuggaucuugcugaa

SEQ ID NO: 676554 - RNA, 19 nt, Homo sapiens
ggguaaaguaagaaauguu

SEQ ID NO: 676555 - RNA, 19 nt, Homo sapiens
gcuguccuccagucuuaaa

SEQ ID NO: 676556 - RNA, 19 nt, Homo sapiens
ggauccugaugauauuugg

SEQ ID NO: 676557 - RNA, 19 nt, Homo sapiens
ggauucugaccauuuauac

SEQ ID NO: 676558 - RNA, 19 nt, Homo sapiens
uauaucugauuugggaaga

SEQ ID NO: 676559 - RNA, 19 nt, Homo sapiens
gaacuuaaaauggguaaag

SEQ ID NO: 676560 - RNA, 19 nt, Homo sapiens
caauuaaagaagccaaugg

SEQ ID NO: 676561 - RNA, 19 nt, Homo sapiens
ccaauuaaagaagccaaug

SEQ ID NO: 676562 - RNA, 19 nt, Homo sapiens
uuguagcucugaugucuag

SEQ ID NO: 676563 - RNA, 19 nt, Homo sapiens
uggguaaaguaagaaaugu

SEQ ID NO: 676564 - RNA, 19 nt, Homo sapiens
ucugauuugggaagaauuu

SEQ ID NO: 676565 - RNA, 19 nt, Homo sapiens
aauauguguuuccuugaag

SEQ ID NO: 676566 - RNA, 19 nt, Homo sapiens
cuagcaguacuuuauauag

SEQ ID NO: 676567 - RNA, 19 nt, Homo sapiens
gcggcuuguuggauaagug

SEQ ID NO: 676568 - RNA, 19 nt, Homo sapiens
ggaaagagcucaagagaug

SEQ ID NO: 676569 - RNA, 19 nt, Homo sapiens
gaagaaagcuccucacuca

SEQ ID NO: 676570 - RNA, 19 nt, Homo sapiens
gacaaaggcuucuaaagua

SEQ ID NO: 676571 - RNA, 19 nt, Homo sapiens
ggaagaagauuacaaggaa

SEQ ID NO: 676572 - RNA, 19 nt, Homo sapiens
gcacaaggcugacucuuug

SEQ ID NO: 676573 - RNA, 19 nt, Homo sapiens
aaacaucgcugguauaaga

SEQ ID NO: 676574 - RNA, 19 nt, Homo sapiens
gaagaaacaucgcugguau

SEQ ID NO: 676575 - RNA, 19 nt, Homo sapiens
ccacagaacuucauugaug

SEQ ID NO: 676576 - RNA, 19 nt, Homo sapiens
gaacaaggacucucuguau

SEQ ID NO: 676577 - RNA, 19 nt, Homo sapiens
ugaagaagaugaugaaaug

SEQ ID NO: 676578 - RNA, 19 nt, Homo sapiens
gaaagaaguuaaggaagaa

SEQ ID NO: 676579 - RNA, 19 nt, Homo sapiens
guacauggcuuuccuaaaa

SEQ ID NO: 676580 - RNA, 19 nt, Homo sapiens
gacagaagauaaugaagaa

SEQ ID NO: 676581 - RNA, 19 nt, Homo sapiens
uaaaguagcagaucuggua

SEQ ID NO: 676582 - RNA, 19 nt, Homo sapiens
gaagaaacacagaaagaaa

SEQ ID NO: 676583 - RNA, 19 nt, Homo sapiens
ggaggaagcugaugaaagc

SEQ ID NO: 676584 - RNA, 19 nt, Homo sapiens
aagaagcgcuguuuaaaug

SEQ ID NO: 676585 - RNA, 19 nt, Homo sapiens
gaagagaaaucccaaagcu

SEQ ID NO: 676586 - RNA, 19 nt, Homo sapiens
ggucagaggauauagauaa

SEQ ID NO: 676587 - RNA, 19 nt, Homo sapiens
gcuuauagaugccagcuuu

SEQ ID NO: 676588 - RNA, 19 nt, Homo sapiens
gauguaagcugugguuaug

SEQ ID NO: 676589 - RNA, 19 nt, Homo sapiens
agaaagaaguuaaggaaga

SEQ ID NO: 676590 - RNA, 19 nt, Homo sapiens
ucaaagaggaagaagauua

SEQ ID NO: 676591 - RNA, 19 nt, Homo sapiens
gaaagugggaagaugauaa

SEQ ID NO: 676592 - RNA, 19 nt, Homo sapiens
ggaagaagacagugaaaug

SEQ ID NO: 676593 - RNA, 19 nt, Homo sapiens
gaagaugcccggaagagaa

SEQ ID NO: 676594 - RNA, 19 nt, Homo sapiens
gauguuugaugcagaauau

SEQ ID NO: 676595 - RNA, 19 nt, Homo sapiens
ggagaagucuuugcugaug

SEQ ID NO: 676596 - RNA, 19 nt, Homo sapiens
agaaggcccugccauuuaa

SEQ ID NO: 676597 - RNA, 19 nt, Homo sapiens
gaaaacggcucuagugaug

SEQ ID NO: 676598 - RNA, 19 nt, Homo sapiens
gcaaacuucucacccuuau

SEQ ID NO: 676599 - RNA, 19 nt, Homo sapiens
cagaaggcccugccauuua

SEQ ID NO: 676600 - RNA, 19 nt, Homo sapiens
ggagauguuugaugcagaa

SEQ ID NO: 676601 - RNA, 19 nt, Homo sapiens
agaagaaagugccaagaaa

SEQ ID NO: 676602 - RNA, 19 nt, Homo sapiens
ggaaguggccaaauuugaa

SEQ ID NO: 676603 - RNA, 19 nt, Homo sapiens
gcgcagaauuugaagauca

SEQ ID NO: 676604 - RNA, 19 nt, Homo sapiens
ggacagugacagaagauaa

SEQ ID NO: 676605 - RNA, 19 nt, Homo sapiens
ccaaaccuccgaaagcuua

SEQ ID NO: 676606 - RNA, 19 nt, Homo sapiens
gaagaugacggguuggaaa

SEQ ID NO: 676607 - RNA, 19 nt, Homo sapiens
gaggauauccgaacaaaca

SEQ ID NO: 676608 - RNA, 19 nt, Homo sapiens
ggagguagacaguuucaaa

SEQ ID NO: 676609 - RNA, 19 nt, Homo sapiens
acccaaagcugcaaagaaa

SEQ ID NO: 676610 - RNA, 19 nt, Homo sapiens
gaugagcgauauugucuuc

SEQ ID NO: 676611 - RNA, 19 nt, Homo sapiens
gaacugguuucuuggcaau

SEQ ID NO: 676612 - RNA, 19 nt, Homo sapiens
acagggaacugguuucuug

SEQ ID NO: 676613 - RNA, 19 nt, Homo sapiens
gaugaaaugucugaagaug

SEQ ID NO: 676614 - RNA, 19 nt, Homo sapiens
gaucugguacugaugcuua

SEQ ID NO: 676615 - RNA, 19 nt, Homo sapiens
gcucuacggugacuuugaa

SEQ ID NO: 676616 - RNA, 19 nt, Homo sapiens
gauaaucaagggcuaauga

SEQ ID NO: 676617 - RNA, 19 nt, Homo sapiens
gaagggcauuucaggauca

SEQ ID NO: 676618 - RNA, 19 nt, Homo sapiens
cagacaggauggaagauuu

SEQ ID NO: 676619 - RNA, 19 nt, Homo sapiens
gaggauaagcugcugauga

SEQ ID NO: 676620 - RNA, 19 nt, Homo sapiens
cagaggauauagauaauca

SEQ ID NO: 676621 - RNA, 19 nt, Homo sapiens
cuaaacaucugucaaguac

SEQ ID NO: 676622 - RNA, 19 nt, Homo sapiens
gacauuaacaugaugauug

SEQ ID NO: 676623 - RNA, 19 nt, Homo sapiens
ucacaggacucaggauuug

SEQ ID NO: 676624 - RNA, 19 nt, Homo sapiens
ucaaagccuucucaaguga

SEQ ID NO: 676625 - RNA, 19 nt, Homo sapiens
gagaagucuuugcugauga

SEQ ID NO: 676626 - RNA, 19 nt, Homo sapiens
ccacuugggucagaggaua

SEQ ID NO: 676627 - RNA, 19 nt, Homo sapiens
aacaaggacucucuguaua

SEQ ID NO: 676628 - RNA, 19 nt, Homo sapiens
gucccgagauccaaucaua

SEQ ID NO: 676629 - RNA, 19 nt, Homo sapiens
gaagaagacucagaaaaug

SEQ ID NO: 676630 - RNA, 19 nt, Homo sapiens
agagaaaucccaaagcuuu

SEQ ID NO: 676631 - RNA, 19 nt, Homo sapiens
gccaagcuguucuaccuuu

SEQ ID NO: 676632 - RNA, 19 nt, Homo sapiens
gaagacaaagaagcgauua

SEQ ID NO: 676633 - RNA, 19 nt, Homo sapiens
agaaggaccucaggaagaa

SEQ ID NO: 676634 - RNA, 19 nt, Homo sapiens
aaacaucugucaaguacau

SEQ ID NO: 676635 - RNA, 19 nt, Homo sapiens
guacugaugcuuauagaug

SEQ ID NO: 676636 - RNA, 19 nt, Homo sapiens
gaaagaagaaaccagaagu

SEQ ID NO: 676637 - RNA, 19 nt, Homo sapiens
gaaacaagcacagcugaau

SEQ ID NO: 676638 - RNA, 19 nt, Homo sapiens
caaaggcuucuaaaguaua

SEQ ID NO: 676639 - RNA, 19 nt, Homo sapiens
ggagaaagcacauauuuug

SEQ ID NO: 676640 - RNA, 19 nt, Homo sapiens
gugggaagaugauaaagau

SEQ ID NO: 676641 - RNA, 19 nt, Homo sapiens
ugacaaacccagaggauau

SEQ ID NO: 676642 - RNA, 19 nt, Homo sapiens
acaaaggcuucuaaaguau

SEQ ID NO: 676643 - RNA, 19 nt, Homo sapiens
gaaggagaaagcacauauu

SEQ ID NO: 676644 - RNA, 19 nt, Homo sapiens
gaagaagaagaugaugaua

SEQ ID NO: 676645 - RNA, 19 nt, Homo sapiens
uccgaaagcuuauuuaugg

SEQ ID NO: 676646 - RNA, 19 nt, Homo sapiens
agaaggagaagcugguuua

SEQ ID NO: 676647 - RNA, 19 nt, Homo sapiens
uagcagaucugguacugau

SEQ ID NO: 676648 - RNA, 19 nt, Homo sapiens
ugauugaucuggcuaaagu

SEQ ID NO: 676649 - RNA, 19 nt, Homo sapiens
caauaaagagcacuucaga

SEQ ID NO: 676650 - RNA, 19 nt, Homo sapiens
agacaaaggcuucuaaagu

SEQ ID NO: 676651 - RNA, 19 nt, Homo sapiens
gcccauggcgucagacuaa

SEQ ID NO: 676652 - RNA, 19 nt, Homo sapiens
gaaguuaaggaagaaauug

SEQ ID NO: 676653 - RNA, 19 nt, Homo sapiens
ugagaccagugauauagaa

SEQ ID NO: 676654 - RNA, 19 nt, Homo sapiens
caaaagaagcgcuguuuaa

SEQ ID NO: 676655 - RNA, 19 nt, Homo sapiens
cagaggauauccgaacaaa

SEQ ID NO: 676656 - RNA, 19 nt, Homo sapiens
aaacuucucacccuuauau

SEQ ID NO: 676657 - RNA, 19 nt, Homo sapiens
aaccagaaguccaguuuga

SEQ ID NO: 676658 - RNA, 19 nt, Homo sapiens
acaaggacucucuguauaa

SEQ ID NO: 676659 - RNA, 19 nt, Homo sapiens
gaagauauagagaaagaag

SEQ ID NO: 676660 - RNA, 19 nt, Homo sapiens
agaagaagaugaugauacu

SEQ ID NO: 676661 - RNA, 19 nt, Homo sapiens
gaagagguguuugcaucug

SEQ ID NO: 676662 - RNA, 19 nt, Homo sapiens
gagaagggcauuucaggau

SEQ ID NO: 676663 - RNA, 19 nt, Homo sapiens
agaauaugaugaaggagaa

SEQ ID NO: 676664 - RNA, 19 nt, Homo sapiens
ugaaagcagugaagaagag

SEQ ID NO: 676665 - RNA, 19 nt, Homo sapiens
ugaaaugucugaagaugac

SEQ ID NO: 676666 - RNA, 19 nt, Homo sapiens
gaugggaccuccaaaaguu

SEQ ID NO: 676667 - RNA, 19 nt, Homo sapiens
gaugauugaucuggcuaaa

SEQ ID NO: 676668 - RNA, 19 nt, Homo sapiens
gaggguagcugccugcaua

SEQ ID NO: 676669 - RNA, 19 nt, Homo sapiens
guaaacaucuuccuucaga

SEQ ID NO: 676670 - RNA, 19 nt, Homo sapiens
gaaucuaccuuuccauuga

SEQ ID NO: 676671 - RNA, 19 nt, Homo sapiens
gagaguagcuggaguguac

SEQ ID NO: 676672 - RNA, 19 nt, Homo sapiens
gaucguggaugcagcguaa

SEQ ID NO: 676673 - RNA, 19 nt, Homo sapiens
gcugugaacugccauguga

SEQ ID NO: 676674 - RNA, 19 nt, Homo sapiens
gagccucgcuuccgauuau

SEQ ID NO: 676675 - RNA, 19 nt, Homo sapiens
ccaagccagucauccauua

SEQ ID NO: 676676 - RNA, 19 nt, Homo sapiens
gcaaggaugaugugaacua

SEQ ID NO: 676677 - RNA, 19 nt, Homo sapiens
agaagccgcugcugaaauu

SEQ ID NO: 676678 - RNA, 19 nt, Homo sapiens
gaacugagagggaaaugga

SEQ ID NO: 676679 - RNA, 19 nt, Homo sapiens
aagcagaugucauggagua

SEQ ID NO: 676680 - RNA, 19 nt, Homo sapiens
uaaccucagucuccuguaa

SEQ ID NO: 676681 - RNA, 19 nt, Homo sapiens
ugacugagcucuucuucau

SEQ ID NO: 676682 - RNA, 19 nt, Homo sapiens
ggacaucaccauugacuuc

SEQ ID NO: 676683 - RNA, 19 nt, Homo sapiens
cagguuaaaucucuaaugu

SEQ ID NO: 676684 - RNA, 19 nt, Homo sapiens
gaagggaaacgguagcuau

SEQ ID NO: 676685 - RNA, 19 nt, Homo sapiens
uugaauaccuucuucuuga

SEQ ID NO: 676686 - RNA, 19 nt, Homo sapiens
gggaaacgguagcuauuca

SEQ ID NO: 676687 - RNA, 19 nt, Homo sapiens
guagaauucucuuuauugg

SEQ ID NO: 676688 - RNA, 19 nt, Homo sapiens
ggguagaauucucuuuauu

SEQ ID NO: 676689 - RNA, 19 nt, Homo sapiens
ugacugaguugaauaccuu

SEQ ID NO: 676690 - RNA, 19 nt, Homo sapiens
gguagaauucucuuuauug

SEQ ID NO: 676691 - RNA, 19 nt, Homo sapiens
ggaccuauguucgaugguu

SEQ ID NO: 676692 - RNA, 19 nt, Homo sapiens
ucuagaaccuugaccuuga

SEQ ID NO: 676693 - RNA, 19 nt, Homo sapiens
gaggugcuggugaguauua

SEQ ID NO: 676694 - RNA, 19 nt, Homo sapiens
caauggcguuggaaagaaa

SEQ ID NO: 676695 - RNA, 19 nt, Homo sapiens
ggaggccauuguuugcaua

SEQ ID NO: 676696 - RNA, 19 nt, Homo sapiens
gaaacgguagcuauucauu

SEQ ID NO: 676697 - RNA, 19 nt, Homo sapiens
ggucucugcuggacaauca

SEQ ID NO: 676698 - RNA, 19 nt, Homo sapiens
aguauuaccuuucaucugu

SEQ ID NO: 676699 - RNA, 19 nt, Homo sapiens
ggcauccucucuguuauuu

SEQ ID NO: 676700 - RNA, 19 nt, Homo sapiens
ugaagcauaucuuuguguu

SEQ ID NO: 676701 - RNA, 19 nt, Homo sapiens
gugaggugcuggugaguau

SEQ ID NO: 676702 - RNA, 19 nt, Homo sapiens
ugaauaccuucuucuugaa

SEQ ID NO: 676703 - RNA, 19 nt, Homo sapiens
gaccuauguucgaugguuu

SEQ ID NO: 676704 - RNA, 19 nt, Homo sapiens
gcguaaacaucuuccuuca

SEQ ID NO: 676705 - RNA, 19 nt, Homo sapiens
gaucguaagucuuguuucc

SEQ ID NO: 676706 - RNA, 19 nt, Homo sapiens
uggaggacaucaccauuga

SEQ ID NO: 676707 - RNA, 19 nt, Homo sapiens
gcagugaacaccacagcuu

SEQ ID NO: 676708 - RNA, 19 nt, Homo sapiens
gcagcugacugaguugaau

SEQ ID NO: 676709 - RNA, 19 nt, Homo sapiens
gcuggugaguauuaccuuu

SEQ ID NO: 676710 - RNA, 19 nt, Homo sapiens
ccacuuuccucugucugua

SEQ ID NO: 676711 - RNA, 19 nt, Homo sapiens
ccaaauacucuauguugug

SEQ ID NO: 676712 - RNA, 19 nt, Homo sapiens
agagagcuguucugcaguu

SEQ ID NO: 676713 - RNA, 19 nt, Homo sapiens
gagaucguaagucuuguuu

SEQ ID NO: 676714 - RNA, 19 nt, Homo sapiens
ugagacaguacuacgcuua

SEQ ID NO: 676715 - RNA, 19 nt, Homo sapiens
cauggucguuugccgguuu

SEQ ID NO: 676716 - RNA, 19 nt, Homo sapiens
gagcagguuaaaucucuaa

SEQ ID NO: 676717 - RNA, 19 nt, Homo sapiens
acacuauggucaccgagaa

SEQ ID NO: 676718 - RNA, 19 nt, Homo sapiens
guugugcuuuggcuucuuu

SEQ ID NO: 676719 - RNA, 19 nt, Homo sapiens
gacauccuguugugcaaug

SEQ ID NO: 676720 - RNA, 19 nt, Homo sapiens
aggaugaugugaacuacaa

SEQ ID NO: 676721 - RNA, 19 nt, Homo sapiens
gaauuucgagcagguuaaa

SEQ ID NO: 676722 - RNA, 19 nt, Homo sapiens
ccagucauccauuaaguug

SEQ ID NO: 676723 - RNA, 19 nt, Homo sapiens
ucuggcagcugacugaguu

SEQ ID NO: 676724 - RNA, 19 nt, Homo sapiens
gaaccuugaccuugauagu

SEQ ID NO: 676725 - RNA, 19 nt, Homo sapiens
uaagaccuccuaccacaug

SEQ ID NO: 676726 - RNA, 19 nt, Homo sapiens
aacgguagcuauucauuca

SEQ ID NO: 676727 - RNA, 19 nt, Homo sapiens
gucauuauuugagaucgua

SEQ ID NO: 676728 - RNA, 19 nt, Homo sapiens
gagaucuccuggcaucaca

SEQ ID NO: 676729 - RNA, 19 nt, Homo sapiens
uaccagggaugacucuguu

SEQ ID NO: 676730 - RNA, 19 nt, Homo sapiens
caucaccauugacuucuuc

SEQ ID NO: 676731 - RNA, 19 nt, Homo sapiens
gcauaucuuuguguuccaa

SEQ ID NO: 676732 - RNA, 19 nt, Homo sapiens
gaagaucaagagagcuguu

SEQ ID NO: 676733 - RNA, 19 nt, Homo sapiens
uauuugagaucguaagucu

SEQ ID NO: 676734 - RNA, 19 nt, Homo sapiens
ugaguugaauaccuucuuc

SEQ ID NO: 676735 - RNA, 19 nt, Homo sapiens
ccugcuagcuggaccuaug

SEQ ID NO: 676736 - RNA, 19 nt, Homo sapiens
ccacuuuucugucuuuuau

SEQ ID NO: 676737 - RNA, 19 nt, Homo sapiens
aagcaaggaugaugugaac

SEQ ID NO: 676738 - RNA, 19 nt, Homo sapiens
ccagagugccuagaacuga

SEQ ID NO: 676739 - RNA, 19 nt, Homo sapiens
ggacaaaagguucugaaga

SEQ ID NO: 676740 - RNA, 19 nt, Homo sapiens
gcauuuggcugggcauggu

SEQ ID NO: 676741 - RNA, 19 nt, Homo sapiens
gaagaggcgagggcacuug

SEQ ID NO: 676742 - RNA, 19 nt, Homo sapiens
uguacggcaugauuuggua

SEQ ID NO: 676743 - RNA, 19 nt, Homo sapiens
guugaauaccuucuucuug

SEQ ID NO: 676744 - RNA, 19 nt, Homo sapiens
gcagguuaaaucucuaaug

SEQ ID NO: 676745 - RNA, 19 nt, Homo sapiens
gaucaacgagcagcaagug

SEQ ID NO: 676746 - RNA, 19 nt, Homo sapiens
ccucauguacuucgccuuu

SEQ ID NO: 676747 - RNA, 19 nt, Homo sapiens
gacaaaagguucugaagac

SEQ ID NO: 676748 - RNA, 19 nt, Homo sapiens
ccacagugagacaguacua

SEQ ID NO: 676749 - RNA, 19 nt, Homo sapiens
cuggugggaucaagucauu

SEQ ID NO: 676750 - RNA, 19 nt, Homo sapiens
ucaucaguguguuagcuuu

SEQ ID NO: 676751 - RNA, 19 nt, Homo sapiens
caacaacgaaagccauucu

SEQ ID NO: 676752 - RNA, 19 nt, Homo sapiens
caagccagucauccauuaa

SEQ ID NO: 676753 - RNA, 19 nt, Homo sapiens
caaaucuucuuuucagaga

SEQ ID NO: 676754 - RNA, 19 nt, Homo sapiens
gcagaugucauggaguaug

SEQ ID NO: 676755 - RNA, 19 nt, Homo sapiens
uuccuacucuuccugaauu

SEQ ID NO: 676756 - RNA, 19 nt, Homo sapiens
ggaucccuguuuuaaauaa

SEQ ID NO: 676757 - RNA, 19 nt, Homo sapiens
ugaaucuaccuuuccauug

SEQ ID NO: 676758 - RNA, 19 nt, Homo sapiens
agacccaaauacucuaugu

SEQ ID NO: 676759 - RNA, 19 nt, Homo sapiens
gggcaagcuucaaggacau

SEQ ID NO: 676760 - RNA, 19 nt, Homo sapiens
caaggaugaugugaacuac

SEQ ID NO: 676761 - RNA, 19 nt, Homo sapiens
guuguauuccuguuuggua

SEQ ID NO: 676762 - RNA, 19 nt, Homo sapiens
gcgguguguugaagggaaa

SEQ ID NO: 676763 - RNA, 19 nt, Homo sapiens
gcaugcaggcaacaacgaa

SEQ ID NO: 676764 - RNA, 19 nt, Homo sapiens
gcaccuacaguccagagau

SEQ ID NO: 676765 - RNA, 19 nt, Homo sapiens
cccaaauacucuauguugu

SEQ ID NO: 676766 - RNA, 19 nt, Homo sapiens
guagcuggaguguaccuuu

SEQ ID NO: 676767 - RNA, 19 nt, Homo sapiens
ucgagcagguuaaaucucu

SEQ ID NO: 676768 - RNA, 19 nt, Homo sapiens
gcagauggcuucuuuagga

SEQ ID NO: 676769 - RNA, 19 nt, Homo sapiens
gcacacaucuaccuacgua

SEQ ID NO: 676770 - RNA, 19 nt, Homo sapiens
gcauuuacauggcuguuua

SEQ ID NO: 676771 - RNA, 19 nt, Homo sapiens
gauaggauuugcucacaua

SEQ ID NO: 676772 - RNA, 19 nt, Homo sapiens
gcacaaggauuaaguugga

SEQ ID NO: 676773 - RNA, 19 nt, Homo sapiens
gcaaugaagugacaagaug

SEQ ID NO: 676774 - RNA, 19 nt, Homo sapiens
gugagaaacugaucaaauu

SEQ ID NO: 676775 - RNA, 19 nt, Homo sapiens
gcuaacaucuggaucguaa

SEQ ID NO: 676776 - RNA, 19 nt, Homo sapiens
uuacauggcuguuuagaaa

SEQ ID NO: 676777 - RNA, 19 nt, Homo sapiens
gaaagaauccauuugaaga

SEQ ID NO: 676778 - RNA, 19 nt, Homo sapiens
cagacuaucuucaacauuu

SEQ ID NO: 676779 - RNA, 19 nt, Homo sapiens
gcuguaaucuaaacaauug

SEQ ID NO: 676780 - RNA, 19 nt, Homo sapiens
gaacccagauggcuguauu

SEQ ID NO: 676781 - RNA, 19 nt, Homo sapiens
ugaaggaacugcucaucua

SEQ ID NO: 676782 - RNA, 19 nt, Homo sapiens
caacaugugugacucuuga

SEQ ID NO: 676783 - RNA, 19 nt, Homo sapiens
cguaagagcuuugaauuug

SEQ ID NO: 676784 - RNA, 19 nt, Homo sapiens
gaugagagcagaaucguaa

SEQ ID NO: 676785 - RNA, 19 nt, Homo sapiens
ccaaagagccaaaguauca

SEQ ID NO: 676786 - RNA, 19 nt, Homo sapiens
gguuugggcuguaaucuaa

SEQ ID NO: 676787 - RNA, 19 nt, Homo sapiens
gaaaacugcugcccaaauu

SEQ ID NO: 676788 - RNA, 19 nt, Homo sapiens
ccagauggcuguauucaca

SEQ ID NO: 676789 - RNA, 19 nt, Homo sapiens
guaagagcuuugaauuuga

SEQ ID NO: 676790 - RNA, 19 nt, Homo sapiens
ucacagagcuggaccacau

SEQ ID NO: 676791 - RNA, 19 nt, Homo sapiens
gggcagccuucuuaaauga

SEQ ID NO: 676792 - RNA, 19 nt, Homo sapiens
guaggaauguaaaucugua

SEQ ID NO: 676793 - RNA, 19 nt, Homo sapiens
gauggcuucuuuaggaaua

SEQ ID NO: 676794 - RNA, 19 nt, Homo sapiens
caaaugcuauugcagacaa

SEQ ID NO: 676795 - RNA, 19 nt, Homo sapiens
gcacaguccgcauucauuu

SEQ ID NO: 676796 - RNA, 19 nt, Homo sapiens
ccucguaaguguugcauuu

SEQ ID NO: 676797 - RNA, 19 nt, Homo sapiens
aaacccagaucuuuccuuu

SEQ ID NO: 676798 - RNA, 19 nt, Homo sapiens
gcucaucaaacuugcauua

SEQ ID NO: 676799 - RNA, 19 nt, Homo sapiens
gcagaugacucaaaacuga

SEQ ID NO: 676800 - RNA, 19 nt, Homo sapiens
gaaggaacugcucaucuaa

SEQ ID NO: 676801 - RNA, 19 nt, Homo sapiens
aaacugcugcccaaauuua

SEQ ID NO: 676802 - RNA, 19 nt, Homo sapiens
gaaggcauccaucauguug

SEQ ID NO: 676803 - RNA, 19 nt, Homo sapiens
gaaguuugaugagcaugaa

SEQ ID NO: 676804 - RNA, 19 nt, Homo sapiens
cagauuaaauguacaugga

SEQ ID NO: 676805 - RNA, 19 nt, Homo sapiens
cuaaacaauuggacagauu

SEQ ID NO: 676806 - RNA, 19 nt, Homo sapiens
guuacaaauuggaccuuua

SEQ ID NO: 676807 - RNA, 19 nt, Homo sapiens
ucaaaacucuggcuccuua

SEQ ID NO: 676808 - RNA, 19 nt, Homo sapiens
ugugauauauguuggguaa

SEQ ID NO: 676809 - RNA, 19 nt, Homo sapiens
gaucguaacaugugcagaa

SEQ ID NO: 676810 - RNA, 19 nt, Homo sapiens
ucaguaugccuguuaauuu

SEQ ID NO: 676811 - RNA, 19 nt, Homo sapiens
caaccuauauuguuaugca

SEQ ID NO: 676812 - RNA, 19 nt, Homo sapiens
cagcagugccuucccuuua

SEQ ID NO: 676813 - RNA, 19 nt, Homo sapiens
cuaccuacguacacauaua

SEQ ID NO: 676814 - RNA, 19 nt, Homo sapiens
gggucuuucuggcuaauua

SEQ ID NO: 676815 - RNA, 19 nt, Homo sapiens
gaugcacucuuacaacaug

SEQ ID NO: 676816 - RNA, 19 nt, Homo sapiens
gaacucagcccuguugcaa

SEQ ID NO: 676817 - RNA, 19 nt, Homo sapiens
ggaaagaauccauuugaag

SEQ ID NO: 676818 - RNA, 19 nt, Homo sapiens
gaucuaggguucuaauugc

SEQ ID NO: 676819 - RNA, 19 nt, Homo sapiens
ggucauuugucaauauuca

SEQ ID NO: 676820 - RNA, 19 nt, Homo sapiens
gggaugcacucuuacaaca

SEQ ID NO: 676821 - RNA, 19 nt, Homo sapiens
ucaaaucaaucugcaguug

SEQ ID NO: 676822 - RNA, 19 nt, Homo sapiens
gcaugaagaugggcuggaa

SEQ ID NO: 676823 - RNA, 19 nt, Homo sapiens
cagauuccaugcuuucuau

SEQ ID NO: 676824 - RNA, 19 nt, Homo sapiens
ugaagacaauguugcaaug

SEQ ID NO: 676825 - RNA, 19 nt, Homo sapiens
caaauuggaccuuuauaca

SEQ ID NO: 676826 - RNA, 19 nt, Homo sapiens
aaaccuugcuguuacaaau

SEQ ID NO: 676827 - RNA, 19 nt, Homo sapiens
ucgagugucuuuaccaauu

SEQ ID NO: 676828 - RNA, 19 nt, Homo sapiens
agagaacggcggagucuua

SEQ ID NO: 676829 - RNA, 19 nt, Homo sapiens
gcacauggcaaagcaaaga

SEQ ID NO: 676830 - RNA, 19 nt, Homo sapiens
caauucugcucacuucuug

SEQ ID NO: 676831 - RNA, 19 nt, Homo sapiens
ccugcaaacuucagaugua

SEQ ID NO: 676832 - RNA, 19 nt, Homo sapiens
ccgcagggcagccuucuua

SEQ ID NO: 676833 - RNA, 19 nt, Homo sapiens
ugaggugccuuuacgagaa

SEQ ID NO: 676834 - RNA, 19 nt, Homo sapiens
gggcaacaguucaaauaag

SEQ ID NO: 676835 - RNA, 19 nt, Homo sapiens
gcacacacccauaaacaca

SEQ ID NO: 676836 - RNA, 19 nt, Homo sapiens
ucacauaguuccugcaaac

SEQ ID NO: 676837 - RNA, 19 nt, Homo sapiens
caaagucuaacaagaaaga

SEQ ID NO: 676838 - RNA, 19 nt, Homo sapiens
ugacaccguugccauaaau

SEQ ID NO: 676839 - RNA, 19 nt, Homo sapiens
uaacugaggugaggguugu

SEQ ID NO: 676840 - RNA, 19 nt, Homo sapiens
ggugugucauuuccuuuaa

SEQ ID NO: 676841 - RNA, 19 nt, Homo sapiens
guuuauggccuucuuguuu

SEQ ID NO: 676842 - RNA, 19 nt, Homo sapiens
caauguaucaugcuuguug

SEQ ID NO: 676843 - RNA, 19 nt, Homo sapiens
caaccaacuucuucaugga

SEQ ID NO: 676844 - RNA, 19 nt, Homo sapiens
agacaauguugcaauguug

SEQ ID NO: 676845 - RNA, 19 nt, Homo sapiens
gaggugccuuuacgagaaa

SEQ ID NO: 676846 - RNA, 19 nt, Homo sapiens
ggagaaguguugcccaaac

SEQ ID NO: 676847 - RNA, 19 nt, Homo sapiens
uuuaagagcuucccuuucu

SEQ ID NO: 676848 - RNA, 19 nt, Homo sapiens
ggagcugcaugugauauau

SEQ ID NO: 676849 - RNA, 19 nt, Homo sapiens
cagaaggcauccaucaugu

SEQ ID NO: 676850 - RNA, 19 nt, Homo sapiens
gcuuagggcccuuaaagaa

SEQ ID NO: 676851 - RNA, 19 nt, Homo sapiens
gaaagggccaggugauauc

SEQ ID NO: 676852 - RNA, 19 nt, Homo sapiens
ugcaagagguaaagaagaa

SEQ ID NO: 676853 - RNA, 19 nt, Homo sapiens
cagaauguaugguaggaau

SEQ ID NO: 676854 - RNA, 19 nt, Homo sapiens
gcagugccuucccuuuaug

SEQ ID NO: 676855 - RNA, 19 nt, Homo sapiens
guagaugcuuccaguguca

SEQ ID NO: 676856 - RNA, 19 nt, Homo sapiens
agacaggacuuucuaugca

SEQ ID NO: 676857 - RNA, 19 nt, Homo sapiens
ugauaucacacccaaauuu

SEQ ID NO: 676858 - RNA, 19 nt, Homo sapiens
gauaacaaguuuuggaaga

SEQ ID NO: 676859 - RNA, 19 nt, Homo sapiens
ggugaggguuguaguagau

SEQ ID NO: 676860 - RNA, 19 nt, Homo sapiens
gaucaaauugcacuuguuc

SEQ ID NO: 676861 - RNA, 19 nt, Homo sapiens
aagcuacugucuuucuuaa

SEQ ID NO: 676862 - RNA, 19 nt, Homo sapiens
gaggagcucugucccacau

SEQ ID NO: 676863 - RNA, 19 nt, Homo sapiens
guauucacauguagguuug

SEQ ID NO: 676864 - RNA, 19 nt, Homo sapiens
gagaaaugcaggccauaug

SEQ ID NO: 676865 - RNA, 19 nt, Homo sapiens
gaugugcaaugaagugaca

SEQ ID NO: 676866 - RNA, 19 nt, Homo sapiens
aauauucagucaccaauuc

SEQ ID NO: 676867 - RNA, 19 nt, Homo sapiens
uuaugcagauggcuucuuu

SEQ ID NO: 676868 - RNA, 19 nt, Homo sapiens
ggaaauagcuguucacaua

SEQ ID NO: 676869 - RNA, 19 nt, Homo sapiens
gaagaaaccucaaguggua

SEQ ID NO: 676870 - RNA, 19 nt, Homo sapiens
ggccaaagcuccaggauua

SEQ ID NO: 676871 - RNA, 19 nt, Homo sapiens
ccagauagaugcagaauuu

SEQ ID NO: 676872 - RNA, 19 nt, Homo sapiens
caagaaaccuggauggaaa

SEQ ID NO: 676873 - RNA, 19 nt, Homo sapiens
caaaggaugucauucguaa

SEQ ID NO: 676874 - RNA, 19 nt, Homo sapiens
uaaagaagguuguuggaaa

SEQ ID NO: 676875 - RNA, 19 nt, Homo sapiens
gagcaagucugauaaggaa

SEQ ID NO: 676876 - RNA, 19 nt, Homo sapiens
ggaagaagaugccaagcaa

SEQ ID NO: 676877 - RNA, 19 nt, Homo sapiens
ggaagaaauuuggacaaua

SEQ ID NO: 676878 - RNA, 19 nt, Homo sapiens
gaaagaaggccuagaugaa

SEQ ID NO: 676879 - RNA, 19 nt, Homo sapiens
uaaguaagguguucaauca

SEQ ID NO: 676880 - RNA, 19 nt, Homo sapiens
uaacauagacgacuugaaa

SEQ ID NO: 676881 - RNA, 19 nt, Homo sapiens
uagaugagauugagaauga

SEQ ID NO: 676882 - RNA, 19 nt, Homo sapiens
gaugaaagcacuagaauau

SEQ ID NO: 676883 - RNA, 19 nt, Homo sapiens
gaaguggcagguauuauua

SEQ ID NO: 676884 - RNA, 19 nt, Homo sapiens
gaugcaaucuuccuuacua

SEQ ID NO: 676885 - RNA, 19 nt, Homo sapiens
agaaaggacuggagacuaa

SEQ ID NO: 676886 - RNA, 19 nt, Homo sapiens
ggacauuucugcacccaaa

SEQ ID NO: 676887 - RNA, 19 nt, Homo sapiens
ugaaagaacuagaagaaga

SEQ ID NO: 676888 - RNA, 19 nt, Homo sapiens
cuacagaccuuauccuuug

SEQ ID NO: 676889 - RNA, 19 nt, Homo sapiens
ccagaaggcuguugagcua

SEQ ID NO: 676890 - RNA, 19 nt, Homo sapiens
gagaaugguucgacuguug

SEQ ID NO: 676891 - RNA, 19 nt, Homo sapiens
ggacaugucuuccaaacuc

SEQ ID NO: 676892 - RNA, 19 nt, Homo sapiens
ucucagagcuuguuaugaa

SEQ ID NO: 676893 - RNA, 19 nt, Homo sapiens
gaaggugguuggcgagaaa

SEQ ID NO: 676894 - RNA, 19 nt, Homo sapiens
gccaugggcccaaauauua

SEQ ID NO: 676895 - RNA, 19 nt, Homo sapiens
ugaaaggcuuggacaauaa

SEQ ID NO: 676896 - RNA, 19 nt, Homo sapiens
uagaaguccucauaguuua

SEQ ID NO: 676897 - RNA, 19 nt, Homo sapiens
gaauauaggugaacuucca

SEQ ID NO: 676898 - RNA, 19 nt, Homo sapiens
gcaaugaugucguugaucu

SEQ ID NO: 676899 - RNA, 19 nt, Homo sapiens
gcacucaacaccauuguaa

SEQ ID NO: 676900 - RNA, 19 nt, Homo sapiens
uaauugcuguggagauuua

SEQ ID NO: 676901 - RNA, 19 nt, Homo sapiens
gaagauuggcucuaaagaa

SEQ ID NO: 676902 - RNA, 19 nt, Homo sapiens
ugacacagcuguuucagau

SEQ ID NO: 676903 - RNA, 19 nt, Homo sapiens
ggaaagaaggccuagauga

SEQ ID NO: 676904 - RNA, 19 nt, Homo sapiens
gaucaaagaauguucagaa

SEQ ID NO: 676905 - RNA, 19 nt, Homo sapiens
aagauuggcucuaaagaaa

SEQ ID NO: 676906 - RNA, 19 nt, Homo sapiens
gauugaagaucuugaggaa

SEQ ID NO: 676907 - RNA, 19 nt, Homo sapiens
gaggaaagccuuaagugaa

SEQ ID NO: 676908 - RNA, 19 nt, Homo sapiens
aaagagcagucgcaaauga

SEQ ID NO: 676909 - RNA, 19 nt, Homo sapiens
gaaagaacuagaagaagaa

SEQ ID NO: 676910 - RNA, 19 nt, Homo sapiens
gcauagagaucugucuuau

SEQ ID NO: 676911 - RNA, 19 nt, Homo sapiens
ggaaggaaccaaauccaaa

SEQ ID NO: 676912 - RNA, 19 nt, Homo sapiens
gcaagauguuucccuuuau

SEQ ID NO: 676913 - RNA, 19 nt, Homo sapiens
aagaaaggcuggcuuguau

SEQ ID NO: 676914 - RNA, 19 nt, Homo sapiens
uuaagaagauuggcucuaa

SEQ ID NO: 676915 - RNA, 19 nt, Homo sapiens
cuacacaccuuaugcaaau

SEQ ID NO: 676916 - RNA, 19 nt, Homo sapiens
gcauuaaccuagacagaau

SEQ ID NO: 676917 - RNA, 19 nt, Homo sapiens
guacauagagauugagaaa

SEQ ID NO: 676918 - RNA, 19 nt, Homo sapiens
ccaaggagcugggcauaga

SEQ ID NO: 676919 - RNA, 19 nt, Homo sapiens
aaagggagcaucucgaaua

SEQ ID NO: 676920 - RNA, 19 nt, Homo sapiens
gauugaaggugcuaaagug

SEQ ID NO: 676921 - RNA, 19 nt, Homo sapiens
aaaggaggaugaagacaaa

SEQ ID NO: 676922 - RNA, 19 nt, Homo sapiens
cuucagaguugguaucuaa

SEQ ID NO: 676923 - RNA, 19 nt, Homo sapiens
gaucauaguggccuguaua

SEQ ID NO: 676924 - RNA, 19 nt, Homo sapiens
auagagaucugucuuaugu

SEQ ID NO: 676925 - RNA, 19 nt, Homo sapiens
ccaaugcagugguucaauu

SEQ ID NO: 676926 - RNA, 19 nt, Homo sapiens
uaaacuagaaguccucaua

SEQ ID NO: 676927 - RNA, 19 nt, Homo sapiens
gcuaaaugguuacaagaug

SEQ ID NO: 676928 - RNA, 19 nt, Homo sapiens
gaaaggagaggcuguucaa

SEQ ID NO: 676929 - RNA, 19 nt, Homo sapiens
gaaguugugucagguguug

SEQ ID NO: 676930 - RNA, 19 nt, Homo sapiens
auucagaccuggauucuaa

SEQ ID NO: 676931 - RNA, 19 nt, Homo sapiens
ccagagcuaugucgaaaga

SEQ ID NO: 676932 - RNA, 19 nt, Homo sapiens
gagcaaaggaugaaagaug

SEQ ID NO: 676933 - RNA, 19 nt, Homo sapiens
ggacaagauuggagaugug

SEQ ID NO: 676934 - RNA, 19 nt, Homo sapiens
aaaccuggauggaaagaaa

SEQ ID NO: 676935 - RNA, 19 nt, Homo sapiens
gcacaaacuggaugacauu

SEQ ID NO: 676936 - RNA, 19 nt, Homo sapiens
uaaagcaacuucuaaacca

SEQ ID NO: 676937 - RNA, 19 nt, Homo sapiens
uaaaaucacuucagaguug

SEQ ID NO: 676938 - RNA, 19 nt, Homo sapiens
acaaauagaugcuuaugag

SEQ ID NO: 676939 - RNA, 19 nt, Homo sapiens
gagaggcuguucaagaaga

SEQ ID NO: 676940 - RNA, 19 nt, Homo sapiens
gaugacaugcacaguaaua

SEQ ID NO: 676941 - RNA, 19 nt, Homo sapiens
acaaagcccuugcuguuau

SEQ ID NO: 676942 - RNA, 19 nt, Homo sapiens
gauuguauuuccagcagua

SEQ ID NO: 676943 - RNA, 19 nt, Homo sapiens
cugaaaggcuuggacaaua

SEQ ID NO: 676944 - RNA, 19 nt, Homo sapiens
aagaagagcuccugaaagg

SEQ ID NO: 676945 - RNA, 19 nt, Homo sapiens
aagagaaacugaagcaaug

SEQ ID NO: 676946 - RNA, 19 nt, Homo sapiens
cuaaaugguuacaagauga

SEQ ID NO: 676947 - RNA, 19 nt, Homo sapiens
gcacaagugguacagauga

SEQ ID NO: 676948 - RNA, 19 nt, Homo sapiens
gcaaagggagcaucucgaa

SEQ ID NO: 676949 - RNA, 19 nt, Homo sapiens
guucgacuguugccugaua

SEQ ID NO: 676950 - RNA, 19 nt, Homo sapiens
guuacaagaugagauguuu

SEQ ID NO: 676951 - RNA, 19 nt, Homo sapiens
gaaacuaccuacucuucgu

SEQ ID NO: 676952 - RNA, 19 nt, Homo sapiens
gcccaaauauuaagcaaca

SEQ ID NO: 676953 - RNA, 19 nt, Homo sapiens
gaacugauacaugguaaga

SEQ ID NO: 676954 - RNA, 19 nt, Homo sapiens
aacaagaacuagaagcuaa

SEQ ID NO: 676955 - RNA, 19 nt, Homo sapiens
ugucagguguuguaaguaa

SEQ ID NO: 676956 - RNA, 19 nt, Homo sapiens
ucgaugacaugcacaguaa

SEQ ID NO: 676957 - RNA, 19 nt, Homo sapiens
ugacaaugcuguacgcaau

SEQ ID NO: 676958 - RNA, 19 nt, Homo sapiens
uaaaggaaauagcuguuca

SEQ ID NO: 676959 - RNA, 19 nt, Homo sapiens
gccuggaucuuaucuuaaa

SEQ ID NO: 676960 - RNA, 19 nt, Homo sapiens
caacuaaagacucaaaugu

SEQ ID NO: 676961 - RNA, 19 nt, Homo sapiens
cuagagaaagccaaaguua

SEQ ID NO: 676962 - RNA, 19 nt, Homo sapiens
caugaugcauuuaggauau

SEQ ID NO: 676963 - RNA, 19 nt, Homo sapiens
gagcaaugaugucguugau

SEQ ID NO: 676964 - RNA, 19 nt, Homo sapiens
ugagaagccugcccuccua

SEQ ID NO: 676965 - RNA, 19 nt, Homo sapiens
cagcucagguuguauuaga

SEQ ID NO: 676966 - RNA, 19 nt, Homo sapiens
ccuggagucuguagaagua

SEQ ID NO: 676967 - RNA, 19 nt, Homo sapiens
uuuagaagcuguagaaauc

SEQ ID NO: 676968 - RNA, 19 nt, Homo sapiens
gcacaggacauuaauauua

SEQ ID NO: 676969 - RNA, 19 nt, Homo sapiens
gcacagaugucuuuccuuu

SEQ ID NO: 676970 - RNA, 19 nt, Homo sapiens
ggaaggauuuguaguguuu

SEQ ID NO: 676971 - RNA, 19 nt, Homo sapiens
ugaaggaccuguuuaauga

SEQ ID NO: 676972 - RNA, 19 nt, Homo sapiens
guacacacauugguaguua

SEQ ID NO: 676973 - RNA, 19 nt, Homo sapiens
gagcagaacucccuguuuc

SEQ ID NO: 676974 - RNA, 19 nt, Homo sapiens
gcagugggcucucuagugu

SEQ ID NO: 676975 - RNA, 19 nt, Homo sapiens
gcuagacucucucaacaaa

SEQ ID NO: 676976 - RNA, 19 nt, Homo sapiens
gcccauggcuuuauuuaug

SEQ ID NO: 676977 - RNA, 19 nt, Homo sapiens
caacagcaguuccuucaga

SEQ ID NO: 676978 - RNA, 19 nt, Homo sapiens
caaaaccccuuucucauua

SEQ ID NO: 676979 - RNA, 19 nt, Homo sapiens
gcaaacgguugguauuguu

SEQ ID NO: 676980 - RNA, 19 nt, Homo sapiens
caguuuagcucucaaagaa

SEQ ID NO: 676981 - RNA, 19 nt, Homo sapiens
uaggguaggugaugguuua

SEQ ID NO: 676982 - RNA, 19 nt, Homo sapiens
gaauggcgaucaacagaau

SEQ ID NO: 676983 - RNA, 19 nt, Homo sapiens
aaucagaacuccgcgaaua

SEQ ID NO: 676984 - RNA, 19 nt, Homo sapiens
uggcauggcuucuggcaua

SEQ ID NO: 676985 - RNA, 19 nt, Homo sapiens
acuaagacauccuuucuaa

SEQ ID NO: 676986 - RNA, 19 nt, Homo sapiens
gaaaagagaaugcugaaaa

SEQ ID NO: 676987 - RNA, 19 nt, Homo sapiens
cgaaauagaauaugacaug

SEQ ID NO: 676988 - RNA, 19 nt, Homo sapiens
ggaggccacuggaaaauua

SEQ ID NO: 676989 - RNA, 19 nt, Homo sapiens
ccgaguaacuugaaucaga

SEQ ID NO: 676990 - RNA, 19 nt, Homo sapiens
gagaugacuuugcuucugu

SEQ ID NO: 676991 - RNA, 19 nt, Homo sapiens
ccuguauccuggaguauua

SEQ ID NO: 676992 - RNA, 19 nt, Homo sapiens
ccacuugguuugacaacuu

SEQ ID NO: 676993 - RNA, 19 nt, Homo sapiens
gguaggugaugguuuaaau

SEQ ID NO: 676994 - RNA, 19 nt, Homo sapiens
ggacaggaggcaugggaua

SEQ ID NO: 676995 - RNA, 19 nt, Homo sapiens
aaauaugccuuuccgauca

SEQ ID NO: 676996 - RNA, 19 nt, Homo sapiens
ugccagaccucaaccuuaa

SEQ ID NO: 676997 - RNA, 19 nt, Homo sapiens
ccacgcaucuucaugauac

SEQ ID NO: 676998 - RNA, 19 nt, Homo sapiens
gggacaaguuucuguugaa

SEQ ID NO: 676999 - RNA, 19 nt, Homo sapiens
cgaguaacuugaaucagaa

SEQ ID NO: 677000 - RNA, 19 nt, Homo sapiens
uaacgaaagcaaaguggua

SEQ ID NO: 677001 - RNA, 19 nt, Homo sapiens
gaagaccugccuugcauga

SEQ ID NO: 677002 - RNA, 19 nt, Homo sapiens
ggagaugacuuugcuucug

SEQ ID NO: 677003 - RNA, 19 nt, Homo sapiens
gcugaggguccacgaaaua

SEQ ID NO: 677004 - RNA, 19 nt, Homo sapiens
gaagaaggacccagagucu

SEQ ID NO: 677005 - RNA, 19 nt, Homo sapiens
gcagugucauagcaauaaa

SEQ ID NO: 677006 - RNA, 19 nt, Homo sapiens
gggcuagacucucucaaca

SEQ ID NO: 677007 - RNA, 19 nt, Homo sapiens
ccacucccaugucagauga

SEQ ID NO: 677008 - RNA, 19 nt, Homo sapiens
gguccuguauccuggagua

SEQ ID NO: 677009 - RNA, 19 nt, Homo sapiens
aaagaaagagcaacuacuu

SEQ ID NO: 677010 - RNA, 19 nt, Homo sapiens
agacuucacuaacuccaaa

SEQ ID NO: 677011 - RNA, 19 nt, Homo sapiens
uaugaaagauggaauaagc

SEQ ID NO: 677012 - RNA, 19 nt, Homo sapiens
acagaaugguggagagaaa

SEQ ID NO: 677013 - RNA, 19 nt, Homo sapiens
ugacacagcuagggucuuc

SEQ ID NO: 677014 - RNA, 19 nt, Homo sapiens
guuaggcucuccacaagug

SEQ ID NO: 677015 - RNA, 19 nt, Homo sapiens
ugucggccauuucuccuua

SEQ ID NO: 677016 - RNA, 19 nt, Homo sapiens
acagaugucuuuccuuuac

SEQ ID NO: 677017 - RNA, 19 nt, Homo sapiens
gcaaaagcauuuacagcaa

SEQ ID NO: 677018 - RNA, 19 nt, Homo sapiens
caaacgguugguauuguua

SEQ ID NO: 677019 - RNA, 19 nt, Homo sapiens
gcuagagcuuccaacugua

SEQ ID NO: 677020 - RNA, 19 nt, Homo sapiens
guacucaguuuagcucuca

SEQ ID NO: 677021 - RNA, 19 nt, Homo sapiens
gagagguuguacacacauu

SEQ ID NO: 677022 - RNA, 19 nt, Homo sapiens
gcaauuccacuugguuuga

SEQ ID NO: 677023 - RNA, 19 nt, Homo sapiens
ugauuuggacgaccuguua

SEQ ID NO: 677024 - RNA, 19 nt, Homo sapiens
uagcaggucuggugacaca

SEQ ID NO: 677025 - RNA, 19 nt, Homo sapiens
gcaauuuguagcauagaaa

SEQ ID NO: 677026 - RNA, 19 nt, Homo sapiens
uaaugaagcagcaucaguu

SEQ ID NO: 677027 - RNA, 19 nt, Homo sapiens
gcccuuaacucugguauac

SEQ ID NO: 677028 - RNA, 19 nt, Homo sapiens
ccucagaucuucuuuucua

SEQ ID NO: 677029 - RNA, 19 nt, Homo sapiens
gaagcaauuccacuugguu

SEQ ID NO: 677030 - RNA, 19 nt, Homo sapiens
caugaugccuagugugaau

SEQ ID NO: 677031 - RNA, 19 nt, Homo sapiens
gauagcaggucuggugaca

SEQ ID NO: 677032 - RNA, 19 nt, Homo sapiens
aagcaagacuucacuaacu

SEQ ID NO: 677033 - RNA, 19 nt, Homo sapiens
ccucugagccugaauaaag

SEQ ID NO: 677034 - RNA, 19 nt, Homo sapiens
gaagauggagagagcacuu

SEQ ID NO: 677035 - RNA, 19 nt, Homo sapiens
uaugacaugugagcuguuu

SEQ ID NO: 677036 - RNA, 19 nt, Homo sapiens
ucagaugacuugcacuucu

SEQ ID NO: 677037 - RNA, 19 nt, Homo sapiens
gacaugaaggaccuguuua

SEQ ID NO: 677038 - RNA, 19 nt, Homo sapiens
gggaggagaugacuuugcu

SEQ ID NO: 677039 - RNA, 19 nt, Homo sapiens
gagaauugagccaaggaaa

SEQ ID NO: 677040 - RNA, 19 nt, Homo sapiens
gagcaagccagcccugaug

SEQ ID NO: 677041 - RNA, 19 nt, Homo sapiens
gugcuggacuacggcaaua

SEQ ID NO: 677042 - RNA, 19 nt, Homo sapiens
cagcagccuuugagcaaga

SEQ ID NO: 677043 - RNA, 19 nt, Homo sapiens
ggcaaacgguugguauugu

SEQ ID NO: 677044 - RNA, 19 nt, Homo sapiens
cgcuagagcuuccaacugu

SEQ ID NO: 677045 - RNA, 19 nt, Homo sapiens
gagauugcuuuauaacacu

SEQ ID NO: 677046 - RNA, 19 nt, Homo sapiens
cagaugacuugcacuucuu

SEQ ID NO: 677047 - RNA, 19 nt, Homo sapiens
ggcauaacccagauaguug

SEQ ID NO: 677048 - RNA, 19 nt, Homo sapiens
gaggguccacgaaauagaa

SEQ ID NO: 677049 - RNA, 19 nt, Homo sapiens
agaaggaggccacuggaaa

SEQ ID NO: 677050 - RNA, 19 nt, Homo sapiens
ccagaacaccuccgucuca

SEQ ID NO: 677051 - RNA, 19 nt, Homo sapiens
gcagcugucccauauaagu

SEQ ID NO: 677052 - RNA, 19 nt, Homo sapiens
aaucauaaagccagugaaa

SEQ ID NO: 677053 - RNA, 19 nt, Homo sapiens
aagaaggggugaaucauaa

SEQ ID NO: 677054 - RNA, 19 nt, Homo sapiens
guacuuggacccucagauc

SEQ ID NO: 677055 - RNA, 19 nt, Homo sapiens
agacaugaaggaccuguuu

SEQ ID NO: 677056 - RNA, 19 nt, Homo sapiens
ucgaagaccugccuugcau

SEQ ID NO: 677057 - RNA, 19 nt, Homo sapiens
ggggagcuaugauaaguuu

SEQ ID NO: 677058 - RNA, 19 nt, Homo sapiens
cccauggcuuuauuuauga

SEQ ID NO: 677059 - RNA, 19 nt, Homo sapiens
ggaguguccuaugugagaa

SEQ ID NO: 677060 - RNA, 19 nt, Homo sapiens
gcucagaugcagaguguuc

SEQ ID NO: 677061 - RNA, 19 nt, Homo sapiens
cagcuguccucgaguguuc

SEQ ID NO: 677062 - RNA, 19 nt, Homo sapiens
gaacaggagaagcaacagu

SEQ ID NO: 677063 - RNA, 19 nt, Homo sapiens
cagaauggcgaucaacaga

SEQ ID NO: 677064 - RNA, 19 nt, Homo sapiens
gaccugccuugcaugauca

SEQ ID NO: 677065 - RNA, 19 nt, Homo sapiens
ggagcuaugauaaguuuua

SEQ ID NO: 677066 - RNA, 19 nt, Homo sapiens
gcaucuucaugauacaguu

SEQ ID NO: 677067 - RNA, 19 nt, Homo sapiens
gagaaggaggccacuggaa

SEQ ID NO: 677068 - RNA, 19 nt, Homo sapiens
gcacuugccuccugucuua

SEQ ID NO: 677069 - RNA, 19 nt, Homo sapiens
ggaaacaacucaucucauu

SEQ ID NO: 677070 - RNA, 19 nt, Homo sapiens
gaacacagaugcucguauu

SEQ ID NO: 677071 - RNA, 19 nt, Homo sapiens
gaaacuggcugcugagaaa

SEQ ID NO: 677072 - RNA, 19 nt, Homo sapiens
gaacucaucuggcuuugaa

SEQ ID NO: 677073 - RNA, 19 nt, Homo sapiens
gaugaaaucucccuuccua

SEQ ID NO: 677074 - RNA, 19 nt, Homo sapiens
gggaagugcuguauauuaa

SEQ ID NO: 677075 - RNA, 19 nt, Homo sapiens
gcagguagcuaauuuaaca

SEQ ID NO: 677076 - RNA, 19 nt, Homo sapiens
caacucaucucauuuccua

SEQ ID NO: 677077 - RNA, 19 nt, Homo sapiens
gcaaggagaugaaugagau

SEQ ID NO: 677078 - RNA, 19 nt, Homo sapiens
agaaggaucucaccaauga

SEQ ID NO: 677079 - RNA, 19 nt, Homo sapiens
gcccagagauccauauuga

SEQ ID NO: 677080 - RNA, 19 nt, Homo sapiens
ggaugggugucuccucuua

SEQ ID NO: 677081 - RNA, 19 nt, Homo sapiens
gaugugagcucccuugauc

SEQ ID NO: 677082 - RNA, 19 nt, Homo sapiens
ggagggaaauaauggauau

SEQ ID NO: 677083 - RNA, 19 nt, Homo sapiens
gaacagauaagauuagcaa

SEQ ID NO: 677084 - RNA, 19 nt, Homo sapiens
gaaaccagaucuacgaaag

SEQ ID NO: 677085 - RNA, 19 nt, Homo sapiens
gauguuaccgccucuguua

SEQ ID NO: 677086 - RNA, 19 nt, Homo sapiens
caacagcgauccaggaaca

SEQ ID NO: 677087 - RNA, 19 nt, Homo sapiens
ccucuuagcugguuauuca

SEQ ID NO: 677088 - RNA, 19 nt, Homo sapiens
aagauaagcuguccucaga

SEQ ID NO: 677089 - RNA, 19 nt, Homo sapiens
ugaaaucccuguggcuaua

SEQ ID NO: 677090 - RNA, 19 nt, Homo sapiens
ggaguuagacugaugagaa

SEQ ID NO: 677091 - RNA, 19 nt, Homo sapiens
gggaauugcuggagaagga

SEQ ID NO: 677092 - RNA, 19 nt, Homo sapiens
ggauaaaucaggaggaauu

SEQ ID NO: 677093 - RNA, 19 nt, Homo sapiens
ggucagggaaguagaguua

SEQ ID NO: 677094 - RNA, 19 nt, Homo sapiens
ucaaaguucucuuagauuc

SEQ ID NO: 677095 - RNA, 19 nt, Homo sapiens
gaacucaucacaugcaaug

SEQ ID NO: 677096 - RNA, 19 nt, Homo sapiens
guaagagccuccuagaauc

SEQ ID NO: 677097 - RNA, 19 nt, Homo sapiens
gcauuuauaccacccauuu

SEQ ID NO: 677098 - RNA, 19 nt, Homo sapiens
gaaacaacucaucucauuu

SEQ ID NO: 677099 - RNA, 19 nt, Homo sapiens
gauaagcuguccucagauc

SEQ ID NO: 677100 - RNA, 19 nt, Homo sapiens
ugccaaagcuucugguaaa

SEQ ID NO: 677101 - RNA, 19 nt, Homo sapiens
gaaaagaagcugugaggua

SEQ ID NO: 677102 - RNA, 19 nt, Homo sapiens
ugaacaaccucccaaagga

SEQ ID NO: 677103 - RNA, 19 nt, Homo sapiens
uacaaggaauagcuucuua

SEQ ID NO: 677104 - RNA, 19 nt, Homo sapiens
caacaagagaguaacaauu

SEQ ID NO: 677105 - RNA, 19 nt, Homo sapiens
gaagaaugguccaguugag

SEQ ID NO: 677106 - RNA, 19 nt, Homo sapiens
ggagaaaccagaucuacga

SEQ ID NO: 677107 - RNA, 19 nt, Homo sapiens
gaguccagccaauguauua

SEQ ID NO: 677108 - RNA, 19 nt, Homo sapiens
gcuucacacucgccuguua

SEQ ID NO: 677109 - RNA, 19 nt, Homo sapiens
uaagaaugcacaaagagua

SEQ ID NO: 677110 - RNA, 19 nt, Homo sapiens
gcacacaagcucuagauag

SEQ ID NO: 677111 - RNA, 19 nt, Homo sapiens
ccacagaggagcugaguga

SEQ ID NO: 677112 - RNA, 19 nt, Homo sapiens
guauuagagcugaucauua

SEQ ID NO: 677113 - RNA, 19 nt, Homo sapiens
uaacagaacaguggaaaug

SEQ ID NO: 677114 - RNA, 19 nt, Homo sapiens
agacaaaguuacuggaaau

SEQ ID NO: 677115 - RNA, 19 nt, Homo sapiens
ugucugcgauggaaucuuu

SEQ ID NO: 677116 - RNA, 19 nt, Homo sapiens
gcacguuuauuucccuguu

SEQ ID NO: 677117 - RNA, 19 nt, Homo sapiens
gugaggaggugcaggaguu

SEQ ID NO: 677118 - RNA, 19 nt, Homo sapiens
ggagauagaacaaggagau

SEQ ID NO: 677119 - RNA, 19 nt, Homo sapiens
ggaagaaugguccaguuga

SEQ ID NO: 677120 - RNA, 19 nt, Homo sapiens
guacuuagccaccuguguu

SEQ ID NO: 677121 - RNA, 19 nt, Homo sapiens
ugucaaaguucucuuagau

SEQ ID NO: 677122 - RNA, 19 nt, Homo sapiens
gcacaaagaguaggacuag

SEQ ID NO: 677123 - RNA, 19 nt, Homo sapiens
gcucauguguugcuguuuc

SEQ ID NO: 677124 - RNA, 19 nt, Homo sapiens
caaaguuacuggaaaugca

SEQ ID NO: 677125 - RNA, 19 nt, Homo sapiens
ggacagugacagaguagaa

SEQ ID NO: 677126 - RNA, 19 nt, Homo sapiens
uguauuuacucgugacuaa

SEQ ID NO: 677127 - RNA, 19 nt, Homo sapiens
ggcuauaaauucuaaggaa

SEQ ID NO: 677128 - RNA, 19 nt, Homo sapiens
caacaggcauuugauuuac

SEQ ID NO: 677129 - RNA, 19 nt, Homo sapiens
gaacagagacagaguuagc

SEQ ID NO: 677130 - RNA, 19 nt, Homo sapiens
cagacaaaguuacuggaaa

SEQ ID NO: 677131 - RNA, 19 nt, Homo sapiens
cguaagagccuccuagaau

SEQ ID NO: 677132 - RNA, 19 nt, Homo sapiens
gaggaaggucuuggaguua

SEQ ID NO: 677133 - RNA, 19 nt, Homo sapiens
caacacaucagccuuaugg

SEQ ID NO: 677134 - RNA, 19 nt, Homo sapiens
gggcuaagauccuauucuc

SEQ ID NO: 677135 - RNA, 19 nt, Homo sapiens
uuagcaaacuuacaaggaa

SEQ ID NO: 677136 - RNA, 19 nt, Homo sapiens
gcugugagguagaggaaug

SEQ ID NO: 677137 - RNA, 19 nt, Homo sapiens
ccucccagaucucguagua

SEQ ID NO: 677138 - RNA, 19 nt, Homo sapiens
caucuggccugguggaguu

SEQ ID NO: 677139 - RNA, 19 nt, Homo sapiens
caguggaaauggcuaugua

SEQ ID NO: 677140 - RNA, 19 nt, Homo sapiens
ggaacaaucagaacucauc

SEQ ID NO: 677141 - RNA, 19 nt, Homo sapiens
ggaaggucuuggaguuaga

SEQ ID NO: 677142 - RNA, 19 nt, Homo sapiens
ggaagugcuguauauuaaa

SEQ ID NO: 677143 - RNA, 19 nt, Homo sapiens
cauacacacucuauacugu

SEQ ID NO: 677144 - RNA, 19 nt, Homo sapiens
aaacaacucaucucauuuc

SEQ ID NO: 677145 - RNA, 19 nt, Homo sapiens
ucucuuagauucugaaguc

SEQ ID NO: 677146 - RNA, 19 nt, Homo sapiens
aaacaagugucaaaguucu

SEQ ID NO: 677147 - RNA, 19 nt, Homo sapiens
gaguagauccuguuuccuu

SEQ ID NO: 677148 - RNA, 19 nt, Homo sapiens
cauggacagugacagagua

SEQ ID NO: 677149 - RNA, 19 nt, Homo sapiens
ggagccagccuuugaggaa

SEQ ID NO: 677150 - RNA, 19 nt, Homo sapiens
ggagaugaaugagaugucu

SEQ ID NO: 677151 - RNA, 19 nt, Homo sapiens
gcaaggcaacugggaauug

SEQ ID NO: 677152 - RNA, 19 nt, Homo sapiens
gaaaucucccuuccuaagu

SEQ ID NO: 677153 - RNA, 19 nt, Homo sapiens
gauuguugcuggugaguag

SEQ ID NO: 677154 - RNA, 19 nt, Homo sapiens
ggugggaugugugaagaaa

SEQ ID NO: 677155 - RNA, 19 nt, Homo sapiens
gaguuagacugaugagaag

SEQ ID NO: 677156 - RNA, 19 nt, Homo sapiens
cagauaagauuagcaaacu

SEQ ID NO: 677157 - RNA, 19 nt, Homo sapiens
caaaggacguguggacagu

SEQ ID NO: 677158 - RNA, 19 nt, Homo sapiens
uaaaauuucuccagcacua

SEQ ID NO: 677159 - RNA, 19 nt, Homo sapiens
gcaagaaggcuagcaaguc

SEQ ID NO: 677160 - RNA, 19 nt, Homo sapiens
gcaaagaaaccaucaugcu

SEQ ID NO: 677161 - RNA, 19 nt, Homo sapiens
ccaccuguguugcuuugaa

SEQ ID NO: 677162 - RNA, 19 nt, Homo sapiens
caacaguuccagaagaaga

SEQ ID NO: 677163 - RNA, 19 nt, Homo sapiens
gaacaguggaaauggcuau

SEQ ID NO: 677164 - RNA, 19 nt, Homo sapiens
guauugccuuugucaagaa

SEQ ID NO: 677165 - RNA, 19 nt, Homo sapiens
guugucaccugcagagcua

SEQ ID NO: 677166 - RNA, 19 nt, Homo sapiens
ggagaaggaugagcgugau

SEQ ID NO: 677167 - RNA, 19 nt, Homo sapiens
cagggaugcuguguucuuu

SEQ ID NO: 677168 - RNA, 19 nt, Homo sapiens
ugacagagaugauggauga

SEQ ID NO: 677169 - RNA, 19 nt, Homo sapiens
ggaacaugcugcagccuua

SEQ ID NO: 677170 - RNA, 19 nt, Homo sapiens
ggacaacggucaccuaucu

SEQ ID NO: 677171 - RNA, 19 nt, Homo sapiens
ggagaaagcugagcagauc

SEQ ID NO: 677172 - RNA, 19 nt, Homo sapiens
ucauugaccuuaacaagaa

SEQ ID NO: 677173 - RNA, 19 nt, Homo sapiens
ggagagguguggagaagga

SEQ ID NO: 677174 - RNA, 19 nt, Homo sapiens
ggaacucucuuucuucucu

SEQ ID NO: 677175 - RNA, 19 nt, Homo sapiens
gcaccaaccucuacuuugc

SEQ ID NO: 677176 - RNA, 19 nt, Homo sapiens
ggucacccauuacuucauu

SEQ ID NO: 677177 - RNA, 19 nt, Homo sapiens
gauguuccuuccuuccaua

SEQ ID NO: 677178 - RNA, 19 nt, Homo sapiens
gcaaccaucacaaggagua

SEQ ID NO: 677179 - RNA, 19 nt, Homo sapiens
acaagaaggagaauaagaa

SEQ ID NO: 677180 - RNA, 19 nt, Homo sapiens
gcucagcgccucuucaauc

SEQ ID NO: 677181 - RNA, 19 nt, Homo sapiens
uggcucagcuucaggagaa

SEQ ID NO: 677182 - RNA, 19 nt, Homo sapiens
uggaugagcagcuggauuu

SEQ ID NO: 677183 - RNA, 19 nt, Homo sapiens
cauaccuucuccuugcuua

SEQ ID NO: 677184 - RNA, 19 nt, Homo sapiens
ucccuuccuucuauaaaua

SEQ ID NO: 677185 - RNA, 19 nt, Homo sapiens
ucagggagcuggcuuucuc

SEQ ID NO: 677186 - RNA, 19 nt, Homo sapiens
ggagcgagacgguggaguu

SEQ ID NO: 677187 - RNA, 19 nt, Homo sapiens
guacacggccuaccacuac

SEQ ID NO: 677188 - RNA, 19 nt, Homo sapiens
ggacuucuacugcauguac

SEQ ID NO: 677189 - RNA, 19 nt, Homo sapiens
cuggaucccuuccuucuau

SEQ ID NO: 677190 - RNA, 19 nt, Homo sapiens
caagaaggagaauaagaau

SEQ ID NO: 677191 - RNA, 19 nt, Homo sapiens
gaacucucuuucuucucuu

SEQ ID NO: 677192 - RNA, 19 nt, Homo sapiens
gaggagagaggccugaauc

SEQ ID NO: 677193 - RNA, 19 nt, Homo sapiens
gguggacucccuacaauca

SEQ ID NO: 677194 - RNA, 19 nt, Homo sapiens
gcgagacgguggaguucug

SEQ ID NO: 677195 - RNA, 19 nt, Homo sapiens
ccgcccagcugugcacuuu

SEQ ID NO: 677196 - RNA, 19 nt, Homo sapiens
cagcaccaaccucuacuuu

SEQ ID NO: 677197 - RNA, 19 nt, Homo sapiens
caacggucaccuaucugua

SEQ ID NO: 677198 - RNA, 19 nt, Homo sapiens
cuugcgacgugcaucaaua

SEQ ID NO: 677199 - RNA, 19 nt, Homo sapiens
uaagaauuccaacaaguuc

SEQ ID NO: 677200 - RNA, 19 nt, Homo sapiens
ggauguuccuuccuuccau

SEQ ID NO: 677201 - RNA, 19 nt, Homo sapiens
ggcaccagcucaugagucu

SEQ ID NO: 677202 - RNA, 19 nt, Homo sapiens
ugucggauguuccuuccuu

SEQ ID NO: 677203 - RNA, 19 nt, Homo sapiens
cuucucagccucuguaguu

SEQ ID NO: 677204 - RNA, 19 nt, Homo sapiens
gcaccuggcucagcuucag

SEQ ID NO: 677205 - RNA, 19 nt, Homo sapiens
gcgucaggcugucggaugu

SEQ ID NO: 677206 - RNA, 19 nt, Homo sapiens
gaucccuuccuucuauaaa

SEQ ID NO: 677207 - RNA, 19 nt, Homo sapiens
caguggagccagccaugua

SEQ ID NO: 677208 - RNA, 19 nt, Homo sapiens
gaacgugagaccuguaagc

SEQ ID NO: 677209 - RNA, 19 nt, Homo sapiens
aaggaacucucuuucuucu

SEQ ID NO: 677210 - RNA, 19 nt, Homo sapiens
cgacgugcaucaauaaacc

SEQ ID NO: 677211 - RNA, 19 nt, Homo sapiens
gcugcagccuuaccugaag

SEQ ID NO: 677212 - RNA, 19 nt, Homo sapiens
gacggugguccucuuggua

SEQ ID NO: 677213 - RNA, 19 nt, Homo sapiens
ggaucccuuccuucuauaa

SEQ ID NO: 677214 - RNA, 19 nt, Homo sapiens
ucaacaaagcaaacagaga

SEQ ID NO: 677215 - RNA, 19 nt, Homo sapiens
ccucauuccuacugucaca

SEQ ID NO: 677216 - RNA, 19 nt, Homo sapiens
gcggacuucuacugcaugu

SEQ ID NO: 677217 - RNA, 19 nt, Homo sapiens
cagcucagcgccucuucaa

SEQ ID NO: 677218 - RNA, 19 nt, Homo sapiens
gcccagcugugcacuuugc

SEQ ID NO: 677219 - RNA, 19 nt, Homo sapiens
uggaucccuuccuucuaua

SEQ ID NO: 677220 - RNA, 19 nt, Homo sapiens
gaccucauccuggagauca

SEQ ID NO: 677221 - RNA, 19 nt, Homo sapiens
ugugagcucuuggcuguca

SEQ ID NO: 677222 - RNA, 19 nt, Homo sapiens
aaucaacaaagcaaacaga

SEQ ID NO: 677223 - RNA, 19 nt, Homo sapiens
cuacaaucaacaaagcaaa

SEQ ID NO: 677224 - RNA, 19 nt, Homo sapiens
ggagagaugagcggaaggu

SEQ ID NO: 677225 - RNA, 19 nt, Homo sapiens
gcauguacacggccuacca

SEQ ID NO: 677226 - RNA, 19 nt, Homo sapiens
uaacaagaaggagaauaag

SEQ ID NO: 677227 - RNA, 19 nt, Homo sapiens
gggaguucuuggugaaguc

SEQ ID NO: 677228 - RNA, 19 nt, Homo sapiens
ccugcucucuagaaaggaa

SEQ ID NO: 677229 - RNA, 19 nt, Homo sapiens
gacauggaaaggcuucuca

SEQ ID NO: 677230 - RNA, 19 nt, Homo sapiens
gagcgagacgguggaguuc

SEQ ID NO: 677231 - RNA, 19 nt, Homo sapiens
cuacugccgaugccaagaa

SEQ ID NO: 677232 - RNA, 19 nt, Homo sapiens
gcucaugagucugucuacu

SEQ ID NO: 677233 - RNA, 19 nt, Homo sapiens
caccagcucaugagucugu

SEQ ID NO: 677234 - RNA, 19 nt, Homo sapiens
gcauggaagcagccuccuu

SEQ ID NO: 677235 - RNA, 19 nt, Homo sapiens
guggacaacggucaccuau

SEQ ID NO: 677236 - RNA, 19 nt, Homo sapiens
cugcucagcugggaacauc

SEQ ID NO: 677237 - RNA, 19 nt, Homo sapiens
uuacuucauugaccuuaac

SEQ ID NO: 677238 - RNA, 19 nt, Homo sapiens
gcugugcacuuugcucacu

SEQ ID NO: 677239 - RNA, 19 nt, Homo sapiens
aacaagaaggagaauaaga

SEQ ID NO: 677240 - RNA, 19 nt, Homo sapiens
caaggaguacuuccagcau

SEQ ID NO: 677241 - RNA, 19 nt, Homo sapiens
gaaauuaacuggacaccua

SEQ ID NO: 677242 - RNA, 19 nt, Homo sapiens
gggaggagcuguugaaaga

SEQ ID NO: 677243 - RNA, 19 nt, Homo sapiens
gaccagggcuccacaauga

SEQ ID NO: 677244 - RNA, 19 nt, Homo sapiens
gaggaagccugcagccuua

SEQ ID NO: 677245 - RNA, 19 nt, Homo sapiens
ggaagugacuggucugaug

SEQ ID NO: 677246 - RNA, 19 nt, Homo sapiens
cggauuagcugugcuguua

SEQ ID NO: 677247 - RNA, 19 nt, Homo sapiens
aaagagaggugaaggagaa

SEQ ID NO: 677248 - RNA, 19 nt, Homo sapiens
ccagaauucucguucauuu

SEQ ID NO: 677249 - RNA, 19 nt, Homo sapiens
gaagaaagagugcgauaug

SEQ ID NO: 677250 - RNA, 19 nt, Homo sapiens
gcagugagguggauagauc

SEQ ID NO: 677251 - RNA, 19 nt, Homo sapiens
ggaaacggaugcucccuau

SEQ ID NO: 677252 - RNA, 19 nt, Homo sapiens
caagugaacugcagcacaa

SEQ ID NO: 677253 - RNA, 19 nt, Homo sapiens
gaggagggcuucauugaca

SEQ ID NO: 677254 - RNA, 19 nt, Homo sapiens
ccaaagauaguucucauaa

SEQ ID NO: 677255 - RNA, 19 nt, Homo sapiens
gaaaugggcuuggauuacu

SEQ ID NO: 677256 - RNA, 19 nt, Homo sapiens
gagaaaugggcuuggauua

SEQ ID NO: 677257 - RNA, 19 nt, Homo sapiens
gaaguacuuucccaacaug

SEQ ID NO: 677258 - RNA, 19 nt, Homo sapiens
aaacggaugcucccuauuu

SEQ ID NO: 677259 - RNA, 19 nt, Homo sapiens
ccgagaagcugaugaagau

SEQ ID NO: 677260 - RNA, 19 nt, Homo sapiens
ucacggcagugcugacaua

SEQ ID NO: 677261 - RNA, 19 nt, Homo sapiens
uauagacccucaagagaaa

SEQ ID NO: 677262 - RNA, 19 nt, Homo sapiens
gggcagcucagccauguua

SEQ ID NO: 677263 - RNA, 19 nt, Homo sapiens
gagaggagacuguacuuug

SEQ ID NO: 677264 - RNA, 19 nt, Homo sapiens
gaacaccagucgccucuac

SEQ ID NO: 677265 - RNA, 19 nt, Homo sapiens
gcacguuacuacagugaga

SEQ ID NO: 677266 - RNA, 19 nt, Homo sapiens
acaaggugcuaucuacuuu

SEQ ID NO: 677267 - RNA, 19 nt, Homo sapiens
guguuaagcugauaagguu

SEQ ID NO: 677268 - RNA, 19 nt, Homo sapiens
gaacacaggcuggcuugaa

SEQ ID NO: 677269 - RNA, 19 nt, Homo sapiens
gaaccugucucccugaaac

SEQ ID NO: 677270 - RNA, 19 nt, Homo sapiens
ccacaaugaucuaccugaa

SEQ ID NO: 677271 - RNA, 19 nt, Homo sapiens
uagcugugcuguuauguug

SEQ ID NO: 677272 - RNA, 19 nt, Homo sapiens
cauugucuaugcagaauaa

SEQ ID NO: 677273 - RNA, 19 nt, Homo sapiens
gaagaucugcuagaaauca

SEQ ID NO: 677274 - RNA, 19 nt, Homo sapiens
gcagcuacccggucauuga

SEQ ID NO: 677275 - RNA, 19 nt, Homo sapiens
cuuggaggcuuaaauugua

SEQ ID NO: 677276 - RNA, 19 nt, Homo sapiens
gcacaagguauuugagaga

SEQ ID NO: 677277 - RNA, 19 nt, Homo sapiens
gaacagcacaagguauuug

SEQ ID NO: 677278 - RNA, 19 nt, Homo sapiens
cauguacccuccucauuug

SEQ ID NO: 677279 - RNA, 19 nt, Homo sapiens
uaaagaagcccuuggugau

SEQ ID NO: 677280 - RNA, 19 nt, Homo sapiens
ggagaaaugggcuuggauu

SEQ ID NO: 677281 - RNA, 19 nt, Homo sapiens
aagcggagaugacauggaa

SEQ ID NO: 677282 - RNA, 19 nt, Homo sapiens
gauuagcugugcuguuaug

SEQ ID NO: 677283 - RNA, 19 nt, Homo sapiens
ggucugauguugaggagau

SEQ ID NO: 677284 - RNA, 19 nt, Homo sapiens
gagaggagcagcuucuaug

SEQ ID NO: 677285 - RNA, 19 nt, Homo sapiens
gauaagacagugccagaga

SEQ ID NO: 677286 - RNA, 19 nt, Homo sapiens
ucucauaacuccacaaacu

SEQ ID NO: 677287 - RNA, 19 nt, Homo sapiens
acaagucacuggccuggaa

SEQ ID NO: 677288 - RNA, 19 nt, Homo sapiens
gaaagcugauuggcauugu

SEQ ID NO: 677289 - RNA, 19 nt, Homo sapiens
cuaaauuccucuagguguu

SEQ ID NO: 677290 - RNA, 19 nt, Homo sapiens
uaaaauacaucccuuaugg

SEQ ID NO: 677291 - RNA, 19 nt, Homo sapiens
ccuggugucugcaaaugua

SEQ ID NO: 677292 - RNA, 19 nt, Homo sapiens
ugacaggagaguaguuaua

SEQ ID NO: 677293 - RNA, 19 nt, Homo sapiens
uaagguugauuccaaagau

SEQ ID NO: 677294 - RNA, 19 nt, Homo sapiens
auacaucccuuauggaauc

SEQ ID NO: 677295 - RNA, 19 nt, Homo sapiens
ggucuuggaggcuuaaauu

SEQ ID NO: 677296 - RNA, 19 nt, Homo sapiens
gguccaggguuaagugaga

SEQ ID NO: 677297 - RNA, 19 nt, Homo sapiens
ggagccgcaugagugauua

SEQ ID NO: 677298 - RNA, 19 nt, Homo sapiens
ugaugaagaucugcuagaa

SEQ ID NO: 677299 - RNA, 19 nt, Homo sapiens
ucauguacccuccucauuu

SEQ ID NO: 677300 - RNA, 19 nt, Homo sapiens
augaagaucugcuagaaau

SEQ ID NO: 677301 - RNA, 19 nt, Homo sapiens
cagaacagcacaagguauu

SEQ ID NO: 677302 - RNA, 19 nt, Homo sapiens
ucugaaaccuugagaacug

SEQ ID NO: 677303 - RNA, 19 nt, Homo sapiens
gagccucuccuucaccuuu

SEQ ID NO: 677304 - RNA, 19 nt, Homo sapiens
gguacuuccuccucacuga

SEQ ID NO: 677305 - RNA, 19 nt, Homo sapiens
aagaaagagugcgauauga

SEQ ID NO: 677306 - RNA, 19 nt, Homo sapiens
cagaagcucagaagaaaga

SEQ ID NO: 677307 - RNA, 19 nt, Homo sapiens
uccagaagcucagaagaaa

SEQ ID NO: 677308 - RNA, 19 nt, Homo sapiens
uguaauagcacugggauuu

SEQ ID NO: 677309 - RNA, 19 nt, Homo sapiens
gaugaagaucugcuagaaa

SEQ ID NO: 677310 - RNA, 19 nt, Homo sapiens
gaaaagaacauuccaagag

SEQ ID NO: 677311 - RNA, 19 nt, Homo sapiens
ugacucugacucucauuua

SEQ ID NO: 677312 - RNA, 19 nt, Homo sapiens
agaggagacuguacuuugu

SEQ ID NO: 677313 - RNA, 19 nt, Homo sapiens
ugaaguacuuucccaacau

SEQ ID NO: 677314 - RNA, 19 nt, Homo sapiens
gggcuuggauuacucuuac

SEQ ID NO: 677315 - RNA, 19 nt, Homo sapiens
caaaacaccuccagagaca

SEQ ID NO: 677316 - RNA, 19 nt, Homo sapiens
gagagaaucaucguggaaa

SEQ ID NO: 677317 - RNA, 19 nt, Homo sapiens
ggagagaaucaucguggaa

SEQ ID NO: 677318 - RNA, 19 nt, Homo sapiens
cagauucucucaggaggaa

SEQ ID NO: 677319 - RNA, 19 nt, Homo sapiens
ggucagaaugauacaauug

SEQ ID NO: 677320 - RNA, 19 nt, Homo sapiens
gggaaugccucuguauuuu

SEQ ID NO: 677321 - RNA, 19 nt, Homo sapiens
caaccagcccuguguuaga

SEQ ID NO: 677322 - RNA, 19 nt, Homo sapiens
aaauacaucccuuauggaa

SEQ ID NO: 677323 - RNA, 19 nt, Homo sapiens
gggacugccuguaauagca

SEQ ID NO: 677324 - RNA, 19 nt, Homo sapiens
ucauaaggcuucagcuucu

SEQ ID NO: 677325 - RNA, 19 nt, Homo sapiens
cugcaucucugacuucugu

SEQ ID NO: 677326 - RNA, 19 nt, Homo sapiens
ugacuggucugauguugag

SEQ ID NO: 677327 - RNA, 19 nt, Homo sapiens
caaagauaguucucauaac

SEQ ID NO: 677328 - RNA, 19 nt, Homo sapiens
ugggaaugccucuguauuu

SEQ ID NO: 677329 - RNA, 19 nt, Homo sapiens
gaagugacuggucugaugu

SEQ ID NO: 677330 - RNA, 19 nt, Homo sapiens
ugaucuaccugaaggcuau

SEQ ID NO: 677331 - RNA, 19 nt, Homo sapiens
aagguugauuccaaagaua

SEQ ID NO: 677332 - RNA, 19 nt, Homo sapiens
cugaagcgcuuugacaguu

SEQ ID NO: 677333 - RNA, 19 nt, Homo sapiens
gaacauuccaagaggagau

SEQ ID NO: 677334 - RNA, 19 nt, Homo sapiens
gccuuaagguugauuccaa

SEQ ID NO: 677335 - RNA, 19 nt, Homo sapiens
ucacugugcugugggaaug

SEQ ID NO: 677336 - RNA, 19 nt, Homo sapiens
ggaacucagccuugauuca

SEQ ID NO: 677337 - RNA, 19 nt, Homo sapiens
gaggugaaucagcguaauu

SEQ ID NO: 677338 - RNA, 19 nt, Homo sapiens
cgaaguagcgcugggcaaa

SEQ ID NO: 677339 - RNA, 19 nt, Homo sapiens
gaugggcaguggaaagaag

SEQ ID NO: 677340 - RNA, 19 nt, Homo sapiens
gaaaagcggagaugacaug

SEQ ID NO: 677341 - RNA, 19 nt, Homo sapiens
ggaaggagauugcugacua

SEQ ID NO: 677342 - RNA, 19 nt, Homo sapiens
caaagaaucuccaugaaau

SEQ ID NO: 677343 - RNA, 19 nt, Homo sapiens
caaauacgccuuucucaua

SEQ ID NO: 677344 - RNA, 19 nt, Homo sapiens
uaucaggccuuucccaaua

SEQ ID NO: 677345 - RNA, 19 nt, Homo sapiens
agacagaucuuauugaugu

SEQ ID NO: 677346 - RNA, 19 nt, Homo sapiens
gcugagcgcuuaagaguga

SEQ ID NO: 677347 - RNA, 19 nt, Homo sapiens
aaacauaggucucuuaaac

SEQ ID NO: 677348 - RNA, 19 nt, Homo sapiens
gaaaggaggcccuggaaga

SEQ ID NO: 677349 - RNA, 19 nt, Homo sapiens
uaacaaagaaucuccauga

SEQ ID NO: 677350 - RNA, 19 nt, Homo sapiens
caaggaauauggcaagcua

SEQ ID NO: 677351 - RNA, 19 nt, Homo sapiens
agagauaccugauugaaau

SEQ ID NO: 677352 - RNA, 19 nt, Homo sapiens
uagaaguacucaagucuuu

SEQ ID NO: 677353 - RNA, 19 nt, Homo sapiens
gcuuccagcugccuuaaua

SEQ ID NO: 677354 - RNA, 19 nt, Homo sapiens
gaaggagauugcugacuau

SEQ ID NO: 677355 - RNA, 19 nt, Homo sapiens
gaauauggcaagcuaugua

SEQ ID NO: 677356 - RNA, 19 nt, Homo sapiens
ccaggcaacuuucacguuu

SEQ ID NO: 677357 - RNA, 19 nt, Homo sapiens
gauguuggauucacagaug

SEQ ID NO: 677358 - RNA, 19 nt, Homo sapiens
ggagagagcacguugugaa

SEQ ID NO: 677359 - RNA, 19 nt, Homo sapiens
gaaucugugucuacauuga

SEQ ID NO: 677360 - RNA, 19 nt, Homo sapiens
ggaugggacucuuauguca

SEQ ID NO: 677361 - RNA, 19 nt, Homo sapiens
caaagggaccaucagauuu

SEQ ID NO: 677362 - RNA, 19 nt, Homo sapiens
ccaaguauagcaaggaaua

SEQ ID NO: 677363 - RNA, 19 nt, Homo sapiens
gcugggcucuggauuuaaa

SEQ ID NO: 677364 - RNA, 19 nt, Homo sapiens
gaaaggacaaggugccauu

SEQ ID NO: 677365 - RNA, 19 nt, Homo sapiens
ccaaagggaccaucagauu

SEQ ID NO: 677366 - RNA, 19 nt, Homo sapiens
ggauccaguugcaaaguuu

SEQ ID NO: 677367 - RNA, 19 nt, Homo sapiens
agaaguggcugaguugaaa

SEQ ID NO: 677368 - RNA, 19 nt, Homo sapiens
cugaagacauugacuuuga

SEQ ID NO: 677369 - RNA, 19 nt, Homo sapiens
guggagagauaccugauug

SEQ ID NO: 677370 - RNA, 19 nt, Homo sapiens
agucauaaaucgccuuaaa

SEQ ID NO: 677371 - RNA, 19 nt, Homo sapiens
cagccuuucuuuaauguuu

SEQ ID NO: 677372 - RNA, 19 nt, Homo sapiens
ccaugcagcuguaguuguu

SEQ ID NO: 677373 - RNA, 19 nt, Homo sapiens
gcagauaacuaugacaacu

SEQ ID NO: 677374 - RNA, 19 nt, Homo sapiens
aaauacgccuuucucauau

SEQ ID NO: 677375 - RNA, 19 nt, Homo sapiens
gagagauaccugauugaaa

SEQ ID NO: 677376 - RNA, 19 nt, Homo sapiens
gggaagcacugugggaaga

SEQ ID NO: 677377 - RNA, 19 nt, Homo sapiens
ucagagugaucccagguuu

SEQ ID NO: 677378 - RNA, 19 nt, Homo sapiens
gaucagcucugugccaagu

SEQ ID NO: 677379 - RNA, 19 nt, Homo sapiens
gaguugagacugagcaauu

SEQ ID NO: 677380 - RNA, 19 nt, Homo sapiens
guagagacagaucuuauug

SEQ ID NO: 677381 - RNA, 19 nt, Homo sapiens
gaagcugggcccucucauu

SEQ ID NO: 677382 - RNA, 19 nt, Homo sapiens
gggaagaccaccaaagaug

SEQ ID NO: 677383 - RNA, 19 nt, Homo sapiens
ggagagauaccugauugaa

SEQ ID NO: 677384 - RNA, 19 nt, Homo sapiens
gcuuugggauuggaugaua

SEQ ID NO: 677385 - RNA, 19 nt, Homo sapiens
gagagcacguugugaagca

SEQ ID NO: 677386 - RNA, 19 nt, Homo sapiens
agagacagaucuuauugau

SEQ ID NO: 677387 - RNA, 19 nt, Homo sapiens
uaauagaaguacucaaguc

SEQ ID NO: 677388 - RNA, 19 nt, Homo sapiens
gggauccaguugcaaaguu

SEQ ID NO: 677389 - RNA, 19 nt, Homo sapiens
acaaagaaucuccaugaaa

SEQ ID NO: 677390 - RNA, 19 nt, Homo sapiens
gagcaauuucuccuuguaa

SEQ ID NO: 677391 - RNA, 19 nt, Homo sapiens
gcaaauacgccuuucucau

SEQ ID NO: 677392 - RNA, 19 nt, Homo sapiens
cagaugaugugaagaaagg

SEQ ID NO: 677393 - RNA, 19 nt, Homo sapiens
ugcaaagaauuacaacgua

SEQ ID NO: 677394 - RNA, 19 nt, Homo sapiens
gaaaauaguugcugaucag

SEQ ID NO: 677395 - RNA, 19 nt, Homo sapiens
ggccuuauccagucuauga

SEQ ID NO: 677396 - RNA, 19 nt, Homo sapiens
cauggaaccuuuaaaacua

SEQ ID NO: 677397 - RNA, 19 nt, Homo sapiens
ugagcaauuucuccuugua

SEQ ID NO: 677398 - RNA, 19 nt, Homo sapiens
gcccauagcuaaggucauc

SEQ ID NO: 677399 - RNA, 19 nt, Homo sapiens
gacauugacuuugaugauc

SEQ ID NO: 677400 - RNA, 19 nt, Homo sapiens
gguagagacagaucuuauu

SEQ ID NO: 677401 - RNA, 19 nt, Homo sapiens
cugaaucugugucuacauu

SEQ ID NO: 677402 - RNA, 19 nt, Homo sapiens
gaaaacauaggucucuuaa

SEQ ID NO: 677403 - RNA, 19 nt, Homo sapiens
uugaaggccucgcuuaguu

SEQ ID NO: 677404 - RNA, 19 nt, Homo sapiens
gaauuacaacguacccuau

SEQ ID NO: 677405 - RNA, 19 nt, Homo sapiens
gccuuaaacuauuggagaa

SEQ ID NO: 677406 - RNA, 19 nt, Homo sapiens
ugacauuaaugcugauaag

SEQ ID NO: 677407 - RNA, 19 nt, Homo sapiens
augcugggcucuggauuua

SEQ ID NO: 677408 - RNA, 19 nt, Homo sapiens
gaaaagagggguaccuguu

SEQ ID NO: 677409 - RNA, 19 nt, Homo sapiens
cauaaaucgccuuaaacua

SEQ ID NO: 677410 - RNA, 19 nt, Homo sapiens
agagugaauuugagauuag

SEQ ID NO: 677411 - RNA, 19 nt, Homo sapiens
uguugagguuccagacuua

SEQ ID NO: 677412 - RNA, 19 nt, Homo sapiens
aacaaagaaucuccaugaa

SEQ ID NO: 677413 - RNA, 19 nt, Homo sapiens
gaccugcagauaacuauga

SEQ ID NO: 677414 - RNA, 19 nt, Homo sapiens
caacguacccuaugaaccu

SEQ ID NO: 677415 - RNA, 19 nt, Homo sapiens
cuggaaagccuacaggaaa

SEQ ID NO: 677416 - RNA, 19 nt, Homo sapiens
ccagcugccuuaauagaag

SEQ ID NO: 677417 - RNA, 19 nt, Homo sapiens
ggacaaggugccauucaag

SEQ ID NO: 677418 - RNA, 19 nt, Homo sapiens
gaagacauugacuuugaug

SEQ ID NO: 677419 - RNA, 19 nt, Homo sapiens
gauuggaugauacagcuuu

SEQ ID NO: 677420 - RNA, 19 nt, Homo sapiens
uccuggagcuguacuguga

SEQ ID NO: 677421 - RNA, 19 nt, Homo sapiens
ggagcccucuguggccuuu

SEQ ID NO: 677422 - RNA, 19 nt, Homo sapiens
gaucuuucccggagguuug

SEQ ID NO: 677423 - RNA, 19 nt, Homo sapiens
ugaagacauugacuuugau

SEQ ID NO: 677424 - RNA, 19 nt, Homo sapiens
aaagggaccaucagauuuc

SEQ ID NO: 677425 - RNA, 19 nt, Homo sapiens
ggauuguggugagugagaa

SEQ ID NO: 677426 - RNA, 19 nt, Homo sapiens
gaaagcaaggaaggagauu

SEQ ID NO: 677427 - RNA, 19 nt, Homo sapiens
cccaugccaucugcaaaua

SEQ ID NO: 677428 - RNA, 19 nt, Homo sapiens
ccuaugaaccugacucugu

SEQ ID NO: 677429 - RNA, 19 nt, Homo sapiens
guguugagguuccagacuu

SEQ ID NO: 677430 - RNA, 19 nt, Homo sapiens
gagauaccugauugaaauu

SEQ ID NO: 677431 - RNA, 19 nt, Homo sapiens
cuaucuggcugcugggaaa

SEQ ID NO: 677432 - RNA, 19 nt, Homo sapiens
aagcugggcccucucauug

SEQ ID NO: 677433 - RNA, 19 nt, Homo sapiens
gcaauuucuccuuguaaca

SEQ ID NO: 677434 - RNA, 19 nt, Homo sapiens
acauaggucucuuaaacca

SEQ ID NO: 677435 - RNA, 19 nt, Homo sapiens
ggacuuaucaggccuuucc

SEQ ID NO: 677436 - RNA, 19 nt, Homo sapiens
ucucauauccacugccaaa

SEQ ID NO: 677437 - RNA, 19 nt, Homo sapiens
gcuggaaagccuacaggaa

SEQ ID NO: 677438 - RNA, 19 nt, Homo sapiens
ucgcuuaguuguacuggau

SEQ ID NO: 677439 - RNA, 19 nt, Homo sapiens
ucagcucugugccaaguau

SEQ ID NO: 677440 - RNA, 19 nt, Homo sapiens
ucuuaaaccaggcaacuuu

SEQ ID NO: 677441 - RNA, 19 nt, Homo sapiens
gaagauacauuggcucuaa

SEQ ID NO: 677442 - RNA, 19 nt, Homo sapiens
gaacuaagcauucauuguu

SEQ ID NO: 677443 - RNA, 19 nt, Homo sapiens
gagaugcccuuccugaaua

SEQ ID NO: 677444 - RNA, 19 nt, Homo sapiens
gaaaaggucuugauucuga

SEQ ID NO: 677445 - RNA, 19 nt, Homo sapiens
gaaugaauuugguuaguug

SEQ ID NO: 677446 - RNA, 19 nt, Homo sapiens
gagauuugcuuugaacuuu

SEQ ID NO: 677447 - RNA, 19 nt, Homo sapiens
ggagcuacuuucauccuua

SEQ ID NO: 677448 - RNA, 19 nt, Homo sapiens
ccagaauggucuuuaauga

SEQ ID NO: 677449 - RNA, 19 nt, Homo sapiens
gaauaggugggaugaauuu

SEQ ID NO: 677450 - RNA, 19 nt, Homo sapiens
aggcaaagcuacaauagaa

SEQ ID NO: 677451 - RNA, 19 nt, Homo sapiens
gaauaugaagccaguagua

SEQ ID NO: 677452 - RNA, 19 nt, Homo sapiens
gggaauaggugggaugaau

SEQ ID NO: 677453 - RNA, 19 nt, Homo sapiens
guaauuaagugaacuaagc

SEQ ID NO: 677454 - RNA, 19 nt, Homo sapiens
gagaaacggcuggaugaua

SEQ ID NO: 677455 - RNA, 19 nt, Homo sapiens
gagggaauaugauacuuca

SEQ ID NO: 677456 - RNA, 19 nt, Homo sapiens
gggaauaugauacuucaaa

SEQ ID NO: 677457 - RNA, 19 nt, Homo sapiens
uaacugaacagcaaaugaa

SEQ ID NO: 677458 - RNA, 19 nt, Homo sapiens
gcugggaacguccaaauuu

SEQ ID NO: 677459 - RNA, 19 nt, Homo sapiens
agaaacggcuggaugauag

SEQ ID NO: 677460 - RNA, 19 nt, Homo sapiens
gaauuacacaugccaaaug

SEQ ID NO: 677461 - RNA, 19 nt, Homo sapiens
gaacagcaaaugaaagaag

SEQ ID NO: 677462 - RNA, 19 nt, Homo sapiens
guuaaugagcugaaaguaa

SEQ ID NO: 677463 - RNA, 19 nt, Homo sapiens
ggaauaggugggaugaauu

SEQ ID NO: 677464 - RNA, 19 nt, Homo sapiens
gagaaugaauuugguuagu

SEQ ID NO: 677465 - RNA, 19 nt, Homo sapiens
guacaagagccuaaccaaa

SEQ ID NO: 677466 - RNA, 19 nt, Homo sapiens
agauucagguggucaaauu

SEQ ID NO: 677467 - RNA, 19 nt, Homo sapiens
guucuugaguccugaauuc

SEQ ID NO: 677468 - RNA, 19 nt, Homo sapiens
ugaaagaagcucagaagug

SEQ ID NO: 677469 - RNA, 19 nt, Homo sapiens
ggacuuggagcuacuuuca

SEQ ID NO: 677470 - RNA, 19 nt, Homo sapiens
gaauauagcacuuuugaug

SEQ ID NO: 677471 - RNA, 19 nt, Homo sapiens
gcugcaauauggaaggaaa

SEQ ID NO: 677472 - RNA, 19 nt, Homo sapiens
ggauuugcauucagagauc

SEQ ID NO: 677473 - RNA, 19 nt, Homo sapiens
ggaagaggacuuggagcua

SEQ ID NO: 677474 - RNA, 19 nt, Homo sapiens
gagaauuacacaugccaaa

SEQ ID NO: 677475 - RNA, 19 nt, Homo sapiens
gcaaagcuacaauagaagu

SEQ ID NO: 677476 - RNA, 19 nt, Homo sapiens
gcuuugaacuuuauaaucc

SEQ ID NO: 677477 - RNA, 19 nt, Homo sapiens
gcuugaauuugauaugaug

SEQ ID NO: 677478 - RNA, 19 nt, Homo sapiens
gagcuacuuucauccuuag

SEQ ID NO: 677479 - RNA, 19 nt, Homo sapiens
uacuacagcugacccauau

SEQ ID NO: 677480 - RNA, 19 nt, Homo sapiens
ccuaagcccuggucuaaac

SEQ ID NO: 677481 - RNA, 19 nt, Homo sapiens
gcauggaaccugagcaaag

SEQ ID NO: 677482 - RNA, 19 nt, Homo sapiens
gauucagguggucaaauua

SEQ ID NO: 677483 - RNA, 19 nt, Homo sapiens
gagcauggaaccugagcaa

SEQ ID NO: 677484 - RNA, 19 nt, Homo sapiens
gaucuuuguuuaacugaac

SEQ ID NO: 677485 - RNA, 19 nt, Homo sapiens
cgagaugcccuuccugaau

SEQ ID NO: 677486 - RNA, 19 nt, Homo sapiens
uagagaaacggcuggauga

SEQ ID NO: 677487 - RNA, 19 nt, Homo sapiens
uggcuugaauuugauauga

SEQ ID NO: 677488 - RNA, 19 nt, Homo sapiens
ggaggcaaagcuacaauag

SEQ ID NO: 677489 - RNA, 19 nt, Homo sapiens
guucuauguuggaaguauu

SEQ ID NO: 677490 - RNA, 19 nt, Homo sapiens
cuugaguccugaauucauu

SEQ ID NO: 677491 - RNA, 19 nt, Homo sapiens
ggaaauugaagcgucgaaa

SEQ ID NO: 677492 - RNA, 19 nt, Homo sapiens
gaggcaaagcuacaauaga

SEQ ID NO: 677493 - RNA, 19 nt, Homo sapiens
ggauauauuuugagaccaa

SEQ ID NO: 677494 - RNA, 19 nt, Homo sapiens
gaaauugaagcgucgaaaa

SEQ ID NO: 677495 - RNA, 19 nt, Homo sapiens
ccagaguucuauguuggaa

SEQ ID NO: 677496 - RNA, 19 nt, Homo sapiens
ccuuaggaauguuaucgaa

SEQ ID NO: 677497 - RNA, 19 nt, Homo sapiens
uguacccacuaucagguua

SEQ ID NO: 677498 - RNA, 19 nt, Homo sapiens
gagaaaaguacuccacauu

SEQ ID NO: 677499 - RNA, 19 nt, Homo sapiens
uuacuacagcugacccaua

SEQ ID NO: 677500 - RNA, 19 nt, Homo sapiens
ugaagccaguaguacaaga

SEQ ID NO: 677501 - RNA, 19 nt, Homo sapiens
gaaaaguacuccacauucc

SEQ ID NO: 677502 - RNA, 19 nt, Homo sapiens
cauggaaccugagcaaagg

SEQ ID NO: 677503 - RNA, 19 nt, Homo sapiens
gcacaauaugauuuacaga

SEQ ID NO: 677504 - RNA, 19 nt, Homo sapiens
uacaagagccuaaccaaaa

SEQ ID NO: 677505 - RNA, 19 nt, Homo sapiens
agaguucuauguuggaagu

SEQ ID NO: 677506 - RNA, 19 nt, Homo sapiens
ccacuaucagguuaagaaa

SEQ ID NO: 677507 - RNA, 19 nt, Homo sapiens
gaaccugagcaaagggaau

SEQ ID NO: 677508 - RNA, 19 nt, Homo sapiens
caaaugaaagaagcucaga

SEQ ID NO: 677509 - RNA, 19 nt, Homo sapiens
cugaacagcaaaugaaaga

SEQ ID NO: 677510 - RNA, 19 nt, Homo sapiens
gguggucaaauuagagaaa

SEQ ID NO: 677511 - RNA, 19 nt, Homo sapiens
cgagauuugcuuugaacuu

SEQ ID NO: 677512 - RNA, 19 nt, Homo sapiens
uugauaugaugagggaaua

SEQ ID NO: 677513 - RNA, 19 nt, Homo sapiens
gugucgagauuugcuuuga

SEQ ID NO: 677514 - RNA, 19 nt, Homo sapiens
caugccaaauggaccaaug

SEQ ID NO: 677515 - RNA, 19 nt, Homo sapiens
uuaagugaacuaagcauuc

SEQ ID NO: 677516 - RNA, 19 nt, Homo sapiens
gaugagggaauaugauacu

SEQ ID NO: 677517 - RNA, 19 nt, Homo sapiens
aagaagcucagaaguggaa

SEQ ID NO: 677518 - RNA, 19 nt, Homo sapiens
uaugaagccaguaguacaa

SEQ ID NO: 677519 - RNA, 19 nt, Homo sapiens
ugucgagauuugcuuugaa

SEQ ID NO: 677520 - RNA, 19 nt, Homo sapiens
ccacauuccagaguucuau

SEQ ID NO: 677521 - RNA, 19 nt, Homo sapiens
gggauuugcauucagagau

SEQ ID NO: 677522 - RNA, 19 nt, Homo sapiens
aauuacacaugccaaaugg

SEQ ID NO: 677523 - RNA, 19 nt, Homo sapiens
cugagaaugaauuugguua

SEQ ID NO: 677524 - RNA, 19 nt, Homo sapiens
gccauggcuugaauuugau

SEQ ID NO: 677525 - RNA, 19 nt, Homo sapiens
gauuugcauucagagauca

SEQ ID NO: 677526 - RNA, 19 nt, Homo sapiens
uugcuauacuuacgagaug

SEQ ID NO: 677527 - RNA, 19 nt, Homo sapiens
gagaucaggaagaggacuu

SEQ ID NO: 677528 - RNA, 19 nt, Homo sapiens
ggagauucagguggucaaa

SEQ ID NO: 677529 - RNA, 19 nt, Homo sapiens
ggucuuuaaugagcaugga

SEQ ID NO: 677530 - RNA, 19 nt, Homo sapiens
cagaauggucuuuaaugag

SEQ ID NO: 677531 - RNA, 19 nt, Homo sapiens
uugguuaguugcagaagau

SEQ ID NO: 677532 - RNA, 19 nt, Homo sapiens
ggcuugaauuugauaugau

SEQ ID NO: 677533 - RNA, 19 nt, Homo sapiens
uaggaauguuaucgaagga

SEQ ID NO: 677534 - RNA, 19 nt, Homo sapiens
guacccacuaucagguuaa

SEQ ID NO: 677535 - RNA, 19 nt, Homo sapiens
uggaggcaaagcuacaaua

SEQ ID NO: 677536 - RNA, 19 nt, Homo sapiens
agccuaagcccuggucuaa

SEQ ID NO: 677537 - RNA, 19 nt, Homo sapiens
acuuggagcuacuuucauc

SEQ ID NO: 677538 - RNA, 19 nt, Homo sapiens
gaagccaguaguacaagag

SEQ ID NO: 677539 - RNA, 19 nt, Homo sapiens
gauauguuagaaaggagaa

SEQ ID NO: 677540 - RNA, 19 nt, Homo sapiens
augaugagggaauaugaua

SEQ ID NO: 677541 - RNA, 19 nt, Homo sapiens
gcacuuaacuuguggaauu

SEQ ID NO: 677542 - RNA, 19 nt, Homo sapiens
gaacaaagaugucgugcaa

SEQ ID NO: 677543 - RNA, 19 nt, Homo sapiens
guucagagcuaaauuaaga

SEQ ID NO: 677544 - RNA, 19 nt, Homo sapiens
ucacaaggauccucugaaa

SEQ ID NO: 677545 - RNA, 19 nt, Homo sapiens
ucacauaccuucagcacuu

SEQ ID NO: 677546 - RNA, 19 nt, Homo sapiens
gaacagcaaaggucaauau

SEQ ID NO: 677547 - RNA, 19 nt, Homo sapiens
ggagggaacuuugaucuuc

SEQ ID NO: 677548 - RNA, 19 nt, Homo sapiens
gaaaucucauuaggguuua

SEQ ID NO: 677549 - RNA, 19 nt, Homo sapiens
ggagguauccauucauaaa

SEQ ID NO: 677550 - RNA, 19 nt, Homo sapiens
guaccucccuaaagcauuu

SEQ ID NO: 677551 - RNA, 19 nt, Homo sapiens
caauguaacugcuuuaguc

SEQ ID NO: 677552 - RNA, 19 nt, Homo sapiens
ggaaagacaucacauaccu

SEQ ID NO: 677553 - RNA, 19 nt, Homo sapiens
ggaggaggaugcauuucaa

SEQ ID NO: 677554 - RNA, 19 nt, Homo sapiens
gaacuuugaucuuccuaag

SEQ ID NO: 677555 - RNA, 19 nt, Homo sapiens
ccucagaccuugcaucuuc

SEQ ID NO: 677556 - RNA, 19 nt, Homo sapiens
uguaacugcuuuagucaua

SEQ ID NO: 677557 - RNA, 19 nt, Homo sapiens
ucagggauccuuaauguuu

SEQ ID NO: 677558 - RNA, 19 nt, Homo sapiens
ggacagaaagccagucaga

SEQ ID NO: 677559 - RNA, 19 nt, Homo sapiens
gcaaggaggaggaugcauu

SEQ ID NO: 677560 - RNA, 19 nt, Homo sapiens
cagacuaauuuccuucuuu

SEQ ID NO: 677561 - RNA, 19 nt, Homo sapiens
gaaguucagcguuguaugu

SEQ ID NO: 677562 - RNA, 19 nt, Homo sapiens
gaaccuaacccaaauuugc

SEQ ID NO: 677563 - RNA, 19 nt, Homo sapiens
uaaauuguguguucuguac

SEQ ID NO: 677564 - RNA, 19 nt, Homo sapiens
ugaaaucucauuaggguuu

SEQ ID NO: 677565 - RNA, 19 nt, Homo sapiens
aaccugaaguugcaguuua

SEQ ID NO: 677566 - RNA, 19 nt, Homo sapiens
cagcacuucucacaaugua

SEQ ID NO: 677567 - RNA, 19 nt, Homo sapiens
cagcaaaggucaauaucca

SEQ ID NO: 677568 - RNA, 19 nt, Homo sapiens
acacgaaccuaacccaaau

SEQ ID NO: 677569 - RNA, 19 nt, Homo sapiens
ugaugcaggugccagauuu

SEQ ID NO: 677570 - RNA, 19 nt, Homo sapiens
caaggaggaggaugcauuu

SEQ ID NO: 677571 - RNA, 19 nt, Homo sapiens
cgugcaaacuguacuguga

SEQ ID NO: 677572 - RNA, 19 nt, Homo sapiens
cauagguugucucugcaua

SEQ ID NO: 677573 - RNA, 19 nt, Homo sapiens
caacccuagucuuccauuu

SEQ ID NO: 677574 - RNA, 19 nt, Homo sapiens
caaccaccaugaacagcaa

SEQ ID NO: 677575 - RNA, 19 nt, Homo sapiens
acuguaccauugacuguua

SEQ ID NO: 677576 - RNA, 19 nt, Homo sapiens
acaaagaugucgugcaaac

SEQ ID NO: 677577 - RNA, 19 nt, Homo sapiens
uuucagggauccuuaaugu

SEQ ID NO: 677578 - RNA, 19 nt, Homo sapiens
agacuaauuuccuucuuuc

SEQ ID NO: 677579 - RNA, 19 nt, Homo sapiens
cuucagcacuucucacaau

SEQ ID NO: 677580 - RNA, 19 nt, Homo sapiens
ggaaggaggguaugaugca

SEQ ID NO: 677581 - RNA, 19 nt, Homo sapiens
gaauaaagugaugaaguug

SEQ ID NO: 677582 - RNA, 19 nt, Homo sapiens
caugugauguuugacugua

SEQ ID NO: 677583 - RNA, 19 nt, Homo sapiens
ccagugaaaucucauuagg

SEQ ID NO: 677584 - RNA, 19 nt, Homo sapiens
ccauacuggucuuugcuuu

SEQ ID NO: 677585 - RNA, 19 nt, Homo sapiens
cauuacuucugcuuucgua

SEQ ID NO: 677586 - RNA, 19 nt, Homo sapiens
caaacuguacugugaacaa

SEQ ID NO: 677587 - RNA, 19 nt, Homo sapiens
ccaacguccucguaacuca

SEQ ID NO: 677588 - RNA, 19 nt, Homo sapiens
ucaucuaaauuguguguuc

SEQ ID NO: 677589 - RNA, 19 nt, Homo sapiens
ggggagguauccauucaua

SEQ ID NO: 677590 - RNA, 19 nt, Homo sapiens
gaaagacaucacauaccuu

SEQ ID NO: 677591 - RNA, 19 nt, Homo sapiens
guaacugcuuuagucauau

SEQ ID NO: 677592 - RNA, 19 nt, Homo sapiens
ggagccaacguccucguaa

SEQ ID NO: 677593 - RNA, 19 nt, Homo sapiens
guggugcacuuaacuugug

SEQ ID NO: 677594 - RNA, 19 nt, Homo sapiens
guaugucucucucuacacu

SEQ ID NO: 677595 - RNA, 19 nt, Homo sapiens
gauguuugacuguaccauu

SEQ ID NO: 677596 - RNA, 19 nt, Homo sapiens
gaacaggaagaggacgaaa

SEQ ID NO: 677597 - RNA, 19 nt, Homo sapiens
aauaaggaaccauguaaug

SEQ ID NO: 677598 - RNA, 19 nt, Homo sapiens
caccaugucagccgcauuu

SEQ ID NO: 677599 - RNA, 19 nt, Homo sapiens
gccuuuagguuccacaauc

SEQ ID NO: 677600 - RNA, 19 nt, Homo sapiens
ugacuguuauggaaguuca

SEQ ID NO: 677601 - RNA, 19 nt, Homo sapiens
caguucaucuaaauugugu

SEQ ID NO: 677602 - RNA, 19 nt, Homo sapiens
gaggaggaugcauuucaaa

SEQ ID NO: 677603 - RNA, 19 nt, Homo sapiens
uguguucagagcuaaauua

SEQ ID NO: 677604 - RNA, 19 nt, Homo sapiens
cuucaugggugguucagau

SEQ ID NO: 677605 - RNA, 19 nt, Homo sapiens
ggcuacugcuggcaacauu

SEQ ID NO: 677606 - RNA, 19 nt, Homo sapiens
cacuuaacuuguggaauuu

SEQ ID NO: 677607 - RNA, 19 nt, Homo sapiens
caauggugcaggacagaaa

SEQ ID NO: 677608 - RNA, 19 nt, Homo sapiens
ccuaaagcauuuugaggua

SEQ ID NO: 677609 - RNA, 19 nt, Homo sapiens
gcaguuuagacacauguug

SEQ ID NO: 677610 - RNA, 19 nt, Homo sapiens
ucacaauguaacugcuuua

SEQ ID NO: 677611 - RNA, 19 nt, Homo sapiens
gcacuucucacaauguaac

SEQ ID NO: 677612 - RNA, 19 nt, Homo sapiens
aaagcuugauugauguguu

SEQ ID NO: 677613 - RNA, 19 nt, Homo sapiens
gcuguugggccuuuagguu

SEQ ID NO: 677614 - RNA, 19 nt, Homo sapiens
ccgccagucuccauugaau

SEQ ID NO: 677615 - RNA, 19 nt, Homo sapiens
aaagaugucgugcaaacug

SEQ ID NO: 677616 - RNA, 19 nt, Homo sapiens
auacuggucuuugcuuuua

SEQ ID NO: 677617 - RNA, 19 nt, Homo sapiens
caguauacccucagaccuu

SEQ ID NO: 677618 - RNA, 19 nt, Homo sapiens
gagccaacguccucguaac

SEQ ID NO: 677619 - RNA, 19 nt, Homo sapiens
cguuguaugucucucucua

SEQ ID NO: 677620 - RNA, 19 nt, Homo sapiens
aagcuugauugauguguuc

SEQ ID NO: 677621 - RNA, 19 nt, Homo sapiens
gccagucuccauugaauca

SEQ ID NO: 677622 - RNA, 19 nt, Homo sapiens
gggagguauccauucauaa

SEQ ID NO: 677623 - RNA, 19 nt, Homo sapiens
ucaggcacuuuucaaauuu

SEQ ID NO: 677624 - RNA, 19 nt, Homo sapiens
uccagucggucccaucuau

SEQ ID NO: 677625 - RNA, 19 nt, Homo sapiens
guccagugaaaucucauua

SEQ ID NO: 677626 - RNA, 19 nt, Homo sapiens
ggucauauugugaaugucu

SEQ ID NO: 677627 - RNA, 19 nt, Homo sapiens
gcuaaauuaagaggaguuu

SEQ ID NO: 677628 - RNA, 19 nt, Homo sapiens
caauccccauggcuuauua

SEQ ID NO: 677629 - RNA, 19 nt, Homo sapiens
ggucuuugcuuuuaguaau

SEQ ID NO: 677630 - RNA, 19 nt, Homo sapiens
auauuaaccugaaguugca

SEQ ID NO: 677631 - RNA, 19 nt, Homo sapiens
ccgggaaagacaucacaua

SEQ ID NO: 677632 - RNA, 19 nt, Homo sapiens
ccacaauccccauggcuua

SEQ ID NO: 677633 - RNA, 19 nt, Homo sapiens
guguucagagcuaaauuaa

SEQ ID NO: 677634 - RNA, 19 nt, Homo sapiens
ucagacuaauuuccuucuu

SEQ ID NO: 677635 - RNA, 19 nt, Homo sapiens
cuaaauuguguguucugua

SEQ ID NO: 677636 - RNA, 19 nt, Homo sapiens
gcauuaguugucugccuuu

SEQ ID NO: 677637 - RNA, 19 nt, Homo sapiens
ugaaguugcaguuuagaca

SEQ ID NO: 677638 - RNA, 19 nt, Homo sapiens
agggucauauugugaaugu

SEQ ID NO: 677639 - RNA, 19 nt, Homo sapiens
uaagaggaguuuucagauc

SEQ ID NO: 677640 - RNA, 19 nt, Homo sapiens
gggagccaacguccucgua

SEQ ID NO: 677641 - RNA, 19 nt, Homo sapiens
gaacuuaccucuacuguua

SEQ ID NO: 677642 - RNA, 19 nt, Homo sapiens
gcaaauagcaccaggaauu

SEQ ID NO: 677643 - RNA, 19 nt, Homo sapiens
caaguuaccugaccuuaaa

SEQ ID NO: 677644 - RNA, 19 nt, Homo sapiens
gaacuacacugaaaucuac

SEQ ID NO: 677645 - RNA, 19 nt, Homo sapiens
gcagauagcucagcaagga

SEQ ID NO: 677646 - RNA, 19 nt, Homo sapiens
ggaauuagauuucuguaca

SEQ ID NO: 677647 - RNA, 19 nt, Homo sapiens
gagcugggcuuuccaaguu

SEQ ID NO: 677648 - RNA, 19 nt, Homo sapiens
gauccuuucuuuccauuua

SEQ ID NO: 677649 - RNA, 19 nt, Homo sapiens
ugacuaagcucccaacaau

SEQ ID NO: 677650 - RNA, 19 nt, Homo sapiens
gagcauuucucauuguaaa

SEQ ID NO: 677651 - RNA, 19 nt, Homo sapiens
gggaugaucugcuuguaaa

SEQ ID NO: 677652 - RNA, 19 nt, Homo sapiens
gagcuucgcuaguuaaugu

SEQ ID NO: 677653 - RNA, 19 nt, Homo sapiens
guaaauguuugguuccuuu

SEQ ID NO: 677654 - RNA, 19 nt, Homo sapiens
ucacuuggcucugaacaua

SEQ ID NO: 677655 - RNA, 19 nt, Homo sapiens
gaaauguaauugccaaaca

SEQ ID NO: 677656 - RNA, 19 nt, Homo sapiens
guacauaugacauggcuua

SEQ ID NO: 677657 - RNA, 19 nt, Homo sapiens
ggagaaauaggucuaguuu

SEQ ID NO: 677658 - RNA, 19 nt, Homo sapiens
gaaagaaugggcucagaaa

SEQ ID NO: 677659 - RNA, 19 nt, Homo sapiens
ugacaacuuuggugcuuua

SEQ ID NO: 677660 - RNA, 19 nt, Homo sapiens
auacacagcuugagcguuu

SEQ ID NO: 677661 - RNA, 19 nt, Homo sapiens
gagcuuggcugaagaugau

SEQ ID NO: 677662 - RNA, 19 nt, Homo sapiens
guaaucagcuuguuguagu

SEQ ID NO: 677663 - RNA, 19 nt, Homo sapiens
gcacagccuugaacaaauc

SEQ ID NO: 677664 - RNA, 19 nt, Homo sapiens
ggagaaaucccaaagacuu

SEQ ID NO: 677665 - RNA, 19 nt, Homo sapiens
guuaaugugugcucacuuu

SEQ ID NO: 677666 - RNA, 19 nt, Homo sapiens
guuaugaacuacacugaaa

SEQ ID NO: 677667 - RNA, 19 nt, Homo sapiens
guacagacaugccaguuag

SEQ ID NO: 677668 - RNA, 19 nt, Homo sapiens
gaacuaauacacagcuuga

SEQ ID NO: 677669 - RNA, 19 nt, Homo sapiens
gagaguaaguugcaaccuu

SEQ ID NO: 677670 - RNA, 19 nt, Homo sapiens
caaauagcaccaggaauua

SEQ ID NO: 677671 - RNA, 19 nt, Homo sapiens
ccugaaacauaguuacaua

SEQ ID NO: 677672 - RNA, 19 nt, Homo sapiens
uaaagaugcugaagcuguu

SEQ ID NO: 677673 - RNA, 19 nt, Homo sapiens
caacuugauuaucuuguga

SEQ ID NO: 677674 - RNA, 19 nt, Homo sapiens
uaacugggaugaucugcuu

SEQ ID NO: 677675 - RNA, 19 nt, Homo sapiens
aaacugagcauuaaagguu

SEQ ID NO: 677676 - RNA, 19 nt, Homo sapiens
acuaagcucccaacaauua

SEQ ID NO: 677677 - RNA, 19 nt, Homo sapiens
ucaguaggcuuaauguguu

SEQ ID NO: 677678 - RNA, 19 nt, Homo sapiens
gcuugugccucaacuguuu

SEQ ID NO: 677679 - RNA, 19 nt, Homo sapiens
cauacuggcuuugcuguaa

SEQ ID NO: 677680 - RNA, 19 nt, Homo sapiens
guuacuagcucaaggugaa

SEQ ID NO: 677681 - RNA, 19 nt, Homo sapiens
guagcagucuugaaauguu

SEQ ID NO: 677682 - RNA, 19 nt, Homo sapiens
gagauguuauugcagaaga

SEQ ID NO: 677683 - RNA, 19 nt, Homo sapiens
uaguagagcuugcauaguc

SEQ ID NO: 677684 - RNA, 19 nt, Homo sapiens
aggagaaacugaagaaugu

SEQ ID NO: 677685 - RNA, 19 nt, Homo sapiens
cagaagagauugagaaaau

SEQ ID NO: 677686 - RNA, 19 nt, Homo sapiens
ggaaagaaugggcucagaa

SEQ ID NO: 677687 - RNA, 19 nt, Homo sapiens
gugcugcugugcuggguua

SEQ ID NO: 677688 - RNA, 19 nt, Homo sapiens
aaauacagcuuggugaaga

SEQ ID NO: 677689 - RNA, 19 nt, Homo sapiens
caacuuuggugcuuuaaaa

SEQ ID NO: 677690 - RNA, 19 nt, Homo sapiens
guugcaaccuugugacuga

SEQ ID NO: 677691 - RNA, 19 nt, Homo sapiens
ggaaggagaaauaggucua

SEQ ID NO: 677692 - RNA, 19 nt, Homo sapiens
ggagagagcugggcuuucc

SEQ ID NO: 677693 - RNA, 19 nt, Homo sapiens
uaagguaacugggaugauc

SEQ ID NO: 677694 - RNA, 19 nt, Homo sapiens
guuuaaaucaguaggcuua

SEQ ID NO: 677695 - RNA, 19 nt, Homo sapiens
ugaagaugauguggaauga

SEQ ID NO: 677696 - RNA, 19 nt, Homo sapiens
ucggguaucuugaggguuu

SEQ ID NO: 677697 - RNA, 19 nt, Homo sapiens
gaggagcauuucucauugu

SEQ ID NO: 677698 - RNA, 19 nt, Homo sapiens
gaaauuugauagacuugac

SEQ ID NO: 677699 - RNA, 19 nt, Homo sapiens
acugaaaucuaccaaaguu

SEQ ID NO: 677700 - RNA, 19 nt, Homo sapiens
gaguguuaaugagauguua

SEQ ID NO: 677701 - RNA, 19 nt, Homo sapiens
ccaaguacguuuucuuauu

SEQ ID NO: 677702 - RNA, 19 nt, Homo sapiens
ugacuaaccaggcagcuaa

SEQ ID NO: 677703 - RNA, 19 nt, Homo sapiens
aagaugauguggaaugaga

SEQ ID NO: 677704 - RNA, 19 nt, Homo sapiens
acagcuuggugaagaguua

SEQ ID NO: 677705 - RNA, 19 nt, Homo sapiens
caccugccauucugacuuu

SEQ ID NO: 677706 - RNA, 19 nt, Homo sapiens
gaacugaggagcauuucuc

SEQ ID NO: 677707 - RNA, 19 nt, Homo sapiens
gaaacgaugagaguaaguu

SEQ ID NO: 677708 - RNA, 19 nt, Homo sapiens
acacugaaaucuaccaaag

SEQ ID NO: 677709 - RNA, 19 nt, Homo sapiens
gcucagcguuguagagaag

SEQ ID NO: 677710 - RNA, 19 nt, Homo sapiens
gaagaaagaaacagaagcu

SEQ ID NO: 677711 - RNA, 19 nt, Homo sapiens
ggguauuuaucuccuugua

SEQ ID NO: 677712 - RNA, 19 nt, Homo sapiens
uaacagcuuccuucccuuu

SEQ ID NO: 677713 - RNA, 19 nt, Homo sapiens
acugaagaauguacacuuu

SEQ ID NO: 677714 - RNA, 19 nt, Homo sapiens
ccucaacuguuuaagugaa

SEQ ID NO: 677715 - RNA, 19 nt, Homo sapiens
gaccagaguguuaaugaga

SEQ ID NO: 677716 - RNA, 19 nt, Homo sapiens
gguggcaucuguugaacug

SEQ ID NO: 677717 - RNA, 19 nt, Homo sapiens
ccaaguuaccugaccuuaa

SEQ ID NO: 677718 - RNA, 19 nt, Homo sapiens
gucuugaaauguucuguuu

SEQ ID NO: 677719 - RNA, 19 nt, Homo sapiens
cuaggcgacucacauuuga

SEQ ID NO: 677720 - RNA, 19 nt, Homo sapiens
augcuugccugacuuagua

SEQ ID NO: 677721 - RNA, 19 nt, Homo sapiens
gagaaugcgucugcugauc

SEQ ID NO: 677722 - RNA, 19 nt, Homo sapiens
gauguggaaugagaaacaa

SEQ ID NO: 677723 - RNA, 19 nt, Homo sapiens
ggcugaagaugauguggaa

SEQ ID NO: 677724 - RNA, 19 nt, Homo sapiens
ggaccagaguguuaaugag

SEQ ID NO: 677725 - RNA, 19 nt, Homo sapiens
cauguggaccagaguguua

SEQ ID NO: 677726 - RNA, 19 nt, Homo sapiens
gcaccaggaauuagauuuc

SEQ ID NO: 677727 - RNA, 19 nt, Homo sapiens
uaaaucaguaggcuuaaug

SEQ ID NO: 677728 - RNA, 19 nt, Homo sapiens
gcguagaccaucugacaaa

SEQ ID NO: 677729 - RNA, 19 nt, Homo sapiens
gucacuacucuguaaauua

SEQ ID NO: 677730 - RNA, 19 nt, Homo sapiens
gcagauaacauacaaaauc

SEQ ID NO: 677731 - RNA, 19 nt, Homo sapiens
gauguaaucagcuuguugu

SEQ ID NO: 677732 - RNA, 19 nt, Homo sapiens
ggugggaccucuuauucuc

SEQ ID NO: 677733 - RNA, 19 nt, Homo sapiens
gaauguaugugggcaacca

SEQ ID NO: 677734 - RNA, 19 nt, Homo sapiens
aauguguucuggguauuua

SEQ ID NO: 677735 - RNA, 19 nt, Homo sapiens
ugaacuacacugaaaucua

SEQ ID NO: 677736 - RNA, 19 nt, Homo sapiens
caguugaugugcuucuuug

SEQ ID NO: 677737 - RNA, 19 nt, Homo sapiens
gaugaccaguacagacaug

SEQ ID NO: 677738 - RNA, 19 nt, Homo sapiens
guaaguugcaaccuuguga

SEQ ID NO: 677739 - RNA, 19 nt, Homo sapiens
cuugugagcuucgcuaguu

SEQ ID NO: 677740 - RNA, 19 nt, Homo sapiens
guguagcagucuugaaaug

SEQ ID NO: 677741 - RNA, 19 nt, Homo sapiens
gaacgagucuuucuuauaa

SEQ ID NO: 677742 - RNA, 19 nt, Homo sapiens
gaacagaaguguauguaaa

SEQ ID NO: 677743 - RNA, 19 nt, Homo sapiens
gcagagagacuuuaauuaa

SEQ ID NO: 677744 - RNA, 19 nt, Homo sapiens
gaagauagccaucauauuc

SEQ ID NO: 677745 - RNA, 19 nt, Homo sapiens
gaaauagguuguuggguuu

SEQ ID NO: 677746 - RNA, 19 nt, Homo sapiens
gaaccaauauguacauguu

SEQ ID NO: 677747 - RNA, 19 nt, Homo sapiens
guacagguguuauucagua

SEQ ID NO: 677748 - RNA, 19 nt, Homo sapiens
caggagagcugauaauuug

SEQ ID NO: 677749 - RNA, 19 nt, Homo sapiens
gaaagaagccauagcaaga

SEQ ID NO: 677750 - RNA, 19 nt, Homo sapiens
uagcuagucuugucuaaua

SEQ ID NO: 677751 - RNA, 19 nt, Homo sapiens
gaagagccaucugucauuu

SEQ ID NO: 677752 - RNA, 19 nt, Homo sapiens
guacugggcugccgagaaa

SEQ ID NO: 677753 - RNA, 19 nt, Homo sapiens
gaagugacaggguuaauaa

SEQ ID NO: 677754 - RNA, 19 nt, Homo sapiens
aaacaaaggccauggauaa

SEQ ID NO: 677755 - RNA, 19 nt, Homo sapiens
gcacagccaucacaggauu

SEQ ID NO: 677756 - RNA, 19 nt, Homo sapiens
uagcaaagcagaaauagua

SEQ ID NO: 677757 - RNA, 19 nt, Homo sapiens
gcacuuacauuucaaucga

SEQ ID NO: 677758 - RNA, 19 nt, Homo sapiens
ggaauugucucuaaaugca

SEQ ID NO: 677759 - RNA, 19 nt, Homo sapiens
gaagcuguaucaugagauu

SEQ ID NO: 677760 - RNA, 19 nt, Homo sapiens
ugcaagagguuguguauuu

SEQ ID NO: 677761 - RNA, 19 nt, Homo sapiens
gaaacacaauggcuacuuc

SEQ ID NO: 677762 - RNA, 19 nt, Homo sapiens
gagagcugauaauuuguua

SEQ ID NO: 677763 - RNA, 19 nt, Homo sapiens
ggaagaacauggacaaggu

SEQ ID NO: 677764 - RNA, 19 nt, Homo sapiens
guacaaauaucuacaaagc

SEQ ID NO: 677765 - RNA, 19 nt, Homo sapiens
ccaaggugauucaggauuu

SEQ ID NO: 677766 - RNA, 19 nt, Homo sapiens
ccacaaacccaaauacaaa

SEQ ID NO: 677767 - RNA, 19 nt, Homo sapiens
gaaguaagcauucccuuuc

SEQ ID NO: 677768 - RNA, 19 nt, Homo sapiens
guacauguuugcaauuaug

SEQ ID NO: 677769 - RNA, 19 nt, Homo sapiens
acuauugggugaaucauua

SEQ ID NO: 677770 - RNA, 19 nt, Homo sapiens
caaagugcauaucugauug

SEQ ID NO: 677771 - RNA, 19 nt, Homo sapiens
ggauaacccuacccgcuuu

SEQ ID NO: 677772 - RNA, 19 nt, Homo sapiens
gauuucagcugacagaguu

SEQ ID NO: 677773 - RNA, 19 nt, Homo sapiens
cccagaagcuguaucauga

SEQ ID NO: 677774 - RNA, 19 nt, Homo sapiens
ggaagugacaggguuaaua

SEQ ID NO: 677775 - RNA, 19 nt, Homo sapiens
gaagccagaucaaacuguu

SEQ ID NO: 677776 - RNA, 19 nt, Homo sapiens
gaacauggagugugcauag

SEQ ID NO: 677777 - RNA, 19 nt, Homo sapiens
gaucagagguuuuaucaga

SEQ ID NO: 677778 - RNA, 19 nt, Homo sapiens
ggcgauagauggauauaga

SEQ ID NO: 677779 - RNA, 19 nt, Homo sapiens
gcaauuaugcugugagaau

SEQ ID NO: 677780 - RNA, 19 nt, Homo sapiens
acagaagccuccuuucauu

SEQ ID NO: 677781 - RNA, 19 nt, Homo sapiens
acagaaagcugcucuaaaa

SEQ ID NO: 677782 - RNA, 19 nt, Homo sapiens
aaagcaagaugauacagaa

SEQ ID NO: 677783 - RNA, 19 nt, Homo sapiens
uagaggugcuuugaaauuu

SEQ ID NO: 677784 - RNA, 19 nt, Homo sapiens
gcccagagaugaagugcaa

SEQ ID NO: 677785 - RNA, 19 nt, Homo sapiens
gaaaugauucccagucuag

SEQ ID NO: 677786 - RNA, 19 nt, Homo sapiens
gcaucaagcauacaauaaa

SEQ ID NO: 677787 - RNA, 19 nt, Homo sapiens
uaacagagcagguauaugc

SEQ ID NO: 677788 - RNA, 19 nt, Homo sapiens
uagaugggauuuacuauag

SEQ ID NO: 677789 - RNA, 19 nt, Homo sapiens
ggaaaccauuuguguaucu

SEQ ID NO: 677790 - RNA, 19 nt, Homo sapiens
gggcagagaugaugaacag

SEQ ID NO: 677791 - RNA, 19 nt, Homo sapiens
acacggagauuaaguucuu

SEQ ID NO: 677792 - RNA, 19 nt, Homo sapiens
uaaagaagccuuagauguc

SEQ ID NO: 677793 - RNA, 19 nt, Homo sapiens
uaacugcauuccugacuga

SEQ ID NO: 677794 - RNA, 19 nt, Homo sapiens
gcaagagguuguguauuuc

SEQ ID NO: 677795 - RNA, 19 nt, Homo sapiens
ggucaggcuugguuuagaa

SEQ ID NO: 677796 - RNA, 19 nt, Homo sapiens
ccuauucacuuccgagauu

SEQ ID NO: 677797 - RNA, 19 nt, Homo sapiens
ugagagcugucuuggcuaa

SEQ ID NO: 677798 - RNA, 19 nt, Homo sapiens
gcagagaugaugaacagaa

SEQ ID NO: 677799 - RNA, 19 nt, Homo sapiens
ggagagggcgaguucaauu

SEQ ID NO: 677800 - RNA, 19 nt, Homo sapiens
ggugaaucauuagguauaa

SEQ ID NO: 677801 - RNA, 19 nt, Homo sapiens
uaagggucauaguguauaa

SEQ ID NO: 677802 - RNA, 19 nt, Homo sapiens
guaauugaauggcccuaug

SEQ ID NO: 677803 - RNA, 19 nt, Homo sapiens
cuuccgagauucagacaua

SEQ ID NO: 677804 - RNA, 19 nt, Homo sapiens
gcuggaaccuauucacuuc

SEQ ID NO: 677805 - RNA, 19 nt, Homo sapiens
guuaauauguggccuccuu

SEQ ID NO: 677806 - RNA, 19 nt, Homo sapiens
ugagugcacuuacauuuca

SEQ ID NO: 677807 - RNA, 19 nt, Homo sapiens
ccaaagugcauaucugauu

SEQ ID NO: 677808 - RNA, 19 nt, Homo sapiens
agagccagcugccgagaua

SEQ ID NO: 677809 - RNA, 19 nt, Homo sapiens
caaccaggcaaauuacuuu

SEQ ID NO: 677810 - RNA, 19 nt, Homo sapiens
guuauuagaacgagucuuu

SEQ ID NO: 677811 - RNA, 19 nt, Homo sapiens
auucaagccuuucaucuuu

SEQ ID NO: 677812 - RNA, 19 nt, Homo sapiens
gauuguggaucgugaugaa

SEQ ID NO: 677813 - RNA, 19 nt, Homo sapiens
ugaaaccacuaacugcauu

SEQ ID NO: 677814 - RNA, 19 nt, Homo sapiens
ccuuagugcucaauaauau

SEQ ID NO: 677815 - RNA, 19 nt, Homo sapiens
gcagaaagaagccauagca

SEQ ID NO: 677816 - RNA, 19 nt, Homo sapiens
ggaaacauugugaguauca

SEQ ID NO: 677817 - RNA, 19 nt, Homo sapiens
gcauuucucugcaggauac

SEQ ID NO: 677818 - RNA, 19 nt, Homo sapiens
cagcagagagacuuuaauu

SEQ ID NO: 677819 - RNA, 19 nt, Homo sapiens
ucuuagaggugcuuugaaa

SEQ ID NO: 677820 - RNA, 19 nt, Homo sapiens
gagcaugcuugugcagaaa

SEQ ID NO: 677821 - RNA, 19 nt, Homo sapiens
gucuggagguggucuauaa

SEQ ID NO: 677822 - RNA, 19 nt, Homo sapiens
cuaauacucugcaccacaa

SEQ ID NO: 677823 - RNA, 19 nt, Homo sapiens
gauaauuuguuagcuggaa

SEQ ID NO: 677824 - RNA, 19 nt, Homo sapiens
ggcaugagcuguacaaagc

SEQ ID NO: 677825 - RNA, 19 nt, Homo sapiens
aaagaagccuuagauguca

SEQ ID NO: 677826 - RNA, 19 nt, Homo sapiens
ggaguaaauuagcaaagca

SEQ ID NO: 677827 - RNA, 19 nt, Homo sapiens
uaaaggauuugacuuacca

SEQ ID NO: 677828 - RNA, 19 nt, Homo sapiens
gcacgugccaucaucgaaa

SEQ ID NO: 677829 - RNA, 19 nt, Homo sapiens
gagagggcgaguucaauuu

SEQ ID NO: 677830 - RNA, 19 nt, Homo sapiens
gggaauuacuuugaagaug

SEQ ID NO: 677831 - RNA, 19 nt, Homo sapiens
guuuaagggucauagugua

SEQ ID NO: 677832 - RNA, 19 nt, Homo sapiens
ugagcaggcuguuauagug

SEQ ID NO: 677833 - RNA, 19 nt, Homo sapiens
aaagaaggcaacccuaauu

SEQ ID NO: 677834 - RNA, 19 nt, Homo sapiens
caaacaaaggccauggaua

SEQ ID NO: 677835 - RNA, 19 nt, Homo sapiens
gaccugacaugucugagau

SEQ ID NO: 677836 - RNA, 19 nt, Homo sapiens
gagcuuaccgccaccuauu

SEQ ID NO: 677837 - RNA, 19 nt, Homo sapiens
ucaucaaccaggcaaauua

SEQ ID NO: 677838 - RNA, 19 nt, Homo sapiens
cacaauggcuacuucuguu

SEQ ID NO: 677839 - RNA, 19 nt, Homo sapiens
ggccugggcuuucacuguu

SEQ ID NO: 677840 - RNA, 19 nt, Homo sapiens
ccagaugggcuuagcauug

SEQ ID NO: 677841 - RNA, 19 nt, Homo sapiens
ggaagaagcuuaaccaugu

SEQ ID NO: 677842 - RNA, 19 nt, Homo sapiens
gaaauuguaucucucagua

SEQ ID NO: 677843 - RNA, 19 nt, Homo sapiens
gaucugggcugcucucuug

SEQ ID NO: 677844 - RNA, 19 nt, Homo sapiens
gaaacuccauggaaacaaa

SEQ ID NO: 677845 - RNA, 19 nt, Homo sapiens
gaagaggcccugugcauuu

SEQ ID NO: 677846 - RNA, 19 nt, Homo sapiens
gcaaauuccuuaacaccuu

SEQ ID NO: 677847 - RNA, 19 nt, Homo sapiens
cuaccuaucucuuccauuu

SEQ ID NO: 677848 - RNA, 19 nt, Homo sapiens
gaacuagccucugguagga

SEQ ID NO: 677849 - RNA, 19 nt, Homo sapiens
gagaacggauccagaaaug

SEQ ID NO: 677850 - RNA, 19 nt, Homo sapiens
ggaacgaagccacccauua

SEQ ID NO: 677851 - RNA, 19 nt, Homo sapiens
caaagcaaauuccuuaaca

SEQ ID NO: 677852 - RNA, 19 nt, Homo sapiens
cagcaaagcaaauuccuua

SEQ ID NO: 677853 - RNA, 19 nt, Homo sapiens
gaggaugacuauaucaaga

SEQ ID NO: 677854 - RNA, 19 nt, Homo sapiens
caaguacacuccacacaug

SEQ ID NO: 677855 - RNA, 19 nt, Homo sapiens
gaacaaauggcugagcuuu

SEQ ID NO: 677856 - RNA, 19 nt, Homo sapiens
gaacgaagccacccauuac

SEQ ID NO: 677857 - RNA, 19 nt, Homo sapiens
ccaucaaccuggacaagua

SEQ ID NO: 677858 - RNA, 19 nt, Homo sapiens
gagacgaaguggaggauga

SEQ ID NO: 677859 - RNA, 19 nt, Homo sapiens
gagcuuagaguuaggaauu

SEQ ID NO: 677860 - RNA, 19 nt, Homo sapiens
gcucagauggccacacuua

SEQ ID NO: 677861 - RNA, 19 nt, Homo sapiens
gagcgucuguuggacuuua

SEQ ID NO: 677862 - RNA, 19 nt, Homo sapiens
gaaaauaaaugugccuuga

SEQ ID NO: 677863 - RNA, 19 nt, Homo sapiens
ggcaugcgcugacaaaugu

SEQ ID NO: 677864 - RNA, 19 nt, Homo sapiens
aaauaaaugugccuugaga

SEQ ID NO: 677865 - RNA, 19 nt, Homo sapiens
gguccagccuugccuguuu

SEQ ID NO: 677866 - RNA, 19 nt, Homo sapiens
caaauuccuuaacaccuuu

SEQ ID NO: 677867 - RNA, 19 nt, Homo sapiens
ggaauagccugucccuuuu

SEQ ID NO: 677868 - RNA, 19 nt, Homo sapiens
gcauaaaggaaaucaaaug

SEQ ID NO: 677869 - RNA, 19 nt, Homo sapiens
ggagguggaugucagaucu

SEQ ID NO: 677870 - RNA, 19 nt, Homo sapiens
uggaauagccugucccuuu

SEQ ID NO: 677871 - RNA, 19 nt, Homo sapiens
gaagaagcuuaaccaugug

SEQ ID NO: 677872 - RNA, 19 nt, Homo sapiens
gcaaggagccugggucuag

SEQ ID NO: 677873 - RNA, 19 nt, Homo sapiens
gaacggauccagaaaugca

SEQ ID NO: 677874 - RNA, 19 nt, Homo sapiens
gguuaagguuuccucauga

SEQ ID NO: 677875 - RNA, 19 nt, Homo sapiens
caaaauccaugaaaugaga

SEQ ID NO: 677876 - RNA, 19 nt, Homo sapiens
ggagaugaagcccuggaua

SEQ ID NO: 677877 - RNA, 19 nt, Homo sapiens
caagggugauggagaagga

SEQ ID NO: 677878 - RNA, 19 nt, Homo sapiens
gcccaguucugauuguuga

SEQ ID NO: 677879 - RNA, 19 nt, Homo sapiens
gguuccagcuccuucauga

SEQ ID NO: 677880 - RNA, 19 nt, Homo sapiens
cgacgaggauggcuacuac

SEQ ID NO: 677881 - RNA, 19 nt, Homo sapiens
ggauuuccgucuguagauu

SEQ ID NO: 677882 - RNA, 19 nt, Homo sapiens
gaauuguguucaagugcuu

SEQ ID NO: 677883 - RNA, 19 nt, Homo sapiens
uaaacugugugaugugcaa

SEQ ID NO: 677884 - RNA, 19 nt, Homo sapiens
uagacaagguuaagguuuc

SEQ ID NO: 677885 - RNA, 19 nt, Homo sapiens
cagcaagcccugucccuuu

SEQ ID NO: 677886 - RNA, 19 nt, Homo sapiens
ggaggacaaucagcaagga

SEQ ID NO: 677887 - RNA, 19 nt, Homo sapiens
acacaugcauaaaggaaau

SEQ ID NO: 677888 - RNA, 19 nt, Homo sapiens
uuccucagcuccuugauuu

SEQ ID NO: 677889 - RNA, 19 nt, Homo sapiens
gagaagaggcccugugcau

SEQ ID NO: 677890 - RNA, 19 nt, Homo sapiens
caccagugcugaccucuuc

SEQ ID NO: 677891 - RNA, 19 nt, Homo sapiens
gaaguucccagcagagcaa

SEQ ID NO: 677892 - RNA, 19 nt, Homo sapiens
uguguaagcuggagcaaca

SEQ ID NO: 677893 - RNA, 19 nt, Homo sapiens
cuaaccaggucacauuuca

SEQ ID NO: 677894 - RNA, 19 nt, Homo sapiens
gagcuucaccugcuuccaa

SEQ ID NO: 677895 - RNA, 19 nt, Homo sapiens
uuaaccauguguucaaaga

SEQ ID NO: 677896 - RNA, 19 nt, Homo sapiens
ggacugggagugugagugu

SEQ ID NO: 677897 - RNA, 19 nt, Homo sapiens
aauccuagacccuggaaua

SEQ ID NO: 677898 - RNA, 19 nt, Homo sapiens
gaggaaggacauuaaaaua

SEQ ID NO: 677899 - RNA, 19 nt, Homo sapiens
ugcaauaacugagcuuaga

SEQ ID NO: 677900 - RNA, 19 nt, Homo sapiens
gcuuaaccauguguucaaa

SEQ ID NO: 677901 - RNA, 19 nt, Homo sapiens
ccgugaaacuccauggaaa

SEQ ID NO: 677902 - RNA, 19 nt, Homo sapiens
gagagacaccacagaagga

SEQ ID NO: 677903 - RNA, 19 nt, Homo sapiens
ggacacgugcucucucugu

SEQ ID NO: 677904 - RNA, 19 nt, Homo sapiens
cgaaguggaggaugacuau

SEQ ID NO: 677905 - RNA, 19 nt, Homo sapiens
ccagugcccucuccucgau

SEQ ID NO: 677906 - RNA, 19 nt, Homo sapiens
uguguguccuuguaaauau

SEQ ID NO: 677907 - RNA, 19 nt, Homo sapiens
agaagcagcugccgaaagc

SEQ ID NO: 677908 - RNA, 19 nt, Homo sapiens
ccuccucccugacccuuaa

SEQ ID NO: 677909 - RNA, 19 nt, Homo sapiens
ggaaggacauuaaaauacu

SEQ ID NO: 677910 - RNA, 19 nt, Homo sapiens
gaaacaaagacuccaucug

SEQ ID NO: 677911 - RNA, 19 nt, Homo sapiens
ccacacaugcauaaaggaa

SEQ ID NO: 677912 - RNA, 19 nt, Homo sapiens
guagguugcagcagagaaa

SEQ ID NO: 677913 - RNA, 19 nt, Homo sapiens
ggauuggagucuaccuauc

SEQ ID NO: 677914 - RNA, 19 nt, Homo sapiens
gcaaagcaaauuccuuaac

SEQ ID NO: 677915 - RNA, 19 nt, Homo sapiens
gguggugguuacacaguug

SEQ ID NO: 677916 - RNA, 19 nt, Homo sapiens
ccuuguagcuguuuucuuu

SEQ ID NO: 677917 - RNA, 19 nt, Homo sapiens
gagaugaagcccuggauac

SEQ ID NO: 677918 - RNA, 19 nt, Homo sapiens
ugucguccaucucgcagua

SEQ ID NO: 677919 - RNA, 19 nt, Homo sapiens
gaugucagaucugguaggu

SEQ ID NO: 677920 - RNA, 19 nt, Homo sapiens
ggagcuacuugaaacuucu

SEQ ID NO: 677921 - RNA, 19 nt, Homo sapiens
cauaaacugcuucccauuc

SEQ ID NO: 677922 - RNA, 19 nt, Homo sapiens
ucaagcagccgaccgugaa

SEQ ID NO: 677923 - RNA, 19 nt, Homo sapiens
ucaagagucccgugaguca

SEQ ID NO: 677924 - RNA, 19 nt, Homo sapiens
gaugaugucaaacgugaug

SEQ ID NO: 677925 - RNA, 19 nt, Homo sapiens
ggacacuggguggugguua

SEQ ID NO: 677926 - RNA, 19 nt, Homo sapiens
caagcugucugaggucugu

SEQ ID NO: 677927 - RNA, 19 nt, Homo sapiens
gugcaucagucgcaagaag

SEQ ID NO: 677928 - RNA, 19 nt, Homo sapiens
guggaugucagaucuggua

SEQ ID NO: 677929 - RNA, 19 nt, Homo sapiens
guugaggugucgcgucguu

SEQ ID NO: 677930 - RNA, 19 nt, Homo sapiens
gcagcccaguucugauugu

SEQ ID NO: 677931 - RNA, 19 nt, Homo sapiens
gggccgauguggugugaca

SEQ ID NO: 677932 - RNA, 19 nt, Homo sapiens
gaaccgcuuccgagacgaa

SEQ ID NO: 677933 - RNA, 19 nt, Homo sapiens
ugucaaacgugaugcugau

SEQ ID NO: 677934 - RNA, 19 nt, Homo sapiens
gcccuggaaucaacaucuu

SEQ ID NO: 677935 - RNA, 19 nt, Homo sapiens
cgucuuuaucugccuauua

SEQ ID NO: 677936 - RNA, 19 nt, Homo sapiens
aggaaggaguucagaggaa

SEQ ID NO: 677937 - RNA, 19 nt, Homo sapiens
gagaagcagcugccgaaag

SEQ ID NO: 677938 - RNA, 19 nt, Homo sapiens
gaugcugaugcuacaguua

SEQ ID NO: 677939 - RNA, 19 nt, Homo sapiens
ggaggaugacuauaucaag

SEQ ID NO: 677940 - RNA, 19 nt, Homo sapiens
acacuccacacaugcauaa

SEQ ID NO: 677941 - RNA, 19 nt, Homo sapiens
gcaaugcccucuaucaaua

SEQ ID NO: 677942 - RNA, 19 nt, Homo sapiens
agacagaggcuacguguuu

SEQ ID NO: 677943 - RNA, 19 nt, Homo sapiens
gaauagaaucugaccauug

SEQ ID NO: 677944 - RNA, 19 nt, Homo sapiens
ggaacaggaugacacaaca

SEQ ID NO: 677945 - RNA, 19 nt, Homo sapiens
gccaggaccuucuauguag

SEQ ID NO: 677946 - RNA, 19 nt, Homo sapiens
accgaaagcucuacaaguu

SEQ ID NO: 677947 - RNA, 19 nt, Homo sapiens
gccgugggcucuccauuga

SEQ ID NO: 677948 - RNA, 19 nt, Homo sapiens
gaugcuagauggcaacagu

SEQ ID NO: 677949 - RNA, 19 nt, Homo sapiens
ggagcaaccucggcgcaaa

SEQ ID NO: 677950 - RNA, 19 nt, Homo sapiens
ucucuuugguguaaacuaa

SEQ ID NO: 677951 - RNA, 19 nt, Homo sapiens
aauagaaucugaccauugg

SEQ ID NO: 677952 - RNA, 19 nt, Homo sapiens
ggccaggaccuucuaugua

SEQ ID NO: 677953 - RNA, 19 nt, Homo sapiens
ggacacacagacuugcuuu

SEQ ID NO: 677954 - RNA, 19 nt, Homo sapiens
ggcauuaccucugcaggaa

SEQ ID NO: 677955 - RNA, 19 nt, Homo sapiens
acaaaggcgugguaucugu

SEQ ID NO: 677956 - RNA, 19 nt, Homo sapiens
gcagggaccauuguucuga

SEQ ID NO: 677957 - RNA, 19 nt, Homo sapiens
gacagaggcuacguguuug

SEQ ID NO: 677958 - RNA, 19 nt, Homo sapiens
ugaauagaaucugaccauu

SEQ ID NO: 677959 - RNA, 19 nt, Homo sapiens
agaggucccuuuccagaug

SEQ ID NO: 677960 - RNA, 19 nt, Homo sapiens
gaaucugaccauuggcuuu

SEQ ID NO: 677961 - RNA, 19 nt, Homo sapiens
ggccuauccuuauguggaa

SEQ ID NO: 677962 - RNA, 19 nt, Homo sapiens
gcaggaacaaguacuaugg

SEQ ID NO: 677963 - RNA, 19 nt, Homo sapiens
gagaaccucaucagcauca

SEQ ID NO: 677964 - RNA, 19 nt, Homo sapiens
ucaagcaccuggacauggu

SEQ ID NO: 677965 - RNA, 19 nt, Homo sapiens
ggaaagugagacuguggaa

SEQ ID NO: 677966 - RNA, 19 nt, Homo sapiens
guggauguccgcaugauug

SEQ ID NO: 677967 - RNA, 19 nt, Homo sapiens
aaagugagacuguggaaca

SEQ ID NO: 677968 - RNA, 19 nt, Homo sapiens
acacagacuugcuuuuaaa

SEQ ID NO: 677969 - RNA, 19 nt, Homo sapiens
ccugcgacgugaccuguuu

SEQ ID NO: 677970 - RNA, 19 nt, Homo sapiens
gguuauauuucucuuuggu

SEQ ID NO: 677971 - RNA, 19 nt, Homo sapiens
aggguuauauuucucuuug

SEQ ID NO: 677972 - RNA, 19 nt, Homo sapiens
cuauguagcucuccuuuug

SEQ ID NO: 677973 - RNA, 19 nt, Homo sapiens
aucaauaucugcacaaugg

SEQ ID NO: 677974 - RNA, 19 nt, Homo sapiens
caugaugcguuacgacgau

SEQ ID NO: 677975 - RNA, 19 nt, Homo sapiens
uggagaaccucaucagcau

SEQ ID NO: 677976 - RNA, 19 nt, Homo sapiens
ugaauacaaaggcguggua

SEQ ID NO: 677977 - RNA, 19 nt, Homo sapiens
ccaaggaccgaaagcucua

SEQ ID NO: 677978 - RNA, 19 nt, Homo sapiens
guucccugcuugucaucua

SEQ ID NO: 677979 - RNA, 19 nt, Homo sapiens
gagccuauccugagcaaac

SEQ ID NO: 677980 - RNA, 19 nt, Homo sapiens
uuaguggccuauccuuaug

SEQ ID NO: 677981 - RNA, 19 nt, Homo sapiens
ccaacgcaauguguguuug

SEQ ID NO: 677982 - RNA, 19 nt, Homo sapiens
cagggaccauuguucugaa

SEQ ID NO: 677983 - RNA, 19 nt, Homo sapiens
ccaguucccugcuugucau

SEQ ID NO: 677984 - RNA, 19 nt, Homo sapiens
gaccgaaagcucuacaagu

SEQ ID NO: 677985 - RNA, 19 nt, Homo sapiens
gaaccucaucagcaucaug

SEQ ID NO: 677986 - RNA, 19 nt, Homo sapiens
ggaccgaaagcucuacaag

SEQ ID NO: 677987 - RNA, 19 nt, Homo sapiens
gcaacaguggcuugaguuc

SEQ ID NO: 677988 - RNA, 19 nt, Homo sapiens
cgugguaucugucuguuuu

SEQ ID NO: 677989 - RNA, 19 nt, Homo sapiens
gucccucccucccgaaaug

SEQ ID NO: 677990 - RNA, 19 nt, Homo sapiens
cauuaccucugcaggaaca

SEQ ID NO: 677991 - RNA, 19 nt, Homo sapiens
aacaguggcuugaguucug

SEQ ID NO: 677992 - RNA, 19 nt, Homo sapiens
gcccuucauccaccaagua

SEQ ID NO: 677993 - RNA, 19 nt, Homo sapiens
aagccagccugucccuuga

SEQ ID NO: 677994 - RNA, 19 nt, Homo sapiens
gcaggcagggaccauuguu

SEQ ID NO: 677995 - RNA, 19 nt, Homo sapiens
ucaagggcuuccgggauga

SEQ ID NO: 677996 - RNA, 19 nt, Homo sapiens
uggagcggcaggccucuua

SEQ ID NO: 677997 - RNA, 19 nt, Homo sapiens
auccuuauguggaaaguga

SEQ ID NO: 677998 - RNA, 19 nt, Homo sapiens
caacgcaauguguguuugu

SEQ ID NO: 677999 - RNA, 19 nt, Homo sapiens
gugaggacacacagacuug

SEQ ID NO: 678000 - RNA, 19 nt, Homo sapiens
acucagaggucccuuucca

SEQ ID NO: 678001 - RNA, 19 nt, Homo sapiens
cuuaguggccuauccuuau

SEQ ID NO: 678002 - RNA, 19 nt, Homo sapiens
cgcaauguguguuugucaa

SEQ ID NO: 678003 - RNA, 19 nt, Homo sapiens
cacacagacuugcuuuuaa

SEQ ID NO: 678004 - RNA, 19 nt, Homo sapiens
acacacagacuugcuuuua

SEQ ID NO: 678005 - RNA, 19 nt, Homo sapiens
uggcaacaguggcuugagu

SEQ ID NO: 678006 - RNA, 19 nt, Homo sapiens
gcucacaggaggcaaagag

SEQ ID NO: 678007 - RNA, 19 nt, Homo sapiens
cuacuccaguucccugcuu

SEQ ID NO: 678008 - RNA, 19 nt, Homo sapiens
ccgcaaugcccucuaucaa

SEQ ID NO: 678009 - RNA, 19 nt, Homo sapiens
cgugggcucuccauugaag

SEQ ID NO: 678010 - RNA, 19 nt, Homo sapiens
ccacucagaggucccuuuc

SEQ ID NO: 678011 - RNA, 19 nt, Homo sapiens
gccagccugucccuugaga

SEQ ID NO: 678012 - RNA, 19 nt, Homo sapiens
ucccugagguggcgucauc

SEQ ID NO: 678013 - RNA, 19 nt, Homo sapiens
cgcaaugcccucuaucaau

SEQ ID NO: 678014 - RNA, 19 nt, Homo sapiens
gaacaggaugacacaacag

SEQ ID NO: 678015 - RNA, 19 nt, Homo sapiens
caaugcccucuaucaauau

SEQ ID NO: 678016 - RNA, 19 nt, Homo sapiens
ccgcaugauugacuuugca

SEQ ID NO: 678017 - RNA, 19 nt, Homo sapiens
ggcaacaguggcuugaguu

SEQ ID NO: 678018 - RNA, 19 nt, Homo sapiens
acaguggcuugaguucuga

SEQ ID NO: 678019 - RNA, 19 nt, Homo sapiens
gauggcaacaguggcuuga

SEQ ID NO: 678020 - RNA, 19 nt, Homo sapiens
ccacagaacucacacuaua

SEQ ID NO: 678021 - RNA, 19 nt, Homo sapiens
gcugaaagcugaaauuuga

SEQ ID NO: 678022 - RNA, 19 nt, Homo sapiens
gaacucacacuauaagaua

SEQ ID NO: 678023 - RNA, 19 nt, Homo sapiens
ggaauuaacauaaggcaua

SEQ ID NO: 678024 - RNA, 19 nt, Homo sapiens
ccacauaaauaacauggua

SEQ ID NO: 678025 - RNA, 19 nt, Homo sapiens
gaaaagaacuaaccaaaga

SEQ ID NO: 678026 - RNA, 19 nt, Homo sapiens
gauuaaagcuggcaugugu

SEQ ID NO: 678027 - RNA, 19 nt, Homo sapiens
gaaggaacgugcuuuguag

SEQ ID NO: 678028 - RNA, 19 nt, Homo sapiens
ggaaggaacgugcuuugua

SEQ ID NO: 678029 - RNA, 19 nt, Homo sapiens
ccaaguggcauucuucuua

SEQ ID NO: 678030 - RNA, 19 nt, Homo sapiens
gaaaauggccuuaaagaaa

SEQ ID NO: 678031 - RNA, 19 nt, Homo sapiens
guacacugguucugauuaa

SEQ ID NO: 678032 - RNA, 19 nt, Homo sapiens
gaacugcuguauucuaaca

SEQ ID NO: 678033 - RNA, 19 nt, Homo sapiens
gaagucaccugccuguaug

SEQ ID NO: 678034 - RNA, 19 nt, Homo sapiens
gugcaugccuugaauauuc

SEQ ID NO: 678035 - RNA, 19 nt, Homo sapiens
gcaaagagacaacaaguag

SEQ ID NO: 678036 - RNA, 19 nt, Homo sapiens
uaacaaagauccuaaugac

SEQ ID NO: 678037 - RNA, 19 nt, Homo sapiens
gaauguaggcuuaaacaga

SEQ ID NO: 678038 - RNA, 19 nt, Homo sapiens
gcccauauuugucuuacua

SEQ ID NO: 678039 - RNA, 19 nt, Homo sapiens
gaaguacacugguucugau

SEQ ID NO: 678040 - RNA, 19 nt, Homo sapiens
uugcagcacuacuuaauua

SEQ ID NO: 678041 - RNA, 19 nt, Homo sapiens
ggacuaggcuacugacuac

SEQ ID NO: 678042 - RNA, 19 nt, Homo sapiens
acagugggcuaucuauaua

SEQ ID NO: 678043 - RNA, 19 nt, Homo sapiens
ccacagcucuuucccugaa

SEQ ID NO: 678044 - RNA, 19 nt, Homo sapiens
uaaguuuccucccuaauau

SEQ ID NO: 678045 - RNA, 19 nt, Homo sapiens
ucacguggaugccauagaa

SEQ ID NO: 678046 - RNA, 19 nt, Homo sapiens
uuacauggcuggacauugu

SEQ ID NO: 678047 - RNA, 19 nt, Homo sapiens
gaauugaaaugggaguauu

SEQ ID NO: 678048 - RNA, 19 nt, Homo sapiens
ggaagaauuuggccacauc

SEQ ID NO: 678049 - RNA, 19 nt, Homo sapiens
ggagauuguuacauuauuc

SEQ ID NO: 678050 - RNA, 19 nt, Homo sapiens
ggaguuaaauggaaguaca

SEQ ID NO: 678051 - RNA, 19 nt, Homo sapiens
gaauuugcagcacuacuua

SEQ ID NO: 678052 - RNA, 19 nt, Homo sapiens
aaacaaacccaagagaaua

SEQ ID NO: 678053 - RNA, 19 nt, Homo sapiens
caaagauccuaaugaccua

SEQ ID NO: 678054 - RNA, 19 nt, Homo sapiens
gcacuaacagccaugauga

SEQ ID NO: 678055 - RNA, 19 nt, Homo sapiens
aauagagaauguaggcuua

SEQ ID NO: 678056 - RNA, 19 nt, Homo sapiens
gcucaacgagucuaaguuu

SEQ ID NO: 678057 - RNA, 19 nt, Homo sapiens
gcagcacuacuuaauuaua

SEQ ID NO: 678058 - RNA, 19 nt, Homo sapiens
acacagagguuuaacugau

SEQ ID NO: 678059 - RNA, 19 nt, Homo sapiens
ggaccgagaaguacuuuga

SEQ ID NO: 678060 - RNA, 19 nt, Homo sapiens
gaagcaaauccuaaacaaa

SEQ ID NO: 678061 - RNA, 19 nt, Homo sapiens
caaguuccaugaugauugu

SEQ ID NO: 678062 - RNA, 19 nt, Homo sapiens
uggaacugcuguauucuaa

SEQ ID NO: 678063 - RNA, 19 nt, Homo sapiens
gacaacaaguaggaauuaa

SEQ ID NO: 678064 - RNA, 19 nt, Homo sapiens
gcacagcagcuuagacuuc

SEQ ID NO: 678065 - RNA, 19 nt, Homo sapiens
gaaguacaaugcaguuugc

SEQ ID NO: 678066 - RNA, 19 nt, Homo sapiens
ccacugccacggugaaaua

SEQ ID NO: 678067 - RNA, 19 nt, Homo sapiens
ggaagaguaugaacuugag

SEQ ID NO: 678068 - RNA, 19 nt, Homo sapiens
ccugugaccuggauacauu

SEQ ID NO: 678069 - RNA, 19 nt, Homo sapiens
ggucaguauuaucucuuua

SEQ ID NO: 678070 - RNA, 19 nt, Homo sapiens
uaagcaguauguuuaguga

SEQ ID NO: 678071 - RNA, 19 nt, Homo sapiens
gguauuaagcaguauguuu

SEQ ID NO: 678072 - RNA, 19 nt, Homo sapiens
ggacauucuuuggauauuc

SEQ ID NO: 678073 - RNA, 19 nt, Homo sapiens
cuacugaucggccagaaua

SEQ ID NO: 678074 - RNA, 19 nt, Homo sapiens
ggaaguacaaugcaguuug

SEQ ID NO: 678075 - RNA, 19 nt, Homo sapiens
aacaacaacccaaucauua

SEQ ID NO: 678076 - RNA, 19 nt, Homo sapiens
gucaaaugcuggucuguga

SEQ ID NO: 678077 - RNA, 19 nt, Homo sapiens
gggagauuguuacauuauu

SEQ ID NO: 678078 - RNA, 19 nt, Homo sapiens
gugggagauuguuacauua

SEQ ID NO: 678079 - RNA, 19 nt, Homo sapiens
gggagcagguagacuaguu

SEQ ID NO: 678080 - RNA, 19 nt, Homo sapiens
gaaguaaaaccaccacaua

SEQ ID NO: 678081 - RNA, 19 nt, Homo sapiens
aaacaacaacccaaucauu

SEQ ID NO: 678082 - RNA, 19 nt, Homo sapiens
guaacaaagauccuaauga

SEQ ID NO: 678083 - RNA, 19 nt, Homo sapiens
gggcuggaguuaaauggaa

SEQ ID NO: 678084 - RNA, 19 nt, Homo sapiens
agagugaacauuagacaua

SEQ ID NO: 678085 - RNA, 19 nt, Homo sapiens
cuaaguuuccucccuaaua

SEQ ID NO: 678086 - RNA, 19 nt, Homo sapiens
guaaaagacugaugugaau

SEQ ID NO: 678087 - RNA, 19 nt, Homo sapiens
acagcaaggucuagacauu

SEQ ID NO: 678088 - RNA, 19 nt, Homo sapiens
gcuggcauguguuaauuau

SEQ ID NO: 678089 - RNA, 19 nt, Homo sapiens
cuauuugccuucauuaguu

SEQ ID NO: 678090 - RNA, 19 nt, Homo sapiens
gaacacacacacaaacaca

SEQ ID NO: 678091 - RNA, 19 nt, Homo sapiens
ugucugaucuucauaugga

SEQ ID NO: 678092 - RNA, 19 nt, Homo sapiens
guuaaggucugucugaucu

SEQ ID NO: 678093 - RNA, 19 nt, Homo sapiens
gagaauaaacuugaaaugg

SEQ ID NO: 678094 - RNA, 19 nt, Homo sapiens
caacaaguaggaauuaaca

SEQ ID NO: 678095 - RNA, 19 nt, Homo sapiens
uaacaucuauuugccuuca

SEQ ID NO: 678096 - RNA, 19 nt, Homo sapiens
gcaaguuccaugaugauug

SEQ ID NO: 678097 - RNA, 19 nt, Homo sapiens
gcacacagugggcuaucua

SEQ ID NO: 678098 - RNA, 19 nt, Homo sapiens
agaagcaaauccuaaacaa

SEQ ID NO: 678099 - RNA, 19 nt, Homo sapiens
gaaagggucaguugcuugu

SEQ ID NO: 678100 - RNA, 19 nt, Homo sapiens
uuucaaagccugcaucauu

SEQ ID NO: 678101 - RNA, 19 nt, Homo sapiens
gagugaacauuagacauau

SEQ ID NO: 678102 - RNA, 19 nt, Homo sapiens
ggugauaggaagaguauga

SEQ ID NO: 678103 - RNA, 19 nt, Homo sapiens
guacacagggugauaggaa

SEQ ID NO: 678104 - RNA, 19 nt, Homo sapiens
gaaagaggaggcagacaca

SEQ ID NO: 678105 - RNA, 19 nt, Homo sapiens
agacaacaaguaggaauua

SEQ ID NO: 678106 - RNA, 19 nt, Homo sapiens
aauaaaggauugcugaaag

SEQ ID NO: 678107 - RNA, 19 nt, Homo sapiens
uuaaagcuggcauguguua

SEQ ID NO: 678108 - RNA, 19 nt, Homo sapiens
caaguggcauucuucuuag

SEQ ID NO: 678109 - RNA, 19 nt, Homo sapiens
aguaugaacuugagaaucu

SEQ ID NO: 678110 - RNA, 19 nt, Homo sapiens
gucaguugcuuguuucuau

SEQ ID NO: 678111 - RNA, 19 nt, Homo sapiens
agugggagauuguuacauu

SEQ ID NO: 678112 - RNA, 19 nt, Homo sapiens
ugucugguauuaagcagua

SEQ ID NO: 678113 - RNA, 19 nt, Homo sapiens
uucaaagccugcaucauuu

SEQ ID NO: 678114 - RNA, 19 nt, Homo sapiens
cauuuagacuuucgaacaa

SEQ ID NO: 678115 - RNA, 19 nt, Homo sapiens
gagccauaauuagaaguaa

SEQ ID NO: 678116 - RNA, 19 nt, Homo sapiens
gcagacauuuaacuggaau

SEQ ID NO: 678117 - RNA, 19 nt, Homo sapiens
guuccaugaugauuguaua

SEQ ID NO: 678118 - RNA, 19 nt, Homo sapiens
ggagugcaguggcgugauc

SEQ ID NO: 678119 - RNA, 19 nt, Homo sapiens
ugggagccauuuagacuuu

SEQ ID NO: 678120 - RNA, 19 nt, Homo sapiens
gaaccaacaucaucaguuu

SEQ ID NO: 678121 - RNA, 19 nt, Homo sapiens
gcaagaagaucgcggauga

SEQ ID NO: 678122 - RNA, 19 nt, Homo sapiens
gagaugcgccaccugauua

SEQ ID NO: 678123 - RNA, 19 nt, Homo sapiens
ccacucagcugcaggagaa

SEQ ID NO: 678124 - RNA, 19 nt, Homo sapiens
gagaacgaauugagaaguu

SEQ ID NO: 678125 - RNA, 19 nt, Homo sapiens
gaugcugaaugcagaguua

SEQ ID NO: 678126 - RNA, 19 nt, Homo sapiens
gaugccaacuuuaagcuaa

SEQ ID NO: 678127 - RNA, 19 nt, Homo sapiens
gaucaaggccaaccagauu

SEQ ID NO: 678128 - RNA, 19 nt, Homo sapiens
gggcaucacuugcuuccuu

SEQ ID NO: 678129 - RNA, 19 nt, Homo sapiens
ccuacuggcucacaaauga

SEQ ID NO: 678130 - RNA, 19 nt, Homo sapiens
ggaguucccuggacaccuu

SEQ ID NO: 678131 - RNA, 19 nt, Homo sapiens
ugaaacugcugcuggauau

SEQ ID NO: 678132 - RNA, 19 nt, Homo sapiens
gcuuaacucuggcuacuau

SEQ ID NO: 678133 - RNA, 19 nt, Homo sapiens
gcagucaccuuccucaucu

SEQ ID NO: 678134 - RNA, 19 nt, Homo sapiens
ggaggaggcucugcucuca

SEQ ID NO: 678135 - RNA, 19 nt, Homo sapiens
gaagaucgcggaugaggau

SEQ ID NO: 678136 - RNA, 19 nt, Homo sapiens
gaagggagagcaagaagau

SEQ ID NO: 678137 - RNA, 19 nt, Homo sapiens
gaauugagaaguuggagaa

SEQ ID NO: 678138 - RNA, 19 nt, Homo sapiens
caacgagucucugcaagug

SEQ ID NO: 678139 - RNA, 19 nt, Homo sapiens
ccuaggaccuccaccugua

SEQ ID NO: 678140 - RNA, 19 nt, Homo sapiens
uauaggcuguuaauuguga

SEQ ID NO: 678141 - RNA, 19 nt, Homo sapiens
uguauaggcuguuaauugu

SEQ ID NO: 678142 - RNA, 19 nt, Homo sapiens
acuccgagcuccaggauaa

SEQ ID NO: 678143 - RNA, 19 nt, Homo sapiens
gcccagagcacuugacuga

SEQ ID NO: 678144 - RNA, 19 nt, Homo sapiens
aggaggagaucaaggagua

SEQ ID NO: 678145 - RNA, 19 nt, Homo sapiens
gcaucgaguuugagcagaa

SEQ ID NO: 678146 - RNA, 19 nt, Homo sapiens
gaacuccgagaacgaauug

SEQ ID NO: 678147 - RNA, 19 nt, Homo sapiens
uggcagagcuggagaaacu

SEQ ID NO: 678148 - RNA, 19 nt, Homo sapiens
ccaaggagcagcgggauaa

SEQ ID NO: 678149 - RNA, 19 nt, Homo sapiens
ccaaggugcuggagaugga

SEQ ID NO: 678150 - RNA, 19 nt, Homo sapiens
cuacagcaguugcgggaaa

SEQ ID NO: 678151 - RNA, 19 nt, Homo sapiens
gggccaacuuccaaucauu

SEQ ID NO: 678152 - RNA, 19 nt, Homo sapiens
caucaucaguuucuauucu

SEQ ID NO: 678153 - RNA, 19 nt, Homo sapiens
caagcuucguuccaucuuu

SEQ ID NO: 678154 - RNA, 19 nt, Homo sapiens
agaagaagcuacgcacaga

SEQ ID NO: 678155 - RNA, 19 nt, Homo sapiens
cuacgcagaugccgacgaa

SEQ ID NO: 678156 - RNA, 19 nt, Homo sapiens
ugcagaagcuggaggagaa

SEQ ID NO: 678157 - RNA, 19 nt, Homo sapiens
agaggaagguggaggucua

SEQ ID NO: 678158 - RNA, 19 nt, Homo sapiens
gcaccuggcagaggccuua

SEQ ID NO: 678159 - RNA, 19 nt, Homo sapiens
gaaugcagaguuagaggaa

SEQ ID NO: 678160 - RNA, 19 nt, Homo sapiens
caacaucaucaguuucuau

SEQ ID NO: 678161 - RNA, 19 nt, Homo sapiens
cgacuuccaucguaucuac

SEQ ID NO: 678162 - RNA, 19 nt, Homo sapiens
gaaacaccaccgcaucuca

SEQ ID NO: 678163 - RNA, 19 nt, Homo sapiens
gggauaaggugcagcucau

SEQ ID NO: 678164 - RNA, 19 nt, Homo sapiens
cggaggagauggaccugaa

SEQ ID NO: 678165 - RNA, 19 nt, Homo sapiens
ggaccuaacccugcuuuca

SEQ ID NO: 678166 - RNA, 19 nt, Homo sapiens
agacaacaguggaggacuu

SEQ ID NO: 678167 - RNA, 19 nt, Homo sapiens
ggagaaggccaagguggaa

SEQ ID NO: 678168 - RNA, 19 nt, Homo sapiens
gaagaugaacuccgagaac

SEQ ID NO: 678169 - RNA, 19 nt, Homo sapiens
gcaggcagaggagcagaua

SEQ ID NO: 678170 - RNA, 19 nt, Homo sapiens
cagcggaacgcaaggcuaa

SEQ ID NO: 678171 - RNA, 19 nt, Homo sapiens
ggaaucagaacuccucaag

SEQ ID NO: 678172 - RNA, 19 nt, Homo sapiens
ggcaucacuugcuuccuuu

SEQ ID NO: 678173 - RNA, 19 nt, Homo sapiens
gcaggcuugugaagaugaa

SEQ ID NO: 678174 - RNA, 19 nt, Homo sapiens
gggaggagaaggaugaguu

SEQ ID NO: 678175 - RNA, 19 nt, Homo sapiens
gaucgaagggagagcaaga

SEQ ID NO: 678176 - RNA, 19 nt, Homo sapiens
uaacucuggcuacuaugua

SEQ ID NO: 678177 - RNA, 19 nt, Homo sapiens
gccaagcccuggagcucaa

SEQ ID NO: 678178 - RNA, 19 nt, Homo sapiens
ggaggagaaggaugaguug

SEQ ID NO: 678179 - RNA, 19 nt, Homo sapiens
cagaggagcagauagaaca

SEQ ID NO: 678180 - RNA, 19 nt, Homo sapiens
gaaaccaagcggaaggaau

SEQ ID NO: 678181 - RNA, 19 nt, Homo sapiens
gaaguacaagcugagauug

SEQ ID NO: 678182 - RNA, 19 nt, Homo sapiens
gaugaacuccgagaacgaa

SEQ ID NO: 678183 - RNA, 19 nt, Homo sapiens
aaagugacaucggcagaga

SEQ ID NO: 678184 - RNA, 19 nt, Homo sapiens
gggcugugcggaccaauga

SEQ ID NO: 678185 - RNA, 19 nt, Homo sapiens
agaccaaggugcuggagau

SEQ ID NO: 678186 - RNA, 19 nt, Homo sapiens
uucuagagaugcuuguaua

SEQ ID NO: 678187 - RNA, 19 nt, Homo sapiens
accaagugcuuccacguuu

SEQ ID NO: 678188 - RNA, 19 nt, Homo sapiens
gggcugcucgugagaaaga

SEQ ID NO: 678189 - RNA, 19 nt, Homo sapiens
gaaacugcaggccgaacuu

SEQ ID NO: 678190 - RNA, 19 nt, Homo sapiens
gcuguuaauugugaugaau

SEQ ID NO: 678191 - RNA, 19 nt, Homo sapiens
acuuuaagcuaaugucaga

SEQ ID NO: 678192 - RNA, 19 nt, Homo sapiens
ccacacuccucaucgucaa

SEQ ID NO: 678193 - RNA, 19 nt, Homo sapiens
aaaccaagcggaaggaauc

SEQ ID NO: 678194 - RNA, 19 nt, Homo sapiens
agaaguacaagcugagauu

SEQ ID NO: 678195 - RNA, 19 nt, Homo sapiens
gggcccagcuggaugaaac

SEQ ID NO: 678196 - RNA, 19 nt, Homo sapiens
ccaaccagauucacaagcu

SEQ ID NO: 678197 - RNA, 19 nt, Homo sapiens
gagaaacaccaccgcaucu

SEQ ID NO: 678198 - RNA, 19 nt, Homo sapiens
gaccuaacccugcuuucau

SEQ ID NO: 678199 - RNA, 19 nt, Homo sapiens
gcacugcccuacagaaaag

SEQ ID NO: 678200 - RNA, 19 nt, Homo sapiens
aggaugaugccaacuuuaa

SEQ ID NO: 678201 - RNA, 19 nt, Homo sapiens
gcaagugaagacccagcua

SEQ ID NO: 678202 - RNA, 19 nt, Homo sapiens
gcuccaggauaaagugaca

SEQ ID NO: 678203 - RNA, 19 nt, Homo sapiens
caacuuuaagcuaauguca

SEQ ID NO: 678204 - RNA, 19 nt, Homo sapiens
agaacgaauugagaaguug

SEQ ID NO: 678205 - RNA, 19 nt, Homo sapiens
ggaaggucccagccuagga

SEQ ID NO: 678206 - RNA, 19 nt, Homo sapiens
ugagaugcgccaccugauu

SEQ ID NO: 678207 - RNA, 19 nt, Homo sapiens
uuguauaggcuguuaauug

SEQ ID NO: 678208 - RNA, 19 nt, Homo sapiens
gagcugcagggacccguuu

SEQ ID NO: 678209 - RNA, 19 nt, Homo sapiens
ccugacacccugugacuga

SEQ ID NO: 678210 - RNA, 19 nt, Homo sapiens
cagccaagcuucguuccau

SEQ ID NO: 678211 - RNA, 19 nt, Homo sapiens
guaacacccgcaagaagga

SEQ ID NO: 678212 - RNA, 19 nt, Homo sapiens
ggacaugcaggaacagaac

SEQ ID NO: 678213 - RNA, 19 nt, Homo sapiens
aagaggacuuccaggguau

SEQ ID NO: 678214 - RNA, 19 nt, Homo sapiens
ucucacugcucuacaacga

SEQ ID NO: 678215 - RNA, 19 nt, Homo sapiens
ggaucaaggccaaccagau

SEQ ID NO: 678216 - RNA, 19 nt, Homo sapiens
acgagucucugcaagugaa

SEQ ID NO: 678217 - RNA, 19 nt, Homo sapiens
ccaacaucaucaguuucua

SEQ ID NO: 678218 - RNA, 19 nt, Homo sapiens
cuacaacgagucucugcaa

SEQ ID NO: 678219 - RNA, 19 nt, Homo sapiens
gcugcaggcccaauucuca

SEQ ID NO: 678220 - RNA, 19 nt, Homo sapiens
gaacgagacuggcaaauua

SEQ ID NO: 678221 - RNA, 19 nt, Homo sapiens
ggacacagaucagaagaaa

SEQ ID NO: 678222 - RNA, 19 nt, Homo sapiens
ggaagguucucgugauuga

SEQ ID NO: 678223 - RNA, 19 nt, Homo sapiens
gagccuagccgcuuccuua

SEQ ID NO: 678224 - RNA, 19 nt, Homo sapiens
caacagaaccauccagaaa

SEQ ID NO: 678225 - RNA, 19 nt, Homo sapiens
ggccagagguugagacaaa

SEQ ID NO: 678226 - RNA, 19 nt, Homo sapiens
aaacaacagucaagccuaa

SEQ ID NO: 678227 - RNA, 19 nt, Homo sapiens
gaagaaagaaagacaacuu

SEQ ID NO: 678228 - RNA, 19 nt, Homo sapiens
ccuagccgcuuccuuauuu

SEQ ID NO: 678229 - RNA, 19 nt, Homo sapiens
caacagggaccaccagaaa

SEQ ID NO: 678230 - RNA, 19 nt, Homo sapiens
gagacgggcucgcauuguu

SEQ ID NO: 678231 - RNA, 19 nt, Homo sapiens
gaguugaccucugaaugua

SEQ ID NO: 678232 - RNA, 19 nt, Homo sapiens
ucagggagcucuugcaauc

SEQ ID NO: 678233 - RNA, 19 nt, Homo sapiens
gaacagguguccacauagc

SEQ ID NO: 678234 - RNA, 19 nt, Homo sapiens
cacgguggcuccagacaua

SEQ ID NO: 678235 - RNA, 19 nt, Homo sapiens
gaacagcugccugagauga

SEQ ID NO: 678236 - RNA, 19 nt, Homo sapiens
ggaagaugcuguccuuugc

SEQ ID NO: 678237 - RNA, 19 nt, Homo sapiens
gcaaagggaagcuggaaga

SEQ ID NO: 678238 - RNA, 19 nt, Homo sapiens
acacagaucagaagaaaga

SEQ ID NO: 678239 - RNA, 19 nt, Homo sapiens
acagacagcuugccaguag

SEQ ID NO: 678240 - RNA, 19 nt, Homo sapiens
guccauccauguaaaugua

SEQ ID NO: 678241 - RNA, 19 nt, Homo sapiens
uagccaaucugaacaacaa

SEQ ID NO: 678242 - RNA, 19 nt, Homo sapiens
uuaauuacaugucguguca

SEQ ID NO: 678243 - RNA, 19 nt, Homo sapiens
ucaucgagcuccacgcuaa

SEQ ID NO: 678244 - RNA, 19 nt, Homo sapiens
gggcacaaguuuaccugaa

SEQ ID NO: 678245 - RNA, 19 nt, Homo sapiens
gugaagaagaagugaaaua

SEQ ID NO: 678246 - RNA, 19 nt, Homo sapiens
ggcacaaguuuaccugaaa

SEQ ID NO: 678247 - RNA, 19 nt, Homo sapiens
ggagauggaguuugcaguu

SEQ ID NO: 678248 - RNA, 19 nt, Homo sapiens
acaccaagcucaccaccuu

SEQ ID NO: 678249 - RNA, 19 nt, Homo sapiens
guuguuggcuggagaggaa

SEQ ID NO: 678250 - RNA, 19 nt, Homo sapiens
ccacugggaccaaguuaaa

SEQ ID NO: 678251 - RNA, 19 nt, Homo sapiens
ugaaugacaucgagaaggu

SEQ ID NO: 678252 - RNA, 19 nt, Homo sapiens
aaacuccucugcagcauca

SEQ ID NO: 678253 - RNA, 19 nt, Homo sapiens
gagggagacugcucagaca

SEQ ID NO: 678254 - RNA, 19 nt, Homo sapiens
ucaguggucucucccaaga

SEQ ID NO: 678255 - RNA, 19 nt, Homo sapiens
gcaucaaccugaaugacau

SEQ ID NO: 678256 - RNA, 19 nt, Homo sapiens
ccaguucucuccagcuuuc

SEQ ID NO: 678257 - RNA, 19 nt, Homo sapiens
cgugauugauugauucuga

SEQ ID NO: 678258 - RNA, 19 nt, Homo sapiens
ggaaggguaccacagauca

SEQ ID NO: 678259 - RNA, 19 nt, Homo sapiens
agacaacucucuggacaug

SEQ ID NO: 678260 - RNA, 19 nt, Homo sapiens
caugcaagcucacaccaau

SEQ ID NO: 678261 - RNA, 19 nt, Homo sapiens
ucaacaugcugcagaagga

SEQ ID NO: 678262 - RNA, 19 nt, Homo sapiens
gcagcgacguggacaccaa

SEQ ID NO: 678263 - RNA, 19 nt, Homo sapiens
gagucgguauuuauucuga

SEQ ID NO: 678264 - RNA, 19 nt, Homo sapiens
gaacaacaacacuuuaagc

SEQ ID NO: 678265 - RNA, 19 nt, Homo sapiens
gagauggaguuugcaguuc

SEQ ID NO: 678266 - RNA, 19 nt, Homo sapiens
gcccagaacuccaccaacu

SEQ ID NO: 678267 - RNA, 19 nt, Homo sapiens
ccaaagagaccaugaccau

SEQ ID NO: 678268 - RNA, 19 nt, Homo sapiens
ugaccagucuguaaaccuu

SEQ ID NO: 678269 - RNA, 19 nt, Homo sapiens
cauacuguuugccuaguuu

SEQ ID NO: 678270 - RNA, 19 nt, Homo sapiens
aagggaagcauguuucuuu

SEQ ID NO: 678271 - RNA, 19 nt, Homo sapiens
cccaaggccugguggcuuu

SEQ ID NO: 678272 - RNA, 19 nt, Homo sapiens
gcuugccaguagccaauua

SEQ ID NO: 678273 - RNA, 19 nt, Homo sapiens
ggagcacacacuuugauga

SEQ ID NO: 678274 - RNA, 19 nt, Homo sapiens
caauaagggaagcauguuu

SEQ ID NO: 678275 - RNA, 19 nt, Homo sapiens
cuauggagcugcagaguac

SEQ ID NO: 678276 - RNA, 19 nt, Homo sapiens
agagcuggauauugcauuu

SEQ ID NO: 678277 - RNA, 19 nt, Homo sapiens
aggcagagcuggauauugc

SEQ ID NO: 678278 - RNA, 19 nt, Homo sapiens
cgaguugaccucugaaugu

SEQ ID NO: 678279 - RNA, 19 nt, Homo sapiens
gaccagagugugaagaaga

SEQ ID NO: 678280 - RNA, 19 nt, Homo sapiens
ccugaacccugccuucuuc

SEQ ID NO: 678281 - RNA, 19 nt, Homo sapiens
gccaagcucugcgacaaga

SEQ ID NO: 678282 - RNA, 19 nt, Homo sapiens
uccgugagcucuugggaaa

SEQ ID NO: 678283 - RNA, 19 nt, Homo sapiens
ugccugagaugaugacaga

SEQ ID NO: 678284 - RNA, 19 nt, Homo sapiens
uggacaagcugaucgagau

SEQ ID NO: 678285 - RNA, 19 nt, Homo sapiens
cguccgaguugaccucuga

SEQ ID NO: 678286 - RNA, 19 nt, Homo sapiens
aggaacagcugccugagau

SEQ ID NO: 678287 - RNA, 19 nt, Homo sapiens
gaccgcagcuucgccuuca

SEQ ID NO: 678288 - RNA, 19 nt, Homo sapiens
guugaccucugaauguaug

SEQ ID NO: 678289 - RNA, 19 nt, Homo sapiens
gaacugcaggacagaagug

SEQ ID NO: 678290 - RNA, 19 nt, Homo sapiens
uaaagaaacaacagucaag

SEQ ID NO: 678291 - RNA, 19 nt, Homo sapiens
ugaagucucuuuggccaau

SEQ ID NO: 678292 - RNA, 19 nt, Homo sapiens
aaacguaaagacaguauuc

SEQ ID NO: 678293 - RNA, 19 nt, Homo sapiens
cagaauggcagcaaagaca

SEQ ID NO: 678294 - RNA, 19 nt, Homo sapiens
uaggguaauuggaaacuuc

SEQ ID NO: 678295 - RNA, 19 nt, Homo sapiens
ggauauugcauuucuaagg

SEQ ID NO: 678296 - RNA, 19 nt, Homo sapiens
aauucuagauggugucuug

SEQ ID NO: 678297 - RNA, 19 nt, Homo sapiens
gaggaacagcugccugaga

SEQ ID NO: 678298 - RNA, 19 nt, Homo sapiens
gcaggacgcuccgaaacac

SEQ ID NO: 678299 - RNA, 19 nt, Homo sapiens
gccuuugccugucucuaaa

SEQ ID NO: 678300 - RNA, 19 nt, Homo sapiens
ggaguuugcaguuccacuu

SEQ ID NO: 678301 - RNA, 19 nt, Homo sapiens
agaacaagauggacaagcu

SEQ ID NO: 678302 - RNA, 19 nt, Homo sapiens
cggcgaaggcuaaaggaaa

SEQ ID NO: 678303 - RNA, 19 nt, Homo sapiens
caccuucgauuccuucagu

SEQ ID NO: 678304 - RNA, 19 nt, Homo sapiens
ugcaagcucacaccaauaa

SEQ ID NO: 678305 - RNA, 19 nt, Homo sapiens
agacugcggcgaaggcuaa

SEQ ID NO: 678306 - RNA, 19 nt, Homo sapiens
ggaccagagugugaagaag

SEQ ID NO: 678307 - RNA, 19 nt, Homo sapiens
agaacgagacuggcaaauu

SEQ ID NO: 678308 - RNA, 19 nt, Homo sapiens
cagagucgguggccagucu

SEQ ID NO: 678309 - RNA, 19 nt, Homo sapiens
guccuuugcugcucuaugg

SEQ ID NO: 678310 - RNA, 19 nt, Homo sapiens
cagcugaacccaaacuaca

SEQ ID NO: 678311 - RNA, 19 nt, Homo sapiens
gcuggauauugcauuucua

SEQ ID NO: 678312 - RNA, 19 nt, Homo sapiens
gagaggcagagcuggauau

SEQ ID NO: 678313 - RNA, 19 nt, Homo sapiens
ggaaaacguuaagacuauu

SEQ ID NO: 678314 - RNA, 19 nt, Homo sapiens
gagcacacacuuugaugag

SEQ ID NO: 678315 - RNA, 19 nt, Homo sapiens
acagaaccauccagaaacu

SEQ ID NO: 678316 - RNA, 19 nt, Homo sapiens
aaauaaacaccaccaccaa

SEQ ID NO: 678317 - RNA, 19 nt, Homo sapiens
cgguauuuauucugauuga

SEQ ID NO: 678318 - RNA, 19 nt, Homo sapiens
ccgcuggaauccuguguuc

SEQ ID NO: 678319 - RNA, 19 nt, Homo sapiens
gccaagucccagucuguuu

SEQ ID NO: 678320 - RNA, 19 nt, Homo sapiens
gcaaauaacuuaccuucuu

SEQ ID NO: 678321 - RNA, 19 nt, Homo sapiens
gcagagagcugugaaauau

SEQ ID NO: 678322 - RNA, 19 nt, Homo sapiens
guacauggcugguaaguga

SEQ ID NO: 678323 - RNA, 19 nt, Homo sapiens
ggauaaagcuaacuguaaa

SEQ ID NO: 678324 - RNA, 19 nt, Homo sapiens
ggaaaggaguguuguaaga

SEQ ID NO: 678325 - RNA, 19 nt, Homo sapiens
gagaguaaauguagauuga

SEQ ID NO: 678326 - RNA, 19 nt, Homo sapiens
gcacagauccagagaggua

SEQ ID NO: 678327 - RNA, 19 nt, Homo sapiens
ggagaggccuugagauguu

SEQ ID NO: 678328 - RNA, 19 nt, Homo sapiens
ucagagagauaucacaauu

SEQ ID NO: 678329 - RNA, 19 nt, Homo sapiens
gauguucugucuaggauaa

SEQ ID NO: 678330 - RNA, 19 nt, Homo sapiens
cagcaacccuuuccaggua

SEQ ID NO: 678331 - RNA, 19 nt, Homo sapiens
gaacagagaacaugaagag

SEQ ID NO: 678332 - RNA, 19 nt, Homo sapiens
agagagauaucacaauuug

SEQ ID NO: 678333 - RNA, 19 nt, Homo sapiens
ucacguacauggcugguaa

SEQ ID NO: 678334 - RNA, 19 nt, Homo sapiens
caaauaacuuaccuucuuc

SEQ ID NO: 678335 - RNA, 19 nt, Homo sapiens
ccaaagaagaggccagaua

SEQ ID NO: 678336 - RNA, 19 nt, Homo sapiens
caccuuagccuuugucuuu

SEQ ID NO: 678337 - RNA, 19 nt, Homo sapiens
gcaggagguuggauaacaa

SEQ ID NO: 678338 - RNA, 19 nt, Homo sapiens
ggaccuuugugcucacuuu

SEQ ID NO: 678339 - RNA, 19 nt, Homo sapiens
gagaggccuugagauguua

SEQ ID NO: 678340 - RNA, 19 nt, Homo sapiens
gaaguuucuugcccaaaug

SEQ ID NO: 678341 - RNA, 19 nt, Homo sapiens
ugaccugacucccuauauu

SEQ ID NO: 678342 - RNA, 19 nt, Homo sapiens
gcaaagcgcaguacaaugc

SEQ ID NO: 678343 - RNA, 19 nt, Homo sapiens
ugucugcccuccuaccuua

SEQ ID NO: 678344 - RNA, 19 nt, Homo sapiens
ggaugugucugcuugacuu

SEQ ID NO: 678345 - RNA, 19 nt, Homo sapiens
gagacuagcccaccauuca

SEQ ID NO: 678346 - RNA, 19 nt, Homo sapiens
cuuaggaaacucugaauua

SEQ ID NO: 678347 - RNA, 19 nt, Homo sapiens
caaaggaugcauucaguga

SEQ ID NO: 678348 - RNA, 19 nt, Homo sapiens
gugaaagcauuaugacugu

SEQ ID NO: 678349 - RNA, 19 nt, Homo sapiens
ugagagaggcccaagcuuu

SEQ ID NO: 678350 - RNA, 19 nt, Homo sapiens
gaacuucucacacaacucu

SEQ ID NO: 678351 - RNA, 19 nt, Homo sapiens
caugaauggcugacacuua

SEQ ID NO: 678352 - RNA, 19 nt, Homo sapiens
auauugaccuguaguuuga

SEQ ID NO: 678353 - RNA, 19 nt, Homo sapiens
ggaauuugcuaugagaaag

SEQ ID NO: 678354 - RNA, 19 nt, Homo sapiens
ccacagagaggaccuuugu

SEQ ID NO: 678355 - RNA, 19 nt, Homo sapiens
guacuacuguuugccaaug

SEQ ID NO: 678356 - RNA, 19 nt, Homo sapiens
gagagaggcccaagcuuuc

SEQ ID NO: 678357 - RNA, 19 nt, Homo sapiens
guaagugacugaucuuucc

SEQ ID NO: 678358 - RNA, 19 nt, Homo sapiens
cagacuaccuccuccacuu

SEQ ID NO: 678359 - RNA, 19 nt, Homo sapiens
uauauuguuuccucaguug

SEQ ID NO: 678360 - RNA, 19 nt, Homo sapiens
gaccugacucccuauauug

SEQ ID NO: 678361 - RNA, 19 nt, Homo sapiens
caaagaagaggccagauac

SEQ ID NO: 678362 - RNA, 19 nt, Homo sapiens
gguaccaccuuggaauuug

SEQ ID NO: 678363 - RNA, 19 nt, Homo sapiens
ggagaguaaauguagauug

SEQ ID NO: 678364 - RNA, 19 nt, Homo sapiens
ccacuugccuggccauguc

SEQ ID NO: 678365 - RNA, 19 nt, Homo sapiens
ccagaugggccucagacua

SEQ ID NO: 678366 - RNA, 19 nt, Homo sapiens
cauauugaccuguaguuug

SEQ ID NO: 678367 - RNA, 19 nt, Homo sapiens
gcauauugaccuguaguuu

SEQ ID NO: 678368 - RNA, 19 nt, Homo sapiens
gguccuuuauuaucaguug

SEQ ID NO: 678369 - RNA, 19 nt, Homo sapiens
uuaagcaccugcgccagua

SEQ ID NO: 678370 - RNA, 19 nt, Homo sapiens
gaugagucuuggaugcauu

SEQ ID NO: 678371 - RNA, 19 nt, Homo sapiens
gcugguaagugacugaucu

SEQ ID NO: 678372 - RNA, 19 nt, Homo sapiens
ggcaggagguuggauaaca

SEQ ID NO: 678373 - RNA, 19 nt, Homo sapiens
agagagcugugaaauaucu

SEQ ID NO: 678374 - RNA, 19 nt, Homo sapiens
gagcagagagcugugaaau

SEQ ID NO: 678375 - RNA, 19 nt, Homo sapiens
uuaggaaacucugaauuag

SEQ ID NO: 678376 - RNA, 19 nt, Homo sapiens
gaguucagguucccaagca

SEQ ID NO: 678377 - RNA, 19 nt, Homo sapiens
cagccgcucugggaaauga

SEQ ID NO: 678378 - RNA, 19 nt, Homo sapiens
uuccaucgcuuucaacuuc

SEQ ID NO: 678379 - RNA, 19 nt, Homo sapiens
caaggcagauccacuucca

SEQ ID NO: 678380 - RNA, 19 nt, Homo sapiens
aggauaaagcuaacuguaa

SEQ ID NO: 678381 - RNA, 19 nt, Homo sapiens
cagcaaagcgcaguacaau

SEQ ID NO: 678382 - RNA, 19 nt, Homo sapiens
ccaguacagucaagaagag

SEQ ID NO: 678383 - RNA, 19 nt, Homo sapiens
ucauuucaccuuugauuug

SEQ ID NO: 678384 - RNA, 19 nt, Homo sapiens
acuuaaaucuguacuacug

SEQ ID NO: 678385 - RNA, 19 nt, Homo sapiens
acacuuaaaucuguacuac

SEQ ID NO: 678386 - RNA, 19 nt, Homo sapiens
ugcauucagugaccuauga

SEQ ID NO: 678387 - RNA, 19 nt, Homo sapiens
aauggugucugcccuccua

SEQ ID NO: 678388 - RNA, 19 nt, Homo sapiens
cugacucccuauauuguuu

SEQ ID NO: 678389 - RNA, 19 nt, Homo sapiens
cagagagauaucacaauuu

SEQ ID NO: 678390 - RNA, 19 nt, Homo sapiens
guguaucccugguucacaa

SEQ ID NO: 678391 - RNA, 19 nt, Homo sapiens
ugaggaaggucccggugau

SEQ ID NO: 678392 - RNA, 19 nt, Homo sapiens
uuugauagauguucugucu

SEQ ID NO: 678393 - RNA, 19 nt, Homo sapiens
cuuaccuucuuccuucuua

SEQ ID NO: 678394 - RNA, 19 nt, Homo sapiens
gugcucaccuuagccuuug

SEQ ID NO: 678395 - RNA, 19 nt, Homo sapiens
ccagcgaccugacaguuac

SEQ ID NO: 678396 - RNA, 19 nt, Homo sapiens
agaggaaagugugugaaga

SEQ ID NO: 678397 - RNA, 19 nt, Homo sapiens
ccagauacccacccaccuu

SEQ ID NO: 678398 - RNA, 19 nt, Homo sapiens
augaauggcugacacuuag

SEQ ID NO: 678399 - RNA, 19 nt, Homo sapiens
uaggauaaagcuaacugua

SEQ ID NO: 678400 - RNA, 19 nt, Homo sapiens
gguaagugacugaucuuuc

SEQ ID NO: 678401 - RNA, 19 nt, Homo sapiens
gaaauuccagcgggaguuc

SEQ ID NO: 678402 - RNA, 19 nt, Homo sapiens
ggccuccucugcagaagug

SEQ ID NO: 678403 - RNA, 19 nt, Homo sapiens
gaaauaucuuuggcuugca

SEQ ID NO: 678404 - RNA, 19 nt, Homo sapiens
gaagaggaaagugugugaa

SEQ ID NO: 678405 - RNA, 19 nt, Homo sapiens
gaauggcugacacuuagga

SEQ ID NO: 678406 - RNA, 19 nt, Homo sapiens
gaaaggaguguuguaagac

SEQ ID NO: 678407 - RNA, 19 nt, Homo sapiens
ucucacacuuaaaucugua

SEQ ID NO: 678408 - RNA, 19 nt, Homo sapiens
gcaacccuuuccagguaga

SEQ ID NO: 678409 - RNA, 19 nt, Homo sapiens
gggcuugugucaugagcau

SEQ ID NO: 678410 - RNA, 19 nt, Homo sapiens
gggaaacaugugccagaaa

SEQ ID NO: 678411 - RNA, 19 nt, Homo sapiens
cuauauuguuuccucaguu

SEQ ID NO: 678412 - RNA, 19 nt, Homo sapiens
guacagucaagaagaggaa

SEQ ID NO: 678413 - RNA, 19 nt, Homo sapiens
ucacagaugagucuuggau

SEQ ID NO: 678414 - RNA, 19 nt, Homo sapiens
caaggagcccuaccuggau

SEQ ID NO: 678415 - RNA, 19 nt, Homo sapiens
aggcgguccuuuauuauca

SEQ ID NO: 678416 - RNA, 19 nt, Homo sapiens
aaugcgggcuugugucaug

SEQ ID NO: 678417 - RNA, 19 nt, Homo sapiens
uugguagccucacagauga

SEQ ID NO: 678418 - RNA, 19 nt, Homo sapiens
cagaugggccucagacuac

SEQ ID NO: 678419 - RNA, 19 nt, Homo sapiens
aaggaguguuguaagacua

SEQ ID NO: 678420 - RNA, 19 nt, Homo sapiens
gcaaagagcucaaugcauu

SEQ ID NO: 678421 - RNA, 19 nt, Homo sapiens
gaaauggacugccuaauau

SEQ ID NO: 678422 - RNA, 19 nt, Homo sapiens
caucagaacuugacaauaa

SEQ ID NO: 678423 - RNA, 19 nt, Homo sapiens
caacagagcugaagaaugg

SEQ ID NO: 678424 - RNA, 19 nt, Homo sapiens
ggaaaucgcucucgcuuug

SEQ ID NO: 678425 - RNA, 19 nt, Homo sapiens
gaaauauacuugaggguaa

SEQ ID NO: 678426 - RNA, 19 nt, Homo sapiens
gagcguguauuguuuguua

SEQ ID NO: 678427 - RNA, 19 nt, Homo sapiens
ugagaaagcugcccaacua

SEQ ID NO: 678428 - RNA, 19 nt, Homo sapiens
caacagaacagauacagua

SEQ ID NO: 678429 - RNA, 19 nt, Homo sapiens
gaggagaccuuaucuuuua

SEQ ID NO: 678430 - RNA, 19 nt, Homo sapiens
gaggaagacuggauaguga

SEQ ID NO: 678431 - RNA, 19 nt, Homo sapiens
gaaagaagcccaagaaagg

SEQ ID NO: 678432 - RNA, 19 nt, Homo sapiens
ggaaauguauauagagaga

SEQ ID NO: 678433 - RNA, 19 nt, Homo sapiens
caaauuagccuggcacuuu

SEQ ID NO: 678434 - RNA, 19 nt, Homo sapiens
caugaaagaucccuagauu

SEQ ID NO: 678435 - RNA, 19 nt, Homo sapiens
gaagauaguucaaauucuc

SEQ ID NO: 678436 - RNA, 19 nt, Homo sapiens
ccaagagccuaauauguuu

SEQ ID NO: 678437 - RNA, 19 nt, Homo sapiens
ggauaaacaucacagaaau

SEQ ID NO: 678438 - RNA, 19 nt, Homo sapiens
ggagauuccuuucuuuaug

SEQ ID NO: 678439 - RNA, 19 nt, Homo sapiens
gauuugagcuuugcauauu

SEQ ID NO: 678440 - RNA, 19 nt, Homo sapiens
gaaccuaaccuaccuuguu

SEQ ID NO: 678441 - RNA, 19 nt, Homo sapiens
agaaguagcuagaggcuuu

SEQ ID NO: 678442 - RNA, 19 nt, Homo sapiens
ugaaagaucccuagauuga

SEQ ID NO: 678443 - RNA, 19 nt, Homo sapiens
caaaggaugccaaaguaua

SEQ ID NO: 678444 - RNA, 19 nt, Homo sapiens
agaaauggacugccuaaua

SEQ ID NO: 678445 - RNA, 19 nt, Homo sapiens
guagagaguuucacaucaa

SEQ ID NO: 678446 - RNA, 19 nt, Homo sapiens
ggagaaagaagcccaagaa

SEQ ID NO: 678447 - RNA, 19 nt, Homo sapiens
guauuuagcuguagucaag

SEQ ID NO: 678448 - RNA, 19 nt, Homo sapiens
aaagaucccuagauugaaa

SEQ ID NO: 678449 - RNA, 19 nt, Homo sapiens
ucacagaaaugaauaagca

SEQ ID NO: 678450 - RNA, 19 nt, Homo sapiens
aaauuagccuggcacuuua

SEQ ID NO: 678451 - RNA, 19 nt, Homo sapiens
aaaccugacuucuagauga

SEQ ID NO: 678452 - RNA, 19 nt, Homo sapiens
gaaaguaggaagaaugguu

SEQ ID NO: 678453 - RNA, 19 nt, Homo sapiens
gggaggagaccuuaucuuu

SEQ ID NO: 678454 - RNA, 19 nt, Homo sapiens
ccagagagcuugagagcau

SEQ ID NO: 678455 - RNA, 19 nt, Homo sapiens
gagacagaaugaucuuaaa

SEQ ID NO: 678456 - RNA, 19 nt, Homo sapiens
gaacuacucagcaagcaaa

SEQ ID NO: 678457 - RNA, 19 nt, Homo sapiens
caagaaauccccaaacuua

SEQ ID NO: 678458 - RNA, 19 nt, Homo sapiens
gcagauacuuugccaccuu

SEQ ID NO: 678459 - RNA, 19 nt, Homo sapiens
gaaagcugcccaacuaaga

SEQ ID NO: 678460 - RNA, 19 nt, Homo sapiens
gagagaaacuccagcugau

SEQ ID NO: 678461 - RNA, 19 nt, Homo sapiens
gcugugagaugaaacaugu

SEQ ID NO: 678462 - RNA, 19 nt, Homo sapiens
gaaguaggauucugguucu

SEQ ID NO: 678463 - RNA, 19 nt, Homo sapiens
gagacagucaguaaucuua

SEQ ID NO: 678464 - RNA, 19 nt, Homo sapiens
uaaaagagccuccccauaa

SEQ ID NO: 678465 - RNA, 19 nt, Homo sapiens
ucagauaacuauacaugga

SEQ ID NO: 678466 - RNA, 19 nt, Homo sapiens
gaucagugcucuuacaaac

SEQ ID NO: 678467 - RNA, 19 nt, Homo sapiens
ugacuuguauuuagcugua

SEQ ID NO: 678468 - RNA, 19 nt, Homo sapiens
uauacacccuuacagauuu

SEQ ID NO: 678469 - RNA, 19 nt, Homo sapiens
cccaaaggaugccaaagua

SEQ ID NO: 678470 - RNA, 19 nt, Homo sapiens
gaaagcauugugcauauug

SEQ ID NO: 678471 - RNA, 19 nt, Homo sapiens
uauagagcguguauuguuu

SEQ ID NO: 678472 - RNA, 19 nt, Homo sapiens
gcugggaaauguauauaga

SEQ ID NO: 678473 - RNA, 19 nt, Homo sapiens
gaacaauggaaucuaauca

SEQ ID NO: 678474 - RNA, 19 nt, Homo sapiens
gaauguguaugaugcaaca

SEQ ID NO: 678475 - RNA, 19 nt, Homo sapiens
gugcuugucugacuaguau

SEQ ID NO: 678476 - RNA, 19 nt, Homo sapiens
gaauugcuguguuguucuu

SEQ ID NO: 678477 - RNA, 19 nt, Homo sapiens
aaagaaagcauugugcaua

SEQ ID NO: 678478 - RNA, 19 nt, Homo sapiens
caaagccaauguuaaguca

SEQ ID NO: 678479 - RNA, 19 nt, Homo sapiens
gaacaaagucuggauaaac

SEQ ID NO: 678480 - RNA, 19 nt, Homo sapiens
cauaauggccuguugaguu

SEQ ID NO: 678481 - RNA, 19 nt, Homo sapiens
caucaaagccaucagcauu

SEQ ID NO: 678482 - RNA, 19 nt, Homo sapiens
ucagugcucuuacaaacaa

SEQ ID NO: 678483 - RNA, 19 nt, Homo sapiens
ccgguacccuuaaacauuu

SEQ ID NO: 678484 - RNA, 19 nt, Homo sapiens
gagcugugcuucuaauuuu

SEQ ID NO: 678485 - RNA, 19 nt, Homo sapiens
uagcugcacuuuauagaga

SEQ ID NO: 678486 - RNA, 19 nt, Homo sapiens
ggaauucggugugguugga

SEQ ID NO: 678487 - RNA, 19 nt, Homo sapiens
uuacugagccugugacuug

SEQ ID NO: 678488 - RNA, 19 nt, Homo sapiens
gagcagacucacuggcuua

SEQ ID NO: 678489 - RNA, 19 nt, Homo sapiens
gauguucagcuugguauua

SEQ ID NO: 678490 - RNA, 19 nt, Homo sapiens
gaucaagucaccaacagaa

SEQ ID NO: 678491 - RNA, 19 nt, Homo sapiens
gagauuccuuucuuuaugg

SEQ ID NO: 678492 - RNA, 19 nt, Homo sapiens
agccauaucucaucucuga

SEQ ID NO: 678493 - RNA, 19 nt, Homo sapiens
gaacaggauaugaacaaau

SEQ ID NO: 678494 - RNA, 19 nt, Homo sapiens
gauagaaagcgaugugguu

SEQ ID NO: 678495 - RNA, 19 nt, Homo sapiens
gaauuacugcagagugaua

SEQ ID NO: 678496 - RNA, 19 nt, Homo sapiens
uaauguagcuuguccuuuu

SEQ ID NO: 678497 - RNA, 19 nt, Homo sapiens
ccaguaccaucuccauuug

SEQ ID NO: 678498 - RNA, 19 nt, Homo sapiens
guaggauucugguucuuug

SEQ ID NO: 678499 - RNA, 19 nt, Homo sapiens
ccagagagucaaccugaua

SEQ ID NO: 678500 - RNA, 19 nt, Homo sapiens
gaacgagacagucaguaau

SEQ ID NO: 678501 - RNA, 19 nt, Homo sapiens
ggaaugaacgagacaguca

SEQ ID NO: 678502 - RNA, 19 nt, Homo sapiens
uaaccuaccuuguuguuuu

SEQ ID NO: 678503 - RNA, 19 nt, Homo sapiens
auaauggccuguugaguug

SEQ ID NO: 678504 - RNA, 19 nt, Homo sapiens
gaugggcucauacucauaa

SEQ ID NO: 678505 - RNA, 19 nt, Homo sapiens
caccuuaacucuuuguugu

SEQ ID NO: 678506 - RNA, 19 nt, Homo sapiens
uauguugagucuagaauug

SEQ ID NO: 678507 - RNA, 19 nt, Homo sapiens
aagaaagcauugugcauau

SEQ ID NO: 678508 - RNA, 19 nt, Homo sapiens
ggagcacccuuagaaguau

SEQ ID NO: 678509 - RNA, 19 nt, Homo sapiens
caaacaaaccugagagcaa

SEQ ID NO: 678510 - RNA, 19 nt, Homo sapiens
ggaagcaaccagaucauuc

SEQ ID NO: 678511 - RNA, 19 nt, Homo sapiens
gaaaagcucauuccaagaa

SEQ ID NO: 678512 - RNA, 19 nt, Homo sapiens
acaauggaaucuaaucaga

SEQ ID NO: 678513 - RNA, 19 nt, Homo sapiens
caagggagacuauuuacga

SEQ ID NO: 678514 - RNA, 19 nt, Homo sapiens
gagaaagaagcccaagaaa

SEQ ID NO: 678515 - RNA, 19 nt, Homo sapiens
ggaauaauaccuccauguc

SEQ ID NO: 678516 - RNA, 19 nt, Homo sapiens
gaaagaucccuagauugaa

SEQ ID NO: 678517 - RNA, 19 nt, Homo sapiens
gaagcugaccuaccaggaa

SEQ ID NO: 678518 - RNA, 19 nt, Homo sapiens
cauccugccugagaaagua

SEQ ID NO: 678519 - RNA, 19 nt, Homo sapiens
gagaaacuccagcugauca

SEQ ID NO: 678520 - RNA, 19 nt, Homo sapiens
ggaaacagcuguaccucua

SEQ ID NO: 678521 - RNA, 19 nt, Homo sapiens
guugagaccuuguauaaua

SEQ ID NO: 678522 - RNA, 19 nt, Homo sapiens
ggacagcacuuuauaauac

SEQ ID NO: 678523 - RNA, 19 nt, Homo sapiens
gcagaacucuucagauuuc

SEQ ID NO: 678524 - RNA, 19 nt, Homo sapiens
ggaaaccacugcaagcaaa

SEQ ID NO: 678525 - RNA, 19 nt, Homo sapiens
guaagaauaugucagaaga

SEQ ID NO: 678526 - RNA, 19 nt, Homo sapiens
caacaaagcauuuccaguu

SEQ ID NO: 678527 - RNA, 19 nt, Homo sapiens
gggcagaggugcacuuuau

SEQ ID NO: 678528 - RNA, 19 nt, Homo sapiens
caaccaauuugaacacuuu

SEQ ID NO: 678529 - RNA, 19 nt, Homo sapiens
gaagaagacacaagaauca

SEQ ID NO: 678530 - RNA, 19 nt, Homo sapiens
gcacuugacugaacagaag

SEQ ID NO: 678531 - RNA, 19 nt, Homo sapiens
gaaaccauaucucccaaug

SEQ ID NO: 678532 - RNA, 19 nt, Homo sapiens
caaagcauuuccaguugua

SEQ ID NO: 678533 - RNA, 19 nt, Homo sapiens
uaacggugcuaacucuaua

SEQ ID NO: 678534 - RNA, 19 nt, Homo sapiens
uaaacaggcucuacaagug

SEQ ID NO: 678535 - RNA, 19 nt, Homo sapiens
aaacacagcauuucaugua

SEQ ID NO: 678536 - RNA, 19 nt, Homo sapiens
gcuaauaacuaagcuucua

SEQ ID NO: 678537 - RNA, 19 nt, Homo sapiens
caaguugccucaauacaug

SEQ ID NO: 678538 - RNA, 19 nt, Homo sapiens
ggaaagauguaucguaucg

SEQ ID NO: 678539 - RNA, 19 nt, Homo sapiens
ccuguuacauguucuguua

SEQ ID NO: 678540 - RNA, 19 nt, Homo sapiens
gaaguuagcucgguucaac

SEQ ID NO: 678541 - RNA, 19 nt, Homo sapiens
gaaacuggcacuugacuga

SEQ ID NO: 678542 - RNA, 19 nt, Homo sapiens
caccuuaucugaacauuug

SEQ ID NO: 678543 - RNA, 19 nt, Homo sapiens
ggugccaucucuccauuua

SEQ ID NO: 678544 - RNA, 19 nt, Homo sapiens
gcagucaucugaguuaguu

SEQ ID NO: 678545 - RNA, 19 nt, Homo sapiens
uagaagauguugccuuuau

SEQ ID NO: 678546 - RNA, 19 nt, Homo sapiens
aauagaagauguugccuuu

SEQ ID NO: 678547 - RNA, 19 nt, Homo sapiens
ggaaaacucccguugauua

SEQ ID NO: 678548 - RNA, 19 nt, Homo sapiens
ucagaagagugcucgguua

SEQ ID NO: 678549 - RNA, 19 nt, Homo sapiens
gcuccuaucucuugauguu

SEQ ID NO: 678550 - RNA, 19 nt, Homo sapiens
gccuauggcugaaacuaua

SEQ ID NO: 678551 - RNA, 19 nt, Homo sapiens
gaucaggucagaaaccaua

SEQ ID NO: 678552 - RNA, 19 nt, Homo sapiens
ccaaagaucuuagcaagca

SEQ ID NO: 678553 - RNA, 19 nt, Homo sapiens
gauaaaguacaucccaaua

SEQ ID NO: 678554 - RNA, 19 nt, Homo sapiens
caaccacucuuccuuaaag

SEQ ID NO: 678555 - RNA, 19 nt, Homo sapiens
guucaacgcccaugaguuu

SEQ ID NO: 678556 - RNA, 19 nt, Homo sapiens
ucacauacauccaaaagua

SEQ ID NO: 678557 - RNA, 19 nt, Homo sapiens
uaacccacuugccuuauuu

SEQ ID NO: 678558 - RNA, 19 nt, Homo sapiens
acgcagaacucuucagauu

SEQ ID NO: 678559 - RNA, 19 nt, Homo sapiens
ggaaugcaaauaguucuua

SEQ ID NO: 678560 - RNA, 19 nt, Homo sapiens
cgccauaucucccaaguga

SEQ ID NO: 678561 - RNA, 19 nt, Homo sapiens
gagcagccucugagucuua

SEQ ID NO: 678562 - RNA, 19 nt, Homo sapiens
ugccaucucuccauuuaua

SEQ ID NO: 678563 - RNA, 19 nt, Homo sapiens
gguaacguguuccuagaaa

SEQ ID NO: 678564 - RNA, 19 nt, Homo sapiens
cccaugagcuuuccaauag

SEQ ID NO: 678565 - RNA, 19 nt, Homo sapiens
gcuggaacaugcucagauu

SEQ ID NO: 678566 - RNA, 19 nt, Homo sapiens
guaauuauugugcccuuua

SEQ ID NO: 678567 - RNA, 19 nt, Homo sapiens
caugagcuuuccaauagua

SEQ ID NO: 678568 - RNA, 19 nt, Homo sapiens
ccucuaagcuccuuucaca

SEQ ID NO: 678569 - RNA, 19 nt, Homo sapiens
uaacaagccagaacucauu

SEQ ID NO: 678570 - RNA, 19 nt, Homo sapiens
ggaaacaggccacaaccaa

SEQ ID NO: 678571 - RNA, 19 nt, Homo sapiens
gcacauggauuccguaccu

SEQ ID NO: 678572 - RNA, 19 nt, Homo sapiens
cuuuauagcuugaccauau

SEQ ID NO: 678573 - RNA, 19 nt, Homo sapiens
gaaaagaaaucaccuacuc

SEQ ID NO: 678574 - RNA, 19 nt, Homo sapiens
gacaucaacuuucaagagu

SEQ ID NO: 678575 - RNA, 19 nt, Homo sapiens
aaggaaagauguaucguau

SEQ ID NO: 678576 - RNA, 19 nt, Homo sapiens
uugcuucucugaccacuua

SEQ ID NO: 678577 - RNA, 19 nt, Homo sapiens
ucacuaccaugaacuauag

SEQ ID NO: 678578 - RNA, 19 nt, Homo sapiens
ccuauuugcugguuuaguu

SEQ ID NO: 678579 - RNA, 19 nt, Homo sapiens
aaacauacaggagcucuua

SEQ ID NO: 678580 - RNA, 19 nt, Homo sapiens
cgaaagggacggcaaagaa

SEQ ID NO: 678581 - RNA, 19 nt, Homo sapiens
gcaaaucgcaccuuaucug

SEQ ID NO: 678582 - RNA, 19 nt, Homo sapiens
aagcauguauguagagaaa

SEQ ID NO: 678583 - RNA, 19 nt, Homo sapiens
gaacagcacaccugagagu

SEQ ID NO: 678584 - RNA, 19 nt, Homo sapiens
gcagacagcagccuggauu

SEQ ID NO: 678585 - RNA, 19 nt, Homo sapiens
guuugagacuguuaucuuu

SEQ ID NO: 678586 - RNA, 19 nt, Homo sapiens
gcagaggugcacuuuauga

SEQ ID NO: 678587 - RNA, 19 nt, Homo sapiens
gcaaacugguucugaguac

SEQ ID NO: 678588 - RNA, 19 nt, Homo sapiens
ccauggauguguacgauga

SEQ ID NO: 678589 - RNA, 19 nt, Homo sapiens
caauaaagcggaauucauc

SEQ ID NO: 678590 - RNA, 19 nt, Homo sapiens
gacaagaaaccuagauguu

SEQ ID NO: 678591 - RNA, 19 nt, Homo sapiens
aagagaagcaucagucuaa

SEQ ID NO: 678592 - RNA, 19 nt, Homo sapiens
ucauugacauucucaguga

SEQ ID NO: 678593 - RNA, 19 nt, Homo sapiens
ggacagacuagccuucuau

SEQ ID NO: 678594 - RNA, 19 nt, Homo sapiens
gacccugcgucuauuauga

SEQ ID NO: 678595 - RNA, 19 nt, Homo sapiens
gugcacggcuucucaagug

SEQ ID NO: 678596 - RNA, 19 nt, Homo sapiens
gaucaaacacagcauuuca

SEQ ID NO: 678597 - RNA, 19 nt, Homo sapiens
gcacaccuuuauagcuuga

SEQ ID NO: 678598 - RNA, 19 nt, Homo sapiens
aaagucagcuugcuucucu

SEQ ID NO: 678599 - RNA, 19 nt, Homo sapiens
gcacaucaccacccauugu

SEQ ID NO: 678600 - RNA, 19 nt, Homo sapiens
uauauucccugcucagaga

SEQ ID NO: 678601 - RNA, 19 nt, Homo sapiens
ggcagaagcuucaaacacu

SEQ ID NO: 678602 - RNA, 19 nt, Homo sapiens
gaacagggaaucuugaaac

SEQ ID NO: 678603 - RNA, 19 nt, Homo sapiens
caacacugcuucagauggu

SEQ ID NO: 678604 - RNA, 19 nt, Homo sapiens
gaccauaugcugucaugaa

SEQ ID NO: 678605 - RNA, 19 nt, Homo sapiens
gugccuauuugcugguuua

SEQ ID NO: 678606 - RNA, 19 nt, Homo sapiens
caagccaacuucuuucauc

SEQ ID NO: 678607 - RNA, 19 nt, Homo sapiens
gcaauaaacaggcucuaca

SEQ ID NO: 678608 - RNA, 19 nt, Homo sapiens
guuggcaaaucgcaccuua

SEQ ID NO: 678609 - RNA, 19 nt, Homo sapiens
uguagaggcuucugggaaa

SEQ ID NO: 678610 - RNA, 19 nt, Homo sapiens
ucacaugaguugcuucaca

SEQ ID NO: 678611 - RNA, 19 nt, Homo sapiens
guucauuucuucucagugu

SEQ ID NO: 678612 - RNA, 19 nt, Homo sapiens
gaaguugacaggcgagaga

SEQ ID NO: 678613 - RNA, 19 nt, Homo sapiens
uuuacaggcugaauuauug

SEQ ID NO: 678614 - RNA, 19 nt, Homo sapiens
aaacugagaugccuuuuau

SEQ ID NO: 678615 - RNA, 19 nt, Homo sapiens
uugaggaccugcaauagaa

SEQ ID NO: 678616 - RNA, 19 nt, Homo sapiens
gcaaccaauuugaacacuu

SEQ ID NO: 678617 - RNA, 19 nt, Homo sapiens
uaaggaaagauguaucgua

SEQ ID NO: 678618 - RNA, 19 nt, Homo sapiens
uuacagcuuucucacauga

SEQ ID NO: 678619 - RNA, 19 nt, Homo sapiens
ccaaagagaacaacaacug

SEQ ID NO: 678620 - RNA, 19 nt, Homo sapiens
gagccuagauucagauuua

SEQ ID NO: 678621 - RNA, 19 nt, Homo sapiens
ggaaacagcuguaccucua

SEQ ID NO: 678622 - RNA, 19 nt, Homo sapiens
guugagaccuuguauaaua

SEQ ID NO: 678623 - RNA, 19 nt, Homo sapiens
ggacagcacuuuauaauac

SEQ ID NO: 678624 - RNA, 19 nt, Homo sapiens
gcagaacucuucagauuuc

SEQ ID NO: 678625 - RNA, 19 nt, Homo sapiens
ggaaaccacugcaagcaaa

SEQ ID NO: 678626 - RNA, 19 nt, Homo sapiens
guaagaauaugucagaaga

SEQ ID NO: 678627 - RNA, 19 nt, Homo sapiens
caacaaagcauuuccaguu

SEQ ID NO: 678628 - RNA, 19 nt, Homo sapiens
gggcagaggugcacuuuau

SEQ ID NO: 678629 - RNA, 19 nt, Homo sapiens
caaccaauuugaacacuuu

SEQ ID NO: 678630 - RNA, 19 nt, Homo sapiens
gaaggugaauaacaacuug

SEQ ID NO: 678631 - RNA, 19 nt, Homo sapiens
gaagaagacacaagaauca

SEQ ID NO: 678632 - RNA, 19 nt, Homo sapiens
gcacuugacugaacagaag

SEQ ID NO: 678633 - RNA, 19 nt, Homo sapiens
gaaaccauaucucccaaug

SEQ ID NO: 678634 - RNA, 19 nt, Homo sapiens
caaagcauuuccaguugua

SEQ ID NO: 678635 - RNA, 19 nt, Homo sapiens
uaacggugcuaacucuaua

SEQ ID NO: 678636 - RNA, 19 nt, Homo sapiens
uaaacaggcucuacaagug

SEQ ID NO: 678637 - RNA, 19 nt, Homo sapiens
aaacacagcauuucaugua

SEQ ID NO: 678638 - RNA, 19 nt, Homo sapiens
gcuaauaacuaagcuucua

SEQ ID NO: 678639 - RNA, 19 nt, Homo sapiens
caaguugccucaauacaug

SEQ ID NO: 678640 - RNA, 19 nt, Homo sapiens
ggaaagauguaucguaucg

SEQ ID NO: 678641 - RNA, 19 nt, Homo sapiens
ccuguuacauguucuguua

SEQ ID NO: 678642 - RNA, 19 nt, Homo sapiens
gaaguuagcucgguucaac

SEQ ID NO: 678643 - RNA, 19 nt, Homo sapiens
gaaacuggcacuugacuga

SEQ ID NO: 678644 - RNA, 19 nt, Homo sapiens
caccuuaucugaacauuug

SEQ ID NO: 678645 - RNA, 19 nt, Homo sapiens
ggugccaucucuccauuua

SEQ ID NO: 678646 - RNA, 19 nt, Homo sapiens
gcagucaucugaguuaguu

SEQ ID NO: 678647 - RNA, 19 nt, Homo sapiens
uagaagauguugccuuuau

SEQ ID NO: 678648 - RNA, 19 nt, Homo sapiens
aauagaagauguugccuuu

SEQ ID NO: 678649 - RNA, 19 nt, Homo sapiens
ggaaaacucccguugauua

SEQ ID NO: 678650 - RNA, 19 nt, Homo sapiens
ucagaagagugcucgguua

SEQ ID NO: 678651 - RNA, 19 nt, Homo sapiens
gcuccuaucucuugauguu

SEQ ID NO: 678652 - RNA, 19 nt, Homo sapiens
gccuauggcugaaacuaua

SEQ ID NO: 678653 - RNA, 19 nt, Homo sapiens
gaucaggucagaaaccaua

SEQ ID NO: 678654 - RNA, 19 nt, Homo sapiens
ccaaagaucuuagcaagca

SEQ ID NO: 678655 - RNA, 19 nt, Homo sapiens
gauaaaguacaucccaaua

SEQ ID NO: 678656 - RNA, 19 nt, Homo sapiens
caaccacucuuccuuaaag

SEQ ID NO: 678657 - RNA, 19 nt, Homo sapiens
guucaacgcccaugaguuu

SEQ ID NO: 678658 - RNA, 19 nt, Homo sapiens
ucacauacauccaaaagua

SEQ ID NO: 678659 - RNA, 19 nt, Homo sapiens
uaacccacuugccuuauuu

SEQ ID NO: 678660 - RNA, 19 nt, Homo sapiens
acgcagaacucuucagauu

SEQ ID NO: 678661 - RNA, 19 nt, Homo sapiens
ggaaugcaaauaguucuua

SEQ ID NO: 678662 - RNA, 19 nt, Homo sapiens
gagcagccucugagucuua

SEQ ID NO: 678663 - RNA, 19 nt, Homo sapiens
ugccaucucuccauuuaua

SEQ ID NO: 678664 - RNA, 19 nt, Homo sapiens
cgccauaucucccaaguga

SEQ ID NO: 678665 - RNA, 19 nt, Homo sapiens
gguaacguguuccuagaaa

SEQ ID NO: 678666 - RNA, 19 nt, Homo sapiens
cccaugagcuuuccaauag

SEQ ID NO: 678667 - RNA, 19 nt, Homo sapiens
gcuggaacaugcucagauu

SEQ ID NO: 678668 - RNA, 19 nt, Homo sapiens
guaauuauugugcccuuua

SEQ ID NO: 678669 - RNA, 19 nt, Homo sapiens
caugagcuuuccaauagua

SEQ ID NO: 678670 - RNA, 19 nt, Homo sapiens
ccucuaagcuccuuucaca

SEQ ID NO: 678671 - RNA, 19 nt, Homo sapiens
uaacaagccagaacucauu

SEQ ID NO: 678672 - RNA, 19 nt, Homo sapiens
ggaaacaggccacaaccaa

SEQ ID NO: 678673 - RNA, 19 nt, Homo sapiens
gcacauggauuccguaccu

SEQ ID NO: 678674 - RNA, 19 nt, Homo sapiens
cuuuauagcuugaccauau

SEQ ID NO: 678675 - RNA, 19 nt, Homo sapiens
gaaaagaaaucaccuacuc

SEQ ID NO: 678676 - RNA, 19 nt, Homo sapiens
gacaucaacuuucaagagu

SEQ ID NO: 678677 - RNA, 19 nt, Homo sapiens
aaggaaagauguaucguau

SEQ ID NO: 678678 - RNA, 19 nt, Homo sapiens
uugcuucucugaccacuua

SEQ ID NO: 678679 - RNA, 19 nt, Homo sapiens
ucacuaccaugaacuauag

SEQ ID NO: 678680 - RNA, 19 nt, Homo sapiens
ccuauuugcugguuuaguu

SEQ ID NO: 678681 - RNA, 19 nt, Homo sapiens
aaacauacaggagcucuua

SEQ ID NO: 678682 - RNA, 19 nt, Homo sapiens
cgaaagggacggcaaagaa

SEQ ID NO: 678683 - RNA, 19 nt, Homo sapiens
gcaaaucgcaccuuaucug

SEQ ID NO: 678684 - RNA, 19 nt, Homo sapiens
aagcauguauguagagaaa

SEQ ID NO: 678685 - RNA, 19 nt, Homo sapiens
gaacagcacaccugagagu

SEQ ID NO: 678686 - RNA, 19 nt, Homo sapiens
gcagacagcagccuggauu

SEQ ID NO: 678687 - RNA, 19 nt, Homo sapiens
guuugagacuguuaucuuu

SEQ ID NO: 678688 - RNA, 19 nt, Homo sapiens
gcagaggugcacuuuauga

SEQ ID NO: 678689 - RNA, 19 nt, Homo sapiens
gcaaacugguucugaguac

SEQ ID NO: 678690 - RNA, 19 nt, Homo sapiens
ccauggauguguacgauga

SEQ ID NO: 678691 - RNA, 19 nt, Homo sapiens
caauaaagcggaauucauc

SEQ ID NO: 678692 - RNA, 19 nt, Homo sapiens
gacaagaaaccuagauguu

SEQ ID NO: 678693 - RNA, 19 nt, Homo sapiens
aagagaagcaucagucuaa

SEQ ID NO: 678694 - RNA, 19 nt, Homo sapiens
ucauugacauucucaguga

SEQ ID NO: 678695 - RNA, 19 nt, Homo sapiens
ggacagacuagccuucuau

SEQ ID NO: 678696 - RNA, 19 nt, Homo sapiens
gacccugcgucuauuauga

SEQ ID NO: 678697 - RNA, 19 nt, Homo sapiens
gugcacggcuucucaagug

SEQ ID NO: 678698 - RNA, 19 nt, Homo sapiens
gaucaaacacagcauuuca

SEQ ID NO: 678699 - RNA, 19 nt, Homo sapiens
gcacaccuuuauagcuuga

SEQ ID NO: 678700 - RNA, 19 nt, Homo sapiens
aaagucagcuugcuucucu

SEQ ID NO: 678701 - RNA, 19 nt, Homo sapiens
gcacaucaccacccauugu

SEQ ID NO: 678702 - RNA, 19 nt, Homo sapiens
uauauucccugcucagaga

SEQ ID NO: 678703 - RNA, 19 nt, Homo sapiens
gaacagggaaucuugaaac

SEQ ID NO: 678704 - RNA, 19 nt, Homo sapiens
gaccauaugcugucaugaa

SEQ ID NO: 678705 - RNA, 19 nt, Homo sapiens
caacacugcuucagauggu

SEQ ID NO: 678706 - RNA, 19 nt, Homo sapiens
gugccuauuugcugguuua

SEQ ID NO: 678707 - RNA, 19 nt, Homo sapiens
gugacgagcugagaauuau

SEQ ID NO: 678708 - RNA, 19 nt, Homo sapiens
caagccaacuucuuucauc

SEQ ID NO: 678709 - RNA, 19 nt, Homo sapiens
gcaauaaacaggcucuaca

SEQ ID NO: 678710 - RNA, 19 nt, Homo sapiens
guuggcaaaucgcaccuua

SEQ ID NO: 678711 - RNA, 19 nt, Homo sapiens
uguagaggcuucugggaaa

SEQ ID NO: 678712 - RNA, 19 nt, Homo sapiens
ucacaugaguugcuucaca

SEQ ID NO: 678713 - RNA, 19 nt, Homo sapiens
guucauuucuucucagugu

SEQ ID NO: 678714 - RNA, 19 nt, Homo sapiens
gaaguugacaggcgagaga

SEQ ID NO: 678715 - RNA, 19 nt, Homo sapiens
uuuacaggcugaauuauug

SEQ ID NO: 678716 - RNA, 19 nt, Homo sapiens
aaacugagaugccuuuuau

SEQ ID NO: 678717 - RNA, 19 nt, Homo sapiens
uugaggaccugcaauagaa

SEQ ID NO: 678718 - RNA, 19 nt, Homo sapiens
gcaaccaauuugaacacuu

SEQ ID NO: 678719 - RNA, 19 nt, Homo sapiens
uaaggaaagauguaucgua

SEQ ID NO: 678720 - RNA, 19 nt, Homo sapiens
gagccuagauucagauuua

SEQ ID NO: 678721 - RNA, 19 nt, Homo sapiens
ggaaacagcuguaccucua

SEQ ID NO: 678722 - RNA, 19 nt, Homo sapiens
guugagaccuuguauaaua

SEQ ID NO: 678723 - RNA, 19 nt, Homo sapiens
ggacagcacuuuauaauac

SEQ ID NO: 678724 - RNA, 19 nt, Homo sapiens
gcagaacucuucagauuuc

SEQ ID NO: 678725 - RNA, 19 nt, Homo sapiens
ggaaaccacugcaagcaaa

SEQ ID NO: 678726 - RNA, 19 nt, Homo sapiens
guaagaauaugucagaaga

SEQ ID NO: 678727 - RNA, 19 nt, Homo sapiens
caacaaagcauuuccaguu

SEQ ID NO: 678728 - RNA, 19 nt, Homo sapiens
gggcagaggugcacuuuau

SEQ ID NO: 678729 - RNA, 19 nt, Homo sapiens
caaccaauuugaacacuuu

SEQ ID NO: 678730 - RNA, 19 nt, Homo sapiens
gaagaagacacaagaauca

SEQ ID NO: 678731 - RNA, 19 nt, Homo sapiens
gcacuugacugaacagaag

SEQ ID NO: 678732 - RNA, 19 nt, Homo sapiens
caaagcauuuccaguugua

SEQ ID NO: 678733 - RNA, 19 nt, Homo sapiens
uaacggugcuaacucuaua

SEQ ID NO: 678734 - RNA, 19 nt, Homo sapiens
uaaacaggcucuacaagug

SEQ ID NO: 678735 - RNA, 19 nt, Homo sapiens
aaacacagcauuucaugua

SEQ ID NO: 678736 - RNA, 19 nt, Homo sapiens
gcuaauaacuaagcuucua

SEQ ID NO: 678737 - RNA, 19 nt, Homo sapiens
caaguugccucaauacaug

SEQ ID NO: 678738 - RNA, 19 nt, Homo sapiens
ggaaagauguaucguaucg

SEQ ID NO: 678739 - RNA, 19 nt, Homo sapiens
ccuguuacauguucuguua

SEQ ID NO: 678740 - RNA, 19 nt, Homo sapiens
gaaguuagcucgguucaac

SEQ ID NO: 678741 - RNA, 19 nt, Homo sapiens
gaaacuggcacuugacuga

SEQ ID NO: 678742 - RNA, 19 nt, Homo sapiens
caccuuaucugaacauuug

SEQ ID NO: 678743 - RNA, 19 nt, Homo sapiens
ggugccaucucuccauuua

SEQ ID NO: 678744 - RNA, 19 nt, Homo sapiens
gcagucaucugaguuaguu

SEQ ID NO: 678745 - RNA, 19 nt, Homo sapiens
uagaagauguugccuuuau

SEQ ID NO: 678746 - RNA, 19 nt, Homo sapiens
aauagaagauguugccuuu

SEQ ID NO: 678747 - RNA, 19 nt, Homo sapiens
ggaaaacucccguugauua

SEQ ID NO: 678748 - RNA, 19 nt, Homo sapiens
ucagaagagugcucgguua

SEQ ID NO: 678749 - RNA, 19 nt, Homo sapiens
gcuccuaucucuugauguu

SEQ ID NO: 678750 - RNA, 19 nt, Homo sapiens
gccuauggcugaaacuaua

SEQ ID NO: 678751 - RNA, 19 nt, Homo sapiens
ccaaagaucuuagcaagca

SEQ ID NO: 678752 - RNA, 19 nt, Homo sapiens
gauaaaguacaucccaaua

SEQ ID NO: 678753 - RNA, 19 nt, Homo sapiens
guucaacgcccaugaguuu

SEQ ID NO: 678754 - RNA, 19 nt, Homo sapiens
ucacauacauccaaaagua

SEQ ID NO: 678755 - RNA, 19 nt, Homo sapiens
uaacccacuugccuuauuu

SEQ ID NO: 678756 - RNA, 19 nt, Homo sapiens
acgcagaacucuucagauu

SEQ ID NO: 678757 - RNA, 19 nt, Homo sapiens
ggaaugcaaauaguucuua

SEQ ID NO: 678758 - RNA, 19 nt, Homo sapiens
cgccauaucucccaaguga

SEQ ID NO: 678759 - RNA, 19 nt, Homo sapiens
gagcagccucugagucuua

SEQ ID NO: 678760 - RNA, 19 nt, Homo sapiens
ugccaucucuccauuuaua

SEQ ID NO: 678761 - RNA, 19 nt, Homo sapiens
gguaacguguuccuagaaa

SEQ ID NO: 678762 - RNA, 19 nt, Homo sapiens
cccaugagcuuuccaauag

SEQ ID NO: 678763 - RNA, 19 nt, Homo sapiens
gcuggaacaugcucagauu

SEQ ID NO: 678764 - RNA, 19 nt, Homo sapiens
guaauuauugugcccuuua

SEQ ID NO: 678765 - RNA, 19 nt, Homo sapiens
caugagcuuuccaauagua

SEQ ID NO: 678766 - RNA, 19 nt, Homo sapiens
ccucuaagcuccuuucaca

SEQ ID NO: 678767 - RNA, 19 nt, Homo sapiens
uaacaagccagaacucauu

SEQ ID NO: 678768 - RNA, 19 nt, Homo sapiens
gcacauggauuccguaccu

SEQ ID NO: 678769 - RNA, 19 nt, Homo sapiens
cuuuauagcuugaccauau

SEQ ID NO: 678770 - RNA, 19 nt, Homo sapiens
gaaaagaaaucaccuacuc

SEQ ID NO: 678771 - RNA, 19 nt, Homo sapiens
gacaucaacuuucaagagu

SEQ ID NO: 678772 - RNA, 19 nt, Homo sapiens
aaggaaagauguaucguau

SEQ ID NO: 678773 - RNA, 19 nt, Homo sapiens
uugcuucucugaccacuua

SEQ ID NO: 678774 - RNA, 19 nt, Homo sapiens
ucacuaccaugaacuauag

SEQ ID NO: 678775 - RNA, 19 nt, Homo sapiens
ccuauuugcugguuuaguu

SEQ ID NO: 678776 - RNA, 19 nt, Homo sapiens
aaacauacaggagcucuua

SEQ ID NO: 678777 - RNA, 19 nt, Homo sapiens
cgaaagggacggcaaagaa

SEQ ID NO: 678778 - RNA, 19 nt, Homo sapiens
gcaaaucgcaccuuaucug

SEQ ID NO: 678779 - RNA, 19 nt, Homo sapiens
aagcauguauguagagaaa

SEQ ID NO: 678780 - RNA, 19 nt, Homo sapiens
gaacagcacaccugagagu

SEQ ID NO: 678781 - RNA, 19 nt, Homo sapiens
gcagacagcagccuggauu

SEQ ID NO: 678782 - RNA, 19 nt, Homo sapiens
guuugagacuguuaucuuu

SEQ ID NO: 678783 - RNA, 19 nt, Homo sapiens
gcagaggugcacuuuauga

SEQ ID NO: 678784 - RNA, 19 nt, Homo sapiens
ccauggauguguacgauga

SEQ ID NO: 678785 - RNA, 19 nt, Homo sapiens
caauaaagcggaauucauc

SEQ ID NO: 678786 - RNA, 19 nt, Homo sapiens
gacaagaaaccuagauguu

SEQ ID NO: 678787 - RNA, 19 nt, Homo sapiens
aagagaagcaucagucuaa

SEQ ID NO: 678788 - RNA, 19 nt, Homo sapiens
ucauugacauucucaguga

SEQ ID NO: 678789 - RNA, 19 nt, Homo sapiens
ggacagacuagccuucuau

SEQ ID NO: 678790 - RNA, 19 nt, Homo sapiens
gacccugcgucuauuauga

SEQ ID NO: 678791 - RNA, 19 nt, Homo sapiens
gugcacggcuucucaagug

SEQ ID NO: 678792 - RNA, 19 nt, Homo sapiens
gaucaaacacagcauuuca

SEQ ID NO: 678793 - RNA, 19 nt, Homo sapiens
gcacaccuuuauagcuuga

SEQ ID NO: 678794 - RNA, 19 nt, Homo sapiens
aaagucagcuugcuucucu

SEQ ID NO: 678795 - RNA, 19 nt, Homo sapiens
gcacaucaccacccauugu

SEQ ID NO: 678796 - RNA, 19 nt, Homo sapiens
uauauucccugcucagaga

SEQ ID NO: 678797 - RNA, 19 nt, Homo sapiens
gaacagggaaucuugaaac

SEQ ID NO: 678798 - RNA, 19 nt, Homo sapiens
gaccauaugcugucaugaa

SEQ ID NO: 678799 - RNA, 19 nt, Homo sapiens
caacacugcuucagauggu

SEQ ID NO: 678800 - RNA, 19 nt, Homo sapiens
gugccuauuugcugguuua

SEQ ID NO: 678801 - RNA, 19 nt, Homo sapiens
caagccaacuucuuucauc

SEQ ID NO: 678802 - RNA, 19 nt, Homo sapiens
gcaauaaacaggcucuaca

SEQ ID NO: 678803 - RNA, 19 nt, Homo sapiens
guuggcaaaucgcaccuua

SEQ ID NO: 678804 - RNA, 19 nt, Homo sapiens
uguagaggcuucugggaaa

SEQ ID NO: 678805 - RNA, 19 nt, Homo sapiens
ucacaugaguugcuucaca

SEQ ID NO: 678806 - RNA, 19 nt, Homo sapiens
guucauuucuucucagugu

SEQ ID NO: 678807 - RNA, 19 nt, Homo sapiens
gaaguugacaggcgagaga

SEQ ID NO: 678808 - RNA, 19 nt, Homo sapiens
uuuacaggcugaauuauug

SEQ ID NO: 678809 - RNA, 19 nt, Homo sapiens
aaacugagaugccuuuuau

SEQ ID NO: 678810 - RNA, 19 nt, Homo sapiens
uugaggaccugcaauagaa

SEQ ID NO: 678811 - RNA, 19 nt, Homo sapiens
gcaaccaauuugaacacuu

SEQ ID NO: 678812 - RNA, 19 nt, Homo sapiens
uaaggaaagauguaucgua

SEQ ID NO: 678813 - RNA, 19 nt, Homo sapiens
uuacagcuuucucacauga

SEQ ID NO: 678814 - RNA, 19 nt, Homo sapiens
ccaaagagaacaacaacug

SEQ ID NO: 678815 - RNA, 19 nt, Homo sapiens
gaaacagcuguaccucuaa

SEQ ID NO: 678816 - RNA, 19 nt, Homo sapiens
gaggugcacuuuaugaaac

SEQ ID NO: 678817 - RNA, 19 nt, Homo sapiens
uaauaacggugcuaacucu

SEQ ID NO: 678818 - RNA, 19 nt, Homo sapiens
ugaauuuccuggccuacuu

SEQ ID NO: 678819 - RNA, 19 nt, Homo sapiens
caggaagacugaacagauc

SEQ ID NO: 678820 - RNA, 19 nt, Homo sapiens
gaaaguaacuccuaacauu

SEQ ID NO: 678821 - RNA, 19 nt, Homo sapiens
gagccuagauucagauuua

SEQ ID NO: 678822 - RNA, 19 nt, Homo sapiens
guugagaccuuguauaaua

SEQ ID NO: 678823 - RNA, 19 nt, Homo sapiens
ggacagcacuuuauaauac

SEQ ID NO: 678824 - RNA, 19 nt, Homo sapiens
gauuggugcuuucuaaaua

SEQ ID NO: 678825 - RNA, 19 nt, Homo sapiens
ggaaaccacugcaagcaaa

SEQ ID NO: 678826 - RNA, 19 nt, Homo sapiens
gaaggugaauaacaacuug

SEQ ID NO: 678827 - RNA, 19 nt, Homo sapiens
gaauguccauggaagauga

SEQ ID NO: 678828 - RNA, 19 nt, Homo sapiens
guagacagcugaacucaca

SEQ ID NO: 678829 - RNA, 19 nt, Homo sapiens
uaacggugcuaacucuaua

SEQ ID NO: 678830 - RNA, 19 nt, Homo sapiens
gaaguuagcucgguucaac

SEQ ID NO: 678831 - RNA, 19 nt, Homo sapiens
ggaaaacucccguugauua

SEQ ID NO: 678832 - RNA, 19 nt, Homo sapiens
ggagagaaaggccaaauau

SEQ ID NO: 678833 - RNA, 19 nt, Homo sapiens
ccaaagaucuuagcaagca

SEQ ID NO: 678834 - RNA, 19 nt, Homo sapiens
gauaaaguacaucccaaua

SEQ ID NO: 678835 - RNA, 19 nt, Homo sapiens
gaauggacguggugaaugg

SEQ ID NO: 678836 - RNA, 19 nt, Homo sapiens
ggaaggacccugcgcagaa

SEQ ID NO: 678837 - RNA, 19 nt, Homo sapiens
guucaacgcccaugaguuu

SEQ ID NO: 678838 - RNA, 19 nt, Homo sapiens
cgccauaucucccaaguga

SEQ ID NO: 678839 - RNA, 19 nt, Homo sapiens
gccgaaagaugaucacuca

SEQ ID NO: 678840 - RNA, 19 nt, Homo sapiens
ugaauggguuugcuacuga

SEQ ID NO: 678841 - RNA, 19 nt, Homo sapiens
acagauuggugcuuucuaa

SEQ ID NO: 678842 - RNA, 19 nt, Homo sapiens
ccauggauauguacgauga

SEQ ID NO: 678843 - RNA, 19 nt, Homo sapiens
gaaggacccugcgcagaau

SEQ ID NO: 678844 - RNA, 19 nt, Homo sapiens
caacuacuauugguguauu

SEQ ID NO: 678845 - RNA, 19 nt, Homo sapiens
gcgaagaugucaauuccau

SEQ ID NO: 678846 - RNA, 19 nt, Homo sapiens
gaagaacuugccauggaua

SEQ ID NO: 678847 - RNA, 19 nt, Homo sapiens
gcagacagcagccuggauu

SEQ ID NO: 678848 - RNA, 19 nt, Homo sapiens
guuugagacuguuaucuuu

SEQ ID NO: 678849 - RNA, 19 nt, Homo sapiens
acacccagcuuauagaaug

SEQ ID NO: 678850 - RNA, 19 nt, Homo sapiens
ggaauuuggucagauuuua

SEQ ID NO: 678851 - RNA, 19 nt, Homo sapiens
gaagaggagcaacuacuau

SEQ ID NO: 678852 - RNA, 19 nt, Homo sapiens
caauaaagcggaauucauc

SEQ ID NO: 678853 - RNA, 19 nt, Homo sapiens
gaagaugucaauuccauag

SEQ ID NO: 678854 - RNA, 19 nt, Homo sapiens
agagaaaggccaaauauuc

SEQ ID NO: 678855 - RNA, 19 nt, Homo sapiens
gagagaaaggccaaauauu

SEQ ID NO: 678856 - RNA, 19 nt, Homo sapiens
ucauugacauucucaguga

SEQ ID NO: 678857 - RNA, 19 nt, Homo sapiens
ggacagacuagccuucuau

SEQ ID NO: 678858 - RNA, 19 nt, Homo sapiens
gacccugcgucuauuauga

SEQ ID NO: 678859 - RNA, 19 nt, Homo sapiens
ggauauguacgaugaaguu

SEQ ID NO: 678860 - RNA, 19 nt, Homo sapiens
gaacuugccauggauaugu

SEQ ID NO: 678861 - RNA, 19 nt, Homo sapiens
gaacagggaaucuugaaac

SEQ ID NO: 678862 - RNA, 19 nt, Homo sapiens
aucaauagguuuccaguuu

SEQ ID NO: 678863 - RNA, 19 nt, Homo sapiens
gugacgagcugagaauuau

SEQ ID NO: 678864 - RNA, 19 nt, Homo sapiens
caagccaacuucuuucauc

SEQ ID NO: 678865 - RNA, 19 nt, Homo sapiens
caacacugcuucagauggu

SEQ ID NO: 678866 - RNA, 19 nt, Homo sapiens
gaaguugacaggcgagaga

SEQ ID NO: 678867 - RNA, 19 nt, Homo sapiens
uuuacaggcugaauuauug

SEQ ID NO: 678868 - RNA, 19 nt, Homo sapiens
gcagaagagccuagauuca

SEQ ID NO: 678869 - RNA, 19 nt, Homo sapiens
gcagagcgccucguggaaa

SEQ ID NO: 678870 - RNA, 19 nt, Homo sapiens
uaauaacggugcuaacucu

SEQ ID NO: 678871 - RNA, 19 nt, Homo sapiens
gaauggguuugcuacugaa

SEQ ID NO: 678872 - RNA, 19 nt, Homo sapiens
gaagacacagauuuggaaa

SEQ ID NO: 678873 - RNA, 19 nt, Homo sapiens
caggaaaccagaucacaaa

SEQ ID NO: 678874 - RNA, 19 nt, Homo sapiens
gcaggaaaccagaucacaa

SEQ ID NO: 678875 - RNA, 19 nt, Homo sapiens
ugaauaacaacuugaguga

SEQ ID NO: 678876 - RNA, 19 nt, Homo sapiens
agaagagccuagauucaga

SEQ ID NO: 678877 - RNA, 19 nt, Homo sapiens
gaaaucagggcagacagaa

SEQ ID NO: 678878 - RNA, 19 nt, Homo sapiens
uuccauagaucaauagguu

SEQ ID NO: 678879 - RNA, 19 nt, Homo sapiens
cguggugaaugguguuuaa

SEQ ID NO: 678880 - RNA, 19 nt, Homo sapiens
uugaagaacuugccaugga

SEQ ID NO: 678881 - RNA, 19 nt, Homo sapiens
gcugaauuguuuggaauau

SEQ ID NO: 678882 - RNA, 19 nt, Homo sapiens
ucacaccacacccagcuua

SEQ ID NO: 678883 - RNA, 19 nt, Homo sapiens
agacuagccuucuaucucu

SEQ ID NO: 678884 - RNA, 19 nt, Homo sapiens
gcacaagccaacuucuuuc

SEQ ID NO: 678885 - RNA, 19 nt, Homo sapiens
cagauuagcauguucaaag

SEQ ID NO: 678886 - RNA, 19 nt, Homo sapiens
gccaaagaguaacacgauu

SEQ ID NO: 678887 - RNA, 19 nt, Homo sapiens
ugaagaggagcaacuacua

SEQ ID NO: 678888 - RNA, 19 nt, Homo sapiens
gagaacagggaaucuugaa

SEQ ID NO: 678889 - RNA, 19 nt, Homo sapiens
gaugucaauuccauagauc

SEQ ID NO: 678890 - RNA, 19 nt, Homo sapiens
gcugagaauuaugcagaaa

SEQ ID NO: 678891 - RNA, 19 nt, Homo sapiens
aaacaaaccggcagaagag

SEQ ID NO: 678892 - RNA, 19 nt, Homo sapiens
cgaagacacagauuuggaa

SEQ ID NO: 678893 - RNA, 19 nt, Homo sapiens
ugaagaacuugccauggau

SEQ ID NO: 678894 - RNA, 19 nt, Homo sapiens
uuuacaaagugcugaauug

SEQ ID NO: 678895 - RNA, 19 nt, Homo sapiens
ccaggcagauuagcauguu

SEQ ID NO: 678896 - RNA, 19 nt, Homo sapiens
ccaagugacagucucuaaa

SEQ ID NO: 678897 - RNA, 19 nt, Homo sapiens
caagauacagcagcuaaug

SEQ ID NO: 678898 - RNA, 19 nt, Homo sapiens
agacgaagacacagauuug

SEQ ID NO: 678899 - RNA, 19 nt, Homo sapiens
guaaauaggggaacguuuu

SEQ ID NO: 678900 - RNA, 19 nt, Homo sapiens
gagcacaagccaacuucuu

SEQ ID NO: 678901 - RNA, 19 nt, Homo sapiens
aaaguaacuccuaacauug

SEQ ID NO: 678902 - RNA, 19 nt, Homo sapiens
ggcaaaagcugcuaagaag

SEQ ID NO: 678903 - RNA, 19 nt, Homo sapiens
aaauggacagcacuuuaua

SEQ ID NO: 678904 - RNA, 19 nt, Homo sapiens
gccaagauacagcagcuaa

SEQ ID NO: 678905 - RNA, 19 nt, Homo sapiens
ggagacagcagggcaguuc

SEQ ID NO: 678906 - RNA, 19 nt, Homo sapiens
gugcugaauuguuuggaau

SEQ ID NO: 678907 - RNA, 19 nt, Homo sapiens
ccaaagaguaacacgauuc

SEQ ID NO: 678908 - RNA, 19 nt, Homo sapiens
acaguugcuuguggacuua

SEQ ID NO: 678909 - RNA, 19 nt, Homo sapiens
ugguugagaccuuguauaa

SEQ ID NO: 678910 - RNA, 19 nt, Homo sapiens
gauguuagcguucguccau

SEQ ID NO: 678911 - RNA, 19 nt, Homo sapiens
agccaaguaucagauguua

SEQ ID NO: 678912 - RNA, 19 nt, Homo sapiens
gcugaccccuuaacucuaa

SEQ ID NO: 678913 - RNA, 19 nt, Homo sapiens
gaugaaggcgcaccagaag

SEQ ID NO: 678914 - RNA, 19 nt, Homo sapiens
uagcaaacuuaccaugauc

SEQ ID NO: 678915 - RNA, 19 nt, Homo sapiens
uauagcaaacuuaccauga

SEQ ID NO: 678916 - RNA, 19 nt, Homo sapiens
gagaaaggccaaauauucc

SEQ ID NO: 678917 - RNA, 19 nt, Homo sapiens
ucaaagcugacaccacuga

SEQ ID NO: 678918 - RNA, 19 nt, Homo sapiens
cagagcgccucguggaaau

SEQ ID NO: 678919 - RNA, 19 nt, Homo sapiens
gcaaggagggcaccaugag

SEQ ID NO: 678920 - RNA, 19 nt, Homo sapiens
ugaaagagcuggagaauga

SEQ ID NO: 678921 - RNA, 19 nt, Homo sapiens
ggaagaagauagagaaguu

SEQ ID NO: 678922 - RNA, 19 nt, Homo sapiens
uuaaggagcucuauaauga

SEQ ID NO: 678923 - RNA, 19 nt, Homo sapiens
gaaggaagauauuguugaa

SEQ ID NO: 678924 - RNA, 19 nt, Homo sapiens
caacaucgcugccgacaga

SEQ ID NO: 678925 - RNA, 19 nt, Homo sapiens
ggaagugauuucugccuua

SEQ ID NO: 678926 - RNA, 19 nt, Homo sapiens
gaaaccagcuucucugcuu

SEQ ID NO: 678927 - RNA, 19 nt, Homo sapiens
cgacauggcccugaaauua

SEQ ID NO: 678928 - RNA, 19 nt, Homo sapiens
gggaugagauuaauucaau

SEQ ID NO: 678929 - RNA, 19 nt, Homo sapiens
gcaaagcccuguccacauc

SEQ ID NO: 678930 - RNA, 19 nt, Homo sapiens
ggaaugagagacaucuuua

SEQ ID NO: 678931 - RNA, 19 nt, Homo sapiens
guacugaccucauuguuca

SEQ ID NO: 678932 - RNA, 19 nt, Homo sapiens
gaugcugccuuuauuauug

SEQ ID NO: 678933 - RNA, 19 nt, Homo sapiens
gaggagaaauugcccagaa

SEQ ID NO: 678934 - RNA, 19 nt, Homo sapiens
uaaguaugcuuucugaaga

SEQ ID NO: 678935 - RNA, 19 nt, Homo sapiens
guacaugggcguauaauuc

SEQ ID NO: 678936 - RNA, 19 nt, Homo sapiens
gagaugcagucccuucauu

SEQ ID NO: 678937 - RNA, 19 nt, Homo sapiens
uggcugagcugcugauaaa

SEQ ID NO: 678938 - RNA, 19 nt, Homo sapiens
ugagagacaucuuuaagga

SEQ ID NO: 678939 - RNA, 19 nt, Homo sapiens
ccuaucaugugcauuauuu

SEQ ID NO: 678940 - RNA, 19 nt, Homo sapiens
gaaguauucuugaaauguc

SEQ ID NO: 678941 - RNA, 19 nt, Homo sapiens
auucagcccuguuuaaaua

SEQ ID NO: 678942 - RNA, 19 nt, Homo sapiens
guaguagguuccuuauuga

SEQ ID NO: 678943 - RNA, 19 nt, Homo sapiens
guagcuaaauuggaucaua

SEQ ID NO: 678944 - RNA, 19 nt, Homo sapiens
gauaaaccaugcacaagca

SEQ ID NO: 678945 - RNA, 19 nt, Homo sapiens
uguauaagcucuuucuaga

SEQ ID NO: 678946 - RNA, 19 nt, Homo sapiens
ggaauuccuccaagugaua

SEQ ID NO: 678947 - RNA, 19 nt, Homo sapiens
aguaguagguuccuuauug

SEQ ID NO: 678948 - RNA, 19 nt, Homo sapiens
gaaccuagaggagaaauug

SEQ ID NO: 678949 - RNA, 19 nt, Homo sapiens
gaggugcgaugcugccuuu

SEQ ID NO: 678950 - RNA, 19 nt, Homo sapiens
gcaggucggugacguuuag

SEQ ID NO: 678951 - RNA, 19 nt, Homo sapiens
cuacugaacugcccacuca

SEQ ID NO: 678952 - RNA, 19 nt, Homo sapiens
ggacuuuaaugcaaacuag

SEQ ID NO: 678953 - RNA, 19 nt, Homo sapiens
gcagagugaugccgacaug

SEQ ID NO: 678954 - RNA, 19 nt, Homo sapiens
ucaguggccuugcuguaua

SEQ ID NO: 678955 - RNA, 19 nt, Homo sapiens
caaguaacaugggaaguau

SEQ ID NO: 678956 - RNA, 19 nt, Homo sapiens
uaacagaguuucgaaccaa

SEQ ID NO: 678957 - RNA, 19 nt, Homo sapiens
uccaaagccuuccuucaua

SEQ ID NO: 678958 - RNA, 19 nt, Homo sapiens
gaaggagccauccaaaguu

SEQ ID NO: 678959 - RNA, 19 nt, Homo sapiens
ggacaaaggaagcauagau

SEQ ID NO: 678960 - RNA, 19 nt, Homo sapiens
caguucagcucucuuggua

SEQ ID NO: 678961 - RNA, 19 nt, Homo sapiens
gcacgccucugcccauugu

SEQ ID NO: 678962 - RNA, 19 nt, Homo sapiens
auacuugccuuucaaauuc

SEQ ID NO: 678963 - RNA, 19 nt, Homo sapiens
guagcugaguucucucuuu

SEQ ID NO: 678964 - RNA, 19 nt, Homo sapiens
gaagaagucagggaaaguu

SEQ ID NO: 678965 - RNA, 19 nt, Homo sapiens
gaaaauccuuugggguuua

SEQ ID NO: 678966 - RNA, 19 nt, Homo sapiens
gagaaugaaagacuuaaga

SEQ ID NO: 678967 - RNA, 19 nt, Homo sapiens
gaaaagauauacggccuaa

SEQ ID NO: 678968 - RNA, 19 nt, Homo sapiens
gaaggacaaaggaagcaua

SEQ ID NO: 678969 - RNA, 19 nt, Homo sapiens
ccagauagucacagcuuua

SEQ ID NO: 678970 - RNA, 19 nt, Homo sapiens
ggacgcugcucucccaugu

SEQ ID NO: 678971 - RNA, 19 nt, Homo sapiens
uauagaaccuagaggagaa

SEQ ID NO: 678972 - RNA, 19 nt, Homo sapiens
gcacgaagaggcucaguuc

SEQ ID NO: 678973 - RNA, 19 nt, Homo sapiens
gaacugaaggaagauauug

SEQ ID NO: 678974 - RNA, 19 nt, Homo sapiens
gcuaguaguagguuccuua

SEQ ID NO: 678975 - RNA, 19 nt, Homo sapiens
agaaauugcccagaacuua

SEQ ID NO: 678976 - RNA, 19 nt, Homo sapiens
guggaucgaugccgaggua

SEQ ID NO: 678977 - RNA, 19 nt, Homo sapiens
gcacuggaaacuacauaaa

SEQ ID NO: 678978 - RNA, 19 nt, Homo sapiens
ccacaaggccaaacaugaa

SEQ ID NO: 678979 - RNA, 19 nt, Homo sapiens
gaaugagagacaucuuuaa

SEQ ID NO: 678980 - RNA, 19 nt, Homo sapiens
ccugggaccuuuccucaaa

SEQ ID NO: 678981 - RNA, 19 nt, Homo sapiens
ggacucacauacccuguag

SEQ ID NO: 678982 - RNA, 19 nt, Homo sapiens
gugcgaugcugccuuuauu

SEQ ID NO: 678983 - RNA, 19 nt, Homo sapiens
aaacaucugugcuguccuu

SEQ ID NO: 678984 - RNA, 19 nt, Homo sapiens
ggucgggccugucuuagau

SEQ ID NO: 678985 - RNA, 19 nt, Homo sapiens
caacaacaauaucuacaac

SEQ ID NO: 678986 - RNA, 19 nt, Homo sapiens
ccacagagcuuuugguugu

SEQ ID NO: 678987 - RNA, 19 nt, Homo sapiens
gacgcuauguucaguuuga

SEQ ID NO: 678988 - RNA, 19 nt, Homo sapiens
guuccagucuuuagucuug

SEQ ID NO: 678989 - RNA, 19 nt, Homo sapiens
gggaaguauucuugaaaug

SEQ ID NO: 678990 - RNA, 19 nt, Homo sapiens
gcaauagaauccugaaaau

SEQ ID NO: 678991 - RNA, 19 nt, Homo sapiens
gaaugaaagacuuaagaug

SEQ ID NO: 678992 - RNA, 19 nt, Homo sapiens
ggagcucuauaaugacuau

SEQ ID NO: 678993 - RNA, 19 nt, Homo sapiens
uagaggagcuaaugcagau

SEQ ID NO: 678994 - RNA, 19 nt, Homo sapiens
ccaaagccuuccuucauag

SEQ ID NO: 678995 - RNA, 19 nt, Homo sapiens
ugcagaaucuccucaagaa

SEQ ID NO: 678996 - RNA, 19 nt, Homo sapiens
ggaaguauucuugaaaugu

SEQ ID NO: 678997 - RNA, 19 nt, Homo sapiens
ucaaguaacaugggaagua

SEQ ID NO: 678998 - RNA, 19 nt, Homo sapiens
gauguucuaauucguagua

SEQ ID NO: 678999 - RNA, 19 nt, Homo sapiens
ggagagaaagcaagucugu

SEQ ID NO: 679000 - RNA, 19 nt, Homo sapiens
guagcacacuggcacuuga

SEQ ID NO: 679001 - RNA, 19 nt, Homo sapiens
ugaagccgcuggaguaugg

SEQ ID NO: 679002 - RNA, 19 nt, Homo sapiens
gaagaagauagagaaguuu

SEQ ID NO: 679003 - RNA, 19 nt, Homo sapiens
aaacacagcauuggaagaa

SEQ ID NO: 679004 - RNA, 19 nt, Homo sapiens
uaaacucaguggccaacaa

SEQ ID NO: 679005 - RNA, 19 nt, Homo sapiens
gggaaugagagacaucuuu

SEQ ID NO: 679006 - RNA, 19 nt, Homo sapiens
aaggagccauccaaaguuu

SEQ ID NO: 679007 - RNA, 19 nt, Homo sapiens
ggagaaguuccagucuuua

SEQ ID NO: 679008 - RNA, 19 nt, Homo sapiens
cagaaucuccucaagaaug

SEQ ID NO: 679009 - RNA, 19 nt, Homo sapiens
cgucuuggcucagugguuu

SEQ ID NO: 679010 - RNA, 19 nt, Homo sapiens
ugaggaguuugcuguguuu

SEQ ID NO: 679011 - RNA, 19 nt, Homo sapiens
gauagucacagcuuuaaca

SEQ ID NO: 679012 - RNA, 19 nt, Homo sapiens
gcauacaucacacuggaaa

SEQ ID NO: 679013 - RNA, 19 nt, Homo sapiens
ucagcucucuugguacaua

SEQ ID NO: 679014 - RNA, 19 nt, Homo sapiens
ggacaucaggagucagauu

SEQ ID NO: 679015 - RNA, 19 nt, Homo sapiens
guagguuccuuauugagau

SEQ ID NO: 679016 - RNA, 19 nt, Homo sapiens
gaaauugcccagaacuuac

SEQ ID NO: 679017 - RNA, 19 nt, Homo sapiens
gaagauagagaaguuuaca

SEQ ID NO: 679018 - RNA, 19 nt, Homo sapiens
gaagucagggaaaguuaga

SEQ ID NO: 679019 - RNA, 19 nt, Homo sapiens
ucagcccuguuuaaauaua

SEQ ID NO: 679020 - RNA, 19 nt, Homo sapiens
ggacaaaccgccuuaauuc

SEQ ID NO: 679021 - RNA, 19 nt, Homo sapiens
caacuucgcugagcagauu

SEQ ID NO: 679022 - RNA, 19 nt, Homo sapiens
cagcagaacuguaccuguu

SEQ ID NO: 679023 - RNA, 19 nt, Homo sapiens
ucagcuaccuggaggcuua

SEQ ID NO: 679024 - RNA, 19 nt, Homo sapiens
gcagaacuguaccuguuga

SEQ ID NO: 679025 - RNA, 19 nt, Homo sapiens
ggaugggccuguacauaga

SEQ ID NO: 679026 - RNA, 19 nt, Homo sapiens
aaacagagacguggacuuu

SEQ ID NO: 679027 - RNA, 19 nt, Homo sapiens
gggcguggcuguccucaau

SEQ ID NO: 679028 - RNA, 19 nt, Homo sapiens
gauaaguaacccuguaauu

SEQ ID NO: 679029 - RNA, 19 nt, Homo sapiens
ccaggaugccucaguguua

SEQ ID NO: 679030 - RNA, 19 nt, Homo sapiens
aaagacagcacugcaaaua

SEQ ID NO: 679031 - RNA, 19 nt, Homo sapiens
gaguacaucuacaugcauu

SEQ ID NO: 679032 - RNA, 19 nt, Homo sapiens
gggacaaaccgccuuaauu

SEQ ID NO: 679033 - RNA, 19 nt, Homo sapiens
gcuacgauguggaaacaga

SEQ ID NO: 679034 - RNA, 19 nt, Homo sapiens
ggagcgaggugacccgaau

SEQ ID NO: 679035 - RNA, 19 nt, Homo sapiens
guugauaaguaacccugua

SEQ ID NO: 679036 - RNA, 19 nt, Homo sapiens
cgaaugaucacagcaauga

SEQ ID NO: 679037 - RNA, 19 nt, Homo sapiens
uuaauucagcugaguguua

SEQ ID NO: 679038 - RNA, 19 nt, Homo sapiens
caggaugccucaguguuaa

SEQ ID NO: 679039 - RNA, 19 nt, Homo sapiens
gggaguacaucuacaugca

SEQ ID NO: 679040 - RNA, 19 nt, Homo sapiens
agacagcacugcaaauaac

SEQ ID NO: 679041 - RNA, 19 nt, Homo sapiens
gcuacacccuggaggauca

SEQ ID NO: 679042 - RNA, 19 nt, Homo sapiens
gcacaacuguaucuaugcu

SEQ ID NO: 679043 - RNA, 19 nt, Homo sapiens
gggaugggccuguacauag

SEQ ID NO: 679044 - RNA, 19 nt, Homo sapiens
uggacaguguggaguguua

SEQ ID NO: 679045 - RNA, 19 nt, Homo sapiens
gaaaagacagcacugcaaa

SEQ ID NO: 679046 - RNA, 19 nt, Homo sapiens
gagaaucuacguccuugga

SEQ ID NO: 679047 - RNA, 19 nt, Homo sapiens
acaacaguguggagaggua

SEQ ID NO: 679048 - RNA, 19 nt, Homo sapiens
ucacacugcaggucaagua

SEQ ID NO: 679049 - RNA, 19 nt, Homo sapiens
gcgcuacgauguggaaaca

SEQ ID NO: 679050 - RNA, 19 nt, Homo sapiens
ucacagcaaugaacaccau

SEQ ID NO: 679051 - RNA, 19 nt, Homo sapiens
ggucauggagcgccucauu

SEQ ID NO: 679052 - RNA, 19 nt, Homo sapiens
ucaaggccauguucaccaa

SEQ ID NO: 679053 - RNA, 19 nt, Homo sapiens
cugcacaacuguaucuaug

SEQ ID NO: 679054 - RNA, 19 nt, Homo sapiens
gaacgaguggcgaaugauc

SEQ ID NO: 679055 - RNA, 19 nt, Homo sapiens
ucaacugggucaaguacga

SEQ ID NO: 679056 - RNA, 19 nt, Homo sapiens
gagguggugguguugcuua

SEQ ID NO: 679057 - RNA, 19 nt, Homo sapiens
gacaaaccgccuuaauuca

SEQ ID NO: 679058 - RNA, 19 nt, Homo sapiens
guccaaagcgggaaucaug

SEQ ID NO: 679059 - RNA, 19 nt, Homo sapiens
uggagcgccucauugaauu

SEQ ID NO: 679060 - RNA, 19 nt, Homo sapiens
gcaggccuuuggcaucaug

SEQ ID NO: 679061 - RNA, 19 nt, Homo sapiens
ucauggagcgccucauuga

SEQ ID NO: 679062 - RNA, 19 nt, Homo sapiens
uaaagaacagacuaacuag

SEQ ID NO: 679063 - RNA, 19 nt, Homo sapiens
gcuaugauggucacacguu

SEQ ID NO: 679064 - RNA, 19 nt, Homo sapiens
ggacaguuauuuuguugau

SEQ ID NO: 679065 - RNA, 19 nt, Homo sapiens
gaggugacccgaaugacau

SEQ ID NO: 679066 - RNA, 19 nt, Homo sapiens
ugccagagguggugguguu

SEQ ID NO: 679067 - RNA, 19 nt, Homo sapiens
gaaacagagacguggacuu

SEQ ID NO: 679068 - RNA, 19 nt, Homo sapiens
aggaacgaguggcgaauga

SEQ ID NO: 679069 - RNA, 19 nt, Homo sapiens
uaauucagcugaguguuac

SEQ ID NO: 679070 - RNA, 19 nt, Homo sapiens
aagcaggccuuuggcauca

SEQ ID NO: 679071 - RNA, 19 nt, Homo sapiens
gcaucaacugggucaagua

SEQ ID NO: 679072 - RNA, 19 nt, Homo sapiens
gaguguuacuacccagaga

SEQ ID NO: 679073 - RNA, 19 nt, Homo sapiens
gauuggcuguguggaguug

SEQ ID NO: 679074 - RNA, 19 nt, Homo sapiens
caugugauuuauucuugga

SEQ ID NO: 679075 - RNA, 19 nt, Homo sapiens
aggacuaccuggucaagau

SEQ ID NO: 679076 - RNA, 19 nt, Homo sapiens
caacuggugacccucauca

SEQ ID NO: 679077 - RNA, 19 nt, Homo sapiens
gauggacaguuauuuuguu

SEQ ID NO: 679078 - RNA, 19 nt, Homo sapiens
acagagacguggacuuucg

SEQ ID NO: 679079 - RNA, 19 nt, Homo sapiens
gcaaccgcaccuucagcua

SEQ ID NO: 679080 - RNA, 19 nt, Homo sapiens
cggcagcugucaccaugug

SEQ ID NO: 679081 - RNA, 19 nt, Homo sapiens
aagacagcacugcaaauaa

SEQ ID NO: 679082 - RNA, 19 nt, Homo sapiens
cuacguccuuggaggcuau

SEQ ID NO: 679083 - RNA, 19 nt, Homo sapiens
ggcgaaugaucacagcaau

SEQ ID NO: 679084 - RNA, 19 nt, Homo sapiens
ggagcgcuacgauguggaa

SEQ ID NO: 679085 - RNA, 19 nt, Homo sapiens
accaugugauuuauucuug

SEQ ID NO: 679086 - RNA, 19 nt, Homo sapiens
guggugguguugcuuaucu

SEQ ID NO: 679087 - RNA, 19 nt, Homo sapiens
gcaaggacuaccuggucaa

SEQ ID NO: 679088 - RNA, 19 nt, Homo sapiens
ugauguacgccuccacuga

SEQ ID NO: 679089 - RNA, 19 nt, Homo sapiens
gacgggacaaaccgccuua

SEQ ID NO: 679090 - RNA, 19 nt, Homo sapiens
ccaaagcgggaaucaugug

SEQ ID NO: 679091 - RNA, 19 nt, Homo sapiens
cgaggugacccgaaugaca

SEQ ID NO: 679092 - RNA, 19 nt, Homo sapiens
gcguggagcgcuacgaugu

SEQ ID NO: 679093 - RNA, 19 nt, Homo sapiens
gaaugaucacagcaaugaa

SEQ ID NO: 679094 - RNA, 19 nt, Homo sapiens
ccaaugcugacacgaagga

SEQ ID NO: 679095 - RNA, 19 nt, Homo sapiens
caaguacgacugcgaacag

SEQ ID NO: 679096 - RNA, 19 nt, Homo sapiens
guuacgacccagauacaga

SEQ ID NO: 679097 - RNA, 19 nt, Homo sapiens
guuacuacccagagaggaa

SEQ ID NO: 679098 - RNA, 19 nt, Homo sapiens
gacagucgcucagcuaccu

SEQ ID NO: 679099 - RNA, 19 nt, Homo sapiens
ggacuaccuggucaagauc

SEQ ID NO: 679100 - RNA, 19 nt, Homo sapiens
gaugggccuguacauagaa

SEQ ID NO: 679101 - RNA, 19 nt, Homo sapiens
gcgaaugaucacagcaaug

SEQ ID NO: 679102 - RNA, 19 nt, Homo sapiens
gaggaacgaguggcgaaug

SEQ ID NO: 679103 - RNA, 19 nt, Homo sapiens
gcaggucaaguaccaggau

SEQ ID NO: 679104 - RNA, 19 nt, Homo sapiens
gggagguggccaagcaaga

SEQ ID NO: 679105 - RNA, 19 nt, Homo sapiens
gaguguuacgacccagaua

SEQ ID NO: 679106 - RNA, 19 nt, Homo sapiens
gccaggaugccucaguguu

SEQ ID NO: 679107 - RNA, 19 nt, Homo sapiens
acaaaccgccuuaauucag

SEQ ID NO: 679108 - RNA, 19 nt, Homo sapiens
ggagguggccaagcaagag

SEQ ID NO: 679109 - RNA, 19 nt, Homo sapiens
ggaguacaucuacaugcau

SEQ ID NO: 679110 - RNA, 19 nt, Homo sapiens
ccaucggcaucgccaacuu

SEQ ID NO: 679111 - RNA, 19 nt, Homo sapiens
gugauuuauucuuggauac

SEQ ID NO: 679112 - RNA, 19 nt, Homo sapiens
cugcaaauaacccaucuuc

SEQ ID NO: 679113 - RNA, 19 nt, Homo sapiens
gcguggcugucaccaugga

SEQ ID NO: 679114 - RNA, 19 nt, Homo sapiens
gcauccaccacaacagugu

SEQ ID NO: 679115 - RNA, 19 nt, Homo sapiens
gcaaauagcuucuuagacu

SEQ ID NO: 679116 - RNA, 19 nt, Homo sapiens
gaaacaaguucaagaagaa

SEQ ID NO: 679117 - RNA, 19 nt, Homo sapiens
guaaagcucugaaggauga

SEQ ID NO: 679118 - RNA, 19 nt, Homo sapiens
gauguugccuucagaauuu

SEQ ID NO: 679119 - RNA, 19 nt, Homo sapiens
gaucauccauccauucuuu

SEQ ID NO: 679120 - RNA, 19 nt, Homo sapiens
uagcagagcuuaagaauag

SEQ ID NO: 679121 - RNA, 19 nt, Homo sapiens
gaugauacaugcuagaauu

SEQ ID NO: 679122 - RNA, 19 nt, Homo sapiens
gaagguauguugaagauca

SEQ ID NO: 679123 - RNA, 19 nt, Homo sapiens
gaaauaagaaccucucauu

SEQ ID NO: 679124 - RNA, 19 nt, Homo sapiens
guagauaaguguagauuug

SEQ ID NO: 679125 - RNA, 19 nt, Homo sapiens
agagagagcuuaugcauug

SEQ ID NO: 679126 - RNA, 19 nt, Homo sapiens
ggauugcguuguuaaguua

SEQ ID NO: 679127 - RNA, 19 nt, Homo sapiens
ucaauaggcuuguuuguau

SEQ ID NO: 679128 - RNA, 19 nt, Homo sapiens
cauuuaagguguaguguua

SEQ ID NO: 679129 - RNA, 19 nt, Homo sapiens
ugacuuagcugcuguuuua

SEQ ID NO: 679130 - RNA, 19 nt, Homo sapiens
gaaagucuugucaucauua

SEQ ID NO: 679131 - RNA, 19 nt, Homo sapiens
gaacugagaagcuaaacaa

SEQ ID NO: 679132 - RNA, 19 nt, Homo sapiens
cauaagggcuuucucauca

SEQ ID NO: 679133 - RNA, 19 nt, Homo sapiens
ggacacgauuauaaacaua

SEQ ID NO: 679134 - RNA, 19 nt, Homo sapiens
guauguauguugacuguaa

SEQ ID NO: 679135 - RNA, 19 nt, Homo sapiens
gaaauugacugccuucacu

SEQ ID NO: 679136 - RNA, 19 nt, Homo sapiens
guaaaggguugaugauaga

SEQ ID NO: 679137 - RNA, 19 nt, Homo sapiens
aaucaugacuguaccauuu

SEQ ID NO: 679138 - RNA, 19 nt, Homo sapiens
gaagaaugcugaaauagcu

SEQ ID NO: 679139 - RNA, 19 nt, Homo sapiens
guugaagaaugcugaaaua

SEQ ID NO: 679140 - RNA, 19 nt, Homo sapiens
gugcugggcucgaggaaua

SEQ ID NO: 679141 - RNA, 19 nt, Homo sapiens
ggugauaagugguguaaug

SEQ ID NO: 679142 - RNA, 19 nt, Homo sapiens
uuucggagguuaauaguua

SEQ ID NO: 679143 - RNA, 19 nt, Homo sapiens
ugacuucugugaaaucuuu

SEQ ID NO: 679144 - RNA, 19 nt, Homo sapiens
acaagucucucaauguuaa

SEQ ID NO: 679145 - RNA, 19 nt, Homo sapiens
ggaaagucuugucaucauu

SEQ ID NO: 679146 - RNA, 19 nt, Homo sapiens
caacuucagucuauucaug

SEQ ID NO: 679147 - RNA, 19 nt, Homo sapiens
gauaagugguguaauguag

SEQ ID NO: 679148 - RNA, 19 nt, Homo sapiens
gagaugcacugaucacugu

SEQ ID NO: 679149 - RNA, 19 nt, Homo sapiens
gaaaucaugagcaucgaua

SEQ ID NO: 679150 - RNA, 19 nt, Homo sapiens
caugugugauuuacaguua

SEQ ID NO: 679151 - RNA, 19 nt, Homo sapiens
acacagcggugccuuugua

SEQ ID NO: 679152 - RNA, 19 nt, Homo sapiens
uggcagaacuugacacuug

SEQ ID NO: 679153 - RNA, 19 nt, Homo sapiens
gaaaauaauuggugacaug

SEQ ID NO: 679154 - RNA, 19 nt, Homo sapiens
augaguagcuguuccaaua

SEQ ID NO: 679155 - RNA, 19 nt, Homo sapiens
uuaaagaacuggacaugug

SEQ ID NO: 679156 - RNA, 19 nt, Homo sapiens
cagagcaaauagcuucuua

SEQ ID NO: 679157 - RNA, 19 nt, Homo sapiens
ucagauggcagaaauuaua

SEQ ID NO: 679158 - RNA, 19 nt, Homo sapiens
ugaagcagcuccugucguu

SEQ ID NO: 679159 - RNA, 19 nt, Homo sapiens
gcagaaacaaguucaagaa

SEQ ID NO: 679160 - RNA, 19 nt, Homo sapiens
gaacaagaccagaggauag

SEQ ID NO: 679161 - RNA, 19 nt, Homo sapiens
caauaaaccugcagcaucu

SEQ ID NO: 679162 - RNA, 19 nt, Homo sapiens
gcagacuucuugaauuguu

SEQ ID NO: 679163 - RNA, 19 nt, Homo sapiens
gagccaguauuaauccuaa

SEQ ID NO: 679164 - RNA, 19 nt, Homo sapiens
cuacaggucugaacgcauu

SEQ ID NO: 679165 - RNA, 19 nt, Homo sapiens
gaggaggaauagacuuaaa

SEQ ID NO: 679166 - RNA, 19 nt, Homo sapiens
guuauuugcuguaaugcua

SEQ ID NO: 679167 - RNA, 19 nt, Homo sapiens
caacaggccucucuuuagg

SEQ ID NO: 679168 - RNA, 19 nt, Homo sapiens
aagagaggcuaguaaguuu

SEQ ID NO: 679169 - RNA, 19 nt, Homo sapiens
ugaaggcuuugauuucuuu

SEQ ID NO: 679170 - RNA, 19 nt, Homo sapiens
auacaaaccucauucuuca

SEQ ID NO: 679171 - RNA, 19 nt, Homo sapiens
gaauagacuuaaacgacuu

SEQ ID NO: 679172 - RNA, 19 nt, Homo sapiens
cuaaaugagugccuacuau

SEQ ID NO: 679173 - RNA, 19 nt, Homo sapiens
aagcagacuucuugaauug

SEQ ID NO: 679174 - RNA, 19 nt, Homo sapiens
ggaugacuauucaaauuuc

SEQ ID NO: 679175 - RNA, 19 nt, Homo sapiens
ggagauguguguucauucu

SEQ ID NO: 679176 - RNA, 19 nt, Homo sapiens
gcucaggaguugaagaaug

SEQ ID NO: 679177 - RNA, 19 nt, Homo sapiens
agaaacaaguucaagaaga

SEQ ID NO: 679178 - RNA, 19 nt, Homo sapiens
uaccuaaacuugaagcaaa

SEQ ID NO: 679179 - RNA, 19 nt, Homo sapiens
gaagaucaauaggcuuguu

SEQ ID NO: 679180 - RNA, 19 nt, Homo sapiens
ugugagcacugaagaaauu

SEQ ID NO: 679181 - RNA, 19 nt, Homo sapiens
cggcacaacuucagucuau

SEQ ID NO: 679182 - RNA, 19 nt, Homo sapiens
gaaucuugguucagcaauu

SEQ ID NO: 679183 - RNA, 19 nt, Homo sapiens
uucaguagcuccucagaua

SEQ ID NO: 679184 - RNA, 19 nt, Homo sapiens
gcuaguaaguuugaugcua

SEQ ID NO: 679185 - RNA, 19 nt, Homo sapiens
uaagaauucuggcugcuau

SEQ ID NO: 679186 - RNA, 19 nt, Homo sapiens
aaagcagacuucuugaauu

SEQ ID NO: 679187 - RNA, 19 nt, Homo sapiens
gguugacaauguuagcuua

SEQ ID NO: 679188 - RNA, 19 nt, Homo sapiens
gggaagcauucucugguuu

SEQ ID NO: 679189 - RNA, 19 nt, Homo sapiens
cagaacacacccagaguua

SEQ ID NO: 679190 - RNA, 19 nt, Homo sapiens
ccaauggaauacagagaaa

SEQ ID NO: 679191 - RNA, 19 nt, Homo sapiens
gagcaucgauaacguggau

SEQ ID NO: 679192 - RNA, 19 nt, Homo sapiens
gagcaaauagcuucuuaga

SEQ ID NO: 679193 - RNA, 19 nt, Homo sapiens
gagagcuuaugcauuguuu

SEQ ID NO: 679194 - RNA, 19 nt, Homo sapiens
caaccauaguacuaguuua

SEQ ID NO: 679195 - RNA, 19 nt, Homo sapiens
guacccacauucaggauga

SEQ ID NO: 679196 - RNA, 19 nt, Homo sapiens
ggaacaagaccagaggaua

SEQ ID NO: 679197 - RNA, 19 nt, Homo sapiens
ggaauugucauguuacugu

SEQ ID NO: 679198 - RNA, 19 nt, Homo sapiens
acaaacaagucucucaaug

SEQ ID NO: 679199 - RNA, 19 nt, Homo sapiens
gcacgagcacugucuggua

SEQ ID NO: 679200 - RNA, 19 nt, Homo sapiens
gauagguggugcauucuca

SEQ ID NO: 679201 - RNA, 19 nt, Homo sapiens
gagcagaagccaagaagug

SEQ ID NO: 679202 - RNA, 19 nt, Homo sapiens
gagaugcuguugauguguu

SEQ ID NO: 679203 - RNA, 19 nt, Homo sapiens
gcagcagauugaagaacua

SEQ ID NO: 679204 - RNA, 19 nt, Homo sapiens
cagcagugccuccuauuaa

SEQ ID NO: 679205 - RNA, 19 nt, Homo sapiens
uaucugaugugcaauggaa

SEQ ID NO: 679206 - RNA, 19 nt, Homo sapiens
caaagcagacuucuugaau

SEQ ID NO: 679207 - RNA, 19 nt, Homo sapiens
agacuuaaacgacuucuuu

SEQ ID NO: 679208 - RNA, 19 nt, Homo sapiens
caccuggacuucaacauga

SEQ ID NO: 679209 - RNA, 19 nt, Homo sapiens
caaacaagucucucaaugu

SEQ ID NO: 679210 - RNA, 19 nt, Homo sapiens
cuaguaaguuugaugcuau

SEQ ID NO: 679211 - RNA, 19 nt, Homo sapiens
ucaaagugaucucaaacug

SEQ ID NO: 679212 - RNA, 19 nt, Homo sapiens
ccuauuaaccugugacaaa

SEQ ID NO: 679213 - RNA, 19 nt, Homo sapiens
auaagaaccucucauugga

SEQ ID NO: 679214 - RNA, 19 nt, Homo sapiens
cagaauacaagcccucuaa

SEQ ID NO: 679215 - RNA, 19 nt, Homo sapiens
aaagaauccuggcauauuu

SEQ ID NO: 679216 - RNA, 19 nt, Homo sapiens
gaucagcccgugacucuua

SEQ ID NO: 679217 - RNA, 19 nt, Homo sapiens
gaagagacgcuuaacaaug

SEQ ID NO: 679218 - RNA, 19 nt, Homo sapiens
agacccagcuugaauguaa

SEQ ID NO: 679219 - RNA, 19 nt, Homo sapiens
gaaugucuccucagcauaa

SEQ ID NO: 679220 - RNA, 19 nt, Homo sapiens
cagcauagcuauuccuguu

SEQ ID NO: 679221 - RNA, 19 nt, Homo sapiens
gagccuuccuaucacauua

SEQ ID NO: 679222 - RNA, 19 nt, Homo sapiens
caacauuucguaugacuuu

SEQ ID NO: 679223 - RNA, 19 nt, Homo sapiens
gcauagcuauuccuguuga

SEQ ID NO: 679224 - RNA, 19 nt, Homo sapiens
uaagagaaauugccacgau

SEQ ID NO: 679225 - RNA, 19 nt, Homo sapiens
gaacauagugcaacuguac

SEQ ID NO: 679226 - RNA, 19 nt, Homo sapiens
guacacaaggagaauaaua

SEQ ID NO: 679227 - RNA, 19 nt, Homo sapiens
gaccuaagccaguuucaaa

SEQ ID NO: 679228 - RNA, 19 nt, Homo sapiens
aagagacgcuuaacaaugu

SEQ ID NO: 679229 - RNA, 19 nt, Homo sapiens
gaagcaaagcuguguaaug

SEQ ID NO: 679230 - RNA, 19 nt, Homo sapiens
gaaagacaggauugcauuu

SEQ ID NO: 679231 - RNA, 19 nt, Homo sapiens
gagaagaaguggaaguuuu

SEQ ID NO: 679232 - RNA, 19 nt, Homo sapiens
gaagagaccgacacagaga

SEQ ID NO: 679233 - RNA, 19 nt, Homo sapiens
guacuagucugugaacaau

SEQ ID NO: 679234 - RNA, 19 nt, Homo sapiens
guaaagacccagcuugaau

SEQ ID NO: 679235 - RNA, 19 nt, Homo sapiens
gagcaaagucugcauuuua

SEQ ID NO: 679236 - RNA, 19 nt, Homo sapiens
aagcaaagcuguguaaugg

SEQ ID NO: 679237 - RNA, 19 nt, Homo sapiens
gacaggauugcauuuaaua

SEQ ID NO: 679238 - RNA, 19 nt, Homo sapiens
ucucccauguuuccuauua

SEQ ID NO: 679239 - RNA, 19 nt, Homo sapiens
caaccuacuuuguaaccaa

SEQ ID NO: 679240 - RNA, 19 nt, Homo sapiens
gaaaagccauuugauguau

SEQ ID NO: 679241 - RNA, 19 nt, Homo sapiens
gcaagucgacgauacuaga

SEQ ID NO: 679242 - RNA, 19 nt, Homo sapiens
ugcaugaccuauaaucuuu

SEQ ID NO: 679243 - RNA, 19 nt, Homo sapiens
aagacaggauugcauuuaa

SEQ ID NO: 679244 - RNA, 19 nt, Homo sapiens
gaagugaaagacaggauug

SEQ ID NO: 679245 - RNA, 19 nt, Homo sapiens
gaaacgaggaggaggaugu

SEQ ID NO: 679246 - RNA, 19 nt, Homo sapiens
uggcauauuucuaacacua

SEQ ID NO: 679247 - RNA, 19 nt, Homo sapiens
caugaacaaugucacagaa

SEQ ID NO: 679248 - RNA, 19 nt, Homo sapiens
cagcauaaagcuuucuuaa

SEQ ID NO: 679249 - RNA, 19 nt, Homo sapiens
gaacgaacagguaguuugg

SEQ ID NO: 679250 - RNA, 19 nt, Homo sapiens
gaacaaugucacagaacuu

SEQ ID NO: 679251 - RNA, 19 nt, Homo sapiens
aaagacaggauugcauuua

SEQ ID NO: 679252 - RNA, 19 nt, Homo sapiens
aguaacauuugccuacaua

SEQ ID NO: 679253 - RNA, 19 nt, Homo sapiens
gaaauuguucaaccuacuu

SEQ ID NO: 679254 - RNA, 19 nt, Homo sapiens
agacaaucauucuacaaga

SEQ ID NO: 679255 - RNA, 19 nt, Homo sapiens
uaacaccuaugaacagucu

SEQ ID NO: 679256 - RNA, 19 nt, Homo sapiens
aaauaagccuguugugaag

SEQ ID NO: 679257 - RNA, 19 nt, Homo sapiens
gaaaauaagccuguuguga

SEQ ID NO: 679258 - RNA, 19 nt, Homo sapiens
aaacucagacccagccuuu

SEQ ID NO: 679259 - RNA, 19 nt, Homo sapiens
ugaucugcaugaccuauaa

SEQ ID NO: 679260 - RNA, 19 nt, Homo sapiens
gaaagcaaucuauccuugu

SEQ ID NO: 679261 - RNA, 19 nt, Homo sapiens
uaccaagcguuccauuuga

SEQ ID NO: 679262 - RNA, 19 nt, Homo sapiens
gagcggagagcccuauaga

SEQ ID NO: 679263 - RNA, 19 nt, Homo sapiens
gcugagcuaguguacaaua

SEQ ID NO: 679264 - RNA, 19 nt, Homo sapiens
uagugcaacuguacaggua

SEQ ID NO: 679265 - RNA, 19 nt, Homo sapiens
agacaggauugcauuuaau

SEQ ID NO: 679266 - RNA, 19 nt, Homo sapiens
ugaaagacaggauugcauu

SEQ ID NO: 679267 - RNA, 19 nt, Homo sapiens
ggaagugaaagacaggauu

SEQ ID NO: 679268 - RNA, 19 nt, Homo sapiens
gacaaucauucuacaagag

SEQ ID NO: 679269 - RNA, 19 nt, Homo sapiens
gaagccgccuguugcagau

SEQ ID NO: 679270 - RNA, 19 nt, Homo sapiens
gauggacguguauggaaua

SEQ ID NO: 679271 - RNA, 19 nt, Homo sapiens
ccgaagagacgcuuaacaa

SEQ ID NO: 679272 - RNA, 19 nt, Homo sapiens
ccuauuacccauggauuua

SEQ ID NO: 679273 - RNA, 19 nt, Homo sapiens
gauguccaguucuauguca

SEQ ID NO: 679274 - RNA, 19 nt, Homo sapiens
gcaaguagccaugcuuugg

SEQ ID NO: 679275 - RNA, 19 nt, Homo sapiens
ccagcacucuuauuguaau

SEQ ID NO: 679276 - RNA, 19 nt, Homo sapiens
gguguucuuuccacuuuau

SEQ ID NO: 679277 - RNA, 19 nt, Homo sapiens
cuaccaagcguuccauuug

SEQ ID NO: 679278 - RNA, 19 nt, Homo sapiens
ccaccacuuucucucauug

SEQ ID NO: 679279 - RNA, 19 nt, Homo sapiens
ccacauguaguucccguuu

SEQ ID NO: 679280 - RNA, 19 nt, Homo sapiens
uaaagacccagcuugaaug

SEQ ID NO: 679281 - RNA, 19 nt, Homo sapiens
acaaggagaauaauagaug

SEQ ID NO: 679282 - RNA, 19 nt, Homo sapiens
aaagcaaucuauccuugug

SEQ ID NO: 679283 - RNA, 19 nt, Homo sapiens
ccaaaccuccuccuagaug

SEQ ID NO: 679284 - RNA, 19 nt, Homo sapiens
caugaccuauaaucuuuga

SEQ ID NO: 679285 - RNA, 19 nt, Homo sapiens
caaagaagcaaagcugugu

SEQ ID NO: 679286 - RNA, 19 nt, Homo sapiens
caaaauagaacaagcaaug

SEQ ID NO: 679287 - RNA, 19 nt, Homo sapiens
ggaacugacagcuccuuga

SEQ ID NO: 679288 - RNA, 19 nt, Homo sapiens
gacagcagcguccugacua

SEQ ID NO: 679289 - RNA, 19 nt, Homo sapiens
ccgaagagaccgacacaga

SEQ ID NO: 679290 - RNA, 19 nt, Homo sapiens
acauuugccuacauaaguu

SEQ ID NO: 679291 - RNA, 19 nt, Homo sapiens
ccaguucuaugucaucagu

SEQ ID NO: 679292 - RNA, 19 nt, Homo sapiens
acacacagcgcaccaacaa

SEQ ID NO: 679293 - RNA, 19 nt, Homo sapiens
aagagaaauugccacgauu

SEQ ID NO: 679294 - RNA, 19 nt, Homo sapiens
gcggcucccggcugaauua

SEQ ID NO: 679295 - RNA, 19 nt, Homo sapiens
gcucucccauguuuccuau

SEQ ID NO: 679296 - RNA, 19 nt, Homo sapiens
gauguaugcaguaagagaa

SEQ ID NO: 679297 - RNA, 19 nt, Homo sapiens
aauauguacuagucuguga

SEQ ID NO: 679298 - RNA, 19 nt, Homo sapiens
auccagcacucuuauugua

SEQ ID NO: 679299 - RNA, 19 nt, Homo sapiens
guaaaggaagugaaagaca

SEQ ID NO: 679300 - RNA, 19 nt, Homo sapiens
gcgagcaaagucugcauuu

SEQ ID NO: 679301 - RNA, 19 nt, Homo sapiens
gcagcguccugacuagauc

SEQ ID NO: 679302 - RNA, 19 nt, Homo sapiens
cgaagagacgcuuaacaau

SEQ ID NO: 679303 - RNA, 19 nt, Homo sapiens
aauccuggcauauuucuaa

SEQ ID NO: 679304 - RNA, 19 nt, Homo sapiens
acaaaagaauccuggcaua

SEQ ID NO: 679305 - RNA, 19 nt, Homo sapiens
uuacagggcugcuauuuuc

SEQ ID NO: 679306 - RNA, 19 nt, Homo sapiens
gagguguuguagccauuga

SEQ ID NO: 679307 - RNA, 19 nt, Homo sapiens
gggagguguuguagccauu

SEQ ID NO: 679308 - RNA, 19 nt, Homo sapiens
gcagcauaauccagcaugu

SEQ ID NO: 679309 - RNA, 19 nt, Homo sapiens
cgauggacguguauggaau

SEQ ID NO: 679310 - RNA, 19 nt, Homo sapiens
uguucaaccuacuuuguaa

SEQ ID NO: 679311 - RNA, 19 nt, Homo sapiens
gccuuccuaucacauuaua

SEQ ID NO: 679312 - RNA, 19 nt, Homo sapiens
ccgaaugucuccucagcau

SEQ ID NO: 679313 - RNA, 19 nt, Homo sapiens
cauuugauguaugcaguaa

SEQ ID NO: 679314 - RNA, 19 nt, Homo sapiens
gcuccaagcgugccuagug

SEQ ID NO: 679315 - RNA, 19 nt, Homo sapiens
gaacuccucuucuucauca

SEQ ID NO: 679316 - RNA, 19 nt, Homo sapiens
gaacagauacuccaacuuc

SEQ ID NO: 679317 - RNA, 19 nt, Homo sapiens
gaaauuaaacccaagaguu

SEQ ID NO: 679318 - RNA, 19 nt, Homo sapiens
caacaucccuuucuuugau

SEQ ID NO: 679319 - RNA, 19 nt, Homo sapiens
agaagcaggugaacaauuu

SEQ ID NO: 679320 - RNA, 19 nt, Homo sapiens
gaacucaacucggugaaug

SEQ ID NO: 679321 - RNA, 19 nt, Homo sapiens
gaaccugccugcccuccua

SEQ ID NO: 679322 - RNA, 19 nt, Homo sapiens
gaacuccgcuacagggaau

SEQ ID NO: 679323 - RNA, 19 nt, Homo sapiens
gggcugagcugcaguuugg

SEQ ID NO: 679324 - RNA, 19 nt, Homo sapiens
caacaggccgcaccuauug

SEQ ID NO: 679325 - RNA, 19 nt, Homo sapiens
gaugugaagucccucauuc

SEQ ID NO: 679326 - RNA, 19 nt, Homo sapiens
gggagauucuggaugauga

SEQ ID NO: 679327 - RNA, 19 nt, Homo sapiens
ugaagcagcugguggacuu

SEQ ID NO: 679328 - RNA, 19 nt, Homo sapiens
ccgcagacaugcucaauca

SEQ ID NO: 679329 - RNA, 19 nt, Homo sapiens
gcuaaggacucagaagaug

SEQ ID NO: 679330 - RNA, 19 nt, Homo sapiens
gacggaaucuucugaacug

SEQ ID NO: 679331 - RNA, 19 nt, Homo sapiens
ugugagcacuuuaauauuc

SEQ ID NO: 679332 - RNA, 19 nt, Homo sapiens
acaagaagccauugagaaa

SEQ ID NO: 679333 - RNA, 19 nt, Homo sapiens
ggccagaacuuggagaaga

SEQ ID NO: 679334 - RNA, 19 nt, Homo sapiens
caagcagcaucaugagaaa

SEQ ID NO: 679335 - RNA, 19 nt, Homo sapiens
ggugggaacuccucuucuu

SEQ ID NO: 679336 - RNA, 19 nt, Homo sapiens
gagcuggaguucaguaugg

SEQ ID NO: 679337 - RNA, 19 nt, Homo sapiens
caacugccaugucuacaag

SEQ ID NO: 679338 - RNA, 19 nt, Homo sapiens
ggaccaggccucagacaga

SEQ ID NO: 679339 - RNA, 19 nt, Homo sapiens
ccugcaagcuguccugauu

SEQ ID NO: 679340 - RNA, 19 nt, Homo sapiens
uggcacagcugcagcaaug

SEQ ID NO: 679341 - RNA, 19 nt, Homo sapiens
gaacucaagcucugaacug

SEQ ID NO: 679342 - RNA, 19 nt, Homo sapiens
gaagcucccuuuucucaaa

SEQ ID NO: 679343 - RNA, 19 nt, Homo sapiens
cucaagcucugaacuguuu

SEQ ID NO: 679344 - RNA, 19 nt, Homo sapiens
cuagugaggacucgaguua

SEQ ID NO: 679345 - RNA, 19 nt, Homo sapiens
gaucuugggcuuugaggaa

SEQ ID NO: 679346 - RNA, 19 nt, Homo sapiens
ucaccucgcuccuggauca

SEQ ID NO: 679347 - RNA, 19 nt, Homo sapiens
cgacacuccuggccuguug

SEQ ID NO: 679348 - RNA, 19 nt, Homo sapiens
gagaagcaggugaacaauu

SEQ ID NO: 679349 - RNA, 19 nt, Homo sapiens
gaacuggccgugcccauag

SEQ ID NO: 679350 - RNA, 19 nt, Homo sapiens
gaaccuagauggggagauu

SEQ ID NO: 679351 - RNA, 19 nt, Homo sapiens
uuacaugccuauccugaug

SEQ ID NO: 679352 - RNA, 19 nt, Homo sapiens
gcaauaccuaugcuuugua

SEQ ID NO: 679353 - RNA, 19 nt, Homo sapiens
ccaagcagcaucaugagaa

SEQ ID NO: 679354 - RNA, 19 nt, Homo sapiens
gcaaacucaucaccaacau

SEQ ID NO: 679355 - RNA, 19 nt, Homo sapiens
ggacaugguguucaagugu

SEQ ID NO: 679356 - RNA, 19 nt, Homo sapiens
caacaagaagccauugaga

SEQ ID NO: 679357 - RNA, 19 nt, Homo sapiens
ggagauagccaccacuuuu

SEQ ID NO: 679358 - RNA, 19 nt, Homo sapiens
gcaacugacucugcuugug

SEQ ID NO: 679359 - RNA, 19 nt, Homo sapiens
ggaagacauugaggacaug

SEQ ID NO: 679360 - RNA, 19 nt, Homo sapiens
ucauggagccucacacuga

SEQ ID NO: 679361 - RNA, 19 nt, Homo sapiens
cagccaaaguggaagcaaa

SEQ ID NO: 679362 - RNA, 19 nt, Homo sapiens
ggcaauaccuaugcuuugu

SEQ ID NO: 679363 - RNA, 19 nt, Homo sapiens
gcaaguggcaauaccuaug

SEQ ID NO: 679364 - RNA, 19 nt, Homo sapiens
cagcagcagugguggaugu

SEQ ID NO: 679365 - RNA, 19 nt, Homo sapiens
caucaacaucccuuucuuu

SEQ ID NO: 679366 - RNA, 19 nt, Homo sapiens
ggacaugguugaggcugau

SEQ ID NO: 679367 - RNA, 19 nt, Homo sapiens
ugcggaugcuggaugauua

SEQ ID NO: 679368 - RNA, 19 nt, Homo sapiens
agaaacaccuggauuuuga

SEQ ID NO: 679369 - RNA, 19 nt, Homo sapiens
aagaagccauugagaaaca

SEQ ID NO: 679370 - RNA, 19 nt, Homo sapiens
gauggaaaccgaugugaag

SEQ ID NO: 679371 - RNA, 19 nt, Homo sapiens
gcacaagagcgagaaggaa

SEQ ID NO: 679372 - RNA, 19 nt, Homo sapiens
gagaggugcuccaggaacu

SEQ ID NO: 679373 - RNA, 19 nt, Homo sapiens
caagaaguaugggccugaa

SEQ ID NO: 679374 - RNA, 19 nt, Homo sapiens
gagugcggaugcuggauga

SEQ ID NO: 679375 - RNA, 19 nt, Homo sapiens
ccacagcgacucaaugaca

SEQ ID NO: 679376 - RNA, 19 nt, Homo sapiens
ucacuggaguauucaagga

SEQ ID NO: 679377 - RNA, 19 nt, Homo sapiens
ggaaccagacccugcaugu

SEQ ID NO: 679378 - RNA, 19 nt, Homo sapiens
gaugagaucuaugccaacu

SEQ ID NO: 679379 - RNA, 19 nt, Homo sapiens
gguugaggcugaugaguac

SEQ ID NO: 679380 - RNA, 19 nt, Homo sapiens
ugacgaggcugcccaagcu

SEQ ID NO: 679381 - RNA, 19 nt, Homo sapiens
acacacgccucuucuacau

SEQ ID NO: 679382 - RNA, 19 nt, Homo sapiens
cagcaggguggcauugaua

SEQ ID NO: 679383 - RNA, 19 nt, Homo sapiens
guccaaggaugagaucuau

SEQ ID NO: 679384 - RNA, 19 nt, Homo sapiens
ucuagaagcccaagaagau

SEQ ID NO: 679385 - RNA, 19 nt, Homo sapiens
gaucaacugccaugucuac

SEQ ID NO: 679386 - RNA, 19 nt, Homo sapiens
ucacugagccaacaagaag

SEQ ID NO: 679387 - RNA, 19 nt, Homo sapiens
agauguggcuacugcugua

SEQ ID NO: 679388 - RNA, 19 nt, Homo sapiens
gcccaaaggcagaaacaga

SEQ ID NO: 679389 - RNA, 19 nt, Homo sapiens
gcagcucugucgucacaca

SEQ ID NO: 679390 - RNA, 19 nt, Homo sapiens
aggaagaggaggagaauga

SEQ ID NO: 679391 - RNA, 19 nt, Homo sapiens
gauucuggaugaugagauc

SEQ ID NO: 679392 - RNA, 19 nt, Homo sapiens
gcuggaggcccaugacaga

SEQ ID NO: 679393 - RNA, 19 nt, Homo sapiens
gaugcuggaugauuaugag

SEQ ID NO: 679394 - RNA, 19 nt, Homo sapiens
guugaguaguccugauuau

SEQ ID NO: 679395 - RNA, 19 nt, Homo sapiens
acugugagcacuuuaauau

SEQ ID NO: 679396 - RNA, 19 nt, Homo sapiens
gggacaugguguucaagug

SEQ ID NO: 679397 - RNA, 19 nt, Homo sapiens
cucagaagaugcagccaaa

SEQ ID NO: 679398 - RNA, 19 nt, Homo sapiens
ucuaugcugugccuuaugu

SEQ ID NO: 679399 - RNA, 19 nt, Homo sapiens
gcccaugacagaacucuau

SEQ ID NO: 679400 - RNA, 19 nt, Homo sapiens
gcacugccacccagagcuu

SEQ ID NO: 679401 - RNA, 19 nt, Homo sapiens
ccacgugagugagcaguuc

SEQ ID NO: 679402 - RNA, 19 nt, Homo sapiens
ucaacaggccgcaccuauu

SEQ ID NO: 679403 - RNA, 19 nt, Homo sapiens
ccagaucgaagaccacaga

SEQ ID NO: 679404 - RNA, 19 nt, Homo sapiens
gagacggaaucuucugaac

SEQ ID NO: 679405 - RNA, 19 nt, Homo sapiens
gaaccagacccugcaugug

SEQ ID NO: 679406 - RNA, 19 nt, Homo sapiens
acagauacuccaacuucua

SEQ ID NO: 679407 - RNA, 19 nt, Homo sapiens
ggaggaagaggaggagaau

SEQ ID NO: 679408 - RNA, 19 nt, Homo sapiens
ccaccacuuuugagcauua

SEQ ID NO: 679409 - RNA, 19 nt, Homo sapiens
ucaacucggugaaugugau

SEQ ID NO: 679410 - RNA, 19 nt, Homo sapiens
gaagcaugcccaccucuac

SEQ ID NO: 679411 - RNA, 19 nt, Homo sapiens
cuacccaucccuucuagaa

SEQ ID NO: 679412 - RNA, 19 nt, Homo sapiens
agaauuggcccaggacuug

SEQ ID NO: 679413 - RNA, 19 nt, Homo sapiens
gcacauugaccagcagauc

SEQ ID NO: 679414 - RNA, 19 nt, Homo sapiens
uggagaagcaggugaacaa

SEQ ID NO: 679415 - RNA, 19 nt, Homo sapiens
gaagagagcugaaaacuua

SEQ ID NO: 679416 - RNA, 19 nt, Homo sapiens
gaacgaacauugcaauuga

SEQ ID NO: 679417 - RNA, 19 nt, Homo sapiens
ggaaagagauuauaugaag

SEQ ID NO: 679418 - RNA, 19 nt, Homo sapiens
gaacuacucuaacauuuga

SEQ ID NO: 679419 - RNA, 19 nt, Homo sapiens
gguauaagcucacagaauu

SEQ ID NO: 679420 - RNA, 19 nt, Homo sapiens
ggagugggcuggugcuuua

SEQ ID NO: 679421 - RNA, 19 nt, Homo sapiens
ggaccaaacuacuucauuu

SEQ ID NO: 679422 - RNA, 19 nt, Homo sapiens
ggacacagcuugcauugga

SEQ ID NO: 679423 - RNA, 19 nt, Homo sapiens
gggcauaccuugugcauug

SEQ ID NO: 679424 - RNA, 19 nt, Homo sapiens
gaucagaaguuguuagaga

SEQ ID NO: 679425 - RNA, 19 nt, Homo sapiens
gcaaauaaccuacauguca

SEQ ID NO: 679426 - RNA, 19 nt, Homo sapiens
gaaaguggcaaagaaauua

SEQ ID NO: 679427 - RNA, 19 nt, Homo sapiens
gagagaaguuguugagaaa

SEQ ID NO: 679428 - RNA, 19 nt, Homo sapiens
ggaaagauguagaguuguu

SEQ ID NO: 679429 - RNA, 19 nt, Homo sapiens
gaaaguacagcaggaauua

SEQ ID NO: 679430 - RNA, 19 nt, Homo sapiens
gaagugguguugcuuugua

SEQ ID NO: 679431 - RNA, 19 nt, Homo sapiens
uaauugaacugcagaguaa

SEQ ID NO: 679432 - RNA, 19 nt, Homo sapiens
gcuaagaacuuuaaugaca

SEQ ID NO: 679433 - RNA, 19 nt, Homo sapiens
aaacuacgauugacacuaa

SEQ ID NO: 679434 - RNA, 19 nt, Homo sapiens
gagauuauaugaagcagaa

SEQ ID NO: 679435 - RNA, 19 nt, Homo sapiens
gaacaacuaacgaaucuuu

SEQ ID NO: 679436 - RNA, 19 nt, Homo sapiens
gaagaccuuugccacuuua

SEQ ID NO: 679437 - RNA, 19 nt, Homo sapiens
ggaagagucugugcuacua

SEQ ID NO: 679438 - RNA, 19 nt, Homo sapiens
gagcaugucuucaguaucu

SEQ ID NO: 679439 - RNA, 19 nt, Homo sapiens
ggagagaaguuacaagcuu

SEQ ID NO: 679440 - RNA, 19 nt, Homo sapiens
cuaaugauguggaaucuuu

SEQ ID NO: 679441 - RNA, 19 nt, Homo sapiens
ggauaaauguucaagauag

SEQ ID NO: 679442 - RNA, 19 nt, Homo sapiens
uaaaugcccuuugauguuu

SEQ ID NO: 679443 - RNA, 19 nt, Homo sapiens
ccagacaacucuagaaaug

SEQ ID NO: 679444 - RNA, 19 nt, Homo sapiens
gaugagaaguuacaguuau

SEQ ID NO: 679445 - RNA, 19 nt, Homo sapiens
gaucauacuucucugaaug

SEQ ID NO: 679446 - RNA, 19 nt, Homo sapiens
uaauagagcuguuagaaag

SEQ ID NO: 679447 - RNA, 19 nt, Homo sapiens
gaagagaaauacgaagcua

SEQ ID NO: 679448 - RNA, 19 nt, Homo sapiens
gagcuaagaacuuuaauga

SEQ ID NO: 679449 - RNA, 19 nt, Homo sapiens
ggaagaccuuugccacuuu

SEQ ID NO: 679450 - RNA, 19 nt, Homo sapiens
ccacaaagcccagaaauga

SEQ ID NO: 679451 - RNA, 19 nt, Homo sapiens
cagaauacuugcacucuuu

SEQ ID NO: 679452 - RNA, 19 nt, Homo sapiens
gcaaagucaucuaaaggaa

SEQ ID NO: 679453 - RNA, 19 nt, Homo sapiens
ggaauccuuugggaaauua

SEQ ID NO: 679454 - RNA, 19 nt, Homo sapiens
gagagaaguuacaagcuuu

SEQ ID NO: 679455 - RNA, 19 nt, Homo sapiens
gcaaagaaauuagggaauc

SEQ ID NO: 679456 - RNA, 19 nt, Homo sapiens
gaacauguguccccagaua

SEQ ID NO: 679457 - RNA, 19 nt, Homo sapiens
caaauuaucugcaguccau

SEQ ID NO: 679458 - RNA, 19 nt, Homo sapiens
gaacauugcaauugaaaga

SEQ ID NO: 679459 - RNA, 19 nt, Homo sapiens
ggaaacagcagaugaagga

SEQ ID NO: 679460 - RNA, 19 nt, Homo sapiens
gggcagaacuucaguccuu

SEQ ID NO: 679461 - RNA, 19 nt, Homo sapiens
gugaaggucuuguacauga

SEQ ID NO: 679462 - RNA, 19 nt, Homo sapiens
ccaugacaauuauguguua

SEQ ID NO: 679463 - RNA, 19 nt, Homo sapiens
uuacagaucuacugaguga

SEQ ID NO: 679464 - RNA, 19 nt, Homo sapiens
ggaagugcuuugauucuau

SEQ ID NO: 679465 - RNA, 19 nt, Homo sapiens
ggaauaaacaucauagugu

SEQ ID NO: 679466 - RNA, 19 nt, Homo sapiens
caugaugucuguacaagaa

SEQ ID NO: 679467 - RNA, 19 nt, Homo sapiens
gagaaguuguugagaaaga

SEQ ID NO: 679468 - RNA, 19 nt, Homo sapiens
gcaagacagagaacaguua

SEQ ID NO: 679469 - RNA, 19 nt, Homo sapiens
gaagcagucacgagaaaua

SEQ ID NO: 679470 - RNA, 19 nt, Homo sapiens
gcagaaugccgucaaacua

SEQ ID NO: 679471 - RNA, 19 nt, Homo sapiens
caagauagaccuaaugaug

SEQ ID NO: 679472 - RNA, 19 nt, Homo sapiens
caaagcaaauacaagauug

SEQ ID NO: 679473 - RNA, 19 nt, Homo sapiens
gagaacaguuaauucagaa

SEQ ID NO: 679474 - RNA, 19 nt, Homo sapiens
ugaaaucucuucuugaaca

SEQ ID NO: 679475 - RNA, 19 nt, Homo sapiens
aaaggaaacugaagagaau

SEQ ID NO: 679476 - RNA, 19 nt, Homo sapiens
cauagaagacaucaaguua

SEQ ID NO: 679477 - RNA, 19 nt, Homo sapiens
agcagaaacugaugaaaua

SEQ ID NO: 679478 - RNA, 19 nt, Homo sapiens
ccauauuaauugccuguua

SEQ ID NO: 679479 - RNA, 19 nt, Homo sapiens
gagaaauaguguuagaaga

SEQ ID NO: 679480 - RNA, 19 nt, Homo sapiens
ggauaaagauuugauagag

SEQ ID NO: 679481 - RNA, 19 nt, Homo sapiens
guucgaacaucuuugauug

SEQ ID NO: 679482 - RNA, 19 nt, Homo sapiens
guaugaaguugccaagaaa

SEQ ID NO: 679483 - RNA, 19 nt, Homo sapiens
acaagaaucucaugcugaa

SEQ ID NO: 679484 - RNA, 19 nt, Homo sapiens
aaacuugacggacuaauaa

SEQ ID NO: 679485 - RNA, 19 nt, Homo sapiens
ggaggacuguucaaauuca

SEQ ID NO: 679486 - RNA, 19 nt, Homo sapiens
gagaauuguuugagguuug

SEQ ID NO: 679487 - RNA, 19 nt, Homo sapiens
gaacaugaagacucagaaa

SEQ ID NO: 679488 - RNA, 19 nt, Homo sapiens
gcagagcuaagaacuuuaa

SEQ ID NO: 679489 - RNA, 19 nt, Homo sapiens
ggagcaaagucaucuaaag

SEQ ID NO: 679490 - RNA, 19 nt, Homo sapiens
aaaggaugcaucuguauua

SEQ ID NO: 679491 - RNA, 19 nt, Homo sapiens
gcucacagaauucagauaa

SEQ ID NO: 679492 - RNA, 19 nt, Homo sapiens
uuagagaaguugccauuga

SEQ ID NO: 679493 - RNA, 19 nt, Homo sapiens
uaagaucagccauaaguaa

SEQ ID NO: 679494 - RNA, 19 nt, Homo sapiens
gaacaacagaccaauuuua

SEQ ID NO: 679495 - RNA, 19 nt, Homo sapiens
gaagugcuuugauucuaug

SEQ ID NO: 679496 - RNA, 19 nt, Homo sapiens
gaguuugccucaguagaua

SEQ ID NO: 679497 - RNA, 19 nt, Homo sapiens
agagagaaguuguugagaa

SEQ ID NO: 679498 - RNA, 19 nt, Homo sapiens
caagguuucugauuuguca

SEQ ID NO: 679499 - RNA, 19 nt, Homo sapiens
gaggacacacuucagguua

SEQ ID NO: 679500 - RNA, 19 nt, Homo sapiens
gcaauugaaagaagaagaa

SEQ ID NO: 679501 - RNA, 19 nt, Homo sapiens
gaaggaagcagaaacugau

SEQ ID NO: 679502 - RNA, 19 nt, Homo sapiens
ggaauuagaggacacacuu

SEQ ID NO: 679503 - RNA, 19 nt, Homo sapiens
ggaaaguacagcaggaauu

SEQ ID NO: 679504 - RNA, 19 nt, Homo sapiens
agucaaagauggaaagaga

SEQ ID NO: 679505 - RNA, 19 nt, Homo sapiens
gaggaggcguugccgguuu

SEQ ID NO: 679506 - RNA, 19 nt, Homo sapiens
guaaucagcaaucuucaaa

SEQ ID NO: 679507 - RNA, 19 nt, Homo sapiens
uaaaggaaacugaagagaa

SEQ ID NO: 679508 - RNA, 19 nt, Homo sapiens
gaauaugaagguaaacuug

SEQ ID NO: 679509 - RNA, 19 nt, Homo sapiens
uagagucacuuucugaaga

SEQ ID NO: 679510 - RNA, 19 nt, Homo sapiens
uucagaagcuuaauuguga

SEQ ID NO: 679511 - RNA, 19 nt, Homo sapiens
gaauugagugcucuugaaa

SEQ ID NO: 679512 - RNA, 19 nt, Homo sapiens
gaaaucucuucuugaacaa

SEQ ID NO: 679513 - RNA, 19 nt, Homo sapiens
cuugaaaucucuucuugaa

SEQ ID NO: 679514 - RNA, 19 nt, Homo sapiens
uaaacuugacggacuaaua

SEQ ID NO: 679515 - RNA, 19 nt, Homo sapiens
gaaacagccuugaaucuuu

SEQ ID NO: 679516 - RNA, 19 nt, Homo sapiens
gagcagaaguguuuaacua

SEQ ID NO: 679517 - RNA, 19 nt, Homo sapiens
gcagaaguguuuaacuaua

SEQ ID NO: 679518 - RNA, 19 nt, Homo sapiens
ggaugaagcucuaacugaa

SEQ ID NO: 679519 - RNA, 19 nt, Homo sapiens
guaaaccuguccauuauga

SEQ ID NO: 679520 - RNA, 19 nt, Homo sapiens
gaacaaauucugauugguu

SEQ ID NO: 679521 - RNA, 19 nt, Homo sapiens
gaacugaaguaaggagaaa

SEQ ID NO: 679522 - RNA, 19 nt, Homo sapiens
gagcaacaaugccaauuau

SEQ ID NO: 679523 - RNA, 19 nt, Homo sapiens
ugaauaaagugauggauga

SEQ ID NO: 679524 - RNA, 19 nt, Homo sapiens
gaacaucagcugccaagaa

SEQ ID NO: 679525 - RNA, 19 nt, Homo sapiens
uaacugaacugaaguaagg

SEQ ID NO: 679526 - RNA, 19 nt, Homo sapiens
gguacugugucuacaaaua

SEQ ID NO: 679527 - RNA, 19 nt, Homo sapiens
ggcagaagcucccagagaa

SEQ ID NO: 679528 - RNA, 19 nt, Homo sapiens
ggagagaccagaccaagaa

SEQ ID NO: 679529 - RNA, 19 nt, Homo sapiens
guacaugaauaaagugaug

SEQ ID NO: 679530 - RNA, 19 nt, Homo sapiens
caguaaaccuguccauuau

SEQ ID NO: 679531 - RNA, 19 nt, Homo sapiens
aaacugauccacacauuaa

SEQ ID NO: 679532 - RNA, 19 nt, Homo sapiens
gcaacaaugccaauuauuc

SEQ ID NO: 679533 - RNA, 19 nt, Homo sapiens
ugaauaaccugagugagaa

SEQ ID NO: 679534 - RNA, 19 nt, Homo sapiens
aaauagaccucuuguacug

SEQ ID NO: 679535 - RNA, 19 nt, Homo sapiens
gcuaagagccggauucaca

SEQ ID NO: 679536 - RNA, 19 nt, Homo sapiens
ucauuuaguucccucuaua

SEQ ID NO: 679537 - RNA, 19 nt, Homo sapiens
ggaauucgggcuuucauug

SEQ ID NO: 679538 - RNA, 19 nt, Homo sapiens
ccaaauaaauagaccucuu

SEQ ID NO: 679539 - RNA, 19 nt, Homo sapiens
agagugauguuaucuguga

SEQ ID NO: 679540 - RNA, 19 nt, Homo sapiens
caacaaugccaauuauuca

SEQ ID NO: 679541 - RNA, 19 nt, Homo sapiens
ucucagagcagaaguguuu

SEQ ID NO: 679542 - RNA, 19 nt, Homo sapiens
uuaaugcccuuacucuauu

SEQ ID NO: 679543 - RNA, 19 nt, Homo sapiens
ggacagggcccaggaugaa

SEQ ID NO: 679544 - RNA, 19 nt, Homo sapiens
gcucuucagucuguccuua

SEQ ID NO: 679545 - RNA, 19 nt, Homo sapiens
ugaauggccuacuguucua

SEQ ID NO: 679546 - RNA, 19 nt, Homo sapiens
ggaaucagaaauccuuauu

SEQ ID NO: 679547 - RNA, 19 nt, Homo sapiens
uuaguucccucuauaauuc

SEQ ID NO: 679548 - RNA, 19 nt, Homo sapiens
aaacagccuugaaucuuug

SEQ ID NO: 679549 - RNA, 19 nt, Homo sapiens
caagugccagcaucauuua

SEQ ID NO: 679550 - RNA, 19 nt, Homo sapiens
ccagauauguugaagaaac

SEQ ID NO: 679551 - RNA, 19 nt, Homo sapiens
gaaaagcaaaguugaagua

SEQ ID NO: 679552 - RNA, 19 nt, Homo sapiens
ggccuacuguucuauuauu

SEQ ID NO: 679553 - RNA, 19 nt, Homo sapiens
cagaaguguuuaacuauag

SEQ ID NO: 679554 - RNA, 19 nt, Homo sapiens
caaauaaauagaccucuug

SEQ ID NO: 679555 - RNA, 19 nt, Homo sapiens
aaaucaccaugaccucuua

SEQ ID NO: 679556 - RNA, 19 nt, Homo sapiens
guaaccaggucccggaaug

SEQ ID NO: 679557 - RNA, 19 nt, Homo sapiens
aacaucagcugccaagaaa

SEQ ID NO: 679558 - RNA, 19 nt, Homo sapiens
uaacgucgacagucuauau

SEQ ID NO: 679559 - RNA, 19 nt, Homo sapiens
cagaaauccuuauuaaugc

SEQ ID NO: 679560 - RNA, 19 nt, Homo sapiens
ccaagugccagcaucauuu

SEQ ID NO: 679561 - RNA, 19 nt, Homo sapiens
uggcagaggucccugauuc

SEQ ID NO: 679562 - RNA, 19 nt, Homo sapiens
uaaucgugcugcuuggaua

SEQ ID NO: 679563 - RNA, 19 nt, Homo sapiens
gcaauggcuucugcaauag

SEQ ID NO: 679564 - RNA, 19 nt, Homo sapiens
ggcuagagcugggcuaaga

SEQ ID NO: 679565 - RNA, 19 nt, Homo sapiens
ugagcaacaaugccaauua

SEQ ID NO: 679566 - RNA, 19 nt, Homo sapiens
agacuucauuuguguauca

SEQ ID NO: 679567 - RNA, 19 nt, Homo sapiens
gaagacccguugccaugca

SEQ ID NO: 679568 - RNA, 19 nt, Homo sapiens
uugcaaacaugaucaacaa

SEQ ID NO: 679569 - RNA, 19 nt, Homo sapiens
gagaaacagccuugaaucu

SEQ ID NO: 679570 - RNA, 19 nt, Homo sapiens
ggagaaacagccuugaauc

SEQ ID NO: 679571 - RNA, 19 nt, Homo sapiens
gugaacaaauucugauugg

SEQ ID NO: 679572 - RNA, 19 nt, Homo sapiens
aaagcaaaguugaaguaga

SEQ ID NO: 679573 - RNA, 19 nt, Homo sapiens
gcagaacuuguaagccuaa

SEQ ID NO: 679574 - RNA, 19 nt, Homo sapiens
caagagacaauccgcaaau

SEQ ID NO: 679575 - RNA, 19 nt, Homo sapiens
gcaggcaucccuuaaccuu

SEQ ID NO: 679576 - RNA, 19 nt, Homo sapiens
caccaugaccucuuaguga

SEQ ID NO: 679577 - RNA, 19 nt, Homo sapiens
uggaguguguguuaagaaa

SEQ ID NO: 679578 - RNA, 19 nt, Homo sapiens
cuauaauucuuacguggaa

SEQ ID NO: 679579 - RNA, 19 nt, Homo sapiens
uaaccugagugagaauuau

SEQ ID NO: 679580 - RNA, 19 nt, Homo sapiens
gagaauggccaagcccaaa

SEQ ID NO: 679581 - RNA, 19 nt, Homo sapiens
gaacuuguaagccuaaacu

SEQ ID NO: 679582 - RNA, 19 nt, Homo sapiens
gaccagaccaagaagagaa

SEQ ID NO: 679583 - RNA, 19 nt, Homo sapiens
gaauuuauccaccaaagac

SEQ ID NO: 679584 - RNA, 19 nt, Homo sapiens
uccacuugcucauauagua

SEQ ID NO: 679585 - RNA, 19 nt, Homo sapiens
caucuggaguguguguuaa

SEQ ID NO: 679586 - RNA, 19 nt, Homo sapiens
gugccagcaucauuuaguu

SEQ ID NO: 679587 - RNA, 19 nt, Homo sapiens
gauccacacauuaaggaaa

SEQ ID NO: 679588 - RNA, 19 nt, Homo sapiens
caaaacugauccacacauu

SEQ ID NO: 679589 - RNA, 19 nt, Homo sapiens
guccuugccuugcuucaga

SEQ ID NO: 679590 - RNA, 19 nt, Homo sapiens
cugcuuggauagaaauauu

SEQ ID NO: 679591 - RNA, 19 nt, Homo sapiens
gaauucgggcuuucauugu

SEQ ID NO: 679592 - RNA, 19 nt, Homo sapiens
cgucgacagucuauauuuc

SEQ ID NO: 679593 - RNA, 19 nt, Homo sapiens
caaaguugaaguagacgaa

SEQ ID NO: 679594 - RNA, 19 nt, Homo sapiens
aagcaaaguugaaguagac

SEQ ID NO: 679595 - RNA, 19 nt, Homo sapiens
gccuacuguucuauuauuu

SEQ ID NO: 679596 - RNA, 19 nt, Homo sapiens
auaaauagaccucuuguac

SEQ ID NO: 679597 - RNA, 19 nt, Homo sapiens
aauuagagccuuagcaaau

SEQ ID NO: 679598 - RNA, 19 nt, Homo sapiens
agaaaucugaugauccuuu

SEQ ID NO: 679599 - RNA, 19 nt, Homo sapiens
ccacuugcucauauaguaa

SEQ ID NO: 679600 - RNA, 19 nt, Homo sapiens
uaaugcccuuacucuauuu

SEQ ID NO: 679601 - RNA, 19 nt, Homo sapiens
auccagauauguugaagaa

SEQ ID NO: 679602 - RNA, 19 nt, Homo sapiens
caacaccugcuugucaauu

SEQ ID NO: 679603 - RNA, 19 nt, Homo sapiens
cuucugaauugacaguaaa

SEQ ID NO: 679604 - RNA, 19 nt, Homo sapiens
gcaaacaugaucaacaaaa

SEQ ID NO: 679605 - RNA, 19 nt, Homo sapiens
aagagacaauccgcaaauu

SEQ ID NO: 679606 - RNA, 19 nt, Homo sapiens
gagcaggcaucccuuaacc

SEQ ID NO: 679607 - RNA, 19 nt, Homo sapiens
cagcugccaguguugaaua

SEQ ID NO: 679608 - RNA, 19 nt, Homo sapiens
caaaucaccaugaccucuu

SEQ ID NO: 679609 - RNA, 19 nt, Homo sapiens
agaaacagccuugaaucuu

SEQ ID NO: 679610 - RNA, 19 nt, Homo sapiens
gcgaggaggaggaggagaa

SEQ ID NO: 679611 - RNA, 19 nt, Homo sapiens
acacagagucagauucaga

SEQ ID NO: 679612 - RNA, 19 nt, Homo sapiens
gacgagcaggcaucccuua

SEQ ID NO: 679613 - RNA, 19 nt, Homo sapiens
ugaaauugaugagauucug

SEQ ID NO: 679614 - RNA, 19 nt, Homo sapiens
gggcuuccguccuggagau

SEQ ID NO: 679615 - RNA, 19 nt, Homo sapiens
gaauaaagcuacacuguug

SEQ ID NO: 679616 - RNA, 19 nt, Homo sapiens
ccacacaguucauguauua

SEQ ID NO: 679617 - RNA, 19 nt, Homo sapiens
uaaccaaggugauuucuua

SEQ ID NO: 679618 - RNA, 19 nt, Homo sapiens
gaacuaagaacaaugguua

SEQ ID NO: 679619 - RNA, 19 nt, Homo sapiens
gaaauucaaucuagggaaa

SEQ ID NO: 679620 - RNA, 19 nt, Homo sapiens
caaguaaucucuucaauag

SEQ ID NO: 679621 - RNA, 19 nt, Homo sapiens
caaaucagguccuaaagaa

SEQ ID NO: 679622 - RNA, 19 nt, Homo sapiens
caagucaccucuuaaguuu

SEQ ID NO: 679623 - RNA, 19 nt, Homo sapiens
gagagaaucuggcaauaga

SEQ ID NO: 679624 - RNA, 19 nt, Homo sapiens
gcaccaaauugucaaguaa

SEQ ID NO: 679625 - RNA, 19 nt, Homo sapiens
aaagauaacucucuggaaa

SEQ ID NO: 679626 - RNA, 19 nt, Homo sapiens
gauaaacucugcaaaucuu

SEQ ID NO: 679627 - RNA, 19 nt, Homo sapiens
caaguaaaccuguagauuu

SEQ ID NO: 679628 - RNA, 19 nt, Homo sapiens
ggacaggaccuaauaauuc

SEQ ID NO: 679629 - RNA, 19 nt, Homo sapiens
caaccagacuuacagcaua

SEQ ID NO: 679630 - RNA, 19 nt, Homo sapiens
gaagaucucugcguuugaa

SEQ ID NO: 679631 - RNA, 19 nt, Homo sapiens
gaagauagcccagaggaaa

SEQ ID NO: 679632 - RNA, 19 nt, Homo sapiens
ugaagaaggugaauaugaa

SEQ ID NO: 679633 - RNA, 19 nt, Homo sapiens
ucugagagaugaaucaaua

SEQ ID NO: 679634 - RNA, 19 nt, Homo sapiens
gaacagaaguccaugucau

SEQ ID NO: 679635 - RNA, 19 nt, Homo sapiens
gugaguagcugaaagcauu

SEQ ID NO: 679636 - RNA, 19 nt, Homo sapiens
cuaaggcucucaugaaauu

SEQ ID NO: 679637 - RNA, 19 nt, Homo sapiens
gaaggucgguguaagugaa

SEQ ID NO: 679638 - RNA, 19 nt, Homo sapiens
gaagacuaauucaguaaga

SEQ ID NO: 679639 - RNA, 19 nt, Homo sapiens
gagauaaacucugcaaauc

SEQ ID NO: 679640 - RNA, 19 nt, Homo sapiens
aaagucaagucaccucuua

SEQ ID NO: 679641 - RNA, 19 nt, Homo sapiens
uacagacucuuaucgauua

SEQ ID NO: 679642 - RNA, 19 nt, Homo sapiens
gacuaaggcucucaugaaa

SEQ ID NO: 679643 - RNA, 19 nt, Homo sapiens
ccaaggugauuucuuauau

SEQ ID NO: 679644 - RNA, 19 nt, Homo sapiens
gggcauuucuucugggaua

SEQ ID NO: 679645 - RNA, 19 nt, Homo sapiens
agaaguagaugcaaaugaa

SEQ ID NO: 679646 - RNA, 19 nt, Homo sapiens
gaggaaaccuuacuaacuc

SEQ ID NO: 679647 - RNA, 19 nt, Homo sapiens
gaaagaaucagaaagaagu

SEQ ID NO: 679648 - RNA, 19 nt, Homo sapiens
guacaaagguucuccaaaa

SEQ ID NO: 679649 - RNA, 19 nt, Homo sapiens
caacucagaugaagaugga

SEQ ID NO: 679650 - RNA, 19 nt, Homo sapiens
ggaauaagcagacagaauc

SEQ ID NO: 679651 - RNA, 19 nt, Homo sapiens
aagcagagguuagacuuua

SEQ ID NO: 679652 - RNA, 19 nt, Homo sapiens
aaagguuucugaucacaua

SEQ ID NO: 679653 - RNA, 19 nt, Homo sapiens
caaauuaccggaugucuug

SEQ ID NO: 679654 - RNA, 19 nt, Homo sapiens
guaaaccuguagauuugua

SEQ ID NO: 679655 - RNA, 19 nt, Homo sapiens
gaaagaaggucgguguaag

SEQ ID NO: 679656 - RNA, 19 nt, Homo sapiens
ggaagggccugguacaaag

SEQ ID NO: 679657 - RNA, 19 nt, Homo sapiens
aaacagcagucauuggaaa

SEQ ID NO: 679658 - RNA, 19 nt, Homo sapiens
caagaauucuccagugaug

SEQ ID NO: 679659 - RNA, 19 nt, Homo sapiens
gacaggaccuaauaauuca

SEQ ID NO: 679660 - RNA, 19 nt, Homo sapiens
uaaaguggaucauggugaa

SEQ ID NO: 679661 - RNA, 19 nt, Homo sapiens
gaaagaagucuaugugagu

SEQ ID NO: 679662 - RNA, 19 nt, Homo sapiens
gauauauguugucugcuuu

SEQ ID NO: 679663 - RNA, 19 nt, Homo sapiens
guucuggugucaauagaua

SEQ ID NO: 679664 - RNA, 19 nt, Homo sapiens
ggaaguccaucaagcacaa

SEQ ID NO: 679665 - RNA, 19 nt, Homo sapiens
gaucaaagggcuaagagaa

SEQ ID NO: 679666 - RNA, 19 nt, Homo sapiens
gaaaaugacuugacuaagg

SEQ ID NO: 679667 - RNA, 19 nt, Homo sapiens
gaaagugcaucaaaagauu

SEQ ID NO: 679668 - RNA, 19 nt, Homo sapiens
ccaaguaaucucuucaaua

SEQ ID NO: 679669 - RNA, 19 nt, Homo sapiens
guggagcacuaaauaaauu

SEQ ID NO: 679670 - RNA, 19 nt, Homo sapiens
gaucacauacagugguuua

SEQ ID NO: 679671 - RNA, 19 nt, Homo sapiens
ucagagaguuaucgacgua

SEQ ID NO: 679672 - RNA, 19 nt, Homo sapiens
ggaaagaguauuaugaaca

SEQ ID NO: 679673 - RNA, 19 nt, Homo sapiens
gaggaaagaguauuaugaa

SEQ ID NO: 679674 - RNA, 19 nt, Homo sapiens
gaaagaauggagcaaguug

SEQ ID NO: 679675 - RNA, 19 nt, Homo sapiens
guacaagcaacuuagauuu

SEQ ID NO: 679676 - RNA, 19 nt, Homo sapiens
gcaggaugauguacauguu

SEQ ID NO: 679677 - RNA, 19 nt, Homo sapiens
gguaugacuugcaggauga

SEQ ID NO: 679678 - RNA, 19 nt, Homo sapiens
ugauacagcuucuccuuug

SEQ ID NO: 679679 - RNA, 19 nt, Homo sapiens
ucucaugguuucucaagua

SEQ ID NO: 679680 - RNA, 19 nt, Homo sapiens
gagaagcgggucuguguaa

SEQ ID NO: 679681 - RNA, 19 nt, Homo sapiens
gcuagguucuacuuuguuu

SEQ ID NO: 679682 - RNA, 19 nt, Homo sapiens
gaaucaaccacuaaaggua

SEQ ID NO: 679683 - RNA, 19 nt, Homo sapiens
ugaaacuccuggugaauau

SEQ ID NO: 679684 - RNA, 19 nt, Homo sapiens
gcaguaguacagacucuua

SEQ ID NO: 679685 - RNA, 19 nt, Homo sapiens
gauauugcgggacuucuua

SEQ ID NO: 679686 - RNA, 19 nt, Homo sapiens
gaguauagcagacaaccua

SEQ ID NO: 679687 - RNA, 19 nt, Homo sapiens
cagaggcagucaucaguaa

SEQ ID NO: 679688 - RNA, 19 nt, Homo sapiens
ccaaagaaagguucagaaa

SEQ ID NO: 679689 - RNA, 19 nt, Homo sapiens
aaguaaaccuguagauuug

SEQ ID NO: 679690 - RNA, 19 nt, Homo sapiens
gaagggucaucucagaguu

SEQ ID NO: 679691 - RNA, 19 nt, Homo sapiens
ucagaagggucaucucaga

SEQ ID NO: 679692 - RNA, 19 nt, Homo sapiens
agaaagaauugcccagcua

SEQ ID NO: 679693 - RNA, 19 nt, Homo sapiens
gauuaugcaucagauauug

SEQ ID NO: 679694 - RNA, 19 nt, Homo sapiens
ggugauuucuuauauguag

SEQ ID NO: 679695 - RNA, 19 nt, Homo sapiens
gcucuuuccucuuguauag

SEQ ID NO: 679696 - RNA, 19 nt, Homo sapiens
agaugaagauggaacauga

SEQ ID NO: 679697 - RNA, 19 nt, Homo sapiens
gaagaaggugaauaugaaa

SEQ ID NO: 679698 - RNA, 19 nt, Homo sapiens
aaagaagucuaugugagua

SEQ ID NO: 679699 - RNA, 19 nt, Homo sapiens
guuagaaugucauguuuag

SEQ ID NO: 679700 - RNA, 19 nt, Homo sapiens
gaaggaauaagcagacaga

SEQ ID NO: 679701 - RNA, 19 nt, Homo sapiens
gaacaugcaccaaauuguc

SEQ ID NO: 679702 - RNA, 19 nt, Homo sapiens
gacagaacauagaaagguu

SEQ ID NO: 679703 - RNA, 19 nt, Homo sapiens
agaauaugauggaagguaa

SEQ ID NO: 679704 - RNA, 19 nt, Homo sapiens
gaugaaaaguuaccaaaga

SEQ ID NO: 679705 - RNA, 19 nt, Homo sapiens
gauuagagcagcauucaug

SEQ ID NO: 679706 - RNA, 19 nt, Homo sapiens
uauuacaccucaagaagaa

SEQ ID NO: 679707 - RNA, 19 nt, Homo sapiens
guacagacucuuaucgauu

SEQ ID NO: 679708 - RNA, 19 nt, Homo sapiens
gcacagaggaaaagaauaa

SEQ ID NO: 679709 - RNA, 19 nt, Homo sapiens
auauguagaugcucgauuu

SEQ ID NO: 679710 - RNA, 19 nt, Homo sapiens
caaggugauuucuuauaug

SEQ ID NO: 679711 - RNA, 19 nt, Homo sapiens
gguuaaggcagaauaauga

SEQ ID NO: 679712 - RNA, 19 nt, Homo sapiens
cauauaaaggguagagaua

SEQ ID NO: 679713 - RNA, 19 nt, Homo sapiens
gagcaaguugugccuauuu

SEQ ID NO: 679714 - RNA, 19 nt, Homo sapiens
ucaaaucagugagcuguga

SEQ ID NO: 679715 - RNA, 19 nt, Homo sapiens
ggacucaucugcaacauuu

SEQ ID NO: 679716 - RNA, 19 nt, Homo sapiens
uaaagugucuuccauuguu

SEQ ID NO: 679717 - RNA, 19 nt, Homo sapiens
ucagauaucucaaccaaug

SEQ ID NO: 679718 - RNA, 19 nt, Homo sapiens
guaacuaucuauacaccua

SEQ ID NO: 679719 - RNA, 19 nt, Homo sapiens
gcaggaaccuugcacuuca

SEQ ID NO: 679720 - RNA, 19 nt, Homo sapiens
agagugagcugcacaaguu

SEQ ID NO: 679721 - RNA, 19 nt, Homo sapiens
uaaaugcccuggguucuuu

SEQ ID NO: 679722 - RNA, 19 nt, Homo sapiens
gcacuuccguucagauuca

SEQ ID NO: 679723 - RNA, 19 nt, Homo sapiens
ccucagcgcuuaccauuau

SEQ ID NO: 679724 - RNA, 19 nt, Homo sapiens
ccaguucaauggauacuaa

SEQ ID NO: 679725 - RNA, 19 nt, Homo sapiens
gaagaaguacuaacgcauu

SEQ ID NO: 679726 - RNA, 19 nt, Homo sapiens
gggacgaccucaaggauga

SEQ ID NO: 679727 - RNA, 19 nt, Homo sapiens
cagcuucucaugugaauua

SEQ ID NO: 679728 - RNA, 19 nt, Homo sapiens
ugaaccgaguccaguauua

SEQ ID NO: 679729 - RNA, 19 nt, Homo sapiens
ucacuuagcgacucagaua

SEQ ID NO: 679730 - RNA, 19 nt, Homo sapiens
gcagggcauucaucuuuga

SEQ ID NO: 679731 - RNA, 19 nt, Homo sapiens
gcaucaaccucuuccucua

SEQ ID NO: 679732 - RNA, 19 nt, Homo sapiens
gaguugaaauguugagaga

SEQ ID NO: 679733 - RNA, 19 nt, Homo sapiens
ggcaagaguuugaaaauaa

SEQ ID NO: 679734 - RNA, 19 nt, Homo sapiens
ggaugagguugcugugauu

SEQ ID NO: 679735 - RNA, 19 nt, Homo sapiens
uaacuuacccuauggacaa

SEQ ID NO: 679736 - RNA, 19 nt, Homo sapiens
guugaaauguugagagaug

SEQ ID NO: 679737 - RNA, 19 nt, Homo sapiens
ccagauugcgccagcauua

SEQ ID NO: 679738 - RNA, 19 nt, Homo sapiens
ugaauuugcugauguucuu

SEQ ID NO: 679739 - RNA, 19 nt, Homo sapiens
ccacgugggaguucacuua

SEQ ID NO: 679740 - RNA, 19 nt, Homo sapiens
aauaaagugucuuccauug

SEQ ID NO: 679741 - RNA, 19 nt, Homo sapiens
gaaaguuauucagcucuug

SEQ ID NO: 679742 - RNA, 19 nt, Homo sapiens
guaacuaacucuuucuaac

SEQ ID NO: 679743 - RNA, 19 nt, Homo sapiens
ccuguuggcuugugaaaug

SEQ ID NO: 679744 - RNA, 19 nt, Homo sapiens
acaaccagcugaacuacaa

SEQ ID NO: 679745 - RNA, 19 nt, Homo sapiens
ugaagauggucuccuuuga

SEQ ID NO: 679746 - RNA, 19 nt, Homo sapiens
ucagaagcaucaagaccua

SEQ ID NO: 679747 - RNA, 19 nt, Homo sapiens
uagcagggcauucaucuuu

SEQ ID NO: 679748 - RNA, 19 nt, Homo sapiens
gcuaaccuaugacaauuca

SEQ ID NO: 679749 - RNA, 19 nt, Homo sapiens
guuaagggauuuauaugca

SEQ ID NO: 679750 - RNA, 19 nt, Homo sapiens
cauaacuguuugugaugua

SEQ ID NO: 679751 - RNA, 19 nt, Homo sapiens
caagagcagugcagaggau

SEQ ID NO: 679752 - RNA, 19 nt, Homo sapiens
gagggaaaguccaguguac

SEQ ID NO: 679753 - RNA, 19 nt, Homo sapiens
accaauggcugcuuuguug

SEQ ID NO: 679754 - RNA, 19 nt, Homo sapiens
guaccuacuucuccacuca

SEQ ID NO: 679755 - RNA, 19 nt, Homo sapiens
gcaguuccaugagagcaaa

SEQ ID NO: 679756 - RNA, 19 nt, Homo sapiens
ccucuucucuucaccaguu

SEQ ID NO: 679757 - RNA, 19 nt, Homo sapiens
ccaacaaccagcugaacua

SEQ ID NO: 679758 - RNA, 19 nt, Homo sapiens
gaauucagaagcaucaaga

SEQ ID NO: 679759 - RNA, 19 nt, Homo sapiens
ggagggaaaguccagugua

SEQ ID NO: 679760 - RNA, 19 nt, Homo sapiens
agagacggcuccucagaug

SEQ ID NO: 679761 - RNA, 19 nt, Homo sapiens
accaagaguugaaauguug

SEQ ID NO: 679762 - RNA, 19 nt, Homo sapiens
cagacuggaauacgaaaua

SEQ ID NO: 679763 - RNA, 19 nt, Homo sapiens
gggcaagaguuugaaaaua

SEQ ID NO: 679764 - RNA, 19 nt, Homo sapiens
uuacuguacugucaauaga

SEQ ID NO: 679765 - RNA, 19 nt, Homo sapiens
uaccaagaguugaaauguu

SEQ ID NO: 679766 - RNA, 19 nt, Homo sapiens
ggccugcacuugaccaugu

SEQ ID NO: 679767 - RNA, 19 nt, Homo sapiens
ccacccagcucucccaucu

SEQ ID NO: 679768 - RNA, 19 nt, Homo sapiens
gcaaggccucgacucauga

SEQ ID NO: 679769 - RNA, 19 nt, Homo sapiens
ggaagaaggaauucagaag

SEQ ID NO: 679770 - RNA, 19 nt, Homo sapiens
ccauguagguggcagagau

SEQ ID NO: 679771 - RNA, 19 nt, Homo sapiens
guucaaaagucucauguga

SEQ ID NO: 679772 - RNA, 19 nt, Homo sapiens
gaaugacuaacacauccua

SEQ ID NO: 679773 - RNA, 19 nt, Homo sapiens
acuguacugucaauagaua

SEQ ID NO: 679774 - RNA, 19 nt, Homo sapiens
acucagauaucucaaccaa

SEQ ID NO: 679775 - RNA, 19 nt, Homo sapiens
aagaaguacuaacgcauug

SEQ ID NO: 679776 - RNA, 19 nt, Homo sapiens
gaagauggucuccuuugag

SEQ ID NO: 679777 - RNA, 19 nt, Homo sapiens
uacaguaacuaacucuuuc

SEQ ID NO: 679778 - RNA, 19 nt, Homo sapiens
ucugguagaucacauguag

SEQ ID NO: 679779 - RNA, 19 nt, Homo sapiens
gaaccgaguccaguauuag

SEQ ID NO: 679780 - RNA, 19 nt, Homo sapiens
cagaagccauggaggagau

SEQ ID NO: 679781 - RNA, 19 nt, Homo sapiens
gaagcccaguucaauggau

SEQ ID NO: 679782 - RNA, 19 nt, Homo sapiens
ucucaauccucuucucuuc

SEQ ID NO: 679783 - RNA, 19 nt, Homo sapiens
ggucaguggaugccuauga

SEQ ID NO: 679784 - RNA, 19 nt, Homo sapiens
gaaauguugagagaugauu

SEQ ID NO: 679785 - RNA, 19 nt, Homo sapiens
ccauggaggagauaaggua

SEQ ID NO: 679786 - RNA, 19 nt, Homo sapiens
gauuccggcugauccaguu

SEQ ID NO: 679787 - RNA, 19 nt, Homo sapiens
gagcaggaaccuugcacuu

SEQ ID NO: 679788 - RNA, 19 nt, Homo sapiens
aguauuagcugaaugucau

SEQ ID NO: 679789 - RNA, 19 nt, Homo sapiens
gcugggcacugcauacaag

SEQ ID NO: 679790 - RNA, 19 nt, Homo sapiens
cauuugauuucuaccaaga

SEQ ID NO: 679791 - RNA, 19 nt, Homo sapiens
gcugugauugagauaguua

SEQ ID NO: 679792 - RNA, 19 nt, Homo sapiens
ucuuugauguucuuccuuu

SEQ ID NO: 679793 - RNA, 19 nt, Homo sapiens
guuuaagucuggcugaauc

SEQ ID NO: 679794 - RNA, 19 nt, Homo sapiens
aggaugacguggaucugua

SEQ ID NO: 679795 - RNA, 19 nt, Homo sapiens
aagaaggaauucagaagca

SEQ ID NO: 679796 - RNA, 19 nt, Homo sapiens
uacacaauguuaagggauu

SEQ ID NO: 679797 - RNA, 19 nt, Homo sapiens
gcagggaggaacagacaug

SEQ ID NO: 679798 - RNA, 19 nt, Homo sapiens
gaaguacuaacgcauugau

SEQ ID NO: 679799 - RNA, 19 nt, Homo sapiens
caugagagcaaaguggaua

SEQ ID NO: 679800 - RNA, 19 nt, Homo sapiens
acuccgagcuggacauugu

SEQ ID NO: 679801 - RNA, 19 nt, Homo sapiens
ccugagagcucuaguuuuc

SEQ ID NO: 679802 - RNA, 19 nt, Homo sapiens
guguguauauuaagcugaa

SEQ ID NO: 679803 - RNA, 19 nt, Homo sapiens
acacaauguuaagggauuu

SEQ ID NO: 679804 - RNA, 19 nt, Homo sapiens
gcacuucacacuucuugag

SEQ ID NO: 679805 - RNA, 19 nt, Homo sapiens
guacaccacagcucaguca

SEQ ID NO: 679806 - RNA, 19 nt, Homo sapiens
aagcccaguucaauggaua

SEQ ID NO: 679807 - RNA, 19 nt, Homo sapiens
cugcuaaccuaugacaauu

SEQ ID NO: 679808 - RNA, 19 nt, Homo sapiens
ugacguggaucuguacaca

SEQ ID NO: 679809 - RNA, 19 nt, Homo sapiens
uggccaaagucgaguguga

SEQ ID NO: 679810 - RNA, 19 nt, Homo sapiens
gggaagcccaguucaaugg

SEQ ID NO: 679811 - RNA, 19 nt, Homo sapiens
ucacagacuggaauacgaa

SEQ ID NO: 679812 - RNA, 19 nt, Homo sapiens
ccauaacuguuugugaugu

SEQ ID NO: 679813 - RNA, 19 nt, Homo sapiens
gagagacggcuccucagau

SEQ ID NO: 679814 - RNA, 19 nt, Homo sapiens
ugacuaacacauccuagga

SEQ ID NO: 679815 - RNA, 19 nt, Homo sapiens
gaaccugccugaacucaua

SEQ ID NO: 679816 - RNA, 19 nt, Homo sapiens
gaaaucauguucacuggua

SEQ ID NO: 679817 - RNA, 19 nt, Homo sapiens
ggacauacuuccacuauau

SEQ ID NO: 679818 - RNA, 19 nt, Homo sapiens
gauauuugcuguugucaua

SEQ ID NO: 679819 - RNA, 19 nt, Homo sapiens
ggaggaggcuucuguguaa

SEQ ID NO: 679820 - RNA, 19 nt, Homo sapiens
ugagaaagcuggauuuaaa

SEQ ID NO: 679821 - RNA, 19 nt, Homo sapiens
ggaaagacaucuggaauau

SEQ ID NO: 679822 - RNA, 19 nt, Homo sapiens
gaaacccuauccucaaaua

SEQ ID NO: 679823 - RNA, 19 nt, Homo sapiens
gaucaaaucuggcgccuau

SEQ ID NO: 679824 - RNA, 19 nt, Homo sapiens
gcaaguggcugcacaguuc

SEQ ID NO: 679825 - RNA, 19 nt, Homo sapiens
gaacaucauucagcacuuu

SEQ ID NO: 679826 - RNA, 19 nt, Homo sapiens
guucaacgcugugucauua

SEQ ID NO: 679827 - RNA, 19 nt, Homo sapiens
gaagaucccugagaugcua

SEQ ID NO: 679828 - RNA, 19 nt, Homo sapiens
caaagcacauuucauauuc

SEQ ID NO: 679829 - RNA, 19 nt, Homo sapiens
gagcagcaauuccaagaaa

SEQ ID NO: 679830 - RNA, 19 nt, Homo sapiens
caaaucagccgaaagaauu

SEQ ID NO: 679831 - RNA, 19 nt, Homo sapiens
ucacuuugguuuccuauaa

SEQ ID NO: 679832 - RNA, 19 nt, Homo sapiens
ucauagagauucacaauuc

SEQ ID NO: 679833 - RNA, 19 nt, Homo sapiens
caagugccauuucggauuu

SEQ ID NO: 679834 - RNA, 19 nt, Homo sapiens
gaaacaggaugagaagcua

SEQ ID NO: 679835 - RNA, 19 nt, Homo sapiens
guacaaaucagccgaaaga

SEQ ID NO: 679836 - RNA, 19 nt, Homo sapiens
gaaguagaguggagcauca

SEQ ID NO: 679837 - RNA, 19 nt, Homo sapiens
gcaguuaacagugauauuu

SEQ ID NO: 679838 - RNA, 19 nt, Homo sapiens
gcagcuagauggacagaug

SEQ ID NO: 679839 - RNA, 19 nt, Homo sapiens
gagaggaacuccagcaagu

SEQ ID NO: 679840 - RNA, 19 nt, Homo sapiens
gcgaaacccuauccucaaa

SEQ ID NO: 679841 - RNA, 19 nt, Homo sapiens
ucucaaagcacauuucaua

SEQ ID NO: 679842 - RNA, 19 nt, Homo sapiens
cgagaaaccaugaguguaa

SEQ ID NO: 679843 - RNA, 19 nt, Homo sapiens
ucaacaggcucaaggauau

SEQ ID NO: 679844 - RNA, 19 nt, Homo sapiens
gaaaggaggaggcuucugu

SEQ ID NO: 679845 - RNA, 19 nt, Homo sapiens
ucuaugagcugguugcauu

SEQ ID NO: 679846 - RNA, 19 nt, Homo sapiens
gggaaagacaucuggaaua

SEQ ID NO: 679847 - RNA, 19 nt, Homo sapiens
caccaaagcuacaggauuc

SEQ ID NO: 679848 - RNA, 19 nt, Homo sapiens
gaaaggaaaucauguucac

SEQ ID NO: 679849 - RNA, 19 nt, Homo sapiens
gaaaggauucuaucuucaa

SEQ ID NO: 679850 - RNA, 19 nt, Homo sapiens
ccugagagcuggaggagaa

SEQ ID NO: 679851 - RNA, 19 nt, Homo sapiens
gagaagcuauugcugaagu

SEQ ID NO: 679852 - RNA, 19 nt, Homo sapiens
caacgagagcgacaucaua

SEQ ID NO: 679853 - RNA, 19 nt, Homo sapiens
aaacgggccuucuucauca

SEQ ID NO: 679854 - RNA, 19 nt, Homo sapiens
gacaacaggucucguucaa

SEQ ID NO: 679855 - RNA, 19 nt, Homo sapiens
gcaggagguuacaaaguug

SEQ ID NO: 679856 - RNA, 19 nt, Homo sapiens
gaucaagacaccaaagcua

SEQ ID NO: 679857 - RNA, 19 nt, Homo sapiens
ggaacucgguacugucaga

SEQ ID NO: 679858 - RNA, 19 nt, Homo sapiens
acaggaaucuggcugaaga

SEQ ID NO: 679859 - RNA, 19 nt, Homo sapiens
uaucuguacuuugcaguua

SEQ ID NO: 679860 - RNA, 19 nt, Homo sapiens
ggacaggaaucuggcugaa

SEQ ID NO: 679861 - RNA, 19 nt, Homo sapiens
ugguaaagcugaucaaauc

SEQ ID NO: 679862 - RNA, 19 nt, Homo sapiens
gaaggagugcuguugugua

SEQ ID NO: 679863 - RNA, 19 nt, Homo sapiens
gugcuaaccuugaagagau

SEQ ID NO: 679864 - RNA, 19 nt, Homo sapiens
ggagggcagugcagaggaa

SEQ ID NO: 679865 - RNA, 19 nt, Homo sapiens
gcauugacgucaucagaca

SEQ ID NO: 679866 - RNA, 19 nt, Homo sapiens
gaagaggccgugcggaaug

SEQ ID NO: 679867 - RNA, 19 nt, Homo sapiens
ggagugcuguuguguacau

SEQ ID NO: 679868 - RNA, 19 nt, Homo sapiens
gagugaagaucccugagau

SEQ ID NO: 679869 - RNA, 19 nt, Homo sapiens
gaagaaggagaaccugaug

SEQ ID NO: 679870 - RNA, 19 nt, Homo sapiens
gaagaugcccgugguguuc

SEQ ID NO: 679871 - RNA, 19 nt, Homo sapiens
gaaagacaucuggaauauu

SEQ ID NO: 679872 - RNA, 19 nt, Homo sapiens
caugaaggccggugugaaa

SEQ ID NO: 679873 - RNA, 19 nt, Homo sapiens
uaaguagccugucuucucu

SEQ ID NO: 679874 - RNA, 19 nt, Homo sapiens
ccucagacaugcaagugaa

SEQ ID NO: 679875 - RNA, 19 nt, Homo sapiens
guugucauauuaagcauug

SEQ ID NO: 679876 - RNA, 19 nt, Homo sapiens
gcagauccacgacuacaga

SEQ ID NO: 679877 - RNA, 19 nt, Homo sapiens
ggcaugaucuuccauacca

SEQ ID NO: 679878 - RNA, 19 nt, Homo sapiens
gcugugggcuccucagaca

SEQ ID NO: 679879 - RNA, 19 nt, Homo sapiens
uagaguggagcaucaguua

SEQ ID NO: 679880 - RNA, 19 nt, Homo sapiens
gcugagaaagcuggauuua

SEQ ID NO: 679881 - RNA, 19 nt, Homo sapiens
aaagauauuugcuguuguc

SEQ ID NO: 679882 - RNA, 19 nt, Homo sapiens
ccauagugcuaaccuugaa

SEQ ID NO: 679883 - RNA, 19 nt, Homo sapiens
uaugugcgcugcccucaga

SEQ ID NO: 679884 - RNA, 19 nt, Homo sapiens
acacauggauggagcucuu

SEQ ID NO: 679885 - RNA, 19 nt, Homo sapiens
cccaaaagcucuucucaaa

SEQ ID NO: 679886 - RNA, 19 nt, Homo sapiens
aagagcagauccacgacua

SEQ ID NO: 679887 - RNA, 19 nt, Homo sapiens
cagcauggcuucggcuuca

SEQ ID NO: 679888 - RNA, 19 nt, Homo sapiens
gagaaaggaaaucauguuc

SEQ ID NO: 679889 - RNA, 19 nt, Homo sapiens
gagaaccugcgacaucuga

SEQ ID NO: 679890 - RNA, 19 nt, Homo sapiens
gcucaaugcugugcucauc

SEQ ID NO: 679891 - RNA, 19 nt, Homo sapiens
ggaacaucauucagcacuu

SEQ ID NO: 679892 - RNA, 19 nt, Homo sapiens
gcagcaauuccaagaaaga

SEQ ID NO: 679893 - RNA, 19 nt, Homo sapiens
acaaguggcuaccguucuu

SEQ ID NO: 679894 - RNA, 19 nt, Homo sapiens
gaaagcuggauuuaaagga

SEQ ID NO: 679895 - RNA, 19 nt, Homo sapiens
ggaggcuucuguguaaaug

SEQ ID NO: 679896 - RNA, 19 nt, Homo sapiens
gcuguuguguacauacuau

SEQ ID NO: 679897 - RNA, 19 nt, Homo sapiens
uaacccagcgggagauuga

SEQ ID NO: 679898 - RNA, 19 nt, Homo sapiens
gagaacaaccagcaguaug

SEQ ID NO: 679899 - RNA, 19 nt, Homo sapiens
cagaaggacagcugagaaa

SEQ ID NO: 679900 - RNA, 19 nt, Homo sapiens
aggcaacgaugauccaaga

SEQ ID NO: 679901 - RNA, 19 nt, Homo sapiens
agcaggagguuacaaaguu

SEQ ID NO: 679902 - RNA, 19 nt, Homo sapiens
gauaaacgggccuucuuca

SEQ ID NO: 679903 - RNA, 19 nt, Homo sapiens
agagaucagugaccucaug

SEQ ID NO: 679904 - RNA, 19 nt, Homo sapiens
ggugugaagccaugaagaa

SEQ ID NO: 679905 - RNA, 19 nt, Homo sapiens
agaacaaccagcaguauga

SEQ ID NO: 679906 - RNA, 19 nt, Homo sapiens
gcccagaggaagacuauga

SEQ ID NO: 679907 - RNA, 19 nt, Homo sapiens
gaccggaucaucaaaguca

SEQ ID NO: 679908 - RNA, 19 nt, Homo sapiens
ugcagcggcucaccaagua

SEQ ID NO: 679909 - RNA, 19 nt, Homo sapiens
cgagagcgacaucauauuc

SEQ ID NO: 679910 - RNA, 19 nt, Homo sapiens
cauguucacugguagaagu

SEQ ID NO: 679911 - RNA, 19 nt, Homo sapiens
aaagcuggauuuaaaggau

SEQ ID NO: 679912 - RNA, 19 nt, Homo sapiens
uaaacgggccuucuucauc

SEQ ID NO: 679913 - RNA, 19 nt, Homo sapiens
gagggucucuugccaacag

SEQ ID NO: 679914 - RNA, 19 nt, Homo sapiens
cagagaaccgccaccguuu

SEQ ID NO: 679915 - RNA, 19 nt, Homo sapiens
gagaaacuguucccaaaua

SEQ ID NO: 679916 - RNA, 19 nt, Homo sapiens
gcagauggaugaucaguug

SEQ ID NO: 679917 - RNA, 19 nt, Homo sapiens
uaaaggcccuggucaaauu

SEQ ID NO: 679918 - RNA, 19 nt, Homo sapiens
gcucuucuguucauucuua

SEQ ID NO: 679919 - RNA, 19 nt, Homo sapiens
gaagguucaucgccuauaa

SEQ ID NO: 679920 - RNA, 19 nt, Homo sapiens
ggaagaacgggaaauguua

SEQ ID NO: 679921 - RNA, 19 nt, Homo sapiens
gcagacaggugcaauggaa

SEQ ID NO: 679922 - RNA, 19 nt, Homo sapiens
gcacugaucugcacauuuu

SEQ ID NO: 679923 - RNA, 19 nt, Homo sapiens
gauagucucuuuggcauuu

SEQ ID NO: 679924 - RNA, 19 nt, Homo sapiens
gaaggaagcacgccaaguu

SEQ ID NO: 679925 - RNA, 19 nt, Homo sapiens
ggaggaagccuggguauuu

SEQ ID NO: 679926 - RNA, 19 nt, Homo sapiens
gcuuucagcuauagcauua

SEQ ID NO: 679927 - RNA, 19 nt, Homo sapiens
aacaagaggucuagcuuua

SEQ ID NO: 679928 - RNA, 19 nt, Homo sapiens
ggauggagaugcagaaugg

SEQ ID NO: 679929 - RNA, 19 nt, Homo sapiens
ggaugaaggugggaagaaa

SEQ ID NO: 679930 - RNA, 19 nt, Homo sapiens
uauguaaccuggucagauu

SEQ ID NO: 679931 - RNA, 19 nt, Homo sapiens
cuuaucaccuucaaacaua

SEQ ID NO: 679932 - RNA, 19 nt, Homo sapiens
gacacgggaucaucuguaa

SEQ ID NO: 679933 - RNA, 19 nt, Homo sapiens
gaugaucaguugaguuuag

SEQ ID NO: 679934 - RNA, 19 nt, Homo sapiens
guagagacaucaccaagca

SEQ ID NO: 679935 - RNA, 19 nt, Homo sapiens
ccauagggauagucucuuu

SEQ ID NO: 679936 - RNA, 19 nt, Homo sapiens
guacagccauuguguccuu

SEQ ID NO: 679937 - RNA, 19 nt, Homo sapiens
gaguagagcuggaaaaguu

SEQ ID NO: 679938 - RNA, 19 nt, Homo sapiens
gcagucagcagauggauga

SEQ ID NO: 679939 - RNA, 19 nt, Homo sapiens
ggaaggaaccguagcuugu

SEQ ID NO: 679940 - RNA, 19 nt, Homo sapiens
gcacuggacugggcacuuc

SEQ ID NO: 679941 - RNA, 19 nt, Homo sapiens
gaaggagucagcacaguga

SEQ ID NO: 679942 - RNA, 19 nt, Homo sapiens
agaaacuguucccaaauaa

SEQ ID NO: 679943 - RNA, 19 nt, Homo sapiens
gcauagaccucugcaccuu

SEQ ID NO: 679944 - RNA, 19 nt, Homo sapiens
gagaggaagugagagcauu

SEQ ID NO: 679945 - RNA, 19 nt, Homo sapiens
gcccaaaggucuugucagu

SEQ ID NO: 679946 - RNA, 19 nt, Homo sapiens
ggcauuagauucucauaag

SEQ ID NO: 679947 - RNA, 19 nt, Homo sapiens
gcagugcucuuaucaccau

SEQ ID NO: 679948 - RNA, 19 nt, Homo sapiens
agucuuaguuucugucuuu

SEQ ID NO: 679949 - RNA, 19 nt, Homo sapiens
ggucuugacuccuugacuu

SEQ ID NO: 679950 - RNA, 19 nt, Homo sapiens
ccuaauccaugucaccuuu

SEQ ID NO: 679951 - RNA, 19 nt, Homo sapiens
guucaucgccuauaacgaa

SEQ ID NO: 679952 - RNA, 19 nt, Homo sapiens
ucucuucacuguucagaaa

SEQ ID NO: 679953 - RNA, 19 nt, Homo sapiens
ccuguuuccucaucuauaa

SEQ ID NO: 679954 - RNA, 19 nt, Homo sapiens
uuuauagccugaagccuua

SEQ ID NO: 679955 - RNA, 19 nt, Homo sapiens
gugaagugcugcccauaga

SEQ ID NO: 679956 - RNA, 19 nt, Homo sapiens
ggagacagcuaagguggau

SEQ ID NO: 679957 - RNA, 19 nt, Homo sapiens
uguauugacuucugaaugu

SEQ ID NO: 679958 - RNA, 19 nt, Homo sapiens
gaucaucaggcauuagauu

SEQ ID NO: 679959 - RNA, 19 nt, Homo sapiens
gaggugaacuguccauugc

SEQ ID NO: 679960 - RNA, 19 nt, Homo sapiens
uaguuugucuuuccuguuu

SEQ ID NO: 679961 - RNA, 19 nt, Homo sapiens
gggaagaacgggaaauguu

SEQ ID NO: 679962 - RNA, 19 nt, Homo sapiens
ugacuggccuucaggaugu

SEQ ID NO: 679963 - RNA, 19 nt, Homo sapiens
gggagcagagggucacuua

SEQ ID NO: 679964 - RNA, 19 nt, Homo sapiens
ugucaucucuucacuguuc

SEQ ID NO: 679965 - RNA, 19 nt, Homo sapiens
gcguaagcgucaggaaaua

SEQ ID NO: 679966 - RNA, 19 nt, Homo sapiens
ggaaauguuaguaggugua

SEQ ID NO: 679967 - RNA, 19 nt, Homo sapiens
ucaaguacgucuacaaacu

SEQ ID NO: 679968 - RNA, 19 nt, Homo sapiens
ggauaguaaugccaacuca

SEQ ID NO: 679969 - RNA, 19 nt, Homo sapiens
ccuaauguauccaagaaau

SEQ ID NO: 679970 - RNA, 19 nt, Homo sapiens
gagcugccaugauugaagu

SEQ ID NO: 679971 - RNA, 19 nt, Homo sapiens
gaacgggaaauguuaguag

SEQ ID NO: 679972 - RNA, 19 nt, Homo sapiens
ucaaggugcugccuacuag

SEQ ID NO: 679973 - RNA, 19 nt, Homo sapiens
gaaggugggaagaaagauu

SEQ ID NO: 679974 - RNA, 19 nt, Homo sapiens
aaggagagccggauugauu

SEQ ID NO: 679975 - RNA, 19 nt, Homo sapiens
ggaaggagagccggauuga

SEQ ID NO: 679976 - RNA, 19 nt, Homo sapiens
aagaugagguaggcauaua

SEQ ID NO: 679977 - RNA, 19 nt, Homo sapiens
ucagaggauugccaagaaa

SEQ ID NO: 679978 - RNA, 19 nt, Homo sapiens
gaaugucuaguuugagaaa

SEQ ID NO: 679979 - RNA, 19 nt, Homo sapiens
gcacuccugugagaaucua

SEQ ID NO: 679980 - RNA, 19 nt, Homo sapiens
caagaggucuagcuuuaac

SEQ ID NO: 679981 - RNA, 19 nt, Homo sapiens
gaaggaaccguagcuuguu

SEQ ID NO: 679982 - RNA, 19 nt, Homo sapiens
gggauuauuuggucucaca

SEQ ID NO: 679983 - RNA, 19 nt, Homo sapiens
gguauucuccauagggaua

SEQ ID NO: 679984 - RNA, 19 nt, Homo sapiens
uaaggagugugcaaucuag

SEQ ID NO: 679985 - RNA, 19 nt, Homo sapiens
gcugucaccuaccauaugu

SEQ ID NO: 679986 - RNA, 19 nt, Homo sapiens
caguagcucugccgccuuu

SEQ ID NO: 679987 - RNA, 19 nt, Homo sapiens
uugagaaacuguucccaaa

SEQ ID NO: 679988 - RNA, 19 nt, Homo sapiens
guuccugccuccugacgua

SEQ ID NO: 679989 - RNA, 19 nt, Homo sapiens
gagcagagggucacuuagu

SEQ ID NO: 679990 - RNA, 19 nt, Homo sapiens
gagucgggcuuucagcuau

SEQ ID NO: 679991 - RNA, 19 nt, Homo sapiens
ccaccuagugcaucagaua

SEQ ID NO: 679992 - RNA, 19 nt, Homo sapiens
uaugaggauuacugagaua

SEQ ID NO: 679993 - RNA, 19 nt, Homo sapiens
ggaugaaucacuccagguu

SEQ ID NO: 679994 - RNA, 19 nt, Homo sapiens
ggugaacuguccauugcuu

SEQ ID NO: 679995 - RNA, 19 nt, Homo sapiens
agccuuaucuuucacacua

SEQ ID NO: 679996 - RNA, 19 nt, Homo sapiens
gagggaaaguugggacguu

SEQ ID NO: 679997 - RNA, 19 nt, Homo sapiens
acagguaccuccaggaaca

SEQ ID NO: 679998 - RNA, 19 nt, Homo sapiens
gagccuguuuccucaucua

SEQ ID NO: 679999 - RNA, 19 nt, Homo sapiens
ucucuuuccucccauauau

SEQ ID NO: 680000 - RNA, 19 nt, Homo sapiens
aaacaagaggucuagcuuu

SEQ ID NO: 680001 - RNA, 19 nt, Homo sapiens
caacuccccuaucacuuua

SEQ ID NO: 680002 - RNA, 19 nt, Homo sapiens
ggaggagccaggaggguuu

SEQ ID NO: 680003 - RNA, 19 nt, Homo sapiens
gaagaugagguaggcauau

SEQ ID NO: 680004 - RNA, 19 nt, Homo sapiens
gguuugcacuccugugaga

SEQ ID NO: 680005 - RNA, 19 nt, Homo sapiens
uagcugagggcuucuauug

SEQ ID NO: 680006 - RNA, 19 nt, Homo sapiens
guccauugcuuaucaccuu

SEQ ID NO: 680007 - RNA, 19 nt, Homo sapiens
gaagaacgggaaauguuag

SEQ ID NO: 680008 - RNA, 19 nt, Homo sapiens
uaagguggauggagaugca

SEQ ID NO: 680009 - RNA, 19 nt, Homo sapiens
cugaaugucuaguuugaga

SEQ ID NO: 680010 - RNA, 19 nt, Homo sapiens
uuccggagcugccaugauu

SEQ ID NO: 680011 - RNA, 19 nt, Homo sapiens
gacaguaaguacgcacuau

SEQ ID NO: 680012 - RNA, 19 nt, Homo sapiens
uggaugaucaguugaguuu

SEQ ID NO: 680013 - RNA, 19 nt, Homo sapiens
cuucugcucuugcaagcua

SEQ ID NO: 680014 - RNA, 19 nt, Homo sapiens
ugacuccacuuagcuaugu

SEQ ID NO: 680015 - RNA, 19 nt, Homo sapiens
gacaggagauggucauuga

SEQ ID NO: 680016 - RNA, 19 nt, Homo sapiens
ucauugcggucuuagauua

SEQ ID NO: 680017 - RNA, 19 nt, Homo sapiens
gcaccacucugaagcgaaa

SEQ ID NO: 680018 - RNA, 19 nt, Homo sapiens
gagcaaagcaugcgugaga

SEQ ID NO: 680019 - RNA, 19 nt, Homo sapiens
ggucuuagauuauguuucu

SEQ ID NO: 680020 - RNA, 19 nt, Homo sapiens
aaacaucuauucugccuau

SEQ ID NO: 680021 - RNA, 19 nt, Homo sapiens
gcuacgagcuucuggugaa

SEQ ID NO: 680022 - RNA, 19 nt, Homo sapiens
gcacggagacccucaagga

SEQ ID NO: 680023 - RNA, 19 nt, Homo sapiens
accaaacagucauguauua

SEQ ID NO: 680024 - RNA, 19 nt, Homo sapiens
agagaaggcucccacuuga

SEQ ID NO: 680025 - RNA, 19 nt, Homo sapiens
gaagcucccuauuggauca

SEQ ID NO: 680026 - RNA, 19 nt, Homo sapiens
ggaagucccugucaaaucc

SEQ ID NO: 680027 - RNA, 19 nt, Homo sapiens
ucaagaugcugacuauuag

SEQ ID NO: 680028 - RNA, 19 nt, Homo sapiens
ccugggagcuucuaccaaa

SEQ ID NO: 680029 - RNA, 19 nt, Homo sapiens
agugauggguuaaaucuaa

SEQ ID NO: 680030 - RNA, 19 nt, Homo sapiens
acacagagcagucguaugu

SEQ ID NO: 680031 - RNA, 19 nt, Homo sapiens
uguauuaacucucuuugga

SEQ ID NO: 680032 - RNA, 19 nt, Homo sapiens
gauuauguuucucuugcua

SEQ ID NO: 680033 - RNA, 19 nt, Homo sapiens
ggagggccaugugcaauau

SEQ ID NO: 680034 - RNA, 19 nt, Homo sapiens
ccacauuuaugccuauugu

SEQ ID NO: 680035 - RNA, 19 nt, Homo sapiens
gguggugccuuuagugguu

SEQ ID NO: 680036 - RNA, 19 nt, Homo sapiens
ggaagacgcagacaucauc

SEQ ID NO: 680037 - RNA, 19 nt, Homo sapiens
ggagauagaggcucacauc

SEQ ID NO: 680038 - RNA, 19 nt, Homo sapiens
gugaagagagcaagggaua

SEQ ID NO: 680039 - RNA, 19 nt, Homo sapiens
caagggauaucaggagguu

SEQ ID NO: 680040 - RNA, 19 nt, Homo sapiens
gaugaaguuuaaagaguca

SEQ ID NO: 680041 - RNA, 19 nt, Homo sapiens
caagcuggcugacauucug

SEQ ID NO: 680042 - RNA, 19 nt, Homo sapiens
gaagagagcaagggauauc

SEQ ID NO: 680043 - RNA, 19 nt, Homo sapiens
gcggaugguuuacauucuu

SEQ ID NO: 680044 - RNA, 19 nt, Homo sapiens
ugucugaccucaugaucaa

SEQ ID NO: 680045 - RNA, 19 nt, Homo sapiens
ccagauaucgccucagaga

SEQ ID NO: 680046 - RNA, 19 nt, Homo sapiens
ugacagugauggguuaaau

SEQ ID NO: 680047 - RNA, 19 nt, Homo sapiens
cagagaaggcucccacuug

SEQ ID NO: 680048 - RNA, 19 nt, Homo sapiens
guccaaggcccuaaacauu

SEQ ID NO: 680049 - RNA, 19 nt, Homo sapiens
gaaaugacaugaggaaaag

SEQ ID NO: 680050 - RNA, 19 nt, Homo sapiens
gaggaaaugacaugaggaa

SEQ ID NO: 680051 - RNA, 19 nt, Homo sapiens
gggagggccaugugcaaua

SEQ ID NO: 680052 - RNA, 19 nt, Homo sapiens
ugggugacauugaaaggua

SEQ ID NO: 680053 - RNA, 19 nt, Homo sapiens
ggaccacccugggacucua

SEQ ID NO: 680054 - RNA, 19 nt, Homo sapiens
gauaucaggagguuauuca

SEQ ID NO: 680055 - RNA, 19 nt, Homo sapiens
ggaaaugacaugaggaaaa

SEQ ID NO: 680056 - RNA, 19 nt, Homo sapiens
gcagcuggagcacauguuu

SEQ ID NO: 680057 - RNA, 19 nt, Homo sapiens
gcagcgagcccauccuugu

SEQ ID NO: 680058 - RNA, 19 nt, Homo sapiens
ccuggaagcucccuauugg

SEQ ID NO: 680059 - RNA, 19 nt, Homo sapiens
ugaauaaccagguguuugu

SEQ ID NO: 680060 - RNA, 19 nt, Homo sapiens
ggcaccgacuccuacauuu

SEQ ID NO: 680061 - RNA, 19 nt, Homo sapiens
ccaaacagucauguauuaa

SEQ ID NO: 680062 - RNA, 19 nt, Homo sapiens
agaucaagaugcugacuau

SEQ ID NO: 680063 - RNA, 19 nt, Homo sapiens
ugcaauauuuggaggguuu

SEQ ID NO: 680064 - RNA, 19 nt, Homo sapiens
ccgagaagcugccaucacu

SEQ ID NO: 680065 - RNA, 19 nt, Homo sapiens
caucuauucugccuauauc

SEQ ID NO: 680066 - RNA, 19 nt, Homo sapiens
gguuuacauucuuggcaua

SEQ ID NO: 680067 - RNA, 19 nt, Homo sapiens
ucauucaccugcucugaga

SEQ ID NO: 680068 - RNA, 19 nt, Homo sapiens
aucaagaugcugacuauua

SEQ ID NO: 680069 - RNA, 19 nt, Homo sapiens
ggaagcugccgcuggaaga

SEQ ID NO: 680070 - RNA, 19 nt, Homo sapiens
ggagauggucauugaagug

SEQ ID NO: 680071 - RNA, 19 nt, Homo sapiens
ggagguuauucagagcaua

SEQ ID NO: 680072 - RNA, 19 nt, Homo sapiens
caguggaggugauggcuau

SEQ ID NO: 680073 - RNA, 19 nt, Homo sapiens
auggagagcuuguggucua

SEQ ID NO: 680074 - RNA, 19 nt, Homo sapiens
gggcaccgacuccuacauu

SEQ ID NO: 680075 - RNA, 19 nt, Homo sapiens
gagauggucauugaaguga

SEQ ID NO: 680076 - RNA, 19 nt, Homo sapiens
ggacacagagcagucguau

SEQ ID NO: 680077 - RNA, 19 nt, Homo sapiens
gaauguagccuuuucaaca

SEQ ID NO: 680078 - RNA, 19 nt, Homo sapiens
cccaagcacuuauuuaugc

SEQ ID NO: 680079 - RNA, 19 nt, Homo sapiens
gccugacagugauggguua

SEQ ID NO: 680080 - RNA, 19 nt, Homo sapiens
caccaucuccuccagcuuu

SEQ ID NO: 680081 - RNA, 19 nt, Homo sapiens
aaauagaaacaccagauga

SEQ ID NO: 680082 - RNA, 19 nt, Homo sapiens
gcacugaggauggcugugu

SEQ ID NO: 680083 - RNA, 19 nt, Homo sapiens
gauaacuuccucaaugcaa

SEQ ID NO: 680084 - RNA, 19 nt, Homo sapiens
auugagggauggaggauuu

SEQ ID NO: 680085 - RNA, 19 nt, Homo sapiens
uaaauagaaacaccagaug

SEQ ID NO: 680086 - RNA, 19 nt, Homo sapiens
ggaugaugaaguuuaaaga

SEQ ID NO: 680087 - RNA, 19 nt, Homo sapiens
ggucauugcggucuuagau

SEQ ID NO: 680088 - RNA, 19 nt, Homo sapiens
ccucaguccucuagaucaa

SEQ ID NO: 680089 - RNA, 19 nt, Homo sapiens
ccuaaacauugcccguuga

SEQ ID NO: 680090 - RNA, 19 nt, Homo sapiens
aguacaagaugcuguggaa

SEQ ID NO: 680091 - RNA, 19 nt, Homo sapiens
agaacuccgugcucuguga

SEQ ID NO: 680092 - RNA, 19 nt, Homo sapiens
ggaagcacguggccaugac

SEQ ID NO: 680093 - RNA, 19 nt, Homo sapiens
gggauguggcgaccucuuu

SEQ ID NO: 680094 - RNA, 19 nt, Homo sapiens
cuaccaaacagucauguau

SEQ ID NO: 680095 - RNA, 19 nt, Homo sapiens
ccaaggcccuaaacauugc

SEQ ID NO: 680096 - RNA, 19 nt, Homo sapiens
gauggucauugaagugaag

SEQ ID NO: 680097 - RNA, 19 nt, Homo sapiens
ggccugccuuucucaaguu

SEQ ID NO: 680098 - RNA, 19 nt, Homo sapiens
cagcggaagucccugucaa

SEQ ID NO: 680099 - RNA, 19 nt, Homo sapiens
caaggacgacgaccuaugg

SEQ ID NO: 680100 - RNA, 19 nt, Homo sapiens
cccaugaucuccucacagu

SEQ ID NO: 680101 - RNA, 19 nt, Homo sapiens
ucaguccucuagaucaaga

SEQ ID NO: 680102 - RNA, 19 nt, Homo sapiens
ccacgugugucucuaccau

SEQ ID NO: 680103 - RNA, 19 nt, Homo sapiens
ugaccugcaucuuguaucu

SEQ ID NO: 680104 - RNA, 19 nt, Homo sapiens
gcaguggcaugcaguucuc

SEQ ID NO: 680105 - RNA, 19 nt, Homo sapiens
cagcucggccugcagauga

SEQ ID NO: 680106 - RNA, 19 nt, Homo sapiens
agaagaaaucccugaguga

SEQ ID NO: 680107 - RNA, 19 nt, Homo sapiens
aacauugcccguugacaua

SEQ ID NO: 680108 - RNA, 19 nt, Homo sapiens
uugaggaccugcugagugu

SEQ ID NO: 680109 - RNA, 19 nt, Homo sapiens
ugacacagccagcaaguac

SEQ ID NO: 680110 - RNA, 19 nt, Homo sapiens
uuaaaucuaagcagcauga

SEQ ID NO: 680111 - RNA, 19 nt, Homo sapiens
agaagcaggcgcugucuga

SEQ ID NO: 680112 - RNA, 19 nt, Homo sapiens
aaacauugcccguugacau

SEQ ID NO: 680113 - RNA, 19 nt, Homo sapiens
ucugugaccugcaucuugu

SEQ ID NO: 680114 - RNA, 19 nt, Homo sapiens
cagagcuggugcccuuuga

SEQ ID NO: 680115 - RNA, 19 nt, Homo sapiens
ggaaacaggugguaaagua

SEQ ID NO: 680116 - RNA, 19 nt, Homo sapiens
ggaaacaaaugcuguaauu

SEQ ID NO: 680117 - RNA, 19 nt, Homo sapiens
ggaaauggauccugagaaa

SEQ ID NO: 680118 - RNA, 19 nt, Homo sapiens
guacuaaaccguuaaguua

SEQ ID NO: 680119 - RNA, 19 nt, Homo sapiens
gaaacaaagucucagauau

SEQ ID NO: 680120 - RNA, 19 nt, Homo sapiens
uauguuaccuccagaauua

SEQ ID NO: 680121 - RNA, 19 nt, Homo sapiens
gaaagaauaucguguccaa

SEQ ID NO: 680122 - RNA, 19 nt, Homo sapiens
gggaaaggaucaaguaauu

SEQ ID NO: 680123 - RNA, 19 nt, Homo sapiens
ggagauaccugggcuauau

SEQ ID NO: 680124 - RNA, 19 nt, Homo sapiens
gaacaucacugugcaagga

SEQ ID NO: 680125 - RNA, 19 nt, Homo sapiens
caagaggacuaacaaauau

SEQ ID NO: 680126 - RNA, 19 nt, Homo sapiens
gaauguggauguuugguuu

SEQ ID NO: 680127 - RNA, 19 nt, Homo sapiens
aaacgaaucuguauguuga

SEQ ID NO: 680128 - RNA, 19 nt, Homo sapiens
caacuuaucaggaccaaua

SEQ ID NO: 680129 - RNA, 19 nt, Homo sapiens
uaaaggaacuugaaaugug

SEQ ID NO: 680130 - RNA, 19 nt, Homo sapiens
gacaauagcugagaugaga

SEQ ID NO: 680131 - RNA, 19 nt, Homo sapiens
gaaaggaucaaguaauuug

SEQ ID NO: 680132 - RNA, 19 nt, Homo sapiens
gcagggaggcucuuuagua

SEQ ID NO: 680133 - RNA, 19 nt, Homo sapiens
ggacuuuccugcucauuug

SEQ ID NO: 680134 - RNA, 19 nt, Homo sapiens
ucagauggcuugucaguau

SEQ ID NO: 680135 - RNA, 19 nt, Homo sapiens
gaacaauacgcaaagauga

SEQ ID NO: 680136 - RNA, 19 nt, Homo sapiens
gaacgaacgugggaaagga

SEQ ID NO: 680137 - RNA, 19 nt, Homo sapiens
gcaguuugcuauucuguga

SEQ ID NO: 680138 - RNA, 19 nt, Homo sapiens
gaaagcaaagcaagaauga

SEQ ID NO: 680139 - RNA, 19 nt, Homo sapiens
ugaagaagguguacaggaa

SEQ ID NO: 680140 - RNA, 19 nt, Homo sapiens
cagggaggcucuuuaguaa

SEQ ID NO: 680141 - RNA, 19 nt, Homo sapiens
cauaaacuguucaagguaa

SEQ ID NO: 680142 - RNA, 19 nt, Homo sapiens
ucaagaggacuaacaaaua

SEQ ID NO: 680143 - RNA, 19 nt, Homo sapiens
ccagacaucuugaccacua

SEQ ID NO: 680144 - RNA, 19 nt, Homo sapiens
caggauuucuggauuuaua

SEQ ID NO: 680145 - RNA, 19 nt, Homo sapiens
ggaagggucugcaaugagu

SEQ ID NO: 680146 - RNA, 19 nt, Homo sapiens
ucaagccucucacaauuaa

SEQ ID NO: 680147 - RNA, 19 nt, Homo sapiens
caucaauguucacaguuua

SEQ ID NO: 680148 - RNA, 19 nt, Homo sapiens
gccaaaagcccuuauauua

SEQ ID NO: 680149 - RNA, 19 nt, Homo sapiens
ggacaggcuccaauagaua

SEQ ID NO: 680150 - RNA, 19 nt, Homo sapiens
aaagggagauuuagacuuc

SEQ ID NO: 680151 - RNA, 19 nt, Homo sapiens
gacaggauuucuggauuua

SEQ ID NO: 680152 - RNA, 19 nt, Homo sapiens
ugacaggauuucuggauuu

SEQ ID NO: 680153 - RNA, 19 nt, Homo sapiens
uauacaaucugucaccuaa

SEQ ID NO: 680154 - RNA, 19 nt, Homo sapiens
gaaggcaaagaaagaaaua

SEQ ID NO: 680155 - RNA, 19 nt, Homo sapiens
ggaauggauugaaggcaaa

SEQ ID NO: 680156 - RNA, 19 nt, Homo sapiens
gaauaggaguuaagggaau

SEQ ID NO: 680157 - RNA, 19 nt, Homo sapiens
uaaggaauguggauguuug

SEQ ID NO: 680158 - RNA, 19 nt, Homo sapiens
gcaaagcgaccaggaauug

SEQ ID NO: 680159 - RNA, 19 nt, Homo sapiens
ccaccaacuuucugacuaa

SEQ ID NO: 680160 - RNA, 19 nt, Homo sapiens
aaacuacaguccagugauu

SEQ ID NO: 680161 - RNA, 19 nt, Homo sapiens
gacacuggauguagaacua

SEQ ID NO: 680162 - RNA, 19 nt, Homo sapiens
cagauucacuguuucauca

SEQ ID NO: 680163 - RNA, 19 nt, Homo sapiens
gcauaacacccaucacauu

SEQ ID NO: 680164 - RNA, 19 nt, Homo sapiens
ggaaauggccaaggaaaug

SEQ ID NO: 680165 - RNA, 19 nt, Homo sapiens
gauuuagacuucacuuaug

SEQ ID NO: 680166 - RNA, 19 nt, Homo sapiens
guaugugcuugucuuauuu

SEQ ID NO: 680167 - RNA, 19 nt, Homo sapiens
gcaaaucuagacccauuaa

SEQ ID NO: 680168 - RNA, 19 nt, Homo sapiens
gauaaggaauguggauguu

SEQ ID NO: 680169 - RNA, 19 nt, Homo sapiens
gauucacuguuucaucaua

SEQ ID NO: 680170 - RNA, 19 nt, Homo sapiens
caaagguucaugcucaaua

SEQ ID NO: 680171 - RNA, 19 nt, Homo sapiens
gagcaguugugguaagaga

SEQ ID NO: 680172 - RNA, 19 nt, Homo sapiens
gaucagaaaucggagaagu

SEQ ID NO: 680173 - RNA, 19 nt, Homo sapiens
gaacauuacugcacaaaag

SEQ ID NO: 680174 - RNA, 19 nt, Homo sapiens
ugaaagacacccucaaaga

SEQ ID NO: 680175 - RNA, 19 nt, Homo sapiens
ggaaaguuaugaggagaga

SEQ ID NO: 680176 - RNA, 19 nt, Homo sapiens
cuacauagaucucuuucuc

SEQ ID NO: 680177 - RNA, 19 nt, Homo sapiens
ccugagaaauuaaagauuc

SEQ ID NO: 680178 - RNA, 19 nt, Homo sapiens
aaauggauccugagaaauu

SEQ ID NO: 680179 - RNA, 19 nt, Homo sapiens
gcagggaggugccuacaac

SEQ ID NO: 680180 - RNA, 19 nt, Homo sapiens
gcaccaaaauguaaucuga

SEQ ID NO: 680181 - RNA, 19 nt, Homo sapiens
gaaugaaaaugguggcuaa

SEQ ID NO: 680182 - RNA, 19 nt, Homo sapiens
gcauaauacuguaaauguc

SEQ ID NO: 680183 - RNA, 19 nt, Homo sapiens
ggaaaggaucaaguaauuu

SEQ ID NO: 680184 - RNA, 19 nt, Homo sapiens
cuucaagccucucacaauu

SEQ ID NO: 680185 - RNA, 19 nt, Homo sapiens
cuacacaaagggagauuua

SEQ ID NO: 680186 - RNA, 19 nt, Homo sapiens
uaaaggacaacuugaaaga

SEQ ID NO: 680187 - RNA, 19 nt, Homo sapiens
guggaagaauguucaaguu

SEQ ID NO: 680188 - RNA, 19 nt, Homo sapiens
gcacacaugauuuugauua

SEQ ID NO: 680189 - RNA, 19 nt, Homo sapiens
cagacuggcuggauucaga

SEQ ID NO: 680190 - RNA, 19 nt, Homo sapiens
aaauaaaggugccucaucu

SEQ ID NO: 680191 - RNA, 19 nt, Homo sapiens
cgagaccgcugacugugaa

SEQ ID NO: 680192 - RNA, 19 nt, Homo sapiens
gccauucgauugcuauaug

SEQ ID NO: 680193 - RNA, 19 nt, Homo sapiens
gagauuuagacuucacuua

SEQ ID NO: 680194 - RNA, 19 nt, Homo sapiens
gaaagacacccucaaagac

SEQ ID NO: 680195 - RNA, 19 nt, Homo sapiens
uagaaauccuggucuccua

SEQ ID NO: 680196 - RNA, 19 nt, Homo sapiens
ggaauacaaugaggagcuu

SEQ ID NO: 680197 - RNA, 19 nt, Homo sapiens
ucaucaauguucacaguuu

SEQ ID NO: 680198 - RNA, 19 nt, Homo sapiens
guagauauugugugaacua

SEQ ID NO: 680199 - RNA, 19 nt, Homo sapiens
ggaagcagagaaugaaaga

SEQ ID NO: 680200 - RNA, 19 nt, Homo sapiens
ccagucagauggcuuguca

SEQ ID NO: 680201 - RNA, 19 nt, Homo sapiens
gaauaggauuaaugagcaa

SEQ ID NO: 680202 - RNA, 19 nt, Homo sapiens
ccaaaguucccaccauaaa

SEQ ID NO: 680203 - RNA, 19 nt, Homo sapiens
ggacuggcaugcuaaacca

SEQ ID NO: 680204 - RNA, 19 nt, Homo sapiens
gaaagugagcaaucagaug

SEQ ID NO: 680205 - RNA, 19 nt, Homo sapiens
gauauuccagcuucaguuu

SEQ ID NO: 680206 - RNA, 19 nt, Homo sapiens
gcaaggagacgugguuguu

SEQ ID NO: 680207 - RNA, 19 nt, Homo sapiens
ugugugaacuacaguauau

SEQ ID NO: 680208 - RNA, 19 nt, Homo sapiens
gaauggaaggcaacacuga

SEQ ID NO: 680209 - RNA, 19 nt, Homo sapiens
uaaaguaguuuggccuguu

SEQ ID NO: 680210 - RNA, 19 nt, Homo sapiens
uaaggccuuuagcauaaua

SEQ ID NO: 680211 - RNA, 19 nt, Homo sapiens
gaugaacuucugacacuuu

SEQ ID NO: 680212 - RNA, 19 nt, Homo sapiens
uugaucagauucacuguuu

SEQ ID NO: 680213 - RNA, 19 nt, Homo sapiens
ggaggaagcagagaaugaa

SEQ ID NO: 680214 - RNA, 19 nt, Homo sapiens
gaauggaugucgcccuuac

SEQ ID NO: 680215 - RNA, 19 nt, Homo sapiens
gaacucagauuacuacuug

SEQ ID NO: 680216 - RNA, 19 nt, Homo sapiens
gcaaacaccuuaacuucua

SEQ ID NO: 680217 - RNA, 19 nt, Homo sapiens
gccaagaaauucauugaua

SEQ ID NO: 680218 - RNA, 19 nt, Homo sapiens
ggaccugucuuuccaacua

SEQ ID NO: 680219 - RNA, 19 nt, Homo sapiens
gaaugaggcuuccuugguu

SEQ ID NO: 680220 - RNA, 19 nt, Homo sapiens
gaccagggcuagucacuuu

SEQ ID NO: 680221 - RNA, 19 nt, Homo sapiens
gaacaagaaucucacuauc

SEQ ID NO: 680222 - RNA, 19 nt, Homo sapiens
caacuaaauuggaggcuuu

SEQ ID NO: 680223 - RNA, 19 nt, Homo sapiens
gagacaauguagcagaaua

SEQ ID NO: 680224 - RNA, 19 nt, Homo sapiens
ggucugagaugaggccuua

SEQ ID NO: 680225 - RNA, 19 nt, Homo sapiens
cgacuaaacucaucugauc

SEQ ID NO: 680226 - RNA, 19 nt, Homo sapiens
ccgagaagcucaaggcuaa

SEQ ID NO: 680227 - RNA, 19 nt, Homo sapiens
caacauaacccagauagaa

SEQ ID NO: 680228 - RNA, 19 nt, Homo sapiens
uaaagcagcuggcaaucaa

SEQ ID NO: 680229 - RNA, 19 nt, Homo sapiens
caaauugcuugcagauauu

SEQ ID NO: 680230 - RNA, 19 nt, Homo sapiens
gcacuaugcugcaggaauc

SEQ ID NO: 680231 - RNA, 19 nt, Homo sapiens
caaaugagccaaagguuau

SEQ ID NO: 680232 - RNA, 19 nt, Homo sapiens
cccaagcagugaauuaaua

SEQ ID NO: 680233 - RNA, 19 nt, Homo sapiens
gcagcacauugacaacaua

SEQ ID NO: 680234 - RNA, 19 nt, Homo sapiens
agaaaugugucgcauaguu

SEQ ID NO: 680235 - RNA, 19 nt, Homo sapiens
ucacuuaccuucuucucuu

SEQ ID NO: 680236 - RNA, 19 nt, Homo sapiens
ucaaaugagccaaagguua

SEQ ID NO: 680237 - RNA, 19 nt, Homo sapiens
ggcccaaacugaauuguga

SEQ ID NO: 680238 - RNA, 19 nt, Homo sapiens
gcagugagcugagauugca

SEQ ID NO: 680239 - RNA, 19 nt, Homo sapiens
aaacucaucugauccuuuc

SEQ ID NO: 680240 - RNA, 19 nt, Homo sapiens
ggaacaagaaucucacuau

SEQ ID NO: 680241 - RNA, 19 nt, Homo sapiens
gaaccuugcaaacaccuua

SEQ ID NO: 680242 - RNA, 19 nt, Homo sapiens
ucaauucccuagacgguuu

SEQ ID NO: 680243 - RNA, 19 nt, Homo sapiens
gcuccuaccacucuucuua

SEQ ID NO: 680244 - RNA, 19 nt, Homo sapiens
ucagaaaugugucgcauag

SEQ ID NO: 680245 - RNA, 19 nt, Homo sapiens
caaacaccuuaacuucuaa

SEQ ID NO: 680246 - RNA, 19 nt, Homo sapiens
caaguaauaacagcucuua

SEQ ID NO: 680247 - RNA, 19 nt, Homo sapiens
caccuuaacuucuaaccaa

SEQ ID NO: 680248 - RNA, 19 nt, Homo sapiens
gagagcaacuugacaucau

SEQ ID NO: 680249 - RNA, 19 nt, Homo sapiens
gaaacucagccaagaaugu

SEQ ID NO: 680250 - RNA, 19 nt, Homo sapiens
gagggaagaugaauacacu

SEQ ID NO: 680251 - RNA, 19 nt, Homo sapiens
gcauuaguuugaaccauau

SEQ ID NO: 680252 - RNA, 19 nt, Homo sapiens
gccgaauccucgugguuua

SEQ ID NO: 680253 - RNA, 19 nt, Homo sapiens
ucaaccugcuuacucauuu

SEQ ID NO: 680254 - RNA, 19 nt, Homo sapiens
aguaaacguuugugaauga

SEQ ID NO: 680255 - RNA, 19 nt, Homo sapiens
gacauucgccuuaaggaaa

SEQ ID NO: 680256 - RNA, 19 nt, Homo sapiens
ugaaugaucucuccaacag

SEQ ID NO: 680257 - RNA, 19 nt, Homo sapiens
agcaggagcuacuagaaua

SEQ ID NO: 680258 - RNA, 19 nt, Homo sapiens
aaggguuacugaucacuua

SEQ ID NO: 680259 - RNA, 19 nt, Homo sapiens
gccaaagguuauaaacuug

SEQ ID NO: 680260 - RNA, 19 nt, Homo sapiens
gcuacgaccuugaguacug

SEQ ID NO: 680261 - RNA, 19 nt, Homo sapiens
aggaagcgcuggccaagaa

SEQ ID NO: 680262 - RNA, 19 nt, Homo sapiens
ccuagaggguagaaaguuu

SEQ ID NO: 680263 - RNA, 19 nt, Homo sapiens
gcagacagaaccuugcaaa

SEQ ID NO: 680264 - RNA, 19 nt, Homo sapiens
gaagggcagcuuuguccua

SEQ ID NO: 680265 - RNA, 19 nt, Homo sapiens
cauaguaggcacacaguaa

SEQ ID NO: 680266 - RNA, 19 nt, Homo sapiens
caacuugacaucaugaaug

SEQ ID NO: 680267 - RNA, 19 nt, Homo sapiens
cuguaaaggucacaaacua

SEQ ID NO: 680268 - RNA, 19 nt, Homo sapiens
ugaggucccuugaaucuuc

SEQ ID NO: 680269 - RNA, 19 nt, Homo sapiens
gaagaugaauacacuugac

SEQ ID NO: 680270 - RNA, 19 nt, Homo sapiens
ugcauuaguuugaaccaua

SEQ ID NO: 680271 - RNA, 19 nt, Homo sapiens
agucugagguccugaaaga

SEQ ID NO: 680272 - RNA, 19 nt, Homo sapiens
gaaaugugucgcauaguuc

SEQ ID NO: 680273 - RNA, 19 nt, Homo sapiens
agccaaagguuauaaacuu

SEQ ID NO: 680274 - RNA, 19 nt, Homo sapiens
ggaaucagcaggugacagu

SEQ ID NO: 680275 - RNA, 19 nt, Homo sapiens
gcagaaacucagccaagaa

SEQ ID NO: 680276 - RNA, 19 nt, Homo sapiens
ucaaacaggcccuaaacaa

SEQ ID NO: 680277 - RNA, 19 nt, Homo sapiens
cuacagugcuuugaagguu

SEQ ID NO: 680278 - RNA, 19 nt, Homo sapiens
ggaauggcccaaacugaau

SEQ ID NO: 680279 - RNA, 19 nt, Homo sapiens
gauaugagacaauguagca

SEQ ID NO: 680280 - RNA, 19 nt, Homo sapiens
ggcaugagccaccugcaua

SEQ ID NO: 680281 - RNA, 19 nt, Homo sapiens
ccagguaccuuguugaaaa

SEQ ID NO: 680282 - RNA, 19 nt, Homo sapiens
ggacauucgccuuaaggaa

SEQ ID NO: 680283 - RNA, 19 nt, Homo sapiens
uccagaggcuucaggcaua

SEQ ID NO: 680284 - RNA, 19 nt, Homo sapiens
uaauagcacuaccuaccaa

SEQ ID NO: 680285 - RNA, 19 nt, Homo sapiens
gacagaaccuugcaaacac

SEQ ID NO: 680286 - RNA, 19 nt, Homo sapiens
gaaugaagugacagaggua

SEQ ID NO: 680287 - RNA, 19 nt, Homo sapiens
ccaagcagugaauuaauaa

SEQ ID NO: 680288 - RNA, 19 nt, Homo sapiens
caggaagucuaaccaagga

SEQ ID NO: 680289 - RNA, 19 nt, Homo sapiens
gaaaaggcuuccaggaguu

SEQ ID NO: 680290 - RNA, 19 nt, Homo sapiens
cuagagugaucuuccuaaa

SEQ ID NO: 680291 - RNA, 19 nt, Homo sapiens
aaacguuugugaaugaaug

SEQ ID NO: 680292 - RNA, 19 nt, Homo sapiens
ggaagaugaauacacuuga

SEQ ID NO: 680293 - RNA, 19 nt, Homo sapiens
gaccugucuuuccaacuaa

SEQ ID NO: 680294 - RNA, 19 nt, Homo sapiens
gauuacuacuugacgaaga

SEQ ID NO: 680295 - RNA, 19 nt, Homo sapiens
ccaugaugcuuuccuagug

SEQ ID NO: 680296 - RNA, 19 nt, Homo sapiens
uaaauuggaggcuuuggaa

SEQ ID NO: 680297 - RNA, 19 nt, Homo sapiens
acaagaaucucacuaucag

SEQ ID NO: 680298 - RNA, 19 nt, Homo sapiens
gcagagagcaacuugacau

SEQ ID NO: 680299 - RNA, 19 nt, Homo sapiens
gacuuucagugcauuaguu

SEQ ID NO: 680300 - RNA, 19 nt, Homo sapiens
gggcagcuuuguccuauac

SEQ ID NO: 680301 - RNA, 19 nt, Homo sapiens
caaacaggcccuaaacaag

SEQ ID NO: 680302 - RNA, 19 nt, Homo sapiens
guaaacguuugugaaugaa

SEQ ID NO: 680303 - RNA, 19 nt, Homo sapiens
uuaauccaguuccuucaaa

SEQ ID NO: 680304 - RNA, 19 nt, Homo sapiens
aaacaggcccuaaacaagu

SEQ ID NO: 680305 - RNA, 19 nt, Homo sapiens
gcuaaugcagagucaagua

SEQ ID NO: 680306 - RNA, 19 nt, Homo sapiens
acuugaaucuguagacauu

SEQ ID NO: 680307 - RNA, 19 nt, Homo sapiens
gggauaauagcacuaccua

SEQ ID NO: 680308 - RNA, 19 nt, Homo sapiens
gggaagaugaauacacuug

SEQ ID NO: 680309 - RNA, 19 nt, Homo sapiens
gaauggcccaaacugaauu

SEQ ID NO: 680310 - RNA, 19 nt, Homo sapiens
agaagcagcagcacauuga

SEQ ID NO: 680311 - RNA, 19 nt, Homo sapiens
gacagagggaagaugaaua

SEQ ID NO: 680312 - RNA, 19 nt, Homo sapiens
ugacucuucugucucuuga

SEQ ID NO: 680313 - RNA, 19 nt, Homo sapiens
guacauuacagacgccauu

SEQ ID NO: 680314 - RNA, 19 nt, Homo sapiens
gggagugggaggcuucuuu

SEQ ID NO: 680315 - RNA, 19 nt, Homo sapiens
gaacucagauuacuacuug

SEQ ID NO: 680316 - RNA, 19 nt, Homo sapiens
gccaagaaauucauugaua

SEQ ID NO: 680317 - RNA, 19 nt, Homo sapiens
ccgagaagcucaaggcuaa

SEQ ID NO: 680318 - RNA, 19 nt, Homo sapiens
caacauaacccagauagaa

SEQ ID NO: 680319 - RNA, 19 nt, Homo sapiens
uaaagcagcuggcaaucaa

SEQ ID NO: 680320 - RNA, 19 nt, Homo sapiens
caaauugcuugcagauauu

SEQ ID NO: 680321 - RNA, 19 nt, Homo sapiens
gcagcacauugacaacaua

SEQ ID NO: 680322 - RNA, 19 nt, Homo sapiens
gagagcaacuugacaucau

SEQ ID NO: 680323 - RNA, 19 nt, Homo sapiens
gacauucgccuuaaggaaa

SEQ ID NO: 680324 - RNA, 19 nt, Homo sapiens
ugaaugaucucuccaacag

SEQ ID NO: 680325 - RNA, 19 nt, Homo sapiens
gaaacucagccaagaaugu

SEQ ID NO: 680326 - RNA, 19 nt, Homo sapiens
gcuacgaccuugaguacug

SEQ ID NO: 680327 - RNA, 19 nt, Homo sapiens
aggaagcgcuggccaagaa

SEQ ID NO: 680328 - RNA, 19 nt, Homo sapiens
caacuugacaucaugaaug

SEQ ID NO: 680329 - RNA, 19 nt, Homo sapiens
gcagaaacucagccaagaa

SEQ ID NO: 680330 - RNA, 19 nt, Homo sapiens
ggcaugagccaccugcaua

SEQ ID NO: 680331 - RNA, 19 nt, Homo sapiens
ccagguaccuuguugaaaa

SEQ ID NO: 680332 - RNA, 19 nt, Homo sapiens
ggacauucgccuuaaggaa

SEQ ID NO: 680333 - RNA, 19 nt, Homo sapiens
uccagaggcuucaggcaua

SEQ ID NO: 680334 - RNA, 19 nt, Homo sapiens
gauuacuacuugacgaaga

SEQ ID NO: 680335 - RNA, 19 nt, Homo sapiens
gcagagagcaacuugacau

SEQ ID NO: 680336 - RNA, 19 nt, Homo sapiens
gugacagccuccagacuug

SEQ ID NO: 680337 - RNA, 19 nt, Homo sapiens
gcuaaugcagagucaagua

SEQ ID NO: 680338 - RNA, 19 nt, Homo sapiens
acuugaaucuguagacauu

SEQ ID NO: 680339 - RNA, 19 nt, Homo sapiens
guacauuacagacgccauu

SEQ ID NO: 680340 - RNA, 19 nt, Homo sapiens
agaagcagcagcacauuga

SEQ ID NO: 680341 - RNA, 19 nt, Homo sapiens
ccaacagggucuggaguau

SEQ ID NO: 680342 - RNA, 19 nt, Homo sapiens
ccauuggacauucgccuua

SEQ ID NO: 680343 - RNA, 19 nt, Homo sapiens
aacagggucuggaguauca

SEQ ID NO: 680344 - RNA, 19 nt, Homo sapiens
uagaagaugccaccgagaa

SEQ ID NO: 680345 - RNA, 19 nt, Homo sapiens
gagaugcagcagcagauga

SEQ ID NO: 680346 - RNA, 19 nt, Homo sapiens
cuaaugcagagucaaguaa

SEQ ID NO: 680347 - RNA, 19 nt, Homo sapiens
cagaaacucagccaagaau

SEQ ID NO: 680348 - RNA, 19 nt, Homo sapiens
gcaccaagccagguaccuu

SEQ ID NO: 680349 - RNA, 19 nt, Homo sapiens
cauuggacauucgccuuaa

SEQ ID NO: 680350 - RNA, 19 nt, Homo sapiens
ucaagaagcagcagcacau

SEQ ID NO: 680351 - RNA, 19 nt, Homo sapiens
gagcaacuugacaucauga

SEQ ID NO: 680352 - RNA, 19 nt, Homo sapiens
gagaagcucaaggcuaaug

SEQ ID NO: 680353 - RNA, 19 nt, Homo sapiens
aaacucagccaagaauguu

SEQ ID NO: 680354 - RNA, 19 nt, Homo sapiens
caaggcuaaugcagaguca

SEQ ID NO: 680355 - RNA, 19 nt, Homo sapiens
ugacaacauaacccagaua

SEQ ID NO: 680356 - RNA, 19 nt, Homo sapiens
ugagccaccugcauaccuu

SEQ ID NO: 680357 - RNA, 19 nt, Homo sapiens
uaaacugccagcucucaga

SEQ ID NO: 680358 - RNA, 19 nt, Homo sapiens
gcaacuugacaucaugaau

SEQ ID NO: 680359 - RNA, 19 nt, Homo sapiens
gacaacauaacccagauag

SEQ ID NO: 680360 - RNA, 19 nt, Homo sapiens
uaaugcagagucaaguaaa

SEQ ID NO: 680361 - RNA, 19 nt, Homo sapiens
ugcagaaacucagccaaga

SEQ ID NO: 680362 - RNA, 19 nt, Homo sapiens
cagccaagaauguuuaaag

SEQ ID NO: 680363 - RNA, 19 nt, Homo sapiens
agagcaacuugacaucaug

SEQ ID NO: 680364 - RNA, 19 nt, Homo sapiens
caagaagcagcagcacauu

SEQ ID NO: 680365 - RNA, 19 nt, Homo sapiens
guggagaguacauuacaga

SEQ ID NO: 680366 - RNA, 19 nt, Homo sapiens
acucagccaagaauguuua

SEQ ID NO: 680367 - RNA, 19 nt, Homo sapiens
cagcacauugacaacauaa

SEQ ID NO: 680368 - RNA, 19 nt, Homo sapiens
agacuugaaucuguagaca

SEQ ID NO: 680369 - RNA, 19 nt, Homo sapiens
gcgcuacgaccuugaguac

SEQ ID NO: 680370 - RNA, 19 nt, Homo sapiens
cgaucgcuauugcugaaau

SEQ ID NO: 680371 - RNA, 19 nt, Homo sapiens
gaagcgcuggccaagaaau

SEQ ID NO: 680372 - RNA, 19 nt, Homo sapiens
guuuaaagcagcuggcaau

SEQ ID NO: 680373 - RNA, 19 nt, Homo sapiens
uugaaucuguagacauuuc

SEQ ID NO: 680374 - RNA, 19 nt, Homo sapiens
cgugacagccuccagacuu

SEQ ID NO: 680375 - RNA, 19 nt, Homo sapiens
ggaagcgcuggccaagaaa

SEQ ID NO: 680376 - RNA, 19 nt, Homo sapiens
cagauuacuacuugacgaa

SEQ ID NO: 680377 - RNA, 19 nt, Homo sapiens
gcacauugacaacauaacc

SEQ ID NO: 680378 - RNA, 19 nt, Homo sapiens
ggagaugcagcagcagaug

SEQ ID NO: 680379 - RNA, 19 nt, Homo sapiens
ccaccgagcaggagaugca

SEQ ID NO: 680380 - RNA, 19 nt, Homo sapiens
uuaaggaaagcauaaacug

SEQ ID NO: 680381 - RNA, 19 nt, Homo sapiens
uggaagccguggagaguac

SEQ ID NO: 680382 - RNA, 19 nt, Homo sapiens
gccaagaauguuuaaagca

SEQ ID NO: 680383 - RNA, 19 nt, Homo sapiens
acauaacccagauagaaga

SEQ ID NO: 680384 - RNA, 19 nt, Homo sapiens
caacagggucuggaguauc

SEQ ID NO: 680385 - RNA, 19 nt, Homo sapiens
gcagcuggcaaucaagaag

SEQ ID NO: 680386 - RNA, 19 nt, Homo sapiens
uuaaagcagcuggcaauca

SEQ ID NO: 680387 - RNA, 19 nt, Homo sapiens
gcgcuggccaagaaauuca

SEQ ID NO: 680388 - RNA, 19 nt, Homo sapiens
gacagccuccagacuugaa

SEQ ID NO: 680389 - RNA, 19 nt, Homo sapiens
gcaugagccaccugcauac

SEQ ID NO: 680390 - RNA, 19 nt, Homo sapiens
cauaaacugccagcucuca

SEQ ID NO: 680391 - RNA, 19 nt, Homo sapiens
cauuacagacgccauugga

SEQ ID NO: 680392 - RNA, 19 nt, Homo sapiens
gaggaagcgcuggccaaga

SEQ ID NO: 680393 - RNA, 19 nt, Homo sapiens
gaacucagauuacuacuug

SEQ ID NO: 680394 - RNA, 19 nt, Homo sapiens
gccaagaaauucauugaua

SEQ ID NO: 680395 - RNA, 19 nt, Homo sapiens
gaagcagaaucguacagua

SEQ ID NO: 680396 - RNA, 19 nt, Homo sapiens
ccgagaagcucaaggcuaa

SEQ ID NO: 680397 - RNA, 19 nt, Homo sapiens
caacauaacccagauagaa

SEQ ID NO: 680398 - RNA, 19 nt, Homo sapiens
uaaagcagcuggcaaucaa

SEQ ID NO: 680399 - RNA, 19 nt, Homo sapiens
ggaaggagaaucacuugaa

SEQ ID NO: 680400 - RNA, 19 nt, Homo sapiens
gcagcacauugacaacaua

SEQ ID NO: 680401 - RNA, 19 nt, Homo sapiens
gaaggagaaucacuugaac

SEQ ID NO: 680402 - RNA, 19 nt, Homo sapiens
gagagcaacuugacaucau

SEQ ID NO: 680403 - RNA, 19 nt, Homo sapiens
gacauucgccuuaaggaaa

SEQ ID NO: 680404 - RNA, 19 nt, Homo sapiens
ugaaugaucucuccaacag

SEQ ID NO: 680405 - RNA, 19 nt, Homo sapiens
gaaacucagccaagaaugu

SEQ ID NO: 680406 - RNA, 19 nt, Homo sapiens
gcagaaucguacaguaugu

SEQ ID NO: 680407 - RNA, 19 nt, Homo sapiens
gcuacgaccuugaguacug

SEQ ID NO: 680408 - RNA, 19 nt, Homo sapiens
aggaagcgcuggccaagaa

SEQ ID NO: 680409 - RNA, 19 nt, Homo sapiens
caacuugacaucaugaaug

SEQ ID NO: 680410 - RNA, 19 nt, Homo sapiens
ggucaggaguuugagacua

SEQ ID NO: 680411 - RNA, 19 nt, Homo sapiens
gcagaaacucagccaagaa

SEQ ID NO: 680412 - RNA, 19 nt, Homo sapiens
cagcaucauuuccuugaga

SEQ ID NO: 680413 - RNA, 19 nt, Homo sapiens
ggcaugagccaccugcaua

SEQ ID NO: 680414 - RNA, 19 nt, Homo sapiens
ccagguaccuuguugaaaa

SEQ ID NO: 680415 - RNA, 19 nt, Homo sapiens
ggacauucgccuuaaggaa

SEQ ID NO: 680416 - RNA, 19 nt, Homo sapiens
uccagaggcuucaggcaua

SEQ ID NO: 680417 - RNA, 19 nt, Homo sapiens
agacuagccuggccaagau

SEQ ID NO: 680418 - RNA, 19 nt, Homo sapiens
gauuacuacuugacgaaga

SEQ ID NO: 680419 - RNA, 19 nt, Homo sapiens
gcagagagcaacuugacau

SEQ ID NO: 680420 - RNA, 19 nt, Homo sapiens
gcuaaugcagagucaagua

SEQ ID NO: 680421 - RNA, 19 nt, Homo sapiens
gagacuagccuggccaaga

SEQ ID NO: 680422 - RNA, 19 nt, Homo sapiens
gugacagccuccagaaugu

SEQ ID NO: 680423 - RNA, 19 nt, Homo sapiens
gaucacaaggucaggaguu

SEQ ID NO: 680424 - RNA, 19 nt, Homo sapiens
guacauuacagacgccauu

SEQ ID NO: 680425 - RNA, 19 nt, Homo sapiens
agaagcagcagcacauuga

SEQ ID NO: 680426 - RNA, 19 nt, Homo sapiens
ccaacagggucuggaguau

SEQ ID NO: 680427 - RNA, 19 nt, Homo sapiens
gaggaaggagaaucacuug

SEQ ID NO: 680428 - RNA, 19 nt, Homo sapiens
gucaggaguuugagacuag

SEQ ID NO: 680429 - RNA, 19 nt, Homo sapiens
ccauuggacauucgccuua

SEQ ID NO: 680430 - RNA, 19 nt, Homo sapiens
aacagggucuggaguauca

SEQ ID NO: 680431 - RNA, 19 nt, Homo sapiens
uagaagaugccaccgagaa

SEQ ID NO: 680432 - RNA, 19 nt, Homo sapiens
gagaugcagcagcagauga

SEQ ID NO: 680433 - RNA, 19 nt, Homo sapiens
cuaaugcagagucaaguaa

SEQ ID NO: 680434 - RNA, 19 nt, Homo sapiens
cagaaacucagccaagaau

SEQ ID NO: 680435 - RNA, 19 nt, Homo sapiens
gcaccaagccagguaccuu

SEQ ID NO: 680436 - RNA, 19 nt, Homo sapiens
cacaaggucaggaguuuga

SEQ ID NO: 680437 - RNA, 19 nt, Homo sapiens
ucaagaagcagcagcacau

SEQ ID NO: 680438 - RNA, 19 nt, Homo sapiens
cauuggacauucgccuuaa

SEQ ID NO: 680439 - RNA, 19 nt, Homo sapiens
gagcaacuugacaucauga

SEQ ID NO: 680440 - RNA, 19 nt, Homo sapiens
gagaagcucaaggcuaaug

SEQ ID NO: 680441 - RNA, 19 nt, Homo sapiens
gcugcacgcaucaauaguu

SEQ ID NO: 680442 - RNA, 19 nt, Homo sapiens
aaacucagccaagaauguu

SEQ ID NO: 680443 - RNA, 19 nt, Homo sapiens
cgugacagccuccagaaug

SEQ ID NO: 680444 - RNA, 19 nt, Homo sapiens
ugacaacauaacccagaua

SEQ ID NO: 680445 - RNA, 19 nt, Homo sapiens
caaggcuaaugcagaguca

SEQ ID NO: 680446 - RNA, 19 nt, Homo sapiens
aagcagaaucguacaguau

SEQ ID NO: 680447 - RNA, 19 nt, Homo sapiens
ugagccaccugcauaccuu

SEQ ID NO: 680448 - RNA, 19 nt, Homo sapiens
ugcauaugcugcuuucuca

SEQ ID NO: 680449 - RNA, 19 nt, Homo sapiens
uaaacugccagcucucaga

SEQ ID NO: 680450 - RNA, 19 nt, Homo sapiens
gcaacuugacaucaugaau

SEQ ID NO: 680451 - RNA, 19 nt, Homo sapiens
gacaacauaacccagauag

SEQ ID NO: 680452 - RNA, 19 nt, Homo sapiens
gaaaccccaucucugcaaa

SEQ ID NO: 680453 - RNA, 19 nt, Homo sapiens
gcugcugcacgcaucaaua

SEQ ID NO: 680454 - RNA, 19 nt, Homo sapiens
uaaugcagagucaaguaaa

SEQ ID NO: 680455 - RNA, 19 nt, Homo sapiens
ugcagaaacucagccaaga

SEQ ID NO: 680456 - RNA, 19 nt, Homo sapiens
acgcaucaauaguucauuc

SEQ ID NO: 680457 - RNA, 19 nt, Homo sapiens
gcacgcaucaauaguucau

SEQ ID NO: 680458 - RNA, 19 nt, Homo sapiens
gaaugucauggaagcagaa

SEQ ID NO: 680459 - RNA, 19 nt, Homo sapiens
caagaagcagcagcacauu

SEQ ID NO: 680460 - RNA, 19 nt, Homo sapiens
agagcaacuugacaucaug

SEQ ID NO: 680461 - RNA, 19 nt, Homo sapiens
cagccaagaauguuuaaag

SEQ ID NO: 680462 - RNA, 19 nt, Homo sapiens
ugaggaaggagaaucacuu

SEQ ID NO: 680463 - RNA, 19 nt, Homo sapiens
uacaguauguucccuucug

SEQ ID NO: 680464 - RNA, 19 nt, Homo sapiens
ggaagcagaaucguacagu

SEQ ID NO: 680465 - RNA, 19 nt, Homo sapiens
cagcacauugacaacauaa

SEQ ID NO: 680466 - RNA, 19 nt, Homo sapiens
guggagaguacauuacaga

SEQ ID NO: 680467 - RNA, 19 nt, Homo sapiens
acucagccaagaauguuua

SEQ ID NO: 680468 - RNA, 19 nt, Homo sapiens
gcgcuacgaccuugaguac

SEQ ID NO: 680469 - RNA, 19 nt, Homo sapiens
cgaucgcuauugcugaaau

SEQ ID NO: 680470 - RNA, 19 nt, Homo sapiens
guuuaaagcagcuggcaau

SEQ ID NO: 680471 - RNA, 19 nt, Homo sapiens
gaagcgcuggccaagaaau

SEQ ID NO: 680472 - RNA, 19 nt, Homo sapiens
ucauggaagcagaaucgua

SEQ ID NO: 680473 - RNA, 19 nt, Homo sapiens
ggaagcgcuggccaagaaa

SEQ ID NO: 680474 - RNA, 19 nt, Homo sapiens
cagauuacuacuugacgaa

SEQ ID NO: 680475 - RNA, 19 nt, Homo sapiens
cugcacgcaucaauaguuc

SEQ ID NO: 680476 - RNA, 19 nt, Homo sapiens
gcacauugacaacauaacc

SEQ ID NO: 680477 - RNA, 19 nt, Homo sapiens
ggagaugcagcagcagaug

SEQ ID NO: 680478 - RNA, 19 nt, Homo sapiens
ccaccgagcaggagaugca

SEQ ID NO: 680479 - RNA, 19 nt, Homo sapiens
acauaacccagauagaaga

SEQ ID NO: 680480 - RNA, 19 nt, Homo sapiens
gccaagaauguuuaaagca

SEQ ID NO: 680481 - RNA, 19 nt, Homo sapiens
uuaaggaaagcauaaacug

SEQ ID NO: 680482 - RNA, 19 nt, Homo sapiens
uggaagccguggagaguac

SEQ ID NO: 680483 - RNA, 19 nt, Homo sapiens
gcagcuggcaaucaagaag

SEQ ID NO: 680484 - RNA, 19 nt, Homo sapiens
ccuguaaucccagcgcuuu

SEQ ID NO: 680485 - RNA, 19 nt, Homo sapiens
caacagggucuggaguauc

SEQ ID NO: 680486 - RNA, 19 nt, Homo sapiens
gaggagguggagaugaaug

SEQ ID NO: 680487 - RNA, 19 nt, Homo sapiens
uuaaagcagcuggcaauca

SEQ ID NO: 680488 - RNA, 19 nt, Homo sapiens
gcgcuggccaagaaauuca

SEQ ID NO: 680489 - RNA, 19 nt, Homo sapiens
caaggucaggaguuugaga

SEQ ID NO: 680490 - RNA, 19 nt, Homo sapiens
gcaugagccaccugcauac

SEQ ID NO: 680491 - RNA, 19 nt, Homo sapiens
cauaaacugccagcucuca

SEQ ID NO: 680492 - RNA, 19 nt, Homo sapiens
cauuacagacgccauugga

SEQ ID NO: 680493 - RNA, 19 nt, Homo sapiens
gaacucagauuacuacuug

SEQ ID NO: 680494 - RNA, 19 nt, Homo sapiens
gcaaacaccuuaacuucua

SEQ ID NO: 680495 - RNA, 19 nt, Homo sapiens
gccaagaaauucauugaua

SEQ ID NO: 680496 - RNA, 19 nt, Homo sapiens
ggaccugucuuuccaacua

SEQ ID NO: 680497 - RNA, 19 nt, Homo sapiens
gaaugaggcuuccuugguu

SEQ ID NO: 680498 - RNA, 19 nt, Homo sapiens
gaccagggcuagucacuuu

SEQ ID NO: 680499 - RNA, 19 nt, Homo sapiens
gaacaagaaucucacuauc

SEQ ID NO: 680500 - RNA, 19 nt, Homo sapiens
caacuaaauuggaggcuuu

SEQ ID NO: 680501 - RNA, 19 nt, Homo sapiens
gagacaauguagcagaaua

SEQ ID NO: 680502 - RNA, 19 nt, Homo sapiens
ggucugagaugaggccuua

SEQ ID NO: 680503 - RNA, 19 nt, Homo sapiens
cgacuaaacucaucugauc

SEQ ID NO: 680504 - RNA, 19 nt, Homo sapiens
ccgagaagcucaaggcuaa

SEQ ID NO: 680505 - RNA, 19 nt, Homo sapiens
caacauaacccagauagaa

SEQ ID NO: 680506 - RNA, 19 nt, Homo sapiens
uaaagcagcuggcaaucaa

SEQ ID NO: 680507 - RNA, 19 nt, Homo sapiens
caaauugcuugcagauauu

SEQ ID NO: 680508 - RNA, 19 nt, Homo sapiens
gcacuaugcugcaggaauc

SEQ ID NO: 680509 - RNA, 19 nt, Homo sapiens
caaaugagccaaagguuau

SEQ ID NO: 680510 - RNA, 19 nt, Homo sapiens
cccaagcagugaauuaaua

SEQ ID NO: 680511 - RNA, 19 nt, Homo sapiens
gcagcacauugacaacaua

SEQ ID NO: 680512 - RNA, 19 nt, Homo sapiens
agaaaugugucgcauaguu

SEQ ID NO: 680513 - RNA, 19 nt, Homo sapiens
ucacuuaccuucuucucuu

SEQ ID NO: 680514 - RNA, 19 nt, Homo sapiens
ucaaaugagccaaagguua

SEQ ID NO: 680515 - RNA, 19 nt, Homo sapiens
ggcccaaacugaauuguga

SEQ ID NO: 680516 - RNA, 19 nt, Homo sapiens
gcagugagcugagauugca

SEQ ID NO: 680517 - RNA, 19 nt, Homo sapiens
aaacucaucugauccuuuc

SEQ ID NO: 680518 - RNA, 19 nt, Homo sapiens
ggaacaagaaucucacuau

SEQ ID NO: 680519 - RNA, 19 nt, Homo sapiens
gaaccuugcaaacaccuua

SEQ ID NO: 680520 - RNA, 19 nt, Homo sapiens
ucaauucccuagacgguuu

SEQ ID NO: 680521 - RNA, 19 nt, Homo sapiens
gcuccuaccacucuucuua

SEQ ID NO: 680522 - RNA, 19 nt, Homo sapiens
ucagaaaugugucgcauag

SEQ ID NO: 680523 - RNA, 19 nt, Homo sapiens
caaacaccuuaacuucuaa

SEQ ID NO: 680524 - RNA, 19 nt, Homo sapiens
caaguaauaacagcucuua

SEQ ID NO: 680525 - RNA, 19 nt, Homo sapiens
caccuuaacuucuaaccaa

SEQ ID NO: 680526 - RNA, 19 nt, Homo sapiens
gagagcaacuugacaucau

SEQ ID NO: 680527 - RNA, 19 nt, Homo sapiens
gaaacucagccaagaaugu

SEQ ID NO: 680528 - RNA, 19 nt, Homo sapiens
gagggaagaugaauacacu

SEQ ID NO: 680529 - RNA, 19 nt, Homo sapiens
gcauuaguuugaaccauau

SEQ ID NO: 680530 - RNA, 19 nt, Homo sapiens
gccgaauccucgugguuua

SEQ ID NO: 680531 - RNA, 19 nt, Homo sapiens
ucaaccugcuuacucauuu

SEQ ID NO: 680532 - RNA, 19 nt, Homo sapiens
aguaaacguuugugaauga

SEQ ID NO: 680533 - RNA, 19 nt, Homo sapiens
ugaaugaucucuccaacag

SEQ ID NO: 680534 - RNA, 19 nt, Homo sapiens
agcaggagcuacuagaaua

SEQ ID NO: 680535 - RNA, 19 nt, Homo sapiens
aaggguuacugaucacuua

SEQ ID NO: 680536 - RNA, 19 nt, Homo sapiens
gccaaagguuauaaacuug

SEQ ID NO: 680537 - RNA, 19 nt, Homo sapiens
aggaagcgcuggccaagaa

SEQ ID NO: 680538 - RNA, 19 nt, Homo sapiens
ccuagaggguagaaaguuu

SEQ ID NO: 680539 - RNA, 19 nt, Homo sapiens
gcagacagaaccuugcaaa

SEQ ID NO: 680540 - RNA, 19 nt, Homo sapiens
gaagggcagcuuuguccua

SEQ ID NO: 680541 - RNA, 19 nt, Homo sapiens
cauaguaggcacacaguaa

SEQ ID NO: 680542 - RNA, 19 nt, Homo sapiens
caacuugacaucaugaaug

SEQ ID NO: 680543 - RNA, 19 nt, Homo sapiens
cuguaaaggucacaaacua

SEQ ID NO: 680544 - RNA, 19 nt, Homo sapiens
ugaggucccuugaaucuuc

SEQ ID NO: 680545 - RNA, 19 nt, Homo sapiens
gaagaugaauacacuugac

SEQ ID NO: 680546 - RNA, 19 nt, Homo sapiens
ugcauuaguuugaaccaua

SEQ ID NO: 680547 - RNA, 19 nt, Homo sapiens
agucugagguccugaaaga

SEQ ID NO: 680548 - RNA, 19 nt, Homo sapiens
gaaaugugucgcauaguuc

SEQ ID NO: 680549 - RNA, 19 nt, Homo sapiens
agccaaagguuauaaacuu

SEQ ID NO: 680550 - RNA, 19 nt, Homo sapiens
ggaaucagcaggugacagu

SEQ ID NO: 680551 - RNA, 19 nt, Homo sapiens
gcagaaacucagccaagaa

SEQ ID NO: 680552 - RNA, 19 nt, Homo sapiens
ucaaacaggcccuaaacaa

SEQ ID NO: 680553 - RNA, 19 nt, Homo sapiens
cuacagugcuuugaagguu

SEQ ID NO: 680554 - RNA, 19 nt, Homo sapiens
ggaauggcccaaacugaau

SEQ ID NO: 680555 - RNA, 19 nt, Homo sapiens
gauaugagacaauguagca

SEQ ID NO: 680556 - RNA, 19 nt, Homo sapiens
uccagaggcuucaggcaua

SEQ ID NO: 680557 - RNA, 19 nt, Homo sapiens
uaauagcacuaccuaccaa

SEQ ID NO: 680558 - RNA, 19 nt, Homo sapiens
gacagaaccuugcaaacac

SEQ ID NO: 680559 - RNA, 19 nt, Homo sapiens
gaaugaagugacagaggua

SEQ ID NO: 680560 - RNA, 19 nt, Homo sapiens
ccaagcagugaauuaauaa

SEQ ID NO: 680561 - RNA, 19 nt, Homo sapiens
caggaagucuaaccaagga

SEQ ID NO: 680562 - RNA, 19 nt, Homo sapiens
gaaaaggcuuccaggaguu

SEQ ID NO: 680563 - RNA, 19 nt, Homo sapiens
cuagagugaucuuccuaaa

SEQ ID NO: 680564 - RNA, 19 nt, Homo sapiens
aaacguuugugaaugaaug

SEQ ID NO: 680565 - RNA, 19 nt, Homo sapiens
ggaagaugaauacacuuga

SEQ ID NO: 680566 - RNA, 19 nt, Homo sapiens
gaccugucuuuccaacuaa

SEQ ID NO: 680567 - RNA, 19 nt, Homo sapiens
gauuacuacuugacgaaga

SEQ ID NO: 680568 - RNA, 19 nt, Homo sapiens
ccaugaugcuuuccuagug

SEQ ID NO: 680569 - RNA, 19 nt, Homo sapiens
uaaauuggaggcuuuggaa

SEQ ID NO: 680570 - RNA, 19 nt, Homo sapiens
acaagaaucucacuaucag

SEQ ID NO: 680571 - RNA, 19 nt, Homo sapiens
gcagagagcaacuugacau

SEQ ID NO: 680572 - RNA, 19 nt, Homo sapiens
gacuuucagugcauuaguu

SEQ ID NO: 680573 - RNA, 19 nt, Homo sapiens
gggcagcuuuguccuauac

SEQ ID NO: 680574 - RNA, 19 nt, Homo sapiens
caaacaggcccuaaacaag

SEQ ID NO: 680575 - RNA, 19 nt, Homo sapiens
gcuaaugcagagucaagua

SEQ ID NO: 680576 - RNA, 19 nt, Homo sapiens
guaaacguuugugaaugaa

SEQ ID NO: 680577 - RNA, 19 nt, Homo sapiens
uuaauccaguuccuucaaa

SEQ ID NO: 680578 - RNA, 19 nt, Homo sapiens
aaacaggcccuaaacaagu

SEQ ID NO: 680579 - RNA, 19 nt, Homo sapiens
acuugaaucuguagacauu

SEQ ID NO: 680580 - RNA, 19 nt, Homo sapiens
gggauaauagcacuaccua

SEQ ID NO: 680581 - RNA, 19 nt, Homo sapiens
gggaagaugaauacacuug

SEQ ID NO: 680582 - RNA, 19 nt, Homo sapiens
gaauggcccaaacugaauu

SEQ ID NO: 680583 - RNA, 19 nt, Homo sapiens
agaagcagcagcacauuga

SEQ ID NO: 680584 - RNA, 19 nt, Homo sapiens
gacagagggaagaugaaua

SEQ ID NO: 680585 - RNA, 19 nt, Homo sapiens
ugacucuucugucucuuga

SEQ ID NO: 680586 - RNA, 19 nt, Homo sapiens
guacauuacagacgccauu

SEQ ID NO: 680587 - RNA, 19 nt, Homo sapiens
gggagugggaggcuucuuu

SEQ ID NO: 680588 - RNA, 19 nt, Homo sapiens
ccaaggaacaagaaucuca

SEQ ID NO: 680589 - RNA, 19 nt, Homo sapiens
ccaacagggucuggaguau

SEQ ID NO: 680590 - RNA, 19 nt, Homo sapiens
agacagaaccuugcaaaca

SEQ ID NO: 680591 - RNA, 19 nt, Homo sapiens
gaagugacagagguagaaa

SEQ ID NO: 680592 - RNA, 19 nt, Homo sapiens
gcacacaguaaacguuugu

SEQ ID NO: 680593 - RNA, 19 nt, Homo sapiens
gaacugagcucuugucauu

SEQ ID NO: 680594 - RNA, 19 nt, Homo sapiens
ggccagagcucacaccuua

SEQ ID NO: 680595 - RNA, 19 nt, Homo sapiens
gauaagccaucauuuguuu

SEQ ID NO: 680596 - RNA, 19 nt, Homo sapiens
agucagagcuccuuacuua

SEQ ID NO: 680597 - RNA, 19 nt, Homo sapiens
ggaaagacuucauucacua

SEQ ID NO: 680598 - RNA, 19 nt, Homo sapiens
gaacgucucaggacaaaua

SEQ ID NO: 680599 - RNA, 19 nt, Homo sapiens
gagagcagcugaagaagaa

SEQ ID NO: 680600 - RNA, 19 nt, Homo sapiens
ggacagugaucauaucuga

SEQ ID NO: 680601 - RNA, 19 nt, Homo sapiens
aaagguaacucguguauga

SEQ ID NO: 680602 - RNA, 19 nt, Homo sapiens
gaaaugcauuagacuugua

SEQ ID NO: 680603 - RNA, 19 nt, Homo sapiens
acacacagguaacuuauaa

SEQ ID NO: 680604 - RNA, 19 nt, Homo sapiens
gaaacaguaugaaugcaaa

SEQ ID NO: 680605 - RNA, 19 nt, Homo sapiens
gggaaaggcuucagucaga

SEQ ID NO: 680606 - RNA, 19 nt, Homo sapiens
acacagaagugaaacagua

SEQ ID NO: 680607 - RNA, 19 nt, Homo sapiens
gcauuagacuuguacauug

SEQ ID NO: 680608 - RNA, 19 nt, Homo sapiens
gcucagaccuuauugaaca

SEQ ID NO: 680609 - RNA, 19 nt, Homo sapiens
cuacguaacucuucuguug

SEQ ID NO: 680610 - RNA, 19 nt, Homo sapiens
ggugagaggucuguagaua

SEQ ID NO: 680611 - RNA, 19 nt, Homo sapiens
gagaaacucuaugaaugua

SEQ ID NO: 680612 - RNA, 19 nt, Homo sapiens
cagaagaggugacauuuca

SEQ ID NO: 680613 - RNA, 19 nt, Homo sapiens
gaaagggacuagcaagcuu

SEQ ID NO: 680614 - RNA, 19 nt, Homo sapiens
ggaauaguccucaauguug

SEQ ID NO: 680615 - RNA, 19 nt, Homo sapiens
ggauucaugugguuucuaa

SEQ ID NO: 680616 - RNA, 19 nt, Homo sapiens
gagaagcucuaugaaugua

SEQ ID NO: 680617 - RNA, 19 nt, Homo sapiens
ggaacacacagguaacuua

SEQ ID NO: 680618 - RNA, 19 nt, Homo sapiens
gggaaggccuuacagaaga

SEQ ID NO: 680619 - RNA, 19 nt, Homo sapiens
guagagagcagcugaagaa

SEQ ID NO: 680620 - RNA, 19 nt, Homo sapiens
ggacaggcccuucgaaugu

SEQ ID NO: 680621 - RNA, 19 nt, Homo sapiens
cuagagauguuucaaaugu

SEQ ID NO: 680622 - RNA, 19 nt, Homo sapiens
uaacucaacuacaaacguu

SEQ ID NO: 680623 - RNA, 19 nt, Homo sapiens
ggagagagacccuuugaau

SEQ ID NO: 680624 - RNA, 19 nt, Homo sapiens
cgucaucgcucagaccuua

SEQ ID NO: 680625 - RNA, 19 nt, Homo sapiens
gaaagucuucugggauuua

SEQ ID NO: 680626 - RNA, 19 nt, Homo sapiens
gagaaggucuuuacuuacu

SEQ ID NO: 680627 - RNA, 19 nt, Homo sapiens
agaaugaugugauagacua

SEQ ID NO: 680628 - RNA, 19 nt, Homo sapiens
acucugagcuggaacagua

SEQ ID NO: 680629 - RNA, 19 nt, Homo sapiens
ggagaggccuuacguaugc

SEQ ID NO: 680630 - RNA, 19 nt, Homo sapiens
gaaggucuuuacuuacuug

SEQ ID NO: 680631 - RNA, 19 nt, Homo sapiens
gagcugggaucguggcauu

SEQ ID NO: 680632 - RNA, 19 nt, Homo sapiens
ggagaggaaucugcagaaa

SEQ ID NO: 680633 - RNA, 19 nt, Homo sapiens
gagagagaguguaugaaug

SEQ ID NO: 680634 - RNA, 19 nt, Homo sapiens
gaaaagcccuucaaaugug

SEQ ID NO: 680635 - RNA, 19 nt, Homo sapiens
gcagaacugucuacuugau

SEQ ID NO: 680636 - RNA, 19 nt, Homo sapiens
gaaguucccuuuugccuuu

SEQ ID NO: 680637 - RNA, 19 nt, Homo sapiens
gaaaggcacagucucaaug

SEQ ID NO: 680638 - RNA, 19 nt, Homo sapiens
guaauuggcaucucucuug

SEQ ID NO: 680639 - RNA, 19 nt, Homo sapiens
ggaaaugcguggaauuagg

SEQ ID NO: 680640 - RNA, 19 nt, Homo sapiens
gaacacacagguaacuuau

SEQ ID NO: 680641 - RNA, 19 nt, Homo sapiens
ggagagagaguguaugaau

SEQ ID NO: 680642 - RNA, 19 nt, Homo sapiens
guuugcagcucucacauuu

SEQ ID NO: 680643 - RNA, 19 nt, Homo sapiens
gcugggaaguccaagauga

SEQ ID NO: 680644 - RNA, 19 nt, Homo sapiens
guaccuaggacuuuaauug

SEQ ID NO: 680645 - RNA, 19 nt, Homo sapiens
gccaaacuguuagucuuua

SEQ ID NO: 680646 - RNA, 19 nt, Homo sapiens
gagaaaagcccuucaaaug

SEQ ID NO: 680647 - RNA, 19 nt, Homo sapiens
gaugaaaacucacauagga

SEQ ID NO: 680648 - RNA, 19 nt, Homo sapiens
guuaauuucucucaguuug

SEQ ID NO: 680649 - RNA, 19 nt, Homo sapiens
ggacuuuaauugcuguguu

SEQ ID NO: 680650 - RNA, 19 nt, Homo sapiens
gcagcacucuccacacuuc

SEQ ID NO: 680651 - RNA, 19 nt, Homo sapiens
ggagaaaggcccuaugagu

SEQ ID NO: 680652 - RNA, 19 nt, Homo sapiens
ccagauaaccacuuucuau

SEQ ID NO: 680653 - RNA, 19 nt, Homo sapiens
gaaagcaggcgagguaaau

SEQ ID NO: 680654 - RNA, 19 nt, Homo sapiens
agaggaaucugcagaaaca

SEQ ID NO: 680655 - RNA, 19 nt, Homo sapiens
ccacuacccugaagucauc

SEQ ID NO: 680656 - RNA, 19 nt, Homo sapiens
ggucaaacuuccuucaaca

SEQ ID NO: 680657 - RNA, 19 nt, Homo sapiens
uuucugaguucauaccuua

SEQ ID NO: 680658 - RNA, 19 nt, Homo sapiens
gaagugaaacaguaugaau

SEQ ID NO: 680659 - RNA, 19 nt, Homo sapiens
guuuagagccucauacaaa

SEQ ID NO: 680660 - RNA, 19 nt, Homo sapiens
gaaguuucauccccaguua

SEQ ID NO: 680661 - RNA, 19 nt, Homo sapiens
gaaaugcguggaauuagga

SEQ ID NO: 680662 - RNA, 19 nt, Homo sapiens
gggaaagacuucauucacu

SEQ ID NO: 680663 - RNA, 19 nt, Homo sapiens
caacugggaggcuuauaaa

SEQ ID NO: 680664 - RNA, 19 nt, Homo sapiens
gacaggcccuucgaaugua

SEQ ID NO: 680665 - RNA, 19 nt, Homo sapiens
ccuaagaaauugucacaca

SEQ ID NO: 680666 - RNA, 19 nt, Homo sapiens
gugagggccugcuuccuuu

SEQ ID NO: 680667 - RNA, 19 nt, Homo sapiens
aaacgccuauuuaagugua

SEQ ID NO: 680668 - RNA, 19 nt, Homo sapiens
ggccagagaucaguagaga

SEQ ID NO: 680669 - RNA, 19 nt, Homo sapiens
gaaacucuaugaauguaac

SEQ ID NO: 680670 - RNA, 19 nt, Homo sapiens
cauuagacuuguacauuga

SEQ ID NO: 680671 - RNA, 19 nt, Homo sapiens
gcucaugccuguauaaucc

SEQ ID NO: 680672 - RNA, 19 nt, Homo sapiens
uguagugguugaaucauuu

SEQ ID NO: 680673 - RNA, 19 nt, Homo sapiens
gagcauuuguguaaaagua

SEQ ID NO: 680674 - RNA, 19 nt, Homo sapiens
augcagaacugucuacuug

SEQ ID NO: 680675 - RNA, 19 nt, Homo sapiens
gagagaguguaugaaugua

SEQ ID NO: 680676 - RNA, 19 nt, Homo sapiens
gagagagacccuuugaaug

SEQ ID NO: 680677 - RNA, 19 nt, Homo sapiens
ugugggaaauccuucauaa

SEQ ID NO: 680678 - RNA, 19 nt, Homo sapiens
gaaagacuucauucacuau

SEQ ID NO: 680679 - RNA, 19 nt, Homo sapiens
guuaggaauuugacaugaa

SEQ ID NO: 680680 - RNA, 19 nt, Homo sapiens
gauuaguguugcuugguuu

SEQ ID NO: 680681 - RNA, 19 nt, Homo sapiens
gaagacggagaucacagua

SEQ ID NO: 680682 - RNA, 19 nt, Homo sapiens
ugagaggucuguagauaag

SEQ ID NO: 680683 - RNA, 19 nt, Homo sapiens
ucagagcuccuuacuuauu

SEQ ID NO: 680684 - RNA, 19 nt, Homo sapiens
uuacuugucuguaucuuuc

SEQ ID NO: 680685 - RNA, 19 nt, Homo sapiens
caugugguuucuaagauuu

SEQ ID NO: 680686 - RNA, 19 nt, Homo sapiens
caugucaucugugaauaaa

SEQ ID NO: 680687 - RNA, 19 nt, Homo sapiens
gacucaaguucuuuccaua

SEQ ID NO: 680688 - RNA, 19 nt, Homo sapiens
gaugagggugucaacauuu

SEQ ID NO: 680689 - RNA, 19 nt, Homo sapiens
acuaugagcauuuguguaa

SEQ ID NO: 680690 - RNA, 19 nt, Homo sapiens
guuaauggguuuccagucu

SEQ ID NO: 680691 - RNA, 19 nt, Homo sapiens
uggcaucucucuugcuuug

SEQ ID NO: 680692 - RNA, 19 nt, Homo sapiens
gaagcucuaugaauguagu

SEQ ID NO: 680693 - RNA, 19 nt, Homo sapiens
gaacaucccugaucucaua

SEQ ID NO: 680694 - RNA, 19 nt, Homo sapiens
gagaauagcugaauugaau

SEQ ID NO: 680695 - RNA, 19 nt, Homo sapiens
gaacuaagauuucgacaau

SEQ ID NO: 680696 - RNA, 19 nt, Homo sapiens
ggacugaucucauucauau

SEQ ID NO: 680697 - RNA, 19 nt, Homo sapiens
ggacagcgcucaccauuga

SEQ ID NO: 680698 - RNA, 19 nt, Homo sapiens
gaaagaagguguuaaggau

SEQ ID NO: 680699 - RNA, 19 nt, Homo sapiens
gcaaauuucucaagacuau

SEQ ID NO: 680700 - RNA, 19 nt, Homo sapiens
gaaccaaaguuacaaugaa

SEQ ID NO: 680701 - RNA, 19 nt, Homo sapiens
gcaagaaacuguuaucaag

SEQ ID NO: 680702 - RNA, 19 nt, Homo sapiens
ugaagaaucugaacuaaga

SEQ ID NO: 680703 - RNA, 19 nt, Homo sapiens
ggaaauggaccguguuuaa

SEQ ID NO: 680704 - RNA, 19 nt, Homo sapiens
gaugggauguucagcaaua

SEQ ID NO: 680705 - RNA, 19 nt, Homo sapiens
cuagguagguuccagauua

SEQ ID NO: 680706 - RNA, 19 nt, Homo sapiens
ugaacgaaaugaacuguua

SEQ ID NO: 680707 - RNA, 19 nt, Homo sapiens
gagaaacgaugaacugaug

SEQ ID NO: 680708 - RNA, 19 nt, Homo sapiens
ucagagaauucgugacuua

SEQ ID NO: 680709 - RNA, 19 nt, Homo sapiens
gcaaauguauguuccugaa

SEQ ID NO: 680710 - RNA, 19 nt, Homo sapiens
cuaagaagaugauacugua

SEQ ID NO: 680711 - RNA, 19 nt, Homo sapiens
aagauucccucauguaaua

SEQ ID NO: 680712 - RNA, 19 nt, Homo sapiens
gagcaucucugaaucuuuc

SEQ ID NO: 680713 - RNA, 19 nt, Homo sapiens
cgaccaagcuaaugaagaa

SEQ ID NO: 680714 - RNA, 19 nt, Homo sapiens
ggaagaagauaaauuacuc

SEQ ID NO: 680715 - RNA, 19 nt, Homo sapiens
gaugaggacucuauggauu

SEQ ID NO: 680716 - RNA, 19 nt, Homo sapiens
gaaggaggcuuuggacgaa

SEQ ID NO: 680717 - RNA, 19 nt, Homo sapiens
caccacaccuggcuaauuu

SEQ ID NO: 680718 - RNA, 19 nt, Homo sapiens
cagaagagaagaacuauaa

SEQ ID NO: 680719 - RNA, 19 nt, Homo sapiens
caacagaacauuauugaug

SEQ ID NO: 680720 - RNA, 19 nt, Homo sapiens
caagagaaguccaagguau

SEQ ID NO: 680721 - RNA, 19 nt, Homo sapiens
agaaugagcugcuggaguu

SEQ ID NO: 680722 - RNA, 19 nt, Homo sapiens
ucacagacauucagauaga

SEQ ID NO: 680723 - RNA, 19 nt, Homo sapiens
gaugaugacuuggaugaaa

SEQ ID NO: 680724 - RNA, 19 nt, Homo sapiens
ggaccaagcucacagacau

SEQ ID NO: 680725 - RNA, 19 nt, Homo sapiens
gagaauucgugacuuagaa

SEQ ID NO: 680726 - RNA, 19 nt, Homo sapiens
gaaauggaccguguuuaaa

SEQ ID NO: 680727 - RNA, 19 nt, Homo sapiens
gaauaccuaugaagagcua

SEQ ID NO: 680728 - RNA, 19 nt, Homo sapiens
gaacaaguggccauaauuc

SEQ ID NO: 680729 - RNA, 19 nt, Homo sapiens
gaagcuacuuuguacaaug

SEQ ID NO: 680730 - RNA, 19 nt, Homo sapiens
ugaauugaaugccacuaua

SEQ ID NO: 680731 - RNA, 19 nt, Homo sapiens
ggaggaaagucagguggua

SEQ ID NO: 680732 - RNA, 19 nt, Homo sapiens
ggaaauugcggaccugaaa

SEQ ID NO: 680733 - RNA, 19 nt, Homo sapiens
agauagagcugcaucaaga

SEQ ID NO: 680734 - RNA, 19 nt, Homo sapiens
caacagacuccauuuagaa

SEQ ID NO: 680735 - RNA, 19 nt, Homo sapiens
uaacaaaacugguaacgaa

SEQ ID NO: 680736 - RNA, 19 nt, Homo sapiens
gcacgaggaauaccuauga

SEQ ID NO: 680737 - RNA, 19 nt, Homo sapiens
gggcauggaaccaaaguua

SEQ ID NO: 680738 - RNA, 19 nt, Homo sapiens
gcucaagucugcucucugu

SEQ ID NO: 680739 - RNA, 19 nt, Homo sapiens
gggagaaccuuaucaagca

SEQ ID NO: 680740 - RNA, 19 nt, Homo sapiens
ccaagaaauuuguaaguca

SEQ ID NO: 680741 - RNA, 19 nt, Homo sapiens
gauagaagagugugucauu

SEQ ID NO: 680742 - RNA, 19 nt, Homo sapiens
gaucaucucaugcuauuga

SEQ ID NO: 680743 - RNA, 19 nt, Homo sapiens
gaacaauaacugaagaaug

SEQ ID NO: 680744 - RNA, 19 nt, Homo sapiens
acacuaguccugauaauaa

SEQ ID NO: 680745 - RNA, 19 nt, Homo sapiens
ggaacuaguuucugcagau

SEQ ID NO: 680746 - RNA, 19 nt, Homo sapiens
caucgacgcugaacgagaa

SEQ ID NO: 680747 - RNA, 19 nt, Homo sapiens
gaauugaaugccacuauaa

SEQ ID NO: 680748 - RNA, 19 nt, Homo sapiens
ggaacaauguccaagaaag

SEQ ID NO: 680749 - RNA, 19 nt, Homo sapiens
uaacagaacaaccucaauu

SEQ ID NO: 680750 - RNA, 19 nt, Homo sapiens
guucuucucucuugccuuu

SEQ ID NO: 680751 - RNA, 19 nt, Homo sapiens
gaagaaagcauagaagaag

SEQ ID NO: 680752 - RNA, 19 nt, Homo sapiens
caagugcuguauuauuuga

SEQ ID NO: 680753 - RNA, 19 nt, Homo sapiens
gaguaaauuucuaccaaga

SEQ ID NO: 680754 - RNA, 19 nt, Homo sapiens
gagugaagcacgaggaaua

SEQ ID NO: 680755 - RNA, 19 nt, Homo sapiens
gaaacacuaguccugauaa

SEQ ID NO: 680756 - RNA, 19 nt, Homo sapiens
ggaaacacuaguccugaua

SEQ ID NO: 680757 - RNA, 19 nt, Homo sapiens
gcagaggugcuaagguaua

SEQ ID NO: 680758 - RNA, 19 nt, Homo sapiens
gaaguuccaagccaauuaa

SEQ ID NO: 680759 - RNA, 19 nt, Homo sapiens
guacagaaacuccaacuuc

SEQ ID NO: 680760 - RNA, 19 nt, Homo sapiens
gacaggcuauguacagaaa

SEQ ID NO: 680761 - RNA, 19 nt, Homo sapiens
gcucacagacauucagaua

SEQ ID NO: 680762 - RNA, 19 nt, Homo sapiens
caggagagccagucauuaa

SEQ ID NO: 680763 - RNA, 19 nt, Homo sapiens
caucauccauggccucauu

SEQ ID NO: 680764 - RNA, 19 nt, Homo sapiens
gaaaugaacuguuaaaacg

SEQ ID NO: 680765 - RNA, 19 nt, Homo sapiens
cggcagcagugacaaagua

SEQ ID NO: 680766 - RNA, 19 nt, Homo sapiens
ccaacagacuccauuuaga

SEQ ID NO: 680767 - RNA, 19 nt, Homo sapiens
uaccaacucuugcucauga

SEQ ID NO: 680768 - RNA, 19 nt, Homo sapiens
acuauagacugaacuguaa

SEQ ID NO: 680769 - RNA, 19 nt, Homo sapiens
gaacaagaggugcuuaaag

SEQ ID NO: 680770 - RNA, 19 nt, Homo sapiens
aaagugacauggaacaguu

SEQ ID NO: 680771 - RNA, 19 nt, Homo sapiens
gcugaagaaucugaacuaa

SEQ ID NO: 680772 - RNA, 19 nt, Homo sapiens
guaaaccucuccuggaaag

SEQ ID NO: 680773 - RNA, 19 nt, Homo sapiens
gaacgaaaugaacuguuaa

SEQ ID NO: 680774 - RNA, 19 nt, Homo sapiens
gauaagaaacaguaacaug

SEQ ID NO: 680775 - RNA, 19 nt, Homo sapiens
ucaaauggcugcuuaaaau

SEQ ID NO: 680776 - RNA, 19 nt, Homo sapiens
gagcagagaguaugacugu

SEQ ID NO: 680777 - RNA, 19 nt, Homo sapiens
gcuaagguauaaagccaaa

SEQ ID NO: 680778 - RNA, 19 nt, Homo sapiens
gcagggcccauaugaguaa

SEQ ID NO: 680779 - RNA, 19 nt, Homo sapiens
gguuccagauuaaauauga

SEQ ID NO: 680780 - RNA, 19 nt, Homo sapiens
gauggagucuugcucuguu

SEQ ID NO: 680781 - RNA, 19 nt, Homo sapiens
aaacacagcagaaucaaug

SEQ ID NO: 680782 - RNA, 19 nt, Homo sapiens
guaaauuucuaccaagagu

SEQ ID NO: 680783 - RNA, 19 nt, Homo sapiens
gaccaagcauauaugagaa

SEQ ID NO: 680784 - RNA, 19 nt, Homo sapiens
guagguuccagauuaaaua

SEQ ID NO: 680785 - RNA, 19 nt, Homo sapiens
gaauucccaugcauagaga

SEQ ID NO: 680786 - RNA, 19 nt, Homo sapiens
ucugaccucuucuuguuua

SEQ ID NO: 680787 - RNA, 19 nt, Homo sapiens
caucguaaaugggaagaaa

SEQ ID NO: 680788 - RNA, 19 nt, Homo sapiens
gaaaauggauucaguuugc

SEQ ID NO: 680789 - RNA, 19 nt, Homo sapiens
ggaacuagaagcuacuuug

SEQ ID NO: 680790 - RNA, 19 nt, Homo sapiens
gaagaacaaguggccauaa

SEQ ID NO: 680791 - RNA, 19 nt, Homo sapiens
ucucaagacuauagacuga

SEQ ID NO: 680792 - RNA, 19 nt, Homo sapiens
ugacuuaguucuguuuaga

SEQ ID NO: 680793 - RNA, 19 nt, Homo sapiens
gacuaaagcuucacuauaa

SEQ ID NO: 680794 - RNA, 19 nt, Homo sapiens
gaggagagcuguuugacua

SEQ ID NO: 680795 - RNA, 19 nt, Homo sapiens
gguggaaucuaaaucauua

SEQ ID NO: 680796 - RNA, 19 nt, Homo sapiens
uaacaaggauuaccaucua

SEQ ID NO: 680797 - RNA, 19 nt, Homo sapiens
gaagaguacuuuauguuuc

SEQ ID NO: 680798 - RNA, 19 nt, Homo sapiens
ucacagacaucaagucaaa

SEQ ID NO: 680799 - RNA, 19 nt, Homo sapiens
cagaacaccugcaaauaaa

SEQ ID NO: 680800 - RNA, 19 nt, Homo sapiens
caucacaguuuaccaagua

SEQ ID NO: 680801 - RNA, 19 nt, Homo sapiens
caaagacuccaguuaauaa

SEQ ID NO: 680802 - RNA, 19 nt, Homo sapiens
gagcaugggcauacuguua

SEQ ID NO: 680803 - RNA, 19 nt, Homo sapiens
caaaucauaucuuggauca

SEQ ID NO: 680804 - RNA, 19 nt, Homo sapiens
gcaagaggacuaugaaaga

SEQ ID NO: 680805 - RNA, 19 nt, Homo sapiens
gaacaucacaguuuaccaa

SEQ ID NO: 680806 - RNA, 19 nt, Homo sapiens
ggagagcuguuugacuaua

SEQ ID NO: 680807 - RNA, 19 nt, Homo sapiens
gaacaccugcaaauaaauu

SEQ ID NO: 680808 - RNA, 19 nt, Homo sapiens
agaggacuaugaaagauua

SEQ ID NO: 680809 - RNA, 19 nt, Homo sapiens
ggcaaacaauggaggauuu

SEQ ID NO: 680810 - RNA, 19 nt, Homo sapiens
gcauauaugucaacucuac

SEQ ID NO: 680811 - RNA, 19 nt, Homo sapiens
gaaagugacaaugcaauuu

SEQ ID NO: 680812 - RNA, 19 nt, Homo sapiens
gauacagccuacauaaaga

SEQ ID NO: 680813 - RNA, 19 nt, Homo sapiens
gaagcauguugacuuugua

SEQ ID NO: 680814 - RNA, 19 nt, Homo sapiens
caaagaagcauguugacuu

SEQ ID NO: 680815 - RNA, 19 nt, Homo sapiens
gaugugaccgcaagugaua

SEQ ID NO: 680816 - RNA, 19 nt, Homo sapiens
ggagagaugguagcuauaa

SEQ ID NO: 680817 - RNA, 19 nt, Homo sapiens
uagauucacuuccauaugu

SEQ ID NO: 680818 - RNA, 19 nt, Homo sapiens
gcaugggcauacuguuaua

SEQ ID NO: 680819 - RNA, 19 nt, Homo sapiens
ucacuacgccaaaucguua

SEQ ID NO: 680820 - RNA, 19 nt, Homo sapiens
ccaaagacuccaguuaaua

SEQ ID NO: 680821 - RNA, 19 nt, Homo sapiens
gaaugaagaguacuuuaug

SEQ ID NO: 680822 - RNA, 19 nt, Homo sapiens
guaauggcuuuauacaaga

SEQ ID NO: 680823 - RNA, 19 nt, Homo sapiens
aaagggagccaaaguguuu

SEQ ID NO: 680824 - RNA, 19 nt, Homo sapiens
gccaaagacuccaguuaau

SEQ ID NO: 680825 - RNA, 19 nt, Homo sapiens
caaaugggguggaaucuaa

SEQ ID NO: 680826 - RNA, 19 nt, Homo sapiens
gagagaugguagcuauaaa

SEQ ID NO: 680827 - RNA, 19 nt, Homo sapiens
ggaaagugacaaugcaauu

SEQ ID NO: 680828 - RNA, 19 nt, Homo sapiens
caugcaagauuacaacuau

SEQ ID NO: 680829 - RNA, 19 nt, Homo sapiens
gaucagaggcagauguuug

SEQ ID NO: 680830 - RNA, 19 nt, Homo sapiens
guuaugaucgcuuugauuu

SEQ ID NO: 680831 - RNA, 19 nt, Homo sapiens
ccaguucguuuaaggcuuu

SEQ ID NO: 680832 - RNA, 19 nt, Homo sapiens
gcaaacaauggaggauuua

SEQ ID NO: 680833 - RNA, 19 nt, Homo sapiens
aaucauaucuuggaucaga

SEQ ID NO: 680834 - RNA, 19 nt, Homo sapiens
cagcauauaugucaacucu

SEQ ID NO: 680835 - RNA, 19 nt, Homo sapiens
ugaagaaccugagacauca

SEQ ID NO: 680836 - RNA, 19 nt, Homo sapiens
gagccaaagacuccaguua

SEQ ID NO: 680837 - RNA, 19 nt, Homo sapiens
gcagguggacccaaagaaa

SEQ ID NO: 680838 - RNA, 19 nt, Homo sapiens
ccaguaaauucaacaggaa

SEQ ID NO: 680839 - RNA, 19 nt, Homo sapiens
gaagacauccuaucuagcu

SEQ ID NO: 680840 - RNA, 19 nt, Homo sapiens
ccaaggguaacaaggauua

SEQ ID NO: 680841 - RNA, 19 nt, Homo sapiens
ggaacagacaaguuaauga

SEQ ID NO: 680842 - RNA, 19 nt, Homo sapiens
gaaacaacaggcaaacaau

SEQ ID NO: 680843 - RNA, 19 nt, Homo sapiens
gcaccugaguuaauacaag

SEQ ID NO: 680844 - RNA, 19 nt, Homo sapiens
gagagcuguuugacuauau

SEQ ID NO: 680845 - RNA, 19 nt, Homo sapiens
gcccaucugucauuauguu

SEQ ID NO: 680846 - RNA, 19 nt, Homo sapiens
ggacuaugaaagauuauga

SEQ ID NO: 680847 - RNA, 19 nt, Homo sapiens
agacuaaagcuucacuaua

SEQ ID NO: 680848 - RNA, 19 nt, Homo sapiens
gaaagggagccaaaguguu

SEQ ID NO: 680849 - RNA, 19 nt, Homo sapiens
caagaggacuaugaaagau

SEQ ID NO: 680850 - RNA, 19 nt, Homo sapiens
ucaagcccaucugucauua

SEQ ID NO: 680851 - RNA, 19 nt, Homo sapiens
caacaggaacagacaaguu

SEQ ID NO: 680852 - RNA, 19 nt, Homo sapiens
uaagucugcuguaaagaau

SEQ ID NO: 680853 - RNA, 19 nt, Homo sapiens
agaccaauaucucuuuguu

SEQ ID NO: 680854 - RNA, 19 nt, Homo sapiens
gaacagacaaguuaaugac

SEQ ID NO: 680855 - RNA, 19 nt, Homo sapiens
ggacagguggcuuugcaaa

SEQ ID NO: 680856 - RNA, 19 nt, Homo sapiens
acuaccaacuuguuucuaa

SEQ ID NO: 680857 - RNA, 19 nt, Homo sapiens
uggaagacauccuaucuag

SEQ ID NO: 680858 - RNA, 19 nt, Homo sapiens
gaucucaaccaagcacaua

SEQ ID NO: 680859 - RNA, 19 nt, Homo sapiens
gaaaccagugccugaaaga

SEQ ID NO: 680860 - RNA, 19 nt, Homo sapiens
gaaccagcauaagagagaa

SEQ ID NO: 680861 - RNA, 19 nt, Homo sapiens
aauaagaaccagcauaaga

SEQ ID NO: 680862 - RNA, 19 nt, Homo sapiens
agacuccaguuaauaagaa

SEQ ID NO: 680863 - RNA, 19 nt, Homo sapiens
aucauuaacuccagccuua

SEQ ID NO: 680864 - RNA, 19 nt, Homo sapiens
guacaucacagaaacaaca

SEQ ID NO: 680865 - RNA, 19 nt, Homo sapiens
aauaugauguucccaagug

SEQ ID NO: 680866 - RNA, 19 nt, Homo sapiens
acagacaucaagucaaaua

SEQ ID NO: 680867 - RNA, 19 nt, Homo sapiens
ggauuaccaucuacagaca

SEQ ID NO: 680868 - RNA, 19 nt, Homo sapiens
uaucugcuguugcuuaugu

SEQ ID NO: 680869 - RNA, 19 nt, Homo sapiens
cuaucuagcugcaagguau

SEQ ID NO: 680870 - RNA, 19 nt, Homo sapiens
agagcuaucuuaagaccaa

SEQ ID NO: 680871 - RNA, 19 nt, Homo sapiens
caaaaggguuauacacuga

SEQ ID NO: 680872 - RNA, 19 nt, Homo sapiens
aacaggaacagacaaguua

SEQ ID NO: 680873 - RNA, 19 nt, Homo sapiens
cugaaagaaacuccaauua

SEQ ID NO: 680874 - RNA, 19 nt, Homo sapiens
gcauucugcuucuucaaca

SEQ ID NO: 680875 - RNA, 19 nt, Homo sapiens
guuaauacaaggcaaauca

SEQ ID NO: 680876 - RNA, 19 nt, Homo sapiens
cuaccaacuuguuucuaaa

SEQ ID NO: 680877 - RNA, 19 nt, Homo sapiens
agaagcauguugacuuugu

SEQ ID NO: 680878 - RNA, 19 nt, Homo sapiens
guacuggacagaaucaaau

SEQ ID NO: 680879 - RNA, 19 nt, Homo sapiens
caauggaggauuuaauuuc

SEQ ID NO: 680880 - RNA, 19 nt, Homo sapiens
uuauucaccucgaugauga

SEQ ID NO: 680881 - RNA, 19 nt, Homo sapiens
ccuggaucaugcaagauua

SEQ ID NO: 680882 - RNA, 19 nt, Homo sapiens
uaugucaacucuaccaugu

SEQ ID NO: 680883 - RNA, 19 nt, Homo sapiens
gaacuaccaacuuguuucu

SEQ ID NO: 680884 - RNA, 19 nt, Homo sapiens
agacuguuaugaucgcuuu

SEQ ID NO: 680885 - RNA, 19 nt, Homo sapiens
cauaagagagaaauacuca

SEQ ID NO: 680886 - RNA, 19 nt, Homo sapiens
caagaaggcucggggaaaa

SEQ ID NO: 680887 - RNA, 19 nt, Homo sapiens
guggauuucuaccauuuga

SEQ ID NO: 680888 - RNA, 19 nt, Homo sapiens
guguggauuucuaccauuu

SEQ ID NO: 680889 - RNA, 19 nt, Homo sapiens
ugcagcaccugaguuaaua

SEQ ID NO: 680890 - RNA, 19 nt, Homo sapiens
uaaugugacuacaacuaga

SEQ ID NO: 680891 - RNA, 19 nt, Homo sapiens
cuggagagaugguagcuau

SEQ ID NO: 680892 - RNA, 19 nt, Homo sapiens
gcuagagacagccaacaaa

SEQ ID NO: 680893 - RNA, 19 nt, Homo sapiens
ggacacaccuggcgacgua

SEQ ID NO: 680894 - RNA, 19 nt, Homo sapiens
gagaaaccaugguaacgua

SEQ ID NO: 680895 - RNA, 19 nt, Homo sapiens
ggagagagauagagagaga

SEQ ID NO: 680896 - RNA, 19 nt, Homo sapiens
caaagucccucccauauuc

SEQ ID NO: 680897 - RNA, 19 nt, Homo sapiens
ccaggaaucuucacauuug

SEQ ID NO: 680898 - RNA, 19 nt, Homo sapiens
gaaagaagacacucuaugu

SEQ ID NO: 680899 - RNA, 19 nt, Homo sapiens
gcgcauggcuccugcugua

SEQ ID NO: 680900 - RNA, 19 nt, Homo sapiens
gggcuguucuuguguauuu

SEQ ID NO: 680901 - RNA, 19 nt, Homo sapiens
gaaggacacuugugauuac

SEQ ID NO: 680902 - RNA, 19 nt, Homo sapiens
ggacaugccuccuccaaag

SEQ ID NO: 680903 - RNA, 19 nt, Homo sapiens
uaaauguucucaccacaaa

SEQ ID NO: 680904 - RNA, 19 nt, Homo sapiens
uaagauacauccagaaagu

SEQ ID NO: 680905 - RNA, 19 nt, Homo sapiens
gaaauagggcuguggcaaa

SEQ ID NO: 680906 - RNA, 19 nt, Homo sapiens
acacacaucuacauccaua

SEQ ID NO: 680907 - RNA, 19 nt, Homo sapiens
gguguuggcuguucucuug

SEQ ID NO: 680908 - RNA, 19 nt, Homo sapiens
ggacacuugugauuacauu

SEQ ID NO: 680909 - RNA, 19 nt, Homo sapiens
ggacagcucacauagauug

SEQ ID NO: 680910 - RNA, 19 nt, Homo sapiens
gaacacuucuuagaguuug

SEQ ID NO: 680911 - RNA, 19 nt, Homo sapiens
gcaccuuccuccuuucgua

SEQ ID NO: 680912 - RNA, 19 nt, Homo sapiens
caccaaauuugaucaguuu

SEQ ID NO: 680913 - RNA, 19 nt, Homo sapiens
gcacaugauuggguguuaa

SEQ ID NO: 680914 - RNA, 19 nt, Homo sapiens
aaacauauguguguacaga

SEQ ID NO: 680915 - RNA, 19 nt, Homo sapiens
gcaaagucccucccauauu

SEQ ID NO: 680916 - RNA, 19 nt, Homo sapiens
ugacagaguugcuucuaug

SEQ ID NO: 680917 - RNA, 19 nt, Homo sapiens
gaagcugcgugauugagaa

SEQ ID NO: 680918 - RNA, 19 nt, Homo sapiens
ggauuccuccuuucuguua

SEQ ID NO: 680919 - RNA, 19 nt, Homo sapiens
ucaccuggcuucugucuau

SEQ ID NO: 680920 - RNA, 19 nt, Homo sapiens
caaagcaaaugacaggaau

SEQ ID NO: 680921 - RNA, 19 nt, Homo sapiens
ggucaaagggcaugaaguu

SEQ ID NO: 680922 - RNA, 19 nt, Homo sapiens
uaaggacugugaacucuau

SEQ ID NO: 680923 - RNA, 19 nt, Homo sapiens
ggucccaccuagugaagua

SEQ ID NO: 680924 - RNA, 19 nt, Homo sapiens
gcacugugauggaaagaag

SEQ ID NO: 680925 - RNA, 19 nt, Homo sapiens
cagaguugcuucuaugaug

SEQ ID NO: 680926 - RNA, 19 nt, Homo sapiens
ggaaagaagacacucuaug

SEQ ID NO: 680927 - RNA, 19 nt, Homo sapiens
gagagaugcuggucaaagg

SEQ ID NO: 680928 - RNA, 19 nt, Homo sapiens
ugacaccagugaugaaaug

SEQ ID NO: 680929 - RNA, 19 nt, Homo sapiens
ggagggagggagagagaua

SEQ ID NO: 680930 - RNA, 19 nt, Homo sapiens
ccucuccacuucaugauuu

SEQ ID NO: 680931 - RNA, 19 nt, Homo sapiens
aaaguagccagaagaauuu

SEQ ID NO: 680932 - RNA, 19 nt, Homo sapiens
caaagggcaugaaguuucu

SEQ ID NO: 680933 - RNA, 19 nt, Homo sapiens
ggccucagguucucuguga

SEQ ID NO: 680934 - RNA, 19 nt, Homo sapiens
ccauggaggugacagaguu

SEQ ID NO: 680935 - RNA, 19 nt, Homo sapiens
guuaagggcuccgaugaug

SEQ ID NO: 680936 - RNA, 19 nt, Homo sapiens
ggaaaacacgguaauguaa

SEQ ID NO: 680937 - RNA, 19 nt, Homo sapiens
ggaaaacacgguaauguaa

SEQ ID NO: 680938 - RNA, 19 nt, Homo sapiens
aaggaauuguggagaaaua

SEQ ID NO: 680939 - RNA, 19 nt, Homo sapiens
cagcaaagucccucccaua

SEQ ID NO: 680940 - RNA, 19 nt, Homo sapiens
gauggcagcucacguucug

SEQ ID NO: 680941 - RNA, 19 nt, Homo sapiens
gggugaagcugcgugauug

SEQ ID NO: 680942 - RNA, 19 nt, Homo sapiens
aaggacagcucacauagau

SEQ ID NO: 680943 - RNA, 19 nt, Homo sapiens
ucacagggacuccggcaua

SEQ ID NO: 680944 - RNA, 19 nt, Homo sapiens
gaaaccaucgccaucauca

SEQ ID NO: 680945 - RNA, 19 nt, Homo sapiens
ccauauggauguuguacug

SEQ ID NO: 680946 - RNA, 19 nt, Homo sapiens
uguaggugauugagaagua

SEQ ID NO: 680947 - RNA, 19 nt, Homo sapiens
ccacuuaccuuguuuuaau

SEQ ID NO: 680948 - RNA, 19 nt, Homo sapiens
ggcgaccacuccucaguuu

SEQ ID NO: 680949 - RNA, 19 nt, Homo sapiens
acaacagucuauuugcuuu

SEQ ID NO: 680950 - RNA, 19 nt, Homo sapiens
gcaugugucugugugaaug

SEQ ID NO: 680951 - RNA, 19 nt, Homo sapiens
ggccagugcuccagcuuug

SEQ ID NO: 680952 - RNA, 19 nt, Homo sapiens
agaaaguccuggccaugaa

SEQ ID NO: 680953 - RNA, 19 nt, Homo sapiens
agaaggacacuugugauua

SEQ ID NO: 680954 - RNA, 19 nt, Homo sapiens
caacagucuauuugcuuua

SEQ ID NO: 680955 - RNA, 19 nt, Homo sapiens
guaggugauugagaaguaa

SEQ ID NO: 680956 - RNA, 19 nt, Homo sapiens
uuauguaggugauugagaa

SEQ ID NO: 680957 - RNA, 19 nt, Homo sapiens
aaaccaugguaacguaauu

SEQ ID NO: 680958 - RNA, 19 nt, Homo sapiens
gcaugaaguuucugcugau

SEQ ID NO: 680959 - RNA, 19 nt, Homo sapiens
gcagcacgaugcaauuucu

SEQ ID NO: 680960 - RNA, 19 nt, Homo sapiens
gaggaagugugggcccuaa

SEQ ID NO: 680961 - RNA, 19 nt, Homo sapiens
ggagaaggugugagcauga

SEQ ID NO: 680962 - RNA, 19 nt, Homo sapiens
guugaggacuuuaaggaau

SEQ ID NO: 680963 - RNA, 19 nt, Homo sapiens
gcacauacacacaucuaca

SEQ ID NO: 680964 - RNA, 19 nt, Homo sapiens
gaacgggcacauacaggaa

SEQ ID NO: 680965 - RNA, 19 nt, Homo sapiens
caugguaacguaauuagaa

SEQ ID NO: 680966 - RNA, 19 nt, Homo sapiens
gaacgggcacauacaggaa

SEQ ID NO: 680967 - RNA, 19 nt, Homo sapiens
ugugugaggugauggauau

SEQ ID NO: 680968 - RNA, 19 nt, Homo sapiens
caucaaagcccgacauguc

SEQ ID NO: 680969 - RNA, 19 nt, Homo sapiens
ggaaggaccagcaccauac

SEQ ID NO: 680970 - RNA, 19 nt, Homo sapiens
guccauuguuuccaucuuu

SEQ ID NO: 680971 - RNA, 19 nt, Homo sapiens
ugacaacugggaacaauga

SEQ ID NO: 680972 - RNA, 19 nt, Homo sapiens
acugugacauugagaauug

SEQ ID NO: 680973 - RNA, 19 nt, Homo sapiens
aaaggcugauguccuguuu

SEQ ID NO: 680974 - RNA, 19 nt, Homo sapiens
ucaccuccaucccaucaaa

SEQ ID NO: 680975 - RNA, 19 nt, Homo sapiens
ggaugaggguugggugcua

SEQ ID NO: 680976 - RNA, 19 nt, Homo sapiens
uaccacagguccagaugaa

SEQ ID NO: 680977 - RNA, 19 nt, Homo sapiens
ccugggauccucuccuuua

SEQ ID NO: 680978 - RNA, 19 nt, Homo sapiens
ccucugugcucuucaaauc

SEQ ID NO: 680979 - RNA, 19 nt, Homo sapiens
gcaacgugcccuuguaaca

SEQ ID NO: 680980 - RNA, 19 nt, Homo sapiens
ucaaagggcaugaaguuuc

SEQ ID NO: 680981 - RNA, 19 nt, Homo sapiens
gagaaaacacgguaacgua

SEQ ID NO: 680982 - RNA, 19 nt, Homo sapiens
gagaaaacacgguaacgua

SEQ ID NO: 680983 - RNA, 19 nt, Homo sapiens
gagaaaacacgguaacgua

SEQ ID NO: 680984 - RNA, 19 nt, Homo sapiens
gcauggugacuauaguuaa

SEQ ID NO: 680985 - RNA, 19 nt, Homo sapiens
uguaucaucucaauuaguc

SEQ ID NO: 680986 - RNA, 19 nt, Homo sapiens
ggaccaaugaggaaagaga

SEQ ID NO: 680987 - RNA, 19 nt, Homo sapiens
cacaaggacagcucacaua

SEQ ID NO: 680988 - RNA, 19 nt, Homo sapiens
acaccaaauuugaucaguu

SEQ ID NO: 680989 - RNA, 19 nt, Homo sapiens
gcaaaugacaggaauucca

SEQ ID NO: 680990 - RNA, 19 nt, Homo sapiens
gcuccuggauccaaagcaa

SEQ ID NO: 680991 - RNA, 19 nt, Homo sapiens
ggaugaaguaccagaguga

SEQ ID NO: 680992 - RNA, 19 nt, Homo sapiens
ggagggagagagauagaga

SEQ ID NO: 680993 - RNA, 19 nt, Homo sapiens
ggagggaucuggauucauu

SEQ ID NO: 680994 - RNA, 19 nt, Homo sapiens
gauuugagaugguaccuua

SEQ ID NO: 680995 - RNA, 19 nt, Homo sapiens
gcuauugguuccauauuua

SEQ ID NO: 680996 - RNA, 19 nt, Homo sapiens
ccacuaaaguagacaauaa

SEQ ID NO: 680997 - RNA, 19 nt, Homo sapiens
gcagauccuugguugaaua

SEQ ID NO: 680998 - RNA, 19 nt, Homo sapiens
gcaguuccgugguugaaua

SEQ ID NO: 680999 - RNA, 19 nt, Homo sapiens
ggaugacccucuagcuaua

SEQ ID NO: 681000 - RNA, 19 nt, Homo sapiens
caaauaggaugacccucua

SEQ ID NO: 681001 - RNA, 19 nt, Homo sapiens
aguaaggacuggacuaaua

SEQ ID NO: 681002 - RNA, 19 nt, Homo sapiens
gaagugcgcccauuauuuc

SEQ ID NO: 681003 - RNA, 19 nt, Homo sapiens
gaaaacagcugaagacagu

SEQ ID NO: 681004 - RNA, 19 nt, Homo sapiens
ucccaaaccugaagagaua

SEQ ID NO: 681005 - RNA, 19 nt, Homo sapiens
gaacacagucacaguuuga

SEQ ID NO: 681006 - RNA, 19 nt, Homo sapiens
gagugacugugaucaauuu

SEQ ID NO: 681007 - RNA, 19 nt, Homo sapiens
uauuugagaugguaccuua

SEQ ID NO: 681008 - RNA, 19 nt, Homo sapiens
ugaauucuaucacugcuuu

SEQ ID NO: 681009 - RNA, 19 nt, Homo sapiens
gaaguguccugucagaauc

SEQ ID NO: 681010 - RNA, 19 nt, Homo sapiens
gcgcaaagcagaaaggauu

SEQ ID NO: 681011 - RNA, 19 nt, Homo sapiens
gguggaaccuguacuaagu

SEQ ID NO: 681012 - RNA, 19 nt, Homo sapiens
guaggaaaccugaaaugaa

SEQ ID NO: 681013 - RNA, 19 nt, Homo sapiens
gaccugaaagugacaauaa

SEQ ID NO: 681014 - RNA, 19 nt, Homo sapiens
ccacgccucugucuucuug

SEQ ID NO: 681015 - RNA, 19 nt, Homo sapiens
gauccuugguugaauauag

SEQ ID NO: 681016 - RNA, 19 nt, Homo sapiens
cauuagaccuuucuuccuu

SEQ ID NO: 681017 - RNA, 19 nt, Homo sapiens
ggauugagcucugaguauc

SEQ ID NO: 681018 - RNA, 19 nt, Homo sapiens
ggacuuccuuuaccaacau

SEQ ID NO: 681019 - RNA, 19 nt, Homo sapiens
uuacacaaccauacuagua

SEQ ID NO: 681020 - RNA, 19 nt, Homo sapiens
gccauggccauuaauguua

SEQ ID NO: 681021 - RNA, 19 nt, Homo sapiens
gucagaaucaggaauauuu

SEQ ID NO: 681022 - RNA, 19 nt, Homo sapiens
guaguggucugccucuaau

SEQ ID NO: 681023 - RNA, 19 nt, Homo sapiens
uaacaaaggcuggccgaaa

SEQ ID NO: 681024 - RNA, 19 nt, Homo sapiens
ugaagugcgcccauuauuu

SEQ ID NO: 681025 - RNA, 19 nt, Homo sapiens
ggacuggacuaauauucag

SEQ ID NO: 681026 - RNA, 19 nt, Homo sapiens
gaaagugacaauaacaaag

SEQ ID NO: 681027 - RNA, 19 nt, Homo sapiens
cacagucacaguuugauua

SEQ ID NO: 681028 - RNA, 19 nt, Homo sapiens
uaggaaaccugaaaugaac

SEQ ID NO: 681029 - RNA, 19 nt, Homo sapiens
guaaggacuggacuaauau

SEQ ID NO: 681030 - RNA, 19 nt, Homo sapiens
gcagaaaggauuggagaga

SEQ ID NO: 681031 - RNA, 19 nt, Homo sapiens
uaugugccauggccauuaa

SEQ ID NO: 681032 - RNA, 19 nt, Homo sapiens
agaccaaucucuuguggau

SEQ ID NO: 681033 - RNA, 19 nt, Homo sapiens
ggagugacugugaucaauu

SEQ ID NO: 681034 - RNA, 19 nt, Homo sapiens
gauggacgccuuuaucaca

SEQ ID NO: 681035 - RNA, 19 nt, Homo sapiens
gacaauucuucauguagga

SEQ ID NO: 681036 - RNA, 19 nt, Homo sapiens
ggagggagaaguaccugaa

SEQ ID NO: 681037 - RNA, 19 nt, Homo sapiens
gaauggaaaggcagccaaa

SEQ ID NO: 681038 - RNA, 19 nt, Homo sapiens
ugaacccuuugacgaauuu

SEQ ID NO: 681039 - RNA, 19 nt, Homo sapiens
guuccgugguugaauauau

SEQ ID NO: 681040 - RNA, 19 nt, Homo sapiens
gcgcgcagaucuugucucu

SEQ ID NO: 681041 - RNA, 19 nt, Homo sapiens
ggaaaauauugaacccuuu

SEQ ID NO: 681042 - RNA, 19 nt, Homo sapiens
ucccaggccuugugauuug

SEQ ID NO: 681043 - RNA, 19 nt, Homo sapiens
cuuaagugcugggcaguaa

SEQ ID NO: 681044 - RNA, 19 nt, Homo sapiens
gcucaugugcucaauggaa

SEQ ID NO: 681045 - RNA, 19 nt, Homo sapiens
gacauccagccucccauua

SEQ ID NO: 681046 - RNA, 19 nt, Homo sapiens
ccagagcugugcgcguuaa

SEQ ID NO: 681047 - RNA, 19 nt, Homo sapiens
ugaacacagucacaguuug

SEQ ID NO: 681048 - RNA, 19 nt, Homo sapiens
gaguuacaguggucuuuag

SEQ ID NO: 681049 - RNA, 19 nt, Homo sapiens
uaacaacaggaaacacuug

SEQ ID NO: 681050 - RNA, 19 nt, Homo sapiens
gugcgcccauuauuucauu

SEQ ID NO: 681051 - RNA, 19 nt, Homo sapiens
guaaaacaauuucccaauc

SEQ ID NO: 681052 - RNA, 19 nt, Homo sapiens
cagcucaugugcucaaugg

SEQ ID NO: 681053 - RNA, 19 nt, Homo sapiens
ggccauuaauguuacacaa

SEQ ID NO: 681054 - RNA, 19 nt, Homo sapiens
ucaggaauauuuguuugug

SEQ ID NO: 681055 - RNA, 19 nt, Homo sapiens
ggaccugaaagugacaaua

SEQ ID NO: 681056 - RNA, 19 nt, Homo sapiens
gggauggacgccuuuauca

SEQ ID NO: 681057 - RNA, 19 nt, Homo sapiens
caucugaagugcgcccauu

SEQ ID NO: 681058 - RNA, 19 nt, Homo sapiens
ccguggacaugaaugaauu

SEQ ID NO: 681059 - RNA, 19 nt, Homo sapiens
cuacaggauugagcucuga

SEQ ID NO: 681060 - RNA, 19 nt, Homo sapiens
aacaaaggcuggccgaaag

SEQ ID NO: 681061 - RNA, 19 nt, Homo sapiens
gugaggauaauaacacuga

SEQ ID NO: 681062 - RNA, 19 nt, Homo sapiens
ugagggagcguaguauuga

SEQ ID NO: 681063 - RNA, 19 nt, Homo sapiens
gauugugacucugaaugga

SEQ ID NO: 681064 - RNA, 19 nt, Homo sapiens
ugcuauugguuccauauuu

SEQ ID NO: 681065 - RNA, 19 nt, Homo sapiens
guacuaagugacuggcauu

SEQ ID NO: 681066 - RNA, 19 nt, Homo sapiens
gagauugugacucugaaug

SEQ ID NO: 681067 - RNA, 19 nt, Homo sapiens
gcggugccguggacaugaa

SEQ ID NO: 681068 - RNA, 19 nt, Homo sapiens
ccaggagcaugggugguuu

SEQ ID NO: 681069 - RNA, 19 nt, Homo sapiens
ugaggugugugcuaaccaa

SEQ ID NO: 681070 - RNA, 19 nt, Homo sapiens
uaggaugacccucuagcua

SEQ ID NO: 681071 - RNA, 19 nt, Homo sapiens
uuagaccuuucuuccuuaa

SEQ ID NO: 681072 - RNA, 19 nt, Homo sapiens
uaacacugaggaccugaaa

SEQ ID NO: 681073 - RNA, 19 nt, Homo sapiens
gauauggccacgccucugu

SEQ ID NO: 681074 - RNA, 19 nt, Homo sapiens
ugagaugguaccuuagaaa

SEQ ID NO: 681075 - RNA, 19 nt, Homo sapiens
ugagaugguaccuuagaaa

SEQ ID NO: 681076 - RNA, 19 nt, Homo sapiens
agaccuuucuuccuuaagu

SEQ ID NO: 681077 - RNA, 19 nt, Homo sapiens
acagucacauuagaccuuu

SEQ ID NO: 681078 - RNA, 19 nt, Homo sapiens
cagauugacacaacauaug

SEQ ID NO: 681079 - RNA, 19 nt, Homo sapiens
ggauucauuccuccucauu

SEQ ID NO: 681080 - RNA, 19 nt, Homo sapiens
gaaccuguacuaagugacu

SEQ ID NO: 681081 - RNA, 19 nt, Homo sapiens
agaaguguccugucagaau

SEQ ID NO: 681082 - RNA, 19 nt, Homo sapiens
uggaaaggcagccaaauag

SEQ ID NO: 681083 - RNA, 19 nt, Homo sapiens
ugaguuacaguggucuuua

SEQ ID NO: 681084 - RNA, 19 nt, Homo sapiens
gaccuuucuuccuuaagug

SEQ ID NO: 681085 - RNA, 19 nt, Homo sapiens
gcucaauggaaagcuguua

SEQ ID NO: 681086 - RNA, 19 nt, Homo sapiens
gcagccaaauaggcaguug

SEQ ID NO: 681087 - RNA, 19 nt, Homo sapiens
ugcauggccuggagcguuu

SEQ ID NO: 681088 - RNA, 19 nt, Homo sapiens
cuaaguucguuuauugagu

SEQ ID NO: 681089 - RNA, 19 nt, Homo sapiens
auuagaccuuucuuccuua

SEQ ID NO: 681090 - RNA, 19 nt, Homo sapiens
gauucauuccuccucauuu

SEQ ID NO: 681091 - RNA, 19 nt, Homo sapiens
ugacuggcauuuccuccau

SEQ ID NO: 681092 - RNA, 19 nt, Homo sapiens
cguccgcgcugugcuuuga

SEQ ID NO: 681093 - RNA, 19 nt, Homo sapiens
gaaauggagugguuuaaua

SEQ ID NO: 681094 - RNA, 19 nt, Homo sapiens
cuaauaagcuguaucugua

SEQ ID NO: 681095 - RNA, 19 nt, Homo sapiens
gaagguagauccugugugu

SEQ ID NO: 681096 - RNA, 19 nt, Homo sapiens
gaugaaagcuuuguaugaa

SEQ ID NO: 681097 - RNA, 19 nt, Homo sapiens
gagcugaauuucugagaua

SEQ ID NO: 681098 - RNA, 19 nt, Homo sapiens
ucacauggcugcugaagaa

SEQ ID NO: 681099 - RNA, 19 nt, Homo sapiens
gcacuucaguccuauuaaa

SEQ ID NO: 681100 - RNA, 19 nt, Homo sapiens
gaaacuccgucucuacaaa

SEQ ID NO: 681101 - RNA, 19 nt, Homo sapiens
gaaauccaguuuauucguu

SEQ ID NO: 681102 - RNA, 19 nt, Homo sapiens
gaugaagguuuggacauua

SEQ ID NO: 681103 - RNA, 19 nt, Homo sapiens
gaagaaauggagugguuua

SEQ ID NO: 681104 - RNA, 19 nt, Homo sapiens
gaucuuggcucacugcaau

SEQ ID NO: 681105 - RNA, 19 nt, Homo sapiens
caacgaggauggacucaga

SEQ ID NO: 681106 - RNA, 19 nt, Homo sapiens
gaaggacacacauggauuu

SEQ ID NO: 681107 - RNA, 19 nt, Homo sapiens
gggaggagaugaagguuug

SEQ ID NO: 681108 - RNA, 19 nt, Homo sapiens
guacaggucuaccauguca

SEQ ID NO: 681109 - RNA, 19 nt, Homo sapiens
caauguauauguggguuua

SEQ ID NO: 681110 - RNA, 19 nt, Homo sapiens
ggacugcccuuugcucuau

SEQ ID NO: 681111 - RNA, 19 nt, Homo sapiens
gaugaaauccaguuuauuc

SEQ ID NO: 681112 - RNA, 19 nt, Homo sapiens
gauccugugugucuuguuu

SEQ ID NO: 681113 - RNA, 19 nt, Homo sapiens
ucacuuggcuggacaggaa

SEQ ID NO: 681114 - RNA, 19 nt, Homo sapiens
ucaccucccucuuugauuu

SEQ ID NO: 681115 - RNA, 19 nt, Homo sapiens
caccuuagcuucucaaagu

SEQ ID NO: 681116 - RNA, 19 nt, Homo sapiens
ggaauaugguagcgucuug

SEQ ID NO: 681117 - RNA, 19 nt, Homo sapiens
gcacucagaugggaauaug

SEQ ID NO: 681118 - RNA, 19 nt, Homo sapiens
cuagagagcugaauuucug

SEQ ID NO: 681119 - RNA, 19 nt, Homo sapiens
ccaaguagcugggauuaca

SEQ ID NO: 681120 - RNA, 19 nt, Homo sapiens
ugggagaauugacaucuua

SEQ ID NO: 681121 - RNA, 19 nt, Homo sapiens
gcuuaugccuguaauccua

SEQ ID NO: 681122 - RNA, 19 nt, Homo sapiens
uggaggagaugaaagcuuu

SEQ ID NO: 681123 - RNA, 19 nt, Homo sapiens
ugauugagauugcauugaa

SEQ ID NO: 681124 - RNA, 19 nt, Homo sapiens
aagaauacuuggcuaagaa

SEQ ID NO: 681125 - RNA, 19 nt, Homo sapiens
uaagaauacuuggcuaaga

SEQ ID NO: 681126 - RNA, 19 nt, Homo sapiens
cuccugagcuaaagcaaua

SEQ ID NO: 681127 - RNA, 19 nt, Homo sapiens
gguagcgucuugccaaaug

SEQ ID NO: 681128 - RNA, 19 nt, Homo sapiens
aaagucacaugaagaguug

SEQ ID NO: 681129 - RNA, 19 nt, Homo sapiens
gaagcuauagacauuguuu

SEQ ID NO: 681130 - RNA, 19 nt, Homo sapiens
caauugauguugaacuugu

SEQ ID NO: 681131 - RNA, 19 nt, Homo sapiens
ucaccaguaucaccacuuu

SEQ ID NO: 681132 - RNA, 19 nt, Homo sapiens
aagcaguccucccaccuua

SEQ ID NO: 681133 - RNA, 19 nt, Homo sapiens
uaucaaauuucgacacugu

SEQ ID NO: 681134 - RNA, 19 nt, Homo sapiens
uggacgaagugauuugaua

SEQ ID NO: 681135 - RNA, 19 nt, Homo sapiens
aaaccagucugaugugaau

SEQ ID NO: 681136 - RNA, 19 nt, Homo sapiens
ggucuaccaugucagcauu

SEQ ID NO: 681137 - RNA, 19 nt, Homo sapiens
ugagucuucuggccuauaa

SEQ ID NO: 681138 - RNA, 19 nt, Homo sapiens
gcuaagaaguauaauuugc

SEQ ID NO: 681139 - RNA, 19 nt, Homo sapiens
ugucagcauuucauaguuu

SEQ ID NO: 681140 - RNA, 19 nt, Homo sapiens
ggagaugaaagcuuuguau

SEQ ID NO: 681141 - RNA, 19 nt, Homo sapiens
ggcagggugugguggcuua

SEQ ID NO: 681142 - RNA, 19 nt, Homo sapiens
ggaaggacacacauggauu

SEQ ID NO: 681143 - RNA, 19 nt, Homo sapiens
cgacacuguucucuguuaa

SEQ ID NO: 681144 - RNA, 19 nt, Homo sapiens
gaacaaaaccagucugaug

SEQ ID NO: 681145 - RNA, 19 nt, Homo sapiens
gugagcagcugaucagaca

SEQ ID NO: 681146 - RNA, 19 nt, Homo sapiens
gugcaugccuguagucaca

SEQ ID NO: 681147 - RNA, 19 nt, Homo sapiens
ggacuccucuguacucacu

SEQ ID NO: 681148 - RNA, 19 nt, Homo sapiens
aacaaggucugucuuccua

SEQ ID NO: 681149 - RNA, 19 nt, Homo sapiens
guguugaacuccugagcua

SEQ ID NO: 681150 - RNA, 19 nt, Homo sapiens
gcaacugccugccuucaac

SEQ ID NO: 681151 - RNA, 19 nt, Homo sapiens
ugaaagcuuuguaugaaca

SEQ ID NO: 681152 - RNA, 19 nt, Homo sapiens
gacaaguucuggaggagau

SEQ ID NO: 681153 - RNA, 19 nt, Homo sapiens
cugaagaaauggagugguu

SEQ ID NO: 681154 - RNA, 19 nt, Homo sapiens
ucgacacuguucucuguua

SEQ ID NO: 681155 - RNA, 19 nt, Homo sapiens
cuagauggguggaucacuu

SEQ ID NO: 681156 - RNA, 19 nt, Homo sapiens
gaugugaaauuugggaaca

SEQ ID NO: 681157 - RNA, 19 nt, Homo sapiens
gagauggagucuuguucug

SEQ ID NO: 681158 - RNA, 19 nt, Homo sapiens
aaucgacgcugcacuguag

SEQ ID NO: 681159 - RNA, 19 nt, Homo sapiens
cgaagugauuugauaccaa

SEQ ID NO: 681160 - RNA, 19 nt, Homo sapiens
gccagccuaugauccauuu

SEQ ID NO: 681161 - RNA, 19 nt, Homo sapiens
ugucucagccucccaagua

SEQ ID NO: 681162 - RNA, 19 nt, Homo sapiens
agaaggaacuuuguacagu

SEQ ID NO: 681163 - RNA, 19 nt, Homo sapiens
uuuaucaucuggcuauuug

SEQ ID NO: 681164 - RNA, 19 nt, Homo sapiens
augauggucuguagaaauu

SEQ ID NO: 681165 - RNA, 19 nt, Homo sapiens
ugaagaugauggucuguag

SEQ ID NO: 681166 - RNA, 19 nt, Homo sapiens
ugauggcacuucaguccua

SEQ ID NO: 681167 - RNA, 19 nt, Homo sapiens
ugcccaagcuggucucaaa

SEQ ID NO: 681168 - RNA, 19 nt, Homo sapiens
caaauucuaaccacuuguu

SEQ ID NO: 681169 - RNA, 19 nt, Homo sapiens
ggaagcguccgccauguuc

SEQ ID NO: 681170 - RNA, 19 nt, Homo sapiens
gaugauggucuguagaaau

SEQ ID NO: 681171 - RNA, 19 nt, Homo sapiens
uauguuaaguccuuugcuu

SEQ ID NO: 681172 - RNA, 19 nt, Homo sapiens
gagaugaaagcuuuguaug

SEQ ID NO: 681173 - RNA, 19 nt, Homo sapiens
cagccuugcuaaacuguga

SEQ ID NO: 681174 - RNA, 19 nt, Homo sapiens
aaagucagguggacgaagu

SEQ ID NO: 681175 - RNA, 19 nt, Homo sapiens
uagaagcuauagacauugu

SEQ ID NO: 681176 - RNA, 19 nt, Homo sapiens
agaugaagguuuggacauu

SEQ ID NO: 681177 - RNA, 19 nt, Homo sapiens
cauggcugcugaagaaaug

SEQ ID NO: 681178 - RNA, 19 nt, Homo sapiens
gcaccuugauugagauugc

SEQ ID NO: 681179 - RNA, 19 nt, Homo sapiens
gagcuaaagcaauacacuu

SEQ ID NO: 681180 - RNA, 19 nt, Homo sapiens
ggaaggaaggacacacaug

SEQ ID NO: 681181 - RNA, 19 nt, Homo sapiens
gugauuugauaccaacuau

SEQ ID NO: 681182 - RNA, 19 nt, Homo sapiens
acacuguucucuguuaaga

SEQ ID NO: 681183 - RNA, 19 nt, Homo sapiens
cuacaacaacaacaacaaa

SEQ ID NO: 681184 - RNA, 19 nt, Homo sapiens
gcugagaucacaccacugu

SEQ ID NO: 681185 - RNA, 19 nt, Homo sapiens
caguguaccacauuucuuu

SEQ ID NO: 681186 - RNA, 19 nt, Homo sapiens
caugaagaguugauugucu

SEQ ID NO: 681187 - RNA, 19 nt, Homo sapiens
gaagaugauggucuguaga

SEQ ID NO: 681188 - RNA, 19 nt, Homo sapiens
agaugaaagcuuuguauga

SEQ ID NO: 681189 - RNA, 19 nt, Homo sapiens
gauugagauugcauugaau

SEQ ID NO: 681190 - RNA, 19 nt, Homo sapiens
ugacaaagugagacucuau

SEQ ID NO: 681191 - RNA, 19 nt, Homo sapiens
cagccugggugacaaagug

SEQ ID NO: 681192 - RNA, 19 nt, Homo sapiens
uaagcuguaucuguaauca

SEQ ID NO: 681193 - RNA, 19 nt, Homo sapiens
gaacagacaggcuuacuua

SEQ ID NO: 681194 - RNA, 19 nt, Homo sapiens
caaauaaucuggacaacaa

SEQ ID NO: 681195 - RNA, 19 nt, Homo sapiens
gaagcuacguacuuuaaua

SEQ ID NO: 681196 - RNA, 19 nt, Homo sapiens
cgaaagagaucaguucuaa

SEQ ID NO: 681197 - RNA, 19 nt, Homo sapiens
gcaaggccuucaaauauaa

SEQ ID NO: 681198 - RNA, 19 nt, Homo sapiens
gaagauggcauguaauaaa

SEQ ID NO: 681199 - RNA, 19 nt, Homo sapiens
ggacacagguucugaaaca

SEQ ID NO: 681200 - RNA, 19 nt, Homo sapiens
gcacuacaaugcaucagua

SEQ ID NO: 681201 - RNA, 19 nt, Homo sapiens
ccacaugucuguacucaaa

SEQ ID NO: 681202 - RNA, 19 nt, Homo sapiens
gaacauuaauugugagaug

SEQ ID NO: 681203 - RNA, 19 nt, Homo sapiens
caacauauccacuccauuu

SEQ ID NO: 681204 - RNA, 19 nt, Homo sapiens
ggagacagaucaguaauau

SEQ ID NO: 681205 - RNA, 19 nt, Homo sapiens
ggcaaggccuucaaauaua

SEQ ID NO: 681206 - RNA, 19 nt, Homo sapiens
ggaagaggaagaugaaaua

SEQ ID NO: 681207 - RNA, 19 nt, Homo sapiens
gcucagggcgcuucaauua

SEQ ID NO: 681208 - RNA, 19 nt, Homo sapiens
ccacaucagugucagauuu

SEQ ID NO: 681209 - RNA, 19 nt, Homo sapiens
gcacaugaaucacagguau

SEQ ID NO: 681210 - RNA, 19 nt, Homo sapiens
gaaacaaguuggagaaugg

SEQ ID NO: 681211 - RNA, 19 nt, Homo sapiens
gauccgcucuuaucaauga

SEQ ID NO: 681212 - RNA, 19 nt, Homo sapiens
gaauugcacucuacuuaug

SEQ ID NO: 681213 - RNA, 19 nt, Homo sapiens
gcacuaccauacaucagua

SEQ ID NO: 681214 - RNA, 19 nt, Homo sapiens
aaagagggacuguuaaaua

SEQ ID NO: 681215 - RNA, 19 nt, Homo sapiens
guaaauggccgaaugagaa

SEQ ID NO: 681216 - RNA, 19 nt, Homo sapiens
gaagagcauuuauuguguu

SEQ ID NO: 681217 - RNA, 19 nt, Homo sapiens
cuacaaugcaucaguauua

SEQ ID NO: 681218 - RNA, 19 nt, Homo sapiens
gcacucuacuuauguauca

SEQ ID NO: 681219 - RNA, 19 nt, Homo sapiens
gagacuaauuccuguguuu

SEQ ID NO: 681220 - RNA, 19 nt, Homo sapiens
ugaaggagcacaucaagua

SEQ ID NO: 681221 - RNA, 19 nt, Homo sapiens
cagaagaaaugaaggaaga

SEQ ID NO: 681222 - RNA, 19 nt, Homo sapiens
gagaagagcauuuauugug

SEQ ID NO: 681223 - RNA, 19 nt, Homo sapiens
uauggaagauggcauguaa

SEQ ID NO: 681224 - RNA, 19 nt, Homo sapiens
ccaccgagcugcugaugaa

SEQ ID NO: 681225 - RNA, 19 nt, Homo sapiens
ccaaacagcuucucuucug

SEQ ID NO: 681226 - RNA, 19 nt, Homo sapiens
cugcaaggcugaagaaauu

SEQ ID NO: 681227 - RNA, 19 nt, Homo sapiens
gagaagcuacguacuuuaa

SEQ ID NO: 681228 - RNA, 19 nt, Homo sapiens
ggugaacuaugacaaugua

SEQ ID NO: 681229 - RNA, 19 nt, Homo sapiens
uaauaaagcccuccucuug

SEQ ID NO: 681230 - RNA, 19 nt, Homo sapiens
ggacagaucagcaccaaau

SEQ ID NO: 681231 - RNA, 19 nt, Homo sapiens
guugaaagguuaucacaug

SEQ ID NO: 681232 - RNA, 19 nt, Homo sapiens
ggaagacuaugacacuaug

SEQ ID NO: 681233 - RNA, 19 nt, Homo sapiens
gcacuagucccuuuaugaa

SEQ ID NO: 681234 - RNA, 19 nt, Homo sapiens
uaauagauuuggucacuga

SEQ ID NO: 681235 - RNA, 19 nt, Homo sapiens
gaaagaacaccugcgaauu

SEQ ID NO: 681236 - RNA, 19 nt, Homo sapiens
guacuuuccuuucgcuauu

SEQ ID NO: 681237 - RNA, 19 nt, Homo sapiens
gauacgagaugaagaagag

SEQ ID NO: 681238 - RNA, 19 nt, Homo sapiens
gaaagguuaucacaugaag

SEQ ID NO: 681239 - RNA, 19 nt, Homo sapiens
gauggcauguaauaaacua

SEQ ID NO: 681240 - RNA, 19 nt, Homo sapiens
gcaugaacguuaccuuugu

SEQ ID NO: 681241 - RNA, 19 nt, Homo sapiens
ggagcuggguauuguuaaa

SEQ ID NO: 681242 - RNA, 19 nt, Homo sapiens
gagcuugacuacugacuca

SEQ ID NO: 681243 - RNA, 19 nt, Homo sapiens
gcaagaaauguauugguuu

SEQ ID NO: 681244 - RNA, 19 nt, Homo sapiens
uaauacuccuucucccuua

SEQ ID NO: 681245 - RNA, 19 nt, Homo sapiens
gaaggaaugguuugaacaa

SEQ ID NO: 681246 - RNA, 19 nt, Homo sapiens
gagggacuguuaaauacaa

SEQ ID NO: 681247 - RNA, 19 nt, Homo sapiens
gcaugugacuuaugugaca

SEQ ID NO: 681248 - RNA, 19 nt, Homo sapiens
uaacaaaaccuucccauuu

SEQ ID NO: 681249 - RNA, 19 nt, Homo sapiens
ggaaugguuugaacaacga

SEQ ID NO: 681250 - RNA, 19 nt, Homo sapiens
uaagaugaaugaagagauc

SEQ ID NO: 681251 - RNA, 19 nt, Homo sapiens
aaagugaccuggacgugaa

SEQ ID NO: 681252 - RNA, 19 nt, Homo sapiens
guaagaaagcguuuaaaca

SEQ ID NO: 681253 - RNA, 19 nt, Homo sapiens
ccucugaacuugacuuuua

SEQ ID NO: 681254 - RNA, 19 nt, Homo sapiens
aagagaagcuacguacuuu

SEQ ID NO: 681255 - RNA, 19 nt, Homo sapiens
ugacuuaugugacaagaca

SEQ ID NO: 681256 - RNA, 19 nt, Homo sapiens
gcacaucagcagcaagaaa

SEQ ID NO: 681257 - RNA, 19 nt, Homo sapiens
gaagaggaagaugaaauaa

SEQ ID NO: 681258 - RNA, 19 nt, Homo sapiens
aaaugaccaugcucgaaua

SEQ ID NO: 681259 - RNA, 19 nt, Homo sapiens
ggcagcaguuccuuaguuu

SEQ ID NO: 681260 - RNA, 19 nt, Homo sapiens
gaaaguaccagcggaaaca

SEQ ID NO: 681261 - RNA, 19 nt, Homo sapiens
caaacagcuucucuucuga

SEQ ID NO: 681262 - RNA, 19 nt, Homo sapiens
cauaacaucaccaucuaua

SEQ ID NO: 681263 - RNA, 19 nt, Homo sapiens
caaggagacagaucaguaa

SEQ ID NO: 681264 - RNA, 19 nt, Homo sapiens
gaagaaugaagagaacuuu

SEQ ID NO: 681265 - RNA, 19 nt, Homo sapiens
ugcaccagcuucaguguua

SEQ ID NO: 681266 - RNA, 19 nt, Homo sapiens
caaaucagaccacgaggaa

SEQ ID NO: 681267 - RNA, 19 nt, Homo sapiens
gaagaggaagaaagugaaa

SEQ ID NO: 681268 - RNA, 19 nt, Homo sapiens
gaaggaagacuaugacacu

SEQ ID NO: 681269 - RNA, 19 nt, Homo sapiens
aagaauugcacucuacuua

SEQ ID NO: 681270 - RNA, 19 nt, Homo sapiens
agaaagcguuuaaacacaa

SEQ ID NO: 681271 - RNA, 19 nt, Homo sapiens
gacagagaguggcauguau

SEQ ID NO: 681272 - RNA, 19 nt, Homo sapiens
gaacccauuuagugccaaa

SEQ ID NO: 681273 - RNA, 19 nt, Homo sapiens
cuaauucuguuucuucuuc

SEQ ID NO: 681274 - RNA, 19 nt, Homo sapiens
caugcgaacugccaucuga

SEQ ID NO: 681275 - RNA, 19 nt, Homo sapiens
gaugagaaauaaagaaagc

SEQ ID NO: 681276 - RNA, 19 nt, Homo sapiens
ugacaagacauuccagaaa

SEQ ID NO: 681277 - RNA, 19 nt, Homo sapiens
ucagggcgcuucaauuauc

SEQ ID NO: 681278 - RNA, 19 nt, Homo sapiens
ucaaggagacagaucagua

SEQ ID NO: 681279 - RNA, 19 nt, Homo sapiens
guauuaugauuccucugua

SEQ ID NO: 681280 - RNA, 19 nt, Homo sapiens
caaugcaucaguauuauga

SEQ ID NO: 681281 - RNA, 19 nt, Homo sapiens
agaaggagcacgagaaaga

SEQ ID NO: 681282 - RNA, 19 nt, Homo sapiens
gacaagacauuccagaaaa

SEQ ID NO: 681283 - RNA, 19 nt, Homo sapiens
caugaacguuaccuuugua

SEQ ID NO: 681284 - RNA, 19 nt, Homo sapiens
caccagcccuuuaggaguu

SEQ ID NO: 681285 - RNA, 19 nt, Homo sapiens
aaagaacaccugcgaauuc

SEQ ID NO: 681286 - RNA, 19 nt, Homo sapiens
uggcaaggccuucaaauau

SEQ ID NO: 681287 - RNA, 19 nt, Homo sapiens
gcacaacaacgagauucua

SEQ ID NO: 681288 - RNA, 19 nt, Homo sapiens
aaacaagacuucgcagauc

SEQ ID NO: 681289 - RNA, 19 nt, Homo sapiens
ggaagauggcauguaauaa

SEQ ID NO: 681290 - RNA, 19 nt, Homo sapiens
uggaagauggcauguaaua

SEQ ID NO: 681291 - RNA, 19 nt, Homo sapiens
ggaggaagaggaagaaagu

SEQ ID NO: 681292 - RNA, 19 nt, Homo sapiens
aaacacaagcaccaccuua

SEQ ID NO: 681293 - RNA, 19 nt, Homo sapiens
uguaagaacucacucauua

SEQ ID NO: 681294 - RNA, 19 nt, Homo sapiens
ggaagaggcuggaagaaga

SEQ ID NO: 681295 - RNA, 19 nt, Homo sapiens
caaagacacuucucggaua

SEQ ID NO: 681296 - RNA, 19 nt, Homo sapiens
gcaagaagaugcagaagau

SEQ ID NO: 681297 - RNA, 19 nt, Homo sapiens
gaaaggaacucucaaaaga

SEQ ID NO: 681298 - RNA, 19 nt, Homo sapiens
gcacgcauuuccagaagua

SEQ ID NO: 681299 - RNA, 19 nt, Homo sapiens
ccacaacacuggaguccua

SEQ ID NO: 681300 - RNA, 19 nt, Homo sapiens
gaacaaagccuuaauuuuc

SEQ ID NO: 681301 - RNA, 19 nt, Homo sapiens
guauuccucucauaucuua

SEQ ID NO: 681302 - RNA, 19 nt, Homo sapiens
gaacugcgucggucuuuaa

SEQ ID NO: 681303 - RNA, 19 nt, Homo sapiens
agaauaaacuuguggaaug

SEQ ID NO: 681304 - RNA, 19 nt, Homo sapiens
ggagagagcuguguagucu

SEQ ID NO: 681305 - RNA, 19 nt, Homo sapiens
gaggaggucugauuucguu

SEQ ID NO: 681306 - RNA, 19 nt, Homo sapiens
gaaagauauuccugaguug

SEQ ID NO: 681307 - RNA, 19 nt, Homo sapiens
gaucuuggcuguaguuugg

SEQ ID NO: 681308 - RNA, 19 nt, Homo sapiens
agaaagauauuccugaguu

SEQ ID NO: 681309 - RNA, 19 nt, Homo sapiens
uaaaugaccagaucuugua

SEQ ID NO: 681310 - RNA, 19 nt, Homo sapiens
guucaucccuguauuccua

SEQ ID NO: 681311 - RNA, 19 nt, Homo sapiens
agaaagaacuacagcaaau

SEQ ID NO: 681312 - RNA, 19 nt, Homo sapiens
gcacaaacugagucugaua

SEQ ID NO: 681313 - RNA, 19 nt, Homo sapiens
aaacagggcuugagcacau

SEQ ID NO: 681314 - RNA, 19 nt, Homo sapiens
gaagcagaguguagacaga

SEQ ID NO: 681315 - RNA, 19 nt, Homo sapiens
ccugugaccugcauguaua

SEQ ID NO: 681316 - RNA, 19 nt, Homo sapiens
gaacuaucuuccuugaugu

SEQ ID NO: 681317 - RNA, 19 nt, Homo sapiens
ggacaaagugcaagaagau

SEQ ID NO: 681318 - RNA, 19 nt, Homo sapiens
caagagaacagaaauaucu

SEQ ID NO: 681319 - RNA, 19 nt, Homo sapiens
cacaugcagugcucucuua

SEQ ID NO: 681320 - RNA, 19 nt, Homo sapiens
ggaccagcuuugaagauga

SEQ ID NO: 681321 - RNA, 19 nt, Homo sapiens
gaaagaacuacagcaaauu

SEQ ID NO: 681322 - RNA, 19 nt, Homo sapiens
aaacugagucugauacgua

SEQ ID NO: 681323 - RNA, 19 nt, Homo sapiens
gagagggacuugagggaau

SEQ ID NO: 681324 - RNA, 19 nt, Homo sapiens
gaauaaacuuguggaaugg

SEQ ID NO: 681325 - RNA, 19 nt, Homo sapiens
guaguuugcuuuggaaguu

SEQ ID NO: 681326 - RNA, 19 nt, Homo sapiens
ucaagcaucucagaaauuc

SEQ ID NO: 681327 - RNA, 19 nt, Homo sapiens
ugaagcaaguggagaauca

SEQ ID NO: 681328 - RNA, 19 nt, Homo sapiens
ccuaauaaauugugagaca

SEQ ID NO: 681329 - RNA, 19 nt, Homo sapiens
acagugaucuagugucuga

SEQ ID NO: 681330 - RNA, 19 nt, Homo sapiens
ugaggaagcaggacaguuu

SEQ ID NO: 681331 - RNA, 19 nt, Homo sapiens
cagaugacauuacuuugug

SEQ ID NO: 681332 - RNA, 19 nt, Homo sapiens
caugguacaucucacacua

SEQ ID NO: 681333 - RNA, 19 nt, Homo sapiens
gcacagacccagcucagau

SEQ ID NO: 681334 - RNA, 19 nt, Homo sapiens
gaagugauggacaaaguga

SEQ ID NO: 681335 - RNA, 19 nt, Homo sapiens
gaacuguauuaguccauuc

SEQ ID NO: 681336 - RNA, 19 nt, Homo sapiens
aaccaucuguguuuacuaa

SEQ ID NO: 681337 - RNA, 19 nt, Homo sapiens
uaacagcuguaguuugcuu

SEQ ID NO: 681338 - RNA, 19 nt, Homo sapiens
gcacugcccucaacaucca

SEQ ID NO: 681339 - RNA, 19 nt, Homo sapiens
gcagggaggaggucugauu

SEQ ID NO: 681340 - RNA, 19 nt, Homo sapiens
gcaaguggagaaucacaaa

SEQ ID NO: 681341 - RNA, 19 nt, Homo sapiens
ggauuacaguuugacauga

SEQ ID NO: 681342 - RNA, 19 nt, Homo sapiens
agauggugcuaaacgauua

SEQ ID NO: 681343 - RNA, 19 nt, Homo sapiens
gaaaguuaaggcuaucuug

SEQ ID NO: 681344 - RNA, 19 nt, Homo sapiens
caacacuggaguccuauuu

SEQ ID NO: 681345 - RNA, 19 nt, Homo sapiens
caagcugcaugcacaaaga

SEQ ID NO: 681346 - RNA, 19 nt, Homo sapiens
caaguuguguuggaaguga

SEQ ID NO: 681347 - RNA, 19 nt, Homo sapiens
gagacuggguaauuuauac

SEQ ID NO: 681348 - RNA, 19 nt, Homo sapiens
uaaguaggauucagagucu

SEQ ID NO: 681349 - RNA, 19 nt, Homo sapiens
ggaaggacaccucacuuuc

SEQ ID NO: 681350 - RNA, 19 nt, Homo sapiens
gcagagagagagaagaaau

SEQ ID NO: 681351 - RNA, 19 nt, Homo sapiens
gaaagagcagagcaagaaa

SEQ ID NO: 681352 - RNA, 19 nt, Homo sapiens
guucaagcaucucagaaau

SEQ ID NO: 681353 - RNA, 19 nt, Homo sapiens
caggacaguuuaucuacaa

SEQ ID NO: 681354 - RNA, 19 nt, Homo sapiens
uagggaauccaaucaauaa

SEQ ID NO: 681355 - RNA, 19 nt, Homo sapiens
ucacaagagaacagaaaua

SEQ ID NO: 681356 - RNA, 19 nt, Homo sapiens
ugagggaaaucauaaccaa

SEQ ID NO: 681357 - RNA, 19 nt, Homo sapiens
gauaguaaacugaacaaag

SEQ ID NO: 681358 - RNA, 19 nt, Homo sapiens
gcaggacaguuuaucuaca

SEQ ID NO: 681359 - RNA, 19 nt, Homo sapiens
gaggaagcaggacaguuua

SEQ ID NO: 681360 - RNA, 19 nt, Homo sapiens
ucagggagcuuuaacucau

SEQ ID NO: 681361 - RNA, 19 nt, Homo sapiens
gaggcuggaagaagauuua

SEQ ID NO: 681362 - RNA, 19 nt, Homo sapiens
gagauaaguaggauucaga

SEQ ID NO: 681363 - RNA, 19 nt, Homo sapiens
gaaggacaccucacuuucu

SEQ ID NO: 681364 - RNA, 19 nt, Homo sapiens
gaaagaagagaagcaguuc

SEQ ID NO: 681365 - RNA, 19 nt, Homo sapiens
gcagugggccugacaucuu

SEQ ID NO: 681366 - RNA, 19 nt, Homo sapiens
cggauacucugaagaagga

SEQ ID NO: 681367 - RNA, 19 nt, Homo sapiens
cuaccuaccuaaauccuau

SEQ ID NO: 681368 - RNA, 19 nt, Homo sapiens
gaagucaggaagaaaccua

SEQ ID NO: 681369 - RNA, 19 nt, Homo sapiens
caucuguguuuacuaauuc

SEQ ID NO: 681370 - RNA, 19 nt, Homo sapiens
ccaucuguguuuacuaauu

SEQ ID NO: 681371 - RNA, 19 nt, Homo sapiens
guagugaggcagagacaaa

SEQ ID NO: 681372 - RNA, 19 nt, Homo sapiens
gagcaucuuggacacauuu

SEQ ID NO: 681373 - RNA, 19 nt, Homo sapiens
agaaagagcagagcaagaa

SEQ ID NO: 681374 - RNA, 19 nt, Homo sapiens
gccaagaggaucacaaaga

SEQ ID NO: 681375 - RNA, 19 nt, Homo sapiens
ugaaaacucuacccaguaa

SEQ ID NO: 681376 - RNA, 19 nt, Homo sapiens
gggagaaggcacaaacuga

SEQ ID NO: 681377 - RNA, 19 nt, Homo sapiens
cccaaacucuggauucgaa

SEQ ID NO: 681378 - RNA, 19 nt, Homo sapiens
ccaagaggaucacaaagac

SEQ ID NO: 681379 - RNA, 19 nt, Homo sapiens
uaauagaaugggagaagua

SEQ ID NO: 681380 - RNA, 19 nt, Homo sapiens
cagagagagagaagaaaua

SEQ ID NO: 681381 - RNA, 19 nt, Homo sapiens
cacauucucugcccauaga

SEQ ID NO: 681382 - RNA, 19 nt, Homo sapiens
aagacuggcugcaggauug

SEQ ID NO: 681383 - RNA, 19 nt, Homo sapiens
ggugcuaaacgauuaauga

SEQ ID NO: 681384 - RNA, 19 nt, Homo sapiens
ugagggaauuugagggaaa

SEQ ID NO: 681385 - RNA, 19 nt, Homo sapiens
gggaccagcuuugaagaug

SEQ ID NO: 681386 - RNA, 19 nt, Homo sapiens
gagauggugcuaaacgauu

SEQ ID NO: 681387 - RNA, 19 nt, Homo sapiens
gcaggaggaacaaaggaaa

SEQ ID NO: 681388 - RNA, 19 nt, Homo sapiens
ccagaaguauauuauuugg

SEQ ID NO: 681389 - RNA, 19 nt, Homo sapiens
uaaacugaacaaagccuua

SEQ ID NO: 681390 - RNA, 19 nt, Homo sapiens
cccaaacucugcaggagaa

SEQ ID NO: 681391 - RNA, 19 nt, Homo sapiens
gaaauggaagcagagugua

SEQ ID NO: 681392 - RNA, 19 nt, Homo sapiens
ugaaagaagagaagcaguu

SEQ ID NO: 681393 - RNA, 19 nt, Homo sapiens
gagcagagcugaccuguaa

SEQ ID NO: 681394 - RNA, 19 nt, Homo sapiens
caacauaggucacuuuaaa

SEQ ID NO: 681395 - RNA, 19 nt, Homo sapiens
gaaauacaguuaagaguga

SEQ ID NO: 681396 - RNA, 19 nt, Homo sapiens
gauggaagcuuauaauuca

SEQ ID NO: 681397 - RNA, 19 nt, Homo sapiens
gcuaguggcugcuauauug

SEQ ID NO: 681398 - RNA, 19 nt, Homo sapiens
gaaggugaaucuuugguuu

SEQ ID NO: 681399 - RNA, 19 nt, Homo sapiens
gaaaguacuucucaugugu

SEQ ID NO: 681400 - RNA, 19 nt, Homo sapiens
ggagauccgucaaacuuaa

SEQ ID NO: 681401 - RNA, 19 nt, Homo sapiens
gaauuuaucuacacagguu

SEQ ID NO: 681402 - RNA, 19 nt, Homo sapiens
gcaugugucuguaauugua

SEQ ID NO: 681403 - RNA, 19 nt, Homo sapiens
cagagcaacugcagaauuu

SEQ ID NO: 681404 - RNA, 19 nt, Homo sapiens
gaacugggcagaaugguuu

SEQ ID NO: 681405 - RNA, 19 nt, Homo sapiens
gagcugagaucacgccauu

SEQ ID NO: 681406 - RNA, 19 nt, Homo sapiens
gcaaaucuuucacagcaaa

SEQ ID NO: 681407 - RNA, 19 nt, Homo sapiens
ggagcgaccuuucaaaugu

SEQ ID NO: 681408 - RNA, 19 nt, Homo sapiens
ucagaaagauucaaacuca

SEQ ID NO: 681409 - RNA, 19 nt, Homo sapiens
ggaaaugauagcuuuguua

SEQ ID NO: 681410 - RNA, 19 nt, Homo sapiens
gaaauucagcuucucguaa

SEQ ID NO: 681411 - RNA, 19 nt, Homo sapiens
ugauugggcucuucuuaua

SEQ ID NO: 681412 - RNA, 19 nt, Homo sapiens
ucacuauucuggaacauaa

SEQ ID NO: 681413 - RNA, 19 nt, Homo sapiens
guaaagcuuucuucacuau

SEQ ID NO: 681414 - RNA, 19 nt, Homo sapiens
gaagaggucaggaauauuc

SEQ ID NO: 681415 - RNA, 19 nt, Homo sapiens
cagaagaggucaggaauau

SEQ ID NO: 681416 - RNA, 19 nt, Homo sapiens
auacuaagcuuucgaaauc

SEQ ID NO: 681417 - RNA, 19 nt, Homo sapiens
gcaaggcucugaccaccaa

SEQ ID NO: 681418 - RNA, 19 nt, Homo sapiens
acaaggaaaugauagcuuu

SEQ ID NO: 681419 - RNA, 19 nt, Homo sapiens
gaacaacauaggucacuuu

SEQ ID NO: 681420 - RNA, 19 nt, Homo sapiens
gugaauaucuucuccuaau

SEQ ID NO: 681421 - RNA, 19 nt, Homo sapiens
caaaguaacccucaacguu

SEQ ID NO: 681422 - RNA, 19 nt, Homo sapiens
ggaaaucggccaauccauu

SEQ ID NO: 681423 - RNA, 19 nt, Homo sapiens
gagaaacaaggaaaugaua

SEQ ID NO: 681424 - RNA, 19 nt, Homo sapiens
gaacaaauccuggcuacug

SEQ ID NO: 681425 - RNA, 19 nt, Homo sapiens
gaaaacagauucucauauc

SEQ ID NO: 681426 - RNA, 19 nt, Homo sapiens
aagcaacccucccaccuua

SEQ ID NO: 681427 - RNA, 19 nt, Homo sapiens
uaugacagaucacaaugua

SEQ ID NO: 681428 - RNA, 19 nt, Homo sapiens
gagcaucaguccuagcuau

SEQ ID NO: 681429 - RNA, 19 nt, Homo sapiens
aaacagaggagcuccauuu

SEQ ID NO: 681430 - RNA, 19 nt, Homo sapiens
uauaaaugcuuaccuagga

SEQ ID NO: 681431 - RNA, 19 nt, Homo sapiens
acaguugguucuuguguua

SEQ ID NO: 681432 - RNA, 19 nt, Homo sapiens
cagcuaaucuucaucuaau

SEQ ID NO: 681433 - RNA, 19 nt, Homo sapiens
gagaagccauuuacuugug

SEQ ID NO: 681434 - RNA, 19 nt, Homo sapiens
gagcgaccuuucaaaugua

SEQ ID NO: 681435 - RNA, 19 nt, Homo sapiens
ccgucaaacuuaaagauua

SEQ ID NO: 681436 - RNA, 19 nt, Homo sapiens
gaauacuucucaaugaugu

SEQ ID NO: 681437 - RNA, 19 nt, Homo sapiens
ucacaaaacuuccaaaaug

SEQ ID NO: 681438 - RNA, 19 nt, Homo sapiens
uaauagagccuuuccauca

SEQ ID NO: 681439 - RNA, 19 nt, Homo sapiens
guggcaaggucuuuaagua

SEQ ID NO: 681440 - RNA, 19 nt, Homo sapiens
aaacucaccucuacucugu

SEQ ID NO: 681441 - RNA, 19 nt, Homo sapiens
uaaucuagccucuuucuuu

SEQ ID NO: 681442 - RNA, 19 nt, Homo sapiens
gguaaagcuuucuucacua

SEQ ID NO: 681443 - RNA, 19 nt, Homo sapiens
ggaauuugcccuuuuaaua

SEQ ID NO: 681444 - RNA, 19 nt, Homo sapiens
gaaggugggcacuaguaua

SEQ ID NO: 681445 - RNA, 19 nt, Homo sapiens
caccuuagccucccuagua

SEQ ID NO: 681446 - RNA, 19 nt, Homo sapiens
ggaauauucuucagcuaca

SEQ ID NO: 681447 - RNA, 19 nt, Homo sapiens
gaccagcugucaaagagaa

SEQ ID NO: 681448 - RNA, 19 nt, Homo sapiens
cuggauagcuaggugauua

SEQ ID NO: 681449 - RNA, 19 nt, Homo sapiens
cauaaagacucggguaguu

SEQ ID NO: 681450 - RNA, 19 nt, Homo sapiens
uaacugaucuccugaaaau

SEQ ID NO: 681451 - RNA, 19 nt, Homo sapiens
gagcaacugcagaauuuaa

SEQ ID NO: 681452 - RNA, 19 nt, Homo sapiens
gaagaaauacaguuaagag

SEQ ID NO: 681453 - RNA, 19 nt, Homo sapiens
aaaguaacccucaacguuu

SEQ ID NO: 681454 - RNA, 19 nt, Homo sapiens
caagacaagucagggcuaa

SEQ ID NO: 681455 - RNA, 19 nt, Homo sapiens
gcuaggugauuauucagaa

SEQ ID NO: 681456 - RNA, 19 nt, Homo sapiens
ugagagcugugauggcuaa

SEQ ID NO: 681457 - RNA, 19 nt, Homo sapiens
cuugaaggcucacuugaaa

SEQ ID NO: 681458 - RNA, 19 nt, Homo sapiens
ugaaaucuguggcaaaucu

SEQ ID NO: 681459 - RNA, 19 nt, Homo sapiens
cagucuaccucuacacuaa

SEQ ID NO: 681460 - RNA, 19 nt, Homo sapiens
uauuucagguucucguuua

SEQ ID NO: 681461 - RNA, 19 nt, Homo sapiens
cagcaugugucuguaauug

SEQ ID NO: 681462 - RNA, 19 nt, Homo sapiens
aaucugcaaugucucauaa

SEQ ID NO: 681463 - RNA, 19 nt, Homo sapiens
cuaagguacugauuuguau

SEQ ID NO: 681464 - RNA, 19 nt, Homo sapiens
ucauacaggccacucauua

SEQ ID NO: 681465 - RNA, 19 nt, Homo sapiens
gcaaggucuuuaaguacaa

SEQ ID NO: 681466 - RNA, 19 nt, Homo sapiens
gagaaaugauguugcuagu

SEQ ID NO: 681467 - RNA, 19 nt, Homo sapiens
ugaaaguacuucucaugug

SEQ ID NO: 681468 - RNA, 19 nt, Homo sapiens
cagauucucauaucaagua

SEQ ID NO: 681469 - RNA, 19 nt, Homo sapiens
gagauggaagcuuauaauu

SEQ ID NO: 681470 - RNA, 19 nt, Homo sapiens
ggagcaaacagaacacauu

SEQ ID NO: 681471 - RNA, 19 nt, Homo sapiens
cagaauccaucgaggagaa

SEQ ID NO: 681472 - RNA, 19 nt, Homo sapiens
uaaaugaugcugaggaaug

SEQ ID NO: 681473 - RNA, 19 nt, Homo sapiens
gcaguacagugggcuuauu

SEQ ID NO: 681474 - RNA, 19 nt, Homo sapiens
guguguaugucuugucuaa

SEQ ID NO: 681475 - RNA, 19 nt, Homo sapiens
ggaaauucagcuucucgua

SEQ ID NO: 681476 - RNA, 19 nt, Homo sapiens
aaagagccauuaccgaguu

SEQ ID NO: 681477 - RNA, 19 nt, Homo sapiens
uaaaggagacaguggugua

SEQ ID NO: 681478 - RNA, 19 nt, Homo sapiens
ggaaauagaauguuaugcu

SEQ ID NO: 681479 - RNA, 19 nt, Homo sapiens
ggagauggaagcuuauaau

SEQ ID NO: 681480 - RNA, 19 nt, Homo sapiens
auucagagccucaauauga

SEQ ID NO: 681481 - RNA, 19 nt, Homo sapiens
gugagaagccauuuacuug

SEQ ID NO: 681482 - RNA, 19 nt, Homo sapiens
uuaccuaggauucucauua

SEQ ID NO: 681483 - RNA, 19 nt, Homo sapiens
uguuaagcccuaaguauua

SEQ ID NO: 681484 - RNA, 19 nt, Homo sapiens
gagguuagaguaauagaga

SEQ ID NO: 681485 - RNA, 19 nt, Homo sapiens
caagauagccaaaagcaua

SEQ ID NO: 681486 - RNA, 19 nt, Homo sapiens
ugucuaagguacugauuug

SEQ ID NO: 681487 - RNA, 19 nt, Homo sapiens
uaaccgauucuguacauaa

SEQ ID NO: 681488 - RNA, 19 nt, Homo sapiens
aaucggagccuacuuguga

SEQ ID NO: 681489 - RNA, 19 nt, Homo sapiens
cagcaugggccaccuguuu

SEQ ID NO: 681490 - RNA, 19 nt, Homo sapiens
acagugggcuuauuguguu

SEQ ID NO: 681491 - RNA, 19 nt, Homo sapiens
agaacuggcugcagaggaa

SEQ ID NO: 681492 - RNA, 19 nt, Homo sapiens
acacagacuuccaaaauaa

SEQ ID NO: 681493 - RNA, 19 nt, Homo sapiens
caagugagcuguuaagaua

SEQ ID NO: 681494 - RNA, 19 nt, Homo sapiens
gcaagaaucuacuauauca

SEQ ID NO: 681495 - RNA, 19 nt, Homo sapiens
caaagaagaugagacauuu

SEQ ID NO: 681496 - RNA, 19 nt, Homo sapiens
ugaaaggaauguugaguua

SEQ ID NO: 681497 - RNA, 19 nt, Homo sapiens
gaagguaggcugaguauug

SEQ ID NO: 681498 - RNA, 19 nt, Homo sapiens
ccugguaccugguuaauua

SEQ ID NO: 681499 - RNA, 19 nt, Homo sapiens
cagcaaacccuauccauua

SEQ ID NO: 681500 - RNA, 19 nt, Homo sapiens
uuaauuagcugccaaguga

SEQ ID NO: 681501 - RNA, 19 nt, Homo sapiens
ggacaguuaugguuacauu

SEQ ID NO: 681502 - RNA, 19 nt, Homo sapiens
gaucuaccauucucaugua

SEQ ID NO: 681503 - RNA, 19 nt, Homo sapiens
gaugagacauuccaagaga

SEQ ID NO: 681504 - RNA, 19 nt, Homo sapiens
ugacauggaucgggaauuu

SEQ ID NO: 681505 - RNA, 19 nt, Homo sapiens
ggacuuaauuuaggagaaa

SEQ ID NO: 681506 - RNA, 19 nt, Homo sapiens
gaagaacacuugggaaucu

SEQ ID NO: 681507 - RNA, 19 nt, Homo sapiens
gcaauaggaugcaugcaau

SEQ ID NO: 681508 - RNA, 19 nt, Homo sapiens
acaagaagaccaucuauaa

SEQ ID NO: 681509 - RNA, 19 nt, Homo sapiens
ggaauacacugaugguaca

SEQ ID NO: 681510 - RNA, 19 nt, Homo sapiens
uaaccaagauacugacuga

SEQ ID NO: 681511 - RNA, 19 nt, Homo sapiens
gaagaugcauuuggaggaa

SEQ ID NO: 681512 - RNA, 19 nt, Homo sapiens
ugaguuaccucuucauguu

SEQ ID NO: 681513 - RNA, 19 nt, Homo sapiens
gcagugaacuacuuugaag

SEQ ID NO: 681514 - RNA, 19 nt, Homo sapiens
uauccuacaucgcaaauuu

SEQ ID NO: 681515 - RNA, 19 nt, Homo sapiens
guauuaaccuacaggauga

SEQ ID NO: 681516 - RNA, 19 nt, Homo sapiens
gagaaggacucugaagguu

SEQ ID NO: 681517 - RNA, 19 nt, Homo sapiens
gagacccucuucacuguuu

SEQ ID NO: 681518 - RNA, 19 nt, Homo sapiens
gaaacucuaugccaaccuu

SEQ ID NO: 681519 - RNA, 19 nt, Homo sapiens
ggacaaagaagaugagaca

SEQ ID NO: 681520 - RNA, 19 nt, Homo sapiens
gaaggagcaaucaagcuua

SEQ ID NO: 681521 - RNA, 19 nt, Homo sapiens
gagaacgaguggccuggua

SEQ ID NO: 681522 - RNA, 19 nt, Homo sapiens
guacagcaaugccaaucaa

SEQ ID NO: 681523 - RNA, 19 nt, Homo sapiens
gaagagcuccagccgaauu

SEQ ID NO: 681524 - RNA, 19 nt, Homo sapiens
cauaaagaauguugagaug

SEQ ID NO: 681525 - RNA, 19 nt, Homo sapiens
gcauuguuguucuugauuu

SEQ ID NO: 681526 - RNA, 19 nt, Homo sapiens
caaucaagcuuaucuggau

SEQ ID NO: 681527 - RNA, 19 nt, Homo sapiens
gggcaugggugguggagaa

SEQ ID NO: 681528 - RNA, 19 nt, Homo sapiens
uaucauggcagaagaagua

SEQ ID NO: 681529 - RNA, 19 nt, Homo sapiens
gcucuuuccucauaccuuu

SEQ ID NO: 681530 - RNA, 19 nt, Homo sapiens
cagcugcuauguuggauuu

SEQ ID NO: 681531 - RNA, 19 nt, Homo sapiens
gaaagcugaugacucuguu

SEQ ID NO: 681532 - RNA, 19 nt, Homo sapiens
guaccaacaucgacagaga

SEQ ID NO: 681533 - RNA, 19 nt, Homo sapiens
ggacauuugagauuuauug

SEQ ID NO: 681534 - RNA, 19 nt, Homo sapiens
caagaagaccaucuauaaa

SEQ ID NO: 681535 - RNA, 19 nt, Homo sapiens
aguaaacccugccaaauug

SEQ ID NO: 681536 - RNA, 19 nt, Homo sapiens
gaaguagagugggacuauu

SEQ ID NO: 681537 - RNA, 19 nt, Homo sapiens
agaagaccaucuauaaaga

SEQ ID NO: 681538 - RNA, 19 nt, Homo sapiens
gcacugaaaggaauguuga

SEQ ID NO: 681539 - RNA, 19 nt, Homo sapiens
ucaggaaauuucacuuuga

SEQ ID NO: 681540 - RNA, 19 nt, Homo sapiens
cuaccaagcugcaagaauc

SEQ ID NO: 681541 - RNA, 19 nt, Homo sapiens
ggaguacugggaagaauuu

SEQ ID NO: 681542 - RNA, 19 nt, Homo sapiens
gaaggacaguuaugguuac

SEQ ID NO: 681543 - RNA, 19 nt, Homo sapiens
gaggaagggugcagcuaug

SEQ ID NO: 681544 - RNA, 19 nt, Homo sapiens
gaagaccaucuauaaagaa

SEQ ID NO: 681545 - RNA, 19 nt, Homo sapiens
ggaugagggcaaucuauaa

SEQ ID NO: 681546 - RNA, 19 nt, Homo sapiens
uaucaaaggugaaguuggu

SEQ ID NO: 681547 - RNA, 19 nt, Homo sapiens
gagaaggacaguuaugguu

SEQ ID NO: 681548 - RNA, 19 nt, Homo sapiens
gggaugagggcaaucuaua

SEQ ID NO: 681549 - RNA, 19 nt, Homo sapiens
ggauguagaccaugauuuc

SEQ ID NO: 681550 - RNA, 19 nt, Homo sapiens
ggaguaccuuauuauccua

SEQ ID NO: 681551 - RNA, 19 nt, Homo sapiens
gaauuuaccugagcugaac

SEQ ID NO: 681552 - RNA, 19 nt, Homo sapiens
gcaaucaauggcuuuguuu

SEQ ID NO: 681553 - RNA, 19 nt, Homo sapiens
augagaacauugccacuua

SEQ ID NO: 681554 - RNA, 19 nt, Homo sapiens
cauugcaacuggccuaauu

SEQ ID NO: 681555 - RNA, 19 nt, Homo sapiens
gaccaucuauaaagaauac

SEQ ID NO: 681556 - RNA, 19 nt, Homo sapiens
caaugacucugcuuguguu

SEQ ID NO: 681557 - RNA, 19 nt, Homo sapiens
cugcaagaaucuacuauau

SEQ ID NO: 681558 - RNA, 19 nt, Homo sapiens
caguaaacccugccaaauu

SEQ ID NO: 681559 - RNA, 19 nt, Homo sapiens
agaaagcuacgacgcaaua

SEQ ID NO: 681560 - RNA, 19 nt, Homo sapiens
aagagaagaugcauuugga

SEQ ID NO: 681561 - RNA, 19 nt, Homo sapiens
ugaaauugauguccacaca

SEQ ID NO: 681562 - RNA, 19 nt, Homo sapiens
uaccugagcugaacaugug

SEQ ID NO: 681563 - RNA, 19 nt, Homo sapiens
uaacccacacuuaaacuaa

SEQ ID NO: 681564 - RNA, 19 nt, Homo sapiens
gaagaaggcaaugugaaga

SEQ ID NO: 681565 - RNA, 19 nt, Homo sapiens
gaauuugcauuguuguucu

SEQ ID NO: 681566 - RNA, 19 nt, Homo sapiens
gaggccaagugagcuguua

SEQ ID NO: 681567 - RNA, 19 nt, Homo sapiens
caaaguagagaccaagaga

SEQ ID NO: 681568 - RNA, 19 nt, Homo sapiens
ucgcaaauuucaacagcua

SEQ ID NO: 681569 - RNA, 19 nt, Homo sapiens
ccaagauacugacugaaca

SEQ ID NO: 681570 - RNA, 19 nt, Homo sapiens
uaaagaauguugagaugcu

SEQ ID NO: 681571 - RNA, 19 nt, Homo sapiens
gcaauaaaaugcaugcaau

SEQ ID NO: 681572 - RNA, 19 nt, Homo sapiens
acaugaauauggaguaguu

SEQ ID NO: 681573 - RNA, 19 nt, Homo sapiens
agaaggacaguuaugguua

SEQ ID NO: 681574 - RNA, 19 nt, Homo sapiens
ugagggcaaucuauaaugu

SEQ ID NO: 681575 - RNA, 19 nt, Homo sapiens
ugacaaccuugggacauuu

SEQ ID NO: 681576 - RNA, 19 nt, Homo sapiens
gcaacacugugcagcuuca

SEQ ID NO: 681577 - RNA, 19 nt, Homo sapiens
ccauucagguggucuucua

SEQ ID NO: 681578 - RNA, 19 nt, Homo sapiens
gcucagauccugcuucagu

SEQ ID NO: 681579 - RNA, 19 nt, Homo sapiens
cuuggaagguauugaaauu

SEQ ID NO: 681580 - RNA, 19 nt, Homo sapiens
caggauccaggcaguauua

SEQ ID NO: 681581 - RNA, 19 nt, Homo sapiens
ugacugugguauucaagaa

SEQ ID NO: 681582 - RNA, 19 nt, Homo sapiens
gaacagucacuuucgagau

SEQ ID NO: 681583 - RNA, 19 nt, Homo sapiens
ggaauccuggacuuaauuu

SEQ ID NO: 681584 - RNA, 19 nt, Homo sapiens
ggaauuuaccugagcugaa

SEQ ID NO: 681585 - RNA, 19 nt, Homo sapiens
acaaagaagaugagacauu

SEQ ID NO: 681586 - RNA, 19 nt, Homo sapiens
gccaggauguagaccauga

SEQ ID NO: 681587 - RNA, 19 nt, Homo sapiens
ucaccuggaucuaccauuc

SEQ ID NO: 681588 - RNA, 19 nt, Homo sapiens
uggaagguauugaaauuuc

SEQ ID NO: 681589 - RNA, 19 nt, Homo sapiens
caaacccuauccauuaaag

SEQ ID NO: 681590 - RNA, 19 nt, Homo sapiens
cacuuaaacuaaaggcuaa

SEQ ID NO: 681591 - RNA, 19 nt, Homo sapiens
ggaagguauugaaauuucu

SEQ ID NO: 681592 - RNA, 19 nt, Homo sapiens
gaucgggaauuugcauugu

SEQ ID NO: 681593 - RNA, 19 nt, Homo sapiens
caagugagcuguuaagaua

SEQ ID NO: 681594 - RNA, 19 nt, Homo sapiens
gcaagaaucuacuauauca

SEQ ID NO: 681595 - RNA, 19 nt, Homo sapiens
gaagaaaugucaucacgaa

SEQ ID NO: 681596 - RNA, 19 nt, Homo sapiens
caaagaagaugagacauuu

SEQ ID NO: 681597 - RNA, 19 nt, Homo sapiens
ugaaaggaauguugaguua

SEQ ID NO: 681598 - RNA, 19 nt, Homo sapiens
gaagguaggcugaguauug

SEQ ID NO: 681599 - RNA, 19 nt, Homo sapiens
ccugguaccugguuaauua

SEQ ID NO: 681600 - RNA, 19 nt, Homo sapiens
cagcaaacccuauccauua

SEQ ID NO: 681601 - RNA, 19 nt, Homo sapiens
uuaauuagcugccaaguga

SEQ ID NO: 681602 - RNA, 19 nt, Homo sapiens
ggacaguuaugguuacauu

SEQ ID NO: 681603 - RNA, 19 nt, Homo sapiens
gaucuaccauucucaugua

SEQ ID NO: 681604 - RNA, 19 nt, Homo sapiens
gaugagacauuccaagaga

SEQ ID NO: 681605 - RNA, 19 nt, Homo sapiens
ugacauggaucgggaauuu

SEQ ID NO: 681606 - RNA, 19 nt, Homo sapiens
gaagaacacuugggaaucu

SEQ ID NO: 681607 - RNA, 19 nt, Homo sapiens
gcaauaggaugcaugcaau

SEQ ID NO: 681608 - RNA, 19 nt, Homo sapiens
acaagaagaccaucuauaa

SEQ ID NO: 681609 - RNA, 19 nt, Homo sapiens
ggaauacacugaugguaca

SEQ ID NO: 681610 - RNA, 19 nt, Homo sapiens
gaagaugcauuuggaggaa

SEQ ID NO: 681611 - RNA, 19 nt, Homo sapiens
ugaguuaccucuucauguu

SEQ ID NO: 681612 - RNA, 19 nt, Homo sapiens
gcagugaacuacuuugaag

SEQ ID NO: 681613 - RNA, 19 nt, Homo sapiens
uauccuacaucgcaaauuu

SEQ ID NO: 681614 - RNA, 19 nt, Homo sapiens
guauuaaccuacaggauga

SEQ ID NO: 681615 - RNA, 19 nt, Homo sapiens
gagaaggacucugaagguu

SEQ ID NO: 681616 - RNA, 19 nt, Homo sapiens
gagacccucuucacuguuu

SEQ ID NO: 681617 - RNA, 19 nt, Homo sapiens
gaaacucuaugccaaccuu

SEQ ID NO: 681618 - RNA, 19 nt, Homo sapiens
ggacaaagaagaugagaca

SEQ ID NO: 681619 - RNA, 19 nt, Homo sapiens
gaaggagcaaucaagcuua

SEQ ID NO: 681620 - RNA, 19 nt, Homo sapiens
gagaacgaguggccuggua

SEQ ID NO: 681621 - RNA, 19 nt, Homo sapiens
guacagcaaugccaaucaa

SEQ ID NO: 681622 - RNA, 19 nt, Homo sapiens
gaagagcuccagccgaauu

SEQ ID NO: 681623 - RNA, 19 nt, Homo sapiens
cauaaagaauguugagaug

SEQ ID NO: 681624 - RNA, 19 nt, Homo sapiens
gcauuguuguucuugauuu

SEQ ID NO: 681625 - RNA, 19 nt, Homo sapiens
caaucaagcuuaucuggau

SEQ ID NO: 681626 - RNA, 19 nt, Homo sapiens
gggcaugggugguggagaa

SEQ ID NO: 681627 - RNA, 19 nt, Homo sapiens
uaucauggcagaagaagua

SEQ ID NO: 681628 - RNA, 19 nt, Homo sapiens
gcucuuuccucauaccuuu

SEQ ID NO: 681629 - RNA, 19 nt, Homo sapiens
cagcugcuauguuggauuu

SEQ ID NO: 681630 - RNA, 19 nt, Homo sapiens
gaaagcugaugacucuguu

SEQ ID NO: 681631 - RNA, 19 nt, Homo sapiens
guaccaacaucgacagaga

SEQ ID NO: 681632 - RNA, 19 nt, Homo sapiens
ggacauuugagauuuauug

SEQ ID NO: 681633 - RNA, 19 nt, Homo sapiens
caagaagaccaucuauaaa

SEQ ID NO: 681634 - RNA, 19 nt, Homo sapiens
gaaguagagugggacuauu

SEQ ID NO: 681635 - RNA, 19 nt, Homo sapiens
agaagaccaucuauaaaga

SEQ ID NO: 681636 - RNA, 19 nt, Homo sapiens
gcacugaaaggaauguuga

SEQ ID NO: 681637 - RNA, 19 nt, Homo sapiens
ucaggaaauuucacuuuga

SEQ ID NO: 681638 - RNA, 19 nt, Homo sapiens
cuaccaagcugcaagaauc

SEQ ID NO: 681639 - RNA, 19 nt, Homo sapiens
ggaguacugggaagaauuu

SEQ ID NO: 681640 - RNA, 19 nt, Homo sapiens
gaaggacaguuaugguuac

SEQ ID NO: 681641 - RNA, 19 nt, Homo sapiens
gaggaagggugcagcuaug

SEQ ID NO: 681642 - RNA, 19 nt, Homo sapiens
gaagaccaucuauaaagaa

SEQ ID NO: 681643 - RNA, 19 nt, Homo sapiens
ggaugagggcaaucuauaa

SEQ ID NO: 681644 - RNA, 19 nt, Homo sapiens
uaucaaaggugaaguuggu

SEQ ID NO: 681645 - RNA, 19 nt, Homo sapiens
gagaaggacaguuaugguu

SEQ ID NO: 681646 - RNA, 19 nt, Homo sapiens
gggaugagggcaaucuaua

SEQ ID NO: 681647 - RNA, 19 nt, Homo sapiens
ggauguagaccaugauuuc

SEQ ID NO: 681648 - RNA, 19 nt, Homo sapiens
gaaaugucaucacgaacca

SEQ ID NO: 681649 - RNA, 19 nt, Homo sapiens
ggaguaccuuauuauccua

SEQ ID NO: 681650 - RNA, 19 nt, Homo sapiens
gaauuuaccugagcugaac

SEQ ID NO: 681651 - RNA, 19 nt, Homo sapiens
gcaaucaauggcuuuguuu

SEQ ID NO: 681652 - RNA, 19 nt, Homo sapiens
augagaacauugccacuua

SEQ ID NO: 681653 - RNA, 19 nt, Homo sapiens
cauugcaacuggccuaauu

SEQ ID NO: 681654 - RNA, 19 nt, Homo sapiens
gaccaucuauaaagaauac

SEQ ID NO: 681655 - RNA, 19 nt, Homo sapiens
caaugacucugcuuguguu

SEQ ID NO: 681656 - RNA, 19 nt, Homo sapiens
caagaucuccucaucacaa

SEQ ID NO: 681657 - RNA, 19 nt, Homo sapiens
cugcaagaaucuacuauau

SEQ ID NO: 681658 - RNA, 19 nt, Homo sapiens
agaaagcuacgacgcaaua

SEQ ID NO: 681659 - RNA, 19 nt, Homo sapiens
aagagaagaugcauuugga

SEQ ID NO: 681660 - RNA, 19 nt, Homo sapiens
ugaaauugauguccacaca

SEQ ID NO: 681661 - RNA, 19 nt, Homo sapiens
uaccugagcugaacaugug

SEQ ID NO: 681662 - RNA, 19 nt, Homo sapiens
uaacccacacuuaaacuaa

SEQ ID NO: 681663 - RNA, 19 nt, Homo sapiens
gaagaaggcaaugugaaga

SEQ ID NO: 681664 - RNA, 19 nt, Homo sapiens
gaauuugcauuguuguucu

SEQ ID NO: 681665 - RNA, 19 nt, Homo sapiens
gaggccaagugagcuguua

SEQ ID NO: 681666 - RNA, 19 nt, Homo sapiens
caaaguagagaccaagaga

SEQ ID NO: 681667 - RNA, 19 nt, Homo sapiens
ucgcaaauuucaacagcua

SEQ ID NO: 681668 - RNA, 19 nt, Homo sapiens
uaaagaauguugagaugcu

SEQ ID NO: 681669 - RNA, 19 nt, Homo sapiens
gcaauaaaaugcaugcaau

SEQ ID NO: 681670 - RNA, 19 nt, Homo sapiens
agaaggacaguuaugguua

SEQ ID NO: 681671 - RNA, 19 nt, Homo sapiens
ugagggcaaucuauaaugu

SEQ ID NO: 681672 - RNA, 19 nt, Homo sapiens
ugacaaccuugggacauuu

SEQ ID NO: 681673 - RNA, 19 nt, Homo sapiens
gcaacacugugcagcuuca

SEQ ID NO: 681674 - RNA, 19 nt, Homo sapiens
ccauucagguggucuucua

SEQ ID NO: 681675 - RNA, 19 nt, Homo sapiens
gcucagauccugcuucagu

SEQ ID NO: 681676 - RNA, 19 nt, Homo sapiens
cuuggaagguauugaaauu

SEQ ID NO: 681677 - RNA, 19 nt, Homo sapiens
caggauccaggcaguauua

SEQ ID NO: 681678 - RNA, 19 nt, Homo sapiens
ugacugugguauucaagaa

SEQ ID NO: 681679 - RNA, 19 nt, Homo sapiens
gaacagucacuuucgagau

SEQ ID NO: 681680 - RNA, 19 nt, Homo sapiens
ggaauuuaccugagcugaa

SEQ ID NO: 681681 - RNA, 19 nt, Homo sapiens
acaaagaagaugagacauu

SEQ ID NO: 681682 - RNA, 19 nt, Homo sapiens
gccaggauguagaccauga

SEQ ID NO: 681683 - RNA, 19 nt, Homo sapiens
ucaccuggaucuaccauuc

SEQ ID NO: 681684 - RNA, 19 nt, Homo sapiens
uggaagguauugaaauuuc

SEQ ID NO: 681685 - RNA, 19 nt, Homo sapiens
caaacccuauccauuaaag

SEQ ID NO: 681686 - RNA, 19 nt, Homo sapiens
cacuuaaacuaaaggcuaa

SEQ ID NO: 681687 - RNA, 19 nt, Homo sapiens
ggaagguauugaaauuucu

SEQ ID NO: 681688 - RNA, 19 nt, Homo sapiens
gaucgggaauuugcauugu

SEQ ID NO: 681689 - RNA, 19 nt, Homo sapiens
ggaaucuuggguccacuua

SEQ ID NO: 681690 - RNA, 19 nt, Homo sapiens
gcagaucccauaagagaca

SEQ ID NO: 681691 - RNA, 19 nt, Homo sapiens
gaugugcaguggaacuaug

SEQ ID NO: 681692 - RNA, 19 nt, Homo sapiens
gcagccauaucuacaacug

SEQ ID NO: 681693 - RNA, 19 nt, Homo sapiens
ggaaaggacugcccucaua

SEQ ID NO: 681694 - RNA, 19 nt, Homo sapiens
gaagggaccugcuuuagga

SEQ ID NO: 681695 - RNA, 19 nt, Homo sapiens
ggacugcccucauaugaaa

SEQ ID NO: 681696 - RNA, 19 nt, Homo sapiens
caacugcguuccaucauuu

SEQ ID NO: 681697 - RNA, 19 nt, Homo sapiens
guauagagcugaccaagau

SEQ ID NO: 681698 - RNA, 19 nt, Homo sapiens
gcacugugaucgugacaaa

SEQ ID NO: 681699 - RNA, 19 nt, Homo sapiens
caagaaauccaaaccuaua

SEQ ID NO: 681700 - RNA, 19 nt, Homo sapiens
gaacugccuucuucauuuc

SEQ ID NO: 681701 - RNA, 19 nt, Homo sapiens
uaaacaugcuguggaauaa

SEQ ID NO: 681702 - RNA, 19 nt, Homo sapiens
ugaccaagaugcuauguga

SEQ ID NO: 681703 - RNA, 19 nt, Homo sapiens
ggaauaaaauggauuguga

SEQ ID NO: 681704 - RNA, 19 nt, Homo sapiens
ggcaggagauggcgaauau

SEQ ID NO: 681705 - RNA, 19 nt, Homo sapiens
gcaacugcguuccaucauu

SEQ ID NO: 681706 - RNA, 19 nt, Homo sapiens
gccaugaucucuaccagaa

SEQ ID NO: 681707 - RNA, 19 nt, Homo sapiens
uacaagugcucaccuuuaa

SEQ ID NO: 681708 - RNA, 19 nt, Homo sapiens
gaaaagaaccgcaaugaga

SEQ ID NO: 681709 - RNA, 19 nt, Homo sapiens
ccacuggcuuugaacauuu

SEQ ID NO: 681710 - RNA, 19 nt, Homo sapiens
ggaugaaccaggaagauuu

SEQ ID NO: 681711 - RNA, 19 nt, Homo sapiens
gcacugagcgauaccagaa

SEQ ID NO: 681712 - RNA, 19 nt, Homo sapiens
cauccaaguuuacaucauu

SEQ ID NO: 681713 - RNA, 19 nt, Homo sapiens
gcaagggucagaucaagaa

SEQ ID NO: 681714 - RNA, 19 nt, Homo sapiens
gaacaagacauggaaggaa

SEQ ID NO: 681715 - RNA, 19 nt, Homo sapiens
gaaauccaaaccuauacua

SEQ ID NO: 681716 - RNA, 19 nt, Homo sapiens
gaacuucgaagaauugcuu

SEQ ID NO: 681717 - RNA, 19 nt, Homo sapiens
ccaaacaucuuccugaaaa

SEQ ID NO: 681718 - RNA, 19 nt, Homo sapiens
ccaccucucucccugcuuu

SEQ ID NO: 681719 - RNA, 19 nt, Homo sapiens
gaacuaaaggagaagauuc

SEQ ID NO: 681720 - RNA, 19 nt, Homo sapiens
gaacaguagucgagaagac

SEQ ID NO: 681721 - RNA, 19 nt, Homo sapiens
agagggacaucauauuuga

SEQ ID NO: 681722 - RNA, 19 nt, Homo sapiens
gauccucccuagcauaaau

SEQ ID NO: 681723 - RNA, 19 nt, Homo sapiens
ccaaggagcccagcaacua

SEQ ID NO: 681724 - RNA, 19 nt, Homo sapiens
ugagagcacuuacaaccaa

SEQ ID NO: 681725 - RNA, 19 nt, Homo sapiens
gaaaugagggcaacuucug

SEQ ID NO: 681726 - RNA, 19 nt, Homo sapiens
gaaaggacugcccucauau

SEQ ID NO: 681727 - RNA, 19 nt, Homo sapiens
ucuuagagcugaucaaaca

SEQ ID NO: 681728 - RNA, 19 nt, Homo sapiens
agacacguguggccguuua

SEQ ID NO: 681729 - RNA, 19 nt, Homo sapiens
uaugugagaucuugaaagu

SEQ ID NO: 681730 - RNA, 19 nt, Homo sapiens
cauggaaauugaucagaaa

SEQ ID NO: 681731 - RNA, 19 nt, Homo sapiens
ccaaacucauggaaauuga

SEQ ID NO: 681732 - RNA, 19 nt, Homo sapiens
uaacauucccuuaaacaug

SEQ ID NO: 681733 - RNA, 19 nt, Homo sapiens
gagaagacaagcaugaaug

SEQ ID NO: 681734 - RNA, 19 nt, Homo sapiens
ucagagggacaucauauuu

SEQ ID NO: 681735 - RNA, 19 nt, Homo sapiens
cuacaagugcucaccuuua

SEQ ID NO: 681736 - RNA, 19 nt, Homo sapiens
uaccagaaauugcagaaga

SEQ ID NO: 681737 - RNA, 19 nt, Homo sapiens
cgaauccaguccucgagua

SEQ ID NO: 681738 - RNA, 19 nt, Homo sapiens
uuaaacaugcuguggaaua

SEQ ID NO: 681739 - RNA, 19 nt, Homo sapiens
gaacaagucagccauagac

SEQ ID NO: 681740 - RNA, 19 nt, Homo sapiens
aaaccacugucugcaauaa

SEQ ID NO: 681741 - RNA, 19 nt, Homo sapiens
uggccuagcuauuugauga

SEQ ID NO: 681742 - RNA, 19 nt, Homo sapiens
gacucaaacugccaacuga

SEQ ID NO: 681743 - RNA, 19 nt, Homo sapiens
guauccagcuccugaacaa

SEQ ID NO: 681744 - RNA, 19 nt, Homo sapiens
uuauaaaccuggacgguau

SEQ ID NO: 681745 - RNA, 19 nt, Homo sapiens
gcauaaauuucccaaacag

SEQ ID NO: 681746 - RNA, 19 nt, Homo sapiens
caacuaugacuucgucuau

SEQ ID NO: 681747 - RNA, 19 nt, Homo sapiens
gagaagauucagccagaaa

SEQ ID NO: 681748 - RNA, 19 nt, Homo sapiens
caucauauuugaacuucga

SEQ ID NO: 681749 - RNA, 19 nt, Homo sapiens
caggagauggcgaauauuu

SEQ ID NO: 681750 - RNA, 19 nt, Homo sapiens
ggcauaguguccugggaua

SEQ ID NO: 681751 - RNA, 19 nt, Homo sapiens
ggcacuauccuucgauuaa

SEQ ID NO: 681752 - RNA, 19 nt, Homo sapiens
ucauggaaauugaucagaa

SEQ ID NO: 681753 - RNA, 19 nt, Homo sapiens
ggacaucauauuugaacuu

SEQ ID NO: 681754 - RNA, 19 nt, Homo sapiens
uagcauaaauuucccaaac

SEQ ID NO: 681755 - RNA, 19 nt, Homo sapiens
ggagaagauucagccagaa

SEQ ID NO: 681756 - RNA, 19 nt, Homo sapiens
uaaugcagguggugaagga

SEQ ID NO: 681757 - RNA, 19 nt, Homo sapiens
gaugcuaugugagaucuug

SEQ ID NO: 681758 - RNA, 19 nt, Homo sapiens
gaacucgcuuucuccaucu

SEQ ID NO: 681759 - RNA, 19 nt, Homo sapiens
aacaagacauggaaggaaa

SEQ ID NO: 681760 - RNA, 19 nt, Homo sapiens
gagaaacgcaaguccaugu

SEQ ID NO: 681761 - RNA, 19 nt, Homo sapiens
ccaguuacacuugaauuaa

SEQ ID NO: 681762 - RNA, 19 nt, Homo sapiens
gcccucauaugaaagagaa

SEQ ID NO: 681763 - RNA, 19 nt, Homo sapiens
aagcuuggguucauuaauc

SEQ ID NO: 681764 - RNA, 19 nt, Homo sapiens
caauagccaugaucucuac

SEQ ID NO: 681765 - RNA, 19 nt, Homo sapiens
aagcacaaauggugaaauc

SEQ ID NO: 681766 - RNA, 19 nt, Homo sapiens
cacauucccuucagcauca

SEQ ID NO: 681767 - RNA, 19 nt, Homo sapiens
acuaugacuucgucuauga

SEQ ID NO: 681768 - RNA, 19 nt, Homo sapiens
uaagaagcuuggguucauu

SEQ ID NO: 681769 - RNA, 19 nt, Homo sapiens
gacaucauauuugaacuuc

SEQ ID NO: 681770 - RNA, 19 nt, Homo sapiens
gcucagagggacaucauau

SEQ ID NO: 681771 - RNA, 19 nt, Homo sapiens
gaaggagcagguuaugaga

SEQ ID NO: 681772 - RNA, 19 nt, Homo sapiens
ggacaacaugcuguacuuu

SEQ ID NO: 681773 - RNA, 19 nt, Homo sapiens
auccaaaccuauacuauug

SEQ ID NO: 681774 - RNA, 19 nt, Homo sapiens
accacugucugcaauaaua

SEQ ID NO: 681775 - RNA, 19 nt, Homo sapiens
gaaaguggcgcaggagauc

SEQ ID NO: 681776 - RNA, 19 nt, Homo sapiens
aaagaaccgcaaugagaua

SEQ ID NO: 681777 - RNA, 19 nt, Homo sapiens
uaauaaaggaagucuguga

SEQ ID NO: 681778 - RNA, 19 nt, Homo sapiens
gcauuacggagacuuagaa

SEQ ID NO: 681779 - RNA, 19 nt, Homo sapiens
aaccugagcuacacugaga

SEQ ID NO: 681780 - RNA, 19 nt, Homo sapiens
aagcaugaaugucccuuug

SEQ ID NO: 681781 - RNA, 19 nt, Homo sapiens
ggauugugcuugagaacag

SEQ ID NO: 681782 - RNA, 19 nt, Homo sapiens
ccacaucuccagcucagaa

SEQ ID NO: 681783 - RNA, 19 nt, Homo sapiens
gaaccgcaaugagauaaaa

SEQ ID NO: 681784 - RNA, 19 nt, Homo sapiens
ugugauggguggucucuug

SEQ ID NO: 681785 - RNA, 19 nt, Homo sapiens
ggaaccguccuuugguaaa

SEQ ID NO: 681786 - RNA, 19 nt, Homo sapiens
gcaacuaugacuucgucua

SEQ ID NO: 681787 - RNA, 19 nt, Homo sapiens
ugacaagcaugaguacugu

SEQ ID NO: 681788 - RNA, 19 nt, Homo sapiens
ugagaacaguagucgagaa

SEQ ID NO: 681789 - RNA, 19 nt, Homo sapiens
gacaacaugcuguacuuug

SEQ ID NO: 681790 - RNA, 19 nt, Homo sapiens
gcagcuccaugaacgaauc

SEQ ID NO: 681791 - RNA, 19 nt, Homo sapiens
ccuuaaacaugcuguggaa

SEQ ID NO: 681792 - RNA, 19 nt, Homo sapiens
auuaagaucugcgcucaaa

SEQ ID NO: 681793 - RNA, 19 nt, Homo sapiens
ggaaaggacugcccucaua

SEQ ID NO: 681794 - RNA, 19 nt, Homo sapiens
gaagggaccugcuuuagga

SEQ ID NO: 681795 - RNA, 19 nt, Homo sapiens
ggacugcccucauaugaaa

SEQ ID NO: 681796 - RNA, 19 nt, Homo sapiens
ucacauggcucaacuggaa

SEQ ID NO: 681797 - RNA, 19 nt, Homo sapiens
gcacugugaucgugacaaa

SEQ ID NO: 681798 - RNA, 19 nt, Homo sapiens
gaacugccuucuucauuuc

SEQ ID NO: 681799 - RNA, 19 nt, Homo sapiens
gaacaagcuuacucaggaa

SEQ ID NO: 681800 - RNA, 19 nt, Homo sapiens
uaaacaugcuguggaauaa

SEQ ID NO: 681801 - RNA, 19 nt, Homo sapiens
ggaauaaaauggauuguga

SEQ ID NO: 681802 - RNA, 19 nt, Homo sapiens
cagcuuagaaucaguauuu

SEQ ID NO: 681803 - RNA, 19 nt, Homo sapiens
ggaugaaccaggaagauuu

SEQ ID NO: 681804 - RNA, 19 nt, Homo sapiens
cauccaaguuuacaucauu

SEQ ID NO: 681805 - RNA, 19 nt, Homo sapiens
ccaaacaucuuccugaaaa

SEQ ID NO: 681806 - RNA, 19 nt, Homo sapiens
ccaccucucucccugcuuu

SEQ ID NO: 681807 - RNA, 19 nt, Homo sapiens
gaacuaaaggagaagauuc

SEQ ID NO: 681808 - RNA, 19 nt, Homo sapiens
gauccucccuagcauaaau

SEQ ID NO: 681809 - RNA, 19 nt, Homo sapiens
ccaaggagcccagcaacua

SEQ ID NO: 681810 - RNA, 19 nt, Homo sapiens
ugagagcacuuacaaccaa

SEQ ID NO: 681811 - RNA, 19 nt, Homo sapiens
gaaaggacugcccucauau

SEQ ID NO: 681812 - RNA, 19 nt, Homo sapiens
ucuuagagcugaucaaaca

SEQ ID NO: 681813 - RNA, 19 nt, Homo sapiens
uaacauucccuuaaacaug

SEQ ID NO: 681814 - RNA, 19 nt, Homo sapiens
uuaaacaugcuguggaaua

SEQ ID NO: 681815 - RNA, 19 nt, Homo sapiens
uggccuagcuauuugauga

SEQ ID NO: 681816 - RNA, 19 nt, Homo sapiens
gacucaaacugccaacuga

SEQ ID NO: 681817 - RNA, 19 nt, Homo sapiens
gcauaaauuucccaaacag

SEQ ID NO: 681818 - RNA, 19 nt, Homo sapiens
caacuaugacuucgucuau

SEQ ID NO: 681819 - RNA, 19 nt, Homo sapiens
gagaagauucagccagaaa

SEQ ID NO: 681820 - RNA, 19 nt, Homo sapiens
gcgggucucuguucacaug

SEQ ID NO: 681821 - RNA, 19 nt, Homo sapiens
uagcauaaauuucccaaac

SEQ ID NO: 681822 - RNA, 19 nt, Homo sapiens
ggagaagauucagccagaa

SEQ ID NO: 681823 - RNA, 19 nt, Homo sapiens
uaaugcagguggugaagga

SEQ ID NO: 681824 - RNA, 19 nt, Homo sapiens
gaacucgcuuucuccaucu

SEQ ID NO: 681825 - RNA, 19 nt, Homo sapiens
ccaguuacacuugaauuaa

SEQ ID NO: 681826 - RNA, 19 nt, Homo sapiens
gcccucauaugaaagagaa

SEQ ID NO: 681827 - RNA, 19 nt, Homo sapiens
aagcacaaauggugaaauc

SEQ ID NO: 681828 - RNA, 19 nt, Homo sapiens
cacauucccuucagcauca

SEQ ID NO: 681829 - RNA, 19 nt, Homo sapiens
acuaugacuucgucuauga

SEQ ID NO: 681830 - RNA, 19 nt, Homo sapiens
gaaggagcagguuaugaga

SEQ ID NO: 681831 - RNA, 19 nt, Homo sapiens
gcauuacggagacuuagaa

SEQ ID NO: 681832 - RNA, 19 nt, Homo sapiens
aaccugagcuacacugaga

SEQ ID NO: 681833 - RNA, 19 nt, Homo sapiens
ggaaccguccuuugguaaa

SEQ ID NO: 681834 - RNA, 19 nt, Homo sapiens
gcaacuaugacuucgucua

SEQ ID NO: 681835 - RNA, 19 nt, Homo sapiens
ugacaagcaugaguacugu

SEQ ID NO: 681836 - RNA, 19 nt, Homo sapiens
ccuuaaacaugcuguggaa

SEQ ID NO: 681837 - RNA, 19 nt, Homo sapiens
auuaagaucugcgcucaaa

SEQ ID NO: 681838 - RNA, 19 nt, Homo sapiens
cuucaucgcuccugacaag

SEQ ID NO: 681839 - RNA, 19 nt, Homo sapiens
caagacaaguuuugguauu

SEQ ID NO: 681840 - RNA, 19 nt, Homo sapiens
ggaacuaaaggagaagauu

SEQ ID NO: 681841 - RNA, 19 nt, Homo sapiens
gcacaaauggugaaaucag

SEQ ID NO: 681842 - RNA, 19 nt, Homo sapiens
gaggaaauggccuagcuau

SEQ ID NO: 681843 - RNA, 19 nt, Homo sapiens
gaaagcacaaauggugaaa

SEQ ID NO: 681844 - RNA, 19 nt, Homo sapiens
uaagaucugcgcucaaauc

SEQ ID NO: 681845 - RNA, 19 nt, Homo sapiens
ucaccgcccugauucuguu

SEQ ID NO: 681846 - RNA, 19 nt, Homo sapiens
uaacaggagagaggaauga

SEQ ID NO: 681847 - RNA, 19 nt, Homo sapiens
ggaagggaccugcuuuagg

SEQ ID NO: 681848 - RNA, 19 nt, Homo sapiens
acacugagauccugaaaau

SEQ ID NO: 681849 - RNA, 19 nt, Homo sapiens
guuaugagagcacuuacaa

SEQ ID NO: 681850 - RNA, 19 nt, Homo sapiens
gugauccucccuagcauaa

SEQ ID NO: 681851 - RNA, 19 nt, Homo sapiens
acacuugaauuaagaucug

SEQ ID NO: 681852 - RNA, 19 nt, Homo sapiens
gcaccaccaguuacacuug

SEQ ID NO: 681853 - RNA, 19 nt, Homo sapiens
caucucgcaccaccaguua

SEQ ID NO: 681854 - RNA, 19 nt, Homo sapiens
ggaggaaauggccuagcua

SEQ ID NO: 681855 - RNA, 19 nt, Homo sapiens
caaggagcccagcaacuau

SEQ ID NO: 681856 - RNA, 19 nt, Homo sapiens
cacaaauggugaaaucagu

SEQ ID NO: 681857 - RNA, 19 nt, Homo sapiens
caguuacacuugaauuaag

SEQ ID NO: 681858 - RNA, 19 nt, Homo sapiens
ugacgcaccuccgccgauu

SEQ ID NO: 681859 - RNA, 19 nt, Homo sapiens
guggaagggaccugcuuua

SEQ ID NO: 681860 - RNA, 19 nt, Homo sapiens
ucccaaacaucuuccugaa

SEQ ID NO: 681861 - RNA, 19 nt, Homo sapiens
gacaaaagagucuaacauu

SEQ ID NO: 681862 - RNA, 19 nt, Homo sapiens
gaugaaccaggaagauuuc

SEQ ID NO: 681863 - RNA, 19 nt, Homo sapiens
caggucccaugcccacuuu

SEQ ID NO: 681864 - RNA, 19 nt, Homo sapiens
caccaccaguuacacuuga

SEQ ID NO: 681865 - RNA, 19 nt, Homo sapiens
caucuuguaugacucaaac

SEQ ID NO: 681866 - RNA, 19 nt, Homo sapiens
gcggaggcaagacaaguuu

SEQ ID NO: 681867 - RNA, 19 nt, Homo sapiens
acaaauggugaaaucagua

SEQ ID NO: 681868 - RNA, 19 nt, Homo sapiens
aucacaaaguccugcauua

SEQ ID NO: 681869 - RNA, 19 nt, Homo sapiens
ugaaggagcagguuaugag

SEQ ID NO: 681870 - RNA, 19 nt, Homo sapiens
gucuaugacuguaacugaa

SEQ ID NO: 681871 - RNA, 19 nt, Homo sapiens
cagguuaugagagcacuua

SEQ ID NO: 681872 - RNA, 19 nt, Homo sapiens
ccacgcucccagccucuua

SEQ ID NO: 681873 - RNA, 19 nt, Homo sapiens
gccccuagcuggcaucuug

SEQ ID NO: 681874 - RNA, 19 nt, Homo sapiens
uuggaaccguccuuuggua

SEQ ID NO: 681875 - RNA, 19 nt, Homo sapiens
aagcaugaguacuguaucu

SEQ ID NO: 681876 - RNA, 19 nt, Homo sapiens
cagcagcuuagaaucagua

SEQ ID NO: 681877 - RNA, 19 nt, Homo sapiens
gccgguggcagauaucaaa

SEQ ID NO: 681878 - RNA, 19 nt, Homo sapiens
uuacggagacuuagaagag

SEQ ID NO: 681879 - RNA, 19 nt, Homo sapiens
gguggcagcagcuuagaau

SEQ ID NO: 681880 - RNA, 19 nt, Homo sapiens
ugaaagcacaaauggugaa

SEQ ID NO: 681881 - RNA, 19 nt, Homo sapiens
ugacuucgucuaugacugu

SEQ ID NO: 681882 - RNA, 19 nt, Homo sapiens
ccucuaggacggacuguug

SEQ ID NO: 681883 - RNA, 19 nt, Homo sapiens
caaauggugaaaucaguag

SEQ ID NO: 681884 - RNA, 19 nt, Homo sapiens
aaacuggaacaccuagcua

SEQ ID NO: 681885 - RNA, 19 nt, Homo sapiens
gcccagcaacuaugacuuc

SEQ ID NO: 681886 - RNA, 19 nt, Homo sapiens
caaacugccaacugaacuu

SEQ ID NO: 681887 - RNA, 19 nt, Homo sapiens
cucuagcccuggcaacuuu

SEQ ID NO: 681888 - RNA, 19 nt, Homo sapiens
gguauuccagcacauuguu

SEQ ID NO: 681889 - RNA, 19 nt, Homo sapiens
ggacggauggacugaaugc

SEQ ID NO: 681890 - RNA, 19 nt, Homo sapiens
cgucuaugacuguaacuga

SEQ ID NO: 681891 - RNA, 19 nt, Homo sapiens
aaucuuagagcugaucaaa

SEQ ID NO: 681892 - RNA, 19 nt, Homo sapiens
ggacaaaagagucuaacau

SEQ ID NO: 681893 - RNA, 19 nt, Homo sapiens
ggaaagaggugguuacuuc

SEQ ID NO: 681894 - RNA, 19 nt, Homo sapiens
caaauaagcuguuacuugu

SEQ ID NO: 681895 - RNA, 19 nt, Homo sapiens
gagaugaaaugaauacuug

SEQ ID NO: 681896 - RNA, 19 nt, Homo sapiens
gaaauggucuugucaccuu

SEQ ID NO: 681897 - RNA, 19 nt, Homo sapiens
aaaggugacuucagaauaa

SEQ ID NO: 681898 - RNA, 19 nt, Homo sapiens
gaacagccgcucacaauau

SEQ ID NO: 681899 - RNA, 19 nt, Homo sapiens
caacgacccuggacaguga

SEQ ID NO: 681900 - RNA, 19 nt, Homo sapiens
gaucaagguuaacaaagaa

SEQ ID NO: 681901 - RNA, 19 nt, Homo sapiens
uaagaaaggucuauaagag

SEQ ID NO: 681902 - RNA, 19 nt, Homo sapiens
gaaccugaccucaaggaua

SEQ ID NO: 681903 - RNA, 19 nt, Homo sapiens
gaaaguggguagcauuaca

SEQ ID NO: 681904 - RNA, 19 nt, Homo sapiens
agaaaggucuauaagagua

SEQ ID NO: 681905 - RNA, 19 nt, Homo sapiens
gcaggacucuucucacaug

SEQ ID NO: 681906 - RNA, 19 nt, Homo sapiens
gagcagauauccuguaaac

SEQ ID NO: 681907 - RNA, 19 nt, Homo sapiens
caaaccagcugagaugaaa

SEQ ID NO: 681908 - RNA, 19 nt, Homo sapiens
gcagauauccuguaaacga

SEQ ID NO: 681909 - RNA, 19 nt, Homo sapiens
gccaaucgauuugacuuua

SEQ ID NO: 681910 - RNA, 19 nt, Homo sapiens
ggacucuucucacaugauu

SEQ ID NO: 681911 - RNA, 19 nt, Homo sapiens
ugaaagagauccagggaau

SEQ ID NO: 681912 - RNA, 19 nt, Homo sapiens
ccaaauaagcuguuacuug

SEQ ID NO: 681913 - RNA, 19 nt, Homo sapiens
ugaaaggagucaccggaua

SEQ ID NO: 681914 - RNA, 19 nt, Homo sapiens
cagcugagaugaaaugaau

SEQ ID NO: 681915 - RNA, 19 nt, Homo sapiens
gcauuacauuggcaguuua

SEQ ID NO: 681916 - RNA, 19 nt, Homo sapiens
gcugagcuguucacuguuu

SEQ ID NO: 681917 - RNA, 19 nt, Homo sapiens
gaacucagcauucaugaca

SEQ ID NO: 681918 - RNA, 19 nt, Homo sapiens
guucaaagcugguucuagu

SEQ ID NO: 681919 - RNA, 19 nt, Homo sapiens
caaaggugacuucagaaua

SEQ ID NO: 681920 - RNA, 19 nt, Homo sapiens
cgagcuagcuucugcaaug

SEQ ID NO: 681921 - RNA, 19 nt, Homo sapiens
guacaaggcgaguggauaa

SEQ ID NO: 681922 - RNA, 19 nt, Homo sapiens
aaggagagcuguuccagaa

SEQ ID NO: 681923 - RNA, 19 nt, Homo sapiens
ugacaaaggacagugauua

SEQ ID NO: 681924 - RNA, 19 nt, Homo sapiens
ucaugcagcugguucuaua

SEQ ID NO: 681925 - RNA, 19 nt, Homo sapiens
gcgcagugcuguccaacaa

SEQ ID NO: 681926 - RNA, 19 nt, Homo sapiens
gaggagagcucugggaaca

SEQ ID NO: 681927 - RNA, 19 nt, Homo sapiens
cagagcagauauccuguaa

SEQ ID NO: 681928 - RNA, 19 nt, Homo sapiens
ccaaauugauuaagacaca

SEQ ID NO: 681929 - RNA, 19 nt, Homo sapiens
guucugggauucugucaaa

SEQ ID NO: 681930 - RNA, 19 nt, Homo sapiens
gcuccuaugugaccuggua

SEQ ID NO: 681931 - RNA, 19 nt, Homo sapiens
uggcuuagcugcucuugaa

SEQ ID NO: 681932 - RNA, 19 nt, Homo sapiens
uaacauugaugaugacuac

SEQ ID NO: 681933 - RNA, 19 nt, Homo sapiens
gcaguauccagaacaauaa

SEQ ID NO: 681934 - RNA, 19 nt, Homo sapiens
guguuuacaugauggaaua

SEQ ID NO: 681935 - RNA, 19 nt, Homo sapiens
gaaaaucgauggugucaag

SEQ ID NO: 681936 - RNA, 19 nt, Homo sapiens
ccaaucgauuugacuuuaa

SEQ ID NO: 681937 - RNA, 19 nt, Homo sapiens
ucaaggugaucaagguuaa

SEQ ID NO: 681938 - RNA, 19 nt, Homo sapiens
ggaacagccgcucacaaua

SEQ ID NO: 681939 - RNA, 19 nt, Homo sapiens
cuucaaaggugacuucaga

SEQ ID NO: 681940 - RNA, 19 nt, Homo sapiens
gcuagcuucugcaauguuu

SEQ ID NO: 681941 - RNA, 19 nt, Homo sapiens
ccaaguggcauuacauuga

SEQ ID NO: 681942 - RNA, 19 nt, Homo sapiens
ccacgucccugcacucuca

SEQ ID NO: 681943 - RNA, 19 nt, Homo sapiens
gcacaguggcggcaacauu

SEQ ID NO: 681944 - RNA, 19 nt, Homo sapiens
gcagcaggagcuuauauuu

SEQ ID NO: 681945 - RNA, 19 nt, Homo sapiens
uaaaccaacucuucugcuu

SEQ ID NO: 681946 - RNA, 19 nt, Homo sapiens
ggacacuguucucaaguuc

SEQ ID NO: 681947 - RNA, 19 nt, Homo sapiens
gaacacagaacugaucuca

SEQ ID NO: 681948 - RNA, 19 nt, Homo sapiens
ugaucaagguuaacaaaga

SEQ ID NO: 681949 - RNA, 19 nt, Homo sapiens
gaacuuucauucucauggu

SEQ ID NO: 681950 - RNA, 19 nt, Homo sapiens
cauuugaccugacuuuaga

SEQ ID NO: 681951 - RNA, 19 nt, Homo sapiens
gggcugcaccugaacauuu

SEQ ID NO: 681952 - RNA, 19 nt, Homo sapiens
gcgcagaacagcccagaaa

SEQ ID NO: 681953 - RNA, 19 nt, Homo sapiens
ggcaguauccagaacaaua

SEQ ID NO: 681954 - RNA, 19 nt, Homo sapiens
caagaccguucucuccaaa

SEQ ID NO: 681955 - RNA, 19 nt, Homo sapiens
gaucuggugcuccaaauug

SEQ ID NO: 681956 - RNA, 19 nt, Homo sapiens
gaaaugaauacuugagcuu

SEQ ID NO: 681957 - RNA, 19 nt, Homo sapiens
ucuaaggacuucacccaaa

SEQ ID NO: 681958 - RNA, 19 nt, Homo sapiens
ugagauggcccacugcuuu

SEQ ID NO: 681959 - RNA, 19 nt, Homo sapiens
cagcaggacucuucucaca

SEQ ID NO: 681960 - RNA, 19 nt, Homo sapiens
gacauggaccuacugcaua

SEQ ID NO: 681961 - RNA, 19 nt, Homo sapiens
gacgacagguggcaacaau

SEQ ID NO: 681962 - RNA, 19 nt, Homo sapiens
acauggaccuacugcauaa

SEQ ID NO: 681963 - RNA, 19 nt, Homo sapiens
ggaaugaugacaacaaucu

SEQ ID NO: 681964 - RNA, 19 nt, Homo sapiens
ccacugugcuggcccucua

SEQ ID NO: 681965 - RNA, 19 nt, Homo sapiens
ccaucagccuggauucuuu

SEQ ID NO: 681966 - RNA, 19 nt, Homo sapiens
gggaacagccgcucacaau

SEQ ID NO: 681967 - RNA, 19 nt, Homo sapiens
caaggcgaguggauaauuc

SEQ ID NO: 681968 - RNA, 19 nt, Homo sapiens
uauaggugguuacuugaaa

SEQ ID NO: 681969 - RNA, 19 nt, Homo sapiens
guaaggaugcggaaggauu

SEQ ID NO: 681970 - RNA, 19 nt, Homo sapiens
aaacuccucuccuggauca

SEQ ID NO: 681971 - RNA, 19 nt, Homo sapiens
ggagguagaagccaucaug

SEQ ID NO: 681972 - RNA, 19 nt, Homo sapiens
aaccugaccucaaggauau

SEQ ID NO: 681973 - RNA, 19 nt, Homo sapiens
ggucaagccugcuagaacu

SEQ ID NO: 681974 - RNA, 19 nt, Homo sapiens
cuuuaaagcugcugagaug

SEQ ID NO: 681975 - RNA, 19 nt, Homo sapiens
ugucaaugcuggaguuaga

SEQ ID NO: 681976 - RNA, 19 nt, Homo sapiens
cagaugauccgagaacuuu

SEQ ID NO: 681977 - RNA, 19 nt, Homo sapiens
ggucagguuuggagaguuc

SEQ ID NO: 681978 - RNA, 19 nt, Homo sapiens
ucacuugcccugacgagua

SEQ ID NO: 681979 - RNA, 19 nt, Homo sapiens
gaaauuggaaauggucuug

SEQ ID NO: 681980 - RNA, 19 nt, Homo sapiens
gaugacaacaaucucaauu

SEQ ID NO: 681981 - RNA, 19 nt, Homo sapiens
ucauaggccugaugucaau

SEQ ID NO: 681982 - RNA, 19 nt, Homo sapiens
uuaaagaccgccacucauu

SEQ ID NO: 681983 - RNA, 19 nt, Homo sapiens
cagccuaaauacuugcuuu

SEQ ID NO: 681984 - RNA, 19 nt, Homo sapiens
acaaggagccacaggauug

SEQ ID NO: 681985 - RNA, 19 nt, Homo sapiens
ccagcgcgcucgucauuuc

SEQ ID NO: 681986 - RNA, 19 nt, Homo sapiens
agaagaagguggucaucug

SEQ ID NO: 681987 - RNA, 19 nt, Homo sapiens
uggcauagccucuccaaga

SEQ ID NO: 681988 - RNA, 19 nt, Homo sapiens
ugacuacucaccaccauuu

SEQ ID NO: 681989 - RNA, 19 nt, Homo sapiens
uugcugagcuguucacugu

SEQ ID NO: 681990 - RNA, 19 nt, Homo sapiens
gaaagaggugguuacuuca

SEQ ID NO: 681991 - RNA, 19 nt, Homo sapiens
gaaaggagucaccggauac

SEQ ID NO: 681992 - RNA, 19 nt, Homo sapiens
guguuaaagucacaaucua

SEQ ID NO: 681993 - RNA, 19 nt, Homo sapiens
gcacaaccauucugaaguu

SEQ ID NO: 681994 - RNA, 19 nt, Homo sapiens
ggacuuagaugcccagaug

SEQ ID NO: 681995 - RNA, 19 nt, Homo sapiens
gaagguggauucuaggaaa

SEQ ID NO: 681996 - RNA, 19 nt, Homo sapiens
ggacuagcccugcuguuua

SEQ ID NO: 681997 - RNA, 19 nt, Homo sapiens
ggaaugggagguuggauua

SEQ ID NO: 681998 - RNA, 19 nt, Homo sapiens
gauccaggcugucauguga

SEQ ID NO: 681999 - RNA, 19 nt, Homo sapiens
gaacuucugugagcaggua

SEQ ID NO: 682000 - RNA, 19 nt, Homo sapiens
ggaccuggcuggaaucuuc

SEQ ID NO: 682001 - RNA, 19 nt, Homo sapiens
gaccagacguuucauucua

SEQ ID NO: 682002 - RNA, 19 nt, Homo sapiens
cgacugagguguucaaauc

SEQ ID NO: 682003 - RNA, 19 nt, Homo sapiens
ggaauuagaccuuugguau

SEQ ID NO: 682004 - RNA, 19 nt, Homo sapiens
gagacucccuccucuguaa

SEQ ID NO: 682005 - RNA, 19 nt, Homo sapiens
ugaagaagaucccugaaga

SEQ ID NO: 682006 - RNA, 19 nt, Homo sapiens
cagaagaggacaugaauaa

SEQ ID NO: 682007 - RNA, 19 nt, Homo sapiens
acaauaaaguccacuagaa

SEQ ID NO: 682008 - RNA, 19 nt, Homo sapiens
gaacaacaccgucaucgau

SEQ ID NO: 682009 - RNA, 19 nt, Homo sapiens
gcaggucccuuucuacugu

SEQ ID NO: 682010 - RNA, 19 nt, Homo sapiens
ccucaaaccugaucggaaa

SEQ ID NO: 682011 - RNA, 19 nt, Homo sapiens
ggacagaccagacguuuca

SEQ ID NO: 682012 - RNA, 19 nt, Homo sapiens
agaaggagcugcaggauag

SEQ ID NO: 682013 - RNA, 19 nt, Homo sapiens
ggacugagccuacggaaag

SEQ ID NO: 682014 - RNA, 19 nt, Homo sapiens
guuaggagcuacuuccaaa

SEQ ID NO: 682015 - RNA, 19 nt, Homo sapiens
uaagauagccacaaucaga

SEQ ID NO: 682016 - RNA, 19 nt, Homo sapiens
gcacagacucccugagaaa

SEQ ID NO: 682017 - RNA, 19 nt, Homo sapiens
ggccugaccuuuaacaaga

SEQ ID NO: 682018 - RNA, 19 nt, Homo sapiens
uggcauguguuguguauuu

SEQ ID NO: 682019 - RNA, 19 nt, Homo sapiens
gaagaggacaugaauaagu

SEQ ID NO: 682020 - RNA, 19 nt, Homo sapiens
guuggugccuaaucacuua

SEQ ID NO: 682021 - RNA, 19 nt, Homo sapiens
gcagaauugucacuguuug

SEQ ID NO: 682022 - RNA, 19 nt, Homo sapiens
caauaaaguccacuagaaa

SEQ ID NO: 682023 - RNA, 19 nt, Homo sapiens
ggaaggagaggcuuggaaa

SEQ ID NO: 682024 - RNA, 19 nt, Homo sapiens
gcacuaaggacacaagaau

SEQ ID NO: 682025 - RNA, 19 nt, Homo sapiens
gaugagaggugaaauugac

SEQ ID NO: 682026 - RNA, 19 nt, Homo sapiens
ugacuguucuugacuaaau

SEQ ID NO: 682027 - RNA, 19 nt, Homo sapiens
ggaagugaguuucuuugca

SEQ ID NO: 682028 - RNA, 19 nt, Homo sapiens
ggaacgagcaggugauaau

SEQ ID NO: 682029 - RNA, 19 nt, Homo sapiens
gacauucacucuggacaaa

SEQ ID NO: 682030 - RNA, 19 nt, Homo sapiens
gaugcaggccugaccuuua

SEQ ID NO: 682031 - RNA, 19 nt, Homo sapiens
gauggugucuccuuaaguc

SEQ ID NO: 682032 - RNA, 19 nt, Homo sapiens
uggaaagccuugugucuug

SEQ ID NO: 682033 - RNA, 19 nt, Homo sapiens
gcacaauacagaauucaga

SEQ ID NO: 682034 - RNA, 19 nt, Homo sapiens
uagcuugacuuuagugguu

SEQ ID NO: 682035 - RNA, 19 nt, Homo sapiens
ggcagaagaugaaggacaa

SEQ ID NO: 682036 - RNA, 19 nt, Homo sapiens
gcaacacccucccugcaau

SEQ ID NO: 682037 - RNA, 19 nt, Homo sapiens
gcaaagccaacaccacuug

SEQ ID NO: 682038 - RNA, 19 nt, Homo sapiens
ggacagcaccaauucugaa

SEQ ID NO: 682039 - RNA, 19 nt, Homo sapiens
ucaaguccauggcuucuau

SEQ ID NO: 682040 - RNA, 19 nt, Homo sapiens
agaauuauuucacgcagaa

SEQ ID NO: 682041 - RNA, 19 nt, Homo sapiens
ccuccuagcuugacuuuag

SEQ ID NO: 682042 - RNA, 19 nt, Homo sapiens
aaaccaaaguggauaaugg

SEQ ID NO: 682043 - RNA, 19 nt, Homo sapiens
gcaauagagagacaaguga

SEQ ID NO: 682044 - RNA, 19 nt, Homo sapiens
gagcacagacucccugaga

SEQ ID NO: 682045 - RNA, 19 nt, Homo sapiens
gaugagcggugacccagau

SEQ ID NO: 682046 - RNA, 19 nt, Homo sapiens
ugagaacgaugagaaauag

SEQ ID NO: 682047 - RNA, 19 nt, Homo sapiens
gugagaacgaugagaaaua

SEQ ID NO: 682048 - RNA, 19 nt, Homo sapiens
gaccuucucccugaacuua

SEQ ID NO: 682049 - RNA, 19 nt, Homo sapiens
gaacgagcaggugauaauu

SEQ ID NO: 682050 - RNA, 19 nt, Homo sapiens
cagcagagaccgccaauca

SEQ ID NO: 682051 - RNA, 19 nt, Homo sapiens
ggacaggaguguguucaag

SEQ ID NO: 682052 - RNA, 19 nt, Homo sapiens
ggagaaagcagggcagaau

SEQ ID NO: 682053 - RNA, 19 nt, Homo sapiens
gcaccggcagcguugauua

SEQ ID NO: 682054 - RNA, 19 nt, Homo sapiens
ucacuuggcuacccaucaa

SEQ ID NO: 682055 - RNA, 19 nt, Homo sapiens
caacucuguucacguuuga

SEQ ID NO: 682056 - RNA, 19 nt, Homo sapiens
ccagaucuguggcuucaau

SEQ ID NO: 682057 - RNA, 19 nt, Homo sapiens
gaaguggugggaugaagaa

SEQ ID NO: 682058 - RNA, 19 nt, Homo sapiens
caagugagaacgaugagaa

SEQ ID NO: 682059 - RNA, 19 nt, Homo sapiens
gaaaaggccuggaagaaac

SEQ ID NO: 682060 - RNA, 19 nt, Homo sapiens
cagggaagguggauucuag

SEQ ID NO: 682061 - RNA, 19 nt, Homo sapiens
cuacuugugucuugaaauc

SEQ ID NO: 682062 - RNA, 19 nt, Homo sapiens
gaugagaaauagggagaug

SEQ ID NO: 682063 - RNA, 19 nt, Homo sapiens
uugaaaggccaucagauua

SEQ ID NO: 682064 - RNA, 19 nt, Homo sapiens
ccaaagggccugggaguug

SEQ ID NO: 682065 - RNA, 19 nt, Homo sapiens
gcagagaccgccaaucagu

SEQ ID NO: 682066 - RNA, 19 nt, Homo sapiens
gaucaguggucaaguccau

SEQ ID NO: 682067 - RNA, 19 nt, Homo sapiens
aagaggacaugaauaagug

SEQ ID NO: 682068 - RNA, 19 nt, Homo sapiens
gaagcccagucuugaguuc

SEQ ID NO: 682069 - RNA, 19 nt, Homo sapiens
gguggcauguguuguguau

SEQ ID NO: 682070 - RNA, 19 nt, Homo sapiens
ggagagcgacugagguguu

SEQ ID NO: 682071 - RNA, 19 nt, Homo sapiens
gaguggaccuggcuggaau

SEQ ID NO: 682072 - RNA, 19 nt, Homo sapiens
ggaaguacuuagggagguu

SEQ ID NO: 682073 - RNA, 19 nt, Homo sapiens
cgagacagauaaugaggau

SEQ ID NO: 682074 - RNA, 19 nt, Homo sapiens
ugccuaaucacuuaaguua

SEQ ID NO: 682075 - RNA, 19 nt, Homo sapiens
gggacuagcccugcuguuu

SEQ ID NO: 682076 - RNA, 19 nt, Homo sapiens
gaucagggaagguggauuc

SEQ ID NO: 682077 - RNA, 19 nt, Homo sapiens
gaacuuaagauagccacaa

SEQ ID NO: 682078 - RNA, 19 nt, Homo sapiens
gaucggacagcaccaauuc

SEQ ID NO: 682079 - RNA, 19 nt, Homo sapiens
gcuccgagacagauaauga

SEQ ID NO: 682080 - RNA, 19 nt, Homo sapiens
ggaaggaugagaggugaaa

SEQ ID NO: 682081 - RNA, 19 nt, Homo sapiens
gaagucgggcacagaggua

SEQ ID NO: 682082 - RNA, 19 nt, Homo sapiens
gugccaagcugugaugaga

SEQ ID NO: 682083 - RNA, 19 nt, Homo sapiens
acaacuaugugcccaugaa

SEQ ID NO: 682084 - RNA, 19 nt, Homo sapiens
ccaacucuguucacguuug

SEQ ID NO: 682085 - RNA, 19 nt, Homo sapiens
augcaggccugaccuuuaa

SEQ ID NO: 682086 - RNA, 19 nt, Homo sapiens
gcugucaugugauuuaugg

SEQ ID NO: 682087 - RNA, 19 nt, Homo sapiens
gacuagcccugcuguuuag

SEQ ID NO: 682088 - RNA, 19 nt, Homo sapiens
gaauuagaccuuugguauc

SEQ ID NO: 682089 - RNA, 19 nt, Homo sapiens
gugcagaggcagaagauga

SEQ ID NO: 682090 - RNA, 19 nt, Homo sapiens
ucacagcccucagcuaucu

SEQ ID NO: 682091 - RNA, 19 nt, Homo sapiens
gaacuaugucccuaugcaa

SEQ ID NO: 682092 - RNA, 19 nt, Homo sapiens
gcuugcaggucccuuucua

SEQ ID NO: 682093 - RNA, 19 nt, Homo sapiens
gcacaaccauucugaaguu

SEQ ID NO: 682094 - RNA, 19 nt, Homo sapiens
ggacuuagaugcccagaug

SEQ ID NO: 682095 - RNA, 19 nt, Homo sapiens
gaagguggauucuaggaaa

SEQ ID NO: 682096 - RNA, 19 nt, Homo sapiens
ggacuagcccugcuguuua

SEQ ID NO: 682097 - RNA, 19 nt, Homo sapiens
ggaaugggagguuggauua

SEQ ID NO: 682098 - RNA, 19 nt, Homo sapiens
gauccaggcugucauguga

SEQ ID NO: 682099 - RNA, 19 nt, Homo sapiens
gaacuucugugagcaggua

SEQ ID NO: 682100 - RNA, 19 nt, Homo sapiens
ggaaaucgccucccgagaa

SEQ ID NO: 682101 - RNA, 19 nt, Homo sapiens
ggaccuggcuggaaucuuc

SEQ ID NO: 682102 - RNA, 19 nt, Homo sapiens
gaccagacguuucauucua

SEQ ID NO: 682103 - RNA, 19 nt, Homo sapiens
cgacugagguguucaaauc

SEQ ID NO: 682104 - RNA, 19 nt, Homo sapiens
gagacucccuccucuguaa

SEQ ID NO: 682105 - RNA, 19 nt, Homo sapiens
cagaagaggacaugaauaa

SEQ ID NO: 682106 - RNA, 19 nt, Homo sapiens
acaauaaaguccacuagaa

SEQ ID NO: 682107 - RNA, 19 nt, Homo sapiens
gaacaacaccgucaucgau

SEQ ID NO: 682108 - RNA, 19 nt, Homo sapiens
gcaggucccuuucuacugu

SEQ ID NO: 682109 - RNA, 19 nt, Homo sapiens
ccucaaaccugaucggaaa

SEQ ID NO: 682110 - RNA, 19 nt, Homo sapiens
ggacagaccagacguuuca

SEQ ID NO: 682111 - RNA, 19 nt, Homo sapiens
agaaggagcugcaggauag

SEQ ID NO: 682112 - RNA, 19 nt, Homo sapiens
ggacugagccuacggaaag

SEQ ID NO: 682113 - RNA, 19 nt, Homo sapiens
guuaggagcuacuuccaaa

SEQ ID NO: 682114 - RNA, 19 nt, Homo sapiens
uaagauagccacaaucaga

SEQ ID NO: 682115 - RNA, 19 nt, Homo sapiens
gcacagacucccugagaaa

SEQ ID NO: 682116 - RNA, 19 nt, Homo sapiens
ggccugaccuuuaacaaga

SEQ ID NO: 682117 - RNA, 19 nt, Homo sapiens
uggcauguguuguguauuu

SEQ ID NO: 682118 - RNA, 19 nt, Homo sapiens
gaaaucgccucccgagaag

SEQ ID NO: 682119 - RNA, 19 nt, Homo sapiens
gaagaggacaugaauaagu

SEQ ID NO: 682120 - RNA, 19 nt, Homo sapiens
guuggugccuaaucacuua

SEQ ID NO: 682121 - RNA, 19 nt, Homo sapiens
gcagaauugucacuguuug

SEQ ID NO: 682122 - RNA, 19 nt, Homo sapiens
caauaaaguccacuagaaa

SEQ ID NO: 682123 - RNA, 19 nt, Homo sapiens
ggaaggagaggcuuggaaa

SEQ ID NO: 682124 - RNA, 19 nt, Homo sapiens
gcacuaaggacacaagaau

SEQ ID NO: 682125 - RNA, 19 nt, Homo sapiens
gaugagaggugaaauugac

SEQ ID NO: 682126 - RNA, 19 nt, Homo sapiens
ugacuguucuugacuaaau

SEQ ID NO: 682127 - RNA, 19 nt, Homo sapiens
ggaagugaguuucuuugca

SEQ ID NO: 682128 - RNA, 19 nt, Homo sapiens
ggaacgagcaggugauaau

SEQ ID NO: 682129 - RNA, 19 nt, Homo sapiens
gacauucacucuggacaaa

SEQ ID NO: 682130 - RNA, 19 nt, Homo sapiens
gaugcaggccugaccuuua

SEQ ID NO: 682131 - RNA, 19 nt, Homo sapiens
gauggugucuccuuaaguc

SEQ ID NO: 682132 - RNA, 19 nt, Homo sapiens
uggaaagccuugugucuug

SEQ ID NO: 682133 - RNA, 19 nt, Homo sapiens
gcacaauacagaauucaga

SEQ ID NO: 682134 - RNA, 19 nt, Homo sapiens
uagcuugacuuuagugguu

SEQ ID NO: 682135 - RNA, 19 nt, Homo sapiens
ggcagaagaugaaggacaa

SEQ ID NO: 682136 - RNA, 19 nt, Homo sapiens
gcaacacccucccugcaau

SEQ ID NO: 682137 - RNA, 19 nt, Homo sapiens
gcaaagccaacaccacuug

SEQ ID NO: 682138 - RNA, 19 nt, Homo sapiens
ggacagcaccaauucugaa

SEQ ID NO: 682139 - RNA, 19 nt, Homo sapiens
ucaaguccauggcuucuau

SEQ ID NO: 682140 - RNA, 19 nt, Homo sapiens
agaauuauuucacgcagaa

SEQ ID NO: 682141 - RNA, 19 nt, Homo sapiens
ccuccuagcuugacuuuag

SEQ ID NO: 682142 - RNA, 19 nt, Homo sapiens
aaaccaaaguggauaaugg

SEQ ID NO: 682143 - RNA, 19 nt, Homo sapiens
gaugagcggugacccagau

SEQ ID NO: 682144 - RNA, 19 nt, Homo sapiens
gagcacagacucccugaga

SEQ ID NO: 682145 - RNA, 19 nt, Homo sapiens
ugagaacgaugagaaauag

SEQ ID NO: 682146 - RNA, 19 nt, Homo sapiens
gugagaacgaugagaaaua

SEQ ID NO: 682147 - RNA, 19 nt, Homo sapiens
gaccuucucccugaacuua

SEQ ID NO: 682148 - RNA, 19 nt, Homo sapiens
gaacgagcaggugauaauu

SEQ ID NO: 682149 - RNA, 19 nt, Homo sapiens
cagcagagaccgccaauca

SEQ ID NO: 682150 - RNA, 19 nt, Homo sapiens
ggacaggaguguguucaag

SEQ ID NO: 682151 - RNA, 19 nt, Homo sapiens
ggagaaagcagggcagaau

SEQ ID NO: 682152 - RNA, 19 nt, Homo sapiens
gcaccggcagcguugauua

SEQ ID NO: 682153 - RNA, 19 nt, Homo sapiens
ucacuuggcuacccaucaa

SEQ ID NO: 682154 - RNA, 19 nt, Homo sapiens
caacucuguucacguuuga

SEQ ID NO: 682155 - RNA, 19 nt, Homo sapiens
ccagaucuguggcuucaau

SEQ ID NO: 682156 - RNA, 19 nt, Homo sapiens
caagugagaacgaugagaa

SEQ ID NO: 682157 - RNA, 19 nt, Homo sapiens
cagggaagguggauucuag

SEQ ID NO: 682158 - RNA, 19 nt, Homo sapiens
cuacuugugucuugaaauc

SEQ ID NO: 682159 - RNA, 19 nt, Homo sapiens
gaugagaaauagggagaug

SEQ ID NO: 682160 - RNA, 19 nt, Homo sapiens
uugaaaggccaucagauua

SEQ ID NO: 682161 - RNA, 19 nt, Homo sapiens
ccaaagggccugggaguug

SEQ ID NO: 682162 - RNA, 19 nt, Homo sapiens
gcagagaccgccaaucagu

SEQ ID NO: 682163 - RNA, 19 nt, Homo sapiens
gaucaguggucaaguccau

SEQ ID NO: 682164 - RNA, 19 nt, Homo sapiens
aagaggacaugaauaagug

SEQ ID NO: 682165 - RNA, 19 nt, Homo sapiens
gaagcccagucuugaguuc

SEQ ID NO: 682166 - RNA, 19 nt, Homo sapiens
gguggcauguguuguguau

SEQ ID NO: 682167 - RNA, 19 nt, Homo sapiens
ggagagcgacugagguguu

SEQ ID NO: 682168 - RNA, 19 nt, Homo sapiens
gaguggaccuggcuggaau

SEQ ID NO: 682169 - RNA, 19 nt, Homo sapiens
ggaaguacuuagggagguu

SEQ ID NO: 682170 - RNA, 19 nt, Homo sapiens
cgagacagauaaugaggau

SEQ ID NO: 682171 - RNA, 19 nt, Homo sapiens
ugccuaaucacuuaaguua

SEQ ID NO: 682172 - RNA, 19 nt, Homo sapiens
gggacuagcccugcuguuu

SEQ ID NO: 682173 - RNA, 19 nt, Homo sapiens
gaucagggaagguggauuc

SEQ ID NO: 682174 - RNA, 19 nt, Homo sapiens
gaacuuaagauagccacaa

SEQ ID NO: 682175 - RNA, 19 nt, Homo sapiens
gaucggacagcaccaauuc

SEQ ID NO: 682176 - RNA, 19 nt, Homo sapiens
gcuccgagacagauaauga

SEQ ID NO: 682177 - RNA, 19 nt, Homo sapiens
ggaaggaugagaggugaaa

SEQ ID NO: 682178 - RNA, 19 nt, Homo sapiens
augcaggccugaccuuuaa

SEQ ID NO: 682179 - RNA, 19 nt, Homo sapiens
gaagucgggcacagaggua

SEQ ID NO: 682180 - RNA, 19 nt, Homo sapiens
gugccaagcugugaugaga

SEQ ID NO: 682181 - RNA, 19 nt, Homo sapiens
acaacuaugugcccaugaa

SEQ ID NO: 682182 - RNA, 19 nt, Homo sapiens
ccaacucuguucacguuug

SEQ ID NO: 682183 - RNA, 19 nt, Homo sapiens
gcugucaugugauuuaugg

SEQ ID NO: 682184 - RNA, 19 nt, Homo sapiens
gacuagcccugcuguuuag

SEQ ID NO: 682185 - RNA, 19 nt, Homo sapiens
gugcagaggcagaagauga

SEQ ID NO: 682186 - RNA, 19 nt, Homo sapiens
ucacagcccucagcuaucu

SEQ ID NO: 682187 - RNA, 19 nt, Homo sapiens
gaacuaugucccuaugcaa

SEQ ID NO: 682188 - RNA, 19 nt, Homo sapiens
gcuugcaggucccuuucua

SEQ ID NO: 682189 - RNA, 19 nt, Homo sapiens
agacagagacuucaaaugc

SEQ ID NO: 682190 - RNA, 19 nt, Homo sapiens
gaggauguguacaccuuca

SEQ ID NO: 682191 - RNA, 19 nt, Homo sapiens
gacaauaaaguccacuaga

SEQ ID NO: 682192 - RNA, 19 nt, Homo sapiens
guucuugucuuguuaccau

SEQ ID NO: 682193 - RNA, 19 nt, Homo sapiens
gaaagucacuguuuaaguu

SEQ ID NO: 682194 - RNA, 19 nt, Homo sapiens
caacgaagcugcuguuaaa

SEQ ID NO: 682195 - RNA, 19 nt, Homo sapiens
guauaggucugcuacaaua

SEQ ID NO: 682196 - RNA, 19 nt, Homo sapiens
gaauagcacuuuaauaguc

SEQ ID NO: 682197 - RNA, 19 nt, Homo sapiens
gaaggugucuaugugauaa

SEQ ID NO: 682198 - RNA, 19 nt, Homo sapiens
ccaagaggguggacaguuu

SEQ ID NO: 682199 - RNA, 19 nt, Homo sapiens
ccaugaaagucacuguuua

SEQ ID NO: 682200 - RNA, 19 nt, Homo sapiens
ccaccgagcuaacaucuga

SEQ ID NO: 682201 - RNA, 19 nt, Homo sapiens
gggaugaggucuacacaau

SEQ ID NO: 682202 - RNA, 19 nt, Homo sapiens
cgaaagccaugucuaauac

SEQ ID NO: 682203 - RNA, 19 nt, Homo sapiens
guaguuacgaggcuuguua

SEQ ID NO: 682204 - RNA, 19 nt, Homo sapiens
caagucacauuacauuugu

SEQ ID NO: 682205 - RNA, 19 nt, Homo sapiens
gcugaucucugccaaauac

SEQ ID NO: 682206 - RNA, 19 nt, Homo sapiens
gaaaagcuaugcauaucaa

SEQ ID NO: 682207 - RNA, 19 nt, Homo sapiens
gagcagccaucuaaagaag

SEQ ID NO: 682208 - RNA, 19 nt, Homo sapiens
uguaagauauucugaguuc

SEQ ID NO: 682209 - RNA, 19 nt, Homo sapiens
gcaaagaguacaccacugu

SEQ ID NO: 682210 - RNA, 19 nt, Homo sapiens
cggaauagcacuuuaauag

SEQ ID NO: 682211 - RNA, 19 nt, Homo sapiens
cgagcaaccucagcaaauu

SEQ ID NO: 682212 - RNA, 19 nt, Homo sapiens
gggcugauaucuacaaguc

SEQ ID NO: 682213 - RNA, 19 nt, Homo sapiens
gcagaaggcauuugagauc

SEQ ID NO: 682214 - RNA, 19 nt, Homo sapiens
guguuuaccugucugauug

SEQ ID NO: 682215 - RNA, 19 nt, Homo sapiens
gaccgaaggugcagagaag

SEQ ID NO: 682216 - RNA, 19 nt, Homo sapiens
ggccaucaaugaguucuuu

SEQ ID NO: 682217 - RNA, 19 nt, Homo sapiens
caaagucacccaguucaaa

SEQ ID NO: 682218 - RNA, 19 nt, Homo sapiens
cuacaagucacauuacauu

SEQ ID NO: 682219 - RNA, 19 nt, Homo sapiens
uacaucauccuccaaauaa

SEQ ID NO: 682220 - RNA, 19 nt, Homo sapiens
uuacaucauccuccaaaua

SEQ ID NO: 682221 - RNA, 19 nt, Homo sapiens
ggaauagcacuuuaauagu

SEQ ID NO: 682222 - RNA, 19 nt, Homo sapiens
caugaaagucacuguuuaa

SEQ ID NO: 682223 - RNA, 19 nt, Homo sapiens
uuacgaggcuuguuauuuu

SEQ ID NO: 682224 - RNA, 19 nt, Homo sapiens
uuacgaaagccaugucuaa

SEQ ID NO: 682225 - RNA, 19 nt, Homo sapiens
gcaugcagaugaccaagag

SEQ ID NO: 682226 - RNA, 19 nt, Homo sapiens
ggacuaucauggaggagau

SEQ ID NO: 682227 - RNA, 19 nt, Homo sapiens
cgaagcugcuguuaaacga

SEQ ID NO: 682228 - RNA, 19 nt, Homo sapiens
uaccagggcugauaucuac

SEQ ID NO: 682229 - RNA, 19 nt, Homo sapiens
gaaucaaagggaagaaaga

SEQ ID NO: 682230 - RNA, 19 nt, Homo sapiens
agaaggccaucaaugaguu

SEQ ID NO: 682231 - RNA, 19 nt, Homo sapiens
gaauugauaccagacagaa

SEQ ID NO: 682232 - RNA, 19 nt, Homo sapiens
acgaaagccaugucuaaua

SEQ ID NO: 682233 - RNA, 19 nt, Homo sapiens
auuaugaacugcaggacua

SEQ ID NO: 682234 - RNA, 19 nt, Homo sapiens
ccaacgaagcugcuguuaa

SEQ ID NO: 682235 - RNA, 19 nt, Homo sapiens
gagcaaccucagcaaauug

SEQ ID NO: 682236 - RNA, 19 nt, Homo sapiens
caucaucaccuccgccaaa

SEQ ID NO: 682237 - RNA, 19 nt, Homo sapiens
guuacgaggcuuguuauuu

SEQ ID NO: 682238 - RNA, 19 nt, Homo sapiens
guaccagggcugauaucua

SEQ ID NO: 682239 - RNA, 19 nt, Homo sapiens
acacguaccucagagacuu

SEQ ID NO: 682240 - RNA, 19 nt, Homo sapiens
gaugaggucuacacaaucc

SEQ ID NO: 682241 - RNA, 19 nt, Homo sapiens
gaacugcaggacuaucaug

SEQ ID NO: 682242 - RNA, 19 nt, Homo sapiens
gagaaggccaucaaugagu

SEQ ID NO: 682243 - RNA, 19 nt, Homo sapiens
acaagucacauuacauuug

SEQ ID NO: 682244 - RNA, 19 nt, Homo sapiens
ucagggugcagaauugaua

SEQ ID NO: 682245 - RNA, 19 nt, Homo sapiens
ccacggugacugaaucaaa

SEQ ID NO: 682246 - RNA, 19 nt, Homo sapiens
cugagaaggccaucaauga

SEQ ID NO: 682247 - RNA, 19 nt, Homo sapiens
aagcugcuguuaaacgaaa

SEQ ID NO: 682248 - RNA, 19 nt, Homo sapiens
cagaaggugucuaugugau

SEQ ID NO: 682249 - RNA, 19 nt, Homo sapiens
ccacaccacccaugaaagu

SEQ ID NO: 682250 - RNA, 19 nt, Homo sapiens
guccuuauguuucccuaga

SEQ ID NO: 682251 - RNA, 19 nt, Homo sapiens
ugcaguuucuucucaguuu

SEQ ID NO: 682252 - RNA, 19 nt, Homo sapiens
gugaaugggacuggaauuu

SEQ ID NO: 682253 - RNA, 19 nt, Homo sapiens
ccaucaaggugucaguuca

SEQ ID NO: 682254 - RNA, 19 nt, Homo sapiens
ggaccgaaggugcagagaa

SEQ ID NO: 682255 - RNA, 19 nt, Homo sapiens
uagagaagggugcgagaaa

SEQ ID NO: 682256 - RNA, 19 nt, Homo sapiens
guuaaacgaaacugagaaa

SEQ ID NO: 682257 - RNA, 19 nt, Homo sapiens
ucacauuacauuugucaug

SEQ ID NO: 682258 - RNA, 19 nt, Homo sapiens
acaucagggugcagaauug

SEQ ID NO: 682259 - RNA, 19 nt, Homo sapiens
gagaagggugcgagaaaca

SEQ ID NO: 682260 - RNA, 19 nt, Homo sapiens
ucucaucccuuagguagga

SEQ ID NO: 682261 - RNA, 19 nt, Homo sapiens
ccucugccgccucucauua

SEQ ID NO: 682262 - RNA, 19 nt, Homo sapiens
gcagccaucuaaagaagac

SEQ ID NO: 682263 - RNA, 19 nt, Homo sapiens
guguguggcuucuaacauc

SEQ ID NO: 682264 - RNA, 19 nt, Homo sapiens
gaacaucaccaagguaucc

SEQ ID NO: 682265 - RNA, 19 nt, Homo sapiens
gcauugcuuuuccuuuuaa

SEQ ID NO: 682266 - RNA, 19 nt, Homo sapiens
gaacccacggugacugaau

SEQ ID NO: 682267 - RNA, 19 nt, Homo sapiens
ucucagaccgagguaaaua

SEQ ID NO: 682268 - RNA, 19 nt, Homo sapiens
agaaggugucuaugugaua

SEQ ID NO: 682269 - RNA, 19 nt, Homo sapiens
cuguugagguaccagauaa

SEQ ID NO: 682270 - RNA, 19 nt, Homo sapiens
aaguauaggucugcuacaa

SEQ ID NO: 682271 - RNA, 19 nt, Homo sapiens
caagaggguggacaguuug

SEQ ID NO: 682272 - RNA, 19 nt, Homo sapiens
ccaaauaaagacugauucu

SEQ ID NO: 682273 - RNA, 19 nt, Homo sapiens
acaccugcauuauuuacga

SEQ ID NO: 682274 - RNA, 19 nt, Homo sapiens
cucuagagcuugccaaagu

SEQ ID NO: 682275 - RNA, 19 nt, Homo sapiens
ccucagagacuuugguauc

SEQ ID NO: 682276 - RNA, 19 nt, Homo sapiens
gaagggugcgagaaacauc

SEQ ID NO: 682277 - RNA, 19 nt, Homo sapiens
gucaugguccucaauauca

SEQ ID NO: 682278 - RNA, 19 nt, Homo sapiens
ugaaagucacuguuuaagu

SEQ ID NO: 682279 - RNA, 19 nt, Homo sapiens
gggaacccacggugacuga

SEQ ID NO: 682280 - RNA, 19 nt, Homo sapiens
uuacauggacccuaaagca

SEQ ID NO: 682281 - RNA, 19 nt, Homo sapiens
gaaacaucagggugcagaa

SEQ ID NO: 682282 - RNA, 19 nt, Homo sapiens
aguacgcacuugccgcuaa

SEQ ID NO: 682283 - RNA, 19 nt, Homo sapiens
acauggacccuaaagcaaa

SEQ ID NO: 682284 - RNA, 19 nt, Homo sapiens
gcacgagcaaccucagcaa

SEQ ID NO: 682285 - RNA, 19 nt, Homo sapiens
cagagacuuugguaucagu

SEQ ID NO: 682286 - RNA, 19 nt, Homo sapiens
cuagaacacguaccucaga

SEQ ID NO: 682287 - RNA, 19 nt, Homo sapiens
gguggacaguuugaaguca

SEQ ID NO: 682288 - RNA, 19 nt, Homo sapiens
acaucauccuccaaauaaa

SEQ ID NO: 682289 - RNA, 19 nt, Homo sapiens
gaagcugcuguuaaacgaa

SEQ ID NO: 682290 - RNA, 19 nt, Homo sapiens
aagcuaugcauaucaagaa

SEQ ID NO: 682291 - RNA, 19 nt, Homo sapiens
gaacugucggcggaacauu

SEQ ID NO: 682292 - RNA, 19 nt, Homo sapiens
cacggugacugaaucaaag

SEQ ID NO: 682293 - RNA, 19 nt, Homo sapiens
guaaagagcuucaagguaa

SEQ ID NO: 682294 - RNA, 19 nt, Homo sapiens
gcucaaagcugaagaaaug

SEQ ID NO: 682295 - RNA, 19 nt, Homo sapiens
cagaagagcugguagauga

SEQ ID NO: 682296 - RNA, 19 nt, Homo sapiens
aaagauggcucgucaguaa

SEQ ID NO: 682297 - RNA, 19 nt, Homo sapiens
gaacaaaggaacugaauga

SEQ ID NO: 682298 - RNA, 19 nt, Homo sapiens
gaaagauaaucgauacgua

SEQ ID NO: 682299 - RNA, 19 nt, Homo sapiens
caacacaacuugauuaugg

SEQ ID NO: 682300 - RNA, 19 nt, Homo sapiens
ggaaauguaugaugcaaug

SEQ ID NO: 682301 - RNA, 19 nt, Homo sapiens
ggaagaaacuuaagaacca

SEQ ID NO: 682302 - RNA, 19 nt, Homo sapiens
gaagaaggaccauuuauuc

SEQ ID NO: 682303 - RNA, 19 nt, Homo sapiens
gcaagaagauccucaagag

SEQ ID NO: 682304 - RNA, 19 nt, Homo sapiens
ggaauaagggaacucuuua

SEQ ID NO: 682305 - RNA, 19 nt, Homo sapiens
gggcaguucuguuucauuu

SEQ ID NO: 682306 - RNA, 19 nt, Homo sapiens
gaaggaccauuuauucuag

SEQ ID NO: 682307 - RNA, 19 nt, Homo sapiens
gaacugggcagccuuauuc

SEQ ID NO: 682308 - RNA, 19 nt, Homo sapiens
ggucagaagugucucuauu

SEQ ID NO: 682309 - RNA, 19 nt, Homo sapiens
ggaagaaggaccauuuauu

SEQ ID NO: 682310 - RNA, 19 nt, Homo sapiens
gcaauucccuggaugaaag

SEQ ID NO: 682311 - RNA, 19 nt, Homo sapiens
caggauaggugaccacaaa

SEQ ID NO: 682312 - RNA, 19 nt, Homo sapiens
gagugagcuugauguauua

SEQ ID NO: 682313 - RNA, 19 nt, Homo sapiens
agagugagcuugauguauu

SEQ ID NO: 682314 - RNA, 19 nt, Homo sapiens
ccacuuagcagacaaggua

SEQ ID NO: 682315 - RNA, 19 nt, Homo sapiens
gaaauugacagcaugcaaa

SEQ ID NO: 682316 - RNA, 19 nt, Homo sapiens
agaaccagcugcaguuuaa

SEQ ID NO: 682317 - RNA, 19 nt, Homo sapiens
gaaaggaagaaacuuaaga

SEQ ID NO: 682318 - RNA, 19 nt, Homo sapiens
gagaaaggaagaaacuuaa

SEQ ID NO: 682319 - RNA, 19 nt, Homo sapiens
ccucaaagcucucagaagu

SEQ ID NO: 682320 - RNA, 19 nt, Homo sapiens
gugcgaagauuaugcagaa

SEQ ID NO: 682321 - RNA, 19 nt, Homo sapiens
gaacgucgaauccguauca

SEQ ID NO: 682322 - RNA, 19 nt, Homo sapiens
gaaaggaaggaaucaaaga

SEQ ID NO: 682323 - RNA, 19 nt, Homo sapiens
cuuagaggcugcuacauaa

SEQ ID NO: 682324 - RNA, 19 nt, Homo sapiens
gcagaaagaaugccugaga

SEQ ID NO: 682325 - RNA, 19 nt, Homo sapiens
ggauucagguugcuguuga

SEQ ID NO: 682326 - RNA, 19 nt, Homo sapiens
ccacaugccauuagaauug

SEQ ID NO: 682327 - RNA, 19 nt, Homo sapiens
gaagacuguugccggauga

SEQ ID NO: 682328 - RNA, 19 nt, Homo sapiens
uaagggaacucuuuauaac

SEQ ID NO: 682329 - RNA, 19 nt, Homo sapiens
gacuuucucucaauucgua

SEQ ID NO: 682330 - RNA, 19 nt, Homo sapiens
caaugguucuggaaaugua

SEQ ID NO: 682331 - RNA, 19 nt, Homo sapiens
uguauuagaugcggauaua

SEQ ID NO: 682332 - RNA, 19 nt, Homo sapiens
gggaauaagggaacucuuu

SEQ ID NO: 682333 - RNA, 19 nt, Homo sapiens
ggaaugugcguaagaauca

SEQ ID NO: 682334 - RNA, 19 nt, Homo sapiens
ggaaacaagucgaccuucu

SEQ ID NO: 682335 - RNA, 19 nt, Homo sapiens
gaaacgaagacaauuugaa

SEQ ID NO: 682336 - RNA, 19 nt, Homo sapiens
caagagagacuuagcuaug

SEQ ID NO: 682337 - RNA, 19 nt, Homo sapiens
gaaauaccauguucauucc

SEQ ID NO: 682338 - RNA, 19 nt, Homo sapiens
caacaacauucgucagcuu

SEQ ID NO: 682339 - RNA, 19 nt, Homo sapiens
caagcagccugucagugua

SEQ ID NO: 682340 - RNA, 19 nt, Homo sapiens
uaaagagcuucaagguaaa

SEQ ID NO: 682341 - RNA, 19 nt, Homo sapiens
gaaggaaacaugcagaaag

SEQ ID NO: 682342 - RNA, 19 nt, Homo sapiens
agagaaaggaagaaacuua

SEQ ID NO: 682343 - RNA, 19 nt, Homo sapiens
gaagugucucuauuucaua

SEQ ID NO: 682344 - RNA, 19 nt, Homo sapiens
caacuugauuauggcaaua

SEQ ID NO: 682345 - RNA, 19 nt, Homo sapiens
gcaguaccuucggaucaua

SEQ ID NO: 682346 - RNA, 19 nt, Homo sapiens
cagcaucggugacuacugu

SEQ ID NO: 682347 - RNA, 19 nt, Homo sapiens
uguauagacuccaacaauu

SEQ ID NO: 682348 - RNA, 19 nt, Homo sapiens
ggaacugaaugagcucaaa

SEQ ID NO: 682349 - RNA, 19 nt, Homo sapiens
aaggaaacaugcagaaaga

SEQ ID NO: 682350 - RNA, 19 nt, Homo sapiens
ucacuauuguucuguacua

SEQ ID NO: 682351 - RNA, 19 nt, Homo sapiens
ccaaguacaucaccaaagg

SEQ ID NO: 682352 - RNA, 19 nt, Homo sapiens
cagaagagaugugaaacga

SEQ ID NO: 682353 - RNA, 19 nt, Homo sapiens
gaaacaugcagaaagaaug

SEQ ID NO: 682354 - RNA, 19 nt, Homo sapiens
gcacaauaauagacacaca

SEQ ID NO: 682355 - RNA, 19 nt, Homo sapiens
gaacagaggaaggaucaga

SEQ ID NO: 682356 - RNA, 19 nt, Homo sapiens
gcugaaagagguagacaaa

SEQ ID NO: 682357 - RNA, 19 nt, Homo sapiens
gguuauagauauucugcaa

SEQ ID NO: 682358 - RNA, 19 nt, Homo sapiens
gauaaauugaguccacaua

SEQ ID NO: 682359 - RNA, 19 nt, Homo sapiens
uaaaagaaauccaggaaga

SEQ ID NO: 682360 - RNA, 19 nt, Homo sapiens
ucucagaaguguggacaua

SEQ ID NO: 682361 - RNA, 19 nt, Homo sapiens
gaacaucaucucagaaguc

SEQ ID NO: 682362 - RNA, 19 nt, Homo sapiens
ucagaagugucucuauuuc

SEQ ID NO: 682363 - RNA, 19 nt, Homo sapiens
gacacaaucugguauaaaa

SEQ ID NO: 682364 - RNA, 19 nt, Homo sapiens
gaaagauggcucgucagua

SEQ ID NO: 682365 - RNA, 19 nt, Homo sapiens
gauauucugcaacaaauug

SEQ ID NO: 682366 - RNA, 19 nt, Homo sapiens
ucaaagcucucagaagugu

SEQ ID NO: 682367 - RNA, 19 nt, Homo sapiens
agaaggugcugcccacuga

SEQ ID NO: 682368 - RNA, 19 nt, Homo sapiens
gcaccuaggacccaacuug

SEQ ID NO: 682369 - RNA, 19 nt, Homo sapiens
guucaccucagaauucuua

SEQ ID NO: 682370 - RNA, 19 nt, Homo sapiens
gaucuuacugugccaaauu

SEQ ID NO: 682371 - RNA, 19 nt, Homo sapiens
gaccugggcaguucuguuu

SEQ ID NO: 682372 - RNA, 19 nt, Homo sapiens
ggaaacaugcagaaagaau

SEQ ID NO: 682373 - RNA, 19 nt, Homo sapiens
gagagucaauucuacuaca

SEQ ID NO: 682374 - RNA, 19 nt, Homo sapiens
ccaaggaaauugacagcau

SEQ ID NO: 682375 - RNA, 19 nt, Homo sapiens
ugaaagagguagacaaagc

SEQ ID NO: 682376 - RNA, 19 nt, Homo sapiens
aaaagaaacugucaccaaa

SEQ ID NO: 682377 - RNA, 19 nt, Homo sapiens
ccacaaaauugaagaggua

SEQ ID NO: 682378 - RNA, 19 nt, Homo sapiens
guaaagaugcagauuguag

SEQ ID NO: 682379 - RNA, 19 nt, Homo sapiens
caggauaugugcgaagauu

SEQ ID NO: 682380 - RNA, 19 nt, Homo sapiens
gcaaggauccagccgugaa

SEQ ID NO: 682381 - RNA, 19 nt, Homo sapiens
guauagacuccaacaauug

SEQ ID NO: 682382 - RNA, 19 nt, Homo sapiens
gaagaacaaaggaacugaa

SEQ ID NO: 682383 - RNA, 19 nt, Homo sapiens
gagaaugugccguuuagga

SEQ ID NO: 682384 - RNA, 19 nt, Homo sapiens
gcagagugagcuugaugua

SEQ ID NO: 682385 - RNA, 19 nt, Homo sapiens
uagcuaugcuguccaccua

SEQ ID NO: 682386 - RNA, 19 nt, Homo sapiens
ggauaugugcgaagauuau

SEQ ID NO: 682387 - RNA, 19 nt, Homo sapiens
cagcugcaguuuaauagga

SEQ ID NO: 682388 - RNA, 19 nt, Homo sapiens
caacuuggcgauccgauau

SEQ ID NO: 682389 - RNA, 19 nt, Homo sapiens
cgucauaucccaagagaga

SEQ ID NO: 682390 - RNA, 19 nt, Homo sapiens
cugaagcacucauacaaug

SEQ ID NO: 682391 - RNA, 19 nt, Homo sapiens
gaagaaacuuaagaaccau

SEQ ID NO: 682392 - RNA, 19 nt, Homo sapiens
ggagucuguucgucaaaga

SEQ ID NO: 682393 - RNA, 19 nt, Homo sapiens
cagcagagcuuuauuacuu

SEQ ID NO: 682394 - RNA, 19 nt, Homo sapiens
uaagggcucuguccuguua

SEQ ID NO: 682395 - RNA, 19 nt, Homo sapiens
gcacacaaguagaaauauu

SEQ ID NO: 682396 - RNA, 19 nt, Homo sapiens
gggcuuagcuugcagagaa

SEQ ID NO: 682397 - RNA, 19 nt, Homo sapiens
uagauccucucaaguauua

SEQ ID NO: 682398 - RNA, 19 nt, Homo sapiens
uuuaucagcuugccuauua

SEQ ID NO: 682399 - RNA, 19 nt, Homo sapiens
gcuauaagcuagucuuguu

SEQ ID NO: 682400 - RNA, 19 nt, Homo sapiens
gacgaugucugaacaauug

SEQ ID NO: 682401 - RNA, 19 nt, Homo sapiens
aaacaggacccaauuuaua

SEQ ID NO: 682402 - RNA, 19 nt, Homo sapiens
ggguauugcugcuuuauuu

SEQ ID NO: 682403 - RNA, 19 nt, Homo sapiens
gauaacacauuacugauag

SEQ ID NO: 682404 - RNA, 19 nt, Homo sapiens
gcugaauccuacccaauua

SEQ ID NO: 682405 - RNA, 19 nt, Homo sapiens
aaaggaagcccauacauaa

SEQ ID NO: 682406 - RNA, 19 nt, Homo sapiens
ccaaacugaucacaauuaa

SEQ ID NO: 682407 - RNA, 19 nt, Homo sapiens
acacuaaucuuuggaauga

SEQ ID NO: 682408 - RNA, 19 nt, Homo sapiens
ucagagaaguuguugauga

SEQ ID NO: 682409 - RNA, 19 nt, Homo sapiens
ucacauagcaaguucauaa

SEQ ID NO: 682410 - RNA, 19 nt, Homo sapiens
gggaugaccuugugagaga

SEQ ID NO: 682411 - RNA, 19 nt, Homo sapiens
agaacucagugaagaauua

SEQ ID NO: 682412 - RNA, 19 nt, Homo sapiens
guuccaaaguccugucuua

SEQ ID NO: 682413 - RNA, 19 nt, Homo sapiens
ggacugaccacgacccaua

SEQ ID NO: 682414 - RNA, 19 nt, Homo sapiens
ccauagcacuuguaaauca

SEQ ID NO: 682415 - RNA, 19 nt, Homo sapiens
gcauugauaaguucuguua

SEQ ID NO: 682416 - RNA, 19 nt, Homo sapiens
ggaagucauuagaaucauu

SEQ ID NO: 682417 - RNA, 19 nt, Homo sapiens
caaccugacucaucauuuc

SEQ ID NO: 682418 - RNA, 19 nt, Homo sapiens
uaacaaaacuucaggcaaa

SEQ ID NO: 682419 - RNA, 19 nt, Homo sapiens
ucacagcagagcuuuauua

SEQ ID NO: 682420 - RNA, 19 nt, Homo sapiens
ggaaccaggcuaugacuaa

SEQ ID NO: 682421 - RNA, 19 nt, Homo sapiens
aaacuucuguucaccauga

SEQ ID NO: 682422 - RNA, 19 nt, Homo sapiens
gcaaggcguugacuuaucu

SEQ ID NO: 682423 - RNA, 19 nt, Homo sapiens
ucauagauccucucaagua

SEQ ID NO: 682424 - RNA, 19 nt, Homo sapiens
caagggauagggcagauua

SEQ ID NO: 682425 - RNA, 19 nt, Homo sapiens
agauugcacuccaggauua

SEQ ID NO: 682426 - RNA, 19 nt, Homo sapiens
ccucagugauaacacauua

SEQ ID NO: 682427 - RNA, 19 nt, Homo sapiens
gggcuucuguuggcauuua

SEQ ID NO: 682428 - RNA, 19 nt, Homo sapiens
gcaguaaccugucauucca

SEQ ID NO: 682429 - RNA, 19 nt, Homo sapiens
uaagauagcacacaaguag

SEQ ID NO: 682430 - RNA, 19 nt, Homo sapiens
acucaggacucgucucaua

SEQ ID NO: 682431 - RNA, 19 nt, Homo sapiens
gaagaauuacgaguuagua

SEQ ID NO: 682432 - RNA, 19 nt, Homo sapiens
gcagagcuuuauuacuuga

SEQ ID NO: 682433 - RNA, 19 nt, Homo sapiens
gcuuacauaucuagagaaa

SEQ ID NO: 682434 - RNA, 19 nt, Homo sapiens
gaucauaaauaccauaucc

SEQ ID NO: 682435 - RNA, 19 nt, Homo sapiens
aaaguuacaugucgauuag

SEQ ID NO: 682436 - RNA, 19 nt, Homo sapiens
cuuaaucugugguuacuaa

SEQ ID NO: 682437 - RNA, 19 nt, Homo sapiens
agugaagaauuacgaguua

SEQ ID NO: 682438 - RNA, 19 nt, Homo sapiens
uaaaggcauugauaaguuc

SEQ ID NO: 682439 - RNA, 19 nt, Homo sapiens
uaaauaccauauccgaaug

SEQ ID NO: 682440 - RNA, 19 nt, Homo sapiens
gaacucaggacucgucuca

SEQ ID NO: 682441 - RNA, 19 nt, Homo sapiens
uaaauugacccuuagcuau

SEQ ID NO: 682442 - RNA, 19 nt, Homo sapiens
cccaguagcuuugaauauu

SEQ ID NO: 682443 - RNA, 19 nt, Homo sapiens
gaaacaacauaguggaaaa

SEQ ID NO: 682444 - RNA, 19 nt, Homo sapiens
aaaggacuaugguaaguau

SEQ ID NO: 682445 - RNA, 19 nt, Homo sapiens
gaggaagucauuagaauca

SEQ ID NO: 682446 - RNA, 19 nt, Homo sapiens
uaaucaaccugacucauca

SEQ ID NO: 682447 - RNA, 19 nt, Homo sapiens
aaauugacccuuagcuaua

SEQ ID NO: 682448 - RNA, 19 nt, Homo sapiens
caccauagcacuuguaaau

SEQ ID NO: 682449 - RNA, 19 nt, Homo sapiens
ugggcaaacugacagaaua

SEQ ID NO: 682450 - RNA, 19 nt, Homo sapiens
cauagauccucucaaguau

SEQ ID NO: 682451 - RNA, 19 nt, Homo sapiens
uagaggaagucauuagaau

SEQ ID NO: 682452 - RNA, 19 nt, Homo sapiens
aaacauuucugaguucgaa

SEQ ID NO: 682453 - RNA, 19 nt, Homo sapiens
gaaccaauuugcagaagcu

SEQ ID NO: 682454 - RNA, 19 nt, Homo sapiens
ccuaugauguagauguuaa

SEQ ID NO: 682455 - RNA, 19 nt, Homo sapiens
gcaaacugacagaauacua

SEQ ID NO: 682456 - RNA, 19 nt, Homo sapiens
ccaaaguccugucuuaacu

SEQ ID NO: 682457 - RNA, 19 nt, Homo sapiens
gcagucuuauucacagauu

SEQ ID NO: 682458 - RNA, 19 nt, Homo sapiens
cuaguaaagugcaauaaag

SEQ ID NO: 682459 - RNA, 19 nt, Homo sapiens
aaauuuggcuaguaaagug

SEQ ID NO: 682460 - RNA, 19 nt, Homo sapiens
ggcuaugacuaagaauuua

SEQ ID NO: 682461 - RNA, 19 nt, Homo sapiens
uaggagacuucaugcaauu

SEQ ID NO: 682462 - RNA, 19 nt, Homo sapiens
cagaggauccugagcauug

SEQ ID NO: 682463 - RNA, 19 nt, Homo sapiens
gagaauuugcuauaagcua

SEQ ID NO: 682464 - RNA, 19 nt, Homo sapiens
ccaguagcuuugaauauuc

SEQ ID NO: 682465 - RNA, 19 nt, Homo sapiens
gcuaguaaagugcaauaaa

SEQ ID NO: 682466 - RNA, 19 nt, Homo sapiens
ggacagccuggcacaauga

SEQ ID NO: 682467 - RNA, 19 nt, Homo sapiens
uagcacacaaguagaaaua

SEQ ID NO: 682468 - RNA, 19 nt, Homo sapiens
cagcuugccuauuaaagga

SEQ ID NO: 682469 - RNA, 19 nt, Homo sapiens
caacaacaguccacuucuc

SEQ ID NO: 682470 - RNA, 19 nt, Homo sapiens
guuaauggacgaugucuga

SEQ ID NO: 682471 - RNA, 19 nt, Homo sapiens
uaggaggugugagauauuu

SEQ ID NO: 682472 - RNA, 19 nt, Homo sapiens
ucaaagggguugccuguaa

SEQ ID NO: 682473 - RNA, 19 nt, Homo sapiens
gagcauggugaaaggguua

SEQ ID NO: 682474 - RNA, 19 nt, Homo sapiens
gagcuccuaugauguagau

SEQ ID NO: 682475 - RNA, 19 nt, Homo sapiens
gaacuaccuccuggucuuu

SEQ ID NO: 682476 - RNA, 19 nt, Homo sapiens
gauccucucaaguauuaua

SEQ ID NO: 682477 - RNA, 19 nt, Homo sapiens
ggacgaugucugaacaauu

SEQ ID NO: 682478 - RNA, 19 nt, Homo sapiens
gaaccaggcuaugacuaag

SEQ ID NO: 682479 - RNA, 19 nt, Homo sapiens
ucuuaaugguugccaguua

SEQ ID NO: 682480 - RNA, 19 nt, Homo sapiens
gauagaggaagucauuaga

SEQ ID NO: 682481 - RNA, 19 nt, Homo sapiens
cguccaaacugaucacaau

SEQ ID NO: 682482 - RNA, 19 nt, Homo sapiens
gagaaacaacauaguggaa

SEQ ID NO: 682483 - RNA, 19 nt, Homo sapiens
gaacugucguacacauucu

SEQ ID NO: 682484 - RNA, 19 nt, Homo sapiens
cauccuuguuugauaguaa

SEQ ID NO: 682485 - RNA, 19 nt, Homo sapiens
gaccauauuuguacuuucg

SEQ ID NO: 682486 - RNA, 19 nt, Homo sapiens
guugagcuccuaugaugua

SEQ ID NO: 682487 - RNA, 19 nt, Homo sapiens
ccuuagcuauagagaauuu

SEQ ID NO: 682488 - RNA, 19 nt, Homo sapiens
agauauaagccaaggauuu

SEQ ID NO: 682489 - RNA, 19 nt, Homo sapiens
ggagauauaagccaaggau

SEQ ID NO: 682490 - RNA, 19 nt, Homo sapiens
cccaguuccuuaaauauug

SEQ ID NO: 682491 - RNA, 19 nt, Homo sapiens
cuacgaggcugagcacgaa

SEQ ID NO: 682492 - RNA, 19 nt, Homo sapiens
gcucaugucggcaauccua

SEQ ID NO: 682493 - RNA, 19 nt, Homo sapiens
gaacauaccucaaggauuu

SEQ ID NO: 682494 - RNA, 19 nt, Homo sapiens
gaagagaauuccauaugaa

SEQ ID NO: 682495 - RNA, 19 nt, Homo sapiens
caacaucgaucccaucuau

SEQ ID NO: 682496 - RNA, 19 nt, Homo sapiens
gcacucggcuggagaaaga

SEQ ID NO: 682497 - RNA, 19 nt, Homo sapiens
cgaaauugcucgaaaguug

SEQ ID NO: 682498 - RNA, 19 nt, Homo sapiens
caggauaucugcuaagaaa

SEQ ID NO: 682499 - RNA, 19 nt, Homo sapiens
uaaaugcgauggccaggua

SEQ ID NO: 682500 - RNA, 19 nt, Homo sapiens
gaguaaagcugcuggacaa

SEQ ID NO: 682501 - RNA, 19 nt, Homo sapiens
ggauuuggcuugaaccuau

SEQ ID NO: 682502 - RNA, 19 nt, Homo sapiens
ggacaacaccauggaaaua

SEQ ID NO: 682503 - RNA, 19 nt, Homo sapiens
ugaagagaauuccauauga

SEQ ID NO: 682504 - RNA, 19 nt, Homo sapiens
ggaaauauuugacauugag

SEQ ID NO: 682505 - RNA, 19 nt, Homo sapiens
ggaaguggcuguggucuca

SEQ ID NO: 682506 - RNA, 19 nt, Homo sapiens
gaaagaaggcacagcaaga

SEQ ID NO: 682507 - RNA, 19 nt, Homo sapiens
agaaccagcuuucaggaua

SEQ ID NO: 682508 - RNA, 19 nt, Homo sapiens
ccucaaggauuuagaaguu

SEQ ID NO: 682509 - RNA, 19 nt, Homo sapiens
ggacacaacuacaaagaac

SEQ ID NO: 682510 - RNA, 19 nt, Homo sapiens
gaaccagcuuucaggauau

SEQ ID NO: 682511 - RNA, 19 nt, Homo sapiens
gagagcaccucaaagugaa

SEQ ID NO: 682512 - RNA, 19 nt, Homo sapiens
ggaaauaggagauuacgau

SEQ ID NO: 682513 - RNA, 19 nt, Homo sapiens
gaaaagaggcccugccaua

SEQ ID NO: 682514 - RNA, 19 nt, Homo sapiens
gcacugccuugagaagaua

SEQ ID NO: 682515 - RNA, 19 nt, Homo sapiens
ggucacagcuaaacaaguc

SEQ ID NO: 682516 - RNA, 19 nt, Homo sapiens
gaagauuuguguggaguau

SEQ ID NO: 682517 - RNA, 19 nt, Homo sapiens
agagagaccugcuggaaga

SEQ ID NO: 682518 - RNA, 19 nt, Homo sapiens
agacgaggccuacuucaua

SEQ ID NO: 682519 - RNA, 19 nt, Homo sapiens
ggaaauguacggcaucaga

SEQ ID NO: 682520 - RNA, 19 nt, Homo sapiens
aauaggagauuacgaugaa

SEQ ID NO: 682521 - RNA, 19 nt, Homo sapiens
gagagcaaguacacauuug

SEQ ID NO: 682522 - RNA, 19 nt, Homo sapiens
gauaacgaguggucuguuc

SEQ ID NO: 682523 - RNA, 19 nt, Homo sapiens
ucucagauauguugcugua

SEQ ID NO: 682524 - RNA, 19 nt, Homo sapiens
guuuaaaccugguagaaug

SEQ ID NO: 682525 - RNA, 19 nt, Homo sapiens
caaagacaguggaaugaag

SEQ ID NO: 682526 - RNA, 19 nt, Homo sapiens
caacuucuguuuguucuuc

SEQ ID NO: 682527 - RNA, 19 nt, Homo sapiens
gagaauuccauaugaaaga

SEQ ID NO: 682528 - RNA, 19 nt, Homo sapiens
ccaggacacauuagaauuu

SEQ ID NO: 682529 - RNA, 19 nt, Homo sapiens
gcucgaaaguuggaaaugu

SEQ ID NO: 682530 - RNA, 19 nt, Homo sapiens
ggagauagaaggaacauac

SEQ ID NO: 682531 - RNA, 19 nt, Homo sapiens
caaauacgaaggccaaaga

SEQ ID NO: 682532 - RNA, 19 nt, Homo sapiens
guucacacacauuugauua

SEQ ID NO: 682533 - RNA, 19 nt, Homo sapiens
guagaugggcgacugcuuu

SEQ ID NO: 682534 - RNA, 19 nt, Homo sapiens
gauuucacauggcuucuga

SEQ ID NO: 682535 - RNA, 19 nt, Homo sapiens
ucaaagugaacgaguauuu

SEQ ID NO: 682536 - RNA, 19 nt, Homo sapiens
ggaccgagagcaccucaaa

SEQ ID NO: 682537 - RNA, 19 nt, Homo sapiens
caacaccauggaaauauuu

SEQ ID NO: 682538 - RNA, 19 nt, Homo sapiens
cgagagcaccucaaaguga

SEQ ID NO: 682539 - RNA, 19 nt, Homo sapiens
gagcaggagucagaagaug

SEQ ID NO: 682540 - RNA, 19 nt, Homo sapiens
uggaagaacucagaaacaa

SEQ ID NO: 682541 - RNA, 19 nt, Homo sapiens
gggauggaguuucaaaaua

SEQ ID NO: 682542 - RNA, 19 nt, Homo sapiens
gauaucugcuaagaaaguu

SEQ ID NO: 682543 - RNA, 19 nt, Homo sapiens
ucagauauguugcuguaca

SEQ ID NO: 682544 - RNA, 19 nt, Homo sapiens
gaacaugcgccaguuaaag

SEQ ID NO: 682545 - RNA, 19 nt, Homo sapiens
gaccuuaccaggacacauu

SEQ ID NO: 682546 - RNA, 19 nt, Homo sapiens
ccauguaccucuagagaag

SEQ ID NO: 682547 - RNA, 19 nt, Homo sapiens
gggcauagagaaccucauu

SEQ ID NO: 682548 - RNA, 19 nt, Homo sapiens
gaagaacucagaaacaacu

SEQ ID NO: 682549 - RNA, 19 nt, Homo sapiens
gauagaaggaacauacaga

SEQ ID NO: 682550 - RNA, 19 nt, Homo sapiens
uagagaagcagaaaccaaa

SEQ ID NO: 682551 - RNA, 19 nt, Homo sapiens
gcucaaagacgcagacaag

SEQ ID NO: 682552 - RNA, 19 nt, Homo sapiens
gcaaguacacauuugaaag

SEQ ID NO: 682553 - RNA, 19 nt, Homo sapiens
ggaacaugcgccaguuaaa

SEQ ID NO: 682554 - RNA, 19 nt, Homo sapiens
uauuugacauugagccuaa

SEQ ID NO: 682555 - RNA, 19 nt, Homo sapiens
ccaggacccucucagacaa

SEQ ID NO: 682556 - RNA, 19 nt, Homo sapiens
acaacaccauggaaauauu

SEQ ID NO: 682557 - RNA, 19 nt, Homo sapiens
guaguagagaugaauguaa

SEQ ID NO: 682558 - RNA, 19 nt, Homo sapiens
gcaccugcaccucagagua

SEQ ID NO: 682559 - RNA, 19 nt, Homo sapiens
gcaggucacagcuaaacaa

SEQ ID NO: 682560 - RNA, 19 nt, Homo sapiens
gagcaaguacacauuugaa

SEQ ID NO: 682561 - RNA, 19 nt, Homo sapiens
gacgaggccuacuucauag

SEQ ID NO: 682562 - RNA, 19 nt, Homo sapiens
guccaggccuuuccacgaa

SEQ ID NO: 682563 - RNA, 19 nt, Homo sapiens
ucgccuagcuguaaaauuu

SEQ ID NO: 682564 - RNA, 19 nt, Homo sapiens
gcagcgcaguggugaagga

SEQ ID NO: 682565 - RNA, 19 nt, Homo sapiens
cagacucucuugcccagaa

SEQ ID NO: 682566 - RNA, 19 nt, Homo sapiens
caaacuucauccagagguu

SEQ ID NO: 682567 - RNA, 19 nt, Homo sapiens
ccaccaaaaucaacacuuu

SEQ ID NO: 682568 - RNA, 19 nt, Homo sapiens
ggaaggaaccaagauucaa

SEQ ID NO: 682569 - RNA, 19 nt, Homo sapiens
gaagcucugggucgucuuu

SEQ ID NO: 682570 - RNA, 19 nt, Homo sapiens
ggauaucugcuaagaaagu

SEQ ID NO: 682571 - RNA, 19 nt, Homo sapiens
gcgagaggccgagguguuu

SEQ ID NO: 682572 - RNA, 19 nt, Homo sapiens
gaaauguacggcaucagau

SEQ ID NO: 682573 - RNA, 19 nt, Homo sapiens
gaagauacuagaauuccau

SEQ ID NO: 682574 - RNA, 19 nt, Homo sapiens
uaagagagaccugcuggaa

SEQ ID NO: 682575 - RNA, 19 nt, Homo sapiens
caucuacgcggcucagaaa

SEQ ID NO: 682576 - RNA, 19 nt, Homo sapiens
gagaugaauguaagaacuu

SEQ ID NO: 682577 - RNA, 19 nt, Homo sapiens
cucgaaaguuggaaaugua

SEQ ID NO: 682578 - RNA, 19 nt, Homo sapiens
gacaacaccauggaaauau

SEQ ID NO: 682579 - RNA, 19 nt, Homo sapiens
gaaccuaugaaacccauca

SEQ ID NO: 682580 - RNA, 19 nt, Homo sapiens
ucaaaucccacgucuacuu

SEQ ID NO: 682581 - RNA, 19 nt, Homo sapiens
guucaaaucccacgucuac

SEQ ID NO: 682582 - RNA, 19 nt, Homo sapiens
guacacaagcaaaggaguu

SEQ ID NO: 682583 - RNA, 19 nt, Homo sapiens
auacuagaauuccaucaga

SEQ ID NO: 682584 - RNA, 19 nt, Homo sapiens
ugagagcaaguacacauuu

SEQ ID NO: 682585 - RNA, 19 nt, Homo sapiens
cagggaggccgauggcaua

SEQ ID NO: 682586 - RNA, 19 nt, Homo sapiens
agucggaaauaggagauua

SEQ ID NO: 682587 - RNA, 19 nt, Homo sapiens
cuacaaaacucaucaggau

SEQ ID NO: 682588 - RNA, 19 nt, Homo sapiens
gauccaagcagccaagagu

SEQ ID NO: 682589 - RNA, 19 nt, Homo sapiens
uucacaagcucaccaagaa

SEQ ID NO: 682590 - RNA, 19 nt, Homo sapiens
gaaguuggaggcaguguac

SEQ ID NO: 682591 - RNA, 19 nt, Homo sapiens
caaacgcuguaagaaguug

SEQ ID NO: 682592 - RNA, 19 nt, Homo sapiens
uaguagagaugaauguaag

SEQ ID NO: 682593 - RNA, 19 nt, Homo sapiens
ggaaggagauuauacauuu

SEQ ID NO: 682594 - RNA, 19 nt, Homo sapiens
gaacaacgauuucuaucug

SEQ ID NO: 682595 - RNA, 19 nt, Homo sapiens
gaaagugaguccugucuug

SEQ ID NO: 682596 - RNA, 19 nt, Homo sapiens
gagcacaccuaaacaauau

SEQ ID NO: 682597 - RNA, 19 nt, Homo sapiens
gaacaaagcacgagaugga

SEQ ID NO: 682598 - RNA, 19 nt, Homo sapiens
gcacuaaucuaaauaaagg

SEQ ID NO: 682599 - RNA, 19 nt, Homo sapiens
gaaauacagucagucuuaa

SEQ ID NO: 682600 - RNA, 19 nt, Homo sapiens
uaacauggaugaacaggaa

SEQ ID NO: 682601 - RNA, 19 nt, Homo sapiens
gaaacaaccuacaacuaug

SEQ ID NO: 682602 - RNA, 19 nt, Homo sapiens
gaacugaggcccaaauaug

SEQ ID NO: 682603 - RNA, 19 nt, Homo sapiens
gaagcaagguauuuaaaca

SEQ ID NO: 682604 - RNA, 19 nt, Homo sapiens
ggacacaagcaaacucuua

SEQ ID NO: 682605 - RNA, 19 nt, Homo sapiens
aaaggaagcuugcaccaaa

SEQ ID NO: 682606 - RNA, 19 nt, Homo sapiens
gaagaagcaagguauuuaa

SEQ ID NO: 682607 - RNA, 19 nt, Homo sapiens
ugaaauacagucagucuua

SEQ ID NO: 682608 - RNA, 19 nt, Homo sapiens
gcagucagauggcugugua

SEQ ID NO: 682609 - RNA, 19 nt, Homo sapiens
agaagggagugaacauuua

SEQ ID NO: 682610 - RNA, 19 nt, Homo sapiens
gauaacgacucagcaauug

SEQ ID NO: 682611 - RNA, 19 nt, Homo sapiens
uagaggagaugucugagua

SEQ ID NO: 682612 - RNA, 19 nt, Homo sapiens
gaacaaugcuguggacuac

SEQ ID NO: 682613 - RNA, 19 nt, Homo sapiens
gaaaucaaacaucacagua

SEQ ID NO: 682614 - RNA, 19 nt, Homo sapiens
ugaaagaacuuacgguauc

SEQ ID NO: 682615 - RNA, 19 nt, Homo sapiens
gcacuuuaguugcugguuu

SEQ ID NO: 682616 - RNA, 19 nt, Homo sapiens
ggcacaaucucauauuaaa

SEQ ID NO: 682617 - RNA, 19 nt, Homo sapiens
ucucaaagcugcugaagug

SEQ ID NO: 682618 - RNA, 19 nt, Homo sapiens
gagaaggauuugucaaugu

SEQ ID NO: 682619 - RNA, 19 nt, Homo sapiens
ggagaaggauuugucaaug

SEQ ID NO: 682620 - RNA, 19 nt, Homo sapiens
gaacugaaggccuuuguug

SEQ ID NO: 682621 - RNA, 19 nt, Homo sapiens
ggacagcagcccaaaugua

SEQ ID NO: 682622 - RNA, 19 nt, Homo sapiens
ccuagaaucugccuuauca

SEQ ID NO: 682623 - RNA, 19 nt, Homo sapiens
caaaucacaccauaacuuu

SEQ ID NO: 682624 - RNA, 19 nt, Homo sapiens
gacagcagcccaaauguaa

SEQ ID NO: 682625 - RNA, 19 nt, Homo sapiens
uaacuuggauggcgugguu

SEQ ID NO: 682626 - RNA, 19 nt, Homo sapiens
ggaaugcauugcugaugaa

SEQ ID NO: 682627 - RNA, 19 nt, Homo sapiens
gaagaggaagcgaggauuu

SEQ ID NO: 682628 - RNA, 19 nt, Homo sapiens
gagagugacuaccauuguu

SEQ ID NO: 682629 - RNA, 19 nt, Homo sapiens
ggaaagugcuacccuggau

SEQ ID NO: 682630 - RNA, 19 nt, Homo sapiens
caaagucacuguuucuagu

SEQ ID NO: 682631 - RNA, 19 nt, Homo sapiens
gcaguauaguucucuaaug

SEQ ID NO: 682632 - RNA, 19 nt, Homo sapiens
gguguacacuuuccacuug

SEQ ID NO: 682633 - RNA, 19 nt, Homo sapiens
caggagagguguuggagaa

SEQ ID NO: 682634 - RNA, 19 nt, Homo sapiens
acaaagcuaucauggacua

SEQ ID NO: 682635 - RNA, 19 nt, Homo sapiens
gaacauuuaccgcuuuaug

SEQ ID NO: 682636 - RNA, 19 nt, Homo sapiens
gagagggaauccaaagguu

SEQ ID NO: 682637 - RNA, 19 nt, Homo sapiens
ggauaacgacucagcaauu

SEQ ID NO: 682638 - RNA, 19 nt, Homo sapiens
ggagcuuccuucaguuauu

SEQ ID NO: 682639 - RNA, 19 nt, Homo sapiens
gugcuggacucggacauua

SEQ ID NO: 682640 - RNA, 19 nt, Homo sapiens
gaaggagauuauacauuuc

SEQ ID NO: 682641 - RNA, 19 nt, Homo sapiens
ugaagaagcaagguauuua

SEQ ID NO: 682642 - RNA, 19 nt, Homo sapiens
gagcucacuuugccuuuga

SEQ ID NO: 682643 - RNA, 19 nt, Homo sapiens
agaaggaucuugaaucucu

SEQ ID NO: 682644 - RNA, 19 nt, Homo sapiens
gaguucugcuuuccacuaa

SEQ ID NO: 682645 - RNA, 19 nt, Homo sapiens
ccaauucaauacugucuau

SEQ ID NO: 682646 - RNA, 19 nt, Homo sapiens
gcaguacucccgagcaauu

SEQ ID NO: 682647 - RNA, 19 nt, Homo sapiens
caguauaguucucuaaugu

SEQ ID NO: 682648 - RNA, 19 nt, Homo sapiens
cuaaggaacagcauucuaa

SEQ ID NO: 682649 - RNA, 19 nt, Homo sapiens
ccaaagguuuccaugaaug

SEQ ID NO: 682650 - RNA, 19 nt, Homo sapiens
uggaguauauucuauguga

SEQ ID NO: 682651 - RNA, 19 nt, Homo sapiens
ggaccuaccacuuccguuu

SEQ ID NO: 682652 - RNA, 19 nt, Homo sapiens
caucugagcuacccauauc

SEQ ID NO: 682653 - RNA, 19 nt, Homo sapiens
gcauguguaugacuaagga

SEQ ID NO: 682654 - RNA, 19 nt, Homo sapiens
gagauggccugcauagucu

SEQ ID NO: 682655 - RNA, 19 nt, Homo sapiens
uccaagaacugaaugcaaa

SEQ ID NO: 682656 - RNA, 19 nt, Homo sapiens
gcccagagagguuaaguaa

SEQ ID NO: 682657 - RNA, 19 nt, Homo sapiens
gguugaagguagcauugua

SEQ ID NO: 682658 - RNA, 19 nt, Homo sapiens
ucagauggcuguguauguu

SEQ ID NO: 682659 - RNA, 19 nt, Homo sapiens
uaacuuuacccgacaauga

SEQ ID NO: 682660 - RNA, 19 nt, Homo sapiens
gcaguuuacauacucauuu

SEQ ID NO: 682661 - RNA, 19 nt, Homo sapiens
ucuaaggacugaggcaaua

SEQ ID NO: 682662 - RNA, 19 nt, Homo sapiens
gagcuaaggaagaaucgua

SEQ ID NO: 682663 - RNA, 19 nt, Homo sapiens
aaauggagcuuccuucagu

SEQ ID NO: 682664 - RNA, 19 nt, Homo sapiens
gagagguguuggagaaaga

SEQ ID NO: 682665 - RNA, 19 nt, Homo sapiens
cuaagcauguguaugacua

SEQ ID NO: 682666 - RNA, 19 nt, Homo sapiens
gaagaagggagugaacauu

SEQ ID NO: 682667 - RNA, 19 nt, Homo sapiens
ucaauacugucuauagugu

SEQ ID NO: 682668 - RNA, 19 nt, Homo sapiens
gcacaacuccagccugaug

SEQ ID NO: 682669 - RNA, 19 nt, Homo sapiens
guacagaugauacugaaau

SEQ ID NO: 682670 - RNA, 19 nt, Homo sapiens
agaaacaaccuacaacuau

SEQ ID NO: 682671 - RNA, 19 nt, Homo sapiens
cauacucauuugauccuua

SEQ ID NO: 682672 - RNA, 19 nt, Homo sapiens
gugaacauuuaccgcuuua

SEQ ID NO: 682673 - RNA, 19 nt, Homo sapiens
gaagguagcauuguaacau

SEQ ID NO: 682674 - RNA, 19 nt, Homo sapiens
gaugaacaacgauuucuau

SEQ ID NO: 682675 - RNA, 19 nt, Homo sapiens
gaaauaaaggcuggguaaa

SEQ ID NO: 682676 - RNA, 19 nt, Homo sapiens
gagcuuccuucaguuauug

SEQ ID NO: 682677 - RNA, 19 nt, Homo sapiens
gcccaaauaugguaucaag

SEQ ID NO: 682678 - RNA, 19 nt, Homo sapiens
gcaccgugauuguguuuua

SEQ ID NO: 682679 - RNA, 19 nt, Homo sapiens
ccaaagaauuguguccuau

SEQ ID NO: 682680 - RNA, 19 nt, Homo sapiens
ggacggagccacuaacucu

SEQ ID NO: 682681 - RNA, 19 nt, Homo sapiens
gggaggacauauuccaaug

SEQ ID NO: 682682 - RNA, 19 nt, Homo sapiens
aaaagugggucuuauguuu

SEQ ID NO: 682683 - RNA, 19 nt, Homo sapiens
acagaaggaucuugaaucu

SEQ ID NO: 682684 - RNA, 19 nt, Homo sapiens
cgccauaccuucauuuauc

SEQ ID NO: 682685 - RNA, 19 nt, Homo sapiens
ccaaaucacaccauaacuu

SEQ ID NO: 682686 - RNA, 19 nt, Homo sapiens
cuacaacuaugaauggaau

SEQ ID NO: 682687 - RNA, 19 nt, Homo sapiens
ggagaaggaccucuugcaa

SEQ ID NO: 682688 - RNA, 19 nt, Homo sapiens
caggugugcucucuucauu

SEQ ID NO: 682689 - RNA, 19 nt, Homo sapiens
cacuuuaguugcugguuua

SEQ ID NO: 682690 - RNA, 19 nt, Homo sapiens
gaaguaguggcuccaagaa

SEQ ID NO: 682691 - RNA, 19 nt, Homo sapiens
acucagcaauuguguauau

SEQ ID NO: 682692 - RNA, 19 nt, Homo sapiens
ggacugaggcaauagaaag

SEQ ID NO: 682693 - RNA, 19 nt, Homo sapiens
ggaaagcacugaaauguug

SEQ ID NO: 682694 - RNA, 19 nt, Homo sapiens
gcaagauacuguagaguua

SEQ ID NO: 682695 - RNA, 19 nt, Homo sapiens
caaauauccuggaauguua

SEQ ID NO: 682696 - RNA, 19 nt, Homo sapiens
ccacauagcgucauuaaua

SEQ ID NO: 682697 - RNA, 19 nt, Homo sapiens
gcacugaaauguugugauu

SEQ ID NO: 682698 - RNA, 19 nt, Homo sapiens
gaacauggcuccaauacca

SEQ ID NO: 682699 - RNA, 19 nt, Homo sapiens
gcacauaggugguacacaa

SEQ ID NO: 682700 - RNA, 19 nt, Homo sapiens
gaaacuagcuucaucucuu

SEQ ID NO: 682701 - RNA, 19 nt, Homo sapiens
gcagcaaacuuucuguuaa

SEQ ID NO: 682702 - RNA, 19 nt, Homo sapiens
acaaagaccucauuucuga

SEQ ID NO: 682703 - RNA, 19 nt, Homo sapiens
gacagaagaugaaauagaa

SEQ ID NO: 682704 - RNA, 19 nt, Homo sapiens
uaugauagcucuugacaaa

SEQ ID NO: 682705 - RNA, 19 nt, Homo sapiens
gcacuugucuuacucauuc

SEQ ID NO: 682706 - RNA, 19 nt, Homo sapiens
gaacagaacagaaagaaau

SEQ ID NO: 682707 - RNA, 19 nt, Homo sapiens
gaugggagcuucuaugaga

SEQ ID NO: 682708 - RNA, 19 nt, Homo sapiens
guagauaccuggaugauuc

SEQ ID NO: 682709 - RNA, 19 nt, Homo sapiens
gaacguggcucccaucaag

SEQ ID NO: 682710 - RNA, 19 nt, Homo sapiens
ugauagcucuugacaaaua

SEQ ID NO: 682711 - RNA, 19 nt, Homo sapiens
caguaaaggucuagauaua

SEQ ID NO: 682712 - RNA, 19 nt, Homo sapiens
ugacuuaccucugaguuua

SEQ ID NO: 682713 - RNA, 19 nt, Homo sapiens
uggaacagcuggaaguuua

SEQ ID NO: 682714 - RNA, 19 nt, Homo sapiens
cacaaugacugguaugaua

SEQ ID NO: 682715 - RNA, 19 nt, Homo sapiens
gaacagucgccaaguauuu

SEQ ID NO: 682716 - RNA, 19 nt, Homo sapiens
gcagugauguggagcauga

SEQ ID NO: 682717 - RNA, 19 nt, Homo sapiens
gaggaaauguugaaagaga

SEQ ID NO: 682718 - RNA, 19 nt, Homo sapiens
gaagaacaaucauuucgau

SEQ ID NO: 682719 - RNA, 19 nt, Homo sapiens
caucagcacuguuauaguu

SEQ ID NO: 682720 - RNA, 19 nt, Homo sapiens
gcaaagggaaguccacaua

SEQ ID NO: 682721 - RNA, 19 nt, Homo sapiens
caaagaaacucagaacguu

SEQ ID NO: 682722 - RNA, 19 nt, Homo sapiens
ugacagagguggaagaaga

SEQ ID NO: 682723 - RNA, 19 nt, Homo sapiens
gaagaaaugccuaacagaa

SEQ ID NO: 682724 - RNA, 19 nt, Homo sapiens
caaguaaucuagaagaaug

SEQ ID NO: 682725 - RNA, 19 nt, Homo sapiens
ggaaauauuugcugaggau

SEQ ID NO: 682726 - RNA, 19 nt, Homo sapiens
ggaagaacuugcuaagaga

SEQ ID NO: 682727 - RNA, 19 nt, Homo sapiens
gcaaagagaguaaaugaau

SEQ ID NO: 682728 - RNA, 19 nt, Homo sapiens
gagagucaccgcagauuua

SEQ ID NO: 682729 - RNA, 19 nt, Homo sapiens
gaggaacagucgccaagua

SEQ ID NO: 682730 - RNA, 19 nt, Homo sapiens
ggagaugguucgacaguau

SEQ ID NO: 682731 - RNA, 19 nt, Homo sapiens
gaagaaacccgaaacaaag

SEQ ID NO: 682732 - RNA, 19 nt, Homo sapiens
gauguuaccucccagcauu

SEQ ID NO: 682733 - RNA, 19 nt, Homo sapiens
gaaauguaauucuggucua

SEQ ID NO: 682734 - RNA, 19 nt, Homo sapiens
ugagagagguauagauaaa

SEQ ID NO: 682735 - RNA, 19 nt, Homo sapiens
cagaagaacuuuggaaaug

SEQ ID NO: 682736 - RNA, 19 nt, Homo sapiens
cagcugaagucaucacuaa

SEQ ID NO: 682737 - RNA, 19 nt, Homo sapiens
gcagacgaguuauuugauu

SEQ ID NO: 682738 - RNA, 19 nt, Homo sapiens
gaagaaacuuaauggugaa

SEQ ID NO: 682739 - RNA, 19 nt, Homo sapiens
gaccagaacugaaacagau

SEQ ID NO: 682740 - RNA, 19 nt, Homo sapiens
uaacaggauuuaagccuaa

SEQ ID NO: 682741 - RNA, 19 nt, Homo sapiens
ggaguuagauaaaccugaa

SEQ ID NO: 682742 - RNA, 19 nt, Homo sapiens
gaaagaccuaguuggauua

SEQ ID NO: 682743 - RNA, 19 nt, Homo sapiens
uaagugguguuucauauga

SEQ ID NO: 682744 - RNA, 19 nt, Homo sapiens
ugacaugucucucucagaa

SEQ ID NO: 682745 - RNA, 19 nt, Homo sapiens
ugugacaucuugcaaauaa

SEQ ID NO: 682746 - RNA, 19 nt, Homo sapiens
gaugaagacuuugguuuga

SEQ ID NO: 682747 - RNA, 19 nt, Homo sapiens
gaaaagaccuugcuugaag

SEQ ID NO: 682748 - RNA, 19 nt, Homo sapiens
gaagaacuuuggaaaugga

SEQ ID NO: 682749 - RNA, 19 nt, Homo sapiens
cagcaaacuuucuguuaaa

SEQ ID NO: 682750 - RNA, 19 nt, Homo sapiens
uuauacagaugccuuguua

SEQ ID NO: 682751 - RNA, 19 nt, Homo sapiens
uaaagaaacuagcuucauc

SEQ ID NO: 682752 - RNA, 19 nt, Homo sapiens
gguuucaucuugucguuua

SEQ ID NO: 682753 - RNA, 19 nt, Homo sapiens
gaggaugaguuguguguga

SEQ ID NO: 682754 - RNA, 19 nt, Homo sapiens
ccaaggaacucucaaagca

SEQ ID NO: 682755 - RNA, 19 nt, Homo sapiens
agguaaaucugaugucuua

SEQ ID NO: 682756 - RNA, 19 nt, Homo sapiens
ccagaucacaguauacuua

SEQ ID NO: 682757 - RNA, 19 nt, Homo sapiens
gaagaggaaucuccaguac

SEQ ID NO: 682758 - RNA, 19 nt, Homo sapiens
ccaagaaaguccuucaguu

SEQ ID NO: 682759 - RNA, 19 nt, Homo sapiens
ucagaacguucgagaagua

SEQ ID NO: 682760 - RNA, 19 nt, Homo sapiens
ggaagaagaagaacugcua

SEQ ID NO: 682761 - RNA, 19 nt, Homo sapiens
ccaaucaucugucaucaau

SEQ ID NO: 682762 - RNA, 19 nt, Homo sapiens
caagacaucuacuggauuc

SEQ ID NO: 682763 - RNA, 19 nt, Homo sapiens
gcuguuacuugaaugauuu

SEQ ID NO: 682764 - RNA, 19 nt, Homo sapiens
caagugaaguacucaaguu

SEQ ID NO: 682765 - RNA, 19 nt, Homo sapiens
ccaaauaaccuugaugaaa

SEQ ID NO: 682766 - RNA, 19 nt, Homo sapiens
agaaagaccuaguuggauu

SEQ ID NO: 682767 - RNA, 19 nt, Homo sapiens
agaaagaaauagcaaguga

SEQ ID NO: 682768 - RNA, 19 nt, Homo sapiens
caaaggagaggaugauaaa

SEQ ID NO: 682769 - RNA, 19 nt, Homo sapiens
caacgucuauugcaacaga

SEQ ID NO: 682770 - RNA, 19 nt, Homo sapiens
gaaaggaagagaaagcaaa

SEQ ID NO: 682771 - RNA, 19 nt, Homo sapiens
gcacuucacuuugcagaug

SEQ ID NO: 682772 - RNA, 19 nt, Homo sapiens
gauaggcagucgagaagaa

SEQ ID NO: 682773 - RNA, 19 nt, Homo sapiens
gacuccagcugcuacauua

SEQ ID NO: 682774 - RNA, 19 nt, Homo sapiens
gagcaugaacagcaaguua

SEQ ID NO: 682775 - RNA, 19 nt, Homo sapiens
gaacugaaacagauaggaa

SEQ ID NO: 682776 - RNA, 19 nt, Homo sapiens
gacuagaacucauaucuca

SEQ ID NO: 682777 - RNA, 19 nt, Homo sapiens
gcaggcaccucaagaagau

SEQ ID NO: 682778 - RNA, 19 nt, Homo sapiens
ccaagugcaucuuccagua

SEQ ID NO: 682779 - RNA, 19 nt, Homo sapiens
gaacaaucauuucgaucau

SEQ ID NO: 682780 - RNA, 19 nt, Homo sapiens
gcagaugauucucuacgaa

SEQ ID NO: 682781 - RNA, 19 nt, Homo sapiens
cagcauagauucagucagu

SEQ ID NO: 682782 - RNA, 19 nt, Homo sapiens
gaaaugcucagauugaugu

SEQ ID NO: 682783 - RNA, 19 nt, Homo sapiens
ggaauguuauagcuucaaa

SEQ ID NO: 682784 - RNA, 19 nt, Homo sapiens
uuacaaauauccuggaaug

SEQ ID NO: 682785 - RNA, 19 nt, Homo sapiens
gaccuuguacuuauucuua

SEQ ID NO: 682786 - RNA, 19 nt, Homo sapiens
caacagcaguuuacagaag

SEQ ID NO: 682787 - RNA, 19 nt, Homo sapiens
gauaggguguugauuggaa

SEQ ID NO: 682788 - RNA, 19 nt, Homo sapiens
gaaaagacauucacgaaca

SEQ ID NO: 682789 - RNA, 19 nt, Homo sapiens
gugaggaaauguugaaaga

SEQ ID NO: 682790 - RNA, 19 nt, Homo sapiens
gaucauuacuaccuucaga

SEQ ID NO: 682791 - RNA, 19 nt, Homo sapiens
uaaacuggaucguauugaa

SEQ ID NO: 682792 - RNA, 19 nt, Homo sapiens
uggagaaucugacaaagaa

SEQ ID NO: 682793 - RNA, 19 nt, Homo sapiens
ggaggaaacuacagacuuu

SEQ ID NO: 682794 - RNA, 19 nt, Homo sapiens
gaagggaaacagucuauua

SEQ ID NO: 682795 - RNA, 19 nt, Homo sapiens
gaauaaaggugggaucaaa

SEQ ID NO: 682796 - RNA, 19 nt, Homo sapiens
uaacagacguguccuggua

SEQ ID NO: 682797 - RNA, 19 nt, Homo sapiens
gcauacaagucuuagcuua

SEQ ID NO: 682798 - RNA, 19 nt, Homo sapiens
ggagaaauguuuacguuca

SEQ ID NO: 682799 - RNA, 19 nt, Homo sapiens
gaagaaaccagacacaaau

SEQ ID NO: 682800 - RNA, 19 nt, Homo sapiens
gagaaugccucggugugua

SEQ ID NO: 682801 - RNA, 19 nt, Homo sapiens
gaaagacgguagccaggau

SEQ ID NO: 682802 - RNA, 19 nt, Homo sapiens
gaacgcuucuccagugguu

SEQ ID NO: 682803 - RNA, 19 nt, Homo sapiens
ugaagccgguagagaaaua

SEQ ID NO: 682804 - RNA, 19 nt, Homo sapiens
gggaaacagucuauuauac

SEQ ID NO: 682805 - RNA, 19 nt, Homo sapiens
gcagcucccuggacaguga

SEQ ID NO: 682806 - RNA, 19 nt, Homo sapiens
caggagaaauguuuacguu

SEQ ID NO: 682807 - RNA, 19 nt, Homo sapiens
ggaaacagucuauuauaca

SEQ ID NO: 682808 - RNA, 19 nt, Homo sapiens
gcaucgaacuggagauuag

SEQ ID NO: 682809 - RNA, 19 nt, Homo sapiens
gagaagagacagcaugaga

SEQ ID NO: 682810 - RNA, 19 nt, Homo sapiens
ggaaacauuugguucuuac

SEQ ID NO: 682811 - RNA, 19 nt, Homo sapiens
gauccuggguuucuaguca

SEQ ID NO: 682812 - RNA, 19 nt, Homo sapiens
agaaugaaccuacgcauga

SEQ ID NO: 682813 - RNA, 19 nt, Homo sapiens
gaaaccagacacaaaugaa

SEQ ID NO: 682814 - RNA, 19 nt, Homo sapiens
gacguguccugguaaauau

SEQ ID NO: 682815 - RNA, 19 nt, Homo sapiens
gaacaguuucugaaugaga

SEQ ID NO: 682816 - RNA, 19 nt, Homo sapiens
caucagggcggaaauagaa

SEQ ID NO: 682817 - RNA, 19 nt, Homo sapiens
ccacccagcucuuccacuu

SEQ ID NO: 682818 - RNA, 19 nt, Homo sapiens
gggcggaaauagaacaguu

SEQ ID NO: 682819 - RNA, 19 nt, Homo sapiens
gggcugaguuugcaugaca

SEQ ID NO: 682820 - RNA, 19 nt, Homo sapiens
guauauauguacaccaaca

SEQ ID NO: 682821 - RNA, 19 nt, Homo sapiens
gcaggaagaaggucagguu

SEQ ID NO: 682822 - RNA, 19 nt, Homo sapiens
ggaaaauacuguuguucaa

SEQ ID NO: 682823 - RNA, 19 nt, Homo sapiens
guugauugcuggugagaau

SEQ ID NO: 682824 - RNA, 19 nt, Homo sapiens
ucagugagcaggagaaaug

SEQ ID NO: 682825 - RNA, 19 nt, Homo sapiens
ggaagaaggucagguucag

SEQ ID NO: 682826 - RNA, 19 nt, Homo sapiens
gcuacucccuguugcaugu

SEQ ID NO: 682827 - RNA, 19 nt, Homo sapiens
cagaggaaccuuucacaug

SEQ ID NO: 682828 - RNA, 19 nt, Homo sapiens
cagaagcagcacagaauaa

SEQ ID NO: 682829 - RNA, 19 nt, Homo sapiens
agaagaaaccagacacaaa

SEQ ID NO: 682830 - RNA, 19 nt, Homo sapiens
gagcaucagggcggaaaua

SEQ ID NO: 682831 - RNA, 19 nt, Homo sapiens
agacguguccugguaaaua

SEQ ID NO: 682832 - RNA, 19 nt, Homo sapiens
aggaguaccugaaggcaaa

SEQ ID NO: 682833 - RNA, 19 nt, Homo sapiens
gcucaguagugaaggucua

SEQ ID NO: 682834 - RNA, 19 nt, Homo sapiens
gcacagcccagacgcacuu

SEQ ID NO: 682835 - RNA, 19 nt, Homo sapiens
ggguaccgcuugccaacuu

SEQ ID NO: 682836 - RNA, 19 nt, Homo sapiens
ucgguugggucaagaauga

SEQ ID NO: 682837 - RNA, 19 nt, Homo sapiens
agucuuagcuuaggaaaca

SEQ ID NO: 682838 - RNA, 19 nt, Homo sapiens
gaacuggagauuaggaagu

SEQ ID NO: 682839 - RNA, 19 nt, Homo sapiens
acacagccaucaaggacuu

SEQ ID NO: 682840 - RNA, 19 nt, Homo sapiens
ugcaggagguggugaaaga

SEQ ID NO: 682841 - RNA, 19 nt, Homo sapiens
gagcugaugugugcagaag

SEQ ID NO: 682842 - RNA, 19 nt, Homo sapiens
ggugcuagauucagacagu

SEQ ID NO: 682843 - RNA, 19 nt, Homo sapiens
aaccuggacucacagaauu

SEQ ID NO: 682844 - RNA, 19 nt, Homo sapiens
aggaaacauuugguucuua

SEQ ID NO: 682845 - RNA, 19 nt, Homo sapiens
gcacaggcagggcugaguu

SEQ ID NO: 682846 - RNA, 19 nt, Homo sapiens
gagaagaaaccagacacaa

SEQ ID NO: 682847 - RNA, 19 nt, Homo sapiens
ggguucauguccaaucuug

SEQ ID NO: 682848 - RNA, 19 nt, Homo sapiens
caugucaaauccacacaga

SEQ ID NO: 682849 - RNA, 19 nt, Homo sapiens
caaggcgccuagacgagaa

SEQ ID NO: 682850 - RNA, 19 nt, Homo sapiens
gcugaugugugcagaagca

SEQ ID NO: 682851 - RNA, 19 nt, Homo sapiens
ucagaagcagcacagaaua

SEQ ID NO: 682852 - RNA, 19 nt, Homo sapiens
ccagaagccucagguccaa

SEQ ID NO: 682853 - RNA, 19 nt, Homo sapiens
caaccuggacucacagaau

SEQ ID NO: 682854 - RNA, 19 nt, Homo sapiens
ggcggcagcucaguaguga

SEQ ID NO: 682855 - RNA, 19 nt, Homo sapiens
aaaccagacacaaaugaaa

SEQ ID NO: 682856 - RNA, 19 nt, Homo sapiens
ggacccagcccugucuuug

SEQ ID NO: 682857 - RNA, 19 nt, Homo sapiens
gugagcaggagaaauguuu

SEQ ID NO: 682858 - RNA, 19 nt, Homo sapiens
cgacuucgcccaccagagu

SEQ ID NO: 682859 - RNA, 19 nt, Homo sapiens
cggagagacuggaaagaca

SEQ ID NO: 682860 - RNA, 19 nt, Homo sapiens
cagcagcgacgauggcauu

SEQ ID NO: 682861 - RNA, 19 nt, Homo sapiens
accaagagccgccuacaaa

SEQ ID NO: 682862 - RNA, 19 nt, Homo sapiens
guucauguccaaucuuguu

SEQ ID NO: 682863 - RNA, 19 nt, Homo sapiens
gaagcaauccuggacaucu

SEQ ID NO: 682864 - RNA, 19 nt, Homo sapiens
cagaagcaauccuggacau

SEQ ID NO: 682865 - RNA, 19 nt, Homo sapiens
agaagcauuugcagacguu

SEQ ID NO: 682866 - RNA, 19 nt, Homo sapiens
uaggaaacauuugguucuu

SEQ ID NO: 682867 - RNA, 19 nt, Homo sapiens
cacagaauuucaagagcuu

SEQ ID NO: 682868 - RNA, 19 nt, Homo sapiens
ucacaaccacgcaggagaa

SEQ ID NO: 682869 - RNA, 19 nt, Homo sapiens
guucugcauacaagucuua

SEQ ID NO: 682870 - RNA, 19 nt, Homo sapiens
cagaggugcugugcaggaa

SEQ ID NO: 682871 - RNA, 19 nt, Homo sapiens
agcgaaagcucaagaagag

SEQ ID NO: 682872 - RNA, 19 nt, Homo sapiens
ucacagggccaggguaaga

SEQ ID NO: 682873 - RNA, 19 nt, Homo sapiens
caagaccccucucucuaaa

SEQ ID NO: 682874 - RNA, 19 nt, Homo sapiens
ggagaagaaaccagacaca

SEQ ID NO: 682875 - RNA, 19 nt, Homo sapiens
caaucuuguucgaucacua

SEQ ID NO: 682876 - RNA, 19 nt, Homo sapiens
ugucaaauccacacagaug

SEQ ID NO: 682877 - RNA, 19 nt, Homo sapiens
gguaccgcuugccaacuuu

SEQ ID NO: 682878 - RNA, 19 nt, Homo sapiens
guguguaaguggagugaug

SEQ ID NO: 682879 - RNA, 19 nt, Homo sapiens
agugagcaguucagaaguu

SEQ ID NO: 682880 - RNA, 19 nt, Homo sapiens
cgaggguccugggaagaaa

SEQ ID NO: 682881 - RNA, 19 nt, Homo sapiens
ggaaaacacccagcaagaa

SEQ ID NO: 682882 - RNA, 19 nt, Homo sapiens
caaccacgcaggagaacga

SEQ ID NO: 682883 - RNA, 19 nt, Homo sapiens
gaaugaaccuacgcaugac

SEQ ID NO: 682884 - RNA, 19 nt, Homo sapiens
gcccguuggugcuagauuc

SEQ ID NO: 682885 - RNA, 19 nt, Homo sapiens
acagacguguccugguaaa

SEQ ID NO: 682886 - RNA, 19 nt, Homo sapiens
agggaaacagucuauuaua

SEQ ID NO: 682887 - RNA, 19 nt, Homo sapiens
gaaauguuuacguucacaa

SEQ ID NO: 682888 - RNA, 19 nt, Homo sapiens
ucagugagcaguucagaag

SEQ ID NO: 682889 - RNA, 19 nt, Homo sapiens
agaagcagcacagaauaaa

SEQ ID NO: 682890 - RNA, 19 nt, Homo sapiens
agaaaccagacacaaauga

SEQ ID NO: 682891 - RNA, 19 nt, Homo sapiens
gagaaauguuuacguucac

SEQ ID NO: 682892 - RNA, 19 nt, Homo sapiens
gaagccgguagagaaauaa

SEQ ID NO: 682893 - RNA, 19 nt, Homo sapiens
gaaagaaagucaacccaaa

SEQ ID NO: 682894 - RNA, 19 nt, Homo sapiens
caagggagcuucacuauag

SEQ ID NO: 682895 - RNA, 19 nt, Homo sapiens
gaaaugaucaugagguuaa

SEQ ID NO: 682896 - RNA, 19 nt, Homo sapiens
gcaacaauuucuagaagua

SEQ ID NO: 682897 - RNA, 19 nt, Homo sapiens
ccuacaaacugcauuauua

SEQ ID NO: 682898 - RNA, 19 nt, Homo sapiens
gaacuauucuccuuguaaa

SEQ ID NO: 682899 - RNA, 19 nt, Homo sapiens
gaaauggacuucuucaucu

SEQ ID NO: 682900 - RNA, 19 nt, Homo sapiens
gaauugggaugacauagaa

SEQ ID NO: 682901 - RNA, 19 nt, Homo sapiens
gagcaaagguuguaacaca

SEQ ID NO: 682902 - RNA, 19 nt, Homo sapiens
gaagauaagcugagauuug

SEQ ID NO: 682903 - RNA, 19 nt, Homo sapiens
gcauggagauuucuucuau

SEQ ID NO: 682904 - RNA, 19 nt, Homo sapiens
cagcaaccaucacaaauaa

SEQ ID NO: 682905 - RNA, 19 nt, Homo sapiens
aagcauagauucaaaggua

SEQ ID NO: 682906 - RNA, 19 nt, Homo sapiens
gaaguaaaguaacgaaauc

SEQ ID NO: 682907 - RNA, 19 nt, Homo sapiens
aaacaacccuccucaaaug

SEQ ID NO: 682908 - RNA, 19 nt, Homo sapiens
guauauugguccuguguua

SEQ ID NO: 682909 - RNA, 19 nt, Homo sapiens
ggacacaacccuuauucua

SEQ ID NO: 682910 - RNA, 19 nt, Homo sapiens
acacagaacuucaggagaa

SEQ ID NO: 682911 - RNA, 19 nt, Homo sapiens
caaaguaacucuauacacu

SEQ ID NO: 682912 - RNA, 19 nt, Homo sapiens
cccgaucacuuaacaauua

SEQ ID NO: 682913 - RNA, 19 nt, Homo sapiens
aaacauacccgucuacgua

SEQ ID NO: 682914 - RNA, 19 nt, Homo sapiens
gcaaguagaauacgagaaa

SEQ ID NO: 682915 - RNA, 19 nt, Homo sapiens
gaccagauacucccaguua

SEQ ID NO: 682916 - RNA, 19 nt, Homo sapiens
uaagacagcuggaaagauc

SEQ ID NO: 682917 - RNA, 19 nt, Homo sapiens
gauauuaugucaucugauc

SEQ ID NO: 682918 - RNA, 19 nt, Homo sapiens
ucacuagccucuauaaaga

SEQ ID NO: 682919 - RNA, 19 nt, Homo sapiens
gaacagggcaguaaaugga

SEQ ID NO: 682920 - RNA, 19 nt, Homo sapiens
uaaacaagaugcugacaga

SEQ ID NO: 682921 - RNA, 19 nt, Homo sapiens
ggagauggauaaaauguua

SEQ ID NO: 682922 - RNA, 19 nt, Homo sapiens
ucaauacccuuccuacaaa

SEQ ID NO: 682923 - RNA, 19 nt, Homo sapiens
gcauuaacaucugcaagua

SEQ ID NO: 682924 - RNA, 19 nt, Homo sapiens
agaggaagauguuacagua

SEQ ID NO: 682925 - RNA, 19 nt, Homo sapiens
acacaacccuuauucuaaa

SEQ ID NO: 682926 - RNA, 19 nt, Homo sapiens
ggaauaagauuuggucucu

SEQ ID NO: 682927 - RNA, 19 nt, Homo sapiens
gaccaaaccucuaguguac

SEQ ID NO: 682928 - RNA, 19 nt, Homo sapiens
ccagaaagauaaacaagau

SEQ ID NO: 682929 - RNA, 19 nt, Homo sapiens
guaauuaccuuuguguuuc

SEQ ID NO: 682930 - RNA, 19 nt, Homo sapiens
gaagaaaggauaauggaau

SEQ ID NO: 682931 - RNA, 19 nt, Homo sapiens
gaaagugaagucccuauug

SEQ ID NO: 682932 - RNA, 19 nt, Homo sapiens
gagaagagauagccaggau

SEQ ID NO: 682933 - RNA, 19 nt, Homo sapiens
gcacugaaauccgaggaaa

SEQ ID NO: 682934 - RNA, 19 nt, Homo sapiens
gaaugacuuucucuugauu

SEQ ID NO: 682935 - RNA, 19 nt, Homo sapiens
gaagaugaauuuggaucaa

SEQ ID NO: 682936 - RNA, 19 nt, Homo sapiens
ccaugaagcuggaacauca

SEQ ID NO: 682937 - RNA, 19 nt, Homo sapiens
gaucagcaaugccuacuag

SEQ ID NO: 682938 - RNA, 19 nt, Homo sapiens
gauacucccaguuauaaua

SEQ ID NO: 682939 - RNA, 19 nt, Homo sapiens
uauaucaccuugaaacuug

SEQ ID NO: 682940 - RNA, 19 nt, Homo sapiens
aaagauuccuccauuaguu

SEQ ID NO: 682941 - RNA, 19 nt, Homo sapiens
ggaaagaacagaagaggau

SEQ ID NO: 682942 - RNA, 19 nt, Homo sapiens
gagcuuaacauccugguuu

SEQ ID NO: 682943 - RNA, 19 nt, Homo sapiens
acaauaauccugugcuaua

SEQ ID NO: 682944 - RNA, 19 nt, Homo sapiens
ccgaaagauuccuccauua

SEQ ID NO: 682945 - RNA, 19 nt, Homo sapiens
gcagaagccaucauuagaa

SEQ ID NO: 682946 - RNA, 19 nt, Homo sapiens
cguaacaucucucggauug

SEQ ID NO: 682947 - RNA, 19 nt, Homo sapiens
ccagggaagguaacuauua

SEQ ID NO: 682948 - RNA, 19 nt, Homo sapiens
ccuugaaacuugaagauaa

SEQ ID NO: 682949 - RNA, 19 nt, Homo sapiens
cugcuuacauucuuguuua

SEQ ID NO: 682950 - RNA, 19 nt, Homo sapiens
guacagauuuguuaaacca

SEQ ID NO: 682951 - RNA, 19 nt, Homo sapiens
ugaagucccuauugugaaa

SEQ ID NO: 682952 - RNA, 19 nt, Homo sapiens
gacacaacccuuauucuaa

SEQ ID NO: 682953 - RNA, 19 nt, Homo sapiens
ggaggaaacuuuuaaacaa

SEQ ID NO: 682954 - RNA, 19 nt, Homo sapiens
aaagugauguuccagugua

SEQ ID NO: 682955 - RNA, 19 nt, Homo sapiens
caaaugcuaugggaaagaa

SEQ ID NO: 682956 - RNA, 19 nt, Homo sapiens
guaaaugcugucugucuua

SEQ ID NO: 682957 - RNA, 19 nt, Homo sapiens
guaacgaaaucuaagacuu

SEQ ID NO: 682958 - RNA, 19 nt, Homo sapiens
caucugaucaagaaacuua

SEQ ID NO: 682959 - RNA, 19 nt, Homo sapiens
gcaaagugauucagagaac

SEQ ID NO: 682960 - RNA, 19 nt, Homo sapiens
caugagaaguuuaccauuc

SEQ ID NO: 682961 - RNA, 19 nt, Homo sapiens
agacuuauaucaccuugaa

SEQ ID NO: 682962 - RNA, 19 nt, Homo sapiens
gcaacacgcugucaucaac

SEQ ID NO: 682963 - RNA, 19 nt, Homo sapiens
gaagagauagccaggauca

SEQ ID NO: 682964 - RNA, 19 nt, Homo sapiens
agaaagcacuauucaugaa

SEQ ID NO: 682965 - RNA, 19 nt, Homo sapiens
caacaaguucuacaucaaa

SEQ ID NO: 682966 - RNA, 19 nt, Homo sapiens
ccacuuaccucagcugaug

SEQ ID NO: 682967 - RNA, 19 nt, Homo sapiens
ggagagagaaggagacgaa

SEQ ID NO: 682968 - RNA, 19 nt, Homo sapiens
guacuuauaccauugaguu

SEQ ID NO: 682969 - RNA, 19 nt, Homo sapiens
gaauacauuauccuccuua

SEQ ID NO: 682970 - RNA, 19 nt, Homo sapiens
aaucuacucugcuuacauu

SEQ ID NO: 682971 - RNA, 19 nt, Homo sapiens
gaagcaacaauuucuagaa

SEQ ID NO: 682972 - RNA, 19 nt, Homo sapiens
ggaaguaaaguaacgaaau

SEQ ID NO: 682973 - RNA, 19 nt, Homo sapiens
gcauguacauuccaaacug

SEQ ID NO: 682974 - RNA, 19 nt, Homo sapiens
aaacauacccauagaacuu

SEQ ID NO: 682975 - RNA, 19 nt, Homo sapiens
guggacaccuacuaaauug

SEQ ID NO: 682976 - RNA, 19 nt, Homo sapiens
uaguuuagguggaguauau

SEQ ID NO: 682977 - RNA, 19 nt, Homo sapiens
uuaaagagcaggaagacua

SEQ ID NO: 682978 - RNA, 19 nt, Homo sapiens
uaugucaucugaucaagaa

SEQ ID NO: 682979 - RNA, 19 nt, Homo sapiens
ucaguagacuuaacagaug

SEQ ID NO: 682980 - RNA, 19 nt, Homo sapiens
ggauaaugaugaugaccaa

SEQ ID NO: 682981 - RNA, 19 nt, Homo sapiens
gaaagcacuauucaugaaa

SEQ ID NO: 682982 - RNA, 19 nt, Homo sapiens
caauaauccugugcuauau

SEQ ID NO: 682983 - RNA, 19 nt, Homo sapiens
aagcagaccuuucacaaca

SEQ ID NO: 682984 - RNA, 19 nt, Homo sapiens
gcugugaccuacaagcaaa

SEQ ID NO: 682985 - RNA, 19 nt, Homo sapiens
gacuuucucuugauuguug

SEQ ID NO: 682986 - RNA, 19 nt, Homo sapiens
cgauguagcaggagagaua

SEQ ID NO: 682987 - RNA, 19 nt, Homo sapiens
uaacaucucucggauugau

SEQ ID NO: 682988 - RNA, 19 nt, Homo sapiens
ccagauacucccaguuaua

SEQ ID NO: 682989 - RNA, 19 nt, Homo sapiens
gauuauaauaggccuguua

SEQ ID NO: 682990 - RNA, 19 nt, Homo sapiens
ccagcaaccaucacaaaua

SEQ ID NO: 682991 - RNA, 19 nt, Homo sapiens
gauuuggucucucauuuua

SEQ ID NO: 682992 - RNA, 19 nt, Homo sapiens
ggacacaaugacauaagua

SEQ ID NO: 682993 - RNA, 19 nt, Homo sapiens
gagacacccucauuuauua

SEQ ID NO: 682994 - RNA, 19 nt, Homo sapiens
gaccucagcucaaauauaa

SEQ ID NO: 682995 - RNA, 19 nt, Homo sapiens
ggcagagacuuauuaauua

SEQ ID NO: 682996 - RNA, 19 nt, Homo sapiens
gaaacucacuucaggauga

SEQ ID NO: 682997 - RNA, 19 nt, Homo sapiens
gaacuugauuuguccuaua

SEQ ID NO: 682998 - RNA, 19 nt, Homo sapiens
gaacauaaacagagaacua

SEQ ID NO: 682999 - RNA, 19 nt, Homo sapiens
gaaaccagauuaagucaau

SEQ ID NO: 683000 - RNA, 19 nt, Homo sapiens
gaugacgucuucuuuauug

SEQ ID NO: 683001 - RNA, 19 nt, Homo sapiens
gggcagagacuuauuaauu

SEQ ID NO: 683002 - RNA, 19 nt, Homo sapiens
gagaagcucuggaauauac

SEQ ID NO: 683003 - RNA, 19 nt, Homo sapiens
gaugagcggugaaacauug

SEQ ID NO: 683004 - RNA, 19 nt, Homo sapiens
gcuagaagaugcugggaaa

SEQ ID NO: 683005 - RNA, 19 nt, Homo sapiens
gaggauaagugagaagaaa

SEQ ID NO: 683006 - RNA, 19 nt, Homo sapiens
ccucagagcucagaagaaa

SEQ ID NO: 683007 - RNA, 19 nt, Homo sapiens
gguaccaggucaaagauuu

SEQ ID NO: 683008 - RNA, 19 nt, Homo sapiens
gcagugagcagcagugauu

SEQ ID NO: 683009 - RNA, 19 nt, Homo sapiens
gcccagggaugucauugua

SEQ ID NO: 683010 - RNA, 19 nt, Homo sapiens
ggcaacagcugacagaaau

SEQ ID NO: 683011 - RNA, 19 nt, Homo sapiens
gaaauauaccugcauuaug

SEQ ID NO: 683012 - RNA, 19 nt, Homo sapiens
ggaaauauaccugcauuau

SEQ ID NO: 683013 - RNA, 19 nt, Homo sapiens
ggaugaaucugccuuugug

SEQ ID NO: 683014 - RNA, 19 nt, Homo sapiens
ccagaaugcuauugaaaga

SEQ ID NO: 683015 - RNA, 19 nt, Homo sapiens
caacaaccuuacacgagua

SEQ ID NO: 683016 - RNA, 19 nt, Homo sapiens
ggagagagccagacuguuc

SEQ ID NO: 683017 - RNA, 19 nt, Homo sapiens
gcucuggaauauacuagua

SEQ ID NO: 683018 - RNA, 19 nt, Homo sapiens
gaagaugcugggaaauaua

SEQ ID NO: 683019 - RNA, 19 nt, Homo sapiens
gaggaugacgucuucuuua

SEQ ID NO: 683020 - RNA, 19 nt, Homo sapiens
cauagaagaugcuagugaa

SEQ ID NO: 683021 - RNA, 19 nt, Homo sapiens
gacagaacguggccacauu

SEQ ID NO: 683022 - RNA, 19 nt, Homo sapiens
gcagaaagauggugguacu

SEQ ID NO: 683023 - RNA, 19 nt, Homo sapiens
aaacuucccuccacacaga

SEQ ID NO: 683024 - RNA, 19 nt, Homo sapiens
ggaggucucucagcaaaug

SEQ ID NO: 683025 - RNA, 19 nt, Homo sapiens
ggagaaccuacaucuaaua

SEQ ID NO: 683026 - RNA, 19 nt, Homo sapiens
uaacauggaagaacuagaa

SEQ ID NO: 683027 - RNA, 19 nt, Homo sapiens
gaacaucagcuuggaauca

SEQ ID NO: 683028 - RNA, 19 nt, Homo sapiens
ccagggaugucauuguaaa

SEQ ID NO: 683029 - RNA, 19 nt, Homo sapiens
ccaaucagcuucucaucau

SEQ ID NO: 683030 - RNA, 19 nt, Homo sapiens
gaacugauucugaacacaa

SEQ ID NO: 683031 - RNA, 19 nt, Homo sapiens
ucacaagucucacuaaacu

SEQ ID NO: 683032 - RNA, 19 nt, Homo sapiens
gaugguguauuuagauuuc

SEQ ID NO: 683033 - RNA, 19 nt, Homo sapiens
cagcuuaaauaccugaauu

SEQ ID NO: 683034 - RNA, 19 nt, Homo sapiens
ucacauugcugcuuaacau

SEQ ID NO: 683035 - RNA, 19 nt, Homo sapiens
gcaaaugugcuuccugaug

SEQ ID NO: 683036 - RNA, 19 nt, Homo sapiens
ccaaaugccuaaagagaca

SEQ ID NO: 683037 - RNA, 19 nt, Homo sapiens
caacuggacuaaagaugau

SEQ ID NO: 683038 - RNA, 19 nt, Homo sapiens
gggcaaagcauccugaaug

SEQ ID NO: 683039 - RNA, 19 nt, Homo sapiens
caaagacuauccgaacuug

SEQ ID NO: 683040 - RNA, 19 nt, Homo sapiens
gaauggaauuagcaaacuu

SEQ ID NO: 683041 - RNA, 19 nt, Homo sapiens
gggcuugacuccuuaagau

SEQ ID NO: 683042 - RNA, 19 nt, Homo sapiens
gggaugucauuguaaauau

SEQ ID NO: 683043 - RNA, 19 nt, Homo sapiens
cuacuucgauguucuacuu

SEQ ID NO: 683044 - RNA, 19 nt, Homo sapiens
uggagaagcucuggaauau

SEQ ID NO: 683045 - RNA, 19 nt, Homo sapiens
gaauuuaggagacaacaga

SEQ ID NO: 683046 - RNA, 19 nt, Homo sapiens
ggaauuagcaaacuuaagg

SEQ ID NO: 683047 - RNA, 19 nt, Homo sapiens
uaucagaaaucaagacauc

SEQ ID NO: 683048 - RNA, 19 nt, Homo sapiens
uuagagacacccucauuua

SEQ ID NO: 683049 - RNA, 19 nt, Homo sapiens
cuacuuugcuuuccaagga

SEQ ID NO: 683050 - RNA, 19 nt, Homo sapiens
ucauauugcugauggugua

SEQ ID NO: 683051 - RNA, 19 nt, Homo sapiens
agagucacauugcugcuua

SEQ ID NO: 683052 - RNA, 19 nt, Homo sapiens
cauaaucgguugucuaacu

SEQ ID NO: 683053 - RNA, 19 nt, Homo sapiens
gagaaaacaucacuacuuc

SEQ ID NO: 683054 - RNA, 19 nt, Homo sapiens
caggaggucucucagcaaa

SEQ ID NO: 683055 - RNA, 19 nt, Homo sapiens
gcuuuacucuuucuuuaug

SEQ ID NO: 683056 - RNA, 19 nt, Homo sapiens
caaacugacuguaaaugag

SEQ ID NO: 683057 - RNA, 19 nt, Homo sapiens
gaaggaaaauaucagugua

SEQ ID NO: 683058 - RNA, 19 nt, Homo sapiens
gacacauccugaaaccaua

SEQ ID NO: 683059 - RNA, 19 nt, Homo sapiens
ggacacauccugaaaccau

SEQ ID NO: 683060 - RNA, 19 nt, Homo sapiens
ggcaaagcauccugaaugu

SEQ ID NO: 683061 - RNA, 19 nt, Homo sapiens
gagccagaaugcuauugaa

SEQ ID NO: 683062 - RNA, 19 nt, Homo sapiens
gcugguugcuucgauaauu

SEQ ID NO: 683063 - RNA, 19 nt, Homo sapiens
gcauugggcaugaagauga

SEQ ID NO: 683064 - RNA, 19 nt, Homo sapiens
uagaagaugcugggaaaua

SEQ ID NO: 683065 - RNA, 19 nt, Homo sapiens
gcaaaugcuucccuaacag

SEQ ID NO: 683066 - RNA, 19 nt, Homo sapiens
gcaucuagauuugaacaau

SEQ ID NO: 683067 - RNA, 19 nt, Homo sapiens
agaagaaacuccgaaguca

SEQ ID NO: 683068 - RNA, 19 nt, Homo sapiens
agaagaugcugggaaauau

SEQ ID NO: 683069 - RNA, 19 nt, Homo sapiens
ccaaacugacuguaaauga

SEQ ID NO: 683070 - RNA, 19 nt, Homo sapiens
gaauaacauggaagaacua

SEQ ID NO: 683071 - RNA, 19 nt, Homo sapiens
caauggaucugacuauucg

SEQ ID NO: 683072 - RNA, 19 nt, Homo sapiens
uagagugcuuucucgguua

SEQ ID NO: 683073 - RNA, 19 nt, Homo sapiens
gcaugggaguucugccaaa

SEQ ID NO: 683074 - RNA, 19 nt, Homo sapiens
gaggcugguugcuucgaua

SEQ ID NO: 683075 - RNA, 19 nt, Homo sapiens
ccucagcucaaauauaaua

SEQ ID NO: 683076 - RNA, 19 nt, Homo sapiens
aagccaaacugacuguaaa

SEQ ID NO: 683077 - RNA, 19 nt, Homo sapiens
gcgcaaagacagugaaauc

SEQ ID NO: 683078 - RNA, 19 nt, Homo sapiens
gaaaccauaauugcucuaa

SEQ ID NO: 683079 - RNA, 19 nt, Homo sapiens
acaaagaaagcauucauug

SEQ ID NO: 683080 - RNA, 19 nt, Homo sapiens
caaggaaaccagauuaagu

SEQ ID NO: 683081 - RNA, 19 nt, Homo sapiens
uuacaaggaaaccagauua

SEQ ID NO: 683082 - RNA, 19 nt, Homo sapiens
ggaauggaauuagcaaacu

SEQ ID NO: 683083 - RNA, 19 nt, Homo sapiens
gcaugcagcuuaaauaccu

SEQ ID NO: 683084 - RNA, 19 nt, Homo sapiens
cgagaauacuguccauaca

SEQ ID NO: 683085 - RNA, 19 nt, Homo sapiens
guuguggucugcuguguug

SEQ ID NO: 683086 - RNA, 19 nt, Homo sapiens
acaagucucacuaaacuaa

SEQ ID NO: 683087 - RNA, 19 nt, Homo sapiens
ugaauaacauggaagaacu

SEQ ID NO: 683088 - RNA, 19 nt, Homo sapiens
guuuagaccucagcucaaa

SEQ ID NO: 683089 - RNA, 19 nt, Homo sapiens
gcccuagucuucagaaugg

SEQ ID NO: 683090 - RNA, 19 nt, Homo sapiens
gccaauggauauauacaca

SEQ ID NO: 683091 - RNA, 19 nt, Homo sapiens
gccaauggaucugacuauu

SEQ ID NO: 683092 - RNA, 19 nt, Homo sapiens
ggagaagcucuggaauaua

SEQ ID NO: 683093 - RNA, 19 nt, Homo sapiens
caacauggcuccuuacuau

SEQ ID NO: 683094 - RNA, 19 nt, Homo sapiens
gaaaggagaucugcuacua

SEQ ID NO: 683095 - RNA, 19 nt, Homo sapiens
ccaagaaacuaucaagaaa

SEQ ID NO: 683096 - RNA, 19 nt, Homo sapiens
gagcagagauucuugaagu

SEQ ID NO: 683097 - RNA, 19 nt, Homo sapiens
ggaaucauauaggucauua

SEQ ID NO: 683098 - RNA, 19 nt, Homo sapiens
gaaaccaacagaccugaua

SEQ ID NO: 683099 - RNA, 19 nt, Homo sapiens
ggaauucauugaucaggaa

SEQ ID NO: 683100 - RNA, 19 nt, Homo sapiens
cagcugaacucuuccuuga

SEQ ID NO: 683101 - RNA, 19 nt, Homo sapiens
gaacuguccagguuuauug

SEQ ID NO: 683102 - RNA, 19 nt, Homo sapiens
gaaauucgcgaugcaauga

SEQ ID NO: 683103 - RNA, 19 nt, Homo sapiens
caggaacuguccagguuua

SEQ ID NO: 683104 - RNA, 19 nt, Homo sapiens
gaagaaggcaaaugaagau

SEQ ID NO: 683105 - RNA, 19 nt, Homo sapiens
caagaaaggagaucugcua

SEQ ID NO: 683106 - RNA, 19 nt, Homo sapiens
gcagaagcguuugguguug

SEQ ID NO: 683107 - RNA, 19 nt, Homo sapiens
aaggagaucugcuacuaaa

SEQ ID NO: 683108 - RNA, 19 nt, Homo sapiens
aggauuugcuuuagagaua

SEQ ID NO: 683109 - RNA, 19 nt, Homo sapiens
ggucaccgauuggauauug

SEQ ID NO: 683110 - RNA, 19 nt, Homo sapiens
gcagauagacguggaccua

SEQ ID NO: 683111 - RNA, 19 nt, Homo sapiens
gaaugccguuacucuguuu

SEQ ID NO: 683112 - RNA, 19 nt, Homo sapiens
gaaggcaaaugaagaugag

SEQ ID NO: 683113 - RNA, 19 nt, Homo sapiens
ccauguaacuaacaaagga

SEQ ID NO: 683114 - RNA, 19 nt, Homo sapiens
auaacaacauggcuccuua

SEQ ID NO: 683115 - RNA, 19 nt, Homo sapiens
gcugaacucuuccuugaca

SEQ ID NO: 683116 - RNA, 19 nt, Homo sapiens
aagaugaguugaagcguuu

SEQ ID NO: 683117 - RNA, 19 nt, Homo sapiens
gcacagucuuccagcaguu

SEQ ID NO: 683118 - RNA, 19 nt, Homo sapiens
caaaugaagaugaguugaa

SEQ ID NO: 683119 - RNA, 19 nt, Homo sapiens
caacauuuacauccuauga

SEQ ID NO: 683120 - RNA, 19 nt, Homo sapiens
gcgaugcaaugauggcaaa

SEQ ID NO: 683121 - RNA, 19 nt, Homo sapiens
ggauuugcuuuagagauaa

SEQ ID NO: 683122 - RNA, 19 nt, Homo sapiens
ggagaucugcuacuaaaca

SEQ ID NO: 683123 - RNA, 19 nt, Homo sapiens
gagaauucaugcauacagu

SEQ ID NO: 683124 - RNA, 19 nt, Homo sapiens
ugacuuauacugucuaugu

SEQ ID NO: 683125 - RNA, 19 nt, Homo sapiens
acaggcagcugaacucuuc

SEQ ID NO: 683126 - RNA, 19 nt, Homo sapiens
uaugaagccuugugcaaau

SEQ ID NO: 683127 - RNA, 19 nt, Homo sapiens
gacguggaccuacucaaua

SEQ ID NO: 683128 - RNA, 19 nt, Homo sapiens
gcuggaagaugcagagaag

SEQ ID NO: 683129 - RNA, 19 nt, Homo sapiens
guaaagccauguaacuaac

SEQ ID NO: 683130 - RNA, 19 nt, Homo sapiens
ccgauuggauauuguauuc

SEQ ID NO: 683131 - RNA, 19 nt, Homo sapiens
cauuaacccuuggcuauau

SEQ ID NO: 683132 - RNA, 19 nt, Homo sapiens
guaagagaaaugagaauuc

SEQ ID NO: 683133 - RNA, 19 nt, Homo sapiens
gccaaaagcuuaauagaag

SEQ ID NO: 683134 - RNA, 19 nt, Homo sapiens
aaaugaagaaggcaaauga

SEQ ID NO: 683135 - RNA, 19 nt, Homo sapiens
ugaagaaggcaaaugaaga

SEQ ID NO: 683136 - RNA, 19 nt, Homo sapiens
uguaaagccauguaacuaa

SEQ ID NO: 683137 - RNA, 19 nt, Homo sapiens
ugaaugccguuacucuguu

SEQ ID NO: 683138 - RNA, 19 nt, Homo sapiens
gaucucaucacacgaaaca

SEQ ID NO: 683139 - RNA, 19 nt, Homo sapiens
cagagauucuugaaguguu

SEQ ID NO: 683140 - RNA, 19 nt, Homo sapiens
uaugauugccuuagaaaga

SEQ ID NO: 683141 - RNA, 19 nt, Homo sapiens
ucaguaugauugccuuaga

SEQ ID NO: 683142 - RNA, 19 nt, Homo sapiens
ccuuaggauuggcuuauuu

SEQ ID NO: 683143 - RNA, 19 nt, Homo sapiens
ccggauaggugacaaagag

SEQ ID NO: 683144 - RNA, 19 nt, Homo sapiens
gaaauaguagaaaccaaca

SEQ ID NO: 683145 - RNA, 19 nt, Homo sapiens
uaaaggagcagagauucuu

SEQ ID NO: 683146 - RNA, 19 nt, Homo sapiens
gggaaaaggucauuaaagg

SEQ ID NO: 683147 - RNA, 19 nt, Homo sapiens
gaccagaucucagggaaaa

SEQ ID NO: 683148 - RNA, 19 nt, Homo sapiens
guaucagggucuuuauugu

SEQ ID NO: 683149 - RNA, 19 nt, Homo sapiens
gaaaaggccaaaagcuuaa

SEQ ID NO: 683150 - RNA, 19 nt, Homo sapiens
gaguaccucugccggauag

SEQ ID NO: 683151 - RNA, 19 nt, Homo sapiens
gagacuacacugcaaaaua

SEQ ID NO: 683152 - RNA, 19 nt, Homo sapiens
gguguggaauucauugauc

SEQ ID NO: 683153 - RNA, 19 nt, Homo sapiens
ucgauacuauguaagagaa

SEQ ID NO: 683154 - RNA, 19 nt, Homo sapiens
acguggaccuacucaauaa

SEQ ID NO: 683155 - RNA, 19 nt, Homo sapiens
gagaagaaucuaggagaga

SEQ ID NO: 683156 - RNA, 19 nt, Homo sapiens
cuacuaaacagaguucaaa

SEQ ID NO: 683157 - RNA, 19 nt, Homo sapiens
aagaaacuaucaagaaagg

SEQ ID NO: 683158 - RNA, 19 nt, Homo sapiens
caguaugauugccuuagaa

SEQ ID NO: 683159 - RNA, 19 nt, Homo sapiens
gcagagauucuugaagugu

SEQ ID NO: 683160 - RNA, 19 nt, Homo sapiens
cauuaaaggagcagagauu

SEQ ID NO: 683161 - RNA, 19 nt, Homo sapiens
gaagaugcagagaagaauc

SEQ ID NO: 683162 - RNA, 19 nt, Homo sapiens
aaaugaagaugaguugaag

SEQ ID NO: 683163 - RNA, 19 nt, Homo sapiens
aggagggucugcccaagaa

SEQ ID NO: 683164 - RNA, 19 nt, Homo sapiens
ggaacuguccagguuuauu

SEQ ID NO: 683165 - RNA, 19 nt, Homo sapiens
cuauauggcagaagcguuu

SEQ ID NO: 683166 - RNA, 19 nt, Homo sapiens
gaauucaugcauacaguca

SEQ ID NO: 683167 - RNA, 19 nt, Homo sapiens
cauuagcgguuguggaaca

SEQ ID NO: 683168 - RNA, 19 nt, Homo sapiens
gcaguucggcaguaucugu

SEQ ID NO: 683169 - RNA, 19 nt, Homo sapiens
gaaaccgccuaaaagugua

SEQ ID NO: 683170 - RNA, 19 nt, Homo sapiens
gacaggagaaaccgccuaa

SEQ ID NO: 683171 - RNA, 19 nt, Homo sapiens
caagaaacuaucaagaaag

SEQ ID NO: 683172 - RNA, 19 nt, Homo sapiens
ggcagaagcguuugguguu

SEQ ID NO: 683173 - RNA, 19 nt, Homo sapiens
agaaaaggccaaaagcuua

SEQ ID NO: 683174 - RNA, 19 nt, Homo sapiens
ggaagaugcagagaagaau

SEQ ID NO: 683175 - RNA, 19 nt, Homo sapiens
gagaucugcuacuaaacag

SEQ ID NO: 683176 - RNA, 19 nt, Homo sapiens
aaaggagaucugcuacuaa

SEQ ID NO: 683177 - RNA, 19 nt, Homo sapiens
ucauuaacccuuggcuaua

SEQ ID NO: 683178 - RNA, 19 nt, Homo sapiens
agagauucuugaaguguug

SEQ ID NO: 683179 - RNA, 19 nt, Homo sapiens
gcaaaugaagaugaguuga

SEQ ID NO: 683180 - RNA, 19 nt, Homo sapiens
ucgcaagacauaugacaaa

SEQ ID NO: 683181 - RNA, 19 nt, Homo sapiens
acauggcuccuuacuauga

SEQ ID NO: 683182 - RNA, 19 nt, Homo sapiens
gaggagggucugcccaaga

SEQ ID NO: 683183 - RNA, 19 nt, Homo sapiens
gauaacaacauggcuccuu

SEQ ID NO: 683184 - RNA, 19 nt, Homo sapiens
gucauuaacccuuggcuau

SEQ ID NO: 683185 - RNA, 19 nt, Homo sapiens
ggcuauucgugauuucaaa

SEQ ID NO: 683186 - RNA, 19 nt, Homo sapiens
agacuacacugcaaaauag

SEQ ID NO: 683187 - RNA, 19 nt, Homo sapiens
aaagccauguaacuaacaa

SEQ ID NO: 683188 - RNA, 19 nt, Homo sapiens
ggcaguaccaagaaacuau

SEQ ID NO: 683189 - RNA, 19 nt, Homo sapiens
ccaacagaccugauagcaa

SEQ ID NO: 683190 - RNA, 19 nt, Homo sapiens
uguaucagggucuuuauug

SEQ ID NO: 683191 - RNA, 19 nt, Homo sapiens
ggagaaaccgccuaaaagu

SEQ ID NO: 683192 - RNA, 19 nt, Homo sapiens
cauggcuccuuacuaugaa

SEQ ID NO: 683193 - RNA, 19 nt, Homo sapiens
gcgaagacauugaggauua

SEQ ID NO: 683194 - RNA, 19 nt, Homo sapiens
gcaacaaccugauuaagga

SEQ ID NO: 683195 - RNA, 19 nt, Homo sapiens
ggaaggagcgcuggaguua

SEQ ID NO: 683196 - RNA, 19 nt, Homo sapiens
ucaacaaccuuauggcuaa

SEQ ID NO: 683197 - RNA, 19 nt, Homo sapiens
uuaaggagcugcugaagga

SEQ ID NO: 683198 - RNA, 19 nt, Homo sapiens
gagcugaggugcccuucuu

SEQ ID NO: 683199 - RNA, 19 nt, Homo sapiens
ggacugccaucgagcauuc

SEQ ID NO: 683200 - RNA, 19 nt, Homo sapiens
ggagagauccugaccaauc

SEQ ID NO: 683201 - RNA, 19 nt, Homo sapiens
gcagaaaucgggagagaau

SEQ ID NO: 683202 - RNA, 19 nt, Homo sapiens
caaccuggcagaugcguua

SEQ ID NO: 683203 - RNA, 19 nt, Homo sapiens
gcaaucaacaugaagaaau

SEQ ID NO: 683204 - RNA, 19 nt, Homo sapiens
uaccuucguucauguauaa

SEQ ID NO: 683205 - RNA, 19 nt, Homo sapiens
gaagaaguacucucaugga

SEQ ID NO: 683206 - RNA, 19 nt, Homo sapiens
gcacaucgccaaacuagag

SEQ ID NO: 683207 - RNA, 19 nt, Homo sapiens
ggaaaucuaccuucguuca

SEQ ID NO: 683208 - RNA, 19 nt, Homo sapiens
guggacagcuuucacuuuc

SEQ ID NO: 683209 - RNA, 19 nt, Homo sapiens
caaacuuccugcuccaaga

SEQ ID NO: 683210 - RNA, 19 nt, Homo sapiens
gcucagagugaaauaauga

SEQ ID NO: 683211 - RNA, 19 nt, Homo sapiens
cuggaaagcugaaauccuu

SEQ ID NO: 683212 - RNA, 19 nt, Homo sapiens
ucacaaacauccucaagac

SEQ ID NO: 683213 - RNA, 19 nt, Homo sapiens
caucgagcauucucucuug

SEQ ID NO: 683214 - RNA, 19 nt, Homo sapiens
agaagucgcugcagaugau

SEQ ID NO: 683215 - RNA, 19 nt, Homo sapiens
ucacagccaucaguaaguu

SEQ ID NO: 683216 - RNA, 19 nt, Homo sapiens
gggaagcagugaggaaaga

SEQ ID NO: 683217 - RNA, 19 nt, Homo sapiens
ggacuucacugaggauguc

SEQ ID NO: 683218 - RNA, 19 nt, Homo sapiens
gagacaaggacuucacuga

SEQ ID NO: 683219 - RNA, 19 nt, Homo sapiens
ggagccaccugggauauuc

SEQ ID NO: 683220 - RNA, 19 nt, Homo sapiens
ugacaucuccuuccucaug

SEQ ID NO: 683221 - RNA, 19 nt, Homo sapiens
caucucagccgccaucuug

SEQ ID NO: 683222 - RNA, 19 nt, Homo sapiens
cagcagaaaucgggagaga

SEQ ID NO: 683223 - RNA, 19 nt, Homo sapiens
gaagagacaccgcgaagac

SEQ ID NO: 683224 - RNA, 19 nt, Homo sapiens
cgagcauucucucuugaaa

SEQ ID NO: 683225 - RNA, 19 nt, Homo sapiens
caaacauccucaagacgau

SEQ ID NO: 683226 - RNA, 19 nt, Homo sapiens
uggugaaguugaagaagua

SEQ ID NO: 683227 - RNA, 19 nt, Homo sapiens
ugaaguaugccauuaguuc

SEQ ID NO: 683228 - RNA, 19 nt, Homo sapiens
guacggaggagcucaagug

SEQ ID NO: 683229 - RNA, 19 nt, Homo sapiens
uaccugaaguaugccauua

SEQ ID NO: 683230 - RNA, 19 nt, Homo sapiens
caggaugucucccgguuuc

SEQ ID NO: 683231 - RNA, 19 nt, Homo sapiens
gaagacauugaggauuaua

SEQ ID NO: 683232 - RNA, 19 nt, Homo sapiens
gcgcuggaguuacuaccaa

SEQ ID NO: 683233 - RNA, 19 nt, Homo sapiens
gagaagucgcugcagauga

SEQ ID NO: 683234 - RNA, 19 nt, Homo sapiens
gggagagaaugccaacauc

SEQ ID NO: 683235 - RNA, 19 nt, Homo sapiens
ccaauccucucaucuuguc

SEQ ID NO: 683236 - RNA, 19 nt, Homo sapiens
uaccuggccugcucacuga

SEQ ID NO: 683237 - RNA, 19 nt, Homo sapiens
cauucucucuugaaacuug

SEQ ID NO: 683238 - RNA, 19 nt, Homo sapiens
guucccagaugguguccua

SEQ ID NO: 683239 - RNA, 19 nt, Homo sapiens
cgaagacauugaggauuau

SEQ ID NO: 683240 - RNA, 19 nt, Homo sapiens
acacaaugcccuacuggaa

SEQ ID NO: 683241 - RNA, 19 nt, Homo sapiens
cuggagaucuggaaagcuu

SEQ ID NO: 683242 - RNA, 19 nt, Homo sapiens
caguguggcacccucauua

SEQ ID NO: 683243 - RNA, 19 nt, Homo sapiens
uguaauaugugagggaaau

SEQ ID NO: 683244 - RNA, 19 nt, Homo sapiens
gcaaaguguguaugugugu

SEQ ID NO: 683245 - RNA, 19 nt, Homo sapiens
ggugugcccucaguuccua

SEQ ID NO: 683246 - RNA, 19 nt, Homo sapiens
uaacaucaaagggaaggua

SEQ ID NO: 683247 - RNA, 19 nt, Homo sapiens
cuaccuucguucauguaua

SEQ ID NO: 683248 - RNA, 19 nt, Homo sapiens
agggaaaucuaccuucguu

SEQ ID NO: 683249 - RNA, 19 nt, Homo sapiens
ugucggaacuggugaaggu

SEQ ID NO: 683250 - RNA, 19 nt, Homo sapiens
gugcagccuucgaaguuga

SEQ ID NO: 683251 - RNA, 19 nt, Homo sapiens
gagaggguggugaucauga

SEQ ID NO: 683252 - RNA, 19 nt, Homo sapiens
ccaaugggcaaucaacaug

SEQ ID NO: 683253 - RNA, 19 nt, Homo sapiens
agaugaagcuagugcagau

SEQ ID NO: 683254 - RNA, 19 nt, Homo sapiens
gaaaucuaccuucguucau

SEQ ID NO: 683255 - RNA, 19 nt, Homo sapiens
ccucggagaugaagcuagu

SEQ ID NO: 683256 - RNA, 19 nt, Homo sapiens
ccucaagauuccacagguu

SEQ ID NO: 683257 - RNA, 19 nt, Homo sapiens
ggacagcuuucacuuuccu

SEQ ID NO: 683258 - RNA, 19 nt, Homo sapiens
aaaucuaccuucguucaug

SEQ ID NO: 683259 - RNA, 19 nt, Homo sapiens
agccauugcugcacucuga

SEQ ID NO: 683260 - RNA, 19 nt, Homo sapiens
ccacgcagaucaaguuucc

SEQ ID NO: 683261 - RNA, 19 nt, Homo sapiens
gaugcaaaguguguaugug

SEQ ID NO: 683262 - RNA, 19 nt, Homo sapiens
caagggaagcagugaggaa

SEQ ID NO: 683263 - RNA, 19 nt, Homo sapiens
gagacaccgcgaagacauu

SEQ ID NO: 683264 - RNA, 19 nt, Homo sapiens
caacauccagcccaacauc

SEQ ID NO: 683265 - RNA, 19 nt, Homo sapiens
aaaggagccaccugggaua

SEQ ID NO: 683266 - RNA, 19 nt, Homo sapiens
agagugaaauaaugaaggu

SEQ ID NO: 683267 - RNA, 19 nt, Homo sapiens
uugaagaaguacucucaug

SEQ ID NO: 683268 - RNA, 19 nt, Homo sapiens
gcaaagcagaggaaugcau

SEQ ID NO: 683269 - RNA, 19 nt, Homo sapiens
gaagcagugaggaaagaug

SEQ ID NO: 683270 - RNA, 19 nt, Homo sapiens
ucacugaggaugucaacug

SEQ ID NO: 683271 - RNA, 19 nt, Homo sapiens
gcagacagccacgcagauc

SEQ ID NO: 683272 - RNA, 19 nt, Homo sapiens
agaggguggugaucaugaa

SEQ ID NO: 683273 - RNA, 19 nt, Homo sapiens
ccuggcagaugcguuacua

SEQ ID NO: 683274 - RNA, 19 nt, Homo sapiens
cagaugguguccuacucuu

SEQ ID NO: 683275 - RNA, 19 nt, Homo sapiens
uguccuaccugaaguaugc

SEQ ID NO: 683276 - RNA, 19 nt, Homo sapiens
gggcaaucaacaugaagaa

SEQ ID NO: 683277 - RNA, 19 nt, Homo sapiens
cgacugcugagcucuaaug

SEQ ID NO: 683278 - RNA, 19 nt, Homo sapiens
cagccacgcagaucaaguu

SEQ ID NO: 683279 - RNA, 19 nt, Homo sapiens
aaugggcaaucaacaugaa

SEQ ID NO: 683280 - RNA, 19 nt, Homo sapiens
ggagcccacugucacaaac

SEQ ID NO: 683281 - RNA, 19 nt, Homo sapiens
gcaguguggcacccucauu

SEQ ID NO: 683282 - RNA, 19 nt, Homo sapiens
ugagcagccuggaccacaa

SEQ ID NO: 683283 - RNA, 19 nt, Homo sapiens
gugaaggugucagccaugu

SEQ ID NO: 683284 - RNA, 19 nt, Homo sapiens
ugaaggagacgcggaagga

SEQ ID NO: 683285 - RNA, 19 nt, Homo sapiens
gugagaacacccugcaguu

SEQ ID NO: 683286 - RNA, 19 nt, Homo sapiens
ugaagcuagugcagaugaa

SEQ ID NO: 683287 - RNA, 19 nt, Homo sapiens
gagagaaugccaacaucca

SEQ ID NO: 683288 - RNA, 19 nt, Homo sapiens
gcuuucacuuuccucaaga

SEQ ID NO: 683289 - RNA, 19 nt, Homo sapiens
ccugaaguaugccauuagu

SEQ ID NO: 683290 - RNA, 19 nt, Homo sapiens
aaggagcgcuggaguuacu

SEQ ID NO: 683291 - RNA, 19 nt, Homo sapiens
cccgguuucuucuuucaaa

SEQ ID NO: 683292 - RNA, 19 nt, Homo sapiens
caaugggcaaucaacauga

SEQ ID NO: 683293 - RNA, 19 nt, Homo sapiens
gagaugagcuuguguaugu

SEQ ID NO: 683294 - RNA, 19 nt, Homo sapiens
ggaaacaggugaugucauu

SEQ ID NO: 683295 - RNA, 19 nt, Homo sapiens
gaaaggagccaaaggauuu

SEQ ID NO: 683296 - RNA, 19 nt, Homo sapiens
ggacaaugcuucuguagug

SEQ ID NO: 683297 - RNA, 19 nt, Homo sapiens
gguaggagaucaaaucauu

SEQ ID NO: 683298 - RNA, 19 nt, Homo sapiens
gaaauggccuauacagaga

SEQ ID NO: 683299 - RNA, 19 nt, Homo sapiens
caauagaacucaucaaauc

SEQ ID NO: 683300 - RNA, 19 nt, Homo sapiens
ggacuuaugaagacaauua

SEQ ID NO: 683301 - RNA, 19 nt, Homo sapiens
guacagaaccugagccaua

SEQ ID NO: 683302 - RNA, 19 nt, Homo sapiens
caguguagcuuuaguuuaa

SEQ ID NO: 683303 - RNA, 19 nt, Homo sapiens
cauaugagcucuacgagaa

SEQ ID NO: 683304 - RNA, 19 nt, Homo sapiens
caucaaaucuggaggaaga

SEQ ID NO: 683305 - RNA, 19 nt, Homo sapiens
caauggaaauggaguagua

SEQ ID NO: 683306 - RNA, 19 nt, Homo sapiens
gagcagaggcagaguauuu

SEQ ID NO: 683307 - RNA, 19 nt, Homo sapiens
gaccuaaacugauccuaaa

SEQ ID NO: 683308 - RNA, 19 nt, Homo sapiens
gaagauggaccagcaauaa

SEQ ID NO: 683309 - RNA, 19 nt, Homo sapiens
caacaugggcuuuggauuu

SEQ ID NO: 683310 - RNA, 19 nt, Homo sapiens
gaagacagcacaucaucua

SEQ ID NO: 683311 - RNA, 19 nt, Homo sapiens
gcucauagaucuuaauugg

SEQ ID NO: 683312 - RNA, 19 nt, Homo sapiens
gcagaguauuugucuuaua

SEQ ID NO: 683313 - RNA, 19 nt, Homo sapiens
guaccacuauggauaaauu

SEQ ID NO: 683314 - RNA, 19 nt, Homo sapiens
acacagaacuuggaacaaa

SEQ ID NO: 683315 - RNA, 19 nt, Homo sapiens
gcagauggaugacacaaag

SEQ ID NO: 683316 - RNA, 19 nt, Homo sapiens
ucaaaggucacacguaaua

SEQ ID NO: 683317 - RNA, 19 nt, Homo sapiens
ucucaaaggucacacguaa

SEQ ID NO: 683318 - RNA, 19 nt, Homo sapiens
cuaaaucccauuccaaaua

SEQ ID NO: 683319 - RNA, 19 nt, Homo sapiens
caguauaguuugccauuaa

SEQ ID NO: 683320 - RNA, 19 nt, Homo sapiens
agacgagccugaugaguuu

SEQ ID NO: 683321 - RNA, 19 nt, Homo sapiens
ggaaauggaguaguaguaa

SEQ ID NO: 683322 - RNA, 19 nt, Homo sapiens
acagaaaucuuguuuacug

SEQ ID NO: 683323 - RNA, 19 nt, Homo sapiens
ccagaagagugcaaagaaa

SEQ ID NO: 683324 - RNA, 19 nt, Homo sapiens
caacuaaaccugaagacaa

SEQ ID NO: 683325 - RNA, 19 nt, Homo sapiens
aaacuggaauaucgccuua

SEQ ID NO: 683326 - RNA, 19 nt, Homo sapiens
ggauuuggauucagcauuc

SEQ ID NO: 683327 - RNA, 19 nt, Homo sapiens
gagucuggauccacuauaa

SEQ ID NO: 683328 - RNA, 19 nt, Homo sapiens
ggacagcgggugaaacaaa

SEQ ID NO: 683329 - RNA, 19 nt, Homo sapiens
ccacauaaauagaagaaca

SEQ ID NO: 683330 - RNA, 19 nt, Homo sapiens
gaggaauuguugauaaaga

SEQ ID NO: 683331 - RNA, 19 nt, Homo sapiens
ggaguucaaaugcaaauaa

SEQ ID NO: 683332 - RNA, 19 nt, Homo sapiens
gaucuaaagcguuguaaau

SEQ ID NO: 683333 - RNA, 19 nt, Homo sapiens
uagcagagauggauagcuu

SEQ ID NO: 683334 - RNA, 19 nt, Homo sapiens
gcgcagaccuaaacugauc

SEQ ID NO: 683335 - RNA, 19 nt, Homo sapiens
ggagaaagccaguauagag

SEQ ID NO: 683336 - RNA, 19 nt, Homo sapiens
aaacguaccacuauggaua

SEQ ID NO: 683337 - RNA, 19 nt, Homo sapiens
ccaccucccugcacuugua

SEQ ID NO: 683338 - RNA, 19 nt, Homo sapiens
agagauggauagcuucuuu

SEQ ID NO: 683339 - RNA, 19 nt, Homo sapiens
ggacaaaguuaagagcaau

SEQ ID NO: 683340 - RNA, 19 nt, Homo sapiens
cuuaugaccuuaaccauug

SEQ ID NO: 683341 - RNA, 19 nt, Homo sapiens
gacuagaaauccaguauag

SEQ ID NO: 683342 - RNA, 19 nt, Homo sapiens
ggagaaaggagccaaagga

SEQ ID NO: 683343 - RNA, 19 nt, Homo sapiens
ccagacccauugccugaua

SEQ ID NO: 683344 - RNA, 19 nt, Homo sapiens
gacagcacaucaucuaaau

SEQ ID NO: 683345 - RNA, 19 nt, Homo sapiens
ggacuagaaauccaguaua

SEQ ID NO: 683346 - RNA, 19 nt, Homo sapiens
caagaaacaggacaaaguu

SEQ ID NO: 683347 - RNA, 19 nt, Homo sapiens
gagacgagccugaugaguu

SEQ ID NO: 683348 - RNA, 19 nt, Homo sapiens
ugaaggagcagauggauga

SEQ ID NO: 683349 - RNA, 19 nt, Homo sapiens
gcugaaagccucaagugaa

SEQ ID NO: 683350 - RNA, 19 nt, Homo sapiens
ugauugaccuccuaguaaa

SEQ ID NO: 683351 - RNA, 19 nt, Homo sapiens
gcuuauccuucuuuccuua

SEQ ID NO: 683352 - RNA, 19 nt, Homo sapiens
aacaugggcuuuggauuua

SEQ ID NO: 683353 - RNA, 19 nt, Homo sapiens
aaaggaagcuacagcaaca

SEQ ID NO: 683354 - RNA, 19 nt, Homo sapiens
gaaaaguggugcucuccua

SEQ ID NO: 683355 - RNA, 19 nt, Homo sapiens
cugaguagcaguuuaauuu

SEQ ID NO: 683356 - RNA, 19 nt, Homo sapiens
gcaauagaacucaucaaau

SEQ ID NO: 683357 - RNA, 19 nt, Homo sapiens
gaaggcgaccucauuguug

SEQ ID NO: 683358 - RNA, 19 nt, Homo sapiens
acagucaguuccagauaua

SEQ ID NO: 683359 - RNA, 19 nt, Homo sapiens
ggaagacacaacuaugaaa

SEQ ID NO: 683360 - RNA, 19 nt, Homo sapiens
auaaagaccuucgucacua

SEQ ID NO: 683361 - RNA, 19 nt, Homo sapiens
cagcugggcuuugaacuga

SEQ ID NO: 683362 - RNA, 19 nt, Homo sapiens
gaaacccauucaucguaaa

SEQ ID NO: 683363 - RNA, 19 nt, Homo sapiens
guuagcaacuucuagaugu

SEQ ID NO: 683364 - RNA, 19 nt, Homo sapiens
ccagugauguggucauuca

SEQ ID NO: 683365 - RNA, 19 nt, Homo sapiens
gaggauggagucuggauuu

SEQ ID NO: 683366 - RNA, 19 nt, Homo sapiens
gaccuuaaccauugugaaa

SEQ ID NO: 683367 - RNA, 19 nt, Homo sapiens
gcaaaucauucgugacaac

SEQ ID NO: 683368 - RNA, 19 nt, Homo sapiens
aaggaggaauuguugauaa

SEQ ID NO: 683369 - RNA, 19 nt, Homo sapiens
gcaguguagcuuuaguuua

SEQ ID NO: 683370 - RNA, 19 nt, Homo sapiens
acagugcaguguagcuuua

SEQ ID NO: 683371 - RNA, 19 nt, Homo sapiens
gagagacagugcaguguag

SEQ ID NO: 683372 - RNA, 19 nt, Homo sapiens
gcgcaggcaguucuucuua

SEQ ID NO: 683373 - RNA, 19 nt, Homo sapiens
gaaugagggcuucggcuuu

SEQ ID NO: 683374 - RNA, 19 nt, Homo sapiens
cacccaagcugaacuuaug

SEQ ID NO: 683375 - RNA, 19 nt, Homo sapiens
gcucaagugugucaagcaa

SEQ ID NO: 683376 - RNA, 19 nt, Homo sapiens
ggcaaagucugcuguucuu

SEQ ID NO: 683377 - RNA, 19 nt, Homo sapiens
gcagauguugucaaacuuu

SEQ ID NO: 683378 - RNA, 19 nt, Homo sapiens
aaaaugagcuuccauaugg

SEQ ID NO: 683379 - RNA, 19 nt, Homo sapiens
guucacagcuacuacuugu

SEQ ID NO: 683380 - RNA, 19 nt, Homo sapiens
cggaguaguuuaguuguuu

SEQ ID NO: 683381 - RNA, 19 nt, Homo sapiens
cgagaaaucuagggccauu

SEQ ID NO: 683382 - RNA, 19 nt, Homo sapiens
aagcugaacuuaugaccuu

SEQ ID NO: 683383 - RNA, 19 nt, Homo sapiens
ucaugcagauguugucaaa

SEQ ID NO: 683384 - RNA, 19 nt, Homo sapiens
ccacaaggccacauaagga

SEQ ID NO: 683385 - RNA, 19 nt, Homo sapiens
ccaguauaguuugccauua

SEQ ID NO: 683386 - RNA, 19 nt, Homo sapiens
cuagaaauccaguauaguu

SEQ ID NO: 683387 - RNA, 19 nt, Homo sapiens
caguuuagcucauagaucu

SEQ ID NO: 683388 - RNA, 19 nt, Homo sapiens
gaaacugagacaagauuau

SEQ ID NO: 683389 - RNA, 19 nt, Homo sapiens
ggaacacgacguuaggaaa

SEQ ID NO: 683390 - RNA, 19 nt, Homo sapiens
auacagaaguaguggauau

SEQ ID NO: 683391 - RNA, 19 nt, Homo sapiens
gaacuuaugaccuuaacca

SEQ ID NO: 683392 - RNA, 19 nt, Homo sapiens
gaccauaacacaaagacaa

SEQ ID NO: 683393 - RNA, 19 nt, Homo sapiens
gaaauagacugucauucuu

SEQ ID NO: 683394 - RNA, 19 nt, Homo sapiens
gaaaagcucugacauuuaa

SEQ ID NO: 683395 - RNA, 19 nt, Homo sapiens
guaaacaggugguaaaguu

SEQ ID NO: 683396 - RNA, 19 nt, Homo sapiens
ccaaggaacucguuuaugu

SEQ ID NO: 683397 - RNA, 19 nt, Homo sapiens
ggaaggaacuuauuaccau

SEQ ID NO: 683398 - RNA, 19 nt, Homo sapiens
ggagcuaucuggcaccuuu

SEQ ID NO: 683399 - RNA, 19 nt, Homo sapiens
caaugaagguuauuuccua

SEQ ID NO: 683400 - RNA, 19 nt, Homo sapiens
ccacauuagugucuuuaua

SEQ ID NO: 683401 - RNA, 19 nt, Homo sapiens
gcaaauaccuggauuaccu

SEQ ID NO: 683402 - RNA, 19 nt, Homo sapiens
caacauggccagaaauauu

SEQ ID NO: 683403 - RNA, 19 nt, Homo sapiens
ucacagugguuauggauuu

SEQ ID NO: 683404 - RNA, 19 nt, Homo sapiens
ggaaauagacugucauucu

SEQ ID NO: 683405 - RNA, 19 nt, Homo sapiens
ugaaugagcugaucguugu

SEQ ID NO: 683406 - RNA, 19 nt, Homo sapiens
gaaggaacuuauuaccauu

SEQ ID NO: 683407 - RNA, 19 nt, Homo sapiens
guggguaucuguucuacua

SEQ ID NO: 683408 - RNA, 19 nt, Homo sapiens
uaacauacccgccaaggaa

SEQ ID NO: 683409 - RNA, 19 nt, Homo sapiens
ggaucuguguucuacuuua

SEQ ID NO: 683410 - RNA, 19 nt, Homo sapiens
gaaccagccaucugaauga

SEQ ID NO: 683411 - RNA, 19 nt, Homo sapiens
ggacugggccauuuuauua

SEQ ID NO: 683412 - RNA, 19 nt, Homo sapiens
ugugaugcauuacuucuua

SEQ ID NO: 683413 - RNA, 19 nt, Homo sapiens
gaacugaccaauagacuca

SEQ ID NO: 683414 - RNA, 19 nt, Homo sapiens
ucaauaaacccacuaauag

SEQ ID NO: 683415 - RNA, 19 nt, Homo sapiens
gucaauaaacccacuaaua

SEQ ID NO: 683416 - RNA, 19 nt, Homo sapiens
guaggauccuuuauuuguu

SEQ ID NO: 683417 - RNA, 19 nt, Homo sapiens
uaaauguccagaccacuua

SEQ ID NO: 683418 - RNA, 19 nt, Homo sapiens
gcugaucguuguuuauguu

SEQ ID NO: 683419 - RNA, 19 nt, Homo sapiens
gaggauaacuaagauuaca

SEQ ID NO: 683420 - RNA, 19 nt, Homo sapiens
uuaacgaacugaccaauag

SEQ ID NO: 683421 - RNA, 19 nt, Homo sapiens
ugauagagcauucaggaua

SEQ ID NO: 683422 - RNA, 19 nt, Homo sapiens
gguaggauccuuuauuugu

SEQ ID NO: 683423 - RNA, 19 nt, Homo sapiens
guaguguuguuugcucuua

SEQ ID NO: 683424 - RNA, 19 nt, Homo sapiens
caauaaacccacuaauaga

SEQ ID NO: 683425 - RNA, 19 nt, Homo sapiens
gggagaugaauaaauguua

SEQ ID NO: 683426 - RNA, 19 nt, Homo sapiens
ggacaaggccucugguucu

SEQ ID NO: 683427 - RNA, 19 nt, Homo sapiens
caugagagcaguaguguug

SEQ ID NO: 683428 - RNA, 19 nt, Homo sapiens
guuaagcaaugaagguuau

SEQ ID NO: 683429 - RNA, 19 nt, Homo sapiens
gugaaaagcucugacauuu

SEQ ID NO: 683430 - RNA, 19 nt, Homo sapiens
gaauguacacugugguuau

SEQ ID NO: 683431 - RNA, 19 nt, Homo sapiens
gaaauuucaaugccagauu

SEQ ID NO: 683432 - RNA, 19 nt, Homo sapiens
gauagagcauucaggauac

SEQ ID NO: 683433 - RNA, 19 nt, Homo sapiens
agacugucauucuuaguuu

SEQ ID NO: 683434 - RNA, 19 nt, Homo sapiens
gugguuugguuuacauuaa

SEQ ID NO: 683435 - RNA, 19 nt, Homo sapiens
ugacacagcuaugcgaaug

SEQ ID NO: 683436 - RNA, 19 nt, Homo sapiens
ccauagaacaucacugaaa

SEQ ID NO: 683437 - RNA, 19 nt, Homo sapiens
ccaguucacuuaccacauc

SEQ ID NO: 683438 - RNA, 19 nt, Homo sapiens
gauguaaacaggugguaaa

SEQ ID NO: 683439 - RNA, 19 nt, Homo sapiens
gaucuguguucuacuuuag

SEQ ID NO: 683440 - RNA, 19 nt, Homo sapiens
gaucguuguuuauguucaa

SEQ ID NO: 683441 - RNA, 19 nt, Homo sapiens
ugacuucgaggauaacuaa

SEQ ID NO: 683442 - RNA, 19 nt, Homo sapiens
gagcauucaggauaccuua

SEQ ID NO: 683443 - RNA, 19 nt, Homo sapiens
ggugaucucugccaagaag

SEQ ID NO: 683444 - RNA, 19 nt, Homo sapiens
ggaaccagccaucugaaug

SEQ ID NO: 683445 - RNA, 19 nt, Homo sapiens
ggguaucuguucuacuaaa

SEQ ID NO: 683446 - RNA, 19 nt, Homo sapiens
aggcggaccucaucgaauu

SEQ ID NO: 683447 - RNA, 19 nt, Homo sapiens
agugggagaugaauaaaug

SEQ ID NO: 683448 - RNA, 19 nt, Homo sapiens
cuaagagaauguacacugu

SEQ ID NO: 683449 - RNA, 19 nt, Homo sapiens
cagaagauuguuaugagua

SEQ ID NO: 683450 - RNA, 19 nt, Homo sapiens
caacugagugucuuacugu

SEQ ID NO: 683451 - RNA, 19 nt, Homo sapiens
cuaauucucuugaguugca

SEQ ID NO: 683452 - RNA, 19 nt, Homo sapiens
gguugacugugcccuaauu

SEQ ID NO: 683453 - RNA, 19 nt, Homo sapiens
guaaauguccagaccacuu

SEQ ID NO: 683454 - RNA, 19 nt, Homo sapiens
gggguaggauccuuuauuu

SEQ ID NO: 683455 - RNA, 19 nt, Homo sapiens
ucgaggauaacuaagauua

SEQ ID NO: 683456 - RNA, 19 nt, Homo sapiens
gcauucaggauaccuuaaa

SEQ ID NO: 683457 - RNA, 19 nt, Homo sapiens
gcagcgauuugccgacuag

SEQ ID NO: 683458 - RNA, 19 nt, Homo sapiens
gagcucagccugcgcaaca

SEQ ID NO: 683459 - RNA, 19 nt, Homo sapiens
ccauggaggucacugcaau

SEQ ID NO: 683460 - RNA, 19 nt, Homo sapiens
ucucuugaguugcaguuaa

SEQ ID NO: 683461 - RNA, 19 nt, Homo sapiens
gacaguguguuuagauugg

SEQ ID NO: 683462 - RNA, 19 nt, Homo sapiens
gugacaguguguuuagauu

SEQ ID NO: 683463 - RNA, 19 nt, Homo sapiens
gagcugaucguuguuuaug

SEQ ID NO: 683464 - RNA, 19 nt, Homo sapiens
gagaauguacacugugguu

SEQ ID NO: 683465 - RNA, 19 nt, Homo sapiens
uaaguguagugguuugguu

SEQ ID NO: 683466 - RNA, 19 nt, Homo sapiens
ccagaagauuguuaugagu

SEQ ID NO: 683467 - RNA, 19 nt, Homo sapiens
ucaggauaccuuaaaguuu

SEQ ID NO: 683468 - RNA, 19 nt, Homo sapiens
caaggaacucguuuauguu

SEQ ID NO: 683469 - RNA, 19 nt, Homo sapiens
gcgaauggcuuuuguagca

SEQ ID NO: 683470 - RNA, 19 nt, Homo sapiens
cccuagaccugcacaagaa

SEQ ID NO: 683471 - RNA, 19 nt, Homo sapiens
gaggcaaauaccuggauua

SEQ ID NO: 683472 - RNA, 19 nt, Homo sapiens
cauagaacaucacugaaaa

SEQ ID NO: 683473 - RNA, 19 nt, Homo sapiens
ugagagcaguaguguuguu

SEQ ID NO: 683474 - RNA, 19 nt, Homo sapiens
cacagugguuauggauuua

SEQ ID NO: 683475 - RNA, 19 nt, Homo sapiens
guacauguuuaucacuaag

SEQ ID NO: 683476 - RNA, 19 nt, Homo sapiens
gcaaccugcucuaccuaca

SEQ ID NO: 683477 - RNA, 19 nt, Homo sapiens
gagcaguaguguuguuugc

SEQ ID NO: 683478 - RNA, 19 nt, Homo sapiens
ggcuggaccugcaguacaa

SEQ ID NO: 683479 - RNA, 19 nt, Homo sapiens
guacaugagagcaguagug

SEQ ID NO: 683480 - RNA, 19 nt, Homo sapiens
aguggaaucuucuguuuag

SEQ ID NO: 683481 - RNA, 19 nt, Homo sapiens
uuucauucccugcuauuua

SEQ ID NO: 683482 - RNA, 19 nt, Homo sapiens
ugagugucuuacuguguua

SEQ ID NO: 683483 - RNA, 19 nt, Homo sapiens
uaggauccuuuauuuguuc

SEQ ID NO: 683484 - RNA, 19 nt, Homo sapiens
caucacggccuucgacuuc

SEQ ID NO: 683485 - RNA, 19 nt, Homo sapiens
ccaacugagugucuuacug

SEQ ID NO: 683486 - RNA, 19 nt, Homo sapiens
ugaccacauuagugucuuu

SEQ ID NO: 683487 - RNA, 19 nt, Homo sapiens
guagugguuugguuuacau

SEQ ID NO: 683488 - RNA, 19 nt, Homo sapiens
caacuauuugggauacuuu

SEQ ID NO: 683489 - RNA, 19 nt, Homo sapiens
gugucuuacuguguuauua

SEQ ID NO: 683490 - RNA, 19 nt, Homo sapiens
uugcugacuucgaggauaa

SEQ ID NO: 683491 - RNA, 19 nt, Homo sapiens
cgaggcaaauaccuggauu

SEQ ID NO: 683492 - RNA, 19 nt, Homo sapiens
uaaacccacuaauagagau

SEQ ID NO: 683493 - RNA, 19 nt, Homo sapiens
gaaaugaaccugccaauga

SEQ ID NO: 683494 - RNA, 19 nt, Homo sapiens
uaagauagcuguuguacuu

SEQ ID NO: 683495 - RNA, 19 nt, Homo sapiens
guaacaagcucugguauaa

SEQ ID NO: 683496 - RNA, 19 nt, Homo sapiens
gaacaaugcuguccaaucu

SEQ ID NO: 683497 - RNA, 19 nt, Homo sapiens
uaauuaagcuguccuguuu

SEQ ID NO: 683498 - RNA, 19 nt, Homo sapiens
gaacauaacacuugcauuc

SEQ ID NO: 683499 - RNA, 19 nt, Homo sapiens
ggacauaauaguucacuua

SEQ ID NO: 683500 - RNA, 19 nt, Homo sapiens
aaacuaagaugcacaaugu

SEQ ID NO: 683501 - RNA, 19 nt, Homo sapiens
ggaauggucugcuucuuug

SEQ ID NO: 683502 - RNA, 19 nt, Homo sapiens
cagaugaccucuuaauaaa

SEQ ID NO: 683503 - RNA, 19 nt, Homo sapiens
aaacagaaauucccacuug

SEQ ID NO: 683504 - RNA, 19 nt, Homo sapiens
gaacacucauggcacauuu

SEQ ID NO: 683505 - RNA, 19 nt, Homo sapiens
ggaauugcauugguucaua

SEQ ID NO: 683506 - RNA, 19 nt, Homo sapiens
acaaugagcugaauuagau

SEQ ID NO: 683507 - RNA, 19 nt, Homo sapiens
aaacuuacguugcuaaaga

SEQ ID NO: 683508 - RNA, 19 nt, Homo sapiens
gaggaugacuccaguguga

SEQ ID NO: 683509 - RNA, 19 nt, Homo sapiens
acaaagaaguguucaaaga

SEQ ID NO: 683510 - RNA, 19 nt, Homo sapiens
gagaugaguuugaagaguu

SEQ ID NO: 683511 - RNA, 19 nt, Homo sapiens
gaaaugagaucaguguauc

SEQ ID NO: 683512 - RNA, 19 nt, Homo sapiens
acaauaaccuggaggauga

SEQ ID NO: 683513 - RNA, 19 nt, Homo sapiens
gggagaaauuccuugguua

SEQ ID NO: 683514 - RNA, 19 nt, Homo sapiens
agaauuaucucuucaggaa

SEQ ID NO: 683515 - RNA, 19 nt, Homo sapiens
ugacaaagaugaagauagu

SEQ ID NO: 683516 - RNA, 19 nt, Homo sapiens
guuagauucuguaccauua

SEQ ID NO: 683517 - RNA, 19 nt, Homo sapiens
ugaauuagauggccuuaug

SEQ ID NO: 683518 - RNA, 19 nt, Homo sapiens
gagagaggcuuuggaaguu

SEQ ID NO: 683519 - RNA, 19 nt, Homo sapiens
gaaugaaccugagcuacaa

SEQ ID NO: 683520 - RNA, 19 nt, Homo sapiens
ucagaugaccucuuaauaa

SEQ ID NO: 683521 - RNA, 19 nt, Homo sapiens
gcacauaugaggcuuaaau

SEQ ID NO: 683522 - RNA, 19 nt, Homo sapiens
gugaguauauuaaggauga

SEQ ID NO: 683523 - RNA, 19 nt, Homo sapiens
gauagcagcugucccaaag

SEQ ID NO: 683524 - RNA, 19 nt, Homo sapiens
cauaacacuugcauucuaa

SEQ ID NO: 683525 - RNA, 19 nt, Homo sapiens
gcuauuaucugccaguugu

SEQ ID NO: 683526 - RNA, 19 nt, Homo sapiens
ggaaauuuguggcuagugu

SEQ ID NO: 683527 - RNA, 19 nt, Homo sapiens
gaaauuccuugguuacagu

SEQ ID NO: 683528 - RNA, 19 nt, Homo sapiens
gaagauaguucugaaugca

SEQ ID NO: 683529 - RNA, 19 nt, Homo sapiens
gaauggcuguggagauuau

SEQ ID NO: 683530 - RNA, 19 nt, Homo sapiens
caaaugacaucagaaagug

SEQ ID NO: 683531 - RNA, 19 nt, Homo sapiens
guagauaccaggaaucauu

SEQ ID NO: 683532 - RNA, 19 nt, Homo sapiens
guugagagcugaacuuaag

SEQ ID NO: 683533 - RNA, 19 nt, Homo sapiens
gaagaucacacugcuauug

SEQ ID NO: 683534 - RNA, 19 nt, Homo sapiens
agacugcucuggcccauuu

SEQ ID NO: 683535 - RNA, 19 nt, Homo sapiens
gagcaugacuguauguucu

SEQ ID NO: 683536 - RNA, 19 nt, Homo sapiens
uggcucagaugaccucuua

SEQ ID NO: 683537 - RNA, 19 nt, Homo sapiens
gaagcacccuaaaccuuga

SEQ ID NO: 683538 - RNA, 19 nt, Homo sapiens
ccagugaaccuauauuuga

SEQ ID NO: 683539 - RNA, 19 nt, Homo sapiens
guucauaugcugagaaauu

SEQ ID NO: 683540 - RNA, 19 nt, Homo sapiens
gcaaacauggagaagauaa

SEQ ID NO: 683541 - RNA, 19 nt, Homo sapiens
uguaaugguugguuuauug

SEQ ID NO: 683542 - RNA, 19 nt, Homo sapiens
gagcugaacuuaagauagc

SEQ ID NO: 683543 - RNA, 19 nt, Homo sapiens
gugcaaacauggacauaau

SEQ ID NO: 683544 - RNA, 19 nt, Homo sapiens
gguacaaugagcugaauua

SEQ ID NO: 683545 - RNA, 19 nt, Homo sapiens
gaacuuaagauagcuguug

SEQ ID NO: 683546 - RNA, 19 nt, Homo sapiens
ugcauuagcuagcauguuu

SEQ ID NO: 683547 - RNA, 19 nt, Homo sapiens
uuauauggcuucccaaaug

SEQ ID NO: 683548 - RNA, 19 nt, Homo sapiens
gcacagggucaucuuugua

SEQ ID NO: 683549 - RNA, 19 nt, Homo sapiens
gcucagggcuugguacaau

SEQ ID NO: 683550 - RNA, 19 nt, Homo sapiens
ucacuagucccuuugauuu

SEQ ID NO: 683551 - RNA, 19 nt, Homo sapiens
caucaaauguaaagacugu

SEQ ID NO: 683552 - RNA, 19 nt, Homo sapiens
aaaugaaccugccaaugaa

SEQ ID NO: 683553 - RNA, 19 nt, Homo sapiens
aaagaaguguucaaagaug

SEQ ID NO: 683554 - RNA, 19 nt, Homo sapiens
caggagauauggaagaaga

SEQ ID NO: 683555 - RNA, 19 nt, Homo sapiens
gauuugauguuaacacuag

SEQ ID NO: 683556 - RNA, 19 nt, Homo sapiens
ggaaagcauugauggucuu

SEQ ID NO: 683557 - RNA, 19 nt, Homo sapiens
gggagacucugccaggaaa

SEQ ID NO: 683558 - RNA, 19 nt, Homo sapiens
ugagagcagucaauccuuu

SEQ ID NO: 683559 - RNA, 19 nt, Homo sapiens
guagaucuaugugguauuc

SEQ ID NO: 683560 - RNA, 19 nt, Homo sapiens
guuauuggcuuugucugua

SEQ ID NO: 683561 - RNA, 19 nt, Homo sapiens
cagagacccuuguucuuga

SEQ ID NO: 683562 - RNA, 19 nt, Homo sapiens
ggagagaggcuuuggaagu

SEQ ID NO: 683563 - RNA, 19 nt, Homo sapiens
gcaguacaaaucuucauaa

SEQ ID NO: 683564 - RNA, 19 nt, Homo sapiens
gauuggagccuauuugaug

SEQ ID NO: 683565 - RNA, 19 nt, Homo sapiens
aaagaucaauccucaagug

SEQ ID NO: 683566 - RNA, 19 nt, Homo sapiens
ugaaaugguuaguacgaaa

SEQ ID NO: 683567 - RNA, 19 nt, Homo sapiens
acauaacacuugcauucua

SEQ ID NO: 683568 - RNA, 19 nt, Homo sapiens
gaacauuugagcaaguaaa

SEQ ID NO: 683569 - RNA, 19 nt, Homo sapiens
ugccauauaugucacagua

SEQ ID NO: 683570 - RNA, 19 nt, Homo sapiens
gauaacaccuuuuggaaug

SEQ ID NO: 683571 - RNA, 19 nt, Homo sapiens
uagaugauguuccaaagga

SEQ ID NO: 683572 - RNA, 19 nt, Homo sapiens
gguaacaagcucugguaua

SEQ ID NO: 683573 - RNA, 19 nt, Homo sapiens
ggacgaguaugugcaaaca

SEQ ID NO: 683574 - RNA, 19 nt, Homo sapiens
cuacauggcacuagaagaa

SEQ ID NO: 683575 - RNA, 19 nt, Homo sapiens
cagugugagugaagacuua

SEQ ID NO: 683576 - RNA, 19 nt, Homo sapiens
gggaauggucugcuucuuu

SEQ ID NO: 683577 - RNA, 19 nt, Homo sapiens
agaaguggauaacaccuuu

SEQ ID NO: 683578 - RNA, 19 nt, Homo sapiens
uagcagcugucccaaagaa

SEQ ID NO: 683579 - RNA, 19 nt, Homo sapiens
aaccugagcuacaaaguga

SEQ ID NO: 683580 - RNA, 19 nt, Homo sapiens
gcaggaggguaucagacaa

SEQ ID NO: 683581 - RNA, 19 nt, Homo sapiens
agggucaucuuuguaauua

SEQ ID NO: 683582 - RNA, 19 nt, Homo sapiens
gagaggcuuuggaaguuga

SEQ ID NO: 683583 - RNA, 19 nt, Homo sapiens
ugaaguaagagaugaguuu

SEQ ID NO: 683584 - RNA, 19 nt, Homo sapiens
gaucaguguaucaaaguaa

SEQ ID NO: 683585 - RNA, 19 nt, Homo sapiens
gcagugaguauauuaagga

SEQ ID NO: 683586 - RNA, 19 nt, Homo sapiens
acagccagcuuucauguug

SEQ ID NO: 683587 - RNA, 19 nt, Homo sapiens
acaaugaagucaaugaaag

SEQ ID NO: 683588 - RNA, 19 nt, Homo sapiens
caaagaaguguucaaagau

SEQ ID NO: 683589 - RNA, 19 nt, Homo sapiens
ggcauacacuggucuuuca

SEQ ID NO: 683590 - RNA, 19 nt, Homo sapiens
cagcagcaauggaccaaga

SEQ ID NO: 683591 - RNA, 19 nt, Homo sapiens
gauguuaacacuagagaau

SEQ ID NO: 683592 - RNA, 19 nt, Homo sapiens
gcaaacauggacauaauag

SEQ ID NO: 683593 - RNA, 19 nt, Homo sapiens
ggaaacaacucuucacaaa

SEQ ID NO: 683594 - RNA, 19 nt, Homo sapiens
uaaaugaccucacauguaa

SEQ ID NO: 683595 - RNA, 19 nt, Homo sapiens
gcagauugcuuguauguaa

SEQ ID NO: 683596 - RNA, 19 nt, Homo sapiens
aaacagagcugcugccuuu

SEQ ID NO: 683597 - RNA, 19 nt, Homo sapiens
gaaagaagcuaaugugaag

SEQ ID NO: 683598 - RNA, 19 nt, Homo sapiens
gacaugaacucucuugaua

SEQ ID NO: 683599 - RNA, 19 nt, Homo sapiens
ggaaagaaguggcacaaga

SEQ ID NO: 683600 - RNA, 19 nt, Homo sapiens
gagguaagaugaaacagua

SEQ ID NO: 683601 - RNA, 19 nt, Homo sapiens
gcaaagaaauacggauuaa

SEQ ID NO: 683602 - RNA, 19 nt, Homo sapiens
gaaggaauguuuagaagau

SEQ ID NO: 683603 - RNA, 19 nt, Homo sapiens
gcaaggcuauugaaauuga

SEQ ID NO: 683604 - RNA, 19 nt, Homo sapiens
gagcuaaccuugaucucua

SEQ ID NO: 683605 - RNA, 19 nt, Homo sapiens
cagcaaggcuauugaaauu

SEQ ID NO: 683606 - RNA, 19 nt, Homo sapiens
ugaaugaccucugacuuua

SEQ ID NO: 683607 - RNA, 19 nt, Homo sapiens
aaacaacucuucacaaauc

SEQ ID NO: 683608 - RNA, 19 nt, Homo sapiens
uaacauggcugcugacauc

SEQ ID NO: 683609 - RNA, 19 nt, Homo sapiens
gauagagguuuggaacuua

SEQ ID NO: 683610 - RNA, 19 nt, Homo sapiens
guaaaugaccucacaugua

SEQ ID NO: 683611 - RNA, 19 nt, Homo sapiens
uugaggaggucacuaauua

SEQ ID NO: 683612 - RNA, 19 nt, Homo sapiens
gacagaaguugcaaagaaa

SEQ ID NO: 683613 - RNA, 19 nt, Homo sapiens
agacagaaguugcaaagaa

SEQ ID NO: 683614 - RNA, 19 nt, Homo sapiens
ggagaaagccauugacaug

SEQ ID NO: 683615 - RNA, 19 nt, Homo sapiens
caugggaacuauugaagua

SEQ ID NO: 683616 - RNA, 19 nt, Homo sapiens
ugacaguguuuaagcuuua

SEQ ID NO: 683617 - RNA, 19 nt, Homo sapiens
ccaaauaaagguagaguaa

SEQ ID NO: 683618 - RNA, 19 nt, Homo sapiens
gaaggaaguuugcagucuu

SEQ ID NO: 683619 - RNA, 19 nt, Homo sapiens
gaagcaagaucuggauaga

SEQ ID NO: 683620 - RNA, 19 nt, Homo sapiens
gaacuuaaucccaaauaug

SEQ ID NO: 683621 - RNA, 19 nt, Homo sapiens
ggagagguuuauuuaagaa

SEQ ID NO: 683622 - RNA, 19 nt, Homo sapiens
ggauagagguuuggaacuu

SEQ ID NO: 683623 - RNA, 19 nt, Homo sapiens
gauaaagucaucaguuuga

SEQ ID NO: 683624 - RNA, 19 nt, Homo sapiens
aaaggaaacugaagcaugu

SEQ ID NO: 683625 - RNA, 19 nt, Homo sapiens
gaagaggucauaaagaaau

SEQ ID NO: 683626 - RNA, 19 nt, Homo sapiens
gggagagguuuauuuaaga

SEQ ID NO: 683627 - RNA, 19 nt, Homo sapiens
gaaacuugguggcacuuau

SEQ ID NO: 683628 - RNA, 19 nt, Homo sapiens
ugacaucgauccucagaau

SEQ ID NO: 683629 - RNA, 19 nt, Homo sapiens
gcuguuagccgauaaaguu

SEQ ID NO: 683630 - RNA, 19 nt, Homo sapiens
guagugagcuaaccuugau

SEQ ID NO: 683631 - RNA, 19 nt, Homo sapiens
guuaaccgcuuucaguuga

SEQ ID NO: 683632 - RNA, 19 nt, Homo sapiens
gaaagccauugacauguuc

SEQ ID NO: 683633 - RNA, 19 nt, Homo sapiens
cagauaaugcuacaacaua

SEQ ID NO: 683634 - RNA, 19 nt, Homo sapiens
ugguaaagcugaugaaaug

SEQ ID NO: 683635 - RNA, 19 nt, Homo sapiens
uugaagaggucauaaagaa

SEQ ID NO: 683636 - RNA, 19 nt, Homo sapiens
caugaacucucuugauaga

SEQ ID NO: 683637 - RNA, 19 nt, Homo sapiens
augagaagcuagacaauaa

SEQ ID NO: 683638 - RNA, 19 nt, Homo sapiens
acaaagagguaagaugaaa

SEQ ID NO: 683639 - RNA, 19 nt, Homo sapiens
cuaauuaguuggugcaguu

SEQ ID NO: 683640 - RNA, 19 nt, Homo sapiens
caacugaacccuaaagaca

SEQ ID NO: 683641 - RNA, 19 nt, Homo sapiens
caacaacaguuugguaaag

SEQ ID NO: 683642 - RNA, 19 nt, Homo sapiens
ggagagaaaucugaugaag

SEQ ID NO: 683643 - RNA, 19 nt, Homo sapiens
ugauauauguguuggaaga

SEQ ID NO: 683644 - RNA, 19 nt, Homo sapiens
guaaagcugaugaaaugua

SEQ ID NO: 683645 - RNA, 19 nt, Homo sapiens
gcacaagacuguacaaaag

SEQ ID NO: 683646 - RNA, 19 nt, Homo sapiens
gagagacccuuuaaaccau

SEQ ID NO: 683647 - RNA, 19 nt, Homo sapiens
gaaaccaugggaacuauug

SEQ ID NO: 683648 - RNA, 19 nt, Homo sapiens
caaaagcuguugaacuuaa

SEQ ID NO: 683649 - RNA, 19 nt, Homo sapiens
agacaaagagguaagauga

SEQ ID NO: 683650 - RNA, 19 nt, Homo sapiens
gcccaucuguauucacuuu

SEQ ID NO: 683651 - RNA, 19 nt, Homo sapiens
gaucaacaacaguuuggua

SEQ ID NO: 683652 - RNA, 19 nt, Homo sapiens
uaacagaucaacaacaguu

SEQ ID NO: 683653 - RNA, 19 nt, Homo sapiens
aagaagcaguggcagauuu

SEQ ID NO: 683654 - RNA, 19 nt, Homo sapiens
agaaagccauugacauguu

SEQ ID NO: 683655 - RNA, 19 nt, Homo sapiens
gaaacaacucuucacaaau

SEQ ID NO: 683656 - RNA, 19 nt, Homo sapiens
gaccucacauguaaauuca

SEQ ID NO: 683657 - RNA, 19 nt, Homo sapiens
ugaagcaugugccauucua

SEQ ID NO: 683658 - RNA, 19 nt, Homo sapiens
gaaacacaaaggaaacuga

SEQ ID NO: 683659 - RNA, 19 nt, Homo sapiens
uaaauuaugcaccuucuga

SEQ ID NO: 683660 - RNA, 19 nt, Homo sapiens
gcuguaaugugccaugaug

SEQ ID NO: 683661 - RNA, 19 nt, Homo sapiens
gcacaaugccucugauucu

SEQ ID NO: 683662 - RNA, 19 nt, Homo sapiens
ggaugauuccgucuauaua

SEQ ID NO: 683663 - RNA, 19 nt, Homo sapiens
gugguguuguuauuuguua

SEQ ID NO: 683664 - RNA, 19 nt, Homo sapiens
gaguaagugugauauaugg

SEQ ID NO: 683665 - RNA, 19 nt, Homo sapiens
gaggaaacauggagaaagc

SEQ ID NO: 683666 - RNA, 19 nt, Homo sapiens
aagcagcuaugaaagguuu

SEQ ID NO: 683667 - RNA, 19 nt, Homo sapiens
gaaugaccucugacuuuaa

SEQ ID NO: 683668 - RNA, 19 nt, Homo sapiens
uacaugugcuuaaggaauu

SEQ ID NO: 683669 - RNA, 19 nt, Homo sapiens
ggacaugaacucucuugau

SEQ ID NO: 683670 - RNA, 19 nt, Homo sapiens
cgaaggcuaugcacuauac

SEQ ID NO: 683671 - RNA, 19 nt, Homo sapiens
gcacaagcacagaaauguu

SEQ ID NO: 683672 - RNA, 19 nt, Homo sapiens
agaagaauguugaccuuuc

SEQ ID NO: 683673 - RNA, 19 nt, Homo sapiens
gagcauaguauuuccugaa

SEQ ID NO: 683674 - RNA, 19 nt, Homo sapiens
ggcacuguauauacuauuu

SEQ ID NO: 683675 - RNA, 19 nt, Homo sapiens
gaugauuccgucuauauau

SEQ ID NO: 683676 - RNA, 19 nt, Homo sapiens
cuacagagaagaauguuga

SEQ ID NO: 683677 - RNA, 19 nt, Homo sapiens
gcugaugaaauguaugaua

SEQ ID NO: 683678 - RNA, 19 nt, Homo sapiens
ugaaagaagcuaaugugaa

SEQ ID NO: 683679 - RNA, 19 nt, Homo sapiens
gaaaagagaaagccaaaga

SEQ ID NO: 683680 - RNA, 19 nt, Homo sapiens
gcaucugucuguaucuuuc

SEQ ID NO: 683681 - RNA, 19 nt, Homo sapiens
cuacucuucucccuucuuu

SEQ ID NO: 683682 - RNA, 19 nt, Homo sapiens
guuggaagacugaguauug

SEQ ID NO: 683683 - RNA, 19 nt, Homo sapiens
ggguguggcuguugaagga

SEQ ID NO: 683684 - RNA, 19 nt, Homo sapiens
cuauuaaccuggccaaauc

SEQ ID NO: 683685 - RNA, 19 nt, Homo sapiens
gagagaaaucugaugaaga

SEQ ID NO: 683686 - RNA, 19 nt, Homo sapiens
aaagagaaagccaaagaaa

SEQ ID NO: 683687 - RNA, 19 nt, Homo sapiens
aaugaccucugacuuuaaa

SEQ ID NO: 683688 - RNA, 19 nt, Homo sapiens
aaagguagaguaaguguga

SEQ ID NO: 683689 - RNA, 19 nt, Homo sapiens
ggaguggaccagacaaaga

SEQ ID NO: 683690 - RNA, 19 nt, Homo sapiens
guacauucuucuuaaaguc

SEQ ID NO: 683691 - RNA, 19 nt, Homo sapiens
ccaaaccagauuuagauaa

SEQ ID NO: 683692 - RNA, 19 nt, Homo sapiens
guagagaaacacaaaggaa

SEQ ID NO: 683693 - RNA, 19 nt, Homo sapiens
gaugauagcucagaugaua

SEQ ID NO: 683694 - RNA, 19 nt, Homo sapiens
gaacaugacugguccaaug

SEQ ID NO: 683695 - RNA, 19 nt, Homo sapiens
gcaaggagcuacucuguug

SEQ ID NO: 683696 - RNA, 19 nt, Homo sapiens
aagaugggcuuucauguua

SEQ ID NO: 683697 - RNA, 19 nt, Homo sapiens
gcaauuaaaucaaccaaca

SEQ ID NO: 683698 - RNA, 19 nt, Homo sapiens
caaagauggugaccugaua

SEQ ID NO: 683699 - RNA, 19 nt, Homo sapiens
gaugauaacuucuguaagg

SEQ ID NO: 683700 - RNA, 19 nt, Homo sapiens
ggaaaugggugaugaguac

SEQ ID NO: 683701 - RNA, 19 nt, Homo sapiens
gaaacaagaugucaguagu

SEQ ID NO: 683702 - RNA, 19 nt, Homo sapiens
uaauugagauuccugauga

SEQ ID NO: 683703 - RNA, 19 nt, Homo sapiens
gaacacacgccaauucuau

SEQ ID NO: 683704 - RNA, 19 nt, Homo sapiens
gaagauggauuguguacag

SEQ ID NO: 683705 - RNA, 19 nt, Homo sapiens
acugaaagcucucgaaauu

SEQ ID NO: 683706 - RNA, 19 nt, Homo sapiens
gcagaggacgucuucuuua

SEQ ID NO: 683707 - RNA, 19 nt, Homo sapiens
gaugauguccucaguauug

SEQ ID NO: 683708 - RNA, 19 nt, Homo sapiens
aaagucagcucaagauguu

SEQ ID NO: 683709 - RNA, 19 nt, Homo sapiens
cuacagcgguugacaguga

SEQ ID NO: 683710 - RNA, 19 nt, Homo sapiens
ccucaugucugcagcuaua

SEQ ID NO: 683711 - RNA, 19 nt, Homo sapiens
gaauggagccuguguaucu

SEQ ID NO: 683712 - RNA, 19 nt, Homo sapiens
gaagagcaguucccaggau

SEQ ID NO: 683713 - RNA, 19 nt, Homo sapiens
gaugaucccuuccaaugug

SEQ ID NO: 683714 - RNA, 19 nt, Homo sapiens
cagaaugucuucguggaua

SEQ ID NO: 683715 - RNA, 19 nt, Homo sapiens
caacauggacuacaaguuc

SEQ ID NO: 683716 - RNA, 19 nt, Homo sapiens
uaacaaacgcugcaaaugu

SEQ ID NO: 683717 - RNA, 19 nt, Homo sapiens
caucaaagccgaagacuca

SEQ ID NO: 683718 - RNA, 19 nt, Homo sapiens
ugaaagcucucgaaauuac

SEQ ID NO: 683719 - RNA, 19 nt, Homo sapiens
gaagagacacccaagaaca

SEQ ID NO: 683720 - RNA, 19 nt, Homo sapiens
gaagaaauacaaggugaaa

SEQ ID NO: 683721 - RNA, 19 nt, Homo sapiens
gaacuaagacuuggcacaa

SEQ ID NO: 683722 - RNA, 19 nt, Homo sapiens
uaucuacuaucuccaguuu

SEQ ID NO: 683723 - RNA, 19 nt, Homo sapiens
aagcucagguuucucauuu

SEQ ID NO: 683724 - RNA, 19 nt, Homo sapiens
aacaagaugucaguaguua

SEQ ID NO: 683725 - RNA, 19 nt, Homo sapiens
gcaaggguguuuucauuaa

SEQ ID NO: 683726 - RNA, 19 nt, Homo sapiens
ggaaucaggucuggcucua

SEQ ID NO: 683727 - RNA, 19 nt, Homo sapiens
gaaagucagcucaagaugu

SEQ ID NO: 683728 - RNA, 19 nt, Homo sapiens
gcaaaauccugacagauga

SEQ ID NO: 683729 - RNA, 19 nt, Homo sapiens
ggacaaugcaggagauaga

SEQ ID NO: 683730 - RNA, 19 nt, Homo sapiens
gaccaacucuuugaugaug

SEQ ID NO: 683731 - RNA, 19 nt, Homo sapiens
caaccaacauggccucugu

SEQ ID NO: 683732 - RNA, 19 nt, Homo sapiens
uugcaaaucuggaccauau

SEQ ID NO: 683733 - RNA, 19 nt, Homo sapiens
ccagggcagugacuaauug

SEQ ID NO: 683734 - RNA, 19 nt, Homo sapiens
ucaaacaggccaagaaaga

SEQ ID NO: 683735 - RNA, 19 nt, Homo sapiens
guacagaggacccugaaga

SEQ ID NO: 683736 - RNA, 19 nt, Homo sapiens
acauauagaucaccuuuag

SEQ ID NO: 683737 - RNA, 19 nt, Homo sapiens
agacauggguaauacagaa

SEQ ID NO: 683738 - RNA, 19 nt, Homo sapiens
caagaugggcuuucauguu

SEQ ID NO: 683739 - RNA, 19 nt, Homo sapiens
gcuccuaguugauagaaau

SEQ ID NO: 683740 - RNA, 19 nt, Homo sapiens
cagcagugguguagacuug

SEQ ID NO: 683741 - RNA, 19 nt, Homo sapiens
ggagauagaacgcuaccuu

SEQ ID NO: 683742 - RNA, 19 nt, Homo sapiens
gaaggcacgugguggaagu

SEQ ID NO: 683743 - RNA, 19 nt, Homo sapiens
gaacuuacuugggacuaca

SEQ ID NO: 683744 - RNA, 19 nt, Homo sapiens
uagcucagaugauaacuuc

SEQ ID NO: 683745 - RNA, 19 nt, Homo sapiens
caaggagggucuggaaaug

SEQ ID NO: 683746 - RNA, 19 nt, Homo sapiens
gggaucaaccagacauaua

SEQ ID NO: 683747 - RNA, 19 nt, Homo sapiens
caaguguuccugcuucuaa

SEQ ID NO: 683748 - RNA, 19 nt, Homo sapiens
cccaugggauugcaauuaa

SEQ ID NO: 683749 - RNA, 19 nt, Homo sapiens
gcagugguguagacuugaa

SEQ ID NO: 683750 - RNA, 19 nt, Homo sapiens
gaucugaccgguacuggaa

SEQ ID NO: 683751 - RNA, 19 nt, Homo sapiens
ccucugcacuggagaagaa

SEQ ID NO: 683752 - RNA, 19 nt, Homo sapiens
agaagcagcuagcagaguu

SEQ ID NO: 683753 - RNA, 19 nt, Homo sapiens
ggaacuggguaucucuaug

SEQ ID NO: 683754 - RNA, 19 nt, Homo sapiens
gaggacgucuucuuuagag

SEQ ID NO: 683755 - RNA, 19 nt, Homo sapiens
cagaggacgucuucuuuag

SEQ ID NO: 683756 - RNA, 19 nt, Homo sapiens
gagauagaacgcuaccuuu

SEQ ID NO: 683757 - RNA, 19 nt, Homo sapiens
caaagaaggauaugagagu

SEQ ID NO: 683758 - RNA, 19 nt, Homo sapiens
gaugaguacuuugcaaauc

SEQ ID NO: 683759 - RNA, 19 nt, Homo sapiens
gaggccaaaucaacccuaa

SEQ ID NO: 683760 - RNA, 19 nt, Homo sapiens
cagcuacaguggagucuga

SEQ ID NO: 683761 - RNA, 19 nt, Homo sapiens
uggaggaacuucggcauuu

SEQ ID NO: 683762 - RNA, 19 nt, Homo sapiens
gggcuuucauguuaucuau

SEQ ID NO: 683763 - RNA, 19 nt, Homo sapiens
ugagauuccugaugaagau

SEQ ID NO: 683764 - RNA, 19 nt, Homo sapiens
uagcagaguuagagacaug

SEQ ID NO: 683765 - RNA, 19 nt, Homo sapiens
uggagaagauggauugugu

SEQ ID NO: 683766 - RNA, 19 nt, Homo sapiens
cgaggagucuugcuacauc

SEQ ID NO: 683767 - RNA, 19 nt, Homo sapiens
uaagaacacacgccaauuc

SEQ ID NO: 683768 - RNA, 19 nt, Homo sapiens
gagcgcaccuguucguaag

SEQ ID NO: 683769 - RNA, 19 nt, Homo sapiens
gaaauuacgguuacaaucc

SEQ ID NO: 683770 - RNA, 19 nt, Homo sapiens
agaacaagguggccucaug

SEQ ID NO: 683771 - RNA, 19 nt, Homo sapiens
gaagaguccaaugaugaua

SEQ ID NO: 683772 - RNA, 19 nt, Homo sapiens
gagcaaaggcccuguuguc

SEQ ID NO: 683773 - RNA, 19 nt, Homo sapiens
cagaugaucccuuccaaug

SEQ ID NO: 683774 - RNA, 19 nt, Homo sapiens
gaacuggguaucucuaugg

SEQ ID NO: 683775 - RNA, 19 nt, Homo sapiens
gggaugacuuugaggacaa

SEQ ID NO: 683776 - RNA, 19 nt, Homo sapiens
aaaugucucuggugggaaa

SEQ ID NO: 683777 - RNA, 19 nt, Homo sapiens
gcucaagaguggccagcuu

SEQ ID NO: 683778 - RNA, 19 nt, Homo sapiens
gaagcagcuagcagaguua

SEQ ID NO: 683779 - RNA, 19 nt, Homo sapiens
gagccuguguaucuacuau

SEQ ID NO: 683780 - RNA, 19 nt, Homo sapiens
caucaaacaggccaagaaa

SEQ ID NO: 683781 - RNA, 19 nt, Homo sapiens
aacaaacgcugcaaaugug

SEQ ID NO: 683782 - RNA, 19 nt, Homo sapiens
cucaagauguucagaaguu

SEQ ID NO: 683783 - RNA, 19 nt, Homo sapiens
gggcagugacuaauuguga

SEQ ID NO: 683784 - RNA, 19 nt, Homo sapiens
ccaagaaagaggacacuga

SEQ ID NO: 683785 - RNA, 19 nt, Homo sapiens
gggcaaggguguuuucauu

SEQ ID NO: 683786 - RNA, 19 nt, Homo sapiens
ggaggaacuucggcauuuc

SEQ ID NO: 683787 - RNA, 19 nt, Homo sapiens
ggagaacuaagcaaagaug

SEQ ID NO: 683788 - RNA, 19 nt, Homo sapiens
ggugcaacauggacuacaa

SEQ ID NO: 683789 - RNA, 19 nt, Homo sapiens
aaucaggucuggcucuaug

SEQ ID NO: 683790 - RNA, 19 nt, Homo sapiens
gcaaagauggugaccugau

SEQ ID NO: 683791 - RNA, 19 nt, Homo sapiens
uaagaaagucagcucaaga

SEQ ID NO: 683792 - RNA, 19 nt, Homo sapiens
ucuacuaucuccaguuugu

SEQ ID NO: 683793 - RNA, 19 nt, Homo sapiens
gaagaacucuguaagcuuu

SEQ ID NO: 683794 - RNA, 19 nt, Homo sapiens
ggaggaagcuuauuagguu

SEQ ID NO: 683795 - RNA, 19 nt, Homo sapiens
gcagauagacugaagaaua

SEQ ID NO: 683796 - RNA, 19 nt, Homo sapiens
gaacaugggcccucguuua

SEQ ID NO: 683797 - RNA, 19 nt, Homo sapiens
uaaauuugcuggcccaaua

SEQ ID NO: 683798 - RNA, 19 nt, Homo sapiens
gcauucuucuucacaauua

SEQ ID NO: 683799 - RNA, 19 nt, Homo sapiens
gcagucaacucugagaaua

SEQ ID NO: 683800 - RNA, 19 nt, Homo sapiens
ggugauauguuacacagua

SEQ ID NO: 683801 - RNA, 19 nt, Homo sapiens
gcacacccuucaaauagua

SEQ ID NO: 683802 - RNA, 19 nt, Homo sapiens
cgaagaagguguacugcua

SEQ ID NO: 683803 - RNA, 19 nt, Homo sapiens
gaaugaugauugaagagua

SEQ ID NO: 683804 - RNA, 19 nt, Homo sapiens
gcauuuacuuugaggcuua

SEQ ID NO: 683805 - RNA, 19 nt, Homo sapiens
gaacagggacuaggaguuu

SEQ ID NO: 683806 - RNA, 19 nt, Homo sapiens
gauagacccuuucuguuga

SEQ ID NO: 683807 - RNA, 19 nt, Homo sapiens
gaccagacaugagugaaua

SEQ ID NO: 683808 - RNA, 19 nt, Homo sapiens
cagauagacugaagaauau

SEQ ID NO: 683809 - RNA, 19 nt, Homo sapiens
ggaccaugcugcuaucauu

SEQ ID NO: 683810 - RNA, 19 nt, Homo sapiens
ccaaagcaauucucaguga

SEQ ID NO: 683811 - RNA, 19 nt, Homo sapiens
gaauggugguuccuucuaa

SEQ ID NO: 683812 - RNA, 19 nt, Homo sapiens
gagagaguguuauuucuug

SEQ ID NO: 683813 - RNA, 19 nt, Homo sapiens
ggagggaggaagcuuauua

SEQ ID NO: 683814 - RNA, 19 nt, Homo sapiens
cagaaacacugaccugauu

SEQ ID NO: 683815 - RNA, 19 nt, Homo sapiens
gauuaaauguggcauauag

SEQ ID NO: 683816 - RNA, 19 nt, Homo sapiens
caauuaaguuccucuuuga

SEQ ID NO: 683817 - RNA, 19 nt, Homo sapiens
gauaggagguggcccauag

SEQ ID NO: 683818 - RNA, 19 nt, Homo sapiens
gaauaggagugcucuacuu

SEQ ID NO: 683819 - RNA, 19 nt, Homo sapiens
ugaaacagaugacccagaa

SEQ ID NO: 683820 - RNA, 19 nt, Homo sapiens
guacuggugucucauuuga

SEQ ID NO: 683821 - RNA, 19 nt, Homo sapiens
ggauagacccuuucuguug

SEQ ID NO: 683822 - RNA, 19 nt, Homo sapiens
gacaaagucugauggauag

SEQ ID NO: 683823 - RNA, 19 nt, Homo sapiens
aagaggagguggaacauuu

SEQ ID NO: 683824 - RNA, 19 nt, Homo sapiens
ugacaacaaccaagcauua

SEQ ID NO: 683825 - RNA, 19 nt, Homo sapiens
cagcagacaugccuuguug

SEQ ID NO: 683826 - RNA, 19 nt, Homo sapiens
gcucagcccuguugggaaa

SEQ ID NO: 683827 - RNA, 19 nt, Homo sapiens
ugagagaugagcacaauua

SEQ ID NO: 683828 - RNA, 19 nt, Homo sapiens
gaagcuugguggauuaaau

SEQ ID NO: 683829 - RNA, 19 nt, Homo sapiens
ugaagaauaugaaggauag

SEQ ID NO: 683830 - RNA, 19 nt, Homo sapiens
gcaaguuacagacaucaua

SEQ ID NO: 683831 - RNA, 19 nt, Homo sapiens
uaaaucaggucaauuggau

SEQ ID NO: 683832 - RNA, 19 nt, Homo sapiens
gcaagaacuuugagguugu

SEQ ID NO: 683833 - RNA, 19 nt, Homo sapiens
gcucggcccucaagaagaa

SEQ ID NO: 683834 - RNA, 19 nt, Homo sapiens
ugacaaagucugauggaua

SEQ ID NO: 683835 - RNA, 19 nt, Homo sapiens
gauaaucccaccaacaauu

SEQ ID NO: 683836 - RNA, 19 nt, Homo sapiens
acacugaccugauuacugu

SEQ ID NO: 683837 - RNA, 19 nt, Homo sapiens
ggaguuggcucggcuacuu

SEQ ID NO: 683838 - RNA, 19 nt, Homo sapiens
acaauuaaguuccucuuug

SEQ ID NO: 683839 - RNA, 19 nt, Homo sapiens
agacaugagugaauaccua

SEQ ID NO: 683840 - RNA, 19 nt, Homo sapiens
gcugagcucuucauucugu

SEQ ID NO: 683841 - RNA, 19 nt, Homo sapiens
uaaaaggccugaaugaauu

SEQ ID NO: 683842 - RNA, 19 nt, Homo sapiens
ucauugacuucccaaauuu

SEQ ID NO: 683843 - RNA, 19 nt, Homo sapiens
caaagcccaugcaguaguu

SEQ ID NO: 683844 - RNA, 19 nt, Homo sapiens
gagaaguccaggaaugaua

SEQ ID NO: 683845 - RNA, 19 nt, Homo sapiens
cuuauuagguucacuguug

SEQ ID NO: 683846 - RNA, 19 nt, Homo sapiens
gcacuggacugccucuaag

SEQ ID NO: 683847 - RNA, 19 nt, Homo sapiens
gaugagagaguguuauuuc

SEQ ID NO: 683848 - RNA, 19 nt, Homo sapiens
aagaguaccugcugcugua

SEQ ID NO: 683849 - RNA, 19 nt, Homo sapiens
cgagugcauuuauucuaua

SEQ ID NO: 683850 - RNA, 19 nt, Homo sapiens
cuucaaagcccaugcagua

SEQ ID NO: 683851 - RNA, 19 nt, Homo sapiens
ccagaauucuacaaaucua

SEQ ID NO: 683852 - RNA, 19 nt, Homo sapiens
gaaaagaccacauuccaaa

SEQ ID NO: 683853 - RNA, 19 nt, Homo sapiens
gacgggaccugauguuuua

SEQ ID NO: 683854 - RNA, 19 nt, Homo sapiens
gcacuaagacaaaggaaca

SEQ ID NO: 683855 - RNA, 19 nt, Homo sapiens
gauauauucuugggcugua

SEQ ID NO: 683856 - RNA, 19 nt, Homo sapiens
ugaaggaguucuaccugaa

SEQ ID NO: 683857 - RNA, 19 nt, Homo sapiens
gagauugaguugauugucu

SEQ ID NO: 683858 - RNA, 19 nt, Homo sapiens
caucauuuguccuuucuug

SEQ ID NO: 683859 - RNA, 19 nt, Homo sapiens
gcuaccaccuggaggcuuu

SEQ ID NO: 683860 - RNA, 19 nt, Homo sapiens
agacaugccuuguuggaau

SEQ ID NO: 683861 - RNA, 19 nt, Homo sapiens
caaagcaauucucagugaa

SEQ ID NO: 683862 - RNA, 19 nt, Homo sapiens
gaccugauguuuuacguua

SEQ ID NO: 683863 - RNA, 19 nt, Homo sapiens
gagaugagagaguguuauu

SEQ ID NO: 683864 - RNA, 19 nt, Homo sapiens
gcucauggcauuucagaga

SEQ ID NO: 683865 - RNA, 19 nt, Homo sapiens
acaaguacuuugaaacaga

SEQ ID NO: 683866 - RNA, 19 nt, Homo sapiens
gaguacuggugucucauuu

SEQ ID NO: 683867 - RNA, 19 nt, Homo sapiens
gcgcaaggcugggcguuau

SEQ ID NO: 683868 - RNA, 19 nt, Homo sapiens
ggacuaagaguucacaucu

SEQ ID NO: 683869 - RNA, 19 nt, Homo sapiens
ucaauuggauaagguugua

SEQ ID NO: 683870 - RNA, 19 nt, Homo sapiens
aaacagaugacccagaauu

SEQ ID NO: 683871 - RNA, 19 nt, Homo sapiens
agagagaaguccaggaaug

SEQ ID NO: 683872 - RNA, 19 nt, Homo sapiens
gggaaugguuugagcuaau

SEQ ID NO: 683873 - RNA, 19 nt, Homo sapiens
gagcaagaacuuugagguu

SEQ ID NO: 683874 - RNA, 19 nt, Homo sapiens
uaagugaggaugagaagaa

SEQ ID NO: 683875 - RNA, 19 nt, Homo sapiens
caaguuacagacaucauaa

SEQ ID NO: 683876 - RNA, 19 nt, Homo sapiens
gguuugagcuaaucugcaa

SEQ ID NO: 683877 - RNA, 19 nt, Homo sapiens
gagagaaguccaggaauga

SEQ ID NO: 683878 - RNA, 19 nt, Homo sapiens
gaagaagguguacugcuau

SEQ ID NO: 683879 - RNA, 19 nt, Homo sapiens
gauauguaccggaagguuu

SEQ ID NO: 683880 - RNA, 19 nt, Homo sapiens
uuacaagccaucuuuauug

SEQ ID NO: 683881 - RNA, 19 nt, Homo sapiens
ucacaaagaagaacucugu

SEQ ID NO: 683882 - RNA, 19 nt, Homo sapiens
guugguggcucauggcauu

SEQ ID NO: 683883 - RNA, 19 nt, Homo sapiens
ggugguggaugauggcauu

SEQ ID NO: 683884 - RNA, 19 nt, Homo sapiens
ggagcccaauuccaacgua

SEQ ID NO: 683885 - RNA, 19 nt, Homo sapiens
ggcuagaccugucauuuua

SEQ ID NO: 683886 - RNA, 19 nt, Homo sapiens
gcaaaagauuagaacagua

SEQ ID NO: 683887 - RNA, 19 nt, Homo sapiens
ccacugauccuaacacaca

SEQ ID NO: 683888 - RNA, 19 nt, Homo sapiens
ggauaagguuguagaacuc

SEQ ID NO: 683889 - RNA, 19 nt, Homo sapiens
ggaaugguuugagcuaauc

SEQ ID NO: 683890 - RNA, 19 nt, Homo sapiens
gguacaauaugucaaagag

SEQ ID NO: 683891 - RNA, 19 nt, Homo sapiens
gggaaaagguacaauaugu

SEQ ID NO: 683892 - RNA, 19 nt, Homo sapiens
guugaaugaugauugaaga

SEQ ID NO: 683893 - RNA, 19 nt, Homo sapiens
gaggaacccuuuacaaaua

SEQ ID NO: 683894 - RNA, 19 nt, Homo sapiens
gaagaagacuggaccacua

SEQ ID NO: 683895 - RNA, 19 nt, Homo sapiens
gaccagagaucucaacuga

SEQ ID NO: 683896 - RNA, 19 nt, Homo sapiens
uaacaaaguucuccauuuc

SEQ ID NO: 683897 - RNA, 19 nt, Homo sapiens
guacaugaauugcuuguug

SEQ ID NO: 683898 - RNA, 19 nt, Homo sapiens
gaagagacgucugcaauuc

SEQ ID NO: 683899 - RNA, 19 nt, Homo sapiens
ucugucagcugcuuaauua

SEQ ID NO: 683900 - RNA, 19 nt, Homo sapiens
gaacaacaccaccgaugua

SEQ ID NO: 683901 - RNA, 19 nt, Homo sapiens
caacaacucagaaugauaa

SEQ ID NO: 683902 - RNA, 19 nt, Homo sapiens
ccagagaucucaacugaug

SEQ ID NO: 683903 - RNA, 19 nt, Homo sapiens
gaagagauggcauuuagaa

SEQ ID NO: 683904 - RNA, 19 nt, Homo sapiens
gcacuuggauagacaacaa

SEQ ID NO: 683905 - RNA, 19 nt, Homo sapiens
ggauuuaucugguagaaca

SEQ ID NO: 683906 - RNA, 19 nt, Homo sapiens
guaacuccauugaacauuu

SEQ ID NO: 683907 - RNA, 19 nt, Homo sapiens
gaacugauccaaggaauau

SEQ ID NO: 683908 - RNA, 19 nt, Homo sapiens
caacacagauaugacauug

SEQ ID NO: 683909 - RNA, 19 nt, Homo sapiens
uaauggauguuaaccagua

SEQ ID NO: 683910 - RNA, 19 nt, Homo sapiens
gaucucaacugaugaacga

SEQ ID NO: 683911 - RNA, 19 nt, Homo sapiens
gacaaucaguggucaaaga

SEQ ID NO: 683912 - RNA, 19 nt, Homo sapiens
ugaagacaguggagccuua

SEQ ID NO: 683913 - RNA, 19 nt, Homo sapiens
gcucauaugugaagaacug

SEQ ID NO: 683914 - RNA, 19 nt, Homo sapiens
gagauggcauuuagaacuu

SEQ ID NO: 683915 - RNA, 19 nt, Homo sapiens
ccucagaaaugauauugaa

SEQ ID NO: 683916 - RNA, 19 nt, Homo sapiens
gggaaauucuaguuaauca

SEQ ID NO: 683917 - RNA, 19 nt, Homo sapiens
ggaggaacccuuuacaaau

SEQ ID NO: 683918 - RNA, 19 nt, Homo sapiens
ggagaagucuuuguuccuu

SEQ ID NO: 683919 - RNA, 19 nt, Homo sapiens
cagagccacugauuucuuu

SEQ ID NO: 683920 - RNA, 19 nt, Homo sapiens
ugaacgaccucagaaauga

SEQ ID NO: 683921 - RNA, 19 nt, Homo sapiens
gagcgugaguccaggcuaa

SEQ ID NO: 683922 - RNA, 19 nt, Homo sapiens
ugucaagaguacaauguua

SEQ ID NO: 683923 - RNA, 19 nt, Homo sapiens
cagaugcucuuaucaacuu

SEQ ID NO: 683924 - RNA, 19 nt, Homo sapiens
gaacagacuucuuuuguag

SEQ ID NO: 683925 - RNA, 19 nt, Homo sapiens
caacaccaccgauguagaa

SEQ ID NO: 683926 - RNA, 19 nt, Homo sapiens
gguggaaucuugaugaaca

SEQ ID NO: 683927 - RNA, 19 nt, Homo sapiens
gagaagucuuuguuccuuu

SEQ ID NO: 683928 - RNA, 19 nt, Homo sapiens
gcaacugugugaaugaugu

SEQ ID NO: 683929 - RNA, 19 nt, Homo sapiens
aaacuucucugucauugau

SEQ ID NO: 683930 - RNA, 19 nt, Homo sapiens
gaccuugggugcuggauau

SEQ ID NO: 683931 - RNA, 19 nt, Homo sapiens
gcacacagcaucuccaaca

SEQ ID NO: 683932 - RNA, 19 nt, Homo sapiens
gaauuauccuauggaauga

SEQ ID NO: 683933 - RNA, 19 nt, Homo sapiens
gccuuuaucuucaugauug

SEQ ID NO: 683934 - RNA, 19 nt, Homo sapiens
guagaauuauccuauggaa

SEQ ID NO: 683935 - RNA, 19 nt, Homo sapiens
ugucauugauguugcauuu

SEQ ID NO: 683936 - RNA, 19 nt, Homo sapiens
ggaacagacuucuuuugua

SEQ ID NO: 683937 - RNA, 19 nt, Homo sapiens
cacuacagauugcaugaua

SEQ ID NO: 683938 - RNA, 19 nt, Homo sapiens
gauguugcauuuccaagga

SEQ ID NO: 683939 - RNA, 19 nt, Homo sapiens
gugaagaacugaagaccau

SEQ ID NO: 683940 - RNA, 19 nt, Homo sapiens
gaugauaauaggcuaguuu

SEQ ID NO: 683941 - RNA, 19 nt, Homo sapiens
gccuacaugugcccauuua

SEQ ID NO: 683942 - RNA, 19 nt, Homo sapiens
ugacauugcugccugaagu

SEQ ID NO: 683943 - RNA, 19 nt, Homo sapiens
gaauauucuuacuggcuaa

SEQ ID NO: 683944 - RNA, 19 nt, Homo sapiens
gaagcuggauccugacucu

SEQ ID NO: 683945 - RNA, 19 nt, Homo sapiens
agaauuauccuauggaaug

SEQ ID NO: 683946 - RNA, 19 nt, Homo sapiens
cagauuccaugaaaguauu

SEQ ID NO: 683947 - RNA, 19 nt, Homo sapiens
augaauauguugccacuuu

SEQ ID NO: 683948 - RNA, 19 nt, Homo sapiens
ugagacagaugcucuuauc

SEQ ID NO: 683949 - RNA, 19 nt, Homo sapiens
ggaccacauuggaagaaga

SEQ ID NO: 683950 - RNA, 19 nt, Homo sapiens
ggagauaucaguguggauu

SEQ ID NO: 683951 - RNA, 19 nt, Homo sapiens
gauacaagaccaaggaaau

SEQ ID NO: 683952 - RNA, 19 nt, Homo sapiens
cagauugcaugauacaaga

SEQ ID NO: 683953 - RNA, 19 nt, Homo sapiens
caaaucaacagcuaugguu

SEQ ID NO: 683954 - RNA, 19 nt, Homo sapiens
ucagguauaaagccaauua

SEQ ID NO: 683955 - RNA, 19 nt, Homo sapiens
gaagacuggaccacuauga

SEQ ID NO: 683956 - RNA, 19 nt, Homo sapiens
gaaaugccaguccucgauu

SEQ ID NO: 683957 - RNA, 19 nt, Homo sapiens
cagcuuuggugcucaggua

SEQ ID NO: 683958 - RNA, 19 nt, Homo sapiens
aggaagagauggcauuuag

SEQ ID NO: 683959 - RNA, 19 nt, Homo sapiens
gucagcugcuuaauuaauu

SEQ ID NO: 683960 - RNA, 19 nt, Homo sapiens
gacaguuccugguagaaga

SEQ ID NO: 683961 - RNA, 19 nt, Homo sapiens
cuaauggucuacacauguu

SEQ ID NO: 683962 - RNA, 19 nt, Homo sapiens
acaaaguucuccauuucuu

SEQ ID NO: 683963 - RNA, 19 nt, Homo sapiens
gauuauugcagaaagagua

SEQ ID NO: 683964 - RNA, 19 nt, Homo sapiens
gcacgucagauauggcuaa

SEQ ID NO: 683965 - RNA, 19 nt, Homo sapiens
gcagaggaggacaaguuua

SEQ ID NO: 683966 - RNA, 19 nt, Homo sapiens
gauguuaaccaguaucaau

SEQ ID NO: 683967 - RNA, 19 nt, Homo sapiens
guauaaagccaauuaaggu

SEQ ID NO: 683968 - RNA, 19 nt, Homo sapiens
caaaggaagagcaagaaga

SEQ ID NO: 683969 - RNA, 19 nt, Homo sapiens
cauaaugagucaacaaggu

SEQ ID NO: 683970 - RNA, 19 nt, Homo sapiens
gcagccagcucagugcuau

SEQ ID NO: 683971 - RNA, 19 nt, Homo sapiens
caccaccgauguagaaaug

SEQ ID NO: 683972 - RNA, 19 nt, Homo sapiens
auacaacaauuuccagaug

SEQ ID NO: 683973 - RNA, 19 nt, Homo sapiens
ggaccagauuccagacaug

SEQ ID NO: 683974 - RNA, 19 nt, Homo sapiens
ccaccagccuuuaucuuca

SEQ ID NO: 683975 - RNA, 19 nt, Homo sapiens
ggaaaugccaguccucgau

SEQ ID NO: 683976 - RNA, 19 nt, Homo sapiens
caacucagaaugauaaugg

SEQ ID NO: 683977 - RNA, 19 nt, Homo sapiens
cauguuaccggaagaauug

SEQ ID NO: 683978 - RNA, 19 nt, Homo sapiens
cgucagauauggcuaagca

SEQ ID NO: 683979 - RNA, 19 nt, Homo sapiens
cagcagaggaggacaaguu

SEQ ID NO: 683980 - RNA, 19 nt, Homo sapiens
caacuuaaggucugcauag

SEQ ID NO: 683981 - RNA, 19 nt, Homo sapiens
ggagaucugucagcugcuu

SEQ ID NO: 683982 - RNA, 19 nt, Homo sapiens
caaacucagugaagacagu

SEQ ID NO: 683983 - RNA, 19 nt, Homo sapiens
gguggugacugauguugga

SEQ ID NO: 683984 - RNA, 19 nt, Homo sapiens
gaaaguauugccaguguac

SEQ ID NO: 683985 - RNA, 19 nt, Homo sapiens
ugaaaguauugccagugua

SEQ ID NO: 683986 - RNA, 19 nt, Homo sapiens
gcccauauguuggcauguu

SEQ ID NO: 683987 - RNA, 19 nt, Homo sapiens
ccaaacaaaugucuaugac

SEQ ID NO: 683988 - RNA, 19 nt, Homo sapiens
cauaaagaauggacuuguc

SEQ ID NO: 683989 - RNA, 19 nt, Homo sapiens
caaaugagaguccccuuua

SEQ ID NO: 683990 - RNA, 19 nt, Homo sapiens
ccauguaacuccauugaac

SEQ ID NO: 683991 - RNA, 19 nt, Homo sapiens
ugaaacuucucugucauug

SEQ ID NO: 683992 - RNA, 19 nt, Homo sapiens
gacagaugcucuuaucaac

SEQ ID NO: 683993 - RNA, 19 nt, Homo sapiens
gaagaaggcugcuauugaa

SEQ ID NO: 683994 - RNA, 19 nt, Homo sapiens
gaaggcaaguguaaaguua

SEQ ID NO: 683995 - RNA, 19 nt, Homo sapiens
ggugauaacugaagaaauu

SEQ ID NO: 683996 - RNA, 19 nt, Homo sapiens
gguaaaggcucgaaauaaa

SEQ ID NO: 683997 - RNA, 19 nt, Homo sapiens
ccagacagaugaugaguua

SEQ ID NO: 683998 - RNA, 19 nt, Homo sapiens
gcgaagaguuugaagauaa

SEQ ID NO: 683999 - RNA, 19 nt, Homo sapiens
ggacugagcuagaaacaug

SEQ ID NO: 684000 - RNA, 19 nt, Homo sapiens
gagcagagcuagaacagaa

SEQ ID NO: 684001 - RNA, 19 nt, Homo sapiens
ugacaaagauccaaacuga

SEQ ID NO: 684002 - RNA, 19 nt, Homo sapiens
gaaaggaggcuguggcuaa

SEQ ID NO: 684003 - RNA, 19 nt, Homo sapiens
caacggagaugccagugua

SEQ ID NO: 684004 - RNA, 19 nt, Homo sapiens
gaucugaaauuagccaaua

SEQ ID NO: 684005 - RNA, 19 nt, Homo sapiens
uaaaugaucuggaguguca

SEQ ID NO: 684006 - RNA, 19 nt, Homo sapiens
acacauaccugcauuguug

SEQ ID NO: 684007 - RNA, 19 nt, Homo sapiens
ggaaggacauucagucaga

SEQ ID NO: 684008 - RNA, 19 nt, Homo sapiens
gauccaaacugaauuacaa

SEQ ID NO: 684009 - RNA, 19 nt, Homo sapiens
ccaaaugucuagauaaguu

SEQ ID NO: 684010 - RNA, 19 nt, Homo sapiens
gcaauaauccguaucuuga

SEQ ID NO: 684011 - RNA, 19 nt, Homo sapiens
gcaaaguuguuuauuccua

SEQ ID NO: 684012 - RNA, 19 nt, Homo sapiens
gaaguuggcuagucaauac

SEQ ID NO: 684013 - RNA, 19 nt, Homo sapiens
aaaguaaggugauaacuga

SEQ ID NO: 684014 - RNA, 19 nt, Homo sapiens
gaaaauagaugaagcuaga

SEQ ID NO: 684015 - RNA, 19 nt, Homo sapiens
uaaugaaucuucuccauga

SEQ ID NO: 684016 - RNA, 19 nt, Homo sapiens
gaauccaaaugucuagaua

SEQ ID NO: 684017 - RNA, 19 nt, Homo sapiens
gugcagaugugcuuucuuu

SEQ ID NO: 684018 - RNA, 19 nt, Homo sapiens
caaggaggauuauguguga

SEQ ID NO: 684019 - RNA, 19 nt, Homo sapiens
acagauggcucaugcagua

SEQ ID NO: 684020 - RNA, 19 nt, Homo sapiens
agaaaggacugaaggauug

SEQ ID NO: 684021 - RNA, 19 nt, Homo sapiens
gggcacagucccuaaauua

SEQ ID NO: 684022 - RNA, 19 nt, Homo sapiens
gcacaucucuuccacaacu

SEQ ID NO: 684023 - RNA, 19 nt, Homo sapiens
gaaauaaaguuggccaagu

SEQ ID NO: 684024 - RNA, 19 nt, Homo sapiens
ccacucaccugcaaaguug

SEQ ID NO: 684025 - RNA, 19 nt, Homo sapiens
gaagguagggagcacaaua

SEQ ID NO: 684026 - RNA, 19 nt, Homo sapiens
gaggagcacagucuaaaua

SEQ ID NO: 684027 - RNA, 19 nt, Homo sapiens
gcagaacacauuccaguuu

SEQ ID NO: 684028 - RNA, 19 nt, Homo sapiens
agaaauacuuugagacuga

SEQ ID NO: 684029 - RNA, 19 nt, Homo sapiens
gaaggcugcuauugaaaga

SEQ ID NO: 684030 - RNA, 19 nt, Homo sapiens
gcacucguacaguauauua

SEQ ID NO: 684031 - RNA, 19 nt, Homo sapiens
cagagaagauugaagaugu

SEQ ID NO: 684032 - RNA, 19 nt, Homo sapiens
ucacaggcaucaaggcaua

SEQ ID NO: 684033 - RNA, 19 nt, Homo sapiens
gauugaagauggagauaug

SEQ ID NO: 684034 - RNA, 19 nt, Homo sapiens
gaccaguaauggcacuuua

SEQ ID NO: 684035 - RNA, 19 nt, Homo sapiens
cagaugaguugaccauuga

SEQ ID NO: 684036 - RNA, 19 nt, Homo sapiens
ucauggagcugcuguauca

SEQ ID NO: 684037 - RNA, 19 nt, Homo sapiens
caggaucgcuacuaucaaa

SEQ ID NO: 684038 - RNA, 19 nt, Homo sapiens
caaguuguauuaugcuuug

SEQ ID NO: 684039 - RNA, 19 nt, Homo sapiens
gucaauaccugaagagaga

SEQ ID NO: 684040 - RNA, 19 nt, Homo sapiens
ugaaggcucuugauggaaa

SEQ ID NO: 684041 - RNA, 19 nt, Homo sapiens
caaacugaauuacaagaga

SEQ ID NO: 684042 - RNA, 19 nt, Homo sapiens
ucacacacguccagcaauu

SEQ ID NO: 684043 - RNA, 19 nt, Homo sapiens
ccagaugaguugaccauug

SEQ ID NO: 684044 - RNA, 19 nt, Homo sapiens
caacaacggguucuaaaug

SEQ ID NO: 684045 - RNA, 19 nt, Homo sapiens
gagaaaggacugaaggauu

SEQ ID NO: 684046 - RNA, 19 nt, Homo sapiens
cugagaaagugaaaccuua

SEQ ID NO: 684047 - RNA, 19 nt, Homo sapiens
gacaauacccauuaaugaa

SEQ ID NO: 684048 - RNA, 19 nt, Homo sapiens
ugacaauacccauuaauga

SEQ ID NO: 684049 - RNA, 19 nt, Homo sapiens
ggaaacagaaggagggauu

SEQ ID NO: 684050 - RNA, 19 nt, Homo sapiens
caugugcacucguacagua

SEQ ID NO: 684051 - RNA, 19 nt, Homo sapiens
ggaauucaaugggcguauu

SEQ ID NO: 684052 - RNA, 19 nt, Homo sapiens
agaagaaggcgaagaguuu

SEQ ID NO: 684053 - RNA, 19 nt, Homo sapiens
gaaauacuuugagacugaa

SEQ ID NO: 684054 - RNA, 19 nt, Homo sapiens
caagagacagugaaagauu

SEQ ID NO: 684055 - RNA, 19 nt, Homo sapiens
cacaauaccuagggacuaa

SEQ ID NO: 684056 - RNA, 19 nt, Homo sapiens
gaugaugacucuugaacag

SEQ ID NO: 684057 - RNA, 19 nt, Homo sapiens
cuacaaggcuucucaacca

SEQ ID NO: 684058 - RNA, 19 nt, Homo sapiens
augaucaucucaaggauua

SEQ ID NO: 684059 - RNA, 19 nt, Homo sapiens
uggaagagcugcuaauuuu

SEQ ID NO: 684060 - RNA, 19 nt, Homo sapiens
aaauaaaguuggccaagug

SEQ ID NO: 684061 - RNA, 19 nt, Homo sapiens
gcaagaaaacgcuguauuu

SEQ ID NO: 684062 - RNA, 19 nt, Homo sapiens
gcuguccgcuccuguagaa

SEQ ID NO: 684063 - RNA, 19 nt, Homo sapiens
uaugaaggcucuugaugga

SEQ ID NO: 684064 - RNA, 19 nt, Homo sapiens
gaggcaaaaucuaaacuua

SEQ ID NO: 684065 - RNA, 19 nt, Homo sapiens
gcauguaucccguuuggaa

SEQ ID NO: 684066 - RNA, 19 nt, Homo sapiens
gagcauguaucccguuugg

SEQ ID NO: 684067 - RNA, 19 nt, Homo sapiens
ugucauuucuccuaccaua

SEQ ID NO: 684068 - RNA, 19 nt, Homo sapiens
gaagauugaagauguggaa

SEQ ID NO: 684069 - RNA, 19 nt, Homo sapiens
aagagacagugaaagauuu

SEQ ID NO: 684070 - RNA, 19 nt, Homo sapiens
guaaggugauaacugaaga

SEQ ID NO: 684071 - RNA, 19 nt, Homo sapiens
acaagugucuucugugugu

SEQ ID NO: 684072 - RNA, 19 nt, Homo sapiens
gcaugaugaugacucuuga

SEQ ID NO: 684073 - RNA, 19 nt, Homo sapiens
ggaaauguguaugaucauc

SEQ ID NO: 684074 - RNA, 19 nt, Homo sapiens
gaguguaauuccaaagcua

SEQ ID NO: 684075 - RNA, 19 nt, Homo sapiens
ucagugacaauacccauua

SEQ ID NO: 684076 - RNA, 19 nt, Homo sapiens
guagacuccucccacguuu

SEQ ID NO: 684077 - RNA, 19 nt, Homo sapiens
agaagaaggcugcuauuga

SEQ ID NO: 684078 - RNA, 19 nt, Homo sapiens
gucuuuagcuagccaaauu

SEQ ID NO: 684079 - RNA, 19 nt, Homo sapiens
gauaaguugaggacacaua

SEQ ID NO: 684080 - RNA, 19 nt, Homo sapiens
gagaauuaaucagaucaug

SEQ ID NO: 684081 - RNA, 19 nt, Homo sapiens
acaaggauguggcaaagau

SEQ ID NO: 684082 - RNA, 19 nt, Homo sapiens
ggguaaaggcucgaaauaa

SEQ ID NO: 684083 - RNA, 19 nt, Homo sapiens
ucuggcaccuuaagaaauu

SEQ ID NO: 684084 - RNA, 19 nt, Homo sapiens
gagaagaaggcgaagaguu

SEQ ID NO: 684085 - RNA, 19 nt, Homo sapiens
gcacuuuacacucgcuuaa

SEQ ID NO: 684086 - RNA, 19 nt, Homo sapiens
gauacuagccgacaguuag

SEQ ID NO: 684087 - RNA, 19 nt, Homo sapiens
ucaagaaucaguuuacaga

SEQ ID NO: 684088 - RNA, 19 nt, Homo sapiens
gaaggacauucagucagaa

SEQ ID NO: 684089 - RNA, 19 nt, Homo sapiens
cagaugugcuuucuuuaca

SEQ ID NO: 684090 - RNA, 19 nt, Homo sapiens
gaggacacauaccugcauu

SEQ ID NO: 684091 - RNA, 19 nt, Homo sapiens
aacaguguccuucguauua

SEQ ID NO: 684092 - RNA, 19 nt, Homo sapiens
cugaugaucggaaugauua

SEQ ID NO: 684093 - RNA, 19 nt, Homo sapiens
gcaaauagaugaacaacaa

SEQ ID NO: 684094 - RNA, 19 nt, Homo sapiens
ggaauaccauguuaagaua

SEQ ID NO: 684095 - RNA, 19 nt, Homo sapiens
gaaagaagcucggucuauu

SEQ ID NO: 684096 - RNA, 19 nt, Homo sapiens
gaaauuagcagcauuagaa

SEQ ID NO: 684097 - RNA, 19 nt, Homo sapiens
gaagcucggucuauuguaa

SEQ ID NO: 684098 - RNA, 19 nt, Homo sapiens
gcaaugacuuggauuucua

SEQ ID NO: 684099 - RNA, 19 nt, Homo sapiens
gaagauaauucacaguuca

SEQ ID NO: 684100 - RNA, 19 nt, Homo sapiens
gaagauacaucagcuuaau

SEQ ID NO: 684101 - RNA, 19 nt, Homo sapiens
gaaguccaguucccuguaa

SEQ ID NO: 684102 - RNA, 19 nt, Homo sapiens
gaaggaugacugccuguua

SEQ ID NO: 684103 - RNA, 19 nt, Homo sapiens
gcuaaagccacaacaaaua

SEQ ID NO: 684104 - RNA, 19 nt, Homo sapiens
gagaaugaucccuuuguua

SEQ ID NO: 684105 - RNA, 19 nt, Homo sapiens
gauuauuucuccuuggaua

SEQ ID NO: 684106 - RNA, 19 nt, Homo sapiens
agacauggcgcuucauuua

SEQ ID NO: 684107 - RNA, 19 nt, Homo sapiens
gcacacuucugacuauaau

SEQ ID NO: 684108 - RNA, 19 nt, Homo sapiens
caccaaagauuuccaacaa

SEQ ID NO: 684109 - RNA, 19 nt, Homo sapiens
agucagaaaucuucacaua

SEQ ID NO: 684110 - RNA, 19 nt, Homo sapiens
ggcaugauaucuuugaauu

SEQ ID NO: 684111 - RNA, 19 nt, Homo sapiens
gcaauccguucuccucaaa

SEQ ID NO: 684112 - RNA, 19 nt, Homo sapiens
gaugcacacuuaaguuuga

SEQ ID NO: 684113 - RNA, 19 nt, Homo sapiens
gaugauagcuaugguguag

SEQ ID NO: 684114 - RNA, 19 nt, Homo sapiens
gaacuugaacguuuggaaa

SEQ ID NO: 684115 - RNA, 19 nt, Homo sapiens
gcaaaccucccacagcuaa

SEQ ID NO: 684116 - RNA, 19 nt, Homo sapiens
gcaaagggaagauauugaa

SEQ ID NO: 684117 - RNA, 19 nt, Homo sapiens
gagagaggaucauggacaa

SEQ ID NO: 684118 - RNA, 19 nt, Homo sapiens
cacaagacgugguuaaaga

SEQ ID NO: 684119 - RNA, 19 nt, Homo sapiens
aggcagaacuugaacguuu

SEQ ID NO: 684120 - RNA, 19 nt, Homo sapiens
guauuuaccuccugagugu

SEQ ID NO: 684121 - RNA, 19 nt, Homo sapiens
ggagagaugagaagaaaga

SEQ ID NO: 684122 - RNA, 19 nt, Homo sapiens
ggagucggguucccagaaa

SEQ ID NO: 684123 - RNA, 19 nt, Homo sapiens
ggaccacccuauuguacaa

SEQ ID NO: 684124 - RNA, 19 nt, Homo sapiens
ggacguggccacaaaauua

SEQ ID NO: 684125 - RNA, 19 nt, Homo sapiens
gaucaaauucuucaggaaa

SEQ ID NO: 684126 - RNA, 19 nt, Homo sapiens
aaacaaagcagucaaugga

SEQ ID NO: 684127 - RNA, 19 nt, Homo sapiens
caaaguagcaguggaaguu

SEQ ID NO: 684128 - RNA, 19 nt, Homo sapiens
gaagccaaggcauuuauaa

SEQ ID NO: 684129 - RNA, 19 nt, Homo sapiens
aaacaugccugcagagagu

SEQ ID NO: 684130 - RNA, 19 nt, Homo sapiens
gcauaucaaugagcaagaa

SEQ ID NO: 684131 - RNA, 19 nt, Homo sapiens
ugacugaaguuccucauag

SEQ ID NO: 684132 - RNA, 19 nt, Homo sapiens
ugagagcauuugaguguuu

SEQ ID NO: 684133 - RNA, 19 nt, Homo sapiens
gcuuccagaugcacacuua

SEQ ID NO: 684134 - RNA, 19 nt, Homo sapiens
ugacuuuccuccaagauug

SEQ ID NO: 684135 - RNA, 19 nt, Homo sapiens
ccaagauuauggaugauga

SEQ ID NO: 684136 - RNA, 19 nt, Homo sapiens
ccgaauagcccuucuccua

SEQ ID NO: 684137 - RNA, 19 nt, Homo sapiens
gaagaaacaaucggaauca

SEQ ID NO: 684138 - RNA, 19 nt, Homo sapiens
cgaaagcucuaaucacagu

SEQ ID NO: 684139 - RNA, 19 nt, Homo sapiens
gaaaagagccaccaaagau

SEQ ID NO: 684140 - RNA, 19 nt, Homo sapiens
gagagaagaguaugcaaga

SEQ ID NO: 684141 - RNA, 19 nt, Homo sapiens
caagaaggcaagaguuauu

SEQ ID NO: 684142 - RNA, 19 nt, Homo sapiens
gaaagaaaacuaccacaaa

SEQ ID NO: 684143 - RNA, 19 nt, Homo sapiens
gugaagauacaucagcuua

SEQ ID NO: 684144 - RNA, 19 nt, Homo sapiens
gaaaagaguacacaagaaa

SEQ ID NO: 684145 - RNA, 19 nt, Homo sapiens
ggaacagcauguggugaaa

SEQ ID NO: 684146 - RNA, 19 nt, Homo sapiens
gaaaggcaaaggaaacuuc

SEQ ID NO: 684147 - RNA, 19 nt, Homo sapiens
caacaagaaugggugaauc

SEQ ID NO: 684148 - RNA, 19 nt, Homo sapiens
gaucucagacggcaaauag

SEQ ID NO: 684149 - RNA, 19 nt, Homo sapiens
gaauagcccuucuccuacu

SEQ ID NO: 684150 - RNA, 19 nt, Homo sapiens
cauggacaaugaauaaaug

SEQ ID NO: 684151 - RNA, 19 nt, Homo sapiens
gaagauauugaaaggcaaa

SEQ ID NO: 684152 - RNA, 19 nt, Homo sapiens
gaguaugcaagaucgauua

SEQ ID NO: 684153 - RNA, 19 nt, Homo sapiens
cuaaagccacaacaaauaa

SEQ ID NO: 684154 - RNA, 19 nt, Homo sapiens
ggagggacguauagaugau

SEQ ID NO: 684155 - RNA, 19 nt, Homo sapiens
gcagugaagccaaggcauu

SEQ ID NO: 684156 - RNA, 19 nt, Homo sapiens
aaagagccaccaaagauuu

SEQ ID NO: 684157 - RNA, 19 nt, Homo sapiens
uagcagcauuagaaaguaa

SEQ ID NO: 684158 - RNA, 19 nt, Homo sapiens
aacgaaagcucuaaucaca

SEQ ID NO: 684159 - RNA, 19 nt, Homo sapiens
ugacuuggauuucuaucug

SEQ ID NO: 684160 - RNA, 19 nt, Homo sapiens
cugcagagaguauagaaua

SEQ ID NO: 684161 - RNA, 19 nt, Homo sapiens
ucagaaaucuucacauacg

SEQ ID NO: 684162 - RNA, 19 nt, Homo sapiens
ccagaaaguagcuugauga

SEQ ID NO: 684163 - RNA, 19 nt, Homo sapiens
caagaguuauuggaagcua

SEQ ID NO: 684164 - RNA, 19 nt, Homo sapiens
guuaaagaacuguuuguga

SEQ ID NO: 684165 - RNA, 19 nt, Homo sapiens
cagaugcacacuuaaguuu

SEQ ID NO: 684166 - RNA, 19 nt, Homo sapiens
ggcaggcacuuacugguau

SEQ ID NO: 684167 - RNA, 19 nt, Homo sapiens
gaaggagggacguauagau

SEQ ID NO: 684168 - RNA, 19 nt, Homo sapiens
gggcaggcacuuacuggua

SEQ ID NO: 684169 - RNA, 19 nt, Homo sapiens
uaaugcagauuguaaaugc

SEQ ID NO: 684170 - RNA, 19 nt, Homo sapiens
aauaaaagcuggagagaug

SEQ ID NO: 684171 - RNA, 19 nt, Homo sapiens
gaaugaucccuuuguuaga

SEQ ID NO: 684172 - RNA, 19 nt, Homo sapiens
gagaagaguaugcaagauc

SEQ ID NO: 684173 - RNA, 19 nt, Homo sapiens
ucaaugagcaagaaacuuc

SEQ ID NO: 684174 - RNA, 19 nt, Homo sapiens
caaucaaucucaacaagac

SEQ ID NO: 684175 - RNA, 19 nt, Homo sapiens
caaguuaaugucagagaaa

SEQ ID NO: 684176 - RNA, 19 nt, Homo sapiens
aaagaaggagggacguaua

SEQ ID NO: 684177 - RNA, 19 nt, Homo sapiens
gcagaaaaccagaaugaaa

SEQ ID NO: 684178 - RNA, 19 nt, Homo sapiens
gagaagaaacaaucggaau

SEQ ID NO: 684179 - RNA, 19 nt, Homo sapiens
ugacaaagaaucagagaca

SEQ ID NO: 684180 - RNA, 19 nt, Homo sapiens
agagguggcuuuagugaag

SEQ ID NO: 684181 - RNA, 19 nt, Homo sapiens
agagaaugaucccuuuguu

SEQ ID NO: 684182 - RNA, 19 nt, Homo sapiens
gaacaauggacagaugguu

SEQ ID NO: 684183 - RNA, 19 nt, Homo sapiens
guuauuggaagcuagauuu

SEQ ID NO: 684184 - RNA, 19 nt, Homo sapiens
caaauaacgaaagcucuaa

SEQ ID NO: 684185 - RNA, 19 nt, Homo sapiens
ggcagaacuugaacguuug

SEQ ID NO: 684186 - RNA, 19 nt, Homo sapiens
cagggaaggugcaauggau

SEQ ID NO: 684187 - RNA, 19 nt, Homo sapiens
aggcauaccuccugcaauc

SEQ ID NO: 684188 - RNA, 19 nt, Homo sapiens
uuacacagaaacaggaaua

SEQ ID NO: 684189 - RNA, 19 nt, Homo sapiens
ccucauagugucauuggua

SEQ ID NO: 684190 - RNA, 19 nt, Homo sapiens
acacauggcugggcugaca

SEQ ID NO: 684191 - RNA, 19 nt, Homo sapiens
gaaagccauuuggucacaa

SEQ ID NO: 684192 - RNA, 19 nt, Homo sapiens
gcaggcacuuacugguauu

SEQ ID NO: 684193 - RNA, 19 nt, Homo sapiens
gcagugaaauuccuuguua

SEQ ID NO: 684194 - RNA, 19 nt, Homo sapiens
gcaagaagcuccuccacua

SEQ ID NO: 684195 - RNA, 19 nt, Homo sapiens
gaacagggaugaaagaaga

SEQ ID NO: 684196 - RNA, 19 nt, Homo sapiens
gaagacagcugcuaccauu

SEQ ID NO: 684197 - RNA, 19 nt, Homo sapiens
gaaaugaaguugauucuca

SEQ ID NO: 684198 - RNA, 19 nt, Homo sapiens
gaaguauaccucugaauua

SEQ ID NO: 684199 - RNA, 19 nt, Homo sapiens
ggacuuaguuucaucuauu

SEQ ID NO: 684200 - RNA, 19 nt, Homo sapiens
gaaaggagauauguuguau

SEQ ID NO: 684201 - RNA, 19 nt, Homo sapiens
gauguagccucuugcaaua

SEQ ID NO: 684202 - RNA, 19 nt, Homo sapiens
aaacuaaacucaagacaga

SEQ ID NO: 684203 - RNA, 19 nt, Homo sapiens
ugacagugauccuccauua

SEQ ID NO: 684204 - RNA, 19 nt, Homo sapiens
ggaauaagcaugauggaaa

SEQ ID NO: 684205 - RNA, 19 nt, Homo sapiens
cuaaggaacugcuguugua

SEQ ID NO: 684206 - RNA, 19 nt, Homo sapiens
gauguugguuuccuucaua

SEQ ID NO: 684207 - RNA, 19 nt, Homo sapiens
ggaaggaaaugaaguugau

SEQ ID NO: 684208 - RNA, 19 nt, Homo sapiens
ucagaaacguggagaauug

SEQ ID NO: 684209 - RNA, 19 nt, Homo sapiens
gaauaagcaugauggaaau

SEQ ID NO: 684210 - RNA, 19 nt, Homo sapiens
gaucauuucuuuagucuag

SEQ ID NO: 684211 - RNA, 19 nt, Homo sapiens
guagaaaccucagggauug

SEQ ID NO: 684212 - RNA, 19 nt, Homo sapiens
ggaaggugaugaaaccaaa

SEQ ID NO: 684213 - RNA, 19 nt, Homo sapiens
caaggugaauguuugaauu

SEQ ID NO: 684214 - RNA, 19 nt, Homo sapiens
gacugaauguuguaugaua

SEQ ID NO: 684215 - RNA, 19 nt, Homo sapiens
ucaagacgcuggaagaaau

SEQ ID NO: 684216 - RNA, 19 nt, Homo sapiens
ugaaagagccagucagaaa

SEQ ID NO: 684217 - RNA, 19 nt, Homo sapiens
ccacaggacugcccauuca

SEQ ID NO: 684218 - RNA, 19 nt, Homo sapiens
gaagccaucugugguuaaa

SEQ ID NO: 684219 - RNA, 19 nt, Homo sapiens
gaugcacgcugcugucauu

SEQ ID NO: 684220 - RNA, 19 nt, Homo sapiens
ccaaagaaagcucaaguuu

SEQ ID NO: 684221 - RNA, 19 nt, Homo sapiens
uauaugagauggugacaug

SEQ ID NO: 684222 - RNA, 19 nt, Homo sapiens
agagggagaucaagugaaa

SEQ ID NO: 684223 - RNA, 19 nt, Homo sapiens
gagagaagcacaugcagaa

SEQ ID NO: 684224 - RNA, 19 nt, Homo sapiens
uugguuagauugagucuua

SEQ ID NO: 684225 - RNA, 19 nt, Homo sapiens
cacaauggauuacgaguga

SEQ ID NO: 684226 - RNA, 19 nt, Homo sapiens
gcacuuguauuagucaaug

SEQ ID NO: 684227 - RNA, 19 nt, Homo sapiens
guggagaauugcaaacuaa

SEQ ID NO: 684228 - RNA, 19 nt, Homo sapiens
gcacauggagauugauaaa

SEQ ID NO: 684229 - RNA, 19 nt, Homo sapiens
ucuaugggcuguagcagua

SEQ ID NO: 684230 - RNA, 19 nt, Homo sapiens
gauuggagacucauuauug

SEQ ID NO: 684231 - RNA, 19 nt, Homo sapiens
gugaagacauuagaagaaa

SEQ ID NO: 684232 - RNA, 19 nt, Homo sapiens
gaaaccugcagucaauaua

SEQ ID NO: 684233 - RNA, 19 nt, Homo sapiens
caauuucugugaucaaguu

SEQ ID NO: 684234 - RNA, 19 nt, Homo sapiens
gcacagaggcuagggaaga

SEQ ID NO: 684235 - RNA, 19 nt, Homo sapiens
gguagaauguucagguuuc

SEQ ID NO: 684236 - RNA, 19 nt, Homo sapiens
gagaugaucauuucuuuag

SEQ ID NO: 684237 - RNA, 19 nt, Homo sapiens
cagaggagccugcagguaa

SEQ ID NO: 684238 - RNA, 19 nt, Homo sapiens
uaauaaaguuggugagauc

SEQ ID NO: 684239 - RNA, 19 nt, Homo sapiens
aagaugaccuucugcuuga

SEQ ID NO: 684240 - RNA, 19 nt, Homo sapiens
aaagcaaggugaauguuug

SEQ ID NO: 684241 - RNA, 19 nt, Homo sapiens
guugucauuuggaagauua

SEQ ID NO: 684242 - RNA, 19 nt, Homo sapiens
guaagcggcucaucaagag

SEQ ID NO: 684243 - RNA, 19 nt, Homo sapiens
caaauuggaagcugagauu

SEQ ID NO: 684244 - RNA, 19 nt, Homo sapiens
gagguagaauguucagguu

SEQ ID NO: 684245 - RNA, 19 nt, Homo sapiens
gaacuuagugacuccuuga

SEQ ID NO: 684246 - RNA, 19 nt, Homo sapiens
cuacaggauuacaguuuaa

SEQ ID NO: 684247 - RNA, 19 nt, Homo sapiens
cagcaugccuaaucaagga

SEQ ID NO: 684248 - RNA, 19 nt, Homo sapiens
gguagaaaccucagggauu

SEQ ID NO: 684249 - RNA, 19 nt, Homo sapiens
gcuaaagauugauagugaa

SEQ ID NO: 684250 - RNA, 19 nt, Homo sapiens
cagcugauccagauaauga

SEQ ID NO: 684251 - RNA, 19 nt, Homo sapiens
ugaaauuccuuguuauugg

SEQ ID NO: 684252 - RNA, 19 nt, Homo sapiens
ggauuacaguuuaaagaca

SEQ ID NO: 684253 - RNA, 19 nt, Homo sapiens
guauaccucugaauuaucu

SEQ ID NO: 684254 - RNA, 19 nt, Homo sapiens
gaugaucauuucuuuaguc

SEQ ID NO: 684255 - RNA, 19 nt, Homo sapiens
gugaucaaguugucauuug

SEQ ID NO: 684256 - RNA, 19 nt, Homo sapiens
gugaagccaucugugguua

SEQ ID NO: 684257 - RNA, 19 nt, Homo sapiens
gaugugagaccaugagaga

SEQ ID NO: 684258 - RNA, 19 nt, Homo sapiens
ucucagagcaguauuagaa

SEQ ID NO: 684259 - RNA, 19 nt, Homo sapiens
aagcagagguagaauguuc

SEQ ID NO: 684260 - RNA, 19 nt, Homo sapiens
ugacaugauuagaggaauu

SEQ ID NO: 684261 - RNA, 19 nt, Homo sapiens
uaccugagaugaucauuuc

SEQ ID NO: 684262 - RNA, 19 nt, Homo sapiens
caaagcagagguagaaugu

SEQ ID NO: 684263 - RNA, 19 nt, Homo sapiens
gaaaguugaagcuccagaa

SEQ ID NO: 684264 - RNA, 19 nt, Homo sapiens
uaaagcaaggugaauguuu

SEQ ID NO: 684265 - RNA, 19 nt, Homo sapiens
ggaaaccugcagucaauau

SEQ ID NO: 684266 - RNA, 19 nt, Homo sapiens
ccggaaaccugcagucaau

SEQ ID NO: 684267 - RNA, 19 nt, Homo sapiens
cgcauuauuugaaccauuu

SEQ ID NO: 684268 - RNA, 19 nt, Homo sapiens
caagaaguuucccuaccuu

SEQ ID NO: 684269 - RNA, 19 nt, Homo sapiens
cgacaggugugcagguuuc

SEQ ID NO: 684270 - RNA, 19 nt, Homo sapiens
uaaagcacuuguauuaguc

SEQ ID NO: 684271 - RNA, 19 nt, Homo sapiens
acuacaggauuacaguuua

SEQ ID NO: 684272 - RNA, 19 nt, Homo sapiens
caauagaggacgauauguu

SEQ ID NO: 684273 - RNA, 19 nt, Homo sapiens
agaaguauaccucugaauu

SEQ ID NO: 684274 - RNA, 19 nt, Homo sapiens
gaugcaacagauaaaguua

SEQ ID NO: 684275 - RNA, 19 nt, Homo sapiens
acagugauccuccauuaaa

SEQ ID NO: 684276 - RNA, 19 nt, Homo sapiens
ugaaaggagauauguugua

SEQ ID NO: 684277 - RNA, 19 nt, Homo sapiens
agacagcugcuaccauuaa

SEQ ID NO: 684278 - RNA, 19 nt, Homo sapiens
ggaugcaacagauaaaguu

SEQ ID NO: 684279 - RNA, 19 nt, Homo sapiens
caugucagcugauccagau

SEQ ID NO: 684280 - RNA, 19 nt, Homo sapiens
ucaggaguuuccagucuuu

SEQ ID NO: 684281 - RNA, 19 nt, Homo sapiens
ugaugaagaugaugaugau

SEQ ID NO: 684282 - RNA, 19 nt, Homo sapiens
uaugauagcccuucuccaa

SEQ ID NO: 684283 - RNA, 19 nt, Homo sapiens
gaaagaugaagaugaccuu

SEQ ID NO: 684284 - RNA, 19 nt, Homo sapiens
caaggcggcugcugcgaau

SEQ ID NO: 684285 - RNA, 19 nt, Homo sapiens
caaguuuccaagucucuua

SEQ ID NO: 684286 - RNA, 19 nt, Homo sapiens
uaauuaaugcugcagauga

SEQ ID NO: 684287 - RNA, 19 nt, Homo sapiens
ccacucagucuguguuaaa

SEQ ID NO: 684288 - RNA, 19 nt, Homo sapiens
gccauuguuuaucaucuuu

SEQ ID NO: 684289 - RNA, 19 nt, Homo sapiens
cugagaugaucauuucuuu

SEQ ID NO: 684290 - RNA, 19 nt, Homo sapiens
gacuuaguuucaucuauug

SEQ ID NO: 684291 - RNA, 19 nt, Homo sapiens
gaaaugauugauagcugaa

SEQ ID NO: 684292 - RNA, 19 nt, Homo sapiens
ugaccuggauccugggaaa

SEQ ID NO: 684293 - RNA, 19 nt, Homo sapiens
gaagaaagcuauuguacaa

SEQ ID NO: 684294 - RNA, 19 nt, Homo sapiens
ggagugauuucucuuuaua

SEQ ID NO: 684295 - RNA, 19 nt, Homo sapiens
gcggaacucuacaucauua

SEQ ID NO: 684296 - RNA, 19 nt, Homo sapiens
ggacuugccuaaaauauua

SEQ ID NO: 684297 - RNA, 19 nt, Homo sapiens
guacaaauaucacucuuca

SEQ ID NO: 684298 - RNA, 19 nt, Homo sapiens
ucagauggauguugaauug

SEQ ID NO: 684299 - RNA, 19 nt, Homo sapiens
ccuagaaccuguugaguuu

SEQ ID NO: 684300 - RNA, 19 nt, Homo sapiens
ugaaggcacuggcugcuua

SEQ ID NO: 684301 - RNA, 19 nt, Homo sapiens
gaaauaguccuuccuguuc

SEQ ID NO: 684302 - RNA, 19 nt, Homo sapiens
caacccaccuguuacaauu

SEQ ID NO: 684303 - RNA, 19 nt, Homo sapiens
ggaaugcuguccuagagaa

SEQ ID NO: 684304 - RNA, 19 nt, Homo sapiens
ggacuuggaccacucuaua

SEQ ID NO: 684305 - RNA, 19 nt, Homo sapiens
gagaugaguugcacaagau

SEQ ID NO: 684306 - RNA, 19 nt, Homo sapiens
ccaagccagugaagaguua

SEQ ID NO: 684307 - RNA, 19 nt, Homo sapiens
ggagggaugguuacuguua

SEQ ID NO: 684308 - RNA, 19 nt, Homo sapiens
ccaccuaucuccuuggauu

SEQ ID NO: 684309 - RNA, 19 nt, Homo sapiens
gagcuuaacauuagaauag

SEQ ID NO: 684310 - RNA, 19 nt, Homo sapiens
ccaccaaagucuaaaguug

SEQ ID NO: 684311 - RNA, 19 nt, Homo sapiens
gaacucuacaucauuagua

SEQ ID NO: 684312 - RNA, 19 nt, Homo sapiens
caggagugauuucucuuua

SEQ ID NO: 684313 - RNA, 19 nt, Homo sapiens
caacuaggccaaaccagua

SEQ ID NO: 684314 - RNA, 19 nt, Homo sapiens
gaagauccuuggguuguga

SEQ ID NO: 684315 - RNA, 19 nt, Homo sapiens
ucagaaaguucgaaucaau

SEQ ID NO: 684316 - RNA, 19 nt, Homo sapiens
gcacaagauuauacacugu

SEQ ID NO: 684317 - RNA, 19 nt, Homo sapiens
gcaacccaaugagguaaua

SEQ ID NO: 684318 - RNA, 19 nt, Homo sapiens
gcagaaguuuacagcauga

SEQ ID NO: 684319 - RNA, 19 nt, Homo sapiens
aaauaucacucuucagguu

SEQ ID NO: 684320 - RNA, 19 nt, Homo sapiens
cagcuaauuugugguauuu

SEQ ID NO: 684321 - RNA, 19 nt, Homo sapiens
cagaauaagcagaaguuua

SEQ ID NO: 684322 - RNA, 19 nt, Homo sapiens
cauagauucugguguuaaa

SEQ ID NO: 684323 - RNA, 19 nt, Homo sapiens
agaguuaucugcugggaaa

SEQ ID NO: 684324 - RNA, 19 nt, Homo sapiens
gcuuuauucuuucgugaua

SEQ ID NO: 684325 - RNA, 19 nt, Homo sapiens
cagaaauccuggaauuaga

SEQ ID NO: 684326 - RNA, 19 nt, Homo sapiens
uguauucacuuguguuuga

SEQ ID NO: 684327 - RNA, 19 nt, Homo sapiens
aaacugaggcugccaagaa

SEQ ID NO: 684328 - RNA, 19 nt, Homo sapiens
cagaauggcugaggaagau

SEQ ID NO: 684329 - RNA, 19 nt, Homo sapiens
aguaagagguuccaccaaa

SEQ ID NO: 684330 - RNA, 19 nt, Homo sapiens
gaugaucacagauguaguu

SEQ ID NO: 684331 - RNA, 19 nt, Homo sapiens
ccaaguugauuauuaccaa

SEQ ID NO: 684332 - RNA, 19 nt, Homo sapiens
gggaguauucuuuggauaa

SEQ ID NO: 684333 - RNA, 19 nt, Homo sapiens
ucaaccagcuacguacaua

SEQ ID NO: 684334 - RNA, 19 nt, Homo sapiens
gacuggaucuguauuaucu

SEQ ID NO: 684335 - RNA, 19 nt, Homo sapiens
uggcauagauucugguguu

SEQ ID NO: 684336 - RNA, 19 nt, Homo sapiens
ccagcuacguacauaguuu

SEQ ID NO: 684337 - RNA, 19 nt, Homo sapiens
gcauaugcuuuauucuuuc

SEQ ID NO: 684338 - RNA, 19 nt, Homo sapiens
guucagaauuggcauagau

SEQ ID NO: 684339 - RNA, 19 nt, Homo sapiens
gcaguuaccauccuuaucu

SEQ ID NO: 684340 - RNA, 19 nt, Homo sapiens
ccacuacgcccagcuaauu

SEQ ID NO: 684341 - RNA, 19 nt, Homo sapiens
caagaaagaguaucugaag

SEQ ID NO: 684342 - RNA, 19 nt, Homo sapiens
caagggugauccugaaaca

SEQ ID NO: 684343 - RNA, 19 nt, Homo sapiens
ucacaguucaugaaucuaa

SEQ ID NO: 684344 - RNA, 19 nt, Homo sapiens
cugcagggauguauucuug

SEQ ID NO: 684345 - RNA, 19 nt, Homo sapiens
ccuguugaguuucuaauga

SEQ ID NO: 684346 - RNA, 19 nt, Homo sapiens
cagaaucccaacuacaaua

SEQ ID NO: 684347 - RNA, 19 nt, Homo sapiens
gaugaguugcacaagauua

SEQ ID NO: 684348 - RNA, 19 nt, Homo sapiens
guaauacucccauuucaca

SEQ ID NO: 684349 - RNA, 19 nt, Homo sapiens
guaagagguuccaccaaag

SEQ ID NO: 684350 - RNA, 19 nt, Homo sapiens
uaucacaguucaugaaucu

SEQ ID NO: 684351 - RNA, 19 nt, Homo sapiens
ugagaacccucccauugug

SEQ ID NO: 684352 - RNA, 19 nt, Homo sapiens
ccaaagugcucggauuaca

SEQ ID NO: 684353 - RNA, 19 nt, Homo sapiens
ccaaagugcugggauuaca

SEQ ID NO: 684354 - RNA, 19 nt, Homo sapiens
uggguagccucuagaaauu

SEQ ID NO: 684355 - RNA, 19 nt, Homo sapiens
gagggaugguuacuguuau

SEQ ID NO: 684356 - RNA, 19 nt, Homo sapiens
cccaugcacucauuuaguu

SEQ ID NO: 684357 - RNA, 19 nt, Homo sapiens
agacaggguuucaccaugu

SEQ ID NO: 684358 - RNA, 19 nt, Homo sapiens
uaucugaguuaucacaguu

SEQ ID NO: 684359 - RNA, 19 nt, Homo sapiens
gcaaugaguguguggugaa

SEQ ID NO: 684360 - RNA, 19 nt, Homo sapiens
guaaggacugggacaauga

SEQ ID NO: 684361 - RNA, 19 nt, Homo sapiens
gaucacagauguaguuccu

SEQ ID NO: 684362 - RNA, 19 nt, Homo sapiens
gaaagauccuaaugaaccu

SEQ ID NO: 684363 - RNA, 19 nt, Homo sapiens
gacaugacaucuggcuuga

SEQ ID NO: 684364 - RNA, 19 nt, Homo sapiens
ggcauagauucugguguua

SEQ ID NO: 684365 - RNA, 19 nt, Homo sapiens
aagacugccuaucaucaua

SEQ ID NO: 684366 - RNA, 19 nt, Homo sapiens
agagaugaguugcacaaga

SEQ ID NO: 684367 - RNA, 19 nt, Homo sapiens
uagagaaccuccuccucaa

SEQ ID NO: 684368 - RNA, 19 nt, Homo sapiens
ccaccugguuguaacagaa

SEQ ID NO: 684369 - RNA, 19 nt, Homo sapiens
ggugggagcgguuguguga

SEQ ID NO: 684370 - RNA, 19 nt, Homo sapiens
ugaaauaguccuuccuguu

SEQ ID NO: 684371 - RNA, 19 nt, Homo sapiens
gcacugcagggauguauuc

SEQ ID NO: 684372 - RNA, 19 nt, Homo sapiens
ggacugggacaaugaauac

SEQ ID NO: 684373 - RNA, 19 nt, Homo sapiens
ucaccaaguugauuauuac

SEQ ID NO: 684374 - RNA, 19 nt, Homo sapiens
ggaagauccuuggguugug

SEQ ID NO: 684375 - RNA, 19 nt, Homo sapiens
cauauaauacugagagaug

SEQ ID NO: 684376 - RNA, 19 nt, Homo sapiens
gagguaauacucccauuuc

SEQ ID NO: 684377 - RNA, 19 nt, Homo sapiens
auacugggcuacauggaaa

SEQ ID NO: 684378 - RNA, 19 nt, Homo sapiens
aaaauagacuggaucugua

SEQ ID NO: 684379 - RNA, 19 nt, Homo sapiens
gaaguuuacagcaugauag

SEQ ID NO: 684380 - RNA, 19 nt, Homo sapiens
gaagccaccugguuguaac

SEQ ID NO: 684381 - RNA, 19 nt, Homo sapiens
cagugguguuugugaaaua

SEQ ID NO: 684382 - RNA, 19 nt, Homo sapiens
gguagccucuagaaauuca

SEQ ID NO: 684383 - RNA, 19 nt, Homo sapiens
ggccaaaccaguacagcua

SEQ ID NO: 684384 - RNA, 19 nt, Homo sapiens
ggaaacaguggaauuggau

SEQ ID NO: 684385 - RNA, 19 nt, Homo sapiens
aaaugaagacugccuauca

SEQ ID NO: 684386 - RNA, 19 nt, Homo sapiens
ccagcuaauuugugguauu

SEQ ID NO: 684387 - RNA, 19 nt, Homo sapiens
gguagugccucaucacaac

SEQ ID NO: 684388 - RNA, 19 nt, Homo sapiens
gaaaaugcagacuaccuua

SEQ ID NO: 684389 - RNA, 19 nt, Homo sapiens
gcaccaccaucacaaacuc

SEQ ID NO: 684390 - RNA, 19 nt, Homo sapiens
gaagacagucgugguggaa

SEQ ID NO: 684391 - RNA, 19 nt, Homo sapiens
gaaccuguugaguuucuaa

SEQ ID NO: 684392 - RNA, 19 nt, Homo sapiens
ggaguauucuuuggauaag

SEQ ID NO: 684393 - RNA, 19 nt, Homo sapiens
gaacuggcuuuacagauua

SEQ ID NO: 684394 - RNA, 19 nt, Homo sapiens
cgaagaagaucucgaagua

SEQ ID NO: 684395 - RNA, 19 nt, Homo sapiens
gaaaagaggugcugaaauu

SEQ ID NO: 684396 - RNA, 19 nt, Homo sapiens
ugacagagauagcaucaua

SEQ ID NO: 684397 - RNA, 19 nt, Homo sapiens
gaaacaaggguuaugcuua

SEQ ID NO: 684398 - RNA, 19 nt, Homo sapiens
gaagaaaggugagcugaug

SEQ ID NO: 684399 - RNA, 19 nt, Homo sapiens
ggaguuagauccauuagau

SEQ ID NO: 684400 - RNA, 19 nt, Homo sapiens
gaacuggauuuaagaaugu

SEQ ID NO: 684401 - RNA, 19 nt, Homo sapiens
gccaauagcugucaucaug

SEQ ID NO: 684402 - RNA, 19 nt, Homo sapiens
agaauaagcuggaagaaga

SEQ ID NO: 684403 - RNA, 19 nt, Homo sapiens
gaaaucaccaggcucauaa

SEQ ID NO: 684404 - RNA, 19 nt, Homo sapiens
gagaaacuguggagugauu

SEQ ID NO: 684405 - RNA, 19 nt, Homo sapiens
gucaggaucugucauuaua

SEQ ID NO: 684406 - RNA, 19 nt, Homo sapiens
gaagaagaauuagagauca

SEQ ID NO: 684407 - RNA, 19 nt, Homo sapiens
gaacaagcuuuggcuaaug

SEQ ID NO: 684408 - RNA, 19 nt, Homo sapiens
gguaagggauucaaguuug

SEQ ID NO: 684409 - RNA, 19 nt, Homo sapiens
aaacaaggguuaugcuuau

SEQ ID NO: 684410 - RNA, 19 nt, Homo sapiens
caguaaaccuauugaagua

SEQ ID NO: 684411 - RNA, 19 nt, Homo sapiens
gaauagaucuagguccaaa

SEQ ID NO: 684412 - RNA, 19 nt, Homo sapiens
gguggaaaguuaccucuaa

SEQ ID NO: 684413 - RNA, 19 nt, Homo sapiens
gcagauugcugagcugaaa

SEQ ID NO: 684414 - RNA, 19 nt, Homo sapiens
ccaugaagaucuuaaauuc

SEQ ID NO: 684415 - RNA, 19 nt, Homo sapiens
ggaagucggucuagaaguc

SEQ ID NO: 684416 - RNA, 19 nt, Homo sapiens
ggacgaugaugaugacgaa

SEQ ID NO: 684417 - RNA, 19 nt, Homo sapiens
ugcaguaccuccugauuua

SEQ ID NO: 684418 - RNA, 19 nt, Homo sapiens
ggaacaauaugaacuggau

SEQ ID NO: 684419 - RNA, 19 nt, Homo sapiens
gaaacaagaagaagagaga

SEQ ID NO: 684420 - RNA, 19 nt, Homo sapiens
ugaaacaucugauucuugu

SEQ ID NO: 684421 - RNA, 19 nt, Homo sapiens
caagaagcauggcuaugaa

SEQ ID NO: 684422 - RNA, 19 nt, Homo sapiens
gaucuuaaauucccucaag

SEQ ID NO: 684423 - RNA, 19 nt, Homo sapiens
gaaaguuaccucuaaggaa

SEQ ID NO: 684424 - RNA, 19 nt, Homo sapiens
aggaaaugcugagaaauua

SEQ ID NO: 684425 - RNA, 19 nt, Homo sapiens
uaaauucccucaagaagca

SEQ ID NO: 684426 - RNA, 19 nt, Homo sapiens
aaacauaggagaacugaaa

SEQ ID NO: 684427 - RNA, 19 nt, Homo sapiens
ucaauuaugugccguuaga

SEQ ID NO: 684428 - RNA, 19 nt, Homo sapiens
agaacuggcuuuacagauu

SEQ ID NO: 684429 - RNA, 19 nt, Homo sapiens
guaaauguguuucgauugg

SEQ ID NO: 684430 - RNA, 19 nt, Homo sapiens
cacaaucagucaaacuaua

SEQ ID NO: 684431 - RNA, 19 nt, Homo sapiens
gagaaucagugaauacucu

SEQ ID NO: 684432 - RNA, 19 nt, Homo sapiens
ucgaaugauugacauguua

SEQ ID NO: 684433 - RNA, 19 nt, Homo sapiens
gcauuacaguuaaaggaaa

SEQ ID NO: 684434 - RNA, 19 nt, Homo sapiens
gaauuuccaugaagaucuu

SEQ ID NO: 684435 - RNA, 19 nt, Homo sapiens
aagaagaucucgaaguaga

SEQ ID NO: 684436 - RNA, 19 nt, Homo sapiens
gaaguaaacguggagauga

SEQ ID NO: 684437 - RNA, 19 nt, Homo sapiens
aaagaaaucuguccguaag

SEQ ID NO: 684438 - RNA, 19 nt, Homo sapiens
gugcugaaauuauuguuug

SEQ ID NO: 684439 - RNA, 19 nt, Homo sapiens
agaaaucuguccguaagua

SEQ ID NO: 684440 - RNA, 19 nt, Homo sapiens
gcaauuacaaucagaggaa

SEQ ID NO: 684441 - RNA, 19 nt, Homo sapiens
gaaaugcugagaaauuaga

SEQ ID NO: 684442 - RNA, 19 nt, Homo sapiens
gcaaauugaaagcauguuu

SEQ ID NO: 684443 - RNA, 19 nt, Homo sapiens
guaguggguucucugguaa

SEQ ID NO: 684444 - RNA, 19 nt, Homo sapiens
agagauagcaucauaaaug

SEQ ID NO: 684445 - RNA, 19 nt, Homo sapiens
caggaucugucauuauauu

SEQ ID NO: 684446 - RNA, 19 nt, Homo sapiens
ccagagcuauggaggcuuu

SEQ ID NO: 684447 - RNA, 19 nt, Homo sapiens
acaugacucuggaacaaua

SEQ ID NO: 684448 - RNA, 19 nt, Homo sapiens
gagcaggaaacaaggguua

SEQ ID NO: 684449 - RNA, 19 nt, Homo sapiens
ggaaaucgaagagaugaaa

SEQ ID NO: 684450 - RNA, 19 nt, Homo sapiens
gagcugauccggcugcaaa

SEQ ID NO: 684451 - RNA, 19 nt, Homo sapiens
ugaacuggauuuaagaaug

SEQ ID NO: 684452 - RNA, 19 nt, Homo sapiens
ucaaugccaagcucaauua

SEQ ID NO: 684453 - RNA, 19 nt, Homo sapiens
ucaaugcccagaagaauuu

SEQ ID NO: 684454 - RNA, 19 nt, Homo sapiens
cagcucagccuccuuguuu

SEQ ID NO: 684455 - RNA, 19 nt, Homo sapiens
uagagaaacuguggaguga

SEQ ID NO: 684456 - RNA, 19 nt, Homo sapiens
uaaagaaaucuguccguaa

SEQ ID NO: 684457 - RNA, 19 nt, Homo sapiens
gcucaauuaugugccguua

SEQ ID NO: 684458 - RNA, 19 nt, Homo sapiens
aaggugagcugauggagaa

SEQ ID NO: 684459 - RNA, 19 nt, Homo sapiens
caggaaaugcugagaaauu

SEQ ID NO: 684460 - RNA, 19 nt, Homo sapiens
gcagaaagcugaggggaaa

SEQ ID NO: 684461 - RNA, 19 nt, Homo sapiens
ggaacaugcugauggucuu

SEQ ID NO: 684462 - RNA, 19 nt, Homo sapiens
gagucaggaucugucauua

SEQ ID NO: 684463 - RNA, 19 nt, Homo sapiens
aagaggugcugaaauuauu

SEQ ID NO: 684464 - RNA, 19 nt, Homo sapiens
agaguaugauguccuuuaa

SEQ ID NO: 684465 - RNA, 19 nt, Homo sapiens
gaaagcaaaggcagaaauc

SEQ ID NO: 684466 - RNA, 19 nt, Homo sapiens
cuacuucccuccuggcaaa

SEQ ID NO: 684467 - RNA, 19 nt, Homo sapiens
uauaaugucuggacgagau

SEQ ID NO: 684468 - RNA, 19 nt, Homo sapiens
ucaagaagcauggcuauga

SEQ ID NO: 684469 - RNA, 19 nt, Homo sapiens
cgaagaugauccugcagaa

SEQ ID NO: 684470 - RNA, 19 nt, Homo sapiens
acugcuagguggaaaguua

SEQ ID NO: 684471 - RNA, 19 nt, Homo sapiens
aagaagagaguaaaggaua

SEQ ID NO: 684472 - RNA, 19 nt, Homo sapiens
caaagaagagaguaaagga

SEQ ID NO: 684473 - RNA, 19 nt, Homo sapiens
gcaggaacaugcugauggu

SEQ ID NO: 684474 - RNA, 19 nt, Homo sapiens
ggagggcauuacaguuaaa

SEQ ID NO: 684475 - RNA, 19 nt, Homo sapiens
aggagacgcucaaggagua

SEQ ID NO: 684476 - RNA, 19 nt, Homo sapiens
gagcgaagaagaucucgaa

SEQ ID NO: 684477 - RNA, 19 nt, Homo sapiens
ugaacuggcugugcagaaa

SEQ ID NO: 684478 - RNA, 19 nt, Homo sapiens
gaaggcgagcggaagauuu

SEQ ID NO: 684479 - RNA, 19 nt, Homo sapiens
ggaaaguuaccucuaagga

SEQ ID NO: 684480 - RNA, 19 nt, Homo sapiens
gaaucaaugcccagaagaa

SEQ ID NO: 684481 - RNA, 19 nt, Homo sapiens
uuaaagcucuugaauuguc

SEQ ID NO: 684482 - RNA, 19 nt, Homo sapiens
gaaugggaccugcaaacuu

SEQ ID NO: 684483 - RNA, 19 nt, Homo sapiens
guaaaccuauugaaguaca

SEQ ID NO: 684484 - RNA, 19 nt, Homo sapiens
aagaagagguaaauguguu

SEQ ID NO: 684485 - RNA, 19 nt, Homo sapiens
uaaaguacacaagucguua

SEQ ID NO: 684486 - RNA, 19 nt, Homo sapiens
cagaguaugauguccuuua

SEQ ID NO: 684487 - RNA, 19 nt, Homo sapiens
gcuggucuaugauguaugu

SEQ ID NO: 684488 - RNA, 19 nt, Homo sapiens
uaccugugcuggucuauga

SEQ ID NO: 684489 - RNA, 19 nt, Homo sapiens
agaaauugcuaagagauug

SEQ ID NO: 684490 - RNA, 19 nt, Homo sapiens
agaaguagagauagagaua

SEQ ID NO: 684491 - RNA, 19 nt, Homo sapiens
cuaaagaguguaagaaguu

SEQ ID NO: 684492 - RNA, 19 nt, Homo sapiens
aguaugauguccuuuaaug

SEQ ID NO: 684493 - RNA, 19 nt, Homo sapiens
gcacagagcuuucuauuua

SEQ ID NO: 684494 - RNA, 19 nt, Homo sapiens
guacugaccuccuaauauu

SEQ ID NO: 684495 - RNA, 19 nt, Homo sapiens
caacagcccuaucacauuu

SEQ ID NO: 684496 - RNA, 19 nt, Homo sapiens
gcuaaagucucuuaugaaa

SEQ ID NO: 684497 - RNA, 19 nt, Homo sapiens
ugacaugaaugaccuauuu

SEQ ID NO: 684498 - RNA, 19 nt, Homo sapiens
ucacagaccugaucaaugu

SEQ ID NO: 684499 - RNA, 19 nt, Homo sapiens
gaagaaaggaggugggaua

SEQ ID NO: 684500 - RNA, 19 nt, Homo sapiens
ggaauucuguucuguguug

SEQ ID NO: 684501 - RNA, 19 nt, Homo sapiens
ucaagugucugcuacauuu

SEQ ID NO: 684502 - RNA, 19 nt, Homo sapiens
ggaaauguguaacagacua

SEQ ID NO: 684503 - RNA, 19 nt, Homo sapiens
gaacaagugacaugaauga

SEQ ID NO: 684504 - RNA, 19 nt, Homo sapiens
cagauugucucuagcauaa

SEQ ID NO: 684505 - RNA, 19 nt, Homo sapiens
gauugucucuagcauaaua

SEQ ID NO: 684506 - RNA, 19 nt, Homo sapiens
gaacagccuugaccagaga

SEQ ID NO: 684507 - RNA, 19 nt, Homo sapiens
ucagaaagcuuugggauga

SEQ ID NO: 684508 - RNA, 19 nt, Homo sapiens
cauaggagcugcuaagaug

SEQ ID NO: 684509 - RNA, 19 nt, Homo sapiens
gagcagaccuucauguaca

SEQ ID NO: 684510 - RNA, 19 nt, Homo sapiens
gaugaugacuugcaguuug

SEQ ID NO: 684511 - RNA, 19 nt, Homo sapiens
cagaaccucuuccugaaua

SEQ ID NO: 684512 - RNA, 19 nt, Homo sapiens
gaccgaaacucccggguaa

SEQ ID NO: 684513 - RNA, 19 nt, Homo sapiens
cugguuagcuccacucuua

SEQ ID NO: 684514 - RNA, 19 nt, Homo sapiens
ccaggaugcugauaucuaa

SEQ ID NO: 684515 - RNA, 19 nt, Homo sapiens
ugaaggaacucaacaagug

SEQ ID NO: 684516 - RNA, 19 nt, Homo sapiens
uagcuaaagucucuuauga

SEQ ID NO: 684517 - RNA, 19 nt, Homo sapiens
gagaagccauaccaaugua

SEQ ID NO: 684518 - RNA, 19 nt, Homo sapiens
gaaaggaggugggauaagg

SEQ ID NO: 684519 - RNA, 19 nt, Homo sapiens
ccaaagaggcggauaagaa

SEQ ID NO: 684520 - RNA, 19 nt, Homo sapiens
caaagcaaauucuagauag

SEQ ID NO: 684521 - RNA, 19 nt, Homo sapiens
gcacauaagcuguuacugu

SEQ ID NO: 684522 - RNA, 19 nt, Homo sapiens
ggauguuggugucugcuua

SEQ ID NO: 684523 - RNA, 19 nt, Homo sapiens
ggaaaguauuggccaaaga

SEQ ID NO: 684524 - RNA, 19 nt, Homo sapiens
gaagaguuguugacgucua

SEQ ID NO: 684525 - RNA, 19 nt, Homo sapiens
cggauuaacugugcugaua

SEQ ID NO: 684526 - RNA, 19 nt, Homo sapiens
guacuuaaccugaaacugu

SEQ ID NO: 684527 - RNA, 19 nt, Homo sapiens
cacauaagcuguuacuguu

SEQ ID NO: 684528 - RNA, 19 nt, Homo sapiens
ccaacaaccugcugaagga

SEQ ID NO: 684529 - RNA, 19 nt, Homo sapiens
gaauagcuaaagucucuua

SEQ ID NO: 684530 - RNA, 19 nt, Homo sapiens
acacugaccauuagaauuu

SEQ ID NO: 684531 - RNA, 19 nt, Homo sapiens
ccuccugucuuuauuuaua

SEQ ID NO: 684532 - RNA, 19 nt, Homo sapiens
cagcaucucuuuuguauaa

SEQ ID NO: 684533 - RNA, 19 nt, Homo sapiens
agaagaauguugccaguga

SEQ ID NO: 684534 - RNA, 19 nt, Homo sapiens
cuagauagacacuguauuu

SEQ ID NO: 684535 - RNA, 19 nt, Homo sapiens
gaagaagaaauagcacaua

SEQ ID NO: 684536 - RNA, 19 nt, Homo sapiens
ggccaaagauuuccaugug

SEQ ID NO: 684537 - RNA, 19 nt, Homo sapiens
gcacagcauuaguuucaau

SEQ ID NO: 684538 - RNA, 19 nt, Homo sapiens
ccaaagcaaauucuagaua

SEQ ID NO: 684539 - RNA, 19 nt, Homo sapiens
cguaguccauggcuaguua

SEQ ID NO: 684540 - RNA, 19 nt, Homo sapiens
gcacccagcucuccagaag

SEQ ID NO: 684541 - RNA, 19 nt, Homo sapiens
caacugaggaggugauuga

SEQ ID NO: 684542 - RNA, 19 nt, Homo sapiens
gacacuguauuuauuggua

SEQ ID NO: 684543 - RNA, 19 nt, Homo sapiens
gcccaagacugcuuaacuu

SEQ ID NO: 684544 - RNA, 19 nt, Homo sapiens
gcugagagcagauaaaugu

SEQ ID NO: 684545 - RNA, 19 nt, Homo sapiens
caaccaacagccucacuua

SEQ ID NO: 684546 - RNA, 19 nt, Homo sapiens
ggaccuaugugguggacuu

SEQ ID NO: 684547 - RNA, 19 nt, Homo sapiens
gaagcucugcugaaccuua

SEQ ID NO: 684548 - RNA, 19 nt, Homo sapiens
ugagagaggugguaauuac

SEQ ID NO: 684549 - RNA, 19 nt, Homo sapiens
ggaaagcaguguugagacu

SEQ ID NO: 684550 - RNA, 19 nt, Homo sapiens
ugauaaagccucagaguug

SEQ ID NO: 684551 - RNA, 19 nt, Homo sapiens
gggaacaagugacaugaau

SEQ ID NO: 684552 - RNA, 19 nt, Homo sapiens
gcaauggagacuucaguaa

SEQ ID NO: 684553 - RNA, 19 nt, Homo sapiens
ucaaagcaauggagacuuc

SEQ ID NO: 684554 - RNA, 19 nt, Homo sapiens
ugaccuauuugcacaguuu

SEQ ID NO: 684555 - RNA, 19 nt, Homo sapiens
gcaacagcccuaucacauu

SEQ ID NO: 684556 - RNA, 19 nt, Homo sapiens
gaagccuccugucuuuauu

SEQ ID NO: 684557 - RNA, 19 nt, Homo sapiens
ggacuggcaucuucuagag

SEQ ID NO: 684558 - RNA, 19 nt, Homo sapiens
ccacauccuugaccaucua

SEQ ID NO: 684559 - RNA, 19 nt, Homo sapiens
ugauugagcugagugauga

SEQ ID NO: 684560 - RNA, 19 nt, Homo sapiens
cgagguagcugagcguuug

SEQ ID NO: 684561 - RNA, 19 nt, Homo sapiens
acucugaaguucuguuuaa

SEQ ID NO: 684562 - RNA, 19 nt, Homo sapiens
cgcgagcccuucaggauua

SEQ ID NO: 684563 - RNA, 19 nt, Homo sapiens
cagcagccuugccuuaauu

SEQ ID NO: 684564 - RNA, 19 nt, Homo sapiens
gauaagaacccggacaguu

SEQ ID NO: 684565 - RNA, 19 nt, Homo sapiens
ggagaagccauaccaaugu

SEQ ID NO: 684566 - RNA, 19 nt, Homo sapiens
gaaacucgauuuugauguu

SEQ ID NO: 684567 - RNA, 19 nt, Homo sapiens
cauagagcauuaaaccaaa

SEQ ID NO: 684568 - RNA, 19 nt, Homo sapiens
acuacucucuucuguguua

SEQ ID NO: 684569 - RNA, 19 nt, Homo sapiens
gcagcagccuugccuuaau

SEQ ID NO: 684570 - RNA, 19 nt, Homo sapiens
gaggauagggaaccacuuu

SEQ ID NO: 684571 - RNA, 19 nt, Homo sapiens
ccgacgggauggaauauuu

SEQ ID NO: 684572 - RNA, 19 nt, Homo sapiens
gggaccaacuccugucuga

SEQ ID NO: 684573 - RNA, 19 nt, Homo sapiens
ggaagccuccugucuuuau

SEQ ID NO: 684574 - RNA, 19 nt, Homo sapiens
ccaacagccucacuuaaca

SEQ ID NO: 684575 - RNA, 19 nt, Homo sapiens
gaaaguauuggccaaagau

SEQ ID NO: 684576 - RNA, 19 nt, Homo sapiens
cugcugaaccuuaguauuu

SEQ ID NO: 684577 - RNA, 19 nt, Homo sapiens
gcuccacucuuacuugguu

SEQ ID NO: 684578 - RNA, 19 nt, Homo sapiens
caucauaagcuuaacauca

SEQ ID NO: 684579 - RNA, 19 nt, Homo sapiens
gguagaagguauucauuuu

SEQ ID NO: 684580 - RNA, 19 nt, Homo sapiens
gaaaugcuggugugagaga

SEQ ID NO: 684581 - RNA, 19 nt, Homo sapiens
uuacuacucucuucugugu

SEQ ID NO: 684582 - RNA, 19 nt, Homo sapiens
gaaggaaauguguaacaga

SEQ ID NO: 684583 - RNA, 19 nt, Homo sapiens
caauggagacuucaguaaa

SEQ ID NO: 684584 - RNA, 19 nt, Homo sapiens
ucaaugugguuaugcauca

SEQ ID NO: 684585 - RNA, 19 nt, Homo sapiens
guccauggcuaguuaggaa

SEQ ID NO: 684586 - RNA, 19 nt, Homo sapiens
uaacagagggcaucaugga

SEQ ID NO: 684587 - RNA, 19 nt, Homo sapiens
uaacagugccggagcuuug

SEQ ID NO: 684588 - RNA, 19 nt, Homo sapiens
agccuugccuuaauuuaua

SEQ ID NO: 684589 - RNA, 19 nt, Homo sapiens
guuggugucugcuuaucua

SEQ ID NO: 684590 - RNA, 19 nt, Homo sapiens
gaagaaauagcacauaagc

SEQ ID NO: 684591 - RNA, 19 nt, Homo sapiens
gggagaagccauaccaaug

SEQ ID NO: 684592 - RNA, 19 nt, Homo sapiens
aauaaguacugaccuccua

SEQ ID NO: 684593 - RNA, 19 nt, Homo sapiens
ggacauaugugaaaucuuu

SEQ ID NO: 684594 - RNA, 19 nt, Homo sapiens
ggacuuagccaguauauuu

SEQ ID NO: 684595 - RNA, 19 nt, Homo sapiens
ggaggaggaugcccauuua

SEQ ID NO: 684596 - RNA, 19 nt, Homo sapiens
acaaauagcucauuagaug

SEQ ID NO: 684597 - RNA, 19 nt, Homo sapiens
guacagaccugacaugaug

SEQ ID NO: 684598 - RNA, 19 nt, Homo sapiens
agacacagauugccuaaua

SEQ ID NO: 684599 - RNA, 19 nt, Homo sapiens
gacaagcuguguugaaaua

SEQ ID NO: 684600 - RNA, 19 nt, Homo sapiens
ggaaauaagccauaauuga

SEQ ID NO: 684601 - RNA, 19 nt, Homo sapiens
uagauuagcuuucugcuuu

SEQ ID NO: 684602 - RNA, 19 nt, Homo sapiens
gaacagugcagcaaucuuu

SEQ ID NO: 684603 - RNA, 19 nt, Homo sapiens
ggacauauguagacugguu

SEQ ID NO: 684604 - RNA, 19 nt, Homo sapiens
gcgaaucucugguugauga

SEQ ID NO: 684605 - RNA, 19 nt, Homo sapiens
gaaagugguaccaguguua

SEQ ID NO: 684606 - RNA, 19 nt, Homo sapiens
gaauaccucugaaauggaa

SEQ ID NO: 684607 - RNA, 19 nt, Homo sapiens
ugagcaagcugacaucuuu

SEQ ID NO: 684608 - RNA, 19 nt, Homo sapiens
gaaagugcuccuuagaaua

SEQ ID NO: 684609 - RNA, 19 nt, Homo sapiens
gcacaugagugaagagcaa

SEQ ID NO: 684610 - RNA, 19 nt, Homo sapiens
ugagaacugugaaauguuu

SEQ ID NO: 684611 - RNA, 19 nt, Homo sapiens
ugugagugcuuguaauuua

SEQ ID NO: 684612 - RNA, 19 nt, Homo sapiens
acagguagcucauacuaaa

SEQ ID NO: 684613 - RNA, 19 nt, Homo sapiens
gauaggaaauaagccauaa

SEQ ID NO: 684614 - RNA, 19 nt, Homo sapiens
ucucaucacugacagauaa

SEQ ID NO: 684615 - RNA, 19 nt, Homo sapiens
cagagaugauucuaugaua

SEQ ID NO: 684616 - RNA, 19 nt, Homo sapiens
gagccaagcuggugauaca

SEQ ID NO: 684617 - RNA, 19 nt, Homo sapiens
gagaggaccuggcugacuu

SEQ ID NO: 684618 - RNA, 19 nt, Homo sapiens
gaaauuucccuuggacaua

SEQ ID NO: 684619 - RNA, 19 nt, Homo sapiens
gauagugccucugaaaguu

SEQ ID NO: 684620 - RNA, 19 nt, Homo sapiens
gacaaggauuugccacuuu

SEQ ID NO: 684621 - RNA, 19 nt, Homo sapiens
uaaaggagaauguugcuaa

SEQ ID NO: 684622 - RNA, 19 nt, Homo sapiens
ccuaugagguggaauauca

SEQ ID NO: 684623 - RNA, 19 nt, Homo sapiens
gacagaaucuaauaagcuu

SEQ ID NO: 684624 - RNA, 19 nt, Homo sapiens
gcagcaaucuuucgucagu

SEQ ID NO: 684625 - RNA, 19 nt, Homo sapiens
agagaaagcugaauuugca

SEQ ID NO: 684626 - RNA, 19 nt, Homo sapiens
caaagagaaagcugaauuu

SEQ ID NO: 684627 - RNA, 19 nt, Homo sapiens
cagcauaucucgcgcuuca

SEQ ID NO: 684628 - RNA, 19 nt, Homo sapiens
aggagaauguugcuaauuu

SEQ ID NO: 684629 - RNA, 19 nt, Homo sapiens
caacaaagccaagauagga

SEQ ID NO: 684630 - RNA, 19 nt, Homo sapiens
uaacaacaaagccaagaua

SEQ ID NO: 684631 - RNA, 19 nt, Homo sapiens
gaaaucagccccagucuuu

SEQ ID NO: 684632 - RNA, 19 nt, Homo sapiens
gaaggucucuacccaccaa

SEQ ID NO: 684633 - RNA, 19 nt, Homo sapiens
gaacagcagcgccugaaga

SEQ ID NO: 684634 - RNA, 19 nt, Homo sapiens
ggaaagguaaacugaaauu

SEQ ID NO: 684635 - RNA, 19 nt, Homo sapiens
gguggaauaucaugugcua

SEQ ID NO: 684636 - RNA, 19 nt, Homo sapiens
gaagagcaagccuuugaaa

SEQ ID NO: 684637 - RNA, 19 nt, Homo sapiens
uuaacuagcucccuggaaa

SEQ ID NO: 684638 - RNA, 19 nt, Homo sapiens
ggaagauucuggcuuugau

SEQ ID NO: 684639 - RNA, 19 nt, Homo sapiens
caaaggaaagguaaacuga

SEQ ID NO: 684640 - RNA, 19 nt, Homo sapiens
agaaagugcuccuuagaau

SEQ ID NO: 684641 - RNA, 19 nt, Homo sapiens
acaacagccuccugacaua

SEQ ID NO: 684642 - RNA, 19 nt, Homo sapiens
gaggagaaauuuggcaguu

SEQ ID NO: 684643 - RNA, 19 nt, Homo sapiens
agucagaacuucaugaaau

SEQ ID NO: 684644 - RNA, 19 nt, Homo sapiens
aaacauggaccuccuagaa

SEQ ID NO: 684645 - RNA, 19 nt, Homo sapiens
gggauaagaaguuguuaaa

SEQ ID NO: 684646 - RNA, 19 nt, Homo sapiens
ugaagaaguuggugcaugu

SEQ ID NO: 684647 - RNA, 19 nt, Homo sapiens
gagaaaagcuauacaccaa

SEQ ID NO: 684648 - RNA, 19 nt, Homo sapiens
gcaaugagucccuaagugu

SEQ ID NO: 684649 - RNA, 19 nt, Homo sapiens
guggaucacuuuggcuuua

SEQ ID NO: 684650 - RNA, 19 nt, Homo sapiens
uaaaucaguugugcuagaa

SEQ ID NO: 684651 - RNA, 19 nt, Homo sapiens
gguuaggcauuacuuuaaa

SEQ ID NO: 684652 - RNA, 19 nt, Homo sapiens
aaggaaagguaaacugaaa

SEQ ID NO: 684653 - RNA, 19 nt, Homo sapiens
caagagacacuuauaaugg

SEQ ID NO: 684654 - RNA, 19 nt, Homo sapiens
gacacagauugccuaauaa

SEQ ID NO: 684655 - RNA, 19 nt, Homo sapiens
acaagacacugcuucagaa

SEQ ID NO: 684656 - RNA, 19 nt, Homo sapiens
gcacaaagagaaagcugaa

SEQ ID NO: 684657 - RNA, 19 nt, Homo sapiens
ccaacagucuugcuucaga

SEQ ID NO: 684658 - RNA, 19 nt, Homo sapiens
ggaaacguaauuaugauug

SEQ ID NO: 684659 - RNA, 19 nt, Homo sapiens
cagagcaucuuuguauauu

SEQ ID NO: 684660 - RNA, 19 nt, Homo sapiens
ugagagaccuaaacugcaa

SEQ ID NO: 684661 - RNA, 19 nt, Homo sapiens
agacacugcuucagaauca

SEQ ID NO: 684662 - RNA, 19 nt, Homo sapiens
guauaaagcauguggauca

SEQ ID NO: 684663 - RNA, 19 nt, Homo sapiens
gcaaacuagaccagcauua

SEQ ID NO: 684664 - RNA, 19 nt, Homo sapiens
gccagagcaucuuuguaua

SEQ ID NO: 684665 - RNA, 19 nt, Homo sapiens
gaaauccacaccaaaggaa

SEQ ID NO: 684666 - RNA, 19 nt, Homo sapiens
guucaugcuuucagauaaa

SEQ ID NO: 684667 - RNA, 19 nt, Homo sapiens
gagcaagccuuugaaaugc

SEQ ID NO: 684668 - RNA, 19 nt, Homo sapiens
cagauugccuaauaaacaa

SEQ ID NO: 684669 - RNA, 19 nt, Homo sapiens
uaaagcauguggaucacuu

SEQ ID NO: 684670 - RNA, 19 nt, Homo sapiens
guugggcgauuugagauua

SEQ ID NO: 684671 - RNA, 19 nt, Homo sapiens
gaauccauacaguuucuua

SEQ ID NO: 684672 - RNA, 19 nt, Homo sapiens
uaaagaaggaguucccaaa

SEQ ID NO: 684673 - RNA, 19 nt, Homo sapiens
cugaggagcuuguggagaa

SEQ ID NO: 684674 - RNA, 19 nt, Homo sapiens
cauaagcucugugaaagga

SEQ ID NO: 684675 - RNA, 19 nt, Homo sapiens
ucagaaagcuuugaugaac

SEQ ID NO: 684676 - RNA, 19 nt, Homo sapiens
gaauuccucuuuauuuggu

SEQ ID NO: 684677 - RNA, 19 nt, Homo sapiens
gcagaaagugcuccuuaga

SEQ ID NO: 684678 - RNA, 19 nt, Homo sapiens
aaagggaguuuguuauaca

SEQ ID NO: 684679 - RNA, 19 nt, Homo sapiens
gccuacaaauagcucauua

SEQ ID NO: 684680 - RNA, 19 nt, Homo sapiens
cuugauaucuacugacauu

SEQ ID NO: 684681 - RNA, 19 nt, Homo sapiens
cuaaaucaguugugcuaga

SEQ ID NO: 684682 - RNA, 19 nt, Homo sapiens
gaaaagguggaaacauuua

SEQ ID NO: 684683 - RNA, 19 nt, Homo sapiens
caaaucuuguuacuucgaa

SEQ ID NO: 684684 - RNA, 19 nt, Homo sapiens
gcauguacaaggagaguaa

SEQ ID NO: 684685 - RNA, 19 nt, Homo sapiens
aggcaucucucaucacuga

SEQ ID NO: 684686 - RNA, 19 nt, Homo sapiens
gagguaaugcugacucuga

SEQ ID NO: 684687 - RNA, 19 nt, Homo sapiens
gaacaggaccaugcucuuc

SEQ ID NO: 684688 - RNA, 19 nt, Homo sapiens
gaaguccuguacuguggaa

SEQ ID NO: 684689 - RNA, 19 nt, Homo sapiens
gugaaaagguggaaacauu

SEQ ID NO: 684690 - RNA, 19 nt, Homo sapiens
aaacaaagccagagcaucu

SEQ ID NO: 684691 - RNA, 19 nt, Homo sapiens
ccaagagacacuuauaaug

SEQ ID NO: 684692 - RNA, 19 nt, Homo sapiens
ccuuugaaaugcugaaauu

SEQ ID NO: 684693 - RNA, 19 nt, Homo sapiens
ggaauuagcuguauaguua

SEQ ID NO: 684694 - RNA, 19 nt, Homo sapiens
ggaagaagaccaaauauuc

SEQ ID NO: 684695 - RNA, 19 nt, Homo sapiens
ggaggaagaagaccaaaua

SEQ ID NO: 684696 - RNA, 19 nt, Homo sapiens
uuagagagcuugaagaaga

SEQ ID NO: 684697 - RNA, 19 nt, Homo sapiens
gaugaccacuugaauaaga

SEQ ID NO: 684698 - RNA, 19 nt, Homo sapiens
gaccaaauauuccuugaug

SEQ ID NO: 684699 - RNA, 19 nt, Homo sapiens
ggacuuuccauuacaaaua

SEQ ID NO: 684700 - RNA, 19 nt, Homo sapiens
gaggaagaguugaguugua

SEQ ID NO: 684701 - RNA, 19 nt, Homo sapiens
gagcucagaugaccacuug

SEQ ID NO: 684702 - RNA, 19 nt, Homo sapiens
ucauugaggugguuaagua

SEQ ID NO: 684703 - RNA, 19 nt, Homo sapiens
gagugaaccucaagccuaa

SEQ ID NO: 684704 - RNA, 19 nt, Homo sapiens
uaaaugcccuugaaucuag

SEQ ID NO: 684705 - RNA, 19 nt, Homo sapiens
gaaugcgugugucuaaauu

SEQ ID NO: 684706 - RNA, 19 nt, Homo sapiens
gcucugauccucguuaaua

SEQ ID NO: 684707 - RNA, 19 nt, Homo sapiens
gaggagcugugucaucauu

SEQ ID NO: 684708 - RNA, 19 nt, Homo sapiens
gaagagaggccucaauucu

SEQ ID NO: 684709 - RNA, 19 nt, Homo sapiens
aaacugugaucuaucguaa

SEQ ID NO: 684710 - RNA, 19 nt, Homo sapiens
caaagaagaggcucaaaug

SEQ ID NO: 684711 - RNA, 19 nt, Homo sapiens
cagaugaccacuugaauaa

SEQ ID NO: 684712 - RNA, 19 nt, Homo sapiens
gcccauccauccuaucuuu

SEQ ID NO: 684713 - RNA, 19 nt, Homo sapiens
ggagaggagcuguggauaa

SEQ ID NO: 684714 - RNA, 19 nt, Homo sapiens
gauaacgggaggugaauuu

SEQ ID NO: 684715 - RNA, 19 nt, Homo sapiens
ucaaagagaaggagaagaa

SEQ ID NO: 684716 - RNA, 19 nt, Homo sapiens
gcaaagaagaggcucaaau

SEQ ID NO: 684717 - RNA, 19 nt, Homo sapiens
gaagaguugaguuguauga

SEQ ID NO: 684718 - RNA, 19 nt, Homo sapiens
gcacaccguuugccuucaa

SEQ ID NO: 684719 - RNA, 19 nt, Homo sapiens
ccacuuaacugaccucacu

SEQ ID NO: 684720 - RNA, 19 nt, Homo sapiens
ggagaggccagcaaagaaa

SEQ ID NO: 684721 - RNA, 19 nt, Homo sapiens
caaacgucaucauuaaguu

SEQ ID NO: 684722 - RNA, 19 nt, Homo sapiens
gagaagaggagcuguguca

SEQ ID NO: 684723 - RNA, 19 nt, Homo sapiens
caacauaguccagggauug

SEQ ID NO: 684724 - RNA, 19 nt, Homo sapiens
gaggugaauuuccauguca

SEQ ID NO: 684725 - RNA, 19 nt, Homo sapiens
gagaggagcuguggauaac

SEQ ID NO: 684726 - RNA, 19 nt, Homo sapiens
gcccaaguccuucuucuuu

SEQ ID NO: 684727 - RNA, 19 nt, Homo sapiens
gcuauuaacuaggaauuag

SEQ ID NO: 684728 - RNA, 19 nt, Homo sapiens
gcguuuggcuuuggcauaa

SEQ ID NO: 684729 - RNA, 19 nt, Homo sapiens
cagcuuggcuauucgauca

SEQ ID NO: 684730 - RNA, 19 nt, Homo sapiens
gacaggcgcuuacgcaagu

SEQ ID NO: 684731 - RNA, 19 nt, Homo sapiens
auaaucagcucaacacugu

SEQ ID NO: 684732 - RNA, 19 nt, Homo sapiens
ucagaugaccacuugaaua

SEQ ID NO: 684733 - RNA, 19 nt, Homo sapiens
caguggacauucagcauuu

SEQ ID NO: 684734 - RNA, 19 nt, Homo sapiens
gaagggagaagcucuugga

SEQ ID NO: 684735 - RNA, 19 nt, Homo sapiens
cagcacaacugagagcaaa

SEQ ID NO: 684736 - RNA, 19 nt, Homo sapiens
gaccuagacuuagagaaga

SEQ ID NO: 684737 - RNA, 19 nt, Homo sapiens
agccaaacgucaucauuaa

SEQ ID NO: 684738 - RNA, 19 nt, Homo sapiens
uaacuaggaauuagcugua

SEQ ID NO: 684739 - RNA, 19 nt, Homo sapiens
ggaccuagacuuagagaag

SEQ ID NO: 684740 - RNA, 19 nt, Homo sapiens
gggaugugauguuggagaa

SEQ ID NO: 684741 - RNA, 19 nt, Homo sapiens
ggacccugaugagaagaua

SEQ ID NO: 684742 - RNA, 19 nt, Homo sapiens
gggccucgcuaauugaaug

SEQ ID NO: 684743 - RNA, 19 nt, Homo sapiens
gcaccaacccacuguuaga

SEQ ID NO: 684744 - RNA, 19 nt, Homo sapiens
gaagaggagcugugucauc

SEQ ID NO: 684745 - RNA, 19 nt, Homo sapiens
ucuccaggauuguauguuu

SEQ ID NO: 684746 - RNA, 19 nt, Homo sapiens
ggaggugaauuuccauguc

SEQ ID NO: 684747 - RNA, 19 nt, Homo sapiens
uaguuucccuggcuuauga

SEQ ID NO: 684748 - RNA, 19 nt, Homo sapiens
ggucaccgcuugcucuagu

SEQ ID NO: 684749 - RNA, 19 nt, Homo sapiens
aagaggagcugugucauca

SEQ ID NO: 684750 - RNA, 19 nt, Homo sapiens
cagccuucauuuaccuuua

SEQ ID NO: 684751 - RNA, 19 nt, Homo sapiens
ggaaugguuaucacaagaa

SEQ ID NO: 684752 - RNA, 19 nt, Homo sapiens
aagccaaacgucaucauua

SEQ ID NO: 684753 - RNA, 19 nt, Homo sapiens
uugaggugguuaaguauaa

SEQ ID NO: 684754 - RNA, 19 nt, Homo sapiens
ccgaggaccuagacuuaga

SEQ ID NO: 684755 - RNA, 19 nt, Homo sapiens
gcaguggacauucagcauu

SEQ ID NO: 684756 - RNA, 19 nt, Homo sapiens
ggacaguggaggaagaaga

SEQ ID NO: 684757 - RNA, 19 nt, Homo sapiens
gacuuuccauuacaaauag

SEQ ID NO: 684758 - RNA, 19 nt, Homo sapiens
gagcuaguuuaccucaguu

SEQ ID NO: 684759 - RNA, 19 nt, Homo sapiens
gcuucuaccuguaccuuau

SEQ ID NO: 684760 - RNA, 19 nt, Homo sapiens
gcagcagccucuccuuugg

SEQ ID NO: 684761 - RNA, 19 nt, Homo sapiens
gcaaaggagacaguacuga

SEQ ID NO: 684762 - RNA, 19 nt, Homo sapiens
gaaugguuaucacaagaag

SEQ ID NO: 684763 - RNA, 19 nt, Homo sapiens
ggagaacuacagccaucua

SEQ ID NO: 684764 - RNA, 19 nt, Homo sapiens
gcuugugacauuaagaaua

SEQ ID NO: 684765 - RNA, 19 nt, Homo sapiens
ggccagagcacaccguuug

SEQ ID NO: 684766 - RNA, 19 nt, Homo sapiens
gaaggacacccgccuggau

SEQ ID NO: 684767 - RNA, 19 nt, Homo sapiens
cugaugagaagauaacaua

SEQ ID NO: 684768 - RNA, 19 nt, Homo sapiens
aauaagagaucccgaagcu

SEQ ID NO: 684769 - RNA, 19 nt, Homo sapiens
aaaggacaguggaggaaga

SEQ ID NO: 684770 - RNA, 19 nt, Homo sapiens
gagacuucauuccuguuga

SEQ ID NO: 684771 - RNA, 19 nt, Homo sapiens
gcccuugaaucuagcuuug

SEQ ID NO: 684772 - RNA, 19 nt, Homo sapiens
gaccucuacuugaacaguu

SEQ ID NO: 684773 - RNA, 19 nt, Homo sapiens
gcucagaugaccacuugaa

SEQ ID NO: 684774 - RNA, 19 nt, Homo sapiens
acaaauagagacuucauuc

SEQ ID NO: 684775 - RNA, 19 nt, Homo sapiens
aaucaagcuucuaccugua

SEQ ID NO: 684776 - RNA, 19 nt, Homo sapiens
ucacucagccuucauuuac

SEQ ID NO: 684777 - RNA, 19 nt, Homo sapiens
uguaauaacaccuagaaga

SEQ ID NO: 684778 - RNA, 19 nt, Homo sapiens
gaaccucaagccuaaauac

SEQ ID NO: 684779 - RNA, 19 nt, Homo sapiens
gcuguauaguuaaguuaug

SEQ ID NO: 684780 - RNA, 19 nt, Homo sapiens
ccaacccucugccaguuug

SEQ ID NO: 684781 - RNA, 19 nt, Homo sapiens
aaagaaggcgccaugauag

SEQ ID NO: 684782 - RNA, 19 nt, Homo sapiens
aaaagaaggcgccaugaua

SEQ ID NO: 684783 - RNA, 19 nt, Homo sapiens
gaagaagaccaaauauucc

SEQ ID NO: 684784 - RNA, 19 nt, Homo sapiens
cagcucugauccucguuaa

SEQ ID NO: 684785 - RNA, 19 nt, Homo sapiens
uaugaaugcgugugucuaa

SEQ ID NO: 684786 - RNA, 19 nt, Homo sapiens
gaaguaugaaugcgugugu

SEQ ID NO: 684787 - RNA, 19 nt, Homo sapiens
ccaaaguagauguuagaaa

SEQ ID NO: 684788 - RNA, 19 nt, Homo sapiens
gaggcuacaucacccaaag

SEQ ID NO: 684789 - RNA, 19 nt, Homo sapiens
ugccaagccugaaucaaug

SEQ ID NO: 684790 - RNA, 19 nt, Homo sapiens
cagaacaccucaccuucca

SEQ ID NO: 684791 - RNA, 19 nt, Homo sapiens
caacuggacccugaugaga

SEQ ID NO: 684792 - RNA, 19 nt, Homo sapiens
guaauaacaccuagaagac

SEQ ID NO: 684793 - RNA, 19 nt, Homo sapiens
agaagaagcuggaccuuua

SEQ ID NO: 684794 - RNA, 19 nt, Homo sapiens
gaacccagaucuauuuauu

SEQ ID NO: 684795 - RNA, 19 nt, Homo sapiens
gaacacaggugacccuaga

SEQ ID NO: 684796 - RNA, 19 nt, Homo sapiens
gaacuagcacuucugaaua

SEQ ID NO: 684797 - RNA, 19 nt, Homo sapiens
gaagaguguucucggauuu

SEQ ID NO: 684798 - RNA, 19 nt, Homo sapiens
ccaucaaacucaucauuua

SEQ ID NO: 684799 - RNA, 19 nt, Homo sapiens
caaggagacuucaagcuuu

SEQ ID NO: 684800 - RNA, 19 nt, Homo sapiens
guaaguauacgcuaugaua

SEQ ID NO: 684801 - RNA, 19 nt, Homo sapiens
gauuuaacaugcugacuuu

SEQ ID NO: 684802 - RNA, 19 nt, Homo sapiens
gaacugaacuagcacuucu

SEQ ID NO: 684803 - RNA, 19 nt, Homo sapiens
gaagaggacuauaguuucu

SEQ ID NO: 684804 - RNA, 19 nt, Homo sapiens
caacucagccuccuaagaa

SEQ ID NO: 684805 - RNA, 19 nt, Homo sapiens
ugacagagguugaacuuuc

SEQ ID NO: 684806 - RNA, 19 nt, Homo sapiens
ccaaauccuuccucacuaa

SEQ ID NO: 684807 - RNA, 19 nt, Homo sapiens
ggaagaguguucucggauu

SEQ ID NO: 684808 - RNA, 19 nt, Homo sapiens
gaagucagcuggguucuag

SEQ ID NO: 684809 - RNA, 19 nt, Homo sapiens
ucaauuuccucaccuuuaa

SEQ ID NO: 684810 - RNA, 19 nt, Homo sapiens
gagauguugucauguauug

SEQ ID NO: 684811 - RNA, 19 nt, Homo sapiens
caacauaugugagcucugu

SEQ ID NO: 684812 - RNA, 19 nt, Homo sapiens
gaaacagacuuugcagaau

SEQ ID NO: 684813 - RNA, 19 nt, Homo sapiens
gcaguucuguggcauaaau

SEQ ID NO: 684814 - RNA, 19 nt, Homo sapiens
gagcaguucuguggcauaa

SEQ ID NO: 684815 - RNA, 19 nt, Homo sapiens
ggacuauaguuucuccaaa

SEQ ID NO: 684816 - RNA, 19 nt, Homo sapiens
gaauauuccaguacagaua

SEQ ID NO: 684817 - RNA, 19 nt, Homo sapiens
aaacagacuuugcagaaug

SEQ ID NO: 684818 - RNA, 19 nt, Homo sapiens
uaacauacaguacagguuu

SEQ ID NO: 684819 - RNA, 19 nt, Homo sapiens
gaagugcaguguugugauc

SEQ ID NO: 684820 - RNA, 19 nt, Homo sapiens
gaagucagcacucauuuca

SEQ ID NO: 684821 - RNA, 19 nt, Homo sapiens
gcaacacuuuggaauaaau

SEQ ID NO: 684822 - RNA, 19 nt, Homo sapiens
guucucggauuucaccuua

SEQ ID NO: 684823 - RNA, 19 nt, Homo sapiens
uggcaacacuuuggaauaa

SEQ ID NO: 684824 - RNA, 19 nt, Homo sapiens
caacugacuuucugcuuuc

SEQ ID NO: 684825 - RNA, 19 nt, Homo sapiens
gugaggaucaagcuuauua

SEQ ID NO: 684826 - RNA, 19 nt, Homo sapiens
gagcuuaccauaacuacaa

SEQ ID NO: 684827 - RNA, 19 nt, Homo sapiens
gaauggcuguguugaguca

SEQ ID NO: 684828 - RNA, 19 nt, Homo sapiens
gguggugaauuaauuauca

SEQ ID NO: 684829 - RNA, 19 nt, Homo sapiens
gcucuucacucggauuaaa

SEQ ID NO: 684830 - RNA, 19 nt, Homo sapiens
gagccacaguucaaccuuu

SEQ ID NO: 684831 - RNA, 19 nt, Homo sapiens
acaguugccuuuaguauuc

SEQ ID NO: 684832 - RNA, 19 nt, Homo sapiens
ucaagaccauccuggcuaa

SEQ ID NO: 684833 - RNA, 19 nt, Homo sapiens
acaacugacuuucugcuuu

SEQ ID NO: 684834 - RNA, 19 nt, Homo sapiens
aaggagacuucaagcuuua

SEQ ID NO: 684835 - RNA, 19 nt, Homo sapiens
ggugggaacuucucuaguc

SEQ ID NO: 684836 - RNA, 19 nt, Homo sapiens
gaggaaggcugccagaacu

SEQ ID NO: 684837 - RNA, 19 nt, Homo sapiens
agaguuggcuguucacaug

SEQ ID NO: 684838 - RNA, 19 nt, Homo sapiens
ucucggagcugccagaaug

SEQ ID NO: 684839 - RNA, 19 nt, Homo sapiens
gucccuagcuuucuauaug

SEQ ID NO: 684840 - RNA, 19 nt, Homo sapiens
ggaaucgacugaaaauuug

SEQ ID NO: 684841 - RNA, 19 nt, Homo sapiens
gggaauggcuguguugagu

SEQ ID NO: 684842 - RNA, 19 nt, Homo sapiens
guaauuaugccagacagua

SEQ ID NO: 684843 - RNA, 19 nt, Homo sapiens
ccgaagaggacuauaguuu

SEQ ID NO: 684844 - RNA, 19 nt, Homo sapiens
cuagggaggucgaaucuuc

SEQ ID NO: 684845 - RNA, 19 nt, Homo sapiens
gagccuugcugagauuauu

SEQ ID NO: 684846 - RNA, 19 nt, Homo sapiens
gagaggaagucagcacuca

SEQ ID NO: 684847 - RNA, 19 nt, Homo sapiens
gaaaguuacacccaaaaua

SEQ ID NO: 684848 - RNA, 19 nt, Homo sapiens
gagcaugaacuuuccauca

SEQ ID NO: 684849 - RNA, 19 nt, Homo sapiens
caacuauuguggcuacuag

SEQ ID NO: 684850 - RNA, 19 nt, Homo sapiens
gaacacaaggccuccacaa

SEQ ID NO: 684851 - RNA, 19 nt, Homo sapiens
ggaccuggagcuuaccaua

SEQ ID NO: 684852 - RNA, 19 nt, Homo sapiens
cuacagcccugaugacuac

SEQ ID NO: 684853 - RNA, 19 nt, Homo sapiens
gcugagauuauuggaauua

SEQ ID NO: 684854 - RNA, 19 nt, Homo sapiens
gcacuagcgugugucaugu

SEQ ID NO: 684855 - RNA, 19 nt, Homo sapiens
ccaaaguucugggauuaug

SEQ ID NO: 684856 - RNA, 19 nt, Homo sapiens
gaacuuucuccaaccauga

SEQ ID NO: 684857 - RNA, 19 nt, Homo sapiens
ggaauaaaugacuguaaug

SEQ ID NO: 684858 - RNA, 19 nt, Homo sapiens
gaggaagucagcacucauu

SEQ ID NO: 684859 - RNA, 19 nt, Homo sapiens
caaguuauucugccuguga

SEQ ID NO: 684860 - RNA, 19 nt, Homo sapiens
ucuaagugguuaagaguug

SEQ ID NO: 684861 - RNA, 19 nt, Homo sapiens
cccaucacaucauugcuua

SEQ ID NO: 684862 - RNA, 19 nt, Homo sapiens
caggagacuucauuucaau

SEQ ID NO: 684863 - RNA, 19 nt, Homo sapiens
gugcagaggugggaacuuc

SEQ ID NO: 684864 - RNA, 19 nt, Homo sapiens
ccaaugagacagaaucuuc

SEQ ID NO: 684865 - RNA, 19 nt, Homo sapiens
cuucagaggcuaccaauga

SEQ ID NO: 684866 - RNA, 19 nt, Homo sapiens
agacuuugcagaaugaaua

SEQ ID NO: 684867 - RNA, 19 nt, Homo sapiens
uaucaaacaugcgacaguu

SEQ ID NO: 684868 - RNA, 19 nt, Homo sapiens
caggguagaucucugaaca

SEQ ID NO: 684869 - RNA, 19 nt, Homo sapiens
ccaaggagacuucaagcuu

SEQ ID NO: 684870 - RNA, 19 nt, Homo sapiens
ggaucaagcuuauuaucac

SEQ ID NO: 684871 - RNA, 19 nt, Homo sapiens
agaaacagacuuugcagaa

SEQ ID NO: 684872 - RNA, 19 nt, Homo sapiens
gcauaugaaagcucuuaaa

SEQ ID NO: 684873 - RNA, 19 nt, Homo sapiens
agucagcacucauuucaga

SEQ ID NO: 684874 - RNA, 19 nt, Homo sapiens
gggcuacaguguuuuauuu

SEQ ID NO: 684875 - RNA, 19 nt, Homo sapiens
gacuauaguuucuccaaag

SEQ ID NO: 684876 - RNA, 19 nt, Homo sapiens
ucauuucagugggaacuua

SEQ ID NO: 684877 - RNA, 19 nt, Homo sapiens
cuacggagguuggacauuc

SEQ ID NO: 684878 - RNA, 19 nt, Homo sapiens
gcaugaacuuuccaucagu

SEQ ID NO: 684879 - RNA, 19 nt, Homo sapiens
caggugaggaucaagcuua

SEQ ID NO: 684880 - RNA, 19 nt, Homo sapiens
gaaaccccaucucuacuaa

SEQ ID NO: 684881 - RNA, 19 nt, Homo sapiens
ggauuguugugaaauuuag

SEQ ID NO: 684882 - RNA, 19 nt, Homo sapiens
ucauaggauuguugugaaa

SEQ ID NO: 684883 - RNA, 19 nt, Homo sapiens
ccagaucuauuuauuagcu

SEQ ID NO: 684884 - RNA, 19 nt, Homo sapiens
gaccuggagcuuaccauaa

SEQ ID NO: 684885 - RNA, 19 nt, Homo sapiens
caacaggagacuucauuuc

SEQ ID NO: 684886 - RNA, 19 nt, Homo sapiens
caucaugaagucacaguuu

SEQ ID NO: 684887 - RNA, 19 nt, Homo sapiens
ugagugcccuggugacaug

SEQ ID NO: 684888 - RNA, 19 nt, Homo sapiens
gaaauuuaggugagugaau

SEQ ID NO: 684889 - RNA, 19 nt, Homo sapiens
uaauguaguuguagcucaa

SEQ ID NO: 684890 - RNA, 19 nt, Homo sapiens
cuccggaaccuauuaauaa

SEQ ID NO: 684891 - RNA, 19 nt, Homo sapiens
acaggagacuucauuucaa

SEQ ID NO: 684892 - RNA, 19 nt, Homo sapiens
caaguuggaccuucucaau

SEQ ID NO: 684893 - RNA, 19 nt, Homo sapiens
gggauugccuucuaaauua

SEQ ID NO: 684894 - RNA, 19 nt, Homo sapiens
gaucaaggauguaauucua

SEQ ID NO: 684895 - RNA, 19 nt, Homo sapiens
gcaaauggacggaauguuu

SEQ ID NO: 684896 - RNA, 19 nt, Homo sapiens
gggagaaacguaugaauua

SEQ ID NO: 684897 - RNA, 19 nt, Homo sapiens
ggagaaacguaugaauuaa

SEQ ID NO: 684898 - RNA, 19 nt, Homo sapiens
gcauagauccuguuucgua

SEQ ID NO: 684899 - RNA, 19 nt, Homo sapiens
gaacggagaggaagaauuc

SEQ ID NO: 684900 - RNA, 19 nt, Homo sapiens
gaaagugacugcauuuagg

SEQ ID NO: 684901 - RNA, 19 nt, Homo sapiens
gaaaagaacuucacaaggu

SEQ ID NO: 684902 - RNA, 19 nt, Homo sapiens
ccacagaacuggacauaag

SEQ ID NO: 684903 - RNA, 19 nt, Homo sapiens
ccauagcacucuuguguuu

SEQ ID NO: 684904 - RNA, 19 nt, Homo sapiens
gaaagucacgggaaugauu

SEQ ID NO: 684905 - RNA, 19 nt, Homo sapiens
cagauacgaugauucagua

SEQ ID NO: 684906 - RNA, 19 nt, Homo sapiens
gcuaacacauaaaccauga

SEQ ID NO: 684907 - RNA, 19 nt, Homo sapiens
uaaaccguguggauuauuu

SEQ ID NO: 684908 - RNA, 19 nt, Homo sapiens
gggaucaucgucuucauua

SEQ ID NO: 684909 - RNA, 19 nt, Homo sapiens
ucagacacauugaaaguga

SEQ ID NO: 684910 - RNA, 19 nt, Homo sapiens
ccaaguagcugggauuaca

SEQ ID NO: 684911 - RNA, 19 nt, Homo sapiens
uaaagauggccaccacuua

SEQ ID NO: 684912 - RNA, 19 nt, Homo sapiens
gaacuggacauaagugugu

SEQ ID NO: 684913 - RNA, 19 nt, Homo sapiens
cggaaggucucaaccauga

SEQ ID NO: 684914 - RNA, 19 nt, Homo sapiens
caagagaacggaauucaga

SEQ ID NO: 684915 - RNA, 19 nt, Homo sapiens
uaggaaggcugauggcaaa

SEQ ID NO: 684916 - RNA, 19 nt, Homo sapiens
gcauucaccuuuaucaagu

SEQ ID NO: 684917 - RNA, 19 nt, Homo sapiens
cagggaagauuuaggauuc

SEQ ID NO: 684918 - RNA, 19 nt, Homo sapiens
gcugugccgucucuucaua

SEQ ID NO: 684919 - RNA, 19 nt, Homo sapiens
cuaauuaacuguugauugc

SEQ ID NO: 684920 - RNA, 19 nt, Homo sapiens
gggcauagauccuguuucg

SEQ ID NO: 684921 - RNA, 19 nt, Homo sapiens
ggccagggauugccuucua

SEQ ID NO: 684922 - RNA, 19 nt, Homo sapiens
ggaccauccugaagaagug

SEQ ID NO: 684923 - RNA, 19 nt, Homo sapiens
gaaaggccaagcuggauga

SEQ ID NO: 684924 - RNA, 19 nt, Homo sapiens
ggauugccuucuaaauuau

SEQ ID NO: 684925 - RNA, 19 nt, Homo sapiens
gcccagauguauaauuuca

SEQ ID NO: 684926 - RNA, 19 nt, Homo sapiens
gaggcuggcugcugaagga

SEQ ID NO: 684927 - RNA, 19 nt, Homo sapiens
aagaggagacuuugaaauu

SEQ ID NO: 684928 - RNA, 19 nt, Homo sapiens
gaucuucagugucuauugg

SEQ ID NO: 684929 - RNA, 19 nt, Homo sapiens
ggagugcaauggcaugauc

SEQ ID NO: 684930 - RNA, 19 nt, Homo sapiens
ggaaagugauggccuucuc

SEQ ID NO: 684931 - RNA, 19 nt, Homo sapiens
aaagauggccaccacuuaa

SEQ ID NO: 684932 - RNA, 19 nt, Homo sapiens
acacauaaaccaugaccua

SEQ ID NO: 684933 - RNA, 19 nt, Homo sapiens
cugcccagauguauaauuu

SEQ ID NO: 684934 - RNA, 19 nt, Homo sapiens
ucacagaggcaaaucagaa

SEQ ID NO: 684935 - RNA, 19 nt, Homo sapiens
ugcaaaugcuaacacauaa

SEQ ID NO: 684936 - RNA, 19 nt, Homo sapiens
ggaucaucgucuucauuaa

SEQ ID NO: 684937 - RNA, 19 nt, Homo sapiens
cgacugaguucgcggagau

SEQ ID NO: 684938 - RNA, 19 nt, Homo sapiens
cuuaauguguggaaaguga

SEQ ID NO: 684939 - RNA, 19 nt, Homo sapiens
cugcaaaugcuaacacaua

SEQ ID NO: 684940 - RNA, 19 nt, Homo sapiens
gauuguggcguuauucaaa

SEQ ID NO: 684941 - RNA, 19 nt, Homo sapiens
ccaaagugcugggauuaca

SEQ ID NO: 684942 - RNA, 19 nt, Homo sapiens
uagauccuguuucguauga

SEQ ID NO: 684943 - RNA, 19 nt, Homo sapiens
guccagaucuucagugucu

SEQ ID NO: 684944 - RNA, 19 nt, Homo sapiens
gaaggacacauucaagaca

SEQ ID NO: 684945 - RNA, 19 nt, Homo sapiens
caccuuggauaucuauuga

SEQ ID NO: 684946 - RNA, 19 nt, Homo sapiens
aaccagagguggaggaaga

SEQ ID NO: 684947 - RNA, 19 nt, Homo sapiens
caucucagcauucaccuuu

SEQ ID NO: 684948 - RNA, 19 nt, Homo sapiens
gaagagcaagauaugcauu

SEQ ID NO: 684949 - RNA, 19 nt, Homo sapiens
cauguucucuuuauaaugc

SEQ ID NO: 684950 - RNA, 19 nt, Homo sapiens
cauagauccuguuucguau

SEQ ID NO: 684951 - RNA, 19 nt, Homo sapiens
cauaaaccaugaccuaacu

SEQ ID NO: 684952 - RNA, 19 nt, Homo sapiens
gcaaaugcuaacacauaaa

SEQ ID NO: 684953 - RNA, 19 nt, Homo sapiens
ggcagaaucuacuuacagu

SEQ ID NO: 684954 - RNA, 19 nt, Homo sapiens
gcuggcugcugaaggauga

SEQ ID NO: 684955 - RNA, 19 nt, Homo sapiens
gcacucuuguguuucuguu

SEQ ID NO: 684956 - RNA, 19 nt, Homo sapiens
gccagggauugccuucuaa

SEQ ID NO: 684957 - RNA, 19 nt, Homo sapiens
gaucaucgucuucauuaag

SEQ ID NO: 684958 - RNA, 19 nt, Homo sapiens
auacgaugauucaguagaa

SEQ ID NO: 684959 - RNA, 19 nt, Homo sapiens
gaacggaauucagaaacac

SEQ ID NO: 684960 - RNA, 19 nt, Homo sapiens
ucacgggaaugauugacuu

SEQ ID NO: 684961 - RNA, 19 nt, Homo sapiens
uuacugaucauuccacuug

SEQ ID NO: 684962 - RNA, 19 nt, Homo sapiens
cauugaaagugacugcauu

SEQ ID NO: 684963 - RNA, 19 nt, Homo sapiens
agaggagacuuugaaauuc

SEQ ID NO: 684964 - RNA, 19 nt, Homo sapiens
gauccuguuucguaugaau

SEQ ID NO: 684965 - RNA, 19 nt, Homo sapiens
uuucagagcaucagauuga

SEQ ID NO: 684966 - RNA, 19 nt, Homo sapiens
ggguucauguucucuuuau

SEQ ID NO: 684967 - RNA, 19 nt, Homo sapiens
cagcacacucucagucaua

SEQ ID NO: 684968 - RNA, 19 nt, Homo sapiens
aggccaagcuggaugaaga

SEQ ID NO: 684969 - RNA, 19 nt, Homo sapiens
caagguggaaggacacauu

SEQ ID NO: 684970 - RNA, 19 nt, Homo sapiens
ugacuuagacaccagcaaa

SEQ ID NO: 684971 - RNA, 19 nt, Homo sapiens
agagcaagauaugcauuaa

SEQ ID NO: 684972 - RNA, 19 nt, Homo sapiens
gaaaucagcuggggcuugu

SEQ ID NO: 684973 - RNA, 19 nt, Homo sapiens
uaugaucuauggcaaaugg

SEQ ID NO: 684974 - RNA, 19 nt, Homo sapiens
uaaaccaugaccuaacuuu

SEQ ID NO: 684975 - RNA, 19 nt, Homo sapiens
gguggagggucaucugcuu

SEQ ID NO: 684976 - RNA, 19 nt, Homo sapiens
agcaagauaugcauuaauc

SEQ ID NO: 684977 - RNA, 19 nt, Homo sapiens
cuuuaaaccguguggauua

SEQ ID NO: 684978 - RNA, 19 nt, Homo sapiens
gaggaccggcaaaccauuu

SEQ ID NO: 684979 - RNA, 19 nt, Homo sapiens
gcucccauguucagcagaa

SEQ ID NO: 684980 - RNA, 19 nt, Homo sapiens
aagcugcucuggaggauca

SEQ ID NO: 684981 - RNA, 19 nt, Homo sapiens
gaagcucuuuaugaucuau

SEQ ID NO: 684982 - RNA, 19 nt, Homo sapiens
ucaacgagccucugagcuu

SEQ ID NO: 684983 - RNA, 19 nt, Homo sapiens
gaggagacuuugaaauucc

SEQ ID NO: 684984 - RNA, 19 nt, Homo sapiens
gcaagcugcucuggaggau

SEQ ID NO: 684985 - RNA, 19 nt, Homo sapiens
gaagauuuaggauucagau

SEQ ID NO: 684986 - RNA, 19 nt, Homo sapiens
ggagaggaccggcaaacca

SEQ ID NO: 684987 - RNA, 19 nt, Homo sapiens
ggaggaagaacgguaggaa

SEQ ID NO: 684988 - RNA, 19 nt, Homo sapiens
gagguuuaacgaguucuua

SEQ ID NO: 684989 - RNA, 19 nt, Homo sapiens
ucucagcauucaccuuuau

SEQ ID NO: 684990 - RNA, 19 nt, Homo sapiens
ggucagaggcagaaucuac

SEQ ID NO: 684991 - RNA, 19 nt, Homo sapiens
cgggaaugauugacuuaga

SEQ ID NO: 684992 - RNA, 19 nt, Homo sapiens
aagagcaagauaugcauua

SEQ ID NO: 684993 - RNA, 19 nt, Homo sapiens
gggauugccuucuaaauua

SEQ ID NO: 684994 - RNA, 19 nt, Homo sapiens
gaucaaggauguaauucua

SEQ ID NO: 684995 - RNA, 19 nt, Homo sapiens
gcaaauggacggaauguuu

SEQ ID NO: 684996 - RNA, 19 nt, Homo sapiens
gggagaaacguaugaauua

SEQ ID NO: 684997 - RNA, 19 nt, Homo sapiens
ggagaaacguaugaauuaa

SEQ ID NO: 684998 - RNA, 19 nt, Homo sapiens
gcauagauccuguuucgua

SEQ ID NO: 684999 - RNA, 19 nt, Homo sapiens
gaacggagaggaagaauuc

SEQ ID NO: 685000 - RNA, 19 nt, Homo sapiens
gaaagugacugcauuuagg

SEQ ID NO: 685001 - RNA, 19 nt, Homo sapiens
gaaaagaacuucacaaggu

SEQ ID NO: 685002 - RNA, 19 nt, Homo sapiens
ccacagaacuggacauaag

SEQ ID NO: 685003 - RNA, 19 nt, Homo sapiens
ccauagcacucuuguguuu

SEQ ID NO: 685004 - RNA, 19 nt, Homo sapiens
gaaagucacgggaaugauu

SEQ ID NO: 685005 - RNA, 19 nt, Homo sapiens
cagauacgaugauucagua

SEQ ID NO: 685006 - RNA, 19 nt, Homo sapiens
gcuaacacauaaaccauga

SEQ ID NO: 685007 - RNA, 19 nt, Homo sapiens
uaaaccguguggauuauuu

SEQ ID NO: 685008 - RNA, 19 nt, Homo sapiens
gggaucaucgucuucauua

SEQ ID NO: 685009 - RNA, 19 nt, Homo sapiens
ucagacacauugaaaguga

SEQ ID NO: 685010 - RNA, 19 nt, Homo sapiens
ccaaguagcugggauuaca

SEQ ID NO: 685011 - RNA, 19 nt, Homo sapiens
uaaagauggccaccacuua

SEQ ID NO: 685012 - RNA, 19 nt, Homo sapiens
gaacuggacauaagugugu

SEQ ID NO: 685013 - RNA, 19 nt, Homo sapiens
cggaaggucucaaccauga

SEQ ID NO: 685014 - RNA, 19 nt, Homo sapiens
caagagaacggaauucaga

SEQ ID NO: 685015 - RNA, 19 nt, Homo sapiens
uaggaaggcugauggcaaa

SEQ ID NO: 685016 - RNA, 19 nt, Homo sapiens
gcauucaccuuuaucaagu

SEQ ID NO: 685017 - RNA, 19 nt, Homo sapiens
cagggaagauuuaggauuc

SEQ ID NO: 685018 - RNA, 19 nt, Homo sapiens
gcugugccgucucuucaua

SEQ ID NO: 685019 - RNA, 19 nt, Homo sapiens
ucacaggcuuugauucuga

SEQ ID NO: 685020 - RNA, 19 nt, Homo sapiens
cuaauuaacuguugauugc

SEQ ID NO: 685021 - RNA, 19 nt, Homo sapiens
gggcauagauccuguuucg

SEQ ID NO: 685022 - RNA, 19 nt, Homo sapiens
ggccagggauugccuucua

SEQ ID NO: 685023 - RNA, 19 nt, Homo sapiens
ggaccauccugaagaagug

SEQ ID NO: 685024 - RNA, 19 nt, Homo sapiens
gaaaggccaagcuggauga

SEQ ID NO: 685025 - RNA, 19 nt, Homo sapiens
ggauugccuucuaaauuau

SEQ ID NO: 685026 - RNA, 19 nt, Homo sapiens
gcccagauguauaauuuca

SEQ ID NO: 685027 - RNA, 19 nt, Homo sapiens
gaggcuggcugcugaagga

SEQ ID NO: 685028 - RNA, 19 nt, Homo sapiens
aagaggagacuuugaaauu

SEQ ID NO: 685029 - RNA, 19 nt, Homo sapiens
gaucuucagugucuauugg

SEQ ID NO: 685030 - RNA, 19 nt, Homo sapiens
ggagugcaauggcaugauc

SEQ ID NO: 685031 - RNA, 19 nt, Homo sapiens
ggaaagugauggccuucuc

SEQ ID NO: 685032 - RNA, 19 nt, Homo sapiens
aaagauggccaccacuuaa

SEQ ID NO: 685033 - RNA, 19 nt, Homo sapiens
acacauaaaccaugaccua

SEQ ID NO: 685034 - RNA, 19 nt, Homo sapiens
cugcccagauguauaauuu

SEQ ID NO: 685035 - RNA, 19 nt, Homo sapiens
ugcaaaugcuaacacauaa

SEQ ID NO: 685036 - RNA, 19 nt, Homo sapiens
ggaucaucgucuucauuaa

SEQ ID NO: 685037 - RNA, 19 nt, Homo sapiens
cgacugaguucgcggagau

SEQ ID NO: 685038 - RNA, 19 nt, Homo sapiens
cuuaauguguggaaaguga

SEQ ID NO: 685039 - RNA, 19 nt, Homo sapiens
cugcaaaugcuaacacaua

SEQ ID NO: 685040 - RNA, 19 nt, Homo sapiens
gauuguggcguuauucaaa

SEQ ID NO: 685041 - RNA, 19 nt, Homo sapiens
ccaaagugcugggauuaca

SEQ ID NO: 685042 - RNA, 19 nt, Homo sapiens
uagauccuguuucguauga

SEQ ID NO: 685043 - RNA, 19 nt, Homo sapiens
guccagaucuucagugucu

SEQ ID NO: 685044 - RNA, 19 nt, Homo sapiens
gaaggacacauucaagaca

SEQ ID NO: 685045 - RNA, 19 nt, Homo sapiens
caccuuggauaucuauuga

SEQ ID NO: 685046 - RNA, 19 nt, Homo sapiens
aaccagagguggaggaaga

SEQ ID NO: 685047 - RNA, 19 nt, Homo sapiens
caucucagcauucaccuuu

SEQ ID NO: 685048 - RNA, 19 nt, Homo sapiens
gaagagcaagauaugcauu

SEQ ID NO: 685049 - RNA, 19 nt, Homo sapiens
cauguucucuuuauaaugc

SEQ ID NO: 685050 - RNA, 19 nt, Homo sapiens
cauagauccuguuucguau

SEQ ID NO: 685051 - RNA, 19 nt, Homo sapiens
cauaaaccaugaccuaacu

SEQ ID NO: 685052 - RNA, 19 nt, Homo sapiens
gcaaaugcuaacacauaaa

SEQ ID NO: 685053 - RNA, 19 nt, Homo sapiens
ggcagaaucuacuuacagu

SEQ ID NO: 685054 - RNA, 19 nt, Homo sapiens
gcuggcugcugaaggauga

SEQ ID NO: 685055 - RNA, 19 nt, Homo sapiens
gcacucuuguguuucuguu

SEQ ID NO: 685056 - RNA, 19 nt, Homo sapiens
gccagggauugccuucuaa

SEQ ID NO: 685057 - RNA, 19 nt, Homo sapiens
gaucaucgucuucauuaag

SEQ ID NO: 685058 - RNA, 19 nt, Homo sapiens
auacgaugauucaguagaa

SEQ ID NO: 685059 - RNA, 19 nt, Homo sapiens
gaacggaauucagaaacac

SEQ ID NO: 685060 - RNA, 19 nt, Homo sapiens
ucacgggaaugauugacuu

SEQ ID NO: 685061 - RNA, 19 nt, Homo sapiens
uuacugaucauuccacuug

SEQ ID NO: 685062 - RNA, 19 nt, Homo sapiens
cauugaaagugacugcauu

SEQ ID NO: 685063 - RNA, 19 nt, Homo sapiens
agaggagacuuugaaauuc

SEQ ID NO: 685064 - RNA, 19 nt, Homo sapiens
gauccuguuucguaugaau

SEQ ID NO: 685065 - RNA, 19 nt, Homo sapiens
uuucagagcaucagauuga

SEQ ID NO: 685066 - RNA, 19 nt, Homo sapiens
ggguucauguucucuuuau

SEQ ID NO: 685067 - RNA, 19 nt, Homo sapiens
cagcacacucucagucaua

SEQ ID NO: 685068 - RNA, 19 nt, Homo sapiens
aggccaagcuggaugaaga

SEQ ID NO: 685069 - RNA, 19 nt, Homo sapiens
caagguggaaggacacauu

SEQ ID NO: 685070 - RNA, 19 nt, Homo sapiens
ugacuuagacaccagcaaa

SEQ ID NO: 685071 - RNA, 19 nt, Homo sapiens
agagcaagauaugcauuaa

SEQ ID NO: 685072 - RNA, 19 nt, Homo sapiens
gaaaucagcuggggcuugu

SEQ ID NO: 685073 - RNA, 19 nt, Homo sapiens
uaugaucuauggcaaaugg

SEQ ID NO: 685074 - RNA, 19 nt, Homo sapiens
uaaaccaugaccuaacuuu

SEQ ID NO: 685075 - RNA, 19 nt, Homo sapiens
gguggagggucaucugcuu

SEQ ID NO: 685076 - RNA, 19 nt, Homo sapiens
agcaagauaugcauuaauc

SEQ ID NO: 685077 - RNA, 19 nt, Homo sapiens
cuuuaaaccguguggauua

SEQ ID NO: 685078 - RNA, 19 nt, Homo sapiens
gaggaccggcaaaccauuu

SEQ ID NO: 685079 - RNA, 19 nt, Homo sapiens
gcucccauguucagcagaa

SEQ ID NO: 685080 - RNA, 19 nt, Homo sapiens
aagcugcucuggaggauca

SEQ ID NO: 685081 - RNA, 19 nt, Homo sapiens
gaagcucuuuaugaucuau

SEQ ID NO: 685082 - RNA, 19 nt, Homo sapiens
ucaacgagccucugagcuu

SEQ ID NO: 685083 - RNA, 19 nt, Homo sapiens
gaggagacuuugaaauucc

SEQ ID NO: 685084 - RNA, 19 nt, Homo sapiens
gcaagcugcucuggaggau

SEQ ID NO: 685085 - RNA, 19 nt, Homo sapiens
gaagauuuaggauucagau

SEQ ID NO: 685086 - RNA, 19 nt, Homo sapiens
ggagaggaccggcaaacca

SEQ ID NO: 685087 - RNA, 19 nt, Homo sapiens
ggaggaagaacgguaggaa

SEQ ID NO: 685088 - RNA, 19 nt, Homo sapiens
gagguuuaacgaguucuua

SEQ ID NO: 685089 - RNA, 19 nt, Homo sapiens
ucucagcauucaccuuuau

SEQ ID NO: 685090 - RNA, 19 nt, Homo sapiens
ggucagaggcagaaucuac

SEQ ID NO: 685091 - RNA, 19 nt, Homo sapiens
aagagcaagauaugcauua

SEQ ID NO: 685092 - RNA, 19 nt, Homo sapiens
gguucauguucucuuuaua

SEQ ID NO: 685093 - RNA, 19 nt, Homo sapiens
gaaggaagauauugcacua

SEQ ID NO: 685094 - RNA, 19 nt, Homo sapiens
aaaugaagcugccuguuua

SEQ ID NO: 685095 - RNA, 19 nt, Homo sapiens
gaacuuggcuuaccauacu

SEQ ID NO: 685096 - RNA, 19 nt, Homo sapiens
gaacacaucuuugcacauc

SEQ ID NO: 685097 - RNA, 19 nt, Homo sapiens
ggacgugacauuuaaauug

SEQ ID NO: 685098 - RNA, 19 nt, Homo sapiens
ggaaaucccaccuaaagaa

SEQ ID NO: 685099 - RNA, 19 nt, Homo sapiens
gggugcagcucccauauaa

SEQ ID NO: 685100 - RNA, 19 nt, Homo sapiens
caaaugaagcugccuguuu

SEQ ID NO: 685101 - RNA, 19 nt, Homo sapiens
gcauuuaucuuuguuagga

SEQ ID NO: 685102 - RNA, 19 nt, Homo sapiens
gcaguggccugaagaggaa

SEQ ID NO: 685103 - RNA, 19 nt, Homo sapiens
ugaaggagccugugagaaa

SEQ ID NO: 685104 - RNA, 19 nt, Homo sapiens
gaacacccguuauccuugu

SEQ ID NO: 685105 - RNA, 19 nt, Homo sapiens
ccaagcaguugucuccuaa

SEQ ID NO: 685106 - RNA, 19 nt, Homo sapiens
gaaaucccaccuaaagaaa

SEQ ID NO: 685107 - RNA, 19 nt, Homo sapiens
aagcaucgcucaagacgaa

SEQ ID NO: 685108 - RNA, 19 nt, Homo sapiens
ggaagauauugcacuaaau

SEQ ID NO: 685109 - RNA, 19 nt, Homo sapiens
uggcagaguuucauaaaug

SEQ ID NO: 685110 - RNA, 19 nt, Homo sapiens
uauaaaugcuggcagaguu

SEQ ID NO: 685111 - RNA, 19 nt, Homo sapiens
ccaauucccuaaaucaugu

SEQ ID NO: 685112 - RNA, 19 nt, Homo sapiens
ucucggacgugacauuuaa

SEQ ID NO: 685113 - RNA, 19 nt, Homo sapiens
gacccaacguugaaacuau

SEQ ID NO: 685114 - RNA, 19 nt, Homo sapiens
ugacauggacuacgaaaga

SEQ ID NO: 685115 - RNA, 19 nt, Homo sapiens
ccagaaaccuuuacuucag

SEQ ID NO: 685116 - RNA, 19 nt, Homo sapiens
gacagacgcuuugcauaug

SEQ ID NO: 685117 - RNA, 19 nt, Homo sapiens
cgaaagacccaacguugaa

SEQ ID NO: 685118 - RNA, 19 nt, Homo sapiens
gaaggaagaagaucacuac

SEQ ID NO: 685119 - RNA, 19 nt, Homo sapiens
uggauuaucucuauaccaa

SEQ ID NO: 685120 - RNA, 19 nt, Homo sapiens
gaaggagccugugagaaag

SEQ ID NO: 685121 - RNA, 19 nt, Homo sapiens
ggaccaggaacacaucuuu

SEQ ID NO: 685122 - RNA, 19 nt, Homo sapiens
gaaaguggugcuucuggaa

SEQ ID NO: 685123 - RNA, 19 nt, Homo sapiens
aggaagauauugcacuaaa

SEQ ID NO: 685124 - RNA, 19 nt, Homo sapiens
acaccacacucacgcagua

SEQ ID NO: 685125 - RNA, 19 nt, Homo sapiens
ucacaaugcccaccaguug

SEQ ID NO: 685126 - RNA, 19 nt, Homo sapiens
gcauauggcaggucugaug

SEQ ID NO: 685127 - RNA, 19 nt, Homo sapiens
aaaccaaucgguaaucuga

SEQ ID NO: 685128 - RNA, 19 nt, Homo sapiens
ugcaagcaguauuggauua

SEQ ID NO: 685129 - RNA, 19 nt, Homo sapiens
gacgugacauuuaaauugg

SEQ ID NO: 685130 - RNA, 19 nt, Homo sapiens
aaauaagcaucgcucaaga

SEQ ID NO: 685131 - RNA, 19 nt, Homo sapiens
aaggaaagccaaucggaua

SEQ ID NO: 685132 - RNA, 19 nt, Homo sapiens
agacagacgcuuugcauau

SEQ ID NO: 685133 - RNA, 19 nt, Homo sapiens
gaaagacccaacguugaaa

SEQ ID NO: 685134 - RNA, 19 nt, Homo sapiens
gaacgagagaaggaagaua

SEQ ID NO: 685135 - RNA, 19 nt, Homo sapiens
gugcagcucccauauaaau

SEQ ID NO: 685136 - RNA, 19 nt, Homo sapiens
gagaagcagagcagagauu

SEQ ID NO: 685137 - RNA, 19 nt, Homo sapiens
uaaagaaaguccagaaacc

SEQ ID NO: 685138 - RNA, 19 nt, Homo sapiens
gccgagagguagcaaagga

SEQ ID NO: 685139 - RNA, 19 nt, Homo sapiens
ccuggaagcuguuaaucga

SEQ ID NO: 685140 - RNA, 19 nt, Homo sapiens
uuaggaggcuuaauaaacu

SEQ ID NO: 685141 - RNA, 19 nt, Homo sapiens
ggaauuggcucaguuucac

SEQ ID NO: 685142 - RNA, 19 nt, Homo sapiens
ggaaagccaaucggauaaa

SEQ ID NO: 685143 - RNA, 19 nt, Homo sapiens
uaccucuucuuccaaauuu

SEQ ID NO: 685144 - RNA, 19 nt, Homo sapiens
ugugguaccugaaggaaga

SEQ ID NO: 685145 - RNA, 19 nt, Homo sapiens
gaaccaggagauuacgaaa

SEQ ID NO: 685146 - RNA, 19 nt, Homo sapiens
gcuaaucccaauucccuaa

SEQ ID NO: 685147 - RNA, 19 nt, Homo sapiens
uuagagauacgacauaguu

SEQ ID NO: 685148 - RNA, 19 nt, Homo sapiens
aaauucgucuuguuagaga

SEQ ID NO: 685149 - RNA, 19 nt, Homo sapiens
gaaagccaaucggauaaaa

SEQ ID NO: 685150 - RNA, 19 nt, Homo sapiens
ggauguuguugaugaagug

SEQ ID NO: 685151 - RNA, 19 nt, Homo sapiens
ggaagacgcgcuugaucug

SEQ ID NO: 685152 - RNA, 19 nt, Homo sapiens
guaaucugauccaccacuu

SEQ ID NO: 685153 - RNA, 19 nt, Homo sapiens
ucgcucggcuucaggguaa

SEQ ID NO: 685154 - RNA, 19 nt, Homo sapiens
gauaucaaugcaagcagua

SEQ ID NO: 685155 - RNA, 19 nt, Homo sapiens
cgacauaguucagguuucg

SEQ ID NO: 685156 - RNA, 19 nt, Homo sapiens
uaaauaagcaucgcucaag

SEQ ID NO: 685157 - RNA, 19 nt, Homo sapiens
guguaucucccgaacauaa

SEQ ID NO: 685158 - RNA, 19 nt, Homo sapiens
guucaggaguugaccaaag

SEQ ID NO: 685159 - RNA, 19 nt, Homo sapiens
ggacccugcuccaguuucu

SEQ ID NO: 685160 - RNA, 19 nt, Homo sapiens
aagcguguuugaccaguuu

SEQ ID NO: 685161 - RNA, 19 nt, Homo sapiens
caugugguauccagaaauc

SEQ ID NO: 685162 - RNA, 19 nt, Homo sapiens
uggcaggucugauguugug

SEQ ID NO: 685163 - RNA, 19 nt, Homo sapiens
ugugggcgauugaccagua

SEQ ID NO: 685164 - RNA, 19 nt, Homo sapiens
cugcuccaguuucuuuaua

SEQ ID NO: 685165 - RNA, 19 nt, Homo sapiens
ggagugaaggagccuguga

SEQ ID NO: 685166 - RNA, 19 nt, Homo sapiens
caucuuugcacaucgaauu

SEQ ID NO: 685167 - RNA, 19 nt, Homo sapiens
caaaggaacuuggcuuacc

SEQ ID NO: 685168 - RNA, 19 nt, Homo sapiens
uagcaaggcccauaaagag

SEQ ID NO: 685169 - RNA, 19 nt, Homo sapiens
guuaggaggcuuaauaaac

SEQ ID NO: 685170 - RNA, 19 nt, Homo sapiens
gcacaagcucaccaucaau

SEQ ID NO: 685171 - RNA, 19 nt, Homo sapiens
gugcauuuaucuuuguuag

SEQ ID NO: 685172 - RNA, 19 nt, Homo sapiens
gcuccaaguuccguaagga

SEQ ID NO: 685173 - RNA, 19 nt, Homo sapiens
gaucuggacccgcuggaau

SEQ ID NO: 685174 - RNA, 19 nt, Homo sapiens
gcaagcaguauuggauuau

SEQ ID NO: 685175 - RNA, 19 nt, Homo sapiens
caacagugugggcgauuga

SEQ ID NO: 685176 - RNA, 19 nt, Homo sapiens
gcuggcagaguuucauaaa

SEQ ID NO: 685177 - RNA, 19 nt, Homo sapiens
uuuguuaggaggcuuaaua

SEQ ID NO: 685178 - RNA, 19 nt, Homo sapiens
acagggaaaugcaagucaa

SEQ ID NO: 685179 - RNA, 19 nt, Homo sapiens
caccugcaauucuggaaau

SEQ ID NO: 685180 - RNA, 19 nt, Homo sapiens
agacgaaaguggugcuucu

SEQ ID NO: 685181 - RNA, 19 nt, Homo sapiens
ggcagaguuucauaaaugg

SEQ ID NO: 685182 - RNA, 19 nt, Homo sapiens
cugcagacaaccaggaaua

SEQ ID NO: 685183 - RNA, 19 nt, Homo sapiens
ggaagccgagggugcaguu

SEQ ID NO: 685184 - RNA, 19 nt, Homo sapiens
guccagaaaccuuuacuuc

SEQ ID NO: 685185 - RNA, 19 nt, Homo sapiens
gggaagacgcgcuugaucu

SEQ ID NO: 685186 - RNA, 19 nt, Homo sapiens
gcaccugcaauucuggaaa

SEQ ID NO: 685187 - RNA, 19 nt, Homo sapiens
caagcguguuugaccaguu

SEQ ID NO: 685188 - RNA, 19 nt, Homo sapiens
cagcaagccagaacucuuc

SEQ ID NO: 685189 - RNA, 19 nt, Homo sapiens
guugaugaagugaguguuu

SEQ ID NO: 685190 - RNA, 19 nt, Homo sapiens
gggauguuguugaugaagu

SEQ ID NO: 685191 - RNA, 19 nt, Homo sapiens
ucacugcauuccuuaaacu

SEQ ID NO: 685192 - RNA, 19 nt, Homo sapiens
aaagggaagcugacucuca

SEQ ID NO: 685193 - RNA, 19 nt, Homo sapiens
gaagacagcuguagagcaa

SEQ ID NO: 685194 - RNA, 19 nt, Homo sapiens
gaacagagaccaaggaaga

SEQ ID NO: 685195 - RNA, 19 nt, Homo sapiens
guagggaaauuguuguuua

SEQ ID NO: 685196 - RNA, 19 nt, Homo sapiens
gagaggaacugcuguuuau

SEQ ID NO: 685197 - RNA, 19 nt, Homo sapiens
gcaagaaacaucugugaua

SEQ ID NO: 685198 - RNA, 19 nt, Homo sapiens
caggaaagauacccaaaua

SEQ ID NO: 685199 - RNA, 19 nt, Homo sapiens
ggaauacgcuuuagacaag

SEQ ID NO: 685200 - RNA, 19 nt, Homo sapiens
gaaauuggaagaacaguuu

SEQ ID NO: 685201 - RNA, 19 nt, Homo sapiens
ucacagaaaucccagaauu

SEQ ID NO: 685202 - RNA, 19 nt, Homo sapiens
uaucuuagcuucuuccaaa

SEQ ID NO: 685203 - RNA, 19 nt, Homo sapiens
ggaaugcccuucacucugu

SEQ ID NO: 685204 - RNA, 19 nt, Homo sapiens
gaaagaaggacaacaacaa

SEQ ID NO: 685205 - RNA, 19 nt, Homo sapiens
guagacugcuguaggauuu

SEQ ID NO: 685206 - RNA, 19 nt, Homo sapiens
ggaaagauacccaaauaau

SEQ ID NO: 685207 - RNA, 19 nt, Homo sapiens
gaugaaagacaguacauuu

SEQ ID NO: 685208 - RNA, 19 nt, Homo sapiens
ccagggaccucaacaauca

SEQ ID NO: 685209 - RNA, 19 nt, Homo sapiens
cagcaacgcuugaucucua

SEQ ID NO: 685210 - RNA, 19 nt, Homo sapiens
gugguuaccuucaaagaaa

SEQ ID NO: 685211 - RNA, 19 nt, Homo sapiens
gaaggaagcagcaguaucu

SEQ ID NO: 685212 - RNA, 19 nt, Homo sapiens
aaaccgagcagcacacuua

SEQ ID NO: 685213 - RNA, 19 nt, Homo sapiens
ggagaaucuuuaucagaaa

SEQ ID NO: 685214 - RNA, 19 nt, Homo sapiens
gaacuuaagagcuggaaga

SEQ ID NO: 685215 - RNA, 19 nt, Homo sapiens
ccucagagcucaugucaca

SEQ ID NO: 685216 - RNA, 19 nt, Homo sapiens
gcaaguguccucuacagaa

SEQ ID NO: 685217 - RNA, 19 nt, Homo sapiens
ucaagaggguguaaguauu

SEQ ID NO: 685218 - RNA, 19 nt, Homo sapiens
ggaaugaaggcuccauaaa

SEQ ID NO: 685219 - RNA, 19 nt, Homo sapiens
gagaagggacuauagcaaa

SEQ ID NO: 685220 - RNA, 19 nt, Homo sapiens
ggagagaagccagugguua

SEQ ID NO: 685221 - RNA, 19 nt, Homo sapiens
caagaaacaucugugauag

SEQ ID NO: 685222 - RNA, 19 nt, Homo sapiens
gggaaauuguuguuuauca

SEQ ID NO: 685223 - RNA, 19 nt, Homo sapiens
agacauugcucgauacaga

SEQ ID NO: 685224 - RNA, 19 nt, Homo sapiens
caugaacccuccacacuga

SEQ ID NO: 685225 - RNA, 19 nt, Homo sapiens
ggucauguguaccugagua

SEQ ID NO: 685226 - RNA, 19 nt, Homo sapiens
ccaauggucagccuuauaa

SEQ ID NO: 685227 - RNA, 19 nt, Homo sapiens
ggaaucacgccuuuaagaa

SEQ ID NO: 685228 - RNA, 19 nt, Homo sapiens
gcauuucuguuagucauuu

SEQ ID NO: 685229 - RNA, 19 nt, Homo sapiens
caggaaacaucucuguauu

SEQ ID NO: 685230 - RNA, 19 nt, Homo sapiens
ggaauaacuguaacuaaga

SEQ ID NO: 685231 - RNA, 19 nt, Homo sapiens
ggacaaagaaggccagcaa

SEQ ID NO: 685232 - RNA, 19 nt, Homo sapiens
gagagaaauuggaagaaca

SEQ ID NO: 685233 - RNA, 19 nt, Homo sapiens
auacccagcuccuaucuaa

SEQ ID NO: 685234 - RNA, 19 nt, Homo sapiens
gcagguggcagcccucuuu

SEQ ID NO: 685235 - RNA, 19 nt, Homo sapiens
caaauggauugcugauaau

SEQ ID NO: 685236 - RNA, 19 nt, Homo sapiens
gcuaguggcuucuauacuc

SEQ ID NO: 685237 - RNA, 19 nt, Homo sapiens
gcaugagaauuugguguuu

SEQ ID NO: 685238 - RNA, 19 nt, Homo sapiens
gaacugucacugauucuug

SEQ ID NO: 685239 - RNA, 19 nt, Homo sapiens
ucaggcagcugcaacauuc

SEQ ID NO: 685240 - RNA, 19 nt, Homo sapiens
caagaaaugcaccuuagaa

SEQ ID NO: 685241 - RNA, 19 nt, Homo sapiens
gagaccaucugaccacaau

SEQ ID NO: 685242 - RNA, 19 nt, Homo sapiens
cagcuuugccuuuaauuaa

SEQ ID NO: 685243 - RNA, 19 nt, Homo sapiens
aaacugaaaccaagaaaug

SEQ ID NO: 685244 - RNA, 19 nt, Homo sapiens
gcaguuaguucaugucacu

SEQ ID NO: 685245 - RNA, 19 nt, Homo sapiens
gcaauaaacagacgcauac

SEQ ID NO: 685246 - RNA, 19 nt, Homo sapiens
aggagaaucuuuaucagaa

SEQ ID NO: 685247 - RNA, 19 nt, Homo sapiens
caacacacaaccauaauuc

SEQ ID NO: 685248 - RNA, 19 nt, Homo sapiens
gggaaauuauggaaacaau

SEQ ID NO: 685249 - RNA, 19 nt, Homo sapiens
gaacucagucccucaaugg

SEQ ID NO: 685250 - RNA, 19 nt, Homo sapiens
gaaacagcccuacuaccuu

SEQ ID NO: 685251 - RNA, 19 nt, Homo sapiens
ucuacaagccgaaauuuaa

SEQ ID NO: 685252 - RNA, 19 nt, Homo sapiens
cacagaaaucccagaauua

SEQ ID NO: 685253 - RNA, 19 nt, Homo sapiens
gcauugagaccuucuuuca

SEQ ID NO: 685254 - RNA, 19 nt, Homo sapiens
ugauuucucuucugaauag

SEQ ID NO: 685255 - RNA, 19 nt, Homo sapiens
caaguguccucuacagaau

SEQ ID NO: 685256 - RNA, 19 nt, Homo sapiens
gaaguucaggcaaaccuuu

SEQ ID NO: 685257 - RNA, 19 nt, Homo sapiens
gaaucacgccuuuaagaau

SEQ ID NO: 685258 - RNA, 19 nt, Homo sapiens
aaaaucagcuuugccuuua

SEQ ID NO: 685259 - RNA, 19 nt, Homo sapiens
gaaugaaggcuccauaaac

SEQ ID NO: 685260 - RNA, 19 nt, Homo sapiens
gaaugccguuugagaaauc

SEQ ID NO: 685261 - RNA, 19 nt, Homo sapiens
cauaaucccucagaaguca

SEQ ID NO: 685262 - RNA, 19 nt, Homo sapiens
uaagaaugauggaaagaag

SEQ ID NO: 685263 - RNA, 19 nt, Homo sapiens
ggacuauagcaaaggaaua

SEQ ID NO: 685264 - RNA, 19 nt, Homo sapiens
acagaaaucccagaauuaa

SEQ ID NO: 685265 - RNA, 19 nt, Homo sapiens
cagaggaguuugaauuaca

SEQ ID NO: 685266 - RNA, 19 nt, Homo sapiens
gaccaucugaccacaauuu

SEQ ID NO: 685267 - RNA, 19 nt, Homo sapiens
gggaggagaaucuuuauca

SEQ ID NO: 685268 - RNA, 19 nt, Homo sapiens
ggaggaaagaggacugaaa

SEQ ID NO: 685269 - RNA, 19 nt, Homo sapiens
ccaaugcuguaugcuagua

SEQ ID NO: 685270 - RNA, 19 nt, Homo sapiens
caagccagcugcagguuca

SEQ ID NO: 685271 - RNA, 19 nt, Homo sapiens
gaaaaucagcuuugccuuu

SEQ ID NO: 685272 - RNA, 19 nt, Homo sapiens
aaacagaaggacagcauuu

SEQ ID NO: 685273 - RNA, 19 nt, Homo sapiens
ccauaauucuguuccauuc

SEQ ID NO: 685274 - RNA, 19 nt, Homo sapiens
gcaaaggaauaacuguaac

SEQ ID NO: 685275 - RNA, 19 nt, Homo sapiens
gauuuaccaugccguguga

SEQ ID NO: 685276 - RNA, 19 nt, Homo sapiens
uggcuucuauacucaguua

SEQ ID NO: 685277 - RNA, 19 nt, Homo sapiens
gaggagaaucuuuaucaga

SEQ ID NO: 685278 - RNA, 19 nt, Homo sapiens
gaggaaggaagcagcagua

SEQ ID NO: 685279 - RNA, 19 nt, Homo sapiens
aggcaaaccuuucucuguu

SEQ ID NO: 685280 - RNA, 19 nt, Homo sapiens
ggcaaagaaucgagcaaau

SEQ ID NO: 685281 - RNA, 19 nt, Homo sapiens
uggaaagccuaaagucuau

SEQ ID NO: 685282 - RNA, 19 nt, Homo sapiens
gcacagcaagcaaacauag

SEQ ID NO: 685283 - RNA, 19 nt, Homo sapiens
gcaaagaaucgagcaaauc

SEQ ID NO: 685284 - RNA, 19 nt, Homo sapiens
guucaugucacugucauua

SEQ ID NO: 685285 - RNA, 19 nt, Homo sapiens
uuaaggagcugcuauucca

SEQ ID NO: 685286 - RNA, 19 nt, Homo sapiens
gaaagaggacugaaaaugu

SEQ ID NO: 685287 - RNA, 19 nt, Homo sapiens
gggaaugaaggcuccauaa

SEQ ID NO: 685288 - RNA, 19 nt, Homo sapiens
cagaaugccguuugagaaa

SEQ ID NO: 685289 - RNA, 19 nt, Homo sapiens
ccaaacagcuguggaaucc

SEQ ID NO: 685290 - RNA, 19 nt, Homo sapiens
gacuauagcaaaggaauaa

SEQ ID NO: 685291 - RNA, 19 nt, Homo sapiens
cauccucacuguggaguaa

SEQ ID NO: 685292 - RNA, 19 nt, Homo sapiens
uuacccaguuuguguguuu

SEQ ID NO: 685293 - RNA, 19 nt, Homo sapiens
ggaagaagcuuguuauauu

SEQ ID NO: 685294 - RNA, 19 nt, Homo sapiens
uagaagagauggcuuauua

SEQ ID NO: 685295 - RNA, 19 nt, Homo sapiens
gaaagugaaucuucccuua

SEQ ID NO: 685296 - RNA, 19 nt, Homo sapiens
caaguuauguuuccuguua

SEQ ID NO: 685297 - RNA, 19 nt, Homo sapiens
gaagaaaucuccucugaca

SEQ ID NO: 685298 - RNA, 19 nt, Homo sapiens
gaaaugugaucccuuugua

SEQ ID NO: 685299 - RNA, 19 nt, Homo sapiens
gcacaagggucacguguau

SEQ ID NO: 685300 - RNA, 19 nt, Homo sapiens
gaagaagcuuguuauauuc

SEQ ID NO: 685301 - RNA, 19 nt, Homo sapiens
gaagaaagacccaagagaa

SEQ ID NO: 685302 - RNA, 19 nt, Homo sapiens
guacauacgcuuaaucuaa

SEQ ID NO: 685303 - RNA, 19 nt, Homo sapiens
ggaagaagccgacuaacuu

SEQ ID NO: 685304 - RNA, 19 nt, Homo sapiens
gaaaguuccucuuccaaau

SEQ ID NO: 685305 - RNA, 19 nt, Homo sapiens
ggaagaugaugauggaauu

SEQ ID NO: 685306 - RNA, 19 nt, Homo sapiens
gagaugggcugauggaaga

SEQ ID NO: 685307 - RNA, 19 nt, Homo sapiens
gcagugaucuaugcuguaa

SEQ ID NO: 685308 - RNA, 19 nt, Homo sapiens
caaagaagauguaaaccau

SEQ ID NO: 685309 - RNA, 19 nt, Homo sapiens
agacagcacuaaagcaaua

SEQ ID NO: 685310 - RNA, 19 nt, Homo sapiens
aagaauagccuuaguguuu

SEQ ID NO: 685311 - RNA, 19 nt, Homo sapiens
ggacagcuaucccagguau

SEQ ID NO: 685312 - RNA, 19 nt, Homo sapiens
gaaauagcuuguccuguca

SEQ ID NO: 685313 - RNA, 19 nt, Homo sapiens
ggucagucauggagaauaa

SEQ ID NO: 685314 - RNA, 19 nt, Homo sapiens
uuaacaggcugcuugaaua

SEQ ID NO: 685315 - RNA, 19 nt, Homo sapiens
auaauuaugucccaccuua

SEQ ID NO: 685316 - RNA, 19 nt, Homo sapiens
ggaaagcagugaucuaugc

SEQ ID NO: 685317 - RNA, 19 nt, Homo sapiens
uaacugugcucaucacuuc

SEQ ID NO: 685318 - RNA, 19 nt, Homo sapiens
gaaacgaaacuuagauguu

SEQ ID NO: 685319 - RNA, 19 nt, Homo sapiens
gguaccagcugucuucuga

SEQ ID NO: 685320 - RNA, 19 nt, Homo sapiens
caucaaacuuguccagaaa

SEQ ID NO: 685321 - RNA, 19 nt, Homo sapiens
gagaaagacuugaguacca

SEQ ID NO: 685322 - RNA, 19 nt, Homo sapiens
caaaugagcacuuggauca

SEQ ID NO: 685323 - RNA, 19 nt, Homo sapiens
cuagaaacauccugaaaga

SEQ ID NO: 685324 - RNA, 19 nt, Homo sapiens
ggccaucacugggauauuu

SEQ ID NO: 685325 - RNA, 19 nt, Homo sapiens
agaauagccuuaguguuua

SEQ ID NO: 685326 - RNA, 19 nt, Homo sapiens
gugcagugcuucagccaua

SEQ ID NO: 685327 - RNA, 19 nt, Homo sapiens
uacaaggccucccuguuua

SEQ ID NO: 685328 - RNA, 19 nt, Homo sapiens
gaaaguggcgucuaagauc

SEQ ID NO: 685329 - RNA, 19 nt, Homo sapiens
ccacaaaucagguacugua

SEQ ID NO: 685330 - RNA, 19 nt, Homo sapiens
cuacaaggccucccuguuu

SEQ ID NO: 685331 - RNA, 19 nt, Homo sapiens
uuugagaacuuucccauuu

SEQ ID NO: 685332 - RNA, 19 nt, Homo sapiens
gagaaccuguggucacuug

SEQ ID NO: 685333 - RNA, 19 nt, Homo sapiens
ggcuuuacauggucaguua

SEQ ID NO: 685334 - RNA, 19 nt, Homo sapiens
gaacucgaacucaugaauu

SEQ ID NO: 685335 - RNA, 19 nt, Homo sapiens
gaauuccuccugauaguuu

SEQ ID NO: 685336 - RNA, 19 nt, Homo sapiens
ccugaaagauggaauuaug

SEQ ID NO: 685337 - RNA, 19 nt, Homo sapiens
ugaauauggugacuagauu

SEQ ID NO: 685338 - RNA, 19 nt, Homo sapiens
guacuugucugcagagagu

SEQ ID NO: 685339 - RNA, 19 nt, Homo sapiens
cgacagagacguggcauuu

SEQ ID NO: 685340 - RNA, 19 nt, Homo sapiens
gaagaagccgacuaacuug

SEQ ID NO: 685341 - RNA, 19 nt, Homo sapiens
gcuaucaaaugaaaucugu

SEQ ID NO: 685342 - RNA, 19 nt, Homo sapiens
gcagaaaguuccucuucca

SEQ ID NO: 685343 - RNA, 19 nt, Homo sapiens
gaccaugagucacagauuc

SEQ ID NO: 685344 - RNA, 19 nt, Homo sapiens
gcugaguccuagauuguuu

SEQ ID NO: 685345 - RNA, 19 nt, Homo sapiens
gauaauauucuggaaggua

SEQ ID NO: 685346 - RNA, 19 nt, Homo sapiens
gagaugagcacgcagaugu

SEQ ID NO: 685347 - RNA, 19 nt, Homo sapiens
ccacuucacgucuggaaua

SEQ ID NO: 685348 - RNA, 19 nt, Homo sapiens
caauaugcauguacugugu

SEQ ID NO: 685349 - RNA, 19 nt, Homo sapiens
ccucgaagcuguggaauca

SEQ ID NO: 685350 - RNA, 19 nt, Homo sapiens
cugaagaaaucuccucuga

SEQ ID NO: 685351 - RNA, 19 nt, Homo sapiens
cagcuccucugaaauguga

SEQ ID NO: 685352 - RNA, 19 nt, Homo sapiens
ucuggaagguaacuguuua

SEQ ID NO: 685353 - RNA, 19 nt, Homo sapiens
gaagaagaaagacccaaga

SEQ ID NO: 685354 - RNA, 19 nt, Homo sapiens
gaauauggaugaguaacca

SEQ ID NO: 685355 - RNA, 19 nt, Homo sapiens
cuccaaagcugucugcauu

SEQ ID NO: 685356 - RNA, 19 nt, Homo sapiens
gaagugcggcagagaagaa

SEQ ID NO: 685357 - RNA, 19 nt, Homo sapiens
gauggaauuccuccugaua

SEQ ID NO: 685358 - RNA, 19 nt, Homo sapiens
ggacggugauuucguuucu

SEQ ID NO: 685359 - RNA, 19 nt, Homo sapiens
gcacaaaugagcacuugga

SEQ ID NO: 685360 - RNA, 19 nt, Homo sapiens
gaagcugucuuucaaaaug

SEQ ID NO: 685361 - RNA, 19 nt, Homo sapiens
ucugaaaugugaucccuuu

SEQ ID NO: 685362 - RNA, 19 nt, Homo sapiens
gaauauggugacuagauuu

SEQ ID NO: 685363 - RNA, 19 nt, Homo sapiens
gauaaugugaagcagauaa

SEQ ID NO: 685364 - RNA, 19 nt, Homo sapiens
gaaaucuccucugacaugu

SEQ ID NO: 685365 - RNA, 19 nt, Homo sapiens
aacaugagcuccaggaaga

SEQ ID NO: 685366 - RNA, 19 nt, Homo sapiens
ccaaagaggacggugauuu

SEQ ID NO: 685367 - RNA, 19 nt, Homo sapiens
gggaagaagcuuguuauau

SEQ ID NO: 685368 - RNA, 19 nt, Homo sapiens
ggcaagccauccugacuga

SEQ ID NO: 685369 - RNA, 19 nt, Homo sapiens
gcaacagcauucagaagca

SEQ ID NO: 685370 - RNA, 19 nt, Homo sapiens
ccaucaaacuuguccagaa

SEQ ID NO: 685371 - RNA, 19 nt, Homo sapiens
gugauuucguuucugauaa

SEQ ID NO: 685372 - RNA, 19 nt, Homo sapiens
caaagaggacggugauuuc

SEQ ID NO: 685373 - RNA, 19 nt, Homo sapiens
gaauagccuuaguguuuag

SEQ ID NO: 685374 - RNA, 19 nt, Homo sapiens
agagauggcuuauuaacag

SEQ ID NO: 685375 - RNA, 19 nt, Homo sapiens
gaaugacaaagaagaugua

SEQ ID NO: 685376 - RNA, 19 nt, Homo sapiens
ugacaccaaugagaaguuu

SEQ ID NO: 685377 - RNA, 19 nt, Homo sapiens
agaggaagaugaugaugga

SEQ ID NO: 685378 - RNA, 19 nt, Homo sapiens
gggcacaaaugagcacuug

SEQ ID NO: 685379 - RNA, 19 nt, Homo sapiens
gaagagauggcuuauuaac

SEQ ID NO: 685380 - RNA, 19 nt, Homo sapiens
gcaguacaaacaggauuua

SEQ ID NO: 685381 - RNA, 19 nt, Homo sapiens
ucuggaauauggaugagua

SEQ ID NO: 685382 - RNA, 19 nt, Homo sapiens
guagacaacguuggcuuua

SEQ ID NO: 685383 - RNA, 19 nt, Homo sapiens
gcaggacucuuggaaagca

SEQ ID NO: 685384 - RNA, 19 nt, Homo sapiens
ucccagguauguaugauaa

SEQ ID NO: 685385 - RNA, 19 nt, Homo sapiens
uagcaggacucuuggaaag

SEQ ID NO: 685386 - RNA, 19 nt, Homo sapiens
ucgaagcuguggaaucauu

SEQ ID NO: 685387 - RNA, 19 nt, Homo sapiens
ccaaagcugucugcauuca

SEQ ID NO: 685388 - RNA, 19 nt, Homo sapiens
cuaaagcaauaugcaugua

SEQ ID NO: 685389 - RNA, 19 nt, Homo sapiens
ggugauuucguuucugaua

SEQ ID NO: 685390 - RNA, 19 nt, Homo sapiens
uggccaaggugaagaagaa

SEQ ID NO: 685391 - RNA, 19 nt, Homo sapiens
cacuugaccuccagccaua

SEQ ID NO: 685392 - RNA, 19 nt, Homo sapiens
gcaacgugcugaaaacuga

SEQ ID NO: 685393 - RNA, 19 nt, Homo sapiens
gaugacaacugcaauauua

SEQ ID NO: 685394 - RNA, 19 nt, Homo sapiens
gcaggacucuuaucuuaaa

SEQ ID NO: 685395 - RNA, 19 nt, Homo sapiens
aaacuugacugcacauuaa

SEQ ID NO: 685396 - RNA, 19 nt, Homo sapiens
gaaauguucuguagggauu

SEQ ID NO: 685397 - RNA, 19 nt, Homo sapiens
ugaauaagguguugaaaga

SEQ ID NO: 685398 - RNA, 19 nt, Homo sapiens
gagauucacugucagcuuu

SEQ ID NO: 685399 - RNA, 19 nt, Homo sapiens
cggcaggacucuuaucuua

SEQ ID NO: 685400 - RNA, 19 nt, Homo sapiens
gaaagaugauggugucaga

SEQ ID NO: 685401 - RNA, 19 nt, Homo sapiens
ggacaaagcaggagauuca

SEQ ID NO: 685402 - RNA, 19 nt, Homo sapiens
gaaacuugacugcacauua

SEQ ID NO: 685403 - RNA, 19 nt, Homo sapiens
gcauguagaugggauauug

SEQ ID NO: 685404 - RNA, 19 nt, Homo sapiens
ucacagcacuggcuucauu

SEQ ID NO: 685405 - RNA, 19 nt, Homo sapiens
gaacucugcuaaggacaua

SEQ ID NO: 685406 - RNA, 19 nt, Homo sapiens
gcagcaagcucaacuagca

SEQ ID NO: 685407 - RNA, 19 nt, Homo sapiens
ggacaguaaugaugugaug

SEQ ID NO: 685408 - RNA, 19 nt, Homo sapiens
gaaagcccauccaaguuga

SEQ ID NO: 685409 - RNA, 19 nt, Homo sapiens
ggaagggcaucuugaaaca

SEQ ID NO: 685410 - RNA, 19 nt, Homo sapiens
agagaaaguuccauucauu

SEQ ID NO: 685411 - RNA, 19 nt, Homo sapiens
ggagugcugugauugacua

SEQ ID NO: 685412 - RNA, 19 nt, Homo sapiens
ccucauaucaucaguauuu

SEQ ID NO: 685413 - RNA, 19 nt, Homo sapiens
ggaggaagcauguaagaga

SEQ ID NO: 685414 - RNA, 19 nt, Homo sapiens
gaagagaaaguuccauuca

SEQ ID NO: 685415 - RNA, 19 nt, Homo sapiens
gcucccugcuucaucauua

SEQ ID NO: 685416 - RNA, 19 nt, Homo sapiens
gauagcaaauugugugugu

SEQ ID NO: 685417 - RNA, 19 nt, Homo sapiens
gaauugcccuuuccuuaag

SEQ ID NO: 685418 - RNA, 19 nt, Homo sapiens
gggaaggagugcugugauu

SEQ ID NO: 685419 - RNA, 19 nt, Homo sapiens
gggauuuacuggcauggua

SEQ ID NO: 685420 - RNA, 19 nt, Homo sapiens
gagaaaguuccauucauuu

SEQ ID NO: 685421 - RNA, 19 nt, Homo sapiens
ggaaucggguuuagucauc

SEQ ID NO: 685422 - RNA, 19 nt, Homo sapiens
gauacuagguuuguacuuc

SEQ ID NO: 685423 - RNA, 19 nt, Homo sapiens
agaggcaacuugucacuuu

SEQ ID NO: 685424 - RNA, 19 nt, Homo sapiens
ggaaguugaugcacaccaa

SEQ ID NO: 685425 - RNA, 19 nt, Homo sapiens
ggaucuguguuaacucuuu

SEQ ID NO: 685426 - RNA, 19 nt, Homo sapiens
gugaggcauuuguuaauuu

SEQ ID NO: 685427 - RNA, 19 nt, Homo sapiens
uuaggcaucugcauuguuu

SEQ ID NO: 685428 - RNA, 19 nt, Homo sapiens
cuauguaguugucaucuuu

SEQ ID NO: 685429 - RNA, 19 nt, Homo sapiens
gugcugugauugacuagua

SEQ ID NO: 685430 - RNA, 19 nt, Homo sapiens
gaaggagugcugugauuga

SEQ ID NO: 685431 - RNA, 19 nt, Homo sapiens
gagaaugacuuugcucagu

SEQ ID NO: 685432 - RNA, 19 nt, Homo sapiens
augggaagcugcucaauuu

SEQ ID NO: 685433 - RNA, 19 nt, Homo sapiens
cauauucuccagaggauua

SEQ ID NO: 685434 - RNA, 19 nt, Homo sapiens
ggagacacuugggcuguuu

SEQ ID NO: 685435 - RNA, 19 nt, Homo sapiens
ggaagcauauguggaagga

SEQ ID NO: 685436 - RNA, 19 nt, Homo sapiens
gauugagucuguuuaguag

SEQ ID NO: 685437 - RNA, 19 nt, Homo sapiens
ggugaggcauuuguuaauu

SEQ ID NO: 685438 - RNA, 19 nt, Homo sapiens
gcuuuacacucuuguuuau

SEQ ID NO: 685439 - RNA, 19 nt, Homo sapiens
ucacucauuugauugguuu

SEQ ID NO: 685440 - RNA, 19 nt, Homo sapiens
ugaauggccaugccuguua

SEQ ID NO: 685441 - RNA, 19 nt, Homo sapiens
uuaccuggcugaaccauug

SEQ ID NO: 685442 - RNA, 19 nt, Homo sapiens
gacgagagauugagaucau

SEQ ID NO: 685443 - RNA, 19 nt, Homo sapiens
agacaugguucacaucaga

SEQ ID NO: 685444 - RNA, 19 nt, Homo sapiens
gguguugacuguccuuuca

SEQ ID NO: 685445 - RNA, 19 nt, Homo sapiens
ggacuggucuugggaacau

SEQ ID NO: 685446 - RNA, 19 nt, Homo sapiens
gcaagaggccugcaaaucg

SEQ ID NO: 685447 - RNA, 19 nt, Homo sapiens
caaaggcaccuacggcaaa

SEQ ID NO: 685448 - RNA, 19 nt, Homo sapiens
gggcuggagggaugaauua

SEQ ID NO: 685449 - RNA, 19 nt, Homo sapiens
gugcuaagaaagugcauua

SEQ ID NO: 685450 - RNA, 19 nt, Homo sapiens
guagacguguagauagaaa

SEQ ID NO: 685451 - RNA, 19 nt, Homo sapiens
gcguggagcuggcaaguag

SEQ ID NO: 685452 - RNA, 19 nt, Homo sapiens
gaagaaauccaagaaagag

SEQ ID NO: 685453 - RNA, 19 nt, Homo sapiens
gcuauaaaauccauucgua

SEQ ID NO: 685454 - RNA, 19 nt, Homo sapiens
gcuccuaccuacugguuga

SEQ ID NO: 685455 - RNA, 19 nt, Homo sapiens
guccguagcugucaguaug

SEQ ID NO: 685456 - RNA, 19 nt, Homo sapiens
acucugagcucccuacuuc

SEQ ID NO: 685457 - RNA, 19 nt, Homo sapiens
gaaaugcccacacuggaau

SEQ ID NO: 685458 - RNA, 19 nt, Homo sapiens
ggaggaagggcaucuugaa

SEQ ID NO: 685459 - RNA, 19 nt, Homo sapiens
cauccaaguugaguucuaa

SEQ ID NO: 685460 - RNA, 19 nt, Homo sapiens
cauggaauaugccagcaaa

SEQ ID NO: 685461 - RNA, 19 nt, Homo sapiens
agaaaguccuccacucaga

SEQ ID NO: 685462 - RNA, 19 nt, Homo sapiens
uuacuggcaugguaucauu

SEQ ID NO: 685463 - RNA, 19 nt, Homo sapiens
uguaagagagggaacauuu

SEQ ID NO: 685464 - RNA, 19 nt, Homo sapiens
acagaugaauggaaguuga

SEQ ID NO: 685465 - RNA, 19 nt, Homo sapiens
ccaguucugucaauuguca

SEQ ID NO: 685466 - RNA, 19 nt, Homo sapiens
ugacucaggucuacaagca

SEQ ID NO: 685467 - RNA, 19 nt, Homo sapiens
ggaagcaguagcacuaaug

SEQ ID NO: 685468 - RNA, 19 nt, Homo sapiens
aaggggagcuguacgauua

SEQ ID NO: 685469 - RNA, 19 nt, Homo sapiens
caaccauccucauaucauc

SEQ ID NO: 685470 - RNA, 19 nt, Homo sapiens
ugauugagucuguuuagua

SEQ ID NO: 685471 - RNA, 19 nt, Homo sapiens
ggacaaccugcaacucuga

SEQ ID NO: 685472 - RNA, 19 nt, Homo sapiens
ggagcuggcaaguagauuu

SEQ ID NO: 685473 - RNA, 19 nt, Homo sapiens
gaggaagggcaucuugaaa

SEQ ID NO: 685474 - RNA, 19 nt, Homo sapiens
gagaacaaagauaagauug

SEQ ID NO: 685475 - RNA, 19 nt, Homo sapiens
gauaaccacccaaaguguu

SEQ ID NO: 685476 - RNA, 19 nt, Homo sapiens
cuuuauggcuccugucaaa

SEQ ID NO: 685477 - RNA, 19 nt, Homo sapiens
gucacuuucuuucucaaua

SEQ ID NO: 685478 - RNA, 19 nt, Homo sapiens
gcucugaacucugcuaagg

SEQ ID NO: 685479 - RNA, 19 nt, Homo sapiens
ugaggcauuuguuaauuug

SEQ ID NO: 685480 - RNA, 19 nt, Homo sapiens
gauuggcacugucucacuu

SEQ ID NO: 685481 - RNA, 19 nt, Homo sapiens
gagagaaucagguuacuac

SEQ ID NO: 685482 - RNA, 19 nt, Homo sapiens
ugaaagcccauccaaguug

SEQ ID NO: 685483 - RNA, 19 nt, Homo sapiens
ugaagaaauccaagaaaga

SEQ ID NO: 685484 - RNA, 19 nt, Homo sapiens
caacaaacaauaguucuag

SEQ ID NO: 685485 - RNA, 19 nt, Homo sapiens
caacuugucacuuucuuuc

SEQ ID NO: 685486 - RNA, 19 nt, Homo sapiens
gcacagaugaauggaaguu

SEQ ID NO: 685487 - RNA, 19 nt, Homo sapiens
gccgagugguugcuauaaa

SEQ ID NO: 685488 - RNA, 19 nt, Homo sapiens
agaaucagguuacuacucu

SEQ ID NO: 685489 - RNA, 19 nt, Homo sapiens
uguaguugguccugccuua

SEQ ID NO: 685490 - RNA, 19 nt, Homo sapiens
gauucuaggugugguguug

SEQ ID NO: 685491 - RNA, 19 nt, Homo sapiens
gccaagugauugagucugu

SEQ ID NO: 685492 - RNA, 19 nt, Homo sapiens
gaagcggcaucaccacaag

SEQ ID NO: 685493 - RNA, 19 nt, Homo sapiens
gaagcuaccuuaucaagaa

SEQ ID NO: 685494 - RNA, 19 nt, Homo sapiens
gaaagguguuugccuauuu

SEQ ID NO: 685495 - RNA, 19 nt, Homo sapiens
gaagugaucuugauucauc

SEQ ID NO: 685496 - RNA, 19 nt, Homo sapiens
uaaaugaggucacuguuga

SEQ ID NO: 685497 - RNA, 19 nt, Homo sapiens
guaccaaacccaauacuua

SEQ ID NO: 685498 - RNA, 19 nt, Homo sapiens
gcaaagcccuuggaaguga

SEQ ID NO: 685499 - RNA, 19 nt, Homo sapiens
caaaugaacuaacaaaugg

SEQ ID NO: 685500 - RNA, 19 nt, Homo sapiens
gaagaaaggacaauguaaa

SEQ ID NO: 685501 - RNA, 19 nt, Homo sapiens
ggacaacgccuucaacuuc

SEQ ID NO: 685502 - RNA, 19 nt, Homo sapiens
aaagaaaccuggaaacaau

SEQ ID NO: 685503 - RNA, 19 nt, Homo sapiens
uaagauugaugcugaguuu

SEQ ID NO: 685504 - RNA, 19 nt, Homo sapiens
caagaaaccuccagcaaag

SEQ ID NO: 685505 - RNA, 19 nt, Homo sapiens
gcauagaccuguuuaguac

SEQ ID NO: 685506 - RNA, 19 nt, Homo sapiens
cagcaaagguggauucuuc

SEQ ID NO: 685507 - RNA, 19 nt, Homo sapiens
gaaagaaaccuggaaacaa

SEQ ID NO: 685508 - RNA, 19 nt, Homo sapiens
gcaaguugguauugauaaa

SEQ ID NO: 685509 - RNA, 19 nt, Homo sapiens
gcaaagccacuacucauga

SEQ ID NO: 685510 - RNA, 19 nt, Homo sapiens
ggaaagguguuugccuauu

SEQ ID NO: 685511 - RNA, 19 nt, Homo sapiens
cuagauaucuuuggugauu

SEQ ID NO: 685512 - RNA, 19 nt, Homo sapiens
gaaaggacaauguaaagau

SEQ ID NO: 685513 - RNA, 19 nt, Homo sapiens
gaucuugauucaucucuug

SEQ ID NO: 685514 - RNA, 19 nt, Homo sapiens
guaaagaugcucuagaaau

SEQ ID NO: 685515 - RNA, 19 nt, Homo sapiens
cuacaaugaugguguuauu

SEQ ID NO: 685516 - RNA, 19 nt, Homo sapiens
gaucuuaacaucaaggauu

SEQ ID NO: 685517 - RNA, 19 nt, Homo sapiens
gcaauaaacaccuugaaca

SEQ ID NO: 685518 - RNA, 19 nt, Homo sapiens
gacaacacaucaucucaug

SEQ ID NO: 685519 - RNA, 19 nt, Homo sapiens
gcaucuaaauugaccuauu

SEQ ID NO: 685520 - RNA, 19 nt, Homo sapiens
ucucacugcugaccucuua

SEQ ID NO: 685521 - RNA, 19 nt, Homo sapiens
aggaauauguacuaccuua

SEQ ID NO: 685522 - RNA, 19 nt, Homo sapiens
gcaaugaagccaccugaga

SEQ ID NO: 685523 - RNA, 19 nt, Homo sapiens
caaauggugucauaaaugc

SEQ ID NO: 685524 - RNA, 19 nt, Homo sapiens
ccaaaugaacuaacaaaug

SEQ ID NO: 685525 - RNA, 19 nt, Homo sapiens
gcuaaagaguaugccaaua

SEQ ID NO: 685526 - RNA, 19 nt, Homo sapiens
cgagaccaauguuaauauu

SEQ ID NO: 685527 - RNA, 19 nt, Homo sapiens
gagaggugcuauucaagug

SEQ ID NO: 685528 - RNA, 19 nt, Homo sapiens
uuacaagcguagugugaua

SEQ ID NO: 685529 - RNA, 19 nt, Homo sapiens
uagcggaucuuaacaucaa

SEQ ID NO: 685530 - RNA, 19 nt, Homo sapiens
ccaagaaaccuccagcaaa

SEQ ID NO: 685531 - RNA, 19 nt, Homo sapiens
acuaacaaauggugucaua

SEQ ID NO: 685532 - RNA, 19 nt, Homo sapiens
acagacagauggccuuuga

SEQ ID NO: 685533 - RNA, 19 nt, Homo sapiens
caaagccacuacucaugaa

SEQ ID NO: 685534 - RNA, 19 nt, Homo sapiens
uguacuaccuuagcuguua

SEQ ID NO: 685535 - RNA, 19 nt, Homo sapiens
ggagaugccuuugcagcuu

SEQ ID NO: 685536 - RNA, 19 nt, Homo sapiens
guggaaugcuggagagaaa

SEQ ID NO: 685537 - RNA, 19 nt, Homo sapiens
aaaagcaccuggacuauuu

SEQ ID NO: 685538 - RNA, 19 nt, Homo sapiens
ggaaagaaaccuggaaaca

SEQ ID NO: 685539 - RNA, 19 nt, Homo sapiens
gaacagcaucuaaauacau

SEQ ID NO: 685540 - RNA, 19 nt, Homo sapiens
uuagagaggugcuauucaa

SEQ ID NO: 685541 - RNA, 19 nt, Homo sapiens
cccaaacucuucccauaaa

SEQ ID NO: 685542 - RNA, 19 nt, Homo sapiens
ccaacgagaccaauguuaa

SEQ ID NO: 685543 - RNA, 19 nt, Homo sapiens
ggugcucccucuccauuaa

SEQ ID NO: 685544 - RNA, 19 nt, Homo sapiens
gagcaaguugguauugaua

SEQ ID NO: 685545 - RNA, 19 nt, Homo sapiens
uaaaugaguuuggagacuu

SEQ ID NO: 685546 - RNA, 19 nt, Homo sapiens
ugaaguggaucucuuugga

SEQ ID NO: 685547 - RNA, 19 nt, Homo sapiens
gaaaagcugcuaaagagua

SEQ ID NO: 685548 - RNA, 19 nt, Homo sapiens
gcugggugguuguguuuaa

SEQ ID NO: 685549 - RNA, 19 nt, Homo sapiens
caauaaacaccuugaacaa

SEQ ID NO: 685550 - RNA, 19 nt, Homo sapiens
ggaaagacgucuguguuuu

SEQ ID NO: 685551 - RNA, 19 nt, Homo sapiens
gcuguuaucccuacucuug

SEQ ID NO: 685552 - RNA, 19 nt, Homo sapiens
caacuggcagccuaaagua

SEQ ID NO: 685553 - RNA, 19 nt, Homo sapiens
guuaugauaugucuaccuu

SEQ ID NO: 685554 - RNA, 19 nt, Homo sapiens
uaacuucucuuccaaaaug

SEQ ID NO: 685555 - RNA, 19 nt, Homo sapiens
gaccaguguuccuguaguu

SEQ ID NO: 685556 - RNA, 19 nt, Homo sapiens
gugguuguaucugaauuua

SEQ ID NO: 685557 - RNA, 19 nt, Homo sapiens
uaacacagccgugaaagug

SEQ ID NO: 685558 - RNA, 19 nt, Homo sapiens
cagcaaagcccuuggaagu

SEQ ID NO: 685559 - RNA, 19 nt, Homo sapiens
gcacagauuucagauccau

SEQ ID NO: 685560 - RNA, 19 nt, Homo sapiens
aaaggacaauguaaagaug

SEQ ID NO: 685561 - RNA, 19 nt, Homo sapiens
ggaagaauccccuauuuau

SEQ ID NO: 685562 - RNA, 19 nt, Homo sapiens
aagguuaacguccauaaua

SEQ ID NO: 685563 - RNA, 19 nt, Homo sapiens
uacuacaacugcugaaauu

SEQ ID NO: 685564 - RNA, 19 nt, Homo sapiens
auaaacaccuugaacaaag

SEQ ID NO: 685565 - RNA, 19 nt, Homo sapiens
gagaugcaauaaacaccuu

SEQ ID NO: 685566 - RNA, 19 nt, Homo sapiens
uaugauaugucuaccuuca

SEQ ID NO: 685567 - RNA, 19 nt, Homo sapiens
guuuaaggcuuuagugaca

SEQ ID NO: 685568 - RNA, 19 nt, Homo sapiens
guuguaacauugugauuag

SEQ ID NO: 685569 - RNA, 19 nt, Homo sapiens
guaaagggucuguuugugu

SEQ ID NO: 685570 - RNA, 19 nt, Homo sapiens
caagcguagugugauaaua

SEQ ID NO: 685571 - RNA, 19 nt, Homo sapiens
gaaagugaacauuaggaau

SEQ ID NO: 685572 - RNA, 19 nt, Homo sapiens
cuuggcagcucuucauaaa

SEQ ID NO: 685573 - RNA, 19 nt, Homo sapiens
gaacaaaccccaaacucuu

SEQ ID NO: 685574 - RNA, 19 nt, Homo sapiens
cagaagaugucgggccaaa

SEQ ID NO: 685575 - RNA, 19 nt, Homo sapiens
gaaccuaccccuccuacua

SEQ ID NO: 685576 - RNA, 19 nt, Homo sapiens
ugacauuccugaccucaca

SEQ ID NO: 685577 - RNA, 19 nt, Homo sapiens
caaacucuucccauaaauu

SEQ ID NO: 685578 - RNA, 19 nt, Homo sapiens
ucaaagggagccaccagua

SEQ ID NO: 685579 - RNA, 19 nt, Homo sapiens
agggagaucuucaguggaa

SEQ ID NO: 685580 - RNA, 19 nt, Homo sapiens
caacgagaccaauguuaau

SEQ ID NO: 685581 - RNA, 19 nt, Homo sapiens
gaaggaaagaaaccuggaa

SEQ ID NO: 685582 - RNA, 19 nt, Homo sapiens
gcauccaaaugaacuaaca

SEQ ID NO: 685583 - RNA, 19 nt, Homo sapiens
acaaauugaugcacugcuu

SEQ ID NO: 685584 - RNA, 19 nt, Homo sapiens
agguuaacguccauaauaa

SEQ ID NO: 685585 - RNA, 19 nt, Homo sapiens
caccugagcuggaccucuu

SEQ ID NO: 685586 - RNA, 19 nt, Homo sapiens
gguuguaucugaauuuacu

SEQ ID NO: 685587 - RNA, 19 nt, Homo sapiens
gcugauggcuuggcuuaag

SEQ ID NO: 685588 - RNA, 19 nt, Homo sapiens
guggcgagcuauuuggaaa

SEQ ID NO: 685589 - RNA, 19 nt, Homo sapiens
gccgugaaagugaacauua

SEQ ID NO: 685590 - RNA, 19 nt, Homo sapiens
acacagccgugaaagugaa

SEQ ID NO: 685591 - RNA, 19 nt, Homo sapiens
acccaauacuuacucauaa

SEQ ID NO: 685592 - RNA, 19 nt, Homo sapiens
cugcugaccucuuaucugu

SEQ ID NO: 685593 - RNA, 19 nt, Homo sapiens
ggacagcgaugaugaguuu

SEQ ID NO: 685594 - RNA, 19 nt, Homo sapiens
gcaaggcccugcuggaauu

SEQ ID NO: 685595 - RNA, 19 nt, Homo sapiens
gaacaagaaggcccaguuu

SEQ ID NO: 685596 - RNA, 19 nt, Homo sapiens
ggaaucggcugcagcgaau

SEQ ID NO: 685597 - RNA, 19 nt, Homo sapiens
gaccacgucugaggacaua

SEQ ID NO: 685598 - RNA, 19 nt, Homo sapiens
ggacguggcugagaaagac

SEQ ID NO: 685599 - RNA, 19 nt, Homo sapiens
gagcggaucagaagcaaga

SEQ ID NO: 685600 - RNA, 19 nt, Homo sapiens
ggaaccugguggugaagaa

SEQ ID NO: 685601 - RNA, 19 nt, Homo sapiens
gcaaggcuguccucaucug

SEQ ID NO: 685602 - RNA, 19 nt, Homo sapiens
ugaugugccuggcuguuaa

SEQ ID NO: 685603 - RNA, 19 nt, Homo sapiens
ccaaggugcuucugcaucu

SEQ ID NO: 685604 - RNA, 19 nt, Homo sapiens
guacgaagaggaugaacug

SEQ ID NO: 685605 - RNA, 19 nt, Homo sapiens
gaaauuccaguacgaagag

SEQ ID NO: 685606 - RNA, 19 nt, Homo sapiens
uaucugaccucacaguucu

SEQ ID NO: 685607 - RNA, 19 nt, Homo sapiens
caagaaggcccaguuugug

SEQ ID NO: 685608 - RNA, 19 nt, Homo sapiens
gggcacgggcucucagaaa

SEQ ID NO: 685609 - RNA, 19 nt, Homo sapiens
ccgacuaucugaccucaca

SEQ ID NO: 685610 - RNA, 19 nt, Homo sapiens
ggacagccgggaugaacug

SEQ ID NO: 685611 - RNA, 19 nt, Homo sapiens
ugaaauuccaguacgaaga

SEQ ID NO: 685612 - RNA, 19 nt, Homo sapiens
uggcggacguggcugagaa

SEQ ID NO: 685613 - RNA, 19 nt, Homo sapiens
gaucguggcagaggucguu

SEQ ID NO: 685614 - RNA, 19 nt, Homo sapiens
cgagggagaaggaggaguu

SEQ ID NO: 685615 - RNA, 19 nt, Homo sapiens
gaaggcccaguuugugaug

SEQ ID NO: 685616 - RNA, 19 nt, Homo sapiens
aagaaggcccaguuuguga

SEQ ID NO: 685617 - RNA, 19 nt, Homo sapiens
agaccuguguggugggauu

SEQ ID NO: 685618 - RNA, 19 nt, Homo sapiens
gauccugggcgugcuggua

SEQ ID NO: 685619 - RNA, 19 nt, Homo sapiens
gaggagcggaucagaagca

SEQ ID NO: 685620 - RNA, 19 nt, Homo sapiens
caaccuggcuccccaaguc

SEQ ID NO: 685621 - RNA, 19 nt, Homo sapiens
cugcagagacucaagaaca

SEQ ID NO: 685622 - RNA, 19 nt, Homo sapiens
ccccaaggcucuccucuga

SEQ ID NO: 685623 - RNA, 19 nt, Homo sapiens
ucuaugcccucaacuacag

SEQ ID NO: 685624 - RNA, 19 nt, Homo sapiens
ccacgucugaggacauaga

SEQ ID NO: 685625 - RNA, 19 nt, Homo sapiens
ggcacgggcucucagaaaa

SEQ ID NO: 685626 - RNA, 19 nt, Homo sapiens
ugagggcccugcugcuucu

SEQ ID NO: 685627 - RNA, 19 nt, Homo sapiens
ggcaaggcccugcuggaau

SEQ ID NO: 685628 - RNA, 19 nt, Homo sapiens
ggaccuggacagcgaugau

SEQ ID NO: 685629 - RNA, 19 nt, Homo sapiens
agaacaagaaggcccaguu

SEQ ID NO: 685630 - RNA, 19 nt, Homo sapiens
cugaugugccuggcuguua

SEQ ID NO: 685631 - RNA, 19 nt, Homo sapiens
acaggccucuggugaccuu

SEQ ID NO: 685632 - RNA, 19 nt, Homo sapiens
cuucucgccuguccucaga

SEQ ID NO: 685633 - RNA, 19 nt, Homo sapiens
ggguugacucuuccaguga

SEQ ID NO: 685634 - RNA, 19 nt, Homo sapiens
gagggagaaggaggaguuu

SEQ ID NO: 685635 - RNA, 19 nt, Homo sapiens
gggagaaggaggaguuugc

SEQ ID NO: 685636 - RNA, 19 nt, Homo sapiens
guucuaugcccucaacuac

SEQ ID NO: 685637 - RNA, 19 nt, Homo sapiens
gaaaggagauaggaacauu

SEQ ID NO: 685638 - RNA, 19 nt, Homo sapiens
ggagauaggaacauuauaa

SEQ ID NO: 685639 - RNA, 19 nt, Homo sapiens
ggacgagucuacuaauuau

SEQ ID NO: 685640 - RNA, 19 nt, Homo sapiens
gaacuggcauuauuuccaa

SEQ ID NO: 685641 - RNA, 19 nt, Homo sapiens
ggaaggauccggugauauu

SEQ ID NO: 685642 - RNA, 19 nt, Homo sapiens
ggauuaacaucaacaguga

SEQ ID NO: 685643 - RNA, 19 nt, Homo sapiens
aagcaggccugaaggauua

SEQ ID NO: 685644 - RNA, 19 nt, Homo sapiens
ggaagaagaagaagaagaa

SEQ ID NO: 685645 - RNA, 19 nt, Homo sapiens
aaagugaucuaaccuugua

SEQ ID NO: 685646 - RNA, 19 nt, Homo sapiens
caacacaccucaccucaca

SEQ ID NO: 685647 - RNA, 19 nt, Homo sapiens
ggacuguagugcaauuaaa

SEQ ID NO: 685648 - RNA, 19 nt, Homo sapiens
gaaaaguacugggaaauuu

SEQ ID NO: 685649 - RNA, 19 nt, Homo sapiens
uaucagagccuguuacauu

SEQ ID NO: 685650 - RNA, 19 nt, Homo sapiens
ggaaugguguuuaacuaau

SEQ ID NO: 685651 - RNA, 19 nt, Homo sapiens
gcuaggagcuguaaaauug

SEQ ID NO: 685652 - RNA, 19 nt, Homo sapiens
gaagacauccaacccauug

SEQ ID NO: 685653 - RNA, 19 nt, Homo sapiens
gaggacgagucuacuaauu

SEQ ID NO: 685654 - RNA, 19 nt, Homo sapiens
ugaggaagaugacauuaga

SEQ ID NO: 685655 - RNA, 19 nt, Homo sapiens
gaggagccaucuuccauug

SEQ ID NO: 685656 - RNA, 19 nt, Homo sapiens
gaaugguguuuaacuaaug

SEQ ID NO: 685657 - RNA, 19 nt, Homo sapiens
gcagaugauggaccaaaua

SEQ ID NO: 685658 - RNA, 19 nt, Homo sapiens
gaagaugacauuagaacug

SEQ ID NO: 685659 - RNA, 19 nt, Homo sapiens
gaaauuuggugcuuguuuu

SEQ ID NO: 685660 - RNA, 19 nt, Homo sapiens
ggacccagccagccacaua

SEQ ID NO: 685661 - RNA, 19 nt, Homo sapiens
gcaguagcguggaucaguu

SEQ ID NO: 685662 - RNA, 19 nt, Homo sapiens
ccaggacucuguaagcaaa

SEQ ID NO: 685663 - RNA, 19 nt, Homo sapiens
ggaguuuacuuccguguag

SEQ ID NO: 685664 - RNA, 19 nt, Homo sapiens
caagccacguuuaucuuaa

SEQ ID NO: 685665 - RNA, 19 nt, Homo sapiens
ggaaauuuggugcuuguuu

SEQ ID NO: 685666 - RNA, 19 nt, Homo sapiens
ggacagcuucugcuacaaa

SEQ ID NO: 685667 - RNA, 19 nt, Homo sapiens
auaaacagcuucggagauu

SEQ ID NO: 685668 - RNA, 19 nt, Homo sapiens
gcaaauggaaccuggaugu

SEQ ID NO: 685669 - RNA, 19 nt, Homo sapiens
gcucaagccagaucaguuu

SEQ ID NO: 685670 - RNA, 19 nt, Homo sapiens
ggguauggguugacacuug

SEQ ID NO: 685671 - RNA, 19 nt, Homo sapiens
uagaaaagguggcagauaa

SEQ ID NO: 685672 - RNA, 19 nt, Homo sapiens
cacaauugcugguuuggaa

SEQ ID NO: 685673 - RNA, 19 nt, Homo sapiens
caguggaaguugcagcuua

SEQ ID NO: 685674 - RNA, 19 nt, Homo sapiens
gauuugaugucacugguau

SEQ ID NO: 685675 - RNA, 19 nt, Homo sapiens
caccauaccucaccacauc

SEQ ID NO: 685676 - RNA, 19 nt, Homo sapiens
gguuggacccgcacacuua

SEQ ID NO: 685677 - RNA, 19 nt, Homo sapiens
ccaaggagaugacgaccau

SEQ ID NO: 685678 - RNA, 19 nt, Homo sapiens
gagauggucuggagauguc

SEQ ID NO: 685679 - RNA, 19 nt, Homo sapiens
gguauggguugacacuuga

SEQ ID NO: 685680 - RNA, 19 nt, Homo sapiens
ggagccaucuuccauugug

SEQ ID NO: 685681 - RNA, 19 nt, Homo sapiens
cugcugagcugcuuugaug

SEQ ID NO: 685682 - RNA, 19 nt, Homo sapiens
ucaaccagaugaggaagua

SEQ ID NO: 685683 - RNA, 19 nt, Homo sapiens
ucaagccacguuuaucuua

SEQ ID NO: 685684 - RNA, 19 nt, Homo sapiens
caacuuguaucuucauugc

SEQ ID NO: 685685 - RNA, 19 nt, Homo sapiens
aagggucgcucacuuagaa

SEQ ID NO: 685686 - RNA, 19 nt, Homo sapiens
cagugcagcuuauuucaga

SEQ ID NO: 685687 - RNA, 19 nt, Homo sapiens
caggagcccuucucuggaa

SEQ ID NO: 685688 - RNA, 19 nt, Homo sapiens
ccagaucaguuugcagaaa

SEQ ID NO: 685689 - RNA, 19 nt, Homo sapiens
ccaaauagcacacaguuac

SEQ ID NO: 685690 - RNA, 19 nt, Homo sapiens
agaaaugucuuuggaaugg

SEQ ID NO: 685691 - RNA, 19 nt, Homo sapiens
cagcacaccucaccacaca

SEQ ID NO: 685692 - RNA, 19 nt, Homo sapiens
gagcguggaucgcccuugu

SEQ ID NO: 685693 - RNA, 19 nt, Homo sapiens
gugcugaguuggaaugaau

SEQ ID NO: 685694 - RNA, 19 nt, Homo sapiens
gguggagggugauaaaaua

SEQ ID NO: 685695 - RNA, 19 nt, Homo sapiens
ggagagaacccacgcacau

SEQ ID NO: 685696 - RNA, 19 nt, Homo sapiens
cagcuuauuucagacgaua

SEQ ID NO: 685697 - RNA, 19 nt, Homo sapiens
aaaggaagaagaagaagaa

SEQ ID NO: 685698 - RNA, 19 nt, Homo sapiens
gaucacagcccggaacaau

SEQ ID NO: 685699 - RNA, 19 nt, Homo sapiens
gcagguggagggugauaaa

SEQ ID NO: 685700 - RNA, 19 nt, Homo sapiens
ugccuuuguuguuguauua

SEQ ID NO: 685701 - RNA, 19 nt, Homo sapiens
cuacuggaaucaugugguu

SEQ ID NO: 685702 - RNA, 19 nt, Homo sapiens
cagaaggguuuccgcucua

SEQ ID NO: 685703 - RNA, 19 nt, Homo sapiens
ggcaugcugucacugauga

SEQ ID NO: 685704 - RNA, 19 nt, Homo sapiens
ucacgggacucggagauga

SEQ ID NO: 685705 - RNA, 19 nt, Homo sapiens
uucccuagaugacaaauaa

SEQ ID NO: 685706 - RNA, 19 nt, Homo sapiens
gcacacuuacuuucaucua

SEQ ID NO: 685707 - RNA, 19 nt, Homo sapiens
ggacucagccucucaaucc

SEQ ID NO: 685708 - RNA, 19 nt, Homo sapiens
acaguuacccuuccaagaa

SEQ ID NO: 685709 - RNA, 19 nt, Homo sapiens
gguugacacuugacagguu

SEQ ID NO: 685710 - RNA, 19 nt, Homo sapiens
acacuuacuuucaucuaug

SEQ ID NO: 685711 - RNA, 19 nt, Homo sapiens
gaugauggaccaaauagca

SEQ ID NO: 685712 - RNA, 19 nt, Homo sapiens
aagaugacauuagaacuga

SEQ ID NO: 685713 - RNA, 19 nt, Homo sapiens
ugucacagcucccuggaau

SEQ ID NO: 685714 - RNA, 19 nt, Homo sapiens
ccugaaggauuaacaucaa

SEQ ID NO: 685715 - RNA, 19 nt, Homo sapiens
ggugauauugugucuguuu

SEQ ID NO: 685716 - RNA, 19 nt, Homo sapiens
caauuaaacccgcgucuag

SEQ ID NO: 685717 - RNA, 19 nt, Homo sapiens
gcaauuaaacccgcgucua

SEQ ID NO: 685718 - RNA, 19 nt, Homo sapiens
ucacggcccucgacaccaa

SEQ ID NO: 685719 - RNA, 19 nt, Homo sapiens
caaagauccagaaggguuu

SEQ ID NO: 685720 - RNA, 19 nt, Homo sapiens
cagccuggauaaugauuga

SEQ ID NO: 685721 - RNA, 19 nt, Homo sapiens
cggacuaugugguguuuga

SEQ ID NO: 685722 - RNA, 19 nt, Homo sapiens
gacacggccuggaucauca

SEQ ID NO: 685723 - RNA, 19 nt, Homo sapiens
gaccaaauagcacacaguu

SEQ ID NO: 685724 - RNA, 19 nt, Homo sapiens
gcacacaguuacccuucca

SEQ ID NO: 685725 - RNA, 19 nt, Homo sapiens
caagcaggccugaaggauu

SEQ ID NO: 685726 - RNA, 19 nt, Homo sapiens
gagcaucacggacuaugug

SEQ ID NO: 685727 - RNA, 19 nt, Homo sapiens
gcuauggcauccucagcuu

SEQ ID NO: 685728 - RNA, 19 nt, Homo sapiens
ggaagacauccaacccauu

SEQ ID NO: 685729 - RNA, 19 nt, Homo sapiens
ggaggugucaggaucaaug

SEQ ID NO: 685730 - RNA, 19 nt, Homo sapiens
gaacggugucccacaggaa

SEQ ID NO: 685731 - RNA, 19 nt, Homo sapiens
uaacaucaacagugagaga

SEQ ID NO: 685732 - RNA, 19 nt, Homo sapiens
ggaggagccaucuuccauu

SEQ ID NO: 685733 - RNA, 19 nt, Homo sapiens
uaaacagcuucggagauuu

SEQ ID NO: 685734 - RNA, 19 nt, Homo sapiens
ugacuucacacuucccuuu

SEQ ID NO: 685735 - RNA, 19 nt, Homo sapiens
ucccagaucugacuucaca

SEQ ID NO: 685736 - RNA, 19 nt, Homo sapiens
aggacgagucuacuaauua

SEQ ID NO: 685737 - RNA, 19 nt, Homo sapiens
gaacaaagaugggacagaa

SEQ ID NO: 685738 - RNA, 19 nt, Homo sapiens
gaaguuaucugugcuguga

SEQ ID NO: 685739 - RNA, 19 nt, Homo sapiens
caaaugaaguggagacuga

SEQ ID NO: 685740 - RNA, 19 nt, Homo sapiens
ggaggaagauggcggauau

SEQ ID NO: 685741 - RNA, 19 nt, Homo sapiens
gaaaggauccucgggcuua

SEQ ID NO: 685742 - RNA, 19 nt, Homo sapiens
gcuagaagauccaguaaau

SEQ ID NO: 685743 - RNA, 19 nt, Homo sapiens
gaggaucugugcccuuaua

SEQ ID NO: 685744 - RNA, 19 nt, Homo sapiens
ggaauuaaccucucagaug

SEQ ID NO: 685745 - RNA, 19 nt, Homo sapiens
gaagauugauagaacagaa

SEQ ID NO: 685746 - RNA, 19 nt, Homo sapiens
gaagcuagguaucuacgaa

SEQ ID NO: 685747 - RNA, 19 nt, Homo sapiens
gaaccugucuugucucauc

SEQ ID NO: 685748 - RNA, 19 nt, Homo sapiens
ugaccuaucucaaccaauu

SEQ ID NO: 685749 - RNA, 19 nt, Homo sapiens
caagagagcuuugacaucu

SEQ ID NO: 685750 - RNA, 19 nt, Homo sapiens
gaacagaaccaaaagauuu

SEQ ID NO: 685751 - RNA, 19 nt, Homo sapiens
gugcucagauggaguuaua

SEQ ID NO: 685752 - RNA, 19 nt, Homo sapiens
ccacaaauaugaagaagag

SEQ ID NO: 685753 - RNA, 19 nt, Homo sapiens
uagagaagaagcuguauua

SEQ ID NO: 685754 - RNA, 19 nt, Homo sapiens
gaacuaggaggauguguga

SEQ ID NO: 685755 - RNA, 19 nt, Homo sapiens
guagugagccuuauaugaa

SEQ ID NO: 685756 - RNA, 19 nt, Homo sapiens
ggucgaagauacaaauaug

SEQ ID NO: 685757 - RNA, 19 nt, Homo sapiens
gaagauggcggauauugga

SEQ ID NO: 685758 - RNA, 19 nt, Homo sapiens
gauaacaucuaugaaguuc

SEQ ID NO: 685759 - RNA, 19 nt, Homo sapiens
ugaaggagcuauauggaau

SEQ ID NO: 685760 - RNA, 19 nt, Homo sapiens
gugaagaaauuccacaaau

SEQ ID NO: 685761 - RNA, 19 nt, Homo sapiens
cagaaaguguggugaagaa

SEQ ID NO: 685762 - RNA, 19 nt, Homo sapiens
uaaaccaccuauuacauug

SEQ ID NO: 685763 - RNA, 19 nt, Homo sapiens
uagaggaucugugcccuua

SEQ ID NO: 685764 - RNA, 19 nt, Homo sapiens
cgaaauaucgugucuugaa

SEQ ID NO: 685765 - RNA, 19 nt, Homo sapiens
ggacugaucgggaagaaga

SEQ ID NO: 685766 - RNA, 19 nt, Homo sapiens
uaucugugcugugaacuua

SEQ ID NO: 685767 - RNA, 19 nt, Homo sapiens
gaaauaucgugucuugaag

SEQ ID NO: 685768 - RNA, 19 nt, Homo sapiens
ccaacaagaagaaguuaua

SEQ ID NO: 685769 - RNA, 19 nt, Homo sapiens
cuuugaagaugaaggauua

SEQ ID NO: 685770 - RNA, 19 nt, Homo sapiens
ugcaaacccugucuagaua

SEQ ID NO: 685771 - RNA, 19 nt, Homo sapiens
ccaaagacaucaugcaaac

SEQ ID NO: 685772 - RNA, 19 nt, Homo sapiens
ggaccuaucuagcaauuuu

SEQ ID NO: 685773 - RNA, 19 nt, Homo sapiens
ccaacuguguggacuguuu

SEQ ID NO: 685774 - RNA, 19 nt, Homo sapiens
gcaauaaugcagaaacgaa

SEQ ID NO: 685775 - RNA, 19 nt, Homo sapiens
aaagcaagcuguguaaugu

SEQ ID NO: 685776 - RNA, 19 nt, Homo sapiens
gaaaaucaguauugggaaa

SEQ ID NO: 685777 - RNA, 19 nt, Homo sapiens
gauagacaagauuccauua

SEQ ID NO: 685778 - RNA, 19 nt, Homo sapiens
ugacaaaccuaaucuacag

SEQ ID NO: 685779 - RNA, 19 nt, Homo sapiens
gaaagaauucugagugaag

SEQ ID NO: 685780 - RNA, 19 nt, Homo sapiens
gcagauccauuugcacaug

SEQ ID NO: 685781 - RNA, 19 nt, Homo sapiens
caggacauuucaacuauga

SEQ ID NO: 685782 - RNA, 19 nt, Homo sapiens
caaauacucugcgaugcuu

SEQ ID NO: 685783 - RNA, 19 nt, Homo sapiens
aguggagacugaacaaaua

SEQ ID NO: 685784 - RNA, 19 nt, Homo sapiens
uaaaagaggugcaaacugu

SEQ ID NO: 685785 - RNA, 19 nt, Homo sapiens
cagcuuugaugauaccuuu

SEQ ID NO: 685786 - RNA, 19 nt, Homo sapiens
uaaaccgcccugauucuua

SEQ ID NO: 685787 - RNA, 19 nt, Homo sapiens
gaaaagaaagcaugaaaga

SEQ ID NO: 685788 - RNA, 19 nt, Homo sapiens
cagauggccucucagaaga

SEQ ID NO: 685789 - RNA, 19 nt, Homo sapiens
caauagagaagaagcugua

SEQ ID NO: 685790 - RNA, 19 nt, Homo sapiens
caaacccugucuagauauu

SEQ ID NO: 685791 - RNA, 19 nt, Homo sapiens
gaugaaggauuaauuacac

SEQ ID NO: 685792 - RNA, 19 nt, Homo sapiens
cccacucacuucaauauaa

SEQ ID NO: 685793 - RNA, 19 nt, Homo sapiens
ggacccagcacuccaaaga

SEQ ID NO: 685794 - RNA, 19 nt, Homo sapiens
gauucuuacuguagcauuu

SEQ ID NO: 685795 - RNA, 19 nt, Homo sapiens
uaaaugugauugcagaaag

SEQ ID NO: 685796 - RNA, 19 nt, Homo sapiens
agagagcuuugacaucuuu

SEQ ID NO: 685797 - RNA, 19 nt, Homo sapiens
ucugaagccuuucuccuuu

SEQ ID NO: 685798 - RNA, 19 nt, Homo sapiens
cagaggugauaaagcauuu

SEQ ID NO: 685799 - RNA, 19 nt, Homo sapiens
caacacagcacaguuuaug

SEQ ID NO: 685800 - RNA, 19 nt, Homo sapiens
ggagcuauauggaauuaac

SEQ ID NO: 685801 - RNA, 19 nt, Homo sapiens
ccugggacauggccaagua

SEQ ID NO: 685802 - RNA, 19 nt, Homo sapiens
gauguuaaagucagaaaug

SEQ ID NO: 685803 - RNA, 19 nt, Homo sapiens
ccacucacuucaauauaau

SEQ ID NO: 685804 - RNA, 19 nt, Homo sapiens
gaagggaaaccucaucucu

SEQ ID NO: 685805 - RNA, 19 nt, Homo sapiens
aaccuaaucuacaguuuga

SEQ ID NO: 685806 - RNA, 19 nt, Homo sapiens
aaaguggaaugaacuagga

SEQ ID NO: 685807 - RNA, 19 nt, Homo sapiens
cuaaaccaccuauuacauu

SEQ ID NO: 685808 - RNA, 19 nt, Homo sapiens
gaggucaugcaaucuauaa

SEQ ID NO: 685809 - RNA, 19 nt, Homo sapiens
cagcagcccuguucuaggu

SEQ ID NO: 685810 - RNA, 19 nt, Homo sapiens
caacauaaacaagacaaga

SEQ ID NO: 685811 - RNA, 19 nt, Homo sapiens
ggagacagugccaaaguga

SEQ ID NO: 685812 - RNA, 19 nt, Homo sapiens
uugagcagcuuugaugaua

SEQ ID NO: 685813 - RNA, 19 nt, Homo sapiens
gcaugucuauacucaacaa

SEQ ID NO: 685814 - RNA, 19 nt, Homo sapiens
ugaaauauguauggaaugg

SEQ ID NO: 685815 - RNA, 19 nt, Homo sapiens
aaggagcuauauggaauua

SEQ ID NO: 685816 - RNA, 19 nt, Homo sapiens
caaaagcaauagagaagaa

SEQ ID NO: 685817 - RNA, 19 nt, Homo sapiens
gcuuggaucuuggaaauag

SEQ ID NO: 685818 - RNA, 19 nt, Homo sapiens
uugaggaacucuaugaaga

SEQ ID NO: 685819 - RNA, 19 nt, Homo sapiens
uagugagccuuauaugaaa

SEQ ID NO: 685820 - RNA, 19 nt, Homo sapiens
cuagguaucuacgaauauu

SEQ ID NO: 685821 - RNA, 19 nt, Homo sapiens
gcucagcacgugacuuuau

SEQ ID NO: 685822 - RNA, 19 nt, Homo sapiens
aagaagagauugauaucca

SEQ ID NO: 685823 - RNA, 19 nt, Homo sapiens
ugaaagaauucugagugaa

SEQ ID NO: 685824 - RNA, 19 nt, Homo sapiens
gcucagauggaguuauaaa

SEQ ID NO: 685825 - RNA, 19 nt, Homo sapiens
gaaggagcuauauggaauu

SEQ ID NO: 685826 - RNA, 19 nt, Homo sapiens
agaaguugauagugaagaa

SEQ ID NO: 685827 - RNA, 19 nt, Homo sapiens
aaagaauucugagugaaga

SEQ ID NO: 685828 - RNA, 19 nt, Homo sapiens
uggcugcccuucacuuuga

SEQ ID NO: 685829 - RNA, 19 nt, Homo sapiens
ggacauuucaacuaugaug

SEQ ID NO: 685830 - RNA, 19 nt, Homo sapiens
ugucuauacucaacaagaa

SEQ ID NO: 685831 - RNA, 19 nt, Homo sapiens
ugaugaagcuagguaucua

SEQ ID NO: 685832 - RNA, 19 nt, Homo sapiens
ucuauaaggucgaagauac

SEQ ID NO: 685833 - RNA, 19 nt, Homo sapiens
ccaaagugaccgagaaugu

SEQ ID NO: 685834 - RNA, 19 nt, Homo sapiens
gaauugauccaaguccauu

SEQ ID NO: 685835 - RNA, 19 nt, Homo sapiens
gaguugagcagcuuugaug

SEQ ID NO: 685836 - RNA, 19 nt, Homo sapiens
caacuguguggacuguuua

SEQ ID NO: 685837 - RNA, 19 nt, Homo sapiens
gaacgaagauucaagauug

SEQ ID NO: 685838 - RNA, 19 nt, Homo sapiens
agaaguaucucguaucaua

SEQ ID NO: 685839 - RNA, 19 nt, Homo sapiens
gaagaaguaucucguauca

SEQ ID NO: 685840 - RNA, 19 nt, Homo sapiens
gaucacaguuaaucuagua

SEQ ID NO: 685841 - RNA, 19 nt, Homo sapiens
gaaaacaacuucuauguga

SEQ ID NO: 685842 - RNA, 19 nt, Homo sapiens
caacagaaauauggagaua

SEQ ID NO: 685843 - RNA, 19 nt, Homo sapiens
gcaagaguguaauaacuuu

SEQ ID NO: 685844 - RNA, 19 nt, Homo sapiens
gugaagcacuguacuuaua

SEQ ID NO: 685845 - RNA, 19 nt, Homo sapiens
gagagauaguggauaaaua

SEQ ID NO: 685846 - RNA, 19 nt, Homo sapiens
cgacugagaucugaugaua

SEQ ID NO: 685847 - RNA, 19 nt, Homo sapiens
caagaaagcauaaggguaa

SEQ ID NO: 685848 - RNA, 19 nt, Homo sapiens
ggaagagguucaagaauuc

SEQ ID NO: 685849 - RNA, 19 nt, Homo sapiens
aaacugugcuucucaauga

SEQ ID NO: 685850 - RNA, 19 nt, Homo sapiens
ugagagagauaguggauaa

SEQ ID NO: 685851 - RNA, 19 nt, Homo sapiens
guacuuauauggaguuaug

SEQ ID NO: 685852 - RNA, 19 nt, Homo sapiens
gaucagaaccauuaacauu

SEQ ID NO: 685853 - RNA, 19 nt, Homo sapiens
ugacugagcuugcugaugu

SEQ ID NO: 685854 - RNA, 19 nt, Homo sapiens
caaagaagauaacacacuu

SEQ ID NO: 685855 - RNA, 19 nt, Homo sapiens
ggaugagucuguaacguuu

SEQ ID NO: 685856 - RNA, 19 nt, Homo sapiens
ucaaagagauguucaagca

SEQ ID NO: 685857 - RNA, 19 nt, Homo sapiens
gaagauaccugaaauuccu

SEQ ID NO: 685858 - RNA, 19 nt, Homo sapiens
acaaagcgcuuacccuauu

SEQ ID NO: 685859 - RNA, 19 nt, Homo sapiens
gagcugaucaacagaaaua

SEQ ID NO: 685860 - RNA, 19 nt, Homo sapiens
aaagagauguucaagcaaa

SEQ ID NO: 685861 - RNA, 19 nt, Homo sapiens
gcugacagguucuuuaaug

SEQ ID NO: 685862 - RNA, 19 nt, Homo sapiens
uggaagagguucaagaauu

SEQ ID NO: 685863 - RNA, 19 nt, Homo sapiens
guacgugauucucuacuuu

SEQ ID NO: 685864 - RNA, 19 nt, Homo sapiens
agaggaugcugguuucuua

SEQ ID NO: 685865 - RNA, 19 nt, Homo sapiens
guacuauucuggagaguug

SEQ ID NO: 685866 - RNA, 19 nt, Homo sapiens
uuacagaauuuccucagua

SEQ ID NO: 685867 - RNA, 19 nt, Homo sapiens
ggaauccaaucugcaagua

SEQ ID NO: 685868 - RNA, 19 nt, Homo sapiens
caauaaggcucuccuagca

SEQ ID NO: 685869 - RNA, 19 nt, Homo sapiens
gcacagcccuggcaaacca

SEQ ID NO: 685870 - RNA, 19 nt, Homo sapiens
gcaaguaugucaguuucuu

SEQ ID NO: 685871 - RNA, 19 nt, Homo sapiens
agacagagcugaucaacag

SEQ ID NO: 685872 - RNA, 19 nt, Homo sapiens
gagagugccuaucaacgaa

SEQ ID NO: 685873 - RNA, 19 nt, Homo sapiens
gagcaagaguguaauaacu

SEQ ID NO: 685874 - RNA, 19 nt, Homo sapiens
ugaaauuccugcagauguu

SEQ ID NO: 685875 - RNA, 19 nt, Homo sapiens
ucacauccaucaugcaaga

SEQ ID NO: 685876 - RNA, 19 nt, Homo sapiens
gauacaagcuuuggaagag

SEQ ID NO: 685877 - RNA, 19 nt, Homo sapiens
acugagaucugaugauauu

SEQ ID NO: 685878 - RNA, 19 nt, Homo sapiens
gagagaggaugcugguuuc

SEQ ID NO: 685879 - RNA, 19 nt, Homo sapiens
caacgaauccuucaucagu

SEQ ID NO: 685880 - RNA, 19 nt, Homo sapiens
guuggauacugcacaauuu

SEQ ID NO: 685881 - RNA, 19 nt, Homo sapiens
gaacaggcaagcagauaug

SEQ ID NO: 685882 - RNA, 19 nt, Homo sapiens
gcuacaggauuuagaugaa

SEQ ID NO: 685883 - RNA, 19 nt, Homo sapiens
caaagcgcuuacccuauuu

SEQ ID NO: 685884 - RNA, 19 nt, Homo sapiens
acucagagcuaccuuccua

SEQ ID NO: 685885 - RNA, 19 nt, Homo sapiens
cgagagcuauuuccagaga

SEQ ID NO: 685886 - RNA, 19 nt, Homo sapiens
cagcaaaccuuagaaacug

SEQ ID NO: 685887 - RNA, 19 nt, Homo sapiens
gauaaaagcagaacacauu

SEQ ID NO: 685888 - RNA, 19 nt, Homo sapiens
caccugguuucaucuaaua

SEQ ID NO: 685889 - RNA, 19 nt, Homo sapiens
uagaccagcugaacacuug

SEQ ID NO: 685890 - RNA, 19 nt, Homo sapiens
caacauuuauggucugaag

SEQ ID NO: 685891 - RNA, 19 nt, Homo sapiens
gaagauggaauaaggaaag

SEQ ID NO: 685892 - RNA, 19 nt, Homo sapiens
ggcaguugauugacaguuu

SEQ ID NO: 685893 - RNA, 19 nt, Homo sapiens
ggucauuggucgacugaga

SEQ ID NO: 685894 - RNA, 19 nt, Homo sapiens
gaagcacuguacuuauaug

SEQ ID NO: 685895 - RNA, 19 nt, Homo sapiens
agccagagcuacaggauuu

SEQ ID NO: 685896 - RNA, 19 nt, Homo sapiens
ugagcuugcugaugucuuu

SEQ ID NO: 685897 - RNA, 19 nt, Homo sapiens
gaucuucugcugauucaaa

SEQ ID NO: 685898 - RNA, 19 nt, Homo sapiens
gaaguaucucguaucauaa

SEQ ID NO: 685899 - RNA, 19 nt, Homo sapiens
gcuggaagauggaauaagg

SEQ ID NO: 685900 - RNA, 19 nt, Homo sapiens
gagggacuaugcucagcua

SEQ ID NO: 685901 - RNA, 19 nt, Homo sapiens
gaguugguauccuauguga

SEQ ID NO: 685902 - RNA, 19 nt, Homo sapiens
gagaguugguauccuaugu

SEQ ID NO: 685903 - RNA, 19 nt, Homo sapiens
ucucuuaaaugcugaaugu

SEQ ID NO: 685904 - RNA, 19 nt, Homo sapiens
ggagaugguucuggacaau

SEQ ID NO: 685905 - RNA, 19 nt, Homo sapiens
ggaugcugguuucuuacua

SEQ ID NO: 685906 - RNA, 19 nt, Homo sapiens
gaaacugugcuucucaaug

SEQ ID NO: 685907 - RNA, 19 nt, Homo sapiens
ucccaaagcuucugaacug

SEQ ID NO: 685908 - RNA, 19 nt, Homo sapiens
gagaacaggcaagcagaua

SEQ ID NO: 685909 - RNA, 19 nt, Homo sapiens
gccagaagauaccugaaau

SEQ ID NO: 685910 - RNA, 19 nt, Homo sapiens
ggauaaauacuuuccagau

SEQ ID NO: 685911 - RNA, 19 nt, Homo sapiens
caagcuuacucaugcuauu

SEQ ID NO: 685912 - RNA, 19 nt, Homo sapiens
gcaguugauugacaguuuc

SEQ ID NO: 685913 - RNA, 19 nt, Homo sapiens
caacaaacgccuucgucaa

SEQ ID NO: 685914 - RNA, 19 nt, Homo sapiens
uagaaauugugaccagauu

SEQ ID NO: 685915 - RNA, 19 nt, Homo sapiens
cugaacacuugguaugaua

SEQ ID NO: 685916 - RNA, 19 nt, Homo sapiens
caagccaagugaauugaug

SEQ ID NO: 685917 - RNA, 19 nt, Homo sapiens
ccaacuaucccgagagcua

SEQ ID NO: 685918 - RNA, 19 nt, Homo sapiens
cagcugcucuggagaaucu

SEQ ID NO: 685919 - RNA, 19 nt, Homo sapiens
cuucugugcuuuaugauug

SEQ ID NO: 685920 - RNA, 19 nt, Homo sapiens
uaagaacgaagauucaaga

SEQ ID NO: 685921 - RNA, 19 nt, Homo sapiens
gauacgagguugccaagcu

SEQ ID NO: 685922 - RNA, 19 nt, Homo sapiens
cgaaguacagguuauucua

SEQ ID NO: 685923 - RNA, 19 nt, Homo sapiens
gggaaccuuuggucuaaau

SEQ ID NO: 685924 - RNA, 19 nt, Homo sapiens
guucggagcggaugacuga

SEQ ID NO: 685925 - RNA, 19 nt, Homo sapiens
caagugcagcaauuucuaa

SEQ ID NO: 685926 - RNA, 19 nt, Homo sapiens
gaaguacagguuauucuag

SEQ ID NO: 685927 - RNA, 19 nt, Homo sapiens
gguccagaauuaugggaaa

SEQ ID NO: 685928 - RNA, 19 nt, Homo sapiens
aaaguauugucgcaaauuc

SEQ ID NO: 685929 - RNA, 19 nt, Homo sapiens
gcagccgccucuucucaga

SEQ ID NO: 685930 - RNA, 19 nt, Homo sapiens
uuuauggucugaagauuug

SEQ ID NO: 685931 - RNA, 19 nt, Homo sapiens
gagaucugaugauauuuac

SEQ ID NO: 685932 - RNA, 19 nt, Homo sapiens
uaucucauggcauuaguua

SEQ ID NO: 685933 - RNA, 19 nt, Homo sapiens
gaauuuccucaguauguuu

SEQ ID NO: 685934 - RNA, 19 nt, Homo sapiens
gcacaccugguuucaucua

SEQ ID NO: 685935 - RNA, 19 nt, Homo sapiens
cugagagacugcaauguug

SEQ ID NO: 685936 - RNA, 19 nt, Homo sapiens
gaaggagaagucagagaga

SEQ ID NO: 685937 - RNA, 19 nt, Homo sapiens
gaacaacacuggccacuuu

SEQ ID NO: 685938 - RNA, 19 nt, Homo sapiens
gaacagagauccacacaga

SEQ ID NO: 685939 - RNA, 19 nt, Homo sapiens
gcagauaucucagggcuaa

SEQ ID NO: 685940 - RNA, 19 nt, Homo sapiens
gaugauaacuauggcaaua

SEQ ID NO: 685941 - RNA, 19 nt, Homo sapiens
gaaaugaguugguggauac

SEQ ID NO: 685942 - RNA, 19 nt, Homo sapiens
ggaaaugaguugguggaua

SEQ ID NO: 685943 - RNA, 19 nt, Homo sapiens
gaaucauccucuacaauuu

SEQ ID NO: 685944 - RNA, 19 nt, Homo sapiens
gcaguauucuaccuuguaa

SEQ ID NO: 685945 - RNA, 19 nt, Homo sapiens
gaaaggauuuggugauguc

SEQ ID NO: 685946 - RNA, 19 nt, Homo sapiens
caauggagaugucaacaga

SEQ ID NO: 685947 - RNA, 19 nt, Homo sapiens
ggaaugaagaucuuucuga

SEQ ID NO: 685948 - RNA, 19 nt, Homo sapiens
caucuacaauggagaauga

SEQ ID NO: 685949 - RNA, 19 nt, Homo sapiens
gaauugaccuugcuguucu

SEQ ID NO: 685950 - RNA, 19 nt, Homo sapiens
gacccugucuuacccauuu

SEQ ID NO: 685951 - RNA, 19 nt, Homo sapiens
gaagacaccaucuacaaug

SEQ ID NO: 685952 - RNA, 19 nt, Homo sapiens
gaucuucacugccucuaau

SEQ ID NO: 685953 - RNA, 19 nt, Homo sapiens
gcaagaaccaggaugaaug

SEQ ID NO: 685954 - RNA, 19 nt, Homo sapiens
ugacaucggugggcacuaa

SEQ ID NO: 685955 - RNA, 19 nt, Homo sapiens
ccauaaugaugcugacuuu

SEQ ID NO: 685956 - RNA, 19 nt, Homo sapiens
gcucugcagugaaaucuga

SEQ ID NO: 685957 - RNA, 19 nt, Homo sapiens
ccucuacaauuucaucuaa

SEQ ID NO: 685958 - RNA, 19 nt, Homo sapiens
gcuaaaggcggcaguacua

SEQ ID NO: 685959 - RNA, 19 nt, Homo sapiens
caacacagcagcacguuau

SEQ ID NO: 685960 - RNA, 19 nt, Homo sapiens
gugaggagauuccaaauac

SEQ ID NO: 685961 - RNA, 19 nt, Homo sapiens
gaggagauuccaaauacua

SEQ ID NO: 685962 - RNA, 19 nt, Homo sapiens
ggucagagccuguccuuuc

SEQ ID NO: 685963 - RNA, 19 nt, Homo sapiens
gcacacaccugcuguugcu

SEQ ID NO: 685964 - RNA, 19 nt, Homo sapiens
ccacagaugucgccuggau

SEQ ID NO: 685965 - RNA, 19 nt, Homo sapiens
gaaggugaaacaauugauu

SEQ ID NO: 685966 - RNA, 19 nt, Homo sapiens
caaauuagacuugcacaga

SEQ ID NO: 685967 - RNA, 19 nt, Homo sapiens
gcaaagaauggcuucaguu

SEQ ID NO: 685968 - RNA, 19 nt, Homo sapiens
ugaaucauccucuacaauu

SEQ ID NO: 685969 - RNA, 19 nt, Homo sapiens
ggaaaggauuuggugaugu

SEQ ID NO: 685970 - RNA, 19 nt, Homo sapiens
gggaaaggauuuggugaug

SEQ ID NO: 685971 - RNA, 19 nt, Homo sapiens
ggacugaagauuggaauga

SEQ ID NO: 685972 - RNA, 19 nt, Homo sapiens
aggagaaggugaaacaauu

SEQ ID NO: 685973 - RNA, 19 nt, Homo sapiens
gcagaacaaauuagacuug

SEQ ID NO: 685974 - RNA, 19 nt, Homo sapiens
gaauacccuuucaucauca

SEQ ID NO: 685975 - RNA, 19 nt, Homo sapiens
gcucagggcccucuuuaug

SEQ ID NO: 685976 - RNA, 19 nt, Homo sapiens
uaacccagcugauuaugca

SEQ ID NO: 685977 - RNA, 19 nt, Homo sapiens
agaauacccuuucaucauc

SEQ ID NO: 685978 - RNA, 19 nt, Homo sapiens
gcagaauacccuuucauca

SEQ ID NO: 685979 - RNA, 19 nt, Homo sapiens
gaagaacccaagugauuca

SEQ ID NO: 685980 - RNA, 19 nt, Homo sapiens
ccucugguguucaguaauu

SEQ ID NO: 685981 - RNA, 19 nt, Homo sapiens
ggcaauacguggaacaaca

SEQ ID NO: 685982 - RNA, 19 nt, Homo sapiens
ggcaauagcagcggcaaua

SEQ ID NO: 685983 - RNA, 19 nt, Homo sapiens
ucagggcccucuuuaugaa

SEQ ID NO: 685984 - RNA, 19 nt, Homo sapiens
ccaaguagccuguauacca

SEQ ID NO: 685985 - RNA, 19 nt, Homo sapiens
ggaagacaccaucuacaau

SEQ ID NO: 685986 - RNA, 19 nt, Homo sapiens
gggaagacaccaucuacaa

SEQ ID NO: 685987 - RNA, 19 nt, Homo sapiens
acaccagccugccauacua

SEQ ID NO: 685988 - RNA, 19 nt, Homo sapiens
gcuacaggcucugcaguga

SEQ ID NO: 685989 - RNA, 19 nt, Homo sapiens
gaagaagaagggagucuca

SEQ ID NO: 685990 - RNA, 19 nt, Homo sapiens
guauaaauuugcacugaag

SEQ ID NO: 685991 - RNA, 19 nt, Homo sapiens
caaagaauggcuucaguuc

SEQ ID NO: 685992 - RNA, 19 nt, Homo sapiens
ggagaaggugaaacaauug

SEQ ID NO: 685993 - RNA, 19 nt, Homo sapiens
gcagaugcuucagacaaga

SEQ ID NO: 685994 - RNA, 19 nt, Homo sapiens
gagccuguccuuucugauu

SEQ ID NO: 685995 - RNA, 19 nt, Homo sapiens
ggaacaaccucaaaaccaa

SEQ ID NO: 685996 - RNA, 19 nt, Homo sapiens
cagacaagauuuccauugg

SEQ ID NO: 685997 - RNA, 19 nt, Homo sapiens
gaaacgguaucugcagcuu

SEQ ID NO: 685998 - RNA, 19 nt, Homo sapiens
ggagaugucaacagagcua

SEQ ID NO: 685999 - RNA, 19 nt, Homo sapiens
guaugggccugcuguguuc

SEQ ID NO: 686000 - RNA, 19 nt, Homo sapiens
cgccacaaguauaugguua

SEQ ID NO: 686001 - RNA, 19 nt, Homo sapiens
ggcagcaacuccacuguca

SEQ ID NO: 686002 - RNA, 19 nt, Homo sapiens
uacaggcucugcagugaaa

SEQ ID NO: 686003 - RNA, 19 nt, Homo sapiens
ugacuuaaacucccaccua

SEQ ID NO: 686004 - RNA, 19 nt, Homo sapiens
ccaauacugaugauaacua

SEQ ID NO: 686005 - RNA, 19 nt, Homo sapiens
cagccaauacugaugauaa

SEQ ID NO: 686006 - RNA, 19 nt, Homo sapiens
cagaugauuucggaccaua

SEQ ID NO: 686007 - RNA, 19 nt, Homo sapiens
guguauaaauuugcacuga

SEQ ID NO: 686008 - RNA, 19 nt, Homo sapiens
ccacaaguauaugguuaug

SEQ ID NO: 686009 - RNA, 19 nt, Homo sapiens
acucgaagcucaguugcua

SEQ ID NO: 686010 - RNA, 19 nt, Homo sapiens
uaucaauguucuucuggaa

SEQ ID NO: 686011 - RNA, 19 nt, Homo sapiens
cagaauacccuuucaucau

SEQ ID NO: 686012 - RNA, 19 nt, Homo sapiens
gacugaagauuggaaugaa

SEQ ID NO: 686013 - RNA, 19 nt, Homo sapiens
gagaaggugaaacaauuga

SEQ ID NO: 686014 - RNA, 19 nt, Homo sapiens
aaauuagacuugcacagau

SEQ ID NO: 686015 - RNA, 19 nt, Homo sapiens
caaccaaucagcauucauc

SEQ ID NO: 686016 - RNA, 19 nt, Homo sapiens
gaugucgccuggaucuuca

SEQ ID NO: 686017 - RNA, 19 nt, Homo sapiens
gauaggcgcaguauucuac

SEQ ID NO: 686018 - RNA, 19 nt, Homo sapiens
ugaugucggugaagcuaaa

SEQ ID NO: 686019 - RNA, 19 nt, Homo sapiens
gagaauugaccuugcuguu

SEQ ID NO: 686020 - RNA, 19 nt, Homo sapiens
gagauggucgggaagaaga

SEQ ID NO: 686021 - RNA, 19 nt, Homo sapiens
caagaaccaggaugaaugu

SEQ ID NO: 686022 - RNA, 19 nt, Homo sapiens
gaggagaaggugaaacaau

SEQ ID NO: 686023 - RNA, 19 nt, Homo sapiens
caagcagcauggugugaau

SEQ ID NO: 686024 - RNA, 19 nt, Homo sapiens
ugauggagguguuccuuca

SEQ ID NO: 686025 - RNA, 19 nt, Homo sapiens
uugaagaacccaagugauu

SEQ ID NO: 686026 - RNA, 19 nt, Homo sapiens
caggaugaaugugugauug

SEQ ID NO: 686027 - RNA, 19 nt, Homo sapiens
gauacaacacuggaagaaa

SEQ ID NO: 686028 - RNA, 19 nt, Homo sapiens
gcagcagaauacccuuuca

SEQ ID NO: 686029 - RNA, 19 nt, Homo sapiens
gguaucugcagcuuccuua

SEQ ID NO: 686030 - RNA, 19 nt, Homo sapiens
ggcaaagaauggcuucagu

SEQ ID NO: 686031 - RNA, 19 nt, Homo sapiens
agccuguccuuucugauua

SEQ ID NO: 686032 - RNA, 19 nt, Homo sapiens
ccucuaaugugucuucagu

SEQ ID NO: 686033 - RNA, 19 nt, Homo sapiens
ggauacaacacuggaagaa

SEQ ID NO: 686034 - RNA, 19 nt, Homo sapiens
caaauacuaccaccacaca

SEQ ID NO: 686035 - RNA, 19 nt, Homo sapiens
gagccacagugaggagauu

SEQ ID NO: 686036 - RNA, 19 nt, Homo sapiens
cacacaaucuguugaaggu

SEQ ID NO: 686037 - RNA, 19 nt, Homo sapiens
gauaaugacuuccugauuu

SEQ ID NO: 686038 - RNA, 19 nt, Homo sapiens
gaaaugaggucugaucaaa

SEQ ID NO: 686039 - RNA, 19 nt, Homo sapiens
gaagacauauugacucuga

SEQ ID NO: 686040 - RNA, 19 nt, Homo sapiens
ucacagagcugcguguuua

SEQ ID NO: 686041 - RNA, 19 nt, Homo sapiens
gaagucacaugaacauauu

SEQ ID NO: 686042 - RNA, 19 nt, Homo sapiens
ggacaucuuucuguaauuu

SEQ ID NO: 686043 - RNA, 19 nt, Homo sapiens
ggaaacuugugaaugauaa

SEQ ID NO: 686044 - RNA, 19 nt, Homo sapiens
caacugguaucugcaaaua

SEQ ID NO: 686045 - RNA, 19 nt, Homo sapiens
gagaaaguguucacgguuu

SEQ ID NO: 686046 - RNA, 19 nt, Homo sapiens
gagccugcauuucuaguua

SEQ ID NO: 686047 - RNA, 19 nt, Homo sapiens
gacguaacaucaacagaua

SEQ ID NO: 686048 - RNA, 19 nt, Homo sapiens
acaaguaucaggacaauua

SEQ ID NO: 686049 - RNA, 19 nt, Homo sapiens
ggaauuagagggucagaaa

SEQ ID NO: 686050 - RNA, 19 nt, Homo sapiens
gccaagcucugcagacuuu

SEQ ID NO: 686051 - RNA, 19 nt, Homo sapiens
ggagcaagcauuucucuaa

SEQ ID NO: 686052 - RNA, 19 nt, Homo sapiens
gaugaagccuggaugauuc

SEQ ID NO: 686053 - RNA, 19 nt, Homo sapiens
ggaugaggcuuuccuuugu

SEQ ID NO: 686054 - RNA, 19 nt, Homo sapiens
ccacaguucuuccaaaugu

SEQ ID NO: 686055 - RNA, 19 nt, Homo sapiens
gaagauugggcuugaagua

SEQ ID NO: 686056 - RNA, 19 nt, Homo sapiens
ccaagcaaauggaugaauu

SEQ ID NO: 686057 - RNA, 19 nt, Homo sapiens
guaccgggcuacuucuuaa

SEQ ID NO: 686058 - RNA, 19 nt, Homo sapiens
gaauggaugacuacaagua

SEQ ID NO: 686059 - RNA, 19 nt, Homo sapiens
caaaucaacuuggcuggaa

SEQ ID NO: 686060 - RNA, 19 nt, Homo sapiens
ggaaugcucuggaugugau

SEQ ID NO: 686061 - RNA, 19 nt, Homo sapiens
ggagcaagauaaugacuuc

SEQ ID NO: 686062 - RNA, 19 nt, Homo sapiens
ucacucaggucuuuguaaa

SEQ ID NO: 686063 - RNA, 19 nt, Homo sapiens
gaaacggaaugggauaguu

SEQ ID NO: 686064 - RNA, 19 nt, Homo sapiens
gagaagacauauugacucu

SEQ ID NO: 686065 - RNA, 19 nt, Homo sapiens
caugagaaaucuaugcuau

SEQ ID NO: 686066 - RNA, 19 nt, Homo sapiens
caacagauaccuacuucaa

SEQ ID NO: 686067 - RNA, 19 nt, Homo sapiens
gaacaucagccugcaagaa

SEQ ID NO: 686068 - RNA, 19 nt, Homo sapiens
gaaauagcccaaaccucua

SEQ ID NO: 686069 - RNA, 19 nt, Homo sapiens
gggagaacuugguguuuga

SEQ ID NO: 686070 - RNA, 19 nt, Homo sapiens
agauugggcuugaaguaua

SEQ ID NO: 686071 - RNA, 19 nt, Homo sapiens
gcaagaaucaaacaacaug

SEQ ID NO: 686072 - RNA, 19 nt, Homo sapiens
ugaaaugcauccacacuuc

SEQ ID NO: 686073 - RNA, 19 nt, Homo sapiens
ucacaguucuugaugaugu

SEQ ID NO: 686074 - RNA, 19 nt, Homo sapiens
ccugauuccuccaaauaua

SEQ ID NO: 686075 - RNA, 19 nt, Homo sapiens
cagaaugaauacacugauu

SEQ ID NO: 686076 - RNA, 19 nt, Homo sapiens
ugaaaggcucgauguaaua

SEQ ID NO: 686077 - RNA, 19 nt, Homo sapiens
ugagaaaucuaugcuaugu

SEQ ID NO: 686078 - RNA, 19 nt, Homo sapiens
gcaagcauuucucuaaguc

SEQ ID NO: 686079 - RNA, 19 nt, Homo sapiens
ggaaacaccaucuuugcuu

SEQ ID NO: 686080 - RNA, 19 nt, Homo sapiens
ucaagcaggucugggauaa

SEQ ID NO: 686081 - RNA, 19 nt, Homo sapiens
ggaguacuaacauuuauug

SEQ ID NO: 686082 - RNA, 19 nt, Homo sapiens
gcaagaacuaguuguuuga

SEQ ID NO: 686083 - RNA, 19 nt, Homo sapiens
agaaaucuaugcuaugugu

SEQ ID NO: 686084 - RNA, 19 nt, Homo sapiens
gaggaugaauuaacaaacu

SEQ ID NO: 686085 - RNA, 19 nt, Homo sapiens
gcucauggauagaauugga

SEQ ID NO: 686086 - RNA, 19 nt, Homo sapiens
gaugaagaauacaagucua

SEQ ID NO: 686087 - RNA, 19 nt, Homo sapiens
agaucucacuucugcauua

SEQ ID NO: 686088 - RNA, 19 nt, Homo sapiens
aaugaggucugaucaaaug

SEQ ID NO: 686089 - RNA, 19 nt, Homo sapiens
ggaaguuagagucauuaua

SEQ ID NO: 686090 - RNA, 19 nt, Homo sapiens
ccacagagcgagggauaua

SEQ ID NO: 686091 - RNA, 19 nt, Homo sapiens
ucauugagauccaaaguuc

SEQ ID NO: 686092 - RNA, 19 nt, Homo sapiens
uguaguggaugccaaauau

SEQ ID NO: 686093 - RNA, 19 nt, Homo sapiens
aaacggaaugggauaguua

SEQ ID NO: 686094 - RNA, 19 nt, Homo sapiens
gagcaagcauuucucuaag

SEQ ID NO: 686095 - RNA, 19 nt, Homo sapiens
acaguuugguuuccugaua

SEQ ID NO: 686096 - RNA, 19 nt, Homo sapiens
agaagaagaugcacagagu

SEQ ID NO: 686097 - RNA, 19 nt, Homo sapiens
gaugaggcuuuccuuuguu

SEQ ID NO: 686098 - RNA, 19 nt, Homo sapiens
gaaaggcucgauguaauau

SEQ ID NO: 686099 - RNA, 19 nt, Homo sapiens
ugggauaguuauucuguaa

SEQ ID NO: 686100 - RNA, 19 nt, Homo sapiens
gggcuugaaguauauauuu

SEQ ID NO: 686101 - RNA, 19 nt, Homo sapiens
gcuggaaguuagagucauu

SEQ ID NO: 686102 - RNA, 19 nt, Homo sapiens
caacaugggaaacuuguga

SEQ ID NO: 686103 - RNA, 19 nt, Homo sapiens
ccagagagcccaagguuuc

SEQ ID NO: 686104 - RNA, 19 nt, Homo sapiens
cgaaggccaugaugaggaa

SEQ ID NO: 686105 - RNA, 19 nt, Homo sapiens
gaggucugaucaaaugaaa

SEQ ID NO: 686106 - RNA, 19 nt, Homo sapiens
ugaauacaguggcuagguu

SEQ ID NO: 686107 - RNA, 19 nt, Homo sapiens
acugguaucugcaaauauu

SEQ ID NO: 686108 - RNA, 19 nt, Homo sapiens
cccaacaacuuaacaaauc

SEQ ID NO: 686109 - RNA, 19 nt, Homo sapiens
gcaacagccuucggcauuc

SEQ ID NO: 686110 - RNA, 19 nt, Homo sapiens
gaaggagggcugccacaug

SEQ ID NO: 686111 - RNA, 19 nt, Homo sapiens
gauaaguucacaagaaugu

SEQ ID NO: 686112 - RNA, 19 nt, Homo sapiens
cugagaggcuggaagauga

SEQ ID NO: 686113 - RNA, 19 nt, Homo sapiens
cauaguagcauugaggaua

SEQ ID NO: 686114 - RNA, 19 nt, Homo sapiens
ccaacaacuuaacaaauca

SEQ ID NO: 686115 - RNA, 19 nt, Homo sapiens
aaggaaaggucgagagaau

SEQ ID NO: 686116 - RNA, 19 nt, Homo sapiens
ggaaggcucaagaugauug

SEQ ID NO: 686117 - RNA, 19 nt, Homo sapiens
gggaugaggcuuuccuuug

SEQ ID NO: 686118 - RNA, 19 nt, Homo sapiens
ucuagaaagccaaguauuu

SEQ ID NO: 686119 - RNA, 19 nt, Homo sapiens
ugggaggccuggcugauaa

SEQ ID NO: 686120 - RNA, 19 nt, Homo sapiens
gaagaugcacagagugaug

SEQ ID NO: 686121 - RNA, 19 nt, Homo sapiens
cgucacuccugcugagaua

SEQ ID NO: 686122 - RNA, 19 nt, Homo sapiens
aggauacucugaucuagaa

SEQ ID NO: 686123 - RNA, 19 nt, Homo sapiens
gauugggcuugaaguauau

SEQ ID NO: 686124 - RNA, 19 nt, Homo sapiens
ccacuucagcugucaauau

SEQ ID NO: 686125 - RNA, 19 nt, Homo sapiens
uaacaucaacagauaccua

SEQ ID NO: 686126 - RNA, 19 nt, Homo sapiens
ccaauuaccacuuccauag

SEQ ID NO: 686127 - RNA, 19 nt, Homo sapiens
gcuuggaaauaguugcuuu

SEQ ID NO: 686128 - RNA, 19 nt, Homo sapiens
uuacagccauuuaacuuuc

SEQ ID NO: 686129 - RNA, 19 nt, Homo sapiens
ggucugaucaaaugaaaug

SEQ ID NO: 686130 - RNA, 19 nt, Homo sapiens
ggaaaugaggucugaucaa

SEQ ID NO: 686131 - RNA, 19 nt, Homo sapiens
ugagcaacaucuauagaga

SEQ ID NO: 686132 - RNA, 19 nt, Homo sapiens
ugauuuaccucgucagcuu

SEQ ID NO: 686133 - RNA, 19 nt, Homo sapiens
gggaaacuugugaaugaua

SEQ ID NO: 686134 - RNA, 19 nt, Homo sapiens
caagguuucugcuagagau

SEQ ID NO: 686135 - RNA, 19 nt, Homo sapiens
ccaagagacucccgauguc

SEQ ID NO: 686136 - RNA, 19 nt, Homo sapiens
acagaugacuugugaaacu

SEQ ID NO: 686137 - RNA, 19 nt, Homo sapiens
ggacgaauauucccgaaga

SEQ ID NO: 686138 - RNA, 19 nt, Homo sapiens
ggucaaagcuccucuccuu

SEQ ID NO: 686139 - RNA, 19 nt, Homo sapiens
gagaagaacuggcccaaca

SEQ ID NO: 686140 - RNA, 19 nt, Homo sapiens
ggaaugcgcuggacguguu

SEQ ID NO: 686141 - RNA, 19 nt, Homo sapiens
ccaaagacauugcuaagga

SEQ ID NO: 686142 - RNA, 19 nt, Homo sapiens
acacugaccuguucgagua

SEQ ID NO: 686143 - RNA, 19 nt, Homo sapiens
gagcgaguguucucaguaa

SEQ ID NO: 686144 - RNA, 19 nt, Homo sapiens
guacauuccugcacaacaa

SEQ ID NO: 686145 - RNA, 19 nt, Homo sapiens
gaaggugccuacaugguau

SEQ ID NO: 686146 - RNA, 19 nt, Homo sapiens
gaggaugaauugauugaga

SEQ ID NO: 686147 - RNA, 19 nt, Homo sapiens
gcacauucaucaacacugu

SEQ ID NO: 686148 - RNA, 19 nt, Homo sapiens
ccacagguaugcaauuaug

SEQ ID NO: 686149 - RNA, 19 nt, Homo sapiens
gugaacagccgucugauaa

SEQ ID NO: 686150 - RNA, 19 nt, Homo sapiens
ccacuuuccucucaauuug

SEQ ID NO: 686151 - RNA, 19 nt, Homo sapiens
gggcgaaggugccuacaug

SEQ ID NO: 686152 - RNA, 19 nt, Homo sapiens
gaacagccgucugauaaac

SEQ ID NO: 686153 - RNA, 19 nt, Homo sapiens
ucaggaggaugaauugauu

SEQ ID NO: 686154 - RNA, 19 nt, Homo sapiens
caaagacauugcuaaggaa

SEQ ID NO: 686155 - RNA, 19 nt, Homo sapiens
gcugugacguguuguaguu

SEQ ID NO: 686156 - RNA, 19 nt, Homo sapiens
ucacuauacuguccucaaa

SEQ ID NO: 686157 - RNA, 19 nt, Homo sapiens
gcguagagcauguaacuuu

SEQ ID NO: 686158 - RNA, 19 nt, Homo sapiens
gagaagggacccaggauga

SEQ ID NO: 686159 - RNA, 19 nt, Homo sapiens
ggaggaggaugaugaugau

SEQ ID NO: 686160 - RNA, 19 nt, Homo sapiens
ggaaacaaauccucaaaau

SEQ ID NO: 686161 - RNA, 19 nt, Homo sapiens
ggaauuuucucuccuguuu

SEQ ID NO: 686162 - RNA, 19 nt, Homo sapiens
gagaagacccagugaagug

SEQ ID NO: 686163 - RNA, 19 nt, Homo sapiens
ggacuagaagccucaguuu

SEQ ID NO: 686164 - RNA, 19 nt, Homo sapiens
acuauacuguccucaaaua

SEQ ID NO: 686165 - RNA, 19 nt, Homo sapiens
gaaagaacgagaagaacug

SEQ ID NO: 686166 - RNA, 19 nt, Homo sapiens
caacugaacuggguauagg

SEQ ID NO: 686167 - RNA, 19 nt, Homo sapiens
gugugaauguguauguaua

SEQ ID NO: 686168 - RNA, 19 nt, Homo sapiens
gcaaauaugaagccugaau

SEQ ID NO: 686169 - RNA, 19 nt, Homo sapiens
cgaaggugccuacauggua

SEQ ID NO: 686170 - RNA, 19 nt, Homo sapiens
gcauguaacuuuuaacuuc

SEQ ID NO: 686171 - RNA, 19 nt, Homo sapiens
ggaugaugaugaugacuuc

SEQ ID NO: 686172 - RNA, 19 nt, Homo sapiens
aaccacagguaugcaauua

SEQ ID NO: 686173 - RNA, 19 nt, Homo sapiens
gggcaguacuucaaugaca

SEQ ID NO: 686174 - RNA, 19 nt, Homo sapiens
ugacgaggaugaugagauc

SEQ ID NO: 686175 - RNA, 19 nt, Homo sapiens
ggugacuguuuaacucuuu

SEQ ID NO: 686176 - RNA, 19 nt, Homo sapiens
aaauauaagccaaggguaa

SEQ ID NO: 686177 - RNA, 19 nt, Homo sapiens
gcagcucucuggcccugaa

SEQ ID NO: 686178 - RNA, 19 nt, Homo sapiens
uuacggcacuuuccucuuc

SEQ ID NO: 686179 - RNA, 19 nt, Homo sapiens
gcacaacgacggaaagaac

SEQ ID NO: 686180 - RNA, 19 nt, Homo sapiens
gauaagagucccacagucu

SEQ ID NO: 686181 - RNA, 19 nt, Homo sapiens
caaauaugaagccugaauu

SEQ ID NO: 686182 - RNA, 19 nt, Homo sapiens
ugaagcagguccaugauac

SEQ ID NO: 686183 - RNA, 19 nt, Homo sapiens
caauagccucuguagguua

SEQ ID NO: 686184 - RNA, 19 nt, Homo sapiens
ggucaaaccagcagaucaa

SEQ ID NO: 686185 - RNA, 19 nt, Homo sapiens
gaacuggguauaggucaaa

SEQ ID NO: 686186 - RNA, 19 nt, Homo sapiens
ggaaagaacgagaagaacu

SEQ ID NO: 686187 - RNA, 19 nt, Homo sapiens
gcaggacugugugugaaug

SEQ ID NO: 686188 - RNA, 19 nt, Homo sapiens
ucaguaacccacauuaaga

SEQ ID NO: 686189 - RNA, 19 nt, Homo sapiens
cacaauagccucuguaggu

SEQ ID NO: 686190 - RNA, 19 nt, Homo sapiens
gaugauugguggcguguac

SEQ ID NO: 686191 - RNA, 19 nt, Homo sapiens
ggaaagaaaccaggcaucu

SEQ ID NO: 686192 - RNA, 19 nt, Homo sapiens
ucucacaucuccuguugga

SEQ ID NO: 686193 - RNA, 19 nt, Homo sapiens
ccacugcccuugacuuugc

SEQ ID NO: 686194 - RNA, 19 nt, Homo sapiens
gugccuacaugguauacuu

SEQ ID NO: 686195 - RNA, 19 nt, Homo sapiens
ccugaguuauccuggcuua

SEQ ID NO: 686196 - RNA, 19 nt, Homo sapiens
ugaagggccuggacagagu

SEQ ID NO: 686197 - RNA, 19 nt, Homo sapiens
acaauagccucuguagguu

SEQ ID NO: 686198 - RNA, 19 nt, Homo sapiens
gaaagaaaccaggcaucug

SEQ ID NO: 686199 - RNA, 19 nt, Homo sapiens
uaacccacauuaagacgau

SEQ ID NO: 686200 - RNA, 19 nt, Homo sapiens
gagaauggaaagcaugaug

SEQ ID NO: 686201 - RNA, 19 nt, Homo sapiens
gguggugacuguuuaacuc

SEQ ID NO: 686202 - RNA, 19 nt, Homo sapiens
cuguguggcugcuuucuuu

SEQ ID NO: 686203 - RNA, 19 nt, Homo sapiens
uaaucugguuucuguguug

SEQ ID NO: 686204 - RNA, 19 nt, Homo sapiens
ccucucacaucuccuguug

SEQ ID NO: 686205 - RNA, 19 nt, Homo sapiens
ggcgacccuuccugaguua

SEQ ID NO: 686206 - RNA, 19 nt, Homo sapiens
caacaugcgagccaaagga

SEQ ID NO: 686207 - RNA, 19 nt, Homo sapiens
ccauugucuucuccuauuu

SEQ ID NO: 686208 - RNA, 19 nt, Homo sapiens
ggcaguacuucaaugacaa

SEQ ID NO: 686209 - RNA, 19 nt, Homo sapiens
cccauugucuucuccuauu

SEQ ID NO: 686210 - RNA, 19 nt, Homo sapiens
aagcuccucuccuuccuuu

SEQ ID NO: 686211 - RNA, 19 nt, Homo sapiens
gacugugugugaaugugua

SEQ ID NO: 686212 - RNA, 19 nt, Homo sapiens
acaagaggaccacagcuuu

SEQ ID NO: 686213 - RNA, 19 nt, Homo sapiens
gacaagaggaccacagcuu

SEQ ID NO: 686214 - RNA, 19 nt, Homo sapiens
aggauucccuguuugaaga

SEQ ID NO: 686215 - RNA, 19 nt, Homo sapiens
cgccuuuccuucuguguuu

SEQ ID NO: 686216 - RNA, 19 nt, Homo sapiens
gggagagguugggcaguga

SEQ ID NO: 686217 - RNA, 19 nt, Homo sapiens
ucacauccuucgugggaau

SEQ ID NO: 686218 - RNA, 19 nt, Homo sapiens
ggccuccacuuuccucuca

SEQ ID NO: 686219 - RNA, 19 nt, Homo sapiens
gcucaagucaguguccuuu

SEQ ID NO: 686220 - RNA, 19 nt, Homo sapiens
cgaggaugaugagaucuau

SEQ ID NO: 686221 - RNA, 19 nt, Homo sapiens
ggaucagcaucuucacauc

SEQ ID NO: 686222 - RNA, 19 nt, Homo sapiens
uacaugguauacuuuguga

SEQ ID NO: 686223 - RNA, 19 nt, Homo sapiens
ggagaagacccagugaagu

SEQ ID NO: 686224 - RNA, 19 nt, Homo sapiens
uaucggcgcaucacucuga

SEQ ID NO: 686225 - RNA, 19 nt, Homo sapiens
ggaggaugaugaugaugac

SEQ ID NO: 686226 - RNA, 19 nt, Homo sapiens
gagguugggcagugaguga

SEQ ID NO: 686227 - RNA, 19 nt, Homo sapiens
gaaaccacagguaugcaau

SEQ ID NO: 686228 - RNA, 19 nt, Homo sapiens
cgucuucgccuucuucuca

SEQ ID NO: 686229 - RNA, 19 nt, Homo sapiens
cuuugaggauucccuguuu

SEQ ID NO: 686230 - RNA, 19 nt, Homo sapiens
uauaagccaaggguaauuu

SEQ ID NO: 686231 - RNA, 19 nt, Homo sapiens
gaccaacaacuccuuccuu

SEQ ID NO: 686232 - RNA, 19 nt, Homo sapiens
caacugcacauucaucaac

SEQ ID NO: 686233 - RNA, 19 nt, Homo sapiens
gggccaaagacauugcuaa

SEQ ID NO: 686234 - RNA, 19 nt, Homo sapiens
acauuaagacgauucauca

SEQ ID NO: 686235 - RNA, 19 nt, Homo sapiens
gaucguacucccgcuuuga

SEQ ID NO: 686236 - RNA, 19 nt, Homo sapiens
cuccuucccuccucaagaa

SEQ ID NO: 686237 - RNA, 19 nt, Homo sapiens
ggaaauggcugaugaguuc

SEQ ID NO: 686238 - RNA, 19 nt, Homo sapiens
gaccagagcugugugauua

SEQ ID NO: 686239 - RNA, 19 nt, Homo sapiens
gaaugaacccuucucuuua

SEQ ID NO: 686240 - RNA, 19 nt, Homo sapiens
ggaaaacacugaaucaaua

SEQ ID NO: 686241 - RNA, 19 nt, Homo sapiens
cagaguggcuggucuauuu

SEQ ID NO: 686242 - RNA, 19 nt, Homo sapiens
gcaauagguuugauucuga

SEQ ID NO: 686243 - RNA, 19 nt, Homo sapiens
gaacauuggcuuucucuuu

SEQ ID NO: 686244 - RNA, 19 nt, Homo sapiens
gcugaugaguucacauuua

SEQ ID NO: 686245 - RNA, 19 nt, Homo sapiens
ggagcuauccugugaaaua

SEQ ID NO: 686246 - RNA, 19 nt, Homo sapiens
gaagugagcaguggaauuu

SEQ ID NO: 686247 - RNA, 19 nt, Homo sapiens
uagaaaugcuguaggaaua

SEQ ID NO: 686248 - RNA, 19 nt, Homo sapiens
ugagauaccucuucgcuuu

SEQ ID NO: 686249 - RNA, 19 nt, Homo sapiens
gcaguaaccucaucaccaa

SEQ ID NO: 686250 - RNA, 19 nt, Homo sapiens
caacgcagcuauaagcaaa

SEQ ID NO: 686251 - RNA, 19 nt, Homo sapiens
ccagcaaguuguucauuua

SEQ ID NO: 686252 - RNA, 19 nt, Homo sapiens
guagguguguguauauaua

SEQ ID NO: 686253 - RNA, 19 nt, Homo sapiens
ccaaugagcucuacacagu

SEQ ID NO: 686254 - RNA, 19 nt, Homo sapiens
gaugagcuguuucuggaua

SEQ ID NO: 686255 - RNA, 19 nt, Homo sapiens
gcacggcucugcacgaguu

SEQ ID NO: 686256 - RNA, 19 nt, Homo sapiens
ugaagaagauugagaagau

SEQ ID NO: 686257 - RNA, 19 nt, Homo sapiens
gagcuauccugugaaauaa

SEQ ID NO: 686258 - RNA, 19 nt, Homo sapiens
gaaauguaguaaccuaguu

SEQ ID NO: 686259 - RNA, 19 nt, Homo sapiens
gaauaaaucugugguaacu

SEQ ID NO: 686260 - RNA, 19 nt, Homo sapiens
gcacgaauguggaggacuu

SEQ ID NO: 686261 - RNA, 19 nt, Homo sapiens
gagaagcaguucaauaagu

SEQ ID NO: 686262 - RNA, 19 nt, Homo sapiens
gaauaugaagcccaaauaa

SEQ ID NO: 686263 - RNA, 19 nt, Homo sapiens
ggaaugaaccagcaaguug

SEQ ID NO: 686264 - RNA, 19 nt, Homo sapiens
gaaaugcuguaggaauaaa

SEQ ID NO: 686265 - RNA, 19 nt, Homo sapiens
cagaacugcucaugcguua

SEQ ID NO: 686266 - RNA, 19 nt, Homo sapiens
uuaggagccuucugacuua

SEQ ID NO: 686267 - RNA, 19 nt, Homo sapiens
acacaagacuucugauuuc

SEQ ID NO: 686268 - RNA, 19 nt, Homo sapiens
gcacuuaggagccuucuga

SEQ ID NO: 686269 - RNA, 19 nt, Homo sapiens
gcaaggaggcuuugaguca

SEQ ID NO: 686270 - RNA, 19 nt, Homo sapiens
cuuaaaugcuggaaaguaa

SEQ ID NO: 686271 - RNA, 19 nt, Homo sapiens
gcaaauacuacauccauga

SEQ ID NO: 686272 - RNA, 19 nt, Homo sapiens
ugacuguucugcuccauaa

SEQ ID NO: 686273 - RNA, 19 nt, Homo sapiens
gaacauuuaguguagauga

SEQ ID NO: 686274 - RNA, 19 nt, Homo sapiens
caacuacccugacaagaag

SEQ ID NO: 686275 - RNA, 19 nt, Homo sapiens
gcugugggauucuaugaaa

SEQ ID NO: 686276 - RNA, 19 nt, Homo sapiens
gaccaaagacaauuaauuc

SEQ ID NO: 686277 - RNA, 19 nt, Homo sapiens
ggagggaccuaguuaaguc

SEQ ID NO: 686278 - RNA, 19 nt, Homo sapiens
uaaccgacguucagucuau

SEQ ID NO: 686279 - RNA, 19 nt, Homo sapiens
gggaagugguguuuaccua

SEQ ID NO: 686280 - RNA, 19 nt, Homo sapiens
guauaucgaugugugcaua

SEQ ID NO: 686281 - RNA, 19 nt, Homo sapiens
guauagccauaaacucuuu

SEQ ID NO: 686282 - RNA, 19 nt, Homo sapiens
gaagaagauugagaagaug

SEQ ID NO: 686283 - RNA, 19 nt, Homo sapiens
gaggagaagcaguucaaua

SEQ ID NO: 686284 - RNA, 19 nt, Homo sapiens
gaagagacacagggaaauu

SEQ ID NO: 686285 - RNA, 19 nt, Homo sapiens
acagaaagauauugccauu

SEQ ID NO: 686286 - RNA, 19 nt, Homo sapiens
gauaaauguugcccucuuc

SEQ ID NO: 686287 - RNA, 19 nt, Homo sapiens
gacacaagacuucugauuu

SEQ ID NO: 686288 - RNA, 19 nt, Homo sapiens
ggacacaagacuucugauu

SEQ ID NO: 686289 - RNA, 19 nt, Homo sapiens
gguguugccuagcugauuu

SEQ ID NO: 686290 - RNA, 19 nt, Homo sapiens
acagggaaauugagccaua

SEQ ID NO: 686291 - RNA, 19 nt, Homo sapiens
cauaguaacugcgaaugaa

SEQ ID NO: 686292 - RNA, 19 nt, Homo sapiens
cggagcacaucucggauua

SEQ ID NO: 686293 - RNA, 19 nt, Homo sapiens
ugacaaggccucuuccaaa

SEQ ID NO: 686294 - RNA, 19 nt, Homo sapiens
gauggugccugcugguuug

SEQ ID NO: 686295 - RNA, 19 nt, Homo sapiens
ggucaagccuuuugucuuu

SEQ ID NO: 686296 - RNA, 19 nt, Homo sapiens
ucaaccaccucucccagua

SEQ ID NO: 686297 - RNA, 19 nt, Homo sapiens
gaucugccuuauaaacauu

SEQ ID NO: 686298 - RNA, 19 nt, Homo sapiens
gaucucagguggaagucaa

SEQ ID NO: 686299 - RNA, 19 nt, Homo sapiens
gagaaacccagaaagaaga

SEQ ID NO: 686300 - RNA, 19 nt, Homo sapiens
acaaauaccuaacuguaca

SEQ ID NO: 686301 - RNA, 19 nt, Homo sapiens
ccuaguagauauaucaaug

SEQ ID NO: 686302 - RNA, 19 nt, Homo sapiens
gcugugaccugcccaagau

SEQ ID NO: 686303 - RNA, 19 nt, Homo sapiens
gaaaggccaucugcuugga

SEQ ID NO: 686304 - RNA, 19 nt, Homo sapiens
uuucuuaaccuucgacuua

SEQ ID NO: 686305 - RNA, 19 nt, Homo sapiens
ggagaagguuggcgagaag

SEQ ID NO: 686306 - RNA, 19 nt, Homo sapiens
gauccucugucgcguauuc

SEQ ID NO: 686307 - RNA, 19 nt, Homo sapiens
gcaccuaguagauauauca

SEQ ID NO: 686308 - RNA, 19 nt, Homo sapiens
ucucugaauugacugauuu

SEQ ID NO: 686309 - RNA, 19 nt, Homo sapiens
gaacuuaaaggcccauagu

SEQ ID NO: 686310 - RNA, 19 nt, Homo sapiens
gaacugcucaugcguuauc

SEQ ID NO: 686311 - RNA, 19 nt, Homo sapiens
caugaugucucugaucuga

SEQ ID NO: 686312 - RNA, 19 nt, Homo sapiens
ggcagagucuuagcuguuu

SEQ ID NO: 686313 - RNA, 19 nt, Homo sapiens
gcaacaaucagaguagaaa

SEQ ID NO: 686314 - RNA, 19 nt, Homo sapiens
aaagguaaauacacccaaa

SEQ ID NO: 686315 - RNA, 19 nt, Homo sapiens
gggcaguccuuggcacuuu

SEQ ID NO: 686316 - RNA, 19 nt, Homo sapiens
gggagaagguuggcgagaa

SEQ ID NO: 686317 - RNA, 19 nt, Homo sapiens
uaucgucacuggaaacuuc

SEQ ID NO: 686318 - RNA, 19 nt, Homo sapiens
caagaaagacaaagagauc

SEQ ID NO: 686319 - RNA, 19 nt, Homo sapiens
aggagaagcaguucaauaa

SEQ ID NO: 686320 - RNA, 19 nt, Homo sapiens
cccaagggaugaaagguuu

SEQ ID NO: 686321 - RNA, 19 nt, Homo sapiens
gaaagacaaagagaucauu

SEQ ID NO: 686322 - RNA, 19 nt, Homo sapiens
cgaguuauuuggugggauu

SEQ ID NO: 686323 - RNA, 19 nt, Homo sapiens
caucucggauuacggcuuu

SEQ ID NO: 686324 - RNA, 19 nt, Homo sapiens
agagaucauugcugaauau

SEQ ID NO: 686325 - RNA, 19 nt, Homo sapiens
ucgaugaaguugaccauga

SEQ ID NO: 686326 - RNA, 19 nt, Homo sapiens
ccacugaaguuuggaguca

SEQ ID NO: 686327 - RNA, 19 nt, Homo sapiens
agaaaugggugcaugaucu

SEQ ID NO: 686328 - RNA, 19 nt, Homo sapiens
aaacaucucccaccgaguu

SEQ ID NO: 686329 - RNA, 19 nt, Homo sapiens
ucaacuacccugacaagaa

SEQ ID NO: 686330 - RNA, 19 nt, Homo sapiens
gacugcagcugcuucaaga

SEQ ID NO: 686331 - RNA, 19 nt, Homo sapiens
guugacaccuccuuucugu

SEQ ID NO: 686332 - RNA, 19 nt, Homo sapiens
ccagaugguuccacacuag

SEQ ID NO: 686333 - RNA, 19 nt, Homo sapiens
acaauuaauuccuggucua

SEQ ID NO: 686334 - RNA, 19 nt, Homo sapiens
ucagauccaugccaccaaa

SEQ ID NO: 686335 - RNA, 19 nt, Homo sapiens
ggccauugcuggaugacaa

SEQ ID NO: 686336 - RNA, 19 nt, Homo sapiens
ugaauaugaagcccaaaua

SEQ ID NO: 686337 - RNA, 19 nt, Homo sapiens
ggaagugggucucccgaaa

SEQ ID NO: 686338 - RNA, 19 nt, Homo sapiens
gaucuucggugaaucagaa

SEQ ID NO: 686339 - RNA, 19 nt, Homo sapiens
gaggagaacuguggaguga

SEQ ID NO: 686340 - RNA, 19 nt, Homo sapiens
caucagcgcuuccagagaa

SEQ ID NO: 686341 - RNA, 19 nt, Homo sapiens
gcacugagcucuccuaccu

SEQ ID NO: 686342 - RNA, 19 nt, Homo sapiens
ccgcagcccucauccuuua

SEQ ID NO: 686343 - RNA, 19 nt, Homo sapiens
gcagcaacgucaccaaaga

SEQ ID NO: 686344 - RNA, 19 nt, Homo sapiens
ccaagcagaucaagcaaga

SEQ ID NO: 686345 - RNA, 19 nt, Homo sapiens
gcaggagccuuugauguau

SEQ ID NO: 686346 - RNA, 19 nt, Homo sapiens
cagaggagccgcugaacua

SEQ ID NO: 686347 - RNA, 19 nt, Homo sapiens
gaugggcgcuucagaugga

SEQ ID NO: 686348 - RNA, 19 nt, Homo sapiens
ggagaacuguggagugauc

SEQ ID NO: 686349 - RNA, 19 nt, Homo sapiens
caaaauaaguucccuaaca

SEQ ID NO: 686350 - RNA, 19 nt, Homo sapiens
gggagcaccugcagagcua

SEQ ID NO: 686351 - RNA, 19 nt, Homo sapiens
acacacagcuggacuggau

SEQ ID NO: 686352 - RNA, 19 nt, Homo sapiens
gcaucgcgcugcccuaugu

SEQ ID NO: 686353 - RNA, 19 nt, Homo sapiens
uggaugagauggagaaugu

SEQ ID NO: 686354 - RNA, 19 nt, Homo sapiens
aaacuccgguauugcuaua

SEQ ID NO: 686355 - RNA, 19 nt, Homo sapiens
gagaagaccaagugaccua

SEQ ID NO: 686356 - RNA, 19 nt, Homo sapiens
gacagcugcuaccaguuua

SEQ ID NO: 686357 - RNA, 19 nt, Homo sapiens
gaacauggacucgaagaca

SEQ ID NO: 686358 - RNA, 19 nt, Homo sapiens
ugaaacugcagaugaauuu

SEQ ID NO: 686359 - RNA, 19 nt, Homo sapiens
caacagcugcuacuggauu

SEQ ID NO: 686360 - RNA, 19 nt, Homo sapiens
ccaacaugcucaacaagau

SEQ ID NO: 686361 - RNA, 19 nt, Homo sapiens
acaccaaacuccgguauug

SEQ ID NO: 686362 - RNA, 19 nt, Homo sapiens
ugacagcugcuaccaguuu

SEQ ID NO: 686363 - RNA, 19 nt, Homo sapiens
ggagacccauggcuucauc

SEQ ID NO: 686364 - RNA, 19 nt, Homo sapiens
gauuugaaacugcagauga

SEQ ID NO: 686365 - RNA, 19 nt, Homo sapiens
ccagcugccuguccaguug

SEQ ID NO: 686366 - RNA, 19 nt, Homo sapiens
gcacagccaggcagagcua

SEQ ID NO: 686367 - RNA, 19 nt, Homo sapiens
gcuacuggauucagagcaa

SEQ ID NO: 686368 - RNA, 19 nt, Homo sapiens
aaugugaccuuugaccuuu

SEQ ID NO: 686369 - RNA, 19 nt, Homo sapiens
gcacgacgacgacgacauc

SEQ ID NO: 686370 - RNA, 19 nt, Homo sapiens
gagcaggagccuuugaugu

SEQ ID NO: 686371 - RNA, 19 nt, Homo sapiens
caagaucuucggugaauca

SEQ ID NO: 686372 - RNA, 19 nt, Homo sapiens
gcuacuggcugggagaaga

SEQ ID NO: 686373 - RNA, 19 nt, Homo sapiens
ggauccaguuccucaacaa

SEQ ID NO: 686374 - RNA, 19 nt, Homo sapiens
gcacugaccauggcucuca

SEQ ID NO: 686375 - RNA, 19 nt, Homo sapiens
gaaaccggcuauucaaccu

SEQ ID NO: 686376 - RNA, 19 nt, Homo sapiens
cacaagggcugggcugaga

SEQ ID NO: 686377 - RNA, 19 nt, Homo sapiens
ucagcagccucaucuacaa

SEQ ID NO: 686378 - RNA, 19 nt, Homo sapiens
ccagacaggugggccaaug

SEQ ID NO: 686379 - RNA, 19 nt, Homo sapiens
cagccagccugcccaaugu

SEQ ID NO: 686380 - RNA, 19 nt, Homo sapiens
caacaagaucuucggugaa

SEQ ID NO: 686381 - RNA, 19 nt, Homo sapiens
cagagcggcugcaggacaa

SEQ ID NO: 686382 - RNA, 19 nt, Homo sapiens
acaaggaccagcugacuga

SEQ ID NO: 686383 - RNA, 19 nt, Homo sapiens
acauggcccuuucucugua

SEQ ID NO: 686384 - RNA, 19 nt, Homo sapiens
cagcguggcguuucccuuu

SEQ ID NO: 686385 - RNA, 19 nt, Homo sapiens
ugagauggagaauguguuu

SEQ ID NO: 686386 - RNA, 19 nt, Homo sapiens
gacaagaagugcguguaca

SEQ ID NO: 686387 - RNA, 19 nt, Homo sapiens
aacaagaucuucggugaau

SEQ ID NO: 686388 - RNA, 19 nt, Homo sapiens
uggcggagcuggaauucau

SEQ ID NO: 686389 - RNA, 19 nt, Homo sapiens
ucgaagacauggcccuuuc

SEQ ID NO: 686390 - RNA, 19 nt, Homo sapiens
ggacaagaagugcguguac

SEQ ID NO: 686391 - RNA, 19 nt, Homo sapiens
aaucuucgcuggcauuguc

SEQ ID NO: 686392 - RNA, 19 nt, Homo sapiens
ccaccgaggccacugagaa

SEQ ID NO: 686393 - RNA, 19 nt, Homo sapiens
gacauggcccuuucucugu

SEQ ID NO: 686394 - RNA, 19 nt, Homo sapiens
gcugugaacuacuccaacu

SEQ ID NO: 686395 - RNA, 19 nt, Homo sapiens
gcgcagcaacgucaccaaa

SEQ ID NO: 686396 - RNA, 19 nt, Homo sapiens
gcgaugggcgcuucagaug

SEQ ID NO: 686397 - RNA, 19 nt, Homo sapiens
gaagaacauccugguguca

SEQ ID NO: 686398 - RNA, 19 nt, Homo sapiens
gaccgcagcccucauccuu

SEQ ID NO: 686399 - RNA, 19 nt, Homo sapiens
agcaggagccuuugaugua

SEQ ID NO: 686400 - RNA, 19 nt, Homo sapiens
caacgucuuccucaucuuc

SEQ ID NO: 686401 - RNA, 19 nt, Homo sapiens
gaagugcguguacaugaca

SEQ ID NO: 686402 - RNA, 19 nt, Homo sapiens
ggguggagcaggagccuuu

SEQ ID NO: 686403 - RNA, 19 nt, Homo sapiens
ggacaccaaacuccgguau

SEQ ID NO: 686404 - RNA, 19 nt, Homo sapiens
cgacagcgugggacaaugu

SEQ ID NO: 686405 - RNA, 19 nt, Homo sapiens
gaugagauggagaaugugu

SEQ ID NO: 686406 - RNA, 19 nt, Homo sapiens
caaugugaccuuugaccuu

SEQ ID NO: 686407 - RNA, 19 nt, Homo sapiens
ugacagccuugcccuacau

SEQ ID NO: 686408 - RNA, 19 nt, Homo sapiens
gcauggcggagcuggaauu

SEQ ID NO: 686409 - RNA, 19 nt, Homo sapiens
gcaccauccccuucaaaua

SEQ ID NO: 686410 - RNA, 19 nt, Homo sapiens
agaacauccuggugucaga

SEQ ID NO: 686411 - RNA, 19 nt, Homo sapiens
aagaagugcguguacauga

SEQ ID NO: 686412 - RNA, 19 nt, Homo sapiens
gccaacaugcucaacaaga

SEQ ID NO: 686413 - RNA, 19 nt, Homo sapiens
ucaccaagcagaucaagca

SEQ ID NO: 686414 - RNA, 19 nt, Homo sapiens
gaccuuugaccuuuggauu

SEQ ID NO: 686415 - RNA, 19 nt, Homo sapiens
cagcaacgucaccaaagaa

SEQ ID NO: 686416 - RNA, 19 nt, Homo sapiens
ugugggaggugaagaacug

SEQ ID NO: 686417 - RNA, 19 nt, Homo sapiens
gaacuucaaccccaaagga

SEQ ID NO: 686418 - RNA, 19 nt, Homo sapiens
caagaagugcguguacaug

SEQ ID NO: 686419 - RNA, 19 nt, Homo sapiens
uggccaacaugcucaacaa

SEQ ID NO: 686420 - RNA, 19 nt, Homo sapiens
gcuccuggcucugguuugg

SEQ ID NO: 686421 - RNA, 19 nt, Homo sapiens
cugcugggcuggagauaag

SEQ ID NO: 686422 - RNA, 19 nt, Homo sapiens
gggcugagcauccaucacu

SEQ ID NO: 686423 - RNA, 19 nt, Homo sapiens
caggagccuuugauguaug

SEQ ID NO: 686424 - RNA, 19 nt, Homo sapiens
ccgaguacaaguucuuuga

SEQ ID NO: 686425 - RNA, 19 nt, Homo sapiens
caacaugcucaacaagauc

SEQ ID NO: 686426 - RNA, 19 nt, Homo sapiens
ccaaacuccgguauugcua

SEQ ID NO: 686427 - RNA, 19 nt, Homo sapiens
gcugggagaagaccaagug

SEQ ID NO: 686428 - RNA, 19 nt, Homo sapiens
ccuuugagcccaacaacuu

SEQ ID NO: 686429 - RNA, 19 nt, Homo sapiens
gcagcuggcaggaguccaa

SEQ ID NO: 686430 - RNA, 19 nt, Homo sapiens
ggacaaggaccagcugacu

SEQ ID NO: 686431 - RNA, 19 nt, Homo sapiens
cugcuauucuuuccacaug

SEQ ID NO: 686432 - RNA, 19 nt, Homo sapiens
ggagcaggagccuuugaug

SEQ ID NO: 686433 - RNA, 19 nt, Homo sapiens
ggaggccgaguacaaguuc

SEQ ID NO: 686434 - RNA, 19 nt, Homo sapiens
gcacuuuguggccaacaug

SEQ ID NO: 686435 - RNA, 19 nt, Homo sapiens
gaagugggucucccgaaac

SEQ ID NO: 686436 - RNA, 19 nt, Homo sapiens
gaagacauggcccuuucuc

SEQ ID NO: 686437 - RNA, 19 nt, Homo sapiens
ggucucaucucaauuaaua

SEQ ID NO: 686438 - RNA, 19 nt, Homo sapiens
agacacagauguuaaguaa

SEQ ID NO: 686439 - RNA, 19 nt, Homo sapiens
ggaagucagugugggaaua

SEQ ID NO: 686440 - RNA, 19 nt, Homo sapiens
gagcaguguuuauugagua

SEQ ID NO: 686441 - RNA, 19 nt, Homo sapiens
ggucagcuuuguuugauuu

SEQ ID NO: 686442 - RNA, 19 nt, Homo sapiens
ccaaagugcuaggauuaua

SEQ ID NO: 686443 - RNA, 19 nt, Homo sapiens
guacagaacuuugucuaca

SEQ ID NO: 686444 - RNA, 19 nt, Homo sapiens
gacaagaucccguccauga

SEQ ID NO: 686445 - RNA, 19 nt, Homo sapiens
cagagacgcguauguaaua

SEQ ID NO: 686446 - RNA, 19 nt, Homo sapiens
ugucauugcugucggguua

SEQ ID NO: 686447 - RNA, 19 nt, Homo sapiens
gaacuaacucguagagaug

SEQ ID NO: 686448 - RNA, 19 nt, Homo sapiens
ggagguggcuuuggugguu

SEQ ID NO: 686449 - RNA, 19 nt, Homo sapiens
ggacucauguacuuuguca

SEQ ID NO: 686450 - RNA, 19 nt, Homo sapiens
uaaacggacucauguacuu

SEQ ID NO: 686451 - RNA, 19 nt, Homo sapiens
gaagaagugggaagaagaa

SEQ ID NO: 686452 - RNA, 19 nt, Homo sapiens
cauccagccucacagcuua

SEQ ID NO: 686453 - RNA, 19 nt, Homo sapiens
gaaaaugcuugcaguuuga

SEQ ID NO: 686454 - RNA, 19 nt, Homo sapiens
caccgcaccuuccugaaua

SEQ ID NO: 686455 - RNA, 19 nt, Homo sapiens
ggaagaagaaggagcucua

SEQ ID NO: 686456 - RNA, 19 nt, Homo sapiens
ccaugaaucagguaaauuu

SEQ ID NO: 686457 - RNA, 19 nt, Homo sapiens
aaggaugucuuuacacuga

SEQ ID NO: 686458 - RNA, 19 nt, Homo sapiens
ccucacagcuuacaucaca

SEQ ID NO: 686459 - RNA, 19 nt, Homo sapiens
gagcugcgcuugggauugu

SEQ ID NO: 686460 - RNA, 19 nt, Homo sapiens
ugaacuaacucguagagau

SEQ ID NO: 686461 - RNA, 19 nt, Homo sapiens
gaacgaaugggacaagauc

SEQ ID NO: 686462 - RNA, 19 nt, Homo sapiens
gagggccacugcagagauu

SEQ ID NO: 686463 - RNA, 19 nt, Homo sapiens
guuaacauuuccaaaccua

SEQ ID NO: 686464 - RNA, 19 nt, Homo sapiens
gguauuuaaugcugaucua

SEQ ID NO: 686465 - RNA, 19 nt, Homo sapiens
cagcuugucucccuuguca

SEQ ID NO: 686466 - RNA, 19 nt, Homo sapiens
gaagugggaagaagaagga

SEQ ID NO: 686467 - RNA, 19 nt, Homo sapiens
ccugggaggugaucauuga

SEQ ID NO: 686468 - RNA, 19 nt, Homo sapiens
gcccuacccucuccucuga

SEQ ID NO: 686469 - RNA, 19 nt, Homo sapiens
gcacauagucauagcgaau

SEQ ID NO: 686470 - RNA, 19 nt, Homo sapiens
ggagugcagugguacaauc

SEQ ID NO: 686471 - RNA, 19 nt, Homo sapiens
gaucuacuauaagguauuc

SEQ ID NO: 686472 - RNA, 19 nt, Homo sapiens
gacaauacauuugaacucu

SEQ ID NO: 686473 - RNA, 19 nt, Homo sapiens
gggauacgacaauacauuu

SEQ ID NO: 686474 - RNA, 19 nt, Homo sapiens
ccgcugagguggacgugua

SEQ ID NO: 686475 - RNA, 19 nt, Homo sapiens
gcugaucuacuauaaggua

SEQ ID NO: 686476 - RNA, 19 nt, Homo sapiens
guuaaguaauacccuauga

SEQ ID NO: 686477 - RNA, 19 nt, Homo sapiens
gcaaggagaccauggugau

SEQ ID NO: 686478 - RNA, 19 nt, Homo sapiens
gcuaugaccacaccacuga

SEQ ID NO: 686479 - RNA, 19 nt, Homo sapiens
uuacacagcuuaguacaca

SEQ ID NO: 686480 - RNA, 19 nt, Homo sapiens
cuuagcagauugcacuuaa

SEQ ID NO: 686481 - RNA, 19 nt, Homo sapiens
gauacgacaauacauuuga

SEQ ID NO: 686482 - RNA, 19 nt, Homo sapiens
ccaaagugcugggauuaca

SEQ ID NO: 686483 - RNA, 19 nt, Homo sapiens
ccucaaaguacccaaagua

SEQ ID NO: 686484 - RNA, 19 nt, Homo sapiens
guucugggcugucaugucu

SEQ ID NO: 686485 - RNA, 19 nt, Homo sapiens
guggcugguugccuuaaua

SEQ ID NO: 686486 - RNA, 19 nt, Homo sapiens
ccagaacagugggacauga

SEQ ID NO: 686487 - RNA, 19 nt, Homo sapiens
ggguuuagaagaccaagua

SEQ ID NO: 686488 - RNA, 19 nt, Homo sapiens
ggaaagauggaaggaauca

SEQ ID NO: 686489 - RNA, 19 nt, Homo sapiens
gagacacagauguuaagua

SEQ ID NO: 686490 - RNA, 19 nt, Homo sapiens
uaauagaaggcugcucuua

SEQ ID NO: 686491 - RNA, 19 nt, Homo sapiens
ccagaauccugcuuaaggu

SEQ ID NO: 686492 - RNA, 19 nt, Homo sapiens
gcagguugacauauuuauu

SEQ ID NO: 686493 - RNA, 19 nt, Homo sapiens
gcaguuugaccuuagaaga

SEQ ID NO: 686494 - RNA, 19 nt, Homo sapiens
ggagucccacugcuucuaa

SEQ ID NO: 686495 - RNA, 19 nt, Homo sapiens
gaugugguccuaucagaug

SEQ ID NO: 686496 - RNA, 19 nt, Homo sapiens
ccagagagcagaaggaagu

SEQ ID NO: 686497 - RNA, 19 nt, Homo sapiens
gagaagagggcauuuagac

SEQ ID NO: 686498 - RNA, 19 nt, Homo sapiens
gggagaggacgaugacuug

SEQ ID NO: 686499 - RNA, 19 nt, Homo sapiens
ggccaugugagcaguguua

SEQ ID NO: 686500 - RNA, 19 nt, Homo sapiens
caagaucccguccaugaau

SEQ ID NO: 686501 - RNA, 19 nt, Homo sapiens
ugucaugucuccaccacuu

SEQ ID NO: 686502 - RNA, 19 nt, Homo sapiens
gcaccagccucugcagcaa

SEQ ID NO: 686503 - RNA, 19 nt, Homo sapiens
ugggaaagauggaaggaau

SEQ ID NO: 686504 - RNA, 19 nt, Homo sapiens
ccaccacacccaguaauuu

SEQ ID NO: 686505 - RNA, 19 nt, Homo sapiens
gcagcugggcuuccuguga

SEQ ID NO: 686506 - RNA, 19 nt, Homo sapiens
ucuuggaaauggucaguuu

SEQ ID NO: 686507 - RNA, 19 nt, Homo sapiens
gcacauguuucugggucuu

SEQ ID NO: 686508 - RNA, 19 nt, Homo sapiens
gggcagguugacauauuua

SEQ ID NO: 686509 - RNA, 19 nt, Homo sapiens
cuacagcacaaauuaaguu

SEQ ID NO: 686510 - RNA, 19 nt, Homo sapiens
gaagucccauugccaaagc

SEQ ID NO: 686511 - RNA, 19 nt, Homo sapiens
ugaaaaugcuugcaguuug

SEQ ID NO: 686512 - RNA, 19 nt, Homo sapiens
ugagguacacaucauauug

SEQ ID NO: 686513 - RNA, 19 nt, Homo sapiens
cagcuuaguacacauuuga

SEQ ID NO: 686514 - RNA, 19 nt, Homo sapiens
ucacugagacacagauguu

SEQ ID NO: 686515 - RNA, 19 nt, Homo sapiens
guacaacucaagcgugaau

SEQ ID NO: 686516 - RNA, 19 nt, Homo sapiens
gcugguugccuuaauaugu

SEQ ID NO: 686517 - RNA, 19 nt, Homo sapiens
cgggcagguugacauauuu

SEQ ID NO: 686518 - RNA, 19 nt, Homo sapiens
gaagguuaaagcaaauguu

SEQ ID NO: 686519 - RNA, 19 nt, Homo sapiens
acauagucauagcgaauuu

SEQ ID NO: 686520 - RNA, 19 nt, Homo sapiens
ccaccacgcccagcuaauu

SEQ ID NO: 686521 - RNA, 19 nt, Homo sapiens
ucccaaagugcuaggauua

SEQ ID NO: 686522 - RNA, 19 nt, Homo sapiens
cugaauagcugagacuaca

SEQ ID NO: 686523 - RNA, 19 nt, Homo sapiens
ggagcaaggcauacaguca

SEQ ID NO: 686524 - RNA, 19 nt, Homo sapiens
uuaaggaugucuuuacacu

SEQ ID NO: 686525 - RNA, 19 nt, Homo sapiens
ccacuuaaggaugucuuua

SEQ ID NO: 686526 - RNA, 19 nt, Homo sapiens
caucugcaccuacuuguuc

SEQ ID NO: 686527 - RNA, 19 nt, Homo sapiens
ucgggcagguugacauauu

SEQ ID NO: 686528 - RNA, 19 nt, Homo sapiens
ggucgggcagguugacaua

SEQ ID NO: 686529 - RNA, 19 nt, Homo sapiens
gauguucucagcaggaaga

SEQ ID NO: 686530 - RNA, 19 nt, Homo sapiens
gccaggggcuuacaucaaa

SEQ ID NO: 686531 - RNA, 19 nt, Homo sapiens
gacgggauuucacuguguu

SEQ ID NO: 686532 - RNA, 19 nt, Homo sapiens
gugcagugguacaaucaug

SEQ ID NO: 686533 - RNA, 19 nt, Homo sapiens
ccuggcguguucuuagaua

SEQ ID NO: 686534 - RNA, 19 nt, Homo sapiens
gagcaaggcauacagucau

SEQ ID NO: 686535 - RNA, 19 nt, Homo sapiens
ccaagacugcgacucuaaa

SEQ ID NO: 686536 - RNA, 19 nt, Homo sapiens
ccauggugaugcagugcua

SEQ ID NO: 686537 - RNA, 19 nt, Homo sapiens
ccacugagcuucacuaaua

SEQ ID NO: 686538 - RNA, 19 nt, Homo sapiens
ggacauggauuaccugaaa

SEQ ID NO: 686539 - RNA, 19 nt, Homo sapiens
gagcaaacaugcccagaaa

SEQ ID NO: 686540 - RNA, 19 nt, Homo sapiens
gagaaacgcucaugggaau

SEQ ID NO: 686541 - RNA, 19 nt, Homo sapiens
gcagacaacucuucagcaa

SEQ ID NO: 686542 - RNA, 19 nt, Homo sapiens
ggauguacucuguuuauua

SEQ ID NO: 686543 - RNA, 19 nt, Homo sapiens
gaagagagccucccaggau

SEQ ID NO: 686544 - RNA, 19 nt, Homo sapiens
gaaacaaguucccagaaag

SEQ ID NO: 686545 - RNA, 19 nt, Homo sapiens
ccacagacuuacacaguuu

SEQ ID NO: 686546 - RNA, 19 nt, Homo sapiens
gagcuucacuaauaauaug

SEQ ID NO: 686547 - RNA, 19 nt, Homo sapiens
gaaggaggauacagaguuc

SEQ ID NO: 686548 - RNA, 19 nt, Homo sapiens
gggaggaccuggaagaaga

SEQ ID NO: 686549 - RNA, 19 nt, Homo sapiens
gagcgcaugcugaaauuua

SEQ ID NO: 686550 - RNA, 19 nt, Homo sapiens
gaagcaagcucugaaaugc

SEQ ID NO: 686551 - RNA, 19 nt, Homo sapiens
ugaagaaucucccgaaugg

SEQ ID NO: 686552 - RNA, 19 nt, Homo sapiens
agaaacaaguucccagaaa

SEQ ID NO: 686553 - RNA, 19 nt, Homo sapiens
gacauuggcucggaagaaa

SEQ ID NO: 686554 - RNA, 19 nt, Homo sapiens
ggauacaucuuuguggauu

SEQ ID NO: 686555 - RNA, 19 nt, Homo sapiens
caccaaagauggcaaguuc

SEQ ID NO: 686556 - RNA, 19 nt, Homo sapiens
ggaagaggaagaagaagaa

SEQ ID NO: 686557 - RNA, 19 nt, Homo sapiens
ggaggaagaggaagaagaa

SEQ ID NO: 686558 - RNA, 19 nt, Homo sapiens
ucagccgucuuaauaauaa

SEQ ID NO: 686559 - RNA, 19 nt, Homo sapiens
gaacagagccgagcuuggu

SEQ ID NO: 686560 - RNA, 19 nt, Homo sapiens
caccacgccuggcuaauuu

SEQ ID NO: 686561 - RNA, 19 nt, Homo sapiens
gaaacgcucaugggaauaa

SEQ ID NO: 686562 - RNA, 19 nt, Homo sapiens
uaagaaagaugagaagaag

SEQ ID NO: 686563 - RNA, 19 nt, Homo sapiens
gaaagcagaccaccuccaa

SEQ ID NO: 686564 - RNA, 19 nt, Homo sapiens
caaagaauaccaccaaauc

SEQ ID NO: 686565 - RNA, 19 nt, Homo sapiens
gaaggaggcccaggacaaa

SEQ ID NO: 686566 - RNA, 19 nt, Homo sapiens
ggaaggagcagacaacucu

SEQ ID NO: 686567 - RNA, 19 nt, Homo sapiens
gagcgaagcaagacuguga

SEQ ID NO: 686568 - RNA, 19 nt, Homo sapiens
gcaggaugcuccacguguu

SEQ ID NO: 686569 - RNA, 19 nt, Homo sapiens
gagccgagcuugguuucaa

SEQ ID NO: 686570 - RNA, 19 nt, Homo sapiens
aaagcggccucucggguua

SEQ ID NO: 686571 - RNA, 19 nt, Homo sapiens
aagagaagcugaaggaagu

SEQ ID NO: 686572 - RNA, 19 nt, Homo sapiens
gaaggaagccagcgaggau

SEQ ID NO: 686573 - RNA, 19 nt, Homo sapiens
gaacuucgacuccgauucu

SEQ ID NO: 686574 - RNA, 19 nt, Homo sapiens
acacagaggcuucggcuuu

SEQ ID NO: 686575 - RNA, 19 nt, Homo sapiens
agacaacucuucagcaaag

SEQ ID NO: 686576 - RNA, 19 nt, Homo sapiens
ggagugaggccgaggaaga

SEQ ID NO: 686577 - RNA, 19 nt, Homo sapiens
gcacagaagcauuucaaca

SEQ ID NO: 686578 - RNA, 19 nt, Homo sapiens
gaaaugguugccagucaaa

SEQ ID NO: 686579 - RNA, 19 nt, Homo sapiens
gaaguacaacgccaccaaa

SEQ ID NO: 686580 - RNA, 19 nt, Homo sapiens
auacagaguuccaggaguu

SEQ ID NO: 686581 - RNA, 19 nt, Homo sapiens
gagcuugguuucaacaucu

SEQ ID NO: 686582 - RNA, 19 nt, Homo sapiens
ccaaagugcugagauuaca

SEQ ID NO: 686583 - RNA, 19 nt, Homo sapiens
gauacaucuuuguggauuu

SEQ ID NO: 686584 - RNA, 19 nt, Homo sapiens
cagaagcauuucaacaaga

SEQ ID NO: 686585 - RNA, 19 nt, Homo sapiens
caacagaagagaagcugaa

SEQ ID NO: 686586 - RNA, 19 nt, Homo sapiens
gaagcaagacugugauucu

SEQ ID NO: 686587 - RNA, 19 nt, Homo sapiens
agaggaaagugaagaugaa

SEQ ID NO: 686588 - RNA, 19 nt, Homo sapiens
cuccagaaauuaagaaaga

SEQ ID NO: 686589 - RNA, 19 nt, Homo sapiens
gaagcugaaggaaguguuu

SEQ ID NO: 686590 - RNA, 19 nt, Homo sapiens
caucuaccaucaagaagga

SEQ ID NO: 686591 - RNA, 19 nt, Homo sapiens
gcaaugaagaggaagugaa

SEQ ID NO: 686592 - RNA, 19 nt, Homo sapiens
ccucauucauucauucauu

SEQ ID NO: 686593 - RNA, 19 nt, Homo sapiens
gguuuggauuuguggaaua

SEQ ID NO: 686594 - RNA, 19 nt, Homo sapiens
gaucgucguccuacaagaa

SEQ ID NO: 686595 - RNA, 19 nt, Homo sapiens
ggaggaagaggaaagugaa

SEQ ID NO: 686596 - RNA, 19 nt, Homo sapiens
agaaagaugagaagaagaa

SEQ ID NO: 686597 - RNA, 19 nt, Homo sapiens
cuacuacuccagaaauuaa

SEQ ID NO: 686598 - RNA, 19 nt, Homo sapiens
ggaugaaggaggagcguuu

SEQ ID NO: 686599 - RNA, 19 nt, Homo sapiens
ugaaaugguugccagucaa

SEQ ID NO: 686600 - RNA, 19 nt, Homo sapiens
ggagugcaguggcgugauc

SEQ ID NO: 686601 - RNA, 19 nt, Homo sapiens
cagaagagaagcugaagga

SEQ ID NO: 686602 - RNA, 19 nt, Homo sapiens
gaagugaagcaagcucuga

SEQ ID NO: 686603 - RNA, 19 nt, Homo sapiens
ccagggcgguagcgugaaa

SEQ ID NO: 686604 - RNA, 19 nt, Homo sapiens
gaaagagccagcgaacaug

SEQ ID NO: 686605 - RNA, 19 nt, Homo sapiens
gugagcgcaugcugaaauu

SEQ ID NO: 686606 - RNA, 19 nt, Homo sapiens
uaggaaaggauuaguguga

SEQ ID NO: 686607 - RNA, 19 nt, Homo sapiens
caacuggaacacacuauuc

SEQ ID NO: 686608 - RNA, 19 nt, Homo sapiens
ggagcaaacaugcccagaa

SEQ ID NO: 686609 - RNA, 19 nt, Homo sapiens
cacagaagcauuucaacaa

SEQ ID NO: 686610 - RNA, 19 nt, Homo sapiens
cgacugaucgugaagaauc

SEQ ID NO: 686611 - RNA, 19 nt, Homo sapiens
caccaaaagucaaguguuu

SEQ ID NO: 686612 - RNA, 19 nt, Homo sapiens
caaaggcagcugugcagaa

SEQ ID NO: 686613 - RNA, 19 nt, Homo sapiens
ugaaggaggauacagaguu

SEQ ID NO: 686614 - RNA, 19 nt, Homo sapiens
cagcagagccagaaacagu

SEQ ID NO: 686615 - RNA, 19 nt, Homo sapiens
agaaggcacagaagcauuu

SEQ ID NO: 686616 - RNA, 19 nt, Homo sapiens
agaaagagccagcgaacau

SEQ ID NO: 686617 - RNA, 19 nt, Homo sapiens
cccaggauguacucuguuu

SEQ ID NO: 686618 - RNA, 19 nt, Homo sapiens
guacggaaccugcccuaca

SEQ ID NO: 686619 - RNA, 19 nt, Homo sapiens
ccauucgaauugugagaaa

SEQ ID NO: 686620 - RNA, 19 nt, Homo sapiens
ccaguggccauucgaauug

SEQ ID NO: 686621 - RNA, 19 nt, Homo sapiens
gaaaccagcaaaccagaag

SEQ ID NO: 686622 - RNA, 19 nt, Homo sapiens
ggaagaggaaagugaagau

SEQ ID NO: 686623 - RNA, 19 nt, Homo sapiens
gaaagaugagaagaagaaa

SEQ ID NO: 686624 - RNA, 19 nt, Homo sapiens
agacuggguuucaccaugu

SEQ ID NO: 686625 - RNA, 19 nt, Homo sapiens
gcagacccuucagcuguga

SEQ ID NO: 686626 - RNA, 19 nt, Homo sapiens
gcagaccaccuccaagauc

SEQ ID NO: 686627 - RNA, 19 nt, Homo sapiens
cgugaaacuugguggaaga

SEQ ID NO: 686628 - RNA, 19 nt, Homo sapiens
ggaggaggaggaagaggaa

SEQ ID NO: 686629 - RNA, 19 nt, Homo sapiens
ccaagacacaccuucagaa

SEQ ID NO: 686630 - RNA, 19 nt, Homo sapiens
gaagaggaaagugaagaug

SEQ ID NO: 686631 - RNA, 19 nt, Homo sapiens
gugacuaccugaacuucga

SEQ ID NO: 686632 - RNA, 19 nt, Homo sapiens
gauggcaaguuccgcaagu

SEQ ID NO: 686633 - RNA, 19 nt, Homo sapiens
ccaccacgccuggcuaauu

SEQ ID NO: 686634 - RNA, 19 nt, Homo sapiens
caagcaggaugcgaagaga

SEQ ID NO: 686635 - RNA, 19 nt, Homo sapiens
gcugcuccaucuccaagaa

SEQ ID NO: 686636 - RNA, 19 nt, Homo sapiens
ggcgguagcgugaaacuug

SEQ ID NO: 686637 - RNA, 19 nt, Homo sapiens
ggacauggauuaccugaaa

SEQ ID NO: 686638 - RNA, 19 nt, Homo sapiens
gagcaaacaugcccagaaa

SEQ ID NO: 686639 - RNA, 19 nt, Homo sapiens
gagaaacgcucaugggaau

SEQ ID NO: 686640 - RNA, 19 nt, Homo sapiens
gcagacaacucuucagcaa

SEQ ID NO: 686641 - RNA, 19 nt, Homo sapiens
ggauguacucuguuuauua

SEQ ID NO: 686642 - RNA, 19 nt, Homo sapiens
gaagagagccucccaggau

SEQ ID NO: 686643 - RNA, 19 nt, Homo sapiens
gaaacaaguucccagaaag

SEQ ID NO: 686644 - RNA, 19 nt, Homo sapiens
gauagacagugccagaauu

SEQ ID NO: 686645 - RNA, 19 nt, Homo sapiens
caagggagcagccacguua

SEQ ID NO: 686646 - RNA, 19 nt, Homo sapiens
gaaggaggauacagaguuc

SEQ ID NO: 686647 - RNA, 19 nt, Homo sapiens
gggaggaccuggaagaaga

SEQ ID NO: 686648 - RNA, 19 nt, Homo sapiens
gaagcaagcucugaaaugc

SEQ ID NO: 686649 - RNA, 19 nt, Homo sapiens
ugaagaaucucccgaaugg

SEQ ID NO: 686650 - RNA, 19 nt, Homo sapiens
gagcuagaauucccaccua

SEQ ID NO: 686651 - RNA, 19 nt, Homo sapiens
agaaacaaguucccagaaa

SEQ ID NO: 686652 - RNA, 19 nt, Homo sapiens
gacauuggcucggaagaaa

SEQ ID NO: 686653 - RNA, 19 nt, Homo sapiens
ggauacaucuuuguggauu

SEQ ID NO: 686654 - RNA, 19 nt, Homo sapiens
caccaaagauggcaaguuc

SEQ ID NO: 686655 - RNA, 19 nt, Homo sapiens
ggaagaggaagaagaagaa

SEQ ID NO: 686656 - RNA, 19 nt, Homo sapiens
ggaggaagaggaagaagaa

SEQ ID NO: 686657 - RNA, 19 nt, Homo sapiens
gaaacgcucaugggaauaa

SEQ ID NO: 686658 - RNA, 19 nt, Homo sapiens
uaagaaagaugagaagaag

SEQ ID NO: 686659 - RNA, 19 nt, Homo sapiens
gaaagcagaccaccuccaa

SEQ ID NO: 686660 - RNA, 19 nt, Homo sapiens
caccaagagucaaguguuu

SEQ ID NO: 686661 - RNA, 19 nt, Homo sapiens
caaagaauaccaccaaauc

SEQ ID NO: 686662 - RNA, 19 nt, Homo sapiens
gcaucucacugcagucuga

SEQ ID NO: 686663 - RNA, 19 nt, Homo sapiens
gaaggaggcccaggacaaa

SEQ ID NO: 686664 - RNA, 19 nt, Homo sapiens
uggcugagcugaaugaugu

SEQ ID NO: 686665 - RNA, 19 nt, Homo sapiens
ggaaggagcagacaacucu

SEQ ID NO: 686666 - RNA, 19 nt, Homo sapiens
gagcgaagcaagacuguga

SEQ ID NO: 686667 - RNA, 19 nt, Homo sapiens
gcaggaugcuccacguguu

SEQ ID NO: 686668 - RNA, 19 nt, Homo sapiens
agaaauaaacgcaguaaug

SEQ ID NO: 686669 - RNA, 19 nt, Homo sapiens
gaagagagacuugggaaca

SEQ ID NO: 686670 - RNA, 19 nt, Homo sapiens
aagagaagcugaaggaagu

SEQ ID NO: 686671 - RNA, 19 nt, Homo sapiens
gaaggaagccagcgaggau

SEQ ID NO: 686672 - RNA, 19 nt, Homo sapiens
gaacuucgacuccgauucu

SEQ ID NO: 686673 - RNA, 19 nt, Homo sapiens
gaaauaaacgcaguaaugc

SEQ ID NO: 686674 - RNA, 19 nt, Homo sapiens
acacagaggcuucggcuuu

SEQ ID NO: 686675 - RNA, 19 nt, Homo sapiens
agacaacucuucagcaaag

SEQ ID NO: 686676 - RNA, 19 nt, Homo sapiens
ggagugaggccgaggaaga

SEQ ID NO: 686677 - RNA, 19 nt, Homo sapiens
gcacagaagcauuucaaca

SEQ ID NO: 686678 - RNA, 19 nt, Homo sapiens
auacagaguuccaggaguu

SEQ ID NO: 686679 - RNA, 19 nt, Homo sapiens
gauacaucuuuguggauuu

SEQ ID NO: 686680 - RNA, 19 nt, Homo sapiens
cagaagcauuucaacaaga

SEQ ID NO: 686681 - RNA, 19 nt, Homo sapiens
uaaacgcaguaaugcauga

SEQ ID NO: 686682 - RNA, 19 nt, Homo sapiens
caacagaagagaagcugaa

SEQ ID NO: 686683 - RNA, 19 nt, Homo sapiens
gaagcaagacugugauucu

SEQ ID NO: 686684 - RNA, 19 nt, Homo sapiens
agaggaaagugaagaugaa

SEQ ID NO: 686685 - RNA, 19 nt, Homo sapiens
cuccagaaauuaagaaaga

SEQ ID NO: 686686 - RNA, 19 nt, Homo sapiens
ggagagggcagagcaagaa

SEQ ID NO: 686687 - RNA, 19 nt, Homo sapiens
gaagcugaaggaaguguuu

SEQ ID NO: 686688 - RNA, 19 nt, Homo sapiens
caucuaccaucaagaagga

SEQ ID NO: 686689 - RNA, 19 nt, Homo sapiens
gcaaugaagaggaagugaa

SEQ ID NO: 686690 - RNA, 19 nt, Homo sapiens
gguuuggauuuguggaaua

SEQ ID NO: 686691 - RNA, 19 nt, Homo sapiens
gaucgucguccuacaagaa

SEQ ID NO: 686692 - RNA, 19 nt, Homo sapiens
ggaggaagaggaaagugaa

SEQ ID NO: 686693 - RNA, 19 nt, Homo sapiens
agaaagaugagaagaagaa

SEQ ID NO: 686694 - RNA, 19 nt, Homo sapiens
cuacuacuccagaaauuaa

SEQ ID NO: 686695 - RNA, 19 nt, Homo sapiens
ggaugaaggaggagcguuu

SEQ ID NO: 686696 - RNA, 19 nt, Homo sapiens
guucacggcuugggacuug

SEQ ID NO: 686697 - RNA, 19 nt, Homo sapiens
guaaagcccagagaagauu

SEQ ID NO: 686698 - RNA, 19 nt, Homo sapiens
cagaagagaagcugaagga

SEQ ID NO: 686699 - RNA, 19 nt, Homo sapiens
ucacugccaucguggaguu

SEQ ID NO: 686700 - RNA, 19 nt, Homo sapiens
guacaacgccaccaagagu

SEQ ID NO: 686701 - RNA, 19 nt, Homo sapiens
gaagugaagcaagcucuga

SEQ ID NO: 686702 - RNA, 19 nt, Homo sapiens
gcuaguucuuacuucauaa

SEQ ID NO: 686703 - RNA, 19 nt, Homo sapiens
ccagggcgguagcgugaaa

SEQ ID NO: 686704 - RNA, 19 nt, Homo sapiens
gaaucuagacaucgccauu

SEQ ID NO: 686705 - RNA, 19 nt, Homo sapiens
caacuggaacacacuauuc

SEQ ID NO: 686706 - RNA, 19 nt, Homo sapiens
ggagcaaacaugcccagaa

SEQ ID NO: 686707 - RNA, 19 nt, Homo sapiens
cacagaagcauuucaacaa

SEQ ID NO: 686708 - RNA, 19 nt, Homo sapiens
ccaguuuccuuaucuccuu

SEQ ID NO: 686709 - RNA, 19 nt, Homo sapiens
cgacugaucgugaagaauc

SEQ ID NO: 686710 - RNA, 19 nt, Homo sapiens
caaaggcagcugugcagaa

SEQ ID NO: 686711 - RNA, 19 nt, Homo sapiens
ugaaggaggauacagaguu

SEQ ID NO: 686712 - RNA, 19 nt, Homo sapiens
cagcagagccagaaacagu

SEQ ID NO: 686713 - RNA, 19 nt, Homo sapiens
agaaggcacagaagcauuu

SEQ ID NO: 686714 - RNA, 19 nt, Homo sapiens
auagacagugccagaauua

SEQ ID NO: 686715 - RNA, 19 nt, Homo sapiens
ucacugcagucugaaucua

SEQ ID NO: 686716 - RNA, 19 nt, Homo sapiens
gagagaaauaaacgcagua

SEQ ID NO: 686717 - RNA, 19 nt, Homo sapiens
cccaggauguacucuguuu

SEQ ID NO: 686718 - RNA, 19 nt, Homo sapiens
guacggaaccugcccuaca

SEQ ID NO: 686719 - RNA, 19 nt, Homo sapiens
ccauucgaauugugagaaa

SEQ ID NO: 686720 - RNA, 19 nt, Homo sapiens
ccaguggccauucgaauug

SEQ ID NO: 686721 - RNA, 19 nt, Homo sapiens
gaaaccagcaaaccagaag

SEQ ID NO: 686722 - RNA, 19 nt, Homo sapiens
ggaagaggaaagugaagau

SEQ ID NO: 686723 - RNA, 19 nt, Homo sapiens
gaaagaugagaagaagaaa

SEQ ID NO: 686724 - RNA, 19 nt, Homo sapiens
ccaaguaaagcccagagaa

SEQ ID NO: 686725 - RNA, 19 nt, Homo sapiens
cgugaaacuugguggaaga

SEQ ID NO: 686726 - RNA, 19 nt, Homo sapiens
cuccagggcugcugagcua

SEQ ID NO: 686727 - RNA, 19 nt, Homo sapiens
gcagacccuucagcuguga

SEQ ID NO: 686728 - RNA, 19 nt, Homo sapiens
gcagaccaccuccaagauc

SEQ ID NO: 686729 - RNA, 19 nt, Homo sapiens
ggaggaggaggaagaggaa

SEQ ID NO: 686730 - RNA, 19 nt, Homo sapiens
ccaagacacaccuucagaa

SEQ ID NO: 686731 - RNA, 19 nt, Homo sapiens
gauggcaaguuccgcaagu

SEQ ID NO: 686732 - RNA, 19 nt, Homo sapiens
gaagaggaaagugaagaug

SEQ ID NO: 686733 - RNA, 19 nt, Homo sapiens
gugacuaccugaacuucga

SEQ ID NO: 686734 - RNA, 19 nt, Homo sapiens
caagcaggaugcgaagaga

SEQ ID NO: 686735 - RNA, 19 nt, Homo sapiens
gcugcuccaucuccaagaa

SEQ ID NO: 686736 - RNA, 19 nt, Homo sapiens
ggcgguagcgugaaacuug

SEQ ID NO: 686737 - RNA, 19 nt, Homo sapiens
gaauaaagcuccggaauau

SEQ ID NO: 686738 - RNA, 19 nt, Homo sapiens
gcgauggucuugacuauua

SEQ ID NO: 686739 - RNA, 19 nt, Homo sapiens
gaacacaaauagugcaauu

SEQ ID NO: 686740 - RNA, 19 nt, Homo sapiens
gcaaagaaaugguuaugga

SEQ ID NO: 686741 - RNA, 19 nt, Homo sapiens
gcagucagauucuauaaau

SEQ ID NO: 686742 - RNA, 19 nt, Homo sapiens
uggcaaagcuuauccaauu

SEQ ID NO: 686743 - RNA, 19 nt, Homo sapiens
guuuguagcugcuggauua

SEQ ID NO: 686744 - RNA, 19 nt, Homo sapiens
gaagucaguuauuugagua

SEQ ID NO: 686745 - RNA, 19 nt, Homo sapiens
gagaaaugaccauaucuua

SEQ ID NO: 686746 - RNA, 19 nt, Homo sapiens
ggaaguacguuuaaaugug

SEQ ID NO: 686747 - RNA, 19 nt, Homo sapiens
caaauuggcuuuaccaucu

SEQ ID NO: 686748 - RNA, 19 nt, Homo sapiens
ggaaggaggaagucaguua

SEQ ID NO: 686749 - RNA, 19 nt, Homo sapiens
caucuuugguuaucaguua

SEQ ID NO: 686750 - RNA, 19 nt, Homo sapiens
ggaagaauccucucaugaa

SEQ ID NO: 686751 - RNA, 19 nt, Homo sapiens
gaccauaucuuaaacuauc

SEQ ID NO: 686752 - RNA, 19 nt, Homo sapiens
gaggagauauggaacagaa

SEQ ID NO: 686753 - RNA, 19 nt, Homo sapiens
ccauucagcuucagucuuu

SEQ ID NO: 686754 - RNA, 19 nt, Homo sapiens
ggaaagucuugcacuauug

SEQ ID NO: 686755 - RNA, 19 nt, Homo sapiens
gggaaagucuugcacuauu

SEQ ID NO: 686756 - RNA, 19 nt, Homo sapiens
ccgaguggcuccugaauuu

SEQ ID NO: 686757 - RNA, 19 nt, Homo sapiens
gcaaagagccauucagcuu

SEQ ID NO: 686758 - RNA, 19 nt, Homo sapiens
gaugaucgcagggauauua

SEQ ID NO: 686759 - RNA, 19 nt, Homo sapiens
ugaaggaucuguuccaaau

SEQ ID NO: 686760 - RNA, 19 nt, Homo sapiens
cagagaaucuuaauugcaa

SEQ ID NO: 686761 - RNA, 19 nt, Homo sapiens
cuaaaggaauucuucauga

SEQ ID NO: 686762 - RNA, 19 nt, Homo sapiens
cagcuucagucuuuacaua

SEQ ID NO: 686763 - RNA, 19 nt, Homo sapiens
ugaaugaggucuuccaugu

SEQ ID NO: 686764 - RNA, 19 nt, Homo sapiens
ugacaaccguagaauaauu

SEQ ID NO: 686765 - RNA, 19 nt, Homo sapiens
gagggaaagucuugcacua

SEQ ID NO: 686766 - RNA, 19 nt, Homo sapiens
gcacaauucuugaacugau

SEQ ID NO: 686767 - RNA, 19 nt, Homo sapiens
gaacagcagcucuuuaagu

SEQ ID NO: 686768 - RNA, 19 nt, Homo sapiens
ggaagucaguuauuugagu

SEQ ID NO: 686769 - RNA, 19 nt, Homo sapiens
gcagggaacugucauucau

SEQ ID NO: 686770 - RNA, 19 nt, Homo sapiens
gaacuuagaagaacuagag

SEQ ID NO: 686771 - RNA, 19 nt, Homo sapiens
gauggugccuucuauuaau

SEQ ID NO: 686772 - RNA, 19 nt, Homo sapiens
uagaagaacuagaggagaa

SEQ ID NO: 686773 - RNA, 19 nt, Homo sapiens
gagaagaacuuagaagaac

SEQ ID NO: 686774 - RNA, 19 nt, Homo sapiens
ggagaagaacuuagaagaa

SEQ ID NO: 686775 - RNA, 19 nt, Homo sapiens
ggacaugcccacugaauuc

SEQ ID NO: 686776 - RNA, 19 nt, Homo sapiens
gggcuucagugaccaguaa

SEQ ID NO: 686777 - RNA, 19 nt, Homo sapiens
gaagaauccucucaugaac

SEQ ID NO: 686778 - RNA, 19 nt, Homo sapiens
aaugaggucuuccauguuu

SEQ ID NO: 686779 - RNA, 19 nt, Homo sapiens
gaauucagguccuuugagu

SEQ ID NO: 686780 - RNA, 19 nt, Homo sapiens
aaauugagguggacauuau

SEQ ID NO: 686781 - RNA, 19 nt, Homo sapiens
guucagagaaucuuaauug

SEQ ID NO: 686782 - RNA, 19 nt, Homo sapiens
ugaauaaagcuccggaaua

SEQ ID NO: 686783 - RNA, 19 nt, Homo sapiens
uuuaguagcuccauaucua

SEQ ID NO: 686784 - RNA, 19 nt, Homo sapiens
aaggaucuguuccaaauaa

SEQ ID NO: 686785 - RNA, 19 nt, Homo sapiens
gaggcaauauuauacuuug

SEQ ID NO: 686786 - RNA, 19 nt, Homo sapiens
cagcagcucuuuaaguguu

SEQ ID NO: 686787 - RNA, 19 nt, Homo sapiens
gaagaacuuagaagaacua

SEQ ID NO: 686788 - RNA, 19 nt, Homo sapiens
cacaaaguauuaucucuga

SEQ ID NO: 686789 - RNA, 19 nt, Homo sapiens
ccaaacagcugcaaaaugu

SEQ ID NO: 686790 - RNA, 19 nt, Homo sapiens
gaacaacgaccuagagaac

SEQ ID NO: 686791 - RNA, 19 nt, Homo sapiens
gaggagaaaucuacuacuc

SEQ ID NO: 686792 - RNA, 19 nt, Homo sapiens
auaaagcuccggaauauuu

SEQ ID NO: 686793 - RNA, 19 nt, Homo sapiens
caucuuggcuuuaguaggu

SEQ ID NO: 686794 - RNA, 19 nt, Homo sapiens
gcaguacuguggaguuuua

SEQ ID NO: 686795 - RNA, 19 nt, Homo sapiens
gaacuucgcaucaauacca

SEQ ID NO: 686796 - RNA, 19 nt, Homo sapiens
gaugaaguguuuggugauu

SEQ ID NO: 686797 - RNA, 19 nt, Homo sapiens
ggcaaagcuuauccaauuu

SEQ ID NO: 686798 - RNA, 19 nt, Homo sapiens
gaggaagucaguuauuuga

SEQ ID NO: 686799 - RNA, 19 nt, Homo sapiens
gauauuaggcgcaaugauc

SEQ ID NO: 686800 - RNA, 19 nt, Homo sapiens
gcaaguaagccugaaguga

SEQ ID NO: 686801 - RNA, 19 nt, Homo sapiens
ugaguaagccucuaguuga

SEQ ID NO: 686802 - RNA, 19 nt, Homo sapiens
ccagauagucaucaacuuu

SEQ ID NO: 686803 - RNA, 19 nt, Homo sapiens
ugauauacaccacaaagua

SEQ ID NO: 686804 - RNA, 19 nt, Homo sapiens
gaagugaggauacugcaau

SEQ ID NO: 686805 - RNA, 19 nt, Homo sapiens
gagggaguccuguguguuu

SEQ ID NO: 686806 - RNA, 19 nt, Homo sapiens
guugguaacuugccacaug

SEQ ID NO: 686807 - RNA, 19 nt, Homo sapiens
aaacuguucuggcaccaaa

SEQ ID NO: 686808 - RNA, 19 nt, Homo sapiens
aaacaauucugugagcaaa

SEQ ID NO: 686809 - RNA, 19 nt, Homo sapiens
uaacuugccacaugauauu

SEQ ID NO: 686810 - RNA, 19 nt, Homo sapiens
caucauauggagaaguuua

SEQ ID NO: 686811 - RNA, 19 nt, Homo sapiens
ggacacagauuuucauagu

SEQ ID NO: 686812 - RNA, 19 nt, Homo sapiens
ggauuauugucugucuuua

SEQ ID NO: 686813 - RNA, 19 nt, Homo sapiens
ggaggaagucaguuauuug

SEQ ID NO: 686814 - RNA, 19 nt, Homo sapiens
gcaugauggugccuucuau

SEQ ID NO: 686815 - RNA, 19 nt, Homo sapiens
cuacaaguauauuccagaa

SEQ ID NO: 686816 - RNA, 19 nt, Homo sapiens
gaugaagaaucagaagaug

SEQ ID NO: 686817 - RNA, 19 nt, Homo sapiens
gaauguggacguugaaaca

SEQ ID NO: 686818 - RNA, 19 nt, Homo sapiens
ggacugagaaaugaccaua

SEQ ID NO: 686819 - RNA, 19 nt, Homo sapiens
guuuaaauguggaagagaa

SEQ ID NO: 686820 - RNA, 19 nt, Homo sapiens
ggaacaagaagaaagacaa

SEQ ID NO: 686821 - RNA, 19 nt, Homo sapiens
gaaggaucuguuccaaaua

SEQ ID NO: 686822 - RNA, 19 nt, Homo sapiens
caaccagaaagaaaguuua

SEQ ID NO: 686823 - RNA, 19 nt, Homo sapiens
caucuaccauuacuguuau

SEQ ID NO: 686824 - RNA, 19 nt, Homo sapiens
gaguggcuccugaauuuaa

SEQ ID NO: 686825 - RNA, 19 nt, Homo sapiens
cuaguugacuuuucucuua

SEQ ID NO: 686826 - RNA, 19 nt, Homo sapiens
gaaggaggaagucaguuau

SEQ ID NO: 686827 - RNA, 19 nt, Homo sapiens
guucucugguaauguaaua

SEQ ID NO: 686828 - RNA, 19 nt, Homo sapiens
uagaggagccuuuggaaga

SEQ ID NO: 686829 - RNA, 19 nt, Homo sapiens
gaagaaagacaaccaucuc

SEQ ID NO: 686830 - RNA, 19 nt, Homo sapiens
ugaagaaucagaagaugaa

SEQ ID NO: 686831 - RNA, 19 nt, Homo sapiens
guacauaccaguuucugau

SEQ ID NO: 686832 - RNA, 19 nt, Homo sapiens
acaaguauggcaaagcuua

SEQ ID NO: 686833 - RNA, 19 nt, Homo sapiens
gguaauguaauaagcauga

SEQ ID NO: 686834 - RNA, 19 nt, Homo sapiens
gacauuauuuccccaauuu

SEQ ID NO: 686835 - RNA, 19 nt, Homo sapiens
uaaaggaauucuucaugag

SEQ ID NO: 686836 - RNA, 19 nt, Homo sapiens
agaaucagaagaugaagua

SEQ ID NO: 686837 - RNA, 19 nt, Homo sapiens
gaagagggauccacuguua

SEQ ID NO: 686838 - RNA, 19 nt, Homo sapiens
gcacaucucccacuucauu

SEQ ID NO: 686839 - RNA, 19 nt, Homo sapiens
gugauucgcugguguauga

SEQ ID NO: 686840 - RNA, 19 nt, Homo sapiens
guucuucccuuguccuaua

SEQ ID NO: 686841 - RNA, 19 nt, Homo sapiens
ggaaggaugcccagucaaa

SEQ ID NO: 686842 - RNA, 19 nt, Homo sapiens
guacaagucugccuuuaac

SEQ ID NO: 686843 - RNA, 19 nt, Homo sapiens
caauaaggcuguguuggaa

SEQ ID NO: 686844 - RNA, 19 nt, Homo sapiens
ucaccaaccuacccaguuu

SEQ ID NO: 686845 - RNA, 19 nt, Homo sapiens
guacugcuaugauggauuc

SEQ ID NO: 686846 - RNA, 19 nt, Homo sapiens
guccugaccugugcaauaa

SEQ ID NO: 686847 - RNA, 19 nt, Homo sapiens
gcuacgggcugaguuguuu

SEQ ID NO: 686848 - RNA, 19 nt, Homo sapiens
gcgcacaucucccacuuca

SEQ ID NO: 686849 - RNA, 19 nt, Homo sapiens
caguguaccugugcuauaa

SEQ ID NO: 686850 - RNA, 19 nt, Homo sapiens
gcagagcuacugagccuuu

SEQ ID NO: 686851 - RNA, 19 nt, Homo sapiens
guaccugcaucccuuaguu

SEQ ID NO: 686852 - RNA, 19 nt, Homo sapiens
gccacaaacuuuacucuca

SEQ ID NO: 686853 - RNA, 19 nt, Homo sapiens
gggauccacuguuaccaaa

SEQ ID NO: 686854 - RNA, 19 nt, Homo sapiens
acacacagauguucucaca

SEQ ID NO: 686855 - RNA, 19 nt, Homo sapiens
gcagaugucucccuaugac

SEQ ID NO: 686856 - RNA, 19 nt, Homo sapiens
uuaaacugcuucccuguug

SEQ ID NO: 686857 - RNA, 19 nt, Homo sapiens
gaaguacaagucugccuuu

SEQ ID NO: 686858 - RNA, 19 nt, Homo sapiens
acacagauguucucacagu

SEQ ID NO: 686859 - RNA, 19 nt, Homo sapiens
gaacucaacccgucaucug

SEQ ID NO: 686860 - RNA, 19 nt, Homo sapiens
cuaccuaaguguuuguauu

SEQ ID NO: 686861 - RNA, 19 nt, Homo sapiens
gggccaagcuccggaaugu

SEQ ID NO: 686862 - RNA, 19 nt, Homo sapiens
gcaguguaccugugcuaua

SEQ ID NO: 686863 - RNA, 19 nt, Homo sapiens
gagaaagggaagggaaaua

SEQ ID NO: 686864 - RNA, 19 nt, Homo sapiens
cagcugagcccaucacaga

SEQ ID NO: 686865 - RNA, 19 nt, Homo sapiens
gaagggauucuagaguuaa

SEQ ID NO: 686866 - RNA, 19 nt, Homo sapiens
gagauauuauuccugacaa

SEQ ID NO: 686867 - RNA, 19 nt, Homo sapiens
ggaaauagggcaccauggu

SEQ ID NO: 686868 - RNA, 19 nt, Homo sapiens
ggaacaggcugggaaggau

SEQ ID NO: 686869 - RNA, 19 nt, Homo sapiens
ggaacucagugcuggacuu

SEQ ID NO: 686870 - RNA, 19 nt, Homo sapiens
cuggaaagaugcagagcua

SEQ ID NO: 686871 - RNA, 19 nt, Homo sapiens
guguagaccuugauaccaa

SEQ ID NO: 686872 - RNA, 19 nt, Homo sapiens
gugcagaugucucccuaug

SEQ ID NO: 686873 - RNA, 19 nt, Homo sapiens
ccacuucauucacaacguu

SEQ ID NO: 686874 - RNA, 19 nt, Homo sapiens
ggacauaguggccuucgau

SEQ ID NO: 686875 - RNA, 19 nt, Homo sapiens
uggagucgcugguagagaa

SEQ ID NO: 686876 - RNA, 19 nt, Homo sapiens
ccucagagcgccucaguga

SEQ ID NO: 686877 - RNA, 19 nt, Homo sapiens
cugcagggcuuccucaaau

SEQ ID NO: 686878 - RNA, 19 nt, Homo sapiens
ccagaaugcuagagaccuu

SEQ ID NO: 686879 - RNA, 19 nt, Homo sapiens
cuuaugagguucuuaugga

SEQ ID NO: 686880 - RNA, 19 nt, Homo sapiens
gcauugcccuggucauuuu

SEQ ID NO: 686881 - RNA, 19 nt, Homo sapiens
caaccuacccaguuuguuc

SEQ ID NO: 686882 - RNA, 19 nt, Homo sapiens
gcugguguaugaugaggaa

SEQ ID NO: 686883 - RNA, 19 nt, Homo sapiens
guaccaaacaggagaugaa

SEQ ID NO: 686884 - RNA, 19 nt, Homo sapiens
gugcuggccuccugugaug

SEQ ID NO: 686885 - RNA, 19 nt, Homo sapiens
gccaagcuccggaauguug

SEQ ID NO: 686886 - RNA, 19 nt, Homo sapiens
aaacaggagaugaaaguug

SEQ ID NO: 686887 - RNA, 19 nt, Homo sapiens
ccaaacaggagaugaaagu

SEQ ID NO: 686888 - RNA, 19 nt, Homo sapiens
ggaacgcuccagccacaaa

SEQ ID NO: 686889 - RNA, 19 nt, Homo sapiens
caacagcugcucacuccuu

SEQ ID NO: 686890 - RNA, 19 nt, Homo sapiens
gcuccagccacaaacuuua

SEQ ID NO: 686891 - RNA, 19 nt, Homo sapiens
ggaagcaucccuggaguuc

SEQ ID NO: 686892 - RNA, 19 nt, Homo sapiens
guacgaggcaguucuacga

SEQ ID NO: 686893 - RNA, 19 nt, Homo sapiens
ggaagagggauccacuguu

SEQ ID NO: 686894 - RNA, 19 nt, Homo sapiens
gagcaggugucagcacauc

SEQ ID NO: 686895 - RNA, 19 nt, Homo sapiens
ccgcagacccuacaagguu

SEQ ID NO: 686896 - RNA, 19 nt, Homo sapiens
gcaaggaccacguggacau

SEQ ID NO: 686897 - RNA, 19 nt, Homo sapiens
gaggagcugucaggaagug

SEQ ID NO: 686898 - RNA, 19 nt, Homo sapiens
cuccaugccuuucuaccua

SEQ ID NO: 686899 - RNA, 19 nt, Homo sapiens
acaauaaggcuguguugga

SEQ ID NO: 686900 - RNA, 19 nt, Homo sapiens
cagauguucucacaguuca

SEQ ID NO: 686901 - RNA, 19 nt, Homo sapiens
acaacuugcuccucuguca

SEQ ID NO: 686902 - RNA, 19 nt, Homo sapiens
ccaauaauggucccucuuc

SEQ ID NO: 686903 - RNA, 19 nt, Homo sapiens
ugaauucuuugacucuugu

SEQ ID NO: 686904 - RNA, 19 nt, Homo sapiens
gaaguuuuguuggauguaa

SEQ ID NO: 686905 - RNA, 19 nt, Homo sapiens
ggaugucauucuccaccaa

SEQ ID NO: 686906 - RNA, 19 nt, Homo sapiens
gaaagaugcagagcuacug

SEQ ID NO: 686907 - RNA, 19 nt, Homo sapiens
gauauuauuccugacaaug

SEQ ID NO: 686908 - RNA, 19 nt, Homo sapiens
accuauggcuacuacaaua

SEQ ID NO: 686909 - RNA, 19 nt, Homo sapiens
gcacagcggauggcacaga

SEQ ID NO: 686910 - RNA, 19 nt, Homo sapiens
gcacuccucauacuuacug

SEQ ID NO: 686911 - RNA, 19 nt, Homo sapiens
caaggaccacguggacaua

SEQ ID NO: 686912 - RNA, 19 nt, Homo sapiens
ugagcucacugucuuuauc

SEQ ID NO: 686913 - RNA, 19 nt, Homo sapiens
cauaguggccuucgauaag

SEQ ID NO: 686914 - RNA, 19 nt, Homo sapiens
ucagagcgccucagugaca

SEQ ID NO: 686915 - RNA, 19 nt, Homo sapiens
gcaggugucagcacaucaa

SEQ ID NO: 686916 - RNA, 19 nt, Homo sapiens
uguaguuccuucaaaguca

SEQ ID NO: 686917 - RNA, 19 nt, Homo sapiens
gaaagggaagggaaauagg

SEQ ID NO: 686918 - RNA, 19 nt, Homo sapiens
gcucuguucuucccuuguc

SEQ ID NO: 686919 - RNA, 19 nt, Homo sapiens
caagcgaggacaacaggaa

SEQ ID NO: 686920 - RNA, 19 nt, Homo sapiens
gacauaguggccuucgaua

SEQ ID NO: 686921 - RNA, 19 nt, Homo sapiens
aggcagagcccuauuugga

SEQ ID NO: 686922 - RNA, 19 nt, Homo sapiens
cgaggagccugccuuacca

SEQ ID NO: 686923 - RNA, 19 nt, Homo sapiens
gaacucagugcuggacuuc

SEQ ID NO: 686924 - RNA, 19 nt, Homo sapiens
ugucaucuguguagaccuu

SEQ ID NO: 686925 - RNA, 19 nt, Homo sapiens
ggaaagaugcagagcuacu

SEQ ID NO: 686926 - RNA, 19 nt, Homo sapiens
gggcaccugaugacucuaa

SEQ ID NO: 686927 - RNA, 19 nt, Homo sapiens
caucaccuauggcuacuac

SEQ ID NO: 686928 - RNA, 19 nt, Homo sapiens
cagcucugcucacacuaug

SEQ ID NO: 686929 - RNA, 19 nt, Homo sapiens
gauguucucacaguucauu

SEQ ID NO: 686930 - RNA, 19 nt, Homo sapiens
gcacccaucccugaggaaa

SEQ ID NO: 686931 - RNA, 19 nt, Homo sapiens
gaaggaugcccagucaaag

SEQ ID NO: 686932 - RNA, 19 nt, Homo sapiens
gagcucacugucuuuauca

SEQ ID NO: 686933 - RNA, 19 nt, Homo sapiens
gcccugagcuggcuaucac

SEQ ID NO: 686934 - RNA, 19 nt, Homo sapiens
aaguacaagucugccuuua

SEQ ID NO: 686935 - RNA, 19 nt, Homo sapiens
acucuaaccucaacacaac

SEQ ID NO: 686936 - RNA, 19 nt, Homo sapiens
cagccucucugggcaguga

SEQ ID NO: 686937 - RNA, 19 nt, Homo sapiens
ccaagaagcugaagaaaua

SEQ ID NO: 686938 - RNA, 19 nt, Homo sapiens
guacauaccucucaaguuu

SEQ ID NO: 686939 - RNA, 19 nt, Homo sapiens
gcacauaguuccagccuua

SEQ ID NO: 686940 - RNA, 19 nt, Homo sapiens
guacagagcuuguuucaau

SEQ ID NO: 686941 - RNA, 19 nt, Homo sapiens
ggagcaagcuggugaauga

SEQ ID NO: 686942 - RNA, 19 nt, Homo sapiens
ggacagaguauuucauuua

SEQ ID NO: 686943 - RNA, 19 nt, Homo sapiens
gagcaggcuugcaauauua

SEQ ID NO: 686944 - RNA, 19 nt, Homo sapiens
gaaaacagguucuagaaua

SEQ ID NO: 686945 - RNA, 19 nt, Homo sapiens
ggacaaaguuucucaguca

SEQ ID NO: 686946 - RNA, 19 nt, Homo sapiens
gaaagacucuggugucaug

SEQ ID NO: 686947 - RNA, 19 nt, Homo sapiens
gagaaggacucacuuaaga

SEQ ID NO: 686948 - RNA, 19 nt, Homo sapiens
gcuguuagcuuuacuggua

SEQ ID NO: 686949 - RNA, 19 nt, Homo sapiens
ucaaagggaugcuauuuaa

SEQ ID NO: 686950 - RNA, 19 nt, Homo sapiens
gaggagcccuuaugaauga

SEQ ID NO: 686951 - RNA, 19 nt, Homo sapiens
guucugacaucuuucauua

SEQ ID NO: 686952 - RNA, 19 nt, Homo sapiens
gaaggcagaauaugaaaua

SEQ ID NO: 686953 - RNA, 19 nt, Homo sapiens
gaaagaauaucagacaaug

SEQ ID NO: 686954 - RNA, 19 nt, Homo sapiens
caaauggccagcuaaauua

SEQ ID NO: 686955 - RNA, 19 nt, Homo sapiens
gcaguugccuuaucaaaug

SEQ ID NO: 686956 - RNA, 19 nt, Homo sapiens
gagauuaaccagccaaaua

SEQ ID NO: 686957 - RNA, 19 nt, Homo sapiens
gaaaugaagugccaggaau

SEQ ID NO: 686958 - RNA, 19 nt, Homo sapiens
ggacugaauugugagaaua

SEQ ID NO: 686959 - RNA, 19 nt, Homo sapiens
aaacugaccuguucuaugu

SEQ ID NO: 686960 - RNA, 19 nt, Homo sapiens
ggaagagacugcccagcua

SEQ ID NO: 686961 - RNA, 19 nt, Homo sapiens
cauaaugcauggauccuua

SEQ ID NO: 686962 - RNA, 19 nt, Homo sapiens
uuagguaccugccugauua

SEQ ID NO: 686963 - RNA, 19 nt, Homo sapiens
ggagcaggcuugcaauauu

SEQ ID NO: 686964 - RNA, 19 nt, Homo sapiens
caugaaagcacaagaauaa

SEQ ID NO: 686965 - RNA, 19 nt, Homo sapiens
ucucccagcuguuaaauua

SEQ ID NO: 686966 - RNA, 19 nt, Homo sapiens
gcucacaccuccugucaaa

SEQ ID NO: 686967 - RNA, 19 nt, Homo sapiens
caaccaaacuacuauuaga

SEQ ID NO: 686968 - RNA, 19 nt, Homo sapiens
gaucauugguuuacuuuca

SEQ ID NO: 686969 - RNA, 19 nt, Homo sapiens
gcagauguguugaauaaag

SEQ ID NO: 686970 - RNA, 19 nt, Homo sapiens
gaauaaggcuggagauggu

SEQ ID NO: 686971 - RNA, 19 nt, Homo sapiens
caaggagggugcuuugaaa

SEQ ID NO: 686972 - RNA, 19 nt, Homo sapiens
uaacacacccuuagaagaa

SEQ ID NO: 686973 - RNA, 19 nt, Homo sapiens
gauauauacuugcuaagga

SEQ ID NO: 686974 - RNA, 19 nt, Homo sapiens
aggcagauguguugaauaa

SEQ ID NO: 686975 - RNA, 19 nt, Homo sapiens
gcaagcuggugaaugagua

SEQ ID NO: 686976 - RNA, 19 nt, Homo sapiens
cuacauaugucaagcuuau

SEQ ID NO: 686977 - RNA, 19 nt, Homo sapiens
gaauuucacuuagaagaga

SEQ ID NO: 686978 - RNA, 19 nt, Homo sapiens
gagaggagcccuuaugaau

SEQ ID NO: 686979 - RNA, 19 nt, Homo sapiens
ccacuuccuuucuuucuaa

SEQ ID NO: 686980 - RNA, 19 nt, Homo sapiens
uauauggacugaauuguga

SEQ ID NO: 686981 - RNA, 19 nt, Homo sapiens
gggaugcuauuuaaacuga

SEQ ID NO: 686982 - RNA, 19 nt, Homo sapiens
ggagggugcuuugaaacua

SEQ ID NO: 686983 - RNA, 19 nt, Homo sapiens
guuaugaacuugaauugga

SEQ ID NO: 686984 - RNA, 19 nt, Homo sapiens
gaaauguccugaguaaagu

SEQ ID NO: 686985 - RNA, 19 nt, Homo sapiens
ucaaauggccagcuaaauu

SEQ ID NO: 686986 - RNA, 19 nt, Homo sapiens
gcaaaacccugaacucuau

SEQ ID NO: 686987 - RNA, 19 nt, Homo sapiens
gaauaaaggaguugauuag

SEQ ID NO: 686988 - RNA, 19 nt, Homo sapiens
caaaugagggacaaaguuu

SEQ ID NO: 686989 - RNA, 19 nt, Homo sapiens
guucagauccaucauagua

SEQ ID NO: 686990 - RNA, 19 nt, Homo sapiens
uaaaggaguugauuagucu

SEQ ID NO: 686991 - RNA, 19 nt, Homo sapiens
cauaauggcucuaggucaa

SEQ ID NO: 686992 - RNA, 19 nt, Homo sapiens
uagcuuuacugguacuuua

SEQ ID NO: 686993 - RNA, 19 nt, Homo sapiens
ucucaucugugccauauuu

SEQ ID NO: 686994 - RNA, 19 nt, Homo sapiens
gaacuugaauuggauuagu

SEQ ID NO: 686995 - RNA, 19 nt, Homo sapiens
caucucuucucuugaauuu

SEQ ID NO: 686996 - RNA, 19 nt, Homo sapiens
gcucacaucaucuuaguuu

SEQ ID NO: 686997 - RNA, 19 nt, Homo sapiens
aaucagcgaucauugguuu

SEQ ID NO: 686998 - RNA, 19 nt, Homo sapiens
ggagacaucuguuauucca

SEQ ID NO: 686999 - RNA, 19 nt, Homo sapiens
gcacaauguucaaaccaau

SEQ ID NO: 687000 - RNA, 19 nt, Homo sapiens
uaaagaagacuacagcuau

SEQ ID NO: 687001 - RNA, 19 nt, Homo sapiens
ugaaggugcuuuaaaguuc

SEQ ID NO: 687002 - RNA, 19 nt, Homo sapiens
cauggcaucucuaaugaaa

SEQ ID NO: 687003 - RNA, 19 nt, Homo sapiens
cagaaauacuuaucucaug

SEQ ID NO: 687004 - RNA, 19 nt, Homo sapiens
ugaaacagaugaugagaag

SEQ ID NO: 687005 - RNA, 19 nt, Homo sapiens
gagaaagaauaucagacaa

SEQ ID NO: 687006 - RNA, 19 nt, Homo sapiens
ucugaaauguccugaguaa

SEQ ID NO: 687007 - RNA, 19 nt, Homo sapiens
cuaaagaccuuguucaacu

SEQ ID NO: 687008 - RNA, 19 nt, Homo sapiens
gaauagaguggaauauaga

SEQ ID NO: 687009 - RNA, 19 nt, Homo sapiens
ugaauagaguggaauauag

SEQ ID NO: 687010 - RNA, 19 nt, Homo sapiens
ggaaggccauguucagauc

SEQ ID NO: 687011 - RNA, 19 nt, Homo sapiens
ccaaauacacauugagauu

SEQ ID NO: 687012 - RNA, 19 nt, Homo sapiens
gcaaggagggugcuuugaa

SEQ ID NO: 687013 - RNA, 19 nt, Homo sapiens
gggccaagauuacggcauu

SEQ ID NO: 687014 - RNA, 19 nt, Homo sapiens
gaauugaaacagaugauga

SEQ ID NO: 687015 - RNA, 19 nt, Homo sapiens
gaauuggauuaguaucuug

SEQ ID NO: 687016 - RNA, 19 nt, Homo sapiens
ggcaauuaguuaacaugua

SEQ ID NO: 687017 - RNA, 19 nt, Homo sapiens
cagaaugccuaaauugugu

SEQ ID NO: 687018 - RNA, 19 nt, Homo sapiens
aguauaggcuguuagcuuu

SEQ ID NO: 687019 - RNA, 19 nt, Homo sapiens
gcaccaaguugcucacagu

SEQ ID NO: 687020 - RNA, 19 nt, Homo sapiens
ggcagaauaugaaauaaag

SEQ ID NO: 687021 - RNA, 19 nt, Homo sapiens
gaagagacugcccagcuaa

SEQ ID NO: 687022 - RNA, 19 nt, Homo sapiens
gagggagaaccgaagauua

SEQ ID NO: 687023 - RNA, 19 nt, Homo sapiens
ccaccgcaguucuuaauau

SEQ ID NO: 687024 - RNA, 19 nt, Homo sapiens
gacauuagcugacaauucc

SEQ ID NO: 687025 - RNA, 19 nt, Homo sapiens
ugaauuugcugccugcuau

SEQ ID NO: 687026 - RNA, 19 nt, Homo sapiens
caaauauccaggaaaguuu

SEQ ID NO: 687027 - RNA, 19 nt, Homo sapiens
gaaccaaucagcgaucauu

SEQ ID NO: 687028 - RNA, 19 nt, Homo sapiens
ucagauccaucauaguauu

SEQ ID NO: 687029 - RNA, 19 nt, Homo sapiens
gaguagaaagugaacauuu

SEQ ID NO: 687030 - RNA, 19 nt, Homo sapiens
cauagucccuuuccuuuua

SEQ ID NO: 687031 - RNA, 19 nt, Homo sapiens
uaaagaccuuguucaacuu

SEQ ID NO: 687032 - RNA, 19 nt, Homo sapiens
cagagcuuguuucaauuua

SEQ ID NO: 687033 - RNA, 19 nt, Homo sapiens
uagacgggcuguucagauu

SEQ ID NO: 687034 - RNA, 19 nt, Homo sapiens
caaccaagaagcugaagaa

SEQ ID NO: 687035 - RNA, 19 nt, Homo sapiens
ggaaaacaauacagauuug

SEQ ID NO: 687036 - RNA, 19 nt, Homo sapiens
ccaaauauccaggaaaguu

SEQ ID NO: 687037 - RNA, 19 nt, Homo sapiens
acaagaagcuggagcacua

SEQ ID NO: 687038 - RNA, 19 nt, Homo sapiens
ugaaggagauugagcagaa

SEQ ID NO: 687039 - RNA, 19 nt, Homo sapiens
uggaagaccugaagacuca

SEQ ID NO: 687040 - RNA, 19 nt, Homo sapiens
gaggagcgcuacagguaug

SEQ ID NO: 687041 - RNA, 19 nt, Homo sapiens
caacaucgcccaccugaag

SEQ ID NO: 687042 - RNA, 19 nt, Homo sapiens
ucaagcaaguguucgagaa

SEQ ID NO: 687043 - RNA, 19 nt, Homo sapiens
uaaguccaaugcacuguau

SEQ ID NO: 687044 - RNA, 19 nt, Homo sapiens
gaagaagaaccagaaguca

SEQ ID NO: 687045 - RNA, 19 nt, Homo sapiens
cagcaggugucacgcauca

SEQ ID NO: 687046 - RNA, 19 nt, Homo sapiens
gaagagcuacgggagauca

SEQ ID NO: 687047 - RNA, 19 nt, Homo sapiens
ucgcccagcugcacaagaa

SEQ ID NO: 687048 - RNA, 19 nt, Homo sapiens
uggaugcucugcuggaaga

SEQ ID NO: 687049 - RNA, 19 nt, Homo sapiens
uggcagugcugacaacauc

SEQ ID NO: 687050 - RNA, 19 nt, Homo sapiens
cagccucucuggccucuca

SEQ ID NO: 687051 - RNA, 19 nt, Homo sapiens
ccagguuguucagcccuua

SEQ ID NO: 687052 - RNA, 19 nt, Homo sapiens
ucaccgagcagaucaagau

SEQ ID NO: 687053 - RNA, 19 nt, Homo sapiens
gaucaaggagggacagucu

SEQ ID NO: 687054 - RNA, 19 nt, Homo sapiens
acgacaauguggcagagua

SEQ ID NO: 687055 - RNA, 19 nt, Homo sapiens
ggaggagcgcuacagguau

SEQ ID NO: 687056 - RNA, 19 nt, Homo sapiens
gagaagaagaaccagaagu

SEQ ID NO: 687057 - RNA, 19 nt, Homo sapiens
aggaggagcgcuacaggua

SEQ ID NO: 687058 - RNA, 19 nt, Homo sapiens
accagaagauccugaagau

SEQ ID NO: 687059 - RNA, 19 nt, Homo sapiens
uggaagagcuacgggagau

SEQ ID NO: 687060 - RNA, 19 nt, Homo sapiens
guuguucagcccuuaauga

SEQ ID NO: 687061 - RNA, 19 nt, Homo sapiens
gaaggagauugagcagaac

SEQ ID NO: 687062 - RNA, 19 nt, Homo sapiens
aagcaaguguucgagaaga

SEQ ID NO: 687063 - RNA, 19 nt, Homo sapiens
guauggugcuccuggaaac

SEQ ID NO: 687064 - RNA, 19 nt, Homo sapiens
ccaaguauggcagcgauga

SEQ ID NO: 687065 - RNA, 19 nt, Homo sapiens
ccucauccgcaacaaguuu

SEQ ID NO: 687066 - RNA, 19 nt, Homo sapiens
agaagaagaaccagaaguc

SEQ ID NO: 687067 - RNA, 19 nt, Homo sapiens
gcaggugucacgcaucaag

SEQ ID NO: 687068 - RNA, 19 nt, Homo sapiens
cagagggacuacaccuaca

SEQ ID NO: 687069 - RNA, 19 nt, Homo sapiens
ggaguuugccagccucauc

SEQ ID NO: 687070 - RNA, 19 nt, Homo sapiens
cgacaauguggcagaguau

SEQ ID NO: 687071 - RNA, 19 nt, Homo sapiens
ucaaggagggacagucuca

SEQ ID NO: 687072 - RNA, 19 nt, Homo sapiens
caccagaagauccugaaga

SEQ ID NO: 687073 - RNA, 19 nt, Homo sapiens
agaacgagaugacgaaccu

SEQ ID NO: 687074 - RNA, 19 nt, Homo sapiens
ucgagaagaagaaccagaa

SEQ ID NO: 687075 - RNA, 19 nt, Homo sapiens
caccaucgccaacuucauc

SEQ ID NO: 687076 - RNA, 19 nt, Homo sapiens
gcaacagcagcagguggua

SEQ ID NO: 687077 - RNA, 19 nt, Homo sapiens
uggccuaccaguccuauga

SEQ ID NO: 687078 - RNA, 19 nt, Homo sapiens
cuaaguccaaugcacugua

SEQ ID NO: 687079 - RNA, 19 nt, Homo sapiens
aggagaagguggccuacca

SEQ ID NO: 687080 - RNA, 19 nt, Homo sapiens
gcaggcaucagcggcuuug

SEQ ID NO: 687081 - RNA, 19 nt, Homo sapiens
ccaacaacgcggacaagca

SEQ ID NO: 687082 - RNA, 19 nt, Homo sapiens
cgaccugacugagcuucau

SEQ ID NO: 687083 - RNA, 19 nt, Homo sapiens
caaguguucgagaagaaga

SEQ ID NO: 687084 - RNA, 19 nt, Homo sapiens
gcaucaagcaaguguucga

SEQ ID NO: 687085 - RNA, 19 nt, Homo sapiens
gccuaccaguccuaugaga

SEQ ID NO: 687086 - RNA, 19 nt, Homo sapiens
gagggacuacaccuacaug

SEQ ID NO: 687087 - RNA, 19 nt, Homo sapiens
agcaaguguucgagaagaa

SEQ ID NO: 687088 - RNA, 19 nt, Homo sapiens
gagauagaguucaacauua

SEQ ID NO: 687089 - RNA, 19 nt, Homo sapiens
ggaagaggcugccaacaga

SEQ ID NO: 687090 - RNA, 19 nt, Homo sapiens
ggucaugccucaauuugua

SEQ ID NO: 687091 - RNA, 19 nt, Homo sapiens
caacauuacuggcaauuau

SEQ ID NO: 687092 - RNA, 19 nt, Homo sapiens
uauccaagcugucagaaua

SEQ ID NO: 687093 - RNA, 19 nt, Homo sapiens
ggaagucccugacacuauu

SEQ ID NO: 687094 - RNA, 19 nt, Homo sapiens
gaaagcuccuauaucauuu

SEQ ID NO: 687095 - RNA, 19 nt, Homo sapiens
ucagugggcuccaaaguaa

SEQ ID NO: 687096 - RNA, 19 nt, Homo sapiens
gaaagcaugucuacagauc

SEQ ID NO: 687097 - RNA, 19 nt, Homo sapiens
ggagauagaguucaacauu

SEQ ID NO: 687098 - RNA, 19 nt, Homo sapiens
cagcugauauguacaguuu

SEQ ID NO: 687099 - RNA, 19 nt, Homo sapiens
guaaauggcugaaaacaaa

SEQ ID NO: 687100 - RNA, 19 nt, Homo sapiens
cuacagaucuuguccacuu

SEQ ID NO: 687101 - RNA, 19 nt, Homo sapiens
ccaaagaaauugacuaugc

SEQ ID NO: 687102 - RNA, 19 nt, Homo sapiens
gaagggaacauuacagaga

SEQ ID NO: 687103 - RNA, 19 nt, Homo sapiens
caagaugacucccaguaau

SEQ ID NO: 687104 - RNA, 19 nt, Homo sapiens
caacauccgauacuugaua

SEQ ID NO: 687105 - RNA, 19 nt, Homo sapiens
caggagcuuugaaaucuua

SEQ ID NO: 687106 - RNA, 19 nt, Homo sapiens
acugaaagcuccuauauca

SEQ ID NO: 687107 - RNA, 19 nt, Homo sapiens
gaucuuguccacuuugaua

SEQ ID NO: 687108 - RNA, 19 nt, Homo sapiens
caaacaagccugaaagugu

SEQ ID NO: 687109 - RNA, 19 nt, Homo sapiens
gcaaauuguugggaucauu

SEQ ID NO: 687110 - RNA, 19 nt, Homo sapiens
caugcaaagucaaaguuua

SEQ ID NO: 687111 - RNA, 19 nt, Homo sapiens
ugaaagcuccuauaucauu

SEQ ID NO: 687112 - RNA, 19 nt, Homo sapiens
gcucucagcugauauguac

SEQ ID NO: 687113 - RNA, 19 nt, Homo sapiens
gggaaagcaugucuacaga

SEQ ID NO: 687114 - RNA, 19 nt, Homo sapiens
gaaauugacuaugcaaacu

SEQ ID NO: 687115 - RNA, 19 nt, Homo sapiens
gucagaauaucaagaugua

SEQ ID NO: 687116 - RNA, 19 nt, Homo sapiens
ggagaugacacacuucuug

SEQ ID NO: 687117 - RNA, 19 nt, Homo sapiens
caaaguaaauggcugaaaa

SEQ ID NO: 687118 - RNA, 19 nt, Homo sapiens
ccaguaauauggcaauugu

SEQ ID NO: 687119 - RNA, 19 nt, Homo sapiens
caaagaaauugacuaugca

SEQ ID NO: 687120 - RNA, 19 nt, Homo sapiens
uaaagucacccuccucuga

SEQ ID NO: 687121 - RNA, 19 nt, Homo sapiens
gcaccgcccucugacauga

SEQ ID NO: 687122 - RNA, 19 nt, Homo sapiens
guggaaaucccaaauauuc

SEQ ID NO: 687123 - RNA, 19 nt, Homo sapiens
ccuuugaacucuaugauga

SEQ ID NO: 687124 - RNA, 19 nt, Homo sapiens
caacaacauccgauacuug

SEQ ID NO: 687125 - RNA, 19 nt, Homo sapiens
gauccaggcuuccaauguc

SEQ ID NO: 687126 - RNA, 19 nt, Homo sapiens
ggaaaucccaaauauucaa

SEQ ID NO: 687127 - RNA, 19 nt, Homo sapiens
caguacacgugaaccauaa

SEQ ID NO: 687128 - RNA, 19 nt, Homo sapiens
ccaacagaguggagauuug

SEQ ID NO: 687129 - RNA, 19 nt, Homo sapiens
cagaaccucuuaugaccuu

SEQ ID NO: 687130 - RNA, 19 nt, Homo sapiens
gagguggaaaucccaaaua

SEQ ID NO: 687131 - RNA, 19 nt, Homo sapiens
gaaccauaaugccaacuac

SEQ ID NO: 687132 - RNA, 19 nt, Homo sapiens
gaacauuacagagaugaug

SEQ ID NO: 687133 - RNA, 19 nt, Homo sapiens
gagccugucucuucuuucu

SEQ ID NO: 687134 - RNA, 19 nt, Homo sapiens
guaaaccucucggccucua

SEQ ID NO: 687135 - RNA, 19 nt, Homo sapiens
gcaggagcuuugaaaucuu

SEQ ID NO: 687136 - RNA, 19 nt, Homo sapiens
ggccaugcaugcaaaguca

SEQ ID NO: 687137 - RNA, 19 nt, Homo sapiens
ugacugaaagcuccuauau

SEQ ID NO: 687138 - RNA, 19 nt, Homo sapiens
gguugaaaguuguuaucuu

SEQ ID NO: 687139 - RNA, 19 nt, Homo sapiens
gcaggucaugccucaauuu

SEQ ID NO: 687140 - RNA, 19 nt, Homo sapiens
gcacccaguucacuagucu

SEQ ID NO: 687141 - RNA, 19 nt, Homo sapiens
caagcagaagggaacauua

SEQ ID NO: 687142 - RNA, 19 nt, Homo sapiens
gcugauacauuuugaguug

SEQ ID NO: 687143 - RNA, 19 nt, Homo sapiens
gcaugcaaagucaaaguuu

SEQ ID NO: 687144 - RNA, 19 nt, Homo sapiens
agacagaaguuuugaguga

SEQ ID NO: 687145 - RNA, 19 nt, Homo sapiens
gaagucccaucuggucaug

SEQ ID NO: 687146 - RNA, 19 nt, Homo sapiens
caaagcauguggaggaaaa

SEQ ID NO: 687147 - RNA, 19 nt, Homo sapiens
cagugucgcugcaaauugu

SEQ ID NO: 687148 - RNA, 19 nt, Homo sapiens
aagaugacucccaguaaua

SEQ ID NO: 687149 - RNA, 19 nt, Homo sapiens
gguggugacuucggccuuu

SEQ ID NO: 687150 - RNA, 19 nt, Homo sapiens
ccaguacacgugaaccaua

SEQ ID NO: 687151 - RNA, 19 nt, Homo sapiens
caagauguaaacaagauga

SEQ ID NO: 687152 - RNA, 19 nt, Homo sapiens
aaucuuaccuccgagaguu

SEQ ID NO: 687153 - RNA, 19 nt, Homo sapiens
gacauggauuccucacgaa

SEQ ID NO: 687154 - RNA, 19 nt, Homo sapiens
gcacaugcggcgacacuca

SEQ ID NO: 687155 - RNA, 19 nt, Homo sapiens
ggccucuccuucugucuuu

SEQ ID NO: 687156 - RNA, 19 nt, Homo sapiens
auaauuacguuacccaaag

SEQ ID NO: 687157 - RNA, 19 nt, Homo sapiens
agauagaguucaacauuac

SEQ ID NO: 687158 - RNA, 19 nt, Homo sapiens
caaauuguugggaucauug

SEQ ID NO: 687159 - RNA, 19 nt, Homo sapiens
uguauugccucagaucaaa

SEQ ID NO: 687160 - RNA, 19 nt, Homo sapiens
ugacuaugcaaacuacuuu

SEQ ID NO: 687161 - RNA, 19 nt, Homo sapiens
ggccaaagaaauugacuau

SEQ ID NO: 687162 - RNA, 19 nt, Homo sapiens
agugggaugugcagaguuu

SEQ ID NO: 687163 - RNA, 19 nt, Homo sapiens
aagcaugucuacagaucuu

SEQ ID NO: 687164 - RNA, 19 nt, Homo sapiens
gggaagaugcugaaacucu

SEQ ID NO: 687165 - RNA, 19 nt, Homo sapiens
gagaugaugaccacagugu

SEQ ID NO: 687166 - RNA, 19 nt, Homo sapiens
uagaagugcaagcugaaua

SEQ ID NO: 687167 - RNA, 19 nt, Homo sapiens
ggucuugcaggaucaguuu

SEQ ID NO: 687168 - RNA, 19 nt, Homo sapiens
gucuggagcuggugaaaca

SEQ ID NO: 687169 - RNA, 19 nt, Homo sapiens
cagaagggaacauuacaga

SEQ ID NO: 687170 - RNA, 19 nt, Homo sapiens
ccugggagaugacacacuu

SEQ ID NO: 687171 - RNA, 19 nt, Homo sapiens
gagcgcaccagcacaacaa

SEQ ID NO: 687172 - RNA, 19 nt, Homo sapiens
auaauaugaugcuggaguu

SEQ ID NO: 687173 - RNA, 19 nt, Homo sapiens
gggccacgaugaagaagca

SEQ ID NO: 687174 - RNA, 19 nt, Homo sapiens
acaagaugacucccaguaa

SEQ ID NO: 687175 - RNA, 19 nt, Homo sapiens
caagaagcuucaggcucua

SEQ ID NO: 687176 - RNA, 19 nt, Homo sapiens
gguggaaaucccaaauauu

SEQ ID NO: 687177 - RNA, 19 nt, Homo sapiens
aaacaaacaagccugaaag

SEQ ID NO: 687178 - RNA, 19 nt, Homo sapiens
gagcagcguccaugagcuu

SEQ ID NO: 687179 - RNA, 19 nt, Homo sapiens
gggcagggcugaaaagaca

SEQ ID NO: 687180 - RNA, 19 nt, Homo sapiens
gaucauugaaccuaucauc

SEQ ID NO: 687181 - RNA, 19 nt, Homo sapiens
gcaauugcaggagcuuuga

SEQ ID NO: 687182 - RNA, 19 nt, Homo sapiens
cagcuauccugggagauga

SEQ ID NO: 687183 - RNA, 19 nt, Homo sapiens
ggaaagcaugucuacagau

SEQ ID NO: 687184 - RNA, 19 nt, Homo sapiens
ugagggucauggacacaaa

SEQ ID NO: 687185 - RNA, 19 nt, Homo sapiens
gcaggaggagggacucuuc

SEQ ID NO: 687186 - RNA, 19 nt, Homo sapiens
guagagagagacgugauug

SEQ ID NO: 687187 - RNA, 19 nt, Homo sapiens
aacauccgauacuugauaa

SEQ ID NO: 687188 - RNA, 19 nt, Homo sapiens
caacacaccuuaucuauua

SEQ ID NO: 687189 - RNA, 19 nt, Homo sapiens
gggcaaggaucucacauua

SEQ ID NO: 687190 - RNA, 19 nt, Homo sapiens
gaagacaaguuauucugua

SEQ ID NO: 687191 - RNA, 19 nt, Homo sapiens
gcacaugaguauugccuua

SEQ ID NO: 687192 - RNA, 19 nt, Homo sapiens
ggaaauagcuaaacacaac

SEQ ID NO: 687193 - RNA, 19 nt, Homo sapiens
gcaacucucugaagaauau

SEQ ID NO: 687194 - RNA, 19 nt, Homo sapiens
gcaaggaucucacauuauc

SEQ ID NO: 687195 - RNA, 19 nt, Homo sapiens
guagagaugugaggauuua

SEQ ID NO: 687196 - RNA, 19 nt, Homo sapiens
ccaaggagacuuugcauua

SEQ ID NO: 687197 - RNA, 19 nt, Homo sapiens
gggccuagcucuguauuua

SEQ ID NO: 687198 - RNA, 19 nt, Homo sapiens
guaaaugcuucuccucuuu

SEQ ID NO: 687199 - RNA, 19 nt, Homo sapiens
gaagcuguuugcaauuaua

SEQ ID NO: 687200 - RNA, 19 nt, Homo sapiens
gagguaaguugaacaauuc

SEQ ID NO: 687201 - RNA, 19 nt, Homo sapiens
gcaguuaguuuccauaaag

SEQ ID NO: 687202 - RNA, 19 nt, Homo sapiens
caaacaagguugcauuuua

SEQ ID NO: 687203 - RNA, 19 nt, Homo sapiens
guaagcaacucucugaaga

SEQ ID NO: 687204 - RNA, 19 nt, Homo sapiens
gcaaaugaugugaggauua

SEQ ID NO: 687205 - RNA, 19 nt, Homo sapiens
gugaagcuguuugcaauua

SEQ ID NO: 687206 - RNA, 19 nt, Homo sapiens
caaggagacuuugcauuaa

SEQ ID NO: 687207 - RNA, 19 nt, Homo sapiens
gcauaaggaagacaaguua

SEQ ID NO: 687208 - RNA, 19 nt, Homo sapiens
uaaaugauguagcacugua

SEQ ID NO: 687209 - RNA, 19 nt, Homo sapiens
ucacauacuuucaccauau

SEQ ID NO: 687210 - RNA, 19 nt, Homo sapiens
uaagggcuguuauguauga

SEQ ID NO: 687211 - RNA, 19 nt, Homo sapiens
ggaaauaugagaaggcaaa

SEQ ID NO: 687212 - RNA, 19 nt, Homo sapiens
cgaauguucuccucuuaaa

SEQ ID NO: 687213 - RNA, 19 nt, Homo sapiens
uaaggaagauaaagcauuc

SEQ ID NO: 687214 - RNA, 19 nt, Homo sapiens
gugcauauuucauuuguug

SEQ ID NO: 687215 - RNA, 19 nt, Homo sapiens
gaagagacauauggacaau

SEQ ID NO: 687216 - RNA, 19 nt, Homo sapiens
gcaaacaaguacuguccaa

SEQ ID NO: 687217 - RNA, 19 nt, Homo sapiens
gaguauugccuuaaguuua

SEQ ID NO: 687218 - RNA, 19 nt, Homo sapiens
gugcuugaauagacuaaua

SEQ ID NO: 687219 - RNA, 19 nt, Homo sapiens
gcaagaagaggaugaggaa

SEQ ID NO: 687220 - RNA, 19 nt, Homo sapiens
agagacauauggacaauga

SEQ ID NO: 687221 - RNA, 19 nt, Homo sapiens
caaaugaugugaggauuag

SEQ ID NO: 687222 - RNA, 19 nt, Homo sapiens
ggacagccuugugcauauu

SEQ ID NO: 687223 - RNA, 19 nt, Homo sapiens
agagguaaguugaacaauu

SEQ ID NO: 687224 - RNA, 19 nt, Homo sapiens
gaagugaagcuguuugcaa

SEQ ID NO: 687225 - RNA, 19 nt, Homo sapiens
ccacuaaguuggaguacug

SEQ ID NO: 687226 - RNA, 19 nt, Homo sapiens
gcgauuaggcaguuaguuu

SEQ ID NO: 687227 - RNA, 19 nt, Homo sapiens
gaaucuggcccaugugaaa

SEQ ID NO: 687228 - RNA, 19 nt, Homo sapiens
gagcagguauuccaugaag

SEQ ID NO: 687229 - RNA, 19 nt, Homo sapiens
gcagggcaaacguuuauaa

SEQ ID NO: 687230 - RNA, 19 nt, Homo sapiens
ugagaagaaucauacuuug

SEQ ID NO: 687231 - RNA, 19 nt, Homo sapiens
gguaaaugcuucuccucuu

SEQ ID NO: 687232 - RNA, 19 nt, Homo sapiens
gacaaugaaucugcaaaga

SEQ ID NO: 687233 - RNA, 19 nt, Homo sapiens
uuucugaguucauagguua

SEQ ID NO: 687234 - RNA, 19 nt, Homo sapiens
gagaagaaucauacuuuga

SEQ ID NO: 687235 - RNA, 19 nt, Homo sapiens
caagcagucuuagaacaaa

SEQ ID NO: 687236 - RNA, 19 nt, Homo sapiens
guacugacucauagagaua

SEQ ID NO: 687237 - RNA, 19 nt, Homo sapiens
gaaccacuaaguuggagua

SEQ ID NO: 687238 - RNA, 19 nt, Homo sapiens
gaucucacauuaucagucu

SEQ ID NO: 687239 - RNA, 19 nt, Homo sapiens
gacaagcagucuuagaaca

SEQ ID NO: 687240 - RNA, 19 nt, Homo sapiens
gaguaccaauuauuugcua

SEQ ID NO: 687241 - RNA, 19 nt, Homo sapiens
gagcaaagcaaacaaguac

SEQ ID NO: 687242 - RNA, 19 nt, Homo sapiens
acuaauaccuaacaggaaa

SEQ ID NO: 687243 - RNA, 19 nt, Homo sapiens
guaacucuuuagcacauuu

SEQ ID NO: 687244 - RNA, 19 nt, Homo sapiens
gcgaacgcuucccaucuaa

SEQ ID NO: 687245 - RNA, 19 nt, Homo sapiens
cagcaaacauugaguacca

SEQ ID NO: 687246 - RNA, 19 nt, Homo sapiens
caacaucacugugguuacu

SEQ ID NO: 687247 - RNA, 19 nt, Homo sapiens
gaacaacaucacugugguu

SEQ ID NO: 687248 - RNA, 19 nt, Homo sapiens
cacauacuuucaccauaua

SEQ ID NO: 687249 - RNA, 19 nt, Homo sapiens
ucaaggacuaucacaguua

SEQ ID NO: 687250 - RNA, 19 nt, Homo sapiens
cugaugaccuccugccuuu

SEQ ID NO: 687251 - RNA, 19 nt, Homo sapiens
guaaggaagauaaagcauu

SEQ ID NO: 687252 - RNA, 19 nt, Homo sapiens
uuagaccacuccuuuaaug

SEQ ID NO: 687253 - RNA, 19 nt, Homo sapiens
caacugagaagaaucauac

SEQ ID NO: 687254 - RNA, 19 nt, Homo sapiens
guacaacugagaagaauca

SEQ ID NO: 687255 - RNA, 19 nt, Homo sapiens
cauguuauacagccauuua

SEQ ID NO: 687256 - RNA, 19 nt, Homo sapiens
aagccacccuucacagaua

SEQ ID NO: 687257 - RNA, 19 nt, Homo sapiens
caggagaagugaagcuguu

SEQ ID NO: 687258 - RNA, 19 nt, Homo sapiens
ccaaagugcugggauuaca

SEQ ID NO: 687259 - RNA, 19 nt, Homo sapiens
cuaaacacaacacaccuua

SEQ ID NO: 687260 - RNA, 19 nt, Homo sapiens
ccauuuaucuuguacaacu

SEQ ID NO: 687261 - RNA, 19 nt, Homo sapiens
ggaacuggacgucaccaaa

SEQ ID NO: 687262 - RNA, 19 nt, Homo sapiens
aaccagcgcugcaagaaga

SEQ ID NO: 687263 - RNA, 19 nt, Homo sapiens
gaaaauggagccucaagaa

SEQ ID NO: 687264 - RNA, 19 nt, Homo sapiens
gaauaugaaaggauuguca

SEQ ID NO: 687265 - RNA, 19 nt, Homo sapiens
gccuuuagauuguaagaau

SEQ ID NO: 687266 - RNA, 19 nt, Homo sapiens
guucagaguacaauacaaa

SEQ ID NO: 687267 - RNA, 19 nt, Homo sapiens
caaguuauucuguaaggaa

SEQ ID NO: 687268 - RNA, 19 nt, Homo sapiens
aaacugugcuugaauagac

SEQ ID NO: 687269 - RNA, 19 nt, Homo sapiens
uuaccaaguugcugcguuu

SEQ ID NO: 687270 - RNA, 19 nt, Homo sapiens
ucagagccauguagucuca

SEQ ID NO: 687271 - RNA, 19 nt, Homo sapiens
aauaugagaaggcaaauga

SEQ ID NO: 687272 - RNA, 19 nt, Homo sapiens
caaaaguacuacagagaaa

SEQ ID NO: 687273 - RNA, 19 nt, Homo sapiens
ggaagauaaagcauucaaa

SEQ ID NO: 687274 - RNA, 19 nt, Homo sapiens
gaacuugaagagacauaug

SEQ ID NO: 687275 - RNA, 19 nt, Homo sapiens
ggaagacaaguuauucugu

SEQ ID NO: 687276 - RNA, 19 nt, Homo sapiens
gaaguuugauuuucugaug

SEQ ID NO: 687277 - RNA, 19 nt, Homo sapiens
auaugcaccuuucaacuuu

SEQ ID NO: 687278 - RNA, 19 nt, Homo sapiens
gcaaagcaaacaaguacug

SEQ ID NO: 687279 - RNA, 19 nt, Homo sapiens
gcucauaucagaugucagu

SEQ ID NO: 687280 - RNA, 19 nt, Homo sapiens
gaugugaggauuuagaugu

SEQ ID NO: 687281 - RNA, 19 nt, Homo sapiens
cuacuagacccaacagaaa

SEQ ID NO: 687282 - RNA, 19 nt, Homo sapiens
gccuuaaguuuaccaaguu

SEQ ID NO: 687283 - RNA, 19 nt, Homo sapiens
ggaggcagggcaaacguuu

SEQ ID NO: 687284 - RNA, 19 nt, Homo sapiens
caccuggucuggaauuaug

SEQ ID NO: 687285 - RNA, 19 nt, Homo sapiens
gaggauuaguaucuugaga

SEQ ID NO: 687286 - RNA, 19 nt, Homo sapiens
gaugagguuucaccguguu

SEQ ID NO: 687287 - RNA, 19 nt, Homo sapiens
caccacacccagcuaauuu

SEQ ID NO: 687288 - RNA, 19 nt, Homo sapiens
gaacaugguuguacaaaca

SEQ ID NO: 687289 - RNA, 19 nt, Homo sapiens
cauaacagcugcaccauuu

SEQ ID NO: 687290 - RNA, 19 nt, Homo sapiens
ggaaggagaugccugaaga

SEQ ID NO: 687291 - RNA, 19 nt, Homo sapiens
ggagaaguguuuaagauga

SEQ ID NO: 687292 - RNA, 19 nt, Homo sapiens
ggagaugccugaagacaga

SEQ ID NO: 687293 - RNA, 19 nt, Homo sapiens
gaaagcaacugacacucuu

SEQ ID NO: 687294 - RNA, 19 nt, Homo sapiens
agaaauaccuggaucaguu

SEQ ID NO: 687295 - RNA, 19 nt, Homo sapiens
agaccaagcugauauuuga

SEQ ID NO: 687296 - RNA, 19 nt, Homo sapiens
gaauguaacugccuaagag

SEQ ID NO: 687297 - RNA, 19 nt, Homo sapiens
gaacagugcuacgaacaug

SEQ ID NO: 687298 - RNA, 19 nt, Homo sapiens
gcagagcccucauccugaa

SEQ ID NO: 687299 - RNA, 19 nt, Homo sapiens
gaaggaagcaguccagguu

SEQ ID NO: 687300 - RNA, 19 nt, Homo sapiens
aagauggacuuaagugaua

SEQ ID NO: 687301 - RNA, 19 nt, Homo sapiens
ccaaggaagucauuaagga

SEQ ID NO: 687302 - RNA, 19 nt, Homo sapiens
gaaccuguguggaagaaau

SEQ ID NO: 687303 - RNA, 19 nt, Homo sapiens
acaccacacuguuuauuaa

SEQ ID NO: 687304 - RNA, 19 nt, Homo sapiens
ggaagucauuaaggaauuu

SEQ ID NO: 687305 - RNA, 19 nt, Homo sapiens
cauaaucggucucaucaug

SEQ ID NO: 687306 - RNA, 19 nt, Homo sapiens
ccacacaguuuccauaaca

SEQ ID NO: 687307 - RNA, 19 nt, Homo sapiens
acaaugcggucaucagaaa

SEQ ID NO: 687308 - RNA, 19 nt, Homo sapiens
gaaauaccuggaucaguuu

SEQ ID NO: 687309 - RNA, 19 nt, Homo sapiens
gcggugaaaugcagucuga

SEQ ID NO: 687310 - RNA, 19 nt, Homo sapiens
aaagauguguuucugcauu

SEQ ID NO: 687311 - RNA, 19 nt, Homo sapiens
gaagauggacuuaagugau

SEQ ID NO: 687312 - RNA, 19 nt, Homo sapiens
ccucaagguucaacuuaaa

SEQ ID NO: 687313 - RNA, 19 nt, Homo sapiens
acacugggcugucggaguu

SEQ ID NO: 687314 - RNA, 19 nt, Homo sapiens
ugucagagcuccucaaacu

SEQ ID NO: 687315 - RNA, 19 nt, Homo sapiens
gagaaguguuuaagaugau

SEQ ID NO: 687316 - RNA, 19 nt, Homo sapiens
gcccauggcuggaaugagu

SEQ ID NO: 687317 - RNA, 19 nt, Homo sapiens
gaacaagucccagcaccuu

SEQ ID NO: 687318 - RNA, 19 nt, Homo sapiens
guucucaggcuaaauagua

SEQ ID NO: 687319 - RNA, 19 nt, Homo sapiens
cgaugacguucacuuguuu

SEQ ID NO: 687320 - RNA, 19 nt, Homo sapiens
caacaaugcggucaucaga

SEQ ID NO: 687321 - RNA, 19 nt, Homo sapiens
aaagauugguggguuguuu

SEQ ID NO: 687322 - RNA, 19 nt, Homo sapiens
gaugcaggcugaagagaca

SEQ ID NO: 687323 - RNA, 19 nt, Homo sapiens
gcucugcccuggugagugu

SEQ ID NO: 687324 - RNA, 19 nt, Homo sapiens
gcaguuccuuuggguauau

SEQ ID NO: 687325 - RNA, 19 nt, Homo sapiens
ggaucaacaucaucaugga

SEQ ID NO: 687326 - RNA, 19 nt, Homo sapiens
ggacucugacugccaauga

SEQ ID NO: 687327 - RNA, 19 nt, Homo sapiens
cauggaagccgcugccuuu

SEQ ID NO: 687328 - RNA, 19 nt, Homo sapiens
gguagagcccguugacaaa

SEQ ID NO: 687329 - RNA, 19 nt, Homo sapiens
gacauuuacuucaugaaag

SEQ ID NO: 687330 - RNA, 19 nt, Homo sapiens
cgaugaagauggacuuaag

SEQ ID NO: 687331 - RNA, 19 nt, Homo sapiens
gaggaaggcaaggguauuu

SEQ ID NO: 687332 - RNA, 19 nt, Homo sapiens
ggaaagcaacugacacucu

SEQ ID NO: 687333 - RNA, 19 nt, Homo sapiens
ggaagccgcugccuuucag

SEQ ID NO: 687334 - RNA, 19 nt, Homo sapiens
ucagagcuccucaaacuau

SEQ ID NO: 687335 - RNA, 19 nt, Homo sapiens
gcaccugcuugcucgagaa

SEQ ID NO: 687336 - RNA, 19 nt, Homo sapiens
gaagccgagccauguagua

SEQ ID NO: 687337 - RNA, 19 nt, Homo sapiens
ggaagaaauaccuggauca

SEQ ID NO: 687338 - RNA, 19 nt, Homo sapiens
gucacuggcuugugccuuu

SEQ ID NO: 687339 - RNA, 19 nt, Homo sapiens
ggaauugcuggaucuggua

SEQ ID NO: 687340 - RNA, 19 nt, Homo sapiens
ggaggggccuguacagaaa

SEQ ID NO: 687341 - RNA, 19 nt, Homo sapiens
gcaccacgacgaugacguu

SEQ ID NO: 687342 - RNA, 19 nt, Homo sapiens
gcgggacccucuuuaucuu

SEQ ID NO: 687343 - RNA, 19 nt, Homo sapiens
gaugcacccugaagaugug

SEQ ID NO: 687344 - RNA, 19 nt, Homo sapiens
caaggaagucauuaaggaa

SEQ ID NO: 687345 - RNA, 19 nt, Homo sapiens
uuaaagguguauccauguu

SEQ ID NO: 687346 - RNA, 19 nt, Homo sapiens
gggagucuguacccuguug

SEQ ID NO: 687347 - RNA, 19 nt, Homo sapiens
agaaguggauggcggugaa

SEQ ID NO: 687348 - RNA, 19 nt, Homo sapiens
gcagcguucucuguucuga

SEQ ID NO: 687349 - RNA, 19 nt, Homo sapiens
ggucucaucaugcucauug

SEQ ID NO: 687350 - RNA, 19 nt, Homo sapiens
ucggagaaguguuuaagau

SEQ ID NO: 687351 - RNA, 19 nt, Homo sapiens
aagauguguuucugcauuu

SEQ ID NO: 687352 - RNA, 19 nt, Homo sapiens
cuacgaacaugguuguaca

SEQ ID NO: 687353 - RNA, 19 nt, Homo sapiens
ggguagagcccguugacaa

SEQ ID NO: 687354 - RNA, 19 nt, Homo sapiens
gagcaucuccgcccugagu

SEQ ID NO: 687355 - RNA, 19 nt, Homo sapiens
guucagagcagaaguggau

SEQ ID NO: 687356 - RNA, 19 nt, Homo sapiens
aaagagauuccauucaguu

SEQ ID NO: 687357 - RNA, 19 nt, Homo sapiens
gaguacaggucggagaaau

SEQ ID NO: 687358 - RNA, 19 nt, Homo sapiens
uaacuggauuggccucauc

SEQ ID NO: 687359 - RNA, 19 nt, Homo sapiens
gguggaugaugacuucuca

SEQ ID NO: 687360 - RNA, 19 nt, Homo sapiens
acagugacccagcuuguaa

SEQ ID NO: 687361 - RNA, 19 nt, Homo sapiens
gcgaaccuguguggaagaa

SEQ ID NO: 687362 - RNA, 19 nt, Homo sapiens
gagauuccauucaguucag

SEQ ID NO: 687363 - RNA, 19 nt, Homo sapiens
aaagguguauccauguugu

SEQ ID NO: 687364 - RNA, 19 nt, Homo sapiens
ccaagagaguccagaugca

SEQ ID NO: 687365 - RNA, 19 nt, Homo sapiens
ggccucauccgucuucauu

SEQ ID NO: 687366 - RNA, 19 nt, Homo sapiens
cgacgaugacguucacuug

SEQ ID NO: 687367 - RNA, 19 nt, Homo sapiens
ucaguucggagaaguguuu

SEQ ID NO: 687368 - RNA, 19 nt, Homo sapiens
acgaugacguucacuuguu

SEQ ID NO: 687369 - RNA, 19 nt, Homo sapiens
gcccaaagcacaagcucaa

SEQ ID NO: 687370 - RNA, 19 nt, Homo sapiens
ggucaucgugaagaaguua

SEQ ID NO: 687371 - RNA, 19 nt, Homo sapiens
aggaaucgccacacaguuu

SEQ ID NO: 687372 - RNA, 19 nt, Homo sapiens
uagagcccguugacaaaga

SEQ ID NO: 687373 - RNA, 19 nt, Homo sapiens
ccugguggaugaugacuuc

SEQ ID NO: 687374 - RNA, 19 nt, Homo sapiens
ugauggcccuggcgaugaa

SEQ ID NO: 687375 - RNA, 19 nt, Homo sapiens
aggaagucauuaaggaauu

SEQ ID NO: 687376 - RNA, 19 nt, Homo sapiens
cauccaaggaagucauuaa

SEQ ID NO: 687377 - RNA, 19 nt, Homo sapiens
gacagugacccagcuugua

SEQ ID NO: 687378 - RNA, 19 nt, Homo sapiens
ggcauaaucggucucauca

SEQ ID NO: 687379 - RNA, 19 nt, Homo sapiens
ggacccuggugcaguaugg

SEQ ID NO: 687380 - RNA, 19 nt, Homo sapiens
caucuuuucugcuguaauu

SEQ ID NO: 687381 - RNA, 19 nt, Homo sapiens
ggaggaaggcaaggguauu

SEQ ID NO: 687382 - RNA, 19 nt, Homo sapiens
uaacuucauccucaagguu

SEQ ID NO: 687383 - RNA, 19 nt, Homo sapiens
gaagaaauaccuggaucag

SEQ ID NO: 687384 - RNA, 19 nt, Homo sapiens
uaacagcugcaccauuuua

SEQ ID NO: 687385 - RNA, 19 nt, Homo sapiens
gauauuugagaucggcuuu

SEQ ID NO: 687386 - RNA, 19 nt, Homo sapiens
gugaaaugcagucugaaga

SEQ ID NO: 687387 - RNA, 19 nt, Homo sapiens
gccaaugaaaugacaguga

SEQ ID NO: 687388 - RNA, 19 nt, Homo sapiens
ggaaagagauccucgguuu

SEQ ID NO: 687389 - RNA, 19 nt, Homo sapiens
gcucaaagcuggauuagaa

SEQ ID NO: 687390 - RNA, 19 nt, Homo sapiens
gaagaggucuguacaguga

SEQ ID NO: 687391 - RNA, 19 nt, Homo sapiens
ggaacaagaugacucagua

SEQ ID NO: 687392 - RNA, 19 nt, Homo sapiens
agaaauggcuucagacaua

SEQ ID NO: 687393 - RNA, 19 nt, Homo sapiens
gcagauuucuucuugauuu

SEQ ID NO: 687394 - RNA, 19 nt, Homo sapiens
gaauagaaguguccuuuau

SEQ ID NO: 687395 - RNA, 19 nt, Homo sapiens
gagaggcacuugugacuuu

SEQ ID NO: 687396 - RNA, 19 nt, Homo sapiens
ugaagcagcugauggauuu

SEQ ID NO: 687397 - RNA, 19 nt, Homo sapiens
cggaacagcucuaggaaua

SEQ ID NO: 687398 - RNA, 19 nt, Homo sapiens
gaacugugcuguggauaaa

SEQ ID NO: 687399 - RNA, 19 nt, Homo sapiens
ccauuucucuuucuucuua

SEQ ID NO: 687400 - RNA, 19 nt, Homo sapiens
ggacaaggcaguaaauauu

SEQ ID NO: 687401 - RNA, 19 nt, Homo sapiens
ggaauaacaagucagaaua

SEQ ID NO: 687402 - RNA, 19 nt, Homo sapiens
gcugugaccuucauucauu

SEQ ID NO: 687403 - RNA, 19 nt, Homo sapiens
caaacuggaguaagaauua

SEQ ID NO: 687404 - RNA, 19 nt, Homo sapiens
ccagagagauggauuguca

SEQ ID NO: 687405 - RNA, 19 nt, Homo sapiens
gaaaggacauuuuggaauu

SEQ ID NO: 687406 - RNA, 19 nt, Homo sapiens
cuaagucgcugucuccuaa

SEQ ID NO: 687407 - RNA, 19 nt, Homo sapiens
gaauggacuucgaugauga

SEQ ID NO: 687408 - RNA, 19 nt, Homo sapiens
gccuuuagcuugugaguuu

SEQ ID NO: 687409 - RNA, 19 nt, Homo sapiens
ggccaaagcuaguguuaug

SEQ ID NO: 687410 - RNA, 19 nt, Homo sapiens
guucugaccuaccacauaa

SEQ ID NO: 687411 - RNA, 19 nt, Homo sapiens
ggaaauggcaggugguuga

SEQ ID NO: 687412 - RNA, 19 nt, Homo sapiens
caagagagaaucauaguga

SEQ ID NO: 687413 - RNA, 19 nt, Homo sapiens
gaaguguccuuuauauuac

SEQ ID NO: 687414 - RNA, 19 nt, Homo sapiens
aaacaucaguguccuucua

SEQ ID NO: 687415 - RNA, 19 nt, Homo sapiens
ggaauggacuucgaugaug

SEQ ID NO: 687416 - RNA, 19 nt, Homo sapiens
ggaggagaguugaggcuuu

SEQ ID NO: 687417 - RNA, 19 nt, Homo sapiens
gggaucaguuguauuuauu

SEQ ID NO: 687418 - RNA, 19 nt, Homo sapiens
auugaaagcuccacauuaa

SEQ ID NO: 687419 - RNA, 19 nt, Homo sapiens
uuaagucgguuguguauau

SEQ ID NO: 687420 - RNA, 19 nt, Homo sapiens
gcaacaggauggccaagga

SEQ ID NO: 687421 - RNA, 19 nt, Homo sapiens
gcugauggauuucuguuug

SEQ ID NO: 687422 - RNA, 19 nt, Homo sapiens
ugaagcaucucauccuuga

SEQ ID NO: 687423 - RNA, 19 nt, Homo sapiens
ugacagccaucacaaauag

SEQ ID NO: 687424 - RNA, 19 nt, Homo sapiens
gaggcauuaugacuaaaua

SEQ ID NO: 687425 - RNA, 19 nt, Homo sapiens
ugaaauguuugcaggaauu

SEQ ID NO: 687426 - RNA, 19 nt, Homo sapiens
gaccauaccugaagaagac

SEQ ID NO: 687427 - RNA, 19 nt, Homo sapiens
caggagaaguccagaaaug

SEQ ID NO: 687428 - RNA, 19 nt, Homo sapiens
ugaauguucucuaugacua

SEQ ID NO: 687429 - RNA, 19 nt, Homo sapiens
gagugaggcuccugcugua

SEQ ID NO: 687430 - RNA, 19 nt, Homo sapiens
gcaaucuucucccaggaaa

SEQ ID NO: 687431 - RNA, 19 nt, Homo sapiens
gcagacagcuccccacuga

SEQ ID NO: 687432 - RNA, 19 nt, Homo sapiens
guagaugcaugcaguguuc

SEQ ID NO: 687433 - RNA, 19 nt, Homo sapiens
agucaaacauugcucagua

SEQ ID NO: 687434 - RNA, 19 nt, Homo sapiens
gaacagcucuaggaauaac

SEQ ID NO: 687435 - RNA, 19 nt, Homo sapiens
gauauucaguccucuucuu

SEQ ID NO: 687436 - RNA, 19 nt, Homo sapiens
caaucucaguuuccuuuaa

SEQ ID NO: 687437 - RNA, 19 nt, Homo sapiens
ggaccuacccucugggaaa

SEQ ID NO: 687438 - RNA, 19 nt, Homo sapiens
gagaguuuaugaauccauu

SEQ ID NO: 687439 - RNA, 19 nt, Homo sapiens
aagacaaacuggaguaaga

SEQ ID NO: 687440 - RNA, 19 nt, Homo sapiens
agacagggcgagugauuua

SEQ ID NO: 687441 - RNA, 19 nt, Homo sapiens
caucacaaauagccacauu

SEQ ID NO: 687442 - RNA, 19 nt, Homo sapiens
gggcauguuuccaccguuu

SEQ ID NO: 687443 - RNA, 19 nt, Homo sapiens
gcugaaaguggacaaagua

SEQ ID NO: 687444 - RNA, 19 nt, Homo sapiens
gaaauguuugcaggaauua

SEQ ID NO: 687445 - RNA, 19 nt, Homo sapiens
ggagcacacuguaugaaca

SEQ ID NO: 687446 - RNA, 19 nt, Homo sapiens
gcacuuaaccauuucucuu

SEQ ID NO: 687447 - RNA, 19 nt, Homo sapiens
cuacauguucuccagauua

SEQ ID NO: 687448 - RNA, 19 nt, Homo sapiens
gcucacaccuuguuugaac

SEQ ID NO: 687449 - RNA, 19 nt, Homo sapiens
gagagaguguuugcuguga

SEQ ID NO: 687450 - RNA, 19 nt, Homo sapiens
gaggagaguuuaugaaucc

SEQ ID NO: 687451 - RNA, 19 nt, Homo sapiens
gaauagcuguguuccugau

SEQ ID NO: 687452 - RNA, 19 nt, Homo sapiens
ucaagcaacuucagcaaca

SEQ ID NO: 687453 - RNA, 19 nt, Homo sapiens
gaaugaccauaccugaaga

SEQ ID NO: 687454 - RNA, 19 nt, Homo sapiens
gaauaacaagucagaauag

SEQ ID NO: 687455 - RNA, 19 nt, Homo sapiens
gcucuacucuccaacauac

SEQ ID NO: 687456 - RNA, 19 nt, Homo sapiens
ggaugucggugcccacaga

SEQ ID NO: 687457 - RNA, 19 nt, Homo sapiens
gaccagcucuccuguaugc

SEQ ID NO: 687458 - RNA, 19 nt, Homo sapiens
ggaaugaccauaccugaag

SEQ ID NO: 687459 - RNA, 19 nt, Homo sapiens
gaauaaccaccaugaggaa

SEQ ID NO: 687460 - RNA, 19 nt, Homo sapiens
ugaacacgcugacugugaa

SEQ ID NO: 687461 - RNA, 19 nt, Homo sapiens
ggagauccaugugcucaau

SEQ ID NO: 687462 - RNA, 19 nt, Homo sapiens
gcccaggccuucucacaug

SEQ ID NO: 687463 - RNA, 19 nt, Homo sapiens
ccuaguggguccuuaaguu

SEQ ID NO: 687464 - RNA, 19 nt, Homo sapiens
gcugaaauguuugcaggaa

SEQ ID NO: 687465 - RNA, 19 nt, Homo sapiens
gauccucgguuugcugaaa

SEQ ID NO: 687466 - RNA, 19 nt, Homo sapiens
gaaagaagggcagcaguca

SEQ ID NO: 687467 - RNA, 19 nt, Homo sapiens
ucacagagcaggaacugaa

SEQ ID NO: 687468 - RNA, 19 nt, Homo sapiens
gaaggaguuuggagagagu

SEQ ID NO: 687469 - RNA, 19 nt, Homo sapiens
gaagacauggguuccaguu

SEQ ID NO: 687470 - RNA, 19 nt, Homo sapiens
gugaccagcucuccuguau

SEQ ID NO: 687471 - RNA, 19 nt, Homo sapiens
guccagaaauggcuucaga

SEQ ID NO: 687472 - RNA, 19 nt, Homo sapiens
gucaaacauugcucaguaa

SEQ ID NO: 687473 - RNA, 19 nt, Homo sapiens
cagaacaugucccaaaucu

SEQ ID NO: 687474 - RNA, 19 nt, Homo sapiens
gaaagagauccucgguuug

SEQ ID NO: 687475 - RNA, 19 nt, Homo sapiens
cggcauaacuccgauggaa

SEQ ID NO: 687476 - RNA, 19 nt, Homo sapiens
gacaaggcaguaaauauug

SEQ ID NO: 687477 - RNA, 19 nt, Homo sapiens
caacugugcaccucagaaa

SEQ ID NO: 687478 - RNA, 19 nt, Homo sapiens
caucuaacaaucucaguuu

SEQ ID NO: 687479 - RNA, 19 nt, Homo sapiens
ucaguguccuucuagcuuu

SEQ ID NO: 687480 - RNA, 19 nt, Homo sapiens
ggacugcugugaccuucau

SEQ ID NO: 687481 - RNA, 19 nt, Homo sapiens
gcaacuauaacaucgaaga

SEQ ID NO: 687482 - RNA, 19 nt, Homo sapiens
gacagcaaaucccaucuca

SEQ ID NO: 687483 - RNA, 19 nt, Homo sapiens
gcucuucagugguucaugu

SEQ ID NO: 687484 - RNA, 19 nt, Homo sapiens
gcagaucuacucccaagga

SEQ ID NO: 687485 - RNA, 19 nt, Homo sapiens
ucgguuugcugaaauguuu

SEQ ID NO: 687486 - RNA, 19 nt, Homo sapiens
gaagugcaccagagagaug

SEQ ID NO: 687487 - RNA, 19 nt, Homo sapiens
gaaaggcgcaaacggaaca

SEQ ID NO: 687488 - RNA, 19 nt, Homo sapiens
ggacuuaucuugugauuug

SEQ ID NO: 687489 - RNA, 19 nt, Homo sapiens
ggagauacauguuuaagau

SEQ ID NO: 687490 - RNA, 19 nt, Homo sapiens
gcugaaagccuuacugaua

SEQ ID NO: 687491 - RNA, 19 nt, Homo sapiens
gaagaauucagguacauua

SEQ ID NO: 687492 - RNA, 19 nt, Homo sapiens
ggaguaagcuggaaaagua

SEQ ID NO: 687493 - RNA, 19 nt, Homo sapiens
aaagugaucucaacaugua

SEQ ID NO: 687494 - RNA, 19 nt, Homo sapiens
gaaagaaccuuagugaaag

SEQ ID NO: 687495 - RNA, 19 nt, Homo sapiens
gaaaagaggucaacaugaa

SEQ ID NO: 687496 - RNA, 19 nt, Homo sapiens
ggaccaauguguauaauca

SEQ ID NO: 687497 - RNA, 19 nt, Homo sapiens
acacagcugucuuugauua

SEQ ID NO: 687498 - RNA, 19 nt, Homo sapiens
gaugagagcuacugugaug

SEQ ID NO: 687499 - RNA, 19 nt, Homo sapiens
gaacuaagguguuucucau

SEQ ID NO: 687500 - RNA, 19 nt, Homo sapiens
ucaaauacaugacgccuuu

SEQ ID NO: 687501 - RNA, 19 nt, Homo sapiens
gagaauaccuugguuagug

SEQ ID NO: 687502 - RNA, 19 nt, Homo sapiens
gcaaagugaucucaacaug

SEQ ID NO: 687503 - RNA, 19 nt, Homo sapiens
gguaugagauggauuggaa

SEQ ID NO: 687504 - RNA, 19 nt, Homo sapiens
gaucacccguguauucuuu

SEQ ID NO: 687505 - RNA, 19 nt, Homo sapiens
acaaugggcugaguuauaa

SEQ ID NO: 687506 - RNA, 19 nt, Homo sapiens
ggagaugacugaacuacug

SEQ ID NO: 687507 - RNA, 19 nt, Homo sapiens
uaugagagcuuucaagaug

SEQ ID NO: 687508 - RNA, 19 nt, Homo sapiens
uagaggagauacauguuua

SEQ ID NO: 687509 - RNA, 19 nt, Homo sapiens
ggagggaucugucacacuu

SEQ ID NO: 687510 - RNA, 19 nt, Homo sapiens
guaguuggcagauuuguua

SEQ ID NO: 687511 - RNA, 19 nt, Homo sapiens
guaacacuguccuacuuua

SEQ ID NO: 687512 - RNA, 19 nt, Homo sapiens
uaaacagugugguugaaua

SEQ ID NO: 687513 - RNA, 19 nt, Homo sapiens
gcaaagaccacaaguuuca

SEQ ID NO: 687514 - RNA, 19 nt, Homo sapiens
gaaauucacagcucaguau

SEQ ID NO: 687515 - RNA, 19 nt, Homo sapiens
gauuguacuugguaagaua

SEQ ID NO: 687516 - RNA, 19 nt, Homo sapiens
gaaauggaccaauguguau

SEQ ID NO: 687517 - RNA, 19 nt, Homo sapiens
ggaagagccuuaagauuuu

SEQ ID NO: 687518 - RNA, 19 nt, Homo sapiens
cauggaaucuccuugcuaa

SEQ ID NO: 687519 - RNA, 19 nt, Homo sapiens
gcacaggccagacauacua

SEQ ID NO: 687520 - RNA, 19 nt, Homo sapiens
gcgaauaacuacugagcaa

SEQ ID NO: 687521 - RNA, 19 nt, Homo sapiens
agaaagaaccuuagugaaa

SEQ ID NO: 687522 - RNA, 19 nt, Homo sapiens
gcagugagcugagauugug

SEQ ID NO: 687523 - RNA, 19 nt, Homo sapiens
agaaggaaauggaagaauu

SEQ ID NO: 687524 - RNA, 19 nt, Homo sapiens
ggguuaauaugucaaauga

SEQ ID NO: 687525 - RNA, 19 nt, Homo sapiens
gcaauucuccuugucauuu

SEQ ID NO: 687526 - RNA, 19 nt, Homo sapiens
gagaguggacccuaauuaa

SEQ ID NO: 687527 - RNA, 19 nt, Homo sapiens
gcgaauauauaaacagugu

SEQ ID NO: 687528 - RNA, 19 nt, Homo sapiens
agacugaacuaccuaaaga

SEQ ID NO: 687529 - RNA, 19 nt, Homo sapiens
gggcaggacuuaccgagaa

SEQ ID NO: 687530 - RNA, 19 nt, Homo sapiens
gguaugacauggcacuaaa

SEQ ID NO: 687531 - RNA, 19 nt, Homo sapiens
aaacaugacuuugcaccua

SEQ ID NO: 687532 - RNA, 19 nt, Homo sapiens
gaaggaggccagaaaguug

SEQ ID NO: 687533 - RNA, 19 nt, Homo sapiens
gaagacagacuagcacaaa

SEQ ID NO: 687534 - RNA, 19 nt, Homo sapiens
acaaacaggugugacauuu

SEQ ID NO: 687535 - RNA, 19 nt, Homo sapiens
gagacaggguuucggguuu

SEQ ID NO: 687536 - RNA, 19 nt, Homo sapiens
cuaaguaaauucugcauuc

SEQ ID NO: 687537 - RNA, 19 nt, Homo sapiens
aggaagagccuuaagauuu

SEQ ID NO: 687538 - RNA, 19 nt, Homo sapiens
gaccaagucucacucuguu

SEQ ID NO: 687539 - RNA, 19 nt, Homo sapiens
uaccagaacuaguuacauu

SEQ ID NO: 687540 - RNA, 19 nt, Homo sapiens
gugaagaaauggaccaaug

SEQ ID NO: 687541 - RNA, 19 nt, Homo sapiens
gcaggagaaucacuugaau

SEQ ID NO: 687542 - RNA, 19 nt, Homo sapiens
gaacucuaauccauaaagu

SEQ ID NO: 687543 - RNA, 19 nt, Homo sapiens
guaaguaguugcaguaaaa

SEQ ID NO: 687544 - RNA, 19 nt, Homo sapiens
gcagugcaccgaccaguuu

SEQ ID NO: 687545 - RNA, 19 nt, Homo sapiens
gcucugcucucccuguaaa

SEQ ID NO: 687546 - RNA, 19 nt, Homo sapiens
gcuaaagucugccuuaaaa

SEQ ID NO: 687547 - RNA, 19 nt, Homo sapiens
ggaaagaugaguccuauac

SEQ ID NO: 687548 - RNA, 19 nt, Homo sapiens
acacuguccuacuuuauuu

SEQ ID NO: 687549 - RNA, 19 nt, Homo sapiens
gaaacugggaacuucauaa

SEQ ID NO: 687550 - RNA, 19 nt, Homo sapiens
ucuuagcacucucaaauuu

SEQ ID NO: 687551 - RNA, 19 nt, Homo sapiens
aagcaaagaccacaaguuu

SEQ ID NO: 687552 - RNA, 19 nt, Homo sapiens
gcacucaggguuaauaugu

SEQ ID NO: 687553 - RNA, 19 nt, Homo sapiens
gugcaucagugaagaaaug

SEQ ID NO: 687554 - RNA, 19 nt, Homo sapiens
ccauauuucuucagccuuu

SEQ ID NO: 687555 - RNA, 19 nt, Homo sapiens
ucagaaagcccuaaaauuu

SEQ ID NO: 687556 - RNA, 19 nt, Homo sapiens
agaaacagcacaaucaauu

SEQ ID NO: 687557 - RNA, 19 nt, Homo sapiens
gaacagacugaacuaccua

SEQ ID NO: 687558 - RNA, 19 nt, Homo sapiens
gaaggugcaucagugaaga

SEQ ID NO: 687559 - RNA, 19 nt, Homo sapiens
gguagcagccuuucacuug

SEQ ID NO: 687560 - RNA, 19 nt, Homo sapiens
gaaggaaauggaagaauuc

SEQ ID NO: 687561 - RNA, 19 nt, Homo sapiens
uagaauuuaugcccaguuu

SEQ ID NO: 687562 - RNA, 19 nt, Homo sapiens
ggugagaguguauaccuua

SEQ ID NO: 687563 - RNA, 19 nt, Homo sapiens
acuaagguguuucucauaa

SEQ ID NO: 687564 - RNA, 19 nt, Homo sapiens
ucaagucguugcaggguuu

SEQ ID NO: 687565 - RNA, 19 nt, Homo sapiens
caaaggaggcauugauuuc

SEQ ID NO: 687566 - RNA, 19 nt, Homo sapiens
acucagagcugugugcuuu

SEQ ID NO: 687567 - RNA, 19 nt, Homo sapiens
ccucgucucucuucugaaa

SEQ ID NO: 687568 - RNA, 19 nt, Homo sapiens
aagcaguccuucccaaauu

SEQ ID NO: 687569 - RNA, 19 nt, Homo sapiens
caucauaguuggucagucu

SEQ ID NO: 687570 - RNA, 19 nt, Homo sapiens
aagcugauguggguuauaa

SEQ ID NO: 687571 - RNA, 19 nt, Homo sapiens
ggacccuaauuaacauaaa

SEQ ID NO: 687572 - RNA, 19 nt, Homo sapiens
ucagaaagaaccuuaguga

SEQ ID NO: 687573 - RNA, 19 nt, Homo sapiens
gagaugaacagaacaaugg

SEQ ID NO: 687574 - RNA, 19 nt, Homo sapiens
uuuaggaucuuaaggugua

SEQ ID NO: 687575 - RNA, 19 nt, Homo sapiens
agagagagacccaauggua

SEQ ID NO: 687576 - RNA, 19 nt, Homo sapiens
gaaacacuuugcaaucucu

SEQ ID NO: 687577 - RNA, 19 nt, Homo sapiens
ccaaaggaggcauugauuu

SEQ ID NO: 687578 - RNA, 19 nt, Homo sapiens
cagaguagcugggauuaca

SEQ ID NO: 687579 - RNA, 19 nt, Homo sapiens
ccuaaagaauggugugcua

SEQ ID NO: 687580 - RNA, 19 nt, Homo sapiens
ugaacuaccuaaagaaugg

SEQ ID NO: 687581 - RNA, 19 nt, Homo sapiens
gcucauccuucuugauaau

SEQ ID NO: 687582 - RNA, 19 nt, Homo sapiens
gaacaacuacucagaagcu

SEQ ID NO: 687583 - RNA, 19 nt, Homo sapiens
gggaacaacuacucagaag

SEQ ID NO: 687584 - RNA, 19 nt, Homo sapiens
uaaaugaccacaccucaau

SEQ ID NO: 687585 - RNA, 19 nt, Homo sapiens
ggaaauucacagcucagua

SEQ ID NO: 687586 - RNA, 19 nt, Homo sapiens
ggaaacacuuugcaaucuc

SEQ ID NO: 687587 - RNA, 19 nt, Homo sapiens
aaacaggugugacauuugg

SEQ ID NO: 687588 - RNA, 19 nt, Homo sapiens
guaagaugcuugacaauuu

SEQ ID NO: 687589 - RNA, 19 nt, Homo sapiens
gaacuguuaugcucugaua

SEQ ID NO: 687590 - RNA, 19 nt, Homo sapiens
gaaauucucugugaguuug

SEQ ID NO: 687591 - RNA, 19 nt, Homo sapiens
gaaggagacccagaaauua

SEQ ID NO: 687592 - RNA, 19 nt, Homo sapiens
ugaaacagcuccucuccua

SEQ ID NO: 687593 - RNA, 19 nt, Homo sapiens
uaacacagcuacuucaguu

SEQ ID NO: 687594 - RNA, 19 nt, Homo sapiens
caaagaagauacucuggaa

SEQ ID NO: 687595 - RNA, 19 nt, Homo sapiens
gcauagggcuggaugagaa

SEQ ID NO: 687596 - RNA, 19 nt, Homo sapiens
gcagaaggaugaguugaaa

SEQ ID NO: 687597 - RNA, 19 nt, Homo sapiens
gaagagaggcaaccaauuc

SEQ ID NO: 687598 - RNA, 19 nt, Homo sapiens
cagcagagaugacagaaga

SEQ ID NO: 687599 - RNA, 19 nt, Homo sapiens
gaagaagaauuugucaguu

SEQ ID NO: 687600 - RNA, 19 nt, Homo sapiens
ucaaugagcucucccacaa

SEQ ID NO: 687601 - RNA, 19 nt, Homo sapiens
ggaggugauugaauucuuu

SEQ ID NO: 687602 - RNA, 19 nt, Homo sapiens
ggagauuccugagcaaauu

SEQ ID NO: 687603 - RNA, 19 nt, Homo sapiens
gaauuugucaguuugguua

SEQ ID NO: 687604 - RNA, 19 nt, Homo sapiens
gcaaggcuuucucuuaaau

SEQ ID NO: 687605 - RNA, 19 nt, Homo sapiens
ucagcaagaugauguauga

SEQ ID NO: 687606 - RNA, 19 nt, Homo sapiens
gaauauauguuugccaauc

SEQ ID NO: 687607 - RNA, 19 nt, Homo sapiens
ccaaagaucccaaggagaa

SEQ ID NO: 687608 - RNA, 19 nt, Homo sapiens
ugaaggaaaugaagguuga

SEQ ID NO: 687609 - RNA, 19 nt, Homo sapiens
agaccaggcucuugaauau

SEQ ID NO: 687610 - RNA, 19 nt, Homo sapiens
gcaacugacuauggaauga

SEQ ID NO: 687611 - RNA, 19 nt, Homo sapiens
gugauggucuuccaauuug

SEQ ID NO: 687612 - RNA, 19 nt, Homo sapiens
ugccaaagcuaguuacaaa

SEQ ID NO: 687613 - RNA, 19 nt, Homo sapiens
gauuugaacucgguauuug

SEQ ID NO: 687614 - RNA, 19 nt, Homo sapiens
gagccgaaaucacaccauu

SEQ ID NO: 687615 - RNA, 19 nt, Homo sapiens
gcaacgcaaucuauaaucu

SEQ ID NO: 687616 - RNA, 19 nt, Homo sapiens
gaggaaagccagaaauugu

SEQ ID NO: 687617 - RNA, 19 nt, Homo sapiens
gggaaaugaugaacuagug

SEQ ID NO: 687618 - RNA, 19 nt, Homo sapiens
gauuugagguccugaaagu

SEQ ID NO: 687619 - RNA, 19 nt, Homo sapiens
gaagaucuuucagcagaga

SEQ ID NO: 687620 - RNA, 19 nt, Homo sapiens
aaaguugucuucucaagug

SEQ ID NO: 687621 - RNA, 19 nt, Homo sapiens
gagcgaggccuccguaaga

SEQ ID NO: 687622 - RNA, 19 nt, Homo sapiens
gugauugaauucuuuguga

SEQ ID NO: 687623 - RNA, 19 nt, Homo sapiens
ccacuuuccuguugaugaa

SEQ ID NO: 687624 - RNA, 19 nt, Homo sapiens
ggaaauucucugugaguuu

SEQ ID NO: 687625 - RNA, 19 nt, Homo sapiens
gagaccaggcucuugaaua

SEQ ID NO: 687626 - RNA, 19 nt, Homo sapiens
agaaggagacccagaaauu

SEQ ID NO: 687627 - RNA, 19 nt, Homo sapiens
gagcauagugggagagauu

SEQ ID NO: 687628 - RNA, 19 nt, Homo sapiens
gcacagauccuaggaaguc

SEQ ID NO: 687629 - RNA, 19 nt, Homo sapiens
gacacuggcugccuuuguu

SEQ ID NO: 687630 - RNA, 19 nt, Homo sapiens
gggaagcaauuuagacaca

SEQ ID NO: 687631 - RNA, 19 nt, Homo sapiens
gaaaggacgcaucuaucaa

SEQ ID NO: 687632 - RNA, 19 nt, Homo sapiens
gaacugcguugagcugcuu

SEQ ID NO: 687633 - RNA, 19 nt, Homo sapiens
augcaaggcuuucucuuaa

SEQ ID NO: 687634 - RNA, 19 nt, Homo sapiens
gaauucuguuucccuugua

SEQ ID NO: 687635 - RNA, 19 nt, Homo sapiens
gaacuaauccguggcaucu

SEQ ID NO: 687636 - RNA, 19 nt, Homo sapiens
uggagaagcuagaagagaa

SEQ ID NO: 687637 - RNA, 19 nt, Homo sapiens
gcaagaugauguaugaaaa

SEQ ID NO: 687638 - RNA, 19 nt, Homo sapiens
gaaaugaugaacuagugaa

SEQ ID NO: 687639 - RNA, 19 nt, Homo sapiens
ugggagagauuguaagaga

SEQ ID NO: 687640 - RNA, 19 nt, Homo sapiens
gagaaucccaccauuaauc

SEQ ID NO: 687641 - RNA, 19 nt, Homo sapiens
ugaguuccaucugccauua

SEQ ID NO: 687642 - RNA, 19 nt, Homo sapiens
gcucuugaauauauuagga

SEQ ID NO: 687643 - RNA, 19 nt, Homo sapiens
agaagaauuugucaguuug

SEQ ID NO: 687644 - RNA, 19 nt, Homo sapiens
gaaucucucucugcugcua

SEQ ID NO: 687645 - RNA, 19 nt, Homo sapiens
uaacaacccaggccucuau

SEQ ID NO: 687646 - RNA, 19 nt, Homo sapiens
agucagugcuaguauguaa

SEQ ID NO: 687647 - RNA, 19 nt, Homo sapiens
gaaucaguauguugugcaa

SEQ ID NO: 687648 - RNA, 19 nt, Homo sapiens
ggcgaaaccuggauuagag

SEQ ID NO: 687649 - RNA, 19 nt, Homo sapiens
gaaaacaacucccauucuc

SEQ ID NO: 687650 - RNA, 19 nt, Homo sapiens
ccaagcagguagccagaga

SEQ ID NO: 687651 - RNA, 19 nt, Homo sapiens
uagaugaauuugagcagaa

SEQ ID NO: 687652 - RNA, 19 nt, Homo sapiens
agagacaacugaagaugug

SEQ ID NO: 687653 - RNA, 19 nt, Homo sapiens
guucuuggauacuuuacaa

SEQ ID NO: 687654 - RNA, 19 nt, Homo sapiens
cgaauucuguuucccuugu

SEQ ID NO: 687655 - RNA, 19 nt, Homo sapiens
ucaaggacauggugaaggu

SEQ ID NO: 687656 - RNA, 19 nt, Homo sapiens
ggcaaguucugcaugauca

SEQ ID NO: 687657 - RNA, 19 nt, Homo sapiens
ugacacagaggcagaacua

SEQ ID NO: 687658 - RNA, 19 nt, Homo sapiens
ugcaggaggugauugaauu

SEQ ID NO: 687659 - RNA, 19 nt, Homo sapiens
gaggagaccaggcucuuga

SEQ ID NO: 687660 - RNA, 19 nt, Homo sapiens
uccgaacccuucagucaua

SEQ ID NO: 687661 - RNA, 19 nt, Homo sapiens
ugaaaggacgcaucuauca

SEQ ID NO: 687662 - RNA, 19 nt, Homo sapiens
ggagagauuguaagagaga

SEQ ID NO: 687663 - RNA, 19 nt, Homo sapiens
uggagaaucccaccauuaa

SEQ ID NO: 687664 - RNA, 19 nt, Homo sapiens
caaccaauucuucagcuuu

SEQ ID NO: 687665 - RNA, 19 nt, Homo sapiens
uaagagagauuggacaaaa

SEQ ID NO: 687666 - RNA, 19 nt, Homo sapiens
gcaaccaauucuucagcuu

SEQ ID NO: 687667 - RNA, 19 nt, Homo sapiens
ccaucuaaaugcccucaaa

SEQ ID NO: 687668 - RNA, 19 nt, Homo sapiens
gauacaacuuugaguggau

SEQ ID NO: 687669 - RNA, 19 nt, Homo sapiens
uauagauccuggccucaaa

SEQ ID NO: 687670 - RNA, 19 nt, Homo sapiens
uagcgaaccuccaucucaa

SEQ ID NO: 687671 - RNA, 19 nt, Homo sapiens
ggaaaugaugaacuaguga

SEQ ID NO: 687672 - RNA, 19 nt, Homo sapiens
gcagaaggagacccagaaa

SEQ ID NO: 687673 - RNA, 19 nt, Homo sapiens
agagaccaguucuuggaua

SEQ ID NO: 687674 - RNA, 19 nt, Homo sapiens
uaaaugcccucaaaaugaa

SEQ ID NO: 687675 - RNA, 19 nt, Homo sapiens
aagaagauacucuggaauu

SEQ ID NO: 687676 - RNA, 19 nt, Homo sapiens
gaaaccccaucucuacuaa

SEQ ID NO: 687677 - RNA, 19 nt, Homo sapiens
caagugaugaguccaguga

SEQ ID NO: 687678 - RNA, 19 nt, Homo sapiens
gagauuggccaagcaggua

SEQ ID NO: 687679 - RNA, 19 nt, Homo sapiens
gcacgaggaaagccagaaa

SEQ ID NO: 687680 - RNA, 19 nt, Homo sapiens
gccaugaugucaacuccuu

SEQ ID NO: 687681 - RNA, 19 nt, Homo sapiens
gaccaguucuuggauacuu

SEQ ID NO: 687682 - RNA, 19 nt, Homo sapiens
gcucagugcuacagugaag

SEQ ID NO: 687683 - RNA, 19 nt, Homo sapiens
ucaagaaaauucacccuuu

SEQ ID NO: 687684 - RNA, 19 nt, Homo sapiens
aaugcaaggcuuucucuua

SEQ ID NO: 687685 - RNA, 19 nt, Homo sapiens
ccaaaguugucuucucaag

SEQ ID NO: 687686 - RNA, 19 nt, Homo sapiens
caacagcagaugacacaga

SEQ ID NO: 687687 - RNA, 19 nt, Homo sapiens
gggaagaacaggagcacaa

SEQ ID NO: 687688 - RNA, 19 nt, Homo sapiens
gaaauucuuuggcuacuua

SEQ ID NO: 687689 - RNA, 19 nt, Homo sapiens
gaacguaacuaguugaaau

SEQ ID NO: 687690 - RNA, 19 nt, Homo sapiens
gaaaggauguuaacugaug

SEQ ID NO: 687691 - RNA, 19 nt, Homo sapiens
gaucaaagcuccuccaaag

SEQ ID NO: 687692 - RNA, 19 nt, Homo sapiens
gggcauagauuuauaacaa

SEQ ID NO: 687693 - RNA, 19 nt, Homo sapiens
caaguaaacugcauguauu

SEQ ID NO: 687694 - RNA, 19 nt, Homo sapiens
gugaucagcuugaaccuua

SEQ ID NO: 687695 - RNA, 19 nt, Homo sapiens
ugaaauaaaucacgcagaa

SEQ ID NO: 687696 - RNA, 19 nt, Homo sapiens
ccacaguucugaauaguga

SEQ ID NO: 687697 - RNA, 19 nt, Homo sapiens
gaacaagaguguggugaga

SEQ ID NO: 687698 - RNA, 19 nt, Homo sapiens
aaaggaagcugcagaggaa

SEQ ID NO: 687699 - RNA, 19 nt, Homo sapiens
gcaccgacuucuccuguaa

SEQ ID NO: 687700 - RNA, 19 nt, Homo sapiens
gaacugccaucucuguaga

SEQ ID NO: 687701 - RNA, 19 nt, Homo sapiens
gaaacaguauuuacagcaa

SEQ ID NO: 687702 - RNA, 19 nt, Homo sapiens
caccauagauuugcaagua

SEQ ID NO: 687703 - RNA, 19 nt, Homo sapiens
ggagauccauucaccaaga

SEQ ID NO: 687704 - RNA, 19 nt, Homo sapiens
guugugaucuguguaguua

SEQ ID NO: 687705 - RNA, 19 nt, Homo sapiens
uuaaucaucugcucuguuu

SEQ ID NO: 687706 - RNA, 19 nt, Homo sapiens
ggaguauacuggagaaaug

SEQ ID NO: 687707 - RNA, 19 nt, Homo sapiens
gcaaguaaacugcauguau

SEQ ID NO: 687708 - RNA, 19 nt, Homo sapiens
gcacagcggcuucuccuaa

SEQ ID NO: 687709 - RNA, 19 nt, Homo sapiens
gaauuuaugaucuggguua

SEQ ID NO: 687710 - RNA, 19 nt, Homo sapiens
ccaguaagguuucuuguuc

SEQ ID NO: 687711 - RNA, 19 nt, Homo sapiens
gaaauccugccuacuuuaa

SEQ ID NO: 687712 - RNA, 19 nt, Homo sapiens
uagcgaugauuuaccauua

SEQ ID NO: 687713 - RNA, 19 nt, Homo sapiens
ccacacuccucaugaaauu

SEQ ID NO: 687714 - RNA, 19 nt, Homo sapiens
aaacagcacaucauaagua

SEQ ID NO: 687715 - RNA, 19 nt, Homo sapiens
gaaaaugaauguuguggaa

SEQ ID NO: 687716 - RNA, 19 nt, Homo sapiens
gcuugaaccuuaugcauga

SEQ ID NO: 687717 - RNA, 19 nt, Homo sapiens
ggucucagcuuucuguguu

SEQ ID NO: 687718 - RNA, 19 nt, Homo sapiens
aagcgauucucaaauguua

SEQ ID NO: 687719 - RNA, 19 nt, Homo sapiens
ccacaucauuuccacguuu

SEQ ID NO: 687720 - RNA, 19 nt, Homo sapiens
gaaaucaguggguaauuga

SEQ ID NO: 687721 - RNA, 19 nt, Homo sapiens
gauccaugcucacaaauag

SEQ ID NO: 687722 - RNA, 19 nt, Homo sapiens
acagaggacuuacuauuau

SEQ ID NO: 687723 - RNA, 19 nt, Homo sapiens
caauguggaucguguaguu

SEQ ID NO: 687724 - RNA, 19 nt, Homo sapiens
ccuguaauguuuaguguuu

SEQ ID NO: 687725 - RNA, 19 nt, Homo sapiens
gaccaaacagcacaucaua

SEQ ID NO: 687726 - RNA, 19 nt, Homo sapiens
gaacuucgggauuugguuu

SEQ ID NO: 687727 - RNA, 19 nt, Homo sapiens
ggauugaacgcauaugaaa

SEQ ID NO: 687728 - RNA, 19 nt, Homo sapiens
uuagguaacuuccuguaaa

SEQ ID NO: 687729 - RNA, 19 nt, Homo sapiens
caaaucaguugggucguuu

SEQ ID NO: 687730 - RNA, 19 nt, Homo sapiens
acacgaggcucacugcauu

SEQ ID NO: 687731 - RNA, 19 nt, Homo sapiens
ggaagugacgugcuuauca

SEQ ID NO: 687732 - RNA, 19 nt, Homo sapiens
gaaggaaugcucacacuag

SEQ ID NO: 687733 - RNA, 19 nt, Homo sapiens
uaaagagucugugguuaug

SEQ ID NO: 687734 - RNA, 19 nt, Homo sapiens
agaaaugguuguagaaaca

SEQ ID NO: 687735 - RNA, 19 nt, Homo sapiens
uacagaggacuuacuauua

SEQ ID NO: 687736 - RNA, 19 nt, Homo sapiens
gcgaugauuuaccauuauu

SEQ ID NO: 687737 - RNA, 19 nt, Homo sapiens
gacagugggcauagauuua

SEQ ID NO: 687738 - RNA, 19 nt, Homo sapiens
aaucaaggcucugaaguug

SEQ ID NO: 687739 - RNA, 19 nt, Homo sapiens
ucaaagugguguucuaagu

SEQ ID NO: 687740 - RNA, 19 nt, Homo sapiens
cauaucgccugacuugauu

SEQ ID NO: 687741 - RNA, 19 nt, Homo sapiens
agaaaucaguggguaauug

SEQ ID NO: 687742 - RNA, 19 nt, Homo sapiens
aauccugccuacuuuaaua

SEQ ID NO: 687743 - RNA, 19 nt, Homo sapiens
ggucguuucucauuuaaca

SEQ ID NO: 687744 - RNA, 19 nt, Homo sapiens
ugacaggguaugaggauua

SEQ ID NO: 687745 - RNA, 19 nt, Homo sapiens
ccauagauuugcaaguaaa

SEQ ID NO: 687746 - RNA, 19 nt, Homo sapiens
gagaaaugguuguagaaac

SEQ ID NO: 687747 - RNA, 19 nt, Homo sapiens
caacuugguuaaucaucuu

SEQ ID NO: 687748 - RNA, 19 nt, Homo sapiens
ggaacgagauaaaauauuc

SEQ ID NO: 687749 - RNA, 19 nt, Homo sapiens
uagaugcuuuccuagcuua

SEQ ID NO: 687750 - RNA, 19 nt, Homo sapiens
caggauagauucaagacau

SEQ ID NO: 687751 - RNA, 19 nt, Homo sapiens
ggaaugcucacacuagaug

SEQ ID NO: 687752 - RNA, 19 nt, Homo sapiens
uugaaaggauguuaacuga

SEQ ID NO: 687753 - RNA, 19 nt, Homo sapiens
gaaauaaaucacgcagaaa

SEQ ID NO: 687754 - RNA, 19 nt, Homo sapiens
ggagaaaugguuguagaaa

SEQ ID NO: 687755 - RNA, 19 nt, Homo sapiens
gacaggguaugaggauuaa

SEQ ID NO: 687756 - RNA, 19 nt, Homo sapiens
guucagaaguucagcaagu

SEQ ID NO: 687757 - RNA, 19 nt, Homo sapiens
aaacucauaugcuguuauc

SEQ ID NO: 687758 - RNA, 19 nt, Homo sapiens
gcaacuugguuaaucaucu

SEQ ID NO: 687759 - RNA, 19 nt, Homo sapiens
uaacugauguagcgaugau

SEQ ID NO: 687760 - RNA, 19 nt, Homo sapiens
aaagagggauagcuaguca

SEQ ID NO: 687761 - RNA, 19 nt, Homo sapiens
gauuuggauugaacgcaua

SEQ ID NO: 687762 - RNA, 19 nt, Homo sapiens
cauuugagaugcagaggaa

SEQ ID NO: 687763 - RNA, 19 nt, Homo sapiens
ggcagugaauuacggauga

SEQ ID NO: 687764 - RNA, 19 nt, Homo sapiens
gcacuaagaaacguaaaga

SEQ ID NO: 687765 - RNA, 19 nt, Homo sapiens
gcuugagccuuccuccuuu

SEQ ID NO: 687766 - RNA, 19 nt, Homo sapiens
ggaauuaauacccaccauu

SEQ ID NO: 687767 - RNA, 19 nt, Homo sapiens
ggaaauucuuuggcuacuu

SEQ ID NO: 687768 - RNA, 19 nt, Homo sapiens
uaugagaagugguggaugu

SEQ ID NO: 687769 - RNA, 19 nt, Homo sapiens
cauaugcuguuaucacugu

SEQ ID NO: 687770 - RNA, 19 nt, Homo sapiens
ucaguugggucguuucuca

SEQ ID NO: 687771 - RNA, 19 nt, Homo sapiens
ucuaucgccugcucaagua

SEQ ID NO: 687772 - RNA, 19 nt, Homo sapiens
ucaguugucuugaauuucu

SEQ ID NO: 687773 - RNA, 19 nt, Homo sapiens
acucgugacuguauaaguu

SEQ ID NO: 687774 - RNA, 19 nt, Homo sapiens
ccugucaccucacaacaaa

SEQ ID NO: 687775 - RNA, 19 nt, Homo sapiens
gggauagcuuggcaacuug

SEQ ID NO: 687776 - RNA, 19 nt, Homo sapiens
ccugccuacuuuaauauua

SEQ ID NO: 687777 - RNA, 19 nt, Homo sapiens
guauacagaggacuuacua

SEQ ID NO: 687778 - RNA, 19 nt, Homo sapiens
ccaaacagcacaucauaag

SEQ ID NO: 687779 - RNA, 19 nt, Homo sapiens
gaccaggaccaggcuaaua

SEQ ID NO: 687780 - RNA, 19 nt, Homo sapiens
uuaaguguguuuagaagug

SEQ ID NO: 687781 - RNA, 19 nt, Homo sapiens
caccugauaucccagcaaa

SEQ ID NO: 687782 - RNA, 19 nt, Homo sapiens
gugcuuaucaccauagauu

SEQ ID NO: 687783 - RNA, 19 nt, Homo sapiens
ccagggugcuugucuaucu

SEQ ID NO: 687784 - RNA, 19 nt, Homo sapiens
ucaguuaaguguguuuaga

SEQ ID NO: 687785 - RNA, 19 nt, Homo sapiens
uugaaauccugccuacuuu

SEQ ID NO: 687786 - RNA, 19 nt, Homo sapiens
guugaaauccugccuacuu

SEQ ID NO: 687787 - RNA, 19 nt, Homo sapiens
ggacuuacuauuaugacuu

SEQ ID NO: 687788 - RNA, 19 nt, Homo sapiens
guaaaugucccaucuguua

SEQ ID NO: 687789 - RNA, 19 nt, Homo sapiens
gagaagacguggaguaaau

SEQ ID NO: 687790 - RNA, 19 nt, Homo sapiens
ggaagggugugcuggagua

SEQ ID NO: 687791 - RNA, 19 nt, Homo sapiens
ccaaauggaugaauguaga

SEQ ID NO: 687792 - RNA, 19 nt, Homo sapiens
ggauugagauagaggagaa

SEQ ID NO: 687793 - RNA, 19 nt, Homo sapiens
gaagauggacagcauaugu

SEQ ID NO: 687794 - RNA, 19 nt, Homo sapiens
ggaguuagcagaugacaau

SEQ ID NO: 687795 - RNA, 19 nt, Homo sapiens
agaaggaucucaagagugu

SEQ ID NO: 687796 - RNA, 19 nt, Homo sapiens
cuaagaagaucaaccugaa

SEQ ID NO: 687797 - RNA, 19 nt, Homo sapiens
gaaagaugagaacagcuua

SEQ ID NO: 687798 - RNA, 19 nt, Homo sapiens
acagauaucucucucacuu

SEQ ID NO: 687799 - RNA, 19 nt, Homo sapiens
ccgcuucucuuccuaguuu

SEQ ID NO: 687800 - RNA, 19 nt, Homo sapiens
uaagaaggaucucaagagu

SEQ ID NO: 687801 - RNA, 19 nt, Homo sapiens
caagaugccuccucaaagg

SEQ ID NO: 687802 - RNA, 19 nt, Homo sapiens
ggaggucacugguguugug

SEQ ID NO: 687803 - RNA, 19 nt, Homo sapiens
gaguaaaugucccaucugu

SEQ ID NO: 687804 - RNA, 19 nt, Homo sapiens
ugaaccacuuguugaauuu

SEQ ID NO: 687805 - RNA, 19 nt, Homo sapiens
gccaugaagugccaucuug

SEQ ID NO: 687806 - RNA, 19 nt, Homo sapiens
ccacagagucacaucagua

SEQ ID NO: 687807 - RNA, 19 nt, Homo sapiens
caagagcgauggaaagaac

SEQ ID NO: 687808 - RNA, 19 nt, Homo sapiens
aaagaaggcucgggaggaa

SEQ ID NO: 687809 - RNA, 19 nt, Homo sapiens
uaaggaaacccuagagaug

SEQ ID NO: 687810 - RNA, 19 nt, Homo sapiens
caaaacugcuccaaagaaa

SEQ ID NO: 687811 - RNA, 19 nt, Homo sapiens
gaaggcaguggacauggua

SEQ ID NO: 687812 - RNA, 19 nt, Homo sapiens
ccagacgggucacuuugaa

SEQ ID NO: 687813 - RNA, 19 nt, Homo sapiens
ggacacaccagcuacuuca

SEQ ID NO: 687814 - RNA, 19 nt, Homo sapiens
uaacugggacuuuguggaa

SEQ ID NO: 687815 - RNA, 19 nt, Homo sapiens
cagaugacauugagaagag

SEQ ID NO: 687816 - RNA, 19 nt, Homo sapiens
cagccaagcuauugaagca

SEQ ID NO: 687817 - RNA, 19 nt, Homo sapiens
cugaaccacuuguugaauu

SEQ ID NO: 687818 - RNA, 19 nt, Homo sapiens
gaacuuuccuaccccaaaa

SEQ ID NO: 687819 - RNA, 19 nt, Homo sapiens
gauccugauacauuaguua

SEQ ID NO: 687820 - RNA, 19 nt, Homo sapiens
gccaauuuguggugucuga

SEQ ID NO: 687821 - RNA, 19 nt, Homo sapiens
aaacugcuccaaagaaaga

SEQ ID NO: 687822 - RNA, 19 nt, Homo sapiens
gauagaggagaacaagaaa

SEQ ID NO: 687823 - RNA, 19 nt, Homo sapiens
gcagauguguggcccaaaa

SEQ ID NO: 687824 - RNA, 19 nt, Homo sapiens
ucgagaaucuacagcaguu

SEQ ID NO: 687825 - RNA, 19 nt, Homo sapiens
cagcagcucuccuuguuac

SEQ ID NO: 687826 - RNA, 19 nt, Homo sapiens
cgaugcagcugaugaagag

SEQ ID NO: 687827 - RNA, 19 nt, Homo sapiens
gauccaagcguuauaaucg

SEQ ID NO: 687828 - RNA, 19 nt, Homo sapiens
ggacauaagccuuuuaaca

SEQ ID NO: 687829 - RNA, 19 nt, Homo sapiens
cgagagcgcaggauugaga

SEQ ID NO: 687830 - RNA, 19 nt, Homo sapiens
ggagaaaguagcacuagag

SEQ ID NO: 687831 - RNA, 19 nt, Homo sapiens
gcacuaucuuucacugagu

SEQ ID NO: 687832 - RNA, 19 nt, Homo sapiens
uuaguuaacugggacuuug

SEQ ID NO: 687833 - RNA, 19 nt, Homo sapiens
gcucaacgggcagaguuua

SEQ ID NO: 687834 - RNA, 19 nt, Homo sapiens
acaagaaacagggcaagua

SEQ ID NO: 687835 - RNA, 19 nt, Homo sapiens
ccuguggucucuaaggaaa

SEQ ID NO: 687836 - RNA, 19 nt, Homo sapiens
ggaggaagcagugucugaa

SEQ ID NO: 687837 - RNA, 19 nt, Homo sapiens
gcucaagacucgggaagag

SEQ ID NO: 687838 - RNA, 19 nt, Homo sapiens
gugagaagacguggaguaa

SEQ ID NO: 687839 - RNA, 19 nt, Homo sapiens
caggccaacugccaauuug

SEQ ID NO: 687840 - RNA, 19 nt, Homo sapiens
ccuccgacauggacaagaa

SEQ ID NO: 687841 - RNA, 19 nt, Homo sapiens
ggcagcagcaaacucuuua

SEQ ID NO: 687842 - RNA, 19 nt, Homo sapiens
gagaagccaaggaaggaaa

SEQ ID NO: 687843 - RNA, 19 nt, Homo sapiens
caacugugguggagauugc

SEQ ID NO: 687844 - RNA, 19 nt, Homo sapiens
cagcaacugugguggagau

SEQ ID NO: 687845 - RNA, 19 nt, Homo sapiens
gcagcucuccuuguuacua

SEQ ID NO: 687846 - RNA, 19 nt, Homo sapiens
gaacagcacagccaguacu

SEQ ID NO: 687847 - RNA, 19 nt, Homo sapiens
gacauaagccuuuuaacaa

SEQ ID NO: 687848 - RNA, 19 nt, Homo sapiens
uuguuuggcugcuguaauu

SEQ ID NO: 687849 - RNA, 19 nt, Homo sapiens
ccacggaaguuuguucucu

SEQ ID NO: 687850 - RNA, 19 nt, Homo sapiens
ggaggagaaaguagcacua

SEQ ID NO: 687851 - RNA, 19 nt, Homo sapiens
gaccaucccauucaucuag

SEQ ID NO: 687852 - RNA, 19 nt, Homo sapiens
gcgcauuuguagccaugaa

SEQ ID NO: 687853 - RNA, 19 nt, Homo sapiens
guauuugaguuugaacaga

SEQ ID NO: 687854 - RNA, 19 nt, Homo sapiens
gaagacguggaguaaaugu

SEQ ID NO: 687855 - RNA, 19 nt, Homo sapiens
gcaaacgugaacuuuccua

SEQ ID NO: 687856 - RNA, 19 nt, Homo sapiens
guacccagaaguccacauu

SEQ ID NO: 687857 - RNA, 19 nt, Homo sapiens
caagaaacagggcaaguac

SEQ ID NO: 687858 - RNA, 19 nt, Homo sapiens
agauagaggagaacaagaa

SEQ ID NO: 687859 - RNA, 19 nt, Homo sapiens
cccgaguccugcuuuauug

SEQ ID NO: 687860 - RNA, 19 nt, Homo sapiens
guuuagcccugcccaguuc

SEQ ID NO: 687861 - RNA, 19 nt, Homo sapiens
gcaaacucuuuagcucuuc

SEQ ID NO: 687862 - RNA, 19 nt, Homo sapiens
gcaagacuuuuaacaagau

SEQ ID NO: 687863 - RNA, 19 nt, Homo sapiens
uauaccugcuccucugauu

SEQ ID NO: 687864 - RNA, 19 nt, Homo sapiens
gagaaucuacagcaguuuc

SEQ ID NO: 687865 - RNA, 19 nt, Homo sapiens
aggaaacccuagagauguu

SEQ ID NO: 687866 - RNA, 19 nt, Homo sapiens
ugaagaaaccacggaaguu

SEQ ID NO: 687867 - RNA, 19 nt, Homo sapiens
caaagaaagaugagaacag

SEQ ID NO: 687868 - RNA, 19 nt, Homo sapiens
ccaguggauccaagcguua

SEQ ID NO: 687869 - RNA, 19 nt, Homo sapiens
agugccaucuugcccaaua

SEQ ID NO: 687870 - RNA, 19 nt, Homo sapiens
caggcuaccuucuccaucu

SEQ ID NO: 687871 - RNA, 19 nt, Homo sapiens
uagaggagaacaagaaaca

SEQ ID NO: 687872 - RNA, 19 nt, Homo sapiens
cauaagaaggaucucaaga

SEQ ID NO: 687873 - RNA, 19 nt, Homo sapiens
uugcugauccugauacauu

SEQ ID NO: 687874 - RNA, 19 nt, Homo sapiens
cucagcagcucuccuuguu

SEQ ID NO: 687875 - RNA, 19 nt, Homo sapiens
guaucugucugccuucgau

SEQ ID NO: 687876 - RNA, 19 nt, Homo sapiens
uggaacaacuggugcugau

SEQ ID NO: 687877 - RNA, 19 nt, Homo sapiens
agaaagaugagaacagcuu

SEQ ID NO: 687878 - RNA, 19 nt, Homo sapiens
ggauuggccggaagcagaa

SEQ ID NO: 687879 - RNA, 19 nt, Homo sapiens
uggaguaaaugucccaucu

SEQ ID NO: 687880 - RNA, 19 nt, Homo sapiens
ugcugauccugauacauua

SEQ ID NO: 687881 - RNA, 19 nt, Homo sapiens
aacaagaugccuccucaaa

SEQ ID NO: 687882 - RNA, 19 nt, Homo sapiens
agaucaaccugaaccacuu

SEQ ID NO: 687883 - RNA, 19 nt, Homo sapiens
uggaagacgagaugaggua

SEQ ID NO: 687884 - RNA, 19 nt, Homo sapiens
uuccugccuucaauucuua

SEQ ID NO: 687885 - RNA, 19 nt, Homo sapiens
caagcguuauaaucgcaaa

SEQ ID NO: 687886 - RNA, 19 nt, Homo sapiens
uguuguggcugcucuggaa

SEQ ID NO: 687887 - RNA, 19 nt, Homo sapiens
uggaacaagugcgcauuug

SEQ ID NO: 687888 - RNA, 19 nt, Homo sapiens
ggaaacagcuggcaaugug

SEQ ID NO: 687889 - RNA, 19 nt, Homo sapiens
ggacaacaaucaaaucaug

SEQ ID NO: 687890 - RNA, 19 nt, Homo sapiens
ggaagaaauucaccgauga

SEQ ID NO: 687891 - RNA, 19 nt, Homo sapiens
gcaguuacauacagaauug

SEQ ID NO: 687892 - RNA, 19 nt, Homo sapiens
gagcagauaucaaaguguu

SEQ ID NO: 687893 - RNA, 19 nt, Homo sapiens
cagcaaaucugcaaaccaa

SEQ ID NO: 687894 - RNA, 19 nt, Homo sapiens
cgagaaaucuuccuguuca

SEQ ID NO: 687895 - RNA, 19 nt, Homo sapiens
gaggagagucuaacuguaa

SEQ ID NO: 687896 - RNA, 19 nt, Homo sapiens
gagucuaacuguaaccuuu

SEQ ID NO: 687897 - RNA, 19 nt, Homo sapiens
ggaggagagucuaacugua

SEQ ID NO: 687898 - RNA, 19 nt, Homo sapiens
gcgauuacauauugaguau

SEQ ID NO: 687899 - RNA, 19 nt, Homo sapiens
guaaacacaucguugaagu

SEQ ID NO: 687900 - RNA, 19 nt, Homo sapiens
auacagcaaucuagaguuu

SEQ ID NO: 687901 - RNA, 19 nt, Homo sapiens
gcaaauacagcaaucuaga

SEQ ID NO: 687902 - RNA, 19 nt, Homo sapiens
ucaccaagaucuuccagaa

SEQ ID NO: 687903 - RNA, 19 nt, Homo sapiens
ucucaagucacacaaauua

SEQ ID NO: 687904 - RNA, 19 nt, Homo sapiens
cuagaggacuucaucaaga

SEQ ID NO: 687905 - RNA, 19 nt, Homo sapiens
ggaugcaguucuccuuuga

SEQ ID NO: 687906 - RNA, 19 nt, Homo sapiens
gcacaccuuucucaaguca

SEQ ID NO: 687907 - RNA, 19 nt, Homo sapiens
gagcaaauacagcaaucua

SEQ ID NO: 687908 - RNA, 19 nt, Homo sapiens
aaaccaagcacuuuguuaa

SEQ ID NO: 687909 - RNA, 19 nt, Homo sapiens
ggacuacaccagcgagaaa

SEQ ID NO: 687910 - RNA, 19 nt, Homo sapiens
ggacgauggugaggacauu

SEQ ID NO: 687911 - RNA, 19 nt, Homo sapiens
gcagauaucaaaguguuaa

SEQ ID NO: 687912 - RNA, 19 nt, Homo sapiens
agagagcaauguggaauuu

SEQ ID NO: 687913 - RNA, 19 nt, Homo sapiens
gaauaggaacagacagaaa

SEQ ID NO: 687914 - RNA, 19 nt, Homo sapiens
acacaucguugaaguaaag

SEQ ID NO: 687915 - RNA, 19 nt, Homo sapiens
gcguuaaacugcugcaugu

SEQ ID NO: 687916 - RNA, 19 nt, Homo sapiens
ccagugcucuagccucaaa

SEQ ID NO: 687917 - RNA, 19 nt, Homo sapiens
uagaggacuucaucaagaa

SEQ ID NO: 687918 - RNA, 19 nt, Homo sapiens
gagguuucauucuguuuau

SEQ ID NO: 687919 - RNA, 19 nt, Homo sapiens
aaacacaucguugaaguaa

SEQ ID NO: 687920 - RNA, 19 nt, Homo sapiens
gacaguccuucuccuugua

SEQ ID NO: 687921 - RNA, 19 nt, Homo sapiens
aaaugaagcuagaggacuu

SEQ ID NO: 687922 - RNA, 19 nt, Homo sapiens
gcaagcagaccuaccacaa

SEQ ID NO: 687923 - RNA, 19 nt, Homo sapiens
gcagcuccaugucagagaa

SEQ ID NO: 687924 - RNA, 19 nt, Homo sapiens
cgacaguccuucuccuugu

SEQ ID NO: 687925 - RNA, 19 nt, Homo sapiens
ggauugugcuguccaacau

SEQ ID NO: 687926 - RNA, 19 nt, Homo sapiens
aaucuagaguuuagccuuu

SEQ ID NO: 687927 - RNA, 19 nt, Homo sapiens
gagagcaaauacagcaauc

SEQ ID NO: 687928 - RNA, 19 nt, Homo sapiens
ccaagcacuuuguuaaucu

SEQ ID NO: 687929 - RNA, 19 nt, Homo sapiens
gagaaaucuuccuguucaa

SEQ ID NO: 687930 - RNA, 19 nt, Homo sapiens
uguggaagauacauuguug

SEQ ID NO: 687931 - RNA, 19 nt, Homo sapiens
cuagugagguuucauucug

SEQ ID NO: 687932 - RNA, 19 nt, Homo sapiens
uagcaguaaugaauaggaa

SEQ ID NO: 687933 - RNA, 19 nt, Homo sapiens
uaaacacaucguugaagua

SEQ ID NO: 687934 - RNA, 19 nt, Homo sapiens
guauuggcgugacuguaaa

SEQ ID NO: 687935 - RNA, 19 nt, Homo sapiens
ggucauaucauugagauca

SEQ ID NO: 687936 - RNA, 19 nt, Homo sapiens
ucaagaggcagagugcuua

SEQ ID NO: 687937 - RNA, 19 nt, Homo sapiens
ccucggaccugcaggacaa

SEQ ID NO: 687938 - RNA, 19 nt, Homo sapiens
gaugcuagaacgaaaguau

SEQ ID NO: 687939 - RNA, 19 nt, Homo sapiens
gagaagcacaggauagagu

SEQ ID NO: 687940 - RNA, 19 nt, Homo sapiens
aagcaggucucagugacua

SEQ ID NO: 687941 - RNA, 19 nt, Homo sapiens
gaaacagcuggcaauguga

SEQ ID NO: 687942 - RNA, 19 nt, Homo sapiens
gcaagcuuaucaaaaguuu

SEQ ID NO: 687943 - RNA, 19 nt, Homo sapiens
uguauuggcgugacuguaa

SEQ ID NO: 687944 - RNA, 19 nt, Homo sapiens
cacccucggucauaucauu

SEQ ID NO: 687945 - RNA, 19 nt, Homo sapiens
agucggagcucgagaagca

SEQ ID NO: 687946 - RNA, 19 nt, Homo sapiens
uggcacaccuuucucaagu

SEQ ID NO: 687947 - RNA, 19 nt, Homo sapiens
ccaccuguguccucccauu

SEQ ID NO: 687948 - RNA, 19 nt, Homo sapiens
uuagagaucccaccuguca

SEQ ID NO: 687949 - RNA, 19 nt, Homo sapiens
ggguagcaguaaugaauag

SEQ ID NO: 687950 - RNA, 19 nt, Homo sapiens
gggaggagagucuaacugu

SEQ ID NO: 687951 - RNA, 19 nt, Homo sapiens
cgauuucccuccucacauc

SEQ ID NO: 687952 - RNA, 19 nt, Homo sapiens
agagcaauguggaauuuca

SEQ ID NO: 687953 - RNA, 19 nt, Homo sapiens
ggacucgccugccuuuagc

SEQ ID NO: 687954 - RNA, 19 nt, Homo sapiens
ugagguuucauucuguuua

SEQ ID NO: 687955 - RNA, 19 nt, Homo sapiens
acagcaaucuagaguuuag

SEQ ID NO: 687956 - RNA, 19 nt, Homo sapiens
cgucagugcugugcuccua

SEQ ID NO: 687957 - RNA, 19 nt, Homo sapiens
caacugcagcuccgaguca

SEQ ID NO: 687958 - RNA, 19 nt, Homo sapiens
cuguuuauuugcaagcuua

SEQ ID NO: 687959 - RNA, 19 nt, Homo sapiens
uauugaguaugucagcuuu

SEQ ID NO: 687960 - RNA, 19 nt, Homo sapiens
aguaccagaugaacaagaa

SEQ ID NO: 687961 - RNA, 19 nt, Homo sapiens
gauggagaagcacaggaua

SEQ ID NO: 687962 - RNA, 19 nt, Homo sapiens
gggaguccauugcggaagu

SEQ ID NO: 687963 - RNA, 19 nt, Homo sapiens
cggagcagauaucaaagug

SEQ ID NO: 687964 - RNA, 19 nt, Homo sapiens
gcaaccggcagaagcaguu

SEQ ID NO: 687965 - RNA, 19 nt, Homo sapiens
gcagaugaucggcgaguuc

SEQ ID NO: 687966 - RNA, 19 nt, Homo sapiens
gacaaugacagcaucaaca

SEQ ID NO: 687967 - RNA, 19 nt, Homo sapiens
gcagggcagucccaagcau

SEQ ID NO: 687968 - RNA, 19 nt, Homo sapiens
acaaguagguggagaugcu

SEQ ID NO: 687969 - RNA, 19 nt, Homo sapiens
gagaucaccguaccagcaa

SEQ ID NO: 687970 - RNA, 19 nt, Homo sapiens
cgggaucgcuagagagcaa

SEQ ID NO: 687971 - RNA, 19 nt, Homo sapiens
agaagaacucggugacgua

SEQ ID NO: 687972 - RNA, 19 nt, Homo sapiens
gggaagcaggucucaguga

SEQ ID NO: 687973 - RNA, 19 nt, Homo sapiens
gccaguaccagaugaacaa

SEQ ID NO: 687974 - RNA, 19 nt, Homo sapiens
ggacaaguagguggagaug

SEQ ID NO: 687975 - RNA, 19 nt, Homo sapiens
gcgagaaaucuuccuguuc

SEQ ID NO: 687976 - RNA, 19 nt, Homo sapiens
gaagguggagaagcucauu

SEQ ID NO: 687977 - RNA, 19 nt, Homo sapiens
caacaagaagccugagaag

SEQ ID NO: 687978 - RNA, 19 nt, Homo sapiens
uggcgugacuguaaacaca

SEQ ID NO: 687979 - RNA, 19 nt, Homo sapiens
caucuggcgucagcuguga

SEQ ID NO: 687980 - RNA, 19 nt, Homo sapiens
cucaagaccggaagaaauu

SEQ ID NO: 687981 - RNA, 19 nt, Homo sapiens
ccucaagaccggaagaaau

SEQ ID NO: 687982 - RNA, 19 nt, Homo sapiens
ucaacaagaagccugagaa

SEQ ID NO: 687983 - RNA, 19 nt, Homo sapiens
gcaucggccugaaccucuu

SEQ ID NO: 687984 - RNA, 19 nt, Homo sapiens
gagggaaacagcuggcaau

SEQ ID NO: 687985 - RNA, 19 nt, Homo sapiens
uggagaugcuagaacgaaa

SEQ ID NO: 687986 - RNA, 19 nt, Homo sapiens
gcaguaaugaauaggaaca

SEQ ID NO: 687987 - RNA, 19 nt, Homo sapiens
gaaggguagcaguaaugaa

SEQ ID NO: 687988 - RNA, 19 nt, Homo sapiens
ggagauggcuuccuaaguu

SEQ ID NO: 687989 - RNA, 19 nt, Homo sapiens
gaaaguaccugcaauccuu

SEQ ID NO: 687990 - RNA, 19 nt, Homo sapiens
gcacugagccugagucuuu

SEQ ID NO: 687991 - RNA, 19 nt, Homo sapiens
gcagaaagauggacuggaa

SEQ ID NO: 687992 - RNA, 19 nt, Homo sapiens
gaaaguaucuggagcuaag

SEQ ID NO: 687993 - RNA, 19 nt, Homo sapiens
gcaugaagcugugcaguuu

SEQ ID NO: 687994 - RNA, 19 nt, Homo sapiens
caucaaauauuccaagcua

SEQ ID NO: 687995 - RNA, 19 nt, Homo sapiens
cacaguaguucaagacuua

SEQ ID NO: 687996 - RNA, 19 nt, Homo sapiens
ccacggcccucucccuuua

SEQ ID NO: 687997 - RNA, 19 nt, Homo sapiens
gcaaggugaccaucaaaua

SEQ ID NO: 687998 - RNA, 19 nt, Homo sapiens
gccgauaucuuucauguga

SEQ ID NO: 687999 - RNA, 19 nt, Homo sapiens
gaacaaggaauuugcuuug

SEQ ID NO: 688000 - RNA, 19 nt, Homo sapiens
uaacaacucucaagucuac

SEQ ID NO: 688001 - RNA, 19 nt, Homo sapiens
agaacaaccucaaguauau

SEQ ID NO: 688002 - RNA, 19 nt, Homo sapiens
ggaaacccaugacaguauu

SEQ ID NO: 688003 - RNA, 19 nt, Homo sapiens
gauacaaccugaacaucaa

SEQ ID NO: 688004 - RNA, 19 nt, Homo sapiens
gaaggugucuacucugaau

SEQ ID NO: 688005 - RNA, 19 nt, Homo sapiens
ggucacagauggugcuauu

SEQ ID NO: 688006 - RNA, 19 nt, Homo sapiens
ugacaugaauuggaaagua

SEQ ID NO: 688007 - RNA, 19 nt, Homo sapiens
caagauggcaguaaagaaa

SEQ ID NO: 688008 - RNA, 19 nt, Homo sapiens
gaccuuguuugcuggauua

SEQ ID NO: 688009 - RNA, 19 nt, Homo sapiens
ugagagaccuccguacuuu

SEQ ID NO: 688010 - RNA, 19 nt, Homo sapiens
uaccugcaauccuuuauua

SEQ ID NO: 688011 - RNA, 19 nt, Homo sapiens
gagcugggcuuccuguuuc

SEQ ID NO: 688012 - RNA, 19 nt, Homo sapiens
caacccagccgauaucuuu

SEQ ID NO: 688013 - RNA, 19 nt, Homo sapiens
gacauggagucuagaauug

SEQ ID NO: 688014 - RNA, 19 nt, Homo sapiens
ugacuacccuucccaaaga

SEQ ID NO: 688015 - RNA, 19 nt, Homo sapiens
ucaagggucuuuaugagaa

SEQ ID NO: 688016 - RNA, 19 nt, Homo sapiens
ugacccagauggaaaguaa

SEQ ID NO: 688017 - RNA, 19 nt, Homo sapiens
ggagucagacagugaauuu

SEQ ID NO: 688018 - RNA, 19 nt, Homo sapiens
gcuauuaauugaacuggaa

SEQ ID NO: 688019 - RNA, 19 nt, Homo sapiens
ucacucaacugcaucaaga

SEQ ID NO: 688020 - RNA, 19 nt, Homo sapiens
ccaaacaagucccaagaau

SEQ ID NO: 688021 - RNA, 19 nt, Homo sapiens
ggguauacauugugccuuu

SEQ ID NO: 688022 - RNA, 19 nt, Homo sapiens
gaaaacacauacuaccuuu

SEQ ID NO: 688023 - RNA, 19 nt, Homo sapiens
ggaggagcauggugucuau

SEQ ID NO: 688024 - RNA, 19 nt, Homo sapiens
gcaccaggcugcgcaauca

SEQ ID NO: 688025 - RNA, 19 nt, Homo sapiens
cagcagcacucuacucguu

SEQ ID NO: 688026 - RNA, 19 nt, Homo sapiens
gacagaggauaccacagua

SEQ ID NO: 688027 - RNA, 19 nt, Homo sapiens
ugaaugagaugccacagau

SEQ ID NO: 688028 - RNA, 19 nt, Homo sapiens
gggaagaacuaugacuuug

SEQ ID NO: 688029 - RNA, 19 nt, Homo sapiens
guaccaagucuaccauuaa

SEQ ID NO: 688030 - RNA, 19 nt, Homo sapiens
gauggaaaguaauugguau

SEQ ID NO: 688031 - RNA, 19 nt, Homo sapiens
ucacagauggugcuauuaa

SEQ ID NO: 688032 - RNA, 19 nt, Homo sapiens
gagauggcuuccuaaguug

SEQ ID NO: 688033 - RNA, 19 nt, Homo sapiens
gaagaacuaugacuuugcu

SEQ ID NO: 688034 - RNA, 19 nt, Homo sapiens
gagguggaaucgcuucauu

SEQ ID NO: 688035 - RNA, 19 nt, Homo sapiens
ccacacgucuggcaagguu

SEQ ID NO: 688036 - RNA, 19 nt, Homo sapiens
gcccaucggugcugucuug

SEQ ID NO: 688037 - RNA, 19 nt, Homo sapiens
agugguaucuguucaauga

SEQ ID NO: 688038 - RNA, 19 nt, Homo sapiens
ggaaccacaucuccacaug

SEQ ID NO: 688039 - RNA, 19 nt, Homo sapiens
acaaaucgcuucuucuucu

SEQ ID NO: 688040 - RNA, 19 nt, Homo sapiens
ccaagaacaaccucaagua

SEQ ID NO: 688041 - RNA, 19 nt, Homo sapiens
gaauugacccagauggaaa

SEQ ID NO: 688042 - RNA, 19 nt, Homo sapiens
ggaaauaccacaggcuuau

SEQ ID NO: 688043 - RNA, 19 nt, Homo sapiens
caauggcagugaugauauu

SEQ ID NO: 688044 - RNA, 19 nt, Homo sapiens
gaaguggguguaccuguuu

SEQ ID NO: 688045 - RNA, 19 nt, Homo sapiens
gcaaggagggcguuacuca

SEQ ID NO: 688046 - RNA, 19 nt, Homo sapiens
ccugauggcuacuguggua

SEQ ID NO: 688047 - RNA, 19 nt, Homo sapiens
ccuguacgcugucuaauuc

SEQ ID NO: 688048 - RNA, 19 nt, Homo sapiens
ggagccagauucauuccuu

SEQ ID NO: 688049 - RNA, 19 nt, Homo sapiens
uaaguuggcuauaccuugu

SEQ ID NO: 688050 - RNA, 19 nt, Homo sapiens
aggagcaggugguggauua

SEQ ID NO: 688051 - RNA, 19 nt, Homo sapiens
gaacaucaagaacccuauu

SEQ ID NO: 688052 - RNA, 19 nt, Homo sapiens
ccugguggcucacaucaaa

SEQ ID NO: 688053 - RNA, 19 nt, Homo sapiens
gcugugagauggagaacug

SEQ ID NO: 688054 - RNA, 19 nt, Homo sapiens
gugcaccucuggacugauu

SEQ ID NO: 688055 - RNA, 19 nt, Homo sapiens
caagaacaaccucaaguau

SEQ ID NO: 688056 - RNA, 19 nt, Homo sapiens
uauccugggugacuaauau

SEQ ID NO: 688057 - RNA, 19 nt, Homo sapiens
gguauacauugugccuuua

SEQ ID NO: 688058 - RNA, 19 nt, Homo sapiens
uaccaagucuaccauuaaa

SEQ ID NO: 688059 - RNA, 19 nt, Homo sapiens
caaggugaccaucaaauau

SEQ ID NO: 688060 - RNA, 19 nt, Homo sapiens
ccacaucuccacaugguuu

SEQ ID NO: 688061 - RNA, 19 nt, Homo sapiens
gcaaucagauacccuacag

SEQ ID NO: 688062 - RNA, 19 nt, Homo sapiens
ggaaucagugcacauaaug

SEQ ID NO: 688063 - RNA, 19 nt, Homo sapiens
gcagaauuguugcaaaggu

SEQ ID NO: 688064 - RNA, 19 nt, Homo sapiens
aaacugggaagaacuauga

SEQ ID NO: 688065 - RNA, 19 nt, Homo sapiens
ugauccaggugcucuauuu

SEQ ID NO: 688066 - RNA, 19 nt, Homo sapiens
uugauuaccugcuggauga

SEQ ID NO: 688067 - RNA, 19 nt, Homo sapiens
aagaacaaccucaaguaua

SEQ ID NO: 688068 - RNA, 19 nt, Homo sapiens
gaacuggaacacagcagaa

SEQ ID NO: 688069 - RNA, 19 nt, Homo sapiens
ggaauuugcuuuggcugau

SEQ ID NO: 688070 - RNA, 19 nt, Homo sapiens
ugaaguggguguaccuguu

SEQ ID NO: 688071 - RNA, 19 nt, Homo sapiens
gcugccggcuucauuuauu

SEQ ID NO: 688072 - RNA, 19 nt, Homo sapiens
gcaauccuuuauuauguca

SEQ ID NO: 688073 - RNA, 19 nt, Homo sapiens
gaauuugcuuuggcugauu

SEQ ID NO: 688074 - RNA, 19 nt, Homo sapiens
acacacuucucucugauug

SEQ ID NO: 688075 - RNA, 19 nt, Homo sapiens
gcgcuucauuccuacauau

SEQ ID NO: 688076 - RNA, 19 nt, Homo sapiens
ggaaaguaauugguauucu

SEQ ID NO: 688077 - RNA, 19 nt, Homo sapiens
aaacagugguacagacaug

SEQ ID NO: 688078 - RNA, 19 nt, Homo sapiens
uaagguggaacaugaguuu

SEQ ID NO: 688079 - RNA, 19 nt, Homo sapiens
ccacaguaguucaagacuu

SEQ ID NO: 688080 - RNA, 19 nt, Homo sapiens
cagaauuguugcaaagguu

SEQ ID NO: 688081 - RNA, 19 nt, Homo sapiens
cagcagaauuguugcaaag

SEQ ID NO: 688082 - RNA, 19 nt, Homo sapiens
caaacaagucccaagaaug

SEQ ID NO: 688083 - RNA, 19 nt, Homo sapiens
ccuaacaacucucaagucu

SEQ ID NO: 688084 - RNA, 19 nt, Homo sapiens
ccacugaugcugaaugaga

SEQ ID NO: 688085 - RNA, 19 nt, Homo sapiens
gacaugaauuggaaaguac

SEQ ID NO: 688086 - RNA, 19 nt, Homo sapiens
gcagugguaucuguucaau

SEQ ID NO: 688087 - RNA, 19 nt, Homo sapiens
ccaggagacucagaaguau

SEQ ID NO: 688088 - RNA, 19 nt, Homo sapiens
ggaaauaacuuuacugcaa

SEQ ID NO: 688089 - RNA, 19 nt, Homo sapiens
caaauaaccuagagcauaa

SEQ ID NO: 688090 - RNA, 19 nt, Homo sapiens
gauaugagguccugugaaa

SEQ ID NO: 688091 - RNA, 19 nt, Homo sapiens
gcauagaaguaaucaagua

SEQ ID NO: 688092 - RNA, 19 nt, Homo sapiens
gaaauucaguugugugugu

SEQ ID NO: 688093 - RNA, 19 nt, Homo sapiens
gaagucaguuuaauucaug

SEQ ID NO: 688094 - RNA, 19 nt, Homo sapiens
gugaacagaucauaaaguu

SEQ ID NO: 688095 - RNA, 19 nt, Homo sapiens
uaacagugcuggcaacaug

SEQ ID NO: 688096 - RNA, 19 nt, Homo sapiens
gcacuuugcucuagcuguu

SEQ ID NO: 688097 - RNA, 19 nt, Homo sapiens
gcaagaaggccuuaucaga

SEQ ID NO: 688098 - RNA, 19 nt, Homo sapiens
uauaagcacucaaagacua

SEQ ID NO: 688099 - RNA, 19 nt, Homo sapiens
ggacaagccuguucuccau

SEQ ID NO: 688100 - RNA, 19 nt, Homo sapiens
uaaaguguaucaugagcua

SEQ ID NO: 688101 - RNA, 19 nt, Homo sapiens
uguaauggaugucuuauug

SEQ ID NO: 688102 - RNA, 19 nt, Homo sapiens
guaaugcagucagaaagua

SEQ ID NO: 688103 - RNA, 19 nt, Homo sapiens
gagcagaggaaauaacuuu

SEQ ID NO: 688104 - RNA, 19 nt, Homo sapiens
cauuugaacucuguuguua

SEQ ID NO: 688105 - RNA, 19 nt, Homo sapiens
ggucuuccauggcacauuu

SEQ ID NO: 688106 - RNA, 19 nt, Homo sapiens
ggagcuacguccucauuug

SEQ ID NO: 688107 - RNA, 19 nt, Homo sapiens
uagcaacucucccagguuu

SEQ ID NO: 688108 - RNA, 19 nt, Homo sapiens
agagggagcucgcaaguau

SEQ ID NO: 688109 - RNA, 19 nt, Homo sapiens
guagagaacccauuuagug

SEQ ID NO: 688110 - RNA, 19 nt, Homo sapiens
guuucuaccuggauuauaa

SEQ ID NO: 688111 - RNA, 19 nt, Homo sapiens
guaaucaaguagcaucuga

SEQ ID NO: 688112 - RNA, 19 nt, Homo sapiens
gggaggagccaguaacuuu

SEQ ID NO: 688113 - RNA, 19 nt, Homo sapiens
ggagagcaauguaauggau

SEQ ID NO: 688114 - RNA, 19 nt, Homo sapiens
guaagcaguuaaugccuuu

SEQ ID NO: 688115 - RNA, 19 nt, Homo sapiens
gauggaaccuggaaucucu

SEQ ID NO: 688116 - RNA, 19 nt, Homo sapiens
gcuuuaaaguguaucauga

SEQ ID NO: 688117 - RNA, 19 nt, Homo sapiens
gaagauagugcgaucaugu

SEQ ID NO: 688118 - RNA, 19 nt, Homo sapiens
ccacaaaugcuuuaaagug

SEQ ID NO: 688119 - RNA, 19 nt, Homo sapiens
gaacagcacagguuaaugc

SEQ ID NO: 688120 - RNA, 19 nt, Homo sapiens
guaaaacuguguagcauuu

SEQ ID NO: 688121 - RNA, 19 nt, Homo sapiens
ggcaagagguuuagucagu

SEQ ID NO: 688122 - RNA, 19 nt, Homo sapiens
ccaaggaggagaacaguuu

SEQ ID NO: 688123 - RNA, 19 nt, Homo sapiens
ggaccagugucuugugaga

SEQ ID NO: 688124 - RNA, 19 nt, Homo sapiens
acaaauaaccuagagcaua

SEQ ID NO: 688125 - RNA, 19 nt, Homo sapiens
gcucugugauugugucauu

SEQ ID NO: 688126 - RNA, 19 nt, Homo sapiens
gcauucucuuggacuauua

SEQ ID NO: 688127 - RNA, 19 nt, Homo sapiens
cauaaacacugcacuuugg

SEQ ID NO: 688128 - RNA, 19 nt, Homo sapiens
cacaaaugcuuuaaagugu

SEQ ID NO: 688129 - RNA, 19 nt, Homo sapiens
guucucagcuaaugaugaa

SEQ ID NO: 688130 - RNA, 19 nt, Homo sapiens
uaccaaaccaucauucaua

SEQ ID NO: 688131 - RNA, 19 nt, Homo sapiens
gcccauagcauagaaguaa

SEQ ID NO: 688132 - RNA, 19 nt, Homo sapiens
uaaauggaguguguacuug

SEQ ID NO: 688133 - RNA, 19 nt, Homo sapiens
guaaauggaguguguacuu

SEQ ID NO: 688134 - RNA, 19 nt, Homo sapiens
gucagaaaguaguuuguaa

SEQ ID NO: 688135 - RNA, 19 nt, Homo sapiens
gugaucauguagaaucuuu

SEQ ID NO: 688136 - RNA, 19 nt, Homo sapiens
guuagcagcccauagcaua

SEQ ID NO: 688137 - RNA, 19 nt, Homo sapiens
auacaucacuguuggauag

SEQ ID NO: 688138 - RNA, 19 nt, Homo sapiens
ggaagucacaaauaaccua

SEQ ID NO: 688139 - RNA, 19 nt, Homo sapiens
ggaaggaguuguggucagu

SEQ ID NO: 688140 - RNA, 19 nt, Homo sapiens
ggccuuugcugcacugauu

SEQ ID NO: 688141 - RNA, 19 nt, Homo sapiens
uaccugauuugcagucaua

SEQ ID NO: 688142 - RNA, 19 nt, Homo sapiens
caaggacgcugcccauguc

SEQ ID NO: 688143 - RNA, 19 nt, Homo sapiens
caauguaauggaugucuua

SEQ ID NO: 688144 - RNA, 19 nt, Homo sapiens
gggaauagacacuuuaaag

SEQ ID NO: 688145 - RNA, 19 nt, Homo sapiens
aaaguucuaucaaggaguu

SEQ ID NO: 688146 - RNA, 19 nt, Homo sapiens
ccuaugaucuguaguuucu

SEQ ID NO: 688147 - RNA, 19 nt, Homo sapiens
ucaccuugcuguccucuga

SEQ ID NO: 688148 - RNA, 19 nt, Homo sapiens
gcuacguccucauuugaaa

SEQ ID NO: 688149 - RNA, 19 nt, Homo sapiens
caguacagacccuaaauuu

SEQ ID NO: 688150 - RNA, 19 nt, Homo sapiens
ggaguauuauaucccugua

SEQ ID NO: 688151 - RNA, 19 nt, Homo sapiens
acuaauaaccggagaacua

SEQ ID NO: 688152 - RNA, 19 nt, Homo sapiens
gaguggugguuaaaucuga

SEQ ID NO: 688153 - RNA, 19 nt, Homo sapiens
gcaauguaauggaugucuu

SEQ ID NO: 688154 - RNA, 19 nt, Homo sapiens
ggucagugccgagaagaua

SEQ ID NO: 688155 - RNA, 19 nt, Homo sapiens
gcucuuccaugcgcaguaa

SEQ ID NO: 688156 - RNA, 19 nt, Homo sapiens
uaugagguccugugaaauu

SEQ ID NO: 688157 - RNA, 19 nt, Homo sapiens
aaucuagagugugcaguua

SEQ ID NO: 688158 - RNA, 19 nt, Homo sapiens
acaagccuguucuccauuu

SEQ ID NO: 688159 - RNA, 19 nt, Homo sapiens
gagcuacguccucauuuga

SEQ ID NO: 688160 - RNA, 19 nt, Homo sapiens
ccgcauagcucccaaaaug

SEQ ID NO: 688161 - RNA, 19 nt, Homo sapiens
gagaacaguuugggaugga

SEQ ID NO: 688162 - RNA, 19 nt, Homo sapiens
ccucucaccugcauuugaa

SEQ ID NO: 688163 - RNA, 19 nt, Homo sapiens
gagaggagccagugacaca

SEQ ID NO: 688164 - RNA, 19 nt, Homo sapiens
guuaguggcaccuguauga

SEQ ID NO: 688165 - RNA, 19 nt, Homo sapiens
gacucaggaucauggauuu

SEQ ID NO: 688166 - RNA, 19 nt, Homo sapiens
uauuugugcugcugcauuu

SEQ ID NO: 688167 - RNA, 19 nt, Homo sapiens
cugcaaaucagaacaauga

SEQ ID NO: 688168 - RNA, 19 nt, Homo sapiens
aacaagagcagaggaaaua

SEQ ID NO: 688169 - RNA, 19 nt, Homo sapiens
ugagaguggugguuaaauc

SEQ ID NO: 688170 - RNA, 19 nt, Homo sapiens
ccacgauuccuuucgagua

SEQ ID NO: 688171 - RNA, 19 nt, Homo sapiens
gcucacagaucccagaaaa

SEQ ID NO: 688172 - RNA, 19 nt, Homo sapiens
accaaaccaucauucauaa

SEQ ID NO: 688173 - RNA, 19 nt, Homo sapiens
ccggagaacuaacauguag

SEQ ID NO: 688174 - RNA, 19 nt, Homo sapiens
auagugcgaucauguuuga

SEQ ID NO: 688175 - RNA, 19 nt, Homo sapiens
gcagcgcuccuuuaugcua

SEQ ID NO: 688176 - RNA, 19 nt, Homo sapiens
gguuacaacuugagauuuu

SEQ ID NO: 688177 - RNA, 19 nt, Homo sapiens
ccucuuagucugucaguuu

SEQ ID NO: 688178 - RNA, 19 nt, Homo sapiens
uguagagagugacaaggua

SEQ ID NO: 688179 - RNA, 19 nt, Homo sapiens
cuaauaaccggagaacuaa

SEQ ID NO: 688180 - RNA, 19 nt, Homo sapiens
gagaacccauuuagugaac

SEQ ID NO: 688181 - RNA, 19 nt, Homo sapiens
uagagaacccauuuaguga

SEQ ID NO: 688182 - RNA, 19 nt, Homo sapiens
ggaagcugcaccugagaaa

SEQ ID NO: 688183 - RNA, 19 nt, Homo sapiens
ggaagauagugcgaucaug

SEQ ID NO: 688184 - RNA, 19 nt, Homo sapiens
gcaugcagcgcuccuuuau

SEQ ID NO: 688185 - RNA, 19 nt, Homo sapiens
caugaagucaguuuaauuc

SEQ ID NO: 688186 - RNA, 19 nt, Homo sapiens
guuaaugcgucucccuaga

SEQ ID NO: 688187 - RNA, 19 nt, Homo sapiens
gagccaguaacuuuccuua

SEQ ID NO: 688188 - RNA, 19 nt, Homo sapiens
gaaaggacguuuaaaguau

SEQ ID NO: 688189 - RNA, 19 nt, Homo sapiens
gaaauaggcuaguuuauag

SEQ ID NO: 688190 - RNA, 19 nt, Homo sapiens
gaacaugcauacauaaaug

SEQ ID NO: 688191 - RNA, 19 nt, Homo sapiens
ggaaauaggcuaguuuaua

SEQ ID NO: 688192 - RNA, 19 nt, Homo sapiens
uacaggaucuuuccaauua

SEQ ID NO: 688193 - RNA, 19 nt, Homo sapiens
gaaauucaauggauggauu

SEQ ID NO: 688194 - RNA, 19 nt, Homo sapiens
uagggacgcuuacuaauua

SEQ ID NO: 688195 - RNA, 19 nt, Homo sapiens
gcaaacaaauucacugaga

SEQ ID NO: 688196 - RNA, 19 nt, Homo sapiens
gagaauggcuauaacuuug

SEQ ID NO: 688197 - RNA, 19 nt, Homo sapiens
gaagauagcuaugaguuca

SEQ ID NO: 688198 - RNA, 19 nt, Homo sapiens
guaagucagugguaguuua

SEQ ID NO: 688199 - RNA, 19 nt, Homo sapiens
guacuuaaauugcagagaa

SEQ ID NO: 688200 - RNA, 19 nt, Homo sapiens
gcacacauaucuugaaugg

SEQ ID NO: 688201 - RNA, 19 nt, Homo sapiens
cauggagacuucuuuauaa

SEQ ID NO: 688202 - RNA, 19 nt, Homo sapiens
caauuuaccucauaagaga

SEQ ID NO: 688203 - RNA, 19 nt, Homo sapiens
guucagacuuucuuucaua

SEQ ID NO: 688204 - RNA, 19 nt, Homo sapiens
gguagagacuaauauguuu

SEQ ID NO: 688205 - RNA, 19 nt, Homo sapiens
cacagcagcuucaucuuua

SEQ ID NO: 688206 - RNA, 19 nt, Homo sapiens
gaaauuuguugcgauguuu

SEQ ID NO: 688207 - RNA, 19 nt, Homo sapiens
ugacaaaugccaauagaua

SEQ ID NO: 688208 - RNA, 19 nt, Homo sapiens
ccucuuagcuguagucuau

SEQ ID NO: 688209 - RNA, 19 nt, Homo sapiens
uaacugaaauaccucauug

SEQ ID NO: 688210 - RNA, 19 nt, Homo sapiens
gacaaucacuuccuuaaag

SEQ ID NO: 688211 - RNA, 19 nt, Homo sapiens
gaacuguacuuaaauugca

SEQ ID NO: 688212 - RNA, 19 nt, Homo sapiens
ucccaaagcugaaccuaua

SEQ ID NO: 688213 - RNA, 19 nt, Homo sapiens
gaacuggacccugggaaua

SEQ ID NO: 688214 - RNA, 19 nt, Homo sapiens
guaacaaacuccagucugu

SEQ ID NO: 688215 - RNA, 19 nt, Homo sapiens
guaacaaacuccagucugu

SEQ ID NO: 688216 - RNA, 19 nt, Homo sapiens
ugaaagcacugaugagguu

SEQ ID NO: 688217 - RNA, 19 nt, Homo sapiens
guaaggagucuaugcauuu

SEQ ID NO: 688218 - RNA, 19 nt, Homo sapiens
ggauagucuucuuggauua

SEQ ID NO: 688219 - RNA, 19 nt, Homo sapiens
caucaugcuuggcuaauuu

SEQ ID NO: 688220 - RNA, 19 nt, Homo sapiens
gguacaacaucauucagua

SEQ ID NO: 688221 - RNA, 19 nt, Homo sapiens
cagagaaaccuguaaguaa

SEQ ID NO: 688222 - RNA, 19 nt, Homo sapiens
gcagagaaaccuguaagua

SEQ ID NO: 688223 - RNA, 19 nt, Homo sapiens
guaaagcaacaccaaauaa

SEQ ID NO: 688224 - RNA, 19 nt, Homo sapiens
ggaauuguuucucuaguuc

SEQ ID NO: 688225 - RNA, 19 nt, Homo sapiens
ucgaaggaaucauguauaa

SEQ ID NO: 688226 - RNA, 19 nt, Homo sapiens
guggugaacuguacuuaaa

SEQ ID NO: 688227 - RNA, 19 nt, Homo sapiens
ugaaaggacguuuaaagua

SEQ ID NO: 688228 - RNA, 19 nt, Homo sapiens
gcagcaauaugccacugua

SEQ ID NO: 688229 - RNA, 19 nt, Homo sapiens
gugcauaugugaaagagaa

SEQ ID NO: 688230 - RNA, 19 nt, Homo sapiens
gauauacagugauggaaug

SEQ ID NO: 688231 - RNA, 19 nt, Homo sapiens
gaugagacaguuauacuuu

SEQ ID NO: 688232 - RNA, 19 nt, Homo sapiens
gaacgauaccagcacauaa

SEQ ID NO: 688233 - RNA, 19 nt, Homo sapiens
gaaaugaugcggaaagaca

SEQ ID NO: 688234 - RNA, 19 nt, Homo sapiens
caaacaaauucacugagaa

SEQ ID NO: 688235 - RNA, 19 nt, Homo sapiens
gagaagaggaaaucauaaa

SEQ ID NO: 688236 - RNA, 19 nt, Homo sapiens
gaaagacagcuaucaggaa

SEQ ID NO: 688237 - RNA, 19 nt, Homo sapiens
ggugaacuguacuuaaauu

SEQ ID NO: 688238 - RNA, 19 nt, Homo sapiens
guacaaaacugaagaaaag

SEQ ID NO: 688239 - RNA, 19 nt, Homo sapiens
gaggagaugcuaaagaauu

SEQ ID NO: 688240 - RNA, 19 nt, Homo sapiens
gguuggugcuuuauuguaa

SEQ ID NO: 688241 - RNA, 19 nt, Homo sapiens
aagcaucccugaauaauca

SEQ ID NO: 688242 - RNA, 19 nt, Homo sapiens
gagaugaaaggacguuuaa

SEQ ID NO: 688243 - RNA, 19 nt, Homo sapiens
ggagaugaaaggacguuua

SEQ ID NO: 688244 - RNA, 19 nt, Homo sapiens
uaaugaugcuucuguuuga

SEQ ID NO: 688245 - RNA, 19 nt, Homo sapiens
guagucuguugaaucauua

SEQ ID NO: 688246 - RNA, 19 nt, Homo sapiens
gaucgaaaauggauuguuu

SEQ ID NO: 688247 - RNA, 19 nt, Homo sapiens
gcauuguucucaagccuuu

SEQ ID NO: 688248 - RNA, 19 nt, Homo sapiens
agagaaaccuguaaguaau

SEQ ID NO: 688249 - RNA, 19 nt, Homo sapiens
guaaagagagaaucaguau

SEQ ID NO: 688250 - RNA, 19 nt, Homo sapiens
uuaaauaucuccgugaguu

SEQ ID NO: 688251 - RNA, 19 nt, Homo sapiens
caaaggaacaugauauugu

SEQ ID NO: 688252 - RNA, 19 nt, Homo sapiens
gguaaagcaacaccaaaua

SEQ ID NO: 688253 - RNA, 19 nt, Homo sapiens
aggagaugcuaaagaauua

SEQ ID NO: 688254 - RNA, 19 nt, Homo sapiens
gugcuuuccuuaucaguaa

SEQ ID NO: 688255 - RNA, 19 nt, Homo sapiens
ccacuaaauuacuggauga

SEQ ID NO: 688256 - RNA, 19 nt, Homo sapiens
guaauauaaugaccugcua

SEQ ID NO: 688257 - RNA, 19 nt, Homo sapiens
ggaaggguagagacuaaua

SEQ ID NO: 688258 - RNA, 19 nt, Homo sapiens
gagaguagccuuuaaucau

SEQ ID NO: 688259 - RNA, 19 nt, Homo sapiens
gaaguaggcuauaaaacaa

SEQ ID NO: 688260 - RNA, 19 nt, Homo sapiens
gaaaacaaaugggagcaua

SEQ ID NO: 688261 - RNA, 19 nt, Homo sapiens
gcagauauagcaaaggauu

SEQ ID NO: 688262 - RNA, 19 nt, Homo sapiens
uaucagaggcauaucauaa

SEQ ID NO: 688263 - RNA, 19 nt, Homo sapiens
gggagaagauauuaaagca

SEQ ID NO: 688264 - RNA, 19 nt, Homo sapiens
guagccacauggaagauaa

SEQ ID NO: 688265 - RNA, 19 nt, Homo sapiens
caggaaggguagagacuaa

SEQ ID NO: 688266 - RNA, 19 nt, Homo sapiens
uaacauguucucucucuuu

SEQ ID NO: 688267 - RNA, 19 nt, Homo sapiens
gcuaguggcuuauaauggu

SEQ ID NO: 688268 - RNA, 19 nt, Homo sapiens
aaucugaaaucaccaaaug

SEQ ID NO: 688269 - RNA, 19 nt, Homo sapiens
gcuaugaguucagaucuau

SEQ ID NO: 688270 - RNA, 19 nt, Homo sapiens
ucacugugcuccaaaggaa

SEQ ID NO: 688271 - RNA, 19 nt, Homo sapiens
ccacagcagcuucaucuuu

SEQ ID NO: 688272 - RNA, 19 nt, Homo sapiens
ggaaggauuacuagauuga

SEQ ID NO: 688273 - RNA, 19 nt, Homo sapiens
aaggaaggauuacuagauu

SEQ ID NO: 688274 - RNA, 19 nt, Homo sapiens
gggagaaguugcucacugu

SEQ ID NO: 688275 - RNA, 19 nt, Homo sapiens
agaggcauaucauaaauug

SEQ ID NO: 688276 - RNA, 19 nt, Homo sapiens
gaauugacguggacuuguc

SEQ ID NO: 688277 - RNA, 19 nt, Homo sapiens
cacaaauucuuuacgugua

SEQ ID NO: 688278 - RNA, 19 nt, Homo sapiens
ugucuuggauucauguuaa

SEQ ID NO: 688279 - RNA, 19 nt, Homo sapiens
ggugacaaaugccaauaga

SEQ ID NO: 688280 - RNA, 19 nt, Homo sapiens
caaucucaauuuagaggua

SEQ ID NO: 688281 - RNA, 19 nt, Homo sapiens
agaaacaagucaggcauuu

SEQ ID NO: 688282 - RNA, 19 nt, Homo sapiens
ucauggagacuucuuuaua

SEQ ID NO: 688283 - RNA, 19 nt, Homo sapiens
gggaugguaugcuggauau

SEQ ID NO: 688284 - RNA, 19 nt, Homo sapiens
cauagagaguagccuuuaa

SEQ ID NO: 688285 - RNA, 19 nt, Homo sapiens
gaaaagcaucccugaauaa

SEQ ID NO: 688286 - RNA, 19 nt, Homo sapiens
guuaaugaguagugaaaug

SEQ ID NO: 688287 - RNA, 19 nt, Homo sapiens
caaccaauccuuaacuuuc

SEQ ID NO: 688288 - RNA, 19 nt, Homo sapiens
gcagaaggcuuucaaguga

SEQ ID NO: 688289 - RNA, 19 nt, Homo sapiens
ggaguuaaguugaggcuuu

SEQ ID NO: 688290 - RNA, 19 nt, Homo sapiens
ggacuugccucucuucuca

SEQ ID NO: 688291 - RNA, 19 nt, Homo sapiens
caugauagauggcuugaaa

SEQ ID NO: 688292 - RNA, 19 nt, Homo sapiens
gcaaagcugcucaggaaua

SEQ ID NO: 688293 - RNA, 19 nt, Homo sapiens
ggacagcccugguauugau

SEQ ID NO: 688294 - RNA, 19 nt, Homo sapiens
caugaggccuuucuccuua

SEQ ID NO: 688295 - RNA, 19 nt, Homo sapiens
caagaccgacugaaauuua

SEQ ID NO: 688296 - RNA, 19 nt, Homo sapiens
caaagcugcucaggaauaa

SEQ ID NO: 688297 - RNA, 19 nt, Homo sapiens
caaguuggaucgcuuccua

SEQ ID NO: 688298 - RNA, 19 nt, Homo sapiens
caagugcccuggacuaaau

SEQ ID NO: 688299 - RNA, 19 nt, Homo sapiens
gaagacacguacaggaaug

SEQ ID NO: 688300 - RNA, 19 nt, Homo sapiens
gaaaaucacugucacacaa

SEQ ID NO: 688301 - RNA, 19 nt, Homo sapiens
gacuauaagcugcgaauua

SEQ ID NO: 688302 - RNA, 19 nt, Homo sapiens
gaagaucucucaccaucca

SEQ ID NO: 688303 - RNA, 19 nt, Homo sapiens
acagugagcucaacauguu

SEQ ID NO: 688304 - RNA, 19 nt, Homo sapiens
cgacugaaauuuauugaca

SEQ ID NO: 688305 - RNA, 19 nt, Homo sapiens
gaaggacuguggcuugugu

SEQ ID NO: 688306 - RNA, 19 nt, Homo sapiens
ucaacacagucaaucaaua

SEQ ID NO: 688307 - RNA, 19 nt, Homo sapiens
guugaaggauguaguagaa

SEQ ID NO: 688308 - RNA, 19 nt, Homo sapiens
acuauaagcugcgaauuaa

SEQ ID NO: 688309 - RNA, 19 nt, Homo sapiens
ggaacugucugggaccuuu

SEQ ID NO: 688310 - RNA, 19 nt, Homo sapiens
ggacagaagagaacucaga

SEQ ID NO: 688311 - RNA, 19 nt, Homo sapiens
guacaggaaugcagaacug

SEQ ID NO: 688312 - RNA, 19 nt, Homo sapiens
ccacuaggcuugauugcau

SEQ ID NO: 688313 - RNA, 19 nt, Homo sapiens
gaccgcaucuucuuugugu

SEQ ID NO: 688314 - RNA, 19 nt, Homo sapiens
guucuugacucacuucaga

SEQ ID NO: 688315 - RNA, 19 nt, Homo sapiens
gaccuuugcucaucugugu

SEQ ID NO: 688316 - RNA, 19 nt, Homo sapiens
guauugaugucaccacaga

SEQ ID NO: 688317 - RNA, 19 nt, Homo sapiens
gaaauugccgccaugaaca

SEQ ID NO: 688318 - RNA, 19 nt, Homo sapiens
caguaguccucaagguuua

SEQ ID NO: 688319 - RNA, 19 nt, Homo sapiens
gcucauugcccucuccuuu

SEQ ID NO: 688320 - RNA, 19 nt, Homo sapiens
caggaggaguucaugguuu

SEQ ID NO: 688321 - RNA, 19 nt, Homo sapiens
cagcuggauugacaaguuu

SEQ ID NO: 688322 - RNA, 19 nt, Homo sapiens
gaagagcaccgugaucaau

SEQ ID NO: 688323 - RNA, 19 nt, Homo sapiens
acacauggcugaggugaau

SEQ ID NO: 688324 - RNA, 19 nt, Homo sapiens
caacacagucaaucaauag

SEQ ID NO: 688325 - RNA, 19 nt, Homo sapiens
caugaugccuacccuguga

SEQ ID NO: 688326 - RNA, 19 nt, Homo sapiens
guaccaaggaguuaaguug

SEQ ID NO: 688327 - RNA, 19 nt, Homo sapiens
ccucaagguuuauaagaau

SEQ ID NO: 688328 - RNA, 19 nt, Homo sapiens
gguggacgauuaccagaug

SEQ ID NO: 688329 - RNA, 19 nt, Homo sapiens
gcaagaccgacugaaauuu

SEQ ID NO: 688330 - RNA, 19 nt, Homo sapiens
gcaacucuaucgucacagu

SEQ ID NO: 688331 - RNA, 19 nt, Homo sapiens
ugaaagaaguauggccaaa

SEQ ID NO: 688332 - RNA, 19 nt, Homo sapiens
uuggaucgcuuccuagaaa

SEQ ID NO: 688333 - RNA, 19 nt, Homo sapiens
acuaugaccuaaacuguga

SEQ ID NO: 688334 - RNA, 19 nt, Homo sapiens
ggagggcuguuggauguau

SEQ ID NO: 688335 - RNA, 19 nt, Homo sapiens
ggaauaaagccgguugguu

SEQ ID NO: 688336 - RNA, 19 nt, Homo sapiens
ggaaauugccgccaugaac

SEQ ID NO: 688337 - RNA, 19 nt, Homo sapiens
gaucaggcgccucucugua

SEQ ID NO: 688338 - RNA, 19 nt, Homo sapiens
gacuguggcuugugugugu

SEQ ID NO: 688339 - RNA, 19 nt, Homo sapiens
ccaguaguccucaagguuu

SEQ ID NO: 688340 - RNA, 19 nt, Homo sapiens
ggcaagaccgacugaaauu

SEQ ID NO: 688341 - RNA, 19 nt, Homo sapiens
gcgaggaaaugcgugaaga

SEQ ID NO: 688342 - RNA, 19 nt, Homo sapiens
ucuggaugcugauguguuu

SEQ ID NO: 688343 - RNA, 19 nt, Homo sapiens
ccaagaagaagaucaaugg

SEQ ID NO: 688344 - RNA, 19 nt, Homo sapiens
gggaaugaaugaaauuuug

SEQ ID NO: 688345 - RNA, 19 nt, Homo sapiens
gagaaugggccguccacuu

SEQ ID NO: 688346 - RNA, 19 nt, Homo sapiens
ggacagugagcucaacaug

SEQ ID NO: 688347 - RNA, 19 nt, Homo sapiens
ggacugggucgaaacaugu

SEQ ID NO: 688348 - RNA, 19 nt, Homo sapiens
ugauguggcccaacucuaa

SEQ ID NO: 688349 - RNA, 19 nt, Homo sapiens
ggagagcgccaccuuccuu

SEQ ID NO: 688350 - RNA, 19 nt, Homo sapiens
agaaugggccguccacuug

SEQ ID NO: 688351 - RNA, 19 nt, Homo sapiens
caacuaugaccuaaacugu

SEQ ID NO: 688352 - RNA, 19 nt, Homo sapiens
gcagugaagaccaaguuug

SEQ ID NO: 688353 - RNA, 19 nt, Homo sapiens
agccaucacucaucuuuga

SEQ ID NO: 688354 - RNA, 19 nt, Homo sapiens
cgacagcuauggacagcau

SEQ ID NO: 688355 - RNA, 19 nt, Homo sapiens
gacauugaguuccauuucu

SEQ ID NO: 688356 - RNA, 19 nt, Homo sapiens
gggcacagauggccaugag

SEQ ID NO: 688357 - RNA, 19 nt, Homo sapiens
gguuaccuauccaaaguga

SEQ ID NO: 688358 - RNA, 19 nt, Homo sapiens
gugaaugcauccccacuua

SEQ ID NO: 688359 - RNA, 19 nt, Homo sapiens
gaucgcuuccuagaaauaa

SEQ ID NO: 688360 - RNA, 19 nt, Homo sapiens
gguguugacugugugagaa

SEQ ID NO: 688361 - RNA, 19 nt, Homo sapiens
caagcugugugcugacuuc

SEQ ID NO: 688362 - RNA, 19 nt, Homo sapiens
acagcuggauugacaaguu

SEQ ID NO: 688363 - RNA, 19 nt, Homo sapiens
uagccucugugcacuguuu

SEQ ID NO: 688364 - RNA, 19 nt, Homo sapiens
guccuuugcuuuaguguca

SEQ ID NO: 688365 - RNA, 19 nt, Homo sapiens
gauaaggccucaggaucuc

SEQ ID NO: 688366 - RNA, 19 nt, Homo sapiens
gugacgcgcuuauccacuu

SEQ ID NO: 688367 - RNA, 19 nt, Homo sapiens
ggaagagcaccgugaucaa

SEQ ID NO: 688368 - RNA, 19 nt, Homo sapiens
gggaagagcaccgugauca

SEQ ID NO: 688369 - RNA, 19 nt, Homo sapiens
ugauguauuugcuugaguu

SEQ ID NO: 688370 - RNA, 19 nt, Homo sapiens
ggaucgcuuccuagaaaua

SEQ ID NO: 688371 - RNA, 19 nt, Homo sapiens
gagcugcaccgccacauag

SEQ ID NO: 688372 - RNA, 19 nt, Homo sapiens
cagaagagaacucagaauc

SEQ ID NO: 688373 - RNA, 19 nt, Homo sapiens
caagugaggauguuugagu

SEQ ID NO: 688374 - RNA, 19 nt, Homo sapiens
ccucagagcccgaguacau

SEQ ID NO: 688375 - RNA, 19 nt, Homo sapiens
ucugaaggaugaccucguu

SEQ ID NO: 688376 - RNA, 19 nt, Homo sapiens
guucugcccucugggauug

SEQ ID NO: 688377 - RNA, 19 nt, Homo sapiens
uauuguguccuuugcuuua

SEQ ID NO: 688378 - RNA, 19 nt, Homo sapiens
ugaagcacccagucucgua

SEQ ID NO: 688379 - RNA, 19 nt, Homo sapiens
gaagacauugaguuccauu

SEQ ID NO: 688380 - RNA, 19 nt, Homo sapiens
gaaggacugggucgaaaca

SEQ ID NO: 688381 - RNA, 19 nt, Homo sapiens
ccacuuaagcacuuuguca

SEQ ID NO: 688382 - RNA, 19 nt, Homo sapiens
ccuguaucauugcucauaa

SEQ ID NO: 688383 - RNA, 19 nt, Homo sapiens
gauguauuugcuugaguua

SEQ ID NO: 688384 - RNA, 19 nt, Homo sapiens
aaaucacugucacacaauu

SEQ ID NO: 688385 - RNA, 19 nt, Homo sapiens
gauuguuacugguugaagu

SEQ ID NO: 688386 - RNA, 19 nt, Homo sapiens
cagaaggacuguggcuugu

SEQ ID NO: 688387 - RNA, 19 nt, Homo sapiens
ccaggaagacauugaguuc

SEQ ID NO: 688388 - RNA, 19 nt, Homo sapiens
gcacagagaucacaacuug

SEQ ID NO: 688389 - RNA, 19 nt, Homo sapiens
gcagacagccuaauuaaua

SEQ ID NO: 688390 - RNA, 19 nt, Homo sapiens
gaaauggccuguacaaguu

SEQ ID NO: 688391 - RNA, 19 nt, Homo sapiens
gaaugaagauccacaacua

SEQ ID NO: 688392 - RNA, 19 nt, Homo sapiens
caacuuaacuugcauuguu

SEQ ID NO: 688393 - RNA, 19 nt, Homo sapiens
ggaauuauguuucaaaugg

SEQ ID NO: 688394 - RNA, 19 nt, Homo sapiens
uaaccaagcccguuuaaua

SEQ ID NO: 688395 - RNA, 19 nt, Homo sapiens
gaauaaagguguaccaaag

SEQ ID NO: 688396 - RNA, 19 nt, Homo sapiens
agaaacacgucuuacauua

SEQ ID NO: 688397 - RNA, 19 nt, Homo sapiens
acaggaaacuuguaucaua

SEQ ID NO: 688398 - RNA, 19 nt, Homo sapiens
gaaaacagcugaaauagau

SEQ ID NO: 688399 - RNA, 19 nt, Homo sapiens
gcaaagacauauguaaaug

SEQ ID NO: 688400 - RNA, 19 nt, Homo sapiens
gaaugaaacugcaucaaca

SEQ ID NO: 688401 - RNA, 19 nt, Homo sapiens
ggaaauaaauaaccagaag

SEQ ID NO: 688402 - RNA, 19 nt, Homo sapiens
caaaagaacuucagcauga

SEQ ID NO: 688403 - RNA, 19 nt, Homo sapiens
caaagaguguggaaagaaa

SEQ ID NO: 688404 - RNA, 19 nt, Homo sapiens
caagaauucuggaagcuuu

SEQ ID NO: 688405 - RNA, 19 nt, Homo sapiens
ccagaaggcuaaucacaaa

SEQ ID NO: 688406 - RNA, 19 nt, Homo sapiens
gaagaaagcccugauuugu

SEQ ID NO: 688407 - RNA, 19 nt, Homo sapiens
gcaguuagcaguucugaaa

SEQ ID NO: 688408 - RNA, 19 nt, Homo sapiens
acaacaagcuguaaaguau

SEQ ID NO: 688409 - RNA, 19 nt, Homo sapiens
gaaggugugaguauuaaua

SEQ ID NO: 688410 - RNA, 19 nt, Homo sapiens
uaacuaugcuugggugaua

SEQ ID NO: 688411 - RNA, 19 nt, Homo sapiens
ggaaauaguuugacguuuu

SEQ ID NO: 688412 - RNA, 19 nt, Homo sapiens
gcaauccagucacuuacua

SEQ ID NO: 688413 - RNA, 19 nt, Homo sapiens
gaacacaaacugacaacaa

SEQ ID NO: 688414 - RNA, 19 nt, Homo sapiens
ggaaauaaacaaagagcua

SEQ ID NO: 688415 - RNA, 19 nt, Homo sapiens
ucaaaugaauguccaaaga

SEQ ID NO: 688416 - RNA, 19 nt, Homo sapiens
gagcaguuccuaaagaaua

SEQ ID NO: 688417 - RNA, 19 nt, Homo sapiens
agaaagcccugauuuguug

SEQ ID NO: 688418 - RNA, 19 nt, Homo sapiens
gaaagcaggaauuauguuu

SEQ ID NO: 688419 - RNA, 19 nt, Homo sapiens
uaacagcggugauauucuu

SEQ ID NO: 688420 - RNA, 19 nt, Homo sapiens
guggaaaccugaacaauca

SEQ ID NO: 688421 - RNA, 19 nt, Homo sapiens
gauaugaacgcuaaguuaa

SEQ ID NO: 688422 - RNA, 19 nt, Homo sapiens
cauaagaaauggcuggaaa

SEQ ID NO: 688423 - RNA, 19 nt, Homo sapiens
auacuaaacuguuggauga

SEQ ID NO: 688424 - RNA, 19 nt, Homo sapiens
gaagaacaccaacaaucua

SEQ ID NO: 688425 - RNA, 19 nt, Homo sapiens
gaggucagcuaucacauug

SEQ ID NO: 688426 - RNA, 19 nt, Homo sapiens
ggaacacccugacacgaaa

SEQ ID NO: 688427 - RNA, 19 nt, Homo sapiens
gaacaggaaacuuguauca

SEQ ID NO: 688428 - RNA, 19 nt, Homo sapiens
gagcuuagggucuuaguaa

SEQ ID NO: 688429 - RNA, 19 nt, Homo sapiens
agaaauggcuggaaaucaa

SEQ ID NO: 688430 - RNA, 19 nt, Homo sapiens
caggagaguuuaagagaaa

SEQ ID NO: 688431 - RNA, 19 nt, Homo sapiens
aaugauggcugauaagaaa

SEQ ID NO: 688432 - RNA, 19 nt, Homo sapiens
gacuuaagcugcauuugaa

SEQ ID NO: 688433 - RNA, 19 nt, Homo sapiens
caaaauaguucaucacuga

SEQ ID NO: 688434 - RNA, 19 nt, Homo sapiens
ucagacagcugggauguuu

SEQ ID NO: 688435 - RNA, 19 nt, Homo sapiens
gcaccaguuucuucacuuu

SEQ ID NO: 688436 - RNA, 19 nt, Homo sapiens
gaagaaaugaugcaaggaa

SEQ ID NO: 688437 - RNA, 19 nt, Homo sapiens
cuacugguaugaaugauaa

SEQ ID NO: 688438 - RNA, 19 nt, Homo sapiens
caucuuugcuuguuaguga

SEQ ID NO: 688439 - RNA, 19 nt, Homo sapiens
gcaggagaguuuaagagaa

SEQ ID NO: 688440 - RNA, 19 nt, Homo sapiens
ggacaaaucaagcacuauu

SEQ ID NO: 688441 - RNA, 19 nt, Homo sapiens
gaacaggaaauauauguca

SEQ ID NO: 688442 - RNA, 19 nt, Homo sapiens
uaaauaaccagaaggcuaa

SEQ ID NO: 688443 - RNA, 19 nt, Homo sapiens
gagauacuccuauaaguga

SEQ ID NO: 688444 - RNA, 19 nt, Homo sapiens
gaagagauacuuuguaacu

SEQ ID NO: 688445 - RNA, 19 nt, Homo sapiens
gcagugagcucagaggaau

SEQ ID NO: 688446 - RNA, 19 nt, Homo sapiens
gaagcaaagacauauguaa

SEQ ID NO: 688447 - RNA, 19 nt, Homo sapiens
gaaacagucggaauauuga

SEQ ID NO: 688448 - RNA, 19 nt, Homo sapiens
gagaaacagucggaauauu

SEQ ID NO: 688449 - RNA, 19 nt, Homo sapiens
gcacugaaaggaugccaua

SEQ ID NO: 688450 - RNA, 19 nt, Homo sapiens
gaaggcaaguacaagaaga

SEQ ID NO: 688451 - RNA, 19 nt, Homo sapiens
gguguaggcuuaggaauga

SEQ ID NO: 688452 - RNA, 19 nt, Homo sapiens
cagcagaaucggaauaaua

SEQ ID NO: 688453 - RNA, 19 nt, Homo sapiens
gaagagauacuccuauaag

SEQ ID NO: 688454 - RNA, 19 nt, Homo sapiens
guucuuacauggcuguuaa

SEQ ID NO: 688455 - RNA, 19 nt, Homo sapiens
gaacacgaucacagaauaa

SEQ ID NO: 688456 - RNA, 19 nt, Homo sapiens
agaacacgaucacagaaua

SEQ ID NO: 688457 - RNA, 19 nt, Homo sapiens
gaacaccucugcaggaaaa

SEQ ID NO: 688458 - RNA, 19 nt, Homo sapiens
caucaauacugaagaauag

SEQ ID NO: 688459 - RNA, 19 nt, Homo sapiens
gaacuacaaggaacaaaga

SEQ ID NO: 688460 - RNA, 19 nt, Homo sapiens
ccaagaucaugccacuuua

SEQ ID NO: 688461 - RNA, 19 nt, Homo sapiens
uggaagagauacuccuaua

SEQ ID NO: 688462 - RNA, 19 nt, Homo sapiens
ggucagcuaucacauugaa

SEQ ID NO: 688463 - RNA, 19 nt, Homo sapiens
ccacuuuacuccagucuga

SEQ ID NO: 688464 - RNA, 19 nt, Homo sapiens
ggaagaacacgaucacaga

SEQ ID NO: 688465 - RNA, 19 nt, Homo sapiens
ugaagaaccaggaauaauu

SEQ ID NO: 688466 - RNA, 19 nt, Homo sapiens
ggaaacuuguaucauagaa

SEQ ID NO: 688467 - RNA, 19 nt, Homo sapiens
gaaucaucuuugcuuguua

SEQ ID NO: 688468 - RNA, 19 nt, Homo sapiens
caagcacuauuuacucaaa

SEQ ID NO: 688469 - RNA, 19 nt, Homo sapiens
gagaugcugcuauauauga

SEQ ID NO: 688470 - RNA, 19 nt, Homo sapiens
gcuaaaagcugcucagaga

SEQ ID NO: 688471 - RNA, 19 nt, Homo sapiens
caaagaagaacaccaacaa

SEQ ID NO: 688472 - RNA, 19 nt, Homo sapiens
caucuuugcugaaucgaaa

SEQ ID NO: 688473 - RNA, 19 nt, Homo sapiens
auacaaguccauccaauua

SEQ ID NO: 688474 - RNA, 19 nt, Homo sapiens
agaagagucucaaaggaaa

SEQ ID NO: 688475 - RNA, 19 nt, Homo sapiens
uaccaaaccuuguuaaucu

SEQ ID NO: 688476 - RNA, 19 nt, Homo sapiens
gcaagaaauaacauccuua

SEQ ID NO: 688477 - RNA, 19 nt, Homo sapiens
cauauacgaugaugggauu

SEQ ID NO: 688478 - RNA, 19 nt, Homo sapiens
gaaaagaccccuuaaaagu

SEQ ID NO: 688479 - RNA, 19 nt, Homo sapiens
caaguuggauaucaaagug

SEQ ID NO: 688480 - RNA, 19 nt, Homo sapiens
gaaaugauggcugauaaga

SEQ ID NO: 688481 - RNA, 19 nt, Homo sapiens
uaagagaaaucagcacaga

SEQ ID NO: 688482 - RNA, 19 nt, Homo sapiens
ggaagagauacuccuauaa

SEQ ID NO: 688483 - RNA, 19 nt, Homo sapiens
uaauggagaucgacuaaag

SEQ ID NO: 688484 - RNA, 19 nt, Homo sapiens
guuccuuucuugcaaauaa

SEQ ID NO: 688485 - RNA, 19 nt, Homo sapiens
aaacacgucuuacauuaca

SEQ ID NO: 688486 - RNA, 19 nt, Homo sapiens
gaugauccauuauugagau

SEQ ID NO: 688487 - RNA, 19 nt, Homo sapiens
agagaaaucagcacagaua

SEQ ID NO: 688488 - RNA, 19 nt, Homo sapiens
caaagacgcuuaaacauuu

SEQ ID NO: 688489 - RNA, 19 nt, Homo sapiens
ccaaacaucucaucaaguu

SEQ ID NO: 688490 - RNA, 19 nt, Homo sapiens
gcaaagacgcuuaaacauu

SEQ ID NO: 688491 - RNA, 19 nt, Homo sapiens
ggccaaaucugaaucauug

SEQ ID NO: 688492 - RNA, 19 nt, Homo sapiens
gcaaauggcacuugaaaga

SEQ ID NO: 688493 - RNA, 19 nt, Homo sapiens
ccacaaaucuaccaugaga

SEQ ID NO: 688494 - RNA, 19 nt, Homo sapiens
ggaaacuccucuccacaaa

SEQ ID NO: 688495 - RNA, 19 nt, Homo sapiens
caccacaccuggcuaauuu

SEQ ID NO: 688496 - RNA, 19 nt, Homo sapiens
ggccucagcuucccaagua

SEQ ID NO: 688497 - RNA, 19 nt, Homo sapiens
ggaccgauguguaacaguu

SEQ ID NO: 688498 - RNA, 19 nt, Homo sapiens
gaagugaggaggauacuga

SEQ ID NO: 688499 - RNA, 19 nt, Homo sapiens
ccaagcggcuacugcguua

SEQ ID NO: 688500 - RNA, 19 nt, Homo sapiens
gggagggaauccuagcuua

SEQ ID NO: 688501 - RNA, 19 nt, Homo sapiens
ugacaaagcauaaaucaug

SEQ ID NO: 688502 - RNA, 19 nt, Homo sapiens
gauaguaagccauuucuug

SEQ ID NO: 688503 - RNA, 19 nt, Homo sapiens
uauaagaacuacucagugu

SEQ ID NO: 688504 - RNA, 19 nt, Homo sapiens
gcacauguaucuucaaucc

SEQ ID NO: 688505 - RNA, 19 nt, Homo sapiens
uaagaacuacucaguguuu

SEQ ID NO: 688506 - RNA, 19 nt, Homo sapiens
gguagaggcucaucagagu

SEQ ID NO: 688507 - RNA, 19 nt, Homo sapiens
caaaggcuaugaagcuguu

SEQ ID NO: 688508 - RNA, 19 nt, Homo sapiens
gggauacgcugcaagagau

SEQ ID NO: 688509 - RNA, 19 nt, Homo sapiens
gagacaaggccaaaucuga

SEQ ID NO: 688510 - RNA, 19 nt, Homo sapiens
auaaaggucucucaggaaa

SEQ ID NO: 688511 - RNA, 19 nt, Homo sapiens
aaacaucauuugcgaggaa

SEQ ID NO: 688512 - RNA, 19 nt, Homo sapiens
gaaaggagacaaggccaaa

SEQ ID NO: 688513 - RNA, 19 nt, Homo sapiens
ugaaggacccagagcauaa

SEQ ID NO: 688514 - RNA, 19 nt, Homo sapiens
ggucugcccuugccacuuc

SEQ ID NO: 688515 - RNA, 19 nt, Homo sapiens
aaacuccucuccacaaauc

SEQ ID NO: 688516 - RNA, 19 nt, Homo sapiens
agacaggcuucuuggagua

SEQ ID NO: 688517 - RNA, 19 nt, Homo sapiens
ugacaucaaauuccacuaa

SEQ ID NO: 688518 - RNA, 19 nt, Homo sapiens
ggaggauacugaacaggau

SEQ ID NO: 688519 - RNA, 19 nt, Homo sapiens
gagaugcugccuccacuuu

SEQ ID NO: 688520 - RNA, 19 nt, Homo sapiens
ggaguucugugcacuuaag

SEQ ID NO: 688521 - RNA, 19 nt, Homo sapiens
ccaaugggauaugcaaaga

SEQ ID NO: 688522 - RNA, 19 nt, Homo sapiens
ccacuggcacugucagaua

SEQ ID NO: 688523 - RNA, 19 nt, Homo sapiens
uaggaguucugugcacuua

SEQ ID NO: 688524 - RNA, 19 nt, Homo sapiens
cguguggacuguuauaaga

SEQ ID NO: 688525 - RNA, 19 nt, Homo sapiens
gaaauggcaacuacgaugu

SEQ ID NO: 688526 - RNA, 19 nt, Homo sapiens
gcugguuucucuguucaua

SEQ ID NO: 688527 - RNA, 19 nt, Homo sapiens
ugacuggagugcauguuga

SEQ ID NO: 688528 - RNA, 19 nt, Homo sapiens
cguuauaucuucucagcaa

SEQ ID NO: 688529 - RNA, 19 nt, Homo sapiens
acauguaucuucaauccaa

SEQ ID NO: 688530 - RNA, 19 nt, Homo sapiens
gacaucaaauuccacuaau

SEQ ID NO: 688531 - RNA, 19 nt, Homo sapiens
ccaaagugcugggauuaca

SEQ ID NO: 688532 - RNA, 19 nt, Homo sapiens
gagggaauccuagcuuauu

SEQ ID NO: 688533 - RNA, 19 nt, Homo sapiens
gagaagagguggguuuuau

SEQ ID NO: 688534 - RNA, 19 nt, Homo sapiens
gagcucaggaaguuucuaa

SEQ ID NO: 688535 - RNA, 19 nt, Homo sapiens
gcaacuacgaugugaaugu

SEQ ID NO: 688536 - RNA, 19 nt, Homo sapiens
caacuacgaugugaauguc

SEQ ID NO: 688537 - RNA, 19 nt, Homo sapiens
acaaaucuaccaugagaaa

SEQ ID NO: 688538 - RNA, 19 nt, Homo sapiens
ccauaugcgugucuccaaa

SEQ ID NO: 688539 - RNA, 19 nt, Homo sapiens
gaagagguggguuuuauuu

SEQ ID NO: 688540 - RNA, 19 nt, Homo sapiens
gauaugcaaagacgcuuaa

SEQ ID NO: 688541 - RNA, 19 nt, Homo sapiens
gcuacugcguuauaucuuc

SEQ ID NO: 688542 - RNA, 19 nt, Homo sapiens
cggcagaguuuuauaauga

SEQ ID NO: 688543 - RNA, 19 nt, Homo sapiens
gaaggacccagagcauaaa

SEQ ID NO: 688544 - RNA, 19 nt, Homo sapiens
uaaggccaguggucacaaa

SEQ ID NO: 688545 - RNA, 19 nt, Homo sapiens
agacugagaagcuuacauu

SEQ ID NO: 688546 - RNA, 19 nt, Homo sapiens
gaaaagacugagaagcuua

SEQ ID NO: 688547 - RNA, 19 nt, Homo sapiens
ggauaugcaaagacgcuua

SEQ ID NO: 688548 - RNA, 19 nt, Homo sapiens
gcauguugauccugagcaa

SEQ ID NO: 688549 - RNA, 19 nt, Homo sapiens
agaagagcaugcugggaaa

SEQ ID NO: 688550 - RNA, 19 nt, Homo sapiens
cauggacaccagagaauaa

SEQ ID NO: 688551 - RNA, 19 nt, Homo sapiens
ugacagugguagcaaaaua

SEQ ID NO: 688552 - RNA, 19 nt, Homo sapiens
ggaaaguauugugaagaca

SEQ ID NO: 688553 - RNA, 19 nt, Homo sapiens
ggaaaagacugagaagcuu

SEQ ID NO: 688554 - RNA, 19 nt, Homo sapiens
gcugggaaauggcaacuac

SEQ ID NO: 688555 - RNA, 19 nt, Homo sapiens
ugaguugugugccauggaa

SEQ ID NO: 688556 - RNA, 19 nt, Homo sapiens
agccaucucuggaaccuaa

SEQ ID NO: 688557 - RNA, 19 nt, Homo sapiens
guuuaagggugguuuaugg

SEQ ID NO: 688558 - RNA, 19 nt, Homo sapiens
ggagggaauccuagcuuau

SEQ ID NO: 688559 - RNA, 19 nt, Homo sapiens
uggcagcacuucagaccaa

SEQ ID NO: 688560 - RNA, 19 nt, Homo sapiens
aaacagcgcagggagcuuu

SEQ ID NO: 688561 - RNA, 19 nt, Homo sapiens
aaauggcacuugaaagagu

SEQ ID NO: 688562 - RNA, 19 nt, Homo sapiens
gaaacuccucuccacaaau

SEQ ID NO: 688563 - RNA, 19 nt, Homo sapiens
gggcagccacaauucagua

SEQ ID NO: 688564 - RNA, 19 nt, Homo sapiens
gaccaaaggcuaugaagcu

SEQ ID NO: 688565 - RNA, 19 nt, Homo sapiens
ccauuucgcagcauugauu

SEQ ID NO: 688566 - RNA, 19 nt, Homo sapiens
cauaaaggucucucaggaa

SEQ ID NO: 688567 - RNA, 19 nt, Homo sapiens
ccaugugacugguuugaag

SEQ ID NO: 688568 - RNA, 19 nt, Homo sapiens
cacagguucugcugaguug

SEQ ID NO: 688569 - RNA, 19 nt, Homo sapiens
agggaauccuagcuuauuu

SEQ ID NO: 688570 - RNA, 19 nt, Homo sapiens
caagaugcccgaguggauu

SEQ ID NO: 688571 - RNA, 19 nt, Homo sapiens
agacaaggccaaaucugaa

SEQ ID NO: 688572 - RNA, 19 nt, Homo sapiens
gaggagaaauaaguaucau

SEQ ID NO: 688573 - RNA, 19 nt, Homo sapiens
caaaagaggagaaauaagu

SEQ ID NO: 688574 - RNA, 19 nt, Homo sapiens
gccccuaccucuucagaua

SEQ ID NO: 688575 - RNA, 19 nt, Homo sapiens
gcuccagacucaccuagag

SEQ ID NO: 688576 - RNA, 19 nt, Homo sapiens
uaacaguucugcccaaccu

SEQ ID NO: 688577 - RNA, 19 nt, Homo sapiens
aaucugcccuccagccuau

SEQ ID NO: 688578 - RNA, 19 nt, Homo sapiens
caauucuggugcuuaggaa

SEQ ID NO: 688579 - RNA, 19 nt, Homo sapiens
ggucguggcaggucugaga

SEQ ID NO: 688580 - RNA, 19 nt, Homo sapiens
gauaguuguaggccacuuu

SEQ ID NO: 688581 - RNA, 19 nt, Homo sapiens
ugaggaaaguauugugaag

SEQ ID NO: 688582 - RNA, 19 nt, Homo sapiens
ugaacaggauguggcuaaa

SEQ ID NO: 688583 - RNA, 19 nt, Homo sapiens
gcaaggaagguaggaguuc

SEQ ID NO: 688584 - RNA, 19 nt, Homo sapiens
uuucagggcugguuucucu

SEQ ID NO: 688585 - RNA, 19 nt, Homo sapiens
gaggaaaguauugugaaga

SEQ ID NO: 688586 - RNA, 19 nt, Homo sapiens
ggugaggaaaguauuguga

SEQ ID NO: 688587 - RNA, 19 nt, Homo sapiens
ggacaaaagagaagccaaa

SEQ ID NO: 688588 - RNA, 19 nt, Homo sapiens
gaacagaaguccugaauca

SEQ ID NO: 688589 - RNA, 19 nt, Homo sapiens
ggaaagcaauucagaguuu

SEQ ID NO: 688590 - RNA, 19 nt, Homo sapiens
ggacaaguauucuuuaugu

SEQ ID NO: 688591 - RNA, 19 nt, Homo sapiens
gcaauggccuauaacauga

SEQ ID NO: 688592 - RNA, 19 nt, Homo sapiens
ccacagaggacuuagauua

SEQ ID NO: 688593 - RNA, 19 nt, Homo sapiens
uaaaucagcagcagaauaa

SEQ ID NO: 688594 - RNA, 19 nt, Homo sapiens
guuagaggcuuuagaacua

SEQ ID NO: 688595 - RNA, 19 nt, Homo sapiens
ggagauagcccaguauaaa

SEQ ID NO: 688596 - RNA, 19 nt, Homo sapiens
ggacuuagauuaugguuuu

SEQ ID NO: 688597 - RNA, 19 nt, Homo sapiens
ccaaagagaagguuuauga

SEQ ID NO: 688598 - RNA, 19 nt, Homo sapiens
caaagucaaugcuguuuau

SEQ ID NO: 688599 - RNA, 19 nt, Homo sapiens
gaucaaguguuuagaauac

SEQ ID NO: 688600 - RNA, 19 nt, Homo sapiens
ggauuuggaugaaguaaug

SEQ ID NO: 688601 - RNA, 19 nt, Homo sapiens
ggaaugcugugaagaacuu

SEQ ID NO: 688602 - RNA, 19 nt, Homo sapiens
caaggaaucuguagguaug

SEQ ID NO: 688603 - RNA, 19 nt, Homo sapiens
cuacagaauugccucauuu

SEQ ID NO: 688604 - RNA, 19 nt, Homo sapiens
ugaaugggaugguaacaaa

SEQ ID NO: 688605 - RNA, 19 nt, Homo sapiens
gcaacagaaucaccuaaug

SEQ ID NO: 688606 - RNA, 19 nt, Homo sapiens
gaagacauauguguugaau

SEQ ID NO: 688607 - RNA, 19 nt, Homo sapiens
gaaagugcuuagugaaugu

SEQ ID NO: 688608 - RNA, 19 nt, Homo sapiens
gcaguuacauggaaaccuu

SEQ ID NO: 688609 - RNA, 19 nt, Homo sapiens
guaacgcccucucuggaua

SEQ ID NO: 688610 - RNA, 19 nt, Homo sapiens
gcaguugauccucgaauua

SEQ ID NO: 688611 - RNA, 19 nt, Homo sapiens
ccaaucuucuuucaacuuu

SEQ ID NO: 688612 - RNA, 19 nt, Homo sapiens
caaagaagaaucucaucua

SEQ ID NO: 688613 - RNA, 19 nt, Homo sapiens
cagcacaccuuguuaaauc

SEQ ID NO: 688614 - RNA, 19 nt, Homo sapiens
guagaagaguuaagaagga

SEQ ID NO: 688615 - RNA, 19 nt, Homo sapiens
agaaaucgcuggguaaaga

SEQ ID NO: 688616 - RNA, 19 nt, Homo sapiens
gcacagaggcccuucuuuc

SEQ ID NO: 688617 - RNA, 19 nt, Homo sapiens
caaauuuccucgcaaagau

SEQ ID NO: 688618 - RNA, 19 nt, Homo sapiens
cauaaacagacaccaauua

SEQ ID NO: 688619 - RNA, 19 nt, Homo sapiens
uagaaagggugcuaaaugu

SEQ ID NO: 688620 - RNA, 19 nt, Homo sapiens
aaacagaaguuaguacaga

SEQ ID NO: 688621 - RNA, 19 nt, Homo sapiens
aguaauggaucacuaauga

SEQ ID NO: 688622 - RNA, 19 nt, Homo sapiens
ggaaauagaacgcaucaca

SEQ ID NO: 688623 - RNA, 19 nt, Homo sapiens
ggugagauguguaagaaau

SEQ ID NO: 688624 - RNA, 19 nt, Homo sapiens
cagcagagacauugaagua

SEQ ID NO: 688625 - RNA, 19 nt, Homo sapiens
gcaauccuauuagagcaua

SEQ ID NO: 688626 - RNA, 19 nt, Homo sapiens
agacuaggauucucauuug

SEQ ID NO: 688627 - RNA, 19 nt, Homo sapiens
gaaguaagcacuccucaag

SEQ ID NO: 688628 - RNA, 19 nt, Homo sapiens
ggagaaggaucaacaugag

SEQ ID NO: 688629 - RNA, 19 nt, Homo sapiens
gaaagggugcuaaauguuc

SEQ ID NO: 688630 - RNA, 19 nt, Homo sapiens
aaagauuucuacccacuaa

SEQ ID NO: 688631 - RNA, 19 nt, Homo sapiens
guuguuaccuugaauacuu

SEQ ID NO: 688632 - RNA, 19 nt, Homo sapiens
ccaccucaaucaagacuuu

SEQ ID NO: 688633 - RNA, 19 nt, Homo sapiens
gcucugugcucuauuggaa

SEQ ID NO: 688634 - RNA, 19 nt, Homo sapiens
uagaauacgugcugaacuu

SEQ ID NO: 688635 - RNA, 19 nt, Homo sapiens
ggagagaaaccuucacguu

SEQ ID NO: 688636 - RNA, 19 nt, Homo sapiens
acaaugggaugaacaguug

SEQ ID NO: 688637 - RNA, 19 nt, Homo sapiens
guagaaagggugcuaaaug

SEQ ID NO: 688638 - RNA, 19 nt, Homo sapiens
gcauuacccugcugaguuc

SEQ ID NO: 688639 - RNA, 19 nt, Homo sapiens
caagaccucucaggguaua

SEQ ID NO: 688640 - RNA, 19 nt, Homo sapiens
gaacaaggaaucuguaggu

SEQ ID NO: 688641 - RNA, 19 nt, Homo sapiens
uaaccaaucuucuuucaac

SEQ ID NO: 688642 - RNA, 19 nt, Homo sapiens
cugcugaucucuacauaaa

SEQ ID NO: 688643 - RNA, 19 nt, Homo sapiens
gaaauagaacgcaucacaa

SEQ ID NO: 688644 - RNA, 19 nt, Homo sapiens
gagcucaucuggcagcaau

SEQ ID NO: 688645 - RNA, 19 nt, Homo sapiens
ggucggcccuuguaccaaa

SEQ ID NO: 688646 - RNA, 19 nt, Homo sapiens
gaacuaaagaagacauaug

SEQ ID NO: 688647 - RNA, 19 nt, Homo sapiens
ggauagcauuuaacacaga

SEQ ID NO: 688648 - RNA, 19 nt, Homo sapiens
ucacccaccugucaccaua

SEQ ID NO: 688649 - RNA, 19 nt, Homo sapiens
ccagaaugauggaauuguu

SEQ ID NO: 688650 - RNA, 19 nt, Homo sapiens
cuacagugcuggugagaug

SEQ ID NO: 688651 - RNA, 19 nt, Homo sapiens
cuacagaagaucucgaaua

SEQ ID NO: 688652 - RNA, 19 nt, Homo sapiens
gaugaagauuguagacaug

SEQ ID NO: 688653 - RNA, 19 nt, Homo sapiens
guaaacaccaccucaucua

SEQ ID NO: 688654 - RNA, 19 nt, Homo sapiens
aaagaagaaucucaucuag

SEQ ID NO: 688655 - RNA, 19 nt, Homo sapiens
gauaacagcagagacauug

SEQ ID NO: 688656 - RNA, 19 nt, Homo sapiens
ggaaucaaauccacagaac

SEQ ID NO: 688657 - RNA, 19 nt, Homo sapiens
aggagaagauguacaagaa

SEQ ID NO: 688658 - RNA, 19 nt, Homo sapiens
gaacuaccgcucccaugaa

SEQ ID NO: 688659 - RNA, 19 nt, Homo sapiens
gauuagaucauuacgugua

SEQ ID NO: 688660 - RNA, 19 nt, Homo sapiens
gaggaaagauggcccaaaa

SEQ ID NO: 688661 - RNA, 19 nt, Homo sapiens
gaguaaagguagagcacaa

SEQ ID NO: 688662 - RNA, 19 nt, Homo sapiens
gauaucacguggaagacuu

SEQ ID NO: 688663 - RNA, 19 nt, Homo sapiens
gcaagcugaugaagauugu

SEQ ID NO: 688664 - RNA, 19 nt, Homo sapiens
gagguuaauugugcaacua

SEQ ID NO: 688665 - RNA, 19 nt, Homo sapiens
gaaaugccaccaccucaau

SEQ ID NO: 688666 - RNA, 19 nt, Homo sapiens
ccuauaacaugaaccuauu

SEQ ID NO: 688667 - RNA, 19 nt, Homo sapiens
ggaaaagucuucaucauac

SEQ ID NO: 688668 - RNA, 19 nt, Homo sapiens
gaucaaagcccaguuagag

SEQ ID NO: 688669 - RNA, 19 nt, Homo sapiens
gaagacagaagagcugaaa

SEQ ID NO: 688670 - RNA, 19 nt, Homo sapiens
aaacagcucucaggcaguu

SEQ ID NO: 688671 - RNA, 19 nt, Homo sapiens
cagaagagcugaaaaguca

SEQ ID NO: 688672 - RNA, 19 nt, Homo sapiens
cugcuagacuugcaacuaa

SEQ ID NO: 688673 - RNA, 19 nt, Homo sapiens
gcaauggcuuuuacucaua

SEQ ID NO: 688674 - RNA, 19 nt, Homo sapiens
gcagaacccuuuuguacaa

SEQ ID NO: 688675 - RNA, 19 nt, Homo sapiens
gaaagagcaacuucuggaa

SEQ ID NO: 688676 - RNA, 19 nt, Homo sapiens
gagaagauguacaagaaaa

SEQ ID NO: 688677 - RNA, 19 nt, Homo sapiens
ccucugagcuuuucuauga

SEQ ID NO: 688678 - RNA, 19 nt, Homo sapiens
caaaguaugcucagaaugg

SEQ ID NO: 688679 - RNA, 19 nt, Homo sapiens
ggacagcucagcccagaga

SEQ ID NO: 688680 - RNA, 19 nt, Homo sapiens
ucagcaaguucaaccuuaa

SEQ ID NO: 688681 - RNA, 19 nt, Homo sapiens
gaggagauagcccaguaua

SEQ ID NO: 688682 - RNA, 19 nt, Homo sapiens
gacaaaucauugaccaaga

SEQ ID NO: 688683 - RNA, 19 nt, Homo sapiens
gaaccaguacucaugcaaa

SEQ ID NO: 688684 - RNA, 19 nt, Homo sapiens
caaccuguauccaccauuc

SEQ ID NO: 688685 - RNA, 19 nt, Homo sapiens
guugauccucgaauuauua

SEQ ID NO: 688686 - RNA, 19 nt, Homo sapiens
gcucuaagacugcagcauu

SEQ ID NO: 688687 - RNA, 19 nt, Homo sapiens
gagcucugaugggcuauuu

SEQ ID NO: 688688 - RNA, 19 nt, Homo sapiens
guaaagcaguucaagaaua

SEQ ID NO: 688689 - RNA, 19 nt, Homo sapiens
ggacaaaguguuagaguua

SEQ ID NO: 688690 - RNA, 19 nt, Homo sapiens
gcacauagguggaaagagu

SEQ ID NO: 688691 - RNA, 19 nt, Homo sapiens
caaaugggaugacuucaaa

SEQ ID NO: 688692 - RNA, 19 nt, Homo sapiens
gcagacaacucagugauaa

SEQ ID NO: 688693 - RNA, 19 nt, Homo sapiens
caaggaaaguugcuaaaga

SEQ ID NO: 688694 - RNA, 19 nt, Homo sapiens
ucaaagacauuuccaacaa

SEQ ID NO: 688695 - RNA, 19 nt, Homo sapiens
agucaaagcugcacugaaa

SEQ ID NO: 688696 - RNA, 19 nt, Homo sapiens
gaaaguugcuaaagaaggu

SEQ ID NO: 688697 - RNA, 19 nt, Homo sapiens
gcacauacaguacgagaaa

SEQ ID NO: 688698 - RNA, 19 nt, Homo sapiens
ggaaguaaaccacagauug

SEQ ID NO: 688699 - RNA, 19 nt, Homo sapiens
aaacucagaucagaaauga

SEQ ID NO: 688700 - RNA, 19 nt, Homo sapiens
gagaugauuugguugaguu

SEQ ID NO: 688701 - RNA, 19 nt, Homo sapiens
gaguaaaguuaaugaguga

SEQ ID NO: 688702 - RNA, 19 nt, Homo sapiens
agaaagaacugaagcaaag

SEQ ID NO: 688703 - RNA, 19 nt, Homo sapiens
ggaacaugcugacggaaga

SEQ ID NO: 688704 - RNA, 19 nt, Homo sapiens
ggacggagagcuucacauu

SEQ ID NO: 688705 - RNA, 19 nt, Homo sapiens
gcaagaacacgcccaagaa

SEQ ID NO: 688706 - RNA, 19 nt, Homo sapiens
gcagagauaaucagaaguu

SEQ ID NO: 688707 - RNA, 19 nt, Homo sapiens
gcacacaguaagaaagaua

SEQ ID NO: 688708 - RNA, 19 nt, Homo sapiens
gaaauuaucaguucauugc

SEQ ID NO: 688709 - RNA, 19 nt, Homo sapiens
guaaaucgaggugccauua

SEQ ID NO: 688710 - RNA, 19 nt, Homo sapiens
ggaagguccuauuguacuu

SEQ ID NO: 688711 - RNA, 19 nt, Homo sapiens
caucagccaucguggagua

SEQ ID NO: 688712 - RNA, 19 nt, Homo sapiens
guucugaagugguuaauag

SEQ ID NO: 688713 - RNA, 19 nt, Homo sapiens
gaaaugcacacaguaagaa

SEQ ID NO: 688714 - RNA, 19 nt, Homo sapiens
gaccuaaagucacaucuag

SEQ ID NO: 688715 - RNA, 19 nt, Homo sapiens
gacgggagcuccuagaauc

SEQ ID NO: 688716 - RNA, 19 nt, Homo sapiens
ggaaaugcacacaguaaga

SEQ ID NO: 688717 - RNA, 19 nt, Homo sapiens
gauggaaguuaaagggaaa

SEQ ID NO: 688718 - RNA, 19 nt, Homo sapiens
aaggaaaguugcuaaagaa

SEQ ID NO: 688719 - RNA, 19 nt, Homo sapiens
aagaaguggugcuagauaa

SEQ ID NO: 688720 - RNA, 19 nt, Homo sapiens
ggacaaaucaccaaagaac

SEQ ID NO: 688721 - RNA, 19 nt, Homo sapiens
caagaaguggugcuagaua

SEQ ID NO: 688722 - RNA, 19 nt, Homo sapiens
agagcaagauggaaugauu

SEQ ID NO: 688723 - RNA, 19 nt, Homo sapiens
cagcaaaggaauagaaauu

SEQ ID NO: 688724 - RNA, 19 nt, Homo sapiens
caaugaagacuuauguuga

SEQ ID NO: 688725 - RNA, 19 nt, Homo sapiens
gaagaaagaacugaagcaa

SEQ ID NO: 688726 - RNA, 19 nt, Homo sapiens
uaagcuaccugcaagaaca

SEQ ID NO: 688727 - RNA, 19 nt, Homo sapiens
aaaggaagcugugauuaag

SEQ ID NO: 688728 - RNA, 19 nt, Homo sapiens
ugagugauuugcagaaguu

SEQ ID NO: 688729 - RNA, 19 nt, Homo sapiens
ucuguucucuguucuguuu

SEQ ID NO: 688730 - RNA, 19 nt, Homo sapiens
aaaucgaggugccauuauu

SEQ ID NO: 688731 - RNA, 19 nt, Homo sapiens
gcauuugauuguauugaug

SEQ ID NO: 688732 - RNA, 19 nt, Homo sapiens
aagcagaugugggagauuu

SEQ ID NO: 688733 - RNA, 19 nt, Homo sapiens
gagcaagauggaaugauuu

SEQ ID NO: 688734 - RNA, 19 nt, Homo sapiens
gaaagaaaaugggagagaa

SEQ ID NO: 688735 - RNA, 19 nt, Homo sapiens
caaagacauuuccaacaag

SEQ ID NO: 688736 - RNA, 19 nt, Homo sapiens
ugaguuaaguaaagccaaa

SEQ ID NO: 688737 - RNA, 19 nt, Homo sapiens
ccuggaaguugcaaacaaa

SEQ ID NO: 688738 - RNA, 19 nt, Homo sapiens
gaagguccuauuguacuua

SEQ ID NO: 688739 - RNA, 19 nt, Homo sapiens
ggaccuaaagucacaucua

SEQ ID NO: 688740 - RNA, 19 nt, Homo sapiens
gaggugccauuauucuuuc

SEQ ID NO: 688741 - RNA, 19 nt, Homo sapiens
gaaguaaaccacagauugc

SEQ ID NO: 688742 - RNA, 19 nt, Homo sapiens
caaagcagaugugggagau

SEQ ID NO: 688743 - RNA, 19 nt, Homo sapiens
ucucauguauggaaguaaa

SEQ ID NO: 688744 - RNA, 19 nt, Homo sapiens
guaaugaagaacagagaaa

SEQ ID NO: 688745 - RNA, 19 nt, Homo sapiens
cgaggugccauuauucuuu

SEQ ID NO: 688746 - RNA, 19 nt, Homo sapiens
acaaagacagcacaagaaa

SEQ ID NO: 688747 - RNA, 19 nt, Homo sapiens
cauuucagcuuuacaaguc

SEQ ID NO: 688748 - RNA, 19 nt, Homo sapiens
gaagaagaaagaacugaag

SEQ ID NO: 688749 - RNA, 19 nt, Homo sapiens
guguaaagcaguucaagaa

SEQ ID NO: 688750 - RNA, 19 nt, Homo sapiens
gaagaauugcgagaugauu

SEQ ID NO: 688751 - RNA, 19 nt, Homo sapiens
cugaaaagcuugauuccua

SEQ ID NO: 688752 - RNA, 19 nt, Homo sapiens
ggacaucuaguucugaagu

SEQ ID NO: 688753 - RNA, 19 nt, Homo sapiens
ccagagauccugcacauac

SEQ ID NO: 688754 - RNA, 19 nt, Homo sapiens
acaggaaagugauugugaa

SEQ ID NO: 688755 - RNA, 19 nt, Homo sapiens
gacaggaaagugauuguga

SEQ ID NO: 688756 - RNA, 19 nt, Homo sapiens
ucacaggaaagaauacaaa

SEQ ID NO: 688757 - RNA, 19 nt, Homo sapiens
aagcaaagcagacaacuca

SEQ ID NO: 688758 - RNA, 19 nt, Homo sapiens
guccugggcuaguguaaau

SEQ ID NO: 688759 - RNA, 19 nt, Homo sapiens
caggacaucuaguucugaa

SEQ ID NO: 688760 - RNA, 19 nt, Homo sapiens
aaacagauucuaacuccaa

SEQ ID NO: 688761 - RNA, 19 nt, Homo sapiens
guacgcauacaaugacaaa

SEQ ID NO: 688762 - RNA, 19 nt, Homo sapiens
ucaguaugguaaugaagaa

SEQ ID NO: 688763 - RNA, 19 nt, Homo sapiens
gaaaagacugugacaaaga

SEQ ID NO: 688764 - RNA, 19 nt, Homo sapiens
ucacaucuaggaacuuuga

SEQ ID NO: 688765 - RNA, 19 nt, Homo sapiens
ucacccaacucuggacaaa

SEQ ID NO: 688766 - RNA, 19 nt, Homo sapiens
gaugaaaugaaacagauuc

SEQ ID NO: 688767 - RNA, 19 nt, Homo sapiens
cagagauaaucagaaguuu

SEQ ID NO: 688768 - RNA, 19 nt, Homo sapiens
cgauucaacucgugugauc

SEQ ID NO: 688769 - RNA, 19 nt, Homo sapiens
acaaaucaccaaagaacaa

SEQ ID NO: 688770 - RNA, 19 nt, Homo sapiens
gauggaaaugcacacagua

SEQ ID NO: 688771 - RNA, 19 nt, Homo sapiens
cgagaaaucauugaaguuc

SEQ ID NO: 688772 - RNA, 19 nt, Homo sapiens
acaaugaagacuuauguug

SEQ ID NO: 688773 - RNA, 19 nt, Homo sapiens
ggaaagugauugugaaaac

SEQ ID NO: 688774 - RNA, 19 nt, Homo sapiens
ccacagauugcagagauaa

SEQ ID NO: 688775 - RNA, 19 nt, Homo sapiens
gcaaagcagacaacucagu

SEQ ID NO: 688776 - RNA, 19 nt, Homo sapiens
ccaaaugggaugacuucaa

SEQ ID NO: 688777 - RNA, 19 nt, Homo sapiens
uggaugaaaugaaacagau

SEQ ID NO: 688778 - RNA, 19 nt, Homo sapiens
gaaagaguuaagagcaaga

SEQ ID NO: 688779 - RNA, 19 nt, Homo sapiens
uggaaagaguuaagagcaa

SEQ ID NO: 688780 - RNA, 19 nt, Homo sapiens
ugaaugccaucgccagcuu

SEQ ID NO: 688781 - RNA, 19 nt, Homo sapiens
caaaucaccaaagaacaaa

SEQ ID NO: 688782 - RNA, 19 nt, Homo sapiens
agucacaucuaggaacuuu

SEQ ID NO: 688783 - RNA, 19 nt, Homo sapiens
aaccaacuaugacauuguu

SEQ ID NO: 688784 - RNA, 19 nt, Homo sapiens
guuaagagcaagauggaau

SEQ ID NO: 688785 - RNA, 19 nt, Homo sapiens
gaaguugcaaacaaaguca

SEQ ID NO: 688786 - RNA, 19 nt, Homo sapiens
gagagaagguuguuuugca

SEQ ID NO: 688787 - RNA, 19 nt, Homo sapiens
gaauccauuucuccagcuu

SEQ ID NO: 688788 - RNA, 19 nt, Homo sapiens
gaaaagagaccucauauua

SEQ ID NO: 688789 - RNA, 19 nt, Homo sapiens
ccacuagucuggucaguua

SEQ ID NO: 688790 - RNA, 19 nt, Homo sapiens
caaaggaagaggaauauua

SEQ ID NO: 688791 - RNA, 19 nt, Homo sapiens
gaaauugcacauuccauua

SEQ ID NO: 688792 - RNA, 19 nt, Homo sapiens
ggaaauacaacacuugaaa

SEQ ID NO: 688793 - RNA, 19 nt, Homo sapiens
ggaagaggaauauuaauug

SEQ ID NO: 688794 - RNA, 19 nt, Homo sapiens
gcacaaagcaucaaacuac

SEQ ID NO: 688795 - RNA, 19 nt, Homo sapiens
gcaugacucucacagauga

SEQ ID NO: 688796 - RNA, 19 nt, Homo sapiens
gagagaaacuaaauauugg

SEQ ID NO: 688797 - RNA, 19 nt, Homo sapiens
gcauacgguuacugacuua

SEQ ID NO: 688798 - RNA, 19 nt, Homo sapiens
cuagagagcuguuugcaau

SEQ ID NO: 688799 - RNA, 19 nt, Homo sapiens
gcuauuaacuggcuagaag

SEQ ID NO: 688800 - RNA, 19 nt, Homo sapiens
gcacugccauccaauuuag

SEQ ID NO: 688801 - RNA, 19 nt, Homo sapiens
ccacacagccuccagauga

SEQ ID NO: 688802 - RNA, 19 nt, Homo sapiens
caccguagaacauauauua

SEQ ID NO: 688803 - RNA, 19 nt, Homo sapiens
gaaagcaggcacaguuuga

SEQ ID NO: 688804 - RNA, 19 nt, Homo sapiens
gcuuggacccuauuauuua

SEQ ID NO: 688805 - RNA, 19 nt, Homo sapiens
guuacaagaugaucaauuc

SEQ ID NO: 688806 - RNA, 19 nt, Homo sapiens
ggacggaaguggcacaaag

SEQ ID NO: 688807 - RNA, 19 nt, Homo sapiens
uacaaagacuuacgucauu

SEQ ID NO: 688808 - RNA, 19 nt, Homo sapiens
uaagauaugugcccucauc

SEQ ID NO: 688809 - RNA, 19 nt, Homo sapiens
gcuacuaucugcugcaaau

SEQ ID NO: 688810 - RNA, 19 nt, Homo sapiens
gauagcacuuugaggauau

SEQ ID NO: 688811 - RNA, 19 nt, Homo sapiens
gaaagaauucacucugcua

SEQ ID NO: 688812 - RNA, 19 nt, Homo sapiens
gaugaauccugcucucaga

SEQ ID NO: 688813 - RNA, 19 nt, Homo sapiens
caaagacuuacgucauuua

SEQ ID NO: 688814 - RNA, 19 nt, Homo sapiens
uguaagaaauugcacauuc

SEQ ID NO: 688815 - RNA, 19 nt, Homo sapiens
gaaaucuugcgguauauga

SEQ ID NO: 688816 - RNA, 19 nt, Homo sapiens
gaaaucuagccgcaacaua

SEQ ID NO: 688817 - RNA, 19 nt, Homo sapiens
gaauuccacuucggucaaa

SEQ ID NO: 688818 - RNA, 19 nt, Homo sapiens
guauagaacugaaaaguga

SEQ ID NO: 688819 - RNA, 19 nt, Homo sapiens
caaaaugagugaagcauga

SEQ ID NO: 688820 - RNA, 19 nt, Homo sapiens
agaauucacucugcuacua

SEQ ID NO: 688821 - RNA, 19 nt, Homo sapiens
caacauguacgucagcauu

SEQ ID NO: 688822 - RNA, 19 nt, Homo sapiens
agagagcuguuugcaauaa

SEQ ID NO: 688823 - RNA, 19 nt, Homo sapiens
gaaaacauacccaucagua

SEQ ID NO: 688824 - RNA, 19 nt, Homo sapiens
gaaguuacaagaugaucaa

SEQ ID NO: 688825 - RNA, 19 nt, Homo sapiens
uuucaacacuguccuuaaa

SEQ ID NO: 688826 - RNA, 19 nt, Homo sapiens
gcaaacuucugucagugau

SEQ ID NO: 688827 - RNA, 19 nt, Homo sapiens
guuacugacuuaugagcua

SEQ ID NO: 688828 - RNA, 19 nt, Homo sapiens
ugauagcacuuugaggaua

SEQ ID NO: 688829 - RNA, 19 nt, Homo sapiens
cgcaggaucuuuaauggaa

SEQ ID NO: 688830 - RNA, 19 nt, Homo sapiens
acacuguccuuaaagacua

SEQ ID NO: 688831 - RNA, 19 nt, Homo sapiens
ucaacacuguccuuaaaga

SEQ ID NO: 688832 - RNA, 19 nt, Homo sapiens
gagagcuguuugcaauaaa

SEQ ID NO: 688833 - RNA, 19 nt, Homo sapiens
uuagggagguuacacaaau

SEQ ID NO: 688834 - RNA, 19 nt, Homo sapiens
acaaagacuuacgucauuu

SEQ ID NO: 688835 - RNA, 19 nt, Homo sapiens
gacaaucacuuaagaaacc

SEQ ID NO: 688836 - RNA, 19 nt, Homo sapiens
acagauacuuugugaguuc

SEQ ID NO: 688837 - RNA, 19 nt, Homo sapiens
uagggagguuacacaaaua

SEQ ID NO: 688838 - RNA, 19 nt, Homo sapiens
gcaggaucuuuaauggaaa

SEQ ID NO: 688839 - RNA, 19 nt, Homo sapiens
accagaaucuaguauguaa

SEQ ID NO: 688840 - RNA, 19 nt, Homo sapiens
auacugaccuuucuauucu

SEQ ID NO: 688841 - RNA, 19 nt, Homo sapiens
aaacauacccaucaguaau

SEQ ID NO: 688842 - RNA, 19 nt, Homo sapiens
gaaauacaacacuugaaag

SEQ ID NO: 688843 - RNA, 19 nt, Homo sapiens
gaggaaauacaacacuuga

SEQ ID NO: 688844 - RNA, 19 nt, Homo sapiens
auacugcuaucacaaagaa

SEQ ID NO: 688845 - RNA, 19 nt, Homo sapiens
cuaagaguuucaucaucua

SEQ ID NO: 688846 - RNA, 19 nt, Homo sapiens
gcacuuugaggauauuaga

SEQ ID NO: 688847 - RNA, 19 nt, Homo sapiens
cuagacauuuccagaauca

SEQ ID NO: 688848 - RNA, 19 nt, Homo sapiens
ccuagacgcaggaucuuua

SEQ ID NO: 688849 - RNA, 19 nt, Homo sapiens
gcuuugacagguauuauaa

SEQ ID NO: 688850 - RNA, 19 nt, Homo sapiens
caggauggauauucuuuua

SEQ ID NO: 688851 - RNA, 19 nt, Homo sapiens
caacuuccccuguucaaua

SEQ ID NO: 688852 - RNA, 19 nt, Homo sapiens
uggcauacguuaucagcaa

SEQ ID NO: 688853 - RNA, 19 nt, Homo sapiens
ucuaagaguuucaucaucu

SEQ ID NO: 688854 - RNA, 19 nt, Homo sapiens
cuaaauucuuucucugcua

SEQ ID NO: 688855 - RNA, 19 nt, Homo sapiens
ggcauacgguuacugacuu

SEQ ID NO: 688856 - RNA, 19 nt, Homo sapiens
ccacaccguagaacauaua

SEQ ID NO: 688857 - RNA, 19 nt, Homo sapiens
aagcaugacucucacagau

SEQ ID NO: 688858 - RNA, 19 nt, Homo sapiens
cagacaaucacuuaagaaa

SEQ ID NO: 688859 - RNA, 19 nt, Homo sapiens
ucacucaggcaucuucuuu

SEQ ID NO: 688860 - RNA, 19 nt, Homo sapiens
guugucaucuucaauuaca

SEQ ID NO: 688861 - RNA, 19 nt, Homo sapiens
caucagcuuugacagguau

SEQ ID NO: 688862 - RNA, 19 nt, Homo sapiens
gagccuacaaugagaggua

SEQ ID NO: 688863 - RNA, 19 nt, Homo sapiens
gcgggaauccuacucaaug

SEQ ID NO: 688864 - RNA, 19 nt, Homo sapiens
gaucauuccugugcuguac

SEQ ID NO: 688865 - RNA, 19 nt, Homo sapiens
ucauggcacugcaaaggaa

SEQ ID NO: 688866 - RNA, 19 nt, Homo sapiens
ucaggcaucuucuuucucu

SEQ ID NO: 688867 - RNA, 19 nt, Homo sapiens
cauuacagcugccagucaa

SEQ ID NO: 688868 - RNA, 19 nt, Homo sapiens
cagcaucguguuuguguuu

SEQ ID NO: 688869 - RNA, 19 nt, Homo sapiens
aaaucuagccgcaacauau

SEQ ID NO: 688870 - RNA, 19 nt, Homo sapiens
caucaucuaucucaagaac

SEQ ID NO: 688871 - RNA, 19 nt, Homo sapiens
gaauucacucugcuacuau

SEQ ID NO: 688872 - RNA, 19 nt, Homo sapiens
guaagaaauugcacauucc

SEQ ID NO: 688873 - RNA, 19 nt, Homo sapiens
gaaguggcacaaagcauca

SEQ ID NO: 688874 - RNA, 19 nt, Homo sapiens
uacgguuacugacuuauga

SEQ ID NO: 688875 - RNA, 19 nt, Homo sapiens
acacccagacaaucacuua

SEQ ID NO: 688876 - RNA, 19 nt, Homo sapiens
ugaccuuucuauucucuau

SEQ ID NO: 688877 - RNA, 19 nt, Homo sapiens
agaaauugcacauuccauu

SEQ ID NO: 688878 - RNA, 19 nt, Homo sapiens
gaagcaugacucucacaga

SEQ ID NO: 688879 - RNA, 19 nt, Homo sapiens
aaacuucugucagugauag

SEQ ID NO: 688880 - RNA, 19 nt, Homo sapiens
ucaucuaucucaagaacau

SEQ ID NO: 688881 - RNA, 19 nt, Homo sapiens
gcaaaggaagaggaauauu

SEQ ID NO: 688882 - RNA, 19 nt, Homo sapiens
gacgcaggaucuuuaaugg

SEQ ID NO: 688883 - RNA, 19 nt, Homo sapiens
acuaucugcugcaaaugua

SEQ ID NO: 688884 - RNA, 19 nt, Homo sapiens
ggaauuccacuucggucaa

SEQ ID NO: 688885 - RNA, 19 nt, Homo sapiens
guggccaucuucuggauug

SEQ ID NO: 688886 - RNA, 19 nt, Homo sapiens
cgucagcauuguguucuuu

SEQ ID NO: 688887 - RNA, 19 nt, Homo sapiens
ugacuuaugagcuaccaaa

SEQ ID NO: 688888 - RNA, 19 nt, Homo sapiens
gcccaaaucucaucaguuu

SEQ ID NO: 688889 - RNA, 19 nt, Homo sapiens
ggacauguaugguaauaau

SEQ ID NO: 688890 - RNA, 19 nt, Homo sapiens
gagaagggaucgcaguuug

SEQ ID NO: 688891 - RNA, 19 nt, Homo sapiens
gagcagagccggagagaga

SEQ ID NO: 688892 - RNA, 19 nt, Homo sapiens
gcuguaggcuuguaaauac

SEQ ID NO: 688893 - RNA, 19 nt, Homo sapiens
uuuauugccugcucgauua

SEQ ID NO: 688894 - RNA, 19 nt, Homo sapiens
gaagagagcaacgaggaaa

SEQ ID NO: 688895 - RNA, 19 nt, Homo sapiens
gcaacuaccagcagaugaa

SEQ ID NO: 688896 - RNA, 19 nt, Homo sapiens
ccaaaucucaucaguuuua

SEQ ID NO: 688897 - RNA, 19 nt, Homo sapiens
gagaagacgcagcucauuc

SEQ ID NO: 688898 - RNA, 19 nt, Homo sapiens
agacacaccucgaggaucu

SEQ ID NO: 688899 - RNA, 19 nt, Homo sapiens
gaagacacaccucgaggau

SEQ ID NO: 688900 - RNA, 19 nt, Homo sapiens
acacaggccucaguuagga

SEQ ID NO: 688901 - RNA, 19 nt, Homo sapiens
gagacacaggccucaguua

SEQ ID NO: 688902 - RNA, 19 nt, Homo sapiens
cgcaacagcugcccacuag

SEQ ID NO: 688903 - RNA, 19 nt, Homo sapiens
gaagggaucgcaguuugga

SEQ ID NO: 688904 - RNA, 19 nt, Homo sapiens
ccugcucgauuauauagaa

SEQ ID NO: 688905 - RNA, 19 nt, Homo sapiens
ucgaggaucuguacuggau

SEQ ID NO: 688906 - RNA, 19 nt, Homo sapiens
aagcugagggucuuuguuu

SEQ ID NO: 688907 - RNA, 19 nt, Homo sapiens
ggaagagagcaacgaggaa

SEQ ID NO: 688908 - RNA, 19 nt, Homo sapiens
cgagagagacgccuacaag

SEQ ID NO: 688909 - RNA, 19 nt, Homo sapiens
gccuugaccuguuugacuu

SEQ ID NO: 688910 - RNA, 19 nt, Homo sapiens
gaucauacuccccuuguuu

SEQ ID NO: 688911 - RNA, 19 nt, Homo sapiens
uggaguaugucaacgacuu

SEQ ID NO: 688912 - RNA, 19 nt, Homo sapiens
gcccagucuugcagguaua

SEQ ID NO: 688913 - RNA, 19 nt, Homo sapiens
gcgcaacagcugcccacua

SEQ ID NO: 688914 - RNA, 19 nt, Homo sapiens
caaggucaagugcgagaaa

SEQ ID NO: 688915 - RNA, 19 nt, Homo sapiens
ggucuuuguuuggguuuau

SEQ ID NO: 688916 - RNA, 19 nt, Homo sapiens
gaggcgaggcugagcgaaa

SEQ ID NO: 688917 - RNA, 19 nt, Homo sapiens
gaccagcucguguccaugu

SEQ ID NO: 688918 - RNA, 19 nt, Homo sapiens
agaagacgcagcucauuca

SEQ ID NO: 688919 - RNA, 19 nt, Homo sapiens
gagcaacuaccagcagaug

SEQ ID NO: 688920 - RNA, 19 nt, Homo sapiens
cuggacauguaugguaaua

SEQ ID NO: 688921 - RNA, 19 nt, Homo sapiens
auaaacgcguccagcagaa

SEQ ID NO: 688922 - RNA, 19 nt, Homo sapiens
gcgcccaaaucucaucagu

SEQ ID NO: 688923 - RNA, 19 nt, Homo sapiens
ugagaagggaucgcaguuu

SEQ ID NO: 688924 - RNA, 19 nt, Homo sapiens
guuuaacuuuagcauguug

SEQ ID NO: 688925 - RNA, 19 nt, Homo sapiens
cagcagguggagcagcuua

SEQ ID NO: 688926 - RNA, 19 nt, Homo sapiens
cgccaaaccgcauagagaa

SEQ ID NO: 688927 - RNA, 19 nt, Homo sapiens
uuuagcauguuguugauca

SEQ ID NO: 688928 - RNA, 19 nt, Homo sapiens
agacacaggccucaguuag

SEQ ID NO: 688929 - RNA, 19 nt, Homo sapiens
cgaccgaacagaagacaca

SEQ ID NO: 688930 - RNA, 19 nt, Homo sapiens
agcaccaccuggagaauga

SEQ ID NO: 688931 - RNA, 19 nt, Homo sapiens
ggaggucccggaguaacuu

SEQ ID NO: 688932 - RNA, 19 nt, Homo sapiens
gcagagccggagagagaga

SEQ ID NO: 688933 - RNA, 19 nt, Homo sapiens
ccgccaaaccgcauagaga

SEQ ID NO: 688934 - RNA, 19 nt, Homo sapiens
ccgcucagcacuccgugua

SEQ ID NO: 688935 - RNA, 19 nt, Homo sapiens
gcaagcugagggucuuugu

SEQ ID NO: 688936 - RNA, 19 nt, Homo sapiens
ugcuggacauguaugguaa

SEQ ID NO: 688937 - RNA, 19 nt, Homo sapiens
cgaaagaaggaaggacaga

SEQ ID NO: 688938 - RNA, 19 nt, Homo sapiens
agaagcaccaccuggagaa

SEQ ID NO: 688939 - RNA, 19 nt, Homo sapiens
gcauagucccgagaaguca

SEQ ID NO: 688940 - RNA, 19 nt, Homo sapiens
caaguucgacgugaagaag

SEQ ID NO: 688941 - RNA, 19 nt, Homo sapiens
auacuccccuuguuucuuu

SEQ ID NO: 688942 - RNA, 19 nt, Homo sapiens
ggcauagucccgagaaguc

SEQ ID NO: 688943 - RNA, 19 nt, Homo sapiens
ggaguaugucaacgacuuc

SEQ ID NO: 688944 - RNA, 19 nt, Homo sapiens
ccaucaccaucaucaccaa

SEQ ID NO: 688945 - RNA, 19 nt, Homo sapiens
gcugagggucuuuguuugg

SEQ ID NO: 688946 - RNA, 19 nt, Homo sapiens
uguacuggauggcgagcaa

SEQ ID NO: 688947 - RNA, 19 nt, Homo sapiens
gugagaagggaucgcaguu

SEQ ID NO: 688948 - RNA, 19 nt, Homo sapiens
agagagacgccuacaaggu

SEQ ID NO: 688949 - RNA, 19 nt, Homo sapiens
gaagcaccaccuggagaau

SEQ ID NO: 688950 - RNA, 19 nt, Homo sapiens
gcucaaguucgacgugaag

SEQ ID NO: 688951 - RNA, 19 nt, Homo sapiens
gagacuccuggcuuucuga

SEQ ID NO: 688952 - RNA, 19 nt, Homo sapiens
cgcccagucuugcagguau

SEQ ID NO: 688953 - RNA, 19 nt, Homo sapiens
ugauccgccugaagcagaa

SEQ ID NO: 688954 - RNA, 19 nt, Homo sapiens
caagacaguuguuacauuu

SEQ ID NO: 688955 - RNA, 19 nt, Homo sapiens
guacucaucugcugugaaa

SEQ ID NO: 688956 - RNA, 19 nt, Homo sapiens
caagacaggugaauggaaa

SEQ ID NO: 688957 - RNA, 19 nt, Homo sapiens
ccaagaagccaucaaagua

SEQ ID NO: 688958 - RNA, 19 nt, Homo sapiens
ccaaucaccuuauaaugaa

SEQ ID NO: 688959 - RNA, 19 nt, Homo sapiens
gcacuaagacaucaacaaa

SEQ ID NO: 688960 - RNA, 19 nt, Homo sapiens
ggacagaccaagaugauga

SEQ ID NO: 688961 - RNA, 19 nt, Homo sapiens
ggaaggaacacuaugcaaa

SEQ ID NO: 688962 - RNA, 19 nt, Homo sapiens
ccaagacaguuguuacauu

SEQ ID NO: 688963 - RNA, 19 nt, Homo sapiens
aaacagcuaucccauacaa

SEQ ID NO: 688964 - RNA, 19 nt, Homo sapiens
ggaaaggcccagaugauau

SEQ ID NO: 688965 - RNA, 19 nt, Homo sapiens
agagauaacuugggaaaga

SEQ ID NO: 688966 - RNA, 19 nt, Homo sapiens
gcauagaggaugucagaaa

SEQ ID NO: 688967 - RNA, 19 nt, Homo sapiens
gacaugauaagcauacaua

SEQ ID NO: 688968 - RNA, 19 nt, Homo sapiens
acuaagacaucaacaaaug

SEQ ID NO: 688969 - RNA, 19 nt, Homo sapiens
gcagagauaacuugggaaa

SEQ ID NO: 688970 - RNA, 19 nt, Homo sapiens
cauagaggaugucagaaau

SEQ ID NO: 688971 - RNA, 19 nt, Homo sapiens
gaaaaugaauauccuguuc

SEQ ID NO: 688972 - RNA, 19 nt, Homo sapiens
caucaaaguagaaagcaua

SEQ ID NO: 688973 - RNA, 19 nt, Homo sapiens
gaaucugucacuugaauga

SEQ ID NO: 688974 - RNA, 19 nt, Homo sapiens
caagugguuugauaauuca

SEQ ID NO: 688975 - RNA, 19 nt, Homo sapiens
gaaaggcccagaugauauc

SEQ ID NO: 688976 - RNA, 19 nt, Homo sapiens
gagcggacaugauaagcau

SEQ ID NO: 688977 - RNA, 19 nt, Homo sapiens
gguauuccuuauuccagua

SEQ ID NO: 688978 - RNA, 19 nt, Homo sapiens
gagauaacuugggaaagau

SEQ ID NO: 688979 - RNA, 19 nt, Homo sapiens
acacagaugaugcgaguuu

SEQ ID NO: 688980 - RNA, 19 nt, Homo sapiens
gaauauccuguucaauuug

SEQ ID NO: 688981 - RNA, 19 nt, Homo sapiens
cccaaucaccuuauaauga

SEQ ID NO: 688982 - RNA, 19 nt, Homo sapiens
caagaagccaucaaaguag

SEQ ID NO: 688983 - RNA, 19 nt, Homo sapiens
ccaagaugaugaugaggau

SEQ ID NO: 688984 - RNA, 19 nt, Homo sapiens
uagaggaugucagaaauca

SEQ ID NO: 688985 - RNA, 19 nt, Homo sapiens
ucacuugaaugaaggaaag

SEQ ID NO: 688986 - RNA, 19 nt, Homo sapiens
gcuuuaaugguauuccuua

SEQ ID NO: 688987 - RNA, 19 nt, Homo sapiens
caaaacagcuaucccauac

SEQ ID NO: 688988 - RNA, 19 nt, Homo sapiens
gaaggaacacuaugcaaaa

SEQ ID NO: 688989 - RNA, 19 nt, Homo sapiens
gcaaaacagcuaucccaua

SEQ ID NO: 688990 - RNA, 19 nt, Homo sapiens
gaaugaaggaaagcuuaaa

SEQ ID NO: 688991 - RNA, 19 nt, Homo sapiens
uggaaaggcccagaugaua

SEQ ID NO: 688992 - RNA, 19 nt, Homo sapiens
gcauacauaaugaagaaga

SEQ ID NO: 688993 - RNA, 19 nt, Homo sapiens
gauaacuugggaaagauuu

SEQ ID NO: 688994 - RNA, 19 nt, Homo sapiens
aagaagccaucaaaguaga

SEQ ID NO: 688995 - RNA, 19 nt, Homo sapiens
caaaguagaaagcauagag

SEQ ID NO: 688996 - RNA, 19 nt, Homo sapiens
cauuggauauuagagcuuu

SEQ ID NO: 688997 - RNA, 19 nt, Homo sapiens
uagaaagcauagaggaugu

SEQ ID NO: 688998 - RNA, 19 nt, Homo sapiens
agaugaugaugaggauuua

SEQ ID NO: 688999 - RNA, 19 nt, Homo sapiens
uuaaagcccaagcagauaa

SEQ ID NO: 689000 - RNA, 19 nt, Homo sapiens
ugaaugaaggaaagcuuaa

SEQ ID NO: 689001 - RNA, 19 nt, Homo sapiens
agaccaagaugaugaugag

SEQ ID NO: 689002 - RNA, 19 nt, Homo sapiens
aagcauagaggaugucaga

SEQ ID NO: 689003 - RNA, 19 nt, Homo sapiens
gcaccccaaucaccuuaua

SEQ ID NO: 689004 - RNA, 19 nt, Homo sapiens
gaggaugucagaaaucagu

SEQ ID NO: 689005 - RNA, 19 nt, Homo sapiens
ucauuugguuccuguacaa

SEQ ID NO: 689006 - RNA, 19 nt, Homo sapiens
gaugaugaggauuuaguug

SEQ ID NO: 689007 - RNA, 19 nt, Homo sapiens
aagaugaugaugaggauuu

SEQ ID NO: 689008 - RNA, 19 nt, Homo sapiens
ugucuugccugcuguaucu

SEQ ID NO: 689009 - RNA, 19 nt, Homo sapiens
ugaagacuguguuuuggua

SEQ ID NO: 689010 - RNA, 19 nt, Homo sapiens
gcacaucaagacaggugaa

SEQ ID NO: 689011 - RNA, 19 nt, Homo sapiens
gaugaggauuuaguugaca

SEQ ID NO: 689012 - RNA, 19 nt, Homo sapiens
uuugguaguuggagaagaa

SEQ ID NO: 689013 - RNA, 19 nt, Homo sapiens
gaugucagaaaucagugua

SEQ ID NO: 689014 - RNA, 19 nt, Homo sapiens
ugggagcaaucauuugguu

SEQ ID NO: 689015 - RNA, 19 nt, Homo sapiens
caucaagacaggugaaugg

SEQ ID NO: 689016 - RNA, 19 nt, Homo sapiens
gaagccaucaaaguagaaa

SEQ ID NO: 689017 - RNA, 19 nt, Homo sapiens
uaaagcccaagcagauaaa

SEQ ID NO: 689018 - RNA, 19 nt, Homo sapiens
uaaguggacagaccaagau

SEQ ID NO: 689019 - RNA, 19 nt, Homo sapiens
gaaagcauagaggauguca

SEQ ID NO: 689020 - RNA, 19 nt, Homo sapiens
gcaauggaaaggcccagau

SEQ ID NO: 689021 - RNA, 19 nt, Homo sapiens
uugaaugaaggaaagcuua

SEQ ID NO: 689022 - RNA, 19 nt, Homo sapiens
cccagaugauauccuacua

SEQ ID NO: 689023 - RNA, 19 nt, Homo sapiens
aggcccagaugauauccua

SEQ ID NO: 689024 - RNA, 19 nt, Homo sapiens
uaaaagcccagccuauuug

SEQ ID NO: 689025 - RNA, 19 nt, Homo sapiens
ggacaugauaagcauacau

SEQ ID NO: 689026 - RNA, 19 nt, Homo sapiens
caauggaaaggcccagaug

SEQ ID NO: 689027 - RNA, 19 nt, Homo sapiens
ucaagacaggugaauggaa

SEQ ID NO: 689028 - RNA, 19 nt, Homo sapiens
gaugaugcgaguuucaagu

SEQ ID NO: 689029 - RNA, 19 nt, Homo sapiens
gacuguccuucaucuacuu

SEQ ID NO: 689030 - RNA, 19 nt, Homo sapiens
ggagcggacaugauaagca

SEQ ID NO: 689031 - RNA, 19 nt, Homo sapiens
uaaugaagacuguguuuug

SEQ ID NO: 689032 - RNA, 19 nt, Homo sapiens
cuuaaagcccaagcagaua

SEQ ID NO: 689033 - RNA, 19 nt, Homo sapiens
gagcuuuaaugguauuccu

SEQ ID NO: 689034 - RNA, 19 nt, Homo sapiens
uugguaaucuugcacuaag

SEQ ID NO: 689035 - RNA, 19 nt, Homo sapiens
ucuccaagaagccaucaaa

SEQ ID NO: 689036 - RNA, 19 nt, Homo sapiens
gcacgguaauuuugacagu

SEQ ID NO: 689037 - RNA, 19 nt, Homo sapiens
ugaugaggauuuaguugac

SEQ ID NO: 689038 - RNA, 19 nt, Homo sapiens
ccuuauuccaguaacauuu

SEQ ID NO: 689039 - RNA, 19 nt, Homo sapiens
guggacagaccaagaugau

SEQ ID NO: 689040 - RNA, 19 nt, Homo sapiens
uuaagcaucccgucaaagg

SEQ ID NO: 689041 - RNA, 19 nt, Homo sapiens
ccaacaagcucuacaauuu

SEQ ID NO: 689042 - RNA, 19 nt, Homo sapiens
gaaccuauauuugccauua

SEQ ID NO: 689043 - RNA, 19 nt, Homo sapiens
gacaguagcuucauaacaa

SEQ ID NO: 689044 - RNA, 19 nt, Homo sapiens
gaacuugaaugcuaagaau

SEQ ID NO: 689045 - RNA, 19 nt, Homo sapiens
ggauguagcuuguuaguag

SEQ ID NO: 689046 - RNA, 19 nt, Homo sapiens
ugagauaacuggcaauuug

SEQ ID NO: 689047 - RNA, 19 nt, Homo sapiens
guacuuagauaccacauau

SEQ ID NO: 689048 - RNA, 19 nt, Homo sapiens
gaagaaguguggugggaaa

SEQ ID NO: 689049 - RNA, 19 nt, Homo sapiens
ggagcacaauggagaaaua

SEQ ID NO: 689050 - RNA, 19 nt, Homo sapiens
gcaaguacuuuacaugaga

SEQ ID NO: 689051 - RNA, 19 nt, Homo sapiens
aaacugaagugguugagua

SEQ ID NO: 689052 - RNA, 19 nt, Homo sapiens
gcacaauggagaaauauuu

SEQ ID NO: 689053 - RNA, 19 nt, Homo sapiens
caacaagcucuacaauuua

SEQ ID NO: 689054 - RNA, 19 nt, Homo sapiens
gaacaagcuucaugugcaa

SEQ ID NO: 689055 - RNA, 19 nt, Homo sapiens
ggaaccggcuuuacaguug

SEQ ID NO: 689056 - RNA, 19 nt, Homo sapiens
gaugaaggauuguauagau

SEQ ID NO: 689057 - RNA, 19 nt, Homo sapiens
ucaaguuucucuuccguua

SEQ ID NO: 689058 - RNA, 19 nt, Homo sapiens
aaagauacguccaguuuau

SEQ ID NO: 689059 - RNA, 19 nt, Homo sapiens
ucacucagcucaaucaaau

SEQ ID NO: 689060 - RNA, 19 nt, Homo sapiens
gcaaacaacucagaacaca

SEQ ID NO: 689061 - RNA, 19 nt, Homo sapiens
ccaaagauacguccaguuu

SEQ ID NO: 689062 - RNA, 19 nt, Homo sapiens
ugaaauagcacccauaaug

SEQ ID NO: 689063 - RNA, 19 nt, Homo sapiens
gaaauuggaagcuggauau

SEQ ID NO: 689064 - RNA, 19 nt, Homo sapiens
gaaggagcgugucagaaga

SEQ ID NO: 689065 - RNA, 19 nt, Homo sapiens
gaaacagaguguccugaug

SEQ ID NO: 689066 - RNA, 19 nt, Homo sapiens
guuuguagcuugccaauau

SEQ ID NO: 689067 - RNA, 19 nt, Homo sapiens
gcaagagguuauccgguuu

SEQ ID NO: 689068 - RNA, 19 nt, Homo sapiens
ggauaaguaugaugaagga

SEQ ID NO: 689069 - RNA, 19 nt, Homo sapiens
aaacaacucagaacacaua

SEQ ID NO: 689070 - RNA, 19 nt, Homo sapiens
gcucuacaauuuacagauu

SEQ ID NO: 689071 - RNA, 19 nt, Homo sapiens
gcagcuaccuagaaaugaa

SEQ ID NO: 689072 - RNA, 19 nt, Homo sapiens
cuucuggucuuaaguauaa

SEQ ID NO: 689073 - RNA, 19 nt, Homo sapiens
caaagugaacagcuucuua

SEQ ID NO: 689074 - RNA, 19 nt, Homo sapiens
ggacaagauauuugaauga

SEQ ID NO: 689075 - RNA, 19 nt, Homo sapiens
gagaguacuuugccuuaug

SEQ ID NO: 689076 - RNA, 19 nt, Homo sapiens
caaaugaucccuuauugau

SEQ ID NO: 689077 - RNA, 19 nt, Homo sapiens
uagaagacauuuccgaaga

SEQ ID NO: 689078 - RNA, 19 nt, Homo sapiens
acacauaaauuugccauug

SEQ ID NO: 689079 - RNA, 19 nt, Homo sapiens
aagaagacauuugggaaua

SEQ ID NO: 689080 - RNA, 19 nt, Homo sapiens
guucuaagauuaagcuguu

SEQ ID NO: 689081 - RNA, 19 nt, Homo sapiens
gcgggaaacugaagugguu

SEQ ID NO: 689082 - RNA, 19 nt, Homo sapiens
gaauacaccuuuccaucuc

SEQ ID NO: 689083 - RNA, 19 nt, Homo sapiens
cauaugcuguacuuagaua

SEQ ID NO: 689084 - RNA, 19 nt, Homo sapiens
cagaucaccuuauuaauac

SEQ ID NO: 689085 - RNA, 19 nt, Homo sapiens
uaaguaugaugaaggauug

SEQ ID NO: 689086 - RNA, 19 nt, Homo sapiens
gaagauuguucagauacuu

SEQ ID NO: 689087 - RNA, 19 nt, Homo sapiens
gaaccggcuuuacaguuga

SEQ ID NO: 689088 - RNA, 19 nt, Homo sapiens
guaaugaagcaaauggaua

SEQ ID NO: 689089 - RNA, 19 nt, Homo sapiens
aaugaucccuuauugauga

SEQ ID NO: 689090 - RNA, 19 nt, Homo sapiens
ggacacacucuaacaaguu

SEQ ID NO: 689091 - RNA, 19 nt, Homo sapiens
gcacuuacucuauuggaaa

SEQ ID NO: 689092 - RNA, 19 nt, Homo sapiens
gaagcagucaauuuaagua

SEQ ID NO: 689093 - RNA, 19 nt, Homo sapiens
acagaaaacuugucuagua

SEQ ID NO: 689094 - RNA, 19 nt, Homo sapiens
agaaacagguaauugaaga

SEQ ID NO: 689095 - RNA, 19 nt, Homo sapiens
gaauuucacucagcucaau

SEQ ID NO: 689096 - RNA, 19 nt, Homo sapiens
gaauuacacaucucuuuga

SEQ ID NO: 689097 - RNA, 19 nt, Homo sapiens
aaagagauguagaaaguca

SEQ ID NO: 689098 - RNA, 19 nt, Homo sapiens
gugaacagcuucuuaacuc

SEQ ID NO: 689099 - RNA, 19 nt, Homo sapiens
gguuucaaaugaucccuua

SEQ ID NO: 689100 - RNA, 19 nt, Homo sapiens
caaagauacguccaguuua

SEQ ID NO: 689101 - RNA, 19 nt, Homo sapiens
uuacaaaucucguucuaag

SEQ ID NO: 689102 - RNA, 19 nt, Homo sapiens
ggacugugguuggauuuau

SEQ ID NO: 689103 - RNA, 19 nt, Homo sapiens
guaguuaaguuccuuggau

SEQ ID NO: 689104 - RNA, 19 nt, Homo sapiens
ucuaaacacuucacauuuc

SEQ ID NO: 689105 - RNA, 19 nt, Homo sapiens
ggaaggagcgugucagaag

SEQ ID NO: 689106 - RNA, 19 nt, Homo sapiens
ugaagacacucaugauauc

SEQ ID NO: 689107 - RNA, 19 nt, Homo sapiens
ggaguugcuuugcgucuug

SEQ ID NO: 689108 - RNA, 19 nt, Homo sapiens
gaagaagacauuugggaau

SEQ ID NO: 689109 - RNA, 19 nt, Homo sapiens
uagcagguguugucaggua

SEQ ID NO: 689110 - RNA, 19 nt, Homo sapiens
gugguuggauuuaugaauu

SEQ ID NO: 689111 - RNA, 19 nt, Homo sapiens
ggauauagguguguauuuu

SEQ ID NO: 689112 - RNA, 19 nt, Homo sapiens
gugagaacuugaaugcuaa

SEQ ID NO: 689113 - RNA, 19 nt, Homo sapiens
caaauugccagaugccuuu

SEQ ID NO: 689114 - RNA, 19 nt, Homo sapiens
gaauucaaguuguggagau

SEQ ID NO: 689115 - RNA, 19 nt, Homo sapiens
ggucuuaaguauaaugcaa

SEQ ID NO: 689116 - RNA, 19 nt, Homo sapiens
agugagaacuugaaugcua

SEQ ID NO: 689117 - RNA, 19 nt, Homo sapiens
gaaggauuguauagauuca

SEQ ID NO: 689118 - RNA, 19 nt, Homo sapiens
caacucagaacacauaaau

SEQ ID NO: 689119 - RNA, 19 nt, Homo sapiens
acacaucucuuugauuaug

SEQ ID NO: 689120 - RNA, 19 nt, Homo sapiens
gaagcuggauauugaugau

SEQ ID NO: 689121 - RNA, 19 nt, Homo sapiens
caaguucacuagaauagca

SEQ ID NO: 689122 - RNA, 19 nt, Homo sapiens
gacacugaauguauuguga

SEQ ID NO: 689123 - RNA, 19 nt, Homo sapiens
gaaaaugacuucagugacu

SEQ ID NO: 689124 - RNA, 19 nt, Homo sapiens
acaccucgauggcauguuu

SEQ ID NO: 689125 - RNA, 19 nt, Homo sapiens
gaaagucuuccuagccauu

SEQ ID NO: 689126 - RNA, 19 nt, Homo sapiens
auaacucgguuucaaauga

SEQ ID NO: 689127 - RNA, 19 nt, Homo sapiens
cacagcagcuaccuagaaa

SEQ ID NO: 689128 - RNA, 19 nt, Homo sapiens
caagacauccuucuaccaa

SEQ ID NO: 689129 - RNA, 19 nt, Homo sapiens
guacaccugcuccgaagua

SEQ ID NO: 689130 - RNA, 19 nt, Homo sapiens
gaagaaucaucuguuuaca

SEQ ID NO: 689131 - RNA, 19 nt, Homo sapiens
ggaaaugcagguugucaga

SEQ ID NO: 689132 - RNA, 19 nt, Homo sapiens
gaagacauuugggaauaca

SEQ ID NO: 689133 - RNA, 19 nt, Homo sapiens
ggaaauuggaagcuggaua

SEQ ID NO: 689134 - RNA, 19 nt, Homo sapiens
aaagugaacagcuucuuaa

SEQ ID NO: 689135 - RNA, 19 nt, Homo sapiens
gccaauauguucauuacca

SEQ ID NO: 689136 - RNA, 19 nt, Homo sapiens
gaagggauaaacuuaaauc

SEQ ID NO: 689137 - RNA, 19 nt, Homo sapiens
caauacaagcccacucuuu

SEQ ID NO: 689138 - RNA, 19 nt, Homo sapiens
gaaugaaauagcacccaua

SEQ ID NO: 689139 - RNA, 19 nt, Homo sapiens
gcgaauuacacaucucuuu

SEQ ID NO: 689140 - RNA, 19 nt, Homo sapiens
cuaacaaguucacuagaau

SEQ ID NO: 689141 - RNA, 19 nt, Homo sapiens
gcaacaaacuguauuuaug

SEQ ID NO: 689142 - RNA, 19 nt, Homo sapiens
ggagaaaugugcagaguuc

SEQ ID NO: 689143 - RNA, 19 nt, Homo sapiens
gaaaggaaauagaaacaca

SEQ ID NO: 689144 - RNA, 19 nt, Homo sapiens
gaacugugcuguuaacaag

SEQ ID NO: 689145 - RNA, 19 nt, Homo sapiens
ggacuaaggugugauuaau

SEQ ID NO: 689146 - RNA, 19 nt, Homo sapiens
agaagaagcugggaaguuu

SEQ ID NO: 689147 - RNA, 19 nt, Homo sapiens
ucaaggagaucgccacaaa

SEQ ID NO: 689148 - RNA, 19 nt, Homo sapiens
caaccuggcuacugugauu

SEQ ID NO: 689149 - RNA, 19 nt, Homo sapiens
gaacaagcaacaaacugua

SEQ ID NO: 689150 - RNA, 19 nt, Homo sapiens
gaagaccuccgaauuucua

SEQ ID NO: 689151 - RNA, 19 nt, Homo sapiens
ggacuucuccaacuuacua

SEQ ID NO: 689152 - RNA, 19 nt, Homo sapiens
aagaagaagucaaggaauu

SEQ ID NO: 689153 - RNA, 19 nt, Homo sapiens
ggaagaagaagucaaggaa

SEQ ID NO: 689154 - RNA, 19 nt, Homo sapiens
ggacuuccaccuacgauaa

SEQ ID NO: 689155 - RNA, 19 nt, Homo sapiens
ggacaucucugaccaucca

SEQ ID NO: 689156 - RNA, 19 nt, Homo sapiens
ggaaguuugucuuugaaau

SEQ ID NO: 689157 - RNA, 19 nt, Homo sapiens
gaucagagaccaugaaguc

SEQ ID NO: 689158 - RNA, 19 nt, Homo sapiens
gaaggaaaauuaugacguu

SEQ ID NO: 689159 - RNA, 19 nt, Homo sapiens
aaacacagaagcaaaugua

SEQ ID NO: 689160 - RNA, 19 nt, Homo sapiens
cacuguggcuucccuguua

SEQ ID NO: 689161 - RNA, 19 nt, Homo sapiens
gaccauccaucgcuguauu

SEQ ID NO: 689162 - RNA, 19 nt, Homo sapiens
ggaaauagaaacacagaag

SEQ ID NO: 689163 - RNA, 19 nt, Homo sapiens
gagaagaggaaauugauuc

SEQ ID NO: 689164 - RNA, 19 nt, Homo sapiens
ggacagacagcuucaguag

SEQ ID NO: 689165 - RNA, 19 nt, Homo sapiens
caaagagugaugacuauga

SEQ ID NO: 689166 - RNA, 19 nt, Homo sapiens
acagacagcuucaguagca

SEQ ID NO: 689167 - RNA, 19 nt, Homo sapiens
cgcagcagcucuacuacua

SEQ ID NO: 689168 - RNA, 19 nt, Homo sapiens
cuaccaggauguacaauca

SEQ ID NO: 689169 - RNA, 19 nt, Homo sapiens
gcaaauguaugaggaacag

SEQ ID NO: 689170 - RNA, 19 nt, Homo sapiens
cgaagacccugccgugauc

SEQ ID NO: 689171 - RNA, 19 nt, Homo sapiens
gcagguuccuacaugaaau

SEQ ID NO: 689172 - RNA, 19 nt, Homo sapiens
aagaugggcuggcugaaga

SEQ ID NO: 689173 - RNA, 19 nt, Homo sapiens
ugagggaaacaucaaauuu

SEQ ID NO: 689174 - RNA, 19 nt, Homo sapiens
gaagaagucaaggaauuug

SEQ ID NO: 689175 - RNA, 19 nt, Homo sapiens
gggaggauguugagaagag

SEQ ID NO: 689176 - RNA, 19 nt, Homo sapiens
ggacucaaacacucccuaa

SEQ ID NO: 689177 - RNA, 19 nt, Homo sapiens
caagagcuacgaaaggaaa

SEQ ID NO: 689178 - RNA, 19 nt, Homo sapiens
ggccagcgcuuggaugaga

SEQ ID NO: 689179 - RNA, 19 nt, Homo sapiens
gauguacaaucaaggagau

SEQ ID NO: 689180 - RNA, 19 nt, Homo sapiens
ccaacuuacuauuagacua

SEQ ID NO: 689181 - RNA, 19 nt, Homo sapiens
acuaaggugugauuaauuc

SEQ ID NO: 689182 - RNA, 19 nt, Homo sapiens
gaagaagaagucaaggaau

SEQ ID NO: 689183 - RNA, 19 nt, Homo sapiens
gagaucagccuccgcaaca

SEQ ID NO: 689184 - RNA, 19 nt, Homo sapiens
cacagaagcaaauguauga

SEQ ID NO: 689185 - RNA, 19 nt, Homo sapiens
ggaggacagcagcaaagua

SEQ ID NO: 689186 - RNA, 19 nt, Homo sapiens
gaaguuugucuuugaaauc

SEQ ID NO: 689187 - RNA, 19 nt, Homo sapiens
caagcaacaaacuguauuu

SEQ ID NO: 689188 - RNA, 19 nt, Homo sapiens
gaagaacuggagaaggaaa

SEQ ID NO: 689189 - RNA, 19 nt, Homo sapiens
ggagaagaggaaauugauu

SEQ ID NO: 689190 - RNA, 19 nt, Homo sapiens
aaagagugaugacuaugau

SEQ ID NO: 689191 - RNA, 19 nt, Homo sapiens
ccucagauccaaagaguga

SEQ ID NO: 689192 - RNA, 19 nt, Homo sapiens
gggcgcagcagcucuacua

SEQ ID NO: 689193 - RNA, 19 nt, Homo sapiens
caacaaacuguauuuaugc

SEQ ID NO: 689194 - RNA, 19 nt, Homo sapiens
auccaucgcuguauucaaa

SEQ ID NO: 689195 - RNA, 19 nt, Homo sapiens
agaggaaauugauucuuug

SEQ ID NO: 689196 - RNA, 19 nt, Homo sapiens
ccaggacuucuccaacuua

SEQ ID NO: 689197 - RNA, 19 nt, Homo sapiens
caaaggcucagcaggaguu

SEQ ID NO: 689198 - RNA, 19 nt, Homo sapiens
ggaugagacuguggccuau

SEQ ID NO: 689199 - RNA, 19 nt, Homo sapiens
gaggaugguccaagagcua

SEQ ID NO: 689200 - RNA, 19 nt, Homo sapiens
ggaagccagugcacucucu

SEQ ID NO: 689201 - RNA, 19 nt, Homo sapiens
acuauagucuccugagcua

SEQ ID NO: 689202 - RNA, 19 nt, Homo sapiens
gaagaagcugggaaguuug

SEQ ID NO: 689203 - RNA, 19 nt, Homo sapiens
uggaacagcucaccuuguc

SEQ ID NO: 689204 - RNA, 19 nt, Homo sapiens
gaagcaaauguaugaggaa

SEQ ID NO: 689205 - RNA, 19 nt, Homo sapiens
gaagggcacaggagaacga

SEQ ID NO: 689206 - RNA, 19 nt, Homo sapiens
ggaggaguggguuaaauuc

SEQ ID NO: 689207 - RNA, 19 nt, Homo sapiens
agagguccaucgugaagaa

SEQ ID NO: 689208 - RNA, 19 nt, Homo sapiens
aaaggacauuugagggaaa

SEQ ID NO: 689209 - RNA, 19 nt, Homo sapiens
cugaagaccuccgaauuuc

SEQ ID NO: 689210 - RNA, 19 nt, Homo sapiens
gaaaugugcagaguucauc

SEQ ID NO: 689211 - RNA, 19 nt, Homo sapiens
gcugggaaguuugucuuug

SEQ ID NO: 689212 - RNA, 19 nt, Homo sapiens
caucaaauuuccccauaaa

SEQ ID NO: 689213 - RNA, 19 nt, Homo sapiens
gaaacacagaagcaaaugu

SEQ ID NO: 689214 - RNA, 19 nt, Homo sapiens
gcaaaauggagaucuuuaa

SEQ ID NO: 689215 - RNA, 19 nt, Homo sapiens
gaggacagcagcaaaguac

SEQ ID NO: 689216 - RNA, 19 nt, Homo sapiens
gacaagcgacucugauaca

SEQ ID NO: 689217 - RNA, 19 nt, Homo sapiens
cagcagcucuacuacuaca

SEQ ID NO: 689218 - RNA, 19 nt, Homo sapiens
ugaauggaguuugcaggaa

SEQ ID NO: 689219 - RNA, 19 nt, Homo sapiens
gagagggaaaggacauuug

SEQ ID NO: 689220 - RNA, 19 nt, Homo sapiens
gaagucaaggaauuuguca

SEQ ID NO: 689221 - RNA, 19 nt, Homo sapiens
gcuacgaaaggaaauagaa

SEQ ID NO: 689222 - RNA, 19 nt, Homo sapiens
acugaagaccuccgaauuu

SEQ ID NO: 689223 - RNA, 19 nt, Homo sapiens
gagauggaggaguggguua

SEQ ID NO: 689224 - RNA, 19 nt, Homo sapiens
cugggaaguuugucuuuga

SEQ ID NO: 689225 - RNA, 19 nt, Homo sapiens
agaagaagucaaggaauuu

SEQ ID NO: 689226 - RNA, 19 nt, Homo sapiens
gaaaaugcaaucucguaaa

SEQ ID NO: 689227 - RNA, 19 nt, Homo sapiens
uccaaagagugaugacuau

SEQ ID NO: 689228 - RNA, 19 nt, Homo sapiens
cuucuccaacuuacuauua

SEQ ID NO: 689229 - RNA, 19 nt, Homo sapiens
gcagagguccaucgugaag

SEQ ID NO: 689230 - RNA, 19 nt, Homo sapiens
cagaagaagcugggaaguu

SEQ ID NO: 689231 - RNA, 19 nt, Homo sapiens
caagcaaaauugaugagaa

SEQ ID NO: 689232 - RNA, 19 nt, Homo sapiens
ccaccaggaugcccauucu

SEQ ID NO: 689233 - RNA, 19 nt, Homo sapiens
gcaugaccacguccaguga

SEQ ID NO: 689234 - RNA, 19 nt, Homo sapiens
uccaagagcuacgaaagga

SEQ ID NO: 689235 - RNA, 19 nt, Homo sapiens
gaugaucagagaccaugaa

SEQ ID NO: 689236 - RNA, 19 nt, Homo sapiens
uggacaaccuggcuacugu

SEQ ID NO: 689237 - RNA, 19 nt, Homo sapiens
gacuaaggugugauuaauu

SEQ ID NO: 689238 - RNA, 19 nt, Homo sapiens
gaucagccuccgcaacaug

SEQ ID NO: 689239 - RNA, 19 nt, Homo sapiens
uagaaacacagaagcaaau

SEQ ID NO: 689240 - RNA, 19 nt, Homo sapiens
gcugaacugugcuguuaac

SEQ ID NO: 689241 - RNA, 19 nt, Homo sapiens
gaagugaccuuuaguagua

SEQ ID NO: 689242 - RNA, 19 nt, Homo sapiens
ggacugaacucuauguauu

SEQ ID NO: 689243 - RNA, 19 nt, Homo sapiens
ggucuaggguuaaggauua

SEQ ID NO: 689244 - RNA, 19 nt, Homo sapiens
gaagugagauguuaagauc

SEQ ID NO: 689245 - RNA, 19 nt, Homo sapiens
gggacuauaugauuucuua

SEQ ID NO: 689246 - RNA, 19 nt, Homo sapiens
gguauacucuaguugaaua

SEQ ID NO: 689247 - RNA, 19 nt, Homo sapiens
gaguagaagugagauguua

SEQ ID NO: 689248 - RNA, 19 nt, Homo sapiens
ggaacuugcuguguuuaua

SEQ ID NO: 689249 - RNA, 19 nt, Homo sapiens
ggcaacaggucuaggguua

SEQ ID NO: 689250 - RNA, 19 nt, Homo sapiens
gaggagagguggccgaaga

SEQ ID NO: 689251 - RNA, 19 nt, Homo sapiens
gcuauuagguagguagaua

SEQ ID NO: 689252 - RNA, 19 nt, Homo sapiens
gggcauagcuagugagaca

SEQ ID NO: 689253 - RNA, 19 nt, Homo sapiens
gguuauagguggucucuug

SEQ ID NO: 689254 - RNA, 19 nt, Homo sapiens
gcaugaaucuccucuugga

SEQ ID NO: 689255 - RNA, 19 nt, Homo sapiens
gauagagucuugcuguguu

SEQ ID NO: 689256 - RNA, 19 nt, Homo sapiens
gacauagucucaaguuuca

SEQ ID NO: 689257 - RNA, 19 nt, Homo sapiens
ggaguggaguugaggacua

SEQ ID NO: 689258 - RNA, 19 nt, Homo sapiens
aaacaauccugcuuucuca

SEQ ID NO: 689259 - RNA, 19 nt, Homo sapiens
guuccuacauacucuguua

SEQ ID NO: 689260 - RNA, 19 nt, Homo sapiens
gcagaaagaggcagcagaa

SEQ ID NO: 689261 - RNA, 19 nt, Homo sapiens
ggagaaccaguaccacaua

SEQ ID NO: 689262 - RNA, 19 nt, Homo sapiens
gcacuaaagacuuacuauu

SEQ ID NO: 689263 - RNA, 19 nt, Homo sapiens
gaacuugcuguguuuauau

SEQ ID NO: 689264 - RNA, 19 nt, Homo sapiens
gguggucucuugccauuga

SEQ ID NO: 689265 - RNA, 19 nt, Homo sapiens
gguggaacuugcuguguuu

SEQ ID NO: 689266 - RNA, 19 nt, Homo sapiens
gaaagaggcagcagaaggu

SEQ ID NO: 689267 - RNA, 19 nt, Homo sapiens
ucagguaggguuuaaagua

SEQ ID NO: 689268 - RNA, 19 nt, Homo sapiens
ggagcaggauggcgaugaa

SEQ ID NO: 689269 - RNA, 19 nt, Homo sapiens
acucagcuguuuauaauug

SEQ ID NO: 689270 - RNA, 19 nt, Homo sapiens
ggaugaaggucagcaagau

SEQ ID NO: 689271 - RNA, 19 nt, Homo sapiens
uuauggcacuaaagacuua

SEQ ID NO: 689272 - RNA, 19 nt, Homo sapiens
agacauacacgacaaauuc

SEQ ID NO: 689273 - RNA, 19 nt, Homo sapiens
gcaguaacuauaaugguaa

SEQ ID NO: 689274 - RNA, 19 nt, Homo sapiens
ugcaguaacuauaauggua

SEQ ID NO: 689275 - RNA, 19 nt, Homo sapiens
gaugaaggucagcaagaua

SEQ ID NO: 689276 - RNA, 19 nt, Homo sapiens
ugaaaguucuaaagcauag

SEQ ID NO: 689277 - RNA, 19 nt, Homo sapiens
ccugguaugucuguuauuu

SEQ ID NO: 689278 - RNA, 19 nt, Homo sapiens
gauuaaggccugggaauug

SEQ ID NO: 689279 - RNA, 19 nt, Homo sapiens
acuauucuguuccuacaua

SEQ ID NO: 689280 - RNA, 19 nt, Homo sapiens
auucuaacauugcgcuuua

SEQ ID NO: 689281 - RNA, 19 nt, Homo sapiens
gaggagaggauccaaagga

SEQ ID NO: 689282 - RNA, 19 nt, Homo sapiens
guugaaggcuggauucucu

SEQ ID NO: 689283 - RNA, 19 nt, Homo sapiens
ggacgagagcauucacaaa

SEQ ID NO: 689284 - RNA, 19 nt, Homo sapiens
ggacaaugcggcuauagca

SEQ ID NO: 689285 - RNA, 19 nt, Homo sapiens
guuagaaucucaccauggu

SEQ ID NO: 689286 - RNA, 19 nt, Homo sapiens
agaagagucuauacuaagu

SEQ ID NO: 689287 - RNA, 19 nt, Homo sapiens
uaaaaugggugcugccaaa

SEQ ID NO: 689288 - RNA, 19 nt, Homo sapiens
caacaggucuaggguuaag

SEQ ID NO: 689289 - RNA, 19 nt, Homo sapiens
ugaugguguucaagaauaa

SEQ ID NO: 689290 - RNA, 19 nt, Homo sapiens
uaggagagcaggaguagaa

SEQ ID NO: 689291 - RNA, 19 nt, Homo sapiens
ucuagggacugaacucuau

SEQ ID NO: 689292 - RNA, 19 nt, Homo sapiens
gaguugaggacuauuagaa

SEQ ID NO: 689293 - RNA, 19 nt, Homo sapiens
gaacagcuggaguggaguu

SEQ ID NO: 689294 - RNA, 19 nt, Homo sapiens
gaagcugccuuuggugaca

SEQ ID NO: 689295 - RNA, 19 nt, Homo sapiens
cagguaggguuuaaaguag

SEQ ID NO: 689296 - RNA, 19 nt, Homo sapiens
agacaugguuagaaucuca

SEQ ID NO: 689297 - RNA, 19 nt, Homo sapiens
ggaggagaauguugcaaac

SEQ ID NO: 689298 - RNA, 19 nt, Homo sapiens
ggguggaacuugcuguguu

SEQ ID NO: 689299 - RNA, 19 nt, Homo sapiens
ugaggaagccaccgaagaa

SEQ ID NO: 689300 - RNA, 19 nt, Homo sapiens
auaugaugcugaacaguaa

SEQ ID NO: 689301 - RNA, 19 nt, Homo sapiens
gcuugaauaugaugcugaa

SEQ ID NO: 689302 - RNA, 19 nt, Homo sapiens
ggauuaaggccugggaauu

SEQ ID NO: 689303 - RNA, 19 nt, Homo sapiens
cuaacucagcuguuuauaa

SEQ ID NO: 689304 - RNA, 19 nt, Homo sapiens
gaagagucuauacuaaguu

SEQ ID NO: 689305 - RNA, 19 nt, Homo sapiens
cuaguuaugugaguuucua

SEQ ID NO: 689306 - RNA, 19 nt, Homo sapiens
cgagauggcggacgugcua

SEQ ID NO: 689307 - RNA, 19 nt, Homo sapiens
uaacauugcgcuuuauaag

SEQ ID NO: 689308 - RNA, 19 nt, Homo sapiens
aauaugaugcugaacagua

SEQ ID NO: 689309 - RNA, 19 nt, Homo sapiens
uagaaucucaccaugguuu

SEQ ID NO: 689310 - RNA, 19 nt, Homo sapiens
gacugaacucuauguauuu

SEQ ID NO: 689311 - RNA, 19 nt, Homo sapiens
gaguggaguugaggacuau

SEQ ID NO: 689312 - RNA, 19 nt, Homo sapiens
uagguggucucuugccauu

SEQ ID NO: 689313 - RNA, 19 nt, Homo sapiens
aagaagacauacacgacaa

SEQ ID NO: 689314 - RNA, 19 nt, Homo sapiens
cacuaaagacuuacuauuc

SEQ ID NO: 689315 - RNA, 19 nt, Homo sapiens
auagagucuugcuguguua

SEQ ID NO: 689316 - RNA, 19 nt, Homo sapiens
aguauagggugaauugaug

SEQ ID NO: 689317 - RNA, 19 nt, Homo sapiens
ggacuucaguuagcauggu

SEQ ID NO: 689318 - RNA, 19 nt, Homo sapiens
aggcaugaaucuccucuug

SEQ ID NO: 689319 - RNA, 19 nt, Homo sapiens
cgagagcauucacaaacug

SEQ ID NO: 689320 - RNA, 19 nt, Homo sapiens
gaagggguauacucuaguu

SEQ ID NO: 689321 - RNA, 19 nt, Homo sapiens
gguagauagcuauuaggua

SEQ ID NO: 689322 - RNA, 19 nt, Homo sapiens
gagaaccaguaccacauac

SEQ ID NO: 689323 - RNA, 19 nt, Homo sapiens
ggagggacuucaguuagca

SEQ ID NO: 689324 - RNA, 19 nt, Homo sapiens
cuaaagacuuacuauucug

SEQ ID NO: 689325 - RNA, 19 nt, Homo sapiens
gagagcaggaguagaagug

SEQ ID NO: 689326 - RNA, 19 nt, Homo sapiens
gauugcagcugaucauagc

SEQ ID NO: 689327 - RNA, 19 nt, Homo sapiens
augcagccuuggacaaaua

SEQ ID NO: 689328 - RNA, 19 nt, Homo sapiens
ucuaccaccucacucauau

SEQ ID NO: 689329 - RNA, 19 nt, Homo sapiens
cauccuuaauuccaaguga

SEQ ID NO: 689330 - RNA, 19 nt, Homo sapiens
gaagacauacacgacaaau

SEQ ID NO: 689331 - RNA, 19 nt, Homo sapiens
gcagaaggugaagagguua

SEQ ID NO: 689332 - RNA, 19 nt, Homo sapiens
gaguauagggugaauugau

SEQ ID NO: 689333 - RNA, 19 nt, Homo sapiens
gcggaugcgugaggauuau

SEQ ID NO: 689334 - RNA, 19 nt, Homo sapiens
ggaguagaagugagauguu

SEQ ID NO: 689335 - RNA, 19 nt, Homo sapiens
caccaugcccagcuaaauu

SEQ ID NO: 689336 - RNA, 19 nt, Homo sapiens
guaguaauagucuuaugug

SEQ ID NO: 689337 - RNA, 19 nt, Homo sapiens
aauccugcuuucucaagua

SEQ ID NO: 689338 - RNA, 19 nt, Homo sapiens
cauacugucuccucccaau

SEQ ID NO: 689339 - RNA, 19 nt, Homo sapiens
ugaggacaaugcggcuaua

SEQ ID NO: 689340 - RNA, 19 nt, Homo sapiens
ugaggaggcccaagaggaa

SEQ ID NO: 689341 - RNA, 19 nt, Homo sapiens
gaacagaguugugcugaua

SEQ ID NO: 689342 - RNA, 19 nt, Homo sapiens
ggaagaagcuugcugaguu

SEQ ID NO: 689343 - RNA, 19 nt, Homo sapiens
agaaagagcugaacaagaa

SEQ ID NO: 689344 - RNA, 19 nt, Homo sapiens
ggaagcagcugauuauuag

SEQ ID NO: 689345 - RNA, 19 nt, Homo sapiens
gagcagaccuucaucauca

SEQ ID NO: 689346 - RNA, 19 nt, Homo sapiens
gaagauuacuacaccgaua

SEQ ID NO: 689347 - RNA, 19 nt, Homo sapiens
gcaagucacccaucagaua

SEQ ID NO: 689348 - RNA, 19 nt, Homo sapiens
gcaauaggguggcacagaa

SEQ ID NO: 689349 - RNA, 19 nt, Homo sapiens
gcacaaagacacagacuug

SEQ ID NO: 689350 - RNA, 19 nt, Homo sapiens
cuacagagaucccacacua

SEQ ID NO: 689351 - RNA, 19 nt, Homo sapiens
gagcuugugugcccugaua

SEQ ID NO: 689352 - RNA, 19 nt, Homo sapiens
ggagcuaccuuccugugua

SEQ ID NO: 689353 - RNA, 19 nt, Homo sapiens
gaagaaggcuuuuaagaug

SEQ ID NO: 689354 - RNA, 19 nt, Homo sapiens
ggaaugaccugccaguaca

SEQ ID NO: 689355 - RNA, 19 nt, Homo sapiens
gcaagucaaccaaggaaua

SEQ ID NO: 689356 - RNA, 19 nt, Homo sapiens
gaagugagcgcaagcuuga

SEQ ID NO: 689357 - RNA, 19 nt, Homo sapiens
gaagauucaugcaggaaga

SEQ ID NO: 689358 - RNA, 19 nt, Homo sapiens
gaagaagcuugcugaguuc

SEQ ID NO: 689359 - RNA, 19 nt, Homo sapiens
gcagagaccaccacauuga

SEQ ID NO: 689360 - RNA, 19 nt, Homo sapiens
ccacacuacuuccggcuua

SEQ ID NO: 689361 - RNA, 19 nt, Homo sapiens
gaacuacauugggauaaau

SEQ ID NO: 689362 - RNA, 19 nt, Homo sapiens
ccucagagcuaacauaaag

SEQ ID NO: 689363 - RNA, 19 nt, Homo sapiens
ggccaaggcuccuaugaug

SEQ ID NO: 689364 - RNA, 19 nt, Homo sapiens
gagaugguguuuacucaga

SEQ ID NO: 689365 - RNA, 19 nt, Homo sapiens
ugaaauugguccaguuuau

SEQ ID NO: 689366 - RNA, 19 nt, Homo sapiens
ggaaaggccugaggaugug

SEQ ID NO: 689367 - RNA, 19 nt, Homo sapiens
ggagaccuauguuccagaa

SEQ ID NO: 689368 - RNA, 19 nt, Homo sapiens
aaacauugcccagggauua

SEQ ID NO: 689369 - RNA, 19 nt, Homo sapiens
gagagaugguguuuacuca

SEQ ID NO: 689370 - RNA, 19 nt, Homo sapiens
ggugaaaggcucaguagaa

SEQ ID NO: 689371 - RNA, 19 nt, Homo sapiens
cccgggacaugcuauauua

SEQ ID NO: 689372 - RNA, 19 nt, Homo sapiens
gcuaggaagcagcugauua

SEQ ID NO: 689373 - RNA, 19 nt, Homo sapiens
cagcagagaccaccacauu

SEQ ID NO: 689374 - RNA, 19 nt, Homo sapiens
gaagacaaccaucacacuu

SEQ ID NO: 689375 - RNA, 19 nt, Homo sapiens
ggaugaguuugaaauguug

SEQ ID NO: 689376 - RNA, 19 nt, Homo sapiens
cacagaagcucaucucagu

SEQ ID NO: 689377 - RNA, 19 nt, Homo sapiens
gagagcagcuggauuuuau

SEQ ID NO: 689378 - RNA, 19 nt, Homo sapiens
ggagaacuacauugggaua

SEQ ID NO: 689379 - RNA, 19 nt, Homo sapiens
gaagcuugcugaguucgaa

SEQ ID NO: 689380 - RNA, 19 nt, Homo sapiens
gagcuaccuuccuguguau

SEQ ID NO: 689381 - RNA, 19 nt, Homo sapiens
ggaauugggcagcugauug

SEQ ID NO: 689382 - RNA, 19 nt, Homo sapiens
ccaguacauuguccaguuu

SEQ ID NO: 689383 - RNA, 19 nt, Homo sapiens
agagagagaugguguuuac

SEQ ID NO: 689384 - RNA, 19 nt, Homo sapiens
gaccaacacuacagagauc

SEQ ID NO: 689385 - RNA, 19 nt, Homo sapiens
caaaacagccugagcaaaa

SEQ ID NO: 689386 - RNA, 19 nt, Homo sapiens
agacaaccaucacacuuau

SEQ ID NO: 689387 - RNA, 19 nt, Homo sapiens
gccaguacauuguccaguu

SEQ ID NO: 689388 - RNA, 19 nt, Homo sapiens
ccuaggcccucaugauuug

SEQ ID NO: 689389 - RNA, 19 nt, Homo sapiens
ugaguucgaagaugaguua

SEQ ID NO: 689390 - RNA, 19 nt, Homo sapiens
gaacccuucgccugaauaa

SEQ ID NO: 689391 - RNA, 19 nt, Homo sapiens
ggacugcaaguggccauua

SEQ ID NO: 689392 - RNA, 19 nt, Homo sapiens
gaaauugguccaguuuaug

SEQ ID NO: 689393 - RNA, 19 nt, Homo sapiens
ccacagccacuaaguaaau

SEQ ID NO: 689394 - RNA, 19 nt, Homo sapiens
gaagcacgauccgccaaug

SEQ ID NO: 689395 - RNA, 19 nt, Homo sapiens
gcccugagauccugcacaa

SEQ ID NO: 689396 - RNA, 19 nt, Homo sapiens
aggaagcagcugauuauua

SEQ ID NO: 689397 - RNA, 19 nt, Homo sapiens
caagucaaccaaggaauaa

SEQ ID NO: 689398 - RNA, 19 nt, Homo sapiens
gaagaaagagcugaacaag

SEQ ID NO: 689399 - RNA, 19 nt, Homo sapiens
ggaaguccuccuuguauuc

SEQ ID NO: 689400 - RNA, 19 nt, Homo sapiens
cgucucagcccuucaguuu

SEQ ID NO: 689401 - RNA, 19 nt, Homo sapiens
gcccagcacuucauacgau

SEQ ID NO: 689402 - RNA, 19 nt, Homo sapiens
ugaagagugucuccagaug

SEQ ID NO: 689403 - RNA, 19 nt, Homo sapiens
uggaugaguuugaaauguu

SEQ ID NO: 689404 - RNA, 19 nt, Homo sapiens
aggaagagcugacccaucu

SEQ ID NO: 689405 - RNA, 19 nt, Homo sapiens
ccacacagaccacgaguuc

SEQ ID NO: 689406 - RNA, 19 nt, Homo sapiens
ccaaagagccuaggaaagg

SEQ ID NO: 689407 - RNA, 19 nt, Homo sapiens
ccaaagaaaggaccagaga

SEQ ID NO: 689408 - RNA, 19 nt, Homo sapiens
gccagaagcaggaguguga

SEQ ID NO: 689409 - RNA, 19 nt, Homo sapiens
agaccuauguuccagaaga

SEQ ID NO: 689410 - RNA, 19 nt, Homo sapiens
ggagagcucacagacuuaa

SEQ ID NO: 689411 - RNA, 19 nt, Homo sapiens
cuggagagcucacagacuu

SEQ ID NO: 689412 - RNA, 19 nt, Homo sapiens
gcucccagcugaccagaca

SEQ ID NO: 689413 - RNA, 19 nt, Homo sapiens
ccacugaggacccguguga

SEQ ID NO: 689414 - RNA, 19 nt, Homo sapiens
aagacaaccaucacacuua

SEQ ID NO: 689415 - RNA, 19 nt, Homo sapiens
gaucagcgacugccacauc

SEQ ID NO: 689416 - RNA, 19 nt, Homo sapiens
ugcgacaacugccagauaa

SEQ ID NO: 689417 - RNA, 19 nt, Homo sapiens
cauggaauuuaacuccuaa

SEQ ID NO: 689418 - RNA, 19 nt, Homo sapiens
guucaaaacugacauuuag

SEQ ID NO: 689419 - RNA, 19 nt, Homo sapiens
gcauagcgaagaccaguau

SEQ ID NO: 689420 - RNA, 19 nt, Homo sapiens
gcuccuaugaugagagaua

SEQ ID NO: 689421 - RNA, 19 nt, Homo sapiens
gauaggagaauuccagagu

SEQ ID NO: 689422 - RNA, 19 nt, Homo sapiens
aaagaagccagcaccgaua

SEQ ID NO: 689423 - RNA, 19 nt, Homo sapiens
cgugaggccugcacagcua

SEQ ID NO: 689424 - RNA, 19 nt, Homo sapiens
gaccagccuucccaacaug

SEQ ID NO: 689425 - RNA, 19 nt, Homo sapiens
cuaaggagagcucugauug

SEQ ID NO: 689426 - RNA, 19 nt, Homo sapiens
acauugaggcugucuuuaa

SEQ ID NO: 689427 - RNA, 19 nt, Homo sapiens
agaacuacauugggauaaa

SEQ ID NO: 689428 - RNA, 19 nt, Homo sapiens
cuaggaagcagcugauuau

SEQ ID NO: 689429 - RNA, 19 nt, Homo sapiens
gggacaugcuauauuagug

SEQ ID NO: 689430 - RNA, 19 nt, Homo sapiens
agagagagcuagacagacu

SEQ ID NO: 689431 - RNA, 19 nt, Homo sapiens
caagaaagcaagucaacca

SEQ ID NO: 689432 - RNA, 19 nt, Homo sapiens
agccugacauggaauuuaa

SEQ ID NO: 689433 - RNA, 19 nt, Homo sapiens
gcagccagguggagguuag

SEQ ID NO: 689434 - RNA, 19 nt, Homo sapiens
gaucuauauuucuggugaa

SEQ ID NO: 689435 - RNA, 19 nt, Homo sapiens
aaaccacagccacuaagua

SEQ ID NO: 689436 - RNA, 19 nt, Homo sapiens
ugccgaagcuacuggacua

SEQ ID NO: 689437 - RNA, 19 nt, Homo sapiens
gcaguaccaucuacaucuc

SEQ ID NO: 689438 - RNA, 19 nt, Homo sapiens
ccauuaccaucucuaagga

SEQ ID NO: 689439 - RNA, 19 nt, Homo sapiens
uaaaugugaagaaggcuuu

SEQ ID NO: 689440 - RNA, 19 nt, Homo sapiens
aaugguggcuccuggaaug

SEQ ID NO: 689441 - RNA, 19 nt, Homo sapiens
gaacagaguugugcugaua

SEQ ID NO: 689442 - RNA, 19 nt, Homo sapiens
ggaagaagcuugcugaguu

SEQ ID NO: 689443 - RNA, 19 nt, Homo sapiens
agaaagagcugaacaagaa

SEQ ID NO: 689444 - RNA, 19 nt, Homo sapiens
ggaagcagcugauuauuag

SEQ ID NO: 689445 - RNA, 19 nt, Homo sapiens
gaagauuacuacaccgaua

SEQ ID NO: 689446 - RNA, 19 nt, Homo sapiens
gcaagucacccaucagaua

SEQ ID NO: 689447 - RNA, 19 nt, Homo sapiens
gcaauaggguggcacagaa

SEQ ID NO: 689448 - RNA, 19 nt, Homo sapiens
gcacaaagacacagacuug

SEQ ID NO: 689449 - RNA, 19 nt, Homo sapiens
cuacagagaucccacacua

SEQ ID NO: 689450 - RNA, 19 nt, Homo sapiens
gagcuugugugcccugaua

SEQ ID NO: 689451 - RNA, 19 nt, Homo sapiens
ggagcuaccuuccugugua

SEQ ID NO: 689452 - RNA, 19 nt, Homo sapiens
gaagaaggcuuuuaagaug

SEQ ID NO: 689453 - RNA, 19 nt, Homo sapiens
ggaaugaccugccaguaca

SEQ ID NO: 689454 - RNA, 19 nt, Homo sapiens
gcaagucaaccaaggaaua

SEQ ID NO: 689455 - RNA, 19 nt, Homo sapiens
gaagugagcgcaagcuuga

SEQ ID NO: 689456 - RNA, 19 nt, Homo sapiens
gaagauucaugcaggaaga

SEQ ID NO: 689457 - RNA, 19 nt, Homo sapiens
gaagaagcuugcugaguuc

SEQ ID NO: 689458 - RNA, 19 nt, Homo sapiens
gcagagaccaccacauuga

SEQ ID NO: 689459 - RNA, 19 nt, Homo sapiens
ccacacuacuuccggcuua

SEQ ID NO: 689460 - RNA, 19 nt, Homo sapiens
gaacuacauugggauaaau

SEQ ID NO: 689461 - RNA, 19 nt, Homo sapiens
ccucagagcuaacauaaag

SEQ ID NO: 689462 - RNA, 19 nt, Homo sapiens
ggccaaggcuccuaugaug

SEQ ID NO: 689463 - RNA, 19 nt, Homo sapiens
gagaugguguuuacucaga

SEQ ID NO: 689464 - RNA, 19 nt, Homo sapiens
ugaaauugguccaguuuau

SEQ ID NO: 689465 - RNA, 19 nt, Homo sapiens
ggaaaggccugaggaugug

SEQ ID NO: 689466 - RNA, 19 nt, Homo sapiens
ggagaccuauguuccagaa

SEQ ID NO: 689467 - RNA, 19 nt, Homo sapiens
aaacauugcccagggauua

SEQ ID NO: 689468 - RNA, 19 nt, Homo sapiens
gagagaugguguuuacuca

SEQ ID NO: 689469 - RNA, 19 nt, Homo sapiens
ggugaaaggcucaguagaa

SEQ ID NO: 689470 - RNA, 19 nt, Homo sapiens
cccgggacaugcuauauua

SEQ ID NO: 689471 - RNA, 19 nt, Homo sapiens
gcuaggaagcagcugauua

SEQ ID NO: 689472 - RNA, 19 nt, Homo sapiens
cagcagagaccaccacauu

SEQ ID NO: 689473 - RNA, 19 nt, Homo sapiens
gaagacaaccaucacacuu

SEQ ID NO: 689474 - RNA, 19 nt, Homo sapiens
ggaugaguuugaaauguug

SEQ ID NO: 689475 - RNA, 19 nt, Homo sapiens
cacagaagcucaucucagu

SEQ ID NO: 689476 - RNA, 19 nt, Homo sapiens
gagagcagcuggauuuuau

SEQ ID NO: 689477 - RNA, 19 nt, Homo sapiens
ggagaacuacauugggaua

SEQ ID NO: 689478 - RNA, 19 nt, Homo sapiens
gaagcuugcugaguucgaa

SEQ ID NO: 689479 - RNA, 19 nt, Homo sapiens
gagcuaccuuccuguguau

SEQ ID NO: 689480 - RNA, 19 nt, Homo sapiens
ggaauugggcagcugauug

SEQ ID NO: 689481 - RNA, 19 nt, Homo sapiens
ccaguacauuguccaguuu

SEQ ID NO: 689482 - RNA, 19 nt, Homo sapiens
agagagagaugguguuuac

SEQ ID NO: 689483 - RNA, 19 nt, Homo sapiens
gaccaacacuacagagauc

SEQ ID NO: 689484 - RNA, 19 nt, Homo sapiens
caaaacagccugagcaaaa

SEQ ID NO: 689485 - RNA, 19 nt, Homo sapiens
agacaaccaucacacuuau

SEQ ID NO: 689486 - RNA, 19 nt, Homo sapiens
gccaguacauuguccaguu

SEQ ID NO: 689487 - RNA, 19 nt, Homo sapiens
ccuaggcccucaugauuug

SEQ ID NO: 689488 - RNA, 19 nt, Homo sapiens
ugaguucgaagaugaguua

SEQ ID NO: 689489 - RNA, 19 nt, Homo sapiens
gaacccuucgccugaauaa

SEQ ID NO: 689490 - RNA, 19 nt, Homo sapiens
ggacugcaaguggccauua

SEQ ID NO: 689491 - RNA, 19 nt, Homo sapiens
gaaauugguccaguuuaug

SEQ ID NO: 689492 - RNA, 19 nt, Homo sapiens
ccacagccacuaaguaaau

SEQ ID NO: 689493 - RNA, 19 nt, Homo sapiens
gaagcacgauccgccaaug

SEQ ID NO: 689494 - RNA, 19 nt, Homo sapiens
gcccugagauccugcacaa

SEQ ID NO: 689495 - RNA, 19 nt, Homo sapiens
aggaagcagcugauuauua

SEQ ID NO: 689496 - RNA, 19 nt, Homo sapiens
caagucaaccaaggaauaa

SEQ ID NO: 689497 - RNA, 19 nt, Homo sapiens
gaagaaagagcugaacaag

SEQ ID NO: 689498 - RNA, 19 nt, Homo sapiens
cgucucagcccuucaguuu

SEQ ID NO: 689499 - RNA, 19 nt, Homo sapiens
ggaaguccuccuuguauuc

SEQ ID NO: 689500 - RNA, 19 nt, Homo sapiens
gcccagcacuucauacgau

SEQ ID NO: 689501 - RNA, 19 nt, Homo sapiens
ugaagagugucuccagaug

SEQ ID NO: 689502 - RNA, 19 nt, Homo sapiens
uggaugaguuugaaauguu

SEQ ID NO: 689503 - RNA, 19 nt, Homo sapiens
aggaagagcugacccaucu

SEQ ID NO: 689504 - RNA, 19 nt, Homo sapiens
ccacacagaccacgaguuc

SEQ ID NO: 689505 - RNA, 19 nt, Homo sapiens
ccaaagaaaggaccagaga

SEQ ID NO: 689506 - RNA, 19 nt, Homo sapiens
gccagaagcaggaguguga

SEQ ID NO: 689507 - RNA, 19 nt, Homo sapiens
agaccuauguuccagaaga

SEQ ID NO: 689508 - RNA, 19 nt, Homo sapiens
ggagagcucacagacuuaa

SEQ ID NO: 689509 - RNA, 19 nt, Homo sapiens
cuggagagcucacagacuu

SEQ ID NO: 689510 - RNA, 19 nt, Homo sapiens
gcucccagcugaccagaca

SEQ ID NO: 689511 - RNA, 19 nt, Homo sapiens
ccacugaggacccguguga

SEQ ID NO: 689512 - RNA, 19 nt, Homo sapiens
aagacaaccaucacacuua

SEQ ID NO: 689513 - RNA, 19 nt, Homo sapiens
gaucagcgacugccacauc

SEQ ID NO: 689514 - RNA, 19 nt, Homo sapiens
cauggaauuuaacuccuaa

SEQ ID NO: 689515 - RNA, 19 nt, Homo sapiens
guucaaaacugacauuuag

SEQ ID NO: 689516 - RNA, 19 nt, Homo sapiens
gcauagcgaagaccaguau

SEQ ID NO: 689517 - RNA, 19 nt, Homo sapiens
gcuccuaugaugagagaua

SEQ ID NO: 689518 - RNA, 19 nt, Homo sapiens
gauaggagaauuccagagu

SEQ ID NO: 689519 - RNA, 19 nt, Homo sapiens
aaagaagccagcaccgaua

SEQ ID NO: 689520 - RNA, 19 nt, Homo sapiens
cgugaggccugcacagcua

SEQ ID NO: 689521 - RNA, 19 nt, Homo sapiens
gaccagccuucccaacaug

SEQ ID NO: 689522 - RNA, 19 nt, Homo sapiens
cuaaggagagcucugauug

SEQ ID NO: 689523 - RNA, 19 nt, Homo sapiens
acauugaggcugucuuuaa

SEQ ID NO: 689524 - RNA, 19 nt, Homo sapiens
agaacuacauugggauaaa

SEQ ID NO: 689525 - RNA, 19 nt, Homo sapiens
cuaggaagcagcugauuau

SEQ ID NO: 689526 - RNA, 19 nt, Homo sapiens
gggacaugcuauauuagug

SEQ ID NO: 689527 - RNA, 19 nt, Homo sapiens
agagagagcuagacagacu

SEQ ID NO: 689528 - RNA, 19 nt, Homo sapiens
caagaaagcaagucaacca

SEQ ID NO: 689529 - RNA, 19 nt, Homo sapiens
agccugacauggaauuuaa

SEQ ID NO: 689530 - RNA, 19 nt, Homo sapiens
gcagccagguggagguuag

SEQ ID NO: 689531 - RNA, 19 nt, Homo sapiens
gaucuauauuucuggugaa

SEQ ID NO: 689532 - RNA, 19 nt, Homo sapiens
aaaccacagccacuaagua

SEQ ID NO: 689533 - RNA, 19 nt, Homo sapiens
ugccgaagcuacuggacua

SEQ ID NO: 689534 - RNA, 19 nt, Homo sapiens
gcaguaccaucuacaucuc

SEQ ID NO: 689535 - RNA, 19 nt, Homo sapiens
ccauuaccaucucuaagga

SEQ ID NO: 689536 - RNA, 19 nt, Homo sapiens
ggucaucggcgacgaagug

SEQ ID NO: 689537 - RNA, 19 nt, Homo sapiens
uaaaugugaagaaggcuuu

SEQ ID NO: 689538 - RNA, 19 nt, Homo sapiens
aaugguggcuccuggaaug

SEQ ID NO: 689539 - RNA, 19 nt, Homo sapiens
uuugggaccugcuuuguga

SEQ ID NO: 689540 - RNA, 19 nt, Homo sapiens
caucggaauucagccauga

SEQ ID NO: 689541 - RNA, 19 nt, Homo sapiens
gaacagaguugugcugaua

SEQ ID NO: 689542 - RNA, 19 nt, Homo sapiens
ggaagaagcuugcugaguu

SEQ ID NO: 689543 - RNA, 19 nt, Homo sapiens
agaaagagcugaacaagaa

SEQ ID NO: 689544 - RNA, 19 nt, Homo sapiens
ggaagcagcugauuauuag

SEQ ID NO: 689545 - RNA, 19 nt, Homo sapiens
gagcagaccuucaucauca

SEQ ID NO: 689546 - RNA, 19 nt, Homo sapiens
gaagauuacuacaccgaua

SEQ ID NO: 689547 - RNA, 19 nt, Homo sapiens
gcaagucacccaucagaua

SEQ ID NO: 689548 - RNA, 19 nt, Homo sapiens
gcaauaggguggcacagaa

SEQ ID NO: 689549 - RNA, 19 nt, Homo sapiens
gcacaaagacacagacuug

SEQ ID NO: 689550 - RNA, 19 nt, Homo sapiens
cuacagagaucccacacua

SEQ ID NO: 689551 - RNA, 19 nt, Homo sapiens
gagcuugugugcccugaua

SEQ ID NO: 689552 - RNA, 19 nt, Homo sapiens
ggagcuaccuuccugugua

SEQ ID NO: 689553 - RNA, 19 nt, Homo sapiens
gaagaaggcuuuuaagaug

SEQ ID NO: 689554 - RNA, 19 nt, Homo sapiens
ggaaugaccugccaguaca

SEQ ID NO: 689555 - RNA, 19 nt, Homo sapiens
gcaagucaaccaaggaaua

SEQ ID NO: 689556 - RNA, 19 nt, Homo sapiens
gaagugagcgcaagcuuga

SEQ ID NO: 689557 - RNA, 19 nt, Homo sapiens
gaagauucaugcaggaaga

SEQ ID NO: 689558 - RNA, 19 nt, Homo sapiens
gaagaagcuugcugaguuc

SEQ ID NO: 689559 - RNA, 19 nt, Homo sapiens
gcagagaccaccacauuga

SEQ ID NO: 689560 - RNA, 19 nt, Homo sapiens
ccacacuacuuccggcuua

SEQ ID NO: 689561 - RNA, 19 nt, Homo sapiens
gaacuacauugggauaaau

SEQ ID NO: 689562 - RNA, 19 nt, Homo sapiens
ccucagagcuaacauaaag

SEQ ID NO: 689563 - RNA, 19 nt, Homo sapiens
ggccaaggcuccuaugaug

SEQ ID NO: 689564 - RNA, 19 nt, Homo sapiens
gagaugguguuuacucaga

SEQ ID NO: 689565 - RNA, 19 nt, Homo sapiens
ugaaauugguccaguuuau

SEQ ID NO: 689566 - RNA, 19 nt, Homo sapiens
ggaaaggccugaggaugug

SEQ ID NO: 689567 - RNA, 19 nt, Homo sapiens
ggagaccuauguuccagaa

SEQ ID NO: 689568 - RNA, 19 nt, Homo sapiens
aaacauugcccagggauua

SEQ ID NO: 689569 - RNA, 19 nt, Homo sapiens
gagagaugguguuuacuca

SEQ ID NO: 689570 - RNA, 19 nt, Homo sapiens
ggugaaaggcucaguagaa

SEQ ID NO: 689571 - RNA, 19 nt, Homo sapiens
cccgggacaugcuauauua

SEQ ID NO: 689572 - RNA, 19 nt, Homo sapiens
gcuaggaagcagcugauua

SEQ ID NO: 689573 - RNA, 19 nt, Homo sapiens
cagcagagaccaccacauu

SEQ ID NO: 689574 - RNA, 19 nt, Homo sapiens
gaagacaaccaucacacuu

SEQ ID NO: 689575 - RNA, 19 nt, Homo sapiens
ggaugaguuugaaauguug

SEQ ID NO: 689576 - RNA, 19 nt, Homo sapiens
cacagaagcucaucucagu

SEQ ID NO: 689577 - RNA, 19 nt, Homo sapiens
gagagcagcuggauuuuau

SEQ ID NO: 689578 - RNA, 19 nt, Homo sapiens
ggagaacuacauugggaua

SEQ ID NO: 689579 - RNA, 19 nt, Homo sapiens
gaagcuugcugaguucgaa

SEQ ID NO: 689580 - RNA, 19 nt, Homo sapiens
gagcuaccuuccuguguau

SEQ ID NO: 689581 - RNA, 19 nt, Homo sapiens
ggaauugggcagcugauug

SEQ ID NO: 689582 - RNA, 19 nt, Homo sapiens
ccaguacauuguccaguuu

SEQ ID NO: 689583 - RNA, 19 nt, Homo sapiens
agagagagaugguguuuac

SEQ ID NO: 689584 - RNA, 19 nt, Homo sapiens
gaccaacacuacagagauc

SEQ ID NO: 689585 - RNA, 19 nt, Homo sapiens
caaaacagccugagcaaaa

SEQ ID NO: 689586 - RNA, 19 nt, Homo sapiens
agacaaccaucacacuuau

SEQ ID NO: 689587 - RNA, 19 nt, Homo sapiens
gccaguacauuguccaguu

SEQ ID NO: 689588 - RNA, 19 nt, Homo sapiens
ccuaggcccucaugauuug

SEQ ID NO: 689589 - RNA, 19 nt, Homo sapiens
ugaguucgaagaugaguua

SEQ ID NO: 689590 - RNA, 19 nt, Homo sapiens
gaacccuucgccugaauaa

SEQ ID NO: 689591 - RNA, 19 nt, Homo sapiens
ggacugcaaguggccauua

SEQ ID NO: 689592 - RNA, 19 nt, Homo sapiens
gaaauugguccaguuuaug

SEQ ID NO: 689593 - RNA, 19 nt, Homo sapiens
ccacagccacuaaguaaau

SEQ ID NO: 689594 - RNA, 19 nt, Homo sapiens
gaagcacgauccgccaaug

SEQ ID NO: 689595 - RNA, 19 nt, Homo sapiens
gcccugagauccugcacaa

SEQ ID NO: 689596 - RNA, 19 nt, Homo sapiens
aggaagcagcugauuauua

SEQ ID NO: 689597 - RNA, 19 nt, Homo sapiens
caagucaaccaaggaauaa

SEQ ID NO: 689598 - RNA, 19 nt, Homo sapiens
gaagaaagagcugaacaag

SEQ ID NO: 689599 - RNA, 19 nt, Homo sapiens
ggaaguccuccuuguauuc

SEQ ID NO: 689600 - RNA, 19 nt, Homo sapiens
cgucucagcccuucaguuu

SEQ ID NO: 689601 - RNA, 19 nt, Homo sapiens
gcccagcacuucauacgau

SEQ ID NO: 689602 - RNA, 19 nt, Homo sapiens
ugaagagugucuccagaug

SEQ ID NO: 689603 - RNA, 19 nt, Homo sapiens
uggaugaguuugaaauguu

SEQ ID NO: 689604 - RNA, 19 nt, Homo sapiens
aggaagagcugacccaucu

SEQ ID NO: 689605 - RNA, 19 nt, Homo sapiens
ccaaagagccuaggaaagg

SEQ ID NO: 689606 - RNA, 19 nt, Homo sapiens
ccaaagaaaggaccagaga

SEQ ID NO: 689607 - RNA, 19 nt, Homo sapiens
gccagaagcaggaguguga

SEQ ID NO: 689608 - RNA, 19 nt, Homo sapiens
agaccuauguuccagaaga

SEQ ID NO: 689609 - RNA, 19 nt, Homo sapiens
ggagagcucacagacuuaa

SEQ ID NO: 689610 - RNA, 19 nt, Homo sapiens
cuggagagcucacagacuu

SEQ ID NO: 689611 - RNA, 19 nt, Homo sapiens
gcucccagcugaccagaca

SEQ ID NO: 689612 - RNA, 19 nt, Homo sapiens
ccacugaggacccguguga

SEQ ID NO: 689613 - RNA, 19 nt, Homo sapiens
aagacaaccaucacacuua

SEQ ID NO: 689614 - RNA, 19 nt, Homo sapiens
gaucagcgacugccacauc

SEQ ID NO: 689615 - RNA, 19 nt, Homo sapiens
ugcgacaacugccagauaa

SEQ ID NO: 689616 - RNA, 19 nt, Homo sapiens
cauggaauuuaacuccuaa

SEQ ID NO: 689617 - RNA, 19 nt, Homo sapiens
guucaaaacugacauuuag

SEQ ID NO: 689618 - RNA, 19 nt, Homo sapiens
gcauagcgaagaccaguau

SEQ ID NO: 689619 - RNA, 19 nt, Homo sapiens
gcuccuaugaugagagaua

SEQ ID NO: 689620 - RNA, 19 nt, Homo sapiens
gauaggagaauuccagagu

SEQ ID NO: 689621 - RNA, 19 nt, Homo sapiens
aaagaagccagcaccgaua

SEQ ID NO: 689622 - RNA, 19 nt, Homo sapiens
cgugaggccugcacagcua

SEQ ID NO: 689623 - RNA, 19 nt, Homo sapiens
gaccagccuucccaacaug

SEQ ID NO: 689624 - RNA, 19 nt, Homo sapiens
cuaaggagagcucugauug

SEQ ID NO: 689625 - RNA, 19 nt, Homo sapiens
acauugaggcugucuuuaa

SEQ ID NO: 689626 - RNA, 19 nt, Homo sapiens
agaacuacauugggauaaa

SEQ ID NO: 689627 - RNA, 19 nt, Homo sapiens
cuaggaagcagcugauuau

SEQ ID NO: 689628 - RNA, 19 nt, Homo sapiens
gggacaugcuauauuagug

SEQ ID NO: 689629 - RNA, 19 nt, Homo sapiens
agagagagcuagacagacu

SEQ ID NO: 689630 - RNA, 19 nt, Homo sapiens
caagaaagcaagucaacca

SEQ ID NO: 689631 - RNA, 19 nt, Homo sapiens
agccugacauggaauuuaa

SEQ ID NO: 689632 - RNA, 19 nt, Homo sapiens
gcagccagguggagguuag

SEQ ID NO: 689633 - RNA, 19 nt, Homo sapiens
gaucuauauuucuggugaa

SEQ ID NO: 689634 - RNA, 19 nt, Homo sapiens
aaaccacagccacuaagua

SEQ ID NO: 689635 - RNA, 19 nt, Homo sapiens
ugccgaagcuacuggacua

SEQ ID NO: 689636 - RNA, 19 nt, Homo sapiens
gcaguaccaucuacaucuc

SEQ ID NO: 689637 - RNA, 19 nt, Homo sapiens
ccauuaccaucucuaagga

SEQ ID NO: 689638 - RNA, 19 nt, Homo sapiens
uaaaugugaagaaggcuuu

SEQ ID NO: 689639 - RNA, 19 nt, Homo sapiens
aaugguggcuccuggaaug

SEQ ID NO: 689640 - RNA, 19 nt, Homo sapiens
ggucaucggcgacgaagug

SEQ ID NO: 689641 - RNA, 19 nt, Homo sapiens
gaacagaguugugcugaua

SEQ ID NO: 689642 - RNA, 19 nt, Homo sapiens
ggaagaagcuugcugaguu

SEQ ID NO: 689643 - RNA, 19 nt, Homo sapiens
agaaagagcugaacaagaa

SEQ ID NO: 689644 - RNA, 19 nt, Homo sapiens
ggaagcagcugauuauuag

SEQ ID NO: 689645 - RNA, 19 nt, Homo sapiens
gagcagaccuucaucauca

SEQ ID NO: 689646 - RNA, 19 nt, Homo sapiens
gaagauuacuacaccgaua

SEQ ID NO: 689647 - RNA, 19 nt, Homo sapiens
gcaagucacccaucagaua

SEQ ID NO: 689648 - RNA, 19 nt, Homo sapiens
gcaauaggguggcacagaa

SEQ ID NO: 689649 - RNA, 19 nt, Homo sapiens
gcacaaagacacagacuug

SEQ ID NO: 689650 - RNA, 19 nt, Homo sapiens
cuacagagaucccacacua

SEQ ID NO: 689651 - RNA, 19 nt, Homo sapiens
gagcuugugugcccugaua

SEQ ID NO: 689652 - RNA, 19 nt, Homo sapiens
ggagcuaccuuccugugua

SEQ ID NO: 689653 - RNA, 19 nt, Homo sapiens
gaagaaggcuuuuaagaug

SEQ ID NO: 689654 - RNA, 19 nt, Homo sapiens
ggaaugaccugccaguaca

SEQ ID NO: 689655 - RNA, 19 nt, Homo sapiens
gcaagucaaccaaggaaua

SEQ ID NO: 689656 - RNA, 19 nt, Homo sapiens
gaagugagcgcaagcuuga

SEQ ID NO: 689657 - RNA, 19 nt, Homo sapiens
gaagauucaugcaggaaga

SEQ ID NO: 689658 - RNA, 19 nt, Homo sapiens
gaagaagcuugcugaguuc

SEQ ID NO: 689659 - RNA, 19 nt, Homo sapiens
gcagagaccaccacauuga

SEQ ID NO: 689660 - RNA, 19 nt, Homo sapiens
ccacacuacuuccggcuua

SEQ ID NO: 689661 - RNA, 19 nt, Homo sapiens
gaacuacauugggauaaau

SEQ ID NO: 689662 - RNA, 19 nt, Homo sapiens
ccucagagcuaacauaaag

SEQ ID NO: 689663 - RNA, 19 nt, Homo sapiens
ggccaaggcuccuaugaug

SEQ ID NO: 689664 - RNA, 19 nt, Homo sapiens
gagaugguguuuacucaga

SEQ ID NO: 689665 - RNA, 19 nt, Homo sapiens
ugaaauugguccaguuuau

SEQ ID NO: 689666 - RNA, 19 nt, Homo sapiens
ggaaaggccugaggaugug

SEQ ID NO: 689667 - RNA, 19 nt, Homo sapiens
ggagaccuauguuccagaa

SEQ ID NO: 689668 - RNA, 19 nt, Homo sapiens
aaacauugcccagggauua

SEQ ID NO: 689669 - RNA, 19 nt, Homo sapiens
gagagaugguguuuacuca

SEQ ID NO: 689670 - RNA, 19 nt, Homo sapiens
ggugaaaggcucaguagaa

SEQ ID NO: 689671 - RNA, 19 nt, Homo sapiens
cccgggacaugcuauauua

SEQ ID NO: 689672 - RNA, 19 nt, Homo sapiens
gcuaggaagcagcugauua

SEQ ID NO: 689673 - RNA, 19 nt, Homo sapiens
cagcagagaccaccacauu

SEQ ID NO: 689674 - RNA, 19 nt, Homo sapiens
gaagacaaccaucacacuu

SEQ ID NO: 689675 - RNA, 19 nt, Homo sapiens
ggaugaguuugaaauguug

SEQ ID NO: 689676 - RNA, 19 nt, Homo sapiens
cacagaagcucaucucagu

SEQ ID NO: 689677 - RNA, 19 nt, Homo sapiens
gagagcagcuggauuuuau

SEQ ID NO: 689678 - RNA, 19 nt, Homo sapiens
ggagaacuacauugggaua

SEQ ID NO: 689679 - RNA, 19 nt, Homo sapiens
gaagcuugcugaguucgaa

SEQ ID NO: 689680 - RNA, 19 nt, Homo sapiens
gagcuaccuuccuguguau

SEQ ID NO: 689681 - RNA, 19 nt, Homo sapiens
ggaauugggcagcugauug

SEQ ID NO: 689682 - RNA, 19 nt, Homo sapiens
ccaguacauuguccaguuu

SEQ ID NO: 689683 - RNA, 19 nt, Homo sapiens
agagagagaugguguuuac

SEQ ID NO: 689684 - RNA, 19 nt, Homo sapiens
gaccaacacuacagagauc

SEQ ID NO: 689685 - RNA, 19 nt, Homo sapiens
caaaacagccugagcaaaa

SEQ ID NO: 689686 - RNA, 19 nt, Homo sapiens
agacaaccaucacacuuau

SEQ ID NO: 689687 - RNA, 19 nt, Homo sapiens
gccaguacauuguccaguu

SEQ ID NO: 689688 - RNA, 19 nt, Homo sapiens
ccuaggcccucaugauuug

SEQ ID NO: 689689 - RNA, 19 nt, Homo sapiens
ugaguucgaagaugaguua

SEQ ID NO: 689690 - RNA, 19 nt, Homo sapiens
gaacccuucgccugaauaa

SEQ ID NO: 689691 - RNA, 19 nt, Homo sapiens
ggacugcaaguggccauua

SEQ ID NO: 689692 - RNA, 19 nt, Homo sapiens
gaaauugguccaguuuaug

SEQ ID NO: 689693 - RNA, 19 nt, Homo sapiens
ccacagccacuaaguaaau

SEQ ID NO: 689694 - RNA, 19 nt, Homo sapiens
gcccugagauccugcacaa

SEQ ID NO: 689695 - RNA, 19 nt, Homo sapiens
aggaagcagcugauuauua

SEQ ID NO: 689696 - RNA, 19 nt, Homo sapiens
caagucaaccaaggaauaa

SEQ ID NO: 689697 - RNA, 19 nt, Homo sapiens
gaagaaagagcugaacaag

SEQ ID NO: 689698 - RNA, 19 nt, Homo sapiens
ggaaguccuccuuguauuc

SEQ ID NO: 689699 - RNA, 19 nt, Homo sapiens
cgucucagcccuucaguuu

SEQ ID NO: 689700 - RNA, 19 nt, Homo sapiens
gcccagcacuucauacgau

SEQ ID NO: 689701 - RNA, 19 nt, Homo sapiens
ugaagagugucuccagaug

SEQ ID NO: 689702 - RNA, 19 nt, Homo sapiens
uggaugaguuugaaauguu

SEQ ID NO: 689703 - RNA, 19 nt, Homo sapiens
aggaagagcugacccaucu

SEQ ID NO: 689704 - RNA, 19 nt, Homo sapiens
ccacacagaccacgaguuc

SEQ ID NO: 689705 - RNA, 19 nt, Homo sapiens
ccaaagagccuaggaaagg

SEQ ID NO: 689706 - RNA, 19 nt, Homo sapiens
ccaaagaaaggaccagaga

SEQ ID NO: 689707 - RNA, 19 nt, Homo sapiens
gccagaagcaggaguguga

SEQ ID NO: 689708 - RNA, 19 nt, Homo sapiens
agaccuauguuccagaaga

SEQ ID NO: 689709 - RNA, 19 nt, Homo sapiens
ggagagcucacagacuuaa

SEQ ID NO: 689710 - RNA, 19 nt, Homo sapiens
cuggagagcucacagacuu

SEQ ID NO: 689711 - RNA, 19 nt, Homo sapiens
gcucccagcugaccagaca

SEQ ID NO: 689712 - RNA, 19 nt, Homo sapiens
ccacugaggacccguguga

SEQ ID NO: 689713 - RNA, 19 nt, Homo sapiens
aagacaaccaucacacuua

SEQ ID NO: 689714 - RNA, 19 nt, Homo sapiens
gaucagcgacugccacauc

SEQ ID NO: 689715 - RNA, 19 nt, Homo sapiens
ugcgacaacugccagauaa

SEQ ID NO: 689716 - RNA, 19 nt, Homo sapiens
cauggaauuuaacuccuaa

SEQ ID NO: 689717 - RNA, 19 nt, Homo sapiens
guucaaaacugacauuuag

SEQ ID NO: 689718 - RNA, 19 nt, Homo sapiens
gcauagcgaagaccaguau

SEQ ID NO: 689719 - RNA, 19 nt, Homo sapiens
gcuccuaugaugagagaua

SEQ ID NO: 689720 - RNA, 19 nt, Homo sapiens
gauaggagaauuccagagu

SEQ ID NO: 689721 - RNA, 19 nt, Homo sapiens
aaagaagccagcaccgaua

SEQ ID NO: 689722 - RNA, 19 nt, Homo sapiens
cgugaggccugcacagcua

SEQ ID NO: 689723 - RNA, 19 nt, Homo sapiens
gaccagccuucccaacaug

SEQ ID NO: 689724 - RNA, 19 nt, Homo sapiens
cuaaggagagcucugauug

SEQ ID NO: 689725 - RNA, 19 nt, Homo sapiens
acauugaggcugucuuuaa

SEQ ID NO: 689726 - RNA, 19 nt, Homo sapiens
agaacuacauugggauaaa

SEQ ID NO: 689727 - RNA, 19 nt, Homo sapiens
cuaggaagcagcugauuau

SEQ ID NO: 689728 - RNA, 19 nt, Homo sapiens
gggacaugcuauauuagug

SEQ ID NO: 689729 - RNA, 19 nt, Homo sapiens
agagagagcuagacagacu

SEQ ID NO: 689730 - RNA, 19 nt, Homo sapiens
caagaaagcaagucaacca

SEQ ID NO: 689731 - RNA, 19 nt, Homo sapiens
agccugacauggaauuuaa

SEQ ID NO: 689732 - RNA, 19 nt, Homo sapiens
gcagccagguggagguuag

SEQ ID NO: 689733 - RNA, 19 nt, Homo sapiens
gaucuauauuucuggugaa

SEQ ID NO: 689734 - RNA, 19 nt, Homo sapiens
aaaccacagccacuaagua

SEQ ID NO: 689735 - RNA, 19 nt, Homo sapiens
ugccgaagcuacuggacua

SEQ ID NO: 689736 - RNA, 19 nt, Homo sapiens
ggucaucggcgacgaagug

SEQ ID NO: 689737 - RNA, 19 nt, Homo sapiens
gcaguaccaucuacaucuc

SEQ ID NO: 689738 - RNA, 19 nt, Homo sapiens
ccauuaccaucucuaagga

SEQ ID NO: 689739 - RNA, 19 nt, Homo sapiens
uaaaugugaagaaggcuuu

SEQ ID NO: 689740 - RNA, 19 nt, Homo sapiens
aaugguggcuccuggaaug

SEQ ID NO: 689741 - RNA, 19 nt, Homo sapiens
gaacagaguugugcugaua

SEQ ID NO: 689742 - RNA, 19 nt, Homo sapiens
ggaagaagcuugcugaguu

SEQ ID NO: 689743 - RNA, 19 nt, Homo sapiens
agaaagagcugaacaagaa

SEQ ID NO: 689744 - RNA, 19 nt, Homo sapiens
ggaagcagcugauuauuag

SEQ ID NO: 689745 - RNA, 19 nt, Homo sapiens
gagcagaccuucaucauca

SEQ ID NO: 689746 - RNA, 19 nt, Homo sapiens
gaagauuacuacaccgaua

SEQ ID NO: 689747 - RNA, 19 nt, Homo sapiens
gcaagucacccaucagaua

SEQ ID NO: 689748 - RNA, 19 nt, Homo sapiens
gcaauaggguggcacagaa

SEQ ID NO: 689749 - RNA, 19 nt, Homo sapiens
gcacaaagacacagacuug

SEQ ID NO: 689750 - RNA, 19 nt, Homo sapiens
cuacagagaucccacacua

SEQ ID NO: 689751 - RNA, 19 nt, Homo sapiens
gagcuugugugcccugaua

SEQ ID NO: 689752 - RNA, 19 nt, Homo sapiens
ggagcuaccuuccugugua

SEQ ID NO: 689753 - RNA, 19 nt, Homo sapiens
gaagaaggcuuuuaagaug

SEQ ID NO: 689754 - RNA, 19 nt, Homo sapiens
ggaaugaccugccaguaca

SEQ ID NO: 689755 - RNA, 19 nt, Homo sapiens
gcaagucaaccaaggaaua

SEQ ID NO: 689756 - RNA, 19 nt, Homo sapiens
gaagugagcgcaagcuuga

SEQ ID NO: 689757 - RNA, 19 nt, Homo sapiens
gaagauucaugcaggaaga

SEQ ID NO: 689758 - RNA, 19 nt, Homo sapiens
gaagaagcuugcugaguuc

SEQ ID NO: 689759 - RNA, 19 nt, Homo sapiens
gcagagaccaccacauuga

SEQ ID NO: 689760 - RNA, 19 nt, Homo sapiens
ccacacuacuuccggcuua

SEQ ID NO: 689761 - RNA, 19 nt, Homo sapiens
gaacuacauugggauaaau

SEQ ID NO: 689762 - RNA, 19 nt, Homo sapiens
ccucagagcuaacauaaag

SEQ ID NO: 689763 - RNA, 19 nt, Homo sapiens
ggccaaggcuccuaugaug

SEQ ID NO: 689764 - RNA, 19 nt, Homo sapiens
gagaugguguuuacucaga

SEQ ID NO: 689765 - RNA, 19 nt, Homo sapiens
ugaaauugguccaguuuau

SEQ ID NO: 689766 - RNA, 19 nt, Homo sapiens
ggaaaggccugaggaugug

SEQ ID NO: 689767 - RNA, 19 nt, Homo sapiens
ggagaccuauguuccagaa

SEQ ID NO: 689768 - RNA, 19 nt, Homo sapiens
aaacauugcccagggauua

SEQ ID NO: 689769 - RNA, 19 nt, Homo sapiens
gagagaugguguuuacuca

SEQ ID NO: 689770 - RNA, 19 nt, Homo sapiens
ggugaaaggcucaguagaa

SEQ ID NO: 689771 - RNA, 19 nt, Homo sapiens
cccgggacaugcuauauua

SEQ ID NO: 689772 - RNA, 19 nt, Homo sapiens
gcuaggaagcagcugauua

SEQ ID NO: 689773 - RNA, 19 nt, Homo sapiens
cagcagagaccaccacauu

SEQ ID NO: 689774 - RNA, 19 nt, Homo sapiens
gaagacaaccaucacacuu

SEQ ID NO: 689775 - RNA, 19 nt, Homo sapiens
ggaugaguuugaaauguug

SEQ ID NO: 689776 - RNA, 19 nt, Homo sapiens
cacagaagcucaucucagu

SEQ ID NO: 689777 - RNA, 19 nt, Homo sapiens
gagagcagcuggauuuuau

SEQ ID NO: 689778 - RNA, 19 nt, Homo sapiens
ggagaacuacauugggaua

SEQ ID NO: 689779 - RNA, 19 nt, Homo sapiens
gaagcuugcugaguucgaa

SEQ ID NO: 689780 - RNA, 19 nt, Homo sapiens
gagcuaccuuccuguguau

SEQ ID NO: 689781 - RNA, 19 nt, Homo sapiens
ggaauugggcagcugauug

SEQ ID NO: 689782 - RNA, 19 nt, Homo sapiens
ccaguacauuguccaguuu

SEQ ID NO: 689783 - RNA, 19 nt, Homo sapiens
agagagagaugguguuuac

SEQ ID NO: 689784 - RNA, 19 nt, Homo sapiens
gaccaacacuacagagauc

SEQ ID NO: 689785 - RNA, 19 nt, Homo sapiens
caaaacagccugagcaaaa

SEQ ID NO: 689786 - RNA, 19 nt, Homo sapiens
agacaaccaucacacuuau

SEQ ID NO: 689787 - RNA, 19 nt, Homo sapiens
gccaguacauuguccaguu

SEQ ID NO: 689788 - RNA, 19 nt, Homo sapiens
ccuaggcccucaugauuug

SEQ ID NO: 689789 - RNA, 19 nt, Homo sapiens
ugaguucgaagaugaguua

SEQ ID NO: 689790 - RNA, 19 nt, Homo sapiens
gaacccuucgccugaauaa

SEQ ID NO: 689791 - RNA, 19 nt, Homo sapiens
ggacugcaaguggccauua

SEQ ID NO: 689792 - RNA, 19 nt, Homo sapiens
gaaauugguccaguuuaug

SEQ ID NO: 689793 - RNA, 19 nt, Homo sapiens
ccacagccacuaaguaaau

SEQ ID NO: 689794 - RNA, 19 nt, Homo sapiens
gaagcacgauccgccaaug

SEQ ID NO: 689795 - RNA, 19 nt, Homo sapiens
gcccugagauccugcacaa

SEQ ID NO: 689796 - RNA, 19 nt, Homo sapiens
aggaagcagcugauuauua

SEQ ID NO: 689797 - RNA, 19 nt, Homo sapiens
caagucaaccaaggaauaa

SEQ ID NO: 689798 - RNA, 19 nt, Homo sapiens
gaagaaagagcugaacaag

SEQ ID NO: 689799 - RNA, 19 nt, Homo sapiens
ggaaguccuccuuguauuc

SEQ ID NO: 689800 - RNA, 19 nt, Homo sapiens
cgucucagcccuucaguuu

SEQ ID NO: 689801 - RNA, 19 nt, Homo sapiens
gcccagcacuucauacgau

SEQ ID NO: 689802 - RNA, 19 nt, Homo sapiens
ugaagagugucuccagaug

SEQ ID NO: 689803 - RNA, 19 nt, Homo sapiens
uggaugaguuugaaauguu

SEQ ID NO: 689804 - RNA, 19 nt, Homo sapiens
aggaagagcugacccaucu

SEQ ID NO: 689805 - RNA, 19 nt, Homo sapiens
ccacacagaccacgaguuc

SEQ ID NO: 689806 - RNA, 19 nt, Homo sapiens
ccaaagagccuaggaaagg

SEQ ID NO: 689807 - RNA, 19 nt, Homo sapiens
ccaaagaaaggaccagaga

SEQ ID NO: 689808 - RNA, 19 nt, Homo sapiens
gccagaagcaggaguguga

SEQ ID NO: 689809 - RNA, 19 nt, Homo sapiens
agaccuauguuccagaaga

SEQ ID NO: 689810 - RNA, 19 nt, Homo sapiens
ggagagcucacagacuuaa

SEQ ID NO: 689811 - RNA, 19 nt, Homo sapiens
cuggagagcucacagacuu

SEQ ID NO: 689812 - RNA, 19 nt, Homo sapiens
gcucccagcugaccagaca

SEQ ID NO: 689813 - RNA, 19 nt, Homo sapiens
ccacugaggacccguguga

SEQ ID NO: 689814 - RNA, 19 nt, Homo sapiens
aagacaaccaucacacuua

SEQ ID NO: 689815 - RNA, 19 nt, Homo sapiens
gaucagcgacugccacauc

SEQ ID NO: 689816 - RNA, 19 nt, Homo sapiens
ugcgacaacugccagauaa

SEQ ID NO: 689817 - RNA, 19 nt, Homo sapiens
cauggaauuuaacuccuaa

SEQ ID NO: 689818 - RNA, 19 nt, Homo sapiens
guucaaaacugacauuuag

SEQ ID NO: 689819 - RNA, 19 nt, Homo sapiens
gcauagcgaagaccaguau

SEQ ID NO: 689820 - RNA, 19 nt, Homo sapiens
gcuccuaugaugagagaua

SEQ ID NO: 689821 - RNA, 19 nt, Homo sapiens
gauaggagaauuccagagu

SEQ ID NO: 689822 - RNA, 19 nt, Homo sapiens
aaagaagccagcaccgaua

SEQ ID NO: 689823 - RNA, 19 nt, Homo sapiens
cgugaggccugcacagcua

SEQ ID NO: 689824 - RNA, 19 nt, Homo sapiens
gaccagccuucccaacaug

SEQ ID NO: 689825 - RNA, 19 nt, Homo sapiens
cuaaggagagcucugauug

SEQ ID NO: 689826 - RNA, 19 nt, Homo sapiens
acauugaggcugucuuuaa

SEQ ID NO: 689827 - RNA, 19 nt, Homo sapiens
agaacuacauugggauaaa

SEQ ID NO: 689828 - RNA, 19 nt, Homo sapiens
cuaggaagcagcugauuau

SEQ ID NO: 689829 - RNA, 19 nt, Homo sapiens
gggacaugcuauauuagug

SEQ ID NO: 689830 - RNA, 19 nt, Homo sapiens
agagagagcuagacagacu

SEQ ID NO: 689831 - RNA, 19 nt, Homo sapiens
caagaaagcaagucaacca

SEQ ID NO: 689832 - RNA, 19 nt, Homo sapiens
agccugacauggaauuuaa

SEQ ID NO: 689833 - RNA, 19 nt, Homo sapiens
gcagccagguggagguuag

SEQ ID NO: 689834 - RNA, 19 nt, Homo sapiens
augguuggaucauguauuu

SEQ ID NO: 689835 - RNA, 19 nt, Homo sapiens
gaucuauauuucuggugaa

SEQ ID NO: 689836 - RNA, 19 nt, Homo sapiens
aaaccacagccacuaagua

SEQ ID NO: 689837 - RNA, 19 nt, Homo sapiens
ugccgaagcuacuggacua

SEQ ID NO: 689838 - RNA, 19 nt, Homo sapiens
gcaguaccaucuacaucuc

SEQ ID NO: 689839 - RNA, 19 nt, Homo sapiens
ccauuaccaucucuaagga

SEQ ID NO: 689840 - RNA, 19 nt, Homo sapiens
uaaaugugaagaaggcuuu

SEQ ID NO: 689841 - RNA, 19 nt, Homo sapiens
uagaagaacucaaagcuaa

SEQ ID NO: 689842 - RNA, 19 nt, Homo sapiens
caauuuggauucccuuuaa

SEQ ID NO: 689843 - RNA, 19 nt, Homo sapiens
ccuguaagcuccuggauuu

SEQ ID NO: 689844 - RNA, 19 nt, Homo sapiens
uaagaaagccauccuaguu

SEQ ID NO: 689845 - RNA, 19 nt, Homo sapiens
ugaaccagaugauuacuuu

SEQ ID NO: 689846 - RNA, 19 nt, Homo sapiens
ggaacagaauagaaaugua

SEQ ID NO: 689847 - RNA, 19 nt, Homo sapiens
caaugaagauuauguugga

SEQ ID NO: 689848 - RNA, 19 nt, Homo sapiens
caagauggcuaucaagagu

SEQ ID NO: 689849 - RNA, 19 nt, Homo sapiens
gaagcuagaagaacucaaa

SEQ ID NO: 689850 - RNA, 19 nt, Homo sapiens
acaguggaauccuaaauuu

SEQ ID NO: 689851 - RNA, 19 nt, Homo sapiens
ccagaugauuacuuuauga

SEQ ID NO: 689852 - RNA, 19 nt, Homo sapiens
gaacagaauagaaauguac

SEQ ID NO: 689853 - RNA, 19 nt, Homo sapiens
gaacauauuuccaaaagca

SEQ ID NO: 689854 - RNA, 19 nt, Homo sapiens
gaguucaccuuguacuuga

SEQ ID NO: 689855 - RNA, 19 nt, Homo sapiens
uagaggcgauggaaagaaa

SEQ ID NO: 689856 - RNA, 19 nt, Homo sapiens
cagaaagguuugaagaugu

SEQ ID NO: 689857 - RNA, 19 nt, Homo sapiens
gcugaaaccuuuuaccuuu

SEQ ID NO: 689858 - RNA, 19 nt, Homo sapiens
caaagcgggugccuagaug

SEQ ID NO: 689859 - RNA, 19 nt, Homo sapiens
ggagugcggugguggaauc

SEQ ID NO: 689860 - RNA, 19 nt, Homo sapiens
gaagauguuugggugguau

SEQ ID NO: 689861 - RNA, 19 nt, Homo sapiens
cuaaucacgcuuugucuua

SEQ ID NO: 689862 - RNA, 19 nt, Homo sapiens
gcagacagaaagcauugua

SEQ ID NO: 689863 - RNA, 19 nt, Homo sapiens
acagaaagguuugaagaug

SEQ ID NO: 689864 - RNA, 19 nt, Homo sapiens
gugcggugguggaaucaua

SEQ ID NO: 689865 - RNA, 19 nt, Homo sapiens
gaccuuaccucagacuaga

SEQ ID NO: 689866 - RNA, 19 nt, Homo sapiens
aagaaacaguggaauccua

SEQ ID NO: 689867 - RNA, 19 nt, Homo sapiens
ccucaaacuucugggcuua

SEQ ID NO: 689868 - RNA, 19 nt, Homo sapiens
aagcaggcaugcccucuuu

SEQ ID NO: 689869 - RNA, 19 nt, Homo sapiens
gaagaaugcagagauugaa

SEQ ID NO: 689870 - RNA, 19 nt, Homo sapiens
gcaaagcgggugccuagau

SEQ ID NO: 689871 - RNA, 19 nt, Homo sapiens
acuaguggcuuugcuuuaa

SEQ ID NO: 689872 - RNA, 19 nt, Homo sapiens
agaagaagcuagaagaacu

SEQ ID NO: 689873 - RNA, 19 nt, Homo sapiens
agauugaaccagaugauua

SEQ ID NO: 689874 - RNA, 19 nt, Homo sapiens
agaaagguuugaagauguu

SEQ ID NO: 689875 - RNA, 19 nt, Homo sapiens
gaaccagaugauuacuuua

SEQ ID NO: 689876 - RNA, 19 nt, Homo sapiens
gucgagagcugacagaaag

SEQ ID NO: 689877 - RNA, 19 nt, Homo sapiens
gcagucaggaacccagaua

SEQ ID NO: 689878 - RNA, 19 nt, Homo sapiens
ggaguucaccuuguacuug

SEQ ID NO: 689879 - RNA, 19 nt, Homo sapiens
cgcagaagcucaguaucua

SEQ ID NO: 689880 - RNA, 19 nt, Homo sapiens
ugacagaaagguuugaaga

SEQ ID NO: 689881 - RNA, 19 nt, Homo sapiens
cagcaggaaauaacaaauu

SEQ ID NO: 689882 - RNA, 19 nt, Homo sapiens
ggugguaucugggccuuug

SEQ ID NO: 689883 - RNA, 19 nt, Homo sapiens
agaaaaggcugucuuggaa

SEQ ID NO: 689884 - RNA, 19 nt, Homo sapiens
uuaacugaauuccaaguga

SEQ ID NO: 689885 - RNA, 19 nt, Homo sapiens
uggaaaagaucauggaaaa

SEQ ID NO: 689886 - RNA, 19 nt, Homo sapiens
aagaaagccauccuaguuu

SEQ ID NO: 689887 - RNA, 19 nt, Homo sapiens
ucaggaacccagauaagaa

SEQ ID NO: 689888 - RNA, 19 nt, Homo sapiens
ugaagaaugcagagauuga

SEQ ID NO: 689889 - RNA, 19 nt, Homo sapiens
gacagaaagcauuguaaau

SEQ ID NO: 689890 - RNA, 19 nt, Homo sapiens
agacagaaagcauuguaaa

SEQ ID NO: 689891 - RNA, 19 nt, Homo sapiens
caguggaauccuaaauuua

SEQ ID NO: 689892 - RNA, 19 nt, Homo sapiens
ugucauaccgucuguaaug

SEQ ID NO: 689893 - RNA, 19 nt, Homo sapiens
ccuuugaccuuaccucaga

SEQ ID NO: 689894 - RNA, 19 nt, Homo sapiens
gcuaugagaagaagcuaga

SEQ ID NO: 689895 - RNA, 19 nt, Homo sapiens
uccaggaguucaccuugua

SEQ ID NO: 689896 - RNA, 19 nt, Homo sapiens
gugccuagauggguucuug

SEQ ID NO: 689897 - RNA, 19 nt, Homo sapiens
cuaguggcuuugcuuuaaa

SEQ ID NO: 689898 - RNA, 19 nt, Homo sapiens
ggauggaucugcagaaaag

SEQ ID NO: 689899 - RNA, 19 nt, Homo sapiens
cuucugggcuuaagcaauc

SEQ ID NO: 689900 - RNA, 19 nt, Homo sapiens
cacuauagccucaaacuuc

SEQ ID NO: 689901 - RNA, 19 nt, Homo sapiens
gagauugaaccagaugauu

SEQ ID NO: 689902 - RNA, 19 nt, Homo sapiens
uaaucacgcuuugucuuau

SEQ ID NO: 689903 - RNA, 19 nt, Homo sapiens
guggaauccuaaauuuaug

SEQ ID NO: 689904 - RNA, 19 nt, Homo sapiens
caggaacccagauaagaaa

SEQ ID NO: 689905 - RNA, 19 nt, Homo sapiens
gcaagauggcuaucaagag

SEQ ID NO: 689906 - RNA, 19 nt, Homo sapiens
cuugaagaaugcagagauu

SEQ ID NO: 689907 - RNA, 19 nt, Homo sapiens
gaaacaguggaauccuaaa

SEQ ID NO: 689908 - RNA, 19 nt, Homo sapiens
agaaacaguggaauccuaa

SEQ ID NO: 689909 - RNA, 19 nt, Homo sapiens
uccaggaccuagagaaguu

SEQ ID NO: 689910 - RNA, 19 nt, Homo sapiens
acaauuuggauucccuuua

SEQ ID NO: 689911 - RNA, 19 nt, Homo sapiens
ccggauggaucugcagaaa

SEQ ID NO: 689912 - RNA, 19 nt, Homo sapiens
uuggauagaacuagugaua

SEQ ID NO: 689913 - RNA, 19 nt, Homo sapiens
ugaagauguuuggguggua

SEQ ID NO: 689914 - RNA, 19 nt, Homo sapiens
cuagaagaacucaaagcua

SEQ ID NO: 689915 - RNA, 19 nt, Homo sapiens
gacagaaagguuugaagau

SEQ ID NO: 689916 - RNA, 19 nt, Homo sapiens
ugaagauuauguuggaagu

SEQ ID NO: 689917 - RNA, 19 nt, Homo sapiens
ggcaagauggcuaucaaga

SEQ ID NO: 689918 - RNA, 19 nt, Homo sapiens
ugagaagaagcuagaagaa

SEQ ID NO: 689919 - RNA, 19 nt, Homo sapiens
gcagagauugaaccagaug

SEQ ID NO: 689920 - RNA, 19 nt, Homo sapiens
gcaguccccucacaccuuu

SEQ ID NO: 689921 - RNA, 19 nt, Homo sapiens
gcaggcaugcccucuuuag

SEQ ID NO: 689922 - RNA, 19 nt, Homo sapiens
gagcugacagaaagguuug

SEQ ID NO: 689923 - RNA, 19 nt, Homo sapiens
agauggcuaucaagaguau

SEQ ID NO: 689924 - RNA, 19 nt, Homo sapiens
gaagcaggcaugcccucuu

SEQ ID NO: 689925 - RNA, 19 nt, Homo sapiens
agaaagccauccuaguuuu

SEQ ID NO: 689926 - RNA, 19 nt, Homo sapiens
gcucuguggacaccuguaa

SEQ ID NO: 689927 - RNA, 19 nt, Homo sapiens
uaucugggccuuugaccuu

SEQ ID NO: 689928 - RNA, 19 nt, Homo sapiens
ccaucacccucagcuacua

SEQ ID NO: 689929 - RNA, 19 nt, Homo sapiens
gagaagaagcuagaagaac

SEQ ID NO: 689930 - RNA, 19 nt, Homo sapiens
gaaaagaucauggaaaacu

SEQ ID NO: 689931 - RNA, 19 nt, Homo sapiens
gaagaacucaaagcuaagg

SEQ ID NO: 689932 - RNA, 19 nt, Homo sapiens
gaagaagcuagaagaacuc

SEQ ID NO: 689933 - RNA, 19 nt, Homo sapiens
gauugaaccagaugauuac

SEQ ID NO: 689934 - RNA, 19 nt, Homo sapiens
uuacacuaaucacgcuuug

SEQ ID NO: 689935 - RNA, 19 nt, Homo sapiens
cauaccgucuguaaugaag

SEQ ID NO: 689936 - RNA, 19 nt, Homo sapiens
gcuaaggagcagucaggaa

SEQ ID NO: 689937 - RNA, 19 nt, Homo sapiens
gauugaaggagcccgauca

SEQ ID NO: 689938 - RNA, 19 nt, Homo sapiens
acauugugccucaggauuu

SEQ ID NO: 689939 - RNA, 19 nt, Homo sapiens
aaacaguggaauccuaaau

SEQ ID NO: 689940 - RNA, 19 nt, Homo sapiens
uuaaagaaacaguggaauc

SEQ ID NO: 689941 - RNA, 19 nt, Homo sapiens
ugacugaacuugggaaaua

SEQ ID NO: 689942 - RNA, 19 nt, Homo sapiens
gaagagaacugacugaacu

SEQ ID NO: 689943 - RNA, 19 nt, Homo sapiens
gaagccaucuugaaaguga

SEQ ID NO: 689944 - RNA, 19 nt, Homo sapiens
ggaggagcaucucacaaua

SEQ ID NO: 689945 - RNA, 19 nt, Homo sapiens
ugacagagaucuuccagaa

SEQ ID NO: 689946 - RNA, 19 nt, Homo sapiens
gaaauuauuggacgucaua

SEQ ID NO: 689947 - RNA, 19 nt, Homo sapiens
acagagaucuuccagaauu

SEQ ID NO: 689948 - RNA, 19 nt, Homo sapiens
gcaaaagccucuauagaaa

SEQ ID NO: 689949 - RNA, 19 nt, Homo sapiens
gaaagugagugguguccuu

SEQ ID NO: 689950 - RNA, 19 nt, Homo sapiens
ccaaaggcaucacuucuga

SEQ ID NO: 689951 - RNA, 19 nt, Homo sapiens
gcucaggacuccagcuaaa

SEQ ID NO: 689952 - RNA, 19 nt, Homo sapiens
ugaagaaguugugucauuu

SEQ ID NO: 689953 - RNA, 19 nt, Homo sapiens
ccacaaaccgugacccaua

SEQ ID NO: 689954 - RNA, 19 nt, Homo sapiens
cagcacaucugcaugaaga

SEQ ID NO: 689955 - RNA, 19 nt, Homo sapiens
gaacagaugugcccuuuuc

SEQ ID NO: 689956 - RNA, 19 nt, Homo sapiens
gcacugcaguccacagaga

SEQ ID NO: 689957 - RNA, 19 nt, Homo sapiens
gcaagagguuaaagauaau

SEQ ID NO: 689958 - RNA, 19 nt, Homo sapiens
agcaagagguuaaagauaa

SEQ ID NO: 689959 - RNA, 19 nt, Homo sapiens
gaaguugugucauuucucu

SEQ ID NO: 689960 - RNA, 19 nt, Homo sapiens
uauagaaaguccucuguga

SEQ ID NO: 689961 - RNA, 19 nt, Homo sapiens
aaacucacuuggcauaauu

SEQ ID NO: 689962 - RNA, 19 nt, Homo sapiens
gaugaaaggcgcaaaggaa

SEQ ID NO: 689963 - RNA, 19 nt, Homo sapiens
gcaguccacuugcugaaga

SEQ ID NO: 689964 - RNA, 19 nt, Homo sapiens
gacggucacuucuccagua

SEQ ID NO: 689965 - RNA, 19 nt, Homo sapiens
acuaaacacuucaacauga

SEQ ID NO: 689966 - RNA, 19 nt, Homo sapiens
ccacaagguugcagcauuc

SEQ ID NO: 689967 - RNA, 19 nt, Homo sapiens
gaaugaauuuguugcagau

SEQ ID NO: 689968 - RNA, 19 nt, Homo sapiens
ggucacuucuccaguacua

SEQ ID NO: 689969 - RNA, 19 nt, Homo sapiens
gaacaccagagaucagaaa

SEQ ID NO: 689970 - RNA, 19 nt, Homo sapiens
caccagagaucagaaauuc

SEQ ID NO: 689971 - RNA, 19 nt, Homo sapiens
ucacauacagagagaauuu

SEQ ID NO: 689972 - RNA, 19 nt, Homo sapiens
gaugauacagguaagauug

SEQ ID NO: 689973 - RNA, 19 nt, Homo sapiens
cugaagaaguugugucauu

SEQ ID NO: 689974 - RNA, 19 nt, Homo sapiens
gaggcagaauuaaagcuaa

SEQ ID NO: 689975 - RNA, 19 nt, Homo sapiens
gguaaagguuguugcuguu

SEQ ID NO: 689976 - RNA, 19 nt, Homo sapiens
gagagaagauccgcaacga

SEQ ID NO: 689977 - RNA, 19 nt, Homo sapiens
gaaaagaugauacagguaa

SEQ ID NO: 689978 - RNA, 19 nt, Homo sapiens
ggacucaaaucagcagaau

SEQ ID NO: 689979 - RNA, 19 nt, Homo sapiens
caagaggauucacgcagaa

SEQ ID NO: 689980 - RNA, 19 nt, Homo sapiens
gaagcaagagguuaaagau

SEQ ID NO: 689981 - RNA, 19 nt, Homo sapiens
gaauuucuuuggucaguag

SEQ ID NO: 689982 - RNA, 19 nt, Homo sapiens
gaaaauagauauggucaca

SEQ ID NO: 689983 - RNA, 19 nt, Homo sapiens
cuacaagcauauaugagaa

SEQ ID NO: 689984 - RNA, 19 nt, Homo sapiens
ggaagcaagagguuaaaga

SEQ ID NO: 689985 - RNA, 19 nt, Homo sapiens
ggaaggggcuuagaaaaug

SEQ ID NO: 689986 - RNA, 19 nt, Homo sapiens
acugggauauguccaauaa

SEQ ID NO: 689987 - RNA, 19 nt, Homo sapiens
gcuacaagcauauaugaga

SEQ ID NO: 689988 - RNA, 19 nt, Homo sapiens
uaaagguuguugcuguuga

SEQ ID NO: 689989 - RNA, 19 nt, Homo sapiens
caaaggaagcaagagguua

SEQ ID NO: 689990 - RNA, 19 nt, Homo sapiens
gcaaaggaagcaagagguu

SEQ ID NO: 689991 - RNA, 19 nt, Homo sapiens
ggacuccagcuaaaucaaa

SEQ ID NO: 689992 - RNA, 19 nt, Homo sapiens
caaacucacuuggcauaau

SEQ ID NO: 689993 - RNA, 19 nt, Homo sapiens
caacagcaagcccaagauu

SEQ ID NO: 689994 - RNA, 19 nt, Homo sapiens
gggauccacuucucuguuc

SEQ ID NO: 689995 - RNA, 19 nt, Homo sapiens
gaucaccccugaaauuauu

SEQ ID NO: 689996 - RNA, 19 nt, Homo sapiens
gauuggaacucaugaagac

SEQ ID NO: 689997 - RNA, 19 nt, Homo sapiens
aaauagauauggucacaag

SEQ ID NO: 689998 - RNA, 19 nt, Homo sapiens
gaaaaugaaugggaccaaa

SEQ ID NO: 689999 - RNA, 19 nt, Homo sapiens
gcagauacaggauaaaguc

SEQ ID NO: 690000 - RNA, 19 nt, Homo sapiens
guucuggaaugaauuuguu

SEQ ID NO: 690001 - RNA, 19 nt, Homo sapiens
cagcaacacggaaguauau

SEQ ID NO: 690002 - RNA, 19 nt, Homo sapiens
cagagaucuuccagaauuu

SEQ ID NO: 690003 - RNA, 19 nt, Homo sapiens
ugacggacgcgcagccuua

SEQ ID NO: 690004 - RNA, 19 nt, Homo sapiens
ccagagaucagaaauucaa

SEQ ID NO: 690005 - RNA, 19 nt, Homo sapiens
aaaggaagcaagagguuaa

SEQ ID NO: 690006 - RNA, 19 nt, Homo sapiens
ugcagacucuuccagauuu

SEQ ID NO: 690007 - RNA, 19 nt, Homo sapiens
gaagaaguugugucauuuc

SEQ ID NO: 690008 - RNA, 19 nt, Homo sapiens
gagguucgagcacuaauug

SEQ ID NO: 690009 - RNA, 19 nt, Homo sapiens
aagcauauaugagaagaga

SEQ ID NO: 690010 - RNA, 19 nt, Homo sapiens
gcacgcagcagguaaaggu

SEQ ID NO: 690011 - RNA, 19 nt, Homo sapiens
agaguugaaugucuucuau

SEQ ID NO: 690012 - RNA, 19 nt, Homo sapiens
agacaguggcauagaguua

SEQ ID NO: 690013 - RNA, 19 nt, Homo sapiens
gacugaacuugggaaauaa

SEQ ID NO: 690014 - RNA, 19 nt, Homo sapiens
ggaggcaggacaacacuga

SEQ ID NO: 690015 - RNA, 19 nt, Homo sapiens
cagguaagauuggaacuca

SEQ ID NO: 690016 - RNA, 19 nt, Homo sapiens
ugacagauaaagaagauug

SEQ ID NO: 690017 - RNA, 19 nt, Homo sapiens
gaagguaggaguaagaaaa

SEQ ID NO: 690018 - RNA, 19 nt, Homo sapiens
ggagaucaccccugaaauu

SEQ ID NO: 690019 - RNA, 19 nt, Homo sapiens
guaccaucaugcucaguug

SEQ ID NO: 690020 - RNA, 19 nt, Homo sapiens
ggucacaaguacauuaagg

SEQ ID NO: 690021 - RNA, 19 nt, Homo sapiens
gcuaaucuagggacucaaa

SEQ ID NO: 690022 - RNA, 19 nt, Homo sapiens
uauuggacgucauagguuu

SEQ ID NO: 690023 - RNA, 19 nt, Homo sapiens
gagaagagaacugacugaa

SEQ ID NO: 690024 - RNA, 19 nt, Homo sapiens
ucuauuccuugcucaaauu

SEQ ID NO: 690025 - RNA, 19 nt, Homo sapiens
ggccugggcuaucgaguca

SEQ ID NO: 690026 - RNA, 19 nt, Homo sapiens
guagaagguaggaguaaga

SEQ ID NO: 690027 - RNA, 19 nt, Homo sapiens
gagaucaccccugaaauua

SEQ ID NO: 690028 - RNA, 19 nt, Homo sapiens
ccuauugacuacagugaug

SEQ ID NO: 690029 - RNA, 19 nt, Homo sapiens
gauaagacaguggcauaga

SEQ ID NO: 690030 - RNA, 19 nt, Homo sapiens
auagauauggucacaagua

SEQ ID NO: 690031 - RNA, 19 nt, Homo sapiens
ggaccaaaggcaucacuuc

SEQ ID NO: 690032 - RNA, 19 nt, Homo sapiens
aaaguccucugugaucuga

SEQ ID NO: 690033 - RNA, 19 nt, Homo sapiens
uggaacagaugugcccuuu

SEQ ID NO: 690034 - RNA, 19 nt, Homo sapiens
gucaguagcuuugcugcuu

SEQ ID NO: 690035 - RNA, 19 nt, Homo sapiens
aagauaagacaguggcaua

SEQ ID NO: 690036 - RNA, 19 nt, Homo sapiens
aagcaagagguuaaagaua

SEQ ID NO: 690037 - RNA, 19 nt, Homo sapiens
gaaugucuucuaugaggaa

SEQ ID NO: 690038 - RNA, 19 nt, Homo sapiens
aguugaaugucuucuauga

SEQ ID NO: 690039 - RNA, 19 nt, Homo sapiens
cccgaggccuacucacaua

SEQ ID NO: 690040 - RNA, 19 nt, Homo sapiens
gacaguggcauagaguuaa

SEQ ID NO: 690041 - RNA, 19 nt, Homo sapiens
ggauaaaccuugagaaaug

SEQ ID NO: 690042 - RNA, 19 nt, Homo sapiens
gcacaagaauaguggcuua

SEQ ID NO: 690043 - RNA, 19 nt, Homo sapiens
gaagagaggagauggauuu

SEQ ID NO: 690044 - RNA, 19 nt, Homo sapiens
gaagauggcucaguacaga

SEQ ID NO: 690045 - RNA, 19 nt, Homo sapiens
cggaagggauuuaguaaua

SEQ ID NO: 690046 - RNA, 19 nt, Homo sapiens
gcaaaggcauguugggaaa

SEQ ID NO: 690047 - RNA, 19 nt, Homo sapiens
gaacauaucugaaaaccuu

SEQ ID NO: 690048 - RNA, 19 nt, Homo sapiens
gaaguagaauugauuguuc

SEQ ID NO: 690049 - RNA, 19 nt, Homo sapiens
gaagcuaacucaagaugga

SEQ ID NO: 690050 - RNA, 19 nt, Homo sapiens
gaacgauccuccuucuuug

SEQ ID NO: 690051 - RNA, 19 nt, Homo sapiens
ggaagaaccucagucaaau

SEQ ID NO: 690052 - RNA, 19 nt, Homo sapiens
gcuaggagcuuuagaaguc

SEQ ID NO: 690053 - RNA, 19 nt, Homo sapiens
uaaaggauuuguuggguuu

SEQ ID NO: 690054 - RNA, 19 nt, Homo sapiens
aauaguggcuuaccgcuua

SEQ ID NO: 690055 - RNA, 19 nt, Homo sapiens
aaacugguguucaagauaa

SEQ ID NO: 690056 - RNA, 19 nt, Homo sapiens
ugugaaagcuggaaacauu

SEQ ID NO: 690057 - RNA, 19 nt, Homo sapiens
gcagagagcaccaaccauu

SEQ ID NO: 690058 - RNA, 19 nt, Homo sapiens
ggacagauccacagagaug

SEQ ID NO: 690059 - RNA, 19 nt, Homo sapiens
gaaauaaagugagaaagac

SEQ ID NO: 690060 - RNA, 19 nt, Homo sapiens
uaugauguaugcuagguua

SEQ ID NO: 690061 - RNA, 19 nt, Homo sapiens
cuaaacgacuaaaggauuu

SEQ ID NO: 690062 - RNA, 19 nt, Homo sapiens
ggauuucaguugggaguua

SEQ ID NO: 690063 - RNA, 19 nt, Homo sapiens
caaagaacccagcaacaaa

SEQ ID NO: 690064 - RNA, 19 nt, Homo sapiens
gaugaacuccugaaagaaa

SEQ ID NO: 690065 - RNA, 19 nt, Homo sapiens
aguaauggcuuguaaaugu

SEQ ID NO: 690066 - RNA, 19 nt, Homo sapiens
gaaacugguguucaagaua

SEQ ID NO: 690067 - RNA, 19 nt, Homo sapiens
ggaaacugguguucaagau

SEQ ID NO: 690068 - RNA, 19 nt, Homo sapiens
ugagauuucuacagcaaua

SEQ ID NO: 690069 - RNA, 19 nt, Homo sapiens
guggagugaugaugaauuu

SEQ ID NO: 690070 - RNA, 19 nt, Homo sapiens
ggagaaaguggcaaucaaa

SEQ ID NO: 690071 - RNA, 19 nt, Homo sapiens
ggagaucugucagcucauu

SEQ ID NO: 690072 - RNA, 19 nt, Homo sapiens
ggaguggagugaugaugaa

SEQ ID NO: 690073 - RNA, 19 nt, Homo sapiens
gauggcaccugaaguuaug

SEQ ID NO: 690074 - RNA, 19 nt, Homo sapiens
cgaaauaaagugagaaaga

SEQ ID NO: 690075 - RNA, 19 nt, Homo sapiens
gaaccucagucaaaucgau

SEQ ID NO: 690076 - RNA, 19 nt, Homo sapiens
gaagggaaagcagcaauuu

SEQ ID NO: 690077 - RNA, 19 nt, Homo sapiens
uggaugaacuccugaaaga

SEQ ID NO: 690078 - RNA, 19 nt, Homo sapiens
gaacagguccgugguuaug

SEQ ID NO: 690079 - RNA, 19 nt, Homo sapiens
uggagaagauggcucagua

SEQ ID NO: 690080 - RNA, 19 nt, Homo sapiens
gaacaaggauggggaggua

SEQ ID NO: 690081 - RNA, 19 nt, Homo sapiens
gagcacucauaaugcaaua

SEQ ID NO: 690082 - RNA, 19 nt, Homo sapiens
gaagggauuuaguaauagu

SEQ ID NO: 690083 - RNA, 19 nt, Homo sapiens
gagaguaggugagaugauc

SEQ ID NO: 690084 - RNA, 19 nt, Homo sapiens
caucagauccuucaaagug

SEQ ID NO: 690085 - RNA, 19 nt, Homo sapiens
gagguucuguucuggauau

SEQ ID NO: 690086 - RNA, 19 nt, Homo sapiens
gagugcaccucuuugacua

SEQ ID NO: 690087 - RNA, 19 nt, Homo sapiens
ggacggagaggaacaagga

SEQ ID NO: 690088 - RNA, 19 nt, Homo sapiens
gauacucaaucuggccuua

SEQ ID NO: 690089 - RNA, 19 nt, Homo sapiens
ggagugaugaugaauuuga

SEQ ID NO: 690090 - RNA, 19 nt, Homo sapiens
ucauaaauauccaccaaug

SEQ ID NO: 690091 - RNA, 19 nt, Homo sapiens
gauaaaccuugagaaaugu

SEQ ID NO: 690092 - RNA, 19 nt, Homo sapiens
ggaguagggacuaacuaua

SEQ ID NO: 690093 - RNA, 19 nt, Homo sapiens
ggaagggauuuaguaauag

SEQ ID NO: 690094 - RNA, 19 nt, Homo sapiens
gaugagcuguggcuuguca

SEQ ID NO: 690095 - RNA, 19 nt, Homo sapiens
agagccagcugauaauauu

SEQ ID NO: 690096 - RNA, 19 nt, Homo sapiens
gagaggagauggauuucag

SEQ ID NO: 690097 - RNA, 19 nt, Homo sapiens
ucauaucauuggagaagua

SEQ ID NO: 690098 - RNA, 19 nt, Homo sapiens
cgacggaagggauuuagua

SEQ ID NO: 690099 - RNA, 19 nt, Homo sapiens
gcagcaauuucacaacuca

SEQ ID NO: 690100 - RNA, 19 nt, Homo sapiens
gaggagagaauaaugaugu

SEQ ID NO: 690101 - RNA, 19 nt, Homo sapiens
cagacaacaucgaguaaug

SEQ ID NO: 690102 - RNA, 19 nt, Homo sapiens
gaacagcacguaaccuagu

SEQ ID NO: 690103 - RNA, 19 nt, Homo sapiens
agacaguguucauuugauu

SEQ ID NO: 690104 - RNA, 19 nt, Homo sapiens
gggcuggaauaucugcaua

SEQ ID NO: 690105 - RNA, 19 nt, Homo sapiens
aaaguggaguccuagauga

SEQ ID NO: 690106 - RNA, 19 nt, Homo sapiens
gcuuaccgcuuaccuuaga

SEQ ID NO: 690107 - RNA, 19 nt, Homo sapiens
gaguugcccuuuacagaau

SEQ ID NO: 690108 - RNA, 19 nt, Homo sapiens
aaagagcacucauaaugca

SEQ ID NO: 690109 - RNA, 19 nt, Homo sapiens
gaguagacaguguucauuu

SEQ ID NO: 690110 - RNA, 19 nt, Homo sapiens
gaacuucagccaucagauc

SEQ ID NO: 690111 - RNA, 19 nt, Homo sapiens
ggaucagguucacaagaaa

SEQ ID NO: 690112 - RNA, 19 nt, Homo sapiens
gcaacugguggugauauua

SEQ ID NO: 690113 - RNA, 19 nt, Homo sapiens
gcuggaauaucugcauaaa

SEQ ID NO: 690114 - RNA, 19 nt, Homo sapiens
uggaagggcuggaauaucu

SEQ ID NO: 690115 - RNA, 19 nt, Homo sapiens
ggaaugagguauagaaaag

SEQ ID NO: 690116 - RNA, 19 nt, Homo sapiens
guggaacuuuggauuguuu

SEQ ID NO: 690117 - RNA, 19 nt, Homo sapiens
ucauugcucucuccagaaa

SEQ ID NO: 690118 - RNA, 19 nt, Homo sapiens
ccaaagaacccagcaacaa

SEQ ID NO: 690119 - RNA, 19 nt, Homo sapiens
ccagugggcgucuucauaa

SEQ ID NO: 690120 - RNA, 19 nt, Homo sapiens
guucuguucuggauauuau

SEQ ID NO: 690121 - RNA, 19 nt, Homo sapiens
gggacuaacuauagcacaa

SEQ ID NO: 690122 - RNA, 19 nt, Homo sapiens
gagaguugcccuuuacaga

SEQ ID NO: 690123 - RNA, 19 nt, Homo sapiens
ccuaaacuguguucuuguu

SEQ ID NO: 690124 - RNA, 19 nt, Homo sapiens
ccacugaaguagaauugau

SEQ ID NO: 690125 - RNA, 19 nt, Homo sapiens
ucaaaucgaucugucacuu

SEQ ID NO: 690126 - RNA, 19 nt, Homo sapiens
uggaagaaccucagucaaa

SEQ ID NO: 690127 - RNA, 19 nt, Homo sapiens
aacagcagcagaacuauua

SEQ ID NO: 690128 - RNA, 19 nt, Homo sapiens
aagcugauauuuggaguuu

SEQ ID NO: 690129 - RNA, 19 nt, Homo sapiens
guaauggcuuguaaaugug

SEQ ID NO: 690130 - RNA, 19 nt, Homo sapiens
cuaaggagauuccacacau

SEQ ID NO: 690131 - RNA, 19 nt, Homo sapiens
ugugaaauguuuggucuuu

SEQ ID NO: 690132 - RNA, 19 nt, Homo sapiens
gggcagucauggcaaauag

SEQ ID NO: 690133 - RNA, 19 nt, Homo sapiens
cccaaucagucuaguacua

SEQ ID NO: 690134 - RNA, 19 nt, Homo sapiens
gaaaccaagaucccaauca

SEQ ID NO: 690135 - RNA, 19 nt, Homo sapiens
ggaagggaaagcagcaauu

SEQ ID NO: 690136 - RNA, 19 nt, Homo sapiens
ccagaaagcaaagaauaaa

SEQ ID NO: 690137 - RNA, 19 nt, Homo sapiens
uggaacagguccgugguua

SEQ ID NO: 690138 - RNA, 19 nt, Homo sapiens
aaaguaauaugugccaaug

SEQ ID NO: 690139 - RNA, 19 nt, Homo sapiens
ugacuguacuccuuucuag

SEQ ID NO: 690140 - RNA, 19 nt, Homo sapiens
cagcaucacucuguucuag

SEQ ID NO: 690141 - RNA, 19 nt, Homo sapiens
caacuucuguuuaaucuga

SEQ ID NO: 690142 - RNA, 19 nt, Homo sapiens
cgacucugcucucuauuua

SEQ ID NO: 690143 - RNA, 19 nt, Homo sapiens
ucgccaagcugauuaaaua

SEQ ID NO: 690144 - RNA, 19 nt, Homo sapiens
acaaagaucugaggaaauu

SEQ ID NO: 690145 - RNA, 19 nt, Homo sapiens
agaagggaaucauuguuua

SEQ ID NO: 690146 - RNA, 19 nt, Homo sapiens
gagaagggaaucauuguuu

SEQ ID NO: 690147 - RNA, 19 nt, Homo sapiens
guuccaaguuugcguauaa

SEQ ID NO: 690148 - RNA, 19 nt, Homo sapiens
gaucauccguggcuugaga

SEQ ID NO: 690149 - RNA, 19 nt, Homo sapiens
ugaaauaucccaugcaaga

SEQ ID NO: 690150 - RNA, 19 nt, Homo sapiens
gaaggagcccugaaaauua

SEQ ID NO: 690151 - RNA, 19 nt, Homo sapiens
gaacagccagaaucaguuu

SEQ ID NO: 690152 - RNA, 19 nt, Homo sapiens
agacaaaggcaacgaauuu

SEQ ID NO: 690153 - RNA, 19 nt, Homo sapiens
gaccgaauuucacuacaaa

SEQ ID NO: 690154 - RNA, 19 nt, Homo sapiens
acaaugggaucaucacaaa

SEQ ID NO: 690155 - RNA, 19 nt, Homo sapiens
cagcaaaucaugaaaggua

SEQ ID NO: 690156 - RNA, 19 nt, Homo sapiens
ugacugagcuuccugugau

SEQ ID NO: 690157 - RNA, 19 nt, Homo sapiens
cagagaaacugaggacauu

SEQ ID NO: 690158 - RNA, 19 nt, Homo sapiens
gggcgacucugcucucuau

SEQ ID NO: 690159 - RNA, 19 nt, Homo sapiens
uaaccuacaugcacucaga

SEQ ID NO: 690160 - RNA, 19 nt, Homo sapiens
gaacugcagcaaaucauga

SEQ ID NO: 690161 - RNA, 19 nt, Homo sapiens
uuacaaagaucugaggaaa

SEQ ID NO: 690162 - RNA, 19 nt, Homo sapiens
ucaaggcucucgaugaaga

SEQ ID NO: 690163 - RNA, 19 nt, Homo sapiens
uaccugagcugaucaagga

SEQ ID NO: 690164 - RNA, 19 nt, Homo sapiens
uggagaaugugaagaauau

SEQ ID NO: 690165 - RNA, 19 nt, Homo sapiens
gaagaacuuuacaaacaag

SEQ ID NO: 690166 - RNA, 19 nt, Homo sapiens
ccaccuaugccuccuauaa

SEQ ID NO: 690167 - RNA, 19 nt, Homo sapiens
agauacagcucucuucaga

SEQ ID NO: 690168 - RNA, 19 nt, Homo sapiens
gagcagacuucuccacuac

SEQ ID NO: 690169 - RNA, 19 nt, Homo sapiens
aauacaagcucuccacaga

SEQ ID NO: 690170 - RNA, 19 nt, Homo sapiens
aagcaaaggcuacgaguuu

SEQ ID NO: 690171 - RNA, 19 nt, Homo sapiens
ggaauaaucacgaagucaa

SEQ ID NO: 690172 - RNA, 19 nt, Homo sapiens
ccaagcugauuaaauaugu

SEQ ID NO: 690173 - RNA, 19 nt, Homo sapiens
acauucagcuggucaagaa

SEQ ID NO: 690174 - RNA, 19 nt, Homo sapiens
gcaagagaguaguuucaag

SEQ ID NO: 690175 - RNA, 19 nt, Homo sapiens
caaggacgauacugaaagu

SEQ ID NO: 690176 - RNA, 19 nt, Homo sapiens
ccacagaacagaucccuau

SEQ ID NO: 690177 - RNA, 19 nt, Homo sapiens
gcuacgaguuugagucaga

SEQ ID NO: 690178 - RNA, 19 nt, Homo sapiens
gaauaaucacgaagucaaa

SEQ ID NO: 690179 - RNA, 19 nt, Homo sapiens
agucaaggcucucgaugaa

SEQ ID NO: 690180 - RNA, 19 nt, Homo sapiens
ugagaggucgggugaauuu

SEQ ID NO: 690181 - RNA, 19 nt, Homo sapiens
gagacacacuucggcauug

SEQ ID NO: 690182 - RNA, 19 nt, Homo sapiens
caagacagcauggacuuaa

SEQ ID NO: 690183 - RNA, 19 nt, Homo sapiens
acucugcucucuauuuaaa

SEQ ID NO: 690184 - RNA, 19 nt, Homo sapiens
gcagguggcauucaucuca

SEQ ID NO: 690185 - RNA, 19 nt, Homo sapiens
gaggagaagggaaucauug

SEQ ID NO: 690186 - RNA, 19 nt, Homo sapiens
cgacaaggccguggaauuc

SEQ ID NO: 690187 - RNA, 19 nt, Homo sapiens
cgaaggagcccgagaagca

SEQ ID NO: 690188 - RNA, 19 nt, Homo sapiens
gcagacuucuccacuacug

SEQ ID NO: 690189 - RNA, 19 nt, Homo sapiens
gggaaucauuguuuacaca

SEQ ID NO: 690190 - RNA, 19 nt, Homo sapiens
ggaaggagcccugaaaauu

SEQ ID NO: 690191 - RNA, 19 nt, Homo sapiens
cagaguaacugugaaccuu

SEQ ID NO: 690192 - RNA, 19 nt, Homo sapiens
ccacaucccuccacuucuc

SEQ ID NO: 690193 - RNA, 19 nt, Homo sapiens
gaaucauuguuuacacaug

SEQ ID NO: 690194 - RNA, 19 nt, Homo sapiens
uaacuucagugcguuuaug

SEQ ID NO: 690195 - RNA, 19 nt, Homo sapiens
caacguuggucgagagagu

SEQ ID NO: 690196 - RNA, 19 nt, Homo sapiens
aaacugaggacauuacguu

SEQ ID NO: 690197 - RNA, 19 nt, Homo sapiens
ggagaagauccacgacuug

SEQ ID NO: 690198 - RNA, 19 nt, Homo sapiens
ucaaggaagugcugucucu

SEQ ID NO: 690199 - RNA, 19 nt, Homo sapiens
ggugauguuugguuugaug

SEQ ID NO: 690200 - RNA, 19 nt, Homo sapiens
ggacgugcacucuggagaa

SEQ ID NO: 690201 - RNA, 19 nt, Homo sapiens
ccacuacugugcaauagag

SEQ ID NO: 690202 - RNA, 19 nt, Homo sapiens
ccugaauccuguucucuga

SEQ ID NO: 690203 - RNA, 19 nt, Homo sapiens
ugguugaacuugcuaguga

SEQ ID NO: 690204 - RNA, 19 nt, Homo sapiens
ucagugcguuuaugcagaa

SEQ ID NO: 690205 - RNA, 19 nt, Homo sapiens
agauggaacugcagcaaau

SEQ ID NO: 690206 - RNA, 19 nt, Homo sapiens
gagagucauucagcaguug

SEQ ID NO: 690207 - RNA, 19 nt, Homo sapiens
cgaugaagaacuuuacaaa

SEQ ID NO: 690208 - RNA, 19 nt, Homo sapiens
ggagaagggaaucauuguu

SEQ ID NO: 690209 - RNA, 19 nt, Homo sapiens
gaaaucuggccaagucugu

SEQ ID NO: 690210 - RNA, 19 nt, Homo sapiens
gcgacucugcucucuauuu

SEQ ID NO: 690211 - RNA, 19 nt, Homo sapiens
uacugaaaguuccaaguuu

SEQ ID NO: 690212 - RNA, 19 nt, Homo sapiens
agagaucgcugcuggugau

SEQ ID NO: 690213 - RNA, 19 nt, Homo sapiens
gaagaccgaauuucacuac

SEQ ID NO: 690214 - RNA, 19 nt, Homo sapiens
ugaaggaccacuugaagga

SEQ ID NO: 690215 - RNA, 19 nt, Homo sapiens
ucacgaagucaaagaaaga

SEQ ID NO: 690216 - RNA, 19 nt, Homo sapiens
cgcaguggcugaugggaaa

SEQ ID NO: 690217 - RNA, 19 nt, Homo sapiens
gcgacaaggccguggaauu

SEQ ID NO: 690218 - RNA, 19 nt, Homo sapiens
caagagaguaguuucaagu

SEQ ID NO: 690219 - RNA, 19 nt, Homo sapiens
ucucuaggcugcuccugaa

SEQ ID NO: 690220 - RNA, 19 nt, Homo sapiens
gaaagucaaggcucucgau

SEQ ID NO: 690221 - RNA, 19 nt, Homo sapiens
gauguuugguuugaugaug

SEQ ID NO: 690222 - RNA, 19 nt, Homo sapiens
ggacgaggaaggagaucuu

SEQ ID NO: 690223 - RNA, 19 nt, Homo sapiens
acugaaaguuccaaguuug

SEQ ID NO: 690224 - RNA, 19 nt, Homo sapiens
gauccuugcuucgccaaau

SEQ ID NO: 690225 - RNA, 19 nt, Homo sapiens
gcaguuggaaggugcauuc

SEQ ID NO: 690226 - RNA, 19 nt, Homo sapiens
gaacuuuacaaacaagaca

SEQ ID NO: 690227 - RNA, 19 nt, Homo sapiens
agagcagacuucuccacua

SEQ ID NO: 690228 - RNA, 19 nt, Homo sapiens
gaugcuacaugggaagaga

SEQ ID NO: 690229 - RNA, 19 nt, Homo sapiens
agaccgaauuucacuacaa

SEQ ID NO: 690230 - RNA, 19 nt, Homo sapiens
uaugagaggucgggugaau

SEQ ID NO: 690231 - RNA, 19 nt, Homo sapiens
guggaauucuucuuugcuu

SEQ ID NO: 690232 - RNA, 19 nt, Homo sapiens
gaagaauaucuguaagaca

SEQ ID NO: 690233 - RNA, 19 nt, Homo sapiens
ggacaauaaagaacauaca

SEQ ID NO: 690234 - RNA, 19 nt, Homo sapiens
uuuaagcccuggcagcauu

SEQ ID NO: 690235 - RNA, 19 nt, Homo sapiens
gguaacggccaaacuguuc

SEQ ID NO: 690236 - RNA, 19 nt, Homo sapiens
gaggauaugacguugacuu

SEQ ID NO: 690237 - RNA, 19 nt, Homo sapiens
gcuccaaggacgauacuga

SEQ ID NO: 690238 - RNA, 19 nt, Homo sapiens
guucagggaugacguuugc

SEQ ID NO: 690239 - RNA, 19 nt, Homo sapiens
gugaagaauaucuguaaga

SEQ ID NO: 690240 - RNA, 19 nt, Homo sapiens
gaccaucgccaagcugauu

SEQ ID NO: 690241 - RNA, 19 nt, Homo sapiens
ggagugagauuauauagua

SEQ ID NO: 690242 - RNA, 19 nt, Homo sapiens
caacagaguuccacagaug

SEQ ID NO: 690243 - RNA, 19 nt, Homo sapiens
gauaagcagugccuugaaa

SEQ ID NO: 690244 - RNA, 19 nt, Homo sapiens
cauggaagcuguucagaaa

SEQ ID NO: 690245 - RNA, 19 nt, Homo sapiens
gagcauuacuugguucaua

SEQ ID NO: 690246 - RNA, 19 nt, Homo sapiens
uaaaggaugugauggagaa

SEQ ID NO: 690247 - RNA, 19 nt, Homo sapiens
ggagagaaauugcuggaau

SEQ ID NO: 690248 - RNA, 19 nt, Homo sapiens
ggaauuguauuagauguug

SEQ ID NO: 690249 - RNA, 19 nt, Homo sapiens
gauaauggauggagcaagu

SEQ ID NO: 690250 - RNA, 19 nt, Homo sapiens
ucaaccagaugaugaagua

SEQ ID NO: 690251 - RNA, 19 nt, Homo sapiens
gaacauauuccaguauuug

SEQ ID NO: 690252 - RNA, 19 nt, Homo sapiens
ggaugaacauauuccagua

SEQ ID NO: 690253 - RNA, 19 nt, Homo sapiens
gggaguagauauuguccua

SEQ ID NO: 690254 - RNA, 19 nt, Homo sapiens
gaagcaagguaucauucuu

SEQ ID NO: 690255 - RNA, 19 nt, Homo sapiens
uugcuaagcuaucaaagua

SEQ ID NO: 690256 - RNA, 19 nt, Homo sapiens
gcacguuucucugcuaaga

SEQ ID NO: 690257 - RNA, 19 nt, Homo sapiens
ucacacuacucuugauaaa

SEQ ID NO: 690258 - RNA, 19 nt, Homo sapiens
ccagauagccacugccuuu

SEQ ID NO: 690259 - RNA, 19 nt, Homo sapiens
gaguagauauuguccuaga

SEQ ID NO: 690260 - RNA, 19 nt, Homo sapiens
gcaagugcauuugguacaa

SEQ ID NO: 690261 - RNA, 19 nt, Homo sapiens
ggaagcagcaggaagcauu

SEQ ID NO: 690262 - RNA, 19 nt, Homo sapiens
uuccacagaugaagaaaua

SEQ ID NO: 690263 - RNA, 19 nt, Homo sapiens
ggauggagcaagugcauuu

SEQ ID NO: 690264 - RNA, 19 nt, Homo sapiens
ccagauaaauacaaagcuu

SEQ ID NO: 690265 - RNA, 19 nt, Homo sapiens
gauaucaucacacuucuug

SEQ ID NO: 690266 - RNA, 19 nt, Homo sapiens
cuacaacuacuaccacaua

SEQ ID NO: 690267 - RNA, 19 nt, Homo sapiens
gcaugcagccuugaagaua

SEQ ID NO: 690268 - RNA, 19 nt, Homo sapiens
gaggauaacuuugugaaac

SEQ ID NO: 690269 - RNA, 19 nt, Homo sapiens
gaaagcuguuuggaagaaa

SEQ ID NO: 690270 - RNA, 19 nt, Homo sapiens
ugaaagcuguuuggaagaa

SEQ ID NO: 690271 - RNA, 19 nt, Homo sapiens
caugcagccuugaagauaa

SEQ ID NO: 690272 - RNA, 19 nt, Homo sapiens
ugaagacccuggacuuugu

SEQ ID NO: 690273 - RNA, 19 nt, Homo sapiens
uuaagucuuugcugucaua

SEQ ID NO: 690274 - RNA, 19 nt, Homo sapiens
gugcaaaugaucaagauaa

SEQ ID NO: 690275 - RNA, 19 nt, Homo sapiens
uggcagaaaugaagaugaa

SEQ ID NO: 690276 - RNA, 19 nt, Homo sapiens
agucuuugcugucauaauu

SEQ ID NO: 690277 - RNA, 19 nt, Homo sapiens
gcagugccuugaaagauuc

SEQ ID NO: 690278 - RNA, 19 nt, Homo sapiens
ucaguuggaugaacccauu

SEQ ID NO: 690279 - RNA, 19 nt, Homo sapiens
gaugcucaguugacacauu

SEQ ID NO: 690280 - RNA, 19 nt, Homo sapiens
aagacaagaugcucaguug

SEQ ID NO: 690281 - RNA, 19 nt, Homo sapiens
uagcuuuccugaaugauga

SEQ ID NO: 690282 - RNA, 19 nt, Homo sapiens
ugauguaucuaaugggaaa

SEQ ID NO: 690283 - RNA, 19 nt, Homo sapiens
acaccuuccuuaagucuuu

SEQ ID NO: 690284 - RNA, 19 nt, Homo sapiens
ucagucggaugaacauauu

SEQ ID NO: 690285 - RNA, 19 nt, Homo sapiens
ucucaucucucuccuggaa

SEQ ID NO: 690286 - RNA, 19 nt, Homo sapiens
auacagcucugcauuaucu

SEQ ID NO: 690287 - RNA, 19 nt, Homo sapiens
caagguaucauucuuucaa

SEQ ID NO: 690288 - RNA, 19 nt, Homo sapiens
uagaggagccaaagugauu

SEQ ID NO: 690289 - RNA, 19 nt, Homo sapiens
ucaguuagcacaucauaga

SEQ ID NO: 690290 - RNA, 19 nt, Homo sapiens
cuauacagcucugcauuau

SEQ ID NO: 690291 - RNA, 19 nt, Homo sapiens
gaugaaguaguuggaauuu

SEQ ID NO: 690292 - RNA, 19 nt, Homo sapiens
aacguuagcuuuccugaau

SEQ ID NO: 690293 - RNA, 19 nt, Homo sapiens
gagccaaagugauuucaac

SEQ ID NO: 690294 - RNA, 19 nt, Homo sapiens
ggagcaagugcauuuggua

SEQ ID NO: 690295 - RNA, 19 nt, Homo sapiens
guucucaacaccuuccuua

SEQ ID NO: 690296 - RNA, 19 nt, Homo sapiens
ugagccagauaaauacaaa

SEQ ID NO: 690297 - RNA, 19 nt, Homo sapiens
ggauaacuuugugaaacuu

SEQ ID NO: 690298 - RNA, 19 nt, Homo sapiens
ccuauacagcucugcauua

SEQ ID NO: 690299 - RNA, 19 nt, Homo sapiens
gcaggccuuugcuaagcua

SEQ ID NO: 690300 - RNA, 19 nt, Homo sapiens
ccacauaaacaugauauca

SEQ ID NO: 690301 - RNA, 19 nt, Homo sapiens
ugaaccagcuguaaaacua

SEQ ID NO: 690302 - RNA, 19 nt, Homo sapiens
gaugaugaaccagcuguaa

SEQ ID NO: 690303 - RNA, 19 nt, Homo sapiens
agaggcaggugacuaugaa

SEQ ID NO: 690304 - RNA, 19 nt, Homo sapiens
ggaggccacuggguaacaa

SEQ ID NO: 690305 - RNA, 19 nt, Homo sapiens
ccuagaugcuggagugaga

SEQ ID NO: 690306 - RNA, 19 nt, Homo sapiens
ugaaguaguuggaauuuug

SEQ ID NO: 690307 - RNA, 19 nt, Homo sapiens
gcuaagcuaucaaaguaac

SEQ ID NO: 690308 - RNA, 19 nt, Homo sapiens
guauuugaagccagaauuu

SEQ ID NO: 690309 - RNA, 19 nt, Homo sapiens
ucccauagcccgagugauu

SEQ ID NO: 690310 - RNA, 19 nt, Homo sapiens
uuacagaggauaacuuugu

SEQ ID NO: 690311 - RNA, 19 nt, Homo sapiens
ccucaagggagcaacguua

SEQ ID NO: 690312 - RNA, 19 nt, Homo sapiens
uaguaaagaugaugaacca

SEQ ID NO: 690313 - RNA, 19 nt, Homo sapiens
uuagaguacaugagcauua

SEQ ID NO: 690314 - RNA, 19 nt, Homo sapiens
gaugaacccauuccacugu

SEQ ID NO: 690315 - RNA, 19 nt, Homo sapiens
ucaguugacacauuugaaa

SEQ ID NO: 690316 - RNA, 19 nt, Homo sapiens
caacuacuaccacauaaac

SEQ ID NO: 690317 - RNA, 19 nt, Homo sapiens
guagauauuguccuagaug

SEQ ID NO: 690318 - RNA, 19 nt, Homo sapiens
uacaacuacuaccacauaa

SEQ ID NO: 690319 - RNA, 19 nt, Homo sapiens
gcuggagugagauuauaua

SEQ ID NO: 690320 - RNA, 19 nt, Homo sapiens
ugcauuaucuuucucaucu

SEQ ID NO: 690321 - RNA, 19 nt, Homo sapiens
agcauuacuugguucauaa

SEQ ID NO: 690322 - RNA, 19 nt, Homo sapiens
guuaaagcuugugcucuga

SEQ ID NO: 690323 - RNA, 19 nt, Homo sapiens
ugauugauguaucuaaugg

SEQ ID NO: 690324 - RNA, 19 nt, Homo sapiens
gaugaacauauuccaguau

SEQ ID NO: 690325 - RNA, 19 nt, Homo sapiens
gggaaaauaucuuuguauc

SEQ ID NO: 690326 - RNA, 19 nt, Homo sapiens
cguuagcuuuccugaauga

SEQ ID NO: 690327 - RNA, 19 nt, Homo sapiens
ccaacagaguuccacagau

SEQ ID NO: 690328 - RNA, 19 nt, Homo sapiens
aaagugauuucaacagcau

SEQ ID NO: 690329 - RNA, 19 nt, Homo sapiens
cauagaggagccaaaguga

SEQ ID NO: 690330 - RNA, 19 nt, Homo sapiens
cucaacaccuuccuuaagu

SEQ ID NO: 690331 - RNA, 19 nt, Homo sapiens
uaagacaagaugcucaguu

SEQ ID NO: 690332 - RNA, 19 nt, Homo sapiens
caacagggaaaauaucuuu

SEQ ID NO: 690333 - RNA, 19 nt, Homo sapiens
gcucagaggcaggugacua

SEQ ID NO: 690334 - RNA, 19 nt, Homo sapiens
agcagugccuugaaagauu

SEQ ID NO: 690335 - RNA, 19 nt, Homo sapiens
aagcaagguaucauucuuu

SEQ ID NO: 690336 - RNA, 19 nt, Homo sapiens
gcauuugguacaauagcua

SEQ ID NO: 690337 - RNA, 19 nt, Homo sapiens
caagugcauuugguacaau

SEQ ID NO: 690338 - RNA, 19 nt, Homo sapiens
gcuaucaaaguaacguauu

SEQ ID NO: 690339 - RNA, 19 nt, Homo sapiens
caaggaagauaaaacaagu

SEQ ID NO: 690340 - RNA, 19 nt, Homo sapiens
ggaagguggcgguggugaa

SEQ ID NO: 690341 - RNA, 19 nt, Homo sapiens
ggagugagauuauauagua

SEQ ID NO: 690342 - RNA, 19 nt, Homo sapiens
uaagauaccuggaagauuu

SEQ ID NO: 690343 - RNA, 19 nt, Homo sapiens
gaacagagaugagcccuaa

SEQ ID NO: 690344 - RNA, 19 nt, Homo sapiens
gcacagagauguugauaca

SEQ ID NO: 690345 - RNA, 19 nt, Homo sapiens
gaagaaagauuuacauagc

SEQ ID NO: 690346 - RNA, 19 nt, Homo sapiens
caacagaguuccacagaug

SEQ ID NO: 690347 - RNA, 19 nt, Homo sapiens
gauaagcagugccuugaaa

SEQ ID NO: 690348 - RNA, 19 nt, Homo sapiens
gagcauuacuugguucaua

SEQ ID NO: 690349 - RNA, 19 nt, Homo sapiens
ggagagaaauugcuggaau

SEQ ID NO: 690350 - RNA, 19 nt, Homo sapiens
ggaauuguauuagauguug

SEQ ID NO: 690351 - RNA, 19 nt, Homo sapiens
gauaauggauggagcaagu

SEQ ID NO: 690352 - RNA, 19 nt, Homo sapiens
ucaaccagaugaugaagua

SEQ ID NO: 690353 - RNA, 19 nt, Homo sapiens
gaagauagguuugacuuuu

SEQ ID NO: 690354 - RNA, 19 nt, Homo sapiens
gggaguagauauuguccua

SEQ ID NO: 690355 - RNA, 19 nt, Homo sapiens
gaagcaagguaucauucuu

SEQ ID NO: 690356 - RNA, 19 nt, Homo sapiens
gcaaugacagucuuuauuc

SEQ ID NO: 690357 - RNA, 19 nt, Homo sapiens
gcuaggaaaucuuuaucaa

SEQ ID NO: 690358 - RNA, 19 nt, Homo sapiens
gcuuuaagguaguuaugua

SEQ ID NO: 690359 - RNA, 19 nt, Homo sapiens
uuacauagccuuacacuuc

SEQ ID NO: 690360 - RNA, 19 nt, Homo sapiens
gagaugagcccuaagauac

SEQ ID NO: 690361 - RNA, 19 nt, Homo sapiens
ccagauagccacugccuuu

SEQ ID NO: 690362 - RNA, 19 nt, Homo sapiens
gaguagauauuguccuaga

SEQ ID NO: 690363 - RNA, 19 nt, Homo sapiens
acagagauguugauacaga

SEQ ID NO: 690364 - RNA, 19 nt, Homo sapiens
gcaagugcauuugguacaa

SEQ ID NO: 690365 - RNA, 19 nt, Homo sapiens
ggaagcagcaggaagcauu

SEQ ID NO: 690366 - RNA, 19 nt, Homo sapiens
uuccacagaugaagaaaua

SEQ ID NO: 690367 - RNA, 19 nt, Homo sapiens
uugaaagguugcacacuua

SEQ ID NO: 690368 - RNA, 19 nt, Homo sapiens
ggauggagcaagugcauuu

SEQ ID NO: 690369 - RNA, 19 nt, Homo sapiens
ccagauaaauacaaagcuu

SEQ ID NO: 690370 - RNA, 19 nt, Homo sapiens
gaugaaguuuggaauuugu

SEQ ID NO: 690371 - RNA, 19 nt, Homo sapiens
gauaucaucacacuucuug

SEQ ID NO: 690372 - RNA, 19 nt, Homo sapiens
cuacaacuacuaccacaua

SEQ ID NO: 690373 - RNA, 19 nt, Homo sapiens
gcaugcagccuugaagaua

SEQ ID NO: 690374 - RNA, 19 nt, Homo sapiens
gaggauaacuuugugaaac

SEQ ID NO: 690375 - RNA, 19 nt, Homo sapiens
acacuucucucuacugaau

SEQ ID NO: 690376 - RNA, 19 nt, Homo sapiens
agauaagucuggugugauu

SEQ ID NO: 690377 - RNA, 19 nt, Homo sapiens
caaaagucauucagagaua

SEQ ID NO: 690378 - RNA, 19 nt, Homo sapiens
gaaagcuguuuggaagaaa

SEQ ID NO: 690379 - RNA, 19 nt, Homo sapiens
ugaaagcuguuuggaagaa

SEQ ID NO: 690380 - RNA, 19 nt, Homo sapiens
caugcagccuugaagauaa

SEQ ID NO: 690381 - RNA, 19 nt, Homo sapiens
ugaagacccuggacuuugu

SEQ ID NO: 690382 - RNA, 19 nt, Homo sapiens
ggaaagcacacaucaccuu

SEQ ID NO: 690383 - RNA, 19 nt, Homo sapiens
uggcagaaaugaagaugaa

SEQ ID NO: 690384 - RNA, 19 nt, Homo sapiens
gcagaagaaucgcuugaac

SEQ ID NO: 690385 - RNA, 19 nt, Homo sapiens
ugagauguaaguacuguua

SEQ ID NO: 690386 - RNA, 19 nt, Homo sapiens
gcagugccuugaaagauuc

SEQ ID NO: 690387 - RNA, 19 nt, Homo sapiens
gcacacaucaccuugaaag

SEQ ID NO: 690388 - RNA, 19 nt, Homo sapiens
uagcuuuccugaaugauga

SEQ ID NO: 690389 - RNA, 19 nt, Homo sapiens
ugauguaucuaaugggaaa

SEQ ID NO: 690390 - RNA, 19 nt, Homo sapiens
gcaaguggcggagcaagaa

SEQ ID NO: 690391 - RNA, 19 nt, Homo sapiens
ucucaucucucuccuggaa

SEQ ID NO: 690392 - RNA, 19 nt, Homo sapiens
auacagcucugcauuaucu

SEQ ID NO: 690393 - RNA, 19 nt, Homo sapiens
caagguaucauucuuucaa

SEQ ID NO: 690394 - RNA, 19 nt, Homo sapiens
agagauaagucugguguga

SEQ ID NO: 690395 - RNA, 19 nt, Homo sapiens
uuacacuucucucuacuga

SEQ ID NO: 690396 - RNA, 19 nt, Homo sapiens
uagaggagccaaagugauu

SEQ ID NO: 690397 - RNA, 19 nt, Homo sapiens
ucaguuagcacaucauaga

SEQ ID NO: 690398 - RNA, 19 nt, Homo sapiens
cuauacagcucugcauuau

SEQ ID NO: 690399 - RNA, 19 nt, Homo sapiens
gaugaaguaguuggaauuu

SEQ ID NO: 690400 - RNA, 19 nt, Homo sapiens
aacguuagcuuuccugaau

SEQ ID NO: 690401 - RNA, 19 nt, Homo sapiens
acaguacaauugccugauu

SEQ ID NO: 690402 - RNA, 19 nt, Homo sapiens
auagagaacaguacaauug

SEQ ID NO: 690403 - RNA, 19 nt, Homo sapiens
gagccaaagugauuucaac

SEQ ID NO: 690404 - RNA, 19 nt, Homo sapiens
ggagcaagugcauuuggua

SEQ ID NO: 690405 - RNA, 19 nt, Homo sapiens
ggauaacuuugugaaacuu

SEQ ID NO: 690406 - RNA, 19 nt, Homo sapiens
caguacaauugccugauuu

SEQ ID NO: 690407 - RNA, 19 nt, Homo sapiens
ugagccagauaaauacaaa

SEQ ID NO: 690408 - RNA, 19 nt, Homo sapiens
ccuauacagcucugcauua

SEQ ID NO: 690409 - RNA, 19 nt, Homo sapiens
gagcaaugacagucuuuau

SEQ ID NO: 690410 - RNA, 19 nt, Homo sapiens
gugugugucugaagaaaga

SEQ ID NO: 690411 - RNA, 19 nt, Homo sapiens
ccacauaaacaugauauca

SEQ ID NO: 690412 - RNA, 19 nt, Homo sapiens
ugaaccagcuguaaaacua

SEQ ID NO: 690413 - RNA, 19 nt, Homo sapiens
gaugaugaaccagcuguaa

SEQ ID NO: 690414 - RNA, 19 nt, Homo sapiens
gagccaagauugcacuacu

SEQ ID NO: 690415 - RNA, 19 nt, Homo sapiens
gcauaugugugugucugaa

SEQ ID NO: 690416 - RNA, 19 nt, Homo sapiens
ugauagagcauaugugugu

SEQ ID NO: 690417 - RNA, 19 nt, Homo sapiens
uagaguagggucaacuuaa

SEQ ID NO: 690418 - RNA, 19 nt, Homo sapiens
ucaaugcuaggaaaucuuu

SEQ ID NO: 690419 - RNA, 19 nt, Homo sapiens
aagcacacaucaccuugaa

SEQ ID NO: 690420 - RNA, 19 nt, Homo sapiens
agagaugagcccuaagaua

SEQ ID NO: 690421 - RNA, 19 nt, Homo sapiens
ggaggccacuggguaacaa

SEQ ID NO: 690422 - RNA, 19 nt, Homo sapiens
ccuagaugcuggagugaga

SEQ ID NO: 690423 - RNA, 19 nt, Homo sapiens
ugaaguaguuggaauuuug

SEQ ID NO: 690424 - RNA, 19 nt, Homo sapiens
agaggcaggugacuaugaa

SEQ ID NO: 690425 - RNA, 19 nt, Homo sapiens
gccaaaucauuccaguuga

SEQ ID NO: 690426 - RNA, 19 nt, Homo sapiens
caggcagucucucuccuuu

SEQ ID NO: 690427 - RNA, 19 nt, Homo sapiens
ggagcaagaaucacacuca

SEQ ID NO: 690428 - RNA, 19 nt, Homo sapiens
aaacagaagcacagagaug

SEQ ID NO: 690429 - RNA, 19 nt, Homo sapiens
uaaaaugacuggcuuagag

SEQ ID NO: 690430 - RNA, 19 nt, Homo sapiens
cuugaaagguugcacacuu

SEQ ID NO: 690431 - RNA, 19 nt, Homo sapiens
gaagaaacagaagcacaga

SEQ ID NO: 690432 - RNA, 19 nt, Homo sapiens
ccuugcaaguauucauuua

SEQ ID NO: 690433 - RNA, 19 nt, Homo sapiens
ugaugaaguuuggaauuug

SEQ ID NO: 690434 - RNA, 19 nt, Homo sapiens
ccucaagggagcaacguua

SEQ ID NO: 690435 - RNA, 19 nt, Homo sapiens
uaguaaagaugaugaacca

SEQ ID NO: 690436 - RNA, 19 nt, Homo sapiens
uuagaguacaugagcauua

SEQ ID NO: 690437 - RNA, 19 nt, Homo sapiens
uuacagaggauaacuuugu

SEQ ID NO: 690438 - RNA, 19 nt, Homo sapiens
ggagcaaugacagucuuua

SEQ ID NO: 690439 - RNA, 19 nt, Homo sapiens
ccaaaucauuccaguugag

SEQ ID NO: 690440 - RNA, 19 nt, Homo sapiens
agggucaacuuaagaauuc

SEQ ID NO: 690441 - RNA, 19 nt, Homo sapiens
ggagugagauuauauagua

SEQ ID NO: 690442 - RNA, 19 nt, Homo sapiens
uaagauaccuggaagauuu

SEQ ID NO: 690443 - RNA, 19 nt, Homo sapiens
gaacagagaugagcccuaa

SEQ ID NO: 690444 - RNA, 19 nt, Homo sapiens
gcacagagauguugauaca

SEQ ID NO: 690445 - RNA, 19 nt, Homo sapiens
caacagaguuccacagaug

SEQ ID NO: 690446 - RNA, 19 nt, Homo sapiens
gauaagcagugccuugaaa

SEQ ID NO: 690447 - RNA, 19 nt, Homo sapiens
cauggaagcuguucagaaa

SEQ ID NO: 690448 - RNA, 19 nt, Homo sapiens
gagcauuacuugguucaua

SEQ ID NO: 690449 - RNA, 19 nt, Homo sapiens
uaaaggaugugauggagaa

SEQ ID NO: 690450 - RNA, 19 nt, Homo sapiens
ggagagaaauugcuggaau

SEQ ID NO: 690451 - RNA, 19 nt, Homo sapiens
ggaauuguauuagauguug

SEQ ID NO: 690452 - RNA, 19 nt, Homo sapiens
gauaauggauggagcaagu

SEQ ID NO: 690453 - RNA, 19 nt, Homo sapiens
ucaaccagaugaugaagua

SEQ ID NO: 690454 - RNA, 19 nt, Homo sapiens
gaacauauuccaguauuug

SEQ ID NO: 690455 - RNA, 19 nt, Homo sapiens
ggaugaacauauuccagua

SEQ ID NO: 690456 - RNA, 19 nt, Homo sapiens
gggaguagauauuguccua

SEQ ID NO: 690457 - RNA, 19 nt, Homo sapiens
gaagcaagguaucauucuu

SEQ ID NO: 690458 - RNA, 19 nt, Homo sapiens
uugcuaagcuaucaaagua

SEQ ID NO: 690459 - RNA, 19 nt, Homo sapiens
gcacguuucucugcuaaga

SEQ ID NO: 690460 - RNA, 19 nt, Homo sapiens
gagaugagcccuaagauac

SEQ ID NO: 690461 - RNA, 19 nt, Homo sapiens
ucacacuacucuugauaaa

SEQ ID NO: 690462 - RNA, 19 nt, Homo sapiens
ccagauagccacugccuuu

SEQ ID NO: 690463 - RNA, 19 nt, Homo sapiens
gaguagauauuguccuaga

SEQ ID NO: 690464 - RNA, 19 nt, Homo sapiens
acagagauguugauacaga

SEQ ID NO: 690465 - RNA, 19 nt, Homo sapiens
gcaagugcauuugguacaa

SEQ ID NO: 690466 - RNA, 19 nt, Homo sapiens
ggaagcagcaggaagcauu

SEQ ID NO: 690467 - RNA, 19 nt, Homo sapiens
ugaaagagcuaaacuugac

SEQ ID NO: 690468 - RNA, 19 nt, Homo sapiens
uuccacagaugaagaaaua

SEQ ID NO: 690469 - RNA, 19 nt, Homo sapiens
ggauggagcaagugcauuu

SEQ ID NO: 690470 - RNA, 19 nt, Homo sapiens
ccagauaaauacaaagcuu

SEQ ID NO: 690471 - RNA, 19 nt, Homo sapiens
gaugaaguuuggaauuugu

SEQ ID NO: 690472 - RNA, 19 nt, Homo sapiens
gauaucaucacacuucuug

SEQ ID NO: 690473 - RNA, 19 nt, Homo sapiens
cuacaacuacuaccacaua

SEQ ID NO: 690474 - RNA, 19 nt, Homo sapiens
gcaugcagccuugaagaua

SEQ ID NO: 690475 - RNA, 19 nt, Homo sapiens
gaggauaacuuugugaaac

SEQ ID NO: 690476 - RNA, 19 nt, Homo sapiens
gaaagcuguuuggaagaaa

SEQ ID NO: 690477 - RNA, 19 nt, Homo sapiens
ugaaagcuguuuggaagaa

SEQ ID NO: 690478 - RNA, 19 nt, Homo sapiens
caugcagccuugaagauaa

SEQ ID NO: 690479 - RNA, 19 nt, Homo sapiens
ugaagacccuggacuuugu

SEQ ID NO: 690480 - RNA, 19 nt, Homo sapiens
uuaagucuuugcugucaua

SEQ ID NO: 690481 - RNA, 19 nt, Homo sapiens
gugcaaaugaucaagauaa

SEQ ID NO: 690482 - RNA, 19 nt, Homo sapiens
ggaaagcacacaucaccuu

SEQ ID NO: 690483 - RNA, 19 nt, Homo sapiens
uggcagaaaugaagaugaa

SEQ ID NO: 690484 - RNA, 19 nt, Homo sapiens
agucuuugcugucauaauu

SEQ ID NO: 690485 - RNA, 19 nt, Homo sapiens
ugagauguaaguacuguua

SEQ ID NO: 690486 - RNA, 19 nt, Homo sapiens
gcagugccuugaaagauuc

SEQ ID NO: 690487 - RNA, 19 nt, Homo sapiens
ucaguuggaugaacccauu

SEQ ID NO: 690488 - RNA, 19 nt, Homo sapiens
gaugcucaguugacacauu

SEQ ID NO: 690489 - RNA, 19 nt, Homo sapiens
aagacaagaugcucaguug

SEQ ID NO: 690490 - RNA, 19 nt, Homo sapiens
gcacacaucaccuugaaag

SEQ ID NO: 690491 - RNA, 19 nt, Homo sapiens
uagcuuuccugaaugauga

SEQ ID NO: 690492 - RNA, 19 nt, Homo sapiens
ugauguaucuaaugggaaa

SEQ ID NO: 690493 - RNA, 19 nt, Homo sapiens
acaccuuccuuaagucuuu

SEQ ID NO: 690494 - RNA, 19 nt, Homo sapiens
ucagucggaugaacauauu

SEQ ID NO: 690495 - RNA, 19 nt, Homo sapiens
ggcauccucugcuuauuga

SEQ ID NO: 690496 - RNA, 19 nt, Homo sapiens
gcaaguggcggagcaagaa

SEQ ID NO: 690497 - RNA, 19 nt, Homo sapiens
ucucaucucucuccuggaa

SEQ ID NO: 690498 - RNA, 19 nt, Homo sapiens
auacagcucugcauuaucu

SEQ ID NO: 690499 - RNA, 19 nt, Homo sapiens
caagguaucauucuuucaa

SEQ ID NO: 690500 - RNA, 19 nt, Homo sapiens
uagaggagccaaagugauu

SEQ ID NO: 690501 - RNA, 19 nt, Homo sapiens
ucaguuagcacaucauaga

SEQ ID NO: 690502 - RNA, 19 nt, Homo sapiens
cuauacagcucugcauuau

SEQ ID NO: 690503 - RNA, 19 nt, Homo sapiens
gaugaaguaguuggaauuu

SEQ ID NO: 690504 - RNA, 19 nt, Homo sapiens
aacguuagcuuuccugaau

SEQ ID NO: 690505 - RNA, 19 nt, Homo sapiens
acaguacaauugccugauu

SEQ ID NO: 690506 - RNA, 19 nt, Homo sapiens
auagagaacaguacaauug

SEQ ID NO: 690507 - RNA, 19 nt, Homo sapiens
gagccaaagugauuucaac

SEQ ID NO: 690508 - RNA, 19 nt, Homo sapiens
ggagcaagugcauuuggua

SEQ ID NO: 690509 - RNA, 19 nt, Homo sapiens
guucucaacaccuuccuua

SEQ ID NO: 690510 - RNA, 19 nt, Homo sapiens
ggauaacuuugugaaacuu

SEQ ID NO: 690511 - RNA, 19 nt, Homo sapiens
ugagccagauaaauacaaa

SEQ ID NO: 690512 - RNA, 19 nt, Homo sapiens
caguacaauugccugauuu

SEQ ID NO: 690513 - RNA, 19 nt, Homo sapiens
ccuauacagcucugcauua

SEQ ID NO: 690514 - RNA, 19 nt, Homo sapiens
gcaggccuuugcuaagcua

SEQ ID NO: 690515 - RNA, 19 nt, Homo sapiens
ccacauaaacaugauauca

SEQ ID NO: 690516 - RNA, 19 nt, Homo sapiens
ugaaccagcuguaaaacua

SEQ ID NO: 690517 - RNA, 19 nt, Homo sapiens
gaugaugaaccagcuguaa

SEQ ID NO: 690518 - RNA, 19 nt, Homo sapiens
aagcacacaucaccuugaa

SEQ ID NO: 690519 - RNA, 19 nt, Homo sapiens
agagaugagcccuaagaua

SEQ ID NO: 690520 - RNA, 19 nt, Homo sapiens
ggaggccacuggguaacaa

SEQ ID NO: 690521 - RNA, 19 nt, Homo sapiens
ccuagaugcuggagugaga

SEQ ID NO: 690522 - RNA, 19 nt, Homo sapiens
agaggcaggugacuaugaa

SEQ ID NO: 690523 - RNA, 19 nt, Homo sapiens
ugaaguaguuggaauuuug

SEQ ID NO: 690524 - RNA, 19 nt, Homo sapiens
gcuaagcuaucaaaguaac

SEQ ID NO: 690525 - RNA, 19 nt, Homo sapiens
guauuugaagccagaauuu

SEQ ID NO: 690526 - RNA, 19 nt, Homo sapiens
caggcagucucucuccuuu

SEQ ID NO: 690527 - RNA, 19 nt, Homo sapiens
ggagcaagaaucacacuca

SEQ ID NO: 690528 - RNA, 19 nt, Homo sapiens
aaacagaagcacagagaug

SEQ ID NO: 690529 - RNA, 19 nt, Homo sapiens
uuacagaggauaacuuugu

SEQ ID NO: 690530 - RNA, 19 nt, Homo sapiens
gaagaaacagaagcacaga

SEQ ID NO: 690531 - RNA, 19 nt, Homo sapiens
ccuugcaaguauucauuua

SEQ ID NO: 690532 - RNA, 19 nt, Homo sapiens
ugaugaaguuuggaauuug

SEQ ID NO: 690533 - RNA, 19 nt, Homo sapiens
ccucaagggagcaacguua

SEQ ID NO: 690534 - RNA, 19 nt, Homo sapiens
uaguaaagaugaugaacca

SEQ ID NO: 690535 - RNA, 19 nt, Homo sapiens
uuagaguacaugagcauua

SEQ ID NO: 690536 - RNA, 19 nt, Homo sapiens
gaugaacccauuccacugu

SEQ ID NO: 690537 - RNA, 19 nt, Homo sapiens
ucaguugacacauuugaaa

SEQ ID NO: 690538 - RNA, 19 nt, Homo sapiens
uuaacaauccuuccagcua

SEQ ID NO: 690539 - RNA, 19 nt, Homo sapiens
uaaccucacauuaaggaaa

SEQ ID NO: 690540 - RNA, 19 nt, Homo sapiens
uguaaguacuguuaucauc

SEQ ID NO: 690541 - RNA, 19 nt, Homo sapiens
gagauuagccugagaaaua

SEQ ID NO: 690542 - RNA, 19 nt, Homo sapiens
gaacauuucuguacuagug

SEQ ID NO: 690543 - RNA, 19 nt, Homo sapiens
gcaccacgcugaaggauga

SEQ ID NO: 690544 - RNA, 19 nt, Homo sapiens
ggacaaaacuuccaagauu

SEQ ID NO: 690545 - RNA, 19 nt, Homo sapiens
gaagagggaauaugcauug

SEQ ID NO: 690546 - RNA, 19 nt, Homo sapiens
guaaaucgauccagugucu

SEQ ID NO: 690547 - RNA, 19 nt, Homo sapiens
ggaaagugcgucauccuaa

SEQ ID NO: 690548 - RNA, 19 nt, Homo sapiens
caucaagggucacaguaaa

SEQ ID NO: 690549 - RNA, 19 nt, Homo sapiens
caagagcaaagguuaauuu

SEQ ID NO: 690550 - RNA, 19 nt, Homo sapiens
cggaaucacugguaaaugu

SEQ ID NO: 690551 - RNA, 19 nt, Homo sapiens
gaaagugcgucauccuaag

SEQ ID NO: 690552 - RNA, 19 nt, Homo sapiens
gcaagguggucacaguguu

SEQ ID NO: 690553 - RNA, 19 nt, Homo sapiens
gcgagcaccuaaacaaugu

SEQ ID NO: 690554 - RNA, 19 nt, Homo sapiens
ggugggauuuacgcaauua

SEQ ID NO: 690555 - RNA, 19 nt, Homo sapiens
gcagaaggagcaccuguug

SEQ ID NO: 690556 - RNA, 19 nt, Homo sapiens
gguaaauguuggcugagaa

SEQ ID NO: 690557 - RNA, 19 nt, Homo sapiens
gaccacagccgcuuuguca

SEQ ID NO: 690558 - RNA, 19 nt, Homo sapiens
gaaggaagggagaaguuug

SEQ ID NO: 690559 - RNA, 19 nt, Homo sapiens
ggaaggaagggagaaguuu

SEQ ID NO: 690560 - RNA, 19 nt, Homo sapiens
aggagcaccuguugaagua

SEQ ID NO: 690561 - RNA, 19 nt, Homo sapiens
gacaaaacuuccaagauuu

SEQ ID NO: 690562 - RNA, 19 nt, Homo sapiens
gagcaccuguugaaguaug

SEQ ID NO: 690563 - RNA, 19 nt, Homo sapiens
agauuagccugagaaauaa

SEQ ID NO: 690564 - RNA, 19 nt, Homo sapiens
aacaauguguggagcauaa

SEQ ID NO: 690565 - RNA, 19 nt, Homo sapiens
gcggcaaguccuacauuua

SEQ ID NO: 690566 - RNA, 19 nt, Homo sapiens
guaaacuaaucugucauug

SEQ ID NO: 690567 - RNA, 19 nt, Homo sapiens
cagcaaagccggaauucug

SEQ ID NO: 690568 - RNA, 19 nt, Homo sapiens
aaauaaagcgagcaccuaa

SEQ ID NO: 690569 - RNA, 19 nt, Homo sapiens
ggucaccguuucaccauca

SEQ ID NO: 690570 - RNA, 19 nt, Homo sapiens
ggacuacagcggacaagga

SEQ ID NO: 690571 - RNA, 19 nt, Homo sapiens
ggauuuacgcaauuaguug

SEQ ID NO: 690572 - RNA, 19 nt, Homo sapiens
agaauggaauuguggguau

SEQ ID NO: 690573 - RNA, 19 nt, Homo sapiens
acacagagcacgcccauca

SEQ ID NO: 690574 - RNA, 19 nt, Homo sapiens
aaccaaaccuugagaaugc

SEQ ID NO: 690575 - RNA, 19 nt, Homo sapiens
caaccaaaccuugagaaug

SEQ ID NO: 690576 - RNA, 19 nt, Homo sapiens
ggcggcaaguccuacauuu

SEQ ID NO: 690577 - RNA, 19 nt, Homo sapiens
gauuacaggacacaacaaa

SEQ ID NO: 690578 - RNA, 19 nt, Homo sapiens
agaaggagcaccuguugaa

SEQ ID NO: 690579 - RNA, 19 nt, Homo sapiens
agacauugcuuggacugaa

SEQ ID NO: 690580 - RNA, 19 nt, Homo sapiens
ccagcaagguggucacagu

SEQ ID NO: 690581 - RNA, 19 nt, Homo sapiens
ggaaaggccacacgaacca

SEQ ID NO: 690582 - RNA, 19 nt, Homo sapiens
gagccacgacggacacauu

SEQ ID NO: 690583 - RNA, 19 nt, Homo sapiens
gcagucuuccucugggaua

SEQ ID NO: 690584 - RNA, 19 nt, Homo sapiens
ggaaucacugguaaauguu

SEQ ID NO: 690585 - RNA, 19 nt, Homo sapiens
ggaauuguggguaucuuuc

SEQ ID NO: 690586 - RNA, 19 nt, Homo sapiens
ggcaguagccuccaaagca

SEQ ID NO: 690587 - RNA, 19 nt, Homo sapiens
ccacgggaagcgaugauaa

SEQ ID NO: 690588 - RNA, 19 nt, Homo sapiens
ggacacaacaaagucauca

SEQ ID NO: 690589 - RNA, 19 nt, Homo sapiens
gggaagaucaaagacauug

SEQ ID NO: 690590 - RNA, 19 nt, Homo sapiens
cgaaccagguguccaggau

SEQ ID NO: 690591 - RNA, 19 nt, Homo sapiens
gagauuacaggacacaaca

SEQ ID NO: 690592 - RNA, 19 nt, Homo sapiens
aaagcgagcaccuaaacaa

SEQ ID NO: 690593 - RNA, 19 nt, Homo sapiens
gcuacgagcccgaaguugu

SEQ ID NO: 690594 - RNA, 19 nt, Homo sapiens
gugcugacggccagauaua

SEQ ID NO: 690595 - RNA, 19 nt, Homo sapiens
gugcgauucucuccugaug

SEQ ID NO: 690596 - RNA, 19 nt, Homo sapiens
uaagagauuagccugagaa

SEQ ID NO: 690597 - RNA, 19 nt, Homo sapiens
gaaucacugguaaauguug

SEQ ID NO: 690598 - RNA, 19 nt, Homo sapiens
cguacgagaucaagaaggu

SEQ ID NO: 690599 - RNA, 19 nt, Homo sapiens
gaauggaauuguggguauc

SEQ ID NO: 690600 - RNA, 19 nt, Homo sapiens
gagaagagggaauaugcau

SEQ ID NO: 690601 - RNA, 19 nt, Homo sapiens
gggauuuacgcaauuaguu

SEQ ID NO: 690602 - RNA, 19 nt, Homo sapiens
gggaaggaagggagaaguu

SEQ ID NO: 690603 - RNA, 19 nt, Homo sapiens
uuugagcgcuuuaagagau

SEQ ID NO: 690604 - RNA, 19 nt, Homo sapiens
aaccagguguccaggauga

SEQ ID NO: 690605 - RNA, 19 nt, Homo sapiens
cacauuaauuacugggauu

SEQ ID NO: 690606 - RNA, 19 nt, Homo sapiens
ccauucaaguucaaguuca

SEQ ID NO: 690607 - RNA, 19 nt, Homo sapiens
gccugucaguguuuacaaa

SEQ ID NO: 690608 - RNA, 19 nt, Homo sapiens
ccuuguggcugccuucaga

SEQ ID NO: 690609 - RNA, 19 nt, Homo sapiens
gcccagcggauucuacauu

SEQ ID NO: 690610 - RNA, 19 nt, Homo sapiens
aagcugaggaucugggaua

SEQ ID NO: 690611 - RNA, 19 nt, Homo sapiens
cuagugagaagagggaaua

SEQ ID NO: 690612 - RNA, 19 nt, Homo sapiens
acgacggacacauuaauua

SEQ ID NO: 690613 - RNA, 19 nt, Homo sapiens
ccggguacaucaacuaucu

SEQ ID NO: 690614 - RNA, 19 nt, Homo sapiens
uugcugacaucuacacaga

SEQ ID NO: 690615 - RNA, 19 nt, Homo sapiens
gagcgccaccuccagauca

SEQ ID NO: 690616 - RNA, 19 nt, Homo sapiens
gcaacguccgccuguauuc

SEQ ID NO: 690617 - RNA, 19 nt, Homo sapiens
gggacacgguggcaauugg

SEQ ID NO: 690618 - RNA, 19 nt, Homo sapiens
uaaacaauguguggagcau

SEQ ID NO: 690619 - RNA, 19 nt, Homo sapiens
gaggaugccguacgagauc

SEQ ID NO: 690620 - RNA, 19 nt, Homo sapiens
ccacgacggacacauuaau

SEQ ID NO: 690621 - RNA, 19 nt, Homo sapiens
caacagcguggacaucaag

SEQ ID NO: 690622 - RNA, 19 nt, Homo sapiens
ucaacagcguggacaucaa

SEQ ID NO: 690623 - RNA, 19 nt, Homo sapiens
acaacaaagucaucaacag

SEQ ID NO: 690624 - RNA, 19 nt, Homo sapiens
gacauugcuuggacugaag

SEQ ID NO: 690625 - RNA, 19 nt, Homo sapiens
cuacagcggacaaggaguu

SEQ ID NO: 690626 - RNA, 19 nt, Homo sapiens
cccagcggauucuacauug

SEQ ID NO: 690627 - RNA, 19 nt, Homo sapiens
uuacaggacacaacaaagu

SEQ ID NO: 690628 - RNA, 19 nt, Homo sapiens
gaagaucaaagacauugcu

SEQ ID NO: 690629 - RNA, 19 nt, Homo sapiens
aagccggaauucuguguug

SEQ ID NO: 690630 - RNA, 19 nt, Homo sapiens
aaacauuccagaggcagua

SEQ ID NO: 690631 - RNA, 19 nt, Homo sapiens
ucaucaagggucacaguaa

SEQ ID NO: 690632 - RNA, 19 nt, Homo sapiens
cuacauugccuccggagau

SEQ ID NO: 690633 - RNA, 19 nt, Homo sapiens
cgacggacacauuaauuac

SEQ ID NO: 690634 - RNA, 19 nt, Homo sapiens
gggauaccacgcagaagga

SEQ ID NO: 690635 - RNA, 19 nt, Homo sapiens
ugagcgcuuuaagagauua

SEQ ID NO: 690636 - RNA, 19 nt, Homo sapiens
guucagcaaagccggaauu

SEQ ID NO: 690637 - RNA, 19 nt, Homo sapiens
ugaaggaucagaggaagug

SEQ ID NO: 690638 - RNA, 19 nt, Homo sapiens
ccaggaugaccguggauga

SEQ ID NO: 690639 - RNA, 19 nt, Homo sapiens
gcuacucggagaacaaugu

SEQ ID NO: 690640 - RNA, 19 nt, Homo sapiens
cgugugcauuggacagauu

SEQ ID NO: 690641 - RNA, 19 nt, Homo sapiens
gagauuagccugagaaaua

SEQ ID NO: 690642 - RNA, 19 nt, Homo sapiens
gaacauuucuguacuagug

SEQ ID NO: 690643 - RNA, 19 nt, Homo sapiens
gcaccacgcugaaggauga

SEQ ID NO: 690644 - RNA, 19 nt, Homo sapiens
gaacaugucauuucucuau

SEQ ID NO: 690645 - RNA, 19 nt, Homo sapiens
ggacaaaacuuccaagauu

SEQ ID NO: 690646 - RNA, 19 nt, Homo sapiens
gaagagggaauaugcauug

SEQ ID NO: 690647 - RNA, 19 nt, Homo sapiens
guaaaucgauccagugucu

SEQ ID NO: 690648 - RNA, 19 nt, Homo sapiens
ggaaagugcgucauccuaa

SEQ ID NO: 690649 - RNA, 19 nt, Homo sapiens
caucaagggucacaguaaa

SEQ ID NO: 690650 - RNA, 19 nt, Homo sapiens
caagagcaaagguuaauuu

SEQ ID NO: 690651 - RNA, 19 nt, Homo sapiens
cggaaucacugguaaaugu

SEQ ID NO: 690652 - RNA, 19 nt, Homo sapiens
gaaagugcgucauccuaag

SEQ ID NO: 690653 - RNA, 19 nt, Homo sapiens
ugaaagcuuuagacaguaa

SEQ ID NO: 690654 - RNA, 19 nt, Homo sapiens
gaaucaggcacuagaguuu

SEQ ID NO: 690655 - RNA, 19 nt, Homo sapiens
gcaagguggucacaguguu

SEQ ID NO: 690656 - RNA, 19 nt, Homo sapiens
ucugaaagcuuuagacagu

SEQ ID NO: 690657 - RNA, 19 nt, Homo sapiens
ggugggauuuacgcaauua

SEQ ID NO: 690658 - RNA, 19 nt, Homo sapiens
gcagaaggagcaccuguug

SEQ ID NO: 690659 - RNA, 19 nt, Homo sapiens
gguaaauguuggcugagaa

SEQ ID NO: 690660 - RNA, 19 nt, Homo sapiens
gaccacagccgcuuuguca

SEQ ID NO: 690661 - RNA, 19 nt, Homo sapiens
gaaggaagggagaaguuug

SEQ ID NO: 690662 - RNA, 19 nt, Homo sapiens
ggaaggaagggagaaguuu

SEQ ID NO: 690663 - RNA, 19 nt, Homo sapiens
aggagcaccuguugaagua

SEQ ID NO: 690664 - RNA, 19 nt, Homo sapiens
gacaaaacuuccaagauuu

SEQ ID NO: 690665 - RNA, 19 nt, Homo sapiens
gagcaccuguugaaguaug

SEQ ID NO: 690666 - RNA, 19 nt, Homo sapiens
agauuagccugagaaauaa

SEQ ID NO: 690667 - RNA, 19 nt, Homo sapiens
aacaauguguggagcauaa

SEQ ID NO: 690668 - RNA, 19 nt, Homo sapiens
gcggcaaguccuacauuua

SEQ ID NO: 690669 - RNA, 19 nt, Homo sapiens
guaaacuaaucugucauug

SEQ ID NO: 690670 - RNA, 19 nt, Homo sapiens
cagcaaagccggaauucug

SEQ ID NO: 690671 - RNA, 19 nt, Homo sapiens
ggucaccguuucaccauca

SEQ ID NO: 690672 - RNA, 19 nt, Homo sapiens
guaacaguuugcacaugaa

SEQ ID NO: 690673 - RNA, 19 nt, Homo sapiens
aguaacaguuugcacauga

SEQ ID NO: 690674 - RNA, 19 nt, Homo sapiens
ggacuacagcggacaagga

SEQ ID NO: 690675 - RNA, 19 nt, Homo sapiens
ggauuuacgcaauuaguug

SEQ ID NO: 690676 - RNA, 19 nt, Homo sapiens
agaauggaauuguggguau

SEQ ID NO: 690677 - RNA, 19 nt, Homo sapiens
acacagagcacgcccauca

SEQ ID NO: 690678 - RNA, 19 nt, Homo sapiens
aaccaaaccuugagaaugc

SEQ ID NO: 690679 - RNA, 19 nt, Homo sapiens
caaccaaaccuugagaaug

SEQ ID NO: 690680 - RNA, 19 nt, Homo sapiens
gucaaggaguggacaauca

SEQ ID NO: 690681 - RNA, 19 nt, Homo sapiens
ggcggcaaguccuacauuu

SEQ ID NO: 690682 - RNA, 19 nt, Homo sapiens
gauuacaggacacaacaaa

SEQ ID NO: 690683 - RNA, 19 nt, Homo sapiens
agaaggagcaccuguugaa

SEQ ID NO: 690684 - RNA, 19 nt, Homo sapiens
cccagacaaugaacacuuu

SEQ ID NO: 690685 - RNA, 19 nt, Homo sapiens
agacauugcuuggacugaa

SEQ ID NO: 690686 - RNA, 19 nt, Homo sapiens
ccagcaagguggucacagu

SEQ ID NO: 690687 - RNA, 19 nt, Homo sapiens
ggaaaggccacacgaacca

SEQ ID NO: 690688 - RNA, 19 nt, Homo sapiens
gagccacgacggacacauu

SEQ ID NO: 690689 - RNA, 19 nt, Homo sapiens
gcagucuuccucugggaua

SEQ ID NO: 690690 - RNA, 19 nt, Homo sapiens
ggaaucacugguaaauguu

SEQ ID NO: 690691 - RNA, 19 nt, Homo sapiens
ggaauuguggguaucuuuc

SEQ ID NO: 690692 - RNA, 19 nt, Homo sapiens
ggcaguagccuccaaagca

SEQ ID NO: 690693 - RNA, 19 nt, Homo sapiens
ccacgggaagcgaugauaa

SEQ ID NO: 690694 - RNA, 19 nt, Homo sapiens
ggacacaacaaagucauca

SEQ ID NO: 690695 - RNA, 19 nt, Homo sapiens
gggaagaucaaagacauug

SEQ ID NO: 690696 - RNA, 19 nt, Homo sapiens
cgaaccagguguccaggau

SEQ ID NO: 690697 - RNA, 19 nt, Homo sapiens
gagauuacaggacacaaca

SEQ ID NO: 690698 - RNA, 19 nt, Homo sapiens
cagcggaacaugucauuuc

SEQ ID NO: 690699 - RNA, 19 nt, Homo sapiens
gcuacgagcccgaaguugu

SEQ ID NO: 690700 - RNA, 19 nt, Homo sapiens
gugcugacggccagauaua

SEQ ID NO: 690701 - RNA, 19 nt, Homo sapiens
gugcgauucucuccugaug

SEQ ID NO: 690702 - RNA, 19 nt, Homo sapiens
uaagagauuagccugagaa

SEQ ID NO: 690703 - RNA, 19 nt, Homo sapiens
gaaucacugguaaauguug

SEQ ID NO: 690704 - RNA, 19 nt, Homo sapiens
cguacgagaucaagaaggu

SEQ ID NO: 690705 - RNA, 19 nt, Homo sapiens
gaauggaauuguggguauc

SEQ ID NO: 690706 - RNA, 19 nt, Homo sapiens
gagaagagggaauaugcau

SEQ ID NO: 690707 - RNA, 19 nt, Homo sapiens
caugucauuucucuauuuc

SEQ ID NO: 690708 - RNA, 19 nt, Homo sapiens
cggaacaugucauuucucu

SEQ ID NO: 690709 - RNA, 19 nt, Homo sapiens
gucacgaccucccaugaug

SEQ ID NO: 690710 - RNA, 19 nt, Homo sapiens
gggauuuacgcaauuaguu

SEQ ID NO: 690711 - RNA, 19 nt, Homo sapiens
gggaaggaagggagaaguu

SEQ ID NO: 690712 - RNA, 19 nt, Homo sapiens
uuugagcgcuuuaagagau

SEQ ID NO: 690713 - RNA, 19 nt, Homo sapiens
cgaaucaggcacuagaguu

SEQ ID NO: 690714 - RNA, 19 nt, Homo sapiens
aaccagguguccaggauga

SEQ ID NO: 690715 - RNA, 19 nt, Homo sapiens
cacauuaauuacugggauu

SEQ ID NO: 690716 - RNA, 19 nt, Homo sapiens
ccauucaaguucaaguuca

SEQ ID NO: 690717 - RNA, 19 nt, Homo sapiens
gcccagcggauucuacauu

SEQ ID NO: 690718 - RNA, 19 nt, Homo sapiens
gccugucaguguuuacaaa

SEQ ID NO: 690719 - RNA, 19 nt, Homo sapiens
ccuuguggcugccuucaga

SEQ ID NO: 690720 - RNA, 19 nt, Homo sapiens
uaacugcagcggaacaugu

SEQ ID NO: 690721 - RNA, 19 nt, Homo sapiens
gaccgaaucaggcacuaga

SEQ ID NO: 690722 - RNA, 19 nt, Homo sapiens
aagcugaggaucugggaua

SEQ ID NO: 690723 - RNA, 19 nt, Homo sapiens
cuagugagaagagggaaua

SEQ ID NO: 690724 - RNA, 19 nt, Homo sapiens
uguacacguucuucugaaa

SEQ ID NO: 690725 - RNA, 19 nt, Homo sapiens
ggaaaccagagucaagauc

SEQ ID NO: 690726 - RNA, 19 nt, Homo sapiens
acgacggacacauuaauua

SEQ ID NO: 690727 - RNA, 19 nt, Homo sapiens
ccggguacaucaacuaucu

SEQ ID NO: 690728 - RNA, 19 nt, Homo sapiens
uugcugacaucuacacaga

SEQ ID NO: 690729 - RNA, 19 nt, Homo sapiens
gagcgccaccuccagauca

SEQ ID NO: 690730 - RNA, 19 nt, Homo sapiens
uaacaguuugcacaugaaa

SEQ ID NO: 690731 - RNA, 19 nt, Homo sapiens
ugucauuucucuauuucug

SEQ ID NO: 690732 - RNA, 19 nt, Homo sapiens
gcaacguccgccuguauuc

SEQ ID NO: 690733 - RNA, 19 nt, Homo sapiens
gggacacgguggcaauugg

SEQ ID NO: 690734 - RNA, 19 nt, Homo sapiens
uaaacaauguguggagcau

SEQ ID NO: 690735 - RNA, 19 nt, Homo sapiens
caggagggcccagucauga

SEQ ID NO: 690736 - RNA, 19 nt, Homo sapiens
gaggaugccguacgagauc

SEQ ID NO: 690737 - RNA, 19 nt, Homo sapiens
ccacgacggacacauuaau

SEQ ID NO: 690738 - RNA, 19 nt, Homo sapiens
caacagcguggacaucaag

SEQ ID NO: 690739 - RNA, 19 nt, Homo sapiens
ucaacagcguggacaucaa

SEQ ID NO: 690740 - RNA, 19 nt, Homo sapiens
acaacaaagucaucaacag

SEQ ID NO: 690741 - RNA, 19 nt, Homo sapiens
gaagaugucugugauuauu

SEQ ID NO: 690742 - RNA, 19 nt, Homo sapiens
gaagauuggucgagacaaa

SEQ ID NO: 690743 - RNA, 19 nt, Homo sapiens
gaccauagacuccuuauug

SEQ ID NO: 690744 - RNA, 19 nt, Homo sapiens
guacauggcauuagaauag

SEQ ID NO: 690745 - RNA, 19 nt, Homo sapiens
gagcuaugcugaauaccuu

SEQ ID NO: 690746 - RNA, 19 nt, Homo sapiens
acaaagcuccgauuacuaa

SEQ ID NO: 690747 - RNA, 19 nt, Homo sapiens
gaggaaaggaggauacaaa

SEQ ID NO: 690748 - RNA, 19 nt, Homo sapiens
ggauacaaagcuccgauua

SEQ ID NO: 690749 - RNA, 19 nt, Homo sapiens
uuacguggaugcauaggua

SEQ ID NO: 690750 - RNA, 19 nt, Homo sapiens
aagauuacguggaugcaua

SEQ ID NO: 690751 - RNA, 19 nt, Homo sapiens
aaacugaccagguaucgua

SEQ ID NO: 690752 - RNA, 19 nt, Homo sapiens
uugaagaugucugugauua

SEQ ID NO: 690753 - RNA, 19 nt, Homo sapiens
ucacuaacuuugaagaugu

SEQ ID NO: 690754 - RNA, 19 nt, Homo sapiens
ccagugcccuuaaagauag

SEQ ID NO: 690755 - RNA, 19 nt, Homo sapiens
gcucuacugucaccuguau

SEQ ID NO: 690756 - RNA, 19 nt, Homo sapiens
gaaaggaggauacaaagcu

SEQ ID NO: 690757 - RNA, 19 nt, Homo sapiens
gaccagguaucguagugaa

SEQ ID NO: 690758 - RNA, 19 nt, Homo sapiens
ccauaaaacugaccaggua

SEQ ID NO: 690759 - RNA, 19 nt, Homo sapiens
gggagacuguuccaagaug

SEQ ID NO: 690760 - RNA, 19 nt, Homo sapiens
uaccggagguugcaaagga

SEQ ID NO: 690761 - RNA, 19 nt, Homo sapiens
ggguguacauggcauuaga

SEQ ID NO: 690762 - RNA, 19 nt, Homo sapiens
gacaaaagauuacguggau

SEQ ID NO: 690763 - RNA, 19 nt, Homo sapiens
gaugagcugccacggcuuu

SEQ ID NO: 690764 - RNA, 19 nt, Homo sapiens
auacaaagcuccgauuacu

SEQ ID NO: 690765 - RNA, 19 nt, Homo sapiens
acugucaccuguauggaua

SEQ ID NO: 690766 - RNA, 19 nt, Homo sapiens
gaccauauacagaccauag

SEQ ID NO: 690767 - RNA, 19 nt, Homo sapiens
agaugucugugauuauuug

SEQ ID NO: 690768 - RNA, 19 nt, Homo sapiens
gcucaucgccagcaucauc

SEQ ID NO: 690769 - RNA, 19 nt, Homo sapiens
accauagacuccuuauuga

SEQ ID NO: 690770 - RNA, 19 nt, Homo sapiens
cagcucgccucacuuaugg

SEQ ID NO: 690771 - RNA, 19 nt, Homo sapiens
uuuguaacauggaagauug

SEQ ID NO: 690772 - RNA, 19 nt, Homo sapiens
ggucuaaccggaggaggua

SEQ ID NO: 690773 - RNA, 19 nt, Homo sapiens
ucgaugugcucuacuguca

SEQ ID NO: 690774 - RNA, 19 nt, Homo sapiens
cgccagcucgccucacuua

SEQ ID NO: 690775 - RNA, 19 nt, Homo sapiens
ccugagcuaugcugaauac

SEQ ID NO: 690776 - RNA, 19 nt, Homo sapiens
gauacaaagcuccgauuac

SEQ ID NO: 690777 - RNA, 19 nt, Homo sapiens
ggacugggaggugggugua

SEQ ID NO: 690778 - RNA, 19 nt, Homo sapiens
guggaugcauagguacuuu

SEQ ID NO: 690779 - RNA, 19 nt, Homo sapiens
acacugagccgcacaacca

SEQ ID NO: 690780 - RNA, 19 nt, Homo sapiens
ccagcucgccucacuuaug

SEQ ID NO: 690781 - RNA, 19 nt, Homo sapiens
uaacuuugaagaugucugu

SEQ ID NO: 690782 - RNA, 19 nt, Homo sapiens
ugucucugcucacuaacuu

SEQ ID NO: 690783 - RNA, 19 nt, Homo sapiens
cucagggaguacacacuua

SEQ ID NO: 690784 - RNA, 19 nt, Homo sapiens
gugaagaagcagaaacugu

SEQ ID NO: 690785 - RNA, 19 nt, Homo sapiens
ccauuauuccugacacuga

SEQ ID NO: 690786 - RNA, 19 nt, Homo sapiens
aaagaugacccugagcuau

SEQ ID NO: 690787 - RNA, 19 nt, Homo sapiens
ugaagaugucugugauuau

SEQ ID NO: 690788 - RNA, 19 nt, Homo sapiens
aagaugacccugagcuaug

SEQ ID NO: 690789 - RNA, 19 nt, Homo sapiens
ccaggagacccuacaccuu

SEQ ID NO: 690790 - RNA, 19 nt, Homo sapiens
cgccauacaaccauuauuc

SEQ ID NO: 690791 - RNA, 19 nt, Homo sapiens
accagugcccuuaaagaua

SEQ ID NO: 690792 - RNA, 19 nt, Homo sapiens
gaauucaggaaaaccauaa

SEQ ID NO: 690793 - RNA, 19 nt, Homo sapiens
gcuucgaugugcucuacug

SEQ ID NO: 690794 - RNA, 19 nt, Homo sapiens
uacaaagcuccgauuacua

SEQ ID NO: 690795 - RNA, 19 nt, Homo sapiens
ggaaaggaggauacaaagc

SEQ ID NO: 690796 - RNA, 19 nt, Homo sapiens
uaccagugcccuuaaagau

SEQ ID NO: 690797 - RNA, 19 nt, Homo sapiens
uacauggcauuagaauaga

SEQ ID NO: 690798 - RNA, 19 nt, Homo sapiens
cagcaucaucauuuccaaa

SEQ ID NO: 690799 - RNA, 19 nt, Homo sapiens
ccagcaucaucauuuccaa

SEQ ID NO: 690800 - RNA, 19 nt, Homo sapiens
acauggcauuagaauagaa

SEQ ID NO: 690801 - RNA, 19 nt, Homo sapiens
gcucacuaacuuugaagau

SEQ ID NO: 690802 - RNA, 19 nt, Homo sapiens
gguggugucagcagagaug

SEQ ID NO: 690803 - RNA, 19 nt, Homo sapiens
ggaguggggacccuacuuu

SEQ ID NO: 690804 - RNA, 19 nt, Homo sapiens
ucgccagcaucaucauuuc

SEQ ID NO: 690805 - RNA, 19 nt, Homo sapiens
cucacuaacuuugaagaug

SEQ ID NO: 690806 - RNA, 19 nt, Homo sapiens
ucugcucacuaacuuugaa

SEQ ID NO: 690807 - RNA, 19 nt, Homo sapiens
ggaaucagcuuaccaauaa

SEQ ID NO: 690808 - RNA, 19 nt, Homo sapiens
caaagagacucaagaagaa

SEQ ID NO: 690809 - RNA, 19 nt, Homo sapiens
ccaaauagcugggcagaaa

SEQ ID NO: 690810 - RNA, 19 nt, Homo sapiens
ggaccuaaaucuacguaua

SEQ ID NO: 690811 - RNA, 19 nt, Homo sapiens
guacaaguauucuaccuaa

SEQ ID NO: 690812 - RNA, 19 nt, Homo sapiens
ugacauugauuauggguua

SEQ ID NO: 690813 - RNA, 19 nt, Homo sapiens
gaaguucagucuuuaaauc

SEQ ID NO: 690814 - RNA, 19 nt, Homo sapiens
gcagaaagcauccaaacaa

SEQ ID NO: 690815 - RNA, 19 nt, Homo sapiens
gaacagugcacaagauuau

SEQ ID NO: 690816 - RNA, 19 nt, Homo sapiens
gaaagcauccaaacaagaa

SEQ ID NO: 690817 - RNA, 19 nt, Homo sapiens
gaagaggguugaugaacug

SEQ ID NO: 690818 - RNA, 19 nt, Homo sapiens
gaaauggaacgucagaauu

SEQ ID NO: 690819 - RNA, 19 nt, Homo sapiens
gaaaaugugucaucaaaug

SEQ ID NO: 690820 - RNA, 19 nt, Homo sapiens
ggaauuaauugacuacaag

SEQ ID NO: 690821 - RNA, 19 nt, Homo sapiens
gaaccaagcccaguuguug

SEQ ID NO: 690822 - RNA, 19 nt, Homo sapiens
caggagagcuauaaacaga

SEQ ID NO: 690823 - RNA, 19 nt, Homo sapiens
caacagcucucaguaggaa

SEQ ID NO: 690824 - RNA, 19 nt, Homo sapiens
gaacaaagaacacauugca

SEQ ID NO: 690825 - RNA, 19 nt, Homo sapiens
gaagaucuuuaucgaacaa

SEQ ID NO: 690826 - RNA, 19 nt, Homo sapiens
ggaucugcaugaccaaaua

SEQ ID NO: 690827 - RNA, 19 nt, Homo sapiens
aaacuaaucuggcaggaau

SEQ ID NO: 690828 - RNA, 19 nt, Homo sapiens
ccaaagagacucaagaaga

SEQ ID NO: 690829 - RNA, 19 nt, Homo sapiens
gcucagcucugcuuuaucu

SEQ ID NO: 690830 - RNA, 19 nt, Homo sapiens
gcaaguuaaugaagcagaa

SEQ ID NO: 690831 - RNA, 19 nt, Homo sapiens
guaacagccugcagaauca

SEQ ID NO: 690832 - RNA, 19 nt, Homo sapiens
caaagcugcuaguucaauu

SEQ ID NO: 690833 - RNA, 19 nt, Homo sapiens
ggagagcuauaaacagaug

SEQ ID NO: 690834 - RNA, 19 nt, Homo sapiens
ccaaccauauggcaaauga

SEQ ID NO: 690835 - RNA, 19 nt, Homo sapiens
ugauuguucuguugacuua

SEQ ID NO: 690836 - RNA, 19 nt, Homo sapiens
agaggaaucuucaaaggaa

SEQ ID NO: 690837 - RNA, 19 nt, Homo sapiens
ggucaugauuguucuguug

SEQ ID NO: 690838 - RNA, 19 nt, Homo sapiens
ucgcaaagcugcuaguuca

SEQ ID NO: 690839 - RNA, 19 nt, Homo sapiens
gcauggagcuggaagaacu

SEQ ID NO: 690840 - RNA, 19 nt, Homo sapiens
cuaccuaaaucuuccaauu

SEQ ID NO: 690841 - RNA, 19 nt, Homo sapiens
gaacuucaccagcaaaaua

SEQ ID NO: 690842 - RNA, 19 nt, Homo sapiens
ggaaauggaacgucagaau

SEQ ID NO: 690843 - RNA, 19 nt, Homo sapiens
gcacucgucugcgaaaugu

SEQ ID NO: 690844 - RNA, 19 nt, Homo sapiens
gaaagaaggcucugguuuu

SEQ ID NO: 690845 - RNA, 19 nt, Homo sapiens
gaaagaaaauacucagaug

SEQ ID NO: 690846 - RNA, 19 nt, Homo sapiens
aaacaaagcaagagcaaga

SEQ ID NO: 690847 - RNA, 19 nt, Homo sapiens
caaaucacaugaacugucu

SEQ ID NO: 690848 - RNA, 19 nt, Homo sapiens
ccaugaaggucaagaggaa

SEQ ID NO: 690849 - RNA, 19 nt, Homo sapiens
cagggaaacuaauuguauu

SEQ ID NO: 690850 - RNA, 19 nt, Homo sapiens
ggaguuccacuauauagaa

SEQ ID NO: 690851 - RNA, 19 nt, Homo sapiens
ccaaguagaugaccugacu

SEQ ID NO: 690852 - RNA, 19 nt, Homo sapiens
gccaguaacucagauucua

SEQ ID NO: 690853 - RNA, 19 nt, Homo sapiens
ccacgaagcugccaguaac

SEQ ID NO: 690854 - RNA, 19 nt, Homo sapiens
caucaugucuugguuuguu

SEQ ID NO: 690855 - RNA, 19 nt, Homo sapiens
gaagaagaggguugaugaa

SEQ ID NO: 690856 - RNA, 19 nt, Homo sapiens
ggaaagacaaugccagcaa

SEQ ID NO: 690857 - RNA, 19 nt, Homo sapiens
ggucuucgauuaauauguc

SEQ ID NO: 690858 - RNA, 19 nt, Homo sapiens
gaacuccgccucuggaagu

SEQ ID NO: 690859 - RNA, 19 nt, Homo sapiens
acaaagaacacauugcaaa

SEQ ID NO: 690860 - RNA, 19 nt, Homo sapiens
gcaggaguuccacuauaua

SEQ ID NO: 690861 - RNA, 19 nt, Homo sapiens
aagcaggaguuccacuaua

SEQ ID NO: 690862 - RNA, 19 nt, Homo sapiens
augaugagcugcuguuuga

SEQ ID NO: 690863 - RNA, 19 nt, Homo sapiens
caaguauucuaccuaaauc

SEQ ID NO: 690864 - RNA, 19 nt, Homo sapiens
gcagugauugguugucuuu

SEQ ID NO: 690865 - RNA, 19 nt, Homo sapiens
ccagauacaucagcucaga

SEQ ID NO: 690866 - RNA, 19 nt, Homo sapiens
aauggaacgucagaauuua

SEQ ID NO: 690867 - RNA, 19 nt, Homo sapiens
gaaaaugcaucuguuccua

SEQ ID NO: 690868 - RNA, 19 nt, Homo sapiens
aauuaaagaucgagacgaa

SEQ ID NO: 690869 - RNA, 19 nt, Homo sapiens
gguaacagccugcagaauc

SEQ ID NO: 690870 - RNA, 19 nt, Homo sapiens
gaaagugagacuccaggaa

SEQ ID NO: 690871 - RNA, 19 nt, Homo sapiens
gagaacagugcacaagauu

SEQ ID NO: 690872 - RNA, 19 nt, Homo sapiens
gcaccacgaccaaccauau

SEQ ID NO: 690873 - RNA, 19 nt, Homo sapiens
gaugagcugcuguuugauu

SEQ ID NO: 690874 - RNA, 19 nt, Homo sapiens
gcugauaacauucgaaauc

SEQ ID NO: 690875 - RNA, 19 nt, Homo sapiens
gaccuaaaucuacguauau

SEQ ID NO: 690876 - RNA, 19 nt, Homo sapiens
gagaacaguuacaggaucu

SEQ ID NO: 690877 - RNA, 19 nt, Homo sapiens
ugaaagaaggcucugguuu

SEQ ID NO: 690878 - RNA, 19 nt, Homo sapiens
aagucaagcuguauaaguu

SEQ ID NO: 690879 - RNA, 19 nt, Homo sapiens
ucaaagagugaucgaauga

SEQ ID NO: 690880 - RNA, 19 nt, Homo sapiens
agacaaugccagcaacaua

SEQ ID NO: 690881 - RNA, 19 nt, Homo sapiens
aacaagaacuagagacaga

SEQ ID NO: 690882 - RNA, 19 nt, Homo sapiens
gcaauuacacuggccgaaa

SEQ ID NO: 690883 - RNA, 19 nt, Homo sapiens
ugagaacagugcacaagau

SEQ ID NO: 690884 - RNA, 19 nt, Homo sapiens
gagagcaggagagcuauaa

SEQ ID NO: 690885 - RNA, 19 nt, Homo sapiens
gaaucaagcucugcagacu

SEQ ID NO: 690886 - RNA, 19 nt, Homo sapiens
cuccaaagauccaaagaga

SEQ ID NO: 690887 - RNA, 19 nt, Homo sapiens
gacaaugccagcaacauau

SEQ ID NO: 690888 - RNA, 19 nt, Homo sapiens
cgauuaauaugucuggaau

SEQ ID NO: 690889 - RNA, 19 nt, Homo sapiens
gaaucagcuuaccaauaaa

SEQ ID NO: 690890 - RNA, 19 nt, Homo sapiens
caaagcagaauuaaagauc

SEQ ID NO: 690891 - RNA, 19 nt, Homo sapiens
cagaaagcauccaaacaag

SEQ ID NO: 690892 - RNA, 19 nt, Homo sapiens
caauuacacuggccgaaag

SEQ ID NO: 690893 - RNA, 19 nt, Homo sapiens
gaggaaucuucaaaggaaa

SEQ ID NO: 690894 - RNA, 19 nt, Homo sapiens
cuaguucaauugaucaguu

SEQ ID NO: 690895 - RNA, 19 nt, Homo sapiens
aaacucaggaaucagcuua

SEQ ID NO: 690896 - RNA, 19 nt, Homo sapiens
gcaaagcagaauuaaagau

SEQ ID NO: 690897 - RNA, 19 nt, Homo sapiens
gaagcaggaguuccacuau

SEQ ID NO: 690898 - RNA, 19 nt, Homo sapiens
gcucagauccgaauuacag

SEQ ID NO: 690899 - RNA, 19 nt, Homo sapiens
agaagaagaggguugauga

SEQ ID NO: 690900 - RNA, 19 nt, Homo sapiens
agagagagcaggagagcua

SEQ ID NO: 690901 - RNA, 19 nt, Homo sapiens
gcaaagcugcuaguucaau

SEQ ID NO: 690902 - RNA, 19 nt, Homo sapiens
gcacagcaaguuaaugaag

SEQ ID NO: 690903 - RNA, 19 nt, Homo sapiens
gaauaaugcaggaucaaag

SEQ ID NO: 690904 - RNA, 19 nt, Homo sapiens
ucagagcucucagacauca

SEQ ID NO: 690905 - RNA, 19 nt, Homo sapiens
ucagggaaacuaauuguau

SEQ ID NO: 690906 - RNA, 19 nt, Homo sapiens
uaggugacauugauuaugg

SEQ ID NO: 690907 - RNA, 19 nt, Homo sapiens
ccacguggcuuaucuauug

SEQ ID NO: 690908 - RNA, 19 nt, Homo sapiens
agaguuagcuucauaaucu

SEQ ID NO: 690909 - RNA, 19 nt, Homo sapiens
ccaaugauguagccugaaa

SEQ ID NO: 690910 - RNA, 19 nt, Homo sapiens
gacaagcacuucuacuuca

SEQ ID NO: 690911 - RNA, 19 nt, Homo sapiens
uuagagaguuagcuucaua

SEQ ID NO: 690912 - RNA, 19 nt, Homo sapiens
gcaauuaauucacuaagcu

SEQ ID NO: 690913 - RNA, 19 nt, Homo sapiens
ggacaagcacuucuacuuc

SEQ ID NO: 690914 - RNA, 19 nt, Homo sapiens
ccaaaguguuuaacucuag

SEQ ID NO: 690915 - RNA, 19 nt, Homo sapiens
cgucugaguucuccaguug

SEQ ID NO: 690916 - RNA, 19 nt, Homo sapiens
uggagaagacgcccaguua

SEQ ID NO: 690917 - RNA, 19 nt, Homo sapiens
gcuuaucuauugacagaga

SEQ ID NO: 690918 - RNA, 19 nt, Homo sapiens
uggcuuaucuauugacaga

SEQ ID NO: 690919 - RNA, 19 nt, Homo sapiens
gcacuucuacuucaacaag

SEQ ID NO: 690920 - RNA, 19 nt, Homo sapiens
gcgucuggcucuauauguu

SEQ ID NO: 690921 - RNA, 19 nt, Homo sapiens
aagcacaacuugagauuuu

SEQ ID NO: 690922 - RNA, 19 nt, Homo sapiens
gacccucgcccagcaguua

SEQ ID NO: 690923 - RNA, 19 nt, Homo sapiens
ccagggccaucucggacua

SEQ ID NO: 690924 - RNA, 19 nt, Homo sapiens
gauguggugucccguccaa

SEQ ID NO: 690925 - RNA, 19 nt, Homo sapiens
gaugaccgggcacgacuuu

SEQ ID NO: 690926 - RNA, 19 nt, Homo sapiens
caauugauggugcuucuau

SEQ ID NO: 690927 - RNA, 19 nt, Homo sapiens
caaaguguuuaacucuagu

SEQ ID NO: 690928 - RNA, 19 nt, Homo sapiens
cauaaucuguuaacauucc

SEQ ID NO: 690929 - RNA, 19 nt, Homo sapiens
gagaagacgcccaguuacu

SEQ ID NO: 690930 - RNA, 19 nt, Homo sapiens
uccaaaguguuuaacucua

SEQ ID NO: 690931 - RNA, 19 nt, Homo sapiens
gagaguuagcuucauaauc

SEQ ID NO: 690932 - RNA, 19 nt, Homo sapiens
uuaccgccgucccgacuuu

SEQ ID NO: 690933 - RNA, 19 nt, Homo sapiens
gacagagauuauauguaug

SEQ ID NO: 690934 - RNA, 19 nt, Homo sapiens
ggacccauccugagaucga

SEQ ID NO: 690935 - RNA, 19 nt, Homo sapiens
ucacggacaagcacuucua

SEQ ID NO: 690936 - RNA, 19 nt, Homo sapiens
gcagccuccuugcagaugu

SEQ ID NO: 690937 - RNA, 19 nt, Homo sapiens
gguauucagccuucaguca

SEQ ID NO: 690938 - RNA, 19 nt, Homo sapiens
acaagcacuucuacuucaa

SEQ ID NO: 690939 - RNA, 19 nt, Homo sapiens
cgacuuuccguuccaguug

SEQ ID NO: 690940 - RNA, 19 nt, Homo sapiens
ggcucuauauguuccugua

SEQ ID NO: 690941 - RNA, 19 nt, Homo sapiens
uucgagagcuugacguuca

SEQ ID NO: 690942 - RNA, 19 nt, Homo sapiens
ggagaagacgcccaguuac

SEQ ID NO: 690943 - RNA, 19 nt, Homo sapiens
caaagaaaagcacaacuug

SEQ ID NO: 690944 - RNA, 19 nt, Homo sapiens
cccuaccuguuauauuuaa

SEQ ID NO: 690945 - RNA, 19 nt, Homo sapiens
ggugucccguccaaugaug

SEQ ID NO: 690946 - RNA, 19 nt, Homo sapiens
gcagaucuugccucgaugu

SEQ ID NO: 690947 - RNA, 19 nt, Homo sapiens
cuuucaaccucaaguucua

SEQ ID NO: 690948 - RNA, 19 nt, Homo sapiens
cggacaagcacuucuacuu

SEQ ID NO: 690949 - RNA, 19 nt, Homo sapiens
agaagacgcccaguuacuu

SEQ ID NO: 690950 - RNA, 19 nt, Homo sapiens
gggcgcugcuggaguuucu

SEQ ID NO: 690951 - RNA, 19 nt, Homo sapiens
ccacagcccuaggguucug

SEQ ID NO: 690952 - RNA, 19 nt, Homo sapiens
cugccuagccacacucuuu

SEQ ID NO: 690953 - RNA, 19 nt, Homo sapiens
uccccuaccuguuauauuu

SEQ ID NO: 690954 - RNA, 19 nt, Homo sapiens
gaaaagcacaacuugagau

SEQ ID NO: 690955 - RNA, 19 nt, Homo sapiens
gaguuagcuucauaaucug

SEQ ID NO: 690956 - RNA, 19 nt, Homo sapiens
ucucggccauguccaagga

SEQ ID NO: 690957 - RNA, 19 nt, Homo sapiens
gcagaucaccauggagaag

SEQ ID NO: 690958 - RNA, 19 nt, Homo sapiens
cacaauugauggugcuucu

SEQ ID NO: 690959 - RNA, 19 nt, Homo sapiens
cuguuaacauuccaaagug

SEQ ID NO: 690960 - RNA, 19 nt, Homo sapiens
uagagaguuagcuucauaa

SEQ ID NO: 690961 - RNA, 19 nt, Homo sapiens
cucaaguucuaccagauga

SEQ ID NO: 690962 - RNA, 19 nt, Homo sapiens
cgacuuuggcugggauuga

SEQ ID NO: 690963 - RNA, 19 nt, Homo sapiens
cauuccagcuucccugucu

SEQ ID NO: 690964 - RNA, 19 nt, Homo sapiens
guuuaacucuaguauuucg

SEQ ID NO: 690965 - RNA, 19 nt, Homo sapiens
guggugucccguccaauga

SEQ ID NO: 690966 - RNA, 19 nt, Homo sapiens
aaagcacaacuugagauuu

SEQ ID NO: 690967 - RNA, 19 nt, Homo sapiens
uuacccacguggcuuaucu

SEQ ID NO: 690968 - RNA, 19 nt, Homo sapiens
guauuucguuuucuucuuc

SEQ ID NO: 690969 - RNA, 19 nt, Homo sapiens
ucuguuaacauuccaaagu

SEQ ID NO: 690970 - RNA, 19 nt, Homo sapiens
ugccuagccacacucuuua

SEQ ID NO: 690971 - RNA, 19 nt, Homo sapiens
acacgcagacgcuguccaa

SEQ ID NO: 690972 - RNA, 19 nt, Homo sapiens
gcaucucggccauguccaa

SEQ ID NO: 690973 - RNA, 19 nt, Homo sapiens
gaagggcaggccucaugca

SEQ ID NO: 690974 - RNA, 19 nt, Homo sapiens
aauugauggugcuucuauu

SEQ ID NO: 690975 - RNA, 19 nt, Homo sapiens
ccaaggacaccaagcucau

SEQ ID NO: 690976 - RNA, 19 nt, Homo sapiens
gagaagagacaguuuaaua

SEQ ID NO: 690977 - RNA, 19 nt, Homo sapiens
guagagaagagacaguuua

SEQ ID NO: 690978 - RNA, 19 nt, Homo sapiens
gacaagcacuucuacuuca

SEQ ID NO: 690979 - RNA, 19 nt, Homo sapiens
aagcaucaguugucauuaa

SEQ ID NO: 690980 - RNA, 19 nt, Homo sapiens
cagaaaaucuugagguuaa

SEQ ID NO: 690981 - RNA, 19 nt, Homo sapiens
ggacaagcacuucuacuuc

SEQ ID NO: 690982 - RNA, 19 nt, Homo sapiens
ucacucgucuaaacacuuu

SEQ ID NO: 690983 - RNA, 19 nt, Homo sapiens
acaagggccucgccuggua

SEQ ID NO: 690984 - RNA, 19 nt, Homo sapiens
aaacaucucucucucuuuu

SEQ ID NO: 690985 - RNA, 19 nt, Homo sapiens
gaaagcgccuccugcaacu

SEQ ID NO: 690986 - RNA, 19 nt, Homo sapiens
ucauagugcuuucaaauac

SEQ ID NO: 690987 - RNA, 19 nt, Homo sapiens
uuaaacaucucucucucuu

SEQ ID NO: 690988 - RNA, 19 nt, Homo sapiens
uggagaagacgcccaguua

SEQ ID NO: 690989 - RNA, 19 nt, Homo sapiens
cgucuaaacacuuucaauu

SEQ ID NO: 690990 - RNA, 19 nt, Homo sapiens
uauacccagucauaaagua

SEQ ID NO: 690991 - RNA, 19 nt, Homo sapiens
gcacuucuacuucaacaag

SEQ ID NO: 690992 - RNA, 19 nt, Homo sapiens
caagagcaguuuggagcaa

SEQ ID NO: 690993 - RNA, 19 nt, Homo sapiens
uagagaagagacaguuuaa

SEQ ID NO: 690994 - RNA, 19 nt, Homo sapiens
ccagggccaucucggacua

SEQ ID NO: 690995 - RNA, 19 nt, Homo sapiens
acaaggcccugauaaaauu

SEQ ID NO: 690996 - RNA, 19 nt, Homo sapiens
cuauauacccagucauaaa

SEQ ID NO: 690997 - RNA, 19 nt, Homo sapiens
aaauuucacucgucuaaac

SEQ ID NO: 690998 - RNA, 19 nt, Homo sapiens
guauaagcaucaguuguca

SEQ ID NO: 690999 - RNA, 19 nt, Homo sapiens
gaugaccgggcacgacuuu

SEQ ID NO: 691000 - RNA, 19 nt, Homo sapiens
ggaccgagccagugaugca

SEQ ID NO: 691001 - RNA, 19 nt, Homo sapiens
gagaaagcgccuccugcaa

SEQ ID NO: 691002 - RNA, 19 nt, Homo sapiens
cauagugcuuucaaauaca

SEQ ID NO: 691003 - RNA, 19 nt, Homo sapiens
gagaagacgcccaguuacu

SEQ ID NO: 691004 - RNA, 19 nt, Homo sapiens
aauacaaggcccugauaaa

SEQ ID NO: 691005 - RNA, 19 nt, Homo sapiens
aaauacaaggcccugauaa

SEQ ID NO: 691006 - RNA, 19 nt, Homo sapiens
ggacccauccugagaucga

SEQ ID NO: 691007 - RNA, 19 nt, Homo sapiens
ucacggacaagcacuucua

SEQ ID NO: 691008 - RNA, 19 nt, Homo sapiens
acaagcacuucuacuucaa

SEQ ID NO: 691009 - RNA, 19 nt, Homo sapiens
cccaguuaguauuaucaua

SEQ ID NO: 691010 - RNA, 19 nt, Homo sapiens
gguagagaagagacaguuu

SEQ ID NO: 691011 - RNA, 19 nt, Homo sapiens
uucgagagcuugacguuca

SEQ ID NO: 691012 - RNA, 19 nt, Homo sapiens
ggagaagacgcccaguuac

SEQ ID NO: 691013 - RNA, 19 nt, Homo sapiens
agcaucaguugucauuaaa

SEQ ID NO: 691014 - RNA, 19 nt, Homo sapiens
auaagcaucaguugucauu

SEQ ID NO: 691015 - RNA, 19 nt, Homo sapiens
acccagucauaaaguauaa

SEQ ID NO: 691016 - RNA, 19 nt, Homo sapiens
uaaacaucucucucucuuu

SEQ ID NO: 691017 - RNA, 19 nt, Homo sapiens
cuuucaaccucaaguucua

SEQ ID NO: 691018 - RNA, 19 nt, Homo sapiens
cggacaagcacuucuacuu

SEQ ID NO: 691019 - RNA, 19 nt, Homo sapiens
agaagacgcccaguuacuu

SEQ ID NO: 691020 - RNA, 19 nt, Homo sapiens
uauauacccagucauaaag

SEQ ID NO: 691021 - RNA, 19 nt, Homo sapiens
guuuguacccgucacaguu

SEQ ID NO: 691022 - RNA, 19 nt, Homo sapiens
agacgaugguuucuuaagc

SEQ ID NO: 691023 - RNA, 19 nt, Homo sapiens
cacugucgcucgccacugu

SEQ ID NO: 691024 - RNA, 19 nt, Homo sapiens
guauaaccaacaccaaaca

SEQ ID NO: 691025 - RNA, 19 nt, Homo sapiens
gacuuuggcugggauggau

SEQ ID NO: 691026 - RNA, 19 nt, Homo sapiens
ucucggccauguccaagga

SEQ ID NO: 691027 - RNA, 19 nt, Homo sapiens
gcagaucaccauggagaag

SEQ ID NO: 691028 - RNA, 19 nt, Homo sapiens
cucaaguucuaccagauga

SEQ ID NO: 691029 - RNA, 19 nt, Homo sapiens
ggaaguucuugcugaugcu

SEQ ID NO: 691030 - RNA, 19 nt, Homo sapiens
uggcugggauggauaacca

SEQ ID NO: 691031 - RNA, 19 nt, Homo sapiens
uacccagucauaaaguaua

SEQ ID NO: 691032 - RNA, 19 nt, Homo sapiens
gaauguuaagagauuguuc

SEQ ID NO: 691033 - RNA, 19 nt, Homo sapiens
acacgcagacgcuguccaa

SEQ ID NO: 691034 - RNA, 19 nt, Homo sapiens
gcaucucggccauguccaa

SEQ ID NO: 691035 - RNA, 19 nt, Homo sapiens
aaaguauaagcaucaguug

SEQ ID NO: 691036 - RNA, 19 nt, Homo sapiens
ucuauauacccagucauaa

SEQ ID NO: 691037 - RNA, 19 nt, Homo sapiens
ccaaggacaccaagcucau

SEQ ID NO: 691038 - RNA, 19 nt, Homo sapiens
gcacauaauucugcuguua

SEQ ID NO: 691039 - RNA, 19 nt, Homo sapiens
gagaauugcuuuaagaaga

SEQ ID NO: 691040 - RNA, 19 nt, Homo sapiens
gcauguaucuucccucuga

SEQ ID NO: 691041 - RNA, 19 nt, Homo sapiens
gaacucauguacagauuga

SEQ ID NO: 691042 - RNA, 19 nt, Homo sapiens
ggaguggccuuguuaauuc

SEQ ID NO: 691043 - RNA, 19 nt, Homo sapiens
gaaauaaaccagugacuuc

SEQ ID NO: 691044 - RNA, 19 nt, Homo sapiens
ccucagaccuuaucaauuc

SEQ ID NO: 691045 - RNA, 19 nt, Homo sapiens
gacaagcacuucuauuuca

SEQ ID NO: 691046 - RNA, 19 nt, Homo sapiens
cauacgagcuuucauguuc

SEQ ID NO: 691047 - RNA, 19 nt, Homo sapiens
ggaauaagcccacgaaagg

SEQ ID NO: 691048 - RNA, 19 nt, Homo sapiens
gcacuucuauuucaacaag

SEQ ID NO: 691049 - RNA, 19 nt, Homo sapiens
gauugauccugaagugaua

SEQ ID NO: 691050 - RNA, 19 nt, Homo sapiens
gcaauggaaucaugcuugu

SEQ ID NO: 691051 - RNA, 19 nt, Homo sapiens
cgacgcaucuucaacaugu

SEQ ID NO: 691052 - RNA, 19 nt, Homo sapiens
ccucugagcuucauuucuu

SEQ ID NO: 691053 - RNA, 19 nt, Homo sapiens
ggacaagcacuucuauuuc

SEQ ID NO: 691054 - RNA, 19 nt, Homo sapiens
gaagacgcccagcuacuuu

SEQ ID NO: 691055 - RNA, 19 nt, Homo sapiens
gagaacucauguacagauu

SEQ ID NO: 691056 - RNA, 19 nt, Homo sapiens
caacaagaccaaaggauuc

SEQ ID NO: 691057 - RNA, 19 nt, Homo sapiens
gcgagcgacucaucacuga

SEQ ID NO: 691058 - RNA, 19 nt, Homo sapiens
cggacaagcacuucuauuu

SEQ ID NO: 691059 - RNA, 19 nt, Homo sapiens
ggacuucaggugggaauaa

SEQ ID NO: 691060 - RNA, 19 nt, Homo sapiens
gagagucccugccacuagu

SEQ ID NO: 691061 - RNA, 19 nt, Homo sapiens
gaaaggaaagggcucucaa

SEQ ID NO: 691062 - RNA, 19 nt, Homo sapiens
ccaaguggcauguaucuuc

SEQ ID NO: 691063 - RNA, 19 nt, Homo sapiens
gagugaauguuccaaugau

SEQ ID NO: 691064 - RNA, 19 nt, Homo sapiens
gaaccaggaagcccagcua

SEQ ID NO: 691065 - RNA, 19 nt, Homo sapiens
gcuuguccaugugaaauaa

SEQ ID NO: 691066 - RNA, 19 nt, Homo sapiens
gggccgugcuggaguuuau

SEQ ID NO: 691067 - RNA, 19 nt, Homo sapiens
ggagaacucauguacagau

SEQ ID NO: 691068 - RNA, 19 nt, Homo sapiens
aggauucccuugcuugaaa

SEQ ID NO: 691069 - RNA, 19 nt, Homo sapiens
gacagacccuuuggugaug

SEQ ID NO: 691070 - RNA, 19 nt, Homo sapiens
ucaacaagaccaaaggauu

SEQ ID NO: 691071 - RNA, 19 nt, Homo sapiens
gaagagugaauguuccaau

SEQ ID NO: 691072 - RNA, 19 nt, Homo sapiens
acagauugauccugaagug

SEQ ID NO: 691073 - RNA, 19 nt, Homo sapiens
cgcagacacucuccaagaa

SEQ ID NO: 691074 - RNA, 19 nt, Homo sapiens
ggacaaaagcacauaauuc

SEQ ID NO: 691075 - RNA, 19 nt, Homo sapiens
acccuuuggugaugaaaua

SEQ ID NO: 691076 - RNA, 19 nt, Homo sapiens
uagaccagcuccgagaauu

SEQ ID NO: 691077 - RNA, 19 nt, Homo sapiens
agagcuggcugcaguacuu

SEQ ID NO: 691078 - RNA, 19 nt, Homo sapiens
cccgugccaucucugauua

SEQ ID NO: 691079 - RNA, 19 nt, Homo sapiens
guuccaaugaugauagaua

SEQ ID NO: 691080 - RNA, 19 nt, Homo sapiens
caagggcucuucugcucau

SEQ ID NO: 691081 - RNA, 19 nt, Homo sapiens
aagagugaauguuccaaug

SEQ ID NO: 691082 - RNA, 19 nt, Homo sapiens
uuaagaagagugaauguuc

SEQ ID NO: 691083 - RNA, 19 nt, Homo sapiens
gggaauaagcccacgaaag

SEQ ID NO: 691084 - RNA, 19 nt, Homo sapiens
ugaguugcaucaucuugga

SEQ ID NO: 691085 - RNA, 19 nt, Homo sapiens
gaauaagcccacgaaagga

SEQ ID NO: 691086 - RNA, 19 nt, Homo sapiens
ccagcuacuuugucacuca

SEQ ID NO: 691087 - RNA, 19 nt, Homo sapiens
gcucucucguguccuuaaa

SEQ ID NO: 691088 - RNA, 19 nt, Homo sapiens
auaaaccagugacuucaga

SEQ ID NO: 691089 - RNA, 19 nt, Homo sapiens
uuggagaauugcuuuaaga

SEQ ID NO: 691090 - RNA, 19 nt, Homo sapiens
ugaaauaaaccagugacuu

SEQ ID NO: 691091 - RNA, 19 nt, Homo sapiens
agacagacccuuuggugau

SEQ ID NO: 691092 - RNA, 19 nt, Homo sapiens
gugaauguuccaaugauga

SEQ ID NO: 691093 - RNA, 19 nt, Homo sapiens
ggagaauugcuuuaagaag

SEQ ID NO: 691094 - RNA, 19 nt, Homo sapiens
acaagcacuucuauuucaa

SEQ ID NO: 691095 - RNA, 19 nt, Homo sapiens
gaaauaaauauggcucucu

SEQ ID NO: 691096 - RNA, 19 nt, Homo sapiens
gcuacuuugucacucaaga

SEQ ID NO: 691097 - RNA, 19 nt, Homo sapiens
gagcuuucauguucagcau

SEQ ID NO: 691098 - RNA, 19 nt, Homo sapiens
ccaggaagcccagcuaaag

SEQ ID NO: 691099 - RNA, 19 nt, Homo sapiens
gcagucggucccugucauu

SEQ ID NO: 691100 - RNA, 19 nt, Homo sapiens
gaauguuccaaugaugaua

SEQ ID NO: 691101 - RNA, 19 nt, Homo sapiens
ucacggacaagcacuucua

SEQ ID NO: 691102 - RNA, 19 nt, Homo sapiens
agaauugcuuuaagaagag

SEQ ID NO: 691103 - RNA, 19 nt, Homo sapiens
gaaccccacuucuuugaca

SEQ ID NO: 691104 - RNA, 19 nt, Homo sapiens
gauagaccagcuccgagaa

SEQ ID NO: 691105 - RNA, 19 nt, Homo sapiens
ggcauuaagagauucauca

SEQ ID NO: 691106 - RNA, 19 nt, Homo sapiens
gcagacacucuccaagaag

SEQ ID NO: 691107 - RNA, 19 nt, Homo sapiens
ccaagcugaucgugguugu

SEQ ID NO: 691108 - RNA, 19 nt, Homo sapiens
cagaccuuaucaauucauu

SEQ ID NO: 691109 - RNA, 19 nt, Homo sapiens
gcacggaaccccacuucuu

SEQ ID NO: 691110 - RNA, 19 nt, Homo sapiens
cccaggaguggccuuguua

SEQ ID NO: 691111 - RNA, 19 nt, Homo sapiens
agagugaauguuccaauga

SEQ ID NO: 691112 - RNA, 19 nt, Homo sapiens
ucuccuuucugcccauaaa

SEQ ID NO: 691113 - RNA, 19 nt, Homo sapiens
uggagaagacgcccagcua

SEQ ID NO: 691114 - RNA, 19 nt, Homo sapiens
agggagaacucauguacag

SEQ ID NO: 691115 - RNA, 19 nt, Homo sapiens
gagaagacgcccagcuacu

SEQ ID NO: 691116 - RNA, 19 nt, Homo sapiens
aauaagcccacgaaaggaa

SEQ ID NO: 691117 - RNA, 19 nt, Homo sapiens
agagauucaucacggacaa

SEQ ID NO: 691118 - RNA, 19 nt, Homo sapiens
gacaaaagcacauaauucu

SEQ ID NO: 691119 - RNA, 19 nt, Homo sapiens
aaaacacugucucugaaaa

SEQ ID NO: 691120 - RNA, 19 nt, Homo sapiens
aggaguggccuuguuaauu

SEQ ID NO: 691121 - RNA, 19 nt, Homo sapiens
gaauugcuuuaagaagagu

SEQ ID NO: 691122 - RNA, 19 nt, Homo sapiens
cagcuacuuugucacucaa

SEQ ID NO: 691123 - RNA, 19 nt, Homo sapiens
ucaucagucuguucaagca

SEQ ID NO: 691124 - RNA, 19 nt, Homo sapiens
aaagggagaacucauguac

SEQ ID NO: 691125 - RNA, 19 nt, Homo sapiens
uagcucagauucacuucgu

SEQ ID NO: 691126 - RNA, 19 nt, Homo sapiens
uacggguacuuugcucaua

SEQ ID NO: 691127 - RNA, 19 nt, Homo sapiens
agaagacgcccagcuacuu

SEQ ID NO: 691128 - RNA, 19 nt, Homo sapiens
ccaggaguggccuuguuaa

SEQ ID NO: 691129 - RNA, 19 nt, Homo sapiens
guacagauugauccugaag

SEQ ID NO: 691130 - RNA, 19 nt, Homo sapiens
ccucgaugcuugggcaaau

SEQ ID NO: 691131 - RNA, 19 nt, Homo sapiens
gagccuauggucucaacug

SEQ ID NO: 691132 - RNA, 19 nt, Homo sapiens
agaccagcuccgagaauuu

SEQ ID NO: 691133 - RNA, 19 nt, Homo sapiens
cagcccuccucagaccuua

SEQ ID NO: 691134 - RNA, 19 nt, Homo sapiens
ucugaucucccuccaacaa

SEQ ID NO: 691135 - RNA, 19 nt, Homo sapiens
gaugcuugggcaaaucaaa

SEQ ID NO: 691136 - RNA, 19 nt, Homo sapiens
acgcagacacucuccaaga

SEQ ID NO: 691137 - RNA, 19 nt, Homo sapiens
ggccuuggagaauugcuuu

SEQ ID NO: 691138 - RNA, 19 nt, Homo sapiens
ucaauaaacugcacgaaua

SEQ ID NO: 691139 - RNA, 19 nt, Homo sapiens
ccaagucgaucccaaacua

SEQ ID NO: 691140 - RNA, 19 nt, Homo sapiens
gcuucgaacuucuacuuua

SEQ ID NO: 691141 - RNA, 19 nt, Homo sapiens
gagcgagucuacagcauga

SEQ ID NO: 691142 - RNA, 19 nt, Homo sapiens
gaucaaugcuucgaacuuc

SEQ ID NO: 691143 - RNA, 19 nt, Homo sapiens
gauucacaauugccauaua

SEQ ID NO: 691144 - RNA, 19 nt, Homo sapiens
gcacugauuugcaauaagc

SEQ ID NO: 691145 - RNA, 19 nt, Homo sapiens
gaacgagguccacuucuuc

SEQ ID NO: 691146 - RNA, 19 nt, Homo sapiens
gaucccaaacuacucaaua

SEQ ID NO: 691147 - RNA, 19 nt, Homo sapiens
cuucgaacuucuacuuuaa

SEQ ID NO: 691148 - RNA, 19 nt, Homo sapiens
ccaaacuacucaauaaacu

SEQ ID NO: 691149 - RNA, 19 nt, Homo sapiens
ggagaacgagguccacuuc

SEQ ID NO: 691150 - RNA, 19 nt, Homo sapiens
caauaaacugcacgaauau

SEQ ID NO: 691151 - RNA, 19 nt, Homo sapiens
ggaacuaaacuauuucacu

SEQ ID NO: 691152 - RNA, 19 nt, Homo sapiens
gaaggaacuaaacuauuuc

SEQ ID NO: 691153 - RNA, 19 nt, Homo sapiens
caauugccauauauacuag

SEQ ID NO: 691154 - RNA, 19 nt, Homo sapiens
gcacgaauauuuucaugag

SEQ ID NO: 691155 - RNA, 19 nt, Homo sapiens
cgggaccgcugcuuacaug

SEQ ID NO: 691156 - RNA, 19 nt, Homo sapiens
guacaguauuagauucaca

SEQ ID NO: 691157 - RNA, 19 nt, Homo sapiens
uggcacugauuugcaauaa

SEQ ID NO: 691158 - RNA, 19 nt, Homo sapiens
gacuggcacugauuugcaa

SEQ ID NO: 691159 - RNA, 19 nt, Homo sapiens
gaccgcugcuuacaugagu

SEQ ID NO: 691160 - RNA, 19 nt, Homo sapiens
uccauaaaguacuucugua

SEQ ID NO: 691161 - RNA, 19 nt, Homo sapiens
aucccaaacuacucaauaa

SEQ ID NO: 691162 - RNA, 19 nt, Homo sapiens
uagauucacaauugccaua

SEQ ID NO: 691163 - RNA, 19 nt, Homo sapiens
ucacaauugccauauauac

SEQ ID NO: 691164 - RNA, 19 nt, Homo sapiens
uacuguaaguucuggugua

SEQ ID NO: 691165 - RNA, 19 nt, Homo sapiens
gucgagagguuccuaaagc

SEQ ID NO: 691166 - RNA, 19 nt, Homo sapiens
gcccaugugccacugacua

SEQ ID NO: 691167 - RNA, 19 nt, Homo sapiens
ucaaugcuucgaacuucua

SEQ ID NO: 691168 - RNA, 19 nt, Homo sapiens
caaacuacucaauaaacug

SEQ ID NO: 691169 - RNA, 19 nt, Homo sapiens
uucaugagccaaauaagaa

SEQ ID NO: 691170 - RNA, 19 nt, Homo sapiens
cugcuuacaugaguccaaa

SEQ ID NO: 691171 - RNA, 19 nt, Homo sapiens
cggagcgcgugcuaucuga

SEQ ID NO: 691172 - RNA, 19 nt, Homo sapiens
uaacaaaaccaagggcuuu

SEQ ID NO: 691173 - RNA, 19 nt, Homo sapiens
guauuagauucacaauugc

SEQ ID NO: 691174 - RNA, 19 nt, Homo sapiens
uuucaugagccaaauaaga

SEQ ID NO: 691175 - RNA, 19 nt, Homo sapiens
ucgaacuucuacuuuaaca

SEQ ID NO: 691176 - RNA, 19 nt, Homo sapiens
ggcucaauguggacuacaa

SEQ ID NO: 691177 - RNA, 19 nt, Homo sapiens
acaaccacaugcagaagca

SEQ ID NO: 691178 - RNA, 19 nt, Homo sapiens
ucaugguuguuaacauugu

SEQ ID NO: 691179 - RNA, 19 nt, Homo sapiens
gcgcacugcuggagaugcu

SEQ ID NO: 691180 - RNA, 19 nt, Homo sapiens
ucgacugggaggagcauua

SEQ ID NO: 691181 - RNA, 19 nt, Homo sapiens
ucuguacaguauuagauuc

SEQ ID NO: 691182 - RNA, 19 nt, Homo sapiens
acauuugacuggcacugau

SEQ ID NO: 691183 - RNA, 19 nt, Homo sapiens
ggacuacaaggcccucaac

SEQ ID NO: 691184 - RNA, 19 nt, Homo sapiens
ggaaacagguucuagauuu

SEQ ID NO: 691185 - RNA, 19 nt, Homo sapiens
uagcaaagcugacacaaua

SEQ ID NO: 691186 - RNA, 19 nt, Homo sapiens
gaagaaggcucaccaagug

SEQ ID NO: 691187 - RNA, 19 nt, Homo sapiens
gaacgcaccuuggaaguuu

SEQ ID NO: 691188 - RNA, 19 nt, Homo sapiens
gaacucagcuauucagugu

SEQ ID NO: 691189 - RNA, 19 nt, Homo sapiens
gcagauaagaugauaguua

SEQ ID NO: 691190 - RNA, 19 nt, Homo sapiens
acuguuagcuuuccuauua

SEQ ID NO: 691191 - RNA, 19 nt, Homo sapiens
aaacuaaccuccugcauga

SEQ ID NO: 691192 - RNA, 19 nt, Homo sapiens
gaucauggcuuugcuuuau

SEQ ID NO: 691193 - RNA, 19 nt, Homo sapiens
gcauuaggcugccguauau

SEQ ID NO: 691194 - RNA, 19 nt, Homo sapiens
gcauaaacaccuugaauuu

SEQ ID NO: 691195 - RNA, 19 nt, Homo sapiens
gaugauaccaggcauauaa

SEQ ID NO: 691196 - RNA, 19 nt, Homo sapiens
guaaagcacugcaaaguag

SEQ ID NO: 691197 - RNA, 19 nt, Homo sapiens
ggauguuggucauuuauuu

SEQ ID NO: 691198 - RNA, 19 nt, Homo sapiens
ggaacgggaugauauuuau

SEQ ID NO: 691199 - RNA, 19 nt, Homo sapiens
gaugugaguugaugacaaa

SEQ ID NO: 691200 - RNA, 19 nt, Homo sapiens
gcaaugauaaugacaauga

SEQ ID NO: 691201 - RNA, 19 nt, Homo sapiens
gaagaucccugguauuguc

SEQ ID NO: 691202 - RNA, 19 nt, Homo sapiens
gaacuucccucagagaaug

SEQ ID NO: 691203 - RNA, 19 nt, Homo sapiens
ggauaugucggaauucuua

SEQ ID NO: 691204 - RNA, 19 nt, Homo sapiens
ggaauucaccauagccuua

SEQ ID NO: 691205 - RNA, 19 nt, Homo sapiens
gucaagaacuguuagcuuu

SEQ ID NO: 691206 - RNA, 19 nt, Homo sapiens
acaauuggcuauaaaggua

SEQ ID NO: 691207 - RNA, 19 nt, Homo sapiens
caagugaaauggaaacaga

SEQ ID NO: 691208 - RNA, 19 nt, Homo sapiens
gacaaucccuuaggaauga

SEQ ID NO: 691209 - RNA, 19 nt, Homo sapiens
gaagauagcaaugauaaug

SEQ ID NO: 691210 - RNA, 19 nt, Homo sapiens
gaacugaucaagcaaaugu

SEQ ID NO: 691211 - RNA, 19 nt, Homo sapiens
gaaccuguacaguauauaa

SEQ ID NO: 691212 - RNA, 19 nt, Homo sapiens
gaaaauggauuauguacug

SEQ ID NO: 691213 - RNA, 19 nt, Homo sapiens
gaauugaagcuaugugaaa

SEQ ID NO: 691214 - RNA, 19 nt, Homo sapiens
caaguuggauaccuuaguu

SEQ ID NO: 691215 - RNA, 19 nt, Homo sapiens
ggucagcccuuucuuaugg

SEQ ID NO: 691216 - RNA, 19 nt, Homo sapiens
gcagauggaaggccagaua

SEQ ID NO: 691217 - RNA, 19 nt, Homo sapiens
gguauuguccgaauuguaa

SEQ ID NO: 691218 - RNA, 19 nt, Homo sapiens
gggaugauauuuauguguu

SEQ ID NO: 691219 - RNA, 19 nt, Homo sapiens
ggacagguauuagugauag

SEQ ID NO: 691220 - RNA, 19 nt, Homo sapiens
ucacuugaguuuacauuug

SEQ ID NO: 691221 - RNA, 19 nt, Homo sapiens
gauagucgcugguucaaac

SEQ ID NO: 691222 - RNA, 19 nt, Homo sapiens
ggaaacagaugagccagau

SEQ ID NO: 691223 - RNA, 19 nt, Homo sapiens
gcaagacugucaagaacug

SEQ ID NO: 691224 - RNA, 19 nt, Homo sapiens
cagcauauguacucuucua

SEQ ID NO: 691225 - RNA, 19 nt, Homo sapiens
gaaacaauacugaagacaa

SEQ ID NO: 691226 - RNA, 19 nt, Homo sapiens
caacacaccuccacuuacu

SEQ ID NO: 691227 - RNA, 19 nt, Homo sapiens
agaaguauaucucacagaa

SEQ ID NO: 691228 - RNA, 19 nt, Homo sapiens
gcacugcaaaguagaagua

SEQ ID NO: 691229 - RNA, 19 nt, Homo sapiens
gcaauacugauaucaacua

SEQ ID NO: 691230 - RNA, 19 nt, Homo sapiens
gauaucaacuacaucaaag

SEQ ID NO: 691231 - RNA, 19 nt, Homo sapiens
caaauggcauacaugaaga

SEQ ID NO: 691232 - RNA, 19 nt, Homo sapiens
ucagauaaccgaauguaaa

SEQ ID NO: 691233 - RNA, 19 nt, Homo sapiens
gcagcaagacugucaagaa

SEQ ID NO: 691234 - RNA, 19 nt, Homo sapiens
ugaauuggauuacauacug

SEQ ID NO: 691235 - RNA, 19 nt, Homo sapiens
gucagaaccuguacaguau

SEQ ID NO: 691236 - RNA, 19 nt, Homo sapiens
gaugaaaaccuuaguagua

SEQ ID NO: 691237 - RNA, 19 nt, Homo sapiens
auauuuagcugcaguauca

SEQ ID NO: 691238 - RNA, 19 nt, Homo sapiens
gaguugaugacaaauguua

SEQ ID NO: 691239 - RNA, 19 nt, Homo sapiens
gcagguccuugccgcuaua

SEQ ID NO: 691240 - RNA, 19 nt, Homo sapiens
gaggugaaauagcuaaauc

SEQ ID NO: 691241 - RNA, 19 nt, Homo sapiens
ggaggacacuauacugcuu

SEQ ID NO: 691242 - RNA, 19 nt, Homo sapiens
gagacaaguuggauaccuu

SEQ ID NO: 691243 - RNA, 19 nt, Homo sapiens
gaggagauaaugauucuga

SEQ ID NO: 691244 - RNA, 19 nt, Homo sapiens
cagauaagaugauaguuac

SEQ ID NO: 691245 - RNA, 19 nt, Homo sapiens
ccaaaccuaugcaguacaa

SEQ ID NO: 691246 - RNA, 19 nt, Homo sapiens
gaauggauccgcuuaccaa

SEQ ID NO: 691247 - RNA, 19 nt, Homo sapiens
gaguauuuccucaaugaua

SEQ ID NO: 691248 - RNA, 19 nt, Homo sapiens
ggaacaaauacaugaguaa

SEQ ID NO: 691249 - RNA, 19 nt, Homo sapiens
ucacagaauugaagcuaug

SEQ ID NO: 691250 - RNA, 19 nt, Homo sapiens
ggauaaaugagguauguug

SEQ ID NO: 691251 - RNA, 19 nt, Homo sapiens
gaaaguccuagaagccaua

SEQ ID NO: 691252 - RNA, 19 nt, Homo sapiens
uaaggugguugccgaagaa

SEQ ID NO: 691253 - RNA, 19 nt, Homo sapiens
uguuguaacucgaagauuu

SEQ ID NO: 691254 - RNA, 19 nt, Homo sapiens
guccaaagcagcauaugua

SEQ ID NO: 691255 - RNA, 19 nt, Homo sapiens
cagaugagccagaugauga

SEQ ID NO: 691256 - RNA, 19 nt, Homo sapiens
cauacugguucuucacuuu

SEQ ID NO: 691257 - RNA, 19 nt, Homo sapiens
ccuauuagauggauuacau

SEQ ID NO: 691258 - RNA, 19 nt, Homo sapiens
aauguggucuggaaaguuu

SEQ ID NO: 691259 - RNA, 19 nt, Homo sapiens
aagcaaauguggucuggaa

SEQ ID NO: 691260 - RNA, 19 nt, Homo sapiens
ggaaugagaggugaaauag

SEQ ID NO: 691261 - RNA, 19 nt, Homo sapiens
gcacuugaguucacuugag

SEQ ID NO: 691262 - RNA, 19 nt, Homo sapiens
uaaaugagguauguugauc

SEQ ID NO: 691263 - RNA, 19 nt, Homo sapiens
guauaauguucuucacuug

SEQ ID NO: 691264 - RNA, 19 nt, Homo sapiens
ccacuguuauuaaagcaaa

SEQ ID NO: 691265 - RNA, 19 nt, Homo sapiens
gauuuuaacuugugcagua

SEQ ID NO: 691266 - RNA, 19 nt, Homo sapiens
gcaaagcugacacaauaga

SEQ ID NO: 691267 - RNA, 19 nt, Homo sapiens
guaucaauguggcauaaau

SEQ ID NO: 691268 - RNA, 19 nt, Homo sapiens
ccacuggcaucccauuaga

SEQ ID NO: 691269 - RNA, 19 nt, Homo sapiens
caugaggauuugaauagaa

SEQ ID NO: 691270 - RNA, 19 nt, Homo sapiens
gaaccuggaagaaacaaug

SEQ ID NO: 691271 - RNA, 19 nt, Homo sapiens
guauguugaucauggcuuu

SEQ ID NO: 691272 - RNA, 19 nt, Homo sapiens
uauaaagguaggucuguua

SEQ ID NO: 691273 - RNA, 19 nt, Homo sapiens
cuauggaaaugaugaaguu

SEQ ID NO: 691274 - RNA, 19 nt, Homo sapiens
aaacagaugagccagauga

SEQ ID NO: 691275 - RNA, 19 nt, Homo sapiens
gaauauucgcuauggauga

SEQ ID NO: 691276 - RNA, 19 nt, Homo sapiens
ggaaaaccauuuaaaacga

SEQ ID NO: 691277 - RNA, 19 nt, Homo sapiens
acucagcuauucaguguuu

SEQ ID NO: 691278 - RNA, 19 nt, Homo sapiens
gagaccagauuguggaaca

SEQ ID NO: 691279 - RNA, 19 nt, Homo sapiens
caggauaaaugagguaugu

SEQ ID NO: 691280 - RNA, 19 nt, Homo sapiens
ggugguaucuauggaaaug

SEQ ID NO: 691281 - RNA, 19 nt, Homo sapiens
aaagcuaggugcugaagau

SEQ ID NO: 691282 - RNA, 19 nt, Homo sapiens
augaaaguguggaguauaa

SEQ ID NO: 691283 - RNA, 19 nt, Homo sapiens
ggagauaaugauucugaaa

SEQ ID NO: 691284 - RNA, 19 nt, Homo sapiens
caaagggcaucauuaagua

SEQ ID NO: 691285 - RNA, 19 nt, Homo sapiens
gaaguaagcgcucuaagaa

SEQ ID NO: 691286 - RNA, 19 nt, Homo sapiens
gacagaaucuagaaaguuu

SEQ ID NO: 691287 - RNA, 19 nt, Homo sapiens
caagauguguuccuuauug

SEQ ID NO: 691288 - RNA, 19 nt, Homo sapiens
uaacaaagggcaucauuaa

SEQ ID NO: 691289 - RNA, 19 nt, Homo sapiens
guacuuguccugcaaauaa

SEQ ID NO: 691290 - RNA, 19 nt, Homo sapiens
gacaucagguugacucuaa

SEQ ID NO: 691291 - RNA, 19 nt, Homo sapiens
ccacaggccuucggaauuu

SEQ ID NO: 691292 - RNA, 19 nt, Homo sapiens
ccaagucaguucagaagua

SEQ ID NO: 691293 - RNA, 19 nt, Homo sapiens
guagaagaguuuagaaaga

SEQ ID NO: 691294 - RNA, 19 nt, Homo sapiens
gagauugucuucgcaguuu

SEQ ID NO: 691295 - RNA, 19 nt, Homo sapiens
ucucaaggcugcugucuuu

SEQ ID NO: 691296 - RNA, 19 nt, Homo sapiens
uuaugaagaugcacaagua

SEQ ID NO: 691297 - RNA, 19 nt, Homo sapiens
cuagaaaguuugauccauu

SEQ ID NO: 691298 - RNA, 19 nt, Homo sapiens
gcaggacgcccaugaauuc

SEQ ID NO: 691299 - RNA, 19 nt, Homo sapiens
ggaagauuaugccaaacuu

SEQ ID NO: 691300 - RNA, 19 nt, Homo sapiens
gugcuaugcuuacauuuga

SEQ ID NO: 691301 - RNA, 19 nt, Homo sapiens
gagacagaguuauauaugu

SEQ ID NO: 691302 - RNA, 19 nt, Homo sapiens
caagucaguucagaaguaa

SEQ ID NO: 691303 - RNA, 19 nt, Homo sapiens
gguagugacuuacugaaca

SEQ ID NO: 691304 - RNA, 19 nt, Homo sapiens
gaugagacagaguuauaua

SEQ ID NO: 691305 - RNA, 19 nt, Homo sapiens
ggacagaaucuagaaaguu

SEQ ID NO: 691306 - RNA, 19 nt, Homo sapiens
ccacaaaauuucacaauga

SEQ ID NO: 691307 - RNA, 19 nt, Homo sapiens
ggacagcauauuuaagaaa

SEQ ID NO: 691308 - RNA, 19 nt, Homo sapiens
gccuagacaugaaauggua

SEQ ID NO: 691309 - RNA, 19 nt, Homo sapiens
ggacgcccaugaauucaau

SEQ ID NO: 691310 - RNA, 19 nt, Homo sapiens
ucaguaacauugagcaguu

SEQ ID NO: 691311 - RNA, 19 nt, Homo sapiens
uaaguagaccagguaauua

SEQ ID NO: 691312 - RNA, 19 nt, Homo sapiens
cacaaugacugcugaggaa

SEQ ID NO: 691313 - RNA, 19 nt, Homo sapiens
caaugugucuuugguagaa

SEQ ID NO: 691314 - RNA, 19 nt, Homo sapiens
gaacuuagucuuauuugac

SEQ ID NO: 691315 - RNA, 19 nt, Homo sapiens
gagaacacuuacagaacuu

SEQ ID NO: 691316 - RNA, 19 nt, Homo sapiens
uuuaauaccuccuccaaau

SEQ ID NO: 691317 - RNA, 19 nt, Homo sapiens
cauuagauauuccaaguca

SEQ ID NO: 691318 - RNA, 19 nt, Homo sapiens
gggauaacaaugugucuuu

SEQ ID NO: 691319 - RNA, 19 nt, Homo sapiens
agacagaguuauauaugug

SEQ ID NO: 691320 - RNA, 19 nt, Homo sapiens
aaaguuugauccauuccua

SEQ ID NO: 691321 - RNA, 19 nt, Homo sapiens
gaagauuaugccaaacuuu

SEQ ID NO: 691322 - RNA, 19 nt, Homo sapiens
ggauaacaaugugucuuug

SEQ ID NO: 691323 - RNA, 19 nt, Homo sapiens
ccggagagcugccuguaug

SEQ ID NO: 691324 - RNA, 19 nt, Homo sapiens
cuagaccuuucauuagaua

SEQ ID NO: 691325 - RNA, 19 nt, Homo sapiens
ggagaauucuacucugucu

SEQ ID NO: 691326 - RNA, 19 nt, Homo sapiens
ccacaaauacuugauacaa

SEQ ID NO: 691327 - RNA, 19 nt, Homo sapiens
gacaugaaaugguacuuac

SEQ ID NO: 691328 - RNA, 19 nt, Homo sapiens
ugagaggccuagacaugaa

SEQ ID NO: 691329 - RNA, 19 nt, Homo sapiens
ggaagcaccacugccauuu

SEQ ID NO: 691330 - RNA, 19 nt, Homo sapiens
aguaagcgcucuaagaauc

SEQ ID NO: 691331 - RNA, 19 nt, Homo sapiens
ucagagaacacuuacagaa

SEQ ID NO: 691332 - RNA, 19 nt, Homo sapiens
acaacugccugcugccuuu

SEQ ID NO: 691333 - RNA, 19 nt, Homo sapiens
ucacuuugaggcacauuua

SEQ ID NO: 691334 - RNA, 19 nt, Homo sapiens
caugaaaugguacuuacua

SEQ ID NO: 691335 - RNA, 19 nt, Homo sapiens
gcacaaguaccuuuaacca

SEQ ID NO: 691336 - RNA, 19 nt, Homo sapiens
uaaccaaccauaagaaauc

SEQ ID NO: 691337 - RNA, 19 nt, Homo sapiens
gauguguuccuuauuguga

SEQ ID NO: 691338 - RNA, 19 nt, Homo sapiens
uagaaaguuugauccauuc

SEQ ID NO: 691339 - RNA, 19 nt, Homo sapiens
caggagaauucuacucugu

SEQ ID NO: 691340 - RNA, 19 nt, Homo sapiens
caaggcugcugucuuuauc

SEQ ID NO: 691341 - RNA, 19 nt, Homo sapiens
cagcagauguuuugauuug

SEQ ID NO: 691342 - RNA, 19 nt, Homo sapiens
gaacauggggcaccaacua

SEQ ID NO: 691343 - RNA, 19 nt, Homo sapiens
ucauuggacagcauauuua

SEQ ID NO: 691344 - RNA, 19 nt, Homo sapiens
uaacaaugugucuuuggua

SEQ ID NO: 691345 - RNA, 19 nt, Homo sapiens
uuaaguagaccagguaauu

SEQ ID NO: 691346 - RNA, 19 nt, Homo sapiens
acaaagggcaucauuaagu

SEQ ID NO: 691347 - RNA, 19 nt, Homo sapiens
gaagcaccacugccauuug

SEQ ID NO: 691348 - RNA, 19 nt, Homo sapiens
agaaguaagcgcucuaaga

SEQ ID NO: 691349 - RNA, 19 nt, Homo sapiens
gcacacaguauguauggau

SEQ ID NO: 691350 - RNA, 19 nt, Homo sapiens
gcaagauguguuccuuauu

SEQ ID NO: 691351 - RNA, 19 nt, Homo sapiens
uugauuugcugcuuuaguu

SEQ ID NO: 691352 - RNA, 19 nt, Homo sapiens
cguagaauuuccacugaga

SEQ ID NO: 691353 - RNA, 19 nt, Homo sapiens
ccucauaugugggacagaa

SEQ ID NO: 691354 - RNA, 19 nt, Homo sapiens
agacaugaaaugguacuua

SEQ ID NO: 691355 - RNA, 19 nt, Homo sapiens
agaagaacuugaugagaca

SEQ ID NO: 691356 - RNA, 19 nt, Homo sapiens
cgacuuagaagaacuugau

SEQ ID NO: 691357 - RNA, 19 nt, Homo sapiens
uggaccaguuuguucguua

SEQ ID NO: 691358 - RNA, 19 nt, Homo sapiens
gggacagaaucuagaaagu

SEQ ID NO: 691359 - RNA, 19 nt, Homo sapiens
gcugaaagcaagauguguu

SEQ ID NO: 691360 - RNA, 19 nt, Homo sapiens
ccaaagcuggaucggauaa

SEQ ID NO: 691361 - RNA, 19 nt, Homo sapiens
gguagaagaguuuagaaag

SEQ ID NO: 691362 - RNA, 19 nt, Homo sapiens
acacuaaacagcaaguuau

SEQ ID NO: 691363 - RNA, 19 nt, Homo sapiens
agagaacacuuacagaacu

SEQ ID NO: 691364 - RNA, 19 nt, Homo sapiens
ccacagcuauaauggacau

SEQ ID NO: 691365 - RNA, 19 nt, Homo sapiens
ugaggcacauuuacaucaa

SEQ ID NO: 691366 - RNA, 19 nt, Homo sapiens
uaauaccuccuccaaauca

SEQ ID NO: 691367 - RNA, 19 nt, Homo sapiens
gaccuuucauuagauauuc

SEQ ID NO: 691368 - RNA, 19 nt, Homo sapiens
ggaguuaaggaaugggaaa

SEQ ID NO: 691369 - RNA, 19 nt, Homo sapiens
ugagacagaguuauauaug

SEQ ID NO: 691370 - RNA, 19 nt, Homo sapiens
uguuaucgcugugaugauu

SEQ ID NO: 691371 - RNA, 19 nt, Homo sapiens
auaacaaagggcaucauua

SEQ ID NO: 691372 - RNA, 19 nt, Homo sapiens
gacucuaaaucaaggauca

SEQ ID NO: 691373 - RNA, 19 nt, Homo sapiens
guagugacuuacugaacau

SEQ ID NO: 691374 - RNA, 19 nt, Homo sapiens
gaaacaaaaguccacaaaa

SEQ ID NO: 691375 - RNA, 19 nt, Homo sapiens
gaaaauggaccaguuuguu

SEQ ID NO: 691376 - RNA, 19 nt, Homo sapiens
uccuagaccuuucauuaga

SEQ ID NO: 691377 - RNA, 19 nt, Homo sapiens
gcccagaguccuuauuuua

SEQ ID NO: 691378 - RNA, 19 nt, Homo sapiens
gacacucugugcuuuaugg

SEQ ID NO: 691379 - RNA, 19 nt, Homo sapiens
agaaagacacucugugcuu

SEQ ID NO: 691380 - RNA, 19 nt, Homo sapiens
aagcaccacugccauuugu

SEQ ID NO: 691381 - RNA, 19 nt, Homo sapiens
aaagcaagauguguuccuu

SEQ ID NO: 691382 - RNA, 19 nt, Homo sapiens
aaggugcuaugcuuacauu

SEQ ID NO: 691383 - RNA, 19 nt, Homo sapiens
auuccuagaccuuucauua

SEQ ID NO: 691384 - RNA, 19 nt, Homo sapiens
uaaaggcgcugcuugauuu

SEQ ID NO: 691385 - RNA, 19 nt, Homo sapiens
gaacucagcccgcaucauu

SEQ ID NO: 691386 - RNA, 19 nt, Homo sapiens
ggauaaagauggagacaag

SEQ ID NO: 691387 - RNA, 19 nt, Homo sapiens
uggaggagcugcugaacaa

SEQ ID NO: 691388 - RNA, 19 nt, Homo sapiens
gaggagcaguucacagugu

SEQ ID NO: 691389 - RNA, 19 nt, Homo sapiens
uugaggagguucuggauuu

SEQ ID NO: 691390 - RNA, 19 nt, Homo sapiens
acacugcccuccaucuaaa

SEQ ID NO: 691391 - RNA, 19 nt, Homo sapiens
gcuaacuccugauuaauac

SEQ ID NO: 691392 - RNA, 19 nt, Homo sapiens
ccacaacuacugcgugauu

SEQ ID NO: 691393 - RNA, 19 nt, Homo sapiens
caacacugcccuccaucua

SEQ ID NO: 691394 - RNA, 19 nt, Homo sapiens
ucacagacgucaucaccau

SEQ ID NO: 691395 - RNA, 19 nt, Homo sapiens
gaacgagggcaucuaugug

SEQ ID NO: 691396 - RNA, 19 nt, Homo sapiens
gcagaugacagaggccaua

SEQ ID NO: 691397 - RNA, 19 nt, Homo sapiens
uaacagugcaggacacaga

SEQ ID NO: 691398 - RNA, 19 nt, Homo sapiens
ucgaugacuuccauaagaa

SEQ ID NO: 691399 - RNA, 19 nt, Homo sapiens
gagaaggacacagcuaaga

SEQ ID NO: 691400 - RNA, 19 nt, Homo sapiens
ggaaaggugcgcgcuguga

SEQ ID NO: 691401 - RNA, 19 nt, Homo sapiens
uaccugcacuucuagauuc

SEQ ID NO: 691402 - RNA, 19 nt, Homo sapiens
cauucgcacugcugucuuu

SEQ ID NO: 691403 - RNA, 19 nt, Homo sapiens
ggccugacuucuucacaga

SEQ ID NO: 691404 - RNA, 19 nt, Homo sapiens
gccuacaacuggcacuuug

SEQ ID NO: 691405 - RNA, 19 nt, Homo sapiens
gugagaaggacacagcuaa

SEQ ID NO: 691406 - RNA, 19 nt, Homo sapiens
ugcgcuaacuccugauuaa

SEQ ID NO: 691407 - RNA, 19 nt, Homo sapiens
cuaaaggcgcugcuugauu

SEQ ID NO: 691408 - RNA, 19 nt, Homo sapiens
gcuuggugcuguuugaugu

SEQ ID NO: 691409 - RNA, 19 nt, Homo sapiens
cgcuaacuccugauuaaua

SEQ ID NO: 691410 - RNA, 19 nt, Homo sapiens
uggcugagguggaggugaa

SEQ ID NO: 691411 - RNA, 19 nt, Homo sapiens
ccaucgagaucaccaccaa

SEQ ID NO: 691412 - RNA, 19 nt, Homo sapiens
gagucaccauggcaacuga

SEQ ID NO: 691413 - RNA, 19 nt, Homo sapiens
cgagaacgagggcaucuau

SEQ ID NO: 691414 - RNA, 19 nt, Homo sapiens
gaaaggugcgcgcugugau

SEQ ID NO: 691415 - RNA, 19 nt, Homo sapiens
ucaagggagagaagucuuu

SEQ ID NO: 691416 - RNA, 19 nt, Homo sapiens
gaccggauggcaagaauca

SEQ ID NO: 691417 - RNA, 19 nt, Homo sapiens
gcccaacacugcccuccau

SEQ ID NO: 691418 - RNA, 19 nt, Homo sapiens
caaugagaggguacuguuu

SEQ ID NO: 691419 - RNA, 19 nt, Homo sapiens
uucgaugacuuccauaaga

SEQ ID NO: 691420 - RNA, 19 nt, Homo sapiens
gaaguccugugggagaaag

SEQ ID NO: 691421 - RNA, 19 nt, Homo sapiens
gggcaucuaugugcaggau

SEQ ID NO: 691422 - RNA, 19 nt, Homo sapiens
caggagagcagcuggaaca

SEQ ID NO: 691423 - RNA, 19 nt, Homo sapiens
ccagucagaagccgagaaa

SEQ ID NO: 691424 - RNA, 19 nt, Homo sapiens
ugaggagguucuggauuug

SEQ ID NO: 691425 - RNA, 19 nt, Homo sapiens
agguggaggugaagaaguu

SEQ ID NO: 691426 - RNA, 19 nt, Homo sapiens
caguggagccuguggauca

SEQ ID NO: 691427 - RNA, 19 nt, Homo sapiens
aggaguggcugguaacagu

SEQ ID NO: 691428 - RNA, 19 nt, Homo sapiens
acaaugagaggguacuguu

SEQ ID NO: 691429 - RNA, 19 nt, Homo sapiens
gaagaaguucaagcagaug

SEQ ID NO: 691430 - RNA, 19 nt, Homo sapiens
ugacuuccauaagaacuca

SEQ ID NO: 691431 - RNA, 19 nt, Homo sapiens
uguaggugaugccugcaaa

SEQ ID NO: 691432 - RNA, 19 nt, Homo sapiens
guacgacuaccgagagaag

SEQ ID NO: 691433 - RNA, 19 nt, Homo sapiens
aaugagaggguacuguuug

SEQ ID NO: 691434 - RNA, 19 nt, Homo sapiens
agaacgagggcaucuaugu

SEQ ID NO: 691435 - RNA, 19 nt, Homo sapiens
gccaggccaucccucuaga

SEQ ID NO: 691436 - RNA, 19 nt, Homo sapiens
caggggaggugcuggaaaa

SEQ ID NO: 691437 - RNA, 19 nt, Homo sapiens
gacgucaucaccaucgaaa

SEQ ID NO: 691438 - RNA, 19 nt, Homo sapiens
cggugcagguguacgacua

SEQ ID NO: 691439 - RNA, 19 nt, Homo sapiens
ggugagaaggacacagcua

SEQ ID NO: 691440 - RNA, 19 nt, Homo sapiens
aaaggugcgcgcugugauu

SEQ ID NO: 691441 - RNA, 19 nt, Homo sapiens
ccugauuaauacaauggaa

SEQ ID NO: 691442 - RNA, 19 nt, Homo sapiens
ggugcgcgcugugauugga

SEQ ID NO: 691443 - RNA, 19 nt, Homo sapiens
guaugugccaucugccaaa

SEQ ID NO: 691444 - RNA, 19 nt, Homo sapiens
guaccucccagcgguguuu

SEQ ID NO: 691445 - RNA, 19 nt, Homo sapiens
gggaggugcuggaaaagga

SEQ ID NO: 691446 - RNA, 19 nt, Homo sapiens
gaaguucaagcagaugaca

SEQ ID NO: 691447 - RNA, 19 nt, Homo sapiens
cuaccugcacuucuagauu

SEQ ID NO: 691448 - RNA, 19 nt, Homo sapiens
ggaggucguggagaucauu

SEQ ID NO: 691449 - RNA, 19 nt, Homo sapiens
gaagguccgagagcuggaa

SEQ ID NO: 691450 - RNA, 19 nt, Homo sapiens
gauuggaagcaccuacaug

SEQ ID NO: 691451 - RNA, 19 nt, Homo sapiens
ggcagaagcgcguggucaa

SEQ ID NO: 691452 - RNA, 19 nt, Homo sapiens
guggaggucgggccaaaga

SEQ ID NO: 691453 - RNA, 19 nt, Homo sapiens
gaugucacagggcaaguuc

SEQ ID NO: 691454 - RNA, 19 nt, Homo sapiens
aacugcagcuggccuacaa

SEQ ID NO: 691455 - RNA, 19 nt, Homo sapiens
gagaacgagggcaucuaug

SEQ ID NO: 691456 - RNA, 19 nt, Homo sapiens
ggagagcagcuggaacaag

SEQ ID NO: 691457 - RNA, 19 nt, Homo sapiens
ggggaggaguggcugguaa

SEQ ID NO: 691458 - RNA, 19 nt, Homo sapiens
guguacgacuaccgagaga

SEQ ID NO: 691459 - RNA, 19 nt, Homo sapiens
guguggaggucgggccaaa

SEQ ID NO: 691460 - RNA, 19 nt, Homo sapiens
ugugccaucugccaaagug

SEQ ID NO: 691461 - RNA, 19 nt, Homo sapiens
aaguggaggucguggagau

SEQ ID NO: 691462 - RNA, 19 nt, Homo sapiens
gcaggagaugaguggcuuu

SEQ ID NO: 691463 - RNA, 19 nt, Homo sapiens
ggccuacaacuggcacuuu

SEQ ID NO: 691464 - RNA, 19 nt, Homo sapiens
uaaaggcgcugcuugauuu

SEQ ID NO: 691465 - RNA, 19 nt, Homo sapiens
gaacucagcccgcaucauu

SEQ ID NO: 691466 - RNA, 19 nt, Homo sapiens
ggauaaagauggagacaag

SEQ ID NO: 691467 - RNA, 19 nt, Homo sapiens
uggaggagcugcugaacaa

SEQ ID NO: 691468 - RNA, 19 nt, Homo sapiens
gaggagcaguucacagugu

SEQ ID NO: 691469 - RNA, 19 nt, Homo sapiens
uugaggagguucuggauuu

SEQ ID NO: 691470 - RNA, 19 nt, Homo sapiens
acacugcccuccaucuaaa

SEQ ID NO: 691471 - RNA, 19 nt, Homo sapiens
gcuaacuccugauuaauac

SEQ ID NO: 691472 - RNA, 19 nt, Homo sapiens
ccacaacuacugcgugauu

SEQ ID NO: 691473 - RNA, 19 nt, Homo sapiens
caacacugcccuccaucua

SEQ ID NO: 691474 - RNA, 19 nt, Homo sapiens
ucacagacgucaucaccau

SEQ ID NO: 691475 - RNA, 19 nt, Homo sapiens
gaacgagggcaucuaugug

SEQ ID NO: 691476 - RNA, 19 nt, Homo sapiens
gcagaugacagaggccaua

SEQ ID NO: 691477 - RNA, 19 nt, Homo sapiens
uaacagugcaggacacaga

SEQ ID NO: 691478 - RNA, 19 nt, Homo sapiens
ucgaugacuuccauaagaa

SEQ ID NO: 691479 - RNA, 19 nt, Homo sapiens
gagaaggacacagcuaaga

SEQ ID NO: 691480 - RNA, 19 nt, Homo sapiens
ggaaaggugcgcgcuguga

SEQ ID NO: 691481 - RNA, 19 nt, Homo sapiens
cauucgcacugcugucuuu

SEQ ID NO: 691482 - RNA, 19 nt, Homo sapiens
ggccugacuucuucacaga

SEQ ID NO: 691483 - RNA, 19 nt, Homo sapiens
gccuacaacuggcacuuug

SEQ ID NO: 691484 - RNA, 19 nt, Homo sapiens
gugagaaggacacagcuaa

SEQ ID NO: 691485 - RNA, 19 nt, Homo sapiens
ugcgcuaacuccugauuaa

SEQ ID NO: 691486 - RNA, 19 nt, Homo sapiens
cuaaaggcgcugcuugauu

SEQ ID NO: 691487 - RNA, 19 nt, Homo sapiens
gcuuggugcuguuugaugu

SEQ ID NO: 691488 - RNA, 19 nt, Homo sapiens
cgcuaacuccugauuaaua

SEQ ID NO: 691489 - RNA, 19 nt, Homo sapiens
uggcugagguggaggugaa

SEQ ID NO: 691490 - RNA, 19 nt, Homo sapiens
ccaucgagaucaccaccaa

SEQ ID NO: 691491 - RNA, 19 nt, Homo sapiens
cgagaacgagggcaucuau

SEQ ID NO: 691492 - RNA, 19 nt, Homo sapiens
gagucaccauggcaacuga

SEQ ID NO: 691493 - RNA, 19 nt, Homo sapiens
gaaaggugcgcgcugugau

SEQ ID NO: 691494 - RNA, 19 nt, Homo sapiens
ucaagggagagaagucuuu

SEQ ID NO: 691495 - RNA, 19 nt, Homo sapiens
ccaccuaccagucaucuuc

SEQ ID NO: 691496 - RNA, 19 nt, Homo sapiens
gaccggauggcaagaauca

SEQ ID NO: 691497 - RNA, 19 nt, Homo sapiens
gcccaacacugcccuccau

SEQ ID NO: 691498 - RNA, 19 nt, Homo sapiens
caaugagaggguacuguuu

SEQ ID NO: 691499 - RNA, 19 nt, Homo sapiens
uucgaugacuuccauaaga

SEQ ID NO: 691500 - RNA, 19 nt, Homo sapiens
gaaguccugugggagaaag

SEQ ID NO: 691501 - RNA, 19 nt, Homo sapiens
gggcaucuaugugcaggau

SEQ ID NO: 691502 - RNA, 19 nt, Homo sapiens
caggagagcagcuggaaca

SEQ ID NO: 691503 - RNA, 19 nt, Homo sapiens
ccagucagaagccgagaaa

SEQ ID NO: 691504 - RNA, 19 nt, Homo sapiens
ugaggagguucuggauuug

SEQ ID NO: 691505 - RNA, 19 nt, Homo sapiens
agguggaggugaagaaguu

SEQ ID NO: 691506 - RNA, 19 nt, Homo sapiens
caguggagccuguggauca

SEQ ID NO: 691507 - RNA, 19 nt, Homo sapiens
aggaguggcugguaacagu

SEQ ID NO: 691508 - RNA, 19 nt, Homo sapiens
acaaugagaggguacuguu

SEQ ID NO: 691509 - RNA, 19 nt, Homo sapiens
gaagaaguucaagcagaug

SEQ ID NO: 691510 - RNA, 19 nt, Homo sapiens
ugacuuccauaagaacuca

SEQ ID NO: 691511 - RNA, 19 nt, Homo sapiens
uguaggugaugccugcaaa

SEQ ID NO: 691512 - RNA, 19 nt, Homo sapiens
guacgacuaccgagagaag

SEQ ID NO: 691513 - RNA, 19 nt, Homo sapiens
agaacgagggcaucuaugu

SEQ ID NO: 691514 - RNA, 19 nt, Homo sapiens
gccaggccaucccucuaga

SEQ ID NO: 691515 - RNA, 19 nt, Homo sapiens
caggggaggugcuggaaaa

SEQ ID NO: 691516 - RNA, 19 nt, Homo sapiens
aaugagaggguacuguuug

SEQ ID NO: 691517 - RNA, 19 nt, Homo sapiens
gacgucaucaccaucgaaa

SEQ ID NO: 691518 - RNA, 19 nt, Homo sapiens
cggugcagguguacgacua

SEQ ID NO: 691519 - RNA, 19 nt, Homo sapiens
ggugagaaggacacagcua

SEQ ID NO: 691520 - RNA, 19 nt, Homo sapiens
aaaggugcgcgcugugauu

SEQ ID NO: 691521 - RNA, 19 nt, Homo sapiens
ccugauuaauacaauggaa

SEQ ID NO: 691522 - RNA, 19 nt, Homo sapiens
ggugcgcgcugugauugga

SEQ ID NO: 691523 - RNA, 19 nt, Homo sapiens
guaugugccaucugccaaa

SEQ ID NO: 691524 - RNA, 19 nt, Homo sapiens
guaccucccagcgguguuu

SEQ ID NO: 691525 - RNA, 19 nt, Homo sapiens
gggaggugcuggaaaagga

SEQ ID NO: 691526 - RNA, 19 nt, Homo sapiens
gaaguucaagcagaugaca

SEQ ID NO: 691527 - RNA, 19 nt, Homo sapiens
ggaggucguggagaucauu

SEQ ID NO: 691528 - RNA, 19 nt, Homo sapiens
gaagguccgagagcuggaa

SEQ ID NO: 691529 - RNA, 19 nt, Homo sapiens
gauuggaagcaccuacaug

SEQ ID NO: 691530 - RNA, 19 nt, Homo sapiens
ggcagaagcgcguggucaa

SEQ ID NO: 691531 - RNA, 19 nt, Homo sapiens
guggaggucgggccaaaga

SEQ ID NO: 691532 - RNA, 19 nt, Homo sapiens
gaugucacagggcaaguuc

SEQ ID NO: 691533 - RNA, 19 nt, Homo sapiens
aacugcagcuggccuacaa

SEQ ID NO: 691534 - RNA, 19 nt, Homo sapiens
gagaacgagggcaucuaug

SEQ ID NO: 691535 - RNA, 19 nt, Homo sapiens
ggagagcagcuggaacaag

SEQ ID NO: 691536 - RNA, 19 nt, Homo sapiens
ggggaggaguggcugguaa

SEQ ID NO: 691537 - RNA, 19 nt, Homo sapiens
guguacgacuaccgagaga

SEQ ID NO: 691538 - RNA, 19 nt, Homo sapiens
ugugccaucugccaaagug

SEQ ID NO: 691539 - RNA, 19 nt, Homo sapiens
guguggaggucgggccaaa

SEQ ID NO: 691540 - RNA, 19 nt, Homo sapiens
aaguggaggucguggagau

SEQ ID NO: 691541 - RNA, 19 nt, Homo sapiens
gcaggagaugaguggcuuu

SEQ ID NO: 691542 - RNA, 19 nt, Homo sapiens
uaccagucaucuucuugug

SEQ ID NO: 691543 - RNA, 19 nt, Homo sapiens
ggccuacaacuggcacuuu

SEQ ID NO: 691544 - RNA, 19 nt, Homo sapiens
gaagaagggugugggcaaa

SEQ ID NO: 691545 - RNA, 19 nt, Homo sapiens
ucucacaacugcuauguuu

SEQ ID NO: 691546 - RNA, 19 nt, Homo sapiens
gggaaucacuacuuugcua

SEQ ID NO: 691547 - RNA, 19 nt, Homo sapiens
gcaccgagcuuucuucacu

SEQ ID NO: 691548 - RNA, 19 nt, Homo sapiens
caaguuaccucagacagaa

SEQ ID NO: 691549 - RNA, 19 nt, Homo sapiens
gcauggagucguacaauuu

SEQ ID NO: 691550 - RNA, 19 nt, Homo sapiens
gaaggccucuccuguguuc

SEQ ID NO: 691551 - RNA, 19 nt, Homo sapiens
ccacaucacuuaggugcua

SEQ ID NO: 691552 - RNA, 19 nt, Homo sapiens
gggaauggcucuacuucau

SEQ ID NO: 691553 - RNA, 19 nt, Homo sapiens
gaaguucagcgcccucuuu

SEQ ID NO: 691554 - RNA, 19 nt, Homo sapiens
uaaauuuccucucccgauu

SEQ ID NO: 691555 - RNA, 19 nt, Homo sapiens
ggaaagaggaauccggaaa

SEQ ID NO: 691556 - RNA, 19 nt, Homo sapiens
uaacaggaaucgaucaagu

SEQ ID NO: 691557 - RNA, 19 nt, Homo sapiens
gaauaagccuucacuucca

SEQ ID NO: 691558 - RNA, 19 nt, Homo sapiens
guaguuccuugcugaguaa

SEQ ID NO: 691559 - RNA, 19 nt, Homo sapiens
ggaaaggccucaggaagag

SEQ ID NO: 691560 - RNA, 19 nt, Homo sapiens
ccauuuggcaugaacauua

SEQ ID NO: 691561 - RNA, 19 nt, Homo sapiens
uaauuggccucucugguuu

SEQ ID NO: 691562 - RNA, 19 nt, Homo sapiens
gcuaagagaugccguuugc

SEQ ID NO: 691563 - RNA, 19 nt, Homo sapiens
gaaagaggaauccggaaau

SEQ ID NO: 691564 - RNA, 19 nt, Homo sapiens
cauccugucuucagauaaa

SEQ ID NO: 691565 - RNA, 19 nt, Homo sapiens
ggaaugaucacagcuguug

SEQ ID NO: 691566 - RNA, 19 nt, Homo sapiens
caauacgccagaaauguua

SEQ ID NO: 691567 - RNA, 19 nt, Homo sapiens
caccacagauguuucaguu

SEQ ID NO: 691568 - RNA, 19 nt, Homo sapiens
ucagggaccuuggugcaua

SEQ ID NO: 691569 - RNA, 19 nt, Homo sapiens
ggaaauguaacaccacaga

SEQ ID NO: 691570 - RNA, 19 nt, Homo sapiens
gcggugagcaggacaauga

SEQ ID NO: 691571 - RNA, 19 nt, Homo sapiens
aaauguaacucagcgaauu

SEQ ID NO: 691572 - RNA, 19 nt, Homo sapiens
caacggcuguguaaacuac

SEQ ID NO: 691573 - RNA, 19 nt, Homo sapiens
cacaaaguauggcuucuau

SEQ ID NO: 691574 - RNA, 19 nt, Homo sapiens
gcacaaaguauggcuucua

SEQ ID NO: 691575 - RNA, 19 nt, Homo sapiens
gaauaccacauccaaauca

SEQ ID NO: 691576 - RNA, 19 nt, Homo sapiens
aggaaucgaucaaguguug

SEQ ID NO: 691577 - RNA, 19 nt, Homo sapiens
caacagaaggcaaauacga

SEQ ID NO: 691578 - RNA, 19 nt, Homo sapiens
gaacguccuucucacaacu

SEQ ID NO: 691579 - RNA, 19 nt, Homo sapiens
guaagaauaccacauccaa

SEQ ID NO: 691580 - RNA, 19 nt, Homo sapiens
guaacucagcgaauuguaa

SEQ ID NO: 691581 - RNA, 19 nt, Homo sapiens
gccauccugucuucagaua

SEQ ID NO: 691582 - RNA, 19 nt, Homo sapiens
ggcauggagucguacaauu

SEQ ID NO: 691583 - RNA, 19 nt, Homo sapiens
ucacagggauaacaggaau

SEQ ID NO: 691584 - RNA, 19 nt, Homo sapiens
gcaaggcgugcuucuggua

SEQ ID NO: 691585 - RNA, 19 nt, Homo sapiens
gggcaaagggaacaaauca

SEQ ID NO: 691586 - RNA, 19 nt, Homo sapiens
gagccauccugucuucaga

SEQ ID NO: 691587 - RNA, 19 nt, Homo sapiens
gacaugauuuauaccauag

SEQ ID NO: 691588 - RNA, 19 nt, Homo sapiens
ggaccuuggugcauaagca

SEQ ID NO: 691589 - RNA, 19 nt, Homo sapiens
aaagaggaauccggaaaug

SEQ ID NO: 691590 - RNA, 19 nt, Homo sapiens
cuaauuggccucucugguu

SEQ ID NO: 691591 - RNA, 19 nt, Homo sapiens
gcaauaaacaggggaauuu

SEQ ID NO: 691592 - RNA, 19 nt, Homo sapiens
aauuuccucucccgauuua

SEQ ID NO: 691593 - RNA, 19 nt, Homo sapiens
ucaauacgccagaaauguu

SEQ ID NO: 691594 - RNA, 19 nt, Homo sapiens
ccugguaccuguguauauu

SEQ ID NO: 691595 - RNA, 19 nt, Homo sapiens
gcuggaaguucaacagaag

SEQ ID NO: 691596 - RNA, 19 nt, Homo sapiens
uguaguuccuugcugagua

SEQ ID NO: 691597 - RNA, 19 nt, Homo sapiens
gcauguaucuguaguuccu

SEQ ID NO: 691598 - RNA, 19 nt, Homo sapiens
gcaaagggaacaaaucacu

SEQ ID NO: 691599 - RNA, 19 nt, Homo sapiens
ggacaggucuacgccacau

SEQ ID NO: 691600 - RNA, 19 nt, Homo sapiens
ggccagugcuuuugcauuu

SEQ ID NO: 691601 - RNA, 19 nt, Homo sapiens
uggaaggccucuccugugu

SEQ ID NO: 691602 - RNA, 19 nt, Homo sapiens
gaauuguaauggaaagcau

SEQ ID NO: 691603 - RNA, 19 nt, Homo sapiens
uuaaugauggguauuggua

SEQ ID NO: 691604 - RNA, 19 nt, Homo sapiens
gaaccucuuugugcuugga

SEQ ID NO: 691605 - RNA, 19 nt, Homo sapiens
cagggaccuuggugcauaa

SEQ ID NO: 691606 - RNA, 19 nt, Homo sapiens
caaaguauggcuucuaugc

SEQ ID NO: 691607 - RNA, 19 nt, Homo sapiens
gauggacugcguacaaguu

SEQ ID NO: 691608 - RNA, 19 nt, Homo sapiens
gugugggaaucacuacuuu

SEQ ID NO: 691609 - RNA, 19 nt, Homo sapiens
cauuuggcaugaacauuau

SEQ ID NO: 691610 - RNA, 19 nt, Homo sapiens
gauaacaggaaucgaucaa

SEQ ID NO: 691611 - RNA, 19 nt, Homo sapiens
uaagguuccauacccauuu

SEQ ID NO: 691612 - RNA, 19 nt, Homo sapiens
uauccuggcugcucugcuu

SEQ ID NO: 691613 - RNA, 19 nt, Homo sapiens
cugacaauauuccuaguau

SEQ ID NO: 691614 - RNA, 19 nt, Homo sapiens
gcugacaauauuccuagua

SEQ ID NO: 691615 - RNA, 19 nt, Homo sapiens
ucagcgaauuguaauggaa

SEQ ID NO: 691616 - RNA, 19 nt, Homo sapiens
aagaauaccacauccaaau

SEQ ID NO: 691617 - RNA, 19 nt, Homo sapiens
uggaaaggccucaggaaga

SEQ ID NO: 691618 - RNA, 19 nt, Homo sapiens
caaguuacagcuguucaaa

SEQ ID NO: 691619 - RNA, 19 nt, Homo sapiens
uaacucagcgaauuguaau

SEQ ID NO: 691620 - RNA, 19 nt, Homo sapiens
cuacucguuucucuuaaug

SEQ ID NO: 691621 - RNA, 19 nt, Homo sapiens
ccaaguuaccucagacaga

SEQ ID NO: 691622 - RNA, 19 nt, Homo sapiens
ucucuaaccugcaguucau

SEQ ID NO: 691623 - RNA, 19 nt, Homo sapiens
cuacagcacuaccugacau

SEQ ID NO: 691624 - RNA, 19 nt, Homo sapiens
cgagcuuucuucacucuuc

SEQ ID NO: 691625 - RNA, 19 nt, Homo sapiens
aauggaggcuggaaguuca

SEQ ID NO: 691626 - RNA, 19 nt, Homo sapiens
uaagaauaccacauccaaa

SEQ ID NO: 691627 - RNA, 19 nt, Homo sapiens
ggaauggcucuacuucauc

SEQ ID NO: 691628 - RNA, 19 nt, Homo sapiens
cuugauggcauauuuggua

SEQ ID NO: 691629 - RNA, 19 nt, Homo sapiens
ggcuggaaguucaacagaa

SEQ ID NO: 691630 - RNA, 19 nt, Homo sapiens
gggcuccuagcuugaauaa

SEQ ID NO: 691631 - RNA, 19 nt, Homo sapiens
cagaugcuucagcuacuua

SEQ ID NO: 691632 - RNA, 19 nt, Homo sapiens
ggcucguccuuccaaguua

SEQ ID NO: 691633 - RNA, 19 nt, Homo sapiens
gggcucguccuuccaaguu

SEQ ID NO: 691634 - RNA, 19 nt, Homo sapiens
aaccugcaguucauugauu

SEQ ID NO: 691635 - RNA, 19 nt, Homo sapiens
gauggcauauuugguacug

SEQ ID NO: 691636 - RNA, 19 nt, Homo sapiens
gaaaacggcauugcagaaa

SEQ ID NO: 691637 - RNA, 19 nt, Homo sapiens
gaggaauccggaaauggaa

SEQ ID NO: 691638 - RNA, 19 nt, Homo sapiens
ggucuacgccacaucacuu

SEQ ID NO: 691639 - RNA, 19 nt, Homo sapiens
ggacugcguacaaguuaca

SEQ ID NO: 691640 - RNA, 19 nt, Homo sapiens
gaaauguaacaccacagau

SEQ ID NO: 691641 - RNA, 19 nt, Homo sapiens
cauaagcaaauguaacuca

SEQ ID NO: 691642 - RNA, 19 nt, Homo sapiens
gauggguauugguaagaau

SEQ ID NO: 691643 - RNA, 19 nt, Homo sapiens
ggaauccggaaauggaaga

SEQ ID NO: 691644 - RNA, 19 nt, Homo sapiens
ccacagagccuaaguuuga

SEQ ID NO: 691645 - RNA, 19 nt, Homo sapiens
gaacaccucucauauuugg

SEQ ID NO: 691646 - RNA, 19 nt, Homo sapiens
cuaacuaacuucuguguaa

SEQ ID NO: 691647 - RNA, 19 nt, Homo sapiens
gaagaacagcuagaaauuu

SEQ ID NO: 691648 - RNA, 19 nt, Homo sapiens
ggaagaacagcuagaaauu

SEQ ID NO: 691649 - RNA, 19 nt, Homo sapiens
cugaacaccucucauauuu

SEQ ID NO: 691650 - RNA, 19 nt, Homo sapiens
ggaaugggccaaagucuga

SEQ ID NO: 691651 - RNA, 19 nt, Homo sapiens
ggccaaagucugagucuua

SEQ ID NO: 691652 - RNA, 19 nt, Homo sapiens
caucucagcuugcuccauu

SEQ ID NO: 691653 - RNA, 19 nt, Homo sapiens
uaacuucuguguaaacuca

SEQ ID NO: 691654 - RNA, 19 nt, Homo sapiens
ggaaaggaagcaugguaua

SEQ ID NO: 691655 - RNA, 19 nt, Homo sapiens
aagaggagaucuacgguaa

SEQ ID NO: 691656 - RNA, 19 nt, Homo sapiens
aaggaagcaugguauauaa

SEQ ID NO: 691657 - RNA, 19 nt, Homo sapiens
ugaaauacauuccuaucug

SEQ ID NO: 691658 - RNA, 19 nt, Homo sapiens
gaaaggaagcaugguauau

SEQ ID NO: 691659 - RNA, 19 nt, Homo sapiens
gaaggcauuugcugcauca

SEQ ID NO: 691660 - RNA, 19 nt, Homo sapiens
guaccaauguuaugcuaug

SEQ ID NO: 691661 - RNA, 19 nt, Homo sapiens
ggcucacgcugcccaauua

SEQ ID NO: 691662 - RNA, 19 nt, Homo sapiens
aaaggaagcaugguauaua

SEQ ID NO: 691663 - RNA, 19 nt, Homo sapiens
ucagauaagucaccuuucu

SEQ ID NO: 691664 - RNA, 19 nt, Homo sapiens
guuaugcuaugucucuaaa

SEQ ID NO: 691665 - RNA, 19 nt, Homo sapiens
ggccagugccuuugcauuu

SEQ ID NO: 691666 - RNA, 19 nt, Homo sapiens
agaggagcguggucugaua

SEQ ID NO: 691667 - RNA, 19 nt, Homo sapiens
caugguauauaacaggaaa

SEQ ID NO: 691668 - RNA, 19 nt, Homo sapiens
ggaagcaugguauauaaca

SEQ ID NO: 691669 - RNA, 19 nt, Homo sapiens
gagccuaaguuugacaugu

SEQ ID NO: 691670 - RNA, 19 nt, Homo sapiens
ccagaagacacuccagaaa

SEQ ID NO: 691671 - RNA, 19 nt, Homo sapiens
gguccagggugcaaucaug

SEQ ID NO: 691672 - RNA, 19 nt, Homo sapiens
uuagagacuuguaccaaug

SEQ ID NO: 691673 - RNA, 19 nt, Homo sapiens
cagaagaccuaagccugaa

SEQ ID NO: 691674 - RNA, 19 nt, Homo sapiens
gaggagaucuacgguaacu

SEQ ID NO: 691675 - RNA, 19 nt, Homo sapiens
gugccuugcuuucauacuu

SEQ ID NO: 691676 - RNA, 19 nt, Homo sapiens
caaaauguuuccuaucaug

SEQ ID NO: 691677 - RNA, 19 nt, Homo sapiens
gagacuuguaccaauguua

SEQ ID NO: 691678 - RNA, 19 nt, Homo sapiens
uguccaaccugcaauuugu

SEQ ID NO: 691679 - RNA, 19 nt, Homo sapiens
guggugacaucauggcuau

SEQ ID NO: 691680 - RNA, 19 nt, Homo sapiens
gaagaccuaagccugaaau

SEQ ID NO: 691681 - RNA, 19 nt, Homo sapiens
gagcuacgauuuccccauu

SEQ ID NO: 691682 - RNA, 19 nt, Homo sapiens
caauacaggcauucuugaa

SEQ ID NO: 691683 - RNA, 19 nt, Homo sapiens
uaugcuaugucucuaaauc

SEQ ID NO: 691684 - RNA, 19 nt, Homo sapiens
ccaauguuaugcuaugucu

SEQ ID NO: 691685 - RNA, 19 nt, Homo sapiens
gccaaagucugagucuuag

SEQ ID NO: 691686 - RNA, 19 nt, Homo sapiens
caggaaaggaagcauggua

SEQ ID NO: 691687 - RNA, 19 nt, Homo sapiens
ccugaacaccucucauauu

SEQ ID NO: 691688 - RNA, 19 nt, Homo sapiens
aaucuuuacucuccuaagu

SEQ ID NO: 691689 - RNA, 19 nt, Homo sapiens
gaagcaugguauauaacag

SEQ ID NO: 691690 - RNA, 19 nt, Homo sapiens
gaagacacuccagaaaaua

SEQ ID NO: 691691 - RNA, 19 nt, Homo sapiens
gggcucaugccaacaguga

SEQ ID NO: 691692 - RNA, 19 nt, Homo sapiens
auacaggcauucuugaagu

SEQ ID NO: 691693 - RNA, 19 nt, Homo sapiens
cagacgugcugcccacaga

SEQ ID NO: 691694 - RNA, 19 nt, Homo sapiens
gccagugccuuugcauuuc

SEQ ID NO: 691695 - RNA, 19 nt, Homo sapiens
gcuaugucucuaaaucuuu

SEQ ID NO: 691696 - RNA, 19 nt, Homo sapiens
uguguaaacucagauaagu

SEQ ID NO: 691697 - RNA, 19 nt, Homo sapiens
cgggugccuugcuuucaua

SEQ ID NO: 691698 - RNA, 19 nt, Homo sapiens
ggugacaucauggcuauug

SEQ ID NO: 691699 - RNA, 19 nt, Homo sapiens
ccguguggcugcucugcua

SEQ ID NO: 691700 - RNA, 19 nt, Homo sapiens
gcucaucggcaccaucuuc

SEQ ID NO: 691701 - RNA, 19 nt, Homo sapiens
caucuaggaagaacagcua

SEQ ID NO: 691702 - RNA, 19 nt, Homo sapiens
cuuagagacuuguaccaau

SEQ ID NO: 691703 - RNA, 19 nt, Homo sapiens
gccuaaguuugacauguug

SEQ ID NO: 691704 - RNA, 19 nt, Homo sapiens
caaaagaucagauugcaau

SEQ ID NO: 691705 - RNA, 19 nt, Homo sapiens
caaaggauuuucuucaagu

SEQ ID NO: 691706 - RNA, 19 nt, Homo sapiens
caaguucacggcccucuuc

SEQ ID NO: 691707 - RNA, 19 nt, Homo sapiens
uugaguccaucggagauua

SEQ ID NO: 691708 - RNA, 19 nt, Homo sapiens
caaagaugagggcccaaga

SEQ ID NO: 691709 - RNA, 19 nt, Homo sapiens
agaagacacuccagaaaau

SEQ ID NO: 691710 - RNA, 19 nt, Homo sapiens
agauugcaauuccagaaga

SEQ ID NO: 691711 - RNA, 19 nt, Homo sapiens
uaucugcccagucuucaaa

SEQ ID NO: 691712 - RNA, 19 nt, Homo sapiens
gcgggugccuugcuuucau

SEQ ID NO: 691713 - RNA, 19 nt, Homo sapiens
ucucugggauucaaauuuu

SEQ ID NO: 691714 - RNA, 19 nt, Homo sapiens
ucauuggccuuucugucuu

SEQ ID NO: 691715 - RNA, 19 nt, Homo sapiens
uguaaacucagauaaguca

SEQ ID NO: 691716 - RNA, 19 nt, Homo sapiens
agccuaaguuugacauguu

SEQ ID NO: 691717 - RNA, 19 nt, Homo sapiens
gggcaucaccacucucauc

SEQ ID NO: 691718 - RNA, 19 nt, Homo sapiens
gcccagucuucaaaggauu

SEQ ID NO: 691719 - RNA, 19 nt, Homo sapiens
uuucauacuugacaacaca

SEQ ID NO: 691720 - RNA, 19 nt, Homo sapiens
uuugacauguuguacaaga

SEQ ID NO: 691721 - RNA, 19 nt, Homo sapiens
gcauccagaucuucaaaau

SEQ ID NO: 691722 - RNA, 19 nt, Homo sapiens
cccacugucucccucauug

SEQ ID NO: 691723 - RNA, 19 nt, Homo sapiens
agacuuguaccaauguuau

SEQ ID NO: 691724 - RNA, 19 nt, Homo sapiens
caaagucugagucuuagag

SEQ ID NO: 691725 - RNA, 19 nt, Homo sapiens
cuuccagccucaagagcua

SEQ ID NO: 691726 - RNA, 19 nt, Homo sapiens
gagcguggucugauacagu

SEQ ID NO: 691727 - RNA, 19 nt, Homo sapiens
aggaagaacagcuagaaau

SEQ ID NO: 691728 - RNA, 19 nt, Homo sapiens
acucagauaagucaccuuu

SEQ ID NO: 691729 - RNA, 19 nt, Homo sapiens
ggcauguucugcacucucu

SEQ ID NO: 691730 - RNA, 19 nt, Homo sapiens
ccagugccuuugcauuucu

SEQ ID NO: 691731 - RNA, 19 nt, Homo sapiens
aguuugacauguuguacaa

SEQ ID NO: 691732 - RNA, 19 nt, Homo sapiens
ucagauugcaauuccagaa

SEQ ID NO: 691733 - RNA, 19 nt, Homo sapiens
ccucaagagcuacgauuuc

SEQ ID NO: 691734 - RNA, 19 nt, Homo sapiens
cgccaucaauacaggcauu

SEQ ID NO: 691735 - RNA, 19 nt, Homo sapiens
gcaguauggugcggcuauc

SEQ ID NO: 691736 - RNA, 19 nt, Homo sapiens
cagaagacacuccagaaaa

SEQ ID NO: 691737 - RNA, 19 nt, Homo sapiens
cauguucugcacucucuuu

SEQ ID NO: 691738 - RNA, 19 nt, Homo sapiens
gcuauguccugaccuugac

SEQ ID NO: 691739 - RNA, 19 nt, Homo sapiens
ucaccuuucucugggauuc

SEQ ID NO: 691740 - RNA, 19 nt, Homo sapiens
cuaaguuugacauguugua

SEQ ID NO: 691741 - RNA, 19 nt, Homo sapiens
aaagaucagauugcaauuc

SEQ ID NO: 691742 - RNA, 19 nt, Homo sapiens
ggucugauacaguggaaag

SEQ ID NO: 691743 - RNA, 19 nt, Homo sapiens
gguuccagccaaagccaua

SEQ ID NO: 691744 - RNA, 19 nt, Homo sapiens
ccacagagccuaaguuuga

SEQ ID NO: 691745 - RNA, 19 nt, Homo sapiens
cuaacuaacuucuguguaa

SEQ ID NO: 691746 - RNA, 19 nt, Homo sapiens
cuacaucacuucaagacua

SEQ ID NO: 691747 - RNA, 19 nt, Homo sapiens
gaagaacagcuagaaauuu

SEQ ID NO: 691748 - RNA, 19 nt, Homo sapiens
ggaagaacagcuagaaauu

SEQ ID NO: 691749 - RNA, 19 nt, Homo sapiens
ggaaugggccaaagucuga

SEQ ID NO: 691750 - RNA, 19 nt, Homo sapiens
ggccaaagucugagucuua

SEQ ID NO: 691751 - RNA, 19 nt, Homo sapiens
uaacuucuguguaaacuca

SEQ ID NO: 691752 - RNA, 19 nt, Homo sapiens
ggaaaggaagcaugguaua

SEQ ID NO: 691753 - RNA, 19 nt, Homo sapiens
aaggaagcaugguauauaa

SEQ ID NO: 691754 - RNA, 19 nt, Homo sapiens
ugaaauacauuccuaucug

SEQ ID NO: 691755 - RNA, 19 nt, Homo sapiens
gaaaggaagcaugguauau

SEQ ID NO: 691756 - RNA, 19 nt, Homo sapiens
cuucaagacuaaugcauaa

SEQ ID NO: 691757 - RNA, 19 nt, Homo sapiens
guaccaauguuaugcuaug

SEQ ID NO: 691758 - RNA, 19 nt, Homo sapiens
ggcucacgcugcccaauua

SEQ ID NO: 691759 - RNA, 19 nt, Homo sapiens
aaaggaagcaugguauaua

SEQ ID NO: 691760 - RNA, 19 nt, Homo sapiens
ucagauaagucaccuuucu

SEQ ID NO: 691761 - RNA, 19 nt, Homo sapiens
guuaugcuaugucucuaaa

SEQ ID NO: 691762 - RNA, 19 nt, Homo sapiens
agaggagcguggucugaua

SEQ ID NO: 691763 - RNA, 19 nt, Homo sapiens
caugguauauaacaggaaa

SEQ ID NO: 691764 - RNA, 19 nt, Homo sapiens
ggaagcaugguauauaaca

SEQ ID NO: 691765 - RNA, 19 nt, Homo sapiens
gagccuaaguuugacaugu

SEQ ID NO: 691766 - RNA, 19 nt, Homo sapiens
ggccugaaauguagguaug

SEQ ID NO: 691767 - RNA, 19 nt, Homo sapiens
ccagaagacacuccagaaa

SEQ ID NO: 691768 - RNA, 19 nt, Homo sapiens
uuagagacuuguaccaaug

SEQ ID NO: 691769 - RNA, 19 nt, Homo sapiens
cagaagaccuaagccugaa

SEQ ID NO: 691770 - RNA, 19 nt, Homo sapiens
uacaucacuucaagacuaa

SEQ ID NO: 691771 - RNA, 19 nt, Homo sapiens
gugccuugcuuucauacuu

SEQ ID NO: 691772 - RNA, 19 nt, Homo sapiens
gacccuacaucacuucaag

SEQ ID NO: 691773 - RNA, 19 nt, Homo sapiens
gagacuuguaccaauguua

SEQ ID NO: 691774 - RNA, 19 nt, Homo sapiens
uguccaaccugcaauuugu

SEQ ID NO: 691775 - RNA, 19 nt, Homo sapiens
gaagaccuaagccugaaau

SEQ ID NO: 691776 - RNA, 19 nt, Homo sapiens
gagcuacgauuuccccauu

SEQ ID NO: 691777 - RNA, 19 nt, Homo sapiens
caauacaggcauucuugaa

SEQ ID NO: 691778 - RNA, 19 nt, Homo sapiens
uaugcuaugucucuaaauc

SEQ ID NO: 691779 - RNA, 19 nt, Homo sapiens
gcaaggcuuuuacauugaa

SEQ ID NO: 691780 - RNA, 19 nt, Homo sapiens
ccaauguuaugcuaugucu

SEQ ID NO: 691781 - RNA, 19 nt, Homo sapiens
gccaaagucugagucuuag

SEQ ID NO: 691782 - RNA, 19 nt, Homo sapiens
caggaaaggaagcauggua

SEQ ID NO: 691783 - RNA, 19 nt, Homo sapiens
aaucuuuacucuccuaagu

SEQ ID NO: 691784 - RNA, 19 nt, Homo sapiens
gaagcaugguauauaacag

SEQ ID NO: 691785 - RNA, 19 nt, Homo sapiens
gaagacacuccagaaaaua

SEQ ID NO: 691786 - RNA, 19 nt, Homo sapiens
gggcucaugccaacaguga

SEQ ID NO: 691787 - RNA, 19 nt, Homo sapiens
auacaggcauucuugaagu

SEQ ID NO: 691788 - RNA, 19 nt, Homo sapiens
cugcaaggcuuuuacauug

SEQ ID NO: 691789 - RNA, 19 nt, Homo sapiens
gcuaugucucuaaaucuuu

SEQ ID NO: 691790 - RNA, 19 nt, Homo sapiens
uguguaaacucagauaagu

SEQ ID NO: 691791 - RNA, 19 nt, Homo sapiens
cgggugccuugcuuucaua

SEQ ID NO: 691792 - RNA, 19 nt, Homo sapiens
gcucaucggcaccaucuuc

SEQ ID NO: 691793 - RNA, 19 nt, Homo sapiens
caucuaggaagaacagcua

SEQ ID NO: 691794 - RNA, 19 nt, Homo sapiens
cuuagagacuuguaccaau

SEQ ID NO: 691795 - RNA, 19 nt, Homo sapiens
caaaagaucagauugcaau

SEQ ID NO: 691796 - RNA, 19 nt, Homo sapiens
caaaggauuuucuucaagu

SEQ ID NO: 691797 - RNA, 19 nt, Homo sapiens
gccuaaguuugacauguug

SEQ ID NO: 691798 - RNA, 19 nt, Homo sapiens
ugaauuugacccuacauca

SEQ ID NO: 691799 - RNA, 19 nt, Homo sapiens
gaaaugagggcagguucca

SEQ ID NO: 691800 - RNA, 19 nt, Homo sapiens
agaagacacuccagaaaau

SEQ ID NO: 691801 - RNA, 19 nt, Homo sapiens
agauugcaauuccagaaga

SEQ ID NO: 691802 - RNA, 19 nt, Homo sapiens
uaucugcccagucuucaaa

SEQ ID NO: 691803 - RNA, 19 nt, Homo sapiens
gcgggugccuugcuuucau

SEQ ID NO: 691804 - RNA, 19 nt, Homo sapiens
ucucugggauucaaauuuu

SEQ ID NO: 691805 - RNA, 19 nt, Homo sapiens
uuugacauguuguacaaga

SEQ ID NO: 691806 - RNA, 19 nt, Homo sapiens
uguaaacucagauaaguca

SEQ ID NO: 691807 - RNA, 19 nt, Homo sapiens
agccuaaguuugacauguu

SEQ ID NO: 691808 - RNA, 19 nt, Homo sapiens
gcccagucuucaaaggauu

SEQ ID NO: 691809 - RNA, 19 nt, Homo sapiens
uuucauacuugacaacaca

SEQ ID NO: 691810 - RNA, 19 nt, Homo sapiens
agacuuguaccaauguuau

SEQ ID NO: 691811 - RNA, 19 nt, Homo sapiens
caaagucugagucuuagag

SEQ ID NO: 691812 - RNA, 19 nt, Homo sapiens
cuuccagccucaagagcua

SEQ ID NO: 691813 - RNA, 19 nt, Homo sapiens
gagcguggucugauacagu

SEQ ID NO: 691814 - RNA, 19 nt, Homo sapiens
aaauguagguaugcugcaa

SEQ ID NO: 691815 - RNA, 19 nt, Homo sapiens
aggaagaacagcuagaaau

SEQ ID NO: 691816 - RNA, 19 nt, Homo sapiens
acucagauaagucaccuuu

SEQ ID NO: 691817 - RNA, 19 nt, Homo sapiens
ggcauguucugcacucucu

SEQ ID NO: 691818 - RNA, 19 nt, Homo sapiens
aguuugacauguuguacaa

SEQ ID NO: 691819 - RNA, 19 nt, Homo sapiens
ucagauugcaauuccagaa

SEQ ID NO: 691820 - RNA, 19 nt, Homo sapiens
ccucaagagcuacgauuuc

SEQ ID NO: 691821 - RNA, 19 nt, Homo sapiens
cgccaucaauacaggcauu

SEQ ID NO: 691822 - RNA, 19 nt, Homo sapiens
gaauuugacccuacaucac

SEQ ID NO: 691823 - RNA, 19 nt, Homo sapiens
cauguucugcacucucuuu

SEQ ID NO: 691824 - RNA, 19 nt, Homo sapiens
ggccggacacagcaugaaa

SEQ ID NO: 691825 - RNA, 19 nt, Homo sapiens
cagaagacacuccagaaaa

SEQ ID NO: 691826 - RNA, 19 nt, Homo sapiens
cuaaguuugacauguugua

SEQ ID NO: 691827 - RNA, 19 nt, Homo sapiens
ucaccuuucucugggauuc

SEQ ID NO: 691828 - RNA, 19 nt, Homo sapiens
aaagaucagauugcaauuc

SEQ ID NO: 691829 - RNA, 19 nt, Homo sapiens
ggucugauacaguggaaag

SEQ ID NO: 691830 - RNA, 19 nt, Homo sapiens
uaggaagaacagcuagaaa

SEQ ID NO: 691831 - RNA, 19 nt, Homo sapiens
ugcuaugucucuaaaucuu

SEQ ID NO: 691832 - RNA, 19 nt, Homo sapiens
gcucaugccaacagugaca

SEQ ID NO: 691833 - RNA, 19 nt, Homo sapiens
gcugaccacggagauguuu

SEQ ID NO: 691834 - RNA, 19 nt, Homo sapiens
uacaggcauucuugaagug

SEQ ID NO: 691835 - RNA, 19 nt, Homo sapiens
caucaauacaggcauucuu

SEQ ID NO: 691836 - RNA, 19 nt, Homo sapiens
ugcaauuuguggacaugaa

SEQ ID NO: 691837 - RNA, 19 nt, Homo sapiens
aaagaaaugagggcagguu

SEQ ID NO: 691838 - RNA, 19 nt, Homo sapiens
gggccaaagucugagucuu

SEQ ID NO: 691839 - RNA, 19 nt, Homo sapiens
ggaaccagaagaccuaagc

SEQ ID NO: 691840 - RNA, 19 nt, Homo sapiens
gaaaauacagaaacugcau

SEQ ID NO: 691841 - RNA, 19 nt, Homo sapiens
aagaucagauugcaauucc

SEQ ID NO: 691842 - RNA, 19 nt, Homo sapiens
ugccuugcuuucauacuug

SEQ ID NO: 691843 - RNA, 19 nt, Homo sapiens
gcuguccaaccugcaauuu

SEQ ID NO: 691844 - RNA, 19 nt, Homo sapiens
gaagaaacaucuagaaguu

SEQ ID NO: 691845 - RNA, 19 nt, Homo sapiens
guaaggcgcuacuauauaa

SEQ ID NO: 691846 - RNA, 19 nt, Homo sapiens
ccaccaggcuucaggagua

SEQ ID NO: 691847 - RNA, 19 nt, Homo sapiens
gaaaugcucgggugucuug

SEQ ID NO: 691848 - RNA, 19 nt, Homo sapiens
gcagguaaauuucacucaa

SEQ ID NO: 691849 - RNA, 19 nt, Homo sapiens
gaacagaggcuuucuucca

SEQ ID NO: 691850 - RNA, 19 nt, Homo sapiens
ccagauggcuacaaugugu

SEQ ID NO: 691851 - RNA, 19 nt, Homo sapiens
ucucaguucugcuugaaua

SEQ ID NO: 691852 - RNA, 19 nt, Homo sapiens
ggaagaaacaucuagaagu

SEQ ID NO: 691853 - RNA, 19 nt, Homo sapiens
gaugcuguccugagaauaa

SEQ ID NO: 691854 - RNA, 19 nt, Homo sapiens
gaugcaaucccgauaagaa

SEQ ID NO: 691855 - RNA, 19 nt, Homo sapiens
gaggagauccgcccagaug

SEQ ID NO: 691856 - RNA, 19 nt, Homo sapiens
ggaggaagacugugcuuuc

SEQ ID NO: 691857 - RNA, 19 nt, Homo sapiens
gaaguuguacauauucaga

SEQ ID NO: 691858 - RNA, 19 nt, Homo sapiens
ugggacaacuugagaauuc

SEQ ID NO: 691859 - RNA, 19 nt, Homo sapiens
agaaacaucuagaaguugu

SEQ ID NO: 691860 - RNA, 19 nt, Homo sapiens
cacguucuguuuagcuuua

SEQ ID NO: 691861 - RNA, 19 nt, Homo sapiens
gggacgugcuucuacaaga

SEQ ID NO: 691862 - RNA, 19 nt, Homo sapiens
aaucugacauguucucuuc

SEQ ID NO: 691863 - RNA, 19 nt, Homo sapiens
guacaagaacagaggcuuu

SEQ ID NO: 691864 - RNA, 19 nt, Homo sapiens
cuguuuagcuuuaggaaga

SEQ ID NO: 691865 - RNA, 19 nt, Homo sapiens
cguaaggcgcuacuauaua

SEQ ID NO: 691866 - RNA, 19 nt, Homo sapiens
cauggaugcuguccugaga

SEQ ID NO: 691867 - RNA, 19 nt, Homo sapiens
caggugauccacucuguaa

SEQ ID NO: 691868 - RNA, 19 nt, Homo sapiens
gggaauugaucuauaucuc

SEQ ID NO: 691869 - RNA, 19 nt, Homo sapiens
cagaagacaggcaguaguu

SEQ ID NO: 691870 - RNA, 19 nt, Homo sapiens
cuuggaaucugacauguuc

SEQ ID NO: 691871 - RNA, 19 nt, Homo sapiens
ugugggaauugaucuauau

SEQ ID NO: 691872 - RNA, 19 nt, Homo sapiens
gcaaucccgauaagaaaug

SEQ ID NO: 691873 - RNA, 19 nt, Homo sapiens
ggaagaccuagaacccuuu

SEQ ID NO: 691874 - RNA, 19 nt, Homo sapiens
guauguaagugagguuugu

SEQ ID NO: 691875 - RNA, 19 nt, Homo sapiens
ugaucuauaucucuacuuc

SEQ ID NO: 691876 - RNA, 19 nt, Homo sapiens
ggaauugaucuauaucucu

SEQ ID NO: 691877 - RNA, 19 nt, Homo sapiens
ccagagcgcgcacaguuug

SEQ ID NO: 691878 - RNA, 19 nt, Homo sapiens
aaacagcagguaaauuuca

SEQ ID NO: 691879 - RNA, 19 nt, Homo sapiens
gaaacaucuagaaguugua

SEQ ID NO: 691880 - RNA, 19 nt, Homo sapiens
cgugaggagucccagcuuu

SEQ ID NO: 691881 - RNA, 19 nt, Homo sapiens
ggcggaggcuugaugcaau

SEQ ID NO: 691882 - RNA, 19 nt, Homo sapiens
acaguuugcuggagaucaa

SEQ ID NO: 691883 - RNA, 19 nt, Homo sapiens
gaagacaggcaguaguuuu

SEQ ID NO: 691884 - RNA, 19 nt, Homo sapiens
ggccaguucugucauggau

SEQ ID NO: 691885 - RNA, 19 nt, Homo sapiens
ccacuuggaaucugacaug

SEQ ID NO: 691886 - RNA, 19 nt, Homo sapiens
gaggaagacugugcuuucg

SEQ ID NO: 691887 - RNA, 19 nt, Homo sapiens
caaccugcacuucuuguuc

SEQ ID NO: 691888 - RNA, 19 nt, Homo sapiens
gccaguuucuagccaauag

SEQ ID NO: 691889 - RNA, 19 nt, Homo sapiens
ugaguccacguucuguuua

SEQ ID NO: 691890 - RNA, 19 nt, Homo sapiens
gcccagauggcuacaaugu

SEQ ID NO: 691891 - RNA, 19 nt, Homo sapiens
cuacuuccagggaccauuu

SEQ ID NO: 691892 - RNA, 19 nt, Homo sapiens
gcggaggcuugaugcaauc

SEQ ID NO: 691893 - RNA, 19 nt, Homo sapiens
cgagguugcuggacaagcu

SEQ ID NO: 691894 - RNA, 19 nt, Homo sapiens
caucuagaaguuguacaua

SEQ ID NO: 691895 - RNA, 19 nt, Homo sapiens
agcggcagcuguacaagaa

SEQ ID NO: 691896 - RNA, 19 nt, Homo sapiens
ccguaaggcgcuacuauau

SEQ ID NO: 691897 - RNA, 19 nt, Homo sapiens
ggcaguaguuuuaauuuca

SEQ ID NO: 691898 - RNA, 19 nt, Homo sapiens
gucccagcuuugagaagua

SEQ ID NO: 691899 - RNA, 19 nt, Homo sapiens
uaagugagguuuguuuugu

SEQ ID NO: 691900 - RNA, 19 nt, Homo sapiens
aaccugcacuucuuguuca

SEQ ID NO: 691901 - RNA, 19 nt, Homo sapiens
ugucugaucauaacauugu

SEQ ID NO: 691902 - RNA, 19 nt, Homo sapiens
gaguccacguucuguuuag

SEQ ID NO: 691903 - RNA, 19 nt, Homo sapiens
gaucuagggccacgaccau

SEQ ID NO: 691904 - RNA, 19 nt, Homo sapiens
ugaggccaguucugucaug

SEQ ID NO: 691905 - RNA, 19 nt, Homo sapiens
cagguaaauuucacucaac

SEQ ID NO: 691906 - RNA, 19 nt, Homo sapiens
gccagagcgcgcacaguuu

SEQ ID NO: 691907 - RNA, 19 nt, Homo sapiens
uggaugcuguccugagaau

SEQ ID NO: 691908 - RNA, 19 nt, Homo sapiens
cccguaaggcgcuacuaua

SEQ ID NO: 691909 - RNA, 19 nt, Homo sapiens
ccgcccagauggcuacaau

SEQ ID NO: 691910 - RNA, 19 nt, Homo sapiens
auucuuaugucaagcugaa

SEQ ID NO: 691911 - RNA, 19 nt, Homo sapiens
uaggaagaaacaucuagaa

SEQ ID NO: 691912 - RNA, 19 nt, Homo sapiens
gugaggagucccagcuuug

SEQ ID NO: 691913 - RNA, 19 nt, Homo sapiens
guacucggaggaagacugu

SEQ ID NO: 691914 - RNA, 19 nt, Homo sapiens
acaagcugcugcacugucu

SEQ ID NO: 691915 - RNA, 19 nt, Homo sapiens
ccucgagguugcuggacaa

SEQ ID NO: 691916 - RNA, 19 nt, Homo sapiens
gaaucugacauguucucuu

SEQ ID NO: 691917 - RNA, 19 nt, Homo sapiens
ccaacaugauauuuaugag

SEQ ID NO: 691918 - RNA, 19 nt, Homo sapiens
gaagaccuagaacccuuuc

SEQ ID NO: 691919 - RNA, 19 nt, Homo sapiens
cggcagcuguacaagaaca

SEQ ID NO: 691920 - RNA, 19 nt, Homo sapiens
gggcggaggcuugaugcaa

SEQ ID NO: 691921 - RNA, 19 nt, Homo sapiens
cuagaaguuguacauauuc

SEQ ID NO: 691922 - RNA, 19 nt, Homo sapiens
gagaaguaacugagaccau

SEQ ID NO: 691923 - RNA, 19 nt, Homo sapiens
ggagucccagcuuugagaa

SEQ ID NO: 691924 - RNA, 19 nt, Homo sapiens
gcccguaaggcgcuacuau

SEQ ID NO: 691925 - RNA, 19 nt, Homo sapiens
aagaaaugcucgggugucu

SEQ ID NO: 691926 - RNA, 19 nt, Homo sapiens
uacaagaacaguccugagu

SEQ ID NO: 691927 - RNA, 19 nt, Homo sapiens
ucccagcuuugagaaguaa

SEQ ID NO: 691928 - RNA, 19 nt, Homo sapiens
ugaggagucccagcuuuga

SEQ ID NO: 691929 - RNA, 19 nt, Homo sapiens
cccaggagcagccagaaga

SEQ ID NO: 691930 - RNA, 19 nt, Homo sapiens
ucaagcugaaauucucuaa

SEQ ID NO: 691931 - RNA, 19 nt, Homo sapiens
cuugucugaucauaacauu

SEQ ID NO: 691932 - RNA, 19 nt, Homo sapiens
cugaguccacguucuguuu

SEQ ID NO: 691933 - RNA, 19 nt, Homo sapiens
ggugauccacucuguaaaa

SEQ ID NO: 691934 - RNA, 19 nt, Homo sapiens
ugucucaguucugcuugaa

SEQ ID NO: 691935 - RNA, 19 nt, Homo sapiens
ggacaagcugcugcacugu

SEQ ID NO: 691936 - RNA, 19 nt, Homo sapiens
gagcuggucuucuauuuaa

SEQ ID NO: 691937 - RNA, 19 nt, Homo sapiens
ggaggagacugagugauua

SEQ ID NO: 691938 - RNA, 19 nt, Homo sapiens
gaacaccacuagauacuuc

SEQ ID NO: 691939 - RNA, 19 nt, Homo sapiens
ggacaacgguuuagcuaug

SEQ ID NO: 691940 - RNA, 19 nt, Homo sapiens
uuaagacacugaucacuaa

SEQ ID NO: 691941 - RNA, 19 nt, Homo sapiens
gagagcuggucuucuauuu

SEQ ID NO: 691942 - RNA, 19 nt, Homo sapiens
ggaaacagccaguguggaa

SEQ ID NO: 691943 - RNA, 19 nt, Homo sapiens
ucaaacaucagucaacaua

SEQ ID NO: 691944 - RNA, 19 nt, Homo sapiens
gaggagagcaaauaucauu

SEQ ID NO: 691945 - RNA, 19 nt, Homo sapiens
cgaaugaacuauaccaaca

SEQ ID NO: 691946 - RNA, 19 nt, Homo sapiens
gaacuauaccaacaaauuc

SEQ ID NO: 691947 - RNA, 19 nt, Homo sapiens
ugugagagcuggucuucua

SEQ ID NO: 691948 - RNA, 19 nt, Homo sapiens
gaucaaacaucagucaaca

SEQ ID NO: 691949 - RNA, 19 nt, Homo sapiens
ugaaggaaguccaaggaaa

SEQ ID NO: 691950 - RNA, 19 nt, Homo sapiens
gcacugggaacaugaacua

SEQ ID NO: 691951 - RNA, 19 nt, Homo sapiens
gcaaaauccuucaccaauu

SEQ ID NO: 691952 - RNA, 19 nt, Homo sapiens
ccacagggacaacgguuua

SEQ ID NO: 691953 - RNA, 19 nt, Homo sapiens
gcagaagaauugcuugaac

SEQ ID NO: 691954 - RNA, 19 nt, Homo sapiens
gggacaagcuaauggugaa

SEQ ID NO: 691955 - RNA, 19 nt, Homo sapiens
ggucaggauugaaagagaa

SEQ ID NO: 691956 - RNA, 19 nt, Homo sapiens
gggcacaccugacaguugu

SEQ ID NO: 691957 - RNA, 19 nt, Homo sapiens
uugcaggacucaccacaua

SEQ ID NO: 691958 - RNA, 19 nt, Homo sapiens
aaagagaguugguaugucu

SEQ ID NO: 691959 - RNA, 19 nt, Homo sapiens
uaagauggguuggaggauu

SEQ ID NO: 691960 - RNA, 19 nt, Homo sapiens
ggacaggaguuugcaccuu

SEQ ID NO: 691961 - RNA, 19 nt, Homo sapiens
ggacugagcuuuggggaaa

SEQ ID NO: 691962 - RNA, 19 nt, Homo sapiens
gauacuuccugaucaaaca

SEQ ID NO: 691963 - RNA, 19 nt, Homo sapiens
aguaugaguuucacaugua

SEQ ID NO: 691964 - RNA, 19 nt, Homo sapiens
gaguugguaugucucauga

SEQ ID NO: 691965 - RNA, 19 nt, Homo sapiens
cgguuuagcuaugaaauuu

SEQ ID NO: 691966 - RNA, 19 nt, Homo sapiens
ggagagcaaauaucauuau

SEQ ID NO: 691967 - RNA, 19 nt, Homo sapiens
ccaagaaccgaaugaacua

SEQ ID NO: 691968 - RNA, 19 nt, Homo sapiens
gaaggaaguccaaggaaag

SEQ ID NO: 691969 - RNA, 19 nt, Homo sapiens
gacaacgguuuagcuauga

SEQ ID NO: 691970 - RNA, 19 nt, Homo sapiens
gagcccagaucgcgccauu

SEQ ID NO: 691971 - RNA, 19 nt, Homo sapiens
gagcaaaacucuguccaaa

SEQ ID NO: 691972 - RNA, 19 nt, Homo sapiens
caagguggguggaucaucu

SEQ ID NO: 691973 - RNA, 19 nt, Homo sapiens
cuaaaugaauggaugaucu

SEQ ID NO: 691974 - RNA, 19 nt, Homo sapiens
agacacugaucacuaaaug

SEQ ID NO: 691975 - RNA, 19 nt, Homo sapiens
gugcuggguucuaccuuaa

SEQ ID NO: 691976 - RNA, 19 nt, Homo sapiens
ccaaggaaagcucuagaaa

SEQ ID NO: 691977 - RNA, 19 nt, Homo sapiens
ccuguaaucccaacacuuu

SEQ ID NO: 691978 - RNA, 19 nt, Homo sapiens
aaacaucagucaacauacu

SEQ ID NO: 691979 - RNA, 19 nt, Homo sapiens
caugucaucuacagcauau

SEQ ID NO: 691980 - RNA, 19 nt, Homo sapiens
gaaggaggagacugaguga

SEQ ID NO: 691981 - RNA, 19 nt, Homo sapiens
gaucugggacugagcuuug

SEQ ID NO: 691982 - RNA, 19 nt, Homo sapiens
gcaaguuuaugcaccucuu

SEQ ID NO: 691983 - RNA, 19 nt, Homo sapiens
gaaguaugaguuucacaug

SEQ ID NO: 691984 - RNA, 19 nt, Homo sapiens
gcugaagagagcaaauaua

SEQ ID NO: 691985 - RNA, 19 nt, Homo sapiens
ugacaucucuuugguggau

SEQ ID NO: 691986 - RNA, 19 nt, Homo sapiens
gaaaccccaucucuacuaa

SEQ ID NO: 691987 - RNA, 19 nt, Homo sapiens
agacuccacucaaaauuua

SEQ ID NO: 691988 - RNA, 19 nt, Homo sapiens
guugguaugucucaugaau

SEQ ID NO: 691989 - RNA, 19 nt, Homo sapiens
ggagacuacuucauuuacu

SEQ ID NO: 691990 - RNA, 19 nt, Homo sapiens
cuagauacuuccugaucaa

SEQ ID NO: 691991 - RNA, 19 nt, Homo sapiens
guaugaguuucacauguau

SEQ ID NO: 691992 - RNA, 19 nt, Homo sapiens
acacugaucacuaaaugaa

SEQ ID NO: 691993 - RNA, 19 nt, Homo sapiens
cugaagagagcaaauauau

SEQ ID NO: 691994 - RNA, 19 nt, Homo sapiens
ugagaguacuaacuggaaa

SEQ ID NO: 691995 - RNA, 19 nt, Homo sapiens
uauaggaggagagcaaaua

SEQ ID NO: 691996 - RNA, 19 nt, Homo sapiens
ugagugcagugaaaucaga

SEQ ID NO: 691997 - RNA, 19 nt, Homo sapiens
aagacagacuccacucaaa

SEQ ID NO: 691998 - RNA, 19 nt, Homo sapiens
gaaaagagaguugguaugu

SEQ ID NO: 691999 - RNA, 19 nt, Homo sapiens
gagacuacuucauuuacuc

SEQ ID NO: 692000 - RNA, 19 nt, Homo sapiens
gcucugcacugggaacaug

SEQ ID NO: 692001 - RNA, 19 nt, Homo sapiens
ucaacaccuuccugcuaua

SEQ ID NO: 692002 - RNA, 19 nt, Homo sapiens
gaaugaacuauaccaacaa

SEQ ID NO: 692003 - RNA, 19 nt, Homo sapiens
cagaagaauugcuugaacu

SEQ ID NO: 692004 - RNA, 19 nt, Homo sapiens
ggccgaggcagaagaauug

SEQ ID NO: 692005 - RNA, 19 nt, Homo sapiens
ggaaguaugaguuucacau

SEQ ID NO: 692006 - RNA, 19 nt, Homo sapiens
ggcgaguuucuaaauauua

SEQ ID NO: 692007 - RNA, 19 nt, Homo sapiens
gccaccgaguuccuaauuu

SEQ ID NO: 692008 - RNA, 19 nt, Homo sapiens
uaaagaauaacuccaaguc

SEQ ID NO: 692009 - RNA, 19 nt, Homo sapiens
gaggagacugagugauuaa

SEQ ID NO: 692010 - RNA, 19 nt, Homo sapiens
caagacagacuccacucaa

SEQ ID NO: 692011 - RNA, 19 nt, Homo sapiens
ugguaugucucaugaaugu

SEQ ID NO: 692012 - RNA, 19 nt, Homo sapiens
ccaccgaguuccuaauuuu

SEQ ID NO: 692013 - RNA, 19 nt, Homo sapiens
cuucacaucagcaaguuua

SEQ ID NO: 692014 - RNA, 19 nt, Homo sapiens
ugugcuggguucuaccuua

SEQ ID NO: 692015 - RNA, 19 nt, Homo sapiens
gaguuucacauguauauca

SEQ ID NO: 692016 - RNA, 19 nt, Homo sapiens
aagauggguuggaggauug

SEQ ID NO: 692017 - RNA, 19 nt, Homo sapiens
ucgggagacuacuucauuu

SEQ ID NO: 692018 - RNA, 19 nt, Homo sapiens
gaaacagccaguguggaaa

SEQ ID NO: 692019 - RNA, 19 nt, Homo sapiens
caagcaggccgaccaaaca

SEQ ID NO: 692020 - RNA, 19 nt, Homo sapiens
uaaggaaguaugaguuuca

SEQ ID NO: 692021 - RNA, 19 nt, Homo sapiens
caaacaagccagacuccau

SEQ ID NO: 692022 - RNA, 19 nt, Homo sapiens
caaguuuaugcaccucuua

SEQ ID NO: 692023 - RNA, 19 nt, Homo sapiens
gucaacauacucuaaagaa

SEQ ID NO: 692024 - RNA, 19 nt, Homo sapiens
uauaugaacaccacuagau

SEQ ID NO: 692025 - RNA, 19 nt, Homo sapiens
caggauugaaagagaaaua

SEQ ID NO: 692026 - RNA, 19 nt, Homo sapiens
ucagugacaucucuuuggu

SEQ ID NO: 692027 - RNA, 19 nt, Homo sapiens
cgggagacuacuucauuua

SEQ ID NO: 692028 - RNA, 19 nt, Homo sapiens
ggaaagcucuagaaaacag

SEQ ID NO: 692029 - RNA, 19 nt, Homo sapiens
uggcgaguuucuaaauauu

SEQ ID NO: 692030 - RNA, 19 nt, Homo sapiens
acaucucuuugguggauua

SEQ ID NO: 692031 - RNA, 19 nt, Homo sapiens
caacaaauuccugcugauc

SEQ ID NO: 692032 - RNA, 19 nt, Homo sapiens
ggaguugguuuucauguca

SEQ ID NO: 692033 - RNA, 19 nt, Homo sapiens
acaccuuccugcuauacaa

SEQ ID NO: 692034 - RNA, 19 nt, Homo sapiens
gggucaggauugaaagaga

SEQ ID NO: 692035 - RNA, 19 nt, Homo sapiens
acugaucacuaaaugaaug

SEQ ID NO: 692036 - RNA, 19 nt, Homo sapiens
gagcuaagaugacuaauuu

SEQ ID NO: 692037 - RNA, 19 nt, Homo sapiens
ggagagagaucuuaaacga

SEQ ID NO: 692038 - RNA, 19 nt, Homo sapiens
ggacaaagcuaagggaaga

SEQ ID NO: 692039 - RNA, 19 nt, Homo sapiens
gagaagaauuuccgaguga

SEQ ID NO: 692040 - RNA, 19 nt, Homo sapiens
ggagauggaugaucaagau

SEQ ID NO: 692041 - RNA, 19 nt, Homo sapiens
gaaacuaccgcucaaauug

SEQ ID NO: 692042 - RNA, 19 nt, Homo sapiens
ggagagcgaugcuuggauu

SEQ ID NO: 692043 - RNA, 19 nt, Homo sapiens
gguauaagcuccgagauga

SEQ ID NO: 692044 - RNA, 19 nt, Homo sapiens
gagaagagaaggacaauau

SEQ ID NO: 692045 - RNA, 19 nt, Homo sapiens
gaacccaaauuuaugucua

SEQ ID NO: 692046 - RNA, 19 nt, Homo sapiens
gagaugacuuugagaagaa

SEQ ID NO: 692047 - RNA, 19 nt, Homo sapiens
gacauuacaugaacgcuuu

SEQ ID NO: 692048 - RNA, 19 nt, Homo sapiens
gaugaugaacccaaauuua

SEQ ID NO: 692049 - RNA, 19 nt, Homo sapiens
gaaaggaaucugaguuuga

SEQ ID NO: 692050 - RNA, 19 nt, Homo sapiens
caacauauagugaccauug

SEQ ID NO: 692051 - RNA, 19 nt, Homo sapiens
gcauugggcuuuagcuguu

SEQ ID NO: 692052 - RNA, 19 nt, Homo sapiens
gaucaaagaaacagaagaa

SEQ ID NO: 692053 - RNA, 19 nt, Homo sapiens
gaagaaaggaaucugaguu

SEQ ID NO: 692054 - RNA, 19 nt, Homo sapiens
agucauaggugcaaacaaa

SEQ ID NO: 692055 - RNA, 19 nt, Homo sapiens
aaagggagcuucucugaca

SEQ ID NO: 692056 - RNA, 19 nt, Homo sapiens
ggaaacuaccgcucaaauu

SEQ ID NO: 692057 - RNA, 19 nt, Homo sapiens
cgaggaaccuuucaguuuc

SEQ ID NO: 692058 - RNA, 19 nt, Homo sapiens
auacaaagaugauccuguu

SEQ ID NO: 692059 - RNA, 19 nt, Homo sapiens
ggagcagccuauacaaaga

SEQ ID NO: 692060 - RNA, 19 nt, Homo sapiens
gaaagaaaccacccaagag

SEQ ID NO: 692061 - RNA, 19 nt, Homo sapiens
caacuacucugggaacaau

SEQ ID NO: 692062 - RNA, 19 nt, Homo sapiens
aaucugaguuugaugauga

SEQ ID NO: 692063 - RNA, 19 nt, Homo sapiens
gggaaacuuugauucuuga

SEQ ID NO: 692064 - RNA, 19 nt, Homo sapiens
gcuaagaugacuaauuuga

SEQ ID NO: 692065 - RNA, 19 nt, Homo sapiens
gagaggcgcugggaagaug

SEQ ID NO: 692066 - RNA, 19 nt, Homo sapiens
ccgagugacugcuuauaaa

SEQ ID NO: 692067 - RNA, 19 nt, Homo sapiens
agaagaagauggcugacuu

SEQ ID NO: 692068 - RNA, 19 nt, Homo sapiens
cgagguaaaucgagagaau

SEQ ID NO: 692069 - RNA, 19 nt, Homo sapiens
cgagaugacuuugagaaga

SEQ ID NO: 692070 - RNA, 19 nt, Homo sapiens
acauauggcucaucucaga

SEQ ID NO: 692071 - RNA, 19 nt, Homo sapiens
gaaaagugauccucucuuc

SEQ ID NO: 692072 - RNA, 19 nt, Homo sapiens
caaagaugauccuguugau

SEQ ID NO: 692073 - RNA, 19 nt, Homo sapiens
gauaaggaacagaaacaaa

SEQ ID NO: 692074 - RNA, 19 nt, Homo sapiens
acaaagagguaucuagaag

SEQ ID NO: 692075 - RNA, 19 nt, Homo sapiens
caaagaaacagaagaagca

SEQ ID NO: 692076 - RNA, 19 nt, Homo sapiens
cauaaaggaucaaagaaac

SEQ ID NO: 692077 - RNA, 19 nt, Homo sapiens
gaagagaaggacaauauac

SEQ ID NO: 692078 - RNA, 19 nt, Homo sapiens
ggacagagaaccgagaaga

SEQ ID NO: 692079 - RNA, 19 nt, Homo sapiens
ggagcuaagaugacuaauu

SEQ ID NO: 692080 - RNA, 19 nt, Homo sapiens
gaggagaagucaggcaaau

SEQ ID NO: 692081 - RNA, 19 nt, Homo sapiens
uagaagagcagaagacaga

SEQ ID NO: 692082 - RNA, 19 nt, Homo sapiens
ucacgggccucagcaguuu

SEQ ID NO: 692083 - RNA, 19 nt, Homo sapiens
gcucauaacagagaaagaa

SEQ ID NO: 692084 - RNA, 19 nt, Homo sapiens
gcagaagaguacacugaag

SEQ ID NO: 692085 - RNA, 19 nt, Homo sapiens
gaucuccgccuugauauug

SEQ ID NO: 692086 - RNA, 19 nt, Homo sapiens
guugaucuccgccuugaua

SEQ ID NO: 692087 - RNA, 19 nt, Homo sapiens
caaaugggagggccuggua

SEQ ID NO: 692088 - RNA, 19 nt, Homo sapiens
agaauuaccggcaagcaua

SEQ ID NO: 692089 - RNA, 19 nt, Homo sapiens
gagauacacaggagaauag

SEQ ID NO: 692090 - RNA, 19 nt, Homo sapiens
gaaaccacccaagaguaua

SEQ ID NO: 692091 - RNA, 19 nt, Homo sapiens
cucaagaucugcaucaaga

SEQ ID NO: 692092 - RNA, 19 nt, Homo sapiens
ucgaggaaccuuucaguuu

SEQ ID NO: 692093 - RNA, 19 nt, Homo sapiens
gaucuuaaacgagguaaau

SEQ ID NO: 692094 - RNA, 19 nt, Homo sapiens
gaccauuguucaccauguu

SEQ ID NO: 692095 - RNA, 19 nt, Homo sapiens
gaaaagauaaggaacagaa

SEQ ID NO: 692096 - RNA, 19 nt, Homo sapiens
gaggagcagccuauacaaa

SEQ ID NO: 692097 - RNA, 19 nt, Homo sapiens
ggaggagagugcugcuuca

SEQ ID NO: 692098 - RNA, 19 nt, Homo sapiens
cuacaaagcagaagaguac

SEQ ID NO: 692099 - RNA, 19 nt, Homo sapiens
gccgagaucuaguccauag

SEQ ID NO: 692100 - RNA, 19 nt, Homo sapiens
ggagaagucaggcaaaugg

SEQ ID NO: 692101 - RNA, 19 nt, Homo sapiens
aaaggaaucugaguuugau

SEQ ID NO: 692102 - RNA, 19 nt, Homo sapiens
aaaccuaguccuccacuuu

SEQ ID NO: 692103 - RNA, 19 nt, Homo sapiens
cauauucuccagcucauaa

SEQ ID NO: 692104 - RNA, 19 nt, Homo sapiens
caagauaaggacaaagcua

SEQ ID NO: 692105 - RNA, 19 nt, Homo sapiens
aaagagguaucuagaagag

SEQ ID NO: 692106 - RNA, 19 nt, Homo sapiens
uacaugaacgcuuuacuaa

SEQ ID NO: 692107 - RNA, 19 nt, Homo sapiens
uuacaugaacgcuuuacua

SEQ ID NO: 692108 - RNA, 19 nt, Homo sapiens
gcucaggaacgcaagcuuu

SEQ ID NO: 692109 - RNA, 19 nt, Homo sapiens
gaugaacccaaauuuaugu

SEQ ID NO: 692110 - RNA, 19 nt, Homo sapiens
ccacauauggcucaucuca

SEQ ID NO: 692111 - RNA, 19 nt, Homo sapiens
agaaagaaaccacccaaga

SEQ ID NO: 692112 - RNA, 19 nt, Homo sapiens
ugggaaacuuugauucuug

SEQ ID NO: 692113 - RNA, 19 nt, Homo sapiens
aguguaugcugacuuguaa

SEQ ID NO: 692114 - RNA, 19 nt, Homo sapiens
gagcagaauacaacgcauu

SEQ ID NO: 692115 - RNA, 19 nt, Homo sapiens
ccaaaagcaagaaguauua

SEQ ID NO: 692116 - RNA, 19 nt, Homo sapiens
caagaaaagcccagagaua

SEQ ID NO: 692117 - RNA, 19 nt, Homo sapiens
gggagggccugguauaugc

SEQ ID NO: 692118 - RNA, 19 nt, Homo sapiens
gauggaugaucaagauaag

SEQ ID NO: 692119 - RNA, 19 nt, Homo sapiens
gcgaagcccagcucucaaa

SEQ ID NO: 692120 - RNA, 19 nt, Homo sapiens
ccaagaguauaucagaauc

SEQ ID NO: 692121 - RNA, 19 nt, Homo sapiens
agagaaaacucauaaagga

SEQ ID NO: 692122 - RNA, 19 nt, Homo sapiens
gagaggcacaggucaaugu

SEQ ID NO: 692123 - RNA, 19 nt, Homo sapiens
auaaagcaguccaggagaa

SEQ ID NO: 692124 - RNA, 19 nt, Homo sapiens
aagaaaggaaucugaguuu

SEQ ID NO: 692125 - RNA, 19 nt, Homo sapiens
gcaccucucaagauacaaa

SEQ ID NO: 692126 - RNA, 19 nt, Homo sapiens
uagaaggcccuauuauuuc

SEQ ID NO: 692127 - RNA, 19 nt, Homo sapiens
gaaucugaguuugaugaug

SEQ ID NO: 692128 - RNA, 19 nt, Homo sapiens
agaaaggaaucugaguuug

SEQ ID NO: 692129 - RNA, 19 nt, Homo sapiens
aggaggagauggaugauca

SEQ ID NO: 692130 - RNA, 19 nt, Homo sapiens
caaagagguaucuagaaga

SEQ ID NO: 692131 - RNA, 19 nt, Homo sapiens
gcaagucugcaaaggagaa

SEQ ID NO: 692132 - RNA, 19 nt, Homo sapiens
ucuagaaacucugauaagu

SEQ ID NO: 692133 - RNA, 19 nt, Homo sapiens
acaaggaggagauggauga

SEQ ID NO: 692134 - RNA, 19 nt, Homo sapiens
gcuccgagaugacuuugag

SEQ ID NO: 692135 - RNA, 19 nt, Homo sapiens
gaagagcagaagacagaga

SEQ ID NO: 692136 - RNA, 19 nt, Homo sapiens
gcagagaaauuacguugua

SEQ ID NO: 692137 - RNA, 19 nt, Homo sapiens
ggacugaccuccacucaaa

SEQ ID NO: 692138 - RNA, 19 nt, Homo sapiens
gaagauggcugaauacuac

SEQ ID NO: 692139 - RNA, 19 nt, Homo sapiens
guacuuagaugauugcaaa

SEQ ID NO: 692140 - RNA, 19 nt, Homo sapiens
ucacucaucucauguuaua

SEQ ID NO: 692141 - RNA, 19 nt, Homo sapiens
caacaacagcucucuaaua

SEQ ID NO: 692142 - RNA, 19 nt, Homo sapiens
gaaggagggucuacagguu

SEQ ID NO: 692143 - RNA, 19 nt, Homo sapiens
ggacucagaucaucaccaa

SEQ ID NO: 692144 - RNA, 19 nt, Homo sapiens
uuagaacccuccucuuaua

SEQ ID NO: 692145 - RNA, 19 nt, Homo sapiens
caaagaacgugaucgacaa

SEQ ID NO: 692146 - RNA, 19 nt, Homo sapiens
uacagaagauggcugaaua

SEQ ID NO: 692147 - RNA, 19 nt, Homo sapiens
ggacagcaaugaccugcaa

SEQ ID NO: 692148 - RNA, 19 nt, Homo sapiens
gaucuccucugcaauguug

SEQ ID NO: 692149 - RNA, 19 nt, Homo sapiens
gaaguucgcuggucuuucg

SEQ ID NO: 692150 - RNA, 19 nt, Homo sapiens
gacauuggcugcagacaug

SEQ ID NO: 692151 - RNA, 19 nt, Homo sapiens
cgaagaaguugcagaagga

SEQ ID NO: 692152 - RNA, 19 nt, Homo sapiens
ggagaacguugccuuaagu

SEQ ID NO: 692153 - RNA, 19 nt, Homo sapiens
cagaaucuauggacauuga

SEQ ID NO: 692154 - RNA, 19 nt, Homo sapiens
gaucaucaccaaguacuua

SEQ ID NO: 692155 - RNA, 19 nt, Homo sapiens
acaaugagcucuucacuac

SEQ ID NO: 692156 - RNA, 19 nt, Homo sapiens
uaacacaccuuaacuacag

SEQ ID NO: 692157 - RNA, 19 nt, Homo sapiens
gaacugauucgacaugaug

SEQ ID NO: 692158 - RNA, 19 nt, Homo sapiens
gcagguccgugcaaaguug

SEQ ID NO: 692159 - RNA, 19 nt, Homo sapiens
gcucaggucucccggaaug

SEQ ID NO: 692160 - RNA, 19 nt, Homo sapiens
caagauugcuggcuucgau

SEQ ID NO: 692161 - RNA, 19 nt, Homo sapiens
aaacaagcgugcauacaug

SEQ ID NO: 692162 - RNA, 19 nt, Homo sapiens
caagugaaccagaaggaua

SEQ ID NO: 692163 - RNA, 19 nt, Homo sapiens
guuuagaacccuccucuua

SEQ ID NO: 692164 - RNA, 19 nt, Homo sapiens
gcucuucacuacuguguug

SEQ ID NO: 692165 - RNA, 19 nt, Homo sapiens
ccgagaagcuggccauguu

SEQ ID NO: 692166 - RNA, 19 nt, Homo sapiens
ggaauggacucagaucauc

SEQ ID NO: 692167 - RNA, 19 nt, Homo sapiens
gguggaauucuuuaacuua

SEQ ID NO: 692168 - RNA, 19 nt, Homo sapiens
cagcagacacccaugauaa

SEQ ID NO: 692169 - RNA, 19 nt, Homo sapiens
gagcagaucacgagcuuug

SEQ ID NO: 692170 - RNA, 19 nt, Homo sapiens
uccagcaccuuucacauua

SEQ ID NO: 692171 - RNA, 19 nt, Homo sapiens
guacuuagccaaauacaca

SEQ ID NO: 692172 - RNA, 19 nt, Homo sapiens
gaacugacggccuugaaug

SEQ ID NO: 692173 - RNA, 19 nt, Homo sapiens
ucaugcagcucauuugcua

SEQ ID NO: 692174 - RNA, 19 nt, Homo sapiens
ucucaaggcuguguuugua

SEQ ID NO: 692175 - RNA, 19 nt, Homo sapiens
gcuaaccgcuacagcuuug

SEQ ID NO: 692176 - RNA, 19 nt, Homo sapiens
gaagccugauuucucauug

SEQ ID NO: 692177 - RNA, 19 nt, Homo sapiens
gacggguacuucauacuuu

SEQ ID NO: 692178 - RNA, 19 nt, Homo sapiens
gagaugaccaguacuuaga

SEQ ID NO: 692179 - RNA, 19 nt, Homo sapiens
gaagccagaugucgagaag

SEQ ID NO: 692180 - RNA, 19 nt, Homo sapiens
gcaagaagaaguccaccaa

SEQ ID NO: 692181 - RNA, 19 nt, Homo sapiens
gaccaguacuuagaugauu

SEQ ID NO: 692182 - RNA, 19 nt, Homo sapiens
gaagagcaugucccuauug

SEQ ID NO: 692183 - RNA, 19 nt, Homo sapiens
gcaccuggguuccucuuca

SEQ ID NO: 692184 - RNA, 19 nt, Homo sapiens
gcucaaaggugaagaacac

SEQ ID NO: 692185 - RNA, 19 nt, Homo sapiens
gaggaugaauugcuuaaac

SEQ ID NO: 692186 - RNA, 19 nt, Homo sapiens
guacuuaugggagcaguua

SEQ ID NO: 692187 - RNA, 19 nt, Homo sapiens
caaaguaugcccucucuuc

SEQ ID NO: 692188 - RNA, 19 nt, Homo sapiens
gaucgacacucuagagaac

SEQ ID NO: 692189 - RNA, 19 nt, Homo sapiens
ucucuugacucccuuugua

SEQ ID NO: 692190 - RNA, 19 nt, Homo sapiens
gggcuauacuccuuauguu

SEQ ID NO: 692191 - RNA, 19 nt, Homo sapiens
gugaauaauuggcgagaug

SEQ ID NO: 692192 - RNA, 19 nt, Homo sapiens
ucaacgaucuccucugcaa

SEQ ID NO: 692193 - RNA, 19 nt, Homo sapiens
gcucacaccuucaccuaca

SEQ ID NO: 692194 - RNA, 19 nt, Homo sapiens
gaugaccugugccuacuau

SEQ ID NO: 692195 - RNA, 19 nt, Homo sapiens
aacaacagcucucuaauac

SEQ ID NO: 692196 - RNA, 19 nt, Homo sapiens
acaugaaccuggcgaagaa

SEQ ID NO: 692197 - RNA, 19 nt, Homo sapiens
ucuagcaucucgcaaggua

SEQ ID NO: 692198 - RNA, 19 nt, Homo sapiens
ccaaacagaaggaggauga

SEQ ID NO: 692199 - RNA, 19 nt, Homo sapiens
cagaagagcaugucccuau

SEQ ID NO: 692200 - RNA, 19 nt, Homo sapiens
guagugaacaggacucuga

SEQ ID NO: 692201 - RNA, 19 nt, Homo sapiens
agagacauguugacccuuu

SEQ ID NO: 692202 - RNA, 19 nt, Homo sapiens
gaaagggcaggaugaacaa

SEQ ID NO: 692203 - RNA, 19 nt, Homo sapiens
gcucaccacuugaccacuu

SEQ ID NO: 692204 - RNA, 19 nt, Homo sapiens
gacaugcaguccaacaaug

SEQ ID NO: 692205 - RNA, 19 nt, Homo sapiens
guaggagaacguugccuua

SEQ ID NO: 692206 - RNA, 19 nt, Homo sapiens
gugggcagcuacacuacua

SEQ ID NO: 692207 - RNA, 19 nt, Homo sapiens
gaagagacaggcggagauu

SEQ ID NO: 692208 - RNA, 19 nt, Homo sapiens
ggacggguacuucauacuu

SEQ ID NO: 692209 - RNA, 19 nt, Homo sapiens
ucgcuggucuuucgauaaa

SEQ ID NO: 692210 - RNA, 19 nt, Homo sapiens
gcagcagacacccaugaua

SEQ ID NO: 692211 - RNA, 19 nt, Homo sapiens
caauggcacuugugguuuc

SEQ ID NO: 692212 - RNA, 19 nt, Homo sapiens
gcacaaugaaacaaaguau

SEQ ID NO: 692213 - RNA, 19 nt, Homo sapiens
uauccuugcuuaucucuau

SEQ ID NO: 692214 - RNA, 19 nt, Homo sapiens
cagcggcacugucgacaug

SEQ ID NO: 692215 - RNA, 19 nt, Homo sapiens
gacccuaguuccaguguuc

SEQ ID NO: 692216 - RNA, 19 nt, Homo sapiens
ccugggugcuugaguguuu

SEQ ID NO: 692217 - RNA, 19 nt, Homo sapiens
gaccggcuauugcaaguca

SEQ ID NO: 692218 - RNA, 19 nt, Homo sapiens
uuagugaccugcuuaugug

SEQ ID NO: 692219 - RNA, 19 nt, Homo sapiens
uguuauaucugcucaguca

SEQ ID NO: 692220 - RNA, 19 nt, Homo sapiens
ugcaccagauugugaauaa

SEQ ID NO: 692221 - RNA, 19 nt, Homo sapiens
caacuucagcagcauuauu

SEQ ID NO: 692222 - RNA, 19 nt, Homo sapiens
gagaggaugaauugcuuaa

SEQ ID NO: 692223 - RNA, 19 nt, Homo sapiens
ggagaggaugaauugcuua

SEQ ID NO: 692224 - RNA, 19 nt, Homo sapiens
cgggcugccuggcucauua

SEQ ID NO: 692225 - RNA, 19 nt, Homo sapiens
gaucccagagugccauuaa

SEQ ID NO: 692226 - RNA, 19 nt, Homo sapiens
cagcauuauugcagagaaa

SEQ ID NO: 692227 - RNA, 19 nt, Homo sapiens
uaaguaccaugacuccaau

SEQ ID NO: 692228 - RNA, 19 nt, Homo sapiens
caagguagcauggaggaaa

SEQ ID NO: 692229 - RNA, 19 nt, Homo sapiens
gugcuaacaugucugaaag

SEQ ID NO: 692230 - RNA, 19 nt, Homo sapiens
agaagagcaugucccuauu

SEQ ID NO: 692231 - RNA, 19 nt, Homo sapiens
gcucaauccuugccagucu

SEQ ID NO: 692232 - RNA, 19 nt, Homo sapiens
ugaaugaacugaguguagu

SEQ ID NO: 692233 - RNA, 19 nt, Homo sapiens
ccagggcucucagaaucua

SEQ ID NO: 692234 - RNA, 19 nt, Homo sapiens
gcuggucuuucgauaaaug

SEQ ID NO: 692235 - RNA, 19 nt, Homo sapiens
ccaagaacgucagcuucaa

SEQ ID NO: 692236 - RNA, 19 nt, Homo sapiens
ggaaauaguucuaguauag

SEQ ID NO: 692237 - RNA, 19 nt, Homo sapiens
gaucaaagguggauucuug

SEQ ID NO: 692238 - RNA, 19 nt, Homo sapiens
gaaguucacuguguuuaua

SEQ ID NO: 692239 - RNA, 19 nt, Homo sapiens
gaaguaauauggaucaaga

SEQ ID NO: 692240 - RNA, 19 nt, Homo sapiens
gcacaagucugcagauaug

SEQ ID NO: 692241 - RNA, 19 nt, Homo sapiens
ggacagaaauauaauguuc

SEQ ID NO: 692242 - RNA, 19 nt, Homo sapiens
ggaagaagcacgacucuaa

SEQ ID NO: 692243 - RNA, 19 nt, Homo sapiens
caaauaaacuaccuucguu

SEQ ID NO: 692244 - RNA, 19 nt, Homo sapiens
ggaaguaccuaauauucuu

SEQ ID NO: 692245 - RNA, 19 nt, Homo sapiens
gaauggguaucuuugauuu

SEQ ID NO: 692246 - RNA, 19 nt, Homo sapiens
ggaagaagaugaagccaau

SEQ ID NO: 692247 - RNA, 19 nt, Homo sapiens
caagaucagugcacuaauu

SEQ ID NO: 692248 - RNA, 19 nt, Homo sapiens
ggaaacaguucuauccuau

SEQ ID NO: 692249 - RNA, 19 nt, Homo sapiens
ucaaagaccuggaagaaga

SEQ ID NO: 692250 - RNA, 19 nt, Homo sapiens
acaauuaucuucucaguga

SEQ ID NO: 692251 - RNA, 19 nt, Homo sapiens
gcacacagucuuuauguaa

SEQ ID NO: 692252 - RNA, 19 nt, Homo sapiens
gaagagaauuguggauauu

SEQ ID NO: 692253 - RNA, 19 nt, Homo sapiens
gugcagcaauaucaaauua

SEQ ID NO: 692254 - RNA, 19 nt, Homo sapiens
gcaccgaaauggcaaauuc

SEQ ID NO: 692255 - RNA, 19 nt, Homo sapiens
acaagucagucuuugauua

SEQ ID NO: 692256 - RNA, 19 nt, Homo sapiens
ggacaggcauucaagaugu

SEQ ID NO: 692257 - RNA, 19 nt, Homo sapiens
gauaaucucuucaauucug

SEQ ID NO: 692258 - RNA, 19 nt, Homo sapiens
ucaaauauccgaacuaaug

SEQ ID NO: 692259 - RNA, 19 nt, Homo sapiens
agaauggacuuuccuauga

SEQ ID NO: 692260 - RNA, 19 nt, Homo sapiens
gcagacaucucagcuaaau

SEQ ID NO: 692261 - RNA, 19 nt, Homo sapiens
caagaguacuguuucugua

SEQ ID NO: 692262 - RNA, 19 nt, Homo sapiens
ugaagaagaugcuauguca

SEQ ID NO: 692263 - RNA, 19 nt, Homo sapiens
caaagcaguucacaaucua

SEQ ID NO: 692264 - RNA, 19 nt, Homo sapiens
uggaaacaauucaggauua

SEQ ID NO: 692265 - RNA, 19 nt, Homo sapiens
ugaaggagaugucugaaga

SEQ ID NO: 692266 - RNA, 19 nt, Homo sapiens
caacuugaauaguggagua

SEQ ID NO: 692267 - RNA, 19 nt, Homo sapiens
gaccacagcuucaacuuca

SEQ ID NO: 692268 - RNA, 19 nt, Homo sapiens
gaacuaaugauguagcaaa

SEQ ID NO: 692269 - RNA, 19 nt, Homo sapiens
ggaauaauguccauaccau

SEQ ID NO: 692270 - RNA, 19 nt, Homo sapiens
gcucaugucucccaauuca

SEQ ID NO: 692271 - RNA, 19 nt, Homo sapiens
gaaggaaauaguucuagua

SEQ ID NO: 692272 - RNA, 19 nt, Homo sapiens
gagcgugacuguugcaaug

SEQ ID NO: 692273 - RNA, 19 nt, Homo sapiens
gaauauggcacugcuuaua

SEQ ID NO: 692274 - RNA, 19 nt, Homo sapiens
guaccaguguggaaauuaa

SEQ ID NO: 692275 - RNA, 19 nt, Homo sapiens
uggagaagcuggacagaaa

SEQ ID NO: 692276 - RNA, 19 nt, Homo sapiens
gaauggacuuuccuaugaa

SEQ ID NO: 692277 - RNA, 19 nt, Homo sapiens
ggguaucuuugauuuguua

SEQ ID NO: 692278 - RNA, 19 nt, Homo sapiens
gcaugaagauagagaaauc

SEQ ID NO: 692279 - RNA, 19 nt, Homo sapiens
ggaaacaauucaggauuau

SEQ ID NO: 692280 - RNA, 19 nt, Homo sapiens
ggauagaguuuggcaagaa

SEQ ID NO: 692281 - RNA, 19 nt, Homo sapiens
uaaccaacaucaaccugua

SEQ ID NO: 692282 - RNA, 19 nt, Homo sapiens
gaagcacgacucuaaauau

SEQ ID NO: 692283 - RNA, 19 nt, Homo sapiens
gcagugcaccuccuaguaa

SEQ ID NO: 692284 - RNA, 19 nt, Homo sapiens
gaaccuacaguauauguug

SEQ ID NO: 692285 - RNA, 19 nt, Homo sapiens
gaacagagcacagaacaag

SEQ ID NO: 692286 - RNA, 19 nt, Homo sapiens
gaucaaagaccuggaagaa

SEQ ID NO: 692287 - RNA, 19 nt, Homo sapiens
ugacaggaauuaaguggaa

SEQ ID NO: 692288 - RNA, 19 nt, Homo sapiens
caaaucaugugguggauag

SEQ ID NO: 692289 - RNA, 19 nt, Homo sapiens
gaagaagcacgacucuaaa

SEQ ID NO: 692290 - RNA, 19 nt, Homo sapiens
gcaaggcucuuuuguuauu

SEQ ID NO: 692291 - RNA, 19 nt, Homo sapiens
gaagcuggacagaaauaua

SEQ ID NO: 692292 - RNA, 19 nt, Homo sapiens
gacaucagcucuacagaca

SEQ ID NO: 692293 - RNA, 19 nt, Homo sapiens
gcagcgagcagcacuauga

SEQ ID NO: 692294 - RNA, 19 nt, Homo sapiens
caaagagggugauggaagu

SEQ ID NO: 692295 - RNA, 19 nt, Homo sapiens
ugaaggagaugaggaauuc

SEQ ID NO: 692296 - RNA, 19 nt, Homo sapiens
gcaguaaacuuggaagaag

SEQ ID NO: 692297 - RNA, 19 nt, Homo sapiens
gaaauuaaccaacaucaac

SEQ ID NO: 692298 - RNA, 19 nt, Homo sapiens
caacaaugauggagcagau

SEQ ID NO: 692299 - RNA, 19 nt, Homo sapiens
aaauagggcucgucggaaa

SEQ ID NO: 692300 - RNA, 19 nt, Homo sapiens
ggagaaucaucuucacuuc

SEQ ID NO: 692301 - RNA, 19 nt, Homo sapiens
gaacuaacaccuggaucua

SEQ ID NO: 692302 - RNA, 19 nt, Homo sapiens
gaagauaggauagacaguu

SEQ ID NO: 692303 - RNA, 19 nt, Homo sapiens
ggacaguaaauuuguauug

SEQ ID NO: 692304 - RNA, 19 nt, Homo sapiens
gcugugaucuucauuugau

SEQ ID NO: 692305 - RNA, 19 nt, Homo sapiens
gaaaugguccagacucuuc

SEQ ID NO: 692306 - RNA, 19 nt, Homo sapiens
ggacagcucucuacuuucc

SEQ ID NO: 692307 - RNA, 19 nt, Homo sapiens
gggcgucaguucauggaua

SEQ ID NO: 692308 - RNA, 19 nt, Homo sapiens
gaagcacaauauaggugua

SEQ ID NO: 692309 - RNA, 19 nt, Homo sapiens
gaauaugguaguauggaua

SEQ ID NO: 692310 - RNA, 19 nt, Homo sapiens
gaagaugaagccaauauag

SEQ ID NO: 692311 - RNA, 19 nt, Homo sapiens
ccaaagcaguucacaaucu

SEQ ID NO: 692312 - RNA, 19 nt, Homo sapiens
gccugcaucucuucucuua

SEQ ID NO: 692313 - RNA, 19 nt, Homo sapiens
gaggaaacaugaggaacaa

SEQ ID NO: 692314 - RNA, 19 nt, Homo sapiens
gcacgacucuaaauaugca

SEQ ID NO: 692315 - RNA, 19 nt, Homo sapiens
ccgcaaggcucuuuuguua

SEQ ID NO: 692316 - RNA, 19 nt, Homo sapiens
ggagaaacauuuggagaag

SEQ ID NO: 692317 - RNA, 19 nt, Homo sapiens
gaucagugcacuaauuuau

SEQ ID NO: 692318 - RNA, 19 nt, Homo sapiens
gaagaugaacuagauauca

SEQ ID NO: 692319 - RNA, 19 nt, Homo sapiens
cgucagaguuggacuguug

SEQ ID NO: 692320 - RNA, 19 nt, Homo sapiens
gcacugcagaucuucauaa

SEQ ID NO: 692321 - RNA, 19 nt, Homo sapiens
cauaagcacugcagaucuu

SEQ ID NO: 692322 - RNA, 19 nt, Homo sapiens
agaagaugcuaugucauua

SEQ ID NO: 692323 - RNA, 19 nt, Homo sapiens
gaacaagaaccuaaaauug

SEQ ID NO: 692324 - RNA, 19 nt, Homo sapiens
gugauaaauucaaggauga

SEQ ID NO: 692325 - RNA, 19 nt, Homo sapiens
caauauagccuggaaguau

SEQ ID NO: 692326 - RNA, 19 nt, Homo sapiens
gagcacagaacaagaagaa

SEQ ID NO: 692327 - RNA, 19 nt, Homo sapiens
gaaacaugaggaacaauga

SEQ ID NO: 692328 - RNA, 19 nt, Homo sapiens
cauggaaacugcccuuaga

SEQ ID NO: 692329 - RNA, 19 nt, Homo sapiens
caccugcaauuguuguuua

SEQ ID NO: 692330 - RNA, 19 nt, Homo sapiens
aaugaagccuuguuaaaug

SEQ ID NO: 692331 - RNA, 19 nt, Homo sapiens
gauaacaugucaggaggaa

SEQ ID NO: 692332 - RNA, 19 nt, Homo sapiens
uauccgaacuaaugaugua

SEQ ID NO: 692333 - RNA, 19 nt, Homo sapiens
uggcaagaaugcaauauga

SEQ ID NO: 692334 - RNA, 19 nt, Homo sapiens
cagugaaggucauuuguga

SEQ ID NO: 692335 - RNA, 19 nt, Homo sapiens
ucaaagacauguguagaau

SEQ ID NO: 692336 - RNA, 19 nt, Homo sapiens
ggaaaucugucacaucgua

SEQ ID NO: 692337 - RNA, 19 nt, Homo sapiens
caucaacacuuucauggua

SEQ ID NO: 692338 - RNA, 19 nt, Homo sapiens
gaacucuccuuauaauaga

SEQ ID NO: 692339 - RNA, 19 nt, Homo sapiens
gaccagaucucccuucuca

SEQ ID NO: 692340 - RNA, 19 nt, Homo sapiens
uuaaugcgcugacuuguga

SEQ ID NO: 692341 - RNA, 19 nt, Homo sapiens
gcaaacaccugugcaacug

SEQ ID NO: 692342 - RNA, 19 nt, Homo sapiens
ucgcagacaucaacacuuu

SEQ ID NO: 692343 - RNA, 19 nt, Homo sapiens
ggaacucuccuuauaauag

SEQ ID NO: 692344 - RNA, 19 nt, Homo sapiens
gaacaguuugugcaguuua

SEQ ID NO: 692345 - RNA, 19 nt, Homo sapiens
ccucuucgcuacacaauug

SEQ ID NO: 692346 - RNA, 19 nt, Homo sapiens
gcuggaagcugugaaguca

SEQ ID NO: 692347 - RNA, 19 nt, Homo sapiens
gccacaggcuaccacuuua

SEQ ID NO: 692348 - RNA, 19 nt, Homo sapiens
ccagagagaugagauugau

SEQ ID NO: 692349 - RNA, 19 nt, Homo sapiens
caagggagcagcuguggaa

SEQ ID NO: 692350 - RNA, 19 nt, Homo sapiens
caggugacaugcugccuaa

SEQ ID NO: 692351 - RNA, 19 nt, Homo sapiens
ggagaggcauuccauacca

SEQ ID NO: 692352 - RNA, 19 nt, Homo sapiens
ggaguuacccagagagaug

SEQ ID NO: 692353 - RNA, 19 nt, Homo sapiens
gagcagcuguggaaaucug

SEQ ID NO: 692354 - RNA, 19 nt, Homo sapiens
gggagcagcuguggaaauc

SEQ ID NO: 692355 - RNA, 19 nt, Homo sapiens
ggaacacccuggauacacu

SEQ ID NO: 692356 - RNA, 19 nt, Homo sapiens
gaggaacugugugguaugu

SEQ ID NO: 692357 - RNA, 19 nt, Homo sapiens
caagucaucaaguuuacua

SEQ ID NO: 692358 - RNA, 19 nt, Homo sapiens
ugucacaucguacucaaua

SEQ ID NO: 692359 - RNA, 19 nt, Homo sapiens
cuaaggaccugcccgucuu

SEQ ID NO: 692360 - RNA, 19 nt, Homo sapiens
gcagcaggagggaugauaa

SEQ ID NO: 692361 - RNA, 19 nt, Homo sapiens
gcccagugguugcaaugaa

SEQ ID NO: 692362 - RNA, 19 nt, Homo sapiens
gggccugucugccaugaug

SEQ ID NO: 692363 - RNA, 19 nt, Homo sapiens
gcagacaucaacacuuuca

SEQ ID NO: 692364 - RNA, 19 nt, Homo sapiens
ggaaaaugcugggaccaaa

SEQ ID NO: 692365 - RNA, 19 nt, Homo sapiens
cuacacaauugaagaugga

SEQ ID NO: 692366 - RNA, 19 nt, Homo sapiens
ccuaguccaucccucauga

SEQ ID NO: 692367 - RNA, 19 nt, Homo sapiens
ccaagagccugaguaugug

SEQ ID NO: 692368 - RNA, 19 nt, Homo sapiens
uccaagagccugaguaugu

SEQ ID NO: 692369 - RNA, 19 nt, Homo sapiens
gcaaugaaagacuaaagca

SEQ ID NO: 692370 - RNA, 19 nt, Homo sapiens
gcugaggaacuguguggua

SEQ ID NO: 692371 - RNA, 19 nt, Homo sapiens
aagaugagcugaggaacug

SEQ ID NO: 692372 - RNA, 19 nt, Homo sapiens
ucaucaaguuuacuaagga

SEQ ID NO: 692373 - RNA, 19 nt, Homo sapiens
cugcaagucaucaaguuua

SEQ ID NO: 692374 - RNA, 19 nt, Homo sapiens
uugcagaagugcuuagaug

SEQ ID NO: 692375 - RNA, 19 nt, Homo sapiens
gaagaugagcugaggaacu

SEQ ID NO: 692376 - RNA, 19 nt, Homo sapiens
gggaagaugagcugaggaa

SEQ ID NO: 692377 - RNA, 19 nt, Homo sapiens
gcaacagcgugggaguuug

SEQ ID NO: 692378 - RNA, 19 nt, Homo sapiens
caggagaacagucagcaaa

SEQ ID NO: 692379 - RNA, 19 nt, Homo sapiens
ccacaggcuaccacuuuaa

SEQ ID NO: 692380 - RNA, 19 nt, Homo sapiens
caaagggagcccagugguu

SEQ ID NO: 692381 - RNA, 19 nt, Homo sapiens
ggcagaagcccuggcauug

SEQ ID NO: 692382 - RNA, 19 nt, Homo sapiens
ggugacaugcugccuaaga

SEQ ID NO: 692383 - RNA, 19 nt, Homo sapiens
cgggaucgguuucuguaug

SEQ ID NO: 692384 - RNA, 19 nt, Homo sapiens
gagaagcaggagucuguga

SEQ ID NO: 692385 - RNA, 19 nt, Homo sapiens
ugaguaaggagcaagaaga

SEQ ID NO: 692386 - RNA, 19 nt, Homo sapiens
cccagugguugcaaugaaa

SEQ ID NO: 692387 - RNA, 19 nt, Homo sapiens
ggaguugcucuuucacuuc

SEQ ID NO: 692388 - RNA, 19 nt, Homo sapiens
uggaguugcucuuucacuu

SEQ ID NO: 692389 - RNA, 19 nt, Homo sapiens
ccagaucucccuucucaag

SEQ ID NO: 692390 - RNA, 19 nt, Homo sapiens
cagcucaucuguucaucca

SEQ ID NO: 692391 - RNA, 19 nt, Homo sapiens
ugaacaguuugugcaguuu

SEQ ID NO: 692392 - RNA, 19 nt, Homo sapiens
uugaacaguuugugcaguu

SEQ ID NO: 692393 - RNA, 19 nt, Homo sapiens
cacugacucugcaaagcua

SEQ ID NO: 692394 - RNA, 19 nt, Homo sapiens
gaggaaagacaugauacug

SEQ ID NO: 692395 - RNA, 19 nt, Homo sapiens
gcagguugcagaagugcuu

SEQ ID NO: 692396 - RNA, 19 nt, Homo sapiens
gacaugcugccuaagagaa

SEQ ID NO: 692397 - RNA, 19 nt, Homo sapiens
ggcauuccauaccagauuc

SEQ ID NO: 692398 - RNA, 19 nt, Homo sapiens
gaagcaggagucugugaca

SEQ ID NO: 692399 - RNA, 19 nt, Homo sapiens
aagagaagcaggagucugu

SEQ ID NO: 692400 - RNA, 19 nt, Homo sapiens
caaugaaagacuaaagcaa

SEQ ID NO: 692401 - RNA, 19 nt, Homo sapiens
gcacugacucugcaaagcu

SEQ ID NO: 692402 - RNA, 19 nt, Homo sapiens
ucacacacuucgcagacau

SEQ ID NO: 692403 - RNA, 19 nt, Homo sapiens
gcaacugaguaaggagcaa

SEQ ID NO: 692404 - RNA, 19 nt, Homo sapiens
cugaggaacugugugguau

SEQ ID NO: 692405 - RNA, 19 nt, Homo sapiens
aauccuaacuccaaucacu

SEQ ID NO: 692406 - RNA, 19 nt, Homo sapiens
gggaucgguuucuguaugc

SEQ ID NO: 692407 - RNA, 19 nt, Homo sapiens
agagagaugagauugauca

SEQ ID NO: 692408 - RNA, 19 nt, Homo sapiens
ugagauugaucagcugcaa

SEQ ID NO: 692409 - RNA, 19 nt, Homo sapiens
gccuccagcucaucuguuc

SEQ ID NO: 692410 - RNA, 19 nt, Homo sapiens
caacagcgugggaguuugg

SEQ ID NO: 692411 - RNA, 19 nt, Homo sapiens
gaaaacugcagcuccaaga

SEQ ID NO: 692412 - RNA, 19 nt, Homo sapiens
gucaucaaguuuacuaagg

SEQ ID NO: 692413 - RNA, 19 nt, Homo sapiens
agacaucaacacuuucaug

SEQ ID NO: 692414 - RNA, 19 nt, Homo sapiens
cggcagaagcccuggcauu

SEQ ID NO: 692415 - RNA, 19 nt, Homo sapiens
ggagcccagugguugcaau

SEQ ID NO: 692416 - RNA, 19 nt, Homo sapiens
ugauaauccuaacuccaau

SEQ ID NO: 692417 - RNA, 19 nt, Homo sapiens
caagaggagauggcacuga

SEQ ID NO: 692418 - RNA, 19 nt, Homo sapiens
gugacaugcugccuaagag

SEQ ID NO: 692419 - RNA, 19 nt, Homo sapiens
gguaccaaauccagcacau

SEQ ID NO: 692420 - RNA, 19 nt, Homo sapiens
guacugcaagucaucaagu

SEQ ID NO: 692421 - RNA, 19 nt, Homo sapiens
caaacaccugugcaacuga

SEQ ID NO: 692422 - RNA, 19 nt, Homo sapiens
gcagaagugcuuagaugcu

SEQ ID NO: 692423 - RNA, 19 nt, Homo sapiens
uccguucccugcccauuga

SEQ ID NO: 692424 - RNA, 19 nt, Homo sapiens
ucaauaccacuuucugucu

SEQ ID NO: 692425 - RNA, 19 nt, Homo sapiens
ugguugcaaugaaagacua

SEQ ID NO: 692426 - RNA, 19 nt, Homo sapiens
uacugcaagucaucaaguu

SEQ ID NO: 692427 - RNA, 19 nt, Homo sapiens
gaguaaggagcaagaagag

SEQ ID NO: 692428 - RNA, 19 nt, Homo sapiens
gcagaagcccuggcauugc

SEQ ID NO: 692429 - RNA, 19 nt, Homo sapiens
ggagaacagucagcaaaag

SEQ ID NO: 692430 - RNA, 19 nt, Homo sapiens
ugacaugcugccuaagaga

SEQ ID NO: 692431 - RNA, 19 nt, Homo sapiens
agauugaucagcugcaaga

SEQ ID NO: 692432 - RNA, 19 nt, Homo sapiens
cagcaggagggaugauaau

SEQ ID NO: 692433 - RNA, 19 nt, Homo sapiens
ggcagcaggagggaugaua

SEQ ID NO: 692434 - RNA, 19 nt, Homo sapiens
gauaauccuaacuccaauc

SEQ ID NO: 692435 - RNA, 19 nt, Homo sapiens
gaguuacccagagagauga

SEQ ID NO: 692436 - RNA, 19 nt, Homo sapiens
gaacaacuuucucuacauu

SEQ ID NO: 692437 - RNA, 19 nt, Homo sapiens
aaacauagcucaaagugaa

SEQ ID NO: 692438 - RNA, 19 nt, Homo sapiens
gcaaagagaugggaauguu

SEQ ID NO: 692439 - RNA, 19 nt, Homo sapiens
caagugaccucgacaacaa

SEQ ID NO: 692440 - RNA, 19 nt, Homo sapiens
gaacacugcuucucuuagu

SEQ ID NO: 692441 - RNA, 19 nt, Homo sapiens
gaaauuggauucugagcau

SEQ ID NO: 692442 - RNA, 19 nt, Homo sapiens
gaaagggucugcgguugaa

SEQ ID NO: 692443 - RNA, 19 nt, Homo sapiens
gaaagaauucgaaauagug

SEQ ID NO: 692444 - RNA, 19 nt, Homo sapiens
cauugaacauucccauuua

SEQ ID NO: 692445 - RNA, 19 nt, Homo sapiens
ggacauuuccucaagauga

SEQ ID NO: 692446 - RNA, 19 nt, Homo sapiens
ccagauagacaauacauaa

SEQ ID NO: 692447 - RNA, 19 nt, Homo sapiens
guaaauauugggcuagaua

SEQ ID NO: 692448 - RNA, 19 nt, Homo sapiens
gcaacugugugauggauau

SEQ ID NO: 692449 - RNA, 19 nt, Homo sapiens
gaacauucccauuuaccua

SEQ ID NO: 692450 - RNA, 19 nt, Homo sapiens
gaaauagugguaucucuga

SEQ ID NO: 692451 - RNA, 19 nt, Homo sapiens
caacagacucuucuacauu

SEQ ID NO: 692452 - RNA, 19 nt, Homo sapiens
gacaauacauaaaggauag

SEQ ID NO: 692453 - RNA, 19 nt, Homo sapiens
ggagguagaagacaucgua

SEQ ID NO: 692454 - RNA, 19 nt, Homo sapiens
cagcugagauuuucaauaa

SEQ ID NO: 692455 - RNA, 19 nt, Homo sapiens
guacucuccuggaauauau

SEQ ID NO: 692456 - RNA, 19 nt, Homo sapiens
gaagaccaccauaaagaaa

SEQ ID NO: 692457 - RNA, 19 nt, Homo sapiens
gaugagcuguguguuguuu

SEQ ID NO: 692458 - RNA, 19 nt, Homo sapiens
cuaaggaaaugcaaagaga

SEQ ID NO: 692459 - RNA, 19 nt, Homo sapiens
gugguacucuccuggaaua

SEQ ID NO: 692460 - RNA, 19 nt, Homo sapiens
auacagcaauguucaguuu

SEQ ID NO: 692461 - RNA, 19 nt, Homo sapiens
gaaccauacucgcaauaca

SEQ ID NO: 692462 - RNA, 19 nt, Homo sapiens
gcugggaucuggagaggaa

SEQ ID NO: 692463 - RNA, 19 nt, Homo sapiens
ccagauugcuuugcugaaa

SEQ ID NO: 692464 - RNA, 19 nt, Homo sapiens
caucuuaccauauugcaua

SEQ ID NO: 692465 - RNA, 19 nt, Homo sapiens
cgaagaaagugucaagagu

SEQ ID NO: 692466 - RNA, 19 nt, Homo sapiens
ggcaauaaagcaaacauaa

SEQ ID NO: 692467 - RNA, 19 nt, Homo sapiens
gcugaaugcuuguuaacug

SEQ ID NO: 692468 - RNA, 19 nt, Homo sapiens
ggucugcgguugaagcuau

SEQ ID NO: 692469 - RNA, 19 nt, Homo sapiens
agaauucagugcagaagaa

SEQ ID NO: 692470 - RNA, 19 nt, Homo sapiens
aacagacucuucuacauuu

SEQ ID NO: 692471 - RNA, 19 nt, Homo sapiens
ugucaagagugucgacuaa

SEQ ID NO: 692472 - RNA, 19 nt, Homo sapiens
gggaugagcuguguguugu

SEQ ID NO: 692473 - RNA, 19 nt, Homo sapiens
caaguucaaccacagauuu

SEQ ID NO: 692474 - RNA, 19 nt, Homo sapiens
gacauuuccucaagaugaa

SEQ ID NO: 692475 - RNA, 19 nt, Homo sapiens
gaaugcuuguuaacugaaa

SEQ ID NO: 692476 - RNA, 19 nt, Homo sapiens
gaaauggcaaccaaucaug

SEQ ID NO: 692477 - RNA, 19 nt, Homo sapiens
auaaugcacugaccuguga

SEQ ID NO: 692478 - RNA, 19 nt, Homo sapiens
uagaaggagugaaagaaga

SEQ ID NO: 692479 - RNA, 19 nt, Homo sapiens
ugacggaaauggcaaccaa

SEQ ID NO: 692480 - RNA, 19 nt, Homo sapiens
gaucagaccgugaaugaag

SEQ ID NO: 692481 - RNA, 19 nt, Homo sapiens
aaacugagguagcagagau

SEQ ID NO: 692482 - RNA, 19 nt, Homo sapiens
gguagaagacaucguagaa

SEQ ID NO: 692483 - RNA, 19 nt, Homo sapiens
gaaacauagcucaaaguga

SEQ ID NO: 692484 - RNA, 19 nt, Homo sapiens
agaguuguauucaaucuug

SEQ ID NO: 692485 - RNA, 19 nt, Homo sapiens
cagugaaggucgugacuug

SEQ ID NO: 692486 - RNA, 19 nt, Homo sapiens
ccacaacuguaaauauugg

SEQ ID NO: 692487 - RNA, 19 nt, Homo sapiens
ccacuucucugugaaaucu

SEQ ID NO: 692488 - RNA, 19 nt, Homo sapiens
gauagacaauacauaaagg

SEQ ID NO: 692489 - RNA, 19 nt, Homo sapiens
ugguaucucugaugaauau

SEQ ID NO: 692490 - RNA, 19 nt, Homo sapiens
ccucaggaaauaacaaaua

SEQ ID NO: 692491 - RNA, 19 nt, Homo sapiens
cagaucagaccgugaauga

SEQ ID NO: 692492 - RNA, 19 nt, Homo sapiens
caaacauaauggcaacaga

SEQ ID NO: 692493 - RNA, 19 nt, Homo sapiens
gggagaaacugagguagca

SEQ ID NO: 692494 - RNA, 19 nt, Homo sapiens
uauaugaacucaggcguau

SEQ ID NO: 692495 - RNA, 19 nt, Homo sapiens
ccauaaagaaagugcauuu

SEQ ID NO: 692496 - RNA, 19 nt, Homo sapiens
ugaaaauccucaacacuuu

SEQ ID NO: 692497 - RNA, 19 nt, Homo sapiens
ggaguaugcucugcuuaca

SEQ ID NO: 692498 - RNA, 19 nt, Homo sapiens
ggaagaaagaauucgaaau

SEQ ID NO: 692499 - RNA, 19 nt, Homo sapiens
gcagagaugccuguaacaa

SEQ ID NO: 692500 - RNA, 19 nt, Homo sapiens
ccaaggagguagaagacau

SEQ ID NO: 692501 - RNA, 19 nt, Homo sapiens
uuacggacauucaaucauc

SEQ ID NO: 692502 - RNA, 19 nt, Homo sapiens
uaccaggauuucagacuuu

SEQ ID NO: 692503 - RNA, 19 nt, Homo sapiens
agagaugccuguaacaaag

SEQ ID NO: 692504 - RNA, 19 nt, Homo sapiens
ucucuuaguuuccuggauu

SEQ ID NO: 692505 - RNA, 19 nt, Homo sapiens
caucguagaaggagugaaa

SEQ ID NO: 692506 - RNA, 19 nt, Homo sapiens
ggaaauggcaaccaaucau

SEQ ID NO: 692507 - RNA, 19 nt, Homo sapiens
ucauugaacauucccauuu

SEQ ID NO: 692508 - RNA, 19 nt, Homo sapiens
uugcucaucuuaccauauu

SEQ ID NO: 692509 - RNA, 19 nt, Homo sapiens
ucaacagacucuucuacau

SEQ ID NO: 692510 - RNA, 19 nt, Homo sapiens
gauauguacaugcgaagaa

SEQ ID NO: 692511 - RNA, 19 nt, Homo sapiens
cagagaugccuguaacaaa

SEQ ID NO: 692512 - RNA, 19 nt, Homo sapiens
gaaugaagacagugaaggu

SEQ ID NO: 692513 - RNA, 19 nt, Homo sapiens
aagaaagugucaagagugu

SEQ ID NO: 692514 - RNA, 19 nt, Homo sapiens
aaacauaauggcaacagaa

SEQ ID NO: 692515 - RNA, 19 nt, Homo sapiens
ugaagaccaccauaaagaa

SEQ ID NO: 692516 - RNA, 19 nt, Homo sapiens
gaguaaacgaccacaaguu

SEQ ID NO: 692517 - RNA, 19 nt, Homo sapiens
gagaguaaacgaccacaag

SEQ ID NO: 692518 - RNA, 19 nt, Homo sapiens
uagcagagaugccuguaac

SEQ ID NO: 692519 - RNA, 19 nt, Homo sapiens
ccauuuaccuaccacagau

SEQ ID NO: 692520 - RNA, 19 nt, Homo sapiens
guaacuuccacaacuguaa

SEQ ID NO: 692521 - RNA, 19 nt, Homo sapiens
gaccgugaaugaagacagu

SEQ ID NO: 692522 - RNA, 19 nt, Homo sapiens
ccacagauuuccucgucau

SEQ ID NO: 692523 - RNA, 19 nt, Homo sapiens
gugaacacugcuucucuua

SEQ ID NO: 692524 - RNA, 19 nt, Homo sapiens
guacccaguuucacucaag

SEQ ID NO: 692525 - RNA, 19 nt, Homo sapiens
ggauagagaggcaguagag

SEQ ID NO: 692526 - RNA, 19 nt, Homo sapiens
gcugagauuuucaauaaga

SEQ ID NO: 692527 - RNA, 19 nt, Homo sapiens
cuaccaggauuucagacuu

SEQ ID NO: 692528 - RNA, 19 nt, Homo sapiens
ugaagcagcaugcagauca

SEQ ID NO: 692529 - RNA, 19 nt, Homo sapiens
cugaaugcuuguuaacuga

SEQ ID NO: 692530 - RNA, 19 nt, Homo sapiens
gguacucuccuggaauaua

SEQ ID NO: 692531 - RNA, 19 nt, Homo sapiens
caaaaguuguguaagauuc

SEQ ID NO: 692532 - RNA, 19 nt, Homo sapiens
aaucuaagcgacugagaaa

SEQ ID NO: 692533 - RNA, 19 nt, Homo sapiens
ucaagagugucgacuaagg

SEQ ID NO: 692534 - RNA, 19 nt, Homo sapiens
ugacugaauuacggacauu

SEQ ID NO: 692535 - RNA, 19 nt, Homo sapiens
auagugguaucucugauga

SEQ ID NO: 692536 - RNA, 19 nt, Homo sapiens
gaggagagcucuaauauua

SEQ ID NO: 692537 - RNA, 19 nt, Homo sapiens
gaagaaagcugacaaugaa

SEQ ID NO: 692538 - RNA, 19 nt, Homo sapiens
gaagacaaaugaaagcuaa

SEQ ID NO: 692539 - RNA, 19 nt, Homo sapiens
caacaagaaugaagaugua

SEQ ID NO: 692540 - RNA, 19 nt, Homo sapiens
gauaaagacugcuguuaga

SEQ ID NO: 692541 - RNA, 19 nt, Homo sapiens
gaggaagccugauuaaaga

SEQ ID NO: 692542 - RNA, 19 nt, Homo sapiens
ggauaaaugccaucaauaa

SEQ ID NO: 692543 - RNA, 19 nt, Homo sapiens
ggaagaaagcugacaauga

SEQ ID NO: 692544 - RNA, 19 nt, Homo sapiens
ccuaaggacuucuuuaauu

SEQ ID NO: 692545 - RNA, 19 nt, Homo sapiens
gaagauagauucuguugcu

SEQ ID NO: 692546 - RNA, 19 nt, Homo sapiens
cuaguucacucuccauuua

SEQ ID NO: 692547 - RNA, 19 nt, Homo sapiens
caauucgucucaagcauua

SEQ ID NO: 692548 - RNA, 19 nt, Homo sapiens
gaagcgagcccuuacauug

SEQ ID NO: 692549 - RNA, 19 nt, Homo sapiens
gaacaaaguuacagacaac

SEQ ID NO: 692550 - RNA, 19 nt, Homo sapiens
gaggaauucuguauagauu

SEQ ID NO: 692551 - RNA, 19 nt, Homo sapiens
ggaaauaaaggucacauug

SEQ ID NO: 692552 - RNA, 19 nt, Homo sapiens
ggaauugaaacaccaaaua

SEQ ID NO: 692553 - RNA, 19 nt, Homo sapiens
gaagauguaugcagcuguu

SEQ ID NO: 692554 - RNA, 19 nt, Homo sapiens
ggaacgcguugaaauugua

SEQ ID NO: 692555 - RNA, 19 nt, Homo sapiens
caacaagcccaguaguuua

SEQ ID NO: 692556 - RNA, 19 nt, Homo sapiens
caaagauacuucaacaaga

SEQ ID NO: 692557 - RNA, 19 nt, Homo sapiens
gcagauuauucacugauuu

SEQ ID NO: 692558 - RNA, 19 nt, Homo sapiens
gaagaugucaagcccuuua

SEQ ID NO: 692559 - RNA, 19 nt, Homo sapiens
ggagccagcaguaauaaua

SEQ ID NO: 692560 - RNA, 19 nt, Homo sapiens
gagugaaggcuuuaaauuu

SEQ ID NO: 692561 - RNA, 19 nt, Homo sapiens
gcaacaagcccaguaguuu

SEQ ID NO: 692562 - RNA, 19 nt, Homo sapiens
gcagucccauguuuaaauu

SEQ ID NO: 692563 - RNA, 19 nt, Homo sapiens
gauaacaucucaacuacca

SEQ ID NO: 692564 - RNA, 19 nt, Homo sapiens
aaagguggauucucaauau

SEQ ID NO: 692565 - RNA, 19 nt, Homo sapiens
gauagaggaagccugauua

SEQ ID NO: 692566 - RNA, 19 nt, Homo sapiens
caacuugucugccuuugga

SEQ ID NO: 692567 - RNA, 19 nt, Homo sapiens
gcgcuaaacuuuucugaua

SEQ ID NO: 692568 - RNA, 19 nt, Homo sapiens
gaugagaauucuucaaagu

SEQ ID NO: 692569 - RNA, 19 nt, Homo sapiens
uaaacagacuggaauugaa

SEQ ID NO: 692570 - RNA, 19 nt, Homo sapiens
ggaauucuguauagauuag

SEQ ID NO: 692571 - RNA, 19 nt, Homo sapiens
gauacuggauuguacuuug

SEQ ID NO: 692572 - RNA, 19 nt, Homo sapiens
caaauuuggugucucauca

SEQ ID NO: 692573 - RNA, 19 nt, Homo sapiens
ggaaagugcugagacuaug

SEQ ID NO: 692574 - RNA, 19 nt, Homo sapiens
gauaacaagugcaguacug

SEQ ID NO: 692575 - RNA, 19 nt, Homo sapiens
agaauuccauccauuguuu

SEQ ID NO: 692576 - RNA, 19 nt, Homo sapiens
gauaggagugggauagaua

SEQ ID NO: 692577 - RNA, 19 nt, Homo sapiens
caucaggaguguucacauu

SEQ ID NO: 692578 - RNA, 19 nt, Homo sapiens
agaaaugccugccaccaaa

SEQ ID NO: 692579 - RNA, 19 nt, Homo sapiens
ggauugugauaccuguuua

SEQ ID NO: 692580 - RNA, 19 nt, Homo sapiens
uucaagagcuucugauaaa

SEQ ID NO: 692581 - RNA, 19 nt, Homo sapiens
gugaauggcuuuguauaga

SEQ ID NO: 692582 - RNA, 19 nt, Homo sapiens
uaacaaggccuucucuuca

SEQ ID NO: 692583 - RNA, 19 nt, Homo sapiens
gcaagagccugucacuucu

SEQ ID NO: 692584 - RNA, 19 nt, Homo sapiens
uaacaagcacuggaaauuu

SEQ ID NO: 692585 - RNA, 19 nt, Homo sapiens
caggaagacuaaucaaaga

SEQ ID NO: 692586 - RNA, 19 nt, Homo sapiens
ggacuguggugacuuugga

SEQ ID NO: 692587 - RNA, 19 nt, Homo sapiens
ucugugaacuugaaauuug

SEQ ID NO: 692588 - RNA, 19 nt, Homo sapiens
ugacacaucuuccucaucu

SEQ ID NO: 692589 - RNA, 19 nt, Homo sapiens
ccaguuagaagacaaauga

SEQ ID NO: 692590 - RNA, 19 nt, Homo sapiens
gaugaggagagcucuaaua

SEQ ID NO: 692591 - RNA, 19 nt, Homo sapiens
uagcuagacuggugacuga

SEQ ID NO: 692592 - RNA, 19 nt, Homo sapiens
gaaauaaaggucacauugg

SEQ ID NO: 692593 - RNA, 19 nt, Homo sapiens
gaagacaccaccugaagau

SEQ ID NO: 692594 - RNA, 19 nt, Homo sapiens
gaauauugcagucuuuaga

SEQ ID NO: 692595 - RNA, 19 nt, Homo sapiens
caaauuauccagauguguu

SEQ ID NO: 692596 - RNA, 19 nt, Homo sapiens
caacuaguacugcuucaaa

SEQ ID NO: 692597 - RNA, 19 nt, Homo sapiens
ggagagcucuaauauuacu

SEQ ID NO: 692598 - RNA, 19 nt, Homo sapiens
cagcagcacuacaaauuuc

SEQ ID NO: 692599 - RNA, 19 nt, Homo sapiens
caaaguccacauuuaguuu

SEQ ID NO: 692600 - RNA, 19 nt, Homo sapiens
cuaguacugcuucaaauua

SEQ ID NO: 692601 - RNA, 19 nt, Homo sapiens
acauaaaucugugaacuug

SEQ ID NO: 692602 - RNA, 19 nt, Homo sapiens
ugaauggcuuuguauagaa

SEQ ID NO: 692603 - RNA, 19 nt, Homo sapiens
gcagcagcacuacaaauuu

SEQ ID NO: 692604 - RNA, 19 nt, Homo sapiens
caagauagcaaacuagcaa

SEQ ID NO: 692605 - RNA, 19 nt, Homo sapiens
agucagaucugccuaagga

SEQ ID NO: 692606 - RNA, 19 nt, Homo sapiens
ggacuuucuucugguuuaa

SEQ ID NO: 692607 - RNA, 19 nt, Homo sapiens
aaauaggugugucaucuga

SEQ ID NO: 692608 - RNA, 19 nt, Homo sapiens
gcaacucagugcacaaucu

SEQ ID NO: 692609 - RNA, 19 nt, Homo sapiens
gaagccugauuaaagaaug

SEQ ID NO: 692610 - RNA, 19 nt, Homo sapiens
gaaaccaggaaguucagua

SEQ ID NO: 692611 - RNA, 19 nt, Homo sapiens
gauaggcacuugggauugu

SEQ ID NO: 692612 - RNA, 19 nt, Homo sapiens
aaaguugccuaaauccauu

SEQ ID NO: 692613 - RNA, 19 nt, Homo sapiens
guuccacgcuggccagaaa

SEQ ID NO: 692614 - RNA, 19 nt, Homo sapiens
ugauuucuaugcugaguuu

SEQ ID NO: 692615 - RNA, 19 nt, Homo sapiens
aagaggaacugcccaaauc

SEQ ID NO: 692616 - RNA, 19 nt, Homo sapiens
caucggagccaucugaauu

SEQ ID NO: 692617 - RNA, 19 nt, Homo sapiens
aaauaaaggucacauuggu

SEQ ID NO: 692618 - RNA, 19 nt, Homo sapiens
gugcaguacuggauaugaa

SEQ ID NO: 692619 - RNA, 19 nt, Homo sapiens
caagugcaguacuggauau

SEQ ID NO: 692620 - RNA, 19 nt, Homo sapiens
gaaccuucaacaacuagua

SEQ ID NO: 692621 - RNA, 19 nt, Homo sapiens
cagcaucagggcauucuua

SEQ ID NO: 692622 - RNA, 19 nt, Homo sapiens
gcacuacaaauuucaacuu

SEQ ID NO: 692623 - RNA, 19 nt, Homo sapiens
ccaggagccagcaguaaua

SEQ ID NO: 692624 - RNA, 19 nt, Homo sapiens
gggaaggacagaagagaaa

SEQ ID NO: 692625 - RNA, 19 nt, Homo sapiens
caaaguuacagacaacaaa

SEQ ID NO: 692626 - RNA, 19 nt, Homo sapiens
cuaccuccaucaucuauug

SEQ ID NO: 692627 - RNA, 19 nt, Homo sapiens
ugguuuaucuucuggagua

SEQ ID NO: 692628 - RNA, 19 nt, Homo sapiens
ccagucagcuuggagauuc

SEQ ID NO: 692629 - RNA, 19 nt, Homo sapiens
gggauaaaugccaucaaua

SEQ ID NO: 692630 - RNA, 19 nt, Homo sapiens
guggugacuuuggauaaua

SEQ ID NO: 692631 - RNA, 19 nt, Homo sapiens
ucaggaguguucacauuug

SEQ ID NO: 692632 - RNA, 19 nt, Homo sapiens
gaauucagagcaaaccaaa

SEQ ID NO: 692633 - RNA, 19 nt, Homo sapiens
uaagcaacccaguuucuuu

SEQ ID NO: 692634 - RNA, 19 nt, Homo sapiens
gaaagugcugagacuauga

SEQ ID NO: 692635 - RNA, 19 nt, Homo sapiens
gcagugugauacaugucua

SEQ ID NO: 692636 - RNA, 19 nt, Homo sapiens
ggccaucccuuauccaaga

SEQ ID NO: 692637 - RNA, 19 nt, Homo sapiens
gcggagaccugggcaaugu

SEQ ID NO: 692638 - RNA, 19 nt, Homo sapiens
gcagccugauuauugauga

SEQ ID NO: 692639 - RNA, 19 nt, Homo sapiens
ggccgcagccugauuauug

SEQ ID NO: 692640 - RNA, 19 nt, Homo sapiens
gaaggugugggaugugauu

SEQ ID NO: 692641 - RNA, 19 nt, Homo sapiens
ggcgagcacuuuccacuuc

SEQ ID NO: 692642 - RNA, 19 nt, Homo sapiens
gcacuuggaggaccagaug

SEQ ID NO: 692643 - RNA, 19 nt, Homo sapiens
gguguucccuuggcaaaug

SEQ ID NO: 692644 - RNA, 19 nt, Homo sapiens
gcugugggaaucacuuuaa

SEQ ID NO: 692645 - RNA, 19 nt, Homo sapiens
gauuauugaugagggagaa

SEQ ID NO: 692646 - RNA, 19 nt, Homo sapiens
gccgcagccugauuauuga

SEQ ID NO: 692647 - RNA, 19 nt, Homo sapiens
gaccucaccuuggcucugu

SEQ ID NO: 692648 - RNA, 19 nt, Homo sapiens
cagauggucuugguacaca

SEQ ID NO: 692649 - RNA, 19 nt, Homo sapiens
gguggcagguguccaggau

SEQ ID NO: 692650 - RNA, 19 nt, Homo sapiens
ggaguucgcggugcagaug

SEQ ID NO: 692651 - RNA, 19 nt, Homo sapiens
gacuccacguccaucagua

SEQ ID NO: 692652 - RNA, 19 nt, Homo sapiens
uggcagguguccaggaugu

SEQ ID NO: 692653 - RNA, 19 nt, Homo sapiens
gcagcggccaguugcagaa

SEQ ID NO: 692654 - RNA, 19 nt, Homo sapiens
guuggccuguggcaucauu

SEQ ID NO: 692655 - RNA, 19 nt, Homo sapiens
gaggccaucccuuauccaa

SEQ ID NO: 692656 - RNA, 19 nt, Homo sapiens
cugaaggugugggauguga

SEQ ID NO: 692657 - RNA, 19 nt, Homo sapiens
ugcaacagcugugggaauc

SEQ ID NO: 692658 - RNA, 19 nt, Homo sapiens
caacagcugugggaaucac

SEQ ID NO: 692659 - RNA, 19 nt, Homo sapiens
ggcaauguccgugcugaug

SEQ ID NO: 692660 - RNA, 19 nt, Homo sapiens
gcggccaguugcagaaucu

SEQ ID NO: 692661 - RNA, 19 nt, Homo sapiens
ggauguggaggugcacuug

SEQ ID NO: 692662 - RNA, 19 nt, Homo sapiens
gggcgagcacuuuccacuu

SEQ ID NO: 692663 - RNA, 19 nt, Homo sapiens
gaacagaugucagcaaugu

SEQ ID NO: 692664 - RNA, 19 nt, Homo sapiens
gaagagaugaguuuguuua

SEQ ID NO: 692665 - RNA, 19 nt, Homo sapiens
ccaagaacauggagcaaua

SEQ ID NO: 692666 - RNA, 19 nt, Homo sapiens
ccaaauagcucuaauucug

SEQ ID NO: 692667 - RNA, 19 nt, Homo sapiens
gaagaaugaucgaauagau

SEQ ID NO: 692668 - RNA, 19 nt, Homo sapiens
ugaaagaagugguggaauu

SEQ ID NO: 692669 - RNA, 19 nt, Homo sapiens
gaccagagcucacaaggau

SEQ ID NO: 692670 - RNA, 19 nt, Homo sapiens
gagaacggauucccaagaa

SEQ ID NO: 692671 - RNA, 19 nt, Homo sapiens
gaaagaagugguggaauuu

SEQ ID NO: 692672 - RNA, 19 nt, Homo sapiens
gaacauggagcaauauaau

SEQ ID NO: 692673 - RNA, 19 nt, Homo sapiens
gaggagcucuuggccuuua

SEQ ID NO: 692674 - RNA, 19 nt, Homo sapiens
cuaaaugcccuccaacuua

SEQ ID NO: 692675 - RNA, 19 nt, Homo sapiens
uaaacaacaugcacucuga

SEQ ID NO: 692676 - RNA, 19 nt, Homo sapiens
agaagugccugaagaauga

SEQ ID NO: 692677 - RNA, 19 nt, Homo sapiens
aaacagaggaugcuaauug

SEQ ID NO: 692678 - RNA, 19 nt, Homo sapiens
ggaacguacugucaccuuu

SEQ ID NO: 692679 - RNA, 19 nt, Homo sapiens
gaugguaacuguacauuuu

SEQ ID NO: 692680 - RNA, 19 nt, Homo sapiens
gaagcuaaaugcccuccaa

SEQ ID NO: 692681 - RNA, 19 nt, Homo sapiens
gcaaugaagaccaugauga

SEQ ID NO: 692682 - RNA, 19 nt, Homo sapiens
gcucuuggccuuuaaaguu

SEQ ID NO: 692683 - RNA, 19 nt, Homo sapiens
gaacuucuccaaugcuuau

SEQ ID NO: 692684 - RNA, 19 nt, Homo sapiens
gaagaaugcaucugguuug

SEQ ID NO: 692685 - RNA, 19 nt, Homo sapiens
ggaagaaugcaucugguuu

SEQ ID NO: 692686 - RNA, 19 nt, Homo sapiens
gaggugugauugccuauau

SEQ ID NO: 692687 - RNA, 19 nt, Homo sapiens
uaaaugcccuccaacuuag

SEQ ID NO: 692688 - RNA, 19 nt, Homo sapiens
gcaggaaacucucauucgu

SEQ ID NO: 692689 - RNA, 19 nt, Homo sapiens
gagaugaguuuguuuacag

SEQ ID NO: 692690 - RNA, 19 nt, Homo sapiens
ggucaugccauuuguauug

SEQ ID NO: 692691 - RNA, 19 nt, Homo sapiens
gcaaaggaacguacuguca

SEQ ID NO: 692692 - RNA, 19 nt, Homo sapiens
gugcaacacuggaggaaga

SEQ ID NO: 692693 - RNA, 19 nt, Homo sapiens
gcaugguucuacuguguaa

SEQ ID NO: 692694 - RNA, 19 nt, Homo sapiens
gaguaagucuccauaugug

SEQ ID NO: 692695 - RNA, 19 nt, Homo sapiens
uguaugaacuucuccaaug

SEQ ID NO: 692696 - RNA, 19 nt, Homo sapiens
aaacaugaacugaugguaa

SEQ ID NO: 692697 - RNA, 19 nt, Homo sapiens
ggagaaguauucaacaaaa

SEQ ID NO: 692698 - RNA, 19 nt, Homo sapiens
gaacugaugguaacuguac

SEQ ID NO: 692699 - RNA, 19 nt, Homo sapiens
caugaaaucugggaagaau

SEQ ID NO: 692700 - RNA, 19 nt, Homo sapiens
ccuuuaaaguucacccuua

SEQ ID NO: 692701 - RNA, 19 nt, Homo sapiens
caucugguuuguccaauga

SEQ ID NO: 692702 - RNA, 19 nt, Homo sapiens
uaccauauguggagauaga

SEQ ID NO: 692703 - RNA, 19 nt, Homo sapiens
gaacggauucccaagaaca

SEQ ID NO: 692704 - RNA, 19 nt, Homo sapiens
cuugaagaaugaucgaaua

SEQ ID NO: 692705 - RNA, 19 nt, Homo sapiens
caaauagcucuaauucuga

SEQ ID NO: 692706 - RNA, 19 nt, Homo sapiens
aagaguaugugauagaguu

SEQ ID NO: 692707 - RNA, 19 nt, Homo sapiens
caaugaagaccaugaugaa

SEQ ID NO: 692708 - RNA, 19 nt, Homo sapiens
gagaaugaauaggaacaga

SEQ ID NO: 692709 - RNA, 19 nt, Homo sapiens
gaaauauaguguggaugau

SEQ ID NO: 692710 - RNA, 19 nt, Homo sapiens
agaaauauaguguggauga

SEQ ID NO: 692711 - RNA, 19 nt, Homo sapiens
gacaugaaaucugggaaga

SEQ ID NO: 692712 - RNA, 19 nt, Homo sapiens
aagagaugcuguucgguuu

SEQ ID NO: 692713 - RNA, 19 nt, Homo sapiens
ucagcaaugucgcuucaaa

SEQ ID NO: 692714 - RNA, 19 nt, Homo sapiens
uacaagaagugccugaaga

SEQ ID NO: 692715 - RNA, 19 nt, Homo sapiens
ggagaacggauucccaaga

SEQ ID NO: 692716 - RNA, 19 nt, Homo sapiens
cagaggaugcuaauugaaa

SEQ ID NO: 692717 - RNA, 19 nt, Homo sapiens
gaaugaauaggaacagaug

SEQ ID NO: 692718 - RNA, 19 nt, Homo sapiens
ggugaucucgccaauauug

SEQ ID NO: 692719 - RNA, 19 nt, Homo sapiens
gcuaaaugcccuccaacuu

SEQ ID NO: 692720 - RNA, 19 nt, Homo sapiens
ucaaagaguaugugauaga

SEQ ID NO: 692721 - RNA, 19 nt, Homo sapiens
gaaugcaggaggugugauu

SEQ ID NO: 692722 - RNA, 19 nt, Homo sapiens
gcuguucgguuuggucgua

SEQ ID NO: 692723 - RNA, 19 nt, Homo sapiens
gaauggugaucucgccaau

SEQ ID NO: 692724 - RNA, 19 nt, Homo sapiens
gggaucugcuaaacucuau

SEQ ID NO: 692725 - RNA, 19 nt, Homo sapiens
gaugcuaauugaaaugcaa

SEQ ID NO: 692726 - RNA, 19 nt, Homo sapiens
guuggaaugucaagagaug

SEQ ID NO: 692727 - RNA, 19 nt, Homo sapiens
cuuaaggccuuuguuuauu

SEQ ID NO: 692728 - RNA, 19 nt, Homo sapiens
ucaacucuguggaggcuuu

SEQ ID NO: 692729 - RNA, 19 nt, Homo sapiens
uaaaucaggacaugaaauc

SEQ ID NO: 692730 - RNA, 19 nt, Homo sapiens
agaaugagaacaagaauag

SEQ ID NO: 692731 - RNA, 19 nt, Homo sapiens
caaagaguaugugauagag

SEQ ID NO: 692732 - RNA, 19 nt, Homo sapiens
ccucauaaaucaggacaug

SEQ ID NO: 692733 - RNA, 19 nt, Homo sapiens
gugauagaguuccgauaga

SEQ ID NO: 692734 - RNA, 19 nt, Homo sapiens
aacagaggaugcuaauuga

SEQ ID NO: 692735 - RNA, 19 nt, Homo sapiens
ccagagaggagaacggauu

SEQ ID NO: 692736 - RNA, 19 nt, Homo sapiens
gugaugaagagaugaguuu

SEQ ID NO: 692737 - RNA, 19 nt, Homo sapiens
gcaucugguuuguccaaug

SEQ ID NO: 692738 - RNA, 19 nt, Homo sapiens
ucaaagggaggaauauaau

SEQ ID NO: 692739 - RNA, 19 nt, Homo sapiens
gcaucucaauggacaguuc

SEQ ID NO: 692740 - RNA, 19 nt, Homo sapiens
agaaugaucgaauagauug

SEQ ID NO: 692741 - RNA, 19 nt, Homo sapiens
cagaaugagaacaagaaua

SEQ ID NO: 692742 - RNA, 19 nt, Homo sapiens
gcucuucuccuccaucuuc

SEQ ID NO: 692743 - RNA, 19 nt, Homo sapiens
ugaguaagucuccauaugu

SEQ ID NO: 692744 - RNA, 19 nt, Homo sapiens
guuccaucuucuccaaaua

SEQ ID NO: 692745 - RNA, 19 nt, Homo sapiens
guucaaagggaggaauaua

SEQ ID NO: 692746 - RNA, 19 nt, Homo sapiens
ggauguggcgucaggauuc

SEQ ID NO: 692747 - RNA, 19 nt, Homo sapiens
gguacgguucgcaucauua

SEQ ID NO: 692748 - RNA, 19 nt, Homo sapiens
auggugaucucgccaauau

SEQ ID NO: 692749 - RNA, 19 nt, Homo sapiens
caaagggaggaauauaaug

SEQ ID NO: 692750 - RNA, 19 nt, Homo sapiens
ccaaugguaaucccaagaa

SEQ ID NO: 692751 - RNA, 19 nt, Homo sapiens
gcaaaggaagaagugauug

SEQ ID NO: 692752 - RNA, 19 nt, Homo sapiens
agaggaugcuaauugaaau

SEQ ID NO: 692753 - RNA, 19 nt, Homo sapiens
ccucuucuguuccaucuuc

SEQ ID NO: 692754 - RNA, 19 nt, Homo sapiens
ccuuaaggccuuuguuuau

SEQ ID NO: 692755 - RNA, 19 nt, Homo sapiens
guacgguucgcaucauuau

SEQ ID NO: 692756 - RNA, 19 nt, Homo sapiens
ugauagaguuccgauagau

SEQ ID NO: 692757 - RNA, 19 nt, Homo sapiens
acacauuaguagaacauca

SEQ ID NO: 692758 - RNA, 19 nt, Homo sapiens
ucggagaaguauucaacaa

SEQ ID NO: 692759 - RNA, 19 nt, Homo sapiens
caaugguaaucccaagaau

SEQ ID NO: 692760 - RNA, 19 nt, Homo sapiens
ugaauuuagugagaagcua

SEQ ID NO: 692761 - RNA, 19 nt, Homo sapiens
caauauugaaggcaucuug

SEQ ID NO: 692762 - RNA, 19 nt, Homo sapiens
gauagaguuccgauagaug

SEQ ID NO: 692763 - RNA, 19 nt, Homo sapiens
gaagagaguuucugcaaga

SEQ ID NO: 692764 - RNA, 19 nt, Homo sapiens
guacauggagcuacauuua

SEQ ID NO: 692765 - RNA, 19 nt, Homo sapiens
guaccugucugguuaauuc

SEQ ID NO: 692766 - RNA, 19 nt, Homo sapiens
gagauuggaauucaaguaa

SEQ ID NO: 692767 - RNA, 19 nt, Homo sapiens
uaaacuaacucgagauucu

SEQ ID NO: 692768 - RNA, 19 nt, Homo sapiens
gaagaaggagauuggaauu

SEQ ID NO: 692769 - RNA, 19 nt, Homo sapiens
gaaggagauuggaauucaa

SEQ ID NO: 692770 - RNA, 19 nt, Homo sapiens
gauguuacaccgaaagaaa

SEQ ID NO: 692771 - RNA, 19 nt, Homo sapiens
caacaugccgaccuaacua

SEQ ID NO: 692772 - RNA, 19 nt, Homo sapiens
gagagggagugaaggaugu

SEQ ID NO: 692773 - RNA, 19 nt, Homo sapiens
ggagauuggaauucaagua

SEQ ID NO: 692774 - RNA, 19 nt, Homo sapiens
agaaggagauuggaauuca

SEQ ID NO: 692775 - RNA, 19 nt, Homo sapiens
ucaaaacgcugauuaaaag

SEQ ID NO: 692776 - RNA, 19 nt, Homo sapiens
gagaguuucugcaagacau

SEQ ID NO: 692777 - RNA, 19 nt, Homo sapiens
ggaaaagaauacacuaagu

SEQ ID NO: 692778 - RNA, 19 nt, Homo sapiens
uaaagaagaaggagauugg

SEQ ID NO: 692779 - RNA, 19 nt, Homo sapiens
uaauucugcuuacguguca

SEQ ID NO: 692780 - RNA, 19 nt, Homo sapiens
gugccuaccucagcgauga

SEQ ID NO: 692781 - RNA, 19 nt, Homo sapiens
cgaccuaacuauaauugac

SEQ ID NO: 692782 - RNA, 19 nt, Homo sapiens
caaguaaauacaacuguuc

SEQ ID NO: 692783 - RNA, 19 nt, Homo sapiens
aaagccacuucaaagauug

SEQ ID NO: 692784 - RNA, 19 nt, Homo sapiens
aaaagccacuucaaagauu

SEQ ID NO: 692785 - RNA, 19 nt, Homo sapiens
uuacaacuuugaagagagu

SEQ ID NO: 692786 - RNA, 19 nt, Homo sapiens
aagaagcacgguaugauga

SEQ ID NO: 692787 - RNA, 19 nt, Homo sapiens
gcuagauguuacaccgaaa

SEQ ID NO: 692788 - RNA, 19 nt, Homo sapiens
ugacaacauagaagaaaug

SEQ ID NO: 692789 - RNA, 19 nt, Homo sapiens
aaagaagcacgguaugaug

SEQ ID NO: 692790 - RNA, 19 nt, Homo sapiens
caugccgaccuaacuauaa

SEQ ID NO: 692791 - RNA, 19 nt, Homo sapiens
auacaacuguuccacucaa

SEQ ID NO: 692792 - RNA, 19 nt, Homo sapiens
ugcaagacaugacacaaag

SEQ ID NO: 692793 - RNA, 19 nt, Homo sapiens
uaaaugcaguucugaucac

SEQ ID NO: 692794 - RNA, 19 nt, Homo sapiens
gaacaggacaauggguaca

SEQ ID NO: 692795 - RNA, 19 nt, Homo sapiens
uuucuuaggcgguauaaau

SEQ ID NO: 692796 - RNA, 19 nt, Homo sapiens
gacaacauagaagaaauga

SEQ ID NO: 692797 - RNA, 19 nt, Homo sapiens
ucacuggauuggacugaag

SEQ ID NO: 692798 - RNA, 19 nt, Homo sapiens
agaagaaggagauuggaau

SEQ ID NO: 692799 - RNA, 19 nt, Homo sapiens
uauaaaugcaguucugauc

SEQ ID NO: 692800 - RNA, 19 nt, Homo sapiens
gguacauggagcuacauuu

SEQ ID NO: 692801 - RNA, 19 nt, Homo sapiens
cugcaagacaugacacaaa

SEQ ID NO: 692802 - RNA, 19 nt, Homo sapiens
gauaauggggaaaauagaa

SEQ ID NO: 692803 - RNA, 19 nt, Homo sapiens
gguauaaaugcaguucuga

SEQ ID NO: 692804 - RNA, 19 nt, Homo sapiens
cgguauaaaugcaguucug

SEQ ID NO: 692805 - RNA, 19 nt, Homo sapiens
caugagagggagugaagga

SEQ ID NO: 692806 - RNA, 19 nt, Homo sapiens
gaccuaacuauaauugaca

SEQ ID NO: 692807 - RNA, 19 nt, Homo sapiens
ccuaugauuggauugguuu

SEQ ID NO: 692808 - RNA, 19 nt, Homo sapiens
cuaaagaagaaggagauug

SEQ ID NO: 692809 - RNA, 19 nt, Homo sapiens
guauaaaugcaguucugau

SEQ ID NO: 692810 - RNA, 19 nt, Homo sapiens
gaucacuggauuggacuga

SEQ ID NO: 692811 - RNA, 19 nt, Homo sapiens
uaaaagaagcacgguauga

SEQ ID NO: 692812 - RNA, 19 nt, Homo sapiens
uaaaagccacuucaaagau

SEQ ID NO: 692813 - RNA, 19 nt, Homo sapiens
cauaaaagccacuucaaag

SEQ ID NO: 692814 - RNA, 19 nt, Homo sapiens
acaggacaauggguacaug

SEQ ID NO: 692815 - RNA, 19 nt, Homo sapiens
auaaaugcaguucugauca

SEQ ID NO: 692816 - RNA, 19 nt, Homo sapiens
gccgaccuaacuauaauug

SEQ ID NO: 692817 - RNA, 19 nt, Homo sapiens
aagaagaaggagauuggaa

SEQ ID NO: 692818 - RNA, 19 nt, Homo sapiens
caagacaugacacaaagcu

SEQ ID NO: 692819 - RNA, 19 nt, Homo sapiens
uugaagagaguuucugcaa

SEQ ID NO: 692820 - RNA, 19 nt, Homo sapiens
ccaucaagcuuaauuguuu

SEQ ID NO: 692821 - RNA, 19 nt, Homo sapiens
gcuguuaccuaauuacaaa

SEQ ID NO: 692822 - RNA, 19 nt, Homo sapiens
gcaagaagcgcuuugaagu

SEQ ID NO: 692823 - RNA, 19 nt, Homo sapiens
gaagcgcuuugaagugaaa

SEQ ID NO: 692824 - RNA, 19 nt, Homo sapiens
gggauauugugguugauaa

SEQ ID NO: 692825 - RNA, 19 nt, Homo sapiens
ucaguuugcuguuucugua

SEQ ID NO: 692826 - RNA, 19 nt, Homo sapiens
aagaagcgcuuugaaguga

SEQ ID NO: 692827 - RNA, 19 nt, Homo sapiens
caacagagagugggaauuc

SEQ ID NO: 692828 - RNA, 19 nt, Homo sapiens
cauauuguauucuguguca

SEQ ID NO: 692829 - RNA, 19 nt, Homo sapiens
ggaaccacauuauggaucu

SEQ ID NO: 692830 - RNA, 19 nt, Homo sapiens
gcaggaaccacauuaugga

SEQ ID NO: 692831 - RNA, 19 nt, Homo sapiens
gcauagaaugucaagcuaa

SEQ ID NO: 692832 - RNA, 19 nt, Homo sapiens
caagaagcgcuuugaagug

SEQ ID NO: 692833 - RNA, 19 nt, Homo sapiens
ccugggauauugugguuga

SEQ ID NO: 692834 - RNA, 19 nt, Homo sapiens
cuucuuccaucaagcuuaa

SEQ ID NO: 692835 - RNA, 19 nt, Homo sapiens
guugauaacugugccaucu

SEQ ID NO: 692836 - RNA, 19 nt, Homo sapiens
ggccugggauauugugguu

SEQ ID NO: 692837 - RNA, 19 nt, Homo sapiens
cauagaaugucaagcuaac

SEQ ID NO: 692838 - RNA, 19 nt, Homo sapiens
ucccugcuguuaccuaauu

SEQ ID NO: 692839 - RNA, 19 nt, Homo sapiens
guagccauauuguauucug

SEQ ID NO: 692840 - RNA, 19 nt, Homo sapiens
gaaccacauuauggaucuu

SEQ ID NO: 692841 - RNA, 19 nt, Homo sapiens
uaaccaugcuuuucacuuc

SEQ ID NO: 692842 - RNA, 19 nt, Homo sapiens
ugcauagaaugucaagcua

SEQ ID NO: 692843 - RNA, 19 nt, Homo sapiens
gggcaagaagcgcuuugaa

SEQ ID NO: 692844 - RNA, 19 nt, Homo sapiens
ggcguccgcuacuucagaa

SEQ ID NO: 692845 - RNA, 19 nt, Homo sapiens
ggcaagaagcgcuuugaag

SEQ ID NO: 692846 - RNA, 19 nt, Homo sapiens
uauugugguugauaacugu

SEQ ID NO: 692847 - RNA, 19 nt, Homo sapiens
gccauauuguauucugugu

SEQ ID NO: 692848 - RNA, 19 nt, Homo sapiens
ccucugggccugggauauu

SEQ ID NO: 692849 - RNA, 19 nt, Homo sapiens
gacaacagagagugggaau

SEQ ID NO: 692850 - RNA, 19 nt, Homo sapiens
agaagcgcuuugaagugaa

SEQ ID NO: 692851 - RNA, 19 nt, Homo sapiens
ugucaaauaaaguccaguu

SEQ ID NO: 692852 - RNA, 19 nt, Homo sapiens
gcagcgauggauguggaua

SEQ ID NO: 692853 - RNA, 19 nt, Homo sapiens
ggagaaagcugugccguua

SEQ ID NO: 692854 - RNA, 19 nt, Homo sapiens
ggaaucagcugaacaaaga

SEQ ID NO: 692855 - RNA, 19 nt, Homo sapiens
gaaagagucuguacaguug

SEQ ID NO: 692856 - RNA, 19 nt, Homo sapiens
ggacagacauccauaguug

SEQ ID NO: 692857 - RNA, 19 nt, Homo sapiens
gaacaagccuauuuccauu

SEQ ID NO: 692858 - RNA, 19 nt, Homo sapiens
ccagaagccuugcuaaaua

SEQ ID NO: 692859 - RNA, 19 nt, Homo sapiens
gcaaagaaauaaucuggaa

SEQ ID NO: 692860 - RNA, 19 nt, Homo sapiens
guggagaacuugaucaaua

SEQ ID NO: 692861 - RNA, 19 nt, Homo sapiens
gcagaaaccuggaagugaa

SEQ ID NO: 692862 - RNA, 19 nt, Homo sapiens
gaaauaaucuggaaaucgu

SEQ ID NO: 692863 - RNA, 19 nt, Homo sapiens
gaagaaagaaggcaggaua

SEQ ID NO: 692864 - RNA, 19 nt, Homo sapiens
cacaaucgcuccuuugaua

SEQ ID NO: 692865 - RNA, 19 nt, Homo sapiens
gaauaucuccucaacauuu

SEQ ID NO: 692866 - RNA, 19 nt, Homo sapiens
gaaagucauugcagagaaa

SEQ ID NO: 692867 - RNA, 19 nt, Homo sapiens
ucacacagcuugaagaaga

SEQ ID NO: 692868 - RNA, 19 nt, Homo sapiens
gcagagcaguucuuugaaa

SEQ ID NO: 692869 - RNA, 19 nt, Homo sapiens
gcaagugcaucccagcuaa

SEQ ID NO: 692870 - RNA, 19 nt, Homo sapiens
gaucucauaucuucacuug

SEQ ID NO: 692871 - RNA, 19 nt, Homo sapiens
gcucuuaaaugauuacaga

SEQ ID NO: 692872 - RNA, 19 nt, Homo sapiens
ggacaugguuuaucgaagu

SEQ ID NO: 692873 - RNA, 19 nt, Homo sapiens
gcacgagggucuccauuca

SEQ ID NO: 692874 - RNA, 19 nt, Homo sapiens
gcucacaccuguaaucuca

SEQ ID NO: 692875 - RNA, 19 nt, Homo sapiens
gagaagcaccaacaaagua

SEQ ID NO: 692876 - RNA, 19 nt, Homo sapiens
gaacucggccgaugacuug

SEQ ID NO: 692877 - RNA, 19 nt, Homo sapiens
gggcggaucucauaucuuc

SEQ ID NO: 692878 - RNA, 19 nt, Homo sapiens
aggaagagcugcccuacua

SEQ ID NO: 692879 - RNA, 19 nt, Homo sapiens
gcucugaucuuaaacuuag

SEQ ID NO: 692880 - RNA, 19 nt, Homo sapiens
gcccuuggcucugaucuua

SEQ ID NO: 692881 - RNA, 19 nt, Homo sapiens
caggagcucuuaaaugauu

SEQ ID NO: 692882 - RNA, 19 nt, Homo sapiens
agaaggagcccgagaagua

SEQ ID NO: 692883 - RNA, 19 nt, Homo sapiens
ggaagaaugcaucgaauau

SEQ ID NO: 692884 - RNA, 19 nt, Homo sapiens
gagcaaaccagcuggcuaa

SEQ ID NO: 692885 - RNA, 19 nt, Homo sapiens
ggacucaaauguucuugug

SEQ ID NO: 692886 - RNA, 19 nt, Homo sapiens
gaagagggcuccgagaucu

SEQ ID NO: 692887 - RNA, 19 nt, Homo sapiens
caauaauggucucugaauu

SEQ ID NO: 692888 - RNA, 19 nt, Homo sapiens
uaacgaccauuagucauuu

SEQ ID NO: 692889 - RNA, 19 nt, Homo sapiens
cuacuacccuugcuauuug

SEQ ID NO: 692890 - RNA, 19 nt, Homo sapiens
aagaaugcaucgaauauga

SEQ ID NO: 692891 - RNA, 19 nt, Homo sapiens
uuacuaggcucagacauaa

SEQ ID NO: 692892 - RNA, 19 nt, Homo sapiens
agaaagccaugcuguuaaa

SEQ ID NO: 692893 - RNA, 19 nt, Homo sapiens
caaaccagcuggcuaagca

SEQ ID NO: 692894 - RNA, 19 nt, Homo sapiens
gcagagagcccugaacuuc

SEQ ID NO: 692895 - RNA, 19 nt, Homo sapiens
gugcaaaguucaggaguuu

SEQ ID NO: 692896 - RNA, 19 nt, Homo sapiens
uggaagcucuguuuagauu

SEQ ID NO: 692897 - RNA, 19 nt, Homo sapiens
agcaggagcucuuaaauga

SEQ ID NO: 692898 - RNA, 19 nt, Homo sapiens
gagagaauauguuuaaucc

SEQ ID NO: 692899 - RNA, 19 nt, Homo sapiens
gaacuuuucuucacuguug

SEQ ID NO: 692900 - RNA, 19 nt, Homo sapiens
gcuggaagcucuguuuaga

SEQ ID NO: 692901 - RNA, 19 nt, Homo sapiens
ggaaacaaaggcagugauu

SEQ ID NO: 692902 - RNA, 19 nt, Homo sapiens
cagaagccuugcuaaauau

SEQ ID NO: 692903 - RNA, 19 nt, Homo sapiens
aagaauaucuccucaacau

SEQ ID NO: 692904 - RNA, 19 nt, Homo sapiens
ccagggauauugaaaguca

SEQ ID NO: 692905 - RNA, 19 nt, Homo sapiens
gcugauaacuucucuaagc

SEQ ID NO: 692906 - RNA, 19 nt, Homo sapiens
gagaugcccuuggcucuga

SEQ ID NO: 692907 - RNA, 19 nt, Homo sapiens
guaccagccuugcaagaga

SEQ ID NO: 692908 - RNA, 19 nt, Homo sapiens
uaagauggauccagaagag

SEQ ID NO: 692909 - RNA, 19 nt, Homo sapiens
cauggaggccuuaaguuua

SEQ ID NO: 692910 - RNA, 19 nt, Homo sapiens
gaguggaaauucgcugaua

SEQ ID NO: 692911 - RNA, 19 nt, Homo sapiens
ugaaugggcggaucucaua

SEQ ID NO: 692912 - RNA, 19 nt, Homo sapiens
caaauguucuugugcaaag

SEQ ID NO: 692913 - RNA, 19 nt, Homo sapiens
gaugagaucaccaugaaga

SEQ ID NO: 692914 - RNA, 19 nt, Homo sapiens
uauaagagcucuggacaca

SEQ ID NO: 692915 - RNA, 19 nt, Homo sapiens
agaaaugccucugagauug

SEQ ID NO: 692916 - RNA, 19 nt, Homo sapiens
gaagugaugagaaggagaa

SEQ ID NO: 692917 - RNA, 19 nt, Homo sapiens
ccucuuccguuuacuuuaa

SEQ ID NO: 692918 - RNA, 19 nt, Homo sapiens
gugaacucaucuuguauuu

SEQ ID NO: 692919 - RNA, 19 nt, Homo sapiens
gaccauggcugcaggugau

SEQ ID NO: 692920 - RNA, 19 nt, Homo sapiens
aagcuacucuucagugauu

SEQ ID NO: 692921 - RNA, 19 nt, Homo sapiens
uaaaagcucuggaaaccua

SEQ ID NO: 692922 - RNA, 19 nt, Homo sapiens
gaaagaaggcaggauagug

SEQ ID NO: 692923 - RNA, 19 nt, Homo sapiens
uaaaacaacuggaagaaug

SEQ ID NO: 692924 - RNA, 19 nt, Homo sapiens
gacaagaugccauuauuuc

SEQ ID NO: 692925 - RNA, 19 nt, Homo sapiens
caaaguaaacagaacgaaa

SEQ ID NO: 692926 - RNA, 19 nt, Homo sapiens
ugaaggagguggugaagag

SEQ ID NO: 692927 - RNA, 19 nt, Homo sapiens
aaaccaacccuaaggaauu

SEQ ID NO: 692928 - RNA, 19 nt, Homo sapiens
gagcuaaucgccaacuuug

SEQ ID NO: 692929 - RNA, 19 nt, Homo sapiens
ggaauuuguuucucgaagu

SEQ ID NO: 692930 - RNA, 19 nt, Homo sapiens
aagauuagcucaguguuug

SEQ ID NO: 692931 - RNA, 19 nt, Homo sapiens
cauaguugcugcucagaug

SEQ ID NO: 692932 - RNA, 19 nt, Homo sapiens
gacagacaaucucagaguu

SEQ ID NO: 692933 - RNA, 19 nt, Homo sapiens
caagaacgccugacagaca

SEQ ID NO: 692934 - RNA, 19 nt, Homo sapiens
ugaaagagucuguacaguu

SEQ ID NO: 692935 - RNA, 19 nt, Homo sapiens
gagcugccucgaacuguua

SEQ ID NO: 692936 - RNA, 19 nt, Homo sapiens
cgaguaacaucucacaauc

SEQ ID NO: 692937 - RNA, 19 nt, Homo sapiens
gagaaugggauguugagaa

SEQ ID NO: 692938 - RNA, 19 nt, Homo sapiens
ggacauggaggccuuaagu

SEQ ID NO: 692939 - RNA, 19 nt, Homo sapiens
ggguuuggcugagauauug

SEQ ID NO: 692940 - RNA, 19 nt, Homo sapiens
ccaaggaucuuuuaguuga

SEQ ID NO: 692941 - RNA, 19 nt, Homo sapiens
guacagcugcggguuauuu

SEQ ID NO: 692942 - RNA, 19 nt, Homo sapiens
ccuguaaucucagcacuuu

SEQ ID NO: 692943 - RNA, 19 nt, Homo sapiens
cccaggaacuccauucuug

SEQ ID NO: 692944 - RNA, 19 nt, Homo sapiens
ggaaagggacgacguuugg

SEQ ID NO: 692945 - RNA, 19 nt, Homo sapiens
augcauaccugaagccuuu

SEQ ID NO: 692946 - RNA, 19 nt, Homo sapiens
gauauugcaucagaaguuc

SEQ ID NO: 692947 - RNA, 19 nt, Homo sapiens
gcuggaggcugugcucaaa

SEQ ID NO: 692948 - RNA, 19 nt, Homo sapiens
gaagcucuguuuagauuuu

SEQ ID NO: 692949 - RNA, 19 nt, Homo sapiens
ugaaagucauugcagagaa

SEQ ID NO: 692950 - RNA, 19 nt, Homo sapiens
gacuuucucugggauuaua

SEQ ID NO: 692951 - RNA, 19 nt, Homo sapiens
guuacuaggcucagacaua

SEQ ID NO: 692952 - RNA, 19 nt, Homo sapiens
aauggucucugaauugauu

SEQ ID NO: 692953 - RNA, 19 nt, Homo sapiens
uaagagaugucaugucgua

SEQ ID NO: 692954 - RNA, 19 nt, Homo sapiens
cgaacuuucugcugaauua

SEQ ID NO: 692955 - RNA, 19 nt, Homo sapiens
gccuaaagcucaaggauga

SEQ ID NO: 692956 - RNA, 19 nt, Homo sapiens
ugaaugagccagagugaua

SEQ ID NO: 692957 - RNA, 19 nt, Homo sapiens
gcacucaauuggaccauga

SEQ ID NO: 692958 - RNA, 19 nt, Homo sapiens
gaaacaaguugcccggaau

SEQ ID NO: 692959 - RNA, 19 nt, Homo sapiens
gggcaucucucucaagguu

SEQ ID NO: 692960 - RNA, 19 nt, Homo sapiens
gcaaaguggucucagaaca

SEQ ID NO: 692961 - RNA, 19 nt, Homo sapiens
gaauggacuucacagcaaa

SEQ ID NO: 692962 - RNA, 19 nt, Homo sapiens
caccaaagcucccgagugu

SEQ ID NO: 692963 - RNA, 19 nt, Homo sapiens
caacgaacuuucugcugaa

SEQ ID NO: 692964 - RNA, 19 nt, Homo sapiens
cuagucagcuccacucuau

SEQ ID NO: 692965 - RNA, 19 nt, Homo sapiens
aauccaaccucaugccuaa

SEQ ID NO: 692966 - RNA, 19 nt, Homo sapiens
gagccagagugauaauuuc

SEQ ID NO: 692967 - RNA, 19 nt, Homo sapiens
ggagcucucucugcacauu

SEQ ID NO: 692968 - RNA, 19 nt, Homo sapiens
gagagucuauuggaaacaa

SEQ ID NO: 692969 - RNA, 19 nt, Homo sapiens
aaaguggucucagaacaaa

SEQ ID NO: 692970 - RNA, 19 nt, Homo sapiens
gcaggacacgucaugcuaa

SEQ ID NO: 692971 - RNA, 19 nt, Homo sapiens
gaacuuuugugcuuaguga

SEQ ID NO: 692972 - RNA, 19 nt, Homo sapiens
agaauggacuucacagcaa

SEQ ID NO: 692973 - RNA, 19 nt, Homo sapiens
ugagugcaacgaaauauuu

SEQ ID NO: 692974 - RNA, 19 nt, Homo sapiens
gaugagagagucuauugga

SEQ ID NO: 692975 - RNA, 19 nt, Homo sapiens
gagugcaacgaaauauuua

SEQ ID NO: 692976 - RNA, 19 nt, Homo sapiens
gagaugucaugucguaagu

SEQ ID NO: 692977 - RNA, 19 nt, Homo sapiens
gagagagucuauuggaaac

SEQ ID NO: 692978 - RNA, 19 nt, Homo sapiens
caaaguggucucagaacaa

SEQ ID NO: 692979 - RNA, 19 nt, Homo sapiens
gaaugagccagagugauaa

SEQ ID NO: 692980 - RNA, 19 nt, Homo sapiens
ccaaagcucccgagugugu

SEQ ID NO: 692981 - RNA, 19 nt, Homo sapiens
ugagagagucuauuggaaa

SEQ ID NO: 692982 - RNA, 19 nt, Homo sapiens
ggaagacugcccuggaguu

SEQ ID NO: 692983 - RNA, 19 nt, Homo sapiens
acacaaagcccaggaagga

SEQ ID NO: 692984 - RNA, 19 nt, Homo sapiens
gaggagggcaucucucuca

SEQ ID NO: 692985 - RNA, 19 nt, Homo sapiens
acacccagauuaagcagaa

SEQ ID NO: 692986 - RNA, 19 nt, Homo sapiens
ugucguaagucccucugua

SEQ ID NO: 692987 - RNA, 19 nt, Homo sapiens
cuuuaaagcucucuacagu

SEQ ID NO: 692988 - RNA, 19 nt, Homo sapiens
agaauccagucuuaagcua

SEQ ID NO: 692989 - RNA, 19 nt, Homo sapiens
cuaaugaggucaaaagaga

SEQ ID NO: 692990 - RNA, 19 nt, Homo sapiens
gcacauucuuccucagcau

SEQ ID NO: 692991 - RNA, 19 nt, Homo sapiens
ggaguucuguggagagacu

SEQ ID NO: 692992 - RNA, 19 nt, Homo sapiens
guaagucccucuguauacu

SEQ ID NO: 692993 - RNA, 19 nt, Homo sapiens
uuuccagaauccagucuua

SEQ ID NO: 692994 - RNA, 19 nt, Homo sapiens
gaacuuucugcugaauuaa

SEQ ID NO: 692995 - RNA, 19 nt, Homo sapiens
ccagagugauaauuucagu

SEQ ID NO: 692996 - RNA, 19 nt, Homo sapiens
ugagccagagugauaauuu

SEQ ID NO: 692997 - RNA, 19 nt, Homo sapiens
gaagacugcccuggaguuc

SEQ ID NO: 692998 - RNA, 19 nt, Homo sapiens
cagcaaaguggucucagaa

SEQ ID NO: 692999 - RNA, 19 nt, Homo sapiens
agucagcuccacucuauuu

SEQ ID NO: 693000 - RNA, 19 nt, Homo sapiens
aaaccagagugugcagaaa

SEQ ID NO: 693001 - RNA, 19 nt, Homo sapiens
ccaaagaccaagccaacug

SEQ ID NO: 693002 - RNA, 19 nt, Homo sapiens
acagcaaaguggucucaga

SEQ ID NO: 693003 - RNA, 19 nt, Homo sapiens
gcaacacccagauuaagca

SEQ ID NO: 693004 - RNA, 19 nt, Homo sapiens
caggacacgucaugcuaau

SEQ ID NO: 693005 - RNA, 19 nt, Homo sapiens
agacugcccuggaguucug

SEQ ID NO: 693006 - RNA, 19 nt, Homo sapiens
ccucaugccuaaagcucaa

SEQ ID NO: 693007 - RNA, 19 nt, Homo sapiens
cuuagugagugcaacgaaa

SEQ ID NO: 693008 - RNA, 19 nt, Homo sapiens
gucccucuguauacuuuaa

SEQ ID NO: 693009 - RNA, 19 nt, Homo sapiens
ggaacacaaagcccaggaa

SEQ ID NO: 693010 - RNA, 19 nt, Homo sapiens
ucugcugaauuaaugguaa

SEQ ID NO: 693011 - RNA, 19 nt, Homo sapiens
agugauaauuucagugcaa

SEQ ID NO: 693012 - RNA, 19 nt, Homo sapiens
gcugaaugagccagaguga

SEQ ID NO: 693013 - RNA, 19 nt, Homo sapiens
gcuagucagcuccacucua

SEQ ID NO: 693014 - RNA, 19 nt, Homo sapiens
uaauaaaacucuggguguu

SEQ ID NO: 693015 - RNA, 19 nt, Homo sapiens
gauaauuucagugcaacga

SEQ ID NO: 693016 - RNA, 19 nt, Homo sapiens
ucguaagucccucuguaua

SEQ ID NO: 693017 - RNA, 19 nt, Homo sapiens
ggacccagauauggcaaac

SEQ ID NO: 693018 - RNA, 19 nt, Homo sapiens
gggcaacacccagauuaag

SEQ ID NO: 693019 - RNA, 19 nt, Homo sapiens
gugagugcaacgaaauauu

SEQ ID NO: 693020 - RNA, 19 nt, Homo sapiens
gaccauggccaccaaagcu

SEQ ID NO: 693021 - RNA, 19 nt, Homo sapiens
caaagcccaggaaggagaa

SEQ ID NO: 693022 - RNA, 19 nt, Homo sapiens
cuguagauauuccaagaca

SEQ ID NO: 693023 - RNA, 19 nt, Homo sapiens
gcaggaggagggcaucucu

SEQ ID NO: 693024 - RNA, 19 nt, Homo sapiens
cgggaacaaaggcaaguuu

SEQ ID NO: 693025 - RNA, 19 nt, Homo sapiens
aauccagucuuaagcuagu

SEQ ID NO: 693026 - RNA, 19 nt, Homo sapiens
aggaugagagagucuauug

SEQ ID NO: 693027 - RNA, 19 nt, Homo sapiens
aaggcaaguuugucaccaa

SEQ ID NO: 693028 - RNA, 19 nt, Homo sapiens
cguaagucccucuguauac

SEQ ID NO: 693029 - RNA, 19 nt, Homo sapiens
cacauucuuccucagcaua

SEQ ID NO: 693030 - RNA, 19 nt, Homo sapiens
gagugugcagaaaggauuu

SEQ ID NO: 693031 - RNA, 19 nt, Homo sapiens
caaggaugagagagucuau

SEQ ID NO: 693032 - RNA, 19 nt, Homo sapiens
gaauuuuccugugucuuug

SEQ ID NO: 693033 - RNA, 19 nt, Homo sapiens
uagugagugcaacgaaaua

SEQ ID NO: 693034 - RNA, 19 nt, Homo sapiens
augagagagucuauuggaa

SEQ ID NO: 693035 - RNA, 19 nt, Homo sapiens
ugaauuuuccugugucuuu

SEQ ID NO: 693036 - RNA, 19 nt, Homo sapiens
acuuucugcugaauuaaug

SEQ ID NO: 693037 - RNA, 19 nt, Homo sapiens
cagcugcagccaugaagau

SEQ ID NO: 693038 - RNA, 19 nt, Homo sapiens
gcuuuuguguuuuggaauu

SEQ ID NO: 693039 - RNA, 19 nt, Homo sapiens
gaaaucaggucuuaacuug

SEQ ID NO: 693040 - RNA, 19 nt, Homo sapiens
gauaagagguccacugguu

SEQ ID NO: 693041 - RNA, 19 nt, Homo sapiens
gaauaagucuggauuaagu

SEQ ID NO: 693042 - RNA, 19 nt, Homo sapiens
gcaaugaucuccuaagaag

SEQ ID NO: 693043 - RNA, 19 nt, Homo sapiens
gaugguagagcauauauua

SEQ ID NO: 693044 - RNA, 19 nt, Homo sapiens
gaggagaacauguauauuu

SEQ ID NO: 693045 - RNA, 19 nt, Homo sapiens
ggagagcccugaaacuauu

SEQ ID NO: 693046 - RNA, 19 nt, Homo sapiens
cagaaagucuaacuaauga

SEQ ID NO: 693047 - RNA, 19 nt, Homo sapiens
gggaguaacugaagguauu

SEQ ID NO: 693048 - RNA, 19 nt, Homo sapiens
gaagcacacugaagauaga

SEQ ID NO: 693049 - RNA, 19 nt, Homo sapiens
gcagaaagucuaacuaaug

SEQ ID NO: 693050 - RNA, 19 nt, Homo sapiens
uaauaaagcuagccaagga

SEQ ID NO: 693051 - RNA, 19 nt, Homo sapiens
gggaacacaugcccacuuu

SEQ ID NO: 693052 - RNA, 19 nt, Homo sapiens
uaacaaggcuuuggaaucu

SEQ ID NO: 693053 - RNA, 19 nt, Homo sapiens
gugaaaagcugauggauuu

SEQ ID NO: 693054 - RNA, 19 nt, Homo sapiens
gcaaugcuaugagaagauu

SEQ ID NO: 693055 - RNA, 19 nt, Homo sapiens
gaaaugaaagacucagaaa

SEQ ID NO: 693056 - RNA, 19 nt, Homo sapiens
gcuauuauuucucuugcua

SEQ ID NO: 693057 - RNA, 19 nt, Homo sapiens
gaaaugaggaguuaacaag

SEQ ID NO: 693058 - RNA, 19 nt, Homo sapiens
gaacagcacccgaggacuu

SEQ ID NO: 693059 - RNA, 19 nt, Homo sapiens
gaaagaacaucagauacca

SEQ ID NO: 693060 - RNA, 19 nt, Homo sapiens
gaaauuaggcagauugagu

SEQ ID NO: 693061 - RNA, 19 nt, Homo sapiens
uaagugaccuugcagaaag

SEQ ID NO: 693062 - RNA, 19 nt, Homo sapiens
caaccaaccagcaguuuaa

SEQ ID NO: 693063 - RNA, 19 nt, Homo sapiens
gacgggaaaugaggaguua

SEQ ID NO: 693064 - RNA, 19 nt, Homo sapiens
ggaagauaaugaugcucua

SEQ ID NO: 693065 - RNA, 19 nt, Homo sapiens
ccaacaacgugcucuauuc

SEQ ID NO: 693066 - RNA, 19 nt, Homo sapiens
ucuggucacuucaggauua

SEQ ID NO: 693067 - RNA, 19 nt, Homo sapiens
gaccaagcuuucagaggua

SEQ ID NO: 693068 - RNA, 19 nt, Homo sapiens
caaagaugguagagcauau

SEQ ID NO: 693069 - RNA, 19 nt, Homo sapiens
ggaaaugaaagacucagaa

SEQ ID NO: 693070 - RNA, 19 nt, Homo sapiens
gaugagcaaucacuuugga

SEQ ID NO: 693071 - RNA, 19 nt, Homo sapiens
gcugauggauuuacaacug

SEQ ID NO: 693072 - RNA, 19 nt, Homo sapiens
gauucuggcucccuacuug

SEQ ID NO: 693073 - RNA, 19 nt, Homo sapiens
ggaugaagaugaggaagau

SEQ ID NO: 693074 - RNA, 19 nt, Homo sapiens
uaccaaaccuacgagaaua

SEQ ID NO: 693075 - RNA, 19 nt, Homo sapiens
gugcaaugaucuccuaaga

SEQ ID NO: 693076 - RNA, 19 nt, Homo sapiens
ggugaacaauggaagauuc

SEQ ID NO: 693077 - RNA, 19 nt, Homo sapiens
aaagcuagccaaggaauua

SEQ ID NO: 693078 - RNA, 19 nt, Homo sapiens
gcucuauuccaauugauua

SEQ ID NO: 693079 - RNA, 19 nt, Homo sapiens
ucagagguauucuagaaga

SEQ ID NO: 693080 - RNA, 19 nt, Homo sapiens
gaacacaugcccacuuugg

SEQ ID NO: 693081 - RNA, 19 nt, Homo sapiens
aggaauggauguagaagaa

SEQ ID NO: 693082 - RNA, 19 nt, Homo sapiens
gaagauagagaagaaggaa

SEQ ID NO: 693083 - RNA, 19 nt, Homo sapiens
cugaauaagucuggauuaa

SEQ ID NO: 693084 - RNA, 19 nt, Homo sapiens
ccagagaggccuugaacaa

SEQ ID NO: 693085 - RNA, 19 nt, Homo sapiens
gaauauaaggcuaugaaca

SEQ ID NO: 693086 - RNA, 19 nt, Homo sapiens
uuucagagguauucuagaa

SEQ ID NO: 693087 - RNA, 19 nt, Homo sapiens
uauggaagccuguaaauca

SEQ ID NO: 693088 - RNA, 19 nt, Homo sapiens
acaaggcuuuggaaucuuu

SEQ ID NO: 693089 - RNA, 19 nt, Homo sapiens
gaaagucuaacuaaugaca

SEQ ID NO: 693090 - RNA, 19 nt, Homo sapiens
uguaacaggagaacaaaua

SEQ ID NO: 693091 - RNA, 19 nt, Homo sapiens
gagaggccuugaacaacaa

SEQ ID NO: 693092 - RNA, 19 nt, Homo sapiens
ggaacccugugcaaugcua

SEQ ID NO: 693093 - RNA, 19 nt, Homo sapiens
uuaaugcacugaauaaguc

SEQ ID NO: 693094 - RNA, 19 nt, Homo sapiens
gaaagacucagaaauuagg

SEQ ID NO: 693095 - RNA, 19 nt, Homo sapiens
ccaacaagcugggugaaca

SEQ ID NO: 693096 - RNA, 19 nt, Homo sapiens
aaaugaaaguccugauguu

SEQ ID NO: 693097 - RNA, 19 nt, Homo sapiens
ggauugaagauacuacaaa

SEQ ID NO: 693098 - RNA, 19 nt, Homo sapiens
gacacauccuguugcagua

SEQ ID NO: 693099 - RNA, 19 nt, Homo sapiens
cuacguaugugcaaugauc

SEQ ID NO: 693100 - RNA, 19 nt, Homo sapiens
uuaggcagauugaguguga

SEQ ID NO: 693101 - RNA, 19 nt, Homo sapiens
uggaaucuuugcccugaua

SEQ ID NO: 693102 - RNA, 19 nt, Homo sapiens
gaaagaaagaacaucagau

SEQ ID NO: 693103 - RNA, 19 nt, Homo sapiens
caagcugggugaacaaugg

SEQ ID NO: 693104 - RNA, 19 nt, Homo sapiens
ggacgcgguuuacgaaguc

SEQ ID NO: 693105 - RNA, 19 nt, Homo sapiens
ggaaaugaggaguuaacaa

SEQ ID NO: 693106 - RNA, 19 nt, Homo sapiens
gaagaaguuuuagcuguuu

SEQ ID NO: 693107 - RNA, 19 nt, Homo sapiens
gauaaugaugcucuacuga

SEQ ID NO: 693108 - RNA, 19 nt, Homo sapiens
auaaggcuaugaacaauuc

SEQ ID NO: 693109 - RNA, 19 nt, Homo sapiens
caauacaaaugagcaggaa

SEQ ID NO: 693110 - RNA, 19 nt, Homo sapiens
gacaaugagacaaauaguu

SEQ ID NO: 693111 - RNA, 19 nt, Homo sapiens
gugaagacaugaagaugag

SEQ ID NO: 693112 - RNA, 19 nt, Homo sapiens
agagaggccuugaacaaca

SEQ ID NO: 693113 - RNA, 19 nt, Homo sapiens
cgaaaugggagaugaggaa

SEQ ID NO: 693114 - RNA, 19 nt, Homo sapiens
gaagaaggaauggauguag

SEQ ID NO: 693115 - RNA, 19 nt, Homo sapiens
caagcagcauuugauaaga

SEQ ID NO: 693116 - RNA, 19 nt, Homo sapiens
ccaaccaaccagcaguuua

SEQ ID NO: 693117 - RNA, 19 nt, Homo sapiens
aaaugaagguugcccaagu

SEQ ID NO: 693118 - RNA, 19 nt, Homo sapiens
acaugaagaugagagcuaa

SEQ ID NO: 693119 - RNA, 19 nt, Homo sapiens
cuaaugacaaugagacaaa

SEQ ID NO: 693120 - RNA, 19 nt, Homo sapiens
uaaugaugcucuacugaag

SEQ ID NO: 693121 - RNA, 19 nt, Homo sapiens
ggaauuaccgccuccuucu

SEQ ID NO: 693122 - RNA, 19 nt, Homo sapiens
ucaaagaugguagagcaua

SEQ ID NO: 693123 - RNA, 19 nt, Homo sapiens
cagaagcacacugaagaua

SEQ ID NO: 693124 - RNA, 19 nt, Homo sapiens
aaucaggucuuaacuugca

SEQ ID NO: 693125 - RNA, 19 nt, Homo sapiens
aaugaagguugcccaaguu

SEQ ID NO: 693126 - RNA, 19 nt, Homo sapiens
guaacugaagguauuugua

SEQ ID NO: 693127 - RNA, 19 nt, Homo sapiens
gagaagaaggaauggaugu

SEQ ID NO: 693128 - RNA, 19 nt, Homo sapiens
gcacacugaagauagagaa

SEQ ID NO: 693129 - RNA, 19 nt, Homo sapiens
ugagacaaauaguuagcuu

SEQ ID NO: 693130 - RNA, 19 nt, Homo sapiens
gguagagcauauauuaaac

SEQ ID NO: 693131 - RNA, 19 nt, Homo sapiens
uaacuuucgucgacacauc

SEQ ID NO: 693132 - RNA, 19 nt, Homo sapiens
aaauguugcuacuuggaaa

SEQ ID NO: 693133 - RNA, 19 nt, Homo sapiens
aagaaggaauggauguaga

SEQ ID NO: 693134 - RNA, 19 nt, Homo sapiens
uaugugcaaugaucuccua

SEQ ID NO: 693135 - RNA, 19 nt, Homo sapiens
ccaagcagcauuugauaag

SEQ ID NO: 693136 - RNA, 19 nt, Homo sapiens
caagagggaguucaugcaa

SEQ ID NO: 693137 - RNA, 19 nt, Homo sapiens
gacaugaagaugagagcua

SEQ ID NO: 693138 - RNA, 19 nt, Homo sapiens
gauugagugugacagugaa

SEQ ID NO: 693139 - RNA, 19 nt, Homo sapiens
gaagcuaucuuguuagaaa

SEQ ID NO: 693140 - RNA, 19 nt, Homo sapiens
gaauagauauggagacuga

SEQ ID NO: 693141 - RNA, 19 nt, Homo sapiens
uuacaaagcugccaggaaa

SEQ ID NO: 693142 - RNA, 19 nt, Homo sapiens
gccagaagcuccugcauug

SEQ ID NO: 693143 - RNA, 19 nt, Homo sapiens
gaagagaucccuccugaag

SEQ ID NO: 693144 - RNA, 19 nt, Homo sapiens
ggaauucugugcccuaaag

SEQ ID NO: 693145 - RNA, 19 nt, Homo sapiens
gagggacaauguucuacua

SEQ ID NO: 693146 - RNA, 19 nt, Homo sapiens
gaggagaagucccgcauca

SEQ ID NO: 693147 - RNA, 19 nt, Homo sapiens
gaggaaaggagaaagauug

SEQ ID NO: 693148 - RNA, 19 nt, Homo sapiens
agagaucccuccugaaguu

SEQ ID NO: 693149 - RNA, 19 nt, Homo sapiens
cugcuuaccucauuucuga

SEQ ID NO: 693150 - RNA, 19 nt, Homo sapiens
gcgaauaccugagggugaa

SEQ ID NO: 693151 - RNA, 19 nt, Homo sapiens
ucucagagcuauuguucaa

SEQ ID NO: 693152 - RNA, 19 nt, Homo sapiens
cugcagauccgaauagaua

SEQ ID NO: 693153 - RNA, 19 nt, Homo sapiens
gaaaggagaaagauugaag

SEQ ID NO: 693154 - RNA, 19 nt, Homo sapiens
ggacauccagcacaucuug

SEQ ID NO: 693155 - RNA, 19 nt, Homo sapiens
ggacaauguucuacuaucc

SEQ ID NO: 693156 - RNA, 19 nt, Homo sapiens
ggaaaccggccacuucuag

SEQ ID NO: 693157 - RNA, 19 nt, Homo sapiens
cacuggagcugcaggcuaa

SEQ ID NO: 693158 - RNA, 19 nt, Homo sapiens
gaucgcagaggaagaagaa

SEQ ID NO: 693159 - RNA, 19 nt, Homo sapiens
gcucucagcgcaacagauu

SEQ ID NO: 693160 - RNA, 19 nt, Homo sapiens
acccagaagucucaaguuu

SEQ ID NO: 693161 - RNA, 19 nt, Homo sapiens
agauugaaguuccaaguga

SEQ ID NO: 693162 - RNA, 19 nt, Homo sapiens
agagagaguugaagagauc

SEQ ID NO: 693163 - RNA, 19 nt, Homo sapiens
ccuaaagaauuccgacuca

SEQ ID NO: 693164 - RNA, 19 nt, Homo sapiens
ccuagaagaugcuccagau

SEQ ID NO: 693165 - RNA, 19 nt, Homo sapiens
gagggugaauguggugaaa

SEQ ID NO: 693166 - RNA, 19 nt, Homo sapiens
uaaagaauuccgacucaga

SEQ ID NO: 693167 - RNA, 19 nt, Homo sapiens
ggaggaaaggagaaagauu

SEQ ID NO: 693168 - RNA, 19 nt, Homo sapiens
gagaaagauugaaguucca

SEQ ID NO: 693169 - RNA, 19 nt, Homo sapiens
gggacaauguucuacuauc

SEQ ID NO: 693170 - RNA, 19 nt, Homo sapiens
aaaccggccacuucuagua

SEQ ID NO: 693171 - RNA, 19 nt, Homo sapiens
ccaggaaaccggccacuuc

SEQ ID NO: 693172 - RNA, 19 nt, Homo sapiens
uaacagggagcccgacuuc

SEQ ID NO: 693173 - RNA, 19 nt, Homo sapiens
uauggugucuuuagagauc

SEQ ID NO: 693174 - RNA, 19 nt, Homo sapiens
ggacaaggagacucagauc

SEQ ID NO: 693175 - RNA, 19 nt, Homo sapiens
cugcagagguggaaggaau

SEQ ID NO: 693176 - RNA, 19 nt, Homo sapiens
gauggagacccuagaagau

SEQ ID NO: 693177 - RNA, 19 nt, Homo sapiens
guuagaguccauuuacaaa

SEQ ID NO: 693178 - RNA, 19 nt, Homo sapiens
gguuagaguccauuuacaa

SEQ ID NO: 693179 - RNA, 19 nt, Homo sapiens
gaggaggaaaggagaaaga

SEQ ID NO: 693180 - RNA, 19 nt, Homo sapiens
gaaguuccaagugagauug

SEQ ID NO: 693181 - RNA, 19 nt, Homo sapiens
gcgaucuaguccugcagua

SEQ ID NO: 693182 - RNA, 19 nt, Homo sapiens
cagagagaguugaagagau

SEQ ID NO: 693183 - RNA, 19 nt, Homo sapiens
ccagagggacaauguucua

SEQ ID NO: 693184 - RNA, 19 nt, Homo sapiens
gaacggggaucugguggaa

SEQ ID NO: 693185 - RNA, 19 nt, Homo sapiens
ccgcgucuauucucaacaa

SEQ ID NO: 693186 - RNA, 19 nt, Homo sapiens
gaccagagggacaauguuc

SEQ ID NO: 693187 - RNA, 19 nt, Homo sapiens
gguccugcuuaccucauuu

SEQ ID NO: 693188 - RNA, 19 nt, Homo sapiens
gagguuagaguccauuuac

SEQ ID NO: 693189 - RNA, 19 nt, Homo sapiens
ccauggagaugccuuuggu

SEQ ID NO: 693190 - RNA, 19 nt, Homo sapiens
uacggaugcuggagauuga

SEQ ID NO: 693191 - RNA, 19 nt, Homo sapiens
ucagauucgacaccucuua

SEQ ID NO: 693192 - RNA, 19 nt, Homo sapiens
gcugaucgcagaggaagaa

SEQ ID NO: 693193 - RNA, 19 nt, Homo sapiens
ccagagagaguugaagaga

SEQ ID NO: 693194 - RNA, 19 nt, Homo sapiens
gcagauccgaauagauaug

SEQ ID NO: 693195 - RNA, 19 nt, Homo sapiens
cuuauggugucuuuagaga

SEQ ID NO: 693196 - RNA, 19 nt, Homo sapiens
ccucaucccaccagaagaa

SEQ ID NO: 693197 - RNA, 19 nt, Homo sapiens
cuuuagagaucucccuaga

SEQ ID NO: 693198 - RNA, 19 nt, Homo sapiens
gcccaucuccugcgucuca

SEQ ID NO: 693199 - RNA, 19 nt, Homo sapiens
ggaaaggagaaagauugaa

SEQ ID NO: 693200 - RNA, 19 nt, Homo sapiens
ucugugcccuaaagaauuc

SEQ ID NO: 693201 - RNA, 19 nt, Homo sapiens
gaacccaacccagaagucu

SEQ ID NO: 693202 - RNA, 19 nt, Homo sapiens
ucagaggcccugcggaguu

SEQ ID NO: 693203 - RNA, 19 nt, Homo sapiens
ccauacggaugcuggagau

SEQ ID NO: 693204 - RNA, 19 nt, Homo sapiens
ugauggagacccuagaaga

SEQ ID NO: 693205 - RNA, 19 nt, Homo sapiens
cuaaccaccuggccaugau

SEQ ID NO: 693206 - RNA, 19 nt, Homo sapiens
ccagauuccacugagguua

SEQ ID NO: 693207 - RNA, 19 nt, Homo sapiens
gaaaccggccacuucuagu

SEQ ID NO: 693208 - RNA, 19 nt, Homo sapiens
ugagguuagaguccauuua

SEQ ID NO: 693209 - RNA, 19 nt, Homo sapiens
ugaaagaccagagggacaa

SEQ ID NO: 693210 - RNA, 19 nt, Homo sapiens
ccagggagccagagaggau

SEQ ID NO: 693211 - RNA, 19 nt, Homo sapiens
cgauaucccucagauucga

SEQ ID NO: 693212 - RNA, 19 nt, Homo sapiens
cgucuauucucaacaaugc

SEQ ID NO: 693213 - RNA, 19 nt, Homo sapiens
caacuucagaucgguguga

SEQ ID NO: 693214 - RNA, 19 nt, Homo sapiens
ggugugauccgcgucuauu

SEQ ID NO: 693215 - RNA, 19 nt, Homo sapiens
uagaguccauuuacaaagc

SEQ ID NO: 693216 - RNA, 19 nt, Homo sapiens
uggaaucgagggugaaaga

SEQ ID NO: 693217 - RNA, 19 nt, Homo sapiens
cuccugaaguuccuacaga

SEQ ID NO: 693218 - RNA, 19 nt, Homo sapiens
gcaaucccagagagaguug

SEQ ID NO: 693219 - RNA, 19 nt, Homo sapiens
gaggacauccagcacaucu

SEQ ID NO: 693220 - RNA, 19 nt, Homo sapiens
gugaaaaccugcgaggaaa

SEQ ID NO: 693221 - RNA, 19 nt, Homo sapiens
cgucgucgccgguuacugu

SEQ ID NO: 693222 - RNA, 19 nt, Homo sapiens
aaagaauuccgacucagau

SEQ ID NO: 693223 - RNA, 19 nt, Homo sapiens
ggguccugcuuaccucauu

SEQ ID NO: 693224 - RNA, 19 nt, Homo sapiens
guggaucccagacuuccua

SEQ ID NO: 693225 - RNA, 19 nt, Homo sapiens
ucccugaggugcccaugga

SEQ ID NO: 693226 - RNA, 19 nt, Homo sapiens
caacccagaagucucaagu

SEQ ID NO: 693227 - RNA, 19 nt, Homo sapiens
caugauggagacccuagaa

SEQ ID NO: 693228 - RNA, 19 nt, Homo sapiens
ccgaauagauauggagacu

SEQ ID NO: 693229 - RNA, 19 nt, Homo sapiens
cggaggacauccagcacau

SEQ ID NO: 693230 - RNA, 19 nt, Homo sapiens
ugggaauucugugcccuaa

SEQ ID NO: 693231 - RNA, 19 nt, Homo sapiens
gaaagaccagagggacaau

SEQ ID NO: 693232 - RNA, 19 nt, Homo sapiens
gcagaggaagaagaagcua

SEQ ID NO: 693233 - RNA, 19 nt, Homo sapiens
ucucaguuauccugguguu

SEQ ID NO: 693234 - RNA, 19 nt, Homo sapiens
ggugaaaaccugcgaggaa

SEQ ID NO: 693235 - RNA, 19 nt, Homo sapiens
cacugaggguccacagaga

SEQ ID NO: 693236 - RNA, 19 nt, Homo sapiens
gaauucugugcccuaaaga

SEQ ID NO: 693237 - RNA, 19 nt, Homo sapiens
ugaaguuccaagugagauu

SEQ ID NO: 693238 - RNA, 19 nt, Homo sapiens
cuuccuaguccuuucgaua

SEQ ID NO: 693239 - RNA, 19 nt, Homo sapiens
gaaagaagcagauauccaa

SEQ ID NO: 693240 - RNA, 19 nt, Homo sapiens
uaacauggcuugggccuuu

SEQ ID NO: 693241 - RNA, 19 nt, Homo sapiens
ccgaagaucucaggaauuu

SEQ ID NO: 693242 - RNA, 19 nt, Homo sapiens
gaccuaugcuccugggaua

SEQ ID NO: 693243 - RNA, 19 nt, Homo sapiens
gauacgcuaugaacucuca

SEQ ID NO: 693244 - RNA, 19 nt, Homo sapiens
gccauuccuucugcaauua

SEQ ID NO: 693245 - RNA, 19 nt, Homo sapiens
cagaugggcugaagguugu

SEQ ID NO: 693246 - RNA, 19 nt, Homo sapiens
cuacacugcuuuccucuuc

SEQ ID NO: 693247 - RNA, 19 nt, Homo sapiens
caagagaaagaagcagaua

SEQ ID NO: 693248 - RNA, 19 nt, Homo sapiens
ugaugcagcucucuaugga

SEQ ID NO: 693249 - RNA, 19 nt, Homo sapiens
agauuuaacuuggguaaca

SEQ ID NO: 693250 - RNA, 19 nt, Homo sapiens
ggacugcugcuucucuuag

SEQ ID NO: 693251 - RNA, 19 nt, Homo sapiens
ugacagaggagcugguguu

SEQ ID NO: 693252 - RNA, 19 nt, Homo sapiens
acacucccuuccucacuuu

SEQ ID NO: 693253 - RNA, 19 nt, Homo sapiens
gggauacgcuaugaacucu

SEQ ID NO: 693254 - RNA, 19 nt, Homo sapiens
ugccauuccuucugcaauu

SEQ ID NO: 693255 - RNA, 19 nt, Homo sapiens
augcagcucucuauggauu

SEQ ID NO: 693256 - RNA, 19 nt, Homo sapiens
agaagcagauauccaaagg

SEQ ID NO: 693257 - RNA, 19 nt, Homo sapiens
ggaccaagagaaagaagca

SEQ ID NO: 693258 - RNA, 19 nt, Homo sapiens
ccagggaccaagagaaaga

SEQ ID NO: 693259 - RNA, 19 nt, Homo sapiens
ccuguaugcugcccauguu

SEQ ID NO: 693260 - RNA, 19 nt, Homo sapiens
agagaaagaagcagauauc

SEQ ID NO: 693261 - RNA, 19 nt, Homo sapiens
uuauugagcagcugcguuu

SEQ ID NO: 693262 - RNA, 19 nt, Homo sapiens
uugcugaccaugauucuuu

SEQ ID NO: 693263 - RNA, 19 nt, Homo sapiens
uagcuccucugccucugaa

SEQ ID NO: 693264 - RNA, 19 nt, Homo sapiens
gcugcugggugucaguguu

SEQ ID NO: 693265 - RNA, 19 nt, Homo sapiens
ccacugaugcagcucucua

SEQ ID NO: 693266 - RNA, 19 nt, Homo sapiens
uugcaucaguacuuuguau

SEQ ID NO: 693267 - RNA, 19 nt, Homo sapiens
uguaugggauauuaaagag

SEQ ID NO: 693268 - RNA, 19 nt, Homo sapiens
gauuuaacuuggguaacau

SEQ ID NO: 693269 - RNA, 19 nt, Homo sapiens
gaaaagcugcucgggguuu

SEQ ID NO: 693270 - RNA, 19 nt, Homo sapiens
cacacucccuuccucacuu

SEQ ID NO: 693271 - RNA, 19 nt, Homo sapiens
gauugaagccagagcuagu

SEQ ID NO: 693272 - RNA, 19 nt, Homo sapiens
gggauugaagccagagcua

SEQ ID NO: 693273 - RNA, 19 nt, Homo sapiens
gcaucaguacuuuguaugg

SEQ ID NO: 693274 - RNA, 19 nt, Homo sapiens
aaagaagcagauauccaaa

SEQ ID NO: 693275 - RNA, 19 nt, Homo sapiens
ccaagagaaagaagcagau

SEQ ID NO: 693276 - RNA, 19 nt, Homo sapiens
agagauuuaacuuggguaa

SEQ ID NO: 693277 - RNA, 19 nt, Homo sapiens
guacuuuguaugggauauu

SEQ ID NO: 693278 - RNA, 19 nt, Homo sapiens
ggugguguccagucucuca

SEQ ID NO: 693279 - RNA, 19 nt, Homo sapiens
gcagcucucuauggauugc

SEQ ID NO: 693280 - RNA, 19 nt, Homo sapiens
cagaggaccuggaauaaua

SEQ ID NO: 693281 - RNA, 19 nt, Homo sapiens
gaaagcagauaccaucaaa

SEQ ID NO: 693282 - RNA, 19 nt, Homo sapiens
gaaguuguauuagcuguua

SEQ ID NO: 693283 - RNA, 19 nt, Homo sapiens
gagaaacugugguccuuua

SEQ ID NO: 693284 - RNA, 19 nt, Homo sapiens
gcaacuuucuuaacaauga

SEQ ID NO: 693285 - RNA, 19 nt, Homo sapiens
guauauagcugccaauuag

SEQ ID NO: 693286 - RNA, 19 nt, Homo sapiens
caaacuggauggcaaauug

SEQ ID NO: 693287 - RNA, 19 nt, Homo sapiens
aaacugugguccuuuauaa

SEQ ID NO: 693288 - RNA, 19 nt, Homo sapiens
agacauaaguguugugauu

SEQ ID NO: 693289 - RNA, 19 nt, Homo sapiens
gguaggagcuaugguuuaa

SEQ ID NO: 693290 - RNA, 19 nt, Homo sapiens
gaucaaggauauggaaauu

SEQ ID NO: 693291 - RNA, 19 nt, Homo sapiens
gaccuuggccucaguguua

SEQ ID NO: 693292 - RNA, 19 nt, Homo sapiens
aaagguaucuugguuauga

SEQ ID NO: 693293 - RNA, 19 nt, Homo sapiens
uggaggagauguuaaagua

SEQ ID NO: 693294 - RNA, 19 nt, Homo sapiens
gcaagaaucagcaggauga

SEQ ID NO: 693295 - RNA, 19 nt, Homo sapiens
gaacgaguacagcaauaua

SEQ ID NO: 693296 - RNA, 19 nt, Homo sapiens
caaagaugcugcuaguguu

SEQ ID NO: 693297 - RNA, 19 nt, Homo sapiens
gggcagagcgcaaggcaua

SEQ ID NO: 693298 - RNA, 19 nt, Homo sapiens
guacagcaauauagaggaa

SEQ ID NO: 693299 - RNA, 19 nt, Homo sapiens
gaaaggaagacauaagugu

SEQ ID NO: 693300 - RNA, 19 nt, Homo sapiens
gaaacugugguccuuuaua

SEQ ID NO: 693301 - RNA, 19 nt, Homo sapiens
gaaaagguaucuugguuau

SEQ ID NO: 693302 - RNA, 19 nt, Homo sapiens
uuaaugcucugugaguuua

SEQ ID NO: 693303 - RNA, 19 nt, Homo sapiens
guagaaagguaugaguuug

SEQ ID NO: 693304 - RNA, 19 nt, Homo sapiens
ggauuuggauuugugcuuu

SEQ ID NO: 693305 - RNA, 19 nt, Homo sapiens
gagcugggauacaagcaaa

SEQ ID NO: 693306 - RNA, 19 nt, Homo sapiens
ucacauauacugaugaaga

SEQ ID NO: 693307 - RNA, 19 nt, Homo sapiens
ucaaggauauggaaauuac

SEQ ID NO: 693308 - RNA, 19 nt, Homo sapiens
gcagauaccaucaaauugg

SEQ ID NO: 693309 - RNA, 19 nt, Homo sapiens
gaagggauucuguucauuc

SEQ ID NO: 693310 - RNA, 19 nt, Homo sapiens
gaaagaacacaaacuggau

SEQ ID NO: 693311 - RNA, 19 nt, Homo sapiens
ucaagaggauuuggauuug

SEQ ID NO: 693312 - RNA, 19 nt, Homo sapiens
gaguugacauugagauugu

SEQ ID NO: 693313 - RNA, 19 nt, Homo sapiens
gguagaaagguaugaguuu

SEQ ID NO: 693314 - RNA, 19 nt, Homo sapiens
aguagaagcuuuguaauca

SEQ ID NO: 693315 - RNA, 19 nt, Homo sapiens
uggaggauaugaacgagua

SEQ ID NO: 693316 - RNA, 19 nt, Homo sapiens
gguaugaguuuggucgaaa

SEQ ID NO: 693317 - RNA, 19 nt, Homo sapiens
gacauaaguguugugauua

SEQ ID NO: 693318 - RNA, 19 nt, Homo sapiens
gcaaucaccaaaacaauua

SEQ ID NO: 693319 - RNA, 19 nt, Homo sapiens
aagcagauaccaucaaauu

SEQ ID NO: 693320 - RNA, 19 nt, Homo sapiens
gguagugaauccuguaagu

SEQ ID NO: 693321 - RNA, 19 nt, Homo sapiens
uaggagcuaugguuuaaga

SEQ ID NO: 693322 - RNA, 19 nt, Homo sapiens
ucugaagacuguccugaaa

SEQ ID NO: 693323 - RNA, 19 nt, Homo sapiens
ggacgacauugaagauugg

SEQ ID NO: 693324 - RNA, 19 nt, Homo sapiens
acaauuaccagccauacua

SEQ ID NO: 693325 - RNA, 19 nt, Homo sapiens
gauggcaaauugauagauc

SEQ ID NO: 693326 - RNA, 19 nt, Homo sapiens
gaagacauaaguguuguga

SEQ ID NO: 693327 - RNA, 19 nt, Homo sapiens
ccacaccuuugaacaaugu

SEQ ID NO: 693328 - RNA, 19 nt, Homo sapiens
aaacuggaaccaaggauuu

SEQ ID NO: 693329 - RNA, 19 nt, Homo sapiens
gaacuucccauggauacaa

SEQ ID NO: 693330 - RNA, 19 nt, Homo sapiens
ggugacgaguugacauuga

SEQ ID NO: 693331 - RNA, 19 nt, Homo sapiens
uaaaguaacccaucuugca

SEQ ID NO: 693332 - RNA, 19 nt, Homo sapiens
cagaguacuugucucgauu

SEQ ID NO: 693333 - RNA, 19 nt, Homo sapiens
uaaguuguguggucaguag

SEQ ID NO: 693334 - RNA, 19 nt, Homo sapiens
ccugggcuaucacauuaua

SEQ ID NO: 693335 - RNA, 19 nt, Homo sapiens
gaaagaagaggauuuuguu

SEQ ID NO: 693336 - RNA, 19 nt, Homo sapiens
guauaacuaugggaacuau

SEQ ID NO: 693337 - RNA, 19 nt, Homo sapiens
ucaaagaugcugcuagugu

SEQ ID NO: 693338 - RNA, 19 nt, Homo sapiens
gaucaacgcgagcaagaau

SEQ ID NO: 693339 - RNA, 19 nt, Homo sapiens
uuccugggcuaucacauua

SEQ ID NO: 693340 - RNA, 19 nt, Homo sapiens
ggaggagauguuaaaguaa

SEQ ID NO: 693341 - RNA, 19 nt, Homo sapiens
cagagaaacugugguccuu

SEQ ID NO: 693342 - RNA, 19 nt, Homo sapiens
uaaaugcuuccuuauguga

SEQ ID NO: 693343 - RNA, 19 nt, Homo sapiens
ggauugagcccggauacuu

SEQ ID NO: 693344 - RNA, 19 nt, Homo sapiens
ggaacugaaagaacacaaa

SEQ ID NO: 693345 - RNA, 19 nt, Homo sapiens
guaucuugguuaugacaaa

SEQ ID NO: 693346 - RNA, 19 nt, Homo sapiens
ggaaaagguaucuugguua

SEQ ID NO: 693347 - RNA, 19 nt, Homo sapiens
ucucagagccgccacaaga

SEQ ID NO: 693348 - RNA, 19 nt, Homo sapiens
gaagugugaaaucaaaguu

SEQ ID NO: 693349 - RNA, 19 nt, Homo sapiens
gagcaagaaucagcaggau

SEQ ID NO: 693350 - RNA, 19 nt, Homo sapiens
ccaauuuguagguguauuu

SEQ ID NO: 693351 - RNA, 19 nt, Homo sapiens
gccgacagcuccgucacua

SEQ ID NO: 693352 - RNA, 19 nt, Homo sapiens
ugggaagugugaaaucaaa

SEQ ID NO: 693353 - RNA, 19 nt, Homo sapiens
augauuaggugacgaguug

SEQ ID NO: 693354 - RNA, 19 nt, Homo sapiens
cgacagcuccgucacuaug

SEQ ID NO: 693355 - RNA, 19 nt, Homo sapiens
ugacacagugcaugaacua

SEQ ID NO: 693356 - RNA, 19 nt, Homo sapiens
uaaguguugugauuaguag

SEQ ID NO: 693357 - RNA, 19 nt, Homo sapiens
guucuuucccuucugguua

SEQ ID NO: 693358 - RNA, 19 nt, Homo sapiens
gcuauggcggauaugauua

SEQ ID NO: 693359 - RNA, 19 nt, Homo sapiens
caaauugguucugggaagu

SEQ ID NO: 693360 - RNA, 19 nt, Homo sapiens
caagaggauuuggauuugu

SEQ ID NO: 693361 - RNA, 19 nt, Homo sapiens
gggauuggcauacguguuc

SEQ ID NO: 693362 - RNA, 19 nt, Homo sapiens
gagaaaagucuugauagua

SEQ ID NO: 693363 - RNA, 19 nt, Homo sapiens
uuuaagagcauuggaagua

SEQ ID NO: 693364 - RNA, 19 nt, Homo sapiens
guagaagcuuuguaaucau

SEQ ID NO: 693365 - RNA, 19 nt, Homo sapiens
gaaaacagcgggaacuuca

SEQ ID NO: 693366 - RNA, 19 nt, Homo sapiens
ggacagggauaugcagacu

SEQ ID NO: 693367 - RNA, 19 nt, Homo sapiens
guuaaugcucugugaguuu

SEQ ID NO: 693368 - RNA, 19 nt, Homo sapiens
gcaaggcauacaccagaaa

SEQ ID NO: 693369 - RNA, 19 nt, Homo sapiens
gaacugaaagaacacaaac

SEQ ID NO: 693370 - RNA, 19 nt, Homo sapiens
ggaugacgguaaaauguuu

SEQ ID NO: 693371 - RNA, 19 nt, Homo sapiens
cugguuaucugaagacugu

SEQ ID NO: 693372 - RNA, 19 nt, Homo sapiens
acagcaauauagaggaauu

SEQ ID NO: 693373 - RNA, 19 nt, Homo sapiens
cugugguccuuuauaaaua

SEQ ID NO: 693374 - RNA, 19 nt, Homo sapiens
aaacagcgggaacuucauu

SEQ ID NO: 693375 - RNA, 19 nt, Homo sapiens
ucagcaggaugacgguaaa

SEQ ID NO: 693376 - RNA, 19 nt, Homo sapiens
gggauucuguucauucaac

SEQ ID NO: 693377 - RNA, 19 nt, Homo sapiens
uuucagaggaccuggaaua

SEQ ID NO: 693378 - RNA, 19 nt, Homo sapiens
ugaagacuguccugaaagg

SEQ ID NO: 693379 - RNA, 19 nt, Homo sapiens
uguauauagcugccaauua

SEQ ID NO: 693380 - RNA, 19 nt, Homo sapiens
cagaggaccuggaauaaua

SEQ ID NO: 693381 - RNA, 19 nt, Homo sapiens
gaaagcagauaccaucaaa

SEQ ID NO: 693382 - RNA, 19 nt, Homo sapiens
gaaguuguauuagcuguua

SEQ ID NO: 693383 - RNA, 19 nt, Homo sapiens
gagaaacugugguccuuua

SEQ ID NO: 693384 - RNA, 19 nt, Homo sapiens
gcaacuuucuuaacaauga

SEQ ID NO: 693385 - RNA, 19 nt, Homo sapiens
guauauagcugccaauuag

SEQ ID NO: 693386 - RNA, 19 nt, Homo sapiens
caaacuggauggcaaauug

SEQ ID NO: 693387 - RNA, 19 nt, Homo sapiens
aaacugugguccuuuauaa

SEQ ID NO: 693388 - RNA, 19 nt, Homo sapiens
agacauaaguguugugauu

SEQ ID NO: 693389 - RNA, 19 nt, Homo sapiens
gguaggagcuaugguuuaa

SEQ ID NO: 693390 - RNA, 19 nt, Homo sapiens
gaucaaggauauggaaauu

SEQ ID NO: 693391 - RNA, 19 nt, Homo sapiens
gaccuuggccucaguguua

SEQ ID NO: 693392 - RNA, 19 nt, Homo sapiens
aaagguaucuugguuauga

SEQ ID NO: 693393 - RNA, 19 nt, Homo sapiens
gcaagaaucagcaggauga

SEQ ID NO: 693394 - RNA, 19 nt, Homo sapiens
gaacgaguacagcaauaua

SEQ ID NO: 693395 - RNA, 19 nt, Homo sapiens
caaagaugcugcuaguguu

SEQ ID NO: 693396 - RNA, 19 nt, Homo sapiens
aggaggagauguuaaagua

SEQ ID NO: 693397 - RNA, 19 nt, Homo sapiens
guacagcaauauagaggaa

SEQ ID NO: 693398 - RNA, 19 nt, Homo sapiens
gaaaggaagacauaagugu

SEQ ID NO: 693399 - RNA, 19 nt, Homo sapiens
gaaacugugguccuuuaua

SEQ ID NO: 693400 - RNA, 19 nt, Homo sapiens
gaaaagguaucuugguuau

SEQ ID NO: 693401 - RNA, 19 nt, Homo sapiens
uuaaugcucugugaguuua

SEQ ID NO: 693402 - RNA, 19 nt, Homo sapiens
guagaaagguaugaguuug

SEQ ID NO: 693403 - RNA, 19 nt, Homo sapiens
ggauuuggauuugugcuuu

SEQ ID NO: 693404 - RNA, 19 nt, Homo sapiens
gagcugggauacaagcaaa

SEQ ID NO: 693405 - RNA, 19 nt, Homo sapiens
ucacauauacugaugaaga

SEQ ID NO: 693406 - RNA, 19 nt, Homo sapiens
ucaaggauauggaaauuac

SEQ ID NO: 693407 - RNA, 19 nt, Homo sapiens
gcagauaccaucaaauugg

SEQ ID NO: 693408 - RNA, 19 nt, Homo sapiens
gaagggauucuguucauuc

SEQ ID NO: 693409 - RNA, 19 nt, Homo sapiens
gaaagaacacaaacuggau

SEQ ID NO: 693410 - RNA, 19 nt, Homo sapiens
ucaagaggauuuggauuug

SEQ ID NO: 693411 - RNA, 19 nt, Homo sapiens
gaguugacauugagauugu

SEQ ID NO: 693412 - RNA, 19 nt, Homo sapiens
gguagaaagguaugaguuu

SEQ ID NO: 693413 - RNA, 19 nt, Homo sapiens
aguagaagcuuuguaauca

SEQ ID NO: 693414 - RNA, 19 nt, Homo sapiens
uggaggauaugaacgagua

SEQ ID NO: 693415 - RNA, 19 nt, Homo sapiens
gguaugaguuuggucgaaa

SEQ ID NO: 693416 - RNA, 19 nt, Homo sapiens
gacauaaguguugugauua

SEQ ID NO: 693417 - RNA, 19 nt, Homo sapiens
gcaaucaccaaaacaauua

SEQ ID NO: 693418 - RNA, 19 nt, Homo sapiens
aagcagauaccaucaaauu

SEQ ID NO: 693419 - RNA, 19 nt, Homo sapiens
gguagugaauccuguaagu

SEQ ID NO: 693420 - RNA, 19 nt, Homo sapiens
uaggagcuaugguuuaaga

SEQ ID NO: 693421 - RNA, 19 nt, Homo sapiens
ucugaagacuguccugaaa

SEQ ID NO: 693422 - RNA, 19 nt, Homo sapiens
ggacgacauugaagauugg

SEQ ID NO: 693423 - RNA, 19 nt, Homo sapiens
acaauuaccagccauacua

SEQ ID NO: 693424 - RNA, 19 nt, Homo sapiens
gauggcaaauugauagauc

SEQ ID NO: 693425 - RNA, 19 nt, Homo sapiens
gaagacauaaguguuguga

SEQ ID NO: 693426 - RNA, 19 nt, Homo sapiens
ccacaccuuugaacaaugu

SEQ ID NO: 693427 - RNA, 19 nt, Homo sapiens
aaacuggaaccaaggauuu

SEQ ID NO: 693428 - RNA, 19 nt, Homo sapiens
gaacuucccauggauacaa

SEQ ID NO: 693429 - RNA, 19 nt, Homo sapiens
ggugacgaguugacauuga

SEQ ID NO: 693430 - RNA, 19 nt, Homo sapiens
uaaaguaacccaucuugca

SEQ ID NO: 693431 - RNA, 19 nt, Homo sapiens
cagaguacuugucucgauu

SEQ ID NO: 693432 - RNA, 19 nt, Homo sapiens
uaaguuguguggucaguag

SEQ ID NO: 693433 - RNA, 19 nt, Homo sapiens
ccugggcuaucacauuaua

SEQ ID NO: 693434 - RNA, 19 nt, Homo sapiens
gaaagaagaggauuuuguu

SEQ ID NO: 693435 - RNA, 19 nt, Homo sapiens
guauaacuaugggaacuau

SEQ ID NO: 693436 - RNA, 19 nt, Homo sapiens
ucaaagaugcugcuagugu

SEQ ID NO: 693437 - RNA, 19 nt, Homo sapiens
gaucaacgcgagcaagaau

SEQ ID NO: 693438 - RNA, 19 nt, Homo sapiens
uuccugggcuaucacauua

SEQ ID NO: 693439 - RNA, 19 nt, Homo sapiens
ggaggagauguuaaaguaa

SEQ ID NO: 693440 - RNA, 19 nt, Homo sapiens
cagagaaacugugguccuu

SEQ ID NO: 693441 - RNA, 19 nt, Homo sapiens
uaaaugcuuccuuauguga

SEQ ID NO: 693442 - RNA, 19 nt, Homo sapiens
ggauugagcccggauacuu

SEQ ID NO: 693443 - RNA, 19 nt, Homo sapiens
ggaacugaaagaacacaaa

SEQ ID NO: 693444 - RNA, 19 nt, Homo sapiens
guaucuugguuaugacaaa

SEQ ID NO: 693445 - RNA, 19 nt, Homo sapiens
ggaaaagguaucuugguua

SEQ ID NO: 693446 - RNA, 19 nt, Homo sapiens
ucucagagccgccacaaga

SEQ ID NO: 693447 - RNA, 19 nt, Homo sapiens
gaagugugaaaucaaaguu

SEQ ID NO: 693448 - RNA, 19 nt, Homo sapiens
gagcaagaaucagcaggau

SEQ ID NO: 693449 - RNA, 19 nt, Homo sapiens
ccaauuuguagguguauuu

SEQ ID NO: 693450 - RNA, 19 nt, Homo sapiens
ugggaagugugaaaucaaa

SEQ ID NO: 693451 - RNA, 19 nt, Homo sapiens
gccgacagcuccgucacua

SEQ ID NO: 693452 - RNA, 19 nt, Homo sapiens
augauuaggugacgaguug

SEQ ID NO: 693453 - RNA, 19 nt, Homo sapiens
cgacagcuccgucacuaug

SEQ ID NO: 693454 - RNA, 19 nt, Homo sapiens
ugacacagugcaugaacua

SEQ ID NO: 693455 - RNA, 19 nt, Homo sapiens
uaaguguugugauuaguag

SEQ ID NO: 693456 - RNA, 19 nt, Homo sapiens
guucuuucccuucugguua

SEQ ID NO: 693457 - RNA, 19 nt, Homo sapiens
gcuauggcggauaugauua

SEQ ID NO: 693458 - RNA, 19 nt, Homo sapiens
caaauugguucugggaagu

SEQ ID NO: 693459 - RNA, 19 nt, Homo sapiens
caagaggauuuggauuugu

SEQ ID NO: 693460 - RNA, 19 nt, Homo sapiens
gggauuggcauacguguuc

SEQ ID NO: 693461 - RNA, 19 nt, Homo sapiens
gagaaaagucuugauagua

SEQ ID NO: 693462 - RNA, 19 nt, Homo sapiens
uuuaagagcauuggaagua

SEQ ID NO: 693463 - RNA, 19 nt, Homo sapiens
guagaagcuuuguaaucau

SEQ ID NO: 693464 - RNA, 19 nt, Homo sapiens
ggacagggauaugcagacu

SEQ ID NO: 693465 - RNA, 19 nt, Homo sapiens
guuaaugcucugugaguuu

SEQ ID NO: 693466 - RNA, 19 nt, Homo sapiens
gaacugaaagaacacaaac

SEQ ID NO: 693467 - RNA, 19 nt, Homo sapiens
ggaugacgguaaaauguuu

SEQ ID NO: 693468 - RNA, 19 nt, Homo sapiens
cugguuaucugaagacugu

SEQ ID NO: 693469 - RNA, 19 nt, Homo sapiens
cugugguccuuuauaaaua

SEQ ID NO: 693470 - RNA, 19 nt, Homo sapiens
acagcaauauagaggaauu

SEQ ID NO: 693471 - RNA, 19 nt, Homo sapiens
ucagcaggaugacgguaaa

SEQ ID NO: 693472 - RNA, 19 nt, Homo sapiens
gggauucuguucauucaac

SEQ ID NO: 693473 - RNA, 19 nt, Homo sapiens
uuucagaggaccuggaaua

SEQ ID NO: 693474 - RNA, 19 nt, Homo sapiens
ugaagacuguccugaaagg

SEQ ID NO: 693475 - RNA, 19 nt, Homo sapiens
uguauauagcugccaauua

SEQ ID NO: 693476 - RNA, 19 nt, Homo sapiens
ggucuucuguugaucuaag

SEQ ID NO: 693477 - RNA, 19 nt, Homo sapiens
gcaggacgacauugaagau

SEQ ID NO: 693478 - RNA, 19 nt, Homo sapiens
caauuaccagccauacuaa

SEQ ID NO: 693479 - RNA, 19 nt, Homo sapiens
ugaggaaguuguauuagcu

SEQ ID NO: 693480 - RNA, 19 nt, Homo sapiens
gcacagaacugaugaauag

SEQ ID NO: 693481 - RNA, 19 nt, Homo sapiens
ggacaucacuucuuccaua

SEQ ID NO: 693482 - RNA, 19 nt, Homo sapiens
gaaauagacucagaagaua

SEQ ID NO: 693483 - RNA, 19 nt, Homo sapiens
gaucagagcuuugaaguga

SEQ ID NO: 693484 - RNA, 19 nt, Homo sapiens
caaaggaugucgaagauuu

SEQ ID NO: 693485 - RNA, 19 nt, Homo sapiens
gaaugaagcggaugaaaua

SEQ ID NO: 693486 - RNA, 19 nt, Homo sapiens
gaaggcacacuguuaauua

SEQ ID NO: 693487 - RNA, 19 nt, Homo sapiens
gaacugaugaauaguguua

SEQ ID NO: 693488 - RNA, 19 nt, Homo sapiens
gaaggcaacuugauucugu

SEQ ID NO: 693489 - RNA, 19 nt, Homo sapiens
ggaaacaaaucuaagaauc

SEQ ID NO: 693490 - RNA, 19 nt, Homo sapiens
caaagaaggcacacuguua

SEQ ID NO: 693491 - RNA, 19 nt, Homo sapiens
caaggaagaugaaaucaau

SEQ ID NO: 693492 - RNA, 19 nt, Homo sapiens
cuacagaaaucaucuuuga

SEQ ID NO: 693493 - RNA, 19 nt, Homo sapiens
gaggaaggaaguaauguua

SEQ ID NO: 693494 - RNA, 19 nt, Homo sapiens
gaaucugucuugccuuuga

SEQ ID NO: 693495 - RNA, 19 nt, Homo sapiens
gaacaauauugaacgcuau

SEQ ID NO: 693496 - RNA, 19 nt, Homo sapiens
ccacagaaguagcagauga

SEQ ID NO: 693497 - RNA, 19 nt, Homo sapiens
ggaagaggauucugacaca

SEQ ID NO: 693498 - RNA, 19 nt, Homo sapiens
ucaaggagcuccggauaaa

SEQ ID NO: 693499 - RNA, 19 nt, Homo sapiens
gaaacaaucuggguaacau

SEQ ID NO: 693500 - RNA, 19 nt, Homo sapiens
gauaaggauucucugacua

SEQ ID NO: 693501 - RNA, 19 nt, Homo sapiens
ggaaaguguugcggagaua

SEQ ID NO: 693502 - RNA, 19 nt, Homo sapiens
ggauaagcauaguaacaaa

SEQ ID NO: 693503 - RNA, 19 nt, Homo sapiens
ucaacuaccugaauuggaa

SEQ ID NO: 693504 - RNA, 19 nt, Homo sapiens
gaaauaggcaguucaagca

SEQ ID NO: 693505 - RNA, 19 nt, Homo sapiens
gguaaacugucauuagaau

SEQ ID NO: 693506 - RNA, 19 nt, Homo sapiens
gaaaagcaaugucguucua

SEQ ID NO: 693507 - RNA, 19 nt, Homo sapiens
ggauaaagcauggcaauga

SEQ ID NO: 693508 - RNA, 19 nt, Homo sapiens
gaagauaaggauucucuga

SEQ ID NO: 693509 - RNA, 19 nt, Homo sapiens
gcucauguauccaaauuca

SEQ ID NO: 693510 - RNA, 19 nt, Homo sapiens
gaaggauacuugcaacaca

SEQ ID NO: 693511 - RNA, 19 nt, Homo sapiens
aggauucucugacuaauaa

SEQ ID NO: 693512 - RNA, 19 nt, Homo sapiens
gaggaaguuucagcaguua

SEQ ID NO: 693513 - RNA, 19 nt, Homo sapiens
caucugagguugaguuuua

SEQ ID NO: 693514 - RNA, 19 nt, Homo sapiens
ggucagaacagaagaagaa

SEQ ID NO: 693515 - RNA, 19 nt, Homo sapiens
gaaguggacagaagaagaa

SEQ ID NO: 693516 - RNA, 19 nt, Homo sapiens
aagcaugguuuacaacuaa

SEQ ID NO: 693517 - RNA, 19 nt, Homo sapiens
guauugaaccuccacauaa

SEQ ID NO: 693518 - RNA, 19 nt, Homo sapiens
gagaauaguuugucaucca

SEQ ID NO: 693519 - RNA, 19 nt, Homo sapiens
aauauaaccucucaucuca

SEQ ID NO: 693520 - RNA, 19 nt, Homo sapiens
ugaaauagacucagaagau

SEQ ID NO: 693521 - RNA, 19 nt, Homo sapiens
gacagucgauagugauauu

SEQ ID NO: 693522 - RNA, 19 nt, Homo sapiens
gaacacuacagacauuuga

SEQ ID NO: 693523 - RNA, 19 nt, Homo sapiens
gucuagagcuuaccaguga

SEQ ID NO: 693524 - RNA, 19 nt, Homo sapiens
caacauggucuagagcuua

SEQ ID NO: 693525 - RNA, 19 nt, Homo sapiens
caggaagaaucaaauauca

SEQ ID NO: 693526 - RNA, 19 nt, Homo sapiens
gggaacaauuguauauuca

SEQ ID NO: 693527 - RNA, 19 nt, Homo sapiens
uaacugcugugguuuaaag

SEQ ID NO: 693528 - RNA, 19 nt, Homo sapiens
gcagacacuuucccagaug

SEQ ID NO: 693529 - RNA, 19 nt, Homo sapiens
ccacaauggcuacgaagua

SEQ ID NO: 693530 - RNA, 19 nt, Homo sapiens
gcaaugucguucuaaaugg

SEQ ID NO: 693531 - RNA, 19 nt, Homo sapiens
caagcaugguuuacaacua

SEQ ID NO: 693532 - RNA, 19 nt, Homo sapiens
ucagaaaccacugucauua

SEQ ID NO: 693533 - RNA, 19 nt, Homo sapiens
gggcaguccuguuucagaa

SEQ ID NO: 693534 - RNA, 19 nt, Homo sapiens
acaccgaccuuaaacaaga

SEQ ID NO: 693535 - RNA, 19 nt, Homo sapiens
gacauuaacugggaucugu

SEQ ID NO: 693536 - RNA, 19 nt, Homo sapiens
gauagcagaacuugaugua

SEQ ID NO: 693537 - RNA, 19 nt, Homo sapiens
cgaggaaguuucagcaguu

SEQ ID NO: 693538 - RNA, 19 nt, Homo sapiens
gggaagggcuguagcugau

SEQ ID NO: 693539 - RNA, 19 nt, Homo sapiens
aagcuuaacugcugugguu

SEQ ID NO: 693540 - RNA, 19 nt, Homo sapiens
gaacaugggagagaaacaa

SEQ ID NO: 693541 - RNA, 19 nt, Homo sapiens
gagaauaaaucaggaucug

SEQ ID NO: 693542 - RNA, 19 nt, Homo sapiens
cacaauggcuacgaaguaa

SEQ ID NO: 693543 - RNA, 19 nt, Homo sapiens
uauugaaccuccacauaaa

SEQ ID NO: 693544 - RNA, 19 nt, Homo sapiens
acagaaggguuaaggcaaa

SEQ ID NO: 693545 - RNA, 19 nt, Homo sapiens
aaagaaggcacacuguuaa

SEQ ID NO: 693546 - RNA, 19 nt, Homo sapiens
cagaggacaucacuucuuc

SEQ ID NO: 693547 - RNA, 19 nt, Homo sapiens
gcugagggauggaguagug

SEQ ID NO: 693548 - RNA, 19 nt, Homo sapiens
gcaaagaaggcacacuguu

SEQ ID NO: 693549 - RNA, 19 nt, Homo sapiens
gcaccuaccuacuucaaac

SEQ ID NO: 693550 - RNA, 19 nt, Homo sapiens
cuacagacauuugagauuc

SEQ ID NO: 693551 - RNA, 19 nt, Homo sapiens
gguaaacaggaaagcauua

SEQ ID NO: 693552 - RNA, 19 nt, Homo sapiens
gcaguccuguuucagaaga

SEQ ID NO: 693553 - RNA, 19 nt, Homo sapiens
gaagaacaaguugaucaaa

SEQ ID NO: 693554 - RNA, 19 nt, Homo sapiens
gaaauucaucacccuaaga

SEQ ID NO: 693555 - RNA, 19 nt, Homo sapiens
gaucacccauguuucuuca

SEQ ID NO: 693556 - RNA, 19 nt, Homo sapiens
ggaguuccaaacaguaaua

SEQ ID NO: 693557 - RNA, 19 nt, Homo sapiens
cagaagugguucaugaguu

SEQ ID NO: 693558 - RNA, 19 nt, Homo sapiens
gaaaccaugugggaaaaua

SEQ ID NO: 693559 - RNA, 19 nt, Homo sapiens
uaaauuaccgagagaauag

SEQ ID NO: 693560 - RNA, 19 nt, Homo sapiens
ucaaagaaauaggagcaaa

SEQ ID NO: 693561 - RNA, 19 nt, Homo sapiens
agaagugguucaugaguug

SEQ ID NO: 693562 - RNA, 19 nt, Homo sapiens
aaagauuucuacaggacua

SEQ ID NO: 693563 - RNA, 19 nt, Homo sapiens
uugauaccaugaccauuua

SEQ ID NO: 693564 - RNA, 19 nt, Homo sapiens
ccacagaggacaucacuuc

SEQ ID NO: 693565 - RNA, 19 nt, Homo sapiens
guggaacacuacagacauu

SEQ ID NO: 693566 - RNA, 19 nt, Homo sapiens
aaagcaaugucguucuaaa

SEQ ID NO: 693567 - RNA, 19 nt, Homo sapiens
ggaaguggacagaagaaga

SEQ ID NO: 693568 - RNA, 19 nt, Homo sapiens
gacaucacuucuuccauau

SEQ ID NO: 693569 - RNA, 19 nt, Homo sapiens
ggccuuuguuugcaguuua

SEQ ID NO: 693570 - RNA, 19 nt, Homo sapiens
caaagugcccggacccaaa

SEQ ID NO: 693571 - RNA, 19 nt, Homo sapiens
uaaauagccacaguccuua

SEQ ID NO: 693572 - RNA, 19 nt, Homo sapiens
gaacaaguugaucaaacaa

SEQ ID NO: 693573 - RNA, 19 nt, Homo sapiens
agaacaaguugaucaaaca

SEQ ID NO: 693574 - RNA, 19 nt, Homo sapiens
cuaaauggcucaacuaccu

SEQ ID NO: 693575 - RNA, 19 nt, Homo sapiens
uagaaacugugaacucugu

SEQ ID NO: 693576 - RNA, 19 nt, Homo sapiens
gggaauaaggaauuucauu

SEQ ID NO: 693577 - RNA, 19 nt, Homo sapiens
caucaggaagaaucaaaua

SEQ ID NO: 693578 - RNA, 19 nt, Homo sapiens
gaagaagaaaucucugaca

SEQ ID NO: 693579 - RNA, 19 nt, Homo sapiens
uugcagaagugguucauga

SEQ ID NO: 693580 - RNA, 19 nt, Homo sapiens
gcaaagacauuaagacaaa

SEQ ID NO: 693581 - RNA, 19 nt, Homo sapiens
gaaaggaacuggaagaaau

SEQ ID NO: 693582 - RNA, 19 nt, Homo sapiens
uaaaugagcuaccaaauug

SEQ ID NO: 693583 - RNA, 19 nt, Homo sapiens
ggacagcucuuuacuuugu

SEQ ID NO: 693584 - RNA, 19 nt, Homo sapiens
gaagagaugucaguagaaa

SEQ ID NO: 693585 - RNA, 19 nt, Homo sapiens
gaagugauuugcaagauga

SEQ ID NO: 693586 - RNA, 19 nt, Homo sapiens
gaacuaaaguacaagaugu

SEQ ID NO: 693587 - RNA, 19 nt, Homo sapiens
aaagagaccuucaguauca

SEQ ID NO: 693588 - RNA, 19 nt, Homo sapiens
ucaaugagcuuguggagaa

SEQ ID NO: 693589 - RNA, 19 nt, Homo sapiens
ggaaagaauuagcagauug

SEQ ID NO: 693590 - RNA, 19 nt, Homo sapiens
gcauauugcuguacacauu

SEQ ID NO: 693591 - RNA, 19 nt, Homo sapiens
gaagagaccaucaguauag

SEQ ID NO: 693592 - RNA, 19 nt, Homo sapiens
ggauugacuuaaacucuua

SEQ ID NO: 693593 - RNA, 19 nt, Homo sapiens
caggauagguguucuuaaa

SEQ ID NO: 693594 - RNA, 19 nt, Homo sapiens
gagcggagcugauggaaca

SEQ ID NO: 693595 - RNA, 19 nt, Homo sapiens
ccagagauguuuaugacua

SEQ ID NO: 693596 - RNA, 19 nt, Homo sapiens
gaaaguacaguaaacacua

SEQ ID NO: 693597 - RNA, 19 nt, Homo sapiens
ggacuccacucuucacuau

SEQ ID NO: 693598 - RNA, 19 nt, Homo sapiens
ucacagcgauucagacuug

SEQ ID NO: 693599 - RNA, 19 nt, Homo sapiens
ggagauauuugcaguguag

SEQ ID NO: 693600 - RNA, 19 nt, Homo sapiens
gagcugaacuggcugaaca

SEQ ID NO: 693601 - RNA, 19 nt, Homo sapiens
acauagagcuugaacagaa

SEQ ID NO: 693602 - RNA, 19 nt, Homo sapiens
cagaagagaugucaguaga

SEQ ID NO: 693603 - RNA, 19 nt, Homo sapiens
gcaagcuacugaagaaaug

SEQ ID NO: 693604 - RNA, 19 nt, Homo sapiens
ggacaaguaugcugcaagu

SEQ ID NO: 693605 - RNA, 19 nt, Homo sapiens
ggacuccucuuccugaaau

SEQ ID NO: 693606 - RNA, 19 nt, Homo sapiens
ccagagaccugcauugcuu

SEQ ID NO: 693607 - RNA, 19 nt, Homo sapiens
gcagaucugguuccaauuu

SEQ ID NO: 693608 - RNA, 19 nt, Homo sapiens
gaaaggagaacuaaaguac

SEQ ID NO: 693609 - RNA, 19 nt, Homo sapiens
gcgaugcuguugagaauau

SEQ ID NO: 693610 - RNA, 19 nt, Homo sapiens
ggaacuggaagaaaugaua

SEQ ID NO: 693611 - RNA, 19 nt, Homo sapiens
gaucaggaauuguauaacu

SEQ ID NO: 693612 - RNA, 19 nt, Homo sapiens
ccagcaagcuacugaagaa

SEQ ID NO: 693613 - RNA, 19 nt, Homo sapiens
gaugaaagagauuguauug

SEQ ID NO: 693614 - RNA, 19 nt, Homo sapiens
gcaagugagaacauauuua

SEQ ID NO: 693615 - RNA, 19 nt, Homo sapiens
ggaaaggagaacuaaagua

SEQ ID NO: 693616 - RNA, 19 nt, Homo sapiens
aaagagaagugauuugcaa

SEQ ID NO: 693617 - RNA, 19 nt, Homo sapiens
ggaagcagcuaguaaugag

SEQ ID NO: 693618 - RNA, 19 nt, Homo sapiens
gauauuacagagcgucuua

SEQ ID NO: 693619 - RNA, 19 nt, Homo sapiens
uuagauaccuugcagauca

SEQ ID NO: 693620 - RNA, 19 nt, Homo sapiens
ggaguuugcucgauaccuu

SEQ ID NO: 693621 - RNA, 19 nt, Homo sapiens
agacaaaguuucuucuguu

SEQ ID NO: 693622 - RNA, 19 nt, Homo sapiens
cuggacagcucuuuacuuu

SEQ ID NO: 693623 - RNA, 19 nt, Homo sapiens
cuuaaacacuugcaugauu

SEQ ID NO: 693624 - RNA, 19 nt, Homo sapiens
gaaagagaccuucaguauc

SEQ ID NO: 693625 - RNA, 19 nt, Homo sapiens
acagcgaugucaaguauuu

SEQ ID NO: 693626 - RNA, 19 nt, Homo sapiens
caagaugaacuggauauaa

SEQ ID NO: 693627 - RNA, 19 nt, Homo sapiens
gcucuuuacuuuguacuuu

SEQ ID NO: 693628 - RNA, 19 nt, Homo sapiens
uagcaaugaugaugugaaa

SEQ ID NO: 693629 - RNA, 19 nt, Homo sapiens
ggagcucauugaacgauuu

SEQ ID NO: 693630 - RNA, 19 nt, Homo sapiens
gagugucugugucugauuu

SEQ ID NO: 693631 - RNA, 19 nt, Homo sapiens
ggagaacuuuggcagaugu

SEQ ID NO: 693632 - RNA, 19 nt, Homo sapiens
ugaaagagauuguauugcu

SEQ ID NO: 693633 - RNA, 19 nt, Homo sapiens
gcacagcguccucaaccua

SEQ ID NO: 693634 - RNA, 19 nt, Homo sapiens
caaaugacaggguuccuaa

SEQ ID NO: 693635 - RNA, 19 nt, Homo sapiens
gcccggaguuugcucgaua

SEQ ID NO: 693636 - RNA, 19 nt, Homo sapiens
uaagaucuauagagagaga

SEQ ID NO: 693637 - RNA, 19 nt, Homo sapiens
ucagcgagauggugaagaa

SEQ ID NO: 693638 - RNA, 19 nt, Homo sapiens
ccgaaaggcuugugcugaa

SEQ ID NO: 693639 - RNA, 19 nt, Homo sapiens
ggugcaacuucuucacaua

SEQ ID NO: 693640 - RNA, 19 nt, Homo sapiens
caagagaaaguacaguaaa

SEQ ID NO: 693641 - RNA, 19 nt, Homo sapiens
gacaaaguuucuucuguuc

SEQ ID NO: 693642 - RNA, 19 nt, Homo sapiens
ucucuuagaucaggaauug

SEQ ID NO: 693643 - RNA, 19 nt, Homo sapiens
gaucucaguguuaguaauu

SEQ ID NO: 693644 - RNA, 19 nt, Homo sapiens
ccucagacaugcaguggaa

SEQ ID NO: 693645 - RNA, 19 nt, Homo sapiens
gagaagugauuugcaagau

SEQ ID NO: 693646 - RNA, 19 nt, Homo sapiens
ccacauugaugauccagau

SEQ ID NO: 693647 - RNA, 19 nt, Homo sapiens
aaggagaacuaaaguacaa

SEQ ID NO: 693648 - RNA, 19 nt, Homo sapiens
cuacaaaucuauguuacga

SEQ ID NO: 693649 - RNA, 19 nt, Homo sapiens
gcuuuguucugauaaugua

SEQ ID NO: 693650 - RNA, 19 nt, Homo sapiens
gucaugaccugaaggaaau

SEQ ID NO: 693651 - RNA, 19 nt, Homo sapiens
gcagacgugugcccagaug

SEQ ID NO: 693652 - RNA, 19 nt, Homo sapiens
ucucagaggauuauaauug

SEQ ID NO: 693653 - RNA, 19 nt, Homo sapiens
ggaagucugcgaugaugaa

SEQ ID NO: 693654 - RNA, 19 nt, Homo sapiens
gcaaaugacaggguuccua

SEQ ID NO: 693655 - RNA, 19 nt, Homo sapiens
ggaguggaccucaucaaug

SEQ ID NO: 693656 - RNA, 19 nt, Homo sapiens
ggugacagauaauaguaga

SEQ ID NO: 693657 - RNA, 19 nt, Homo sapiens
uaaaagaccucgaugaagu

SEQ ID NO: 693658 - RNA, 19 nt, Homo sapiens
ccacgagcuugcaguuauu

SEQ ID NO: 693659 - RNA, 19 nt, Homo sapiens
cagaagcuguggcuauaau

SEQ ID NO: 693660 - RNA, 19 nt, Homo sapiens
aaacaagucaggcagcuuu

SEQ ID NO: 693661 - RNA, 19 nt, Homo sapiens
cagaaugguugcugagugu

SEQ ID NO: 693662 - RNA, 19 nt, Homo sapiens
gacaugcaguggaaaguuc

SEQ ID NO: 693663 - RNA, 19 nt, Homo sapiens
gaggaaaggagaacuaaag

SEQ ID NO: 693664 - RNA, 19 nt, Homo sapiens
gaccuuucauaucuacuuu

SEQ ID NO: 693665 - RNA, 19 nt, Homo sapiens
gugcugcagucuuuaauca

SEQ ID NO: 693666 - RNA, 19 nt, Homo sapiens
gcucugaggugcaacuucu

SEQ ID NO: 693667 - RNA, 19 nt, Homo sapiens
cacagacgguugacacuga

SEQ ID NO: 693668 - RNA, 19 nt, Homo sapiens
gaagauucugugccuuuaa

SEQ ID NO: 693669 - RNA, 19 nt, Homo sapiens
ccugguaacuacaaaucua

SEQ ID NO: 693670 - RNA, 19 nt, Homo sapiens
aaauguugcugcccagauu

SEQ ID NO: 693671 - RNA, 19 nt, Homo sapiens
gauuugauguggagaccaa

SEQ ID NO: 693672 - RNA, 19 nt, Homo sapiens
gcugcagucuuuaaucaug

SEQ ID NO: 693673 - RNA, 19 nt, Homo sapiens
ugggagugcugcagucuuu

SEQ ID NO: 693674 - RNA, 19 nt, Homo sapiens
ccagggauuucaagaguca

SEQ ID NO: 693675 - RNA, 19 nt, Homo sapiens
gaaagaauuagcagauugg

SEQ ID NO: 693676 - RNA, 19 nt, Homo sapiens
ggauauaaaugagcuacca

SEQ ID NO: 693677 - RNA, 19 nt, Homo sapiens
gcaagaugaacuggauaua

SEQ ID NO: 693678 - RNA, 19 nt, Homo sapiens
guuaguaauuccaguguca

SEQ ID NO: 693679 - RNA, 19 nt, Homo sapiens
ggagugcugcagucuuuaa

SEQ ID NO: 693680 - RNA, 19 nt, Homo sapiens
gaaacuagaugaagacuua

SEQ ID NO: 693681 - RNA, 19 nt, Homo sapiens
gaacaaugcucaagucuuu

SEQ ID NO: 693682 - RNA, 19 nt, Homo sapiens
gaacuacggugaagcuuua

SEQ ID NO: 693683 - RNA, 19 nt, Homo sapiens
gguaauagcugguaugauc

SEQ ID NO: 693684 - RNA, 19 nt, Homo sapiens
caaaucuucugaugucuua

SEQ ID NO: 693685 - RNA, 19 nt, Homo sapiens
ggaaggaaguuuaaauaca

SEQ ID NO: 693686 - RNA, 19 nt, Homo sapiens
gagaaucuuuggaguaauu

SEQ ID NO: 693687 - RNA, 19 nt, Homo sapiens
ccaaggagcugagaaagaa

SEQ ID NO: 693688 - RNA, 19 nt, Homo sapiens
gaagugaucaccauuuauu

SEQ ID NO: 693689 - RNA, 19 nt, Homo sapiens
gaugaagacuuacauguca

SEQ ID NO: 693690 - RNA, 19 nt, Homo sapiens
aaacaucacugaagggaaa

SEQ ID NO: 693691 - RNA, 19 nt, Homo sapiens
caucugaucugcagucauu

SEQ ID NO: 693692 - RNA, 19 nt, Homo sapiens
uaaaagagcucccaucuga

SEQ ID NO: 693693 - RNA, 19 nt, Homo sapiens
gaaacucaaugcuacgauu

SEQ ID NO: 693694 - RNA, 19 nt, Homo sapiens
ucaacgagguuauaguuaa

SEQ ID NO: 693695 - RNA, 19 nt, Homo sapiens
gaaggaaguuuaaauacag

SEQ ID NO: 693696 - RNA, 19 nt, Homo sapiens
cagagaaucuuuggaguaa

SEQ ID NO: 693697 - RNA, 19 nt, Homo sapiens
cgaaaugcuuaucucaaua

SEQ ID NO: 693698 - RNA, 19 nt, Homo sapiens
ccuaauggcuggcgucaaa

SEQ ID NO: 693699 - RNA, 19 nt, Homo sapiens
gaaaaggucucacuauugu

SEQ ID NO: 693700 - RNA, 19 nt, Homo sapiens
gaaagguaauuugguggua

SEQ ID NO: 693701 - RNA, 19 nt, Homo sapiens
gaagacaacaguauccaaa

SEQ ID NO: 693702 - RNA, 19 nt, Homo sapiens
uuaacaagcugagccaaua

SEQ ID NO: 693703 - RNA, 19 nt, Homo sapiens
ggaaggaccuccacacacu

SEQ ID NO: 693704 - RNA, 19 nt, Homo sapiens
caagacacauugacguuug

SEQ ID NO: 693705 - RNA, 19 nt, Homo sapiens
gggcacagcuggaguucuu

SEQ ID NO: 693706 - RNA, 19 nt, Homo sapiens
uaagaaagcucgaaaugcu

SEQ ID NO: 693707 - RNA, 19 nt, Homo sapiens
cagaaagagcaaaguauua

SEQ ID NO: 693708 - RNA, 19 nt, Homo sapiens
gaaagaugcucagaagucu

SEQ ID NO: 693709 - RNA, 19 nt, Homo sapiens
ccaaggaaauuaacaacau

SEQ ID NO: 693710 - RNA, 19 nt, Homo sapiens
gcacuuugaugauggaaca

SEQ ID NO: 693711 - RNA, 19 nt, Homo sapiens
ccaaauggguaccuucaug

SEQ ID NO: 693712 - RNA, 19 nt, Homo sapiens
gugaugggcuggccuaaug

SEQ ID NO: 693713 - RNA, 19 nt, Homo sapiens
gaaccuaccugggcuuuac

SEQ ID NO: 693714 - RNA, 19 nt, Homo sapiens
ccaccuccuuuguuuauuu

SEQ ID NO: 693715 - RNA, 19 nt, Homo sapiens
gcucugauguucauuucuu

SEQ ID NO: 693716 - RNA, 19 nt, Homo sapiens
gacagucccaucaaaguua

SEQ ID NO: 693717 - RNA, 19 nt, Homo sapiens
ggaccuagccaccuuccua

SEQ ID NO: 693718 - RNA, 19 nt, Homo sapiens
cgaagucaauggaaggauu

SEQ ID NO: 693719 - RNA, 19 nt, Homo sapiens
cuauaucacuuacgcauug

SEQ ID NO: 693720 - RNA, 19 nt, Homo sapiens
uaaauaacaugcgugucua

SEQ ID NO: 693721 - RNA, 19 nt, Homo sapiens
guacauccuuggugccauu

SEQ ID NO: 693722 - RNA, 19 nt, Homo sapiens
guacaauguugacugcuau

SEQ ID NO: 693723 - RNA, 19 nt, Homo sapiens
ucaaccgcauggccaauua

SEQ ID NO: 693724 - RNA, 19 nt, Homo sapiens
gaaacucaacgagguuaua

SEQ ID NO: 693725 - RNA, 19 nt, Homo sapiens
ucucauguguuaccucuuu

SEQ ID NO: 693726 - RNA, 19 nt, Homo sapiens
acaauaacgucacuucaau

SEQ ID NO: 693727 - RNA, 19 nt, Homo sapiens
ugaagaaggagaugaauau

SEQ ID NO: 693728 - RNA, 19 nt, Homo sapiens
cacaguagcccaauuagaa

SEQ ID NO: 693729 - RNA, 19 nt, Homo sapiens
gcaaauauucccucaacau

SEQ ID NO: 693730 - RNA, 19 nt, Homo sapiens
gcacaugacuuggacaaaa

SEQ ID NO: 693731 - RNA, 19 nt, Homo sapiens
agacagagaggcacaauug

SEQ ID NO: 693732 - RNA, 19 nt, Homo sapiens
cuacuaccauuccuacuga

SEQ ID NO: 693733 - RNA, 19 nt, Homo sapiens
ucagaagucuauuccgauu

SEQ ID NO: 693734 - RNA, 19 nt, Homo sapiens
ccaugaauauguucuuguu

SEQ ID NO: 693735 - RNA, 19 nt, Homo sapiens
caaggaaauuaacaacaug

SEQ ID NO: 693736 - RNA, 19 nt, Homo sapiens
aagcaaagcugguuuuauu

SEQ ID NO: 693737 - RNA, 19 nt, Homo sapiens
gguaugaucuacaaguaca

SEQ ID NO: 693738 - RNA, 19 nt, Homo sapiens
uaccugggcuuuacuucua

SEQ ID NO: 693739 - RNA, 19 nt, Homo sapiens
cagcuuaaaccaugaauau

SEQ ID NO: 693740 - RNA, 19 nt, Homo sapiens
aagcugagccaauaaauga

SEQ ID NO: 693741 - RNA, 19 nt, Homo sapiens
ggagaugcaugacagugau

SEQ ID NO: 693742 - RNA, 19 nt, Homo sapiens
ccagcaauguggagcaauu

SEQ ID NO: 693743 - RNA, 19 nt, Homo sapiens
uggauuggcuagugguaua

SEQ ID NO: 693744 - RNA, 19 nt, Homo sapiens
caacaugacagucccauca

SEQ ID NO: 693745 - RNA, 19 nt, Homo sapiens
gagcaaaggaacaugaaga

SEQ ID NO: 693746 - RNA, 19 nt, Homo sapiens
gcaagucaaguacguauuc

SEQ ID NO: 693747 - RNA, 19 nt, Homo sapiens
aaacagagcgagacagaga

SEQ ID NO: 693748 - RNA, 19 nt, Homo sapiens
agacaacaguauccaaaug

SEQ ID NO: 693749 - RNA, 19 nt, Homo sapiens
auacggaucuucacaguag

SEQ ID NO: 693750 - RNA, 19 nt, Homo sapiens
gugaugcugugaaagguaa

SEQ ID NO: 693751 - RNA, 19 nt, Homo sapiens
uaucauggcuggaucaaac

SEQ ID NO: 693752 - RNA, 19 nt, Homo sapiens
gaccgugcuugaccuguuu

SEQ ID NO: 693753 - RNA, 19 nt, Homo sapiens
uaacaagucccaugaagca

SEQ ID NO: 693754 - RNA, 19 nt, Homo sapiens
ggugaaagaccgaaacuca

SEQ ID NO: 693755 - RNA, 19 nt, Homo sapiens
ucgaaaugcuuaucucaau

SEQ ID NO: 693756 - RNA, 19 nt, Homo sapiens
guucauuucuuccugguau

SEQ ID NO: 693757 - RNA, 19 nt, Homo sapiens
gagcuuggaauacucauug

SEQ ID NO: 693758 - RNA, 19 nt, Homo sapiens
caccugugaugaauacuuu

SEQ ID NO: 693759 - RNA, 19 nt, Homo sapiens
gcucuaagaccaaggaaau

SEQ ID NO: 693760 - RNA, 19 nt, Homo sapiens
gacaacaguauccaaauga

SEQ ID NO: 693761 - RNA, 19 nt, Homo sapiens
gaccauaaagcaccuaaug

SEQ ID NO: 693762 - RNA, 19 nt, Homo sapiens
gauaacaucauaccguuuc

SEQ ID NO: 693763 - RNA, 19 nt, Homo sapiens
ugccaaggauaacaucaua

SEQ ID NO: 693764 - RNA, 19 nt, Homo sapiens
gaagaaggagaugaauauu

SEQ ID NO: 693765 - RNA, 19 nt, Homo sapiens
gcacaugcggcuauccaaa

SEQ ID NO: 693766 - RNA, 19 nt, Homo sapiens
gcauacggaucuucacagu

SEQ ID NO: 693767 - RNA, 19 nt, Homo sapiens
caaguacauugaauaccaa

SEQ ID NO: 693768 - RNA, 19 nt, Homo sapiens
gaagucaugguucaauguu

SEQ ID NO: 693769 - RNA, 19 nt, Homo sapiens
uaaaagggaugcuagaaau

SEQ ID NO: 693770 - RNA, 19 nt, Homo sapiens
cauaagaaagcucgaaaug

SEQ ID NO: 693771 - RNA, 19 nt, Homo sapiens
caccuccuuuguuuauuua

SEQ ID NO: 693772 - RNA, 19 nt, Homo sapiens
uugcaaacauuacuucgaa

SEQ ID NO: 693773 - RNA, 19 nt, Homo sapiens
gcuuaaaccaugaauaugu

SEQ ID NO: 693774 - RNA, 19 nt, Homo sapiens
guacguauucagcauuaaa

SEQ ID NO: 693775 - RNA, 19 nt, Homo sapiens
acaaguacauugaauacca

SEQ ID NO: 693776 - RNA, 19 nt, Homo sapiens
ucuaagaccaaggaaauua

SEQ ID NO: 693777 - RNA, 19 nt, Homo sapiens
aaguacguauucagcauua

SEQ ID NO: 693778 - RNA, 19 nt, Homo sapiens
gacaacugcugcccaucuu

SEQ ID NO: 693779 - RNA, 19 nt, Homo sapiens
ggaaaaggucucacuauug

SEQ ID NO: 693780 - RNA, 19 nt, Homo sapiens
guacaucgagugaagauua

SEQ ID NO: 693781 - RNA, 19 nt, Homo sapiens
gaagcuggauguucaguga

SEQ ID NO: 693782 - RNA, 19 nt, Homo sapiens
acagagaacuuaagacuga

SEQ ID NO: 693783 - RNA, 19 nt, Homo sapiens
aagcagagaucauaucauu

SEQ ID NO: 693784 - RNA, 19 nt, Homo sapiens
gaagccagccuguuuauau

SEQ ID NO: 693785 - RNA, 19 nt, Homo sapiens
ggaaugacagcaagaaauu

SEQ ID NO: 693786 - RNA, 19 nt, Homo sapiens
cauagaagcuggauguuca

SEQ ID NO: 693787 - RNA, 19 nt, Homo sapiens
gaucauaucauuaggucua

SEQ ID NO: 693788 - RNA, 19 nt, Homo sapiens
gcaaugaaccaucuaagug

SEQ ID NO: 693789 - RNA, 19 nt, Homo sapiens
gcagagaucauaucauuag

SEQ ID NO: 693790 - RNA, 19 nt, Homo sapiens
gaauaucuuuccaccauca

SEQ ID NO: 693791 - RNA, 19 nt, Homo sapiens
gaaagaaaaugccuugguu

SEQ ID NO: 693792 - RNA, 19 nt, Homo sapiens
cagaauaucuuuccaccau

SEQ ID NO: 693793 - RNA, 19 nt, Homo sapiens
guccaaacaucaagcagua

SEQ ID NO: 693794 - RNA, 19 nt, Homo sapiens
cugaugagcuucuuucuuc

SEQ ID NO: 693795 - RNA, 19 nt, Homo sapiens
gaaaaugccuugguucaga

SEQ ID NO: 693796 - RNA, 19 nt, Homo sapiens
ucagagacuuuaugggaaa

SEQ ID NO: 693797 - RNA, 19 nt, Homo sapiens
gaucuuaucacaccacaug

SEQ ID NO: 693798 - RNA, 19 nt, Homo sapiens
gaagaaccuuuucauagaa

SEQ ID NO: 693799 - RNA, 19 nt, Homo sapiens
cgagugaagauuauguuua

SEQ ID NO: 693800 - RNA, 19 nt, Homo sapiens
ccguuacuauggugaauua

SEQ ID NO: 693801 - RNA, 19 nt, Homo sapiens
cuccuaaacuggaccauaa

SEQ ID NO: 693802 - RNA, 19 nt, Homo sapiens
ccucagaguuuccuucuca

SEQ ID NO: 693803 - RNA, 19 nt, Homo sapiens
gaaagugcuucgugcuaca

SEQ ID NO: 693804 - RNA, 19 nt, Homo sapiens
ucauugagcuucauaacca

SEQ ID NO: 693805 - RNA, 19 nt, Homo sapiens
gugcuacacuguccaaaca

SEQ ID NO: 693806 - RNA, 19 nt, Homo sapiens
ucagaaagaucgcaaaaug

SEQ ID NO: 693807 - RNA, 19 nt, Homo sapiens
acuaaggauuucagcaaua

SEQ ID NO: 693808 - RNA, 19 nt, Homo sapiens
gagauagaccucccuguuc

SEQ ID NO: 693809 - RNA, 19 nt, Homo sapiens
gccagaauaucuauaaugc

SEQ ID NO: 693810 - RNA, 19 nt, Homo sapiens
ugaggaagcugccguuacu

SEQ ID NO: 693811 - RNA, 19 nt, Homo sapiens
gacuaaggauuucagcaau

SEQ ID NO: 693812 - RNA, 19 nt, Homo sapiens
gguauaauuucuucaccau

SEQ ID NO: 693813 - RNA, 19 nt, Homo sapiens
gcagagcccugugcuucga

SEQ ID NO: 693814 - RNA, 19 nt, Homo sapiens
gaacuuaagacugacaauc

SEQ ID NO: 693815 - RNA, 19 nt, Homo sapiens
cgagauagaccucccuguu

SEQ ID NO: 693816 - RNA, 19 nt, Homo sapiens
gaaugacagcaagaaauuu

SEQ ID NO: 693817 - RNA, 19 nt, Homo sapiens
uaaacuggaccauaauuuc

SEQ ID NO: 693818 - RNA, 19 nt, Homo sapiens
gauggcggaugcaaaucaa

SEQ ID NO: 693819 - RNA, 19 nt, Homo sapiens
aagccagccuguuuauauu

SEQ ID NO: 693820 - RNA, 19 nt, Homo sapiens
gaauaguucuacuccuucu

SEQ ID NO: 693821 - RNA, 19 nt, Homo sapiens
aucauuaggucuaccauuu

SEQ ID NO: 693822 - RNA, 19 nt, Homo sapiens
uggagucuauggugaugua

SEQ ID NO: 693823 - RNA, 19 nt, Homo sapiens
gggaaagugcuucgugcua

SEQ ID NO: 693824 - RNA, 19 nt, Homo sapiens
gggaaugacagcaagaaau

SEQ ID NO: 693825 - RNA, 19 nt, Homo sapiens
uauccuauuuggagucuau

SEQ ID NO: 693826 - RNA, 19 nt, Homo sapiens
gccauuggauuuccucaag

SEQ ID NO: 693827 - RNA, 19 nt, Homo sapiens
cuaaggauuucagcaauag

SEQ ID NO: 693828 - RNA, 19 nt, Homo sapiens
caccgaagcagagaucaua

SEQ ID NO: 693829 - RNA, 19 nt, Homo sapiens
aaacuggaccauaauuuca

SEQ ID NO: 693830 - RNA, 19 nt, Homo sapiens
cuaaacuggaccauaauuu

SEQ ID NO: 693831 - RNA, 19 nt, Homo sapiens
ugacuaaggauuucagcaa

SEQ ID NO: 693832 - RNA, 19 nt, Homo sapiens
caaugaaggcacaguccua

SEQ ID NO: 693833 - RNA, 19 nt, Homo sapiens
ggaagcugccguuacuaug

SEQ ID NO: 693834 - RNA, 19 nt, Homo sapiens
aaucaccaccucagaguuu

SEQ ID NO: 693835 - RNA, 19 nt, Homo sapiens
ccaucuaaguggucagaga

SEQ ID NO: 693836 - RNA, 19 nt, Homo sapiens
cugacaaucuaccuaauca

SEQ ID NO: 693837 - RNA, 19 nt, Homo sapiens
agacugacaaucuaccuaa

SEQ ID NO: 693838 - RNA, 19 nt, Homo sapiens
guauuccaaucacagagaa

SEQ ID NO: 693839 - RNA, 19 nt, Homo sapiens
gaagcugccguuacuaugg

SEQ ID NO: 693840 - RNA, 19 nt, Homo sapiens
ucagauggcggaugcaaau

SEQ ID NO: 693841 - RNA, 19 nt, Homo sapiens
uaaauuuggcacagucuug

SEQ ID NO: 693842 - RNA, 19 nt, Homo sapiens
ccugugcuucgaauaauua

SEQ ID NO: 693843 - RNA, 19 nt, Homo sapiens
acuuaagacugacaaucua

SEQ ID NO: 693844 - RNA, 19 nt, Homo sapiens
cuucgaagccagccuguuu

SEQ ID NO: 693845 - RNA, 19 nt, Homo sapiens
cagccacucugcaucuuuc

SEQ ID NO: 693846 - RNA, 19 nt, Homo sapiens
agacuucacucgcuuagac

SEQ ID NO: 693847 - RNA, 19 nt, Homo sapiens
gaugaucugaagaaccuuu

SEQ ID NO: 693848 - RNA, 19 nt, Homo sapiens
gcuacacuguccaaacauc

SEQ ID NO: 693849 - RNA, 19 nt, Homo sapiens
ucucaauccugaucuuauc

SEQ ID NO: 693850 - RNA, 19 nt, Homo sapiens
ggccagaauaucuauaaug

SEQ ID NO: 693851 - RNA, 19 nt, Homo sapiens
gacaaucuaccuaaucaag

SEQ ID NO: 693852 - RNA, 19 nt, Homo sapiens
cgaagcagagaucauauca

SEQ ID NO: 693853 - RNA, 19 nt, Homo sapiens
uucaaaaccuucagacaua

SEQ ID NO: 693854 - RNA, 19 nt, Homo sapiens
accaaggucugacuaagga

SEQ ID NO: 693855 - RNA, 19 nt, Homo sapiens
caccagccuuaaugugaaa

SEQ ID NO: 693856 - RNA, 19 nt, Homo sapiens
gcauugacuucuccaagcu

SEQ ID NO: 693857 - RNA, 19 nt, Homo sapiens
ugaagauuaucaccuuuac

SEQ ID NO: 693858 - RNA, 19 nt, Homo sapiens
ucacagagaacuuaagacu

SEQ ID NO: 693859 - RNA, 19 nt, Homo sapiens
ucaauugggaucuguggaa

SEQ ID NO: 693860 - RNA, 19 nt, Homo sapiens
accaggaaauucuguucua

SEQ ID NO: 693861 - RNA, 19 nt, Homo sapiens
augaauaguucuacuccuu

SEQ ID NO: 693862 - RNA, 19 nt, Homo sapiens
caaucuaccuaaucaagcu

SEQ ID NO: 693863 - RNA, 19 nt, Homo sapiens
gccagccuguuuauauuca

SEQ ID NO: 693864 - RNA, 19 nt, Homo sapiens
gcugcacucugcgcauuga

SEQ ID NO: 693865 - RNA, 19 nt, Homo sapiens
gcacucugcgcauugacuu

SEQ ID NO: 693866 - RNA, 19 nt, Homo sapiens
gcccugugcuucgaauaau

SEQ ID NO: 693867 - RNA, 19 nt, Homo sapiens
ccaaucacagagaacuuaa

SEQ ID NO: 693868 - RNA, 19 nt, Homo sapiens
gugaauuauuacacuccua

SEQ ID NO: 693869 - RNA, 19 nt, Homo sapiens
caaucugacuuuucuguga

SEQ ID NO: 693870 - RNA, 19 nt, Homo sapiens
uacaguggaugaucugaag

SEQ ID NO: 693871 - RNA, 19 nt, Homo sapiens
caaggucugacuaaggauu

SEQ ID NO: 693872 - RNA, 19 nt, Homo sapiens
agugaaggcuuuuaaauuc

SEQ ID NO: 693873 - RNA, 19 nt, Homo sapiens
cauuaggucuaccauuugg

SEQ ID NO: 693874 - RNA, 19 nt, Homo sapiens
uacaucgagugaagauuau

SEQ ID NO: 693875 - RNA, 19 nt, Homo sapiens
ugucagugccguccaauca

SEQ ID NO: 693876 - RNA, 19 nt, Homo sapiens
cagcaagaaauuuaaacga

SEQ ID NO: 693877 - RNA, 19 nt, Homo sapiens
uaaccaugaccuuggagaa

SEQ ID NO: 693878 - RNA, 19 nt, Homo sapiens
uggaugaucugaagaaccu

SEQ ID NO: 693879 - RNA, 19 nt, Homo sapiens
cugcaucuuuccaacauuc

SEQ ID NO: 693880 - RNA, 19 nt, Homo sapiens
gcaccaagcuaacaucuga

SEQ ID NO: 693881 - RNA, 19 nt, Homo sapiens
ggaagcaugucuacuuuau

SEQ ID NO: 693882 - RNA, 19 nt, Homo sapiens
ggaauguucucuuucauca

SEQ ID NO: 693883 - RNA, 19 nt, Homo sapiens
gagaaaggcaccaagcuaa

SEQ ID NO: 693884 - RNA, 19 nt, Homo sapiens
guagaggacuggcaggaaa

SEQ ID NO: 693885 - RNA, 19 nt, Homo sapiens
gcacaccacccacuguuaa

SEQ ID NO: 693886 - RNA, 19 nt, Homo sapiens
gauuuaugcuugcuuguug

SEQ ID NO: 693887 - RNA, 19 nt, Homo sapiens
gaacacaacagcugagcaa

SEQ ID NO: 693888 - RNA, 19 nt, Homo sapiens
gcaaauccaaauugucuuu

SEQ ID NO: 693889 - RNA, 19 nt, Homo sapiens
ggagaaaggcaccaagcua

SEQ ID NO: 693890 - RNA, 19 nt, Homo sapiens
uaaaucaccagccagguua

SEQ ID NO: 693891 - RNA, 19 nt, Homo sapiens
uaaccuuguucgccuauuu

SEQ ID NO: 693892 - RNA, 19 nt, Homo sapiens
gaacuucuacuaugucauc

SEQ ID NO: 693893 - RNA, 19 nt, Homo sapiens
guugagugcuuguuaugaa

SEQ ID NO: 693894 - RNA, 19 nt, Homo sapiens
ucauggagauuaugugguu

SEQ ID NO: 693895 - RNA, 19 nt, Homo sapiens
gcaucucccucccaccuuu

SEQ ID NO: 693896 - RNA, 19 nt, Homo sapiens
gagggaagcaugucuacuu

SEQ ID NO: 693897 - RNA, 19 nt, Homo sapiens
ccagccagguuaagaagaa

SEQ ID NO: 693898 - RNA, 19 nt, Homo sapiens
ugauuggaauguucucuuu

SEQ ID NO: 693899 - RNA, 19 nt, Homo sapiens
gagaaaagcauaaagaaga

SEQ ID NO: 693900 - RNA, 19 nt, Homo sapiens
guccagacaugaagagaug

SEQ ID NO: 693901 - RNA, 19 nt, Homo sapiens
cgaggcaaauccaaauugu

SEQ ID NO: 693902 - RNA, 19 nt, Homo sapiens
agccaaaucuugaaucuag

SEQ ID NO: 693903 - RNA, 19 nt, Homo sapiens
gacgggaacacuccaauga

SEQ ID NO: 693904 - RNA, 19 nt, Homo sapiens
ggugaugauuggaauguuc

SEQ ID NO: 693905 - RNA, 19 nt, Homo sapiens
caaaguugaugcugagaac

SEQ ID NO: 693906 - RNA, 19 nt, Homo sapiens
gaaaggcaccaagcuaaca

SEQ ID NO: 693907 - RNA, 19 nt, Homo sapiens
gggaagcaugucuacuuua

SEQ ID NO: 693908 - RNA, 19 nt, Homo sapiens
ucugaucuauguacuucua

SEQ ID NO: 693909 - RNA, 19 nt, Homo sapiens
guuccuugcucucuguuga

SEQ ID NO: 693910 - RNA, 19 nt, Homo sapiens
ucuacuaugucauccugua

SEQ ID NO: 693911 - RNA, 19 nt, Homo sapiens
agggaagcaugucuacuuu

SEQ ID NO: 693912 - RNA, 19 nt, Homo sapiens
caagacugcugaugaaaau

SEQ ID NO: 693913 - RNA, 19 nt, Homo sapiens
aauguacgcagucaguuua

SEQ ID NO: 693914 - RNA, 19 nt, Homo sapiens
caccauccaugagaacauu

SEQ ID NO: 693915 - RNA, 19 nt, Homo sapiens
cgaaggccaccauccauga

SEQ ID NO: 693916 - RNA, 19 nt, Homo sapiens
gcauuauucuagcucuugu

SEQ ID NO: 693917 - RNA, 19 nt, Homo sapiens
agaagaaagugaguuccuu

SEQ ID NO: 693918 - RNA, 19 nt, Homo sapiens
aauguucucuuucaucauc

SEQ ID NO: 693919 - RNA, 19 nt, Homo sapiens
cacaacagcugagcaagag

SEQ ID NO: 693920 - RNA, 19 nt, Homo sapiens
uauucuagcucuuguaagg

SEQ ID NO: 693921 - RNA, 19 nt, Homo sapiens
augcaagacugcugaugaa

SEQ ID NO: 693922 - RNA, 19 nt, Homo sapiens
ccacgaggcaaauccaaau

SEQ ID NO: 693923 - RNA, 19 nt, Homo sapiens
ccaaaucuugaaucuagaa

SEQ ID NO: 693924 - RNA, 19 nt, Homo sapiens
gcaugucuacuuuauccaa

SEQ ID NO: 693925 - RNA, 19 nt, Homo sapiens
acacaacagcugagcaaga

SEQ ID NO: 693926 - RNA, 19 nt, Homo sapiens
aaauguacgcagucaguuu

SEQ ID NO: 693927 - RNA, 19 nt, Homo sapiens
gccagguuaagaagaaaua

SEQ ID NO: 693928 - RNA, 19 nt, Homo sapiens
gcaagacugcugaugaaaa

SEQ ID NO: 693929 - RNA, 19 nt, Homo sapiens
gauagaugacauuucaauc

SEQ ID NO: 693930 - RNA, 19 nt, Homo sapiens
uuaaaucaccagccagguu

SEQ ID NO: 693931 - RNA, 19 nt, Homo sapiens
cuguuaacauucugaucua

SEQ ID NO: 693932 - RNA, 19 nt, Homo sapiens
gagugcuuguuaugaaugu

SEQ ID NO: 693933 - RNA, 19 nt, Homo sapiens
gccaaaucuugaaucuaga

SEQ ID NO: 693934 - RNA, 19 nt, Homo sapiens
guacgcagucaguuuaaag

SEQ ID NO: 693935 - RNA, 19 nt, Homo sapiens
gcuuguuggagcaauauuu

SEQ ID NO: 693936 - RNA, 19 nt, Homo sapiens
ugaguuccuugcucucugu

SEQ ID NO: 693937 - RNA, 19 nt, Homo sapiens
aagcaugucuacuuuaucc

SEQ ID NO: 693938 - RNA, 19 nt, Homo sapiens
ucaccagccagguuaagaa

SEQ ID NO: 693939 - RNA, 19 nt, Homo sapiens
gagccaaaucuugaaucua

SEQ ID NO: 693940 - RNA, 19 nt, Homo sapiens
ugagcacugugaaauccaa

SEQ ID NO: 693941 - RNA, 19 nt, Homo sapiens
ggugagcacugugaaaucc

SEQ ID NO: 693942 - RNA, 19 nt, Homo sapiens
ccaaaguugaugcugagaa

SEQ ID NO: 693943 - RNA, 19 nt, Homo sapiens
gaagcaugucuacuuuauc

SEQ ID NO: 693944 - RNA, 19 nt, Homo sapiens
aaugcaagacugcugauga

SEQ ID NO: 693945 - RNA, 19 nt, Homo sapiens
gacaauuggcgccagaaca

SEQ ID NO: 693946 - RNA, 19 nt, Homo sapiens
caugucuacuuuauccaau

SEQ ID NO: 693947 - RNA, 19 nt, Homo sapiens
gacauuucaaucucaguga

SEQ ID NO: 693948 - RNA, 19 nt, Homo sapiens
ccaauaaagauagaugaca

SEQ ID NO: 693949 - RNA, 19 nt, Homo sapiens
ggccaauaaagauagauga

SEQ ID NO: 693950 - RNA, 19 nt, Homo sapiens
agagccaaaucuugaaucu

SEQ ID NO: 693951 - RNA, 19 nt, Homo sapiens
gaaaaguacaagagccaaa

SEQ ID NO: 693952 - RNA, 19 nt, Homo sapiens
gugguuggccaauaaagau

SEQ ID NO: 693953 - RNA, 19 nt, Homo sapiens
ucuagcucuuguaagguua

SEQ ID NO: 693954 - RNA, 19 nt, Homo sapiens
guuuguugagugcuuguua

SEQ ID NO: 693955 - RNA, 19 nt, Homo sapiens
guuaacauucugaucuaug

SEQ ID NO: 693956 - RNA, 19 nt, Homo sapiens
auuggaauguucucuuuca

SEQ ID NO: 693957 - RNA, 19 nt, Homo sapiens
caucucccucccaccuuua

SEQ ID NO: 693958 - RNA, 19 nt, Homo sapiens
cagccagguuaagaagaaa

SEQ ID NO: 693959 - RNA, 19 nt, Homo sapiens
ggcauuauucuagcucuug

SEQ ID NO: 693960 - RNA, 19 nt, Homo sapiens
gccacgaggcaaauccaaa

SEQ ID NO: 693961 - RNA, 19 nt, Homo sapiens
caggagggaagcaugucua

SEQ ID NO: 693962 - RNA, 19 nt, Homo sapiens
guuggccaauaaagauaga

SEQ ID NO: 693963 - RNA, 19 nt, Homo sapiens
auuaugugguuggccaaua

SEQ ID NO: 693964 - RNA, 19 nt, Homo sapiens
gaaggccaccauccaugag

SEQ ID NO: 693965 - RNA, 19 nt, Homo sapiens
gcacugugaaauccaagag

SEQ ID NO: 693966 - RNA, 19 nt, Homo sapiens
auucugaucuauguacuuc

SEQ ID NO: 693967 - RNA, 19 nt, Homo sapiens
gcaccaagcuaacaucuga

SEQ ID NO: 693968 - RNA, 19 nt, Homo sapiens
ggaagcaugucuacuuuau

SEQ ID NO: 693969 - RNA, 19 nt, Homo sapiens
ggaauguucucuuucauca

SEQ ID NO: 693970 - RNA, 19 nt, Homo sapiens
gagaaaggcaccaagcuaa

SEQ ID NO: 693971 - RNA, 19 nt, Homo sapiens
guagaggacuggcaggaaa

SEQ ID NO: 693972 - RNA, 19 nt, Homo sapiens
gauuuaugcuugcuuguug

SEQ ID NO: 693973 - RNA, 19 nt, Homo sapiens
gaacacaacagcugagcaa

SEQ ID NO: 693974 - RNA, 19 nt, Homo sapiens
gcaaauccaaauugucuuu

SEQ ID NO: 693975 - RNA, 19 nt, Homo sapiens
ggagaaaggcaccaagcua

SEQ ID NO: 693976 - RNA, 19 nt, Homo sapiens
gaacuucuacuaugucauc

SEQ ID NO: 693977 - RNA, 19 nt, Homo sapiens
ucauggagauuaugugguu

SEQ ID NO: 693978 - RNA, 19 nt, Homo sapiens
gagggaagcaugucuacuu

SEQ ID NO: 693979 - RNA, 19 nt, Homo sapiens
ugauuggaauguucucuuu

SEQ ID NO: 693980 - RNA, 19 nt, Homo sapiens
guccagacaugaagagaug

SEQ ID NO: 693981 - RNA, 19 nt, Homo sapiens
cgaggcaaauccaaauugu

SEQ ID NO: 693982 - RNA, 19 nt, Homo sapiens
agccaaaucuugaaucuag

SEQ ID NO: 693983 - RNA, 19 nt, Homo sapiens
gacgggaacacuccaauga

SEQ ID NO: 693984 - RNA, 19 nt, Homo sapiens
ggugaugauuggaauguuc

SEQ ID NO: 693985 - RNA, 19 nt, Homo sapiens
caaaguugaugcugagaac

SEQ ID NO: 693986 - RNA, 19 nt, Homo sapiens
gaaaggcaccaagcuaaca

SEQ ID NO: 693987 - RNA, 19 nt, Homo sapiens
gggaagcaugucuacuuua

SEQ ID NO: 693988 - RNA, 19 nt, Homo sapiens
guuccuugcucucuguuga

SEQ ID NO: 693989 - RNA, 19 nt, Homo sapiens
ucuacuaugucauccugua

SEQ ID NO: 693990 - RNA, 19 nt, Homo sapiens
agggaagcaugucuacuuu

SEQ ID NO: 693991 - RNA, 19 nt, Homo sapiens
caccauccaugagaacauu

SEQ ID NO: 693992 - RNA, 19 nt, Homo sapiens
cgaaggccaccauccauga

SEQ ID NO: 693993 - RNA, 19 nt, Homo sapiens
agaagaaagugaguuccuu

SEQ ID NO: 693994 - RNA, 19 nt, Homo sapiens
aauguucucuuucaucauc

SEQ ID NO: 693995 - RNA, 19 nt, Homo sapiens
cacaacagcugagcaagag

SEQ ID NO: 693996 - RNA, 19 nt, Homo sapiens
ccacgaggcaaauccaaau

SEQ ID NO: 693997 - RNA, 19 nt, Homo sapiens
ccaaaucuugaaucuagaa

SEQ ID NO: 693998 - RNA, 19 nt, Homo sapiens
gcaugucuacuuuauccaa

SEQ ID NO: 693999 - RNA, 19 nt, Homo sapiens
ccagaagagagcucgcuaa

SEQ ID NO: 694000 - RNA, 19 nt, Homo sapiens
acacaacagcugagcaaga

SEQ ID NO: 694001 - RNA, 19 nt, Homo sapiens
ggcugaggcuugugugcaa

SEQ ID NO: 694002 - RNA, 19 nt, Homo sapiens
gauagaugacauuucaauc

SEQ ID NO: 694003 - RNA, 19 nt, Homo sapiens
ccagcaagaagguucagaa

SEQ ID NO: 694004 - RNA, 19 nt, Homo sapiens
gccaaaucuugaaucuaga

SEQ ID NO: 694005 - RNA, 19 nt, Homo sapiens
gcuuguuggagcaauauuu

SEQ ID NO: 694006 - RNA, 19 nt, Homo sapiens
ugaguuccuugcucucugu

SEQ ID NO: 694007 - RNA, 19 nt, Homo sapiens
aagcaugucuacuuuaucc

SEQ ID NO: 694008 - RNA, 19 nt, Homo sapiens
gaagcaugucuacuuuauc

SEQ ID NO: 694009 - RNA, 19 nt, Homo sapiens
gagccaaaucuugaaucua

SEQ ID NO: 694010 - RNA, 19 nt, Homo sapiens
ugagcacugugaaauccaa

SEQ ID NO: 694011 - RNA, 19 nt, Homo sapiens
ggugagcacugugaaaucc

SEQ ID NO: 694012 - RNA, 19 nt, Homo sapiens
ccaaaguugaugcugagaa

SEQ ID NO: 694013 - RNA, 19 nt, Homo sapiens
caugucuacuuuauccaau

SEQ ID NO: 694014 - RNA, 19 nt, Homo sapiens
gacaauuggcgccagaaca

SEQ ID NO: 694015 - RNA, 19 nt, Homo sapiens
gacauuucaaucucaguga

SEQ ID NO: 694016 - RNA, 19 nt, Homo sapiens
ccaauaaagauagaugaca

SEQ ID NO: 694017 - RNA, 19 nt, Homo sapiens
ggccaauaaagauagauga

SEQ ID NO: 694018 - RNA, 19 nt, Homo sapiens
agagccaaaucuugaaucu

SEQ ID NO: 694019 - RNA, 19 nt, Homo sapiens
gaaaaguacaagagccaaa

SEQ ID NO: 694020 - RNA, 19 nt, Homo sapiens
gugguuggccaauaaagau

SEQ ID NO: 694021 - RNA, 19 nt, Homo sapiens
auuggaauguucucuuuca

SEQ ID NO: 694022 - RNA, 19 nt, Homo sapiens
caggagggaagcaugucua

SEQ ID NO: 694023 - RNA, 19 nt, Homo sapiens
gccacgaggcaaauccaaa

SEQ ID NO: 694024 - RNA, 19 nt, Homo sapiens
guuggccaauaaagauaga

SEQ ID NO: 694025 - RNA, 19 nt, Homo sapiens
auuaugugguuggccaaua

SEQ ID NO: 694026 - RNA, 19 nt, Homo sapiens
gaaggccaccauccaugag

SEQ ID NO: 694027 - RNA, 19 nt, Homo sapiens
gcacugugaaauccaagag

SEQ ID NO: 694028 - RNA, 19 nt, Homo sapiens
gagaagggcugcuacuuaa

SEQ ID NO: 694029 - RNA, 19 nt, Homo sapiens
ggagaagggcugcuacuua

SEQ ID NO: 694030 - RNA, 19 nt, Homo sapiens
cauaaaggguugcuucauu

SEQ ID NO: 694031 - RNA, 19 nt, Homo sapiens
gaaugagaaucuugaguug

SEQ ID NO: 694032 - RNA, 19 nt, Homo sapiens
ggaaggagguugagcucuu

SEQ ID NO: 694033 - RNA, 19 nt, Homo sapiens
gagaaucauuucauccaaa

SEQ ID NO: 694034 - RNA, 19 nt, Homo sapiens
ggaaugagaaucuugaguu

SEQ ID NO: 694035 - RNA, 19 nt, Homo sapiens
gcagcaggcaugugcauua

SEQ ID NO: 694036 - RNA, 19 nt, Homo sapiens
gcaucuaucuccuuaaagu

SEQ ID NO: 694037 - RNA, 19 nt, Homo sapiens
gcagugugcuguccagaga

SEQ ID NO: 694038 - RNA, 19 nt, Homo sapiens
gagcggagcuuugguugga

SEQ ID NO: 694039 - RNA, 19 nt, Homo sapiens
cacagggccuuuaacauuu

SEQ ID NO: 694040 - RNA, 19 nt, Homo sapiens
ggccacaccugaugcguuu

SEQ ID NO: 694041 - RNA, 19 nt, Homo sapiens
ggacugggacgcuuccuuu

SEQ ID NO: 694042 - RNA, 19 nt, Homo sapiens
acacagggccuuuaacauu

SEQ ID NO: 694043 - RNA, 19 nt, Homo sapiens
gcucuugccuccuguugaa

SEQ ID NO: 694044 - RNA, 19 nt, Homo sapiens
gcagaagagugacaaaauu

SEQ ID NO: 694045 - RNA, 19 nt, Homo sapiens
gaagccaacuguccagaag

SEQ ID NO: 694046 - RNA, 19 nt, Homo sapiens
ucagaaacaugcauagcuu

SEQ ID NO: 694047 - RNA, 19 nt, Homo sapiens
gcagcucccucaauacugu

SEQ ID NO: 694048 - RNA, 19 nt, Homo sapiens
gcaggcaugugcauuaugg

SEQ ID NO: 694049 - RNA, 19 nt, Homo sapiens
gugcaacccugggcaguuu

SEQ ID NO: 694050 - RNA, 19 nt, Homo sapiens
gaucuuuccuuuguauguu

SEQ ID NO: 694051 - RNA, 19 nt, Homo sapiens
ggacccagauggcaacagu

SEQ ID NO: 694052 - RNA, 19 nt, Homo sapiens
aaagagugcugcaaguuca

SEQ ID NO: 694053 - RNA, 19 nt, Homo sapiens
auaaaggguugcuucauug

SEQ ID NO: 694054 - RNA, 19 nt, Homo sapiens
agacagacuugaccuuugu

SEQ ID NO: 694055 - RNA, 19 nt, Homo sapiens
gcugggagguggcauucaa

SEQ ID NO: 694056 - RNA, 19 nt, Homo sapiens
gaugaacggaggauaaaug

SEQ ID NO: 694057 - RNA, 19 nt, Homo sapiens
ucauccaaaugccaaauaa

SEQ ID NO: 694058 - RNA, 19 nt, Homo sapiens
gauuugauacuguacauug

SEQ ID NO: 694059 - RNA, 19 nt, Homo sapiens
gaagggcugcuacuuaaca

SEQ ID NO: 694060 - RNA, 19 nt, Homo sapiens
guugagcucuucacugugu

SEQ ID NO: 694061 - RNA, 19 nt, Homo sapiens
ggaaggaccagcgcaaguu

SEQ ID NO: 694062 - RNA, 19 nt, Homo sapiens
aaacaugcauagcuuugga

SEQ ID NO: 694063 - RNA, 19 nt, Homo sapiens
caagcccaguugugaauau

SEQ ID NO: 694064 - RNA, 19 nt, Homo sapiens
cagacagacuugaccuuug

SEQ ID NO: 694065 - RNA, 19 nt, Homo sapiens
cugcaucuaucuccuuaaa

SEQ ID NO: 694066 - RNA, 19 nt, Homo sapiens
gacgaugaacggaggauaa

SEQ ID NO: 694067 - RNA, 19 nt, Homo sapiens
uaacauuucugagguuugg

SEQ ID NO: 694068 - RNA, 19 nt, Homo sapiens
auaaauggcagaagaguga

SEQ ID NO: 694069 - RNA, 19 nt, Homo sapiens
agccgcagcucccucaaua

SEQ ID NO: 694070 - RNA, 19 nt, Homo sapiens
ucacgccgcugcaucuuuc

SEQ ID NO: 694071 - RNA, 19 nt, Homo sapiens
cagcuucagugcuuccauu

SEQ ID NO: 694072 - RNA, 19 nt, Homo sapiens
ccaaaugccaaauaaacuu

SEQ ID NO: 694073 - RNA, 19 nt, Homo sapiens
gcaccaccauccagaaugc

SEQ ID NO: 694074 - RNA, 19 nt, Homo sapiens
cuugagggcuucagaaaca

SEQ ID NO: 694075 - RNA, 19 nt, Homo sapiens
caaagagugcugcaaguuc

SEQ ID NO: 694076 - RNA, 19 nt, Homo sapiens
gaaggaccagcgcaaguug

SEQ ID NO: 694077 - RNA, 19 nt, Homo sapiens
ggcugcaucuaucuccuua

SEQ ID NO: 694078 - RNA, 19 nt, Homo sapiens
gcucuucacugugucuuuc

SEQ ID NO: 694079 - RNA, 19 nt, Homo sapiens
auucagaccgcacauguua

SEQ ID NO: 694080 - RNA, 19 nt, Homo sapiens
gcgcaucgagucccugauu

SEQ ID NO: 694081 - RNA, 19 nt, Homo sapiens
caaaugccaaauaaacuug

SEQ ID NO: 694082 - RNA, 19 nt, Homo sapiens
cagcaggcaugugcauuau

SEQ ID NO: 694083 - RNA, 19 nt, Homo sapiens
cggacaguguguucuauga

SEQ ID NO: 694084 - RNA, 19 nt, Homo sapiens
gggugggacuuuccauuuc

SEQ ID NO: 694085 - RNA, 19 nt, Homo sapiens
gaacuguccagagcuguga

SEQ ID NO: 694086 - RNA, 19 nt, Homo sapiens
ucugagguuuggagauuaa

SEQ ID NO: 694087 - RNA, 19 nt, Homo sapiens
ugagaaucauuucauccaa

SEQ ID NO: 694088 - RNA, 19 nt, Homo sapiens
aaaguccacuccuuacauc

SEQ ID NO: 694089 - RNA, 19 nt, Homo sapiens
ccuuaaaguccacuccuua

SEQ ID NO: 694090 - RNA, 19 nt, Homo sapiens
gagcuuggaaggagguuga

SEQ ID NO: 694091 - RNA, 19 nt, Homo sapiens
gaaccugaagcccugagaa

SEQ ID NO: 694092 - RNA, 19 nt, Homo sapiens
gcucgcguguguacauaga

SEQ ID NO: 694093 - RNA, 19 nt, Homo sapiens
gggcucgcguguguacaua

SEQ ID NO: 694094 - RNA, 19 nt, Homo sapiens
ccaaagagugcugcaaguu

SEQ ID NO: 694095 - RNA, 19 nt, Homo sapiens
agucuucauuucuguguaa

SEQ ID NO: 694096 - RNA, 19 nt, Homo sapiens
gugcccagcuucagugcuu

SEQ ID NO: 694097 - RNA, 19 nt, Homo sapiens
uugguuggguugacacuaa

SEQ ID NO: 694098 - RNA, 19 nt, Homo sapiens
uggacucgcucaucuguuc

SEQ ID NO: 694099 - RNA, 19 nt, Homo sapiens
guccacuucuugacacauu

SEQ ID NO: 694100 - RNA, 19 nt, Homo sapiens
uugaaugucuggaucuuuc

SEQ ID NO: 694101 - RNA, 19 nt, Homo sapiens
gaucacugucuucuccuuu

SEQ ID NO: 694102 - RNA, 19 nt, Homo sapiens
gagcugcaccugccaugga

SEQ ID NO: 694103 - RNA, 19 nt, Homo sapiens
caucccauguggaaugaga

SEQ ID NO: 694104 - RNA, 19 nt, Homo sapiens
uuucugagguuuggagauu

SEQ ID NO: 694105 - RNA, 19 nt, Homo sapiens
ugacacagggccuuuaaca

SEQ ID NO: 694106 - RNA, 19 nt, Homo sapiens
ggcagccucuugacuuugu

SEQ ID NO: 694107 - RNA, 19 nt, Homo sapiens
cuuuauaaauggcagaaga

SEQ ID NO: 694108 - RNA, 19 nt, Homo sapiens
gaaggagagcuuggaagga

SEQ ID NO: 694109 - RNA, 19 nt, Homo sapiens
ucacugucuucuccuuuau

SEQ ID NO: 694110 - RNA, 19 nt, Homo sapiens
ggaucacugucuucuccuu

SEQ ID NO: 694111 - RNA, 19 nt, Homo sapiens
gauacuguacauugucuug

SEQ ID NO: 694112 - RNA, 19 nt, Homo sapiens
gagauuaagcggguucugu

SEQ ID NO: 694113 - RNA, 19 nt, Homo sapiens
gcccaguugugaauaucaa

SEQ ID NO: 694114 - RNA, 19 nt, Homo sapiens
acugucuucuccuuuauaa

SEQ ID NO: 694115 - RNA, 19 nt, Homo sapiens
ucaauacugugguguagac

SEQ ID NO: 694116 - RNA, 19 nt, Homo sapiens
guguguggcugcucucugu

SEQ ID NO: 694117 - RNA, 19 nt, Homo sapiens
ggacaacgugguggaugaa

SEQ ID NO: 694118 - RNA, 19 nt, Homo sapiens
gaugcugugagaaucauuu

SEQ ID NO: 694119 - RNA, 19 nt, Homo sapiens
ggacgaugaacggaggaua

SEQ ID NO: 694120 - RNA, 19 nt, Homo sapiens
gguggcacauggaacuuca

SEQ ID NO: 694121 - RNA, 19 nt, Homo sapiens
gucuggaucuuuccuuugu

SEQ ID NO: 694122 - RNA, 19 nt, Homo sapiens
agguugagcucuucacugu

SEQ ID NO: 694123 - RNA, 19 nt, Homo sapiens
cccguucgcuucagcaguu

SEQ ID NO: 694124 - RNA, 19 nt, Homo sapiens
gagcgacgaagccaacugu

SEQ ID NO: 694125 - RNA, 19 nt, Homo sapiens
uaaaguccacuccuuacau

SEQ ID NO: 694126 - RNA, 19 nt, Homo sapiens
gcugcaaguucaugugucu

SEQ ID NO: 694127 - RNA, 19 nt, Homo sapiens
ccucggccaugucugagaa

SEQ ID NO: 694128 - RNA, 19 nt, Homo sapiens
gaacagagcucuaugauac

SEQ ID NO: 694129 - RNA, 19 nt, Homo sapiens
gaagaaagauaaagugaug

SEQ ID NO: 694130 - RNA, 19 nt, Homo sapiens
ucagagugcucaaauauua

SEQ ID NO: 694131 - RNA, 19 nt, Homo sapiens
gcagauaaguugcugaauu

SEQ ID NO: 694132 - RNA, 19 nt, Homo sapiens
ggaaagaaguuaaaucaca

SEQ ID NO: 694133 - RNA, 19 nt, Homo sapiens
uaugaugccugaugaauua

SEQ ID NO: 694134 - RNA, 19 nt, Homo sapiens
gagaaacacugcacuaaug

SEQ ID NO: 694135 - RNA, 19 nt, Homo sapiens
gaacagcaacuaccagaua

SEQ ID NO: 694136 - RNA, 19 nt, Homo sapiens
caacagugauguauugaaa

SEQ ID NO: 694137 - RNA, 19 nt, Homo sapiens
ggaugaaaguuguauguuu

SEQ ID NO: 694138 - RNA, 19 nt, Homo sapiens
aaagaucccucaucauuaa

SEQ ID NO: 694139 - RNA, 19 nt, Homo sapiens
cagaagacccuguucauua

SEQ ID NO: 694140 - RNA, 19 nt, Homo sapiens
gcagacacauguaagaauu

SEQ ID NO: 694141 - RNA, 19 nt, Homo sapiens
ggaagcagcugucagugaa

SEQ ID NO: 694142 - RNA, 19 nt, Homo sapiens
gaaguuaaaucacaagaca

SEQ ID NO: 694143 - RNA, 19 nt, Homo sapiens
cagaggaacugaaagagua

SEQ ID NO: 694144 - RNA, 19 nt, Homo sapiens
ccgcaaggaugaagaaaua

SEQ ID NO: 694145 - RNA, 19 nt, Homo sapiens
caagucaacucaugaagaa

SEQ ID NO: 694146 - RNA, 19 nt, Homo sapiens
gaugaaaguuguauguuug

SEQ ID NO: 694147 - RNA, 19 nt, Homo sapiens
gaaaaccacuacugauuua

SEQ ID NO: 694148 - RNA, 19 nt, Homo sapiens
gagcaucacuuccucauuc

SEQ ID NO: 694149 - RNA, 19 nt, Homo sapiens
caaaggaggcaacauauaa

SEQ ID NO: 694150 - RNA, 19 nt, Homo sapiens
ggacuuauaugaagagauc

SEQ ID NO: 694151 - RNA, 19 nt, Homo sapiens
ggaacaaguuuauuugaug

SEQ ID NO: 694152 - RNA, 19 nt, Homo sapiens
auaaagagcuugcaaugaa

SEQ ID NO: 694153 - RNA, 19 nt, Homo sapiens
gcagaagacuaauaaggaa

SEQ ID NO: 694154 - RNA, 19 nt, Homo sapiens
aaaggaagcugaugaagga

SEQ ID NO: 694155 - RNA, 19 nt, Homo sapiens
gaaacaaacucaguauauc

SEQ ID NO: 694156 - RNA, 19 nt, Homo sapiens
gcacuucacugccaaaucu

SEQ ID NO: 694157 - RNA, 19 nt, Homo sapiens
ugaaguggcugaugaaugu

SEQ ID NO: 694158 - RNA, 19 nt, Homo sapiens
caagaaaccuacccaagau

SEQ ID NO: 694159 - RNA, 19 nt, Homo sapiens
gaaguacacuguccaagca

SEQ ID NO: 694160 - RNA, 19 nt, Homo sapiens
caagaucacuggagaagau

SEQ ID NO: 694161 - RNA, 19 nt, Homo sapiens
gaagagcccauuuguggua

SEQ ID NO: 694162 - RNA, 19 nt, Homo sapiens
gauaauguguguaguguag

SEQ ID NO: 694163 - RNA, 19 nt, Homo sapiens
uggcauaguugaucguuua

SEQ ID NO: 694164 - RNA, 19 nt, Homo sapiens
caauaaugcuuucagaaga

SEQ ID NO: 694165 - RNA, 19 nt, Homo sapiens
cuacaagucuuucugcaaa

SEQ ID NO: 694166 - RNA, 19 nt, Homo sapiens
gaaaccaagucaacguuau

SEQ ID NO: 694167 - RNA, 19 nt, Homo sapiens
guaaauaccaucuagaaga

SEQ ID NO: 694168 - RNA, 19 nt, Homo sapiens
gcaaaggaggcaacauaua

SEQ ID NO: 694169 - RNA, 19 nt, Homo sapiens
gaagagauccugacugaag

SEQ ID NO: 694170 - RNA, 19 nt, Homo sapiens
uaaagaucccucaucauua

SEQ ID NO: 694171 - RNA, 19 nt, Homo sapiens
ugaaagcauugaagaauug

SEQ ID NO: 694172 - RNA, 19 nt, Homo sapiens
ggagaaauuagaagugaua

SEQ ID NO: 694173 - RNA, 19 nt, Homo sapiens
ggaaaccuauaucgacuug

SEQ ID NO: 694174 - RNA, 19 nt, Homo sapiens
gcaagguucugaucuuuua

SEQ ID NO: 694175 - RNA, 19 nt, Homo sapiens
cagcaagcaucgagccuua

SEQ ID NO: 694176 - RNA, 19 nt, Homo sapiens
uaaguaaucuucaccaaag

SEQ ID NO: 694177 - RNA, 19 nt, Homo sapiens
cagauaaguugcugaauuc

SEQ ID NO: 694178 - RNA, 19 nt, Homo sapiens
gaagaacagagcucuauga

SEQ ID NO: 694179 - RNA, 19 nt, Homo sapiens
gaaaaguacuguguguuua

SEQ ID NO: 694180 - RNA, 19 nt, Homo sapiens
gagaaguccuugauaaugg

SEQ ID NO: 694181 - RNA, 19 nt, Homo sapiens
gaacugaagauaagaggaa

SEQ ID NO: 694182 - RNA, 19 nt, Homo sapiens
acacagaauuucagcuuaa

SEQ ID NO: 694183 - RNA, 19 nt, Homo sapiens
gaagggagaaauuaucauu

SEQ ID NO: 694184 - RNA, 19 nt, Homo sapiens
cuaaagaucccucaucauu

SEQ ID NO: 694185 - RNA, 19 nt, Homo sapiens
ggaaacagacuuaacuaau

SEQ ID NO: 694186 - RNA, 19 nt, Homo sapiens
caaauugcaucaaguaugg

SEQ ID NO: 694187 - RNA, 19 nt, Homo sapiens
gcaacuaccagauaugaaa

SEQ ID NO: 694188 - RNA, 19 nt, Homo sapiens
gaagaaggagaaauuagaa

SEQ ID NO: 694189 - RNA, 19 nt, Homo sapiens
caaaucaggucucagaaag

SEQ ID NO: 694190 - RNA, 19 nt, Homo sapiens
guaaacagaaugcacagua

SEQ ID NO: 694191 - RNA, 19 nt, Homo sapiens
uaacugauauucccaaguc

SEQ ID NO: 694192 - RNA, 19 nt, Homo sapiens
ugaaggagcagauaauaaa

SEQ ID NO: 694193 - RNA, 19 nt, Homo sapiens
gaaauacagacacagaauu

SEQ ID NO: 694194 - RNA, 19 nt, Homo sapiens
gaaaagagggccaucauuu

SEQ ID NO: 694195 - RNA, 19 nt, Homo sapiens
gcacauguuacgaaugaua

SEQ ID NO: 694196 - RNA, 19 nt, Homo sapiens
gaaauuagaagugauagug

SEQ ID NO: 694197 - RNA, 19 nt, Homo sapiens
ggcagcagcuccuguggua

SEQ ID NO: 694198 - RNA, 19 nt, Homo sapiens
gaaacagaaugaaccaaag

SEQ ID NO: 694199 - RNA, 19 nt, Homo sapiens
gacacagaauuucagcuua

SEQ ID NO: 694200 - RNA, 19 nt, Homo sapiens
ugaaaccacugaaagcauu

SEQ ID NO: 694201 - RNA, 19 nt, Homo sapiens
uaaagagcuugcaaugaaa

SEQ ID NO: 694202 - RNA, 19 nt, Homo sapiens
aaggaguacuucacauuua

SEQ ID NO: 694203 - RNA, 19 nt, Homo sapiens
uaaagaugcuucagauaag

SEQ ID NO: 694204 - RNA, 19 nt, Homo sapiens
gcacaaaugggugaaauau

SEQ ID NO: 694205 - RNA, 19 nt, Homo sapiens
gagaauugcugaaagaaaa

SEQ ID NO: 694206 - RNA, 19 nt, Homo sapiens
ggaaaccaagucaacguua

SEQ ID NO: 694207 - RNA, 19 nt, Homo sapiens
ggaaauaaaccgcaaggau

SEQ ID NO: 694208 - RNA, 19 nt, Homo sapiens
gacuaaagaucccucauca

SEQ ID NO: 694209 - RNA, 19 nt, Homo sapiens
agaagacccuguucauuau

SEQ ID NO: 694210 - RNA, 19 nt, Homo sapiens
caacagagaauugcugaaa

SEQ ID NO: 694211 - RNA, 19 nt, Homo sapiens
ggacaacuccaacagagaa

SEQ ID NO: 694212 - RNA, 19 nt, Homo sapiens
agaagaaucucugugauau

SEQ ID NO: 694213 - RNA, 19 nt, Homo sapiens
guauguguguuucuguaua

SEQ ID NO: 694214 - RNA, 19 nt, Homo sapiens
aaagagggccaucauuuaa

SEQ ID NO: 694215 - RNA, 19 nt, Homo sapiens
ggaggcaauuuaaaucaga

SEQ ID NO: 694216 - RNA, 19 nt, Homo sapiens
auacguagaucuaacgaaa

SEQ ID NO: 694217 - RNA, 19 nt, Homo sapiens
uuaaaucuguggaggaauu

SEQ ID NO: 694218 - RNA, 19 nt, Homo sapiens
ugaaacaucuaaaccacaa

SEQ ID NO: 694219 - RNA, 19 nt, Homo sapiens
caaguuccaguguauaaua

SEQ ID NO: 694220 - RNA, 19 nt, Homo sapiens
caaacucaguauaucauga

SEQ ID NO: 694221 - RNA, 19 nt, Homo sapiens
caacaggaaugaaacaaac

SEQ ID NO: 694222 - RNA, 19 nt, Homo sapiens
aagcaacagugauguauug

SEQ ID NO: 694223 - RNA, 19 nt, Homo sapiens
gaaagauuccagcagcuaa

SEQ ID NO: 694224 - RNA, 19 nt, Homo sapiens
gugaugaaguggcugauga

SEQ ID NO: 694225 - RNA, 19 nt, Homo sapiens
ugaagugucuacuaaccua

SEQ ID NO: 694226 - RNA, 19 nt, Homo sapiens
gaauccaucagaccaauaa

SEQ ID NO: 694227 - RNA, 19 nt, Homo sapiens
cuauaaaggugaacgcauu

SEQ ID NO: 694228 - RNA, 19 nt, Homo sapiens
caucugagguccuggcuuu

SEQ ID NO: 694229 - RNA, 19 nt, Homo sapiens
gccagugggugcugaugua

SEQ ID NO: 694230 - RNA, 19 nt, Homo sapiens
ggaagcagagccugguuug

SEQ ID NO: 694231 - RNA, 19 nt, Homo sapiens
gcagaucggcugagcagau

SEQ ID NO: 694232 - RNA, 19 nt, Homo sapiens
acaguuaccgcguguacua

SEQ ID NO: 694233 - RNA, 19 nt, Homo sapiens
gaacccggcugcugaucac

SEQ ID NO: 694234 - RNA, 19 nt, Homo sapiens
gacggccucuucacggauu

SEQ ID NO: 694235 - RNA, 19 nt, Homo sapiens
gauguacuuuggcuucacu

SEQ ID NO: 694236 - RNA, 19 nt, Homo sapiens
gcgaggagcaucagaucca

SEQ ID NO: 694237 - RNA, 19 nt, Homo sapiens
ccacuccauugccaucuac

SEQ ID NO: 694238 - RNA, 19 nt, Homo sapiens
agugggugcugauguacuu

SEQ ID NO: 694239 - RNA, 19 nt, Homo sapiens
cccaggcuagucacaguua

SEQ ID NO: 694240 - RNA, 19 nt, Homo sapiens
gguccuggcuuuugucaag

SEQ ID NO: 694241 - RNA, 19 nt, Homo sapiens
ggacaaagauggccacaua

SEQ ID NO: 694242 - RNA, 19 nt, Homo sapiens
gaagagaugcugccauuua

SEQ ID NO: 694243 - RNA, 19 nt, Homo sapiens
gagaagagaugcugccauu

SEQ ID NO: 694244 - RNA, 19 nt, Homo sapiens
gaagacagauggcucauuc

SEQ ID NO: 694245 - RNA, 19 nt, Homo sapiens
acaaauagcuguugacguu

SEQ ID NO: 694246 - RNA, 19 nt, Homo sapiens
guagacagguauaaugaua

SEQ ID NO: 694247 - RNA, 19 nt, Homo sapiens
gaaauuguaucucagucua

SEQ ID NO: 694248 - RNA, 19 nt, Homo sapiens
ggaguaaacuggcaagaug

SEQ ID NO: 694249 - RNA, 19 nt, Homo sapiens
gcucugaaauggaauauau

SEQ ID NO: 694250 - RNA, 19 nt, Homo sapiens
gaaagcagaguauuaaaga

SEQ ID NO: 694251 - RNA, 19 nt, Homo sapiens
uaaagggucuuaugaaaca

SEQ ID NO: 694252 - RNA, 19 nt, Homo sapiens
ggcaagauguauaugauaa

SEQ ID NO: 694253 - RNA, 19 nt, Homo sapiens
gaauuuggcuuugggagaa

SEQ ID NO: 694254 - RNA, 19 nt, Homo sapiens
ucucagauguugaaacuuu

SEQ ID NO: 694255 - RNA, 19 nt, Homo sapiens
gacauuaaauuuccucgaa

SEQ ID NO: 694256 - RNA, 19 nt, Homo sapiens
aaacgcagcuccaacuuau

SEQ ID NO: 694257 - RNA, 19 nt, Homo sapiens
gaaggcauaugcacaguca

SEQ ID NO: 694258 - RNA, 19 nt, Homo sapiens
gaaauuaugagacacaguu

SEQ ID NO: 694259 - RNA, 19 nt, Homo sapiens
gaccaaagccaaacacauu

SEQ ID NO: 694260 - RNA, 19 nt, Homo sapiens
gaggagagaaugaauugua

SEQ ID NO: 694261 - RNA, 19 nt, Homo sapiens
ugaagaauguagacaggua

SEQ ID NO: 694262 - RNA, 19 nt, Homo sapiens
gcuacugucuuacuauuau

SEQ ID NO: 694263 - RNA, 19 nt, Homo sapiens
ucacugucaucuucaauuu

SEQ ID NO: 694264 - RNA, 19 nt, Homo sapiens
gacguuugcucauuuaaga

SEQ ID NO: 694265 - RNA, 19 nt, Homo sapiens
gcacagucaaggucacuua

SEQ ID NO: 694266 - RNA, 19 nt, Homo sapiens
gcaaagaagggaucacaga

SEQ ID NO: 694267 - RNA, 19 nt, Homo sapiens
gaagaggagagaaugaauu

SEQ ID NO: 694268 - RNA, 19 nt, Homo sapiens
acagauggcucauucauag

SEQ ID NO: 694269 - RNA, 19 nt, Homo sapiens
ccagagguguuagaagaua

SEQ ID NO: 694270 - RNA, 19 nt, Homo sapiens
gcacacacucuaacugaaa

SEQ ID NO: 694271 - RNA, 19 nt, Homo sapiens
aagagaugcugccauuuaa

SEQ ID NO: 694272 - RNA, 19 nt, Homo sapiens
gaaagaagguuggguucag

SEQ ID NO: 694273 - RNA, 19 nt, Homo sapiens
cuuaaagggucuuaugaaa

SEQ ID NO: 694274 - RNA, 19 nt, Homo sapiens
ugagacagauacuagauau

SEQ ID NO: 694275 - RNA, 19 nt, Homo sapiens
uuucagggcucuugauaaa

SEQ ID NO: 694276 - RNA, 19 nt, Homo sapiens
agagaaaccucaagaugug

SEQ ID NO: 694277 - RNA, 19 nt, Homo sapiens
caaacgcagcuccaacuua

SEQ ID NO: 694278 - RNA, 19 nt, Homo sapiens
ugacauuuaucaccucuga

SEQ ID NO: 694279 - RNA, 19 nt, Homo sapiens
cuacuucacugucaucuuc

SEQ ID NO: 694280 - RNA, 19 nt, Homo sapiens
accaagaacugaaggcaua

SEQ ID NO: 694281 - RNA, 19 nt, Homo sapiens
ucugauggcugaagaaugu

SEQ ID NO: 694282 - RNA, 19 nt, Homo sapiens
cgaacacucucuucagaug

SEQ ID NO: 694283 - RNA, 19 nt, Homo sapiens
gaaauauuccuuccagaca

SEQ ID NO: 694284 - RNA, 19 nt, Homo sapiens
aaacacacauacacgcaaa

SEQ ID NO: 694285 - RNA, 19 nt, Homo sapiens
ccaaagccaaacacauuua

SEQ ID NO: 694286 - RNA, 19 nt, Homo sapiens
gguggauacuguagaagaa

SEQ ID NO: 694287 - RNA, 19 nt, Homo sapiens
uagaaggacugaacaacug

SEQ ID NO: 694288 - RNA, 19 nt, Homo sapiens
gaauuuacagcucagacua

SEQ ID NO: 694289 - RNA, 19 nt, Homo sapiens
guaccgugaucucaaguug

SEQ ID NO: 694290 - RNA, 19 nt, Homo sapiens
gaaagaagucauuauugca

SEQ ID NO: 694291 - RNA, 19 nt, Homo sapiens
gcucauucauaggauauaa

SEQ ID NO: 694292 - RNA, 19 nt, Homo sapiens
agaaagaagucauuauugc

SEQ ID NO: 694293 - RNA, 19 nt, Homo sapiens
guugacguuugcucauuua

SEQ ID NO: 694294 - RNA, 19 nt, Homo sapiens
gcaaauacacuccaguuuu

SEQ ID NO: 694295 - RNA, 19 nt, Homo sapiens
gaagaggggagaauauaua

SEQ ID NO: 694296 - RNA, 19 nt, Homo sapiens
gcagcuccaacuuauauaa

SEQ ID NO: 694297 - RNA, 19 nt, Homo sapiens
acagguguuugccuuauuu

SEQ ID NO: 694298 - RNA, 19 nt, Homo sapiens
caaccaggaccaugagaaa

SEQ ID NO: 694299 - RNA, 19 nt, Homo sapiens
auaaggcucugaaauggaa

SEQ ID NO: 694300 - RNA, 19 nt, Homo sapiens
gaaguaggcauauaucacu

SEQ ID NO: 694301 - RNA, 19 nt, Homo sapiens
guucauuugugcaccaauu

SEQ ID NO: 694302 - RNA, 19 nt, Homo sapiens
agaagaagcccauaucaca

SEQ ID NO: 694303 - RNA, 19 nt, Homo sapiens
gcaagaagaggagagaaug

SEQ ID NO: 694304 - RNA, 19 nt, Homo sapiens
gacagauggcucauucaua

SEQ ID NO: 694305 - RNA, 19 nt, Homo sapiens
aaagagaaaccucaagaug

SEQ ID NO: 694306 - RNA, 19 nt, Homo sapiens
uaaacuggcaagauguaua

SEQ ID NO: 694307 - RNA, 19 nt, Homo sapiens
gcaaaaugccaguuaauga

SEQ ID NO: 694308 - RNA, 19 nt, Homo sapiens
aaauagcuguugacguuug

SEQ ID NO: 694309 - RNA, 19 nt, Homo sapiens
gaagaagcccauaucacau

SEQ ID NO: 694310 - RNA, 19 nt, Homo sapiens
acaauaacaccaccugaaa

SEQ ID NO: 694311 - RNA, 19 nt, Homo sapiens
gaacacuagacaucccuuu

SEQ ID NO: 694312 - RNA, 19 nt, Homo sapiens
ggaaaauacuaugcuauga

SEQ ID NO: 694313 - RNA, 19 nt, Homo sapiens
gaauuguaguccaacuuca

SEQ ID NO: 694314 - RNA, 19 nt, Homo sapiens
agaaugaauuguaguccaa

SEQ ID NO: 694315 - RNA, 19 nt, Homo sapiens
ucuaaggucucaugcuguu

SEQ ID NO: 694316 - RNA, 19 nt, Homo sapiens
acaaagauggccacauaaa

SEQ ID NO: 694317 - RNA, 19 nt, Homo sapiens
augaugaccuggcaacaaa

SEQ ID NO: 694318 - RNA, 19 nt, Homo sapiens
ugauaaggcucugaaaugg

SEQ ID NO: 694319 - RNA, 19 nt, Homo sapiens
caagauacuuccuuuugaa

SEQ ID NO: 694320 - RNA, 19 nt, Homo sapiens
gaaguaauuuuccaaccuu

SEQ ID NO: 694321 - RNA, 19 nt, Homo sapiens
cagagguguuagaagauaa

SEQ ID NO: 694322 - RNA, 19 nt, Homo sapiens
ggaccgcacacguuucuau

SEQ ID NO: 694323 - RNA, 19 nt, Homo sapiens
caagaagaggagagaauga

SEQ ID NO: 694324 - RNA, 19 nt, Homo sapiens
gaauugauuaggaagcauu

SEQ ID NO: 694325 - RNA, 19 nt, Homo sapiens
ugagauacacugauucuag

SEQ ID NO: 694326 - RNA, 19 nt, Homo sapiens
aaauauuccuuccagacaa

SEQ ID NO: 694327 - RNA, 19 nt, Homo sapiens
uaguccaacuucacaaauu

SEQ ID NO: 694328 - RNA, 19 nt, Homo sapiens
gaagaauguagacagguau

SEQ ID NO: 694329 - RNA, 19 nt, Homo sapiens
gaagggugguggcgugcau

SEQ ID NO: 694330 - RNA, 19 nt, Homo sapiens
ucagggcucuugauaaagg

SEQ ID NO: 694331 - RNA, 19 nt, Homo sapiens
gaagguuggguucagaaga

SEQ ID NO: 694332 - RNA, 19 nt, Homo sapiens
cagccaccaugaagacauu

SEQ ID NO: 694333 - RNA, 19 nt, Homo sapiens
gcuaugaagauucugaaga

SEQ ID NO: 694334 - RNA, 19 nt, Homo sapiens
gauguggauuuaccuuauc

SEQ ID NO: 694335 - RNA, 19 nt, Homo sapiens
gccaaacacauuuauaauc

SEQ ID NO: 694336 - RNA, 19 nt, Homo sapiens
aaauagacuuacugcaguu

SEQ ID NO: 694337 - RNA, 19 nt, Homo sapiens
gaauguagacagguauaau

SEQ ID NO: 694338 - RNA, 19 nt, Homo sapiens
guagaagaagcccauauca

SEQ ID NO: 694339 - RNA, 19 nt, Homo sapiens
uuaaauuccugguggauac

SEQ ID NO: 694340 - RNA, 19 nt, Homo sapiens
gauuaggaagcauuuggua

SEQ ID NO: 694341 - RNA, 19 nt, Homo sapiens
gaaugaagcuguuuucuuu

SEQ ID NO: 694342 - RNA, 19 nt, Homo sapiens
gaacauccauacccuccua

SEQ ID NO: 694343 - RNA, 19 nt, Homo sapiens
gacagaacauguaauaaug

SEQ ID NO: 694344 - RNA, 19 nt, Homo sapiens
gaaaauggcuguugaucuu

SEQ ID NO: 694345 - RNA, 19 nt, Homo sapiens
uguaaacgcucucggaauu

SEQ ID NO: 694346 - RNA, 19 nt, Homo sapiens
caaguucacucuguuaguu

SEQ ID NO: 694347 - RNA, 19 nt, Homo sapiens
gagacaaucugcugggaau

SEQ ID NO: 694348 - RNA, 19 nt, Homo sapiens
ggaaucgaguacauccuuu

SEQ ID NO: 694349 - RNA, 19 nt, Homo sapiens
ucauguaacuagaguggua

SEQ ID NO: 694350 - RNA, 19 nt, Homo sapiens
uuagaacacuugaaucaga

SEQ ID NO: 694351 - RNA, 19 nt, Homo sapiens
gugguaguguccuggauua

SEQ ID NO: 694352 - RNA, 19 nt, Homo sapiens
guaacuagagugguaauaa

SEQ ID NO: 694353 - RNA, 19 nt, Homo sapiens
gacuugggaucaguuauaa

SEQ ID NO: 694354 - RNA, 19 nt, Homo sapiens
cccacuagcugauuacuau

SEQ ID NO: 694355 - RNA, 19 nt, Homo sapiens
ugaaucagaugguuggaau

SEQ ID NO: 694356 - RNA, 19 nt, Homo sapiens
guaguguccuggauuacuu

SEQ ID NO: 694357 - RNA, 19 nt, Homo sapiens
caaagaucaugaagagcaa

SEQ ID NO: 694358 - RNA, 19 nt, Homo sapiens
uaaacgcucucggaauuau

SEQ ID NO: 694359 - RNA, 19 nt, Homo sapiens
uuaaggugauucaagguuu

SEQ ID NO: 694360 - RNA, 19 nt, Homo sapiens
gaugcaaguucacucuguu

SEQ ID NO: 694361 - RNA, 19 nt, Homo sapiens
guaaacgcucucggaauua

SEQ ID NO: 694362 - RNA, 19 nt, Homo sapiens
gaagagcaagguaaguaga

SEQ ID NO: 694363 - RNA, 19 nt, Homo sapiens
gacaaucugcugggaauuu

SEQ ID NO: 694364 - RNA, 19 nt, Homo sapiens
gaucagccugggcaacaua

SEQ ID NO: 694365 - RNA, 19 nt, Homo sapiens
guaaguagaacauccauac

SEQ ID NO: 694366 - RNA, 19 nt, Homo sapiens
gcucuuggaucccuauuuu

SEQ ID NO: 694367 - RNA, 19 nt, Homo sapiens
uuaguuaacugguagucuu

SEQ ID NO: 694368 - RNA, 19 nt, Homo sapiens
gaucaugaagagcaaggua

SEQ ID NO: 694369 - RNA, 19 nt, Homo sapiens
agacuugggaucaguuaua

SEQ ID NO: 694370 - RNA, 19 nt, Homo sapiens
cagcugagauucauguaac

SEQ ID NO: 694371 - RNA, 19 nt, Homo sapiens
cauuagaacacuugaauca

SEQ ID NO: 694372 - RNA, 19 nt, Homo sapiens
gcagcugagauucauguaa

SEQ ID NO: 694373 - RNA, 19 nt, Homo sapiens
ucagaaagaaguaauccuu

SEQ ID NO: 694374 - RNA, 19 nt, Homo sapiens
ugagauucauguaacuaga

SEQ ID NO: 694375 - RNA, 19 nt, Homo sapiens
gcacgagggaaccuguaaa

SEQ ID NO: 694376 - RNA, 19 nt, Homo sapiens
gagccuaggaguucaagau

SEQ ID NO: 694377 - RNA, 19 nt, Homo sapiens
ucagucagcuuuugaugaa

SEQ ID NO: 694378 - RNA, 19 nt, Homo sapiens
uagaacacuugaaucagau

SEQ ID NO: 694379 - RNA, 19 nt, Homo sapiens
gguggcacuucaaagauca

SEQ ID NO: 694380 - RNA, 19 nt, Homo sapiens
acacuugaaucagaugguu

SEQ ID NO: 694381 - RNA, 19 nt, Homo sapiens
gccuaggaguucaagauca

SEQ ID NO: 694382 - RNA, 19 nt, Homo sapiens
gcaaguucacucuguuagu

SEQ ID NO: 694383 - RNA, 19 nt, Homo sapiens
cauaggaacagaugcaagu

SEQ ID NO: 694384 - RNA, 19 nt, Homo sapiens
guggcucacuccuguaauc

SEQ ID NO: 694385 - RNA, 19 nt, Homo sapiens
ggaauuucuuggguugaca

SEQ ID NO: 694386 - RNA, 19 nt, Homo sapiens
ccagacuugggaucaguua

SEQ ID NO: 694387 - RNA, 19 nt, Homo sapiens
uuaucccacuagcugauua

SEQ ID NO: 694388 - RNA, 19 nt, Homo sapiens
cuagagugguaauaauagu

SEQ ID NO: 694389 - RNA, 19 nt, Homo sapiens
guuaacugguagucuuugu

SEQ ID NO: 694390 - RNA, 19 nt, Homo sapiens
gaagcuguuuucuuuagga

SEQ ID NO: 694391 - RNA, 19 nt, Homo sapiens
acaaucugcugggaauuuc

SEQ ID NO: 694392 - RNA, 19 nt, Homo sapiens
ggguauugguggcacuuca

SEQ ID NO: 694393 - RNA, 19 nt, Homo sapiens
ccuguaaucccggcacuuu

SEQ ID NO: 694394 - RNA, 19 nt, Homo sapiens
guuaaggugauucaagguu

SEQ ID NO: 694395 - RNA, 19 nt, Homo sapiens
gguaaguagaacauccaua

SEQ ID NO: 694396 - RNA, 19 nt, Homo sapiens
gcaccagacuugggaucag

SEQ ID NO: 694397 - RNA, 19 nt, Homo sapiens
guaauaaugaaguggucaa

SEQ ID NO: 694398 - RNA, 19 nt, Homo sapiens
caccugagccuaggaguuc

SEQ ID NO: 694399 - RNA, 19 nt, Homo sapiens
gcugagauucauguaacua

SEQ ID NO: 694400 - RNA, 19 nt, Homo sapiens
ucacauaggaacagaugca

SEQ ID NO: 694401 - RNA, 19 nt, Homo sapiens
gagcaagguaaguagaaca

SEQ ID NO: 694402 - RNA, 19 nt, Homo sapiens
ucgauaucauccuuccaaa

SEQ ID NO: 694403 - RNA, 19 nt, Homo sapiens
ccacuagcugauuacuaua

SEQ ID NO: 694404 - RNA, 19 nt, Homo sapiens
uaaggugauucaagguuuu

SEQ ID NO: 694405 - RNA, 19 nt, Homo sapiens
agaugcaaguucacucugu

SEQ ID NO: 694406 - RNA, 19 nt, Homo sapiens
guauugguggcacuucaaa

SEQ ID NO: 694407 - RNA, 19 nt, Homo sapiens
ccuaggaguucaagaucag

SEQ ID NO: 694408 - RNA, 19 nt, Homo sapiens
aguucacucuguuaguuaa

SEQ ID NO: 694409 - RNA, 19 nt, Homo sapiens
guggauauccgagacaauc

SEQ ID NO: 694410 - RNA, 19 nt, Homo sapiens
gagugguaauaauaguuuc

SEQ ID NO: 694411 - RNA, 19 nt, Homo sapiens
augaagagcaagguaagua

SEQ ID NO: 694412 - RNA, 19 nt, Homo sapiens
ggcacgagggaaccuguaa

SEQ ID NO: 694413 - RNA, 19 nt, Homo sapiens
gggaauuucuuggguugac

SEQ ID NO: 694414 - RNA, 19 nt, Homo sapiens
gucgauaucauccuuccaa

SEQ ID NO: 694415 - RNA, 19 nt, Homo sapiens
gagauucauguaacuagag

SEQ ID NO: 694416 - RNA, 19 nt, Homo sapiens
ugaagagcaagguaaguag

SEQ ID NO: 694417 - RNA, 19 nt, Homo sapiens
aaguucacucuguuaguua

SEQ ID NO: 694418 - RNA, 19 nt, Homo sapiens
gucauacugucgauaucau

SEQ ID NO: 694419 - RNA, 19 nt, Homo sapiens
cauagcagcuuuauucaua

SEQ ID NO: 694420 - RNA, 19 nt, Homo sapiens
gagaagcuccuuugugaua

SEQ ID NO: 694421 - RNA, 19 nt, Homo sapiens
gaacaggcaagacuaauug

SEQ ID NO: 694422 - RNA, 19 nt, Homo sapiens
ggguggaggugaaauguuu

SEQ ID NO: 694423 - RNA, 19 nt, Homo sapiens
ccaagaaccugccuguguu

SEQ ID NO: 694424 - RNA, 19 nt, Homo sapiens
gaagcacuauggcaucuau

SEQ ID NO: 694425 - RNA, 19 nt, Homo sapiens
ggaaaacaaucuacugaaa

SEQ ID NO: 694426 - RNA, 19 nt, Homo sapiens
gaaggauccugagcacgua

SEQ ID NO: 694427 - RNA, 19 nt, Homo sapiens
ucauugagcugugcacuuu

SEQ ID NO: 694428 - RNA, 19 nt, Homo sapiens
gaauauucauagcagcuuu

SEQ ID NO: 694429 - RNA, 19 nt, Homo sapiens
gaaguuggaauagugguua

SEQ ID NO: 694430 - RNA, 19 nt, Homo sapiens
gcagugguuucacaaaugu

SEQ ID NO: 694431 - RNA, 19 nt, Homo sapiens
gcagaaaugcccaccgaaa

SEQ ID NO: 694432 - RNA, 19 nt, Homo sapiens
ggaacaggcaagacuaauu

SEQ ID NO: 694433 - RNA, 19 nt, Homo sapiens
cuacugaaacgaaacauuu

SEQ ID NO: 694434 - RNA, 19 nt, Homo sapiens
gcacagagagacagagguu

SEQ ID NO: 694435 - RNA, 19 nt, Homo sapiens
gaagaggcguggagugaac

SEQ ID NO: 694436 - RNA, 19 nt, Homo sapiens
gggcagugguuucacaaau

SEQ ID NO: 694437 - RNA, 19 nt, Homo sapiens
cagguaaacuucacagaca

SEQ ID NO: 694438 - RNA, 19 nt, Homo sapiens
gaagcuccuuugugauaug

SEQ ID NO: 694439 - RNA, 19 nt, Homo sapiens
aauagaaguuggaauagug

SEQ ID NO: 694440 - RNA, 19 nt, Homo sapiens
ggccgaaguuccauuuaug

SEQ ID NO: 694441 - RNA, 19 nt, Homo sapiens
aaacauuugccuacucuuu

SEQ ID NO: 694442 - RNA, 19 nt, Homo sapiens
ggcagugguuucacaaaug

SEQ ID NO: 694443 - RNA, 19 nt, Homo sapiens
gguaaacuucacagacaua

SEQ ID NO: 694444 - RNA, 19 nt, Homo sapiens
cgaaacauuugccuacucu

SEQ ID NO: 694445 - RNA, 19 nt, Homo sapiens
gaaaugcccaccgaaagau

SEQ ID NO: 694446 - RNA, 19 nt, Homo sapiens
gccaagaaccugccugugu

SEQ ID NO: 694447 - RNA, 19 nt, Homo sapiens
caacacagguaaacuucac

SEQ ID NO: 694448 - RNA, 19 nt, Homo sapiens
gcaagaccauagggaauac

SEQ ID NO: 694449 - RNA, 19 nt, Homo sapiens
ccacggaguuugccugcau

SEQ ID NO: 694450 - RNA, 19 nt, Homo sapiens
acaaucuacugaaacgaaa

SEQ ID NO: 694451 - RNA, 19 nt, Homo sapiens
agaggaugcugaugagaau

SEQ ID NO: 694452 - RNA, 19 nt, Homo sapiens
cuucauggccagccuuaua

SEQ ID NO: 694453 - RNA, 19 nt, Homo sapiens
guucauggacugaggcaaa

SEQ ID NO: 694454 - RNA, 19 nt, Homo sapiens
aagaaugaauuacggauac

SEQ ID NO: 694455 - RNA, 19 nt, Homo sapiens
accgaaagauauuguaaga

SEQ ID NO: 694456 - RNA, 19 nt, Homo sapiens
agaaaugcccaccgaaaga

SEQ ID NO: 694457 - RNA, 19 nt, Homo sapiens
gcugaaaccugugcuaagc

SEQ ID NO: 694458 - RNA, 19 nt, Homo sapiens
gccagagccugugcuguga

SEQ ID NO: 694459 - RNA, 19 nt, Homo sapiens
auucauagcagcuuuauuc

SEQ ID NO: 694460 - RNA, 19 nt, Homo sapiens
ccaccgaaagauauuguaa

SEQ ID NO: 694461 - RNA, 19 nt, Homo sapiens
cauagggaauacuccaaug

SEQ ID NO: 694462 - RNA, 19 nt, Homo sapiens
ggaguuugccugcaugaag

SEQ ID NO: 694463 - RNA, 19 nt, Homo sapiens
guaaacuucacagacauaa

SEQ ID NO: 694464 - RNA, 19 nt, Homo sapiens
ggaagaggcguggagugaa

SEQ ID NO: 694465 - RNA, 19 nt, Homo sapiens
cagaggaugcugaugagaa

SEQ ID NO: 694466 - RNA, 19 nt, Homo sapiens
ucacagacauaaaaguuga

SEQ ID NO: 694467 - RNA, 19 nt, Homo sapiens
ggaugcugaugagaauauu

SEQ ID NO: 694468 - RNA, 19 nt, Homo sapiens
caaacuguauauugauggu

SEQ ID NO: 694469 - RNA, 19 nt, Homo sapiens
gacaauaauagaaguugga

SEQ ID NO: 694470 - RNA, 19 nt, Homo sapiens
cauaauagccccaaacugu

SEQ ID NO: 694471 - RNA, 19 nt, Homo sapiens
gaucugggcagugguuuca

SEQ ID NO: 694472 - RNA, 19 nt, Homo sapiens
aggcaagacuaauugacaa

SEQ ID NO: 694473 - RNA, 19 nt, Homo sapiens
gccccaaacuguauauuga

SEQ ID NO: 694474 - RNA, 19 nt, Homo sapiens
gcuccuuugugauauguuc

SEQ ID NO: 694475 - RNA, 19 nt, Homo sapiens
ggaauagugguuacuucug

SEQ ID NO: 694476 - RNA, 19 nt, Homo sapiens
caggaacaggcaagacuaa

SEQ ID NO: 694477 - RNA, 19 nt, Homo sapiens
gggaagcacuauggcaucu

SEQ ID NO: 694478 - RNA, 19 nt, Homo sapiens
aggaugaauuaacaaguug

SEQ ID NO: 694479 - RNA, 19 nt, Homo sapiens
gaugguaggaugaauuaac

SEQ ID NO: 694480 - RNA, 19 nt, Homo sapiens
uugaugguaggaugaauua

SEQ ID NO: 694481 - RNA, 19 nt, Homo sapiens
cccaaacuguauauugaug

SEQ ID NO: 694482 - RNA, 19 nt, Homo sapiens
cgcaagaccauagggaaua

SEQ ID NO: 694483 - RNA, 19 nt, Homo sapiens
cagcugaaaccugugcuaa

SEQ ID NO: 694484 - RNA, 19 nt, Homo sapiens
aggccgaaguuccauuuau

SEQ ID NO: 694485 - RNA, 19 nt, Homo sapiens
cagaaaugcccaccgaaag

SEQ ID NO: 694486 - RNA, 19 nt, Homo sapiens
caagcacucuggaaaacaa

SEQ ID NO: 694487 - RNA, 19 nt, Homo sapiens
gagcugugcacuuuauuuu

SEQ ID NO: 694488 - RNA, 19 nt, Homo sapiens
ggcggaggcucaucuacag

SEQ ID NO: 694489 - RNA, 19 nt, Homo sapiens
ccaggccgaaguuccauuu

SEQ ID NO: 694490 - RNA, 19 nt, Homo sapiens
gcaacacagguaaacuuca

SEQ ID NO: 694491 - RNA, 19 nt, Homo sapiens
cagcaaugacccugaguuc

SEQ ID NO: 694492 - RNA, 19 nt, Homo sapiens
gccagaggaugcugaugag

SEQ ID NO: 694493 - RNA, 19 nt, Homo sapiens
gcugugcacuuuauuuugu

SEQ ID NO: 694494 - RNA, 19 nt, Homo sapiens
ucaggaacaggcaagacua

SEQ ID NO: 694495 - RNA, 19 nt, Homo sapiens
cgugagguuugggaaauug

SEQ ID NO: 694496 - RNA, 19 nt, Homo sapiens
gaugagaauauugauguca

SEQ ID NO: 694497 - RNA, 19 nt, Homo sapiens
ugagcugugcacuuuauuu

SEQ ID NO: 694498 - RNA, 19 nt, Homo sapiens
agaagcuccuuugugauau

SEQ ID NO: 694499 - RNA, 19 nt, Homo sapiens
uggaagaggcguggaguga

SEQ ID NO: 694500 - RNA, 19 nt, Homo sapiens
acgcaucgagcuccucuuu

SEQ ID NO: 694501 - RNA, 19 nt, Homo sapiens
acagagagacagagguuca

SEQ ID NO: 694502 - RNA, 19 nt, Homo sapiens
ggcaacacagguaaacuuc

SEQ ID NO: 694503 - RNA, 19 nt, Homo sapiens
uggcaacacagguaaacuu

SEQ ID NO: 694504 - RNA, 19 nt, Homo sapiens
aaaugcccaccgaaagaua

SEQ ID NO: 694505 - RNA, 19 nt, Homo sapiens
agaccaacagcucugauga

SEQ ID NO: 694506 - RNA, 19 nt, Homo sapiens
auauugaugucaccagcaa

SEQ ID NO: 694507 - RNA, 19 nt, Homo sapiens
cugaugagaauauugaugu

SEQ ID NO: 694508 - RNA, 19 nt, Homo sapiens
ggaagcacuauggcaucua

SEQ ID NO: 694509 - RNA, 19 nt, Homo sapiens
caggcaagacuaauugaca

SEQ ID NO: 694510 - RNA, 19 nt, Homo sapiens
ugaaggccuugguccucuu

SEQ ID NO: 694511 - RNA, 19 nt, Homo sapiens
auugagcugugcacuuuau

SEQ ID NO: 694512 - RNA, 19 nt, Homo sapiens
augguaggaugaauuaaca

SEQ ID NO: 694513 - RNA, 19 nt, Homo sapiens
gcagcgggaagcacuaugg

SEQ ID NO: 694514 - RNA, 19 nt, Homo sapiens
aacaaucuacugaaacgaa

SEQ ID NO: 694515 - RNA, 19 nt, Homo sapiens
gcugaugagaauauugaug

SEQ ID NO: 694516 - RNA, 19 nt, Homo sapiens
ccugccggcugaagaagug

SEQ ID NO: 694517 - RNA, 19 nt, Homo sapiens
aaagaagccaggccgaagu

SEQ ID NO: 694518 - RNA, 19 nt, Homo sapiens
gaggaugcugaugagaaua

SEQ ID NO: 694519 - RNA, 19 nt, Homo sapiens
ucccagagcucacugauua

SEQ ID NO: 694520 - RNA, 19 nt, Homo sapiens
gcacaagggucucaguuca

SEQ ID NO: 694521 - RNA, 19 nt, Homo sapiens
gaacaggagcccacuuuga

SEQ ID NO: 694522 - RNA, 19 nt, Homo sapiens
ggaccaagauguacauaag

SEQ ID NO: 694523 - RNA, 19 nt, Homo sapiens
gggcaagcaugauauguug

SEQ ID NO: 694524 - RNA, 19 nt, Homo sapiens
agacagggcuggacuugaa

SEQ ID NO: 694525 - RNA, 19 nt, Homo sapiens
ccaagaaccugccuguguu

SEQ ID NO: 694526 - RNA, 19 nt, Homo sapiens
gaagcacuauggcaucuau

SEQ ID NO: 694527 - RNA, 19 nt, Homo sapiens
gaaggauccugagcacgua

SEQ ID NO: 694528 - RNA, 19 nt, Homo sapiens
gggcuggacuugaaaggaa

SEQ ID NO: 694529 - RNA, 19 nt, Homo sapiens
aaacugcccuagccaggua

SEQ ID NO: 694530 - RNA, 19 nt, Homo sapiens
ugaccucacugaagacaaa

SEQ ID NO: 694531 - RNA, 19 nt, Homo sapiens
gcauacagccaacaucuau

SEQ ID NO: 694532 - RNA, 19 nt, Homo sapiens
gcacagagagacagagguu

SEQ ID NO: 694533 - RNA, 19 nt, Homo sapiens
aaaggaagaagaagucuaa

SEQ ID NO: 694534 - RNA, 19 nt, Homo sapiens
ggaaacauaaagcagaauu

SEQ ID NO: 694535 - RNA, 19 nt, Homo sapiens
gaagaggcguggagugaac

SEQ ID NO: 694536 - RNA, 19 nt, Homo sapiens
gaaaggaagaagaagucua

SEQ ID NO: 694537 - RNA, 19 nt, Homo sapiens
caagcaugauauguuguua

SEQ ID NO: 694538 - RNA, 19 nt, Homo sapiens
gaaacauaaagcagaauug

SEQ ID NO: 694539 - RNA, 19 nt, Homo sapiens
ccauggaguucugaucuuu

SEQ ID NO: 694540 - RNA, 19 nt, Homo sapiens
gagcagagggucauacaca

SEQ ID NO: 694541 - RNA, 19 nt, Homo sapiens
caaagcuacugccuucuag

SEQ ID NO: 694542 - RNA, 19 nt, Homo sapiens
ucccugaccucuaaccuuu

SEQ ID NO: 694543 - RNA, 19 nt, Homo sapiens
gguaaggaaugagggaaga

SEQ ID NO: 694544 - RNA, 19 nt, Homo sapiens
ggagcccacuuugaaggua

SEQ ID NO: 694545 - RNA, 19 nt, Homo sapiens
caugauauguuguuagaac

SEQ ID NO: 694546 - RNA, 19 nt, Homo sapiens
gcaagcaugauauguuguu

SEQ ID NO: 694547 - RNA, 19 nt, Homo sapiens
ggacuugaaaggaagaaga

SEQ ID NO: 694548 - RNA, 19 nt, Homo sapiens
gggugaagguaaggaauga

SEQ ID NO: 694549 - RNA, 19 nt, Homo sapiens
gccaagaaccugccugugu

SEQ ID NO: 694550 - RNA, 19 nt, Homo sapiens
ccacggaguuugccugcau

SEQ ID NO: 694551 - RNA, 19 nt, Homo sapiens
agaggaugcugaugagaau

SEQ ID NO: 694552 - RNA, 19 nt, Homo sapiens
cuucauggccagccuuaua

SEQ ID NO: 694553 - RNA, 19 nt, Homo sapiens
ggccauggguccagaggau

SEQ ID NO: 694554 - RNA, 19 nt, Homo sapiens
guucauggacugaggcaaa

SEQ ID NO: 694555 - RNA, 19 nt, Homo sapiens
uagaacaggagcccacuuu

SEQ ID NO: 694556 - RNA, 19 nt, Homo sapiens
agaauaagccagaaaagua

SEQ ID NO: 694557 - RNA, 19 nt, Homo sapiens
gcugaaaccugugcuaagc

SEQ ID NO: 694558 - RNA, 19 nt, Homo sapiens
gagcccacuuugaagguau

SEQ ID NO: 694559 - RNA, 19 nt, Homo sapiens
gaaaacaucauuugcaaag

SEQ ID NO: 694560 - RNA, 19 nt, Homo sapiens
gaauugggagggacuuugu

SEQ ID NO: 694561 - RNA, 19 nt, Homo sapiens
gccagagccugugcuguga

SEQ ID NO: 694562 - RNA, 19 nt, Homo sapiens
ggaguuugccugcaugaag

SEQ ID NO: 694563 - RNA, 19 nt, Homo sapiens
gaagaagaagucuaaaaga

SEQ ID NO: 694564 - RNA, 19 nt, Homo sapiens
ugggaaacauaaagcagaa

SEQ ID NO: 694565 - RNA, 19 nt, Homo sapiens
guacugaggguugcaugaa

SEQ ID NO: 694566 - RNA, 19 nt, Homo sapiens
acaaagcuacugccuucua

SEQ ID NO: 694567 - RNA, 19 nt, Homo sapiens
caagauguacauaagacaa

SEQ ID NO: 694568 - RNA, 19 nt, Homo sapiens
ggaagaggcguggagugaa

SEQ ID NO: 694569 - RNA, 19 nt, Homo sapiens
cagaggaugcugaugagaa

SEQ ID NO: 694570 - RNA, 19 nt, Homo sapiens
ggagacagggcuggacuug

SEQ ID NO: 694571 - RNA, 19 nt, Homo sapiens
ggaugcugaugagaauauu

SEQ ID NO: 694572 - RNA, 19 nt, Homo sapiens
gaccaagauguacauaaga

SEQ ID NO: 694573 - RNA, 19 nt, Homo sapiens
ggucucaguucaacagcau

SEQ ID NO: 694574 - RNA, 19 nt, Homo sapiens
caaaggccacgucugacuu

SEQ ID NO: 694575 - RNA, 19 nt, Homo sapiens
aacaggagcccacuuugaa

SEQ ID NO: 694576 - RNA, 19 nt, Homo sapiens
agcaugauauguuguuaga

SEQ ID NO: 694577 - RNA, 19 nt, Homo sapiens
ggaagaagaagucuaaaag

SEQ ID NO: 694578 - RNA, 19 nt, Homo sapiens
gggaagcacuauggcaucu

SEQ ID NO: 694579 - RNA, 19 nt, Homo sapiens
gggaccaagauguacauaa

SEQ ID NO: 694580 - RNA, 19 nt, Homo sapiens
agagcucacugauuagaca

SEQ ID NO: 694581 - RNA, 19 nt, Homo sapiens
cagcugaaaccugugcuaa

SEQ ID NO: 694582 - RNA, 19 nt, Homo sapiens
ccacuuugaagguauaaca

SEQ ID NO: 694583 - RNA, 19 nt, Homo sapiens
gacuugaaaggaagaagaa

SEQ ID NO: 694584 - RNA, 19 nt, Homo sapiens
cagcaaugacccugaguuc

SEQ ID NO: 694585 - RNA, 19 nt, Homo sapiens
ggcggaggcucaucuacag

SEQ ID NO: 694586 - RNA, 19 nt, Homo sapiens
gccagaggaugcugaugag

SEQ ID NO: 694587 - RNA, 19 nt, Homo sapiens
ugagaaauggggagaauaa

SEQ ID NO: 694588 - RNA, 19 nt, Homo sapiens
cuacugccuucuagagaca

SEQ ID NO: 694589 - RNA, 19 nt, Homo sapiens
gaugagaauauugauguca

SEQ ID NO: 694590 - RNA, 19 nt, Homo sapiens
ccagaaaaguacccuagga

SEQ ID NO: 694591 - RNA, 19 nt, Homo sapiens
gagaggggcaagcaugaua

SEQ ID NO: 694592 - RNA, 19 nt, Homo sapiens
aaacauaaagcagaauugg

SEQ ID NO: 694593 - RNA, 19 nt, Homo sapiens
uggaagaggcguggaguga

SEQ ID NO: 694594 - RNA, 19 nt, Homo sapiens
agccaaaggccacgucuga

SEQ ID NO: 694595 - RNA, 19 nt, Homo sapiens
cagcauacagccaacaucu

SEQ ID NO: 694596 - RNA, 19 nt, Homo sapiens
ccagagcucacugauuaga

SEQ ID NO: 694597 - RNA, 19 nt, Homo sapiens
acagagagacagagguuca

SEQ ID NO: 694598 - RNA, 19 nt, Homo sapiens
agaccaacagcucugauga

SEQ ID NO: 694599 - RNA, 19 nt, Homo sapiens
cagaagggagacucuagga

SEQ ID NO: 694600 - RNA, 19 nt, Homo sapiens
cagcacaagggucucaguu

SEQ ID NO: 694601 - RNA, 19 nt, Homo sapiens
auauugaugucaccagcaa

SEQ ID NO: 694602 - RNA, 19 nt, Homo sapiens
cugaugagaauauugaugu

SEQ ID NO: 694603 - RNA, 19 nt, Homo sapiens
gguguuugggugaagguaa

SEQ ID NO: 694604 - RNA, 19 nt, Homo sapiens
acaagggucucaguucaac

SEQ ID NO: 694605 - RNA, 19 nt, Homo sapiens
ugaaggccuugguccucuu

SEQ ID NO: 694606 - RNA, 19 nt, Homo sapiens
ggaagcacuauggcaucua

SEQ ID NO: 694607 - RNA, 19 nt, Homo sapiens
ggaguugaaaugggucaga

SEQ ID NO: 694608 - RNA, 19 nt, Homo sapiens
ccaaaggccacgucugacu

SEQ ID NO: 694609 - RNA, 19 nt, Homo sapiens
gcagcgggaagcacuaugg

SEQ ID NO: 694610 - RNA, 19 nt, Homo sapiens
gagacagggcuggacuuga

SEQ ID NO: 694611 - RNA, 19 nt, Homo sapiens
agacagagauccccuugca

SEQ ID NO: 694612 - RNA, 19 nt, Homo sapiens
aaaggccacgucugacuug

SEQ ID NO: 694613 - RNA, 19 nt, Homo sapiens
gcugaugagaauauugaug

SEQ ID NO: 694614 - RNA, 19 nt, Homo sapiens
ccagcccguucaggacuuu

SEQ ID NO: 694615 - RNA, 19 nt, Homo sapiens
gcagcagcgggaagcacua

SEQ ID NO: 694616 - RNA, 19 nt, Homo sapiens
ccugccggcugaagaagug

SEQ ID NO: 694617 - RNA, 19 nt, Homo sapiens
gaggaugcugaugagaaua

SEQ ID NO: 694618 - RNA, 19 nt, Homo sapiens
gguacugaggguugcauga

SEQ ID NO: 694619 - RNA, 19 nt, Homo sapiens
caacaaauaugcuggagaa

SEQ ID NO: 694620 - RNA, 19 nt, Homo sapiens
ggaaagaaguaaagaaaca

SEQ ID NO: 694621 - RNA, 19 nt, Homo sapiens
gaggagcacugguauauga

SEQ ID NO: 694622 - RNA, 19 nt, Homo sapiens
gcaguuuccuauaaaguua

SEQ ID NO: 694623 - RNA, 19 nt, Homo sapiens
gaacaugaauucucagaca

SEQ ID NO: 694624 - RNA, 19 nt, Homo sapiens
gaagaaauuuggacuagau

SEQ ID NO: 694625 - RNA, 19 nt, Homo sapiens
caaauaugcuggagaauca

SEQ ID NO: 694626 - RNA, 19 nt, Homo sapiens
caggaaagcuguucuauag

SEQ ID NO: 694627 - RNA, 19 nt, Homo sapiens
gaacuaugcucgcacugaa

SEQ ID NO: 694628 - RNA, 19 nt, Homo sapiens
caacucggauucaucuaua

SEQ ID NO: 694629 - RNA, 19 nt, Homo sapiens
guaaaucacuguaugaaag

SEQ ID NO: 694630 - RNA, 19 nt, Homo sapiens
uaugaaagcugguuggaaa

SEQ ID NO: 694631 - RNA, 19 nt, Homo sapiens
uauaugagcuuguggauuc

SEQ ID NO: 694632 - RNA, 19 nt, Homo sapiens
ggaaagagcauucaucgau

SEQ ID NO: 694633 - RNA, 19 nt, Homo sapiens
gaauacacuuucagacuug

SEQ ID NO: 694634 - RNA, 19 nt, Homo sapiens
gcaaagaaguaugaggaaa

SEQ ID NO: 694635 - RNA, 19 nt, Homo sapiens
gcaaaguguuaaucuaaug

SEQ ID NO: 694636 - RNA, 19 nt, Homo sapiens
gcauguucauugcaacuua

SEQ ID NO: 694637 - RNA, 19 nt, Homo sapiens
caaggaacaugaauucuca

SEQ ID NO: 694638 - RNA, 19 nt, Homo sapiens
ucaccuuucugauaacuua

SEQ ID NO: 694639 - RNA, 19 nt, Homo sapiens
gagaguaaaucacuguaug

SEQ ID NO: 694640 - RNA, 19 nt, Homo sapiens
gaugauggguuugagagua

SEQ ID NO: 694641 - RNA, 19 nt, Homo sapiens
uuacaaagcuuccucaucu

SEQ ID NO: 694642 - RNA, 19 nt, Homo sapiens
agagggagaucuuguauau

SEQ ID NO: 694643 - RNA, 19 nt, Homo sapiens
caaauauugugccaccaua

SEQ ID NO: 694644 - RNA, 19 nt, Homo sapiens
gaggauggcugcaaagaag

SEQ ID NO: 694645 - RNA, 19 nt, Homo sapiens
caaguagccacaacaaaua

SEQ ID NO: 694646 - RNA, 19 nt, Homo sapiens
gagaggaaauguguuaaau

SEQ ID NO: 694647 - RNA, 19 nt, Homo sapiens
gaucacagcaauacuugua

SEQ ID NO: 694648 - RNA, 19 nt, Homo sapiens
gaauuccacuucuaguuau

SEQ ID NO: 694649 - RNA, 19 nt, Homo sapiens
gaagauuguuauugcaaga

SEQ ID NO: 694650 - RNA, 19 nt, Homo sapiens
gaacaugaaacugagauuu

SEQ ID NO: 694651 - RNA, 19 nt, Homo sapiens
gcagagcccguuacacuaa

SEQ ID NO: 694652 - RNA, 19 nt, Homo sapiens
uagaugaaguggcaaacua

SEQ ID NO: 694653 - RNA, 19 nt, Homo sapiens
caucgauccucuugguuua

SEQ ID NO: 694654 - RNA, 19 nt, Homo sapiens
cauuaaagguguugcuaaa

SEQ ID NO: 694655 - RNA, 19 nt, Homo sapiens
ccagagaggaaauguguua

SEQ ID NO: 694656 - RNA, 19 nt, Homo sapiens
cuacuuugcuccugaggua

SEQ ID NO: 694657 - RNA, 19 nt, Homo sapiens
cacaauagacuacuuacua

SEQ ID NO: 694658 - RNA, 19 nt, Homo sapiens
gacaaaugccaacuauaua

SEQ ID NO: 694659 - RNA, 19 nt, Homo sapiens
ccauaggaaucaucuugua

SEQ ID NO: 694660 - RNA, 19 nt, Homo sapiens
ugagacauuugaauuggua

SEQ ID NO: 694661 - RNA, 19 nt, Homo sapiens
gaauugcuccaccagauaa

SEQ ID NO: 694662 - RNA, 19 nt, Homo sapiens
ggaauugcuccaccagaua

SEQ ID NO: 694663 - RNA, 19 nt, Homo sapiens
gcuaugagaauguuacaaa

SEQ ID NO: 694664 - RNA, 19 nt, Homo sapiens
agacaaaugccaacuauau

SEQ ID NO: 694665 - RNA, 19 nt, Homo sapiens
caagcucgguccucaagaa

SEQ ID NO: 694666 - RNA, 19 nt, Homo sapiens
auggugggcugguuuauua

SEQ ID NO: 694667 - RNA, 19 nt, Homo sapiens
cagcugggaugcagaagaa

SEQ ID NO: 694668 - RNA, 19 nt, Homo sapiens
guggcaaauuguaaacuua

SEQ ID NO: 694669 - RNA, 19 nt, Homo sapiens
caacuguacugggaagauu

SEQ ID NO: 694670 - RNA, 19 nt, Homo sapiens
gauuguggaugaacaugaa

SEQ ID NO: 694671 - RNA, 19 nt, Homo sapiens
ugagacaaaugccaacuau

SEQ ID NO: 694672 - RNA, 19 nt, Homo sapiens
ggaagaaauuuggacuaga

SEQ ID NO: 694673 - RNA, 19 nt, Homo sapiens
gcagugagaaugaugaaug

SEQ ID NO: 694674 - RNA, 19 nt, Homo sapiens
cagcaaguaucuauaaucu

SEQ ID NO: 694675 - RNA, 19 nt, Homo sapiens
gaaggcaauuauacucuca

SEQ ID NO: 694676 - RNA, 19 nt, Homo sapiens
aguaaaggcuggagaccua

SEQ ID NO: 694677 - RNA, 19 nt, Homo sapiens
aaacugguauccgaaauga

SEQ ID NO: 694678 - RNA, 19 nt, Homo sapiens
gcgcuaucaucaaaguaua

SEQ ID NO: 694679 - RNA, 19 nt, Homo sapiens
ccaaguagccacaacaaau

SEQ ID NO: 694680 - RNA, 19 nt, Homo sapiens
caacugaugcuccuggaaa

SEQ ID NO: 694681 - RNA, 19 nt, Homo sapiens
uauuaagccucucaaagaa

SEQ ID NO: 694682 - RNA, 19 nt, Homo sapiens
agaauacacuuucagacuu

SEQ ID NO: 694683 - RNA, 19 nt, Homo sapiens
aaacaaugaucacagcaau

SEQ ID NO: 694684 - RNA, 19 nt, Homo sapiens
agggagaucuuguauaugu

SEQ ID NO: 694685 - RNA, 19 nt, Homo sapiens
gaaauuuggacuagauuca

SEQ ID NO: 694686 - RNA, 19 nt, Homo sapiens
ggaaacugguauccgaaau

SEQ ID NO: 694687 - RNA, 19 nt, Homo sapiens
cugcugcgcuggcaucuuu

SEQ ID NO: 694688 - RNA, 19 nt, Homo sapiens
uaaacugugguauccauua

SEQ ID NO: 694689 - RNA, 19 nt, Homo sapiens
gaauguauaaacuguggua

SEQ ID NO: 694690 - RNA, 19 nt, Homo sapiens
ccacacaauuuaugagaca

SEQ ID NO: 694691 - RNA, 19 nt, Homo sapiens
ccaggaaagcuguucuaua

SEQ ID NO: 694692 - RNA, 19 nt, Homo sapiens
ccagauggcuaugagaaug

SEQ ID NO: 694693 - RNA, 19 nt, Homo sapiens
caucauauuugcuccaagu

SEQ ID NO: 694694 - RNA, 19 nt, Homo sapiens
ccuagaagaacuaucauuu

SEQ ID NO: 694695 - RNA, 19 nt, Homo sapiens
uaucggaccuggcuuuaca

SEQ ID NO: 694696 - RNA, 19 nt, Homo sapiens
agauccagcugacuacuuu

SEQ ID NO: 694697 - RNA, 19 nt, Homo sapiens
cauguuagcaggagccaua

SEQ ID NO: 694698 - RNA, 19 nt, Homo sapiens
ccaacuauauaucgauugu

SEQ ID NO: 694699 - RNA, 19 nt, Homo sapiens
ccagacaaacaacuacaua

SEQ ID NO: 694700 - RNA, 19 nt, Homo sapiens
guuuggcaguuuccuauaa

SEQ ID NO: 694701 - RNA, 19 nt, Homo sapiens
caggaacucugaaagaagu

SEQ ID NO: 694702 - RNA, 19 nt, Homo sapiens
gaccauggaguaucauuug

SEQ ID NO: 694703 - RNA, 19 nt, Homo sapiens
gaaacugguauccgaaaug

SEQ ID NO: 694704 - RNA, 19 nt, Homo sapiens
agacgaauguauaaacugu

SEQ ID NO: 694705 - RNA, 19 nt, Homo sapiens
ugacagguauguuauucug

SEQ ID NO: 694706 - RNA, 19 nt, Homo sapiens
ggagugauucuuucaggaa

SEQ ID NO: 694707 - RNA, 19 nt, Homo sapiens
ggagaucuuguauauguga

SEQ ID NO: 694708 - RNA, 19 nt, Homo sapiens
cagugagaaugaugaauga

SEQ ID NO: 694709 - RNA, 19 nt, Homo sapiens
guacagccauaucccaaag

SEQ ID NO: 694710 - RNA, 19 nt, Homo sapiens
auauaucgauuguggauga

SEQ ID NO: 694711 - RNA, 19 nt, Homo sapiens
ugguauccauuacacaaua

SEQ ID NO: 694712 - RNA, 19 nt, Homo sapiens
ccaaauguccauccacaga

SEQ ID NO: 694713 - RNA, 19 nt, Homo sapiens
gaaauugcccggaguuuug

SEQ ID NO: 694714 - RNA, 19 nt, Homo sapiens
uuacagggagugauucuuu

SEQ ID NO: 694715 - RNA, 19 nt, Homo sapiens
uuauuaagccucucaaaga

SEQ ID NO: 694716 - RNA, 19 nt, Homo sapiens
gcaaggaacaugaauucuc

SEQ ID NO: 694717 - RNA, 19 nt, Homo sapiens
cagacuugauguugaagaa

SEQ ID NO: 694718 - RNA, 19 nt, Homo sapiens
augauguccucuuaucuua

SEQ ID NO: 694719 - RNA, 19 nt, Homo sapiens
ggacacagcuucuggaucu

SEQ ID NO: 694720 - RNA, 19 nt, Homo sapiens
ggacauugccuauaccuau

SEQ ID NO: 694721 - RNA, 19 nt, Homo sapiens
gcacugggcugccacuaca

SEQ ID NO: 694722 - RNA, 19 nt, Homo sapiens
uuaaggagcuacagacuca

SEQ ID NO: 694723 - RNA, 19 nt, Homo sapiens
ccacggaauucacagaaga

SEQ ID NO: 694724 - RNA, 19 nt, Homo sapiens
ggaauucacagaagaguuc

SEQ ID NO: 694725 - RNA, 19 nt, Homo sapiens
ccauugcccugacucgaua

SEQ ID NO: 694726 - RNA, 19 nt, Homo sapiens
gggcugagguccagagaca

SEQ ID NO: 694727 - RNA, 19 nt, Homo sapiens
ugacugcaguggagaaguu

SEQ ID NO: 694728 - RNA, 19 nt, Homo sapiens
cuccggugcuuuauauuua

SEQ ID NO: 694729 - RNA, 19 nt, Homo sapiens
gcagaucaaucguguuugc

SEQ ID NO: 694730 - RNA, 19 nt, Homo sapiens
gcguggaccuugccaaugu

SEQ ID NO: 694731 - RNA, 19 nt, Homo sapiens
uuacuccggugcuuuauau

SEQ ID NO: 694732 - RNA, 19 nt, Homo sapiens
gaucauccucggccacuuu

SEQ ID NO: 694733 - RNA, 19 nt, Homo sapiens
gaugcucaaugaccaguug

SEQ ID NO: 694734 - RNA, 19 nt, Homo sapiens
cgucuucucugcaaccaaa

SEQ ID NO: 694735 - RNA, 19 nt, Homo sapiens
ggagaaguuugaggcagaa

SEQ ID NO: 694736 - RNA, 19 nt, Homo sapiens
gacauugccuauaccuaug

SEQ ID NO: 694737 - RNA, 19 nt, Homo sapiens
agagacagcucagcauugu

SEQ ID NO: 694738 - RNA, 19 nt, Homo sapiens
gccuguggcugaccucuga

SEQ ID NO: 694739 - RNA, 19 nt, Homo sapiens
ccauggacauugccuauac

SEQ ID NO: 694740 - RNA, 19 nt, Homo sapiens
gccaaugucuccggauuuc

SEQ ID NO: 694741 - RNA, 19 nt, Homo sapiens
gcagacagccaggugaaug

SEQ ID NO: 694742 - RNA, 19 nt, Homo sapiens
ucgcagaucaaucguguuu

SEQ ID NO: 694743 - RNA, 19 nt, Homo sapiens
gcgcggaagaagacuuuaa

SEQ ID NO: 694744 - RNA, 19 nt, Homo sapiens
gggagaaccucagagaacu

SEQ ID NO: 694745 - RNA, 19 nt, Homo sapiens
gcaggcagcccagcaagau

SEQ ID NO: 694746 - RNA, 19 nt, Homo sapiens
ccagagacagcucagcauu

SEQ ID NO: 694747 - RNA, 19 nt, Homo sapiens
gcauaucaacacugcagaa

SEQ ID NO: 694748 - RNA, 19 nt, Homo sapiens
guggacaucucgguguuug

SEQ ID NO: 694749 - RNA, 19 nt, Homo sapiens
gcacgguggccuacaucaa

SEQ ID NO: 694750 - RNA, 19 nt, Homo sapiens
acacagccuuugacaccuu

SEQ ID NO: 694751 - RNA, 19 nt, Homo sapiens
cacagggccuccucgucua

SEQ ID NO: 694752 - RNA, 19 nt, Homo sapiens
ugacaccuuugacuaugug

SEQ ID NO: 694753 - RNA, 19 nt, Homo sapiens
aaacuugaaggcaccauug

SEQ ID NO: 694754 - RNA, 19 nt, Homo sapiens
ggaacggaccuuucugaac

SEQ ID NO: 694755 - RNA, 19 nt, Homo sapiens
cgacuaugcacccuucguu

SEQ ID NO: 694756 - RNA, 19 nt, Homo sapiens
uugacuauguggacaaguu

SEQ ID NO: 694757 - RNA, 19 nt, Homo sapiens
acucagggcaucaaacuug

SEQ ID NO: 694758 - RNA, 19 nt, Homo sapiens
cggaagaagacuuuaagga

SEQ ID NO: 694759 - RNA, 19 nt, Homo sapiens
cagagacagcucagcauug

SEQ ID NO: 694760 - RNA, 19 nt, Homo sapiens
acgaagugcugcuguccuu

SEQ ID NO: 694761 - RNA, 19 nt, Homo sapiens
uaaccucaacggaacuuug

SEQ ID NO: 694762 - RNA, 19 nt, Homo sapiens
cacagacccugccgacauc

SEQ ID NO: 694763 - RNA, 19 nt, Homo sapiens
acacagacccugccgacau

SEQ ID NO: 694764 - RNA, 19 nt, Homo sapiens
ccuuuacuccggugcuuua

SEQ ID NO: 694765 - RNA, 19 nt, Homo sapiens
ugacuauguggacaaguuu

SEQ ID NO: 694766 - RNA, 19 nt, Homo sapiens
gcugagcucacccgacgaa

SEQ ID NO: 694767 - RNA, 19 nt, Homo sapiens
gcucagcauuguggugaca

SEQ ID NO: 694768 - RNA, 19 nt, Homo sapiens
acaacuggauccgguacuu

SEQ ID NO: 694769 - RNA, 19 nt, Homo sapiens
gugagacacuccgcagcuu

SEQ ID NO: 694770 - RNA, 19 nt, Homo sapiens
gcucagugacagcuucuuc

SEQ ID NO: 694771 - RNA, 19 nt, Homo sapiens
caaacuugaaggcaccauu

SEQ ID NO: 694772 - RNA, 19 nt, Homo sapiens
gaaugugagcgucuacaac

SEQ ID NO: 694773 - RNA, 19 nt, Homo sapiens
cagcagacagccaggugaa

SEQ ID NO: 694774 - RNA, 19 nt, Homo sapiens
gcucuuggaacggaccuuu

SEQ ID NO: 694775 - RNA, 19 nt, Homo sapiens
cacagccuuugacaccuuu

SEQ ID NO: 694776 - RNA, 19 nt, Homo sapiens
gcaggaugcaguggacgaa

SEQ ID NO: 694777 - RNA, 19 nt, Homo sapiens
gcaguggacgaagguguug

SEQ ID NO: 694778 - RNA, 19 nt, Homo sapiens
cucauuggcuccacggaau

SEQ ID NO: 694779 - RNA, 19 nt, Homo sapiens
cuucagcccucccuuuacu

SEQ ID NO: 694780 - RNA, 19 nt, Homo sapiens
gaaguuugaggcagaagcu

SEQ ID NO: 694781 - RNA, 19 nt, Homo sapiens
ugaaugugagcgucuacaa

SEQ ID NO: 694782 - RNA, 19 nt, Homo sapiens
acuccggugcuuuauauuu

SEQ ID NO: 694783 - RNA, 19 nt, Homo sapiens
ggaccuggaccuggagauc

SEQ ID NO: 694784 - RNA, 19 nt, Homo sapiens
cagaggaacgcuacuacag

SEQ ID NO: 694785 - RNA, 19 nt, Homo sapiens
gcaagacuucagccaggau

SEQ ID NO: 694786 - RNA, 19 nt, Homo sapiens
agaagacuuuaaggagcua

SEQ ID NO: 694787 - RNA, 19 nt, Homo sapiens
uugccaaugucuccggauu

SEQ ID NO: 694788 - RNA, 19 nt, Homo sapiens
acaacccuaugcugccuau

SEQ ID NO: 694789 - RNA, 19 nt, Homo sapiens
uaaagagacugauaccaaa

SEQ ID NO: 694790 - RNA, 19 nt, Homo sapiens
ggacgaggaucucuucaga

SEQ ID NO: 694791 - RNA, 19 nt, Homo sapiens
ucaagaaccucccaucuau

SEQ ID NO: 694792 - RNA, 19 nt, Homo sapiens
gaauggagcccaaacagau

SEQ ID NO: 694793 - RNA, 19 nt, Homo sapiens
ggaccuccguagcgucuug

SEQ ID NO: 694794 - RNA, 19 nt, Homo sapiens
ugagccagcugcagagaau

SEQ ID NO: 694795 - RNA, 19 nt, Homo sapiens
auaaagagacugauaccaa

SEQ ID NO: 694796 - RNA, 19 nt, Homo sapiens
ccaagucugugagugaaga

SEQ ID NO: 694797 - RNA, 19 nt, Homo sapiens
caaaagagguacccauugg

SEQ ID NO: 694798 - RNA, 19 nt, Homo sapiens
gcccucacauccaauaaag

SEQ ID NO: 694799 - RNA, 19 nt, Homo sapiens
ccgccuauaucuccgacua

SEQ ID NO: 694800 - RNA, 19 nt, Homo sapiens
ccucauugaccaguauuua

SEQ ID NO: 694801 - RNA, 19 nt, Homo sapiens
aagagcugcuugacuguga

SEQ ID NO: 694802 - RNA, 19 nt, Homo sapiens
gauggaguccuagcuguga

SEQ ID NO: 694803 - RNA, 19 nt, Homo sapiens
cauuggcgcucaaccgaau

SEQ ID NO: 694804 - RNA, 19 nt, Homo sapiens
gacccucauugaccaguau

SEQ ID NO: 694805 - RNA, 19 nt, Homo sapiens
ccaauaaagagacugauac

SEQ ID NO: 694806 - RNA, 19 nt, Homo sapiens
gccuauaucuccgacuaug

SEQ ID NO: 694807 - RNA, 19 nt, Homo sapiens
caaguggagcggacacgaa

SEQ ID NO: 694808 - RNA, 19 nt, Homo sapiens
cagccaagucugugaguga

SEQ ID NO: 694809 - RNA, 19 nt, Homo sapiens
gcuguuugguggucagauc

SEQ ID NO: 694810 - RNA, 19 nt, Homo sapiens
gagaauggagcccaaacag

SEQ ID NO: 694811 - RNA, 19 nt, Homo sapiens
cgaacagggucgagcuucu

SEQ ID NO: 694812 - RNA, 19 nt, Homo sapiens
gcagagaauggagcccaaa

SEQ ID NO: 694813 - RNA, 19 nt, Homo sapiens
ucccugcacugcuacuuug

SEQ ID NO: 694814 - RNA, 19 nt, Homo sapiens
uccaauaaagagacugaua

SEQ ID NO: 694815 - RNA, 19 nt, Homo sapiens
acuggaugcucuaugaaug

SEQ ID NO: 694816 - RNA, 19 nt, Homo sapiens
accacuggaugcucuauga

SEQ ID NO: 694817 - RNA, 19 nt, Homo sapiens
gugaaggccgugcaacaug

SEQ ID NO: 694818 - RNA, 19 nt, Homo sapiens
gaacagggucgagcuucuc

SEQ ID NO: 694819 - RNA, 19 nt, Homo sapiens
uucaagaaccucccaucua

SEQ ID NO: 694820 - RNA, 19 nt, Homo sapiens
cgaagcugccaguacugua

SEQ ID NO: 694821 - RNA, 19 nt, Homo sapiens
agaauggagcccaaacaga

SEQ ID NO: 694822 - RNA, 19 nt, Homo sapiens
cugcagcauugaacuagau

SEQ ID NO: 694823 - RNA, 19 nt, Homo sapiens
caagcgguagccagaggua

SEQ ID NO: 694824 - RNA, 19 nt, Homo sapiens
caccagaagagcugcuuga

SEQ ID NO: 694825 - RNA, 19 nt, Homo sapiens
cugcacugcuacuuuguuc

SEQ ID NO: 694826 - RNA, 19 nt, Homo sapiens
cauccaauaaagagacuga

SEQ ID NO: 694827 - RNA, 19 nt, Homo sapiens
ggcccucacauccaauaaa

SEQ ID NO: 694828 - RNA, 19 nt, Homo sapiens
ggaguuacagucccuuuug

SEQ ID NO: 694829 - RNA, 19 nt, Homo sapiens
caagaaccucccaucuauc

SEQ ID NO: 694830 - RNA, 19 nt, Homo sapiens
ucauugaccaguauuuaag

SEQ ID NO: 694831 - RNA, 19 nt, Homo sapiens
agacccucauugaccagua

SEQ ID NO: 694832 - RNA, 19 nt, Homo sapiens
ccucacauccaauaaagag

SEQ ID NO: 694833 - RNA, 19 nt, Homo sapiens
cuccgacuaugccuucuug

SEQ ID NO: 694834 - RNA, 19 nt, Homo sapiens
gcuggacgaggaucucuuc

SEQ ID NO: 694835 - RNA, 19 nt, Homo sapiens
cucauugaccaguauuuaa

SEQ ID NO: 694836 - RNA, 19 nt, Homo sapiens
ggccugcagcauugaacua

SEQ ID NO: 694837 - RNA, 19 nt, Homo sapiens
ccacuggaugcucuaugaa

SEQ ID NO: 694838 - RNA, 19 nt, Homo sapiens
gacccuaaccuccaaaaga

SEQ ID NO: 694839 - RNA, 19 nt, Homo sapiens
gaacaaauccucuuacuca

SEQ ID NO: 694840 - RNA, 19 nt, Homo sapiens
ugagaaaguuguugcaaua

SEQ ID NO: 694841 - RNA, 19 nt, Homo sapiens
cgacacaacucuacuacuu

SEQ ID NO: 694842 - RNA, 19 nt, Homo sapiens
gcagauaucucgacacaac

SEQ ID NO: 694843 - RNA, 19 nt, Homo sapiens
gaagagagauugguauuuu

SEQ ID NO: 694844 - RNA, 19 nt, Homo sapiens
ucaguugacuccacagaua

SEQ ID NO: 694845 - RNA, 19 nt, Homo sapiens
caaauccucuuacucagaa

SEQ ID NO: 694846 - RNA, 19 nt, Homo sapiens
gaugauggcugguaugaag

SEQ ID NO: 694847 - RNA, 19 nt, Homo sapiens
gaguggaauuugcauuaua

SEQ ID NO: 694848 - RNA, 19 nt, Homo sapiens
ucaagaugcuucccauuug

SEQ ID NO: 694849 - RNA, 19 nt, Homo sapiens
ggaaauaaccagccugcaa

SEQ ID NO: 694850 - RNA, 19 nt, Homo sapiens
ugaggaggcugcaguaguu

SEQ ID NO: 694851 - RNA, 19 nt, Homo sapiens
gcacgaagagagauuggua

SEQ ID NO: 694852 - RNA, 19 nt, Homo sapiens
guacuuaggugucuuaacg

SEQ ID NO: 694853 - RNA, 19 nt, Homo sapiens
gauucagguuguaccauua

SEQ ID NO: 694854 - RNA, 19 nt, Homo sapiens
gaaucaaucaugcacuaua

SEQ ID NO: 694855 - RNA, 19 nt, Homo sapiens
ggacggaauacuccuuaua

SEQ ID NO: 694856 - RNA, 19 nt, Homo sapiens
ggacagcaucuuuaaauca

SEQ ID NO: 694857 - RNA, 19 nt, Homo sapiens
caacaguuccuaaugacua

SEQ ID NO: 694858 - RNA, 19 nt, Homo sapiens
ggugcaaucauuuauguua

SEQ ID NO: 694859 - RNA, 19 nt, Homo sapiens
ugaggcaguuuauguauug

SEQ ID NO: 694860 - RNA, 19 nt, Homo sapiens
gacggaauacuccuuauaa

SEQ ID NO: 694861 - RNA, 19 nt, Homo sapiens
ggaaguggaagucgagaaa

SEQ ID NO: 694862 - RNA, 19 nt, Homo sapiens
acaagaagcuguccauaac

SEQ ID NO: 694863 - RNA, 19 nt, Homo sapiens
gaaugaugauggcugguau

SEQ ID NO: 694864 - RNA, 19 nt, Homo sapiens
gggcgcugaucgagaguua

SEQ ID NO: 694865 - RNA, 19 nt, Homo sapiens
ggagugggguauaauauuu

SEQ ID NO: 694866 - RNA, 19 nt, Homo sapiens
gagguccacuuuauucuca

SEQ ID NO: 694867 - RNA, 19 nt, Homo sapiens
gagaacaaauccucuuacu

SEQ ID NO: 694868 - RNA, 19 nt, Homo sapiens
ggagcgcccuguaagguau

SEQ ID NO: 694869 - RNA, 19 nt, Homo sapiens
caagaugcuucccauuugu

SEQ ID NO: 694870 - RNA, 19 nt, Homo sapiens
ccuguaagcauaaaucuuu

SEQ ID NO: 694871 - RNA, 19 nt, Homo sapiens
uaauagcaccugcgaauau

SEQ ID NO: 694872 - RNA, 19 nt, Homo sapiens
uaaaugcauuggccaacaa

SEQ ID NO: 694873 - RNA, 19 nt, Homo sapiens
gaauauggagcgcccugua

SEQ ID NO: 694874 - RNA, 19 nt, Homo sapiens
ggagaaaguggcacgaaga

SEQ ID NO: 694875 - RNA, 19 nt, Homo sapiens
acacaguucuggaugaugu

SEQ ID NO: 694876 - RNA, 19 nt, Homo sapiens
uagcuaguguugcuuauca

SEQ ID NO: 694877 - RNA, 19 nt, Homo sapiens
uauggagggugcaaucauu

SEQ ID NO: 694878 - RNA, 19 nt, Homo sapiens
cugcaguaguucaguauaa

SEQ ID NO: 694879 - RNA, 19 nt, Homo sapiens
ccaacaauguacuccaguu

SEQ ID NO: 694880 - RNA, 19 nt, Homo sapiens
uacaagaagcuguccauaa

SEQ ID NO: 694881 - RNA, 19 nt, Homo sapiens
ggacuauuaugguuaacag

SEQ ID NO: 694882 - RNA, 19 nt, Homo sapiens
ggaacacugggacggaaua

SEQ ID NO: 694883 - RNA, 19 nt, Homo sapiens
ggaaaccuaucgauuacac

SEQ ID NO: 694884 - RNA, 19 nt, Homo sapiens
gugggacuauuaugguuaa

SEQ ID NO: 694885 - RNA, 19 nt, Homo sapiens
ugauucagguuguaccauu

SEQ ID NO: 694886 - RNA, 19 nt, Homo sapiens
ugacucggguggcagacua

SEQ ID NO: 694887 - RNA, 19 nt, Homo sapiens
caggacagcaucuuuaaau

SEQ ID NO: 694888 - RNA, 19 nt, Homo sapiens
aagaauacaucaagaacuc

SEQ ID NO: 694889 - RNA, 19 nt, Homo sapiens
guaguucaguauaaugauc

SEQ ID NO: 694890 - RNA, 19 nt, Homo sapiens
gaaaacagugguagcagua

SEQ ID NO: 694891 - RNA, 19 nt, Homo sapiens
gacagcaucuuuaaaucag

SEQ ID NO: 694892 - RNA, 19 nt, Homo sapiens
gaucgagaguuaccagaac

SEQ ID NO: 694893 - RNA, 19 nt, Homo sapiens
gcaggacagcaucuuuaaa

SEQ ID NO: 694894 - RNA, 19 nt, Homo sapiens
gccaaguccucccauguca

SEQ ID NO: 694895 - RNA, 19 nt, Homo sapiens
cuaacgcuaugucagacua

SEQ ID NO: 694896 - RNA, 19 nt, Homo sapiens
ugggaacuauguugaauca

SEQ ID NO: 694897 - RNA, 19 nt, Homo sapiens
acaaugaccaggcagauau

SEQ ID NO: 694898 - RNA, 19 nt, Homo sapiens
gcagagggguggaaaaugg

SEQ ID NO: 694899 - RNA, 19 nt, Homo sapiens
guauaaugauccauaugca

SEQ ID NO: 694900 - RNA, 19 nt, Homo sapiens
ggauauucauaaggagaaa

SEQ ID NO: 694901 - RNA, 19 nt, Homo sapiens
guccuuuccuucacugauu

SEQ ID NO: 694902 - RNA, 19 nt, Homo sapiens
caugcacuauacugauuaa

SEQ ID NO: 694903 - RNA, 19 nt, Homo sapiens
gaggagaccaaagccuaua

SEQ ID NO: 694904 - RNA, 19 nt, Homo sapiens
ucgagugacuggucuguuc

SEQ ID NO: 694905 - RNA, 19 nt, Homo sapiens
ucccauguuugaugacuuu

SEQ ID NO: 694906 - RNA, 19 nt, Homo sapiens
gcaagagggcgcugaucga

SEQ ID NO: 694907 - RNA, 19 nt, Homo sapiens
acacaacucuacuacuucu

SEQ ID NO: 694908 - RNA, 19 nt, Homo sapiens
ggcaggacagcaucuuuaa

SEQ ID NO: 694909 - RNA, 19 nt, Homo sapiens
uauaugaccaguccugcua

SEQ ID NO: 694910 - RNA, 19 nt, Homo sapiens
acggaauacuccuuauaaa

SEQ ID NO: 694911 - RNA, 19 nt, Homo sapiens
gcaagaacuggcacacugu

SEQ ID NO: 694912 - RNA, 19 nt, Homo sapiens
uaaccagccugcaagaacu

SEQ ID NO: 694913 - RNA, 19 nt, Homo sapiens
uguaagguauauucggaaa

SEQ ID NO: 694914 - RNA, 19 nt, Homo sapiens
aauaauagcaccugcgaau

SEQ ID NO: 694915 - RNA, 19 nt, Homo sapiens
cgaagagagauugguauuu

SEQ ID NO: 694916 - RNA, 19 nt, Homo sapiens
ugaguggaauuugcauuau

SEQ ID NO: 694917 - RNA, 19 nt, Homo sapiens
aauugaaugucuaccugua

SEQ ID NO: 694918 - RNA, 19 nt, Homo sapiens
ggagggugcaaucauuuau

SEQ ID NO: 694919 - RNA, 19 nt, Homo sapiens
caaggaugaugagcuguca

SEQ ID NO: 694920 - RNA, 19 nt, Homo sapiens
caaaagacaaggaugauga

SEQ ID NO: 694921 - RNA, 19 nt, Homo sapiens
aagaagcuguccauaacug

SEQ ID NO: 694922 - RNA, 19 nt, Homo sapiens
gagaaaguuguugcaauau

SEQ ID NO: 694923 - RNA, 19 nt, Homo sapiens
cccaagaauuauauugaga

SEQ ID NO: 694924 - RNA, 19 nt, Homo sapiens
gcaguaguucaguauaaug

SEQ ID NO: 694925 - RNA, 19 nt, Homo sapiens
gguccacuuuauucucaaa

SEQ ID NO: 694926 - RNA, 19 nt, Homo sapiens
ggaaguaguggaggaagug

SEQ ID NO: 694927 - RNA, 19 nt, Homo sapiens
aagccaagcauggaaauaa

SEQ ID NO: 694928 - RNA, 19 nt, Homo sapiens
agucuuccaucaaucauau

SEQ ID NO: 694929 - RNA, 19 nt, Homo sapiens
uuacuaacgcuaugucaga

SEQ ID NO: 694930 - RNA, 19 nt, Homo sapiens
cauacaggcuacagacaag

SEQ ID NO: 694931 - RNA, 19 nt, Homo sapiens
gcuucccauuuguguaaua

SEQ ID NO: 694932 - RNA, 19 nt, Homo sapiens
ggaaaacauugcugauagu

SEQ ID NO: 694933 - RNA, 19 nt, Homo sapiens
cugcucagccucauguuaa

SEQ ID NO: 694934 - RNA, 19 nt, Homo sapiens
aggcagauaucucgacaca

SEQ ID NO: 694935 - RNA, 19 nt, Homo sapiens
agugguagcaguaguauug

SEQ ID NO: 694936 - RNA, 19 nt, Homo sapiens
ccaaggacacacaguggaa

SEQ ID NO: 694937 - RNA, 19 nt, Homo sapiens
agacuguggauauucauaa

SEQ ID NO: 694938 - RNA, 19 nt, Homo sapiens
aaucaaucaugcacuauac

SEQ ID NO: 694939 - RNA, 19 nt, Homo sapiens
acaagaagcugauugaaua

SEQ ID NO: 694940 - RNA, 19 nt, Homo sapiens
ggagaauguuuguaacuua

SEQ ID NO: 694941 - RNA, 19 nt, Homo sapiens
ugaagacugucaaguauuu

SEQ ID NO: 694942 - RNA, 19 nt, Homo sapiens
ccaaaugcuucuaguauug

SEQ ID NO: 694943 - RNA, 19 nt, Homo sapiens
gcucauggaucaauggauu

SEQ ID NO: 694944 - RNA, 19 nt, Homo sapiens
gaggaggcuucuauugaua

SEQ ID NO: 694945 - RNA, 19 nt, Homo sapiens
caagugcaauggaaagaaa

SEQ ID NO: 694946 - RNA, 19 nt, Homo sapiens
cacaaacucucaauaucua

SEQ ID NO: 694947 - RNA, 19 nt, Homo sapiens
cagcuuaagugugaguuua

SEQ ID NO: 694948 - RNA, 19 nt, Homo sapiens
gcaaggaagcagucucuuu

SEQ ID NO: 694949 - RNA, 19 nt, Homo sapiens
gaagcugauugaauacuau

SEQ ID NO: 694950 - RNA, 19 nt, Homo sapiens
gcacaaacucucaauaucu

SEQ ID NO: 694951 - RNA, 19 nt, Homo sapiens
gagaccacccggagaguua

SEQ ID NO: 694952 - RNA, 19 nt, Homo sapiens
caacagacacugccacaau

SEQ ID NO: 694953 - RNA, 19 nt, Homo sapiens
ggaggugagugccaggaaa

SEQ ID NO: 694954 - RNA, 19 nt, Homo sapiens
ccaaagaggaggcuucuau

SEQ ID NO: 694955 - RNA, 19 nt, Homo sapiens
caaggaagcagucucuuug

SEQ ID NO: 694956 - RNA, 19 nt, Homo sapiens
gagaggugaugauccuuau

SEQ ID NO: 694957 - RNA, 19 nt, Homo sapiens
ugaagacgcuggccaugga

SEQ ID NO: 694958 - RNA, 19 nt, Homo sapiens
ggaacaacuucuucaagca

SEQ ID NO: 694959 - RNA, 19 nt, Homo sapiens
ucaaagagaaagaaacuga

SEQ ID NO: 694960 - RNA, 19 nt, Homo sapiens
gaccuguccuuuaaauaug

SEQ ID NO: 694961 - RNA, 19 nt, Homo sapiens
ggaggcuucuauugauaaa

SEQ ID NO: 694962 - RNA, 19 nt, Homo sapiens
gggagaauguuuguaacuu

SEQ ID NO: 694963 - RNA, 19 nt, Homo sapiens
gcaccguguuuguguguga

SEQ ID NO: 694964 - RNA, 19 nt, Homo sapiens
ggaaugcagucgaccuaca

SEQ ID NO: 694965 - RNA, 19 nt, Homo sapiens
caauuucaguguuguguuc

SEQ ID NO: 694966 - RNA, 19 nt, Homo sapiens
ggaaccguaucauccaguu

SEQ ID NO: 694967 - RNA, 19 nt, Homo sapiens
ucacggaguuuagcuauag

SEQ ID NO: 694968 - RNA, 19 nt, Homo sapiens
gcucuggcuuccuuucauu

SEQ ID NO: 694969 - RNA, 19 nt, Homo sapiens
gaaaauacaccaaaugcuu

SEQ ID NO: 694970 - RNA, 19 nt, Homo sapiens
cagccaugguucacacaua

SEQ ID NO: 694971 - RNA, 19 nt, Homo sapiens
ggcacaaacucucaauauc

SEQ ID NO: 694972 - RNA, 19 nt, Homo sapiens
gggcuuauguauauuggau

SEQ ID NO: 694973 - RNA, 19 nt, Homo sapiens
agaagcugauugaauacua

SEQ ID NO: 694974 - RNA, 19 nt, Homo sapiens
cacuguggcuccucuguuu

SEQ ID NO: 694975 - RNA, 19 nt, Homo sapiens
caaagaggaggcuucuauu

SEQ ID NO: 694976 - RNA, 19 nt, Homo sapiens
agaggaggcuucuauugau

SEQ ID NO: 694977 - RNA, 19 nt, Homo sapiens
ggaauuaggggcuuaugua

SEQ ID NO: 694978 - RNA, 19 nt, Homo sapiens
uaucacaggugcucacaag

SEQ ID NO: 694979 - RNA, 19 nt, Homo sapiens
agaaugugaugccuuugaa

SEQ ID NO: 694980 - RNA, 19 nt, Homo sapiens
ucaaguacccauagggaaa

SEQ ID NO: 694981 - RNA, 19 nt, Homo sapiens
gaaagaaacugagaaaagc

SEQ ID NO: 694982 - RNA, 19 nt, Homo sapiens
agugaagacugucaaguau

SEQ ID NO: 694983 - RNA, 19 nt, Homo sapiens
caccaaaugcuucuaguau

SEQ ID NO: 694984 - RNA, 19 nt, Homo sapiens
ccuuggagcugaaagugaa

SEQ ID NO: 694985 - RNA, 19 nt, Homo sapiens
gcuacaagaagcugauuga

SEQ ID NO: 694986 - RNA, 19 nt, Homo sapiens
aacagacacugccacaauu

SEQ ID NO: 694987 - RNA, 19 nt, Homo sapiens
aagaggaggcuucuauuga

SEQ ID NO: 694988 - RNA, 19 nt, Homo sapiens
caggugggaucgagcuauu

SEQ ID NO: 694989 - RNA, 19 nt, Homo sapiens
ggaucaauggauuuguuua

SEQ ID NO: 694990 - RNA, 19 nt, Homo sapiens
acaaggcauuugcucugua

SEQ ID NO: 694991 - RNA, 19 nt, Homo sapiens
aaagaggaggcuucuauug

SEQ ID NO: 694992 - RNA, 19 nt, Homo sapiens
guaacaagugcaauggaaa

SEQ ID NO: 694993 - RNA, 19 nt, Homo sapiens
aguaacaagugcaauggaa

SEQ ID NO: 694994 - RNA, 19 nt, Homo sapiens
gcugggaccuagugucaag

SEQ ID NO: 694995 - RNA, 19 nt, Homo sapiens
agagaaagaaacugagaaa

SEQ ID NO: 694996 - RNA, 19 nt, Homo sapiens
ggugggcacugucauggau

SEQ ID NO: 694997 - RNA, 19 nt, Homo sapiens
guaccaguguuuugucuuu

SEQ ID NO: 694998 - RNA, 19 nt, Homo sapiens
gguguggucugauguucug

SEQ ID NO: 694999 - RNA, 19 nt, Homo sapiens
accaaaugcuucuaguauu

SEQ ID NO: 695000 - RNA, 19 nt, Homo sapiens
aaccguaucauccaguuua

SEQ ID NO: 695001 - RNA, 19 nt, Homo sapiens
gaaaccauacagcgauuag

SEQ ID NO: 695002 - RNA, 19 nt, Homo sapiens
gagagcaucaggaaauaca

SEQ ID NO: 695003 - RNA, 19 nt, Homo sapiens
acacucccgucaggaauuu

SEQ ID NO: 695004 - RNA, 19 nt, Homo sapiens
auagggagaauguuuguaa

SEQ ID NO: 695005 - RNA, 19 nt, Homo sapiens
gguuuaaugcuuguucaua

SEQ ID NO: 695006 - RNA, 19 nt, Homo sapiens
ugucaaguauuucaaaggu

SEQ ID NO: 695007 - RNA, 19 nt, Homo sapiens
aagugaagacugucaagua

SEQ ID NO: 695008 - RNA, 19 nt, Homo sapiens
gcuauagggagaauguuug

SEQ ID NO: 695009 - RNA, 19 nt, Homo sapiens
aagaaaccauacagcgauu

SEQ ID NO: 695010 - RNA, 19 nt, Homo sapiens
ucaaagguuuaaugcuugu

SEQ ID NO: 695011 - RNA, 19 nt, Homo sapiens
caaggcauuugcucuguac

SEQ ID NO: 695012 - RNA, 19 nt, Homo sapiens
gugaugccuuugaagagaa

SEQ ID NO: 695013 - RNA, 19 nt, Homo sapiens
gaucaauggauuuguuuac

SEQ ID NO: 695014 - RNA, 19 nt, Homo sapiens
agagaggugaugauccuua

SEQ ID NO: 695015 - RNA, 19 nt, Homo sapiens
cagaaugugaugccuuuga

SEQ ID NO: 695016 - RNA, 19 nt, Homo sapiens
gaaccguaucauccaguuu

SEQ ID NO: 695017 - RNA, 19 nt, Homo sapiens
gucacggaguuuagcuaua

SEQ ID NO: 695018 - RNA, 19 nt, Homo sapiens
gaaagugaagacugucaag

SEQ ID NO: 695019 - RNA, 19 nt, Homo sapiens
ccuucaacauggaugagua

SEQ ID NO: 695020 - RNA, 19 nt, Homo sapiens
aacgaucccuuccuucuuc

SEQ ID NO: 695021 - RNA, 19 nt, Homo sapiens
aaagagaaagaaacugaga

SEQ ID NO: 695022 - RNA, 19 nt, Homo sapiens
guacaguaucaaagagaaa

SEQ ID NO: 695023 - RNA, 19 nt, Homo sapiens
aggcuucuauugauaaauc

SEQ ID NO: 695024 - RNA, 19 nt, Homo sapiens
uacaagaagcugauugaau

SEQ ID NO: 695025 - RNA, 19 nt, Homo sapiens
ccagauaagugggugaacu

SEQ ID NO: 695026 - RNA, 19 nt, Homo sapiens
ucuggaaauugucuuuaga

SEQ ID NO: 695027 - RNA, 19 nt, Homo sapiens
ggccuaagggcuauguuug

SEQ ID NO: 695028 - RNA, 19 nt, Homo sapiens
uuucacagcuuuucucuga

SEQ ID NO: 695029 - RNA, 19 nt, Homo sapiens
uaacaagugcaauggaaag

SEQ ID NO: 695030 - RNA, 19 nt, Homo sapiens
gaaggcacaaacucucaau

SEQ ID NO: 695031 - RNA, 19 nt, Homo sapiens
ggccaaugcuagguucuuc

SEQ ID NO: 695032 - RNA, 19 nt, Homo sapiens
ggugggaucgagcuauuug

SEQ ID NO: 695033 - RNA, 19 nt, Homo sapiens
ugugaugccuuugaagaga

SEQ ID NO: 695034 - RNA, 19 nt, Homo sapiens
guaugguuacuccagauaa

SEQ ID NO: 695035 - RNA, 19 nt, Homo sapiens
uguacaguaucaaagagaa

SEQ ID NO: 695036 - RNA, 19 nt, Homo sapiens
cuagagaggugaugauccu

SEQ ID NO: 695037 - RNA, 19 nt, Homo sapiens
gggaucgagcuauuuguug

SEQ ID NO: 695038 - RNA, 19 nt, Homo sapiens
acaccaaaugcuucuagua

SEQ ID NO: 695039 - RNA, 19 nt, Homo sapiens
ggacuaaacuaccuccaaa

SEQ ID NO: 695040 - RNA, 19 nt, Homo sapiens
gaacggagaagaaguugua

SEQ ID NO: 695041 - RNA, 19 nt, Homo sapiens
caacagauaaugaccaaua

SEQ ID NO: 695042 - RNA, 19 nt, Homo sapiens
gaacggagaccugguauga

SEQ ID NO: 695043 - RNA, 19 nt, Homo sapiens
gagaagcagugaugacuau

SEQ ID NO: 695044 - RNA, 19 nt, Homo sapiens
ggugaacacuucugaauuc

SEQ ID NO: 695045 - RNA, 19 nt, Homo sapiens
gaugacaacuccuacaugu

SEQ ID NO: 695046 - RNA, 19 nt, Homo sapiens
ugauaucgcaccuaaauua

SEQ ID NO: 695047 - RNA, 19 nt, Homo sapiens
ugacagcaguuaucucuga

SEQ ID NO: 695048 - RNA, 19 nt, Homo sapiens
uaaacuaccuccaaagcaa

SEQ ID NO: 695049 - RNA, 19 nt, Homo sapiens
gaaagucucuaaggcucua

SEQ ID NO: 695050 - RNA, 19 nt, Homo sapiens
ggaaguacccauugaaaca

SEQ ID NO: 695051 - RNA, 19 nt, Homo sapiens
agacugauaucgcaccuaa

SEQ ID NO: 695052 - RNA, 19 nt, Homo sapiens
gaagaaagcagggcaagug

SEQ ID NO: 695053 - RNA, 19 nt, Homo sapiens
gcaguuaucucugaggaau

SEQ ID NO: 695054 - RNA, 19 nt, Homo sapiens
gaaaauauacugccacauu

SEQ ID NO: 695055 - RNA, 19 nt, Homo sapiens
uucaguggcuggaguauua

SEQ ID NO: 695056 - RNA, 19 nt, Homo sapiens
aaacaugcguauuugugua

SEQ ID NO: 695057 - RNA, 19 nt, Homo sapiens
caaagggacuccugaaacu

SEQ ID NO: 695058 - RNA, 19 nt, Homo sapiens
ucacuguguuuguagguua

SEQ ID NO: 695059 - RNA, 19 nt, Homo sapiens
gcuccgaagucaauacuga

SEQ ID NO: 695060 - RNA, 19 nt, Homo sapiens
ucacagauaugauuuacca

SEQ ID NO: 695061 - RNA, 19 nt, Homo sapiens
gaaacuaucccagaucuca

SEQ ID NO: 695062 - RNA, 19 nt, Homo sapiens
uacauuaaguugagccaua

SEQ ID NO: 695063 - RNA, 19 nt, Homo sapiens
gcaaggcucugucucaaaa

SEQ ID NO: 695064 - RNA, 19 nt, Homo sapiens
gaaaugagacaggaagaug

SEQ ID NO: 695065 - RNA, 19 nt, Homo sapiens
ggagaacggagaagaaguu

SEQ ID NO: 695066 - RNA, 19 nt, Homo sapiens
ucuguaagaucaacaagaa

SEQ ID NO: 695067 - RNA, 19 nt, Homo sapiens
cauauaugguuccagcuaa

SEQ ID NO: 695068 - RNA, 19 nt, Homo sapiens
cacuuaaggugauguauga

SEQ ID NO: 695069 - RNA, 19 nt, Homo sapiens
caacaagaaacacgguuaa

SEQ ID NO: 695070 - RNA, 19 nt, Homo sapiens
acagguacaugguccagua

SEQ ID NO: 695071 - RNA, 19 nt, Homo sapiens
gaccgaagccuugugcaua

SEQ ID NO: 695072 - RNA, 19 nt, Homo sapiens
uguaaucacuguguuugua

SEQ ID NO: 695073 - RNA, 19 nt, Homo sapiens
gcacuucccagccacauug

SEQ ID NO: 695074 - RNA, 19 nt, Homo sapiens
gaaacaugcguauuugugu

SEQ ID NO: 695075 - RNA, 19 nt, Homo sapiens
uaaguugagccauauguaa

SEQ ID NO: 695076 - RNA, 19 nt, Homo sapiens
gccugaaggucauacaauu

SEQ ID NO: 695077 - RNA, 19 nt, Homo sapiens
ccagagacauccugaagag

SEQ ID NO: 695078 - RNA, 19 nt, Homo sapiens
auacugagaucccagaugu

SEQ ID NO: 695079 - RNA, 19 nt, Homo sapiens
caacaggacuaaacuaccu

SEQ ID NO: 695080 - RNA, 19 nt, Homo sapiens
uaagaaggagcucauguga

SEQ ID NO: 695081 - RNA, 19 nt, Homo sapiens
gugcugugcugcccauuug

SEQ ID NO: 695082 - RNA, 19 nt, Homo sapiens
cauugaaacaugcguauuu

SEQ ID NO: 695083 - RNA, 19 nt, Homo sapiens
gcccugauucuaccacuua

SEQ ID NO: 695084 - RNA, 19 nt, Homo sapiens
ucaagaaccgugugucuau

SEQ ID NO: 695085 - RNA, 19 nt, Homo sapiens
caagcagucuuuucaguuu

SEQ ID NO: 695086 - RNA, 19 nt, Homo sapiens
cuacauguacauucucuuu

SEQ ID NO: 695087 - RNA, 19 nt, Homo sapiens
cagaaacuaucccagaucu

SEQ ID NO: 695088 - RNA, 19 nt, Homo sapiens
ugaguaucguaguuucaua

SEQ ID NO: 695089 - RNA, 19 nt, Homo sapiens
guuagaaacagcugaguau

SEQ ID NO: 695090 - RNA, 19 nt, Homo sapiens
aaggugauguaugaucuua

SEQ ID NO: 695091 - RNA, 19 nt, Homo sapiens
gcccaugaacaaacauaua

SEQ ID NO: 695092 - RNA, 19 nt, Homo sapiens
ucaacaagaaacacgguua

SEQ ID NO: 695093 - RNA, 19 nt, Homo sapiens
acggagaccugguaugaga

SEQ ID NO: 695094 - RNA, 19 nt, Homo sapiens
ucccagaucucagcuagaa

SEQ ID NO: 695095 - RNA, 19 nt, Homo sapiens
gauaucgcaccuaaauuau

SEQ ID NO: 695096 - RNA, 19 nt, Homo sapiens
caagaaccgugugucuaug

SEQ ID NO: 695097 - RNA, 19 nt, Homo sapiens
guauuuguguauagcagaa

SEQ ID NO: 695098 - RNA, 19 nt, Homo sapiens
cgaagucaauacugagauc

SEQ ID NO: 695099 - RNA, 19 nt, Homo sapiens
ugagugaugugagaaacuu

SEQ ID NO: 695100 - RNA, 19 nt, Homo sapiens
ugacaacuccuacauguac

SEQ ID NO: 695101 - RNA, 19 nt, Homo sapiens
ggacacuucucucccucau

SEQ ID NO: 695102 - RNA, 19 nt, Homo sapiens
aagagaagcagcccugauu

SEQ ID NO: 695103 - RNA, 19 nt, Homo sapiens
ggauuugccagcagucuga

SEQ ID NO: 695104 - RNA, 19 nt, Homo sapiens
gaauuggguuauaggugau

SEQ ID NO: 695105 - RNA, 19 nt, Homo sapiens
gaucuuaggcuggacacuu

SEQ ID NO: 695106 - RNA, 19 nt, Homo sapiens
gaagcagcccugauucuac

SEQ ID NO: 695107 - RNA, 19 nt, Homo sapiens
gaagagaagcagcccugau

SEQ ID NO: 695108 - RNA, 19 nt, Homo sapiens
cccaugaacaaacauauaa

SEQ ID NO: 695109 - RNA, 19 nt, Homo sapiens
accgaagccuugugcauaa

SEQ ID NO: 695110 - RNA, 19 nt, Homo sapiens
ccuaucauguguauaucaa

SEQ ID NO: 695111 - RNA, 19 nt, Homo sapiens
acauguacauucucuuugu

SEQ ID NO: 695112 - RNA, 19 nt, Homo sapiens
ucugaggaauuggguuaua

SEQ ID NO: 695113 - RNA, 19 nt, Homo sapiens
gcuagaaccauccacuguu

SEQ ID NO: 695114 - RNA, 19 nt, Homo sapiens
caauguggcuggugaacac

SEQ ID NO: 695115 - RNA, 19 nt, Homo sapiens
ggugauguaugaucuuagg

SEQ ID NO: 695116 - RNA, 19 nt, Homo sapiens
uaaaagaagcagaguauga

SEQ ID NO: 695117 - RNA, 19 nt, Homo sapiens
gagcuucuaccgagucuuc

SEQ ID NO: 695118 - RNA, 19 nt, Homo sapiens
gguuagaaacagcugagua

SEQ ID NO: 695119 - RNA, 19 nt, Homo sapiens
gguacaugguccaguagga

SEQ ID NO: 695120 - RNA, 19 nt, Homo sapiens
gggagcccaugaacaaaca

SEQ ID NO: 695121 - RNA, 19 nt, Homo sapiens
ucagugucccuaucuguaa

SEQ ID NO: 695122 - RNA, 19 nt, Homo sapiens
ugaaacaugcguauuugug

SEQ ID NO: 695123 - RNA, 19 nt, Homo sapiens
gaaacagcugaguaucgua

SEQ ID NO: 695124 - RNA, 19 nt, Homo sapiens
ucccagauguguccagaga

SEQ ID NO: 695125 - RNA, 19 nt, Homo sapiens
ccacaaagggacuccugaa

SEQ ID NO: 695126 - RNA, 19 nt, Homo sapiens
agaaacagcugaguaucgu

SEQ ID NO: 695127 - RNA, 19 nt, Homo sapiens
cauauguaaucacuguguu

SEQ ID NO: 695128 - RNA, 19 nt, Homo sapiens
guacaugguccaguaggaa

SEQ ID NO: 695129 - RNA, 19 nt, Homo sapiens
uggaggagccuuagugugu

SEQ ID NO: 695130 - RNA, 19 nt, Homo sapiens
ggaaaugagacaggaagau

SEQ ID NO: 695131 - RNA, 19 nt, Homo sapiens
gaaguacccauugaaacau

SEQ ID NO: 695132 - RNA, 19 nt, Homo sapiens
cauccacuguucuguuugu

SEQ ID NO: 695133 - RNA, 19 nt, Homo sapiens
gaguaucguaguuucauau

SEQ ID NO: 695134 - RNA, 19 nt, Homo sapiens
ccacuuaaggugauguaug

SEQ ID NO: 695135 - RNA, 19 nt, Homo sapiens
ccagcagucugagcuucua

SEQ ID NO: 695136 - RNA, 19 nt, Homo sapiens
agugaugacuaucccauau

SEQ ID NO: 695137 - RNA, 19 nt, Homo sapiens
ggccagacaaccagacuga

SEQ ID NO: 695138 - RNA, 19 nt, Homo sapiens
auucuaggcuucauauaca

SEQ ID NO: 695139 - RNA, 19 nt, Homo sapiens
gaacugagcuuuauaagag

SEQ ID NO: 695140 - RNA, 19 nt, Homo sapiens
gcaaaucuuucaucaacua

SEQ ID NO: 695141 - RNA, 19 nt, Homo sapiens
gcagagaucuuugcagaaa

SEQ ID NO: 695142 - RNA, 19 nt, Homo sapiens
ccaaugaccugggaagaua

SEQ ID NO: 695143 - RNA, 19 nt, Homo sapiens
acucaaagcuuuaucguuu

SEQ ID NO: 695144 - RNA, 19 nt, Homo sapiens
gagaagguauuuccucuug

SEQ ID NO: 695145 - RNA, 19 nt, Homo sapiens
gucagaagaucauuacuuu

SEQ ID NO: 695146 - RNA, 19 nt, Homo sapiens
gaaacaaggccaaugaaga

SEQ ID NO: 695147 - RNA, 19 nt, Homo sapiens
ggacucuucugugauguua

SEQ ID NO: 695148 - RNA, 19 nt, Homo sapiens
ggaagggucuauuauaucu

SEQ ID NO: 695149 - RNA, 19 nt, Homo sapiens
caucagcucuucucuguug

SEQ ID NO: 695150 - RNA, 19 nt, Homo sapiens
ggaggaggaggaaauaaua

SEQ ID NO: 695151 - RNA, 19 nt, Homo sapiens
gcugauaccucccaaaaua

SEQ ID NO: 695152 - RNA, 19 nt, Homo sapiens
gcagcgagauggcaaacaa

SEQ ID NO: 695153 - RNA, 19 nt, Homo sapiens
gauggaagggucuauuaua

SEQ ID NO: 695154 - RNA, 19 nt, Homo sapiens
caaaucauaugcccucuuc

SEQ ID NO: 695155 - RNA, 19 nt, Homo sapiens
uaaagucaguucauaguca

SEQ ID NO: 695156 - RNA, 19 nt, Homo sapiens
cauaugcccucuucaauca

SEQ ID NO: 695157 - RNA, 19 nt, Homo sapiens
guacagcgcaggaugguaa

SEQ ID NO: 695158 - RNA, 19 nt, Homo sapiens
gaugaucacuaugaguuaa

SEQ ID NO: 695159 - RNA, 19 nt, Homo sapiens
agauacagcuacugaaauu

SEQ ID NO: 695160 - RNA, 19 nt, Homo sapiens
guucuucacuuccaaauca

SEQ ID NO: 695161 - RNA, 19 nt, Homo sapiens
caucugacucccaauauua

SEQ ID NO: 695162 - RNA, 19 nt, Homo sapiens
uaaaucagggcaguuauua

SEQ ID NO: 695163 - RNA, 19 nt, Homo sapiens
gagcgaagguaucaguguu

SEQ ID NO: 695164 - RNA, 19 nt, Homo sapiens
uggcacagguccaaucuaa

SEQ ID NO: 695165 - RNA, 19 nt, Homo sapiens
uaucacaccuacucagaaa

SEQ ID NO: 695166 - RNA, 19 nt, Homo sapiens
gaagguauuuccucuugca

SEQ ID NO: 695167 - RNA, 19 nt, Homo sapiens
cagauuugcuugaugaguu

SEQ ID NO: 695168 - RNA, 19 nt, Homo sapiens
gccauggacucuucuguga

SEQ ID NO: 695169 - RNA, 19 nt, Homo sapiens
gcaggaaaaugauucaauu

SEQ ID NO: 695170 - RNA, 19 nt, Homo sapiens
ucaauuuacuugugcagaa

SEQ ID NO: 695171 - RNA, 19 nt, Homo sapiens
ccaugcaggucuuuacaaa

SEQ ID NO: 695172 - RNA, 19 nt, Homo sapiens
caagaaccacuuuccaauu

SEQ ID NO: 695173 - RNA, 19 nt, Homo sapiens
gguauuuccucuugcagaa

SEQ ID NO: 695174 - RNA, 19 nt, Homo sapiens
gcaaacaaacguaugaaag

SEQ ID NO: 695175 - RNA, 19 nt, Homo sapiens
gcagauuccuacacuucuu

SEQ ID NO: 695176 - RNA, 19 nt, Homo sapiens
agagaucuuugcagaaauu

SEQ ID NO: 695177 - RNA, 19 nt, Homo sapiens
gcacuauuccugcaaugaa

SEQ ID NO: 695178 - RNA, 19 nt, Homo sapiens
aagaaccacuuuccaauuc

SEQ ID NO: 695179 - RNA, 19 nt, Homo sapiens
gaugaugaugacacuauua

SEQ ID NO: 695180 - RNA, 19 nt, Homo sapiens
caaacaaacguaugaaagu

SEQ ID NO: 695181 - RNA, 19 nt, Homo sapiens
cagaagaucauuacuuuag

SEQ ID NO: 695182 - RNA, 19 nt, Homo sapiens
cuacagacauucaguacuc

SEQ ID NO: 695183 - RNA, 19 nt, Homo sapiens
ugccgaagauuaugaaaug

SEQ ID NO: 695184 - RNA, 19 nt, Homo sapiens
gauggaucauuaauacaga

SEQ ID NO: 695185 - RNA, 19 nt, Homo sapiens
aaugaaggaugaugguauu

SEQ ID NO: 695186 - RNA, 19 nt, Homo sapiens
ucaaagaugacccugauga

SEQ ID NO: 695187 - RNA, 19 nt, Homo sapiens
uggcaaaucuuucaucaac

SEQ ID NO: 695188 - RNA, 19 nt, Homo sapiens
cauggacucuucugugaug

SEQ ID NO: 695189 - RNA, 19 nt, Homo sapiens
agaaguauccgugccguua

SEQ ID NO: 695190 - RNA, 19 nt, Homo sapiens
gaaggcuuaucgacugguu

SEQ ID NO: 695191 - RNA, 19 nt, Homo sapiens
gcaguuauuaggagugaaa

SEQ ID NO: 695192 - RNA, 19 nt, Homo sapiens
agauuugcuugaugaguua

SEQ ID NO: 695193 - RNA, 19 nt, Homo sapiens
cugcugaacuccuugaaug

SEQ ID NO: 695194 - RNA, 19 nt, Homo sapiens
ggucagaagaucauuacuu

SEQ ID NO: 695195 - RNA, 19 nt, Homo sapiens
gcaguacugaguuugaauu

SEQ ID NO: 695196 - RNA, 19 nt, Homo sapiens
uccgauagaucaagcacua

SEQ ID NO: 695197 - RNA, 19 nt, Homo sapiens
gcgaagguaucaguguuug

SEQ ID NO: 695198 - RNA, 19 nt, Homo sapiens
gauaauggggcuacuauaa

SEQ ID NO: 695199 - RNA, 19 nt, Homo sapiens
aaagaugaagcccaagaua

SEQ ID NO: 695200 - RNA, 19 nt, Homo sapiens
gagacuuugccgaguaaua

SEQ ID NO: 695201 - RNA, 19 nt, Homo sapiens
uaacagauggcaguacuga

SEQ ID NO: 695202 - RNA, 19 nt, Homo sapiens
gcggagacauuuuaacauu

SEQ ID NO: 695203 - RNA, 19 nt, Homo sapiens
caaagaugacccugaugaa

SEQ ID NO: 695204 - RNA, 19 nt, Homo sapiens
caagguuuaugcaaauauc

SEQ ID NO: 695205 - RNA, 19 nt, Homo sapiens
gaaauugaaggcuuaucga

SEQ ID NO: 695206 - RNA, 19 nt, Homo sapiens
aaggagacuuugccgagua

SEQ ID NO: 695207 - RNA, 19 nt, Homo sapiens
gcaaugaaggaugauggua

SEQ ID NO: 695208 - RNA, 19 nt, Homo sapiens
agacuuugccgaguaauaa

SEQ ID NO: 695209 - RNA, 19 nt, Homo sapiens
aagaugaagcccaagauaa

SEQ ID NO: 695210 - RNA, 19 nt, Homo sapiens
cagaauaucgcacaaagca

SEQ ID NO: 695211 - RNA, 19 nt, Homo sapiens
aaacaaggccaaugaagag

SEQ ID NO: 695212 - RNA, 19 nt, Homo sapiens
caccaaaugucaguucuuc

SEQ ID NO: 695213 - RNA, 19 nt, Homo sapiens
acacaucugacucccaaua

SEQ ID NO: 695214 - RNA, 19 nt, Homo sapiens
gggcuacuauaaugccuau

SEQ ID NO: 695215 - RNA, 19 nt, Homo sapiens
gggcaguuauuaggaguga

SEQ ID NO: 695216 - RNA, 19 nt, Homo sapiens
guugaacugagcuuuauaa

SEQ ID NO: 695217 - RNA, 19 nt, Homo sapiens
cucaaagcuuuaucguuua

SEQ ID NO: 695218 - RNA, 19 nt, Homo sapiens
ggugaagauacuuaugaua

SEQ ID NO: 695219 - RNA, 19 nt, Homo sapiens
gagggucagaagaucauua

SEQ ID NO: 695220 - RNA, 19 nt, Homo sapiens
cagaagaugcagauuccua

SEQ ID NO: 695221 - RNA, 19 nt, Homo sapiens
aggaggaaauaauagauga

SEQ ID NO: 695222 - RNA, 19 nt, Homo sapiens
ggaaacaaggccaaugaag

SEQ ID NO: 695223 - RNA, 19 nt, Homo sapiens
caggaaacaaggccaauga

SEQ ID NO: 695224 - RNA, 19 nt, Homo sapiens
auggaagggucuauuauau

SEQ ID NO: 695225 - RNA, 19 nt, Homo sapiens
aaucagacaccacuuucua

SEQ ID NO: 695226 - RNA, 19 nt, Homo sapiens
ccgagauucugcccacaaa

SEQ ID NO: 695227 - RNA, 19 nt, Homo sapiens
cuacaucuacucagaacaa

SEQ ID NO: 695228 - RNA, 19 nt, Homo sapiens
ggaugaugguauuggguau

SEQ ID NO: 695229 - RNA, 19 nt, Homo sapiens
caaugaaggaugaugguau

SEQ ID NO: 695230 - RNA, 19 nt, Homo sapiens
aggccagacuugagaauga

SEQ ID NO: 695231 - RNA, 19 nt, Homo sapiens
gcaagguuuaugcaaauau

SEQ ID NO: 695232 - RNA, 19 nt, Homo sapiens
uuaaaucagacaccacuuu

SEQ ID NO: 695233 - RNA, 19 nt, Homo sapiens
caaacacaaggaagugaaa

SEQ ID NO: 695234 - RNA, 19 nt, Homo sapiens
gaucauuguuaccgauucu

SEQ ID NO: 695235 - RNA, 19 nt, Homo sapiens
caagcacuauuccugcaau

SEQ ID NO: 695236 - RNA, 19 nt, Homo sapiens
aaagucaguucauagucaa

SEQ ID NO: 695237 - RNA, 19 nt, Homo sapiens
ggagacauuuuaacauuca

SEQ ID NO: 695238 - RNA, 19 nt, Homo sapiens
uacugaaauugaaggcuua

SEQ ID NO: 695239 - RNA, 19 nt, Homo sapiens
guaaauagcuucccacuuc

SEQ ID NO: 695240 - RNA, 19 nt, Homo sapiens
ggauagagauucugcagua

SEQ ID NO: 695241 - RNA, 19 nt, Homo sapiens
gaagagaccugucauuuac

SEQ ID NO: 695242 - RNA, 19 nt, Homo sapiens
guaacugucuucaucuuua

SEQ ID NO: 695243 - RNA, 19 nt, Homo sapiens
gaaaauagcagacaacaua

SEQ ID NO: 695244 - RNA, 19 nt, Homo sapiens
agugagagcuguugaauuu

SEQ ID NO: 695245 - RNA, 19 nt, Homo sapiens
ggaauagucuacaaaggaa

SEQ ID NO: 695246 - RNA, 19 nt, Homo sapiens
ggauagagcugcguguuug

SEQ ID NO: 695247 - RNA, 19 nt, Homo sapiens
ggacgaagaggaauggaua

SEQ ID NO: 695248 - RNA, 19 nt, Homo sapiens
gagaagagaccugucauuu

SEQ ID NO: 695249 - RNA, 19 nt, Homo sapiens
aaacaaagcccucaaaucu

SEQ ID NO: 695250 - RNA, 19 nt, Homo sapiens
gaacagcugucacuucaac

SEQ ID NO: 695251 - RNA, 19 nt, Homo sapiens
aaacagacauaucaaguuc

SEQ ID NO: 695252 - RNA, 19 nt, Homo sapiens
gaaagaccacuuaagcaaa

SEQ ID NO: 695253 - RNA, 19 nt, Homo sapiens
ccacucaagauaacaauua

SEQ ID NO: 695254 - RNA, 19 nt, Homo sapiens
gagaauacgugaacaacag

SEQ ID NO: 695255 - RNA, 19 nt, Homo sapiens
ucaaauguuucuaggguuu

SEQ ID NO: 695256 - RNA, 19 nt, Homo sapiens
agaagagaccugucauuua

SEQ ID NO: 695257 - RNA, 19 nt, Homo sapiens
gacaaugacucaacuuucu

SEQ ID NO: 695258 - RNA, 19 nt, Homo sapiens
gcacagaaagaccacuuaa

SEQ ID NO: 695259 - RNA, 19 nt, Homo sapiens
ggaaaacacuuuacaacug

SEQ ID NO: 695260 - RNA, 19 nt, Homo sapiens
gaaauaagccuaaaagaag

SEQ ID NO: 695261 - RNA, 19 nt, Homo sapiens
caagaggacugugcagaga

SEQ ID NO: 695262 - RNA, 19 nt, Homo sapiens
ucacuucaacagacuauua

SEQ ID NO: 695263 - RNA, 19 nt, Homo sapiens
ugacucaacuuucuuacau

SEQ ID NO: 695264 - RNA, 19 nt, Homo sapiens
gaacuaugagcagagaaua

SEQ ID NO: 695265 - RNA, 19 nt, Homo sapiens
gauagagauucugcaguaa

SEQ ID NO: 695266 - RNA, 19 nt, Homo sapiens
uaggugauauucucuuuga

SEQ ID NO: 695267 - RNA, 19 nt, Homo sapiens
caaguucuaugugaugauu

SEQ ID NO: 695268 - RNA, 19 nt, Homo sapiens
gagagacccggcauccuua

SEQ ID NO: 695269 - RNA, 19 nt, Homo sapiens
ugaagacagugaaacaaga

SEQ ID NO: 695270 - RNA, 19 nt, Homo sapiens
acagacauaucaaguucua

SEQ ID NO: 695271 - RNA, 19 nt, Homo sapiens
ugaauucugucaagcaguu

SEQ ID NO: 695272 - RNA, 19 nt, Homo sapiens
gaagacagugaaacaagaa

SEQ ID NO: 695273 - RNA, 19 nt, Homo sapiens
gcaaaagacugagaacuau

SEQ ID NO: 695274 - RNA, 19 nt, Homo sapiens
gccacaagauaaagugauu

SEQ ID NO: 695275 - RNA, 19 nt, Homo sapiens
gcaacucaauaaagcguau

SEQ ID NO: 695276 - RNA, 19 nt, Homo sapiens
gaaaacacuuuacaacugu

SEQ ID NO: 695277 - RNA, 19 nt, Homo sapiens
ggacaaugacucaacuuuc

SEQ ID NO: 695278 - RNA, 19 nt, Homo sapiens
ugaauuccacucaagauaa

SEQ ID NO: 695279 - RNA, 19 nt, Homo sapiens
uuacauagcacuccagaga

SEQ ID NO: 695280 - RNA, 19 nt, Homo sapiens
caaugacucaacuuucuua

SEQ ID NO: 695281 - RNA, 19 nt, Homo sapiens
gaccacagcagcccauuug

SEQ ID NO: 695282 - RNA, 19 nt, Homo sapiens
aaauaugcaugcuagcaaa

SEQ ID NO: 695283 - RNA, 19 nt, Homo sapiens
gauaaagugauuucaggaa

SEQ ID NO: 695284 - RNA, 19 nt, Homo sapiens
cggcaggcaugcauggaua

SEQ ID NO: 695285 - RNA, 19 nt, Homo sapiens
guaauccuuuguauucaug

SEQ ID NO: 695286 - RNA, 19 nt, Homo sapiens
gacucaacuuucuuacaua

SEQ ID NO: 695287 - RNA, 19 nt, Homo sapiens
gaauuccacucaagauaac

SEQ ID NO: 695288 - RNA, 19 nt, Homo sapiens
gcaguccuuugcuccauga

SEQ ID NO: 695289 - RNA, 19 nt, Homo sapiens
guaagaagacaagagguuu

SEQ ID NO: 695290 - RNA, 19 nt, Homo sapiens
ggagaagagaccugucauu

SEQ ID NO: 695291 - RNA, 19 nt, Homo sapiens
gcagacaacauaaacaucu

SEQ ID NO: 695292 - RNA, 19 nt, Homo sapiens
ucugggaucugaaagaaga

SEQ ID NO: 695293 - RNA, 19 nt, Homo sapiens
ucaguuacuucuugugaau

SEQ ID NO: 695294 - RNA, 19 nt, Homo sapiens
gcagagaauacgugaacaa

SEQ ID NO: 695295 - RNA, 19 nt, Homo sapiens
gcgagcaacucaauaaagc

SEQ ID NO: 695296 - RNA, 19 nt, Homo sapiens
aaaucuaguuucacagcua

SEQ ID NO: 695297 - RNA, 19 nt, Homo sapiens
ccucaaaucucguaaacac

SEQ ID NO: 695298 - RNA, 19 nt, Homo sapiens
gguaagaagacaagagguu

SEQ ID NO: 695299 - RNA, 19 nt, Homo sapiens
gcuaaaaucucaguuacuu

SEQ ID NO: 695300 - RNA, 19 nt, Homo sapiens
caacagacuauuauugaca

SEQ ID NO: 695301 - RNA, 19 nt, Homo sapiens
caaaucucguaaacacuug

SEQ ID NO: 695302 - RNA, 19 nt, Homo sapiens
acauagcacuccagagaga

SEQ ID NO: 695303 - RNA, 19 nt, Homo sapiens
aaagaaacuucagcaagga

SEQ ID NO: 695304 - RNA, 19 nt, Homo sapiens
aggaacagcugucacuuca

SEQ ID NO: 695305 - RNA, 19 nt, Homo sapiens
uuggugaugucaaauguuu

SEQ ID NO: 695306 - RNA, 19 nt, Homo sapiens
guaugugacuuagaguuau

SEQ ID NO: 695307 - RNA, 19 nt, Homo sapiens
ucgaguaugugaauucugu

SEQ ID NO: 695308 - RNA, 19 nt, Homo sapiens
ccagggaacuuuguuaaaa

SEQ ID NO: 695309 - RNA, 19 nt, Homo sapiens
agaaagaccacuuaagcaa

SEQ ID NO: 695310 - RNA, 19 nt, Homo sapiens
gugaauuccacucaagaua

SEQ ID NO: 695311 - RNA, 19 nt, Homo sapiens
uugcuuggauuucuaguga

SEQ ID NO: 695312 - RNA, 19 nt, Homo sapiens
caggacaacucuggauaga

SEQ ID NO: 695313 - RNA, 19 nt, Homo sapiens
ucaaaucucguaaacacuu

SEQ ID NO: 695314 - RNA, 19 nt, Homo sapiens
ggaucugaaagaagaauuu

SEQ ID NO: 695315 - RNA, 19 nt, Homo sapiens
gagcagagaauacgugaac

SEQ ID NO: 695316 - RNA, 19 nt, Homo sapiens
ugagagcuguugaauuugg

SEQ ID NO: 695317 - RNA, 19 nt, Homo sapiens
uguaugugacuuagaguua

SEQ ID NO: 695318 - RNA, 19 nt, Homo sapiens
caaggagaaauaagccuaa

SEQ ID NO: 695319 - RNA, 19 nt, Homo sapiens
gaggaauagucuacaaagg

SEQ ID NO: 695320 - RNA, 19 nt, Homo sapiens
aaagugauuucaggaauag

SEQ ID NO: 695321 - RNA, 19 nt, Homo sapiens
agacuuaagacacauuuga

SEQ ID NO: 695322 - RNA, 19 nt, Homo sapiens
caccauccaucacaucugu

SEQ ID NO: 695323 - RNA, 19 nt, Homo sapiens
aaagaccacuuaagcaaac

SEQ ID NO: 695324 - RNA, 19 nt, Homo sapiens
gcuuggauuucuagugaga

SEQ ID NO: 695325 - RNA, 19 nt, Homo sapiens
ggaccacagcagcccauuu

SEQ ID NO: 695326 - RNA, 19 nt, Homo sapiens
ucaacuuucuuacauagca

SEQ ID NO: 695327 - RNA, 19 nt, Homo sapiens
acagaggaauagucuacaa

SEQ ID NO: 695328 - RNA, 19 nt, Homo sapiens
aaaucucaguuacuucuug

SEQ ID NO: 695329 - RNA, 19 nt, Homo sapiens
ugagaacuaugagcagaga

SEQ ID NO: 695330 - RNA, 19 nt, Homo sapiens
guaugugaauucugucaag

SEQ ID NO: 695331 - RNA, 19 nt, Homo sapiens
gaagcccuuuccuaaucaa

SEQ ID NO: 695332 - RNA, 19 nt, Homo sapiens
cagacaacauaaacaucuu

SEQ ID NO: 695333 - RNA, 19 nt, Homo sapiens
uggagagacuuaagacaca

SEQ ID NO: 695334 - RNA, 19 nt, Homo sapiens
ucaggaauagcaagagaaa

SEQ ID NO: 695335 - RNA, 19 nt, Homo sapiens
gaaaacagacauaucaagu

SEQ ID NO: 695336 - RNA, 19 nt, Homo sapiens
uaccagacacugcaacuga

SEQ ID NO: 695337 - RNA, 19 nt, Homo sapiens
gguaauauagagaagacuu

SEQ ID NO: 695338 - RNA, 19 nt, Homo sapiens
gacagugaaacaagaaaga

SEQ ID NO: 695339 - RNA, 19 nt, Homo sapiens
ugacauagcuuccucauuu

SEQ ID NO: 695340 - RNA, 19 nt, Homo sapiens
gaagugaucugcuggaauu

SEQ ID NO: 695341 - RNA, 19 nt, Homo sapiens
ggauagagauucugcagua

SEQ ID NO: 695342 - RNA, 19 nt, Homo sapiens
gaagagaccugucauuuac

SEQ ID NO: 695343 - RNA, 19 nt, Homo sapiens
guaacugucuucaucuuua

SEQ ID NO: 695344 - RNA, 19 nt, Homo sapiens
gcagaaagcagcauuuaaa

SEQ ID NO: 695345 - RNA, 19 nt, Homo sapiens
ggaauagucuacaaaggaa

SEQ ID NO: 695346 - RNA, 19 nt, Homo sapiens
ggacgaagaggaauggaua

SEQ ID NO: 695347 - RNA, 19 nt, Homo sapiens
gagaagagaccugucauuu

SEQ ID NO: 695348 - RNA, 19 nt, Homo sapiens
gaacagcugucacuucaac

SEQ ID NO: 695349 - RNA, 19 nt, Homo sapiens
ccacucaagauaacaauua

SEQ ID NO: 695350 - RNA, 19 nt, Homo sapiens
gagaauacgugaacaacag

SEQ ID NO: 695351 - RNA, 19 nt, Homo sapiens
agaagagaccugucauuua

SEQ ID NO: 695352 - RNA, 19 nt, Homo sapiens
ucacuucaacagacuauua

SEQ ID NO: 695353 - RNA, 19 nt, Homo sapiens
ggaaaacacuuuacaacug

SEQ ID NO: 695354 - RNA, 19 nt, Homo sapiens
gaacuaugagcagagaaua

SEQ ID NO: 695355 - RNA, 19 nt, Homo sapiens
gauagagauucugcaguaa

SEQ ID NO: 695356 - RNA, 19 nt, Homo sapiens
ugaagacagugaaacaaga

SEQ ID NO: 695357 - RNA, 19 nt, Homo sapiens
gaagacagugaaacaagaa

SEQ ID NO: 695358 - RNA, 19 nt, Homo sapiens
gcaaaagacugagaacuau

SEQ ID NO: 695359 - RNA, 19 nt, Homo sapiens
ccaaacagaaguuccauau

SEQ ID NO: 695360 - RNA, 19 nt, Homo sapiens
gccacaagauaaagugauu

SEQ ID NO: 695361 - RNA, 19 nt, Homo sapiens
gaaaacacuuuacaacugu

SEQ ID NO: 695362 - RNA, 19 nt, Homo sapiens
gcaacucaauaaagcguau

SEQ ID NO: 695363 - RNA, 19 nt, Homo sapiens
ugaauuccacucaagauaa

SEQ ID NO: 695364 - RNA, 19 nt, Homo sapiens
caaacagaaguuccauaua

SEQ ID NO: 695365 - RNA, 19 nt, Homo sapiens
gauaaagugauuucaggaa

SEQ ID NO: 695366 - RNA, 19 nt, Homo sapiens
cggcaggcaugcauggaua

SEQ ID NO: 695367 - RNA, 19 nt, Homo sapiens
gaauuccacucaagauaac

SEQ ID NO: 695368 - RNA, 19 nt, Homo sapiens
ggagaagagaccugucauu

SEQ ID NO: 695369 - RNA, 19 nt, Homo sapiens
ucaguuacuucuugugaau

SEQ ID NO: 695370 - RNA, 19 nt, Homo sapiens
gcagagaauacgugaacaa

SEQ ID NO: 695371 - RNA, 19 nt, Homo sapiens
gcgagcaacucaauaaagc

SEQ ID NO: 695372 - RNA, 19 nt, Homo sapiens
gcuaaaaucucaguuacuu

SEQ ID NO: 695373 - RNA, 19 nt, Homo sapiens
caacagacuauuauugaca

SEQ ID NO: 695374 - RNA, 19 nt, Homo sapiens
ggaauuccaaacagaaguu

SEQ ID NO: 695375 - RNA, 19 nt, Homo sapiens
aggaacagcugucacuuca

SEQ ID NO: 695376 - RNA, 19 nt, Homo sapiens
gugaauuccacucaagaua

SEQ ID NO: 695377 - RNA, 19 nt, Homo sapiens
gagcagagaauacgugaac

SEQ ID NO: 695378 - RNA, 19 nt, Homo sapiens
aaagugauuucaggaauag

SEQ ID NO: 695379 - RNA, 19 nt, Homo sapiens
gaggaauagucuacaaagg

SEQ ID NO: 695380 - RNA, 19 nt, Homo sapiens
aggcugagguuuuguauuu

SEQ ID NO: 695381 - RNA, 19 nt, Homo sapiens
acagaggaauagucuacaa

SEQ ID NO: 695382 - RNA, 19 nt, Homo sapiens
aaaucucaguuacuucuug

SEQ ID NO: 695383 - RNA, 19 nt, Homo sapiens
ugagaacuaugagcagaga

SEQ ID NO: 695384 - RNA, 19 nt, Homo sapiens
cagaaagcagcauuuaaau

SEQ ID NO: 695385 - RNA, 19 nt, Homo sapiens
ucaggaauagcaagagaaa

SEQ ID NO: 695386 - RNA, 19 nt, Homo sapiens
gcugagguuuuguauuuaa

SEQ ID NO: 695387 - RNA, 19 nt, Homo sapiens
gacagugaaacaagaaaga

SEQ ID NO: 695388 - RNA, 19 nt, Homo sapiens
uaauuugacucuugaucag

SEQ ID NO: 695389 - RNA, 19 nt, Homo sapiens
aggcaugcauggauagaga

SEQ ID NO: 695390 - RNA, 19 nt, Homo sapiens
uaacugucuucaucuuuac

SEQ ID NO: 695391 - RNA, 19 nt, Homo sapiens
gacuauuauugacaagcua

SEQ ID NO: 695392 - RNA, 19 nt, Homo sapiens
cagaggaauagucuacaaa

SEQ ID NO: 695393 - RNA, 19 nt, Homo sapiens
caagauaaagugauuucag

SEQ ID NO: 695394 - RNA, 19 nt, Homo sapiens
gcugaugcgugacauagcu

SEQ ID NO: 695395 - RNA, 19 nt, Homo sapiens
uugaucagccacaagauaa

SEQ ID NO: 695396 - RNA, 19 nt, Homo sapiens
aggaauagucuacaaagga

SEQ ID NO: 695397 - RNA, 19 nt, Homo sapiens
caagcuaaaaucucaguua

SEQ ID NO: 695398 - RNA, 19 nt, Homo sapiens
gacgaagaggaauggauaa

SEQ ID NO: 695399 - RNA, 19 nt, Homo sapiens
gcuacaggacgaagaggaa

SEQ ID NO: 695400 - RNA, 19 nt, Homo sapiens
gacauagcuuccucauuuu

SEQ ID NO: 695401 - RNA, 19 nt, Homo sapiens
guguaacugucuucaucuu

SEQ ID NO: 695402 - RNA, 19 nt, Homo sapiens
uagagauucugcaguaaaa

SEQ ID NO: 695403 - RNA, 19 nt, Homo sapiens
cuuguaaccuggagaagag

SEQ ID NO: 695404 - RNA, 19 nt, Homo sapiens
aauaaaggcugagguuuug

SEQ ID NO: 695405 - RNA, 19 nt, Homo sapiens
cuucaacagacuauuauug

SEQ ID NO: 695406 - RNA, 19 nt, Homo sapiens
uaaaauaaaggcugagguu

SEQ ID NO: 695407 - RNA, 19 nt, Homo sapiens
aaauaaaggcugagguuuu

SEQ ID NO: 695408 - RNA, 19 nt, Homo sapiens
cuguguaacugucuucauc

SEQ ID NO: 695409 - RNA, 19 nt, Homo sapiens
gcuugaagacagugaaaca

SEQ ID NO: 695410 - RNA, 19 nt, Homo sapiens
guguuccucugcuugaaga

SEQ ID NO: 695411 - RNA, 19 nt, Homo sapiens
uuucaggaauagcaagaga

SEQ ID NO: 695412 - RNA, 19 nt, Homo sapiens
ccacaagauaaagugauuu

SEQ ID NO: 695413 - RNA, 19 nt, Homo sapiens
gaucagccacaagauaaag

SEQ ID NO: 695414 - RNA, 19 nt, Homo sapiens
gcaugcauggauagagauu

SEQ ID NO: 695415 - RNA, 19 nt, Homo sapiens
cagaaguuccauauauaca

SEQ ID NO: 695416 - RNA, 19 nt, Homo sapiens
uaaaugcugaugcgugaca

SEQ ID NO: 695417 - RNA, 19 nt, Homo sapiens
cacaagauaaagugauuuc

SEQ ID NO: 695418 - RNA, 19 nt, Homo sapiens
caggaacagcugucacuuc

SEQ ID NO: 695419 - RNA, 19 nt, Homo sapiens
cuucaucuuuacagaggaa

SEQ ID NO: 695420 - RNA, 19 nt, Homo sapiens
ccaaagguagacauugcuu

SEQ ID NO: 695421 - RNA, 19 nt, Homo sapiens
caaaggaagacuuguaacc

SEQ ID NO: 695422 - RNA, 19 nt, Homo sapiens
gcuguguuccucugcuuga

SEQ ID NO: 695423 - RNA, 19 nt, Homo sapiens
uuacagaggaauagucuac

SEQ ID NO: 695424 - RNA, 19 nt, Homo sapiens
auagagauucugcaguaaa

SEQ ID NO: 695425 - RNA, 19 nt, Homo sapiens
ucucaguuacuucuuguga

SEQ ID NO: 695426 - RNA, 19 nt, Homo sapiens
aaucucaguuacuucuugu

SEQ ID NO: 695427 - RNA, 19 nt, Homo sapiens
ugcagaaagcagcauuuaa

SEQ ID NO: 695428 - RNA, 19 nt, Homo sapiens
gauuucaggaauagcaaga

SEQ ID NO: 695429 - RNA, 19 nt, Homo sapiens
agacuauuauugacaagcu

SEQ ID NO: 695430 - RNA, 19 nt, Homo sapiens
acagaaguuccauauauac

SEQ ID NO: 695431 - RNA, 19 nt, Homo sapiens
uguaacugucuucaucuuu

SEQ ID NO: 695432 - RNA, 19 nt, Homo sapiens
aaagguagacauugcuucu

SEQ ID NO: 695433 - RNA, 19 nt, Homo sapiens
ggcgagcaacucaauaaag

SEQ ID NO: 695434 - RNA, 19 nt, Homo sapiens
gcacagggcuggucuauga

SEQ ID NO: 695435 - RNA, 19 nt, Homo sapiens
gaacugcgacgauuaauug

SEQ ID NO: 695436 - RNA, 19 nt, Homo sapiens
gaaggacccuccaguucua

SEQ ID NO: 695437 - RNA, 19 nt, Homo sapiens
gaacucagcacauguuuga

SEQ ID NO: 695438 - RNA, 19 nt, Homo sapiens
ggauggaucugaaccuuga

SEQ ID NO: 695439 - RNA, 19 nt, Homo sapiens
gaaacaacccaguacauga

SEQ ID NO: 695440 - RNA, 19 nt, Homo sapiens
caagguugcauauguaaua

SEQ ID NO: 695441 - RNA, 19 nt, Homo sapiens
gcaccgagcugauccaaac

SEQ ID NO: 695442 - RNA, 19 nt, Homo sapiens
uaagagaacugcgacgauu

SEQ ID NO: 695443 - RNA, 19 nt, Homo sapiens
ggccaagccuccucaacua

SEQ ID NO: 695444 - RNA, 19 nt, Homo sapiens
gaagguagaagacagagaa

SEQ ID NO: 695445 - RNA, 19 nt, Homo sapiens
gaugagcaguuaaaugaau

SEQ ID NO: 695446 - RNA, 19 nt, Homo sapiens
agagggagcugauaucaug

SEQ ID NO: 695447 - RNA, 19 nt, Homo sapiens
gaacaucgcccaccagaac

SEQ ID NO: 695448 - RNA, 19 nt, Homo sapiens
gcaguuaaaugaauuccau

SEQ ID NO: 695449 - RNA, 19 nt, Homo sapiens
gagcugauaucaugaggau

SEQ ID NO: 695450 - RNA, 19 nt, Homo sapiens
gguguuggaugagcaguua

SEQ ID NO: 695451 - RNA, 19 nt, Homo sapiens
ccagauaucucccaguaca

SEQ ID NO: 695452 - RNA, 19 nt, Homo sapiens
gcuauaaccugacauccau

SEQ ID NO: 695453 - RNA, 19 nt, Homo sapiens
ggucucagcuggcuuugau

SEQ ID NO: 695454 - RNA, 19 nt, Homo sapiens
caggagagguucugaaugg

SEQ ID NO: 695455 - RNA, 19 nt, Homo sapiens
guucacagccuagaauaua

SEQ ID NO: 695456 - RNA, 19 nt, Homo sapiens
ccaaggauauaccaucaau

SEQ ID NO: 695457 - RNA, 19 nt, Homo sapiens
guacaugaaugagggagaa

SEQ ID NO: 695458 - RNA, 19 nt, Homo sapiens
uagcggagguaaagaagaa

SEQ ID NO: 695459 - RNA, 19 nt, Homo sapiens
ccugguggcugcuggauuu

SEQ ID NO: 695460 - RNA, 19 nt, Homo sapiens
ggaaacaacccaguacaug

SEQ ID NO: 695461 - RNA, 19 nt, Homo sapiens
ccaccaggcucuccuagau

SEQ ID NO: 695462 - RNA, 19 nt, Homo sapiens
gcgggaugcugacuacauu

SEQ ID NO: 695463 - RNA, 19 nt, Homo sapiens
gcaccacggucaaggaaca

SEQ ID NO: 695464 - RNA, 19 nt, Homo sapiens
gagaaggacccuccaguuc

SEQ ID NO: 695465 - RNA, 19 nt, Homo sapiens
gaaagucaccucggcauca

SEQ ID NO: 695466 - RNA, 19 nt, Homo sapiens
ggaggguccuuaucguaga

SEQ ID NO: 695467 - RNA, 19 nt, Homo sapiens
ccgcuaugcucaacagaaa

SEQ ID NO: 695468 - RNA, 19 nt, Homo sapiens
ggauggcuauugcauguuc

SEQ ID NO: 695469 - RNA, 19 nt, Homo sapiens
uggaugagcaguuaaauga

SEQ ID NO: 695470 - RNA, 19 nt, Homo sapiens
gcauuauccuuauccuaga

SEQ ID NO: 695471 - RNA, 19 nt, Homo sapiens
gccaagcaauggaagaaga

SEQ ID NO: 695472 - RNA, 19 nt, Homo sapiens
ggaacaauccaagagaauu

SEQ ID NO: 695473 - RNA, 19 nt, Homo sapiens
gcacaggcuucaccgucaa

SEQ ID NO: 695474 - RNA, 19 nt, Homo sapiens
caacuuugacuccaucuau

SEQ ID NO: 695475 - RNA, 19 nt, Homo sapiens
ucacugaucaggccauauu

SEQ ID NO: 695476 - RNA, 19 nt, Homo sapiens
ccucaggacuccaguguca

SEQ ID NO: 695477 - RNA, 19 nt, Homo sapiens
gcacuggcuugguguugga

SEQ ID NO: 695478 - RNA, 19 nt, Homo sapiens
caagccuccucaacuauga

SEQ ID NO: 695479 - RNA, 19 nt, Homo sapiens
uuacaucaauggccacaug

SEQ ID NO: 695480 - RNA, 19 nt, Homo sapiens
uaauggaacucagcacaug

SEQ ID NO: 695481 - RNA, 19 nt, Homo sapiens
ggccaaggauauaccauca

SEQ ID NO: 695482 - RNA, 19 nt, Homo sapiens
gagcugauguugguucaca

SEQ ID NO: 695483 - RNA, 19 nt, Homo sapiens
aaacaacccaguacaugaa

SEQ ID NO: 695484 - RNA, 19 nt, Homo sapiens
gggugugucucucuugcua

SEQ ID NO: 695485 - RNA, 19 nt, Homo sapiens
ggaugcagcuugcgguuuu

SEQ ID NO: 695486 - RNA, 19 nt, Homo sapiens
gggcugagauccggaaugg

SEQ ID NO: 695487 - RNA, 19 nt, Homo sapiens
aggaagagcugauguuggu

SEQ ID NO: 695488 - RNA, 19 nt, Homo sapiens
gaagcucggccaagcaaug

SEQ ID NO: 695489 - RNA, 19 nt, Homo sapiens
agaauacggucccucuuca

SEQ ID NO: 695490 - RNA, 19 nt, Homo sapiens
gguagaagacagagaagga

SEQ ID NO: 695491 - RNA, 19 nt, Homo sapiens
gggugaugcugacuaccua

SEQ ID NO: 695492 - RNA, 19 nt, Homo sapiens
ccaaguccaucgcagauac

SEQ ID NO: 695493 - RNA, 19 nt, Homo sapiens
gcaagcugauccugucucu

SEQ ID NO: 695494 - RNA, 19 nt, Homo sapiens
caacccaguacaugaauga

SEQ ID NO: 695495 - RNA, 19 nt, Homo sapiens
cuugugagaucaacugaga

SEQ ID NO: 695496 - RNA, 19 nt, Homo sapiens
gggagguucuugugagauc

SEQ ID NO: 695497 - RNA, 19 nt, Homo sapiens
cgacucaguuuaucugcau

SEQ ID NO: 695498 - RNA, 19 nt, Homo sapiens
gguggaggcugugcucuca

SEQ ID NO: 695499 - RNA, 19 nt, Homo sapiens
gcuauugcauguucaacca

SEQ ID NO: 695500 - RNA, 19 nt, Homo sapiens
gguugcauauguaauaaag

SEQ ID NO: 695501 - RNA, 19 nt, Homo sapiens
agagaacugcgacgauuaa

SEQ ID NO: 695502 - RNA, 19 nt, Homo sapiens
gaugaaucacugcaacuug

SEQ ID NO: 695503 - RNA, 19 nt, Homo sapiens
uaucguagauugggaugug

SEQ ID NO: 695504 - RNA, 19 nt, Homo sapiens
ucacugagaccauccaagu

SEQ ID NO: 695505 - RNA, 19 nt, Homo sapiens
ccaucaaugugccuuggaa

SEQ ID NO: 695506 - RNA, 19 nt, Homo sapiens
cccaagagugcuuauuuaa

SEQ ID NO: 695507 - RNA, 19 nt, Homo sapiens
caagagggagcugauauca

SEQ ID NO: 695508 - RNA, 19 nt, Homo sapiens
gaagaagcucggccaagca

SEQ ID NO: 695509 - RNA, 19 nt, Homo sapiens
cugacuacauugcugcuuu

SEQ ID NO: 695510 - RNA, 19 nt, Homo sapiens
ccaacaccauggaaauucu

SEQ ID NO: 695511 - RNA, 19 nt, Homo sapiens
caacauggaggaggacaau

SEQ ID NO: 695512 - RNA, 19 nt, Homo sapiens
ugacuacauugcugcuuuc

SEQ ID NO: 695513 - RNA, 19 nt, Homo sapiens
gaugcgggaugcugacuac

SEQ ID NO: 695514 - RNA, 19 nt, Homo sapiens
aaggauauaccaucaaugu

SEQ ID NO: 695515 - RNA, 19 nt, Homo sapiens
cugcaucccauccugaaua

SEQ ID NO: 695516 - RNA, 19 nt, Homo sapiens
cuacuguggucguuacauc

SEQ ID NO: 695517 - RNA, 19 nt, Homo sapiens
cggaugaccacacgagaaa

SEQ ID NO: 695518 - RNA, 19 nt, Homo sapiens
aacuuugacuccaucuaua

SEQ ID NO: 695519 - RNA, 19 nt, Homo sapiens
gaagaaaggcaaaaugaag

SEQ ID NO: 695520 - RNA, 19 nt, Homo sapiens
acaccuacgacucaguuua

SEQ ID NO: 695521 - RNA, 19 nt, Homo sapiens
aagagaacugcgacgauua

SEQ ID NO: 695522 - RNA, 19 nt, Homo sapiens
cagaauacggucccucuuc

SEQ ID NO: 695523 - RNA, 19 nt, Homo sapiens
cagauacuggcgcagcuua

SEQ ID NO: 695524 - RNA, 19 nt, Homo sapiens
gcaggguucgcccagcuaa

SEQ ID NO: 695525 - RNA, 19 nt, Homo sapiens
ucacagccuagaauauauu

SEQ ID NO: 695526 - RNA, 19 nt, Homo sapiens
uggcaggcauggcaagguu

SEQ ID NO: 695527 - RNA, 19 nt, Homo sapiens
ccacuacuccagcccagaa

SEQ ID NO: 695528 - RNA, 19 nt, Homo sapiens
gacgauuaauuguggaucu

SEQ ID NO: 695529 - RNA, 19 nt, Homo sapiens
ggucuacuguggucguuac

SEQ ID NO: 695530 - RNA, 19 nt, Homo sapiens
gaacuacaccccagauauc

SEQ ID NO: 695531 - RNA, 19 nt, Homo sapiens
gagcugcaccgugagaguu

SEQ ID NO: 695532 - RNA, 19 nt, Homo sapiens
ccuagaauauauugaucug

SEQ ID NO: 695533 - RNA, 19 nt, Homo sapiens
ccccaagagugcuuauuua

SEQ ID NO: 695534 - RNA, 19 nt, Homo sapiens
gaagagagcuguugagauc

SEQ ID NO: 695535 - RNA, 19 nt, Homo sapiens
caggagagcucaagaaugg

SEQ ID NO: 695536 - RNA, 19 nt, Homo sapiens
gcaaagccacgcuagauga

SEQ ID NO: 695537 - RNA, 19 nt, Homo sapiens
ggacuucucugcacagcau

SEQ ID NO: 695538 - RNA, 19 nt, Homo sapiens
ggagggaggccaugacuug

SEQ ID NO: 695539 - RNA, 19 nt, Homo sapiens
guuauuagcaccuuuaaga

SEQ ID NO: 695540 - RNA, 19 nt, Homo sapiens
ccucugggcuucaccauug

SEQ ID NO: 695541 - RNA, 19 nt, Homo sapiens
caagagccaugcccaguuc

SEQ ID NO: 695542 - RNA, 19 nt, Homo sapiens
cagcagagcacccucauug

SEQ ID NO: 695543 - RNA, 19 nt, Homo sapiens
ggagcugugugcagaaguu

SEQ ID NO: 695544 - RNA, 19 nt, Homo sapiens
gaauuccucuugucgaagu

SEQ ID NO: 695545 - RNA, 19 nt, Homo sapiens
ggcagaagcuagacagcaa

SEQ ID NO: 695546 - RNA, 19 nt, Homo sapiens
aaagugcguucaaggcuaa

SEQ ID NO: 695547 - RNA, 19 nt, Homo sapiens
aggaagagcuggagaagca

SEQ ID NO: 695548 - RNA, 19 nt, Homo sapiens
agacagugcacucugaaua

SEQ ID NO: 695549 - RNA, 19 nt, Homo sapiens
uagaugagauccagacagu

SEQ ID NO: 695550 - RNA, 19 nt, Homo sapiens
ggcaagauccucaccaaga

SEQ ID NO: 695551 - RNA, 19 nt, Homo sapiens
gagcaaagagagugccauu

SEQ ID NO: 695552 - RNA, 19 nt, Homo sapiens
gcaagauccucaccaagac

SEQ ID NO: 695553 - RNA, 19 nt, Homo sapiens
gcaaggaugggacuguuau

SEQ ID NO: 695554 - RNA, 19 nt, Homo sapiens
gaacaaggagaagagcaaa

SEQ ID NO: 695555 - RNA, 19 nt, Homo sapiens
gcacccagcaggcguucua

SEQ ID NO: 695556 - RNA, 19 nt, Homo sapiens
ggaacaaggagaagagcaa

SEQ ID NO: 695557 - RNA, 19 nt, Homo sapiens
uagagaaagucaucgagau

SEQ ID NO: 695558 - RNA, 19 nt, Homo sapiens
ugacaacgggaacuucuuu

SEQ ID NO: 695559 - RNA, 19 nt, Homo sapiens
ggacgccucccuccuacaa

SEQ ID NO: 695560 - RNA, 19 nt, Homo sapiens
gagcccaccaugcuucuuu

SEQ ID NO: 695561 - RNA, 19 nt, Homo sapiens
uaucgucugucucucuuga

SEQ ID NO: 695562 - RNA, 19 nt, Homo sapiens
gggaggaggaggaggauug

SEQ ID NO: 695563 - RNA, 19 nt, Homo sapiens
gcaggagagcucaagaaug

SEQ ID NO: 695564 - RNA, 19 nt, Homo sapiens
gaagcuagacagcaagaag

SEQ ID NO: 695565 - RNA, 19 nt, Homo sapiens
ggacuguuauuagcaccuu

SEQ ID NO: 695566 - RNA, 19 nt, Homo sapiens
uacgacacguucaugcuaa

SEQ ID NO: 695567 - RNA, 19 nt, Homo sapiens
ggaugggacuguuauuagc

SEQ ID NO: 695568 - RNA, 19 nt, Homo sapiens
ccucugaacccaacuugaa

SEQ ID NO: 695569 - RNA, 19 nt, Homo sapiens
ggagacguggaguaccuua

SEQ ID NO: 695570 - RNA, 19 nt, Homo sapiens
gggcgucguccguguguaa

SEQ ID NO: 695571 - RNA, 19 nt, Homo sapiens
ucgcugaguuccagaaaca

SEQ ID NO: 695572 - RNA, 19 nt, Homo sapiens
gcaguggccacgcuagaga

SEQ ID NO: 695573 - RNA, 19 nt, Homo sapiens
ggacauucaccauggcaau

SEQ ID NO: 695574 - RNA, 19 nt, Homo sapiens
gcaaguucaugagcacauc

SEQ ID NO: 695575 - RNA, 19 nt, Homo sapiens
ggaaccauccuuggaaauc

SEQ ID NO: 695576 - RNA, 19 nt, Homo sapiens
gcagaagcagcuccuguuc

SEQ ID NO: 695577 - RNA, 19 nt, Homo sapiens
gccuggugcuggauacaaa

SEQ ID NO: 695578 - RNA, 19 nt, Homo sapiens
ggaggaggaggacgaggaa

SEQ ID NO: 695579 - RNA, 19 nt, Homo sapiens
guucaaggcuaaaacagaa

SEQ ID NO: 695580 - RNA, 19 nt, Homo sapiens
guuugaugcuguugaagga

SEQ ID NO: 695581 - RNA, 19 nt, Homo sapiens
cgggaaccauccuuggaaa

SEQ ID NO: 695582 - RNA, 19 nt, Homo sapiens
aaggaugggacuguuauua

SEQ ID NO: 695583 - RNA, 19 nt, Homo sapiens
gaaccauccuuggaaaucc

SEQ ID NO: 695584 - RNA, 19 nt, Homo sapiens
ugacuugaccgccaucugu

SEQ ID NO: 695585 - RNA, 19 nt, Homo sapiens
ggauucugcuucuucaacu

SEQ ID NO: 695586 - RNA, 19 nt, Homo sapiens
auuagcaccuuuaagaaga

SEQ ID NO: 695587 - RNA, 19 nt, Homo sapiens
gaggaggccgagacuguga

SEQ ID NO: 695588 - RNA, 19 nt, Homo sapiens
ucaucgagauccagagcaa

SEQ ID NO: 695589 - RNA, 19 nt, Homo sapiens
ggagagcucaagaauggau

SEQ ID NO: 695590 - RNA, 19 nt, Homo sapiens
ucucggcucugcucagugu

SEQ ID NO: 695591 - RNA, 19 nt, Homo sapiens
cuacgacacguucaugcua

SEQ ID NO: 695592 - RNA, 19 nt, Homo sapiens
ccaagagccaugcccaguu

SEQ ID NO: 695593 - RNA, 19 nt, Homo sapiens
cacgaguucucaccugaug

SEQ ID NO: 695594 - RNA, 19 nt, Homo sapiens
guuaucgucugucucucuu

SEQ ID NO: 695595 - RNA, 19 nt, Homo sapiens
ggagaagagcaaagagagu

SEQ ID NO: 695596 - RNA, 19 nt, Homo sapiens
ccaagcagcagcaggagau

SEQ ID NO: 695597 - RNA, 19 nt, Homo sapiens
gcccauugcccacgaguuc

SEQ ID NO: 695598 - RNA, 19 nt, Homo sapiens
ggacugggacauucaccau

SEQ ID NO: 695599 - RNA, 19 nt, Homo sapiens
caugagcacauccucuauu

SEQ ID NO: 695600 - RNA, 19 nt, Homo sapiens
gccaugggauucugcuucu

SEQ ID NO: 695601 - RNA, 19 nt, Homo sapiens
ccacagccaugggauucug

SEQ ID NO: 695602 - RNA, 19 nt, Homo sapiens
acaaggagaagagcaaaga

SEQ ID NO: 695603 - RNA, 19 nt, Homo sapiens
ggaggacgaggaagaggau

SEQ ID NO: 695604 - RNA, 19 nt, Homo sapiens
gacagugcacucugaauac

SEQ ID NO: 695605 - RNA, 19 nt, Homo sapiens
gcagaagcagcagcagcua

SEQ ID NO: 695606 - RNA, 19 nt, Homo sapiens
gagcacauccucuauuccu

SEQ ID NO: 695607 - RNA, 19 nt, Homo sapiens
ucaagcagcagcaggagau

SEQ ID NO: 695608 - RNA, 19 nt, Homo sapiens
cggguuugaugcuguugaa

SEQ ID NO: 695609 - RNA, 19 nt, Homo sapiens
cagcaugaccaccugacaa

SEQ ID NO: 695610 - RNA, 19 nt, Homo sapiens
gaugucaggucgggaacca

SEQ ID NO: 695611 - RNA, 19 nt, Homo sapiens
uuaagaagagagcuguuga

SEQ ID NO: 695612 - RNA, 19 nt, Homo sapiens
caccugaugugguccuagu

SEQ ID NO: 695613 - RNA, 19 nt, Homo sapiens
cgagucggaugggauguca

SEQ ID NO: 695614 - RNA, 19 nt, Homo sapiens
ccaaccaguucagccucua

SEQ ID NO: 695615 - RNA, 19 nt, Homo sapiens
gcaugaacucucccaacga

SEQ ID NO: 695616 - RNA, 19 nt, Homo sapiens
gagggaggccaugacuuga

SEQ ID NO: 695617 - RNA, 19 nt, Homo sapiens
caucguggacugggacauu

SEQ ID NO: 695618 - RNA, 19 nt, Homo sapiens
caaaacuccuacagcagaa

SEQ ID NO: 695619 - RNA, 19 nt, Homo sapiens
gcaggaagagcuggagaag

SEQ ID NO: 695620 - RNA, 19 nt, Homo sapiens
uggccacgcuagagaaagu

SEQ ID NO: 695621 - RNA, 19 nt, Homo sapiens
gcagcagagcacccucauu

SEQ ID NO: 695622 - RNA, 19 nt, Homo sapiens
caaggaugggacuguuauu

SEQ ID NO: 695623 - RNA, 19 nt, Homo sapiens
ucgcaaggaugggacuguu

SEQ ID NO: 695624 - RNA, 19 nt, Homo sapiens
aagccacgcuagaugagau

SEQ ID NO: 695625 - RNA, 19 nt, Homo sapiens
ugggcaagauccucaccaa

SEQ ID NO: 695626 - RNA, 19 nt, Homo sapiens
aacaacagcaccagcaguu

SEQ ID NO: 695627 - RNA, 19 nt, Homo sapiens
augagcacauccucuauuc

SEQ ID NO: 695628 - RNA, 19 nt, Homo sapiens
aagaagagagcuguugaga

SEQ ID NO: 695629 - RNA, 19 nt, Homo sapiens
cuggguggcuacucuguca

SEQ ID NO: 695630 - RNA, 19 nt, Homo sapiens
ccucugugcucuacaucuc

SEQ ID NO: 695631 - RNA, 19 nt, Homo sapiens
gcacgcugaccggcaaguu

SEQ ID NO: 695632 - RNA, 19 nt, Homo sapiens
gaugggacuguuauuagca

SEQ ID NO: 695633 - RNA, 19 nt, Homo sapiens
cgaguucucaccugaugug

SEQ ID NO: 695634 - RNA, 19 nt, Homo sapiens
gaagagagcuguugagauc

SEQ ID NO: 695635 - RNA, 19 nt, Homo sapiens
ccaccaaucuguuuacaua

SEQ ID NO: 695636 - RNA, 19 nt, Homo sapiens
ggauauggauuucaguuaa

SEQ ID NO: 695637 - RNA, 19 nt, Homo sapiens
ggaagucggugccuugguu

SEQ ID NO: 695638 - RNA, 19 nt, Homo sapiens
caggagagcucaagaaugg

SEQ ID NO: 695639 - RNA, 19 nt, Homo sapiens
ggaaggagaggacugguuu

SEQ ID NO: 695640 - RNA, 19 nt, Homo sapiens
ggacuucucugcacagcau

SEQ ID NO: 695641 - RNA, 19 nt, Homo sapiens
ggagggaggccaugacuug

SEQ ID NO: 695642 - RNA, 19 nt, Homo sapiens
guuauuagcaccuuuaaga

SEQ ID NO: 695643 - RNA, 19 nt, Homo sapiens
ccucugggcuucaccauug

SEQ ID NO: 695644 - RNA, 19 nt, Homo sapiens
uaaacccacuccuugcuuu

SEQ ID NO: 695645 - RNA, 19 nt, Homo sapiens
caagagccaugcccaguuc

SEQ ID NO: 695646 - RNA, 19 nt, Homo sapiens
cagcagagcacccucauug

SEQ ID NO: 695647 - RNA, 19 nt, Homo sapiens
ggagcugugugcagaaguu

SEQ ID NO: 695648 - RNA, 19 nt, Homo sapiens
gaauuccucuugucgaagu

SEQ ID NO: 695649 - RNA, 19 nt, Homo sapiens
aaagugcguucaaggcuaa

SEQ ID NO: 695650 - RNA, 19 nt, Homo sapiens
aggaagagcuggagaagca

SEQ ID NO: 695651 - RNA, 19 nt, Homo sapiens
auagugugcuuguguguuu

SEQ ID NO: 695652 - RNA, 19 nt, Homo sapiens
gauccacuacugucuuuaa

SEQ ID NO: 695653 - RNA, 19 nt, Homo sapiens
ggcaagauccucaccaaga

SEQ ID NO: 695654 - RNA, 19 nt, Homo sapiens
gagcaaagagagugccauu

SEQ ID NO: 695655 - RNA, 19 nt, Homo sapiens
gauauggauuucaguuaag

SEQ ID NO: 695656 - RNA, 19 nt, Homo sapiens
caccaucgguucauagugu

SEQ ID NO: 695657 - RNA, 19 nt, Homo sapiens
agacaguacucuccaguuc

SEQ ID NO: 695658 - RNA, 19 nt, Homo sapiens
gcaagauccucaccaagac

SEQ ID NO: 695659 - RNA, 19 nt, Homo sapiens
gcaaggaugggacuguuau

SEQ ID NO: 695660 - RNA, 19 nt, Homo sapiens
gaacaaggagaagagcaaa

SEQ ID NO: 695661 - RNA, 19 nt, Homo sapiens
gcacccagcaggcguucua

SEQ ID NO: 695662 - RNA, 19 nt, Homo sapiens
ggaacaaggagaagagcaa

SEQ ID NO: 695663 - RNA, 19 nt, Homo sapiens
uagagaaagucaucgagau

SEQ ID NO: 695664 - RNA, 19 nt, Homo sapiens
ugacaacgggaacuucuuu

SEQ ID NO: 695665 - RNA, 19 nt, Homo sapiens
gcuguggccugcagucugu

SEQ ID NO: 695666 - RNA, 19 nt, Homo sapiens
ggacgccucccuccuacaa

SEQ ID NO: 695667 - RNA, 19 nt, Homo sapiens
gagcccaccaugcuucuuu

SEQ ID NO: 695668 - RNA, 19 nt, Homo sapiens
uaucgucugucucucuuga

SEQ ID NO: 695669 - RNA, 19 nt, Homo sapiens
gggaggaggaggaggauug

SEQ ID NO: 695670 - RNA, 19 nt, Homo sapiens
gcaggagagcucaagaaug

SEQ ID NO: 695671 - RNA, 19 nt, Homo sapiens
ggacuguuauuagcaccuu

SEQ ID NO: 695672 - RNA, 19 nt, Homo sapiens
uauacuuucucuccuucua

SEQ ID NO: 695673 - RNA, 19 nt, Homo sapiens
ggaugggacuguuauuagc

SEQ ID NO: 695674 - RNA, 19 nt, Homo sapiens
ccucugaacccaacuugaa

SEQ ID NO: 695675 - RNA, 19 nt, Homo sapiens
gcugagagggugaaagugu

SEQ ID NO: 695676 - RNA, 19 nt, Homo sapiens
ggagacguggaguaccuua

SEQ ID NO: 695677 - RNA, 19 nt, Homo sapiens
gggcgucguccguguguaa

SEQ ID NO: 695678 - RNA, 19 nt, Homo sapiens
ucgcugaguuccagaaaca

SEQ ID NO: 695679 - RNA, 19 nt, Homo sapiens
ccagcaccaucgguucaua

SEQ ID NO: 695680 - RNA, 19 nt, Homo sapiens
gaagucggugccuugguuu

SEQ ID NO: 695681 - RNA, 19 nt, Homo sapiens
gcaguggccacgcuagaga

SEQ ID NO: 695682 - RNA, 19 nt, Homo sapiens
ggacauucaccauggcaau

SEQ ID NO: 695683 - RNA, 19 nt, Homo sapiens
gcaaguucaugagcacauc

SEQ ID NO: 695684 - RNA, 19 nt, Homo sapiens
ggaaccauccuuggaaauc

SEQ ID NO: 695685 - RNA, 19 nt, Homo sapiens
gcagaagcagcuccuguuc

SEQ ID NO: 695686 - RNA, 19 nt, Homo sapiens
gccuggugcuggauacaaa

SEQ ID NO: 695687 - RNA, 19 nt, Homo sapiens
ggaggaggaggacgaggaa

SEQ ID NO: 695688 - RNA, 19 nt, Homo sapiens
guucaaggcuaaaacagaa

SEQ ID NO: 695689 - RNA, 19 nt, Homo sapiens
acauauacuuucucuccuu

SEQ ID NO: 695690 - RNA, 19 nt, Homo sapiens
guuugaugcuguugaagga

SEQ ID NO: 695691 - RNA, 19 nt, Homo sapiens
cgggaaccauccuuggaaa

SEQ ID NO: 695692 - RNA, 19 nt, Homo sapiens
aaggaugggacuguuauua

SEQ ID NO: 695693 - RNA, 19 nt, Homo sapiens
gaaccauccuuggaaaucc

SEQ ID NO: 695694 - RNA, 19 nt, Homo sapiens
gggcugagagggugaaagu

SEQ ID NO: 695695 - RNA, 19 nt, Homo sapiens
ugacuugaccgccaucugu

SEQ ID NO: 695696 - RNA, 19 nt, Homo sapiens
ggauucugcuucuucaacu

SEQ ID NO: 695697 - RNA, 19 nt, Homo sapiens
auuagcaccuuuaagaaga

SEQ ID NO: 695698 - RNA, 19 nt, Homo sapiens
gaggaggccgagacuguga

SEQ ID NO: 695699 - RNA, 19 nt, Homo sapiens
ucaucgagauccagagcaa

SEQ ID NO: 695700 - RNA, 19 nt, Homo sapiens
ggagagcucaagaauggau

SEQ ID NO: 695701 - RNA, 19 nt, Homo sapiens
uggauauggauuucaguua

SEQ ID NO: 695702 - RNA, 19 nt, Homo sapiens
guucauagugugcuugugu

SEQ ID NO: 695703 - RNA, 19 nt, Homo sapiens
gaaaguguguggggaagga

SEQ ID NO: 695704 - RNA, 19 nt, Homo sapiens
ucucggcucugcucagugu

SEQ ID NO: 695705 - RNA, 19 nt, Homo sapiens
ccaagagccaugcccaguu

SEQ ID NO: 695706 - RNA, 19 nt, Homo sapiens
guaaacccacuccuugcuu

SEQ ID NO: 695707 - RNA, 19 nt, Homo sapiens
gccaggaggaguaacagaa

SEQ ID NO: 695708 - RNA, 19 nt, Homo sapiens
aggauccacuacugucuuu

SEQ ID NO: 695709 - RNA, 19 nt, Homo sapiens
acaguacucuccaguucug

SEQ ID NO: 695710 - RNA, 19 nt, Homo sapiens
cacgaguucucaccugaug

SEQ ID NO: 695711 - RNA, 19 nt, Homo sapiens
ccaagcagcagcaggagau

SEQ ID NO: 695712 - RNA, 19 nt, Homo sapiens
guuaucgucugucucucuu

SEQ ID NO: 695713 - RNA, 19 nt, Homo sapiens
ggagaagagcaaagagagu

SEQ ID NO: 695714 - RNA, 19 nt, Homo sapiens
gcacccacccugcgauucu

SEQ ID NO: 695715 - RNA, 19 nt, Homo sapiens
gcccauugcccacgaguuc

SEQ ID NO: 695716 - RNA, 19 nt, Homo sapiens
ggacugggacauucaccau

SEQ ID NO: 695717 - RNA, 19 nt, Homo sapiens
caugagcacauccucuauu

SEQ ID NO: 695718 - RNA, 19 nt, Homo sapiens
guguguccuuguguaaaua

SEQ ID NO: 695719 - RNA, 19 nt, Homo sapiens
uguguguccuuguguaaau

SEQ ID NO: 695720 - RNA, 19 nt, Homo sapiens
cugcgauucuccacccuuu

SEQ ID NO: 695721 - RNA, 19 nt, Homo sapiens
gccaugggauucugcuucu

SEQ ID NO: 695722 - RNA, 19 nt, Homo sapiens
ccacagccaugggauucug

SEQ ID NO: 695723 - RNA, 19 nt, Homo sapiens
acaaggagaagagcaaaga

SEQ ID NO: 695724 - RNA, 19 nt, Homo sapiens
ggaggacgaggaagacgau

SEQ ID NO: 695725 - RNA, 19 nt, Homo sapiens
ggucugguucucauguaaa

SEQ ID NO: 695726 - RNA, 19 nt, Homo sapiens
ucaagcagcagcaggagau

SEQ ID NO: 695727 - RNA, 19 nt, Homo sapiens
gaggauccacuacugucuu

SEQ ID NO: 695728 - RNA, 19 nt, Homo sapiens
ucccagcccugucccaugu

SEQ ID NO: 695729 - RNA, 19 nt, Homo sapiens
gcagaagcagcagcagcua

SEQ ID NO: 695730 - RNA, 19 nt, Homo sapiens
gagcacauccucuauuccu

SEQ ID NO: 695731 - RNA, 19 nt, Homo sapiens
cauccagccuguaggaaac

SEQ ID NO: 695732 - RNA, 19 nt, Homo sapiens
ccauccagccuguaggaaa

SEQ ID NO: 695733 - RNA, 19 nt, Homo sapiens
gggaaggagaggacugguu

SEQ ID NO: 695734 - RNA, 19 nt, Homo sapiens
gaagaaauuuggagaagaa

SEQ ID NO: 695735 - RNA, 19 nt, Homo sapiens
gaacaaaugcagugauaua

SEQ ID NO: 695736 - RNA, 19 nt, Homo sapiens
gaauuuagcuacugcauau

SEQ ID NO: 695737 - RNA, 19 nt, Homo sapiens
ccaagaaucucuaaagaaa

SEQ ID NO: 695738 - RNA, 19 nt, Homo sapiens
gaucagauuuguucuauug

SEQ ID NO: 695739 - RNA, 19 nt, Homo sapiens
gaaggaugcuuucgauaaa

SEQ ID NO: 695740 - RNA, 19 nt, Homo sapiens
gagaugaacucuuaaagga

SEQ ID NO: 695741 - RNA, 19 nt, Homo sapiens
gcagugagguuguaaaugu

SEQ ID NO: 695742 - RNA, 19 nt, Homo sapiens
gagaagaaauugcaagguu

SEQ ID NO: 695743 - RNA, 19 nt, Homo sapiens
gaacagaaccuggauaaug

SEQ ID NO: 695744 - RNA, 19 nt, Homo sapiens
gagagggucuggagaauga

SEQ ID NO: 695745 - RNA, 19 nt, Homo sapiens
gaaagaauguuaccagucu

SEQ ID NO: 695746 - RNA, 19 nt, Homo sapiens
gcacaaaguuuuacaauga

SEQ ID NO: 695747 - RNA, 19 nt, Homo sapiens
uuaaagaacugccugaauu

SEQ ID NO: 695748 - RNA, 19 nt, Homo sapiens
gaaauugcauuacaguuca

SEQ ID NO: 695749 - RNA, 19 nt, Homo sapiens
gaucagagggaaagaaaua

SEQ ID NO: 695750 - RNA, 19 nt, Homo sapiens
caaaugcagugauauaguu

SEQ ID NO: 695751 - RNA, 19 nt, Homo sapiens
ggaaggaugcuuucgauaa

SEQ ID NO: 695752 - RNA, 19 nt, Homo sapiens
gaagcuaacuuaagagaag

SEQ ID NO: 695753 - RNA, 19 nt, Homo sapiens
cagaacaaaugcagugaua

SEQ ID NO: 695754 - RNA, 19 nt, Homo sapiens
gaaggaaggcacaaaguuu

SEQ ID NO: 695755 - RNA, 19 nt, Homo sapiens
gaagaugguucccguguca

SEQ ID NO: 695756 - RNA, 19 nt, Homo sapiens
gaaccuggauaaugaugaa

SEQ ID NO: 695757 - RNA, 19 nt, Homo sapiens
uuaaaggacuugcaacaaa

SEQ ID NO: 695758 - RNA, 19 nt, Homo sapiens
caacuaaaguccaagaauc

SEQ ID NO: 695759 - RNA, 19 nt, Homo sapiens
cagaucugcuugacauuua

SEQ ID NO: 695760 - RNA, 19 nt, Homo sapiens
gagaaugacuugaaaucug

SEQ ID NO: 695761 - RNA, 19 nt, Homo sapiens
gaaaaucgcugcuaaacau

SEQ ID NO: 695762 - RNA, 19 nt, Homo sapiens
agaagaaauugcaagguua

SEQ ID NO: 695763 - RNA, 19 nt, Homo sapiens
ggauaaugaugaaggauug

SEQ ID NO: 695764 - RNA, 19 nt, Homo sapiens
uaaagaacugccugaauua

SEQ ID NO: 695765 - RNA, 19 nt, Homo sapiens
caaacagugucaauacaaa

SEQ ID NO: 695766 - RNA, 19 nt, Homo sapiens
gaaccaugccgccuacuaa

SEQ ID NO: 695767 - RNA, 19 nt, Homo sapiens
uuacugaucuguuugagaa

SEQ ID NO: 695768 - RNA, 19 nt, Homo sapiens
gaacuuguagcuaauuuga

SEQ ID NO: 695769 - RNA, 19 nt, Homo sapiens
ggcacaggcucaagaagua

SEQ ID NO: 695770 - RNA, 19 nt, Homo sapiens
gacaucagauacuuacaaa

SEQ ID NO: 695771 - RNA, 19 nt, Homo sapiens
ccaagccgcuggugaaguu

SEQ ID NO: 695772 - RNA, 19 nt, Homo sapiens
gcaggcagauggacaagug

SEQ ID NO: 695773 - RNA, 19 nt, Homo sapiens
gaagaagaagcaaccgaua

SEQ ID NO: 695774 - RNA, 19 nt, Homo sapiens
gcaacgaaauagagaaauc

SEQ ID NO: 695775 - RNA, 19 nt, Homo sapiens
gaaaagagcuguguguugu

SEQ ID NO: 695776 - RNA, 19 nt, Homo sapiens
ucgagacgcuccugagaua

SEQ ID NO: 695777 - RNA, 19 nt, Homo sapiens
gagaagaaguuuugaagaa

SEQ ID NO: 695778 - RNA, 19 nt, Homo sapiens
gggaagagcaggcccagua

SEQ ID NO: 695779 - RNA, 19 nt, Homo sapiens
cagcaaagaaggauaauga

SEQ ID NO: 695780 - RNA, 19 nt, Homo sapiens
gaauuacugcaacgaaaua

SEQ ID NO: 695781 - RNA, 19 nt, Homo sapiens
aacagaaccuggauaauga

SEQ ID NO: 695782 - RNA, 19 nt, Homo sapiens
caaagaugguuuaaguaug

SEQ ID NO: 695783 - RNA, 19 nt, Homo sapiens
guaccucagucuauauuga

SEQ ID NO: 695784 - RNA, 19 nt, Homo sapiens
gaaauuaaaccugcaagug

SEQ ID NO: 695785 - RNA, 19 nt, Homo sapiens
caucagauacuuacaaaga

SEQ ID NO: 695786 - RNA, 19 nt, Homo sapiens
ggucucacaucaggaauuu

SEQ ID NO: 695787 - RNA, 19 nt, Homo sapiens
gcguauggccaguauaaua

SEQ ID NO: 695788 - RNA, 19 nt, Homo sapiens
ggugcuagcuucccuuaau

SEQ ID NO: 695789 - RNA, 19 nt, Homo sapiens
gcaagugaaacauuugaaa

SEQ ID NO: 695790 - RNA, 19 nt, Homo sapiens
gauuacacaugugagauuu

SEQ ID NO: 695791 - RNA, 19 nt, Homo sapiens
aaacaggagggacuucuua

SEQ ID NO: 695792 - RNA, 19 nt, Homo sapiens
auagagaaauccuagauga

SEQ ID NO: 695793 - RNA, 19 nt, Homo sapiens
gagagaagccaccacuuug

SEQ ID NO: 695794 - RNA, 19 nt, Homo sapiens
guucaauugugcagccuua

SEQ ID NO: 695795 - RNA, 19 nt, Homo sapiens
acaaugaguugacugaaau

SEQ ID NO: 695796 - RNA, 19 nt, Homo sapiens
aaagaugguuuaaguaugg

SEQ ID NO: 695797 - RNA, 19 nt, Homo sapiens
ggacaucagauacuuacaa

SEQ ID NO: 695798 - RNA, 19 nt, Homo sapiens
gaagcaaccgauaaugauu

SEQ ID NO: 695799 - RNA, 19 nt, Homo sapiens
caaagaaggauaaugacuu

SEQ ID NO: 695800 - RNA, 19 nt, Homo sapiens
guugggacccucagucuua

SEQ ID NO: 695801 - RNA, 19 nt, Homo sapiens
gaagacagaaagagaugaa

SEQ ID NO: 695802 - RNA, 19 nt, Homo sapiens
aagauggugugauaaauga

SEQ ID NO: 695803 - RNA, 19 nt, Homo sapiens
guuguuggaugaagaagaa

SEQ ID NO: 695804 - RNA, 19 nt, Homo sapiens
ggaaccaacuucagaacag

SEQ ID NO: 695805 - RNA, 19 nt, Homo sapiens
caaaggacaccauccaaug

SEQ ID NO: 695806 - RNA, 19 nt, Homo sapiens
caaaacagcagaagaaauu

SEQ ID NO: 695807 - RNA, 19 nt, Homo sapiens
gagauuugcugcuguugca

SEQ ID NO: 695808 - RNA, 19 nt, Homo sapiens
uaaaggacuugcaacaaag

SEQ ID NO: 695809 - RNA, 19 nt, Homo sapiens
cagcagcaauugaagaugu

SEQ ID NO: 695810 - RNA, 19 nt, Homo sapiens
uacaaugaguugacugaaa

SEQ ID NO: 695811 - RNA, 19 nt, Homo sapiens
guccaagaaucucuaaaga

SEQ ID NO: 695812 - RNA, 19 nt, Homo sapiens
gcagggcagugagguugua

SEQ ID NO: 695813 - RNA, 19 nt, Homo sapiens
ugagagaagccaccacuuu

SEQ ID NO: 695814 - RNA, 19 nt, Homo sapiens
aaauuaaaccugcaaguga

SEQ ID NO: 695815 - RNA, 19 nt, Homo sapiens
gcaaaggacaccauccaau

SEQ ID NO: 695816 - RNA, 19 nt, Homo sapiens
cagaacagaaccuggauaa

SEQ ID NO: 695817 - RNA, 19 nt, Homo sapiens
aaucagaucugcuugacau

SEQ ID NO: 695818 - RNA, 19 nt, Homo sapiens
ggcucaagauggugugaua

SEQ ID NO: 695819 - RNA, 19 nt, Homo sapiens
gacaagugaaagaauguua

SEQ ID NO: 695820 - RNA, 19 nt, Homo sapiens
agacgcuccugagauauua

SEQ ID NO: 695821 - RNA, 19 nt, Homo sapiens
ccagaucugugauugaaca

SEQ ID NO: 695822 - RNA, 19 nt, Homo sapiens
gcaugcagcagaacugauu

SEQ ID NO: 695823 - RNA, 19 nt, Homo sapiens
gcaauaaguguacuaaacu

SEQ ID NO: 695824 - RNA, 19 nt, Homo sapiens
ccacagcagucuuacuauc

SEQ ID NO: 695825 - RNA, 19 nt, Homo sapiens
agaaugacuugaaaucugu

SEQ ID NO: 695826 - RNA, 19 nt, Homo sapiens
cauuaagguuguuggauga

SEQ ID NO: 695827 - RNA, 19 nt, Homo sapiens
gcagaagaaauuuggagaa

SEQ ID NO: 695828 - RNA, 19 nt, Homo sapiens
agccuuagcuagccaaauu

SEQ ID NO: 695829 - RNA, 19 nt, Homo sapiens
ucagauacuuacaaagaug

SEQ ID NO: 695830 - RNA, 19 nt, Homo sapiens
ccaguuccacauuugauua

SEQ ID NO: 695831 - RNA, 19 nt, Homo sapiens
caagauggugugauaaaug

SEQ ID NO: 695832 - RNA, 19 nt, Homo sapiens
ugacaugacaagcaaguuu

SEQ ID NO: 695833 - RNA, 19 nt, Homo sapiens
gaaccaacuucagaacagu

SEQ ID NO: 695834 - RNA, 19 nt, Homo sapiens
ggacccagcuguacauaug

SEQ ID NO: 695835 - RNA, 19 nt, Homo sapiens
gcaguuagaugcuguucuu

SEQ ID NO: 695836 - RNA, 19 nt, Homo sapiens
gcacguggacucccuuuaa

SEQ ID NO: 695837 - RNA, 19 nt, Homo sapiens
agacaggaguggagugaua

SEQ ID NO: 695838 - RNA, 19 nt, Homo sapiens
guacauauguggauaagcu

SEQ ID NO: 695839 - RNA, 19 nt, Homo sapiens
uggauaagcugauuaaugg

SEQ ID NO: 695840 - RNA, 19 nt, Homo sapiens
ggaguggagugauaucaga

SEQ ID NO: 695841 - RNA, 19 nt, Homo sapiens
cugcagagguugacggaua

SEQ ID NO: 695842 - RNA, 19 nt, Homo sapiens
ggucuucaguaucguauga

SEQ ID NO: 695843 - RNA, 19 nt, Homo sapiens
ggauucaggugucguacga

SEQ ID NO: 695844 - RNA, 19 nt, Homo sapiens
uagaugcuguucuuccuuu

SEQ ID NO: 695845 - RNA, 19 nt, Homo sapiens
ggaaagagccaaaauguca

SEQ ID NO: 695846 - RNA, 19 nt, Homo sapiens
gauaagcugauuaaugguu

SEQ ID NO: 695847 - RNA, 19 nt, Homo sapiens
uaacauggaacuuacacaa

SEQ ID NO: 695848 - RNA, 19 nt, Homo sapiens
ucacggguguguggaagua

SEQ ID NO: 695849 - RNA, 19 nt, Homo sapiens
gccaugagguaaauguaau

SEQ ID NO: 695850 - RNA, 19 nt, Homo sapiens
caacauggaaagagccaaa

SEQ ID NO: 695851 - RNA, 19 nt, Homo sapiens
gaucaggacggcuggauuc

SEQ ID NO: 695852 - RNA, 19 nt, Homo sapiens
uaugugacguaagcaauaa

SEQ ID NO: 695853 - RNA, 19 nt, Homo sapiens
gagguugacggauauauuc

SEQ ID NO: 695854 - RNA, 19 nt, Homo sapiens
cauccucauucgaaaguuu

SEQ ID NO: 695855 - RNA, 19 nt, Homo sapiens
guggauaagcugauuaaug

SEQ ID NO: 695856 - RNA, 19 nt, Homo sapiens
ggacaacuccgggaugauc

SEQ ID NO: 695857 - RNA, 19 nt, Homo sapiens
gagcagcacaacauggaaa

SEQ ID NO: 695858 - RNA, 19 nt, Homo sapiens
gaauaugugacguaagcaa

SEQ ID NO: 695859 - RNA, 19 nt, Homo sapiens
gugaagagcagcacaacau

SEQ ID NO: 695860 - RNA, 19 nt, Homo sapiens
acggauauauucagacguu

SEQ ID NO: 695861 - RNA, 19 nt, Homo sapiens
guugacggauauauucaga

SEQ ID NO: 695862 - RNA, 19 nt, Homo sapiens
acuccgggaugaucgauaa

SEQ ID NO: 695863 - RNA, 19 nt, Homo sapiens
guagcuguaucguucuaau

SEQ ID NO: 695864 - RNA, 19 nt, Homo sapiens
uccagagggucgauaaaga

SEQ ID NO: 695865 - RNA, 19 nt, Homo sapiens
ucgaucauauccauguuug

SEQ ID NO: 695866 - RNA, 19 nt, Homo sapiens
gcaucguccugcagagguu

SEQ ID NO: 695867 - RNA, 19 nt, Homo sapiens
ucaggucgaucauauccau

SEQ ID NO: 695868 - RNA, 19 nt, Homo sapiens
uggaauaugugacguaagc

SEQ ID NO: 695869 - RNA, 19 nt, Homo sapiens
gagccaaaaugucacaguu

SEQ ID NO: 695870 - RNA, 19 nt, Homo sapiens
cacguggacucccuuuaau

SEQ ID NO: 695871 - RNA, 19 nt, Homo sapiens
gauaucagacaccgagcuu

SEQ ID NO: 695872 - RNA, 19 nt, Homo sapiens
ccgggaugaucgauaagaa

SEQ ID NO: 695873 - RNA, 19 nt, Homo sapiens
cgggacaacuccgggauga

SEQ ID NO: 695874 - RNA, 19 nt, Homo sapiens
uuuggugacugucucauug

SEQ ID NO: 695875 - RNA, 19 nt, Homo sapiens
ggucgaucauauccauguu

SEQ ID NO: 695876 - RNA, 19 nt, Homo sapiens
acauggaacuuacacaaaa

SEQ ID NO: 695877 - RNA, 19 nt, Homo sapiens
acugucaggucgaucauau

SEQ ID NO: 695878 - RNA, 19 nt, Homo sapiens
gacauuggauuuggugacu

SEQ ID NO: 695879 - RNA, 19 nt, Homo sapiens
uaucagacaccgagcuuca

SEQ ID NO: 695880 - RNA, 19 nt, Homo sapiens
gagguaaauguaauguuuc

SEQ ID NO: 695881 - RNA, 19 nt, Homo sapiens
cauuggauuuggugacugu

SEQ ID NO: 695882 - RNA, 19 nt, Homo sapiens
gcuguucuuccuuuagauu

SEQ ID NO: 695883 - RNA, 19 nt, Homo sapiens
gaucauauccauguuugac

SEQ ID NO: 695884 - RNA, 19 nt, Homo sapiens
cacgacauccucauucgaa

SEQ ID NO: 695885 - RNA, 19 nt, Homo sapiens
caggcauucugcuugcaaa

SEQ ID NO: 695886 - RNA, 19 nt, Homo sapiens
uaguagcuguaucguucua

SEQ ID NO: 695887 - RNA, 19 nt, Homo sapiens
gcuguacauauguggauaa

SEQ ID NO: 695888 - RNA, 19 nt, Homo sapiens
ggacuggcagaacgucuuc

SEQ ID NO: 695889 - RNA, 19 nt, Homo sapiens
gacccuggccucucgugaa

SEQ ID NO: 695890 - RNA, 19 nt, Homo sapiens
ggaucaggacggcuggauu

SEQ ID NO: 695891 - RNA, 19 nt, Homo sapiens
cggauauauucagacguua

SEQ ID NO: 695892 - RNA, 19 nt, Homo sapiens
gcagagguugacggauaua

SEQ ID NO: 695893 - RNA, 19 nt, Homo sapiens
agcaggcccucucagguuu

SEQ ID NO: 695894 - RNA, 19 nt, Homo sapiens
aagcaggcccucucagguu

SEQ ID NO: 695895 - RNA, 19 nt, Homo sapiens
agaugcuguucuuccuuua

SEQ ID NO: 695896 - RNA, 19 nt, Homo sapiens
aaagacaggaguggaguga

SEQ ID NO: 695897 - RNA, 19 nt, Homo sapiens
uaauaguagcuguaucguu

SEQ ID NO: 695898 - RNA, 19 nt, Homo sapiens
auaugugacguaagcaaua

SEQ ID NO: 695899 - RNA, 19 nt, Homo sapiens
gcacguacgaccgggacaa

SEQ ID NO: 695900 - RNA, 19 nt, Homo sapiens
uguccauggucuucaguau

SEQ ID NO: 695901 - RNA, 19 nt, Homo sapiens
gcuggauucaggugucgua

SEQ ID NO: 695902 - RNA, 19 nt, Homo sapiens
agagguugacggauauauu

SEQ ID NO: 695903 - RNA, 19 nt, Homo sapiens
ugcagagguugacggauau

SEQ ID NO: 695904 - RNA, 19 nt, Homo sapiens
gacaggaguggagugauau

SEQ ID NO: 695905 - RNA, 19 nt, Homo sapiens
gacauccucauucgaaagu

SEQ ID NO: 695906 - RNA, 19 nt, Homo sapiens
ugccaugagguaaauguaa

SEQ ID NO: 695907 - RNA, 19 nt, Homo sapiens
ugaagagcagcacaacaug

SEQ ID NO: 695908 - RNA, 19 nt, Homo sapiens
ggauauauucagacguuac

SEQ ID NO: 695909 - RNA, 19 nt, Homo sapiens
ccggcucucugaccaguuc

SEQ ID NO: 695910 - RNA, 19 nt, Homo sapiens
gcuguaucguucuaaugca

SEQ ID NO: 695911 - RNA, 19 nt, Homo sapiens
caaaaugucacaguuccua

SEQ ID NO: 695912 - RNA, 19 nt, Homo sapiens
gacguuacgacacggauca

SEQ ID NO: 695913 - RNA, 19 nt, Homo sapiens
aacauggaacuuacacaaa

SEQ ID NO: 695914 - RNA, 19 nt, Homo sapiens
guuagaugcuguucuuccu

SEQ ID NO: 695915 - RNA, 19 nt, Homo sapiens
uccauggucuucaguaucg

SEQ ID NO: 695916 - RNA, 19 nt, Homo sapiens
gcaaauggcucuuccuuga

SEQ ID NO: 695917 - RNA, 19 nt, Homo sapiens
uaacaacagccuucauuua

SEQ ID NO: 695918 - RNA, 19 nt, Homo sapiens
gaacaagaacugagggaaa

SEQ ID NO: 695919 - RNA, 19 nt, Homo sapiens
caacagccuucauuuaucu

SEQ ID NO: 695920 - RNA, 19 nt, Homo sapiens
guccugagguggugauuug

SEQ ID NO: 695921 - RNA, 19 nt, Homo sapiens
gacaaguacucagguguga

SEQ ID NO: 695922 - RNA, 19 nt, Homo sapiens
cuaaaugacagauguguga

SEQ ID NO: 695923 - RNA, 19 nt, Homo sapiens
ucucuggacacgauuauua

SEQ ID NO: 695924 - RNA, 19 nt, Homo sapiens
ugacagaugugugagaaca

SEQ ID NO: 695925 - RNA, 19 nt, Homo sapiens
ggacacgauuauuaugagu

SEQ ID NO: 695926 - RNA, 19 nt, Homo sapiens
guuaacaacagccuucauu

SEQ ID NO: 695927 - RNA, 19 nt, Homo sapiens
aacaacagccuucauuuau

SEQ ID NO: 695928 - RNA, 19 nt, Homo sapiens
acaacagccuucauuuauc

SEQ ID NO: 695929 - RNA, 19 nt, Homo sapiens
aaauggcucuuccuugagu

SEQ ID NO: 695930 - RNA, 19 nt, Homo sapiens
aaugacagaugugugagaa

SEQ ID NO: 695931 - RNA, 19 nt, Homo sapiens
uuaacaacagccuucauuu

SEQ ID NO: 695932 - RNA, 19 nt, Homo sapiens
aacaagaacugagggaaag

SEQ ID NO: 695933 - RNA, 19 nt, Homo sapiens
gcagauucaccgguccuuu

SEQ ID NO: 695934 - RNA, 19 nt, Homo sapiens
guggugauuuggccagugu

SEQ ID NO: 695935 - RNA, 19 nt, Homo sapiens
gguccaggcuuuucuguca

SEQ ID NO: 695936 - RNA, 19 nt, Homo sapiens
gugaggacaagaaugcaaa

SEQ ID NO: 695937 - RNA, 19 nt, Homo sapiens
ggugauuuggccaguguuu

SEQ ID NO: 695938 - RNA, 19 nt, Homo sapiens
uuucugucaugcuuguuaa

SEQ ID NO: 695939 - RNA, 19 nt, Homo sapiens
ggugugaggacaagaaugc

SEQ ID NO: 695940 - RNA, 19 nt, Homo sapiens
gacacgauuauuaugaguu

SEQ ID NO: 695941 - RNA, 19 nt, Homo sapiens
acagaugugugagaacaag

SEQ ID NO: 695942 - RNA, 19 nt, Homo sapiens
ggcucuuccuugagugaaa

SEQ ID NO: 695943 - RNA, 19 nt, Homo sapiens
ugauuuggccaguguuuua

SEQ ID NO: 695944 - RNA, 19 nt, Homo sapiens
gcucuuccuugagugaaag

SEQ ID NO: 695945 - RNA, 19 nt, Homo sapiens
ucaggugugaggacaagaa

SEQ ID NO: 695946 - RNA, 19 nt, Homo sapiens
gagacgaguuuaacgcuua

SEQ ID NO: 695947 - RNA, 19 nt, Homo sapiens
aaagcaaccuucugaugua

SEQ ID NO: 695948 - RNA, 19 nt, Homo sapiens
ccgagaagguagacaauug

SEQ ID NO: 695949 - RNA, 19 nt, Homo sapiens
gcaaagcaaccuucugaug

SEQ ID NO: 695950 - RNA, 19 nt, Homo sapiens
gcagauaugcgcccagaga

SEQ ID NO: 695951 - RNA, 19 nt, Homo sapiens
caaagcaaccuucugaugu

SEQ ID NO: 695952 - RNA, 19 nt, Homo sapiens
gaagaccacccacgaaugg

SEQ ID NO: 695953 - RNA, 19 nt, Homo sapiens
gcaaccuucugauguaagu

SEQ ID NO: 695954 - RNA, 19 nt, Homo sapiens
ucuuacgacuguuacguua

SEQ ID NO: 695955 - RNA, 19 nt, Homo sapiens
ugauguaaguucugagugu

SEQ ID NO: 695956 - RNA, 19 nt, Homo sapiens
guuuaacgcuuacuaugca

SEQ ID NO: 695957 - RNA, 19 nt, Homo sapiens
agauauggaucgcccaaga

SEQ ID NO: 695958 - RNA, 19 nt, Homo sapiens
ggcugaaccugcagauaug

SEQ ID NO: 695959 - RNA, 19 nt, Homo sapiens
gcccagcacccaugaguug

SEQ ID NO: 695960 - RNA, 19 nt, Homo sapiens
aagcaaccuucugauguaa

SEQ ID NO: 695961 - RNA, 19 nt, Homo sapiens
gguuaucuuacgacuguua

SEQ ID NO: 695962 - RNA, 19 nt, Homo sapiens
gaguuuaacgcuuacuaug

SEQ ID NO: 695963 - RNA, 19 nt, Homo sapiens
cgacuguuacguuacauug

SEQ ID NO: 695964 - RNA, 19 nt, Homo sapiens
uuacgacuguuacguuaca

SEQ ID NO: 695965 - RNA, 19 nt, Homo sapiens
cagcacccaugaguuguga

SEQ ID NO: 695966 - RNA, 19 nt, Homo sapiens
gcguaucggagacgaguuu

SEQ ID NO: 695967 - RNA, 19 nt, Homo sapiens
cuaccucccuacagacaga

SEQ ID NO: 695968 - RNA, 19 nt, Homo sapiens
gccaggccuucaaccacua

SEQ ID NO: 695969 - RNA, 19 nt, Homo sapiens
cgaagaccacccacgaaug

SEQ ID NO: 695970 - RNA, 19 nt, Homo sapiens
agauaugcgcccagagaua

SEQ ID NO: 695971 - RNA, 19 nt, Homo sapiens
augguuaucuuacgacugu

SEQ ID NO: 695972 - RNA, 19 nt, Homo sapiens
aggcugaaccugcagauau

SEQ ID NO: 695973 - RNA, 19 nt, Homo sapiens
gagugugaccgagaaggua

SEQ ID NO: 695974 - RNA, 19 nt, Homo sapiens
cuucugauguaaguucuga

SEQ ID NO: 695975 - RNA, 19 nt, Homo sapiens
cgaguuuaacgcuuacuau

SEQ ID NO: 695976 - RNA, 19 nt, Homo sapiens
ccacgaaugguuaucuuac

SEQ ID NO: 695977 - RNA, 19 nt, Homo sapiens
ugaccgagaagguagacaa

SEQ ID NO: 695978 - RNA, 19 nt, Homo sapiens
gagcccagcacccaugagu

SEQ ID NO: 695979 - RNA, 19 nt, Homo sapiens
acgaaugguuaucuuacga

SEQ ID NO: 695980 - RNA, 19 nt, Homo sapiens
ccgaagaccacccacgaau

SEQ ID NO: 695981 - RNA, 19 nt, Homo sapiens
cccaagaguugcggcguau

SEQ ID NO: 695982 - RNA, 19 nt, Homo sapiens
gcacccaugaguugugaca

SEQ ID NO: 695983 - RNA, 19 nt, Homo sapiens
guaucggagacgaguuuaa

SEQ ID NO: 695984 - RNA, 19 nt, Homo sapiens
gauauggaucgcccaagag

SEQ ID NO: 695985 - RNA, 19 nt, Homo sapiens
gagaagguagacaauugca

SEQ ID NO: 695986 - RNA, 19 nt, Homo sapiens
gaccgagaagguagacaau

SEQ ID NO: 695987 - RNA, 19 nt, Homo sapiens
ugacaaaucaacacaaacc

SEQ ID NO: 695988 - RNA, 19 nt, Homo sapiens
gagacgaguuuaacgcuua

SEQ ID NO: 695989 - RNA, 19 nt, Homo sapiens
aaagcaaccuucugaugua

SEQ ID NO: 695990 - RNA, 19 nt, Homo sapiens
agacagagccacaagguaa

SEQ ID NO: 695991 - RNA, 19 nt, Homo sapiens
ccgagaagguagacaauug

SEQ ID NO: 695992 - RNA, 19 nt, Homo sapiens
gcaaagcaaccuucugaug

SEQ ID NO: 695993 - RNA, 19 nt, Homo sapiens
gcagauaugcgcccagaga

SEQ ID NO: 695994 - RNA, 19 nt, Homo sapiens
caaagcaaccuucugaugu

SEQ ID NO: 695995 - RNA, 19 nt, Homo sapiens
gaagaccacccacgaaugg

SEQ ID NO: 695996 - RNA, 19 nt, Homo sapiens
gcaaccuucugauguaagu

SEQ ID NO: 695997 - RNA, 19 nt, Homo sapiens
ucuuacgacuguuacguua

SEQ ID NO: 695998 - RNA, 19 nt, Homo sapiens
ugauguaaguucugagugu

SEQ ID NO: 695999 - RNA, 19 nt, Homo sapiens
guuuaacgcuuacuaugca

SEQ ID NO: 696000 - RNA, 19 nt, Homo sapiens
agauauggaucgcccaaga

SEQ ID NO: 696001 - RNA, 19 nt, Homo sapiens
ggcugaaccugcagauaug

SEQ ID NO: 696002 - RNA, 19 nt, Homo sapiens
gcccagcacccaugaguug

SEQ ID NO: 696003 - RNA, 19 nt, Homo sapiens
aagcaaccuucugauguaa

SEQ ID NO: 696004 - RNA, 19 nt, Homo sapiens
gguuaucuuacgacuguua

SEQ ID NO: 696005 - RNA, 19 nt, Homo sapiens
gaguuuaacgcuuacuaug

SEQ ID NO: 696006 - RNA, 19 nt, Homo sapiens
ccaguggguauuucucuuu

SEQ ID NO: 696007 - RNA, 19 nt, Homo sapiens
gccacaagguaauccugaa

SEQ ID NO: 696008 - RNA, 19 nt, Homo sapiens
cgacuguuacguuacauug

SEQ ID NO: 696009 - RNA, 19 nt, Homo sapiens
uuacgacuguuacguuaca

SEQ ID NO: 696010 - RNA, 19 nt, Homo sapiens
cagcacccaugaguuguga

SEQ ID NO: 696011 - RNA, 19 nt, Homo sapiens
gcguaucggagacgaguuu

SEQ ID NO: 696012 - RNA, 19 nt, Homo sapiens
cuaccucccuacagacaga

SEQ ID NO: 696013 - RNA, 19 nt, Homo sapiens
gccaggccuucaaccacua

SEQ ID NO: 696014 - RNA, 19 nt, Homo sapiens
cgaagaccacccacgaaug

SEQ ID NO: 696015 - RNA, 19 nt, Homo sapiens
agauaugcgcccagagaua

SEQ ID NO: 696016 - RNA, 19 nt, Homo sapiens
augguuaucuuacgacugu

SEQ ID NO: 696017 - RNA, 19 nt, Homo sapiens
aggcugaaccugcagauau

SEQ ID NO: 696018 - RNA, 19 nt, Homo sapiens
gagugugaccgagaaggua

SEQ ID NO: 696019 - RNA, 19 nt, Homo sapiens
gauccuccaguggguauuu

SEQ ID NO: 696020 - RNA, 19 nt, Homo sapiens
cuucugauguaaguucuga

SEQ ID NO: 696021 - RNA, 19 nt, Homo sapiens
cgaguuuaacgcuuacuau

SEQ ID NO: 696022 - RNA, 19 nt, Homo sapiens
ccacgaaugguuaucuuac

SEQ ID NO: 696023 - RNA, 19 nt, Homo sapiens
cagacagagccacaaggua

SEQ ID NO: 696024 - RNA, 19 nt, Homo sapiens
ugaccgagaagguagacaa

SEQ ID NO: 696025 - RNA, 19 nt, Homo sapiens
gagcccagcacccaugagu

SEQ ID NO: 696026 - RNA, 19 nt, Homo sapiens
guauuucucuuuugacaca

SEQ ID NO: 696027 - RNA, 19 nt, Homo sapiens
acgaaugguuaucuuacga

SEQ ID NO: 696028 - RNA, 19 nt, Homo sapiens
ccgaagaccacccacgaau

SEQ ID NO: 696029 - RNA, 19 nt, Homo sapiens
gacagagccacaagguaau

SEQ ID NO: 696030 - RNA, 19 nt, Homo sapiens
cccaagaguugcggcguau

SEQ ID NO: 696031 - RNA, 19 nt, Homo sapiens
gauccccgcuuuucaucuu

SEQ ID NO: 696032 - RNA, 19 nt, Homo sapiens
gcuaccagauccccgcuuu

SEQ ID NO: 696033 - RNA, 19 nt, Homo sapiens
gcacccaugaguugugaca

SEQ ID NO: 696034 - RNA, 19 nt, Homo sapiens
gagaagguagacaauugca

SEQ ID NO: 696035 - RNA, 19 nt, Homo sapiens
guaucggagacgaguuuaa

SEQ ID NO: 696036 - RNA, 19 nt, Homo sapiens
gauauggaucgcccaagag

SEQ ID NO: 696037 - RNA, 19 nt, Homo sapiens
ugacaaaucaacacaaacc

SEQ ID NO: 696038 - RNA, 19 nt, Homo sapiens
gaccgagaagguagacaau

SEQ ID NO: 696039 - RNA, 19 nt, Homo sapiens
gagacgaguuuaacgcuua

SEQ ID NO: 696040 - RNA, 19 nt, Homo sapiens
caaggagguuagagaaaua

SEQ ID NO: 696041 - RNA, 19 nt, Homo sapiens
gcaaggagguuagagaaau

SEQ ID NO: 696042 - RNA, 19 nt, Homo sapiens
aaagcaaccuucugaugua

SEQ ID NO: 696043 - RNA, 19 nt, Homo sapiens
gcaaagcaaccuucugaug

SEQ ID NO: 696044 - RNA, 19 nt, Homo sapiens
agacagagccacaagguaa

SEQ ID NO: 696045 - RNA, 19 nt, Homo sapiens
ccgagaagguagacaauug

SEQ ID NO: 696046 - RNA, 19 nt, Homo sapiens
gagagaggcacagguauuu

SEQ ID NO: 696047 - RNA, 19 nt, Homo sapiens
gcagauaugcgcccagaga

SEQ ID NO: 696048 - RNA, 19 nt, Homo sapiens
uagaggaaguugucgugua

SEQ ID NO: 696049 - RNA, 19 nt, Homo sapiens
caaagcaaccuucugaugu

SEQ ID NO: 696050 - RNA, 19 nt, Homo sapiens
gaagaccacccacgaaugg

SEQ ID NO: 696051 - RNA, 19 nt, Homo sapiens
ggugagagaggcacaggua

SEQ ID NO: 696052 - RNA, 19 nt, Homo sapiens
gcaaccuucugauguaagu

SEQ ID NO: 696053 - RNA, 19 nt, Homo sapiens
gaaguugucguguaguugu

SEQ ID NO: 696054 - RNA, 19 nt, Homo sapiens
ucuuacgacuguuacguua

SEQ ID NO: 696055 - RNA, 19 nt, Homo sapiens
ugauguaaguucugagugu

SEQ ID NO: 696056 - RNA, 19 nt, Homo sapiens
guuuaacgcuuacuaugca

SEQ ID NO: 696057 - RNA, 19 nt, Homo sapiens
agauauggaucgcccaaga

SEQ ID NO: 696058 - RNA, 19 nt, Homo sapiens
agaggaaguugucguguag

SEQ ID NO: 696059 - RNA, 19 nt, Homo sapiens
ggcugaaccugcagauaug

SEQ ID NO: 696060 - RNA, 19 nt, Homo sapiens
gcccagcacccaugaguug

SEQ ID NO: 696061 - RNA, 19 nt, Homo sapiens
cauguauucaguccacuua

SEQ ID NO: 696062 - RNA, 19 nt, Homo sapiens
ugagagaggcacagguauu

SEQ ID NO: 696063 - RNA, 19 nt, Homo sapiens
ugaaggaggaggugagaga

SEQ ID NO: 696064 - RNA, 19 nt, Homo sapiens
aagcaaccuucugauguaa

SEQ ID NO: 696065 - RNA, 19 nt, Homo sapiens
uuagagaaauagaggaagu

SEQ ID NO: 696066 - RNA, 19 nt, Homo sapiens
gguuaucuuacgacuguua

SEQ ID NO: 696067 - RNA, 19 nt, Homo sapiens
gaguuuaacgcuuacuaug

SEQ ID NO: 696068 - RNA, 19 nt, Homo sapiens
ccaguggguauuucucuuu

SEQ ID NO: 696069 - RNA, 19 nt, Homo sapiens
gccacaagguaauccugaa

SEQ ID NO: 696070 - RNA, 19 nt, Homo sapiens
cgacuguuacguuacauug

SEQ ID NO: 696071 - RNA, 19 nt, Homo sapiens
uuacgacuguuacguuaca

SEQ ID NO: 696072 - RNA, 19 nt, Homo sapiens
agaaauagaggaaguuguc

SEQ ID NO: 696073 - RNA, 19 nt, Homo sapiens
cagcacccaugaguuguga

SEQ ID NO: 696074 - RNA, 19 nt, Homo sapiens
gcguaucggagacgaguuu

SEQ ID NO: 696075 - RNA, 19 nt, Homo sapiens
cuaccucccuacagacaga

SEQ ID NO: 696076 - RNA, 19 nt, Homo sapiens
ggaaguugucguguaguug

SEQ ID NO: 696077 - RNA, 19 nt, Homo sapiens
guguaguugucauguauuc

SEQ ID NO: 696078 - RNA, 19 nt, Homo sapiens
ucguguaguugucauguau

SEQ ID NO: 696079 - RNA, 19 nt, Homo sapiens
gccaggccuucaaccacua

SEQ ID NO: 696080 - RNA, 19 nt, Homo sapiens
cgaagaccacccacgaaug

SEQ ID NO: 696081 - RNA, 19 nt, Homo sapiens
gguuagagaaauagaggaa

SEQ ID NO: 696082 - RNA, 19 nt, Homo sapiens
agauaugcgcccagagaua

SEQ ID NO: 696083 - RNA, 19 nt, Homo sapiens
augguuaucuuacgacugu

SEQ ID NO: 696084 - RNA, 19 nt, Homo sapiens
aggaaguugucguguaguu

SEQ ID NO: 696085 - RNA, 19 nt, Homo sapiens
aggcugaaccugcagauau

SEQ ID NO: 696086 - RNA, 19 nt, Homo sapiens
gagugugaccgagaaggua

SEQ ID NO: 696087 - RNA, 19 nt, Homo sapiens
gauccuccaguggguauuu

SEQ ID NO: 696088 - RNA, 19 nt, Homo sapiens
cuucugauguaaguucuga

SEQ ID NO: 696089 - RNA, 19 nt, Homo sapiens
uguauucaguccacuuaag

SEQ ID NO: 696090 - RNA, 19 nt, Homo sapiens
cgaguuuaacgcuuacuau

SEQ ID NO: 696091 - RNA, 19 nt, Homo sapiens
ccacgaaugguuaucuuac

SEQ ID NO: 696092 - RNA, 19 nt, Homo sapiens
gucguguaguugucaugua

SEQ ID NO: 696093 - RNA, 19 nt, Homo sapiens
cagacagagccacaaggua

SEQ ID NO: 696094 - RNA, 19 nt, Homo sapiens
gagaaauagaggaaguugu

SEQ ID NO: 696095 - RNA, 19 nt, Homo sapiens
ugaccgagaagguagacaa

SEQ ID NO: 696096 - RNA, 19 nt, Homo sapiens
gagcccagcacccaugagu

SEQ ID NO: 696097 - RNA, 19 nt, Homo sapiens
guauuucucuuuugacaca

SEQ ID NO: 696098 - RNA, 19 nt, Homo sapiens
acgaaugguuaucuuacga

SEQ ID NO: 696099 - RNA, 19 nt, Homo sapiens
ccgaagaccacccacgaau

SEQ ID NO: 696100 - RNA, 19 nt, Homo sapiens
gcuaccagauccccgcuuu

SEQ ID NO: 696101 - RNA, 19 nt, Homo sapiens
gacagagccacaagguaau

SEQ ID NO: 696102 - RNA, 19 nt, Homo sapiens
cccaagaguugcggcguau

SEQ ID NO: 696103 - RNA, 19 nt, Homo sapiens
gauccccgcuuuucaucuu

SEQ ID NO: 696104 - RNA, 19 nt, Homo sapiens
gcacccaugaguugugaca

SEQ ID NO: 696105 - RNA, 19 nt, Homo sapiens
gaccgagaagguagacaau

SEQ ID NO: 696106 - RNA, 19 nt, Homo sapiens
gagaagguagacaauugca

SEQ ID NO: 696107 - RNA, 19 nt, Homo sapiens
guaucggagacgaguuuaa

SEQ ID NO: 696108 - RNA, 19 nt, Homo sapiens
gauauggaucgcccaagag

SEQ ID NO: 696109 - RNA, 19 nt, Homo sapiens
ugacaaaucaacacaaacc

SEQ ID NO: 696110 - RNA, 19 nt, Homo sapiens
gagacgaguuuaacgcuua

SEQ ID NO: 696111 - RNA, 19 nt, Homo sapiens
caaggagguuagagaaaua

SEQ ID NO: 696112 - RNA, 19 nt, Homo sapiens
gcaaggagguuagagaaau

SEQ ID NO: 696113 - RNA, 19 nt, Homo sapiens
aaagcaaccuucugaugua

SEQ ID NO: 696114 - RNA, 19 nt, Homo sapiens
gcaaagcaaccuucugaug

SEQ ID NO: 696115 - RNA, 19 nt, Homo sapiens
ccgagaagguagacaauug

SEQ ID NO: 696116 - RNA, 19 nt, Homo sapiens
gagagaggcacagguauuu

SEQ ID NO: 696117 - RNA, 19 nt, Homo sapiens
gcagauaugcgcccagaga

SEQ ID NO: 696118 - RNA, 19 nt, Homo sapiens
uagaggaaguugucgugua

SEQ ID NO: 696119 - RNA, 19 nt, Homo sapiens
caaagcaaccuucugaugu

SEQ ID NO: 696120 - RNA, 19 nt, Homo sapiens
gaagaccacccacgaaugg

SEQ ID NO: 696121 - RNA, 19 nt, Homo sapiens
ggugagagaggcacaggua

SEQ ID NO: 696122 - RNA, 19 nt, Homo sapiens
gcaaccuucugauguaagu

SEQ ID NO: 696123 - RNA, 19 nt, Homo sapiens
gaaguugucguguaguugu

SEQ ID NO: 696124 - RNA, 19 nt, Homo sapiens
ucuuacgacuguuacguua

SEQ ID NO: 696125 - RNA, 19 nt, Homo sapiens
ugauguaaguucugagugu

SEQ ID NO: 696126 - RNA, 19 nt, Homo sapiens
guuuaacgcuuacuaugca

SEQ ID NO: 696127 - RNA, 19 nt, Homo sapiens
agauauggaucgcccaaga

SEQ ID NO: 696128 - RNA, 19 nt, Homo sapiens
agaggaaguugucguguag

SEQ ID NO: 696129 - RNA, 19 nt, Homo sapiens
ggcugaaccugcagauaug

SEQ ID NO: 696130 - RNA, 19 nt, Homo sapiens
gcccagcacccaugaguug

SEQ ID NO: 696131 - RNA, 19 nt, Homo sapiens
cauguauucaguccacuua

SEQ ID NO: 696132 - RNA, 19 nt, Homo sapiens
ugagagaggcacagguauu

SEQ ID NO: 696133 - RNA, 19 nt, Homo sapiens
ugaaggaggaggugagaga

SEQ ID NO: 696134 - RNA, 19 nt, Homo sapiens
aagcaaccuucugauguaa

SEQ ID NO: 696135 - RNA, 19 nt, Homo sapiens
uuagagaaauagaggaagu

SEQ ID NO: 696136 - RNA, 19 nt, Homo sapiens
gguuaucuuacgacuguua

SEQ ID NO: 696137 - RNA, 19 nt, Homo sapiens
gaguuuaacgcuuacuaug

SEQ ID NO: 696138 - RNA, 19 nt, Homo sapiens
cgacuguuacguuacauug

SEQ ID NO: 696139 - RNA, 19 nt, Homo sapiens
uuacgacuguuacguuaca

SEQ ID NO: 696140 - RNA, 19 nt, Homo sapiens
agaaauagaggaaguuguc

SEQ ID NO: 696141 - RNA, 19 nt, Homo sapiens
cagcacccaugaguuguga

SEQ ID NO: 696142 - RNA, 19 nt, Homo sapiens
cuaccucccuacagacaga

SEQ ID NO: 696143 - RNA, 19 nt, Homo sapiens
gcguaucggagacgaguuu

SEQ ID NO: 696144 - RNA, 19 nt, Homo sapiens
ggaaguugucguguaguug

SEQ ID NO: 696145 - RNA, 19 nt, Homo sapiens
guguaguugucauguauuc

SEQ ID NO: 696146 - RNA, 19 nt, Homo sapiens
ucguguaguugucauguau

SEQ ID NO: 696147 - RNA, 19 nt, Homo sapiens
gccaggccuucaaccacua

SEQ ID NO: 696148 - RNA, 19 nt, Homo sapiens
cgaagaccacccacgaaug

SEQ ID NO: 696149 - RNA, 19 nt, Homo sapiens
gguuagagaaauagaggaa

SEQ ID NO: 696150 - RNA, 19 nt, Homo sapiens
agauaugcgcccagagaua

SEQ ID NO: 696151 - RNA, 19 nt, Homo sapiens
augguuaucuuacgacugu

SEQ ID NO: 696152 - RNA, 19 nt, Homo sapiens
aggaaguugucguguaguu

SEQ ID NO: 696153 - RNA, 19 nt, Homo sapiens
aggcugaaccugcagauau

SEQ ID NO: 696154 - RNA, 19 nt, Homo sapiens
gagugugaccgagaaggua

SEQ ID NO: 696155 - RNA, 19 nt, Homo sapiens
cuucugauguaaguucuga

SEQ ID NO: 696156 - RNA, 19 nt, Homo sapiens
uguauucaguccacuuaag

SEQ ID NO: 696157 - RNA, 19 nt, Homo sapiens
cgaguuuaacgcuuacuau

SEQ ID NO: 696158 - RNA, 19 nt, Homo sapiens
ccacgaaugguuaucuuac

SEQ ID NO: 696159 - RNA, 19 nt, Homo sapiens
gucguguaguugucaugua

SEQ ID NO: 696160 - RNA, 19 nt, Homo sapiens
gagaaauagaggaaguugu

SEQ ID NO: 696161 - RNA, 19 nt, Homo sapiens
ugaccgagaagguagacaa

SEQ ID NO: 696162 - RNA, 19 nt, Homo sapiens
gagcccagcacccaugagu

SEQ ID NO: 696163 - RNA, 19 nt, Homo sapiens
acgaaugguuaucuuacga

SEQ ID NO: 696164 - RNA, 19 nt, Homo sapiens
ccgaagaccacccacgaau

SEQ ID NO: 696165 - RNA, 19 nt, Homo sapiens
cccaagaguugcggcguau

SEQ ID NO: 696166 - RNA, 19 nt, Homo sapiens
gcacccaugaguugugaca

SEQ ID NO: 696167 - RNA, 19 nt, Homo sapiens
gagaagguagacaauugca

SEQ ID NO: 696168 - RNA, 19 nt, Homo sapiens
gaccgagaagguagacaau

SEQ ID NO: 696169 - RNA, 19 nt, Homo sapiens
guaucggagacgaguuuaa

SEQ ID NO: 696170 - RNA, 19 nt, Homo sapiens
gauauggaucgcccaagag

SEQ ID NO: 696171 - RNA, 19 nt, Homo sapiens
ugacaaaucaacacaaacc

SEQ ID NO: 696172 - RNA, 19 nt, Homo sapiens
gagacgaguuuaacgcuua

SEQ ID NO: 696173 - RNA, 19 nt, Homo sapiens
aaagcaaccuucugaugua

SEQ ID NO: 696174 - RNA, 19 nt, Homo sapiens
agacagagccacaagguaa

SEQ ID NO: 696175 - RNA, 19 nt, Homo sapiens
ccgagaagguagacaauug

SEQ ID NO: 696176 - RNA, 19 nt, Homo sapiens
gcaaagcaaccuucugaug

SEQ ID NO: 696177 - RNA, 19 nt, Homo sapiens
gcagauaugcgcccagaga

SEQ ID NO: 696178 - RNA, 19 nt, Homo sapiens
caaagcaaccuucugaugu

SEQ ID NO: 696179 - RNA, 19 nt, Homo sapiens
gaagaccacccacgaaugg

SEQ ID NO: 696180 - RNA, 19 nt, Homo sapiens
gcaaccuucugauguaagu

SEQ ID NO: 696181 - RNA, 19 nt, Homo sapiens
ucuuacgacuguuacguua

SEQ ID NO: 696182 - RNA, 19 nt, Homo sapiens
ugauguaaguucugagugu

SEQ ID NO: 696183 - RNA, 19 nt, Homo sapiens
guuuaacgcuuacuaugca

SEQ ID NO: 696184 - RNA, 19 nt, Homo sapiens
agauauggaucgcccaaga

SEQ ID NO: 696185 - RNA, 19 nt, Homo sapiens
ggcugaaccugcagauaug

SEQ ID NO: 696186 - RNA, 19 nt, Homo sapiens
gcccagcacccaugaguug

SEQ ID NO: 696187 - RNA, 19 nt, Homo sapiens
aagcaaccuucugauguaa

SEQ ID NO: 696188 - RNA, 19 nt, Homo sapiens
gguuaucuuacgacuguua

SEQ ID NO: 696189 - RNA, 19 nt, Homo sapiens
gaguuuaacgcuuacuaug

SEQ ID NO: 696190 - RNA, 19 nt, Homo sapiens
ccaguggguauuucucuuu

SEQ ID NO: 696191 - RNA, 19 nt, Homo sapiens
gccacaagguaauccugaa

SEQ ID NO: 696192 - RNA, 19 nt, Homo sapiens
cgacuguuacguuacauug

SEQ ID NO: 696193 - RNA, 19 nt, Homo sapiens
uuacgacuguuacguuaca

SEQ ID NO: 696194 - RNA, 19 nt, Homo sapiens
cagcacccaugaguuguga

SEQ ID NO: 696195 - RNA, 19 nt, Homo sapiens
gcguaucggagacgaguuu

SEQ ID NO: 696196 - RNA, 19 nt, Homo sapiens
cuaccucccuacagacaga

SEQ ID NO: 696197 - RNA, 19 nt, Homo sapiens
gccaggccuucaaccacua

SEQ ID NO: 696198 - RNA, 19 nt, Homo sapiens
cgaagaccacccacgaaug

SEQ ID NO: 696199 - RNA, 19 nt, Homo sapiens
agauaugcgcccagagaua

SEQ ID NO: 696200 - RNA, 19 nt, Homo sapiens
augguuaucuuacgacugu

SEQ ID NO: 696201 - RNA, 19 nt, Homo sapiens
aggcugaaccugcagauau

SEQ ID NO: 696202 - RNA, 19 nt, Homo sapiens
gagugugaccgagaaggua

SEQ ID NO: 696203 - RNA, 19 nt, Homo sapiens
gauccuccaguggguauuu

SEQ ID NO: 696204 - RNA, 19 nt, Homo sapiens
cuucugauguaaguucuga

SEQ ID NO: 696205 - RNA, 19 nt, Homo sapiens
cgaguuuaacgcuuacuau

SEQ ID NO: 696206 - RNA, 19 nt, Homo sapiens
ccacgaaugguuaucuuac

SEQ ID NO: 696207 - RNA, 19 nt, Homo sapiens
cagacagagccacaaggua

SEQ ID NO: 696208 - RNA, 19 nt, Homo sapiens
ugaccgagaagguagacaa

SEQ ID NO: 696209 - RNA, 19 nt, Homo sapiens
gagcccagcacccaugagu

SEQ ID NO: 696210 - RNA, 19 nt, Homo sapiens
guauuucucuuuugacaca

SEQ ID NO: 696211 - RNA, 19 nt, Homo sapiens
acgaaugguuaucuuacga

SEQ ID NO: 696212 - RNA, 19 nt, Homo sapiens
ccgaagaccacccacgaau

SEQ ID NO: 696213 - RNA, 19 nt, Homo sapiens
gacagagccacaagguaau

SEQ ID NO: 696214 - RNA, 19 nt, Homo sapiens
cccaagaguugcggcguau

SEQ ID NO: 696215 - RNA, 19 nt, Homo sapiens
gauccccgcuuuucaucuu

SEQ ID NO: 696216 - RNA, 19 nt, Homo sapiens
gcuaccagauccccgcuuu

SEQ ID NO: 696217 - RNA, 19 nt, Homo sapiens
caucacccagcuuccauga

SEQ ID NO: 696218 - RNA, 19 nt, Homo sapiens
gcacccaugaguugugaca

SEQ ID NO: 696219 - RNA, 19 nt, Homo sapiens
gagaagguagacaauugca

SEQ ID NO: 696220 - RNA, 19 nt, Homo sapiens
guaucggagacgaguuuaa

SEQ ID NO: 696221 - RNA, 19 nt, Homo sapiens
gauauggaucgcccaagag

SEQ ID NO: 696222 - RNA, 19 nt, Homo sapiens
acuagaaacagcuccauca

SEQ ID NO: 696223 - RNA, 19 nt, Homo sapiens
ugacaaaucaacacaaacc

SEQ ID NO: 696224 - RNA, 19 nt, Homo sapiens
gaccgagaagguagacaau

SEQ ID NO: 696225 - RNA, 19 nt, Homo sapiens
gagacgaguuuaacgcuua

SEQ ID NO: 696226 - RNA, 19 nt, Homo sapiens
aaagcaaccuucugaugua

SEQ ID NO: 696227 - RNA, 19 nt, Homo sapiens
ccaaguagcugggauuaca

SEQ ID NO: 696228 - RNA, 19 nt, Homo sapiens
ccgagaagguagacaauug

SEQ ID NO: 696229 - RNA, 19 nt, Homo sapiens
gcaaagcaaccuucugaug

SEQ ID NO: 696230 - RNA, 19 nt, Homo sapiens
gcagauaugcgcccagaga

SEQ ID NO: 696231 - RNA, 19 nt, Homo sapiens
caaagcaaccuucugaugu

SEQ ID NO: 696232 - RNA, 19 nt, Homo sapiens
gaagaccacccacgaaugg

SEQ ID NO: 696233 - RNA, 19 nt, Homo sapiens
gcaaccuucugauguaagu

SEQ ID NO: 696234 - RNA, 19 nt, Homo sapiens
ucuuacgacuguuacguua

SEQ ID NO: 696235 - RNA, 19 nt, Homo sapiens
gggauuacagcuuccauga

SEQ ID NO: 696236 - RNA, 19 nt, Homo sapiens
ugauguaaguucugagugu

SEQ ID NO: 696237 - RNA, 19 nt, Homo sapiens
guuuaacgcuuacuaugca

SEQ ID NO: 696238 - RNA, 19 nt, Homo sapiens
caagaguugcggcguauug

SEQ ID NO: 696239 - RNA, 19 nt, Homo sapiens
agauauggaucgcccaaga

SEQ ID NO: 696240 - RNA, 19 nt, Homo sapiens
ggcugaaccugcagauaug

SEQ ID NO: 696241 - RNA, 19 nt, Homo sapiens
aagcaaccuucugauguaa

SEQ ID NO: 696242 - RNA, 19 nt, Homo sapiens
gguuaucuuacgacuguua

SEQ ID NO: 696243 - RNA, 19 nt, Homo sapiens
gaguuuaacgcuuacuaug

SEQ ID NO: 696244 - RNA, 19 nt, Homo sapiens
cgacuguuacguuacauug

SEQ ID NO: 696245 - RNA, 19 nt, Homo sapiens
uuacgacuguuacguuaca

SEQ ID NO: 696246 - RNA, 19 nt, Homo sapiens
cuaccucccuacagacaga

SEQ ID NO: 696247 - RNA, 19 nt, Homo sapiens
guauuggagacgaguuuaa

SEQ ID NO: 696248 - RNA, 19 nt, Homo sapiens
ugccucagccucccaagua

SEQ ID NO: 696249 - RNA, 19 nt, Homo sapiens
cgaagaccacccacgaaug

SEQ ID NO: 696250 - RNA, 19 nt, Homo sapiens
agauaugcgcccagagaua

SEQ ID NO: 696251 - RNA, 19 nt, Homo sapiens
augguuaucuuacgacugu

SEQ ID NO: 696252 - RNA, 19 nt, Homo sapiens
aggcugaaccugcagauau

SEQ ID NO: 696253 - RNA, 19 nt, Homo sapiens
gacagagccacaagucuca

SEQ ID NO: 696254 - RNA, 19 nt, Homo sapiens
gagugugaccgagaaggua

SEQ ID NO: 696255 - RNA, 19 nt, Homo sapiens
cuucugauguaaguucuga

SEQ ID NO: 696256 - RNA, 19 nt, Homo sapiens
cgaguuuaacgcuuacuau

SEQ ID NO: 696257 - RNA, 19 nt, Homo sapiens
ccacgaaugguuaucuuac

SEQ ID NO: 696258 - RNA, 19 nt, Homo sapiens
gcguauuggagacgaguuu

SEQ ID NO: 696259 - RNA, 19 nt, Homo sapiens
ugaccgagaagguagacaa

SEQ ID NO: 696260 - RNA, 19 nt, Homo sapiens
acgaaugguuaucuuacga

SEQ ID NO: 696261 - RNA, 19 nt, Homo sapiens
ccgaagaccacccacgaau

SEQ ID NO: 696262 - RNA, 19 nt, Homo sapiens
cccaagaguugcggcguau

SEQ ID NO: 696263 - RNA, 19 nt, Homo sapiens
gagaagguagacaauugca

SEQ ID NO: 696264 - RNA, 19 nt, Homo sapiens
gaccgagaagguagacaau

SEQ ID NO: 696265 - RNA, 19 nt, Homo sapiens
gauauggaucgcccaagag

SEQ ID NO: 696266 - RNA, 19 nt, Homo sapiens
aaagcaaccuucugaugua

SEQ ID NO: 696267 - RNA, 19 nt, Homo sapiens
agacagagccacaagguaa

SEQ ID NO: 696268 - RNA, 19 nt, Homo sapiens
gcaaagcaaccuucugaug

SEQ ID NO: 696269 - RNA, 19 nt, Homo sapiens
ccgagaagguagacaauug

SEQ ID NO: 696270 - RNA, 19 nt, Homo sapiens
caaagcaaccuucugaugu

SEQ ID NO: 696271 - RNA, 19 nt, Homo sapiens
gaagaccacccacgaaugg

SEQ ID NO: 696272 - RNA, 19 nt, Homo sapiens
gcaaccuucugauguaagu

SEQ ID NO: 696273 - RNA, 19 nt, Homo sapiens
ucuuacgacuguuacguua

SEQ ID NO: 696274 - RNA, 19 nt, Homo sapiens
ugauguaaguucugagugu

SEQ ID NO: 696275 - RNA, 19 nt, Homo sapiens
gcccagcacccaugaguug

SEQ ID NO: 696276 - RNA, 19 nt, Homo sapiens
aagcaaccuucugauguaa

SEQ ID NO: 696277 - RNA, 19 nt, Homo sapiens
gguuaucuuacgacuguua

SEQ ID NO: 696278 - RNA, 19 nt, Homo sapiens
ccaguggguauuucucuuu

SEQ ID NO: 696279 - RNA, 19 nt, Homo sapiens
gccacaagguaauccugaa

SEQ ID NO: 696280 - RNA, 19 nt, Homo sapiens
cgacuguuacguuacauug

SEQ ID NO: 696281 - RNA, 19 nt, Homo sapiens
uuacgacuguuacguuaca

SEQ ID NO: 696282 - RNA, 19 nt, Homo sapiens
cagcacccaugaguuguga

SEQ ID NO: 696283 - RNA, 19 nt, Homo sapiens
cuaccucccuacagacaga

SEQ ID NO: 696284 - RNA, 19 nt, Homo sapiens
gccaggccuucaaccacua

SEQ ID NO: 696285 - RNA, 19 nt, Homo sapiens
cgaagaccacccacgaaug

SEQ ID NO: 696286 - RNA, 19 nt, Homo sapiens
augguuaucuuacgacugu

SEQ ID NO: 696287 - RNA, 19 nt, Homo sapiens
gauccuccaguggguauuu

SEQ ID NO: 696288 - RNA, 19 nt, Homo sapiens
gagugugaccgagaaggua

SEQ ID NO: 696289 - RNA, 19 nt, Homo sapiens
cuucugauguaaguucuga

SEQ ID NO: 696290 - RNA, 19 nt, Homo sapiens
ccacgaaugguuaucuuac

SEQ ID NO: 696291 - RNA, 19 nt, Homo sapiens
cagacagagccacaaggua

SEQ ID NO: 696292 - RNA, 19 nt, Homo sapiens
gagcccagcacccaugagu

SEQ ID NO: 696293 - RNA, 19 nt, Homo sapiens
guauuucucuuuugacaca

SEQ ID NO: 696294 - RNA, 19 nt, Homo sapiens
ugaccgagaagguagacaa

SEQ ID NO: 696295 - RNA, 19 nt, Homo sapiens
acgaaugguuaucuuacga

SEQ ID NO: 696296 - RNA, 19 nt, Homo sapiens
ccgaagaccacccacgaau

SEQ ID NO: 696297 - RNA, 19 nt, Homo sapiens
gauccccgcuuuucaucuu

SEQ ID NO: 696298 - RNA, 19 nt, Homo sapiens
gcuaccagauccccgcuuu

SEQ ID NO: 696299 - RNA, 19 nt, Homo sapiens
gacagagccacaagguaau

SEQ ID NO: 696300 - RNA, 19 nt, Homo sapiens
gcacccaugaguugugaca

SEQ ID NO: 696301 - RNA, 19 nt, Homo sapiens
gaccgagaagguagacaau

SEQ ID NO: 696302 - RNA, 19 nt, Homo sapiens
ugacaaaucaacacaaacc

SEQ ID NO: 696303 - RNA, 19 nt, Homo sapiens
gagaagguagacaauugca

SEQ ID NO: 696304 - RNA, 19 nt, Homo sapiens
aaagcaaccuucugaugua

SEQ ID NO: 696305 - RNA, 19 nt, Homo sapiens
ccgagaagguagacaauug

SEQ ID NO: 696306 - RNA, 19 nt, Homo sapiens
gcaaagcaaccuucugaug

SEQ ID NO: 696307 - RNA, 19 nt, Homo sapiens
caaagcaaccuucugaugu

SEQ ID NO: 696308 - RNA, 19 nt, Homo sapiens
gaagaccacccacgaaugg

SEQ ID NO: 696309 - RNA, 19 nt, Homo sapiens
agacagagccacaagguau

SEQ ID NO: 696310 - RNA, 19 nt, Homo sapiens
gcaaccuucugauguaagu

SEQ ID NO: 696311 - RNA, 19 nt, Homo sapiens
ucuuacgacuguuacguua

SEQ ID NO: 696312 - RNA, 19 nt, Homo sapiens
ugauguaaguucugagugu

SEQ ID NO: 696313 - RNA, 19 nt, Homo sapiens
aagcaaccuucugauguaa

SEQ ID NO: 696314 - RNA, 19 nt, Homo sapiens
gguuaucuuacgacuguua

SEQ ID NO: 696315 - RNA, 19 nt, Homo sapiens
cgacuguuacguuacauug

SEQ ID NO: 696316 - RNA, 19 nt, Homo sapiens
uuacgacuguuacguuaca

SEQ ID NO: 696317 - RNA, 19 nt, Homo sapiens
cuaccucccuacagacaga

SEQ ID NO: 696318 - RNA, 19 nt, Homo sapiens
gacagagccacaagguauu

SEQ ID NO: 696319 - RNA, 19 nt, Homo sapiens
cgaagaccacccacgaaug

SEQ ID NO: 696320 - RNA, 19 nt, Homo sapiens
augguuaucuuacgacugu

SEQ ID NO: 696321 - RNA, 19 nt, Homo sapiens
gagugugaccgagaaggua

SEQ ID NO: 696322 - RNA, 19 nt, Homo sapiens
cuucugauguaaguucuga

SEQ ID NO: 696323 - RNA, 19 nt, Homo sapiens
ccacgaaugguuaucuuac

SEQ ID NO: 696324 - RNA, 19 nt, Homo sapiens
cagacagagccacaaggua

SEQ ID NO: 696325 - RNA, 19 nt, Homo sapiens
ugaccgagaagguagacaa

SEQ ID NO: 696326 - RNA, 19 nt, Homo sapiens
acgaaugguuaucuuacga

SEQ ID NO: 696327 - RNA, 19 nt, Homo sapiens
ccgaagaccacccacgaau

SEQ ID NO: 696328 - RNA, 19 nt, Homo sapiens
acagagccacaagguauuu

SEQ ID NO: 696329 - RNA, 19 nt, Homo sapiens
gaccgagaagguagacaau

SEQ ID NO: 696330 - RNA, 19 nt, Homo sapiens
gagaagguagacaauugca

SEQ ID NO: 696331 - RNA, 19 nt, Homo sapiens
ggagaaagcuuauuaugga

SEQ ID NO: 696332 - RNA, 19 nt, Homo sapiens
ggacagacaucaucuuuga

SEQ ID NO: 696333 - RNA, 19 nt, Homo sapiens
gcaaguauauuaacaagga

SEQ ID NO: 696334 - RNA, 19 nt, Homo sapiens
guauaaaucuucugccuuu

SEQ ID NO: 696335 - RNA, 19 nt, Homo sapiens
uagaucagcuuuacagaua

SEQ ID NO: 696336 - RNA, 19 nt, Homo sapiens
caacuaaccugccuugaau

SEQ ID NO: 696337 - RNA, 19 nt, Homo sapiens
gggaauacgugcucacuuu

SEQ ID NO: 696338 - RNA, 19 nt, Homo sapiens
ccaccuggcuuucuccuua

SEQ ID NO: 696339 - RNA, 19 nt, Homo sapiens
caccaugccuggcuaauuu

SEQ ID NO: 696340 - RNA, 19 nt, Homo sapiens
caucugacauccuguguuu

SEQ ID NO: 696341 - RNA, 19 nt, Homo sapiens
gcagagccauucaguacaa

SEQ ID NO: 696342 - RNA, 19 nt, Homo sapiens
ggauccaucuuguaucauu

SEQ ID NO: 696343 - RNA, 19 nt, Homo sapiens
uuaaacaucugggauauga

SEQ ID NO: 696344 - RNA, 19 nt, Homo sapiens
gaaagguacccaguagaua

SEQ ID NO: 696345 - RNA, 19 nt, Homo sapiens
ccuaggcccuuucuauuaa

SEQ ID NO: 696346 - RNA, 19 nt, Homo sapiens
uaacaucucccacaagcua

SEQ ID NO: 696347 - RNA, 19 nt, Homo sapiens
gccaacaccuuucuuuaug

SEQ ID NO: 696348 - RNA, 19 nt, Homo sapiens
gauccaucuuguaucauua

SEQ ID NO: 696349 - RNA, 19 nt, Homo sapiens
cuaauucccuuacugcaaa

SEQ ID NO: 696350 - RNA, 19 nt, Homo sapiens
uaaaguggauccaucuugu

SEQ ID NO: 696351 - RNA, 19 nt, Homo sapiens
gacauccuguguuugguua

SEQ ID NO: 696352 - RNA, 19 nt, Homo sapiens
guggaaacuuguucucuuu

SEQ ID NO: 696353 - RNA, 19 nt, Homo sapiens
ccuggugccuuacgaauaa

SEQ ID NO: 696354 - RNA, 19 nt, Homo sapiens
ccacuguccuuccuaaaug

SEQ ID NO: 696355 - RNA, 19 nt, Homo sapiens
gcaaacccuaccuaauuua

SEQ ID NO: 696356 - RNA, 19 nt, Homo sapiens
ugacaaccuuuacaccuuu

SEQ ID NO: 696357 - RNA, 19 nt, Homo sapiens
uaaccugccuugaauuuua

SEQ ID NO: 696358 - RNA, 19 nt, Homo sapiens
gagaaagcuuauuauggaa

SEQ ID NO: 696359 - RNA, 19 nt, Homo sapiens
uacagcagcuuuacaguga

SEQ ID NO: 696360 - RNA, 19 nt, Homo sapiens
caccagcaccaaagaauua

SEQ ID NO: 696361 - RNA, 19 nt, Homo sapiens
ucaaguagcugggauuaca

SEQ ID NO: 696362 - RNA, 19 nt, Homo sapiens
gggagguccugaauucaaa

SEQ ID NO: 696363 - RNA, 19 nt, Homo sapiens
guucuauccuggugccuua

SEQ ID NO: 696364 - RNA, 19 nt, Homo sapiens
gucaagaagugaaguaugu

SEQ ID NO: 696365 - RNA, 19 nt, Homo sapiens
gcucuaacaucucccacaa

SEQ ID NO: 696366 - RNA, 19 nt, Homo sapiens
ggcaauuacugaaauagga

SEQ ID NO: 696367 - RNA, 19 nt, Homo sapiens
ggaaagguacccaguagau

SEQ ID NO: 696368 - RNA, 19 nt, Homo sapiens
gaaagcuuauuauggaaag

SEQ ID NO: 696369 - RNA, 19 nt, Homo sapiens
uaaguaagagucugaaguu

SEQ ID NO: 696370 - RNA, 19 nt, Homo sapiens
ugccauaacuaaugagaaa

SEQ ID NO: 696371 - RNA, 19 nt, Homo sapiens
aaagguacccaguagauaa

SEQ ID NO: 696372 - RNA, 19 nt, Homo sapiens
cagcagcuuuacagugaua

SEQ ID NO: 696373 - RNA, 19 nt, Homo sapiens
ugaaguaugucacccuuuc

SEQ ID NO: 696374 - RNA, 19 nt, Homo sapiens
ugcaaacccuaccuaauuu

SEQ ID NO: 696375 - RNA, 19 nt, Homo sapiens
caacuaacacccaugcuau

SEQ ID NO: 696376 - RNA, 19 nt, Homo sapiens
gauuuaagggacacuguua

SEQ ID NO: 696377 - RNA, 19 nt, Homo sapiens
cauauggcuuuaucuggua

SEQ ID NO: 696378 - RNA, 19 nt, Homo sapiens
acacuaagccaacaccuuu

SEQ ID NO: 696379 - RNA, 19 nt, Homo sapiens
ggacucggacuacgaaaug

SEQ ID NO: 696380 - RNA, 19 nt, Homo sapiens
ccaagaggcacaccaggua

SEQ ID NO: 696381 - RNA, 19 nt, Homo sapiens
ugacacugauccagauuug

SEQ ID NO: 696382 - RNA, 19 nt, Homo sapiens
gaagguggcaagaacaguu

SEQ ID NO: 696383 - RNA, 19 nt, Homo sapiens
gccagaagacggaccauuu

SEQ ID NO: 696384 - RNA, 19 nt, Homo sapiens
ugagaugccugacaaccuu

SEQ ID NO: 696385 - RNA, 19 nt, Homo sapiens
caacaccuuucuuuaugug

SEQ ID NO: 696386 - RNA, 19 nt, Homo sapiens
cuaaugagaaacuccuuua

SEQ ID NO: 696387 - RNA, 19 nt, Homo sapiens
uuagcagccucucuacaua

SEQ ID NO: 696388 - RNA, 19 nt, Homo sapiens
ucacagcaguggcuucuag

SEQ ID NO: 696389 - RNA, 19 nt, Homo sapiens
gcuuuacagugauaguuaa

SEQ ID NO: 696390 - RNA, 19 nt, Homo sapiens
guggauccaucuuguauca

SEQ ID NO: 696391 - RNA, 19 nt, Homo sapiens
gcuuucuccuuauuguuua

SEQ ID NO: 696392 - RNA, 19 nt, Homo sapiens
caggaaagguacccaguag

SEQ ID NO: 696393 - RNA, 19 nt, Homo sapiens
ccaaagugcugggauuaca

SEQ ID NO: 696394 - RNA, 19 nt, Homo sapiens
ggucugcuucuuccacuua

SEQ ID NO: 696395 - RNA, 19 nt, Homo sapiens
aaaugaaaccucagccuaa

SEQ ID NO: 696396 - RNA, 19 nt, Homo sapiens
gcaguucaccgaccucuuc

SEQ ID NO: 696397 - RNA, 19 nt, Homo sapiens
acagauguaguucuuguua

SEQ ID NO: 696398 - RNA, 19 nt, Homo sapiens
gaacuugugaauguaauug

SEQ ID NO: 696399 - RNA, 19 nt, Homo sapiens
acaccucucugaccaguga

SEQ ID NO: 696400 - RNA, 19 nt, Homo sapiens
caaagugcaaguucagauu

SEQ ID NO: 696401 - RNA, 19 nt, Homo sapiens
agacaggguuucaccaugu

SEQ ID NO: 696402 - RNA, 19 nt, Homo sapiens
cugggaaucuggugccaua

SEQ ID NO: 696403 - RNA, 19 nt, Homo sapiens
aaacuuaaccacugcuuau

SEQ ID NO: 696404 - RNA, 19 nt, Homo sapiens
gaucagcuuuacagauaca

SEQ ID NO: 696405 - RNA, 19 nt, Homo sapiens
cacaaucaguguucuguuc

SEQ ID NO: 696406 - RNA, 19 nt, Homo sapiens
ggcacaagcugaaggucaa

SEQ ID NO: 696407 - RNA, 19 nt, Homo sapiens
agugugaacuugugaaugu

SEQ ID NO: 696408 - RNA, 19 nt, Homo sapiens
cgugcucacuuucaacuuu

SEQ ID NO: 696409 - RNA, 19 nt, Homo sapiens
gagcacagaagcagagaug

SEQ ID NO: 696410 - RNA, 19 nt, Homo sapiens
ggagcgaguucugugaguu

SEQ ID NO: 696411 - RNA, 19 nt, Homo sapiens
ccaacaccuuucuuuaugu

SEQ ID NO: 696412 - RNA, 19 nt, Homo sapiens
gauggaguuucucuuguca

SEQ ID NO: 696413 - RNA, 19 nt, Homo sapiens
aaugaaaccucagccuaaa

SEQ ID NO: 696414 - RNA, 19 nt, Homo sapiens
ggaguuuagaucagcuuua

SEQ ID NO: 696415 - RNA, 19 nt, Homo sapiens
acacgguccucuucccuuu

SEQ ID NO: 696416 - RNA, 19 nt, Homo sapiens
gcacagauucccuuaacca

SEQ ID NO: 696417 - RNA, 19 nt, Homo sapiens
gcuauaauguacaaauugc

SEQ ID NO: 696418 - RNA, 19 nt, Homo sapiens
caucugacuuauugaacuu

SEQ ID NO: 696419 - RNA, 19 nt, Homo sapiens
caccaucccuuccuucauc

SEQ ID NO: 696420 - RNA, 19 nt, Homo sapiens
aagcagaccugacacugau

SEQ ID NO: 696421 - RNA, 19 nt, Homo sapiens
gaucagaggcuaaaaugaa

SEQ ID NO: 696422 - RNA, 19 nt, Homo sapiens
ccaagugauacaauucaua

SEQ ID NO: 696423 - RNA, 19 nt, Homo sapiens
ucaaaucucuaucuaucca

SEQ ID NO: 696424 - RNA, 19 nt, Homo sapiens
caaucaguguucuguucua

SEQ ID NO: 696425 - RNA, 19 nt, Homo sapiens
ggaaucuggugccauaacu

SEQ ID NO: 696426 - RNA, 19 nt, Homo sapiens
gcaauuacugaaauaggaa

SEQ ID NO: 696427 - RNA, 19 nt, Homo sapiens
gaauguaauugaucuuucc

SEQ ID NO: 696428 - RNA, 19 nt, Homo sapiens
ggacaugcuccaccacuuc

SEQ ID NO: 696429 - RNA, 19 nt, Homo sapiens
cagcacagauucccuuaac

SEQ ID NO: 696430 - RNA, 19 nt, Homo sapiens
guacaaauugcuauaugug

SEQ ID NO: 696431 - RNA, 19 nt, Homo sapiens
caaagcagcuacaauaaua

SEQ ID NO: 696432 - RNA, 19 nt, Homo sapiens
ggaaauacauaucgaauga

SEQ ID NO: 696433 - RNA, 19 nt, Homo sapiens
aaacugaacugcagaauuu

SEQ ID NO: 696434 - RNA, 19 nt, Homo sapiens
gcacuuaucucauuuaaca

SEQ ID NO: 696435 - RNA, 19 nt, Homo sapiens
caagaugacuuugacauua

SEQ ID NO: 696436 - RNA, 19 nt, Homo sapiens
gcuaauauauuccaacgua

SEQ ID NO: 696437 - RNA, 19 nt, Homo sapiens
gcucaaacccuguaaguua

SEQ ID NO: 696438 - RNA, 19 nt, Homo sapiens
uaacaaaacuggcucauua

SEQ ID NO: 696439 - RNA, 19 nt, Homo sapiens
gaacucugcuuacuaaugu

SEQ ID NO: 696440 - RNA, 19 nt, Homo sapiens
ggaaggacaucuguucuuu

SEQ ID NO: 696441 - RNA, 19 nt, Homo sapiens
gaaaucaugugcauauauc

SEQ ID NO: 696442 - RNA, 19 nt, Homo sapiens
caaccaaacugauccaaga

SEQ ID NO: 696443 - RNA, 19 nt, Homo sapiens
gaacagacauggaccuucu

SEQ ID NO: 696444 - RNA, 19 nt, Homo sapiens
gaucauguuuggcauuaaa

SEQ ID NO: 696445 - RNA, 19 nt, Homo sapiens
gaguuuggcugauuccuaa

SEQ ID NO: 696446 - RNA, 19 nt, Homo sapiens
ggacaggguuucaccaugu

SEQ ID NO: 696447 - RNA, 19 nt, Homo sapiens
gaagguuucuacaacauau

SEQ ID NO: 696448 - RNA, 19 nt, Homo sapiens
gaaaugcuguuccaaggau

SEQ ID NO: 696449 - RNA, 19 nt, Homo sapiens
gcucucaccugauagauga

SEQ ID NO: 696450 - RNA, 19 nt, Homo sapiens
gaacugggccaccuuguug

SEQ ID NO: 696451 - RNA, 19 nt, Homo sapiens
ccacugacauuaagcauuc

SEQ ID NO: 696452 - RNA, 19 nt, Homo sapiens
guucuugucuuuaggauga

SEQ ID NO: 696453 - RNA, 19 nt, Homo sapiens
caugaagggugaaauaguu

SEQ ID NO: 696454 - RNA, 19 nt, Homo sapiens
aagcuuggcugcucaguuu

SEQ ID NO: 696455 - RNA, 19 nt, Homo sapiens
ggacucaacauuacauuug

SEQ ID NO: 696456 - RNA, 19 nt, Homo sapiens
gcagauuauucuaaacuug

SEQ ID NO: 696457 - RNA, 19 nt, Homo sapiens
ggugaaaucugcucuguac

SEQ ID NO: 696458 - RNA, 19 nt, Homo sapiens
guucugagccaaauucuaa

SEQ ID NO: 696459 - RNA, 19 nt, Homo sapiens
gaaagggacuggaaaacuu

SEQ ID NO: 696460 - RNA, 19 nt, Homo sapiens
gaaaggaugguauugaauc

SEQ ID NO: 696461 - RNA, 19 nt, Homo sapiens
gaaacaagcaaaucaugga

SEQ ID NO: 696462 - RNA, 19 nt, Homo sapiens
ccugaaguuugcauuaaua

SEQ ID NO: 696463 - RNA, 19 nt, Homo sapiens
gaccguuucuuaacaauca

SEQ ID NO: 696464 - RNA, 19 nt, Homo sapiens
gaaguauacucaguucaau

SEQ ID NO: 696465 - RNA, 19 nt, Homo sapiens
uaucagacaugccauaaca

SEQ ID NO: 696466 - RNA, 19 nt, Homo sapiens
ggacguggauguggugguu

SEQ ID NO: 696467 - RNA, 19 nt, Homo sapiens
ccaaguuucauaccaaaua

SEQ ID NO: 696468 - RNA, 19 nt, Homo sapiens
gaaaucugcucuguacauc

SEQ ID NO: 696469 - RNA, 19 nt, Homo sapiens
uuaaacacgucccauuuga

SEQ ID NO: 696470 - RNA, 19 nt, Homo sapiens
ggagaagaauggaaauaac

SEQ ID NO: 696471 - RNA, 19 nt, Homo sapiens
gaaccuccgaguugcaaua

SEQ ID NO: 696472 - RNA, 19 nt, Homo sapiens
ucaaaucuaucgaucuuca

SEQ ID NO: 696473 - RNA, 19 nt, Homo sapiens
ggagugcaguggcucaaug

SEQ ID NO: 696474 - RNA, 19 nt, Homo sapiens
gaugaccguuucuuaacaa

SEQ ID NO: 696475 - RNA, 19 nt, Homo sapiens
gcccagagcauccuaagaa

SEQ ID NO: 696476 - RNA, 19 nt, Homo sapiens
gaauggaaauaaccgaaag

SEQ ID NO: 696477 - RNA, 19 nt, Homo sapiens
gguauugaaucuaaaccaa

SEQ ID NO: 696478 - RNA, 19 nt, Homo sapiens
uagaugcuauucuuucuga

SEQ ID NO: 696479 - RNA, 19 nt, Homo sapiens
uaagaaguauacucaguuc

SEQ ID NO: 696480 - RNA, 19 nt, Homo sapiens
cuaguccuguuuccaaaua

SEQ ID NO: 696481 - RNA, 19 nt, Homo sapiens
caugcuggcuguaugauug

SEQ ID NO: 696482 - RNA, 19 nt, Homo sapiens
gacauuaagcauuccauaa

SEQ ID NO: 696483 - RNA, 19 nt, Homo sapiens
ggaugaccguuucuuaaca

SEQ ID NO: 696484 - RNA, 19 nt, Homo sapiens
uggaugcacuuaucucauu

SEQ ID NO: 696485 - RNA, 19 nt, Homo sapiens
gcauguggcuaggugauga

SEQ ID NO: 696486 - RNA, 19 nt, Homo sapiens
ggaagucagugggaccauu

SEQ ID NO: 696487 - RNA, 19 nt, Homo sapiens
ugggaaggcuaauauauuc

SEQ ID NO: 696488 - RNA, 19 nt, Homo sapiens
cagcaugaagggugaaaua

SEQ ID NO: 696489 - RNA, 19 nt, Homo sapiens
ggaugcacuuaucucauuu

SEQ ID NO: 696490 - RNA, 19 nt, Homo sapiens
guggcuaggugaugaugua

SEQ ID NO: 696491 - RNA, 19 nt, Homo sapiens
ugaacuugauguuguggua

SEQ ID NO: 696492 - RNA, 19 nt, Homo sapiens
aaacuucucucagccaaga

SEQ ID NO: 696493 - RNA, 19 nt, Homo sapiens
caucuguucuuugguguaa

SEQ ID NO: 696494 - RNA, 19 nt, Homo sapiens
ugccaaagcagcuacaaua

SEQ ID NO: 696495 - RNA, 19 nt, Homo sapiens
cauccaagcugcgaaacuu

SEQ ID NO: 696496 - RNA, 19 nt, Homo sapiens
ucucaaaucuaucgaucuu

SEQ ID NO: 696497 - RNA, 19 nt, Homo sapiens
guacccuuguucaaagaua

SEQ ID NO: 696498 - RNA, 19 nt, Homo sapiens
gaacaccugugaucaaccu

SEQ ID NO: 696499 - RNA, 19 nt, Homo sapiens
ccgaucauguuuggcauua

SEQ ID NO: 696500 - RNA, 19 nt, Homo sapiens
uguaaucucucauggugaa

SEQ ID NO: 696501 - RNA, 19 nt, Homo sapiens
ggaaucggugguggaauua

SEQ ID NO: 696502 - RNA, 19 nt, Homo sapiens
gaaauuuggccaaggaaag

SEQ ID NO: 696503 - RNA, 19 nt, Homo sapiens
gaagccugauaucaugauu

SEQ ID NO: 696504 - RNA, 19 nt, Homo sapiens
acaagcaaaucauggagaa

SEQ ID NO: 696505 - RNA, 19 nt, Homo sapiens
auacucaguucaauccuaa

SEQ ID NO: 696506 - RNA, 19 nt, Homo sapiens
guuaagaaguauacucagu

SEQ ID NO: 696507 - RNA, 19 nt, Homo sapiens
ccugaagccugauaucaug

SEQ ID NO: 696508 - RNA, 19 nt, Homo sapiens
aggaugguauugaaucuaa

SEQ ID NO: 696509 - RNA, 19 nt, Homo sapiens
gcugggauaucacuucauc

SEQ ID NO: 696510 - RNA, 19 nt, Homo sapiens
aaacgaaacaagcaaauca

SEQ ID NO: 696511 - RNA, 19 nt, Homo sapiens
aggaaucggugguggaauu

SEQ ID NO: 696512 - RNA, 19 nt, Homo sapiens
agacaaugauggcaacugu

SEQ ID NO: 696513 - RNA, 19 nt, Homo sapiens
ggaacucuguggaccuuag

SEQ ID NO: 696514 - RNA, 19 nt, Homo sapiens
gaaggaauugugcugcauu

SEQ ID NO: 696515 - RNA, 19 nt, Homo sapiens
ggaccaugaucgcauccuu

SEQ ID NO: 696516 - RNA, 19 nt, Homo sapiens
gaagucagugggaccauug

SEQ ID NO: 696517 - RNA, 19 nt, Homo sapiens
uagugaagcugccagaugu

SEQ ID NO: 696518 - RNA, 19 nt, Homo sapiens
cucccaaggugcuggauua

SEQ ID NO: 696519 - RNA, 19 nt, Homo sapiens
gccaaagcagcuacaauaa

SEQ ID NO: 696520 - RNA, 19 nt, Homo sapiens
gauugaacaagaugacuuu

SEQ ID NO: 696521 - RNA, 19 nt, Homo sapiens
uugaaaggaugguauugaa

SEQ ID NO: 696522 - RNA, 19 nt, Homo sapiens
gaaggacaucuguucuuug

SEQ ID NO: 696523 - RNA, 19 nt, Homo sapiens
ccaaagcagcuacaauaau

SEQ ID NO: 696524 - RNA, 19 nt, Homo sapiens
gaauuauccaucagcauga

SEQ ID NO: 696525 - RNA, 19 nt, Homo sapiens
cuaccaaguuucauaccaa

SEQ ID NO: 696526 - RNA, 19 nt, Homo sapiens
uugcauugcuaccaaguuu

SEQ ID NO: 696527 - RNA, 19 nt, Homo sapiens
acugaaggacucaacauua

SEQ ID NO: 696528 - RNA, 19 nt, Homo sapiens
ucugaugucuucuuacuag

SEQ ID NO: 696529 - RNA, 19 nt, Homo sapiens
caacacgcaggaucuacua

SEQ ID NO: 696530 - RNA, 19 nt, Homo sapiens
aaagagaugguucgaguga

SEQ ID NO: 696531 - RNA, 19 nt, Homo sapiens
gaggagaucaucaacuuua

SEQ ID NO: 696532 - RNA, 19 nt, Homo sapiens
ggacaccgcuaucaaagug

SEQ ID NO: 696533 - RNA, 19 nt, Homo sapiens
gagcagaugugucauugug

SEQ ID NO: 696534 - RNA, 19 nt, Homo sapiens
gggaggagaucaucaacuu

SEQ ID NO: 696535 - RNA, 19 nt, Homo sapiens
gcagaugugucauuguguu

SEQ ID NO: 696536 - RNA, 19 nt, Homo sapiens
uaacugugauuaggagaua

SEQ ID NO: 696537 - RNA, 19 nt, Homo sapiens
gacuacaucuuccucauug

SEQ ID NO: 696538 - RNA, 19 nt, Homo sapiens
guagauagccacucacaug

SEQ ID NO: 696539 - RNA, 19 nt, Homo sapiens
aaacugccauccaaucuau

SEQ ID NO: 696540 - RNA, 19 nt, Homo sapiens
acaagcagguggagcagua

SEQ ID NO: 696541 - RNA, 19 nt, Homo sapiens
gaacaccacacccuggauu

SEQ ID NO: 696542 - RNA, 19 nt, Homo sapiens
gaucaucaacuuuaacugu

SEQ ID NO: 696543 - RNA, 19 nt, Homo sapiens
gcuccaaacugccauccaa

SEQ ID NO: 696544 - RNA, 19 nt, Homo sapiens
ucaacaacauggugaacaa

SEQ ID NO: 696545 - RNA, 19 nt, Homo sapiens
gucaacaaauucucccuaa

SEQ ID NO: 696546 - RNA, 19 nt, Homo sapiens
agcaagaucuguauaugaa

SEQ ID NO: 696547 - RNA, 19 nt, Homo sapiens
aaacguagcaagaucugua

SEQ ID NO: 696548 - RNA, 19 nt, Homo sapiens
gcaggcaggucccaaaugc

SEQ ID NO: 696549 - RNA, 19 nt, Homo sapiens
cggaagacauccucagguu

SEQ ID NO: 696550 - RNA, 19 nt, Homo sapiens
guacauguccuuucacaag

SEQ ID NO: 696551 - RNA, 19 nt, Homo sapiens
cgugugcggucuaguuuaa

SEQ ID NO: 696552 - RNA, 19 nt, Homo sapiens
guagcaagaucuguauaug

SEQ ID NO: 696553 - RNA, 19 nt, Homo sapiens
gaagacauccucagguucu

SEQ ID NO: 696554 - RNA, 19 nt, Homo sapiens
ggacuacaucuuccucauu

SEQ ID NO: 696555 - RNA, 19 nt, Homo sapiens
ggagauauaccaauaacag

SEQ ID NO: 696556 - RNA, 19 nt, Homo sapiens
gaagaggacgccaggacuu

SEQ ID NO: 696557 - RNA, 19 nt, Homo sapiens
ccacugagcacgccagaga

SEQ ID NO: 696558 - RNA, 19 nt, Homo sapiens
gagaucauccagcagauug

SEQ ID NO: 696559 - RNA, 19 nt, Homo sapiens
cuacagugacuucagauuu

SEQ ID NO: 696560 - RNA, 19 nt, Homo sapiens
ucaacuaccaggagaauga

SEQ ID NO: 696561 - RNA, 19 nt, Homo sapiens
gcugguucaugguagauuu

SEQ ID NO: 696562 - RNA, 19 nt, Homo sapiens
caacaaauucucccuaagg

SEQ ID NO: 696563 - RNA, 19 nt, Homo sapiens
ccauguagauagccacuca

SEQ ID NO: 696564 - RNA, 19 nt, Homo sapiens
uagagcagaugugucauug

SEQ ID NO: 696565 - RNA, 19 nt, Homo sapiens
gaaaagcugguucauggua

SEQ ID NO: 696566 - RNA, 19 nt, Homo sapiens
caaaagacagcagaaaaua

SEQ ID NO: 696567 - RNA, 19 nt, Homo sapiens
caaacugccauccaaucua

SEQ ID NO: 696568 - RNA, 19 nt, Homo sapiens
uagcaagaucuguauauga

SEQ ID NO: 696569 - RNA, 19 nt, Homo sapiens
gucauuguguucauuuaga

SEQ ID NO: 696570 - RNA, 19 nt, Homo sapiens
ggaggagaucaucaacuuu

SEQ ID NO: 696571 - RNA, 19 nt, Homo sapiens
ggacaacacagagaucauc

SEQ ID NO: 696572 - RNA, 19 nt, Homo sapiens
ugacguccaugcugaccaa

SEQ ID NO: 696573 - RNA, 19 nt, Homo sapiens
gggcaucaccuucuucaag

SEQ ID NO: 696574 - RNA, 19 nt, Homo sapiens
ugaccaagcugcguuucga

SEQ ID NO: 696575 - RNA, 19 nt, Homo sapiens
cuaguuuaaucccauguug

SEQ ID NO: 696576 - RNA, 19 nt, Homo sapiens
gaaggcaccauuggcaaga

SEQ ID NO: 696577 - RNA, 19 nt, Homo sapiens
ggagcaggcaggucccaaa

SEQ ID NO: 696578 - RNA, 19 nt, Homo sapiens
ccagguauucuuagagcua

SEQ ID NO: 696579 - RNA, 19 nt, Homo sapiens
gauguucggcagccagaaa

SEQ ID NO: 696580 - RNA, 19 nt, Homo sapiens
gagcguggacaacuucaau

SEQ ID NO: 696581 - RNA, 19 nt, Homo sapiens
caugguagauuucauuucc

SEQ ID NO: 696582 - RNA, 19 nt, Homo sapiens
guucaugguagauuucauu

SEQ ID NO: 696583 - RNA, 19 nt, Homo sapiens
aacaaauucucccuaagga

SEQ ID NO: 696584 - RNA, 19 nt, Homo sapiens
guagagccauguagauagc

SEQ ID NO: 696585 - RNA, 19 nt, Homo sapiens
ggaccgcauuggcaagaag

SEQ ID NO: 696586 - RNA, 19 nt, Homo sapiens
cgacggcuccuacuuugga

SEQ ID NO: 696587 - RNA, 19 nt, Homo sapiens
aggagaucaucaacuuuaa

SEQ ID NO: 696588 - RNA, 19 nt, Homo sapiens
gugucauuguguucauuua

SEQ ID NO: 696589 - RNA, 19 nt, Homo sapiens
aaaccacacacaccagaaa

SEQ ID NO: 696590 - RNA, 19 nt, Homo sapiens
cgacuugguccucaacuuc

SEQ ID NO: 696591 - RNA, 19 nt, Homo sapiens
gagcaguacauguccuuuc

SEQ ID NO: 696592 - RNA, 19 nt, Homo sapiens
gaucauggacgaggaagag

SEQ ID NO: 696593 - RNA, 19 nt, Homo sapiens
gagcaggcaggucccaaau

SEQ ID NO: 696594 - RNA, 19 nt, Homo sapiens
gaucugggcugggcaaccu

SEQ ID NO: 696595 - RNA, 19 nt, Homo sapiens
ggaagcugguggccuccau

SEQ ID NO: 696596 - RNA, 19 nt, Homo sapiens
gaacaggagagggucaagu

SEQ ID NO: 696597 - RNA, 19 nt, Homo sapiens
gcguggacaacuucaauga

SEQ ID NO: 696598 - RNA, 19 nt, Homo sapiens
uacagugacuucagauuuu

SEQ ID NO: 696599 - RNA, 19 nt, Homo sapiens
caguacauguccuuucaca

SEQ ID NO: 696600 - RNA, 19 nt, Homo sapiens
auaaccagguauucuuaga

SEQ ID NO: 696601 - RNA, 19 nt, Homo sapiens
gagauauaccaauaacagu

SEQ ID NO: 696602 - RNA, 19 nt, Homo sapiens
gauggugggaaaccugauu

SEQ ID NO: 696603 - RNA, 19 nt, Homo sapiens
uaggagauauaccaauaac

SEQ ID NO: 696604 - RNA, 19 nt, Homo sapiens
augaggugcuggaggagua

SEQ ID NO: 696605 - RNA, 19 nt, Homo sapiens
gcaacaaggagaccaagcu

SEQ ID NO: 696606 - RNA, 19 nt, Homo sapiens
gagaucaucaacuuuaacu

SEQ ID NO: 696607 - RNA, 19 nt, Homo sapiens
gcuacgccauguucauugg

SEQ ID NO: 696608 - RNA, 19 nt, Homo sapiens
ucucccgccucauucgaua

SEQ ID NO: 696609 - RNA, 19 nt, Homo sapiens
aaagcugguucaugguaga

SEQ ID NO: 696610 - RNA, 19 nt, Homo sapiens
gaugugucauuguguucau

SEQ ID NO: 696611 - RNA, 19 nt, Homo sapiens
ccuucuuccuucagguuua

SEQ ID NO: 696612 - RNA, 19 nt, Homo sapiens
ucccucuucuuucuucuuu

SEQ ID NO: 696613 - RNA, 19 nt, Homo sapiens
ccucaacuccggcgucuuc

SEQ ID NO: 696614 - RNA, 19 nt, Homo sapiens
gcaagaagaacuccauccu

SEQ ID NO: 696615 - RNA, 19 nt, Homo sapiens
ucaacaaauucucccuaag

SEQ ID NO: 696616 - RNA, 19 nt, Homo sapiens
ucaccaagggcaacaagga

SEQ ID NO: 696617 - RNA, 19 nt, Homo sapiens
ggagggagggaggcaagaa

SEQ ID NO: 696618 - RNA, 19 nt, Homo sapiens
gaggacaacacagagauca

SEQ ID NO: 696619 - RNA, 19 nt, Homo sapiens
gcaagaucuguauaugaau

SEQ ID NO: 696620 - RNA, 19 nt, Homo sapiens
ccugcgaccuugggagaaa

SEQ ID NO: 696621 - RNA, 19 nt, Homo sapiens
gagcauccugggcgagcua

SEQ ID NO: 696622 - RNA, 19 nt, Homo sapiens
ggcagcgcauccacgacua

SEQ ID NO: 696623 - RNA, 19 nt, Homo sapiens
ggaucgugguggaggacaa

SEQ ID NO: 696624 - RNA, 19 nt, Homo sapiens
cacccuggauugucuucaa

SEQ ID NO: 696625 - RNA, 19 nt, Homo sapiens
acacgugugcggucuaguu

SEQ ID NO: 696626 - RNA, 19 nt, Homo sapiens
ccaaacugccauccaaucu

SEQ ID NO: 696627 - RNA, 19 nt, Homo sapiens
ugaccaugcugcugcugau

SEQ ID NO: 696628 - RNA, 19 nt, Homo sapiens
ccgccucauucgauauauu

SEQ ID NO: 696629 - RNA, 19 nt, Homo sapiens
cagguauucuuagagcuau

SEQ ID NO: 696630 - RNA, 19 nt, Homo sapiens
gcgcauccacgacuacuac

SEQ ID NO: 696631 - RNA, 19 nt, Homo sapiens
guagaacacuaauauugug

SEQ ID NO: 696632 - RNA, 19 nt, Homo sapiens
cauaucagauucacauuca

SEQ ID NO: 696633 - RNA, 19 nt, Homo sapiens
gcuguuccaugacugauuu

SEQ ID NO: 696634 - RNA, 19 nt, Homo sapiens
gaagagcuuuggaagucaa

SEQ ID NO: 696635 - RNA, 19 nt, Homo sapiens
gcuaagacaagagcaaaua

SEQ ID NO: 696636 - RNA, 19 nt, Homo sapiens
aaagaagcauucagugaug

SEQ ID NO: 696637 - RNA, 19 nt, Homo sapiens
ggacagucaucuauaucug

SEQ ID NO: 696638 - RNA, 19 nt, Homo sapiens
uggcagagcuuuaucacau

SEQ ID NO: 696639 - RNA, 19 nt, Homo sapiens
caaagaagcauucagugau

SEQ ID NO: 696640 - RNA, 19 nt, Homo sapiens
ggacagaugcccacugaag

SEQ ID NO: 696641 - RNA, 19 nt, Homo sapiens
gcagagcuuuaucacaugu

SEQ ID NO: 696642 - RNA, 19 nt, Homo sapiens
ucaaagaagcauucaguga

SEQ ID NO: 696643 - RNA, 19 nt, Homo sapiens
gaauacauacggacaguca

SEQ ID NO: 696644 - RNA, 19 nt, Homo sapiens
aaaccacagugaucucuau

SEQ ID NO: 696645 - RNA, 19 nt, Homo sapiens
ccacagugaucucuauuuu

SEQ ID NO: 696646 - RNA, 19 nt, Homo sapiens
gguagaacacuaauauugu

SEQ ID NO: 696647 - RNA, 19 nt, Homo sapiens
gagcaaggagucugugaga

SEQ ID NO: 696648 - RNA, 19 nt, Homo sapiens
ggaagucaaagaagcauuc

SEQ ID NO: 696649 - RNA, 19 nt, Homo sapiens
cugaagagcuuuggaaguc

SEQ ID NO: 696650 - RNA, 19 nt, Homo sapiens
gaaaccacagugaucucua

SEQ ID NO: 696651 - RNA, 19 nt, Homo sapiens
uuugagugcucuuugcuaa

SEQ ID NO: 696652 - RNA, 19 nt, Homo sapiens
ccuuccagcucccacauaa

SEQ ID NO: 696653 - RNA, 19 nt, Homo sapiens
gagacucugugggcuagaa

SEQ ID NO: 696654 - RNA, 19 nt, Homo sapiens
caagagcaaauacccaaug

SEQ ID NO: 696655 - RNA, 19 nt, Homo sapiens
ccacugaagagcuuuggaa

SEQ ID NO: 696656 - RNA, 19 nt, Homo sapiens
gacagaugcccacugaaga

SEQ ID NO: 696657 - RNA, 19 nt, Homo sapiens
gagcuuuaucacauguuua

SEQ ID NO: 696658 - RNA, 19 nt, Homo sapiens
ugguagaacacuaauauug

SEQ ID NO: 696659 - RNA, 19 nt, Homo sapiens
ccugguagaacacuaauau

SEQ ID NO: 696660 - RNA, 19 nt, Homo sapiens
uacggacagucaucuauau

SEQ ID NO: 696661 - RNA, 19 nt, Homo sapiens
agagcuuuaucacauguuu

SEQ ID NO: 696662 - RNA, 19 nt, Homo sapiens
ggcagagcuuuaucacaug

SEQ ID NO: 696663 - RNA, 19 nt, Homo sapiens
gaugcccacugaagagcuu

SEQ ID NO: 696664 - RNA, 19 nt, Homo sapiens
caaaugcugcgcaaaauug

SEQ ID NO: 696665 - RNA, 19 nt, Homo sapiens
gucaagacaagauuuacaa

SEQ ID NO: 696666 - RNA, 19 nt, Homo sapiens
auacggacagucaucuaua

SEQ ID NO: 696667 - RNA, 19 nt, Homo sapiens
cacauucaguccucagcaa

SEQ ID NO: 696668 - RNA, 19 nt, Homo sapiens
uagaauacauacggacagu

SEQ ID NO: 696669 - RNA, 19 nt, Homo sapiens
ggguuaccauaucagauuc

SEQ ID NO: 696670 - RNA, 19 nt, Homo sapiens
caagacaagauuuacaaac

SEQ ID NO: 696671 - RNA, 19 nt, Homo sapiens
ugaagagcuuuggaaguca

SEQ ID NO: 696672 - RNA, 19 nt, Homo sapiens
uggguuaccauaucagauu

SEQ ID NO: 696673 - RNA, 19 nt, Homo sapiens
ucucagaagugcggagcaa

SEQ ID NO: 696674 - RNA, 19 nt, Homo sapiens
uuccaugacugauuugagu

SEQ ID NO: 696675 - RNA, 19 nt, Homo sapiens
cauacggacagucaucuau

SEQ ID NO: 696676 - RNA, 19 nt, Homo sapiens
ucugugggcuagaauacau

SEQ ID NO: 696677 - RNA, 19 nt, Homo sapiens
ccauaucagauucacauuc

SEQ ID NO: 696678 - RNA, 19 nt, Homo sapiens
gaagucaaagaagcauuca

SEQ ID NO: 696679 - RNA, 19 nt, Homo sapiens
uguccuauuugccaucuca

SEQ ID NO: 696680 - RNA, 19 nt, Homo sapiens
acgcguggguuaccauauc

SEQ ID NO: 696681 - RNA, 19 nt, Homo sapiens
aagagcaaauacccaaugg

SEQ ID NO: 696682 - RNA, 19 nt, Homo sapiens
acagugaucucuauuuucu

SEQ ID NO: 696683 - RNA, 19 nt, Homo sapiens
uaccauaucagauucacau

SEQ ID NO: 696684 - RNA, 19 nt, Homo sapiens
ccuauuugccaucucagaa

SEQ ID NO: 696685 - RNA, 19 nt, Homo sapiens
aagaagcauucagugaugu

SEQ ID NO: 696686 - RNA, 19 nt, Homo sapiens
gaagcauucagugauguca

SEQ ID NO: 696687 - RNA, 19 nt, Homo sapiens
agucaaagaagcauucagu

SEQ ID NO: 696688 - RNA, 19 nt, Homo sapiens
gaauaaauguguuggguuu

SEQ ID NO: 696689 - RNA, 19 nt, Homo sapiens
uaacugaaaugccugcuuu

SEQ ID NO: 696690 - RNA, 19 nt, Homo sapiens
gaacacauuucucugaucu

SEQ ID NO: 696691 - RNA, 19 nt, Homo sapiens
gcaacugucucucuucuca

SEQ ID NO: 696692 - RNA, 19 nt, Homo sapiens
ugaaaugccugcuuugaau

SEQ ID NO: 696693 - RNA, 19 nt, Homo sapiens
gaaaugccugcuuugaaua

SEQ ID NO: 696694 - RNA, 19 nt, Homo sapiens
gcaguuacgugcaaagcuu

SEQ ID NO: 696695 - RNA, 19 nt, Homo sapiens
gugaagugcuuggaacaua

SEQ ID NO: 696696 - RNA, 19 nt, Homo sapiens
gucaauggcuuguucauca

SEQ ID NO: 696697 - RNA, 19 nt, Homo sapiens
ggagaagagcgcaguguuu

SEQ ID NO: 696698 - RNA, 19 nt, Homo sapiens
ggacuuggcccuauuuaag

SEQ ID NO: 696699 - RNA, 19 nt, Homo sapiens
gaaccauggugaagugcuu

SEQ ID NO: 696700 - RNA, 19 nt, Homo sapiens
gcaggaaaccgaguagaaa

SEQ ID NO: 696701 - RNA, 19 nt, Homo sapiens
gcacagcagcuuauaaugg

SEQ ID NO: 696702 - RNA, 19 nt, Homo sapiens
gaaaacacuugaaaucuca

SEQ ID NO: 696703 - RNA, 19 nt, Homo sapiens
ucucugaucuccauaaaca

SEQ ID NO: 696704 - RNA, 19 nt, Homo sapiens
uuacagagcgcaccucaaa

SEQ ID NO: 696705 - RNA, 19 nt, Homo sapiens
gaaggacuuggcccuauuu

SEQ ID NO: 696706 - RNA, 19 nt, Homo sapiens
gaggagaacaugaguagau

SEQ ID NO: 696707 - RNA, 19 nt, Homo sapiens
gcaauaacagcugcaauuc

SEQ ID NO: 696708 - RNA, 19 nt, Homo sapiens
cuggaaaccucaucaagga

SEQ ID NO: 696709 - RNA, 19 nt, Homo sapiens
ugaaggacuuggcccuauu

SEQ ID NO: 696710 - RNA, 19 nt, Homo sapiens
cuugagggcugcaguucua

SEQ ID NO: 696711 - RNA, 19 nt, Homo sapiens
gcaccggagugucuggaau

SEQ ID NO: 696712 - RNA, 19 nt, Homo sapiens
uauagucaauggcuuguuc

SEQ ID NO: 696713 - RNA, 19 nt, Homo sapiens
ggauagacgaguugauuuc

SEQ ID NO: 696714 - RNA, 19 nt, Homo sapiens
gagaacaugaguagauaau

SEQ ID NO: 696715 - RNA, 19 nt, Homo sapiens
ggagaacaugaguagauaa

SEQ ID NO: 696716 - RNA, 19 nt, Homo sapiens
aaaaccaucuugugucuuu

SEQ ID NO: 696717 - RNA, 19 nt, Homo sapiens
aggagaacaugaguagaua

SEQ ID NO: 696718 - RNA, 19 nt, Homo sapiens
gaugccaguuacuugcuuu

SEQ ID NO: 696719 - RNA, 19 nt, Homo sapiens
gcugcaggcuuugccauug

SEQ ID NO: 696720 - RNA, 19 nt, Homo sapiens
cggaggaugaugccaguua

SEQ ID NO: 696721 - RNA, 19 nt, Homo sapiens
gcgcugagacugugcuguu

SEQ ID NO: 696722 - RNA, 19 nt, Homo sapiens
cagcuggccuuuguaagug

SEQ ID NO: 696723 - RNA, 19 nt, Homo sapiens
uagcacagcagcuuauaau

SEQ ID NO: 696724 - RNA, 19 nt, Homo sapiens
ggaggaugaugccaguuac

SEQ ID NO: 696725 - RNA, 19 nt, Homo sapiens
cggagugucuggaauugug

SEQ ID NO: 696726 - RNA, 19 nt, Homo sapiens
cuagggagacgccauguga

SEQ ID NO: 696727 - RNA, 19 nt, Homo sapiens
ggaugaugccaguuacuug

SEQ ID NO: 696728 - RNA, 19 nt, Homo sapiens
ggagaacucuggcuuuugg

SEQ ID NO: 696729 - RNA, 19 nt, Homo sapiens
ggacagcuuccuccuacug

SEQ ID NO: 696730 - RNA, 19 nt, Homo sapiens
gggaggagaacaugaguag

SEQ ID NO: 696731 - RNA, 19 nt, Homo sapiens
aauuguggcuauccugauu

SEQ ID NO: 696732 - RNA, 19 nt, Homo sapiens
gcucugcaguccuacucaa

SEQ ID NO: 696733 - RNA, 19 nt, Homo sapiens
gguucaaggucacuguuuc

SEQ ID NO: 696734 - RNA, 19 nt, Homo sapiens
uggaggugcugcuuaauac

SEQ ID NO: 696735 - RNA, 19 nt, Homo sapiens
cuuuggaggugcugcuuaa

SEQ ID NO: 696736 - RNA, 19 nt, Homo sapiens
acuguucacucacucuaaa

SEQ ID NO: 696737 - RNA, 19 nt, Homo sapiens
aaaugugacccuccaaaug

SEQ ID NO: 696738 - RNA, 19 nt, Homo sapiens
acucggcucugcaguccua

SEQ ID NO: 696739 - RNA, 19 nt, Homo sapiens
gagaagagcgcaguguuuu

SEQ ID NO: 696740 - RNA, 19 nt, Homo sapiens
aaaugccugcuuugaauaa

SEQ ID NO: 696741 - RNA, 19 nt, Homo sapiens
ugaagugcuuggaacauac

SEQ ID NO: 696742 - RNA, 19 nt, Homo sapiens
gaaaaugugacccuccaaa

SEQ ID NO: 696743 - RNA, 19 nt, Homo sapiens
cagcugcaauucccuggau

SEQ ID NO: 696744 - RNA, 19 nt, Homo sapiens
cuacugacauaucuacacu

SEQ ID NO: 696745 - RNA, 19 nt, Homo sapiens
ccagcuggccuuuguaagu

SEQ ID NO: 696746 - RNA, 19 nt, Homo sapiens
ugucuggaauuguggcuau

SEQ ID NO: 696747 - RNA, 19 nt, Homo sapiens
acugacauaucuacacuuc

SEQ ID NO: 696748 - RNA, 19 nt, Homo sapiens
ugugaaccauggugaagug

SEQ ID NO: 696749 - RNA, 19 nt, Homo sapiens
gagggaggaggaagaggaa

SEQ ID NO: 696750 - RNA, 19 nt, Homo sapiens
gguggagaacucuggcuuu

SEQ ID NO: 696751 - RNA, 19 nt, Homo sapiens
auccagauguggcuacuga

SEQ ID NO: 696752 - RNA, 19 nt, Homo sapiens
agacugugcuguuguucuc

SEQ ID NO: 696753 - RNA, 19 nt, Homo sapiens
auacuugccaucagugaaa

SEQ ID NO: 696754 - RNA, 19 nt, Homo sapiens
ucaauggcuuguucaucau

SEQ ID NO: 696755 - RNA, 19 nt, Homo sapiens
guugagggccaaaauauuu

SEQ ID NO: 696756 - RNA, 19 nt, Homo sapiens
cuaaaggcgcugagacugu

SEQ ID NO: 696757 - RNA, 19 nt, Homo sapiens
gaaaccgaguagaaaaugu

SEQ ID NO: 696758 - RNA, 19 nt, Homo sapiens
cugaaaugccugcuuugaa

SEQ ID NO: 696759 - RNA, 19 nt, Homo sapiens
gggacagaguagccagguu

SEQ ID NO: 696760 - RNA, 19 nt, Homo sapiens
uuggaggugcugcuuaaua

SEQ ID NO: 696761 - RNA, 19 nt, Homo sapiens
ugaaaacacuugaaaucuc

SEQ ID NO: 696762 - RNA, 19 nt, Homo sapiens
cugagacugugcuguuguu

SEQ ID NO: 696763 - RNA, 19 nt, Homo sapiens
ccaguuacuugcuuuaccu

SEQ ID NO: 696764 - RNA, 19 nt, Homo sapiens
acauuucucugaucuccau

SEQ ID NO: 696765 - RNA, 19 nt, Homo sapiens
gaauuguggcuauccugau

SEQ ID NO: 696766 - RNA, 19 nt, Homo sapiens
uaaugacgaggaaccgaaa

SEQ ID NO: 696767 - RNA, 19 nt, Homo sapiens
guggagaacucuggcuuuu

SEQ ID NO: 696768 - RNA, 19 nt, Homo sapiens
cagcuagugcucucuggaa

SEQ ID NO: 696769 - RNA, 19 nt, Homo sapiens
guuacuugcuuuaccuuuu

SEQ ID NO: 696770 - RNA, 19 nt, Homo sapiens
agagcgcaccucaaacgua

SEQ ID NO: 696771 - RNA, 19 nt, Homo sapiens
ugccugcuuugaauaaaug

SEQ ID NO: 696772 - RNA, 19 nt, Homo sapiens
aaugugacccuccaaaugg

SEQ ID NO: 696773 - RNA, 19 nt, Homo sapiens
uggauagacgaguugauuu

SEQ ID NO: 696774 - RNA, 19 nt, Homo sapiens
uauuuggaaugaaggacuu

SEQ ID NO: 696775 - RNA, 19 nt, Homo sapiens
gcaccucaaacguacaagu

SEQ ID NO: 696776 - RNA, 19 nt, Homo sapiens
uuucucugaucuccauaaa

SEQ ID NO: 696777 - RNA, 19 nt, Homo sapiens
caccggagugucuggaauu

SEQ ID NO: 696778 - RNA, 19 nt, Homo sapiens
cuggauagacgaguugauu

SEQ ID NO: 696779 - RNA, 19 nt, Homo sapiens
cgcccugucuaaaguguau

SEQ ID NO: 696780 - RNA, 19 nt, Homo sapiens
gcgcaccucaaacguacaa

SEQ ID NO: 696781 - RNA, 19 nt, Homo sapiens
cuagcacagcagcuuauaa

SEQ ID NO: 696782 - RNA, 19 nt, Homo sapiens
gcuggcuccugauccacuu

SEQ ID NO: 696783 - RNA, 19 nt, Homo sapiens
ucaaacguacaagucagua

SEQ ID NO: 696784 - RNA, 19 nt, Homo sapiens
gaucuccauaaacaugaaa

SEQ ID NO: 696785 - RNA, 19 nt, Homo sapiens
ugaucuccauaaacaugaa

SEQ ID NO: 696786 - RNA, 19 nt, Homo sapiens
gcuuugccauugugaacca

SEQ ID NO: 696787 - RNA, 19 nt, Homo sapiens
aacugucucucuucucaga

SEQ ID NO: 696788 - RNA, 19 nt, Homo sapiens
gcagagacaucacaaagau

SEQ ID NO: 696789 - RNA, 19 nt, Homo sapiens
gagcauaacucugggacuu

SEQ ID NO: 696790 - RNA, 19 nt, Homo sapiens
ccaccuuccuggacuguua

SEQ ID NO: 696791 - RNA, 19 nt, Homo sapiens
ccagggcucuccaugauga

SEQ ID NO: 696792 - RNA, 19 nt, Homo sapiens
gaccucauauucaguguug

SEQ ID NO: 696793 - RNA, 19 nt, Homo sapiens
cgaguaccauuaagagaaa

SEQ ID NO: 696794 - RNA, 19 nt, Homo sapiens
gaaaccaccgcucaauauu

SEQ ID NO: 696795 - RNA, 19 nt, Homo sapiens
ugacugagauuucuagaac

SEQ ID NO: 696796 - RNA, 19 nt, Homo sapiens
gaccaggagaguuguauaa

SEQ ID NO: 696797 - RNA, 19 nt, Homo sapiens
cuccaacucugaccucaua

SEQ ID NO: 696798 - RNA, 19 nt, Homo sapiens
cagaaaccaccgcucaaua

SEQ ID NO: 696799 - RNA, 19 nt, Homo sapiens
gcgaguaccauuaagagaa

SEQ ID NO: 696800 - RNA, 19 nt, Homo sapiens
gagccaggccucaggauug

SEQ ID NO: 696801 - RNA, 19 nt, Homo sapiens
caggagaguuguauaaggu

SEQ ID NO: 696802 - RNA, 19 nt, Homo sapiens
gaucuucucuucccaacac

SEQ ID NO: 696803 - RNA, 19 nt, Homo sapiens
ccaggaacagcuugaagua

SEQ ID NO: 696804 - RNA, 19 nt, Homo sapiens
uaaaggagaacgcgagguu

SEQ ID NO: 696805 - RNA, 19 nt, Homo sapiens
ggagaugggugcagaaacc

SEQ ID NO: 696806 - RNA, 19 nt, Homo sapiens
gcucuucucuggauauggu

SEQ ID NO: 696807 - RNA, 19 nt, Homo sapiens
gccagugugucccucuuaa

SEQ ID NO: 696808 - RNA, 19 nt, Homo sapiens
gcuacaggcucugauuuca

SEQ ID NO: 696809 - RNA, 19 nt, Homo sapiens
gcccuacccuccagcagaa

SEQ ID NO: 696810 - RNA, 19 nt, Homo sapiens
ggacgaugagugugccuuu

SEQ ID NO: 696811 - RNA, 19 nt, Homo sapiens
agaaaccaccgcucaauau

SEQ ID NO: 696812 - RNA, 19 nt, Homo sapiens
gcccagcgaguaccauuaa

SEQ ID NO: 696813 - RNA, 19 nt, Homo sapiens
gcagaaaccaccgcucaau

SEQ ID NO: 696814 - RNA, 19 nt, Homo sapiens
aaccaccgcucaauauuca

SEQ ID NO: 696815 - RNA, 19 nt, Homo sapiens
caacucugaccucauauuc

SEQ ID NO: 696816 - RNA, 19 nt, Homo sapiens
guucgggccucugcauauu

SEQ ID NO: 696817 - RNA, 19 nt, Homo sapiens
ccacuuuuguccucaauaa

SEQ ID NO: 696818 - RNA, 19 nt, Homo sapiens
ggaggcucuucucuggaua

SEQ ID NO: 696819 - RNA, 19 nt, Homo sapiens
ccaacccuguggcuacauu

SEQ ID NO: 696820 - RNA, 19 nt, Homo sapiens
ccaggaacagcuugaggua

SEQ ID NO: 696821 - RNA, 19 nt, Homo sapiens
ccaggaacagcuugaggua

SEQ ID NO: 696822 - RNA, 19 nt, Homo sapiens
agagacaucacaaagauug

SEQ ID NO: 696823 - RNA, 19 nt, Homo sapiens
ccaggaacagcuugaggua

SEQ ID NO: 696824 - RNA, 19 nt, Homo sapiens
ccaggagaguuguauaagg

SEQ ID NO: 696825 - RNA, 19 nt, Homo sapiens
uaaccgccauccacugcuu

SEQ ID NO: 696826 - RNA, 19 nt, Homo sapiens
ucugcucacuccagucuuu

SEQ ID NO: 696827 - RNA, 19 nt, Homo sapiens
ggaacagcuugaaguacca

SEQ ID NO: 696828 - RNA, 19 nt, Homo sapiens
gguugucacucacucagau

SEQ ID NO: 696829 - RNA, 19 nt, Homo sapiens
ggagugagccugagauacc

SEQ ID NO: 696830 - RNA, 19 nt, Homo sapiens
ggagugagccugagauacc

SEQ ID NO: 696831 - RNA, 19 nt, Homo sapiens
ccgagagggucaggagaaa

SEQ ID NO: 696832 - RNA, 19 nt, Homo sapiens
agccucaaaucguguuuaa

SEQ ID NO: 696833 - RNA, 19 nt, Homo sapiens
gaugcccuguguuucauuc

SEQ ID NO: 696834 - RNA, 19 nt, Homo sapiens
ggagaacgcgagguuguca

SEQ ID NO: 696835 - RNA, 19 nt, Homo sapiens
ggcagagacaucacaaaga

SEQ ID NO: 696836 - RNA, 19 nt, Homo sapiens
gcaucgguauccugcaaca

SEQ ID NO: 696837 - RNA, 19 nt, Homo sapiens
ucucaccguucaaccuaaa

SEQ ID NO: 696838 - RNA, 19 nt, Homo sapiens
gcaccaggcagagacauca

SEQ ID NO: 696839 - RNA, 19 nt, Homo sapiens
aaaccaccgcucaauauuc

SEQ ID NO: 696840 - RNA, 19 nt, Homo sapiens
ccaccagccugaucuucuc

SEQ ID NO: 696841 - RNA, 19 nt, Homo sapiens
ggccagugugucccucuua

SEQ ID NO: 696842 - RNA, 19 nt, Homo sapiens
ggaccccacucuaacagaa

SEQ ID NO: 696843 - RNA, 19 nt, Homo sapiens
caacccuguggcuacauua

SEQ ID NO: 696844 - RNA, 19 nt, Homo sapiens
gagccucaaaucguguuua

SEQ ID NO: 696845 - RNA, 19 nt, Homo sapiens
uaggauugagccugagaua

SEQ ID NO: 696846 - RNA, 19 nt, Homo sapiens
uggaggcucuucucuggau

SEQ ID NO: 696847 - RNA, 19 nt, Homo sapiens
gugugucccucuuaaugga

SEQ ID NO: 696848 - RNA, 19 nt, Homo sapiens
gaggcuacaggcucugauu

SEQ ID NO: 696849 - RNA, 19 nt, Homo sapiens
ggauugagccugagauacc

SEQ ID NO: 696850 - RNA, 19 nt, Homo sapiens
ccgguacgcucucagaaac

SEQ ID NO: 696851 - RNA, 19 nt, Homo sapiens
guggcuacauuacucgaau

SEQ ID NO: 696852 - RNA, 19 nt, Homo sapiens
ccagcgaguaccauuaaga

SEQ ID NO: 696853 - RNA, 19 nt, Homo sapiens
ucgggccucugcauauuug

SEQ ID NO: 696854 - RNA, 19 nt, Homo sapiens
ggaccaggagaaccaagau

SEQ ID NO: 696855 - RNA, 19 nt, Homo sapiens
gcaaccaccagccugaucu

SEQ ID NO: 696856 - RNA, 19 nt, Homo sapiens
uaggagugagccugagaua

SEQ ID NO: 696857 - RNA, 19 nt, Homo sapiens
uaggagugagccugagaua

SEQ ID NO: 696858 - RNA, 19 nt, Homo sapiens
gagauuucuagaacucuga

SEQ ID NO: 696859 - RNA, 19 nt, Homo sapiens
cagugugucccucuuaaug

SEQ ID NO: 696860 - RNA, 19 nt, Homo sapiens
ccaacucugaccucauauu

SEQ ID NO: 696861 - RNA, 19 nt, Homo sapiens
ccucgaggccggacauugu

SEQ ID NO: 696862 - RNA, 19 nt, Homo sapiens
ggaaguagaggggcuggua

SEQ ID NO: 696863 - RNA, 19 nt, Homo sapiens
acuggaggguucugggaaa

SEQ ID NO: 696864 - RNA, 19 nt, Homo sapiens
ugaccaggagaguuguaua

SEQ ID NO: 696865 - RNA, 19 nt, Homo sapiens
ccaugacucccaccugaug

SEQ ID NO: 696866 - RNA, 19 nt, Homo sapiens
cagccugcuuucucucuuc

SEQ ID NO: 696867 - RNA, 19 nt, Homo sapiens
cagggaccauagaguuugu

SEQ ID NO: 696868 - RNA, 19 nt, Homo sapiens
ccagggaccauagaguuug

SEQ ID NO: 696869 - RNA, 19 nt, Homo sapiens
acgcaucgguauccugcaa

SEQ ID NO: 696870 - RNA, 19 nt, Homo sapiens
cgucucaccguucaaccua

SEQ ID NO: 696871 - RNA, 19 nt, Homo sapiens
ggcccagcgaguaccauua

SEQ ID NO: 696872 - RNA, 19 nt, Homo sapiens
ccugcuuucucucuuccua

SEQ ID NO: 696873 - RNA, 19 nt, Homo sapiens
ccagccugaucuucucuuc

SEQ ID NO: 696874 - RNA, 19 nt, Homo sapiens
ccugcacccuggaacauag

SEQ ID NO: 696875 - RNA, 19 nt, Homo sapiens
gagugagccugagauacca

SEQ ID NO: 696876 - RNA, 19 nt, Homo sapiens
uggacgggcucagcgugua

SEQ ID NO: 696877 - RNA, 19 nt, Homo sapiens
cagagacaucacaaagauu

SEQ ID NO: 696878 - RNA, 19 nt, Homo sapiens
caccaacccuguggcuaca

SEQ ID NO: 696879 - RNA, 19 nt, Homo sapiens
gggccagugugucccucuu

SEQ ID NO: 696880 - RNA, 19 nt, Homo sapiens
aacgcgagguugucacuca

SEQ ID NO: 696881 - RNA, 19 nt, Homo sapiens
ugcuuucucucuuccuaaa

SEQ ID NO: 696882 - RNA, 19 nt, Homo sapiens
gagcagcgcuggaucaaga

SEQ ID NO: 696883 - RNA, 19 nt, Homo sapiens
ggacuuggccuacgucugu

SEQ ID NO: 696884 - RNA, 19 nt, Homo sapiens
gccgaaaucucaucaccuu

SEQ ID NO: 696885 - RNA, 19 nt, Homo sapiens
agaauugccuggcuguuga

SEQ ID NO: 696886 - RNA, 19 nt, Homo sapiens
ucaccgacgucgacauuga

SEQ ID NO: 696887 - RNA, 19 nt, Homo sapiens
cgacaaacagcccacaauu

SEQ ID NO: 696888 - RNA, 19 nt, Homo sapiens
gaucaccgacgucgacauu

SEQ ID NO: 696889 - RNA, 19 nt, Homo sapiens
gaaguucucccgagucaag

SEQ ID NO: 696890 - RNA, 19 nt, Homo sapiens
uaaaggcuaugcagcuauc

SEQ ID NO: 696891 - RNA, 19 nt, Homo sapiens
gacaaacagcccacaauuc

SEQ ID NO: 696892 - RNA, 19 nt, Homo sapiens
gggcaugcuucgggaauug

SEQ ID NO: 696893 - RNA, 19 nt, Homo sapiens
acgaggcgcugguggauga

SEQ ID NO: 696894 - RNA, 19 nt, Homo sapiens
gaccauggccgucuucuac

SEQ ID NO: 696895 - RNA, 19 nt, Homo sapiens
aaacagcccacaauucuca

SEQ ID NO: 696896 - RNA, 19 nt, Homo sapiens
gaaccacggcggugaagca

SEQ ID NO: 696897 - RNA, 19 nt, Homo sapiens
acaaacagcccacaauucu

SEQ ID NO: 696898 - RNA, 19 nt, Homo sapiens
cgaaaucucaucaccuuca

SEQ ID NO: 696899 - RNA, 19 nt, Homo sapiens
ugggagaaaugguccaaga

SEQ ID NO: 696900 - RNA, 19 nt, Homo sapiens
gcucaagucgcccaacaga

SEQ ID NO: 696901 - RNA, 19 nt, Homo sapiens
caccgucgcucacgcuguu

SEQ ID NO: 696902 - RNA, 19 nt, Homo sapiens
gaauuugugcuggacauga

SEQ ID NO: 696903 - RNA, 19 nt, Homo sapiens
acaccaagcucuuccucau

SEQ ID NO: 696904 - RNA, 19 nt, Homo sapiens
gcccacaauucucaaaugg

SEQ ID NO: 696905 - RNA, 19 nt, Homo sapiens
gaucugcugucgcgaugag

SEQ ID NO: 696906 - RNA, 19 nt, Homo sapiens
ucaccaagcucuggaucug

SEQ ID NO: 696907 - RNA, 19 nt, Homo sapiens
uacagagccugguggagaa

SEQ ID NO: 696908 - RNA, 19 nt, Homo sapiens
cuuaaaggcuaugcagcua

SEQ ID NO: 696909 - RNA, 19 nt, Homo sapiens
gcggaccaccuggcuaaua

SEQ ID NO: 696910 - RNA, 19 nt, Homo sapiens
caggugggaugauggacuu

SEQ ID NO: 696911 - RNA, 19 nt, Homo sapiens
ggaccugacccgcaugauc

SEQ ID NO: 696912 - RNA, 19 nt, Homo sapiens
ucaaauggcggauccuauc

SEQ ID NO: 696913 - RNA, 19 nt, Homo sapiens
cggaccaccuggcuaauag

SEQ ID NO: 696914 - RNA, 19 nt, Homo sapiens
ugaccgagaucugcaccaa

SEQ ID NO: 696915 - RNA, 19 nt, Homo sapiens
gggaauugaugguggucau

SEQ ID NO: 696916 - RNA, 19 nt, Homo sapiens
accgagaucugcaccaaga

SEQ ID NO: 696917 - RNA, 19 nt, Homo sapiens
gauccugcccucccuguuc

SEQ ID NO: 696918 - RNA, 19 nt, Homo sapiens
uguccuggcugcacaaugg

SEQ ID NO: 696919 - RNA, 19 nt, Homo sapiens
ccugggaccugcacucgau

SEQ ID NO: 696920 - RNA, 19 nt, Homo sapiens
ucaagucgcccaacagaac

SEQ ID NO: 696921 - RNA, 19 nt, Homo sapiens
caagguggccagcgacaca

SEQ ID NO: 696922 - RNA, 19 nt, Homo sapiens
aauuugugcuggacaugaa

SEQ ID NO: 696923 - RNA, 19 nt, Homo sapiens
caagacggaggaauuugug

SEQ ID NO: 696924 - RNA, 19 nt, Homo sapiens
ucaagacggaggaauuugu

SEQ ID NO: 696925 - RNA, 19 nt, Homo sapiens
gaaaucucaucaccuucac

SEQ ID NO: 696926 - RNA, 19 nt, Homo sapiens
gcgacaaacagcccacaau

SEQ ID NO: 696927 - RNA, 19 nt, Homo sapiens
gcacgugcagcccaguaug

SEQ ID NO: 696928 - RNA, 19 nt, Homo sapiens
ucaacacgccugacaagag

SEQ ID NO: 696929 - RNA, 19 nt, Homo sapiens
gaauugccuggcuguugaa

SEQ ID NO: 696930 - RNA, 19 nt, Homo sapiens
ugaggaagccccugccuuu

SEQ ID NO: 696931 - RNA, 19 nt, Homo sapiens
uggcggaccaccuggcuaa

SEQ ID NO: 696932 - RNA, 19 nt, Homo sapiens
aagaauugccuggcuguug

SEQ ID NO: 696933 - RNA, 19 nt, Homo sapiens
cgacgucgacauugacaag

SEQ ID NO: 696934 - RNA, 19 nt, Homo sapiens
ggccagcgacacacaguuc

SEQ ID NO: 696935 - RNA, 19 nt, Homo sapiens
caucacccaccucaaguuc

SEQ ID NO: 696936 - RNA, 19 nt, Homo sapiens
cgucgcccgugcaguucua

SEQ ID NO: 696937 - RNA, 19 nt, Homo sapiens
agaagcugcacgaggagua

SEQ ID NO: 696938 - RNA, 19 nt, Homo sapiens
uauacggccaccucggaua

SEQ ID NO: 696939 - RNA, 19 nt, Homo sapiens
caccaacaccgaccucaag

SEQ ID NO: 696940 - RNA, 19 nt, Homo sapiens
caaauacccuuucuguuua

SEQ ID NO: 696941 - RNA, 19 nt, Homo sapiens
gcaaauacccuuucuguuu

SEQ ID NO: 696942 - RNA, 19 nt, Homo sapiens
gaaauaugcugaacaacuu

SEQ ID NO: 696943 - RNA, 19 nt, Homo sapiens
cagaauacauugacuguuu

SEQ ID NO: 696944 - RNA, 19 nt, Homo sapiens
gagcuacuguuuauuauug

SEQ ID NO: 696945 - RNA, 19 nt, Homo sapiens
gaacaaauguggcagaaaa

SEQ ID NO: 696946 - RNA, 19 nt, Homo sapiens
gauauggccuguaauccua

SEQ ID NO: 696947 - RNA, 19 nt, Homo sapiens
ggaaguggauuauagaagu

SEQ ID NO: 696948 - RNA, 19 nt, Homo sapiens
acaaugagcuacuguuuau

SEQ ID NO: 696949 - RNA, 19 nt, Homo sapiens
uaauggaaccucugaaaua

SEQ ID NO: 696950 - RNA, 19 nt, Homo sapiens
cagaugauauggccuguaa

SEQ ID NO: 696951 - RNA, 19 nt, Homo sapiens
gugaaugacugcauaguau

SEQ ID NO: 696952 - RNA, 19 nt, Homo sapiens
ggacaucgcacugaucuuu

SEQ ID NO: 696953 - RNA, 19 nt, Homo sapiens
gaaguggauuauagaaguu

SEQ ID NO: 696954 - RNA, 19 nt, Homo sapiens
cugcaaacuuggauaauaa

SEQ ID NO: 696955 - RNA, 19 nt, Homo sapiens
guacggaaaguggaaauua

SEQ ID NO: 696956 - RNA, 19 nt, Homo sapiens
ccagcuagccaaacuaaua

SEQ ID NO: 696957 - RNA, 19 nt, Homo sapiens
guauggagaugauguggaa

SEQ ID NO: 696958 - RNA, 19 nt, Homo sapiens
ccagauggaugagaaacua

SEQ ID NO: 696959 - RNA, 19 nt, Homo sapiens
ggaaagcagcuauaaggaa

SEQ ID NO: 696960 - RNA, 19 nt, Homo sapiens
ccaaggagcauccauguau

SEQ ID NO: 696961 - RNA, 19 nt, Homo sapiens
ggacugcaaacuuggauaa

SEQ ID NO: 696962 - RNA, 19 nt, Homo sapiens
gcacuuauuaucaugguuu

SEQ ID NO: 696963 - RNA, 19 nt, Homo sapiens
gaaauuacaacagagacua

SEQ ID NO: 696964 - RNA, 19 nt, Homo sapiens
cauaauggcucuagcuagu

SEQ ID NO: 696965 - RNA, 19 nt, Homo sapiens
ggauuaugggcacuuauua

SEQ ID NO: 696966 - RNA, 19 nt, Homo sapiens
gauaacugauuucuuugga

SEQ ID NO: 696967 - RNA, 19 nt, Homo sapiens
gaagaaauuaccaacauag

SEQ ID NO: 696968 - RNA, 19 nt, Homo sapiens
gaugaugaaugaagaaugc

SEQ ID NO: 696969 - RNA, 19 nt, Homo sapiens
caaaacgucuucuuucuga

SEQ ID NO: 696970 - RNA, 19 nt, Homo sapiens
ggaacuaaauguguaugga

SEQ ID NO: 696971 - RNA, 19 nt, Homo sapiens
gaaguggccauacaaacaa

SEQ ID NO: 696972 - RNA, 19 nt, Homo sapiens
gaaauuaccaacauagaac

SEQ ID NO: 696973 - RNA, 19 nt, Homo sapiens
ggaucaagcagaacaauuc

SEQ ID NO: 696974 - RNA, 19 nt, Homo sapiens
gaugacagaagcaauauuc

SEQ ID NO: 696975 - RNA, 19 nt, Homo sapiens
agacagagaucagaauaca

SEQ ID NO: 696976 - RNA, 19 nt, Homo sapiens
uaaugcaacugcuuaaugg

SEQ ID NO: 696977 - RNA, 19 nt, Homo sapiens
uaucgaggaucaagcagaa

SEQ ID NO: 696978 - RNA, 19 nt, Homo sapiens
gaagaaauuaacccagcua

SEQ ID NO: 696979 - RNA, 19 nt, Homo sapiens
gaauauggaacuaaaugug

SEQ ID NO: 696980 - RNA, 19 nt, Homo sapiens
ucacaagaauauggaacua

SEQ ID NO: 696981 - RNA, 19 nt, Homo sapiens
acagagaucagaauacauu

SEQ ID NO: 696982 - RNA, 19 nt, Homo sapiens
ggaauuaagcauaugaagu

SEQ ID NO: 696983 - RNA, 19 nt, Homo sapiens
gaaaguggaaauuacaaca

SEQ ID NO: 696984 - RNA, 19 nt, Homo sapiens
ucugaaauaugcugaacaa

SEQ ID NO: 696985 - RNA, 19 nt, Homo sapiens
aauggaaccucugaaauau

SEQ ID NO: 696986 - RNA, 19 nt, Homo sapiens
ucacagucuucuauuguug

SEQ ID NO: 696987 - RNA, 19 nt, Homo sapiens
uagacuugaugaugaauga

SEQ ID NO: 696988 - RNA, 19 nt, Homo sapiens
caaggagcauccauguaug

SEQ ID NO: 696989 - RNA, 19 nt, Homo sapiens
gugaagacauuaaauucuc

SEQ ID NO: 696990 - RNA, 19 nt, Homo sapiens
uccuguagcucagauaaua

SEQ ID NO: 696991 - RNA, 19 nt, Homo sapiens
cagcuacaguguuuaguca

SEQ ID NO: 696992 - RNA, 19 nt, Homo sapiens
cauggaauccugcagcuuu

SEQ ID NO: 696993 - RNA, 19 nt, Homo sapiens
ugagguaacuguggagaau

SEQ ID NO: 696994 - RNA, 19 nt, Homo sapiens
gcuggucacucauggaauc

SEQ ID NO: 696995 - RNA, 19 nt, Homo sapiens
acugcaaacuuggauaaua

SEQ ID NO: 696996 - RNA, 19 nt, Homo sapiens
gccaaacuaauaugaauga

SEQ ID NO: 696997 - RNA, 19 nt, Homo sapiens
aagauucacucucgcauca

SEQ ID NO: 696998 - RNA, 19 nt, Homo sapiens
gaugauauggccuguaauc

SEQ ID NO: 696999 - RNA, 19 nt, Homo sapiens
gggcuuuauucugggauua

SEQ ID NO: 697000 - RNA, 19 nt, Homo sapiens
ugagacagagaucagaaua

SEQ ID NO: 697001 - RNA, 19 nt, Homo sapiens
gggauuaugggcacuuauu

SEQ ID NO: 697002 - RNA, 19 nt, Homo sapiens
uaacccagcuagccaaacu

SEQ ID NO: 697003 - RNA, 19 nt, Homo sapiens
uacaaugagcuacuguuua

SEQ ID NO: 697004 - RNA, 19 nt, Homo sapiens
gacagggcaugguggaaau

SEQ ID NO: 697005 - RNA, 19 nt, Homo sapiens
cugcauaguauucacuuua

SEQ ID NO: 697006 - RNA, 19 nt, Homo sapiens
cugaagaaauuaccaacau

SEQ ID NO: 697007 - RNA, 19 nt, Homo sapiens
gauuaugggcacuuauuau

SEQ ID NO: 697008 - RNA, 19 nt, Homo sapiens
guacaucccgauucugguu

SEQ ID NO: 697009 - RNA, 19 nt, Homo sapiens
cuacaaugagcuacuguuu

SEQ ID NO: 697010 - RNA, 19 nt, Homo sapiens
guauauccucccaaucuuu

SEQ ID NO: 697011 - RNA, 19 nt, Homo sapiens
ucucuuguaugaauuggaa

SEQ ID NO: 697012 - RNA, 19 nt, Homo sapiens
guguuucucuuguaugaau

SEQ ID NO: 697013 - RNA, 19 nt, Homo sapiens
cagagacuauuaaauugca

SEQ ID NO: 697014 - RNA, 19 nt, Homo sapiens
uaauggcucuagcuaguag

SEQ ID NO: 697015 - RNA, 19 nt, Homo sapiens
agguaacuguggagaauuu

SEQ ID NO: 697016 - RNA, 19 nt, Homo sapiens
gaauccugcagcuuuaauu

SEQ ID NO: 697017 - RNA, 19 nt, Homo sapiens
guagucaagugggagaaga

SEQ ID NO: 697018 - RNA, 19 nt, Homo sapiens
cuagucauaucgaggauca

SEQ ID NO: 697019 - RNA, 19 nt, Homo sapiens
ggaaaagaaacaauuguga

SEQ ID NO: 697020 - RNA, 19 nt, Homo sapiens
ucagauaauacaccagaaa

SEQ ID NO: 697021 - RNA, 19 nt, Homo sapiens
ugaaauaugcugaacaacu

SEQ ID NO: 697022 - RNA, 19 nt, Homo sapiens
aaacuaauggaaccucuga

SEQ ID NO: 697023 - RNA, 19 nt, Homo sapiens
ggaagucugaagccgguaa

SEQ ID NO: 697024 - RNA, 19 nt, Homo sapiens
ucccgauucugguuuaauu

SEQ ID NO: 697025 - RNA, 19 nt, Homo sapiens
gcuacaguguuuagucaca

SEQ ID NO: 697026 - RNA, 19 nt, Homo sapiens
aagaccagauggaugagaa

SEQ ID NO: 697027 - RNA, 19 nt, Homo sapiens
gggcuguucugguguguac

SEQ ID NO: 697028 - RNA, 19 nt, Homo sapiens
aauccugcagcuuuaauua

SEQ ID NO: 697029 - RNA, 19 nt, Homo sapiens
gaaacaauugugaagacau

SEQ ID NO: 697030 - RNA, 19 nt, Homo sapiens
aaguggaaauuacaacaga

SEQ ID NO: 697031 - RNA, 19 nt, Homo sapiens
ugauuucuuuggaagugua

SEQ ID NO: 697032 - RNA, 19 nt, Homo sapiens
gcuagccaaacuaauauga

SEQ ID NO: 697033 - RNA, 19 nt, Homo sapiens
ucaaccugauccugcaauu

SEQ ID NO: 697034 - RNA, 19 nt, Homo sapiens
agaaguggccauacaaaca

SEQ ID NO: 697035 - RNA, 19 nt, Homo sapiens
cuaaauguguauggagaug

SEQ ID NO: 697036 - RNA, 19 nt, Homo sapiens
gaaugagacagagaucaga

SEQ ID NO: 697037 - RNA, 19 nt, Homo sapiens
acaucccgauucugguuua

SEQ ID NO: 697038 - RNA, 19 nt, Homo sapiens
aggaagaccagauggauga

SEQ ID NO: 697039 - RNA, 19 nt, Homo sapiens
cagcuagccaaacuaauau

SEQ ID NO: 697040 - RNA, 19 nt, Homo sapiens
gaaaggagcaggacaguug

SEQ ID NO: 697041 - RNA, 19 nt, Homo sapiens
uauauaggaugcuggauua

SEQ ID NO: 697042 - RNA, 19 nt, Homo sapiens
ggaugaagcuccugcaguu

SEQ ID NO: 697043 - RNA, 19 nt, Homo sapiens
gaagaagacucuguacuca

SEQ ID NO: 697044 - RNA, 19 nt, Homo sapiens
acacgaagcuccuggacua

SEQ ID NO: 697045 - RNA, 19 nt, Homo sapiens
ggaagaagagaaacgguua

SEQ ID NO: 697046 - RNA, 19 nt, Homo sapiens
gagaaacgguuaagagaag

SEQ ID NO: 697047 - RNA, 19 nt, Homo sapiens
ugagauugcuggccuauug

SEQ ID NO: 697048 - RNA, 19 nt, Homo sapiens
gaagagaagcgcauuaaag

SEQ ID NO: 697049 - RNA, 19 nt, Homo sapiens
gaagaagagaagcgcauua

SEQ ID NO: 697050 - RNA, 19 nt, Homo sapiens
uggauuaguuccuuugaua

SEQ ID NO: 697051 - RNA, 19 nt, Homo sapiens
ccacagagcagauacuuga

SEQ ID NO: 697052 - RNA, 19 nt, Homo sapiens
ugaggacgaugguuucuuu

SEQ ID NO: 697053 - RNA, 19 nt, Homo sapiens
cgacucaauuccuguguaa

SEQ ID NO: 697054 - RNA, 19 nt, Homo sapiens
gaagagaaacgguuaagag

SEQ ID NO: 697055 - RNA, 19 nt, Homo sapiens
gugaggugcuggaaucuuu

SEQ ID NO: 697056 - RNA, 19 nt, Homo sapiens
gcaagcagcucaaguuacg

SEQ ID NO: 697057 - RNA, 19 nt, Homo sapiens
ggagagacccuuucagaca

SEQ ID NO: 697058 - RNA, 19 nt, Homo sapiens
ggaccacaauaaacuaaau

SEQ ID NO: 697059 - RNA, 19 nt, Homo sapiens
ugacagaggacucgaauga

SEQ ID NO: 697060 - RNA, 19 nt, Homo sapiens
ggacgaugguuucuuugug

SEQ ID NO: 697061 - RNA, 19 nt, Homo sapiens
gcaugugcaucacccaauu

SEQ ID NO: 697062 - RNA, 19 nt, Homo sapiens
ugaaucugcccuuuaauaa

SEQ ID NO: 697063 - RNA, 19 nt, Homo sapiens
auaugaaucugcccuuuaa

SEQ ID NO: 697064 - RNA, 19 nt, Homo sapiens
gcauaugaaucugcccuuu

SEQ ID NO: 697065 - RNA, 19 nt, Homo sapiens
gcagaguucuauauaggau

SEQ ID NO: 697066 - RNA, 19 nt, Homo sapiens
cgaagcuccuggacuauga

SEQ ID NO: 697067 - RNA, 19 nt, Homo sapiens
agaaggagcuuaaggaaaa

SEQ ID NO: 697068 - RNA, 19 nt, Homo sapiens
caaguuacgugcagaaagg

SEQ ID NO: 697069 - RNA, 19 nt, Homo sapiens
gggacgaguuccuggcuaa

SEQ ID NO: 697070 - RNA, 19 nt, Homo sapiens
ccacagccauggauugcaa

SEQ ID NO: 697071 - RNA, 19 nt, Homo sapiens
gggcaagcagcucaaguua

SEQ ID NO: 697072 - RNA, 19 nt, Homo sapiens
gagagacccuuucagacau

SEQ ID NO: 697073 - RNA, 19 nt, Homo sapiens
gccauggauugcaaagaua

SEQ ID NO: 697074 - RNA, 19 nt, Homo sapiens
gaagaagagaaacgguuaa

SEQ ID NO: 697075 - RNA, 19 nt, Homo sapiens
gagaaggagcuuaaggaaa

SEQ ID NO: 697076 - RNA, 19 nt, Homo sapiens
gaacgacaaguuggcauuu

SEQ ID NO: 697077 - RNA, 19 nt, Homo sapiens
gaggagggcgacuguauga

SEQ ID NO: 697078 - RNA, 19 nt, Homo sapiens
acuaugagguggacaguga

SEQ ID NO: 697079 - RNA, 19 nt, Homo sapiens
cauaugaaucugcccuuua

SEQ ID NO: 697080 - RNA, 19 nt, Homo sapiens
gauuggugcugaagacaug

SEQ ID NO: 697081 - RNA, 19 nt, Homo sapiens
gaagaaggaggaagagaag

SEQ ID NO: 697082 - RNA, 19 nt, Homo sapiens
ggaugaugaugacgacaug

SEQ ID NO: 697083 - RNA, 19 nt, Homo sapiens
cgaguucuccuucuugaaa

SEQ ID NO: 697084 - RNA, 19 nt, Homo sapiens
gcacucccaucucgcugaa

SEQ ID NO: 697085 - RNA, 19 nt, Homo sapiens
ggaugaagaugaggacgau

SEQ ID NO: 697086 - RNA, 19 nt, Homo sapiens
gggagaagcgggagaagga

SEQ ID NO: 697087 - RNA, 19 nt, Homo sapiens
ccaaggaggaggccaagaa

SEQ ID NO: 697088 - RNA, 19 nt, Homo sapiens
caggacaucuuggcuguga

SEQ ID NO: 697089 - RNA, 19 nt, Homo sapiens
gccugaaucuugucccaaa

SEQ ID NO: 697090 - RNA, 19 nt, Homo sapiens
gugcagaguucuauauagg

SEQ ID NO: 697091 - RNA, 19 nt, Homo sapiens
ccaucucgcugaagaggaa

SEQ ID NO: 697092 - RNA, 19 nt, Homo sapiens
ggaggaaguuuggcaggau

SEQ ID NO: 697093 - RNA, 19 nt, Homo sapiens
gagcaggggugacguaugu

SEQ ID NO: 697094 - RNA, 19 nt, Homo sapiens
guaccugucugaggacgaa

SEQ ID NO: 697095 - RNA, 19 nt, Homo sapiens
ccagagcacagucaucauu

SEQ ID NO: 697096 - RNA, 19 nt, Homo sapiens
cccaagagccgcauaugaa

SEQ ID NO: 697097 - RNA, 19 nt, Homo sapiens
auaggaugcuggauuaguu

SEQ ID NO: 697098 - RNA, 19 nt, Homo sapiens
agagugaggugcuggaauc

SEQ ID NO: 697099 - RNA, 19 nt, Homo sapiens
guucugacauagacuuuag

SEQ ID NO: 697100 - RNA, 19 nt, Homo sapiens
ucacccaauucaugaagaa

SEQ ID NO: 697101 - RNA, 19 nt, Homo sapiens
gaacaagcucagacugcaa

SEQ ID NO: 697102 - RNA, 19 nt, Homo sapiens
ccaaagcagcacagcagua

SEQ ID NO: 697103 - RNA, 19 nt, Homo sapiens
gagaggcgacucccaggaa

SEQ ID NO: 697104 - RNA, 19 nt, Homo sapiens
gacuuuagaccgaaacuug

SEQ ID NO: 697105 - RNA, 19 nt, Homo sapiens
gugcaucacccaauucaug

SEQ ID NO: 697106 - RNA, 19 nt, Homo sapiens
gggagaggaugaagaugag

SEQ ID NO: 697107 - RNA, 19 nt, Homo sapiens
gcagagaaggccgaaauca

SEQ ID NO: 697108 - RNA, 19 nt, Homo sapiens
gggagaaggaugagaagga

SEQ ID NO: 697109 - RNA, 19 nt, Homo sapiens
gaagagaaggagcuuaagg

SEQ ID NO: 697110 - RNA, 19 nt, Homo sapiens
cuaagaaauucgucaaagg

SEQ ID NO: 697111 - RNA, 19 nt, Homo sapiens
cgaagaagacucuguacuc

SEQ ID NO: 697112 - RNA, 19 nt, Homo sapiens
caaagugugcagaguucua

SEQ ID NO: 697113 - RNA, 19 nt, Homo sapiens
ggacaucuuggcugugaga

SEQ ID NO: 697114 - RNA, 19 nt, Homo sapiens
ggagggcgacuguaugauc

SEQ ID NO: 697115 - RNA, 19 nt, Homo sapiens
ggcgaguucuccuucuuga

SEQ ID NO: 697116 - RNA, 19 nt, Homo sapiens
gcugugagaccaccgcaaa

SEQ ID NO: 697117 - RNA, 19 nt, Homo sapiens
gcaggacaguuggagugaa

SEQ ID NO: 697118 - RNA, 19 nt, Homo sapiens
uuuaagcgccugaaucuug

SEQ ID NO: 697119 - RNA, 19 nt, Homo sapiens
agaagaaggaggaagagaa

SEQ ID NO: 697120 - RNA, 19 nt, Homo sapiens
agaagaagaaggaggaaga

SEQ ID NO: 697121 - RNA, 19 nt, Homo sapiens
uuucagacauuccuugcaa

SEQ ID NO: 697122 - RNA, 19 nt, Homo sapiens
ggauuaguuccuuugauau

SEQ ID NO: 697123 - RNA, 19 nt, Homo sapiens
ggaggagggcgacuguaug

SEQ ID NO: 697124 - RNA, 19 nt, Homo sapiens
aagaagagaagcgcauuaa

SEQ ID NO: 697125 - RNA, 19 nt, Homo sapiens
guuaagagaagaagagaag

SEQ ID NO: 697126 - RNA, 19 nt, Homo sapiens
aauagaaucgaaaccagua

SEQ ID NO: 697127 - RNA, 19 nt, Homo sapiens
ccaagagccgcauaugaau

SEQ ID NO: 697128 - RNA, 19 nt, Homo sapiens
gaacaugaccccugagagu

SEQ ID NO: 697129 - RNA, 19 nt, Homo sapiens
augaaucugcccuuuaaua

SEQ ID NO: 697130 - RNA, 19 nt, Homo sapiens
gaaacgguuaagagaagaa

SEQ ID NO: 697131 - RNA, 19 nt, Homo sapiens
agagcacagucaucauuga

SEQ ID NO: 697132 - RNA, 19 nt, Homo sapiens
cauagacuuuagaccgaaa

SEQ ID NO: 697133 - RNA, 19 nt, Homo sapiens
gaugcuggauuaguuccuu

SEQ ID NO: 697134 - RNA, 19 nt, Homo sapiens
gaggagagacgagcagauc

SEQ ID NO: 697135 - RNA, 19 nt, Homo sapiens
aagaugaggacgaugguuu

SEQ ID NO: 697136 - RNA, 19 nt, Homo sapiens
gaugaggagugggaagaag

SEQ ID NO: 697137 - RNA, 19 nt, Homo sapiens
uaagaagacggcacucauc

SEQ ID NO: 697138 - RNA, 19 nt, Homo sapiens
aagagaaacgguuaagaga

SEQ ID NO: 697139 - RNA, 19 nt, Homo sapiens
aggaagagaaggagcuuaa

SEQ ID NO: 697140 - RNA, 19 nt, Homo sapiens
gaaaugaugucuaugaugu

SEQ ID NO: 697141 - RNA, 19 nt, Homo sapiens
ggagaaggauggugagaaa

SEQ ID NO: 697142 - RNA, 19 nt, Homo sapiens
cagaggaacuucaguguuu

SEQ ID NO: 697143 - RNA, 19 nt, Homo sapiens
caucacagguuacauguuu

SEQ ID NO: 697144 - RNA, 19 nt, Homo sapiens
gaagaaauuccuugacaaa

SEQ ID NO: 697145 - RNA, 19 nt, Homo sapiens
uuaagaagauugaggauug

SEQ ID NO: 697146 - RNA, 19 nt, Homo sapiens
guacaggaguuaauaaagu

SEQ ID NO: 697147 - RNA, 19 nt, Homo sapiens
ucaaagugauuucccagua

SEQ ID NO: 697148 - RNA, 19 nt, Homo sapiens
gaagaaaugaugauggaaa

SEQ ID NO: 697149 - RNA, 19 nt, Homo sapiens
ugaaggaaaugaugucuau

SEQ ID NO: 697150 - RNA, 19 nt, Homo sapiens
gaaaugaugauggaaauga

SEQ ID NO: 697151 - RNA, 19 nt, Homo sapiens
caacaaguacuaucugauu

SEQ ID NO: 697152 - RNA, 19 nt, Homo sapiens
gugaaggccuugcuguuaa

SEQ ID NO: 697153 - RNA, 19 nt, Homo sapiens
ggaaggcucauguguauug

SEQ ID NO: 697154 - RNA, 19 nt, Homo sapiens
gagaggaccuucauaacag

SEQ ID NO: 697155 - RNA, 19 nt, Homo sapiens
gaaggauggugagaaagaa

SEQ ID NO: 697156 - RNA, 19 nt, Homo sapiens
gaaggugccuggaaaauau

SEQ ID NO: 697157 - RNA, 19 nt, Homo sapiens
caagauggcucccaguucu

SEQ ID NO: 697158 - RNA, 19 nt, Homo sapiens
cagaagaaauuccuugaca

SEQ ID NO: 697159 - RNA, 19 nt, Homo sapiens
ggacagaagacaagcaaga

SEQ ID NO: 697160 - RNA, 19 nt, Homo sapiens
guuauacccucaacuacaa

SEQ ID NO: 697161 - RNA, 19 nt, Homo sapiens
caacacggcuccagaagac

SEQ ID NO: 697162 - RNA, 19 nt, Homo sapiens
gaaaauaagcaguguugua

SEQ ID NO: 697163 - RNA, 19 nt, Homo sapiens
ucagagaggaccuucauaa

SEQ ID NO: 697164 - RNA, 19 nt, Homo sapiens
gaagauugaggauuguauu

SEQ ID NO: 697165 - RNA, 19 nt, Homo sapiens
gcagguuaccagucucuua

SEQ ID NO: 697166 - RNA, 19 nt, Homo sapiens
ggugaauguugaucuuaaa

SEQ ID NO: 697167 - RNA, 19 nt, Homo sapiens
ccacuaauccggacacaga

SEQ ID NO: 697168 - RNA, 19 nt, Homo sapiens
aaggauugcuucaagguaa

SEQ ID NO: 697169 - RNA, 19 nt, Homo sapiens
gcaaaagaguuaauaaugg

SEQ ID NO: 697170 - RNA, 19 nt, Homo sapiens
guguuguacuugugaauuu

SEQ ID NO: 697171 - RNA, 19 nt, Homo sapiens
ccaugaaaguuacgaguuc

SEQ ID NO: 697172 - RNA, 19 nt, Homo sapiens
ggaagcaugcaaugaauuc

SEQ ID NO: 697173 - RNA, 19 nt, Homo sapiens
ugauucagcuauuagaaga

SEQ ID NO: 697174 - RNA, 19 nt, Homo sapiens
gcaaaagggucucugaauc

SEQ ID NO: 697175 - RNA, 19 nt, Homo sapiens
caaggcagguuaccagucu

SEQ ID NO: 697176 - RNA, 19 nt, Homo sapiens
agaccaaucuccaguucaa

SEQ ID NO: 697177 - RNA, 19 nt, Homo sapiens
gaagacaagcaagauggua

SEQ ID NO: 697178 - RNA, 19 nt, Homo sapiens
aauaagcaguguuguacuu

SEQ ID NO: 697179 - RNA, 19 nt, Homo sapiens
ugaccuugcuggauuuguu

SEQ ID NO: 697180 - RNA, 19 nt, Homo sapiens
uggacgagcucucauggaa

SEQ ID NO: 697181 - RNA, 19 nt, Homo sapiens
uggaagaaaugaugaugga

SEQ ID NO: 697182 - RNA, 19 nt, Homo sapiens
ggaaaugaugucuaugaug

SEQ ID NO: 697183 - RNA, 19 nt, Homo sapiens
ugaaggccuugcuguuaaa

SEQ ID NO: 697184 - RNA, 19 nt, Homo sapiens
ggacaggacagaagacaag

SEQ ID NO: 697185 - RNA, 19 nt, Homo sapiens
caaagugauuucccaguac

SEQ ID NO: 697186 - RNA, 19 nt, Homo sapiens
gcacaaaucaaggcagguu

SEQ ID NO: 697187 - RNA, 19 nt, Homo sapiens
ucucuuaaaucucccuuga

SEQ ID NO: 697188 - RNA, 19 nt, Homo sapiens
caacaaggccaaggaaauc

SEQ ID NO: 697189 - RNA, 19 nt, Homo sapiens
agaaggaacugucagaaaa

SEQ ID NO: 697190 - RNA, 19 nt, Homo sapiens
acaccaggauuccgcauga

SEQ ID NO: 697191 - RNA, 19 nt, Homo sapiens
agaagaaauuccuugacaa

SEQ ID NO: 697192 - RNA, 19 nt, Homo sapiens
gcaagugacacaggaauuc

SEQ ID NO: 697193 - RNA, 19 nt, Homo sapiens
ccaacacuauagaaaccua

SEQ ID NO: 697194 - RNA, 19 nt, Homo sapiens
gcaacacggcuccagaaga

SEQ ID NO: 697195 - RNA, 19 nt, Homo sapiens
cagaaggaacugucagaaa

SEQ ID NO: 697196 - RNA, 19 nt, Homo sapiens
aaguugaucuguaauguuc

SEQ ID NO: 697197 - RNA, 19 nt, Homo sapiens
ccaccaauacucaggauga

SEQ ID NO: 697198 - RNA, 19 nt, Homo sapiens
gagaaaaguuugagaaggu

SEQ ID NO: 697199 - RNA, 19 nt, Homo sapiens
cagcuguggugaauguuga

SEQ ID NO: 697200 - RNA, 19 nt, Homo sapiens
cuacuuugcugacaugucu

SEQ ID NO: 697201 - RNA, 19 nt, Homo sapiens
uggcaugguuccaggauga

SEQ ID NO: 697202 - RNA, 19 nt, Homo sapiens
cauaacaggaugcuucuau

SEQ ID NO: 697203 - RNA, 19 nt, Homo sapiens
gaagccagagucacagcua

SEQ ID NO: 697204 - RNA, 19 nt, Homo sapiens
cggcagggcgagagcauua

SEQ ID NO: 697205 - RNA, 19 nt, Homo sapiens
gcucauguguauugugaag

SEQ ID NO: 697206 - RNA, 19 nt, Homo sapiens
ggaguacagugccauuagg

SEQ ID NO: 697207 - RNA, 19 nt, Homo sapiens
gcaagauggcucccaguuc

SEQ ID NO: 697208 - RNA, 19 nt, Homo sapiens
gagugccaauuacugcuuu

SEQ ID NO: 697209 - RNA, 19 nt, Homo sapiens
uauagaaaccuacauugug

SEQ ID NO: 697210 - RNA, 19 nt, Homo sapiens
gguuaccagucucuuaaga

SEQ ID NO: 697211 - RNA, 19 nt, Homo sapiens
ccaauacucaggaugaaga

SEQ ID NO: 697212 - RNA, 19 nt, Homo sapiens
gauggacuaugccaccaau

SEQ ID NO: 697213 - RNA, 19 nt, Homo sapiens
ggggaaggcucauguguau

SEQ ID NO: 697214 - RNA, 19 nt, Homo sapiens
cuuccaagagugccaauua

SEQ ID NO: 697215 - RNA, 19 nt, Homo sapiens
ccaugaccuugcuggauuu

SEQ ID NO: 697216 - RNA, 19 nt, Homo sapiens
uacaauuacuagaggcuuu

SEQ ID NO: 697217 - RNA, 19 nt, Homo sapiens
ugugaaggccuugcuguua

SEQ ID NO: 697218 - RNA, 19 nt, Homo sapiens
gaaucuacuuugcugacau

SEQ ID NO: 697219 - RNA, 19 nt, Homo sapiens
ggaaucuacuuugcugaca

SEQ ID NO: 697220 - RNA, 19 nt, Homo sapiens
aagcucccaucacagguua

SEQ ID NO: 697221 - RNA, 19 nt, Homo sapiens
gaagcucccaucacagguu

SEQ ID NO: 697222 - RNA, 19 nt, Homo sapiens
cagguuaccagucucuuaa

SEQ ID NO: 697223 - RNA, 19 nt, Homo sapiens
caacaacaacaaguacuau

SEQ ID NO: 697224 - RNA, 19 nt, Homo sapiens
gaugucaugcuaaaucaga

SEQ ID NO: 697225 - RNA, 19 nt, Homo sapiens
uugagaaggugccuggaaa

SEQ ID NO: 697226 - RNA, 19 nt, Homo sapiens
ucaacaacaacaaguacua

SEQ ID NO: 697227 - RNA, 19 nt, Homo sapiens
uggugaauguugaucuuaa

SEQ ID NO: 697228 - RNA, 19 nt, Homo sapiens
uaagaagauugaggauugu

SEQ ID NO: 697229 - RNA, 19 nt, Homo sapiens
ucagaccaaucuccaguuc

SEQ ID NO: 697230 - RNA, 19 nt, Homo sapiens
gcaguguuguacuugugaa

SEQ ID NO: 697231 - RNA, 19 nt, Homo sapiens
ggaccaacacuauagaaac

SEQ ID NO: 697232 - RNA, 19 nt, Homo sapiens
ucuuaaaucucccuugaag

SEQ ID NO: 697233 - RNA, 19 nt, Homo sapiens
ucaacaaggccaaggaaau

SEQ ID NO: 697234 - RNA, 19 nt, Homo sapiens
gcagggcgagagcauuaaa

SEQ ID NO: 697235 - RNA, 19 nt, Homo sapiens
aacaacaaguacuaucuga

SEQ ID NO: 697236 - RNA, 19 nt, Homo sapiens
aaggaaaugaugucuauga

SEQ ID NO: 697237 - RNA, 19 nt, Homo sapiens
ucauguguauugugaagga

SEQ ID NO: 697238 - RNA, 19 nt, Homo sapiens
auacaggacugcugcucuu

SEQ ID NO: 697239 - RNA, 19 nt, Homo sapiens
uaacugggugggaaucuug

SEQ ID NO: 697240 - RNA, 19 nt, Homo sapiens
caacacaucuggaaaguaa

SEQ ID NO: 697241 - RNA, 19 nt, Homo sapiens
gcaaggagauguucaagaa

SEQ ID NO: 697242 - RNA, 19 nt, Homo sapiens
ccaaauagccgaugucuaa

SEQ ID NO: 697243 - RNA, 19 nt, Homo sapiens
caagucagcuggauauguu

SEQ ID NO: 697244 - RNA, 19 nt, Homo sapiens
gcauuugacucuuuacuug

SEQ ID NO: 697245 - RNA, 19 nt, Homo sapiens
caagaucccugaacuuaug

SEQ ID NO: 697246 - RNA, 19 nt, Homo sapiens
cgcagaagcucaucacuaa

SEQ ID NO: 697247 - RNA, 19 nt, Homo sapiens
gcagagagcaccauaucaa

SEQ ID NO: 697248 - RNA, 19 nt, Homo sapiens
gcucaucacuaacaucuuc

SEQ ID NO: 697249 - RNA, 19 nt, Homo sapiens
gcuagaagaugcaaagaag

SEQ ID NO: 697250 - RNA, 19 nt, Homo sapiens
gaaggacuuugagaagaaa

SEQ ID NO: 697251 - RNA, 19 nt, Homo sapiens
gaacuuaugccuccuaacu

SEQ ID NO: 697252 - RNA, 19 nt, Homo sapiens
gauccaacauguccacuca

SEQ ID NO: 697253 - RNA, 19 nt, Homo sapiens
ucacuaacaucuucagcaa

SEQ ID NO: 697254 - RNA, 19 nt, Homo sapiens
cugcaaggcuggacuguga

SEQ ID NO: 697255 - RNA, 19 nt, Homo sapiens
agaaggacuuugagaagaa

SEQ ID NO: 697256 - RNA, 19 nt, Homo sapiens
gcgaguaccucaucuacca

SEQ ID NO: 697257 - RNA, 19 nt, Homo sapiens
gauacagaccuacuuagaa

SEQ ID NO: 697258 - RNA, 19 nt, Homo sapiens
uacaagaucccugaacuua

SEQ ID NO: 697259 - RNA, 19 nt, Homo sapiens
ggagcuguccucacacuuu

SEQ ID NO: 697260 - RNA, 19 nt, Homo sapiens
ggugauacagaccuacuua

SEQ ID NO: 697261 - RNA, 19 nt, Homo sapiens
gccaggaccucucccaugu

SEQ ID NO: 697262 - RNA, 19 nt, Homo sapiens
agucaaagaucaaccacuu

SEQ ID NO: 697263 - RNA, 19 nt, Homo sapiens
gacaagauuuccuccucaa

SEQ ID NO: 697264 - RNA, 19 nt, Homo sapiens
ggaccgagacuaccagcuu

SEQ ID NO: 697265 - RNA, 19 nt, Homo sapiens
ccaggaagcuguggugaag

SEQ ID NO: 697266 - RNA, 19 nt, Homo sapiens
gugagaucaugcaguguuu

SEQ ID NO: 697267 - RNA, 19 nt, Homo sapiens
ucaccaugcuguacaagau

SEQ ID NO: 697268 - RNA, 19 nt, Homo sapiens
ucauggaccuggaugugaa

SEQ ID NO: 697269 - RNA, 19 nt, Homo sapiens
agaccaacaucgagaacaa

SEQ ID NO: 697270 - RNA, 19 nt, Homo sapiens
gcaucuacuuugccucaga

SEQ ID NO: 697271 - RNA, 19 nt, Homo sapiens
ggacuuugagaagaaauuu

SEQ ID NO: 697272 - RNA, 19 nt, Homo sapiens
aagaaggacuuugagaaga

SEQ ID NO: 697273 - RNA, 19 nt, Homo sapiens
gauauguuauuggcaugaa

SEQ ID NO: 697274 - RNA, 19 nt, Homo sapiens
ggaccuggaugugaagaag

SEQ ID NO: 697275 - RNA, 19 nt, Homo sapiens
guacaagaucccugaacuu

SEQ ID NO: 697276 - RNA, 19 nt, Homo sapiens
aaccagcauuugacucuuu

SEQ ID NO: 697277 - RNA, 19 nt, Homo sapiens
gcaagucagcuggauaugu

SEQ ID NO: 697278 - RNA, 19 nt, Homo sapiens
ggcaagggcaucuacuuug

SEQ ID NO: 697279 - RNA, 19 nt, Homo sapiens
auacagaccuacuuagaac

SEQ ID NO: 697280 - RNA, 19 nt, Homo sapiens
gcagagaagcgcauaaucc

SEQ ID NO: 697281 - RNA, 19 nt, Homo sapiens
uuuauagguuccacaugua

SEQ ID NO: 697282 - RNA, 19 nt, Homo sapiens
gggcagagagcaccauauc

SEQ ID NO: 697283 - RNA, 19 nt, Homo sapiens
ucauccagcugcuccaaga

SEQ ID NO: 697284 - RNA, 19 nt, Homo sapiens
gcuggacugugaucuucaa

SEQ ID NO: 697285 - RNA, 19 nt, Homo sapiens
cagaagcucaucacuaaca

SEQ ID NO: 697286 - RNA, 19 nt, Homo sapiens
ucaaagaucaaccacuuca

SEQ ID NO: 697287 - RNA, 19 nt, Homo sapiens
gagaacaacaacaagaagu

SEQ ID NO: 697288 - RNA, 19 nt, Homo sapiens
ccgcguggauccaacaugu

SEQ ID NO: 697289 - RNA, 19 nt, Homo sapiens
acuuaugccuccuaacuga

SEQ ID NO: 697290 - RNA, 19 nt, Homo sapiens
gcccuacacuucaacacau

SEQ ID NO: 697291 - RNA, 19 nt, Homo sapiens
gagcuguccucacacuuuu

SEQ ID NO: 697292 - RNA, 19 nt, Homo sapiens
ugggaaagcugagcaagca

SEQ ID NO: 697293 - RNA, 19 nt, Homo sapiens
ucagcuggauauguuauug

SEQ ID NO: 697294 - RNA, 19 nt, Homo sapiens
ugauacagaccuacuuaga

SEQ ID NO: 697295 - RNA, 19 nt, Homo sapiens
acuaccagcuucucaagug

SEQ ID NO: 697296 - RNA, 19 nt, Homo sapiens
ccgaagcccuggguacaga

SEQ ID NO: 697297 - RNA, 19 nt, Homo sapiens
uagaagaugcaaagaagga

SEQ ID NO: 697298 - RNA, 19 nt, Homo sapiens
gaggucggccagucaaaga

SEQ ID NO: 697299 - RNA, 19 nt, Homo sapiens
ggccauacccgcagagaag

SEQ ID NO: 697300 - RNA, 19 nt, Homo sapiens
gagcgggaccacuuugugu

SEQ ID NO: 697301 - RNA, 19 nt, Homo sapiens
gcagagcgggaccacuuug

SEQ ID NO: 697302 - RNA, 19 nt, Homo sapiens
gggaaaagaccaagaacaa

SEQ ID NO: 697303 - RNA, 19 nt, Homo sapiens
guucacccauguuuucaua

SEQ ID NO: 697304 - RNA, 19 nt, Homo sapiens
gugccuggcuuauuucacu

SEQ ID NO: 697305 - RNA, 19 nt, Homo sapiens
gaucaugcaguguuugucu

SEQ ID NO: 697306 - RNA, 19 nt, Homo sapiens
guaaccagcauuugacucu

SEQ ID NO: 697307 - RNA, 19 nt, Homo sapiens
ggagaggucggccagucaa

SEQ ID NO: 697308 - RNA, 19 nt, Homo sapiens
uggcaagggcaucuacuuu

SEQ ID NO: 697309 - RNA, 19 nt, Homo sapiens
ccacaggugcccuacacuu

SEQ ID NO: 697310 - RNA, 19 nt, Homo sapiens
gcugagcaagcaacagauu

SEQ ID NO: 697311 - RNA, 19 nt, Homo sapiens
gacagcaaccgcuucuuca

SEQ ID NO: 697312 - RNA, 19 nt, Homo sapiens
gcuuauuucacucagcaua

SEQ ID NO: 697313 - RNA, 19 nt, Homo sapiens
gagaucaugcaguguuugu

SEQ ID NO: 697314 - RNA, 19 nt, Homo sapiens
ccuccuaacugaaauuuug

SEQ ID NO: 697315 - RNA, 19 nt, Homo sapiens
gaaagcugagcaagcaaca

SEQ ID NO: 697316 - RNA, 19 nt, Homo sapiens
agacugagggcccugagaa

SEQ ID NO: 697317 - RNA, 19 nt, Homo sapiens
ucuggaaaguaaaccaaga

SEQ ID NO: 697318 - RNA, 19 nt, Homo sapiens
caacaucgagaacaacaac

SEQ ID NO: 697319 - RNA, 19 nt, Homo sapiens
gggaccacuuugugucuca

SEQ ID NO: 697320 - RNA, 19 nt, Homo sapiens
aaagaucaaccacuucaca

SEQ ID NO: 697321 - RNA, 19 nt, Homo sapiens
agaacaacaacaagaaguu

SEQ ID NO: 697322 - RNA, 19 nt, Homo sapiens
accagcauuugacucuuua

SEQ ID NO: 697323 - RNA, 19 nt, Homo sapiens
ucaaucauccugcccaucu

SEQ ID NO: 697324 - RNA, 19 nt, Homo sapiens
gagcgaguaccucaucuac

SEQ ID NO: 697325 - RNA, 19 nt, Homo sapiens
caggugcccuacacuucaa

SEQ ID NO: 697326 - RNA, 19 nt, Homo sapiens
agacagcaaccgcuucuuc

SEQ ID NO: 697327 - RNA, 19 nt, Homo sapiens
guucagcagcuccacauuc

SEQ ID NO: 697328 - RNA, 19 nt, Homo sapiens
gaguacaaggugauacaga

SEQ ID NO: 697329 - RNA, 19 nt, Homo sapiens
acgcagaagcucaucacua

SEQ ID NO: 697330 - RNA, 19 nt, Homo sapiens
caagauuuccuccucaaaa

SEQ ID NO: 697331 - RNA, 19 nt, Homo sapiens
gaaaagaccaagaacaacu

SEQ ID NO: 697332 - RNA, 19 nt, Homo sapiens
aagcugagcaagcaacaga

SEQ ID NO: 697333 - RNA, 19 nt, Homo sapiens
cgaaguacaggcagaggau

SEQ ID NO: 697334 - RNA, 19 nt, Homo sapiens
ucgagaacaacaacaagaa

SEQ ID NO: 697335 - RNA, 19 nt, Homo sapiens
uucugugccuggcuuauuu

SEQ ID NO: 697336 - RNA, 19 nt, Homo sapiens
uaaccagcauuugacucuu

SEQ ID NO: 697337 - RNA, 19 nt, Homo sapiens
acaagaucccugaacuuau

SEQ ID NO: 697338 - RNA, 19 nt, Homo sapiens
uaacuauagucaccaugcu

SEQ ID NO: 697339 - RNA, 19 nt, Homo sapiens
ccagagcgaguaccucauc

SEQ ID NO: 697340 - RNA, 19 nt, Homo sapiens
caacuuaccuugucacuua

SEQ ID NO: 697341 - RNA, 19 nt, Homo sapiens
ccaaagaacucgacuguua

SEQ ID NO: 697342 - RNA, 19 nt, Homo sapiens
gaacgaagauguaacuguu

SEQ ID NO: 697343 - RNA, 19 nt, Homo sapiens
gaacucgacuguuacauug

SEQ ID NO: 697344 - RNA, 19 nt, Homo sapiens
gcucaaaucucaucaaauc

SEQ ID NO: 697345 - RNA, 19 nt, Homo sapiens
gaauaacaguuccaggaua

SEQ ID NO: 697346 - RNA, 19 nt, Homo sapiens
gaacucaacaccaugaaua

SEQ ID NO: 697347 - RNA, 19 nt, Homo sapiens
uaacugcagugucauguuu

SEQ ID NO: 697348 - RNA, 19 nt, Homo sapiens
uaagaaaggcguucaguuu

SEQ ID NO: 697349 - RNA, 19 nt, Homo sapiens
cugaauagaugaaagcaua

SEQ ID NO: 697350 - RNA, 19 nt, Homo sapiens
ucacaggccuuccuacauu

SEQ ID NO: 697351 - RNA, 19 nt, Homo sapiens
uaugagagguuuacuagaa

SEQ ID NO: 697352 - RNA, 19 nt, Homo sapiens
gacaauaccuaccaacaug

SEQ ID NO: 697353 - RNA, 19 nt, Homo sapiens
caauuuaacugcaguguca

SEQ ID NO: 697354 - RNA, 19 nt, Homo sapiens
gugagaaacugaauguauu

SEQ ID NO: 697355 - RNA, 19 nt, Homo sapiens
gaaggaauuuguuaaagag

SEQ ID NO: 697356 - RNA, 19 nt, Homo sapiens
gggcagccuuuaaauauga

SEQ ID NO: 697357 - RNA, 19 nt, Homo sapiens
cuacagaagcuauuuauga

SEQ ID NO: 697358 - RNA, 19 nt, Homo sapiens
gaauaaugcuauccuugga

SEQ ID NO: 697359 - RNA, 19 nt, Homo sapiens
aauaacaguuccaggauaa

SEQ ID NO: 697360 - RNA, 19 nt, Homo sapiens
cagaagcuauuuaugaaga

SEQ ID NO: 697361 - RNA, 19 nt, Homo sapiens
uggaacaaauacucacuua

SEQ ID NO: 697362 - RNA, 19 nt, Homo sapiens
caucaaaggugccaacucu

SEQ ID NO: 697363 - RNA, 19 nt, Homo sapiens
gauggugacugagaagaaa

SEQ ID NO: 697364 - RNA, 19 nt, Homo sapiens
caaaggagcucaaaaugau

SEQ ID NO: 697365 - RNA, 19 nt, Homo sapiens
caacuugccauuagacauu

SEQ ID NO: 697366 - RNA, 19 nt, Homo sapiens
gaacaggucacuagacucu

SEQ ID NO: 697367 - RNA, 19 nt, Homo sapiens
ggaagacaauaccuaccaa

SEQ ID NO: 697368 - RNA, 19 nt, Homo sapiens
agaagaaaguggaugauca

SEQ ID NO: 697369 - RNA, 19 nt, Homo sapiens
caaauucaguguuucuaca

SEQ ID NO: 697370 - RNA, 19 nt, Homo sapiens
gacaagagacugcucaaau

SEQ ID NO: 697371 - RNA, 19 nt, Homo sapiens
gauacaacuugccauuaga

SEQ ID NO: 697372 - RNA, 19 nt, Homo sapiens
gcagaacugugguccaagu

SEQ ID NO: 697373 - RNA, 19 nt, Homo sapiens
uaaucaacuuucaggcuua

SEQ ID NO: 697374 - RNA, 19 nt, Homo sapiens
agugaaagcuuugaagaaa

SEQ ID NO: 697375 - RNA, 19 nt, Homo sapiens
gauaugagagguuuacuag

SEQ ID NO: 697376 - RNA, 19 nt, Homo sapiens
agauguaacuguugagcua

SEQ ID NO: 697377 - RNA, 19 nt, Homo sapiens
acaagagacugcucaaauc

SEQ ID NO: 697378 - RNA, 19 nt, Homo sapiens
gugaagaaggaauuuguua

SEQ ID NO: 697379 - RNA, 19 nt, Homo sapiens
ggauguaagcgaagucaaa

SEQ ID NO: 697380 - RNA, 19 nt, Homo sapiens
ucaacaccaugaauaauca

SEQ ID NO: 697381 - RNA, 19 nt, Homo sapiens
ugaaaaccaugaagacaua

SEQ ID NO: 697382 - RNA, 19 nt, Homo sapiens
uaacacugauuccugacaa

SEQ ID NO: 697383 - RNA, 19 nt, Homo sapiens
ggagaacucaacaccauga

SEQ ID NO: 697384 - RNA, 19 nt, Homo sapiens
gaaggaagccaccaauacu

SEQ ID NO: 697385 - RNA, 19 nt, Homo sapiens
caccagcucuuucuucugu

SEQ ID NO: 697386 - RNA, 19 nt, Homo sapiens
caucaaauccuccaacauc

SEQ ID NO: 697387 - RNA, 19 nt, Homo sapiens
gacaacagcgugagauuuc

SEQ ID NO: 697388 - RNA, 19 nt, Homo sapiens
guucugauguaacaaacaa

SEQ ID NO: 697389 - RNA, 19 nt, Homo sapiens
ggaacaaauacucacuuaa

SEQ ID NO: 697390 - RNA, 19 nt, Homo sapiens
gccaaaagaugcagugaaa

SEQ ID NO: 697391 - RNA, 19 nt, Homo sapiens
caagaucuccucgaccuaa

SEQ ID NO: 697392 - RNA, 19 nt, Homo sapiens
ugaauuggauauggugaaa

SEQ ID NO: 697393 - RNA, 19 nt, Homo sapiens
gcagugaaagcuuugaaga

SEQ ID NO: 697394 - RNA, 19 nt, Homo sapiens
auaauccucugguuuagaa

SEQ ID NO: 697395 - RNA, 19 nt, Homo sapiens
ggauaugagagguuuacua

SEQ ID NO: 697396 - RNA, 19 nt, Homo sapiens
gaauuuaguuaagcuacug

SEQ ID NO: 697397 - RNA, 19 nt, Homo sapiens
gugcagaacugugguccaa

SEQ ID NO: 697398 - RNA, 19 nt, Homo sapiens
ccacgcauaugauaauuuu

SEQ ID NO: 697399 - RNA, 19 nt, Homo sapiens
aagaugcagugaaagcuuu

SEQ ID NO: 697400 - RNA, 19 nt, Homo sapiens
caacuuucaggcuuaaauu

SEQ ID NO: 697401 - RNA, 19 nt, Homo sapiens
ccagcucuuucuucuguaa

SEQ ID NO: 697402 - RNA, 19 nt, Homo sapiens
agauacaacuugccauuag

SEQ ID NO: 697403 - RNA, 19 nt, Homo sapiens
gaaauccaacuuaccuugu

SEQ ID NO: 697404 - RNA, 19 nt, Homo sapiens
gcacaaaggagcucaaaau

SEQ ID NO: 697405 - RNA, 19 nt, Homo sapiens
ccaccaauacuaccaguga

SEQ ID NO: 697406 - RNA, 19 nt, Homo sapiens
gaaacagcaagacaagaga

SEQ ID NO: 697407 - RNA, 19 nt, Homo sapiens
uaagcgaagucaaagaagu

SEQ ID NO: 697408 - RNA, 19 nt, Homo sapiens
ccucugguuuagaauuaua

SEQ ID NO: 697409 - RNA, 19 nt, Homo sapiens
gaucuccagccaccuaauu

SEQ ID NO: 697410 - RNA, 19 nt, Homo sapiens
caaguucugauguaacaaa

SEQ ID NO: 697411 - RNA, 19 nt, Homo sapiens
cagaaggaagccaccaaua

SEQ ID NO: 697412 - RNA, 19 nt, Homo sapiens
cgagugauguccgccauau

SEQ ID NO: 697413 - RNA, 19 nt, Homo sapiens
ucacuacagaagcuauuua

SEQ ID NO: 697414 - RNA, 19 nt, Homo sapiens
gaacauucaaauucagugu

SEQ ID NO: 697415 - RNA, 19 nt, Homo sapiens
ucaagccacgcauaugaua

SEQ ID NO: 697416 - RNA, 19 nt, Homo sapiens
cagauacaacuugccauua

SEQ ID NO: 697417 - RNA, 19 nt, Homo sapiens
uggcacauuucugcuauaa

SEQ ID NO: 697418 - RNA, 19 nt, Homo sapiens
gguggcacauuucugcuau

SEQ ID NO: 697419 - RNA, 19 nt, Homo sapiens
caccaugaauaaucaacuu

SEQ ID NO: 697420 - RNA, 19 nt, Homo sapiens
ggagaacgaagauguaacu

SEQ ID NO: 697421 - RNA, 19 nt, Homo sapiens
gaagaaaguggaugaucag

SEQ ID NO: 697422 - RNA, 19 nt, Homo sapiens
ggaguuugaucccuuagcu

SEQ ID NO: 697423 - RNA, 19 nt, Homo sapiens
ucaguuuccucccucagaa

SEQ ID NO: 697424 - RNA, 19 nt, Homo sapiens
ccagauacaacuugccauu

SEQ ID NO: 697425 - RNA, 19 nt, Homo sapiens
cacaggccuuccuacauuu

SEQ ID NO: 697426 - RNA, 19 nt, Homo sapiens
ugacaacagcgugagauuu

SEQ ID NO: 697427 - RNA, 19 nt, Homo sapiens
caaaggugccaacucucua

SEQ ID NO: 697428 - RNA, 19 nt, Homo sapiens
aauggaguuugaucccuua

SEQ ID NO: 697429 - RNA, 19 nt, Homo sapiens
ucuggaacauucaaauuca

SEQ ID NO: 697430 - RNA, 19 nt, Homo sapiens
ccucaagccacgcauauga

SEQ ID NO: 697431 - RNA, 19 nt, Homo sapiens
acgaagauguaacuguuga

SEQ ID NO: 697432 - RNA, 19 nt, Homo sapiens
cugcucaaaucucaucaaa

SEQ ID NO: 697433 - RNA, 19 nt, Homo sapiens
gugaaugaggauuugaaua

SEQ ID NO: 697434 - RNA, 19 nt, Homo sapiens
guccuuaggccaaccaauu

SEQ ID NO: 697435 - RNA, 19 nt, Homo sapiens
ucaaaaugauggugacuga

SEQ ID NO: 697436 - RNA, 19 nt, Homo sapiens
ggauuugaauaaugcuauc

SEQ ID NO: 697437 - RNA, 19 nt, Homo sapiens
gaauacuccugggucugaa

SEQ ID NO: 697438 - RNA, 19 nt, Homo sapiens
uuacauuggucccagaaca

SEQ ID NO: 697439 - RNA, 19 nt, Homo sapiens
aaaugauggugacugagaa

SEQ ID NO: 697440 - RNA, 19 nt, Homo sapiens
gaacagaaaucuuaacuug

SEQ ID NO: 697441 - RNA, 19 nt, Homo sapiens
caacauugcuuacaucaug

SEQ ID NO: 697442 - RNA, 19 nt, Homo sapiens
ccaaacaggucuugucaaa

SEQ ID NO: 697443 - RNA, 19 nt, Homo sapiens
gggaagacauggauaguau

SEQ ID NO: 697444 - RNA, 19 nt, Homo sapiens
ggacagaaaccuuauccua

SEQ ID NO: 697445 - RNA, 19 nt, Homo sapiens
ggauaaaucugccuuaaaa

SEQ ID NO: 697446 - RNA, 19 nt, Homo sapiens
aaacaggucuugucaaaca

SEQ ID NO: 697447 - RNA, 19 nt, Homo sapiens
ccacacaacuaccugaauu

SEQ ID NO: 697448 - RNA, 19 nt, Homo sapiens
ggaagcagcucuguugaug

SEQ ID NO: 697449 - RNA, 19 nt, Homo sapiens
gaagaacagucugcauuug

SEQ ID NO: 697450 - RNA, 19 nt, Homo sapiens
caccagauauuucgucuuu

SEQ ID NO: 697451 - RNA, 19 nt, Homo sapiens
gcagggugcuuuacuccua

SEQ ID NO: 697452 - RNA, 19 nt, Homo sapiens
gaaauccucuggcucuuca

SEQ ID NO: 697453 - RNA, 19 nt, Homo sapiens
ggaccaccauggcuuauga

SEQ ID NO: 697454 - RNA, 19 nt, Homo sapiens
aagaagaaguugaaggaua

SEQ ID NO: 697455 - RNA, 19 nt, Homo sapiens
gagcuaacccagaaucuuu

SEQ ID NO: 697456 - RNA, 19 nt, Homo sapiens
caacagaggccaaggaguu

SEQ ID NO: 697457 - RNA, 19 nt, Homo sapiens
gaaggagccuggacacagu

SEQ ID NO: 697458 - RNA, 19 nt, Homo sapiens
caaagccucuucuguagga

SEQ ID NO: 697459 - RNA, 19 nt, Homo sapiens
gaaaucagcucgggaugag

SEQ ID NO: 697460 - RNA, 19 nt, Homo sapiens
ucacugaccauuugccuua

SEQ ID NO: 697461 - RNA, 19 nt, Homo sapiens
gcacuacagcaucaaagua

SEQ ID NO: 697462 - RNA, 19 nt, Homo sapiens
gaaagcauccagcucagaa

SEQ ID NO: 697463 - RNA, 19 nt, Homo sapiens
ggacaaagagagagagaga

SEQ ID NO: 697464 - RNA, 19 nt, Homo sapiens
gcacuccucugaugauuac

SEQ ID NO: 697465 - RNA, 19 nt, Homo sapiens
gcaggaaacugaggguaug

SEQ ID NO: 697466 - RNA, 19 nt, Homo sapiens
gcuugaaccuauucuggua

SEQ ID NO: 697467 - RNA, 19 nt, Homo sapiens
gauaguauaggaagacauu

SEQ ID NO: 697468 - RNA, 19 nt, Homo sapiens
acaccaagcucugaguuaa

SEQ ID NO: 697469 - RNA, 19 nt, Homo sapiens
ggaccuccauacauucuga

SEQ ID NO: 697470 - RNA, 19 nt, Homo sapiens
acaacuaccugaauugaau

SEQ ID NO: 697471 - RNA, 19 nt, Homo sapiens
agacagagcccauugaugu

SEQ ID NO: 697472 - RNA, 19 nt, Homo sapiens
gugcuaaccuugaucuuuc

SEQ ID NO: 697473 - RNA, 19 nt, Homo sapiens
cauagacuguaacuacuuu

SEQ ID NO: 697474 - RNA, 19 nt, Homo sapiens
ugaaaccucucuaugugaa

SEQ ID NO: 697475 - RNA, 19 nt, Homo sapiens
ugaaggauagugaacuuua

SEQ ID NO: 697476 - RNA, 19 nt, Homo sapiens
ccaaaucccauuacaguug

SEQ ID NO: 697477 - RNA, 19 nt, Homo sapiens
agacauggauaguauagga

SEQ ID NO: 697478 - RNA, 19 nt, Homo sapiens
ggacagugguucuuguucu

SEQ ID NO: 697479 - RNA, 19 nt, Homo sapiens
gaaccaaaaucaagaggaa

SEQ ID NO: 697480 - RNA, 19 nt, Homo sapiens
gcaggaccaccauggcuua

SEQ ID NO: 697481 - RNA, 19 nt, Homo sapiens
ggucuugucaaacacauua

SEQ ID NO: 697482 - RNA, 19 nt, Homo sapiens
gaagagaaggacaaagaga

SEQ ID NO: 697483 - RNA, 19 nt, Homo sapiens
ggacggacacacacaagaa

SEQ ID NO: 697484 - RNA, 19 nt, Homo sapiens
agaagaaguugaaggauag

SEQ ID NO: 697485 - RNA, 19 nt, Homo sapiens
acagaaaccuuauccuaca

SEQ ID NO: 697486 - RNA, 19 nt, Homo sapiens
caauaucccucccaacaag

SEQ ID NO: 697487 - RNA, 19 nt, Homo sapiens
uaccaugccucuucuguau

SEQ ID NO: 697488 - RNA, 19 nt, Homo sapiens
ggagaagcauaaagagaag

SEQ ID NO: 697489 - RNA, 19 nt, Homo sapiens
gaaggauagugaacuuuac

SEQ ID NO: 697490 - RNA, 19 nt, Homo sapiens
guagaggguucauuccaau

SEQ ID NO: 697491 - RNA, 19 nt, Homo sapiens
caaagaauccugggacaga

SEQ ID NO: 697492 - RNA, 19 nt, Homo sapiens
aaugaaaccucucuaugug

SEQ ID NO: 697493 - RNA, 19 nt, Homo sapiens
uggaagcaauuaccagaaa

SEQ ID NO: 697494 - RNA, 19 nt, Homo sapiens
gggaguuagugauagauga

SEQ ID NO: 697495 - RNA, 19 nt, Homo sapiens
gaagacauggauaguauag

SEQ ID NO: 697496 - RNA, 19 nt, Homo sapiens
ggaagacauggauaguaua

SEQ ID NO: 697497 - RNA, 19 nt, Homo sapiens
guggauaaaucugccuuaa

SEQ ID NO: 697498 - RNA, 19 nt, Homo sapiens
agucaaagccucuucugua

SEQ ID NO: 697499 - RNA, 19 nt, Homo sapiens
ccuaccagguguucuguaa

SEQ ID NO: 697500 - RNA, 19 nt, Homo sapiens
ccacagugcuaaccuugau

SEQ ID NO: 697501 - RNA, 19 nt, Homo sapiens
ccaagaagaaguugaagga

SEQ ID NO: 697502 - RNA, 19 nt, Homo sapiens
caaaucccauuacaguugu

SEQ ID NO: 697503 - RNA, 19 nt, Homo sapiens
gaaacccagcccuauugua

SEQ ID NO: 697504 - RNA, 19 nt, Homo sapiens
gauacagauuugucauuuc

SEQ ID NO: 697505 - RNA, 19 nt, Homo sapiens
gcaaagguuuagccaagag

SEQ ID NO: 697506 - RNA, 19 nt, Homo sapiens
ccagauauuucgucuuugg

SEQ ID NO: 697507 - RNA, 19 nt, Homo sapiens
gaacagucugcauuuguga

SEQ ID NO: 697508 - RNA, 19 nt, Homo sapiens
ggaggacagugguucuugu

SEQ ID NO: 697509 - RNA, 19 nt, Homo sapiens
gguauuugguacuauuaga

SEQ ID NO: 697510 - RNA, 19 nt, Homo sapiens
auuaagugcuggugucuuu

SEQ ID NO: 697511 - RNA, 19 nt, Homo sapiens
ggugggaggugauaaaauu

SEQ ID NO: 697512 - RNA, 19 nt, Homo sapiens
aaacccagcccuauuguau

SEQ ID NO: 697513 - RNA, 19 nt, Homo sapiens
agacauuaauccuagcauu

SEQ ID NO: 697514 - RNA, 19 nt, Homo sapiens
gucuuagucugaaauguaa

SEQ ID NO: 697515 - RNA, 19 nt, Homo sapiens
gucaaagccucuucuguag

SEQ ID NO: 697516 - RNA, 19 nt, Homo sapiens
gaguaucgcgugaccauug

SEQ ID NO: 697517 - RNA, 19 nt, Homo sapiens
gaagaaagacaaggagaag

SEQ ID NO: 697518 - RNA, 19 nt, Homo sapiens
ucgggagccugaugguuua

SEQ ID NO: 697519 - RNA, 19 nt, Homo sapiens
gauauuucgucuuuggaau

SEQ ID NO: 697520 - RNA, 19 nt, Homo sapiens
ggaagcacuccucugauga

SEQ ID NO: 697521 - RNA, 19 nt, Homo sapiens
ccaucugcauccuauuuaa

SEQ ID NO: 697522 - RNA, 19 nt, Homo sapiens
gagaaccagacguuuguuu

SEQ ID NO: 697523 - RNA, 19 nt, Homo sapiens
ggaagauacagauuuguca

SEQ ID NO: 697524 - RNA, 19 nt, Homo sapiens
gcaugaaguuagccaccaa

SEQ ID NO: 697525 - RNA, 19 nt, Homo sapiens
ugucagugcuucuggauuc

SEQ ID NO: 697526 - RNA, 19 nt, Homo sapiens
gcacaaacagaacaaagca

SEQ ID NO: 697527 - RNA, 19 nt, Homo sapiens
acaaggagaagcauaaaga

SEQ ID NO: 697528 - RNA, 19 nt, Homo sapiens
gacaugaguuacagagcuu

SEQ ID NO: 697529 - RNA, 19 nt, Homo sapiens
aaaugaaaccucucuaugu

SEQ ID NO: 697530 - RNA, 19 nt, Homo sapiens
acccagcccuauuguauuu

SEQ ID NO: 697531 - RNA, 19 nt, Homo sapiens
gacauuaauccuagcauug

SEQ ID NO: 697532 - RNA, 19 nt, Homo sapiens
ucacagggcuauguugcuu

SEQ ID NO: 697533 - RNA, 19 nt, Homo sapiens
guugaaggauagugaacuu

SEQ ID NO: 697534 - RNA, 19 nt, Homo sapiens
guucugcauuccacaugua

SEQ ID NO: 697535 - RNA, 19 nt, Homo sapiens
gauaaacuuugcccagcau

SEQ ID NO: 697536 - RNA, 19 nt, Homo sapiens
ggaaagauaacgggaagau

SEQ ID NO: 697537 - RNA, 19 nt, Homo sapiens
cucagaagguuccaugaaa

SEQ ID NO: 697538 - RNA, 19 nt, Homo sapiens
gcauccagcucagaagguu

SEQ ID NO: 697539 - RNA, 19 nt, Homo sapiens
ccaacaagcgacugugaaa

SEQ ID NO: 697540 - RNA, 19 nt, Homo sapiens
ggagaaagaugaugacaug

SEQ ID NO: 697541 - RNA, 19 nt, Homo sapiens
ggaggaaggucccaaagau

SEQ ID NO: 697542 - RNA, 19 nt, Homo sapiens
gcagugagcuggagauggu

SEQ ID NO: 697543 - RNA, 19 nt, Homo sapiens
ggaagaagacccaggagaa

SEQ ID NO: 697544 - RNA, 19 nt, Homo sapiens
gaagaugaguuugacaugu

SEQ ID NO: 697545 - RNA, 19 nt, Homo sapiens
gaagaagacccaggagaaa

SEQ ID NO: 697546 - RNA, 19 nt, Homo sapiens
ggacugggcccucaacaug

SEQ ID NO: 697547 - RNA, 19 nt, Homo sapiens
ggaccauccugcccaagaa

SEQ ID NO: 697548 - RNA, 19 nt, Homo sapiens
gggcucaccucuugguuga

SEQ ID NO: 697549 - RNA, 19 nt, Homo sapiens
ggaaagagguaaaauacga

SEQ ID NO: 697550 - RNA, 19 nt, Homo sapiens
gaacaggccagaccaccaa

SEQ ID NO: 697551 - RNA, 19 nt, Homo sapiens
ccaaugagcagcugacaga

SEQ ID NO: 697552 - RNA, 19 nt, Homo sapiens
cagcugaccaugagacuuu

SEQ ID NO: 697553 - RNA, 19 nt, Homo sapiens
uuagaaaccugugucaaga

SEQ ID NO: 697554 - RNA, 19 nt, Homo sapiens
caugagacuuugcugagaa

SEQ ID NO: 697555 - RNA, 19 nt, Homo sapiens
ggucaccagcgaagaauuu

SEQ ID NO: 697556 - RNA, 19 nt, Homo sapiens
aagaugaguuugacauguu

SEQ ID NO: 697557 - RNA, 19 nt, Homo sapiens
gagcuggccugcagucucu

SEQ ID NO: 697558 - RNA, 19 nt, Homo sapiens
caaugacaaucucaacaau

SEQ ID NO: 697559 - RNA, 19 nt, Homo sapiens
gaugaugacaugcuguuug

SEQ ID NO: 697560 - RNA, 19 nt, Homo sapiens
cagcugaccugaucgacau

SEQ ID NO: 697561 - RNA, 19 nt, Homo sapiens
ggaccguguucaacucaga

SEQ ID NO: 697562 - RNA, 19 nt, Homo sapiens
caucgugcaugacaaagug

SEQ ID NO: 697563 - RNA, 19 nt, Homo sapiens
ggaagaugaguuugacaug

SEQ ID NO: 697564 - RNA, 19 nt, Homo sapiens
caacucagagacacaauca

SEQ ID NO: 697565 - RNA, 19 nt, Homo sapiens
uggcugcucugccuccuuu

SEQ ID NO: 697566 - RNA, 19 nt, Homo sapiens
gaacuuccacgaggugaug

SEQ ID NO: 697567 - RNA, 19 nt, Homo sapiens
ggagaucugcgacaucauc

SEQ ID NO: 697568 - RNA, 19 nt, Homo sapiens
ugacaugcuguuugccuua

SEQ ID NO: 697569 - RNA, 19 nt, Homo sapiens
ggacagcgcaucgagaaag

SEQ ID NO: 697570 - RNA, 19 nt, Homo sapiens
ucccucagaucgccaauga

SEQ ID NO: 697571 - RNA, 19 nt, Homo sapiens
ugacugaccuggacaugcu

SEQ ID NO: 697572 - RNA, 19 nt, Homo sapiens
gaggaaaggccuggaguuc

SEQ ID NO: 697573 - RNA, 19 nt, Homo sapiens
caucccagcuggcaggaau

SEQ ID NO: 697574 - RNA, 19 nt, Homo sapiens
ucaaugacaaucucaacaa

SEQ ID NO: 697575 - RNA, 19 nt, Homo sapiens
ggaggaaaggccuggaguu

SEQ ID NO: 697576 - RNA, 19 nt, Homo sapiens
gaggaaggucccaaagaug

SEQ ID NO: 697577 - RNA, 19 nt, Homo sapiens
gcucaccucuugguugauc

SEQ ID NO: 697578 - RNA, 19 nt, Homo sapiens
agaugaguuugacauguuu

SEQ ID NO: 697579 - RNA, 19 nt, Homo sapiens
acaaagugcucaaccucau

SEQ ID NO: 697580 - RNA, 19 nt, Homo sapiens
uagcagcaauggacuuucu

SEQ ID NO: 697581 - RNA, 19 nt, Homo sapiens
augacaaucucaacaaugu

SEQ ID NO: 697582 - RNA, 19 nt, Homo sapiens
aaaccugugucaagaacug

SEQ ID NO: 697583 - RNA, 19 nt, Homo sapiens
ccaugagacuuugcugaga

SEQ ID NO: 697584 - RNA, 19 nt, Homo sapiens
caugcuguuugccuuauga

SEQ ID NO: 697585 - RNA, 19 nt, Homo sapiens
gacaugcuguuugccuuau

SEQ ID NO: 697586 - RNA, 19 nt, Homo sapiens
gcucucacagucuuagaaa

SEQ ID NO: 697587 - RNA, 19 nt, Homo sapiens
gacaaucucaacaaugugu

SEQ ID NO: 697588 - RNA, 19 nt, Homo sapiens
gguagcagcaauggacuuu

SEQ ID NO: 697589 - RNA, 19 nt, Homo sapiens
agaagacccaggagaaaga

SEQ ID NO: 697590 - RNA, 19 nt, Homo sapiens
gagcaguaaagaagagaau

SEQ ID NO: 697591 - RNA, 19 nt, Homo sapiens
uugggaagcugcgcaguga

SEQ ID NO: 697592 - RNA, 19 nt, Homo sapiens
cuugguugauccucuugua

SEQ ID NO: 697593 - RNA, 19 nt, Homo sapiens
cacccaccaucgugcauga

SEQ ID NO: 697594 - RNA, 19 nt, Homo sapiens
gguugauccucuuguacug

SEQ ID NO: 697595 - RNA, 19 nt, Homo sapiens
agaaaccugugucaagaac

SEQ ID NO: 697596 - RNA, 19 nt, Homo sapiens
ccuuuuguauccccaauua

SEQ ID NO: 697597 - RNA, 19 nt, Homo sapiens
ugacauguuugcgcugaca

SEQ ID NO: 697598 - RNA, 19 nt, Homo sapiens
gcaguaaagaagagaaucg

SEQ ID NO: 697599 - RNA, 19 nt, Homo sapiens
ggagaggugccuuuuguau

SEQ ID NO: 697600 - RNA, 19 nt, Homo sapiens
gacuggaagaugaguuuga

SEQ ID NO: 697601 - RNA, 19 nt, Homo sapiens
cuggucgacuggaagauga

SEQ ID NO: 697602 - RNA, 19 nt, Homo sapiens
ugagggugaugucggagau

SEQ ID NO: 697603 - RNA, 19 nt, Homo sapiens
ccaccaucgugcaugacaa

SEQ ID NO: 697604 - RNA, 19 nt, Homo sapiens
ccucuugguugauccucuu

SEQ ID NO: 697605 - RNA, 19 nt, Homo sapiens
gaucugcgacaucaucaac

SEQ ID NO: 697606 - RNA, 19 nt, Homo sapiens
gaagacccaggagaaagau

SEQ ID NO: 697607 - RNA, 19 nt, Homo sapiens
gaccaacggaaagagguaa

SEQ ID NO: 697608 - RNA, 19 nt, Homo sapiens
gacacaaucaggacaggau

SEQ ID NO: 697609 - RNA, 19 nt, Homo sapiens
caccaucgugcaugacaaa

SEQ ID NO: 697610 - RNA, 19 nt, Homo sapiens
uagaaaccugugucaagaa

SEQ ID NO: 697611 - RNA, 19 nt, Homo sapiens
gaggugaugcuggcucuca

SEQ ID NO: 697612 - RNA, 19 nt, Homo sapiens
ugaccaacggaaagaggua

SEQ ID NO: 697613 - RNA, 19 nt, Homo sapiens
agacccaggagaaagauga

SEQ ID NO: 697614 - RNA, 19 nt, Homo sapiens
ggccucuggucgacuggaa

SEQ ID NO: 697615 - RNA, 19 nt, Homo sapiens
cggaggaaggucccaaaga

SEQ ID NO: 697616 - RNA, 19 nt, Homo sapiens
gcaucgagaaagccacaga

SEQ ID NO: 697617 - RNA, 19 nt, Homo sapiens
cuuagaaaccugugucaag

SEQ ID NO: 697618 - RNA, 19 nt, Homo sapiens
ccucccuccucugguguua

SEQ ID NO: 697619 - RNA, 19 nt, Homo sapiens
gaaagagguaaaauacgaa

SEQ ID NO: 697620 - RNA, 19 nt, Homo sapiens
ccugcgccaugaacgguuu

SEQ ID NO: 697621 - RNA, 19 nt, Homo sapiens
gagaucugcgacaucauca

SEQ ID NO: 697622 - RNA, 19 nt, Homo sapiens
cuguuugccuuaugagugu

SEQ ID NO: 697623 - RNA, 19 nt, Homo sapiens
auggagaucugcgacauca

SEQ ID NO: 697624 - RNA, 19 nt, Homo sapiens
gaggaccguguucaacuca

SEQ ID NO: 697625 - RNA, 19 nt, Homo sapiens
agaagaagcucaagccuuu

SEQ ID NO: 697626 - RNA, 19 nt, Homo sapiens
ggacauggcucagauuucu

SEQ ID NO: 697627 - RNA, 19 nt, Homo sapiens
cagagaaacuccacaagga

SEQ ID NO: 697628 - RNA, 19 nt, Homo sapiens
uaaaggaacugucagaaaa

SEQ ID NO: 697629 - RNA, 19 nt, Homo sapiens
ggacucaucgccagagaaa

SEQ ID NO: 697630 - RNA, 19 nt, Homo sapiens
gcagaguggugccaucauc

SEQ ID NO: 697631 - RNA, 19 nt, Homo sapiens
gaccugcacucacccaugu

SEQ ID NO: 697632 - RNA, 19 nt, Homo sapiens
ucaacaaggugguggugaa

SEQ ID NO: 697633 - RNA, 19 nt, Homo sapiens
ggcgagagcuacacacaca

SEQ ID NO: 697634 - RNA, 19 nt, Homo sapiens
ucacugcccugucccacaa

SEQ ID NO: 697635 - RNA, 19 nt, Homo sapiens
cuaaaggaacugucagaaa

SEQ ID NO: 697636 - RNA, 19 nt, Homo sapiens
gaaagguuccacaccaugu

SEQ ID NO: 697637 - RNA, 19 nt, Homo sapiens
gcuaggauacugggcguua

SEQ ID NO: 697638 - RNA, 19 nt, Homo sapiens
ccacaccaaugcugaaguc

SEQ ID NO: 697639 - RNA, 19 nt, Homo sapiens
gagaaacuccacaaggaau

SEQ ID NO: 697640 - RNA, 19 nt, Homo sapiens
caccaaugcugaagucaag

SEQ ID NO: 697641 - RNA, 19 nt, Homo sapiens
caccaucacucagcagcua

SEQ ID NO: 697642 - RNA, 19 nt, Homo sapiens
gaaacuccacaaggaauug

SEQ ID NO: 697643 - RNA, 19 nt, Homo sapiens
gcuaugagaaguucgacaa

SEQ ID NO: 697644 - RNA, 19 nt, Homo sapiens
gggagaggcuaaaggaacu

SEQ ID NO: 697645 - RNA, 19 nt, Homo sapiens
caacggcgacuuccucauc

SEQ ID NO: 697646 - RNA, 19 nt, Homo sapiens
ggacuaugggcaacauguu

SEQ ID NO: 697647 - RNA, 19 nt, Homo sapiens
caagguggacugccugguu

SEQ ID NO: 697648 - RNA, 19 nt, Homo sapiens
acacauccaguaccuguuu

SEQ ID NO: 697649 - RNA, 19 nt, Homo sapiens
gccuagaccugcuggaaag

SEQ ID NO: 697650 - RNA, 19 nt, Homo sapiens
gaggaggagcucaaacuca

SEQ ID NO: 697651 - RNA, 19 nt, Homo sapiens
ggagaugcagacccuaaug

SEQ ID NO: 697652 - RNA, 19 nt, Homo sapiens
gcuacacacacauccagua

SEQ ID NO: 697653 - RNA, 19 nt, Homo sapiens
caaccaggccuugcacuuc

SEQ ID NO: 697654 - RNA, 19 nt, Homo sapiens
gcucaagccuuuucucaag

SEQ ID NO: 697655 - RNA, 19 nt, Homo sapiens
gcagcgacuaugugaaguu

SEQ ID NO: 697656 - RNA, 19 nt, Homo sapiens
gcuaaaggaacugucagaa

SEQ ID NO: 697657 - RNA, 19 nt, Homo sapiens
cagcgacuaugugaaguuc

SEQ ID NO: 697658 - RNA, 19 nt, Homo sapiens
gcgacuaugugaaguucuc

SEQ ID NO: 697659 - RNA, 19 nt, Homo sapiens
gagcagaguggugccauca

SEQ ID NO: 697660 - RNA, 19 nt, Homo sapiens
aaccaggccuugcacuuca

SEQ ID NO: 697661 - RNA, 19 nt, Homo sapiens
acaccacguuuccucaugu

SEQ ID NO: 697662 - RNA, 19 nt, Homo sapiens
gaaggggacuggggcaaga

SEQ ID NO: 697663 - RNA, 19 nt, Homo sapiens
gugccauccuguacgagaa

SEQ ID NO: 697664 - RNA, 19 nt, Homo sapiens
agagaaacuccacaaggaa

SEQ ID NO: 697665 - RNA, 19 nt, Homo sapiens
gcugagcaacaccacguuu

SEQ ID NO: 697666 - RNA, 19 nt, Homo sapiens
gaaguacauccuggacuca

SEQ ID NO: 697667 - RNA, 19 nt, Homo sapiens
gagaugcagacccuaaugg

SEQ ID NO: 697668 - RNA, 19 nt, Homo sapiens
cccaagggcagccacauga

SEQ ID NO: 697669 - RNA, 19 nt, Homo sapiens
gcacuucaagaucaacaag

SEQ ID NO: 697670 - RNA, 19 nt, Homo sapiens
guaccacaccaaugcugaa

SEQ ID NO: 697671 - RNA, 19 nt, Homo sapiens
cagagggugccauccugua

SEQ ID NO: 697672 - RNA, 19 nt, Homo sapiens
cugccugguugcuaggaua

SEQ ID NO: 697673 - RNA, 19 nt, Homo sapiens
ggaggaggagcucaaacuc

SEQ ID NO: 697674 - RNA, 19 nt, Homo sapiens
gaggcuaaaggaacuguca

SEQ ID NO: 697675 - RNA, 19 nt, Homo sapiens
acacacacauccaguaccu

SEQ ID NO: 697676 - RNA, 19 nt, Homo sapiens
guggugccaucaucuacug

SEQ ID NO: 697677 - RNA, 19 nt, Homo sapiens
agaaacuccacaaggaauu

SEQ ID NO: 697678 - RNA, 19 nt, Homo sapiens
ccaagggcagccacaugaa

SEQ ID NO: 697679 - RNA, 19 nt, Homo sapiens
caacaccacguuuccucau

SEQ ID NO: 697680 - RNA, 19 nt, Homo sapiens
aaggagaugcagacccuaa

SEQ ID NO: 697681 - RNA, 19 nt, Homo sapiens
gacuaugggcaacauguuc

SEQ ID NO: 697682 - RNA, 19 nt, Homo sapiens
cagcaggccaggagcuaug

SEQ ID NO: 697683 - RNA, 19 nt, Homo sapiens
ucacccaugucgcccaucu

SEQ ID NO: 697684 - RNA, 19 nt, Homo sapiens
caagggcagccacaugaag

SEQ ID NO: 697685 - RNA, 19 nt, Homo sapiens
cagcacggaguuccagaug

SEQ ID NO: 697686 - RNA, 19 nt, Homo sapiens
ugaaggcaggcgagagcua

SEQ ID NO: 697687 - RNA, 19 nt, Homo sapiens
gggacuaugggcaacaugu

SEQ ID NO: 697688 - RNA, 19 nt, Homo sapiens
gaucccagaccugcacuca

SEQ ID NO: 697689 - RNA, 19 nt, Homo sapiens
gcaaggaaguggagcaaca

SEQ ID NO: 697690 - RNA, 19 nt, Homo sapiens
ggccagaguucaaauguga

SEQ ID NO: 697691 - RNA, 19 nt, Homo sapiens
gcucaggccuguaaucuca

SEQ ID NO: 697692 - RNA, 19 nt, Homo sapiens
ccagaaggcugaagcucuu

SEQ ID NO: 697693 - RNA, 19 nt, Homo sapiens
gcacguggcacccaugguu

SEQ ID NO: 697694 - RNA, 19 nt, Homo sapiens
ccuguaaucucagcacuuu

SEQ ID NO: 697695 - RNA, 19 nt, Homo sapiens
ccacagcccucuuucaacu

SEQ ID NO: 697696 - RNA, 19 nt, Homo sapiens
gcagacacccuucuucaca

SEQ ID NO: 697697 - RNA, 19 nt, Homo sapiens
gcugaacgcuuugagaagu

SEQ ID NO: 697698 - RNA, 19 nt, Homo sapiens
acagucagccugcagauuu

SEQ ID NO: 697699 - RNA, 19 nt, Homo sapiens
ggaaguggagcaacaguca

SEQ ID NO: 697700 - RNA, 19 nt, Homo sapiens
ucagcaagauggcgacuuc

SEQ ID NO: 697701 - RNA, 19 nt, Homo sapiens
ggaagagaauagauguuuu

SEQ ID NO: 697702 - RNA, 19 nt, Homo sapiens
cggcucugguucacaguua

SEQ ID NO: 697703 - RNA, 19 nt, Homo sapiens
gcucagcccuccauuuuga

SEQ ID NO: 697704 - RNA, 19 nt, Homo sapiens
cagcagcucaggccuguaa

SEQ ID NO: 697705 - RNA, 19 nt, Homo sapiens
gcgcugaacgcuuugagaa

SEQ ID NO: 697706 - RNA, 19 nt, Homo sapiens
ggaggaagagaauagaugu

SEQ ID NO: 697707 - RNA, 19 nt, Homo sapiens
ggaagacugaggccuguug

SEQ ID NO: 697708 - RNA, 19 nt, Homo sapiens
cugcagauuuggcacauau

SEQ ID NO: 697709 - RNA, 19 nt, Homo sapiens
cagcauaccggcucugguu

SEQ ID NO: 697710 - RNA, 19 nt, Homo sapiens
caacaugggagucucaucu

SEQ ID NO: 697711 - RNA, 19 nt, Homo sapiens
uaaaagccgugauuucuag

SEQ ID NO: 697712 - RNA, 19 nt, Homo sapiens
gcgcagacacccuucuuca

SEQ ID NO: 697713 - RNA, 19 nt, Homo sapiens
cgaggaggaugaggaggaa

SEQ ID NO: 697714 - RNA, 19 nt, Homo sapiens
ggauggcccagcucggaua

SEQ ID NO: 697715 - RNA, 19 nt, Homo sapiens
gaagacugaggccuguuga

SEQ ID NO: 697716 - RNA, 19 nt, Homo sapiens
gccgugauuucuagcaguu

SEQ ID NO: 697717 - RNA, 19 nt, Homo sapiens
agacugaggccuguugaaa

SEQ ID NO: 697718 - RNA, 19 nt, Homo sapiens
ucuuucaacuggaggauga

SEQ ID NO: 697719 - RNA, 19 nt, Homo sapiens
aaugugacuccaccucuua

SEQ ID NO: 697720 - RNA, 19 nt, Homo sapiens
gcucugguucacaguuaua

SEQ ID NO: 697721 - RNA, 19 nt, Homo sapiens
aaaugugacuccaccucuu

SEQ ID NO: 697722 - RNA, 19 nt, Homo sapiens
acugaggccuguugaaagu

SEQ ID NO: 697723 - RNA, 19 nt, Homo sapiens
aggaagagaauagauguuu

SEQ ID NO: 697724 - RNA, 19 nt, Homo sapiens
cagucagccugcagauuug

SEQ ID NO: 697725 - RNA, 19 nt, Homo sapiens
cgugauuucuagcaguuga

SEQ ID NO: 697726 - RNA, 19 nt, Homo sapiens
ggaugaggaggaagagaau

SEQ ID NO: 697727 - RNA, 19 nt, Homo sapiens
gagcagugacccgguguug

SEQ ID NO: 697728 - RNA, 19 nt, Homo sapiens
aggcugagaucucuuucug

SEQ ID NO: 697729 - RNA, 19 nt, Homo sapiens
gaugaggaggaagagaaua

SEQ ID NO: 697730 - RNA, 19 nt, Homo sapiens
gcagugacccgguguugcu

SEQ ID NO: 697731 - RNA, 19 nt, Homo sapiens
caucagaggccagaguuca

SEQ ID NO: 697732 - RNA, 19 nt, Homo sapiens
gcagauuuggcacauaugg

SEQ ID NO: 697733 - RNA, 19 nt, Homo sapiens
gcgaggacacccugaugga

SEQ ID NO: 697734 - RNA, 19 nt, Homo sapiens
gaggccagaguucaaaugu

SEQ ID NO: 697735 - RNA, 19 nt, Homo sapiens
gaggaagagaauagauguu

SEQ ID NO: 697736 - RNA, 19 nt, Homo sapiens
gagcgcagacacccuucuu

SEQ ID NO: 697737 - RNA, 19 nt, Homo sapiens
gcauaccggcucugguuca

SEQ ID NO: 697738 - RNA, 19 nt, Homo sapiens
caguugacuucaccucugu

SEQ ID NO: 697739 - RNA, 19 nt, Homo sapiens
ucagaggccagaguucaaa

SEQ ID NO: 697740 - RNA, 19 nt, Homo sapiens
cugaacgcuuugagaaguu

SEQ ID NO: 697741 - RNA, 19 nt, Homo sapiens
ugugucggccuuuaacaaa

SEQ ID NO: 697742 - RNA, 19 nt, Homo sapiens
gaccagccagggcaacaug

SEQ ID NO: 697743 - RNA, 19 nt, Homo sapiens
gaugcgggcucuggaugag

SEQ ID NO: 697744 - RNA, 19 nt, Homo sapiens
gaggaggaagagaauagau

SEQ ID NO: 697745 - RNA, 19 nt, Homo sapiens
ucuccaggccugugacuug

SEQ ID NO: 697746 - RNA, 19 nt, Homo sapiens
gguucacaguuauaugaca

SEQ ID NO: 697747 - RNA, 19 nt, Homo sapiens
gaccacaggcugagaucuc

SEQ ID NO: 697748 - RNA, 19 nt, Homo sapiens
ccggacacccuccuucgaa

SEQ ID NO: 697749 - RNA, 19 nt, Homo sapiens
cugguucacaguuauauga

SEQ ID NO: 697750 - RNA, 19 nt, Homo sapiens
cacaggcugagaucucuuu

SEQ ID NO: 697751 - RNA, 19 nt, Homo sapiens
gacugaggccuguugaaag

SEQ ID NO: 697752 - RNA, 19 nt, Homo sapiens
caacagucagccugcagau

SEQ ID NO: 697753 - RNA, 19 nt, Homo sapiens
gaacagagaucaggucuua

SEQ ID NO: 697754 - RNA, 19 nt, Homo sapiens
caaaugagcuagaucuuga

SEQ ID NO: 697755 - RNA, 19 nt, Homo sapiens
gcauauaucucccaacaga

SEQ ID NO: 697756 - RNA, 19 nt, Homo sapiens
gcaauuaucgucauguaua

SEQ ID NO: 697757 - RNA, 19 nt, Homo sapiens
gggaacaucuguaaacauu

SEQ ID NO: 697758 - RNA, 19 nt, Homo sapiens
gaaguggugucgauccaua

SEQ ID NO: 697759 - RNA, 19 nt, Homo sapiens
ccucagagcuccauucuug

SEQ ID NO: 697760 - RNA, 19 nt, Homo sapiens
gagaauaacccuaugaaug

SEQ ID NO: 697761 - RNA, 19 nt, Homo sapiens
gaaagaagcccucguggau

SEQ ID NO: 697762 - RNA, 19 nt, Homo sapiens
gcaagcaaaugugaucuuu

SEQ ID NO: 697763 - RNA, 19 nt, Homo sapiens
ccagaaagcuccaggaauc

SEQ ID NO: 697764 - RNA, 19 nt, Homo sapiens
gaucaggucuuauggcaau

SEQ ID NO: 697765 - RNA, 19 nt, Homo sapiens
ccacuguccuguaaacuuu

SEQ ID NO: 697766 - RNA, 19 nt, Homo sapiens
cauugaagcucucuugaaa

SEQ ID NO: 697767 - RNA, 19 nt, Homo sapiens
caagucaccuccaagugua

SEQ ID NO: 697768 - RNA, 19 nt, Homo sapiens
ccacggagccauuuacuuu

SEQ ID NO: 697769 - RNA, 19 nt, Homo sapiens
caagcuacguguacauauu

SEQ ID NO: 697770 - RNA, 19 nt, Homo sapiens
gaauaaauuugcaggucaa

SEQ ID NO: 697771 - RNA, 19 nt, Homo sapiens
ugacaaaugccaaauagaa

SEQ ID NO: 697772 - RNA, 19 nt, Homo sapiens
gcaaugagcaauguggaua

SEQ ID NO: 697773 - RNA, 19 nt, Homo sapiens
caacagaugaguccauuug

SEQ ID NO: 697774 - RNA, 19 nt, Homo sapiens
gggaucagcuauucgauuc

SEQ ID NO: 697775 - RNA, 19 nt, Homo sapiens
gauggaggaagaagauuua

SEQ ID NO: 697776 - RNA, 19 nt, Homo sapiens
guuguuugcuccagugaua

SEQ ID NO: 697777 - RNA, 19 nt, Homo sapiens
gcaguugucucccguuaca

SEQ ID NO: 697778 - RNA, 19 nt, Homo sapiens
ccacagggaucagcuauuc

SEQ ID NO: 697779 - RNA, 19 nt, Homo sapiens
ugacaucacucuaggaagu

SEQ ID NO: 697780 - RNA, 19 nt, Homo sapiens
gaaaaccacuuggccauuu

SEQ ID NO: 697781 - RNA, 19 nt, Homo sapiens
guagaguuguguuuacuau

SEQ ID NO: 697782 - RNA, 19 nt, Homo sapiens
gaacaagucaccuccaagu

SEQ ID NO: 697783 - RNA, 19 nt, Homo sapiens
cauuacugcuggagaauaa

SEQ ID NO: 697784 - RNA, 19 nt, Homo sapiens
gcaggucccuccauugaca

SEQ ID NO: 697785 - RNA, 19 nt, Homo sapiens
ucaagacccuucuccaaau

SEQ ID NO: 697786 - RNA, 19 nt, Homo sapiens
ccuauugccuugugugauu

SEQ ID NO: 697787 - RNA, 19 nt, Homo sapiens
guauuucaccucuacauuu

SEQ ID NO: 697788 - RNA, 19 nt, Homo sapiens
gaaacgccuuggagaguca

SEQ ID NO: 697789 - RNA, 19 nt, Homo sapiens
uugaaaggcuccuguguga

SEQ ID NO: 697790 - RNA, 19 nt, Homo sapiens
gaagaugucacccuugcaa

SEQ ID NO: 697791 - RNA, 19 nt, Homo sapiens
gacaaaugccaaauagaaa

SEQ ID NO: 697792 - RNA, 19 nt, Homo sapiens
ccaaguuacuggcauguca

SEQ ID NO: 697793 - RNA, 19 nt, Homo sapiens
gauguaaggcucugugguu

SEQ ID NO: 697794 - RNA, 19 nt, Homo sapiens
gcgcagagacaguguguga

SEQ ID NO: 697795 - RNA, 19 nt, Homo sapiens
ccacuguuccuuacuauga

SEQ ID NO: 697796 - RNA, 19 nt, Homo sapiens
gggcucaccauuuguagua

SEQ ID NO: 697797 - RNA, 19 nt, Homo sapiens
aaagucggcuuguaaucaa

SEQ ID NO: 697798 - RNA, 19 nt, Homo sapiens
ggagagucaagaauaaauu

SEQ ID NO: 697799 - RNA, 19 nt, Homo sapiens
guugacaaaugccaaauag

SEQ ID NO: 697800 - RNA, 19 nt, Homo sapiens
caagacccuucuccaaaug

SEQ ID NO: 697801 - RNA, 19 nt, Homo sapiens
gcugccaccugccgacuuu

SEQ ID NO: 697802 - RNA, 19 nt, Homo sapiens
ggauggaggaagaagauuu

SEQ ID NO: 697803 - RNA, 19 nt, Homo sapiens
ccacuuggccauuuauuuc

SEQ ID NO: 697804 - RNA, 19 nt, Homo sapiens
gauaugaccaagaguuguu

SEQ ID NO: 697805 - RNA, 19 nt, Homo sapiens
acagaugaguccauuugaa

SEQ ID NO: 697806 - RNA, 19 nt, Homo sapiens
gcagcuccuuugcucauga

SEQ ID NO: 697807 - RNA, 19 nt, Homo sapiens
agaauaacccuaugaaugg

SEQ ID NO: 697808 - RNA, 19 nt, Homo sapiens
ggccuugccuugaagaugu

SEQ ID NO: 697809 - RNA, 19 nt, Homo sapiens
uauuucaccucuacauuug

SEQ ID NO: 697810 - RNA, 19 nt, Homo sapiens
ggccauuuauuucuauguu

SEQ ID NO: 697811 - RNA, 19 nt, Homo sapiens
uagcaaacaccaccaaguu

SEQ ID NO: 697812 - RNA, 19 nt, Homo sapiens
aacaauggaugacuggaaa

SEQ ID NO: 697813 - RNA, 19 nt, Homo sapiens
ugaaaucuggcgucuguuu

SEQ ID NO: 697814 - RNA, 19 nt, Homo sapiens
ggaacaucuguaaacauua

SEQ ID NO: 697815 - RNA, 19 nt, Homo sapiens
ccgcaguugucucccguua

SEQ ID NO: 697816 - RNA, 19 nt, Homo sapiens
gaacggcagaaugcauaua

SEQ ID NO: 697817 - RNA, 19 nt, Homo sapiens
caagcaaaugugaucuuua

SEQ ID NO: 697818 - RNA, 19 nt, Homo sapiens
ccaggacucucuccaccuu

SEQ ID NO: 697819 - RNA, 19 nt, Homo sapiens
ucaccgaguucuucaaugg

SEQ ID NO: 697820 - RNA, 19 nt, Homo sapiens
cagauagugucaccgaguu

SEQ ID NO: 697821 - RNA, 19 nt, Homo sapiens
cgucauguauauuuaagug

SEQ ID NO: 697822 - RNA, 19 nt, Homo sapiens
gcgagcuguuccugguuua

SEQ ID NO: 697823 - RNA, 19 nt, Homo sapiens
caagaguuguugugcaagu

SEQ ID NO: 697824 - RNA, 19 nt, Homo sapiens
cagcagcacucaccuucug

SEQ ID NO: 697825 - RNA, 19 nt, Homo sapiens
gcagcagccugaccauucu

SEQ ID NO: 697826 - RNA, 19 nt, Homo sapiens
guaaggcucugugguuugg

SEQ ID NO: 697827 - RNA, 19 nt, Homo sapiens
ggcgagcuguuccugguuu

SEQ ID NO: 697828 - RNA, 19 nt, Homo sapiens
gaucaguggccucagauuc

SEQ ID NO: 697829 - RNA, 19 nt, Homo sapiens
uagaggagcucaccaaaau

SEQ ID NO: 697830 - RNA, 19 nt, Homo sapiens
gugauaccuuguuaagcua

SEQ ID NO: 697831 - RNA, 19 nt, Homo sapiens
ccacugcguucaacaaugc

SEQ ID NO: 697832 - RNA, 19 nt, Homo sapiens
gggaagcggcaaggaauuu

SEQ ID NO: 697833 - RNA, 19 nt, Homo sapiens
ugagcuagaucuugagaag

SEQ ID NO: 697834 - RNA, 19 nt, Homo sapiens
cuacagaagugggacugaa

SEQ ID NO: 697835 - RNA, 19 nt, Homo sapiens
gcaucgagccaccaagcua

SEQ ID NO: 697836 - RNA, 19 nt, Homo sapiens
gacucugucugccagcaua

SEQ ID NO: 697837 - RNA, 19 nt, Homo sapiens
ggagaauaacccuaugaau

SEQ ID NO: 697838 - RNA, 19 nt, Homo sapiens
gggcuacccuaauaaaauu

SEQ ID NO: 697839 - RNA, 19 nt, Homo sapiens
uuugaaaucuggcgucugu

SEQ ID NO: 697840 - RNA, 19 nt, Homo sapiens
agaguauccuccucccuuu

SEQ ID NO: 697841 - RNA, 19 nt, Homo sapiens
uccgcuagcucuuuccuaa

SEQ ID NO: 697842 - RNA, 19 nt, Homo sapiens
gugucaccgucuaacauua

SEQ ID NO: 697843 - RNA, 19 nt, Homo sapiens
gcauggacuucugcagcua

SEQ ID NO: 697844 - RNA, 19 nt, Homo sapiens
ccaaaugagcuagaucuug

SEQ ID NO: 697845 - RNA, 19 nt, Homo sapiens
caagagcagcccaggaaga

SEQ ID NO: 697846 - RNA, 19 nt, Homo sapiens
ugucuuugaugguuucuau

SEQ ID NO: 697847 - RNA, 19 nt, Homo sapiens
gaguauccuccucccuuua

SEQ ID NO: 697848 - RNA, 19 nt, Homo sapiens
caaauaugcagaccguguu

SEQ ID NO: 697849 - RNA, 19 nt, Homo sapiens
cccacuaaaugaucugauu

SEQ ID NO: 697850 - RNA, 19 nt, Homo sapiens
gcaaaugugaucuuuaagc

SEQ ID NO: 697851 - RNA, 19 nt, Homo sapiens
gcccugcucucacucaaca

SEQ ID NO: 697852 - RNA, 19 nt, Homo sapiens
ggcccacuguuccuuacua

SEQ ID NO: 697853 - RNA, 19 nt, Homo sapiens
ucacaaaucuucuggaaua

SEQ ID NO: 697854 - RNA, 19 nt, Homo sapiens
gaacuaagagugcugaaga

SEQ ID NO: 697855 - RNA, 19 nt, Homo sapiens
uaagagugcugaagaccua

SEQ ID NO: 697856 - RNA, 19 nt, Homo sapiens
ccacaggcaugaacuaaga

SEQ ID NO: 697857 - RNA, 19 nt, Homo sapiens
caaccucugugacuacuuu

SEQ ID NO: 697858 - RNA, 19 nt, Homo sapiens
gaaauugcccgcagcgauu

SEQ ID NO: 697859 - RNA, 19 nt, Homo sapiens
ccaaugugcuuucuucaug

SEQ ID NO: 697860 - RNA, 19 nt, Homo sapiens
ggucacaaaucuucuggaa

SEQ ID NO: 697861 - RNA, 19 nt, Homo sapiens
gaagcagugucugugguuu

SEQ ID NO: 697862 - RNA, 19 nt, Homo sapiens
gcaagaauacaacaaagag

SEQ ID NO: 697863 - RNA, 19 nt, Homo sapiens
gugacuacuuuauccauga

SEQ ID NO: 697864 - RNA, 19 nt, Homo sapiens
ggacugagaagcagauaac

SEQ ID NO: 697865 - RNA, 19 nt, Homo sapiens
ccacagggaguaagaagga

SEQ ID NO: 697866 - RNA, 19 nt, Homo sapiens
gaggaggagagucgacuuu

SEQ ID NO: 697867 - RNA, 19 nt, Homo sapiens
guguguggcucgaagauuc

SEQ ID NO: 697868 - RNA, 19 nt, Homo sapiens
caucauacaggacugagaa

SEQ ID NO: 697869 - RNA, 19 nt, Homo sapiens
gaaaucugcgccauucaag

SEQ ID NO: 697870 - RNA, 19 nt, Homo sapiens
ggaggagagucgacuuugc

SEQ ID NO: 697871 - RNA, 19 nt, Homo sapiens
ugacuacuuuauccaugaa

SEQ ID NO: 697872 - RNA, 19 nt, Homo sapiens
ccgcagcgauugcagaaag

SEQ ID NO: 697873 - RNA, 19 nt, Homo sapiens
ccuuuaagcacuaaugaaa

SEQ ID NO: 697874 - RNA, 19 nt, Homo sapiens
gagucgacuuugccucuug

SEQ ID NO: 697875 - RNA, 19 nt, Homo sapiens
agaagcagauaacaagagu

SEQ ID NO: 697876 - RNA, 19 nt, Homo sapiens
acaaagagagcgaggacaa

SEQ ID NO: 697877 - RNA, 19 nt, Homo sapiens
aagcagauaacaagaguga

SEQ ID NO: 697878 - RNA, 19 nt, Homo sapiens
ccuccaaccucugugacua

SEQ ID NO: 697879 - RNA, 19 nt, Homo sapiens
gaaauuaaaacccgucaau

SEQ ID NO: 697880 - RNA, 19 nt, Homo sapiens
caagaauacaacaaagaga

SEQ ID NO: 697881 - RNA, 19 nt, Homo sapiens
caugcaagaauacaacaaa

SEQ ID NO: 697882 - RNA, 19 nt, Homo sapiens
aaucugcgccauucaagaa

SEQ ID NO: 697883 - RNA, 19 nt, Homo sapiens
gagaagcagauaacaagag

SEQ ID NO: 697884 - RNA, 19 nt, Homo sapiens
caaaucuucuggaauaccu

SEQ ID NO: 697885 - RNA, 19 nt, Homo sapiens
ccucaaaugccaacgugaa

SEQ ID NO: 697886 - RNA, 19 nt, Homo sapiens
agagagcgaggacaaguau

SEQ ID NO: 697887 - RNA, 19 nt, Homo sapiens
ggccacaggcaugaacuaa

SEQ ID NO: 697888 - RNA, 19 nt, Homo sapiens
caaaugccaacgugaagca

SEQ ID NO: 697889 - RNA, 19 nt, Homo sapiens
ccaugaaaaugaagcaaug

SEQ ID NO: 697890 - RNA, 19 nt, Homo sapiens
aaucuucuggaauaccuua

SEQ ID NO: 697891 - RNA, 19 nt, Homo sapiens
aagagagcgaggacaagua

SEQ ID NO: 697892 - RNA, 19 nt, Homo sapiens
ugaagcagugucugugguu

SEQ ID NO: 697893 - RNA, 19 nt, Homo sapiens
cugagaagcagauaacaag

SEQ ID NO: 697894 - RNA, 19 nt, Homo sapiens
gaaaacuccaagcugaaaa

SEQ ID NO: 697895 - RNA, 19 nt, Homo sapiens
cuucaggucacaaaucuuc

SEQ ID NO: 697896 - RNA, 19 nt, Homo sapiens
gggccacaggcaugaacua

SEQ ID NO: 697897 - RNA, 19 nt, Homo sapiens
aaagagagcgaggacaagu

SEQ ID NO: 697898 - RNA, 19 nt, Homo sapiens
ggacauaguuuagguauug

SEQ ID NO: 697899 - RNA, 19 nt, Homo sapiens
caagaacacugcaaacaaa

SEQ ID NO: 697900 - RNA, 19 nt, Homo sapiens
gaucacagcaaguuaauaa

SEQ ID NO: 697901 - RNA, 19 nt, Homo sapiens
gggaagagaugguuacaug

SEQ ID NO: 697902 - RNA, 19 nt, Homo sapiens
gucauuggcuguuguguua

SEQ ID NO: 697903 - RNA, 19 nt, Homo sapiens
uuacauugcuuccuaguuu

SEQ ID NO: 697904 - RNA, 19 nt, Homo sapiens
cuacaaaggucauggcaaa

SEQ ID NO: 697905 - RNA, 19 nt, Homo sapiens
ggagaaacuucauccaaug

SEQ ID NO: 697906 - RNA, 19 nt, Homo sapiens
ggaaggaaauggaacaagu

SEQ ID NO: 697907 - RNA, 19 nt, Homo sapiens
gauguaaacuucaaauugg

SEQ ID NO: 697908 - RNA, 19 nt, Homo sapiens
acacuuauauuguggcaua

SEQ ID NO: 697909 - RNA, 19 nt, Homo sapiens
ugaaacaacacaacaguua

SEQ ID NO: 697910 - RNA, 19 nt, Homo sapiens
caacuugaauguaccagaa

SEQ ID NO: 697911 - RNA, 19 nt, Homo sapiens
agaauuagcuuccauuaag

SEQ ID NO: 697912 - RNA, 19 nt, Homo sapiens
gauaagcauucauaugguu

SEQ ID NO: 697913 - RNA, 19 nt, Homo sapiens
gaucaucacaaauccuuua

SEQ ID NO: 697914 - RNA, 19 nt, Homo sapiens
gacgagagcugcaagcaau

SEQ ID NO: 697915 - RNA, 19 nt, Homo sapiens
gaauuagcuuccauuaaga

SEQ ID NO: 697916 - RNA, 19 nt, Homo sapiens
gaacaugaauagacuacca

SEQ ID NO: 697917 - RNA, 19 nt, Homo sapiens
ccugugggauuuauuauuu

SEQ ID NO: 697918 - RNA, 19 nt, Homo sapiens
gaacagcccaguuggaaau

SEQ ID NO: 697919 - RNA, 19 nt, Homo sapiens
gcaagaacacugcaaacaa

SEQ ID NO: 697920 - RNA, 19 nt, Homo sapiens
gaaacuucauccaaugguu

SEQ ID NO: 697921 - RNA, 19 nt, Homo sapiens
caagagcucacacuuauau

SEQ ID NO: 697922 - RNA, 19 nt, Homo sapiens
caacaguuauacccaaguu

SEQ ID NO: 697923 - RNA, 19 nt, Homo sapiens
aaugguagcucuaaacaug

SEQ ID NO: 697924 - RNA, 19 nt, Homo sapiens
caagaucacagcaaguuaa

SEQ ID NO: 697925 - RNA, 19 nt, Homo sapiens
uaccagaacuaaacaguau

SEQ ID NO: 697926 - RNA, 19 nt, Homo sapiens
ggaaugaauauccacaauu

SEQ ID NO: 697927 - RNA, 19 nt, Homo sapiens
uaucggagaucgagaagga

SEQ ID NO: 697928 - RNA, 19 nt, Homo sapiens
caagaauggacauaguuua

SEQ ID NO: 697929 - RNA, 19 nt, Homo sapiens
gguauuagcaggaagaaug

SEQ ID NO: 697930 - RNA, 19 nt, Homo sapiens
ucacugaccuaccgccaaa

SEQ ID NO: 697931 - RNA, 19 nt, Homo sapiens
gaaggaaauggaacaaguu

SEQ ID NO: 697932 - RNA, 19 nt, Homo sapiens
gaauggacauaguuuaggu

SEQ ID NO: 697933 - RNA, 19 nt, Homo sapiens
gcaaugagugaacagcuaa

SEQ ID NO: 697934 - RNA, 19 nt, Homo sapiens
caauuuagcaucaggcaaa

SEQ ID NO: 697935 - RNA, 19 nt, Homo sapiens
gugcgucaguuuauagaaa

SEQ ID NO: 697936 - RNA, 19 nt, Homo sapiens
ugaaagaaauccuaaucuc

SEQ ID NO: 697937 - RNA, 19 nt, Homo sapiens
gaaacaacacaacaguuau

SEQ ID NO: 697938 - RNA, 19 nt, Homo sapiens
gagaagccauugaaacaac

SEQ ID NO: 697939 - RNA, 19 nt, Homo sapiens
ggaccaacuuucacuacug

SEQ ID NO: 697940 - RNA, 19 nt, Homo sapiens
gggauaagcauucauaugg

SEQ ID NO: 697941 - RNA, 19 nt, Homo sapiens
gcacagauagaucgauuuc

SEQ ID NO: 697942 - RNA, 19 nt, Homo sapiens
uaucaacaauaccugcuuu

SEQ ID NO: 697943 - RNA, 19 nt, Homo sapiens
guggaagacuaccuacauu

SEQ ID NO: 697944 - RNA, 19 nt, Homo sapiens
gugcucagcucuuaacagu

SEQ ID NO: 697945 - RNA, 19 nt, Homo sapiens
aaacagaucacuacuccaa

SEQ ID NO: 697946 - RNA, 19 nt, Homo sapiens
guaauaaacaccagucauc

SEQ ID NO: 697947 - RNA, 19 nt, Homo sapiens
acaguuauacccaaguuua

SEQ ID NO: 697948 - RNA, 19 nt, Homo sapiens
gggagaagccauugaaaca

SEQ ID NO: 697949 - RNA, 19 nt, Homo sapiens
gcagaggccuuugccagau

SEQ ID NO: 697950 - RNA, 19 nt, Homo sapiens
gcaugugggugauguaaac

SEQ ID NO: 697951 - RNA, 19 nt, Homo sapiens
ggaagacuaccuacauuag

SEQ ID NO: 697952 - RNA, 19 nt, Homo sapiens
gaaggaugcauucagucua

SEQ ID NO: 697953 - RNA, 19 nt, Homo sapiens
uagcuuccauuaagaauag

SEQ ID NO: 697954 - RNA, 19 nt, Homo sapiens
uucaagagcucacacuuau

SEQ ID NO: 697955 - RNA, 19 nt, Homo sapiens
gcuguuguguuaaucuuau

SEQ ID NO: 697956 - RNA, 19 nt, Homo sapiens
ggauaagcauucauauggu

SEQ ID NO: 697957 - RNA, 19 nt, Homo sapiens
gcauauagucaacauggaa

SEQ ID NO: 697958 - RNA, 19 nt, Homo sapiens
ccaaagcaaccuccacuug

SEQ ID NO: 697959 - RNA, 19 nt, Homo sapiens
uagaaagaaugauccacuu

SEQ ID NO: 697960 - RNA, 19 nt, Homo sapiens
cgaaauggaaguugauuca

SEQ ID NO: 697961 - RNA, 19 nt, Homo sapiens
gaauguaccagaacuaaac

SEQ ID NO: 697962 - RNA, 19 nt, Homo sapiens
gaacuggacaaccuuaugg

SEQ ID NO: 697963 - RNA, 19 nt, Homo sapiens
guaccagaacuaaacagua

SEQ ID NO: 697964 - RNA, 19 nt, Homo sapiens
gguuucaucuuauuuaguc

SEQ ID NO: 697965 - RNA, 19 nt, Homo sapiens
ccaagaauggacauaguuu

SEQ ID NO: 697966 - RNA, 19 nt, Homo sapiens
gcucuuaacagugcaauau

SEQ ID NO: 697967 - RNA, 19 nt, Homo sapiens
gugaacagcuaaggagaga

SEQ ID NO: 697968 - RNA, 19 nt, Homo sapiens
acaccgaaauggaaguuga

SEQ ID NO: 697969 - RNA, 19 nt, Homo sapiens
ccaaugguuuccuaaaugg

SEQ ID NO: 697970 - RNA, 19 nt, Homo sapiens
acagaucacuacuccaaug

SEQ ID NO: 697971 - RNA, 19 nt, Homo sapiens
ccagaacuaaacaguauaa

SEQ ID NO: 697972 - RNA, 19 nt, Homo sapiens
caaauaaagcacaucaauc

SEQ ID NO: 697973 - RNA, 19 nt, Homo sapiens
uacauugcuuccuaguuua

SEQ ID NO: 697974 - RNA, 19 nt, Homo sapiens
gagcucacacuuauauugu

SEQ ID NO: 697975 - RNA, 19 nt, Homo sapiens
guaagggaagagaugguua

SEQ ID NO: 697976 - RNA, 19 nt, Homo sapiens
cuacauuagcuaugcauuu

SEQ ID NO: 697977 - RNA, 19 nt, Homo sapiens
uuauagaaauggugaaugg

SEQ ID NO: 697978 - RNA, 19 nt, Homo sapiens
uacauuagcuaugcauuuc

SEQ ID NO: 697979 - RNA, 19 nt, Homo sapiens
ugguacagauagugaagua

SEQ ID NO: 697980 - RNA, 19 nt, Homo sapiens
ggagaagccauugaaacaa

SEQ ID NO: 697981 - RNA, 19 nt, Homo sapiens
uggaagacuaccuacauua

SEQ ID NO: 697982 - RNA, 19 nt, Homo sapiens
cgaaggacaaguucagcua

SEQ ID NO: 697983 - RNA, 19 nt, Homo sapiens
ccagcagccugugggauuu

SEQ ID NO: 697984 - RNA, 19 nt, Homo sapiens
cagccugugggauuuauua

SEQ ID NO: 697985 - RNA, 19 nt, Homo sapiens
uggcagaccaugauacaaa

SEQ ID NO: 697986 - RNA, 19 nt, Homo sapiens
gcucaaggugugaacauga

SEQ ID NO: 697987 - RNA, 19 nt, Homo sapiens
ggaacagcccaguuggaaa

SEQ ID NO: 697988 - RNA, 19 nt, Homo sapiens
gagagacuguggcaagaac

SEQ ID NO: 697989 - RNA, 19 nt, Homo sapiens
uccaaugguuuccuaaaug

SEQ ID NO: 697990 - RNA, 19 nt, Homo sapiens
gaauauccacaauuuagca

SEQ ID NO: 697991 - RNA, 19 nt, Homo sapiens
ccaaauuuguauccuacug

SEQ ID NO: 697992 - RNA, 19 nt, Homo sapiens
caaggugugaacaugaaua

SEQ ID NO: 697993 - RNA, 19 nt, Homo sapiens
gaacagcuaaggagagacu

SEQ ID NO: 697994 - RNA, 19 nt, Homo sapiens
ggacgagagcugcaagcaa

SEQ ID NO: 697995 - RNA, 19 nt, Homo sapiens
gaaauggaagauugugaca

SEQ ID NO: 697996 - RNA, 19 nt, Homo sapiens
gaccagaccguucuagaag

SEQ ID NO: 697997 - RNA, 19 nt, Homo sapiens
ucaaacaccaggagaagug

SEQ ID NO: 697998 - RNA, 19 nt, Homo sapiens
ggacaucuaugacaaauau

SEQ ID NO: 697999 - RNA, 19 nt, Homo sapiens
gaacucgacuuucaguaua

SEQ ID NO: 698000 - RNA, 19 nt, Homo sapiens
ugaagaagauggccaguua

SEQ ID NO: 698001 - RNA, 19 nt, Homo sapiens
gguaauacauuucugguuu

SEQ ID NO: 698002 - RNA, 19 nt, Homo sapiens
ugacaaauauggcaaagaa

SEQ ID NO: 698003 - RNA, 19 nt, Homo sapiens
caugaaugcuggcaacuua

SEQ ID NO: 698004 - RNA, 19 nt, Homo sapiens
gaaguggcauccagauaaa

SEQ ID NO: 698005 - RNA, 19 nt, Homo sapiens
caaacgaacucgacuuuca

SEQ ID NO: 698006 - RNA, 19 nt, Homo sapiens
cgagaacggucaagaaaga

SEQ ID NO: 698007 - RNA, 19 nt, Homo sapiens
caaagagaauugucgagaa

SEQ ID NO: 698008 - RNA, 19 nt, Homo sapiens
gaagauggccaguuaaagu

SEQ ID NO: 698009 - RNA, 19 nt, Homo sapiens
gaguagaaguugaagaaga

SEQ ID NO: 698010 - RNA, 19 nt, Homo sapiens
ucaaaucgauaucaacuuc

SEQ ID NO: 698011 - RNA, 19 nt, Homo sapiens
gaugaugucuucagggaau

SEQ ID NO: 698012 - RNA, 19 nt, Homo sapiens
ggauuacuaugaaguucua

SEQ ID NO: 698013 - RNA, 19 nt, Homo sapiens
gcaaguagcggaggcauau

SEQ ID NO: 698014 - RNA, 19 nt, Homo sapiens
uaacccagaugaugucuuc

SEQ ID NO: 698015 - RNA, 19 nt, Homo sapiens
gaagugcugucggaugcua

SEQ ID NO: 698016 - RNA, 19 nt, Homo sapiens
ugaaguggcauccagauaa

SEQ ID NO: 698017 - RNA, 19 nt, Homo sapiens
ccacauaauaggaccauuu

SEQ ID NO: 698018 - RNA, 19 nt, Homo sapiens
ugacaguccauuugaauuu

SEQ ID NO: 698019 - RNA, 19 nt, Homo sapiens
cguaaaacaugguggauua

SEQ ID NO: 698020 - RNA, 19 nt, Homo sapiens
gaaaauaaaugcgaaugug

SEQ ID NO: 698021 - RNA, 19 nt, Homo sapiens
caagaaagaguagaaguug

SEQ ID NO: 698022 - RNA, 19 nt, Homo sapiens
gcaaagaaggauuaaaugg

SEQ ID NO: 698023 - RNA, 19 nt, Homo sapiens
uaaagaagaagcagagaga

SEQ ID NO: 698024 - RNA, 19 nt, Homo sapiens
gaaaggagagaaaggaaag

SEQ ID NO: 698025 - RNA, 19 nt, Homo sapiens
caucggagccucuauuugu

SEQ ID NO: 698026 - RNA, 19 nt, Homo sapiens
gaagaagauggccaguuaa

SEQ ID NO: 698027 - RNA, 19 nt, Homo sapiens
gaacggucaagaaagagua

SEQ ID NO: 698028 - RNA, 19 nt, Homo sapiens
caugguggauuacuaugaa

SEQ ID NO: 698029 - RNA, 19 nt, Homo sapiens
aaguaaagcugguaaacug

SEQ ID NO: 698030 - RNA, 19 nt, Homo sapiens
aagcaccauuugaggauua

SEQ ID NO: 698031 - RNA, 19 nt, Homo sapiens
gcacgcacuuaacagaaau

SEQ ID NO: 698032 - RNA, 19 nt, Homo sapiens
gauacaggauuuacuucau

SEQ ID NO: 698033 - RNA, 19 nt, Homo sapiens
gcugucggaugcuaagaaa

SEQ ID NO: 698034 - RNA, 19 nt, Homo sapiens
caacuaaaaugguuaaugg

SEQ ID NO: 698035 - RNA, 19 nt, Homo sapiens
cgauaucaacuucaacuaa

SEQ ID NO: 698036 - RNA, 19 nt, Homo sapiens
gacaguccauuugaauuug

SEQ ID NO: 698037 - RNA, 19 nt, Homo sapiens
uaagaaacgggacaucuau

SEQ ID NO: 698038 - RNA, 19 nt, Homo sapiens
ucaguggauuuccgucuuu

SEQ ID NO: 698039 - RNA, 19 nt, Homo sapiens
caaagaaggauuaaauggu

SEQ ID NO: 698040 - RNA, 19 nt, Homo sapiens
ucaagaaagaguagaaguu

SEQ ID NO: 698041 - RNA, 19 nt, Homo sapiens
cuaagaaacgggacaucua

SEQ ID NO: 698042 - RNA, 19 nt, Homo sapiens
aaacugggucuuugucauu

SEQ ID NO: 698043 - RNA, 19 nt, Homo sapiens
aaacaugguggauuacuau

SEQ ID NO: 698044 - RNA, 19 nt, Homo sapiens
ccaggacgauucuucuaca

SEQ ID NO: 698045 - RNA, 19 nt, Homo sapiens
cgaacucgacuuucaguau

SEQ ID NO: 698046 - RNA, 19 nt, Homo sapiens
agaaagaguagaaguugaa

SEQ ID NO: 698047 - RNA, 19 nt, Homo sapiens
gaagggacccauuuucauu

SEQ ID NO: 698048 - RNA, 19 nt, Homo sapiens
gcugugaaguuaacauugc

SEQ ID NO: 698049 - RNA, 19 nt, Homo sapiens
ccaacaaucucguaaaaca

SEQ ID NO: 698050 - RNA, 19 nt, Homo sapiens
aagaaagaguagaaguuga

SEQ ID NO: 698051 - RNA, 19 nt, Homo sapiens
aaagagaauugucgagaac

SEQ ID NO: 698052 - RNA, 19 nt, Homo sapiens
uggcaaagaaggauuaaau

SEQ ID NO: 698053 - RNA, 19 nt, Homo sapiens
aggauuaacaggaacauuu

SEQ ID NO: 698054 - RNA, 19 nt, Homo sapiens
aguagaaguugaagaagau

SEQ ID NO: 698055 - RNA, 19 nt, Homo sapiens
aagaguagaaguugaagaa

SEQ ID NO: 698056 - RNA, 19 nt, Homo sapiens
gaaugcuggcaacuuagua

SEQ ID NO: 698057 - RNA, 19 nt, Homo sapiens
gggccucacuucauucucu

SEQ ID NO: 698058 - RNA, 19 nt, Homo sapiens
ggaggagguggaagucauu

SEQ ID NO: 698059 - RNA, 19 nt, Homo sapiens
caaauauggcaaagaagga

SEQ ID NO: 698060 - RNA, 19 nt, Homo sapiens
agaaacgggacaucuauga

SEQ ID NO: 698061 - RNA, 19 nt, Homo sapiens
uaaacugggucuuugucau

SEQ ID NO: 698062 - RNA, 19 nt, Homo sapiens
gggcaacuucaaaucgaua

SEQ ID NO: 698063 - RNA, 19 nt, Homo sapiens
cgcacgcacuuaacagaaa

SEQ ID NO: 698064 - RNA, 19 nt, Homo sapiens
aagaagauggccaguuaaa

SEQ ID NO: 698065 - RNA, 19 nt, Homo sapiens
caacuucaaaucgauauca

SEQ ID NO: 698066 - RNA, 19 nt, Homo sapiens
ggcaaagaaggauuaaaug

SEQ ID NO: 698067 - RNA, 19 nt, Homo sapiens
gcugguaaacugggucuuu

SEQ ID NO: 698068 - RNA, 19 nt, Homo sapiens
caagcaccauuugaggauu

SEQ ID NO: 698069 - RNA, 19 nt, Homo sapiens
aagaagaagcagagagaaa

SEQ ID NO: 698070 - RNA, 19 nt, Homo sapiens
ggacuucuuugggaaucga

SEQ ID NO: 698071 - RNA, 19 nt, Homo sapiens
uauaacaagcaccauuuga

SEQ ID NO: 698072 - RNA, 19 nt, Homo sapiens
guaguggcaugggcaacuu

SEQ ID NO: 698073 - RNA, 19 nt, Homo sapiens
uaacauugccaggacgauu

SEQ ID NO: 698074 - RNA, 19 nt, Homo sapiens
gucgagaacggucaagaaa

SEQ ID NO: 698075 - RNA, 19 nt, Homo sapiens
gaaaugugagccacguagu

SEQ ID NO: 698076 - RNA, 19 nt, Homo sapiens
gaagauuucaaacgaacuc

SEQ ID NO: 698077 - RNA, 19 nt, Homo sapiens
guaaacugggucuuuguca

SEQ ID NO: 698078 - RNA, 19 nt, Homo sapiens
agaaaggagagaaaggaaa

SEQ ID NO: 698079 - RNA, 19 nt, Homo sapiens
guaauguuaagcuuagguu

SEQ ID NO: 698080 - RNA, 19 nt, Homo sapiens
acuauaacaagcaccauuu

SEQ ID NO: 698081 - RNA, 19 nt, Homo sapiens
gaggacuucuuugggaauc

SEQ ID NO: 698082 - RNA, 19 nt, Homo sapiens
aaacgggacaucuaugaca

SEQ ID NO: 698083 - RNA, 19 nt, Homo sapiens
aauaaaugcgaauguguug

SEQ ID NO: 698084 - RNA, 19 nt, Homo sapiens
uaaaugcgaauguguuggu

SEQ ID NO: 698085 - RNA, 19 nt, Homo sapiens
ucuugacucuuuaguguag

SEQ ID NO: 698086 - RNA, 19 nt, Homo sapiens
aaaacaugguggauuacua

SEQ ID NO: 698087 - RNA, 19 nt, Homo sapiens
ggauuaacaggaacauuuu

SEQ ID NO: 698088 - RNA, 19 nt, Homo sapiens
ggacccauuccaacaaucu

SEQ ID NO: 698089 - RNA, 19 nt, Homo sapiens
cugguaaacugggucuuug

SEQ ID NO: 698090 - RNA, 19 nt, Homo sapiens
gcauggaccugcuuuucau

SEQ ID NO: 698091 - RNA, 19 nt, Homo sapiens
gucauagacuuuugaguug

SEQ ID NO: 698092 - RNA, 19 nt, Homo sapiens
ggauaacaaguaauucaac

SEQ ID NO: 698093 - RNA, 19 nt, Homo sapiens
uggcaugggcaacuucaaa

SEQ ID NO: 698094 - RNA, 19 nt, Homo sapiens
gguggauuacuaugaaguu

SEQ ID NO: 698095 - RNA, 19 nt, Homo sapiens
gcuaagaaacgggacaucu

SEQ ID NO: 698096 - RNA, 19 nt, Homo sapiens
ggucuuugucauuugcuuu

SEQ ID NO: 698097 - RNA, 19 nt, Homo sapiens
aaaggcauaucggaaacug

SEQ ID NO: 698098 - RNA, 19 nt, Homo sapiens
ggacaucuaugacaaauau

SEQ ID NO: 698099 - RNA, 19 nt, Homo sapiens
ugaagaagauggccaguua

SEQ ID NO: 698100 - RNA, 19 nt, Homo sapiens
gcagauggcuaacugagua

SEQ ID NO: 698101 - RNA, 19 nt, Homo sapiens
ugacaaauauggcaaagaa

SEQ ID NO: 698102 - RNA, 19 nt, Homo sapiens
gaaguggcauccagauaaa

SEQ ID NO: 698103 - RNA, 19 nt, Homo sapiens
ggagaggagugguauuuga

SEQ ID NO: 698104 - RNA, 19 nt, Homo sapiens
gaauauuucuggcuuuaga

SEQ ID NO: 698105 - RNA, 19 nt, Homo sapiens
gaguguaacuuagagaaua

SEQ ID NO: 698106 - RNA, 19 nt, Homo sapiens
guaauucaguagaguguaa

SEQ ID NO: 698107 - RNA, 19 nt, Homo sapiens
gcaugcugcuggaauauuu

SEQ ID NO: 698108 - RNA, 19 nt, Homo sapiens
cgagaacggucaagaaaga

SEQ ID NO: 698109 - RNA, 19 nt, Homo sapiens
caaagagaauugucgagaa

SEQ ID NO: 698110 - RNA, 19 nt, Homo sapiens
gaagauggccaguuaaagu

SEQ ID NO: 698111 - RNA, 19 nt, Homo sapiens
gaguagaaguugaagaaga

SEQ ID NO: 698112 - RNA, 19 nt, Homo sapiens
uagagaauauugcaaguga

SEQ ID NO: 698113 - RNA, 19 nt, Homo sapiens
ggacagacguuugggacuu

SEQ ID NO: 698114 - RNA, 19 nt, Homo sapiens
ucaaaucgauaucaacuuc

SEQ ID NO: 698115 - RNA, 19 nt, Homo sapiens
gaugaugucuucagggaau

SEQ ID NO: 698116 - RNA, 19 nt, Homo sapiens
ggauuacuaugaaguucua

SEQ ID NO: 698117 - RNA, 19 nt, Homo sapiens
gaguuggcuuuguuuauuu

SEQ ID NO: 698118 - RNA, 19 nt, Homo sapiens
gaacauugacuccuuacga

SEQ ID NO: 698119 - RNA, 19 nt, Homo sapiens
gaaaagcuuugcugugauu

SEQ ID NO: 698120 - RNA, 19 nt, Homo sapiens
gcaaguagcggaggcauau

SEQ ID NO: 698121 - RNA, 19 nt, Homo sapiens
gagaggagucgaagaagaa

SEQ ID NO: 698122 - RNA, 19 nt, Homo sapiens
uaacccagaugaugucuuc

SEQ ID NO: 698123 - RNA, 19 nt, Homo sapiens
gaagugcugucggaugcua

SEQ ID NO: 698124 - RNA, 19 nt, Homo sapiens
ugaaguggcauccagauaa

SEQ ID NO: 698125 - RNA, 19 nt, Homo sapiens
caaggagguugaacucaug

SEQ ID NO: 698126 - RNA, 19 nt, Homo sapiens
ucaaauaugguguagguuu

SEQ ID NO: 698127 - RNA, 19 nt, Homo sapiens
ugacaguccauuugaauuu

SEQ ID NO: 698128 - RNA, 19 nt, Homo sapiens
cguaaaacaugguggauua

SEQ ID NO: 698129 - RNA, 19 nt, Homo sapiens
agaguuggcuuuguuuauu

SEQ ID NO: 698130 - RNA, 19 nt, Homo sapiens
cggauccucuucauucuuu

SEQ ID NO: 698131 - RNA, 19 nt, Homo sapiens
caagaaagaguagaaguug

SEQ ID NO: 698132 - RNA, 19 nt, Homo sapiens
gcaaagaaggauuaaaugg

SEQ ID NO: 698133 - RNA, 19 nt, Homo sapiens
uaaagaagaagcagagaga

SEQ ID NO: 698134 - RNA, 19 nt, Homo sapiens
gaagguaauucaguagagu

SEQ ID NO: 698135 - RNA, 19 nt, Homo sapiens
ggcguaguguuuggaauua

SEQ ID NO: 698136 - RNA, 19 nt, Homo sapiens
ggagggcgcagauggcuaa

SEQ ID NO: 698137 - RNA, 19 nt, Homo sapiens
gaaaggagagaaaggaaag

SEQ ID NO: 698138 - RNA, 19 nt, Homo sapiens
gguauuugaugcuuucugu

SEQ ID NO: 698139 - RNA, 19 nt, Homo sapiens
caugguggauuacuaugaa

SEQ ID NO: 698140 - RNA, 19 nt, Homo sapiens
gcaagaggaagaagcagaa

SEQ ID NO: 698141 - RNA, 19 nt, Homo sapiens
gaagaagauggccaguuaa

SEQ ID NO: 698142 - RNA, 19 nt, Homo sapiens
gaacggucaagaaagagua

SEQ ID NO: 698143 - RNA, 19 nt, Homo sapiens
gaccugggauuuuauuuaa

SEQ ID NO: 698144 - RNA, 19 nt, Homo sapiens
ucauguugcuuucuccuuu

SEQ ID NO: 698145 - RNA, 19 nt, Homo sapiens
caugauguauugcuucuuc

SEQ ID NO: 698146 - RNA, 19 nt, Homo sapiens
uggaauauuucuggcuuua

SEQ ID NO: 698147 - RNA, 19 nt, Homo sapiens
gcagcaggauugaaagaag

SEQ ID NO: 698148 - RNA, 19 nt, Homo sapiens
ccacuuccggucauuauuu

SEQ ID NO: 698149 - RNA, 19 nt, Homo sapiens
auagaaggcugucgugaau

SEQ ID NO: 698150 - RNA, 19 nt, Homo sapiens
gaagguggcaagaggaaga

SEQ ID NO: 698151 - RNA, 19 nt, Homo sapiens
gauacaggauuuacuucau

SEQ ID NO: 698152 - RNA, 19 nt, Homo sapiens
gcugucggaugcuaagaaa

SEQ ID NO: 698153 - RNA, 19 nt, Homo sapiens
gcaagugacacauugaauc

SEQ ID NO: 698154 - RNA, 19 nt, Homo sapiens
caacuaaaaugguuaaugg

SEQ ID NO: 698155 - RNA, 19 nt, Homo sapiens
cgauaucaacuucaacuaa

SEQ ID NO: 698156 - RNA, 19 nt, Homo sapiens
aagcuuugcugugauuuaa

SEQ ID NO: 698157 - RNA, 19 nt, Homo sapiens
ggacuugagggcauuguga

SEQ ID NO: 698158 - RNA, 19 nt, Homo sapiens
ugacuuuccuucccuuuca

SEQ ID NO: 698159 - RNA, 19 nt, Homo sapiens
caacuucaaauauggugua

SEQ ID NO: 698160 - RNA, 19 nt, Homo sapiens
gacaguccauuugaauuug

SEQ ID NO: 698161 - RNA, 19 nt, Homo sapiens
uaagaaacgggacaucuau

SEQ ID NO: 698162 - RNA, 19 nt, Homo sapiens
ggagguugaacucauguuu

SEQ ID NO: 698163 - RNA, 19 nt, Homo sapiens
agaaggcugucgugaauca

SEQ ID NO: 698164 - RNA, 19 nt, Homo sapiens
ucaguggauuuccgucuuu

SEQ ID NO: 698165 - RNA, 19 nt, Homo sapiens
gugaaaagcuuugcuguga

SEQ ID NO: 698166 - RNA, 19 nt, Homo sapiens
caaagaaggauuaaauggu

SEQ ID NO: 698167 - RNA, 19 nt, Homo sapiens
caauguaacccuaaacaca

SEQ ID NO: 698168 - RNA, 19 nt, Homo sapiens
caaauaugguguagguuuu

SEQ ID NO: 698169 - RNA, 19 nt, Homo sapiens
gggcgcagauggcuaacug

SEQ ID NO: 698170 - RNA, 19 nt, Homo sapiens
gaccaaaggcaaucacuag

SEQ ID NO: 698171 - RNA, 19 nt, Homo sapiens
ucaagaaagaguagaaguu

SEQ ID NO: 698172 - RNA, 19 nt, Homo sapiens
ggagugguauuugaugcuu

SEQ ID NO: 698173 - RNA, 19 nt, Homo sapiens
cuaagaaacgggacaucua

SEQ ID NO: 698174 - RNA, 19 nt, Homo sapiens
gcacaaggagguugaacuc

SEQ ID NO: 698175 - RNA, 19 nt, Homo sapiens
aaacaugguggauuacuau

SEQ ID NO: 698176 - RNA, 19 nt, Homo sapiens
aagaagaagucgaccaaag

SEQ ID NO: 698177 - RNA, 19 nt, Homo sapiens
agagaggagucgaagaaga

SEQ ID NO: 698178 - RNA, 19 nt, Homo sapiens
gcagguagugcaaauucaa

SEQ ID NO: 698179 - RNA, 19 nt, Homo sapiens
gaagaagaagucgaccaaa

SEQ ID NO: 698180 - RNA, 19 nt, Homo sapiens
agaaagaguagaaguugaa

SEQ ID NO: 698181 - RNA, 19 nt, Homo sapiens
gaagggacccauuuucauu

SEQ ID NO: 698182 - RNA, 19 nt, Homo sapiens
ccaacaaucucguaaaaca

SEQ ID NO: 698183 - RNA, 19 nt, Homo sapiens
aacauugacuccuuacgaa

SEQ ID NO: 698184 - RNA, 19 nt, Homo sapiens
acaaggagguugaacucau

SEQ ID NO: 698185 - RNA, 19 nt, Homo sapiens
cuucaaauaugguguaggu

SEQ ID NO: 698186 - RNA, 19 nt, Homo sapiens
gagaauauugcaagugaca

SEQ ID NO: 698187 - RNA, 19 nt, Homo sapiens
gacagacguuugggacuug

SEQ ID NO: 698188 - RNA, 19 nt, Homo sapiens
agagagaggagucgaagaa

SEQ ID NO: 698189 - RNA, 19 nt, Homo sapiens
aagaaagaguagaaguuga

SEQ ID NO: 698190 - RNA, 19 nt, Homo sapiens
aaagagaauugucgagaac

SEQ ID NO: 698191 - RNA, 19 nt, Homo sapiens
uggcaaagaaggauuaaau

SEQ ID NO: 698192 - RNA, 19 nt, Homo sapiens
aguagaaguugaagaagau

SEQ ID NO: 698193 - RNA, 19 nt, Homo sapiens
aagaguagaaguugaagaa

SEQ ID NO: 698194 - RNA, 19 nt, Homo sapiens
gggccucacuucauucucu

SEQ ID NO: 698195 - RNA, 19 nt, Homo sapiens
ggaggagguggaagucauu

SEQ ID NO: 698196 - RNA, 19 nt, Homo sapiens
caaauauggcaaagaagga

SEQ ID NO: 698197 - RNA, 19 nt, Homo sapiens
agaaacgggacaucuauga

SEQ ID NO: 698198 - RNA, 19 nt, Homo sapiens
gaacgugucugcaacuaau

SEQ ID NO: 698199 - RNA, 19 nt, Homo sapiens
gagaagagauacauugugu

SEQ ID NO: 698200 - RNA, 19 nt, Homo sapiens
ucaaaugucuggagaaaug

SEQ ID NO: 698201 - RNA, 19 nt, Homo sapiens
ggugcuggcuuguuuauuu

SEQ ID NO: 698202 - RNA, 19 nt, Homo sapiens
ggaauuggcugugcuuguu

SEQ ID NO: 698203 - RNA, 19 nt, Homo sapiens
gaggaaagaacaauaauga

SEQ ID NO: 698204 - RNA, 19 nt, Homo sapiens
ggaguggccuugcucauug

SEQ ID NO: 698205 - RNA, 19 nt, Homo sapiens
gugcagaucuuuaacaugu

SEQ ID NO: 698206 - RNA, 19 nt, Homo sapiens
gcuagacccugacuaugua

SEQ ID NO: 698207 - RNA, 19 nt, Homo sapiens
gaagaaaacacgcuaguua

SEQ ID NO: 698208 - RNA, 19 nt, Homo sapiens
cuauguggcuggaauauuu

SEQ ID NO: 698209 - RNA, 19 nt, Homo sapiens
aaacguggcucaagaggaa

SEQ ID NO: 698210 - RNA, 19 nt, Homo sapiens
gcccuaaccucacuucaaa

SEQ ID NO: 698211 - RNA, 19 nt, Homo sapiens
gcaagauaguacacuuuaa

SEQ ID NO: 698212 - RNA, 19 nt, Homo sapiens
cauggaggaucauaagaua

SEQ ID NO: 698213 - RNA, 19 nt, Homo sapiens
caugauaucugccuucguu

SEQ ID NO: 698214 - RNA, 19 nt, Homo sapiens
gcauagguguguugagauu

SEQ ID NO: 698215 - RNA, 19 nt, Homo sapiens
ucacagacauuucucuuuc

SEQ ID NO: 698216 - RNA, 19 nt, Homo sapiens
ggccuuacgucuucuauau

SEQ ID NO: 698217 - RNA, 19 nt, Homo sapiens
ccaaacaacagaaagcaua

SEQ ID NO: 698218 - RNA, 19 nt, Homo sapiens
gaagagauacauugugugu

SEQ ID NO: 698219 - RNA, 19 nt, Homo sapiens
gaacggcccuccacugacu

SEQ ID NO: 698220 - RNA, 19 nt, Homo sapiens
ggacagugacccaugauau

SEQ ID NO: 698221 - RNA, 19 nt, Homo sapiens
cuuguuaacuucuuggaua

SEQ ID NO: 698222 - RNA, 19 nt, Homo sapiens
ggaaugaacgugucugcaa

SEQ ID NO: 698223 - RNA, 19 nt, Homo sapiens
uaacauaucgggccugguu

SEQ ID NO: 698224 - RNA, 19 nt, Homo sapiens
agagauacauuguguguuc

SEQ ID NO: 698225 - RNA, 19 nt, Homo sapiens
ggagcaagauaguacacuu

SEQ ID NO: 698226 - RNA, 19 nt, Homo sapiens
caacuugcauucuguggau

SEQ ID NO: 698227 - RNA, 19 nt, Homo sapiens
gaaucaggagcccuuguua

SEQ ID NO: 698228 - RNA, 19 nt, Homo sapiens
caggagcccuuguuaacuu

SEQ ID NO: 698229 - RNA, 19 nt, Homo sapiens
gaggaaugcuccaggaaag

SEQ ID NO: 698230 - RNA, 19 nt, Homo sapiens
caagccaaccucagagaua

SEQ ID NO: 698231 - RNA, 19 nt, Homo sapiens
gaugccagcuuuggaauca

SEQ ID NO: 698232 - RNA, 19 nt, Homo sapiens
gugcuuaguucaucauugu

SEQ ID NO: 698233 - RNA, 19 nt, Homo sapiens
ucaaaggacuauugcaagu

SEQ ID NO: 698234 - RNA, 19 nt, Homo sapiens
gguuggugcuggcuuguuu

SEQ ID NO: 698235 - RNA, 19 nt, Homo sapiens
gaacuugagcauugccauu

SEQ ID NO: 698236 - RNA, 19 nt, Homo sapiens
ucaguaggauucaauucaa

SEQ ID NO: 698237 - RNA, 19 nt, Homo sapiens
gaaaacacgcuaguuauuu

SEQ ID NO: 698238 - RNA, 19 nt, Homo sapiens
gaguuugguuggagaaaug

SEQ ID NO: 698239 - RNA, 19 nt, Homo sapiens
caacuauggcucauucuug

SEQ ID NO: 698240 - RNA, 19 nt, Homo sapiens
uaaaaugucucccaaagau

SEQ ID NO: 698241 - RNA, 19 nt, Homo sapiens
gagcaagauaguacacuuu

SEQ ID NO: 698242 - RNA, 19 nt, Homo sapiens
gggacaauuucuuuccaaa

SEQ ID NO: 698243 - RNA, 19 nt, Homo sapiens
agaaauguguguagugcuu

SEQ ID NO: 698244 - RNA, 19 nt, Homo sapiens
uaaccucacuucaaauguc

SEQ ID NO: 698245 - RNA, 19 nt, Homo sapiens
caaggaggaaagaacaaua

SEQ ID NO: 698246 - RNA, 19 nt, Homo sapiens
ccacuguuauccuaguaaa

SEQ ID NO: 698247 - RNA, 19 nt, Homo sapiens
aagcauagguguguugaga

SEQ ID NO: 698248 - RNA, 19 nt, Homo sapiens
gcauugccauuccagcuau

SEQ ID NO: 698249 - RNA, 19 nt, Homo sapiens
gauaguacacuuuaacucu

SEQ ID NO: 698250 - RNA, 19 nt, Homo sapiens
gaagagagaaccaaaaugu

SEQ ID NO: 698251 - RNA, 19 nt, Homo sapiens
gcuggucucuucccauuag

SEQ ID NO: 698252 - RNA, 19 nt, Homo sapiens
gacauucacccaccucuga

SEQ ID NO: 698253 - RNA, 19 nt, Homo sapiens
ggaaugaaacucuaaaaga

SEQ ID NO: 698254 - RNA, 19 nt, Homo sapiens
cuacuggaaugaaacucua

SEQ ID NO: 698255 - RNA, 19 nt, Homo sapiens
ggaggaaagaacaauaaug

SEQ ID NO: 698256 - RNA, 19 nt, Homo sapiens
gggcuaaggagcagacauu

SEQ ID NO: 698257 - RNA, 19 nt, Homo sapiens
guuaacuucuuggauauug

SEQ ID NO: 698258 - RNA, 19 nt, Homo sapiens
guacacuggcuuucucaaa

SEQ ID NO: 698259 - RNA, 19 nt, Homo sapiens
gggcuaugaucaaauccuu

SEQ ID NO: 698260 - RNA, 19 nt, Homo sapiens
ccucaacuauggcucauuc

SEQ ID NO: 698261 - RNA, 19 nt, Homo sapiens
ccuacuggauuuauuugaa

SEQ ID NO: 698262 - RNA, 19 nt, Homo sapiens
guggaaccauucaacauuc

SEQ ID NO: 698263 - RNA, 19 nt, Homo sapiens
uccaacaguucuucaugua

SEQ ID NO: 698264 - RNA, 19 nt, Homo sapiens
cauuagggcuaugaucaaa

SEQ ID NO: 698265 - RNA, 19 nt, Homo sapiens
ggugagaagagauacauug

SEQ ID NO: 698266 - RNA, 19 nt, Homo sapiens
uaucagugcuggugagaag

SEQ ID NO: 698267 - RNA, 19 nt, Homo sapiens
cuucaaaugucuggagaaa

SEQ ID NO: 698268 - RNA, 19 nt, Homo sapiens
caaggcauagcccagguua

SEQ ID NO: 698269 - RNA, 19 nt, Homo sapiens
uuccagugauggcaauuua

SEQ ID NO: 698270 - RNA, 19 nt, Homo sapiens
cagaacggcccuccacuga

SEQ ID NO: 698271 - RNA, 19 nt, Homo sapiens
ucuugcagcucuguaauuu

SEQ ID NO: 698272 - RNA, 19 nt, Homo sapiens
gcauggaggaucauaagau

SEQ ID NO: 698273 - RNA, 19 nt, Homo sapiens
ccagugauggcaauuuaaa

SEQ ID NO: 698274 - RNA, 19 nt, Homo sapiens
caugccugcuugacugaua

SEQ ID NO: 698275 - RNA, 19 nt, Homo sapiens
gagcaaaccgagagaugug

SEQ ID NO: 698276 - RNA, 19 nt, Homo sapiens
cagucaggauucagaguuu

SEQ ID NO: 698277 - RNA, 19 nt, Homo sapiens
guguugagauuucuguguu

SEQ ID NO: 698278 - RNA, 19 nt, Homo sapiens
gauaagccauuagcuagac

SEQ ID NO: 698279 - RNA, 19 nt, Homo sapiens
cuauaucuuuggaggaauu

SEQ ID NO: 698280 - RNA, 19 nt, Homo sapiens
gagcuguccucaaaagaaa

SEQ ID NO: 698281 - RNA, 19 nt, Homo sapiens
gauacauuguguguucauu

SEQ ID NO: 698282 - RNA, 19 nt, Homo sapiens
uagcccagguuaugguauu

SEQ ID NO: 698283 - RNA, 19 nt, Homo sapiens
gggaguggccuugcucauu

SEQ ID NO: 698284 - RNA, 19 nt, Homo sapiens
ucauuccacuggcagcuaa

SEQ ID NO: 698285 - RNA, 19 nt, Homo sapiens
gaaauguguguagugcuuu

SEQ ID NO: 698286 - RNA, 19 nt, Homo sapiens
ccaaagauguauguaagac

SEQ ID NO: 698287 - RNA, 19 nt, Homo sapiens
gcuagauccuggugcuuag

SEQ ID NO: 698288 - RNA, 19 nt, Homo sapiens
ggacaguuaccuucuuucu

SEQ ID NO: 698289 - RNA, 19 nt, Homo sapiens
uuaccacucugggccauuu

SEQ ID NO: 698290 - RNA, 19 nt, Homo sapiens
gcuuguuuauuuccucauu

SEQ ID NO: 698291 - RNA, 19 nt, Homo sapiens
ccucagcucccucaacuau

SEQ ID NO: 698292 - RNA, 19 nt, Homo sapiens
ccaccuagccagcccaaug

SEQ ID NO: 698293 - RNA, 19 nt, Homo sapiens
ucccaaagauguauguaag

SEQ ID NO: 698294 - RNA, 19 nt, Homo sapiens
uaccugugcuuccagaguu

SEQ ID NO: 698295 - RNA, 19 nt, Homo sapiens
caagauaguacacuuuaac

SEQ ID NO: 698296 - RNA, 19 nt, Homo sapiens
gcaagcuacuaaaagcaua

SEQ ID NO: 698297 - RNA, 19 nt, Homo sapiens
ugaggauccugcacucuuc

SEQ ID NO: 698298 - RNA, 19 nt, Homo sapiens
gcaaagagcucauuagcaa

SEQ ID NO: 698299 - RNA, 19 nt, Homo sapiens
ggaaaugccugccaacuaa

SEQ ID NO: 698300 - RNA, 19 nt, Homo sapiens
ugagaaagcugguaaagua

SEQ ID NO: 698301 - RNA, 19 nt, Homo sapiens
gaaguaagauggccucuga

SEQ ID NO: 698302 - RNA, 19 nt, Homo sapiens
guuaaacgcuuacacaaua

SEQ ID NO: 698303 - RNA, 19 nt, Homo sapiens
uaagauaccuugaguaaug

SEQ ID NO: 698304 - RNA, 19 nt, Homo sapiens
gaaaguccuugaugcaaua

SEQ ID NO: 698305 - RNA, 19 nt, Homo sapiens
ccagagagccaguaaauua

SEQ ID NO: 698306 - RNA, 19 nt, Homo sapiens
agaaagaacuuauggguuu

SEQ ID NO: 698307 - RNA, 19 nt, Homo sapiens
uaagauggccucugauuua

SEQ ID NO: 698308 - RNA, 19 nt, Homo sapiens
gaagagauuucgguucuaa

SEQ ID NO: 698309 - RNA, 19 nt, Homo sapiens
acaaauagauggucacauu

SEQ ID NO: 698310 - RNA, 19 nt, Homo sapiens
gaagagcaauauacuauca

SEQ ID NO: 698311 - RNA, 19 nt, Homo sapiens
ucacauaaguggaaagaaa

SEQ ID NO: 698312 - RNA, 19 nt, Homo sapiens
gaaacgaauugcugaaaug

SEQ ID NO: 698313 - RNA, 19 nt, Homo sapiens
gaauugacuuggaccauaa

SEQ ID NO: 698314 - RNA, 19 nt, Homo sapiens
ggaauugacuuggaccaua

SEQ ID NO: 698315 - RNA, 19 nt, Homo sapiens
gcaaucugcuucaagaauu

SEQ ID NO: 698316 - RNA, 19 nt, Homo sapiens
cagcagaggucguaaagaa

SEQ ID NO: 698317 - RNA, 19 nt, Homo sapiens
ucggagaguugaaauauua

SEQ ID NO: 698318 - RNA, 19 nt, Homo sapiens
guaguuaaguuacggcaua

SEQ ID NO: 698319 - RNA, 19 nt, Homo sapiens
gcacuggacuacauuguug

SEQ ID NO: 698320 - RNA, 19 nt, Homo sapiens
gaaagaacaucgcaaucug

SEQ ID NO: 698321 - RNA, 19 nt, Homo sapiens
gaacaaauugcuaugauga

SEQ ID NO: 698322 - RNA, 19 nt, Homo sapiens
gcucaagaauguuauaaug

SEQ ID NO: 698323 - RNA, 19 nt, Homo sapiens
uuaaggaacuugaagcuaa

SEQ ID NO: 698324 - RNA, 19 nt, Homo sapiens
gcagaggucguaaagaaua

SEQ ID NO: 698325 - RNA, 19 nt, Homo sapiens
ggaaucauguucaguguuc

SEQ ID NO: 698326 - RNA, 19 nt, Homo sapiens
gaaugugcuucugcuauua

SEQ ID NO: 698327 - RNA, 19 nt, Homo sapiens
uaaaggaaguuauggauag

SEQ ID NO: 698328 - RNA, 19 nt, Homo sapiens
gagaagagcaauauacuau

SEQ ID NO: 698329 - RNA, 19 nt, Homo sapiens
ccaagaauguguaaacuuc

SEQ ID NO: 698330 - RNA, 19 nt, Homo sapiens
acacagaggagauaaguua

SEQ ID NO: 698331 - RNA, 19 nt, Homo sapiens
gugaggaacuugauaauag

SEQ ID NO: 698332 - RNA, 19 nt, Homo sapiens
gacuuucgguauuguauua

SEQ ID NO: 698333 - RNA, 19 nt, Homo sapiens
ggaaggacuuucgguauug

SEQ ID NO: 698334 - RNA, 19 nt, Homo sapiens
gagacaaucaccacaguua

SEQ ID NO: 698335 - RNA, 19 nt, Homo sapiens
ggaaaguccuugaugcaau

SEQ ID NO: 698336 - RNA, 19 nt, Homo sapiens
cacaagggcuucagaaaga

SEQ ID NO: 698337 - RNA, 19 nt, Homo sapiens
ggacuuuguugaacuuuau

SEQ ID NO: 698338 - RNA, 19 nt, Homo sapiens
uaaggaagcucuaauugca

SEQ ID NO: 698339 - RNA, 19 nt, Homo sapiens
gauuuacacugguucaauu

SEQ ID NO: 698340 - RNA, 19 nt, Homo sapiens
ucacauugcugaacauaau

SEQ ID NO: 698341 - RNA, 19 nt, Homo sapiens
gaaagcugguaaaguagaa

SEQ ID NO: 698342 - RNA, 19 nt, Homo sapiens
gauggagagugguaacuuu

SEQ ID NO: 698343 - RNA, 19 nt, Homo sapiens
gaguaauguuugccuauaa

SEQ ID NO: 698344 - RNA, 19 nt, Homo sapiens
gaaguuauggauagccuua

SEQ ID NO: 698345 - RNA, 19 nt, Homo sapiens
uauaguugcuucaugagua

SEQ ID NO: 698346 - RNA, 19 nt, Homo sapiens
ggauagacuuauuggaauu

SEQ ID NO: 698347 - RNA, 19 nt, Homo sapiens
cuuaguagcugacaacuug

SEQ ID NO: 698348 - RNA, 19 nt, Homo sapiens
aaggaaagcugcaaucaga

SEQ ID NO: 698349 - RNA, 19 nt, Homo sapiens
ugcccuagcuguuaaauuu

SEQ ID NO: 698350 - RNA, 19 nt, Homo sapiens
caaucugcuucaagaauua

SEQ ID NO: 698351 - RNA, 19 nt, Homo sapiens
uaccagagauccagaaaga

SEQ ID NO: 698352 - RNA, 19 nt, Homo sapiens
gcaagcauccagcguuuaa

SEQ ID NO: 698353 - RNA, 19 nt, Homo sapiens
agucagaacuugauaucua

SEQ ID NO: 698354 - RNA, 19 nt, Homo sapiens
ggguaugcuugaauauuua

SEQ ID NO: 698355 - RNA, 19 nt, Homo sapiens
gaacagucagguacaauga

SEQ ID NO: 698356 - RNA, 19 nt, Homo sapiens
ggaagauguucaaguuaga

SEQ ID NO: 698357 - RNA, 19 nt, Homo sapiens
uguaaaggauuaugaguug

SEQ ID NO: 698358 - RNA, 19 nt, Homo sapiens
gaagcccggugucaugaaa

SEQ ID NO: 698359 - RNA, 19 nt, Homo sapiens
gcaaauccaagaacagaaa

SEQ ID NO: 698360 - RNA, 19 nt, Homo sapiens
gaaggaagaauuguauuug

SEQ ID NO: 698361 - RNA, 19 nt, Homo sapiens
uuacauaggucuuguuaag

SEQ ID NO: 698362 - RNA, 19 nt, Homo sapiens
gggugaaguugaacaaauu

SEQ ID NO: 698363 - RNA, 19 nt, Homo sapiens
acaaggacauucagaguug

SEQ ID NO: 698364 - RNA, 19 nt, Homo sapiens
ugaaugugcuucugcuauu

SEQ ID NO: 698365 - RNA, 19 nt, Homo sapiens
gaagaaagaguaguuaagu

SEQ ID NO: 698366 - RNA, 19 nt, Homo sapiens
ccacaagaguagcauauca

SEQ ID NO: 698367 - RNA, 19 nt, Homo sapiens
gaaacaaugcccucgagaa

SEQ ID NO: 698368 - RNA, 19 nt, Homo sapiens
ccaacaguuucuaucauaa

SEQ ID NO: 698369 - RNA, 19 nt, Homo sapiens
gaagauaauccuauugaag

SEQ ID NO: 698370 - RNA, 19 nt, Homo sapiens
gaaaugaggaacacacuag

SEQ ID NO: 698371 - RNA, 19 nt, Homo sapiens
aaucagagauauagaagga

SEQ ID NO: 698372 - RNA, 19 nt, Homo sapiens
gaagucauuccuaacagua

SEQ ID NO: 698373 - RNA, 19 nt, Homo sapiens
guaaguagcagacuaugga

SEQ ID NO: 698374 - RNA, 19 nt, Homo sapiens
guagacagcuuggauccuu

SEQ ID NO: 698375 - RNA, 19 nt, Homo sapiens
ugauauagcccaagaaugu

SEQ ID NO: 698376 - RNA, 19 nt, Homo sapiens
aggaauauauggaagauug

SEQ ID NO: 698377 - RNA, 19 nt, Homo sapiens
ucagagauauagaaggaaa

SEQ ID NO: 698378 - RNA, 19 nt, Homo sapiens
guaaaccagucauucugaa

SEQ ID NO: 698379 - RNA, 19 nt, Homo sapiens
aaauaucacugcauccuau

SEQ ID NO: 698380 - RNA, 19 nt, Homo sapiens
gcagaaauugcuagaagaa

SEQ ID NO: 698381 - RNA, 19 nt, Homo sapiens
gagauaauacuucugucua

SEQ ID NO: 698382 - RNA, 19 nt, Homo sapiens
agaacggccugcagagaua

SEQ ID NO: 698383 - RNA, 19 nt, Homo sapiens
ugaagaagagguaaacaaa

SEQ ID NO: 698384 - RNA, 19 nt, Homo sapiens
gaagcaaaguaaugaaagg

SEQ ID NO: 698385 - RNA, 19 nt, Homo sapiens
uagauaagauggcuguaug

SEQ ID NO: 698386 - RNA, 19 nt, Homo sapiens
ggacuacauuguuguugau

SEQ ID NO: 698387 - RNA, 19 nt, Homo sapiens
ugaguaauguuugccuaua

SEQ ID NO: 698388 - RNA, 19 nt, Homo sapiens
aaucaagacugcugacaga

SEQ ID NO: 698389 - RNA, 19 nt, Homo sapiens
guuccucacuuguuauuga

SEQ ID NO: 698390 - RNA, 19 nt, Homo sapiens
gaaaggaaagcugcaauca

SEQ ID NO: 698391 - RNA, 19 nt, Homo sapiens
uuacacagcuagauuugga

SEQ ID NO: 698392 - RNA, 19 nt, Homo sapiens
ucaugaagauaccaaagaa

SEQ ID NO: 698393 - RNA, 19 nt, Homo sapiens
uccaacaguuucuaucaua

SEQ ID NO: 698394 - RNA, 19 nt, Homo sapiens
aaacguuagugcuuucaaa

SEQ ID NO: 698395 - RNA, 19 nt, Homo sapiens
ggaucaagccacaagagua

SEQ ID NO: 698396 - RNA, 19 nt, Homo sapiens
gaaacaacaaccagaaaca

SEQ ID NO: 698397 - RNA, 19 nt, Homo sapiens
gaaguugaacaaauugcua

SEQ ID NO: 698398 - RNA, 19 nt, Homo sapiens
gaagaacucugucuggauu

SEQ ID NO: 698399 - RNA, 19 nt, Homo sapiens
gagaaugucuguuaugaug

SEQ ID NO: 698400 - RNA, 19 nt, Homo sapiens
gaggagaauccaucuauua

SEQ ID NO: 698401 - RNA, 19 nt, Homo sapiens
ucacaaccauuccacauuu

SEQ ID NO: 698402 - RNA, 19 nt, Homo sapiens
gagacucacuaaacaguaa

SEQ ID NO: 698403 - RNA, 19 nt, Homo sapiens
gcaaugcgcuggaaacaac

SEQ ID NO: 698404 - RNA, 19 nt, Homo sapiens
gagaauccaucuauuacga

SEQ ID NO: 698405 - RNA, 19 nt, Homo sapiens
cgaagaggauccuaugaug

SEQ ID NO: 698406 - RNA, 19 nt, Homo sapiens
ggaggagaauccaucuauu

SEQ ID NO: 698407 - RNA, 19 nt, Homo sapiens
uaacauugcugucaaacca

SEQ ID NO: 698408 - RNA, 19 nt, Homo sapiens
gcugugagaaugucuguua

SEQ ID NO: 698409 - RNA, 19 nt, Homo sapiens
guuagaaagugauaaggaa

SEQ ID NO: 698410 - RNA, 19 nt, Homo sapiens
gagcaagcccuaugcaaug

SEQ ID NO: 698411 - RNA, 19 nt, Homo sapiens
gugagaaugucuguuauga

SEQ ID NO: 698412 - RNA, 19 nt, Homo sapiens
gcuauaacauugcugucaa

SEQ ID NO: 698413 - RNA, 19 nt, Homo sapiens
gcaccucucucccauguac

SEQ ID NO: 698414 - RNA, 19 nt, Homo sapiens
uaagaucgccuacaagcaa

SEQ ID NO: 698415 - RNA, 19 nt, Homo sapiens
agacuuccuuguccucaua

SEQ ID NO: 698416 - RNA, 19 nt, Homo sapiens
cauaagauagacugcuuua

SEQ ID NO: 698417 - RNA, 19 nt, Homo sapiens
gcuaugcuauccacaagau

SEQ ID NO: 698418 - RNA, 19 nt, Homo sapiens
gcaacucccucugugaugu

SEQ ID NO: 698419 - RNA, 19 nt, Homo sapiens
gaccaucuuccuucugaua

SEQ ID NO: 698420 - RNA, 19 nt, Homo sapiens
aagaggauccuaugaugua

SEQ ID NO: 698421 - RNA, 19 nt, Homo sapiens
gaagaggauccuaugaugu

SEQ ID NO: 698422 - RNA, 19 nt, Homo sapiens
ggagcaagcccuaugcaau

SEQ ID NO: 698423 - RNA, 19 nt, Homo sapiens
uuugggagaugcuucauuu

SEQ ID NO: 698424 - RNA, 19 nt, Homo sapiens
gagauggaguuagaaagug

SEQ ID NO: 698425 - RNA, 19 nt, Homo sapiens
gaagaugggcucaugaaaa

SEQ ID NO: 698426 - RNA, 19 nt, Homo sapiens
caacgaagaggauccuaug

SEQ ID NO: 698427 - RNA, 19 nt, Homo sapiens
agaacucugucuggauuua

SEQ ID NO: 698428 - RNA, 19 nt, Homo sapiens
ggaagaugggcucaugaaa

SEQ ID NO: 698429 - RNA, 19 nt, Homo sapiens
ggccuuugccucuugcuua

SEQ ID NO: 698430 - RNA, 19 nt, Homo sapiens
gagcagagccaacccaaac

SEQ ID NO: 698431 - RNA, 19 nt, Homo sapiens
cugauaauguaugguguua

SEQ ID NO: 698432 - RNA, 19 nt, Homo sapiens
uagaggagauucacaacca

SEQ ID NO: 698433 - RNA, 19 nt, Homo sapiens
gcuuggaucuggcaguuca

SEQ ID NO: 698434 - RNA, 19 nt, Homo sapiens
gaagaucuggcucacuguu

SEQ ID NO: 698435 - RNA, 19 nt, Homo sapiens
uaugauguauccagagaug

SEQ ID NO: 698436 - RNA, 19 nt, Homo sapiens
gaugcuucauuuaggguuu

SEQ ID NO: 698437 - RNA, 19 nt, Homo sapiens
gggagaugcuucauuuagg

SEQ ID NO: 698438 - RNA, 19 nt, Homo sapiens
gaacucugucuggauuuaa

SEQ ID NO: 698439 - RNA, 19 nt, Homo sapiens
ggaagaacucugucuggau

SEQ ID NO: 698440 - RNA, 19 nt, Homo sapiens
gccuuugccucuugcuuaa

SEQ ID NO: 698441 - RNA, 19 nt, Homo sapiens
cuauaacauugcugucaaa

SEQ ID NO: 698442 - RNA, 19 nt, Homo sapiens
ccuaugauguauccagaga

SEQ ID NO: 698443 - RNA, 19 nt, Homo sapiens
ggagaagaaggccaaagug

SEQ ID NO: 698444 - RNA, 19 nt, Homo sapiens
gggaagaugggcucaugaa

SEQ ID NO: 698445 - RNA, 19 nt, Homo sapiens
ugagguggguuuucugaua

SEQ ID NO: 698446 - RNA, 19 nt, Homo sapiens
ucacuguucugauugucuu

SEQ ID NO: 698447 - RNA, 19 nt, Homo sapiens
acaccgggcucuggaagaa

SEQ ID NO: 698448 - RNA, 19 nt, Homo sapiens
gauccgggugcuuauaauu

SEQ ID NO: 698449 - RNA, 19 nt, Homo sapiens
aaaucuaugugcugcaguu

SEQ ID NO: 698450 - RNA, 19 nt, Homo sapiens
ggaguuagaaagugauaag

SEQ ID NO: 698451 - RNA, 19 nt, Homo sapiens
agauggaguuagaaaguga

SEQ ID NO: 698452 - RNA, 19 nt, Homo sapiens
ccagagauggaguuagaaa

SEQ ID NO: 698453 - RNA, 19 nt, Homo sapiens
gauagacugcuuuauuucu

SEQ ID NO: 698454 - RNA, 19 nt, Homo sapiens
gggcuaugcuauccacaag

SEQ ID NO: 698455 - RNA, 19 nt, Homo sapiens
gggagaagaaggccaaagu

SEQ ID NO: 698456 - RNA, 19 nt, Homo sapiens
ugucaaaccagaucaaauc

SEQ ID NO: 698457 - RNA, 19 nt, Homo sapiens
ggauccgggugcuuauaau

SEQ ID NO: 698458 - RNA, 19 nt, Homo sapiens
aaagcaaauuugugugcaa

SEQ ID NO: 698459 - RNA, 19 nt, Homo sapiens
caacacagcccaggaacag

SEQ ID NO: 698460 - RNA, 19 nt, Homo sapiens
augcuaagaucgccuacaa

SEQ ID NO: 698461 - RNA, 19 nt, Homo sapiens
gaacuguccaaugcuaaga

SEQ ID NO: 698462 - RNA, 19 nt, Homo sapiens
gaggagauucacaaccauu

SEQ ID NO: 698463 - RNA, 19 nt, Homo sapiens
caacucccucugugaugua

SEQ ID NO: 698464 - RNA, 19 nt, Homo sapiens
caucuuccuucugauaaug

SEQ ID NO: 698465 - RNA, 19 nt, Homo sapiens
ccaaagcuggguccaacaa

SEQ ID NO: 698466 - RNA, 19 nt, Homo sapiens
cacaaccauuccacauuug

SEQ ID NO: 698467 - RNA, 19 nt, Homo sapiens
ccacaagauugccaaaaug

SEQ ID NO: 698468 - RNA, 19 nt, Homo sapiens
gaggauccgggugcuuaua

SEQ ID NO: 698469 - RNA, 19 nt, Homo sapiens
uggcaaggaccguguuuga

SEQ ID NO: 698470 - RNA, 19 nt, Homo sapiens
aaacggaggaggacaacga

SEQ ID NO: 698471 - RNA, 19 nt, Homo sapiens
gccucuugcuuaacauuug

SEQ ID NO: 698472 - RNA, 19 nt, Homo sapiens
ugucuguuaugaugcguuu

SEQ ID NO: 698473 - RNA, 19 nt, Homo sapiens
caaagcuggguccaacaaa

SEQ ID NO: 698474 - RNA, 19 nt, Homo sapiens
gaucaggauggcucaggaa

SEQ ID NO: 698475 - RNA, 19 nt, Homo sapiens
aaccagaucaaauccagua

SEQ ID NO: 698476 - RNA, 19 nt, Homo sapiens
aagaugggcucaugaaaau

SEQ ID NO: 698477 - RNA, 19 nt, Homo sapiens
gacgacggauucgggaaga

SEQ ID NO: 698478 - RNA, 19 nt, Homo sapiens
ggaggacaacgaagaggau

SEQ ID NO: 698479 - RNA, 19 nt, Homo sapiens
uccgggugcuuauaauuau

SEQ ID NO: 698480 - RNA, 19 nt, Homo sapiens
cgagacucacuaaacagua

SEQ ID NO: 698481 - RNA, 19 nt, Homo sapiens
auucgagacucacuaaaca

SEQ ID NO: 698482 - RNA, 19 nt, Homo sapiens
gggaugggaagaacucugu

SEQ ID NO: 698483 - RNA, 19 nt, Homo sapiens
aagaucgccuacaagcaaa

SEQ ID NO: 698484 - RNA, 19 nt, Homo sapiens
ccaucuuccuucugauaau

SEQ ID NO: 698485 - RNA, 19 nt, Homo sapiens
agacugcuuuauuucuaga

SEQ ID NO: 698486 - RNA, 19 nt, Homo sapiens
agagauggaguuagaaagu

SEQ ID NO: 698487 - RNA, 19 nt, Homo sapiens
ggaggaggacaacgaagag

SEQ ID NO: 698488 - RNA, 19 nt, Homo sapiens
ggccaacacagcccaggaa

SEQ ID NO: 698489 - RNA, 19 nt, Homo sapiens
uauccuuucacuuggaaua

SEQ ID NO: 698490 - RNA, 19 nt, Homo sapiens
aacccaaaccuaagcauga

SEQ ID NO: 698491 - RNA, 19 nt, Homo sapiens
cuggcucacuguucugauu

SEQ ID NO: 698492 - RNA, 19 nt, Homo sapiens
uaugcuauccacaagauug

SEQ ID NO: 698493 - RNA, 19 nt, Homo sapiens
cgaugagcaaagcaaauuu

SEQ ID NO: 698494 - RNA, 19 nt, Homo sapiens
cagaucaaauccaguacac

SEQ ID NO: 698495 - RNA, 19 nt, Homo sapiens
cucauaagauagacugcuu

SEQ ID NO: 698496 - RNA, 19 nt, Homo sapiens
uccuuguccucauaagaua

SEQ ID NO: 698497 - RNA, 19 nt, Homo sapiens
agagccaacccaaaccuaa

SEQ ID NO: 698498 - RNA, 19 nt, Homo sapiens
ggagauaucugugccugua

SEQ ID NO: 698499 - RNA, 19 nt, Homo sapiens
ggagagaaacgucgugauu

SEQ ID NO: 698500 - RNA, 19 nt, Homo sapiens
ccacugaucuggauugagu

SEQ ID NO: 698501 - RNA, 19 nt, Homo sapiens
ggucuucauugaugucaua

SEQ ID NO: 698502 - RNA, 19 nt, Homo sapiens
agagaaacgucgugauuug

SEQ ID NO: 698503 - RNA, 19 nt, Homo sapiens
agaacgaggucuucauuga

SEQ ID NO: 698504 - RNA, 19 nt, Homo sapiens
gucgugauuuggaguauua

SEQ ID NO: 698505 - RNA, 19 nt, Homo sapiens
ccgaggguaucaaguauaa

SEQ ID NO: 698506 - RNA, 19 nt, Homo sapiens
acuuugagcucaugucaua

SEQ ID NO: 698507 - RNA, 19 nt, Homo sapiens
caguagagcuggaggaugu

SEQ ID NO: 698508 - RNA, 19 nt, Homo sapiens
gagagaaacgucgugauuu

SEQ ID NO: 698509 - RNA, 19 nt, Homo sapiens
ggccaacgguguggagaua

SEQ ID NO: 698510 - RNA, 19 nt, Homo sapiens
ggauugagucugucauuga

SEQ ID NO: 698511 - RNA, 19 nt, Homo sapiens
ccucaccucuuccuuauuc

SEQ ID NO: 698512 - RNA, 19 nt, Homo sapiens
gguaucaaguauaagaaga

SEQ ID NO: 698513 - RNA, 19 nt, Homo sapiens
gaaaucgucgguaccauca

SEQ ID NO: 698514 - RNA, 19 nt, Homo sapiens
gaacgaggucuucauugau

SEQ ID NO: 698515 - RNA, 19 nt, Homo sapiens
gagcauccgggacaacuuu

SEQ ID NO: 698516 - RNA, 19 nt, Homo sapiens
gcgagugccuucuugcaau

SEQ ID NO: 698517 - RNA, 19 nt, Homo sapiens
gaguggcgauuaccaacuu

SEQ ID NO: 698518 - RNA, 19 nt, Homo sapiens
ccaucaagcucaagguguu

SEQ ID NO: 698519 - RNA, 19 nt, Homo sapiens
gaggguaucaaguauaaga

SEQ ID NO: 698520 - RNA, 19 nt, Homo sapiens
gcuccgaggguaucaagua

SEQ ID NO: 698521 - RNA, 19 nt, Homo sapiens
gagcaagauugagcacuuc

SEQ ID NO: 698522 - RNA, 19 nt, Homo sapiens
ugagcaagauugagcacuu

SEQ ID NO: 698523 - RNA, 19 nt, Homo sapiens
cgagugccuucuugcaauu

SEQ ID NO: 698524 - RNA, 19 nt, Homo sapiens
gugcggcucucucgcuuug

SEQ ID NO: 698525 - RNA, 19 nt, Homo sapiens
gcaagaacaaaucaguaga

SEQ ID NO: 698526 - RNA, 19 nt, Homo sapiens
guauaagacaauagaggua

SEQ ID NO: 698527 - RNA, 19 nt, Homo sapiens
cuucaugccuuugcuggua

SEQ ID NO: 698528 - RNA, 19 nt, Homo sapiens
cagcaagaacaaaucagua

SEQ ID NO: 698529 - RNA, 19 nt, Homo sapiens
uggacgagcucauggacuu

SEQ ID NO: 698530 - RNA, 19 nt, Homo sapiens
gauugagucugucauugag

SEQ ID NO: 698531 - RNA, 19 nt, Homo sapiens
ucaagccacugaucuggau

SEQ ID NO: 698532 - RNA, 19 nt, Homo sapiens
gguguacuccuuccuguau

SEQ ID NO: 698533 - RNA, 19 nt, Homo sapiens
guuaagggcaagccauuga

SEQ ID NO: 698534 - RNA, 19 nt, Homo sapiens
acacagcaaccucuacuug

SEQ ID NO: 698535 - RNA, 19 nt, Homo sapiens
gcguggagaucauggucaa

SEQ ID NO: 698536 - RNA, 19 nt, Homo sapiens
cgccucggcugucuucauu

SEQ ID NO: 698537 - RNA, 19 nt, Homo sapiens
uguacuccuuccuguauaa

SEQ ID NO: 698538 - RNA, 19 nt, Homo sapiens
gcagcaagaacaaaucagu

SEQ ID NO: 698539 - RNA, 19 nt, Homo sapiens
aacgaggucuucauugaug

SEQ ID NO: 698540 - RNA, 19 nt, Homo sapiens
caagauugagcacuucaug

SEQ ID NO: 698541 - RNA, 19 nt, Homo sapiens
ccaacgguguggagauauc

SEQ ID NO: 698542 - RNA, 19 nt, Homo sapiens
ucaaguauaagaagaacga

SEQ ID NO: 698543 - RNA, 19 nt, Homo sapiens
guguacuccuuccuguaua

SEQ ID NO: 698544 - RNA, 19 nt, Homo sapiens
gauguggccaugagcaaga

SEQ ID NO: 698545 - RNA, 19 nt, Homo sapiens
gcuggaggauguaaaauuc

SEQ ID NO: 698546 - RNA, 19 nt, Homo sapiens
caagaacaaaucaguagag

SEQ ID NO: 698547 - RNA, 19 nt, Homo sapiens
gaagaucauugagaaaagu

SEQ ID NO: 698548 - RNA, 19 nt, Homo sapiens
caacuucguaccagcuaga

SEQ ID NO: 698549 - RNA, 19 nt, Homo sapiens
gauuuggaguauuaagucu

SEQ ID NO: 698550 - RNA, 19 nt, Homo sapiens
ugaucuggauugagucugu

SEQ ID NO: 698551 - RNA, 19 nt, Homo sapiens
gccaccacaucgaagaaug

SEQ ID NO: 698552 - RNA, 19 nt, Homo sapiens
ucaaacacagcaaccucua

SEQ ID NO: 698553 - RNA, 19 nt, Homo sapiens
gauccagguccgauacaug

SEQ ID NO: 698554 - RNA, 19 nt, Homo sapiens
ggacgagcucauggacuuu

SEQ ID NO: 698555 - RNA, 19 nt, Homo sapiens
acagcaaccucuacuuggu

SEQ ID NO: 698556 - RNA, 19 nt, Homo sapiens
ucacccagaguggcgauua

SEQ ID NO: 698557 - RNA, 19 nt, Homo sapiens
cagguccgauacaugaaga

SEQ ID NO: 698558 - RNA, 19 nt, Homo sapiens
cuucauugaugucauagag

SEQ ID NO: 698559 - RNA, 19 nt, Homo sapiens
cuuccucaccucuuccuua

SEQ ID NO: 698560 - RNA, 19 nt, Homo sapiens
gcccuggguucgcuacauc

SEQ ID NO: 698561 - RNA, 19 nt, Homo sapiens
uugagucugucauugagaa

SEQ ID NO: 698562 - RNA, 19 nt, Homo sapiens
uggauugagucugucauug

SEQ ID NO: 698563 - RNA, 19 nt, Homo sapiens
caacuacaagggcgaugug

SEQ ID NO: 698564 - RNA, 19 nt, Homo sapiens
ucacucagcagagcaacaa

SEQ ID NO: 698565 - RNA, 19 nt, Homo sapiens
gaucagccgcaacuacaag

SEQ ID NO: 698566 - RNA, 19 nt, Homo sapiens
caucgaagaaugccaaugc

SEQ ID NO: 698567 - RNA, 19 nt, Homo sapiens
ccucgcgagugccuucuug

SEQ ID NO: 698568 - RNA, 19 nt, Homo sapiens
cuagaagggagaagagaug

SEQ ID NO: 698569 - RNA, 19 nt, Homo sapiens
gagaaacgucgugauuugg

SEQ ID NO: 698570 - RNA, 19 nt, Homo sapiens
ucaaugaccgcgugcucuu

SEQ ID NO: 698571 - RNA, 19 nt, Homo sapiens
ccaaugccucccuggugua

SEQ ID NO: 698572 - RNA, 19 nt, Homo sapiens
uccauaggcugggagagaa

SEQ ID NO: 698573 - RNA, 19 nt, Homo sapiens
gcuagaagggagaagagau

SEQ ID NO: 698574 - RNA, 19 nt, Homo sapiens
ccagaguggcgauuaccaa

SEQ ID NO: 698575 - RNA, 19 nt, Homo sapiens
ccaaggggcaguuuaagaa

SEQ ID NO: 698576 - RNA, 19 nt, Homo sapiens
agucugucauugagaaguu

SEQ ID NO: 698577 - RNA, 19 nt, Homo sapiens
gagugccuucuugcaauua

SEQ ID NO: 698578 - RNA, 19 nt, Homo sapiens
ggcgauuaccaacuucgua

SEQ ID NO: 698579 - RNA, 19 nt, Homo sapiens
ggauccagguccgauacau

SEQ ID NO: 698580 - RNA, 19 nt, Homo sapiens
ggccagguccacuuccuau

SEQ ID NO: 698581 - RNA, 19 nt, Homo sapiens
ucaaccugcuggucaaugc

SEQ ID NO: 698582 - RNA, 19 nt, Homo sapiens
gacaacgaccgcaccaucu

SEQ ID NO: 698583 - RNA, 19 nt, Homo sapiens
guagagcuggaggauguaa

SEQ ID NO: 698584 - RNA, 19 nt, Homo sapiens
gcaacuacaagggcgaugu

SEQ ID NO: 698585 - RNA, 19 nt, Homo sapiens
agaaacgucgugauuugga

SEQ ID NO: 698586 - RNA, 19 nt, Homo sapiens
gggcagcgccaaguaugug

SEQ ID NO: 698587 - RNA, 19 nt, Homo sapiens
ccucggcugucuucauucu

SEQ ID NO: 698588 - RNA, 19 nt, Homo sapiens
aaucgucgguaccaucaag

SEQ ID NO: 698589 - RNA, 19 nt, Homo sapiens
caacggcagcguccuucug

SEQ ID NO: 698590 - RNA, 19 nt, Homo sapiens
aguaugugccggagagaaa

SEQ ID NO: 698591 - RNA, 19 nt, Homo sapiens
uugagcacuucaugccuuu

SEQ ID NO: 698592 - RNA, 19 nt, Homo sapiens
uuccucaccucuuccuuau

SEQ ID NO: 698593 - RNA, 19 nt, Homo sapiens
gaccgcaccaucuccuuca

SEQ ID NO: 698594 - RNA, 19 nt, Homo sapiens
ucacuggccgcagcaagaa

SEQ ID NO: 698595 - RNA, 19 nt, Homo sapiens
ccagguccacuuccuaugg

SEQ ID NO: 698596 - RNA, 19 nt, Homo sapiens
gaacagaaaugccucuaaa

SEQ ID NO: 698597 - RNA, 19 nt, Homo sapiens
gaaaggacguugaauuuga

SEQ ID NO: 698598 - RNA, 19 nt, Homo sapiens
gcaaagaggucacguauag

SEQ ID NO: 698599 - RNA, 19 nt, Homo sapiens
gaacaaagugugugcauaa

SEQ ID NO: 698600 - RNA, 19 nt, Homo sapiens
ggacugggcugaaguacaa

SEQ ID NO: 698601 - RNA, 19 nt, Homo sapiens
ggaagaagaugcugaucaa

SEQ ID NO: 698602 - RNA, 19 nt, Homo sapiens
gaacaauccuaauaucuuc

SEQ ID NO: 698603 - RNA, 19 nt, Homo sapiens
gcaguaugcuguauugaaa

SEQ ID NO: 698604 - RNA, 19 nt, Homo sapiens
gaaauuagaugagaaagag

SEQ ID NO: 698605 - RNA, 19 nt, Homo sapiens
guugauaccugguuauaaa

SEQ ID NO: 698606 - RNA, 19 nt, Homo sapiens
ugacagagcugacccugaa

SEQ ID NO: 698607 - RNA, 19 nt, Homo sapiens
gggcagaaccagauuguua

SEQ ID NO: 698608 - RNA, 19 nt, Homo sapiens
aaacagaacccucuuacua

SEQ ID NO: 698609 - RNA, 19 nt, Homo sapiens
uaacagagcugcccgaaac

SEQ ID NO: 698610 - RNA, 19 nt, Homo sapiens
gaacauuauuccugcuauu

SEQ ID NO: 698611 - RNA, 19 nt, Homo sapiens
ggacuauacuuuauugauc

SEQ ID NO: 698612 - RNA, 19 nt, Homo sapiens
uaaaguugauaccugguua

SEQ ID NO: 698613 - RNA, 19 nt, Homo sapiens
aaagaaacauguuggaaga

SEQ ID NO: 698614 - RNA, 19 nt, Homo sapiens
agaaaugccucuaaacaga

SEQ ID NO: 698615 - RNA, 19 nt, Homo sapiens
gaagagagaagccgcaaga

SEQ ID NO: 698616 - RNA, 19 nt, Homo sapiens
agaaguaucuccugacaga

SEQ ID NO: 698617 - RNA, 19 nt, Homo sapiens
cauaaccagucaugagaua

SEQ ID NO: 698618 - RNA, 19 nt, Homo sapiens
ugacagcagugacuugaaa

SEQ ID NO: 698619 - RNA, 19 nt, Homo sapiens
gcugcgagcuccucaagaa

SEQ ID NO: 698620 - RNA, 19 nt, Homo sapiens
agaacccucuuacuauuua

SEQ ID NO: 698621 - RNA, 19 nt, Homo sapiens
caaccaaacccaagaaaga

SEQ ID NO: 698622 - RNA, 19 nt, Homo sapiens
ggaaugggcuaaaucaacu

SEQ ID NO: 698623 - RNA, 19 nt, Homo sapiens
ggaacaauccuaauaucuu

SEQ ID NO: 698624 - RNA, 19 nt, Homo sapiens
caccagauguccaaauuga

SEQ ID NO: 698625 - RNA, 19 nt, Homo sapiens
ugauugaucuggauacuau

SEQ ID NO: 698626 - RNA, 19 nt, Homo sapiens
ucagguaucuguugacaau

SEQ ID NO: 698627 - RNA, 19 nt, Homo sapiens
agaagaugcugaucaagaa

SEQ ID NO: 698628 - RNA, 19 nt, Homo sapiens
aggaagagcuugaugaugu

SEQ ID NO: 698629 - RNA, 19 nt, Homo sapiens
gcaaaccucaggaugcaua

SEQ ID NO: 698630 - RNA, 19 nt, Homo sapiens
gaaacauguuggaagauca

SEQ ID NO: 698631 - RNA, 19 nt, Homo sapiens
aaagaaguaucgagugcua

SEQ ID NO: 698632 - RNA, 19 nt, Homo sapiens
caaacaagcugaagaugcu

SEQ ID NO: 698633 - RNA, 19 nt, Homo sapiens
gaccagugcagaacaauuu

SEQ ID NO: 698634 - RNA, 19 nt, Homo sapiens
ugaagauggugacauuaaa

SEQ ID NO: 698635 - RNA, 19 nt, Homo sapiens
gcauuagauugaacagaaa

SEQ ID NO: 698636 - RNA, 19 nt, Homo sapiens
gaaacagauucaaagaagu

SEQ ID NO: 698637 - RNA, 19 nt, Homo sapiens
acagaacccucuuacuauu

SEQ ID NO: 698638 - RNA, 19 nt, Homo sapiens
caagaaguaucuccugaca

SEQ ID NO: 698639 - RNA, 19 nt, Homo sapiens
ucaugaacccugacuauaa

SEQ ID NO: 698640 - RNA, 19 nt, Homo sapiens
cgagugcuaugcauugaaa

SEQ ID NO: 698641 - RNA, 19 nt, Homo sapiens
gaaaugccucuaaacagaa

SEQ ID NO: 698642 - RNA, 19 nt, Homo sapiens
ggaaaggacguugaauuug

SEQ ID NO: 698643 - RNA, 19 nt, Homo sapiens
gacaagauagugaaagaaa

SEQ ID NO: 698644 - RNA, 19 nt, Homo sapiens
guaugaauaugaagaguag

SEQ ID NO: 698645 - RNA, 19 nt, Homo sapiens
caugaacccugacuauaau

SEQ ID NO: 698646 - RNA, 19 nt, Homo sapiens
ugucauagcauuagauuga

SEQ ID NO: 698647 - RNA, 19 nt, Homo sapiens
ccaggacuauacuuuauug

SEQ ID NO: 698648 - RNA, 19 nt, Homo sapiens
caucagaucaacagaauga

SEQ ID NO: 698649 - RNA, 19 nt, Homo sapiens
gcaagaggaaauuagauga

SEQ ID NO: 698650 - RNA, 19 nt, Homo sapiens
caagaaguugucagaauuu

SEQ ID NO: 698651 - RNA, 19 nt, Homo sapiens
gagaguucauuuagcagaa

SEQ ID NO: 698652 - RNA, 19 nt, Homo sapiens
caaaguacuuguucaacca

SEQ ID NO: 698653 - RNA, 19 nt, Homo sapiens
gauggcacuauguauauua

SEQ ID NO: 698654 - RNA, 19 nt, Homo sapiens
uaagcaaccucaacagaca

SEQ ID NO: 698655 - RNA, 19 nt, Homo sapiens
gaaggaagagcuugaugau

SEQ ID NO: 698656 - RNA, 19 nt, Homo sapiens
ggaaauuagaugagaaaga

SEQ ID NO: 698657 - RNA, 19 nt, Homo sapiens
gagagacggaagcuaauaa

SEQ ID NO: 698658 - RNA, 19 nt, Homo sapiens
cagcugauguuccucuuau

SEQ ID NO: 698659 - RNA, 19 nt, Homo sapiens
uagccuagaucuaaccauu

SEQ ID NO: 698660 - RNA, 19 nt, Homo sapiens
cacaaugcauguugccuuu

SEQ ID NO: 698661 - RNA, 19 nt, Homo sapiens
gaaguugucagaauuugga

SEQ ID NO: 698662 - RNA, 19 nt, Homo sapiens
gacaucagguaucuguuga

SEQ ID NO: 698663 - RNA, 19 nt, Homo sapiens
ggagagacggaagcuaaua

SEQ ID NO: 698664 - RNA, 19 nt, Homo sapiens
gauggugacauuaaacgua

SEQ ID NO: 698665 - RNA, 19 nt, Homo sapiens
uaacacaccuucagaaccu

SEQ ID NO: 698666 - RNA, 19 nt, Homo sapiens
caaagugugugcauaacca

SEQ ID NO: 698667 - RNA, 19 nt, Homo sapiens
ugaacaaagugugugcaua

SEQ ID NO: 698668 - RNA, 19 nt, Homo sapiens
ggacguugaauuugaaguu

SEQ ID NO: 698669 - RNA, 19 nt, Homo sapiens
aaaggacguugaauuugaa

SEQ ID NO: 698670 - RNA, 19 nt, Homo sapiens
ucaacauccuucauaguga

SEQ ID NO: 698671 - RNA, 19 nt, Homo sapiens
gggcugaaguacaaaguca

SEQ ID NO: 698672 - RNA, 19 nt, Homo sapiens
ccgaaaccauguuaauaga

SEQ ID NO: 698673 - RNA, 19 nt, Homo sapiens
uuggaaggauugaagauuu

SEQ ID NO: 698674 - RNA, 19 nt, Homo sapiens
aaacguauuucuacuaagg

SEQ ID NO: 698675 - RNA, 19 nt, Homo sapiens
cccgaaagcuaauaucguu

SEQ ID NO: 698676 - RNA, 19 nt, Homo sapiens
uaacgacuauacuuaugga

SEQ ID NO: 698677 - RNA, 19 nt, Homo sapiens
guauagaacagaaggaaga

SEQ ID NO: 698678 - RNA, 19 nt, Homo sapiens
gaggaaauuagaugagaaa

SEQ ID NO: 698679 - RNA, 19 nt, Homo sapiens
aguaauugcuggguugaua

SEQ ID NO: 698680 - RNA, 19 nt, Homo sapiens
cuucagaaccuauacauug

SEQ ID NO: 698681 - RNA, 19 nt, Homo sapiens
uuagauggcacuauguaua

SEQ ID NO: 698682 - RNA, 19 nt, Homo sapiens
ggcacuauguauauuaaug

SEQ ID NO: 698683 - RNA, 19 nt, Homo sapiens
ggaagagcuugaugauguc

SEQ ID NO: 698684 - RNA, 19 nt, Homo sapiens
aggaaaggacguugaauuu

SEQ ID NO: 698685 - RNA, 19 nt, Homo sapiens
gugaagaccuaggaaagga

SEQ ID NO: 698686 - RNA, 19 nt, Homo sapiens
aagacaagauagugaaaga

SEQ ID NO: 698687 - RNA, 19 nt, Homo sapiens
guucucaccuuacaagaca

SEQ ID NO: 698688 - RNA, 19 nt, Homo sapiens
gauaguauuggaaggauug

SEQ ID NO: 698689 - RNA, 19 nt, Homo sapiens
ccagcagguucuagaugua

SEQ ID NO: 698690 - RNA, 19 nt, Homo sapiens
gguuaugaaugcuuuagau

SEQ ID NO: 698691 - RNA, 19 nt, Homo sapiens
aaagaggucacguauagaa

SEQ ID NO: 698692 - RNA, 19 nt, Homo sapiens
gcugagcucauaugggaua

SEQ ID NO: 698693 - RNA, 19 nt, Homo sapiens
gcccgaaaccauguuaaua

SEQ ID NO: 698694 - RNA, 19 nt, Homo sapiens
caucgagacuuugagaguu

SEQ ID NO: 698695 - RNA, 19 nt, Homo sapiens
gaagcugccugggaaccaa

SEQ ID NO: 698696 - RNA, 19 nt, Homo sapiens
caagugaacucaagauuug

SEQ ID NO: 698697 - RNA, 19 nt, Homo sapiens
gaagaaaccagagucauuu

SEQ ID NO: 698698 - RNA, 19 nt, Homo sapiens
gaagagaucccaguucuga

SEQ ID NO: 698699 - RNA, 19 nt, Homo sapiens
gcucaguucuugauucgua

SEQ ID NO: 698700 - RNA, 19 nt, Homo sapiens
uuagagagcuugucuuuca

SEQ ID NO: 698701 - RNA, 19 nt, Homo sapiens
ugaggaagauucugaguug

SEQ ID NO: 698702 - RNA, 19 nt, Homo sapiens
gggcugaaauugccaagaa

SEQ ID NO: 698703 - RNA, 19 nt, Homo sapiens
ccagggaugucauaguuaa

SEQ ID NO: 698704 - RNA, 19 nt, Homo sapiens
gaauucagguggagaguag

SEQ ID NO: 698705 - RNA, 19 nt, Homo sapiens
ccugcaaaguugaguauua

SEQ ID NO: 698706 - RNA, 19 nt, Homo sapiens
ccugauaccuuauagagaa

SEQ ID NO: 698707 - RNA, 19 nt, Homo sapiens
ggaagauucugaguuguug

SEQ ID NO: 698708 - RNA, 19 nt, Homo sapiens
gagcaaaacuugauucuuc

SEQ ID NO: 698709 - RNA, 19 nt, Homo sapiens
guuacuugcuuuaggauuu

SEQ ID NO: 698710 - RNA, 19 nt, Homo sapiens
gauacgaaaugaugugcuu

SEQ ID NO: 698711 - RNA, 19 nt, Homo sapiens
gaccagaucugucacaaaa

SEQ ID NO: 698712 - RNA, 19 nt, Homo sapiens
gagaugcuaccaagucuuu

SEQ ID NO: 698713 - RNA, 19 nt, Homo sapiens
ucaauucgaugcugugugu

SEQ ID NO: 698714 - RNA, 19 nt, Homo sapiens
gguggacacugaggauaua

SEQ ID NO: 698715 - RNA, 19 nt, Homo sapiens
gaaauugccaagaaucuca

SEQ ID NO: 698716 - RNA, 19 nt, Homo sapiens
ccaagugaacucaagauuu

SEQ ID NO: 698717 - RNA, 19 nt, Homo sapiens
ucagacaggugcccuuaga

SEQ ID NO: 698718 - RNA, 19 nt, Homo sapiens
acagguaacuccagaagau

SEQ ID NO: 698719 - RNA, 19 nt, Homo sapiens
caggguggcugucuuuguu

SEQ ID NO: 698720 - RNA, 19 nt, Homo sapiens
aagcacagcuccaaguuca

SEQ ID NO: 698721 - RNA, 19 nt, Homo sapiens
ggagcucaguucuugauuc

SEQ ID NO: 698722 - RNA, 19 nt, Homo sapiens
uaaaguuccguacagauaa

SEQ ID NO: 698723 - RNA, 19 nt, Homo sapiens
uuaaaguuccguacagaua

SEQ ID NO: 698724 - RNA, 19 nt, Homo sapiens
aaacuugauucuucugaga

SEQ ID NO: 698725 - RNA, 19 nt, Homo sapiens
gauccuaccaguugccuuu

SEQ ID NO: 698726 - RNA, 19 nt, Homo sapiens
ugaagucauuggcccgaua

SEQ ID NO: 698727 - RNA, 19 nt, Homo sapiens
cucagaggcuguugcauuu

SEQ ID NO: 698728 - RNA, 19 nt, Homo sapiens
ggaggaggcggcacaguau

SEQ ID NO: 698729 - RNA, 19 nt, Homo sapiens
caacaacuucuucuucuuc

SEQ ID NO: 698730 - RNA, 19 nt, Homo sapiens
gaacagguaacuccagaag

SEQ ID NO: 698731 - RNA, 19 nt, Homo sapiens
aaaguuccguacagauaaa

SEQ ID NO: 698732 - RNA, 19 nt, Homo sapiens
uaccauggauacacauuug

SEQ ID NO: 698733 - RNA, 19 nt, Homo sapiens
ggaagcacagcuccaaguu

SEQ ID NO: 698734 - RNA, 19 nt, Homo sapiens
caaaguuagccaaggagua

SEQ ID NO: 698735 - RNA, 19 nt, Homo sapiens
agaagaaaccagagucauu

SEQ ID NO: 698736 - RNA, 19 nt, Homo sapiens
aaacauuuccugcaacgaa

SEQ ID NO: 698737 - RNA, 19 nt, Homo sapiens
agagaucccaguucugaua

SEQ ID NO: 698738 - RNA, 19 nt, Homo sapiens
ggugugcuguucuugaguu

SEQ ID NO: 698739 - RNA, 19 nt, Homo sapiens
caucuuggcaggagugaaa

SEQ ID NO: 698740 - RNA, 19 nt, Homo sapiens
gcacagcuccaaguucaga

SEQ ID NO: 698741 - RNA, 19 nt, Homo sapiens
cagaggcuguugcauuuca

SEQ ID NO: 698742 - RNA, 19 nt, Homo sapiens
caaaguugaguauuagaga

SEQ ID NO: 698743 - RNA, 19 nt, Homo sapiens
gggagccucuuguaaccuu

SEQ ID NO: 698744 - RNA, 19 nt, Homo sapiens
ucacaacaacuucuucuuc

SEQ ID NO: 698745 - RNA, 19 nt, Homo sapiens
guggucuucugcccuguua

SEQ ID NO: 698746 - RNA, 19 nt, Homo sapiens
cuauguugguccuuuguuu

SEQ ID NO: 698747 - RNA, 19 nt, Homo sapiens
uauuagagagcuugucuuu

SEQ ID NO: 698748 - RNA, 19 nt, Homo sapiens
cgacuacuuucuccuucaa

SEQ ID NO: 698749 - RNA, 19 nt, Homo sapiens
auacacauuugccaaucua

SEQ ID NO: 698750 - RNA, 19 nt, Homo sapiens
ggauacacauuugccaauc

SEQ ID NO: 698751 - RNA, 19 nt, Homo sapiens
cacaacaacuucuucuucu

SEQ ID NO: 698752 - RNA, 19 nt, Homo sapiens
ugaaaggacugaccaugcu

SEQ ID NO: 698753 - RNA, 19 nt, Homo sapiens
gauacacauuugccaaucu

SEQ ID NO: 698754 - RNA, 19 nt, Homo sapiens
gaugucauaguuaaaguug

SEQ ID NO: 698755 - RNA, 19 nt, Homo sapiens
gagcucaguucuugauucg

SEQ ID NO: 698756 - RNA, 19 nt, Homo sapiens
ggaggagccugccccuuuu

SEQ ID NO: 698757 - RNA, 19 nt, Homo sapiens
cauaugaggaagauucuga

SEQ ID NO: 698758 - RNA, 19 nt, Homo sapiens
uucaagugcucuuaaaguu

SEQ ID NO: 698759 - RNA, 19 nt, Homo sapiens
acacugaggauauagagaa

SEQ ID NO: 698760 - RNA, 19 nt, Homo sapiens
uaaccuucuuggacuuauu

SEQ ID NO: 698761 - RNA, 19 nt, Homo sapiens
gucauuggcccgauacaaa

SEQ ID NO: 698762 - RNA, 19 nt, Homo sapiens
ccaguucugauacauauga

SEQ ID NO: 698763 - RNA, 19 nt, Homo sapiens
ggucuucugcccuguuaaa

SEQ ID NO: 698764 - RNA, 19 nt, Homo sapiens
uaggagagcaugaguuugu

SEQ ID NO: 698765 - RNA, 19 nt, Homo sapiens
cuccagggaugucauaguu

SEQ ID NO: 698766 - RNA, 19 nt, Homo sapiens
cugaggauauagagaagaa

SEQ ID NO: 698767 - RNA, 19 nt, Homo sapiens
cauuuccucuggaguuuga

SEQ ID NO: 698768 - RNA, 19 nt, Homo sapiens
gaagcacagcuccaaguuc

SEQ ID NO: 698769 - RNA, 19 nt, Homo sapiens
aaggaaaacugaagucauu

SEQ ID NO: 698770 - RNA, 19 nt, Homo sapiens
gcagcaugcccaccuguau

SEQ ID NO: 698771 - RNA, 19 nt, Homo sapiens
ucuaggagagcaugaguuu

SEQ ID NO: 698772 - RNA, 19 nt, Homo sapiens
gaauuuuccuugguucuuu

SEQ ID NO: 698773 - RNA, 19 nt, Homo sapiens
uauguugguccuuuguuua

SEQ ID NO: 698774 - RNA, 19 nt, Homo sapiens
gggcuauguugguccuuug

SEQ ID NO: 698775 - RNA, 19 nt, Homo sapiens
guucuugaguuuucguuua

SEQ ID NO: 698776 - RNA, 19 nt, Homo sapiens
gcgcaggguggcugucuuu

SEQ ID NO: 698777 - RNA, 19 nt, Homo sapiens
ucccggagcucaguucuug

SEQ ID NO: 698778 - RNA, 19 nt, Homo sapiens
gaagguggacacugaggau

SEQ ID NO: 698779 - RNA, 19 nt, Homo sapiens
gagagggaaugggaugauc

SEQ ID NO: 698780 - RNA, 19 nt, Homo sapiens
ucccaguucugauacauau

SEQ ID NO: 698781 - RNA, 19 nt, Homo sapiens
gcacgaccuccgacuacuu

SEQ ID NO: 698782 - RNA, 19 nt, Homo sapiens
gaugcugugugucugacuu

SEQ ID NO: 698783 - RNA, 19 nt, Homo sapiens
gcuuuaggauuugcuuguu

SEQ ID NO: 698784 - RNA, 19 nt, Homo sapiens
gcaaaguugaguauuagag

SEQ ID NO: 698785 - RNA, 19 nt, Homo sapiens
acaacaacuucuucuucuu

SEQ ID NO: 698786 - RNA, 19 nt, Homo sapiens
gaguuuucguuuaggauua

SEQ ID NO: 698787 - RNA, 19 nt, Homo sapiens
uugagacccugacaaacaa

SEQ ID NO: 698788 - RNA, 19 nt, Homo sapiens
guucagacaggugcccuua

SEQ ID NO: 698789 - RNA, 19 nt, Homo sapiens
gcauuucagggcuauguug

SEQ ID NO: 698790 - RNA, 19 nt, Homo sapiens
acucagaggcuguugcauu

SEQ ID NO: 698791 - RNA, 19 nt, Homo sapiens
cugcaaaguugaguauuag

SEQ ID NO: 698792 - RNA, 19 nt, Homo sapiens
gaagaucccggagcucagu

SEQ ID NO: 698793 - RNA, 19 nt, Homo sapiens
aggaagagaucccaguucu

SEQ ID NO: 698794 - RNA, 19 nt, Homo sapiens
guacagauaaaggaagaga

SEQ ID NO: 698795 - RNA, 19 nt, Homo sapiens
caaguucuuuacaggagau

SEQ ID NO: 698796 - RNA, 19 nt, Homo sapiens
gaaaugccaucuccacuaa

SEQ ID NO: 698797 - RNA, 19 nt, Homo sapiens
ggugagagcugaccuaauu

SEQ ID NO: 698798 - RNA, 19 nt, Homo sapiens
gauaaaggcuccaguguau

SEQ ID NO: 698799 - RNA, 19 nt, Homo sapiens
gcuaaucaauuuccucuua

SEQ ID NO: 698800 - RNA, 19 nt, Homo sapiens
caccauagcuaaucaauuu

SEQ ID NO: 698801 - RNA, 19 nt, Homo sapiens
ugaaaucucugacauugua

SEQ ID NO: 698802 - RNA, 19 nt, Homo sapiens
acaaucaccugaaacauua

SEQ ID NO: 698803 - RNA, 19 nt, Homo sapiens
gaacaucuauuugggcuuu

SEQ ID NO: 698804 - RNA, 19 nt, Homo sapiens
caacaagaauccuggguuu

SEQ ID NO: 698805 - RNA, 19 nt, Homo sapiens
gcaguucuccguaauauaa

SEQ ID NO: 698806 - RNA, 19 nt, Homo sapiens
ucacauaccuuuccagaau

SEQ ID NO: 698807 - RNA, 19 nt, Homo sapiens
gggcuuugauguuuaauaa

SEQ ID NO: 698808 - RNA, 19 nt, Homo sapiens
gagcugaccuaauuaacaa

SEQ ID NO: 698809 - RNA, 19 nt, Homo sapiens
ggucgaagcugcugaagug

SEQ ID NO: 698810 - RNA, 19 nt, Homo sapiens
uaaauaagaccaaggagua

SEQ ID NO: 698811 - RNA, 19 nt, Homo sapiens
gcaaagcguccuucagaua

SEQ ID NO: 698812 - RNA, 19 nt, Homo sapiens
gcucaugccuguaauccua

SEQ ID NO: 698813 - RNA, 19 nt, Homo sapiens
cgaagaauuugaugaacua

SEQ ID NO: 698814 - RNA, 19 nt, Homo sapiens
ugacauguauucaucauug

SEQ ID NO: 698815 - RNA, 19 nt, Homo sapiens
ccacauaaguaauccuaaa

SEQ ID NO: 698816 - RNA, 19 nt, Homo sapiens
gauaugaucuccugugucu

SEQ ID NO: 698817 - RNA, 19 nt, Homo sapiens
uaaagucccaguagaaaua

SEQ ID NO: 698818 - RNA, 19 nt, Homo sapiens
gcuacuaguuucucuauug

SEQ ID NO: 698819 - RNA, 19 nt, Homo sapiens
gauaaucgaugagaauuca

SEQ ID NO: 698820 - RNA, 19 nt, Homo sapiens
ccucugauguuguucuuua

SEQ ID NO: 698821 - RNA, 19 nt, Homo sapiens
gaucuguucugcuguaaga

SEQ ID NO: 698822 - RNA, 19 nt, Homo sapiens
agaauuagcuuaccgaaag

SEQ ID NO: 698823 - RNA, 19 nt, Homo sapiens
caacaauuauagcuucuga

SEQ ID NO: 698824 - RNA, 19 nt, Homo sapiens
ccacagggaacaucuauuu

SEQ ID NO: 698825 - RNA, 19 nt, Homo sapiens
gaucccauuucuuuccuua

SEQ ID NO: 698826 - RNA, 19 nt, Homo sapiens
ggacagaauuaugcaguug

SEQ ID NO: 698827 - RNA, 19 nt, Homo sapiens
ggauaucucugcaacaaag

SEQ ID NO: 698828 - RNA, 19 nt, Homo sapiens
ggaacugacuuuacuaagg

SEQ ID NO: 698829 - RNA, 19 nt, Homo sapiens
uaaaggcuccaguguauaa

SEQ ID NO: 698830 - RNA, 19 nt, Homo sapiens
ggauaaaggcuccagugua

SEQ ID NO: 698831 - RNA, 19 nt, Homo sapiens
agacaucucugugcuguuu

SEQ ID NO: 698832 - RNA, 19 nt, Homo sapiens
gaacuucuccgacaugaca

SEQ ID NO: 698833 - RNA, 19 nt, Homo sapiens
ugaccaggauguauuuaaa

SEQ ID NO: 698834 - RNA, 19 nt, Homo sapiens
gacaaucaccugaaacauu

SEQ ID NO: 698835 - RNA, 19 nt, Homo sapiens
caggagaaauuacaucaga

SEQ ID NO: 698836 - RNA, 19 nt, Homo sapiens
ugauaucaaugcaguauga

SEQ ID NO: 698837 - RNA, 19 nt, Homo sapiens
gugaacugaugaacauaua

SEQ ID NO: 698838 - RNA, 19 nt, Homo sapiens
ugaccaacaugaugaaaug

SEQ ID NO: 698839 - RNA, 19 nt, Homo sapiens
uaauugagcuacuaguuuc

SEQ ID NO: 698840 - RNA, 19 nt, Homo sapiens
aaagaucuguucugcugua

SEQ ID NO: 698841 - RNA, 19 nt, Homo sapiens
gugugaagcugcauuguug

SEQ ID NO: 698842 - RNA, 19 nt, Homo sapiens
ucagaugacucucccgaaa

SEQ ID NO: 698843 - RNA, 19 nt, Homo sapiens
gcaauggugucguccuuuc

SEQ ID NO: 698844 - RNA, 19 nt, Homo sapiens
gcaggagccucugauguug

SEQ ID NO: 698845 - RNA, 19 nt, Homo sapiens
ugagacaaguucccaggua

SEQ ID NO: 698846 - RNA, 19 nt, Homo sapiens
aaacuuacaccauagcuaa

SEQ ID NO: 698847 - RNA, 19 nt, Homo sapiens
aaagcugggucucauguuu

SEQ ID NO: 698848 - RNA, 19 nt, Homo sapiens
uuaauaagcucacugaacu

SEQ ID NO: 698849 - RNA, 19 nt, Homo sapiens
caugugauauuguagaaga

SEQ ID NO: 698850 - RNA, 19 nt, Homo sapiens
ggaaacaaugagaagcuua

SEQ ID NO: 698851 - RNA, 19 nt, Homo sapiens
ugacgucccugccaauaga

SEQ ID NO: 698852 - RNA, 19 nt, Homo sapiens
ccauaggccauacauguua

SEQ ID NO: 698853 - RNA, 19 nt, Homo sapiens
gaaacaaugagaagcuuau

SEQ ID NO: 698854 - RNA, 19 nt, Homo sapiens
aaccagagcugacauuauc

SEQ ID NO: 698855 - RNA, 19 nt, Homo sapiens
ugaggucaguuuaaaguga

SEQ ID NO: 698856 - RNA, 19 nt, Homo sapiens
uguagaagaugcagcuauu

SEQ ID NO: 698857 - RNA, 19 nt, Homo sapiens
uagcagcaguucuccguaa

SEQ ID NO: 698858 - RNA, 19 nt, Homo sapiens
gaagagacagcuaagauac

SEQ ID NO: 698859 - RNA, 19 nt, Homo sapiens
gugagauucugucuacaaa

SEQ ID NO: 698860 - RNA, 19 nt, Homo sapiens
ccaagaagauauugcugau

SEQ ID NO: 698861 - RNA, 19 nt, Homo sapiens
ggauauaacaacauucaga

SEQ ID NO: 698862 - RNA, 19 nt, Homo sapiens
ccaugcaugugauauugua

SEQ ID NO: 698863 - RNA, 19 nt, Homo sapiens
caccuacacugacgaagaa

SEQ ID NO: 698864 - RNA, 19 nt, Homo sapiens
aaucuagaauucuccagua

SEQ ID NO: 698865 - RNA, 19 nt, Homo sapiens
gaggucaguuuaaagugaa

SEQ ID NO: 698866 - RNA, 19 nt, Homo sapiens
guggagugcuggagaaaug

SEQ ID NO: 698867 - RNA, 19 nt, Homo sapiens
caaaggcaguccacauaag

SEQ ID NO: 698868 - RNA, 19 nt, Homo sapiens
acauaccuuuccagaauua

SEQ ID NO: 698869 - RNA, 19 nt, Homo sapiens
uaagauagaguacaugcaa

SEQ ID NO: 698870 - RNA, 19 nt, Homo sapiens
ugcaggaucuguucugaaa

SEQ ID NO: 698871 - RNA, 19 nt, Homo sapiens
guggauaucucugcaacaa

SEQ ID NO: 698872 - RNA, 19 nt, Homo sapiens
caaagcguccuucagauau

SEQ ID NO: 698873 - RNA, 19 nt, Homo sapiens
gguaaugccugauggaaaa

SEQ ID NO: 698874 - RNA, 19 nt, Homo sapiens
cagccaauccuccuuguuu

SEQ ID NO: 698875 - RNA, 19 nt, Homo sapiens
caagauaaucgaugagaau

SEQ ID NO: 698876 - RNA, 19 nt, Homo sapiens
cgaagcugcugaagugguu

SEQ ID NO: 698877 - RNA, 19 nt, Homo sapiens
gaacugaugaacauauaca

SEQ ID NO: 698878 - RNA, 19 nt, Homo sapiens
cagcaguucuccguaauau

SEQ ID NO: 698879 - RNA, 19 nt, Homo sapiens
cagcuaagauacguccuuu

SEQ ID NO: 698880 - RNA, 19 nt, Homo sapiens
uaaacuagguguggauauc

SEQ ID NO: 698881 - RNA, 19 nt, Homo sapiens
gcaccuacacugacgaaga

SEQ ID NO: 698882 - RNA, 19 nt, Homo sapiens
ucacagaagagacagcuaa

SEQ ID NO: 698883 - RNA, 19 nt, Homo sapiens
guaaagaacaagguaaugu

SEQ ID NO: 698884 - RNA, 19 nt, Homo sapiens
ugacgaagaauuugaugaa

SEQ ID NO: 698885 - RNA, 19 nt, Homo sapiens
gaguuaaaauggacaagua

SEQ ID NO: 698886 - RNA, 19 nt, Homo sapiens
uaggccagcuugugccaua

SEQ ID NO: 698887 - RNA, 19 nt, Homo sapiens
uauuugggcuuugauguuu

SEQ ID NO: 698888 - RNA, 19 nt, Homo sapiens
ggagaaauuacaucagaau

SEQ ID NO: 698889 - RNA, 19 nt, Homo sapiens
agaagagacagcuaagaua

SEQ ID NO: 698890 - RNA, 19 nt, Homo sapiens
gacguuaucaccaaauuug

SEQ ID NO: 698891 - RNA, 19 nt, Homo sapiens
gaagaugcagcuauugcuu

SEQ ID NO: 698892 - RNA, 19 nt, Homo sapiens
caaauucaagccucuaaau

SEQ ID NO: 698893 - RNA, 19 nt, Homo sapiens
gcagcaguucuccguaaua

SEQ ID NO: 698894 - RNA, 19 nt, Homo sapiens
agagugagauucugucuac

SEQ ID NO: 698895 - RNA, 19 nt, Homo sapiens
ugaaaugccaucuccacua

SEQ ID NO: 698896 - RNA, 19 nt, Homo sapiens
gaaggaauaugaugaagaa

SEQ ID NO: 698897 - RNA, 19 nt, Homo sapiens
ggaagagguucacaugaua

SEQ ID NO: 698898 - RNA, 19 nt, Homo sapiens
ggaaacaucucaaguccaa

SEQ ID NO: 698899 - RNA, 19 nt, Homo sapiens
ggaagcaccugccagaauu

SEQ ID NO: 698900 - RNA, 19 nt, Homo sapiens
ggaauaugaugaagaaaga

SEQ ID NO: 698901 - RNA, 19 nt, Homo sapiens
gaugaaggauaucgacaua

SEQ ID NO: 698902 - RNA, 19 nt, Homo sapiens
ggacacacaugaaagaaug

SEQ ID NO: 698903 - RNA, 19 nt, Homo sapiens
ugaaacaccucuuggagua

SEQ ID NO: 698904 - RNA, 19 nt, Homo sapiens
gcacagcaguuccggauug

SEQ ID NO: 698905 - RNA, 19 nt, Homo sapiens
gaucaaaccuaaagagaag

SEQ ID NO: 698906 - RNA, 19 nt, Homo sapiens
ggacacagagacagacuua

SEQ ID NO: 698907 - RNA, 19 nt, Homo sapiens
cagagaagaugaaggauau

SEQ ID NO: 698908 - RNA, 19 nt, Homo sapiens
gaggaucaaucacuacauu

SEQ ID NO: 698909 - RNA, 19 nt, Homo sapiens
caucacggcucacagcaua

SEQ ID NO: 698910 - RNA, 19 nt, Homo sapiens
gcacagagaccgugaagau

SEQ ID NO: 698911 - RNA, 19 nt, Homo sapiens
cggauuggcuuguguguuu

SEQ ID NO: 698912 - RNA, 19 nt, Homo sapiens
gaagcaaacucucuaucau

SEQ ID NO: 698913 - RNA, 19 nt, Homo sapiens
gaacguguccagaagauga

SEQ ID NO: 698914 - RNA, 19 nt, Homo sapiens
gagacagacuuauugauuc

SEQ ID NO: 698915 - RNA, 19 nt, Homo sapiens
uaucagaggccuauaauga

SEQ ID NO: 698916 - RNA, 19 nt, Homo sapiens
ccaaagacauggaugaagu

SEQ ID NO: 698917 - RNA, 19 nt, Homo sapiens
gcaaccacaucuucaauag

SEQ ID NO: 698918 - RNA, 19 nt, Homo sapiens
aagaagagcugaaugaagu

SEQ ID NO: 698919 - RNA, 19 nt, Homo sapiens
guucuuaauugcacucuaa

SEQ ID NO: 698920 - RNA, 19 nt, Homo sapiens
ucagggaaccguuauuaua

SEQ ID NO: 698921 - RNA, 19 nt, Homo sapiens
caagauugauggagugaga

SEQ ID NO: 698922 - RNA, 19 nt, Homo sapiens
ugacuugggcauugaauua

SEQ ID NO: 698923 - RNA, 19 nt, Homo sapiens
gaccuucucuguucauaug

SEQ ID NO: 698924 - RNA, 19 nt, Homo sapiens
augaggaacugaugaauuu

SEQ ID NO: 698925 - RNA, 19 nt, Homo sapiens
ugaagcgucuggacaauau

SEQ ID NO: 698926 - RNA, 19 nt, Homo sapiens
ggaggauucucaacagguu

SEQ ID NO: 698927 - RNA, 19 nt, Homo sapiens
gcacugacuugggcauuga

SEQ ID NO: 698928 - RNA, 19 nt, Homo sapiens
aaacaccucuuggaguaua

SEQ ID NO: 698929 - RNA, 19 nt, Homo sapiens
uaacagugcauauuccuuu

SEQ ID NO: 698930 - RNA, 19 nt, Homo sapiens
caacgacaguucccgauuc

SEQ ID NO: 698931 - RNA, 19 nt, Homo sapiens
ggagaggacacacaugaaa

SEQ ID NO: 698932 - RNA, 19 nt, Homo sapiens
gaagagguucacaugauaa

SEQ ID NO: 698933 - RNA, 19 nt, Homo sapiens
gaaagccauucgaggaguu

SEQ ID NO: 698934 - RNA, 19 nt, Homo sapiens
ggagagacaccgccaguug

SEQ ID NO: 698935 - RNA, 19 nt, Homo sapiens
guugacagauuuaagaguu

SEQ ID NO: 698936 - RNA, 19 nt, Homo sapiens
cagaagaagucacaagaca

SEQ ID NO: 698937 - RNA, 19 nt, Homo sapiens
gaagacguguggcaauagu

SEQ ID NO: 698938 - RNA, 19 nt, Homo sapiens
caggaauucugaugugaaa

SEQ ID NO: 698939 - RNA, 19 nt, Homo sapiens
ggaucaaucacuacauuaa

SEQ ID NO: 698940 - RNA, 19 nt, Homo sapiens
gaacucgaccguuggaaug

SEQ ID NO: 698941 - RNA, 19 nt, Homo sapiens
gcaguacagcuuguuguua

SEQ ID NO: 698942 - RNA, 19 nt, Homo sapiens
gaaucagucuauccacaga

SEQ ID NO: 698943 - RNA, 19 nt, Homo sapiens
ggaagaguagcauuucauu

SEQ ID NO: 698944 - RNA, 19 nt, Homo sapiens
uagccuauauuuacaguga

SEQ ID NO: 698945 - RNA, 19 nt, Homo sapiens
ccacaucacguccagcaua

SEQ ID NO: 698946 - RNA, 19 nt, Homo sapiens
ggaggagcgucggauauug

SEQ ID NO: 698947 - RNA, 19 nt, Homo sapiens
gaacaaggucgcugucaag

SEQ ID NO: 698948 - RNA, 19 nt, Homo sapiens
gaagcaccugccagaauua

SEQ ID NO: 698949 - RNA, 19 nt, Homo sapiens
gaagaagucacaagacaag

SEQ ID NO: 698950 - RNA, 19 nt, Homo sapiens
gaggaacugaugaauuuaa

SEQ ID NO: 698951 - RNA, 19 nt, Homo sapiens
gcagcgaccugacggagau

SEQ ID NO: 698952 - RNA, 19 nt, Homo sapiens
ccaagaggguaaacugguu

SEQ ID NO: 698953 - RNA, 19 nt, Homo sapiens
ggccuauaaugaagcuuua

SEQ ID NO: 698954 - RNA, 19 nt, Homo sapiens
ccgauucuaugccauguuu

SEQ ID NO: 698955 - RNA, 19 nt, Homo sapiens
gaauucugaugugaaacua

SEQ ID NO: 698956 - RNA, 19 nt, Homo sapiens
gcucagagaagaugaagga

SEQ ID NO: 698957 - RNA, 19 nt, Homo sapiens
gcagaagacuagagagacu

SEQ ID NO: 698958 - RNA, 19 nt, Homo sapiens
gacaggugguggaguuuga

SEQ ID NO: 698959 - RNA, 19 nt, Homo sapiens
acacagagacagacuuauu

SEQ ID NO: 698960 - RNA, 19 nt, Homo sapiens
ucagugcccuggucaguau

SEQ ID NO: 698961 - RNA, 19 nt, Homo sapiens
guggugaccuucucuguuc

SEQ ID NO: 698962 - RNA, 19 nt, Homo sapiens
ggugagcucaucaacauuu

SEQ ID NO: 698963 - RNA, 19 nt, Homo sapiens
gcaagaagagcugaaugaa

SEQ ID NO: 698964 - RNA, 19 nt, Homo sapiens
gcauauuccuuucuaucau

SEQ ID NO: 698965 - RNA, 19 nt, Homo sapiens
gacgaagucucuuuucuuu

SEQ ID NO: 698966 - RNA, 19 nt, Homo sapiens
gcaccugccagaauuaaga

SEQ ID NO: 698967 - RNA, 19 nt, Homo sapiens
gcgcaggaauucugaugug

SEQ ID NO: 698968 - RNA, 19 nt, Homo sapiens
ggaaggaauaugaugaaga

SEQ ID NO: 698969 - RNA, 19 nt, Homo sapiens
aaucugaagugauggagaa

SEQ ID NO: 698970 - RNA, 19 nt, Homo sapiens
uggaagagguucacaugau

SEQ ID NO: 698971 - RNA, 19 nt, Homo sapiens
ggaugaacguguccagaag

SEQ ID NO: 698972 - RNA, 19 nt, Homo sapiens
agacagacuuauugauuca

SEQ ID NO: 698973 - RNA, 19 nt, Homo sapiens
gagguucacaugauaaaga

SEQ ID NO: 698974 - RNA, 19 nt, Homo sapiens
caguacagcuuguuguuag

SEQ ID NO: 698975 - RNA, 19 nt, Homo sapiens
gaguagcauuucauucuuc

SEQ ID NO: 698976 - RNA, 19 nt, Homo sapiens
agagacagacuuauugauu

SEQ ID NO: 698977 - RNA, 19 nt, Homo sapiens
cggcagcucuugugcauag

SEQ ID NO: 698978 - RNA, 19 nt, Homo sapiens
caauaaagggcaggaguuu

SEQ ID NO: 698979 - RNA, 19 nt, Homo sapiens
gagagacaccgccaguuga

SEQ ID NO: 698980 - RNA, 19 nt, Homo sapiens
ucagagaagaugaaggaua

SEQ ID NO: 698981 - RNA, 19 nt, Homo sapiens
aaccacaucuucaauagug

SEQ ID NO: 698982 - RNA, 19 nt, Homo sapiens
gagagacuguggcaagaag

SEQ ID NO: 698983 - RNA, 19 nt, Homo sapiens
gcauuucauucuucucuag

SEQ ID NO: 698984 - RNA, 19 nt, Homo sapiens
cgacaguucccgauucuau

SEQ ID NO: 698985 - RNA, 19 nt, Homo sapiens
gcacugucagaucaaauuu

SEQ ID NO: 698986 - RNA, 19 nt, Homo sapiens
aaaguauccuucacgauca

SEQ ID NO: 698987 - RNA, 19 nt, Homo sapiens
uggagaggaucaaucacua

SEQ ID NO: 698988 - RNA, 19 nt, Homo sapiens
ggcaagaagagcugaauga

SEQ ID NO: 698989 - RNA, 19 nt, Homo sapiens
aggaagacguguggcaaua

SEQ ID NO: 698990 - RNA, 19 nt, Homo sapiens
guucuaggcuccgauagga

SEQ ID NO: 698991 - RNA, 19 nt, Homo sapiens
uuaagacucuguccuugga

SEQ ID NO: 698992 - RNA, 19 nt, Homo sapiens
cauccacgccuacaauaaa

SEQ ID NO: 698993 - RNA, 19 nt, Homo sapiens
uggcauuccugguuauuau

SEQ ID NO: 698994 - RNA, 19 nt, Homo sapiens
ggaaagaggcacccaugag

SEQ ID NO: 698995 - RNA, 19 nt, Homo sapiens
cuauuagacuguaggaaga

SEQ ID NO: 698996 - RNA, 19 nt, Homo sapiens
gagaggccaucaucaaaua

SEQ ID NO: 698997 - RNA, 19 nt, Homo sapiens
gaagaaaccucugaagaca

SEQ ID NO: 698998 - RNA, 19 nt, Homo sapiens
gaagggccguauugaguuu

SEQ ID NO: 698999 - RNA, 19 nt, Homo sapiens
ucgagacggugaaguauua

SEQ ID NO: 699000 - RNA, 19 nt, Homo sapiens
gcgcauacuuugucacuga

SEQ ID NO: 699001 - RNA, 19 nt, Homo sapiens
aauaagaugugucuccuuu

SEQ ID NO: 699002 - RNA, 19 nt, Homo sapiens
gcagggaagagcacaauuu

SEQ ID NO: 699003 - RNA, 19 nt, Homo sapiens
ucucuggccuggacuguua

SEQ ID NO: 699004 - RNA, 19 nt, Homo sapiens
acacuguccucuuuaauga

SEQ ID NO: 699005 - RNA, 19 nt, Homo sapiens
gcaaugggcaucuggauca

SEQ ID NO: 699006 - RNA, 19 nt, Homo sapiens
gaacgugcacuucagcuau

SEQ ID NO: 699007 - RNA, 19 nt, Homo sapiens
ggaagaaaccucugaagac

SEQ ID NO: 699008 - RNA, 19 nt, Homo sapiens
gcacacaggcucucaacug

SEQ ID NO: 699009 - RNA, 19 nt, Homo sapiens
gccaacagguucaguuuag

SEQ ID NO: 699010 - RNA, 19 nt, Homo sapiens
gaacgggcacucaaugugu

SEQ ID NO: 699011 - RNA, 19 nt, Homo sapiens
cgucagcgcuggauacauc

SEQ ID NO: 699012 - RNA, 19 nt, Homo sapiens
cauuauggcuuucccugaa

SEQ ID NO: 699013 - RNA, 19 nt, Homo sapiens
ggaccaagauguggaaagg

SEQ ID NO: 699014 - RNA, 19 nt, Homo sapiens
gaaagaggagacagaagug

SEQ ID NO: 699015 - RNA, 19 nt, Homo sapiens
ugaacuugcugacugagaa

SEQ ID NO: 699016 - RNA, 19 nt, Homo sapiens
guacaggcuucgugagcaa

SEQ ID NO: 699017 - RNA, 19 nt, Homo sapiens
gaacuuggcccuggugucu

SEQ ID NO: 699018 - RNA, 19 nt, Homo sapiens
ccacuucccucucaaagac

SEQ ID NO: 699019 - RNA, 19 nt, Homo sapiens
gcauugccauggugacugu

SEQ ID NO: 699020 - RNA, 19 nt, Homo sapiens
gcucucaacuguggucaau

SEQ ID NO: 699021 - RNA, 19 nt, Homo sapiens
gucgagcgcuucacugguu

SEQ ID NO: 699022 - RNA, 19 nt, Homo sapiens
ggagaacauguuugacuug

SEQ ID NO: 699023 - RNA, 19 nt, Homo sapiens
ucagcuaccugguguucaa

SEQ ID NO: 699024 - RNA, 19 nt, Homo sapiens
ccaguuacgucuuccucaa

SEQ ID NO: 699025 - RNA, 19 nt, Homo sapiens
cuggauacaucuaaugaga

SEQ ID NO: 699026 - RNA, 19 nt, Homo sapiens
guuggugccuauauucuau

SEQ ID NO: 699027 - RNA, 19 nt, Homo sapiens
gaccagauccucgucauca

SEQ ID NO: 699028 - RNA, 19 nt, Homo sapiens
cagaagggccguauugagu

SEQ ID NO: 699029 - RNA, 19 nt, Homo sapiens
cagaccaacuucauugaca

SEQ ID NO: 699030 - RNA, 19 nt, Homo sapiens
gauccagaccaacuucauu

SEQ ID NO: 699031 - RNA, 19 nt, Homo sapiens
ucaauugguuuggcaccua

SEQ ID NO: 699032 - RNA, 19 nt, Homo sapiens
auaggaacauugugaacuu

SEQ ID NO: 699033 - RNA, 19 nt, Homo sapiens
cagucuaccuggcgagauu

SEQ ID NO: 699034 - RNA, 19 nt, Homo sapiens
caaccgcaccaccaucgua

SEQ ID NO: 699035 - RNA, 19 nt, Homo sapiens
guauugaguuugagaacgu

SEQ ID NO: 699036 - RNA, 19 nt, Homo sapiens
ugaaagaggagacagaagu

SEQ ID NO: 699037 - RNA, 19 nt, Homo sapiens
caucaucauuggcaucauc

SEQ ID NO: 699038 - RNA, 19 nt, Homo sapiens
cauugcagguucaugaaga

SEQ ID NO: 699039 - RNA, 19 nt, Homo sapiens
ggccaacagguucaguuua

SEQ ID NO: 699040 - RNA, 19 nt, Homo sapiens
uggagaacauguuugacuu

SEQ ID NO: 699041 - RNA, 19 nt, Homo sapiens
gggacuaugugcucuuugg

SEQ ID NO: 699042 - RNA, 19 nt, Homo sapiens
ggaacgggcacucaaugug

SEQ ID NO: 699043 - RNA, 19 nt, Homo sapiens
gguuuggccucauuguguu

SEQ ID NO: 699044 - RNA, 19 nt, Homo sapiens
ucacagcugggaaugauga

SEQ ID NO: 699045 - RNA, 19 nt, Homo sapiens
acacuaagccucagaccau

SEQ ID NO: 699046 - RNA, 19 nt, Homo sapiens
cugccaagcuaucuacuuc

SEQ ID NO: 699047 - RNA, 19 nt, Homo sapiens
caaguuucgucgugcuaug

SEQ ID NO: 699048 - RNA, 19 nt, Homo sapiens
gccaagcuaucuacuucug

SEQ ID NO: 699049 - RNA, 19 nt, Homo sapiens
ucaauguguuggugccuau

SEQ ID NO: 699050 - RNA, 19 nt, Homo sapiens
guuugcagcugagaacuug

SEQ ID NO: 699051 - RNA, 19 nt, Homo sapiens
uccuuucccuggcuuauuu

SEQ ID NO: 699052 - RNA, 19 nt, Homo sapiens
agaaaccucugaagacacu

SEQ ID NO: 699053 - RNA, 19 nt, Homo sapiens
ucauugacauggagaacau

SEQ ID NO: 699054 - RNA, 19 nt, Homo sapiens
ucacugagcagaagcuaca

SEQ ID NO: 699055 - RNA, 19 nt, Homo sapiens
ucauuggcaucaucuacuu

SEQ ID NO: 699056 - RNA, 19 nt, Homo sapiens
gggccaacagguucaguuu

SEQ ID NO: 699057 - RNA, 19 nt, Homo sapiens
ccucuggacuguggcguuu

SEQ ID NO: 699058 - RNA, 19 nt, Homo sapiens
gaauagaugggcaggacau

SEQ ID NO: 699059 - RNA, 19 nt, Homo sapiens
cgagaggccaucaucaaau

SEQ ID NO: 699060 - RNA, 19 nt, Homo sapiens
uaagaugugucuccuuucc

SEQ ID NO: 699061 - RNA, 19 nt, Homo sapiens
ugucacagcugggaaugau

SEQ ID NO: 699062 - RNA, 19 nt, Homo sapiens
caccaucgccgacaauauc

SEQ ID NO: 699063 - RNA, 19 nt, Homo sapiens
ucucuccggucucacauug

SEQ ID NO: 699064 - RNA, 19 nt, Homo sapiens
uggacucucugcuaaacuu

SEQ ID NO: 699065 - RNA, 19 nt, Homo sapiens
auacauugcagguucauga

SEQ ID NO: 699066 - RNA, 19 nt, Homo sapiens
gaagacacuaagccucaga

SEQ ID NO: 699067 - RNA, 19 nt, Homo sapiens
guacgugcccugcgugagu

SEQ ID NO: 699068 - RNA, 19 nt, Homo sapiens
gaagcagcgcgucgccauu

SEQ ID NO: 699069 - RNA, 19 nt, Homo sapiens
gcuaccugguguucaaugu

SEQ ID NO: 699070 - RNA, 19 nt, Homo sapiens
ggauccgggugcagcaguu

SEQ ID NO: 699071 - RNA, 19 nt, Homo sapiens
gaauaagaugugucuccuu

SEQ ID NO: 699072 - RNA, 19 nt, Homo sapiens
gcugaaagaggagacagaa

SEQ ID NO: 699073 - RNA, 19 nt, Homo sapiens
gcucccugcuuugcgcaua

SEQ ID NO: 699074 - RNA, 19 nt, Homo sapiens
ugaagaggaccaagaugug

SEQ ID NO: 699075 - RNA, 19 nt, Homo sapiens
cagaagggaauaagaugug

SEQ ID NO: 699076 - RNA, 19 nt, Homo sapiens
gacaggaagaaaccucuga

SEQ ID NO: 699077 - RNA, 19 nt, Homo sapiens
ugugaugccuggacagaca

SEQ ID NO: 699078 - RNA, 19 nt, Homo sapiens
ccaacuucauugacaugga

SEQ ID NO: 699079 - RNA, 19 nt, Homo sapiens
uaccugguguucaauguca

SEQ ID NO: 699080 - RNA, 19 nt, Homo sapiens
cucaaagacuaacccagaa

SEQ ID NO: 699081 - RNA, 19 nt, Homo sapiens
uagaugggcaggacauuuc

SEQ ID NO: 699082 - RNA, 19 nt, Homo sapiens
guucuucaacgccugguuu

SEQ ID NO: 699083 - RNA, 19 nt, Homo sapiens
gcccuggugucuuggaaca

SEQ ID NO: 699084 - RNA, 19 nt, Homo sapiens
ucucaacuguggucaaugc

SEQ ID NO: 699085 - RNA, 19 nt, Homo sapiens
aggcuucucuggccaaagu

SEQ ID NO: 699086 - RNA, 19 nt, Homo sapiens
caacgucagcgcuggauac

SEQ ID NO: 699087 - RNA, 19 nt, Homo sapiens
ggucucacauuggaguugu

SEQ ID NO: 699088 - RNA, 19 nt, Homo sapiens
ucgagaggccaucaucaaa

SEQ ID NO: 699089 - RNA, 19 nt, Homo sapiens
gggcacauccagugucaca

SEQ ID NO: 699090 - RNA, 19 nt, Homo sapiens
uaggaacauugugaacuug

SEQ ID NO: 699091 - RNA, 19 nt, Homo sapiens
ggugcuagcuaugguaagg

SEQ ID NO: 699092 - RNA, 19 nt, Homo sapiens
aggaagaaaccucugaaga

SEQ ID NO: 699093 - RNA, 19 nt, Homo sapiens
gcaucuggaucaaguucag

SEQ ID NO: 699094 - RNA, 19 nt, Homo sapiens
gugcugauucgcugucuug

SEQ ID NO: 699095 - RNA, 19 nt, Homo sapiens
ccagaagggaauaagaugu

SEQ ID NO: 699096 - RNA, 19 nt, Homo sapiens
gaacacaucacacauuuaa

SEQ ID NO: 699097 - RNA, 19 nt, Homo sapiens
caauugaacuggcuuauau

SEQ ID NO: 699098 - RNA, 19 nt, Homo sapiens
gaaagaagcagcugauaug

SEQ ID NO: 699099 - RNA, 19 nt, Homo sapiens
gaagagaacuauguaauac

SEQ ID NO: 699100 - RNA, 19 nt, Homo sapiens
ggagccagcuagauauuaa

SEQ ID NO: 699101 - RNA, 19 nt, Homo sapiens
gaaacaggcuagccagaga

SEQ ID NO: 699102 - RNA, 19 nt, Homo sapiens
agaauuaccuucagcugua

SEQ ID NO: 699103 - RNA, 19 nt, Homo sapiens
ugacuugucuucuucguaa

SEQ ID NO: 699104 - RNA, 19 nt, Homo sapiens
cagaacacaucacacauuu

SEQ ID NO: 699105 - RNA, 19 nt, Homo sapiens
caaaggcaguaaugcauuu

SEQ ID NO: 699106 - RNA, 19 nt, Homo sapiens
gagacuggcuauaaacuga

SEQ ID NO: 699107 - RNA, 19 nt, Homo sapiens
caaggagccagucaaauua

SEQ ID NO: 699108 - RNA, 19 nt, Homo sapiens
ggaacaaaguaucuugcua

SEQ ID NO: 699109 - RNA, 19 nt, Homo sapiens
guaaauuucuucacaccaa

SEQ ID NO: 699110 - RNA, 19 nt, Homo sapiens
gaacuccuguguauugcaa

SEQ ID NO: 699111 - RNA, 19 nt, Homo sapiens
ggaaagaagcagcugauau

SEQ ID NO: 699112 - RNA, 19 nt, Homo sapiens
gcaaaucaaacgucuagaa

SEQ ID NO: 699113 - RNA, 19 nt, Homo sapiens
caucagagauuguuuacca

SEQ ID NO: 699114 - RNA, 19 nt, Homo sapiens
ggaauaauuggaguaguua

SEQ ID NO: 699115 - RNA, 19 nt, Homo sapiens
gcagaacacaucacacauu

SEQ ID NO: 699116 - RNA, 19 nt, Homo sapiens
caauagaaauggaacaaag

SEQ ID NO: 699117 - RNA, 19 nt, Homo sapiens
cguaaaagguugccuguua

SEQ ID NO: 699118 - RNA, 19 nt, Homo sapiens
acaagaagauaaacggaaa

SEQ ID NO: 699119 - RNA, 19 nt, Homo sapiens
caaauuugccacagaauau

SEQ ID NO: 699120 - RNA, 19 nt, Homo sapiens
gcagaacccuagcuguaau

SEQ ID NO: 699121 - RNA, 19 nt, Homo sapiens
gcaauugaacuggcuuaua

SEQ ID NO: 699122 - RNA, 19 nt, Homo sapiens
acaaggagccagucaaauu

SEQ ID NO: 699123 - RNA, 19 nt, Homo sapiens
caggcuagccagagaauua

SEQ ID NO: 699124 - RNA, 19 nt, Homo sapiens
gaugaaauucgacaagaaa

SEQ ID NO: 699125 - RNA, 19 nt, Homo sapiens
gaacuggcuuauaucaaca

SEQ ID NO: 699126 - RNA, 19 nt, Homo sapiens
ugaaggaacugcaaaauau

SEQ ID NO: 699127 - RNA, 19 nt, Homo sapiens
cacccaacguugucaauuu

SEQ ID NO: 699128 - RNA, 19 nt, Homo sapiens
caucacacauuuaauccaa

SEQ ID NO: 699129 - RNA, 19 nt, Homo sapiens
gcuaaaggcauuacaagga

SEQ ID NO: 699130 - RNA, 19 nt, Homo sapiens
gggcuaaugaacaauaaua

SEQ ID NO: 699131 - RNA, 19 nt, Homo sapiens
uggcuuauaucaacacaaa

SEQ ID NO: 699132 - RNA, 19 nt, Homo sapiens
gaaccaauucaucuuaaga

SEQ ID NO: 699133 - RNA, 19 nt, Homo sapiens
guuauugaacgacucauua

SEQ ID NO: 699134 - RNA, 19 nt, Homo sapiens
ccaaauuugccacagaaua

SEQ ID NO: 699135 - RNA, 19 nt, Homo sapiens
caguaucagucucuucuaa

SEQ ID NO: 699136 - RNA, 19 nt, Homo sapiens
gcuaauuccugucauaaac

SEQ ID NO: 699137 - RNA, 19 nt, Homo sapiens
gcacagcgcaggaaagaag

SEQ ID NO: 699138 - RNA, 19 nt, Homo sapiens
uaaacuucaugaugccaua

SEQ ID NO: 699139 - RNA, 19 nt, Homo sapiens
ucacaucagagauuguuua

SEQ ID NO: 699140 - RNA, 19 nt, Homo sapiens
uggaauaauuggaguaguu

SEQ ID NO: 699141 - RNA, 19 nt, Homo sapiens
ucacuaaacuugaucucau

SEQ ID NO: 699142 - RNA, 19 nt, Homo sapiens
gugaacccguggaugauaa

SEQ ID NO: 699143 - RNA, 19 nt, Homo sapiens
guaucagucucuucuaaau

SEQ ID NO: 699144 - RNA, 19 nt, Homo sapiens
caacaucagaggcacuuaa

SEQ ID NO: 699145 - RNA, 19 nt, Homo sapiens
uuuaugaacuccuguguau

SEQ ID NO: 699146 - RNA, 19 nt, Homo sapiens
gaacgacucauuaaaucau

SEQ ID NO: 699147 - RNA, 19 nt, Homo sapiens
gaaauggaacaaaguaucu

SEQ ID NO: 699148 - RNA, 19 nt, Homo sapiens
caagaagaguguaacugau

SEQ ID NO: 699149 - RNA, 19 nt, Homo sapiens
cuaaggauauugagcuuca

SEQ ID NO: 699150 - RNA, 19 nt, Homo sapiens
aguaagcccugaaccaauu

SEQ ID NO: 699151 - RNA, 19 nt, Homo sapiens
gaaaacaacaggagaagaa

SEQ ID NO: 699152 - RNA, 19 nt, Homo sapiens
ggugcuagaauuuguuaua

SEQ ID NO: 699153 - RNA, 19 nt, Homo sapiens
gcuguaaucacuaaacuug

SEQ ID NO: 699154 - RNA, 19 nt, Homo sapiens
ggaguaagcccugaaccaa

SEQ ID NO: 699155 - RNA, 19 nt, Homo sapiens
ggaaauaauaagggaguaa

SEQ ID NO: 699156 - RNA, 19 nt, Homo sapiens
gcuauaaacugaaaagugu

SEQ ID NO: 699157 - RNA, 19 nt, Homo sapiens
uaugaacuccuguguauug

SEQ ID NO: 699158 - RNA, 19 nt, Homo sapiens
ugccugagguuucauuuga

SEQ ID NO: 699159 - RNA, 19 nt, Homo sapiens
gcuaugcgguggugcuaga

SEQ ID NO: 699160 - RNA, 19 nt, Homo sapiens
gggaacagcgagauuguga

SEQ ID NO: 699161 - RNA, 19 nt, Homo sapiens
ucaaaacccauuccaauua

SEQ ID NO: 699162 - RNA, 19 nt, Homo sapiens
gaagaguuauuagcagaag

SEQ ID NO: 699163 - RNA, 19 nt, Homo sapiens
uaacuuaguggcaauugaa

SEQ ID NO: 699164 - RNA, 19 nt, Homo sapiens
cuacuuuacuccaacuuau

SEQ ID NO: 699165 - RNA, 19 nt, Homo sapiens
acaagaagaguguaacuga

SEQ ID NO: 699166 - RNA, 19 nt, Homo sapiens
gaaggguuauuccagucaa

SEQ ID NO: 699167 - RNA, 19 nt, Homo sapiens
auacagauauggcaacauc

SEQ ID NO: 699168 - RNA, 19 nt, Homo sapiens
gaagauaaacggaaaacaa

SEQ ID NO: 699169 - RNA, 19 nt, Homo sapiens
ugaacuggcuuauaucaac

SEQ ID NO: 699170 - RNA, 19 nt, Homo sapiens
gagauuguuuaccagaguu

SEQ ID NO: 699171 - RNA, 19 nt, Homo sapiens
guacugaugccauggaugu

SEQ ID NO: 699172 - RNA, 19 nt, Homo sapiens
ggugaucaaccuaaggaua

SEQ ID NO: 699173 - RNA, 19 nt, Homo sapiens
ugaugaaauucgacaagaa

SEQ ID NO: 699174 - RNA, 19 nt, Homo sapiens
guauugcaaugguaugaau

SEQ ID NO: 699175 - RNA, 19 nt, Homo sapiens
gguuggagaugguguucaa

SEQ ID NO: 699176 - RNA, 19 nt, Homo sapiens
gaauuaccuucagcuguau

SEQ ID NO: 699177 - RNA, 19 nt, Homo sapiens
acacaggaauuguuacgau

SEQ ID NO: 699178 - RNA, 19 nt, Homo sapiens
aaucaaacgucuagaagag

SEQ ID NO: 699179 - RNA, 19 nt, Homo sapiens
caaggugccuguaggugau

SEQ ID NO: 699180 - RNA, 19 nt, Homo sapiens
gagauugugagguuauuga

SEQ ID NO: 699181 - RNA, 19 nt, Homo sapiens
guauugaugggaaggguua

SEQ ID NO: 699182 - RNA, 19 nt, Homo sapiens
agagaacuauguaauacug

SEQ ID NO: 699183 - RNA, 19 nt, Homo sapiens
aaagguugccuguuacaaa

SEQ ID NO: 699184 - RNA, 19 nt, Homo sapiens
auucagcacuguagcaauu

SEQ ID NO: 699185 - RNA, 19 nt, Homo sapiens
ugagguuucauuugaguua

SEQ ID NO: 699186 - RNA, 19 nt, Homo sapiens
uaccaaauuugccacagaa

SEQ ID NO: 699187 - RNA, 19 nt, Homo sapiens
cuaaauagcuacggugaac

SEQ ID NO: 699188 - RNA, 19 nt, Homo sapiens
acagcgagauugugagguu

SEQ ID NO: 699189 - RNA, 19 nt, Homo sapiens
acaggcaacuggagaggaa

SEQ ID NO: 699190 - RNA, 19 nt, Homo sapiens
agacuuugcugaugcuugu

SEQ ID NO: 699191 - RNA, 19 nt, Homo sapiens
gaggaaaugcaaaggauca

SEQ ID NO: 699192 - RNA, 19 nt, Homo sapiens
ccuuaacacuauugacauu

SEQ ID NO: 699193 - RNA, 19 nt, Homo sapiens
uguggagacuggcuauaaa

SEQ ID NO: 699194 - RNA, 19 nt, Homo sapiens
uaggccagcuguauaaauc

SEQ ID NO: 699195 - RNA, 19 nt, Homo sapiens
caaaacccauuccaauuau

SEQ ID NO: 699196 - RNA, 19 nt, Homo sapiens
gaacacaucacacauuuaa

SEQ ID NO: 699197 - RNA, 19 nt, Homo sapiens
gcucuaagauucacuuuga

SEQ ID NO: 699198 - RNA, 19 nt, Homo sapiens
caauugaacuggcuuauau

SEQ ID NO: 699199 - RNA, 19 nt, Homo sapiens
gaaagaagcagcugauaug

SEQ ID NO: 699200 - RNA, 19 nt, Homo sapiens
uaagaugaccuguguaaua

SEQ ID NO: 699201 - RNA, 19 nt, Homo sapiens
gaagagaacuauguaauac

SEQ ID NO: 699202 - RNA, 19 nt, Homo sapiens
ggagccagcuagauauuaa

SEQ ID NO: 699203 - RNA, 19 nt, Homo sapiens
gaagaaagcaccaagacaa

SEQ ID NO: 699204 - RNA, 19 nt, Homo sapiens
gaaacaggcuagccagaga

SEQ ID NO: 699205 - RNA, 19 nt, Homo sapiens
agaauuaccuucagcugua

SEQ ID NO: 699206 - RNA, 19 nt, Homo sapiens
ugacuugucuucuucguaa

SEQ ID NO: 699207 - RNA, 19 nt, Homo sapiens
cagaacacaucacacauuu

SEQ ID NO: 699208 - RNA, 19 nt, Homo sapiens
caaaggcaguaaugcauuu

SEQ ID NO: 699209 - RNA, 19 nt, Homo sapiens
gagacuggcuauaaacuga

SEQ ID NO: 699210 - RNA, 19 nt, Homo sapiens
caaggagccagucaaauua

SEQ ID NO: 699211 - RNA, 19 nt, Homo sapiens
gauaagaugaccuguguaa

SEQ ID NO: 699212 - RNA, 19 nt, Homo sapiens
ggaacaaaguaucuugcua

SEQ ID NO: 699213 - RNA, 19 nt, Homo sapiens
guaaauuucuucacaccaa

SEQ ID NO: 699214 - RNA, 19 nt, Homo sapiens
uuacauagcccuuccaauu

SEQ ID NO: 699215 - RNA, 19 nt, Homo sapiens
aagaugaccuguguaauaa

SEQ ID NO: 699216 - RNA, 19 nt, Homo sapiens
uagaaagacuugguaauga

SEQ ID NO: 699217 - RNA, 19 nt, Homo sapiens
gcaguuugccuguggauaa

SEQ ID NO: 699218 - RNA, 19 nt, Homo sapiens
gaacuccuguguauugcaa

SEQ ID NO: 699219 - RNA, 19 nt, Homo sapiens
ggaaagaagcagcugauau

SEQ ID NO: 699220 - RNA, 19 nt, Homo sapiens
cuucauagcuucauaccaa

SEQ ID NO: 699221 - RNA, 19 nt, Homo sapiens
ugaccuaaauuucccuuaa

SEQ ID NO: 699222 - RNA, 19 nt, Homo sapiens
ucuuaaagcugcugccaua

SEQ ID NO: 699223 - RNA, 19 nt, Homo sapiens
uaagguacaucucuaaagu

SEQ ID NO: 699224 - RNA, 19 nt, Homo sapiens
ccaccuguccuucaauuua

SEQ ID NO: 699225 - RNA, 19 nt, Homo sapiens
gcaaaucaaacgucuagaa

SEQ ID NO: 699226 - RNA, 19 nt, Homo sapiens
caucagagauuguuuacca

SEQ ID NO: 699227 - RNA, 19 nt, Homo sapiens
ggaauaauuggaguaguua

SEQ ID NO: 699228 - RNA, 19 nt, Homo sapiens
gaugugaguuggcaaguuc

SEQ ID NO: 699229 - RNA, 19 nt, Homo sapiens
gcagaacacaucacacauu

SEQ ID NO: 699230 - RNA, 19 nt, Homo sapiens
caauagaaauggaacaaag

SEQ ID NO: 699231 - RNA, 19 nt, Homo sapiens
ugaaaguacugaaggaguu

SEQ ID NO: 699232 - RNA, 19 nt, Homo sapiens
cguaaaagguugccuguua

SEQ ID NO: 699233 - RNA, 19 nt, Homo sapiens
acaagaagauaaacggaaa

SEQ ID NO: 699234 - RNA, 19 nt, Homo sapiens
ucacauagagucauuguau

SEQ ID NO: 699235 - RNA, 19 nt, Homo sapiens
caaauuugccacagaauau

SEQ ID NO: 699236 - RNA, 19 nt, Homo sapiens
gcagaacccuagcuguaau

SEQ ID NO: 699237 - RNA, 19 nt, Homo sapiens
gcaaguuccucacauagag

SEQ ID NO: 699238 - RNA, 19 nt, Homo sapiens
gcaauugaacuggcuuaua

SEQ ID NO: 699239 - RNA, 19 nt, Homo sapiens
gagcuucuuugcagccuuu

SEQ ID NO: 699240 - RNA, 19 nt, Homo sapiens
acaaggagccagucaaauu

SEQ ID NO: 699241 - RNA, 19 nt, Homo sapiens
caggcuagccagagaauua

SEQ ID NO: 699242 - RNA, 19 nt, Homo sapiens
gaugaaauucgacaagaaa

SEQ ID NO: 699243 - RNA, 19 nt, Homo sapiens
gaacuggcuuauaucaaca

SEQ ID NO: 699244 - RNA, 19 nt, Homo sapiens
ugaaggaacugcaaaauau

SEQ ID NO: 699245 - RNA, 19 nt, Homo sapiens
cacccaacguugucaauuu

SEQ ID NO: 699246 - RNA, 19 nt, Homo sapiens
caucuacccuugauuaucu

SEQ ID NO: 699247 - RNA, 19 nt, Homo sapiens
caucacacauuuaauccaa

SEQ ID NO: 699248 - RNA, 19 nt, Homo sapiens
gcuaaaggcauuacaagga

SEQ ID NO: 699249 - RNA, 19 nt, Homo sapiens
gggcuaaugaacaauaaua

SEQ ID NO: 699250 - RNA, 19 nt, Homo sapiens
uggcuuauaucaacacaaa

SEQ ID NO: 699251 - RNA, 19 nt, Homo sapiens
gaaccaauucaucuuaaga

SEQ ID NO: 699252 - RNA, 19 nt, Homo sapiens
gaccuaaauuucccuuaau

SEQ ID NO: 699253 - RNA, 19 nt, Homo sapiens
gaugaccuguguaauaauc

SEQ ID NO: 699254 - RNA, 19 nt, Homo sapiens
guuauugaacgacucauua

SEQ ID NO: 699255 - RNA, 19 nt, Homo sapiens
ccaaauuugccacagaaua

SEQ ID NO: 699256 - RNA, 19 nt, Homo sapiens
caguaucagucucuucuaa

SEQ ID NO: 699257 - RNA, 19 nt, Homo sapiens
caagacaacauuucauaug

SEQ ID NO: 699258 - RNA, 19 nt, Homo sapiens
gcuaauuccugucauaaac

SEQ ID NO: 699259 - RNA, 19 nt, Homo sapiens
gcacagcgcaggaaagaag

SEQ ID NO: 699260 - RNA, 19 nt, Homo sapiens
uaaacuucaugaugccaua

SEQ ID NO: 699261 - RNA, 19 nt, Homo sapiens
ucacaucagagauuguuua

SEQ ID NO: 699262 - RNA, 19 nt, Homo sapiens
uggaauaauuggaguaguu

SEQ ID NO: 699263 - RNA, 19 nt, Homo sapiens
ucacuaaacuugaucucau

SEQ ID NO: 699264 - RNA, 19 nt, Homo sapiens
gugaacccguggaugauaa

SEQ ID NO: 699265 - RNA, 19 nt, Homo sapiens
guaucagucucuucuaaau

SEQ ID NO: 699266 - RNA, 19 nt, Homo sapiens
caacaucagaggcacuuaa

SEQ ID NO: 699267 - RNA, 19 nt, Homo sapiens
acaccaggcucuaagauuc

SEQ ID NO: 699268 - RNA, 19 nt, Homo sapiens
uuuaugaacuccuguguau

SEQ ID NO: 699269 - RNA, 19 nt, Homo sapiens
gaacgacucauuaaaucau

SEQ ID NO: 699270 - RNA, 19 nt, Homo sapiens
gaaaacaacaggagaagaa

SEQ ID NO: 699271 - RNA, 19 nt, Homo sapiens
gaaauggaacaaaguaucu

SEQ ID NO: 699272 - RNA, 19 nt, Homo sapiens
caagaagaguguaacugau

SEQ ID NO: 699273 - RNA, 19 nt, Homo sapiens
cuaaggauauugagcuuca

SEQ ID NO: 699274 - RNA, 19 nt, Homo sapiens
aguaagcccugaaccaauu

SEQ ID NO: 699275 - RNA, 19 nt, Homo sapiens
gcaccaagacaacauuuca

SEQ ID NO: 699276 - RNA, 19 nt, Homo sapiens
ugaggcugauggcaaguua

SEQ ID NO: 699277 - RNA, 19 nt, Homo sapiens
ggugcuagaauuuguuaua

SEQ ID NO: 699278 - RNA, 19 nt, Homo sapiens
gcuguaaucacuaaacuug

SEQ ID NO: 699279 - RNA, 19 nt, Homo sapiens
ggaguaagcccugaaccaa

SEQ ID NO: 699280 - RNA, 19 nt, Homo sapiens
ggaaauaauaagggaguaa

SEQ ID NO: 699281 - RNA, 19 nt, Homo sapiens
agaaagacuugguaaugau

SEQ ID NO: 699282 - RNA, 19 nt, Homo sapiens
uggauaagaugaccugugu

SEQ ID NO: 699283 - RNA, 19 nt, Homo sapiens
uuucuaaaguuucccagua

SEQ ID NO: 699284 - RNA, 19 nt, Homo sapiens
gcuauaaacugaaaagugu

SEQ ID NO: 699285 - RNA, 19 nt, Homo sapiens
uaugaacuccuguguauug

SEQ ID NO: 699286 - RNA, 19 nt, Homo sapiens
ugccugagguuucauuuga

SEQ ID NO: 699287 - RNA, 19 nt, Homo sapiens
gcuaugcgguggugcuaga

SEQ ID NO: 699288 - RNA, 19 nt, Homo sapiens
guaugaaaguacugaagga

SEQ ID NO: 699289 - RNA, 19 nt, Homo sapiens
gaaagacuugguaaugaug

SEQ ID NO: 699290 - RNA, 19 nt, Homo sapiens
ucuaaaguuucccaguaua

SEQ ID NO: 699291 - RNA, 19 nt, Homo sapiens
gaagauaaacggaaaacaa

SEQ ID NO: 699292 - RNA, 19 nt, Homo sapiens
gggaacagcgagauuguga

SEQ ID NO: 699293 - RNA, 19 nt, Homo sapiens
ucaaaacccauuccaauua

SEQ ID NO: 699294 - RNA, 19 nt, Homo sapiens
gaagaguuauuagcagaag

SEQ ID NO: 699295 - RNA, 19 nt, Homo sapiens
uaacuuaguggcaauugaa

SEQ ID NO: 699296 - RNA, 19 nt, Homo sapiens
gaacacaucacacauuuaa

SEQ ID NO: 699297 - RNA, 19 nt, Homo sapiens
caauugaacuggcuuauau

SEQ ID NO: 699298 - RNA, 19 nt, Homo sapiens
gaaagaagcagcugauaug

SEQ ID NO: 699299 - RNA, 19 nt, Homo sapiens
gaagagaacuauguaauac

SEQ ID NO: 699300 - RNA, 19 nt, Homo sapiens
ggagccagcuagauauuaa

SEQ ID NO: 699301 - RNA, 19 nt, Homo sapiens
gaaacaggcuagccagaga

SEQ ID NO: 699302 - RNA, 19 nt, Homo sapiens
agaauuaccuucagcugua

SEQ ID NO: 699303 - RNA, 19 nt, Homo sapiens
ugacuugucuucuucguaa

SEQ ID NO: 699304 - RNA, 19 nt, Homo sapiens
cagaacacaucacacauuu

SEQ ID NO: 699305 - RNA, 19 nt, Homo sapiens
caaaggcaguaaugcauuu

SEQ ID NO: 699306 - RNA, 19 nt, Homo sapiens
gagacuggcuauaaacuga

SEQ ID NO: 699307 - RNA, 19 nt, Homo sapiens
caaggagccagucaaauua

SEQ ID NO: 699308 - RNA, 19 nt, Homo sapiens
ggaacaaaguaucuugcua

SEQ ID NO: 699309 - RNA, 19 nt, Homo sapiens
guaaauuucuucacaccaa

SEQ ID NO: 699310 - RNA, 19 nt, Homo sapiens
gaacuccuguguauugcaa

SEQ ID NO: 699311 - RNA, 19 nt, Homo sapiens
ggaaagaagcagcugauau

SEQ ID NO: 699312 - RNA, 19 nt, Homo sapiens
gcaaaucaaacgucuagaa

SEQ ID NO: 699313 - RNA, 19 nt, Homo sapiens
caucagagauuguuuacca

SEQ ID NO: 699314 - RNA, 19 nt, Homo sapiens
ggaauaauuggaguaguua

SEQ ID NO: 699315 - RNA, 19 nt, Homo sapiens
gcagaacacaucacacauu

SEQ ID NO: 699316 - RNA, 19 nt, Homo sapiens
caauagaaauggaacaaag

SEQ ID NO: 699317 - RNA, 19 nt, Homo sapiens
cguaaaagguugccuguua

SEQ ID NO: 699318 - RNA, 19 nt, Homo sapiens
acaagaagauaaacggaaa

SEQ ID NO: 699319 - RNA, 19 nt, Homo sapiens
caaauuugccacagaauau

SEQ ID NO: 699320 - RNA, 19 nt, Homo sapiens
gcagaacccuagcuguaau

SEQ ID NO: 699321 - RNA, 19 nt, Homo sapiens
gcaauugaacuggcuuaua

SEQ ID NO: 699322 - RNA, 19 nt, Homo sapiens
acaaggagccagucaaauu

SEQ ID NO: 699323 - RNA, 19 nt, Homo sapiens
caggcuagccagagaauua

SEQ ID NO: 699324 - RNA, 19 nt, Homo sapiens
gaugaaauucgacaagaaa

SEQ ID NO: 699325 - RNA, 19 nt, Homo sapiens
gaacuggcuuauaucaaca

SEQ ID NO: 699326 - RNA, 19 nt, Homo sapiens
ugaaggaacugcaaaauau

SEQ ID NO: 699327 - RNA, 19 nt, Homo sapiens
cacccaacguugucaauuu

SEQ ID NO: 699328 - RNA, 19 nt, Homo sapiens
caucacacauuuaauccaa

SEQ ID NO: 699329 - RNA, 19 nt, Homo sapiens
gcuaaaggcauuacaagga

SEQ ID NO: 699330 - RNA, 19 nt, Homo sapiens
gggcuaaugaacaauaaua

SEQ ID NO: 699331 - RNA, 19 nt, Homo sapiens
uggcuuauaucaacacaaa

SEQ ID NO: 699332 - RNA, 19 nt, Homo sapiens
gaaccaauucaucuuaaga

SEQ ID NO: 699333 - RNA, 19 nt, Homo sapiens
guuauugaacgacucauua

SEQ ID NO: 699334 - RNA, 19 nt, Homo sapiens
ccaaauuugccacagaaua

SEQ ID NO: 699335 - RNA, 19 nt, Homo sapiens
caguaucagucucuucuaa

SEQ ID NO: 699336 - RNA, 19 nt, Homo sapiens
gcuaauuccugucauaaac

SEQ ID NO: 699337 - RNA, 19 nt, Homo sapiens
gcacagcgcaggaaagaag

SEQ ID NO: 699338 - RNA, 19 nt, Homo sapiens
uaaacuucaugaugccaua

SEQ ID NO: 699339 - RNA, 19 nt, Homo sapiens
ucacaucagagauuguuua

SEQ ID NO: 699340 - RNA, 19 nt, Homo sapiens
uggaauaauuggaguaguu

SEQ ID NO: 699341 - RNA, 19 nt, Homo sapiens
ucacuaaacuugaucucau

SEQ ID NO: 699342 - RNA, 19 nt, Homo sapiens
gugaacccguggaugauaa

SEQ ID NO: 699343 - RNA, 19 nt, Homo sapiens
guaucagucucuucuaaau

SEQ ID NO: 699344 - RNA, 19 nt, Homo sapiens
caacaucagaggcacuuaa

SEQ ID NO: 699345 - RNA, 19 nt, Homo sapiens
uuuaugaacuccuguguau

SEQ ID NO: 699346 - RNA, 19 nt, Homo sapiens
gaacgacucauuaaaucau

SEQ ID NO: 699347 - RNA, 19 nt, Homo sapiens
gaaauggaacaaaguaucu

SEQ ID NO: 699348 - RNA, 19 nt, Homo sapiens
caagaagaguguaacugau

SEQ ID NO: 699349 - RNA, 19 nt, Homo sapiens
cuaaggauauugagcuuca

SEQ ID NO: 699350 - RNA, 19 nt, Homo sapiens
aguaagcccugaaccaauu

SEQ ID NO: 699351 - RNA, 19 nt, Homo sapiens
gaaaacaacaggagaagaa

SEQ ID NO: 699352 - RNA, 19 nt, Homo sapiens
ggugcuagaauuuguuaua

SEQ ID NO: 699353 - RNA, 19 nt, Homo sapiens
gcuguaaucacuaaacuug

SEQ ID NO: 699354 - RNA, 19 nt, Homo sapiens
ggaguaagcccugaaccaa

SEQ ID NO: 699355 - RNA, 19 nt, Homo sapiens
ggaaauaauaagggaguaa

SEQ ID NO: 699356 - RNA, 19 nt, Homo sapiens
gcuauaaacugaaaagugu

SEQ ID NO: 699357 - RNA, 19 nt, Homo sapiens
uaugaacuccuguguauug

SEQ ID NO: 699358 - RNA, 19 nt, Homo sapiens
ugccugagguuucauuuga

SEQ ID NO: 699359 - RNA, 19 nt, Homo sapiens
gcuaugcgguggugcuaga

SEQ ID NO: 699360 - RNA, 19 nt, Homo sapiens
gggaacagcgagauuguga

SEQ ID NO: 699361 - RNA, 19 nt, Homo sapiens
ucaaaacccauuccaauua

SEQ ID NO: 699362 - RNA, 19 nt, Homo sapiens
gaagaguuauuagcagaag

SEQ ID NO: 699363 - RNA, 19 nt, Homo sapiens
uaacuuaguggcaauugaa

SEQ ID NO: 699364 - RNA, 19 nt, Homo sapiens
cuacuuuacuccaacuuau

SEQ ID NO: 699365 - RNA, 19 nt, Homo sapiens
acaagaagaguguaacuga

SEQ ID NO: 699366 - RNA, 19 nt, Homo sapiens
gaaggguuauuccagucaa

SEQ ID NO: 699367 - RNA, 19 nt, Homo sapiens
auacagauauggcaacauc

SEQ ID NO: 699368 - RNA, 19 nt, Homo sapiens
gaagauaaacggaaaacaa

SEQ ID NO: 699369 - RNA, 19 nt, Homo sapiens
ugaacuggcuuauaucaac

SEQ ID NO: 699370 - RNA, 19 nt, Homo sapiens
gagauuguuuaccagaguu

SEQ ID NO: 699371 - RNA, 19 nt, Homo sapiens
guacugaugccauggaugu

SEQ ID NO: 699372 - RNA, 19 nt, Homo sapiens
ggugaucaaccuaaggaua

SEQ ID NO: 699373 - RNA, 19 nt, Homo sapiens
ugaugaaauucgacaagaa

SEQ ID NO: 699374 - RNA, 19 nt, Homo sapiens
guauugcaaugguaugaau

SEQ ID NO: 699375 - RNA, 19 nt, Homo sapiens
gguuggagaugguguucaa

SEQ ID NO: 699376 - RNA, 19 nt, Homo sapiens
gaauuaccuucagcuguau

SEQ ID NO: 699377 - RNA, 19 nt, Homo sapiens
acacaggaauuguuacgau

SEQ ID NO: 699378 - RNA, 19 nt, Homo sapiens
aaucaaacgucuagaagag

SEQ ID NO: 699379 - RNA, 19 nt, Homo sapiens
caaggugccuguaggugau

SEQ ID NO: 699380 - RNA, 19 nt, Homo sapiens
gagauugugagguuauuga

SEQ ID NO: 699381 - RNA, 19 nt, Homo sapiens
guauugaugggaaggguua

SEQ ID NO: 699382 - RNA, 19 nt, Homo sapiens
agagaacuauguaauacug

SEQ ID NO: 699383 - RNA, 19 nt, Homo sapiens
caggacagcagaagagaaa

SEQ ID NO: 699384 - RNA, 19 nt, Homo sapiens
aaagguugccuguuacaaa

SEQ ID NO: 699385 - RNA, 19 nt, Homo sapiens
auucagcacuguagcaauu

SEQ ID NO: 699386 - RNA, 19 nt, Homo sapiens
ugagguuucauuugaguua

SEQ ID NO: 699387 - RNA, 19 nt, Homo sapiens
uaccaaauuugccacagaa

SEQ ID NO: 699388 - RNA, 19 nt, Homo sapiens
cuaaauagcuacggugaac

SEQ ID NO: 699389 - RNA, 19 nt, Homo sapiens
acagcgagauugugagguu

SEQ ID NO: 699390 - RNA, 19 nt, Homo sapiens
acaggcaacuggagaggaa

SEQ ID NO: 699391 - RNA, 19 nt, Homo sapiens
agacuuugcugaugcuugu

SEQ ID NO: 699392 - RNA, 19 nt, Homo sapiens
gaggaaaugcaaaggauca

SEQ ID NO: 699393 - RNA, 19 nt, Homo sapiens
ccuuaacacuauugacauu

SEQ ID NO: 699394 - RNA, 19 nt, Homo sapiens
uguggagacuggcuauaaa

SEQ ID NO: 699395 - RNA, 19 nt, Homo sapiens
uaggccagcuguauaaauc

SEQ ID NO: 699396 - RNA, 19 nt, Homo sapiens
caacaucgauaguguauua

SEQ ID NO: 699397 - RNA, 19 nt, Homo sapiens
caacauugccuacuuauuu

SEQ ID NO: 699398 - RNA, 19 nt, Homo sapiens
gauaacauguccacuguaa

SEQ ID NO: 699399 - RNA, 19 nt, Homo sapiens
ugaagaaggugaacaguuu

SEQ ID NO: 699400 - RNA, 19 nt, Homo sapiens
gaaacagccuggaagauau

SEQ ID NO: 699401 - RNA, 19 nt, Homo sapiens
aaacaacauugccuacuua

SEQ ID NO: 699402 - RNA, 19 nt, Homo sapiens
gcuauuaaaugcuacagua

SEQ ID NO: 699403 - RNA, 19 nt, Homo sapiens
ggaaacagccuggaagaua

SEQ ID NO: 699404 - RNA, 19 nt, Homo sapiens
uaacacaacuggaauuuca

SEQ ID NO: 699405 - RNA, 19 nt, Homo sapiens
caccgugucucuucuauua

SEQ ID NO: 699406 - RNA, 19 nt, Homo sapiens
ggucacaaauggauacuuu

SEQ ID NO: 699407 - RNA, 19 nt, Homo sapiens
ugagagcaguaacaaauua

SEQ ID NO: 699408 - RNA, 19 nt, Homo sapiens
ccauugggaugauuucuua

SEQ ID NO: 699409 - RNA, 19 nt, Homo sapiens
cgucaaggcuuacaucaaa

SEQ ID NO: 699410 - RNA, 19 nt, Homo sapiens
caauaaaggucacaaaugg

SEQ ID NO: 699411 - RNA, 19 nt, Homo sapiens
gauaucaccuggacagcua

SEQ ID NO: 699412 - RNA, 19 nt, Homo sapiens
cagaaacccucucaucaaa

SEQ ID NO: 699413 - RNA, 19 nt, Homo sapiens
gaaagaugcauaugaagaa

SEQ ID NO: 699414 - RNA, 19 nt, Homo sapiens
ggacauaaccugagaugga

SEQ ID NO: 699415 - RNA, 19 nt, Homo sapiens
ugagauggauucuuacauu

SEQ ID NO: 699416 - RNA, 19 nt, Homo sapiens
uaucaacgaugguguacua

SEQ ID NO: 699417 - RNA, 19 nt, Homo sapiens
aaccugagauggauucuua

SEQ ID NO: 699418 - RNA, 19 nt, Homo sapiens
cuauauggcuugcaaugua

SEQ ID NO: 699419 - RNA, 19 nt, Homo sapiens
gaaaccagauuuaaacaac

SEQ ID NO: 699420 - RNA, 19 nt, Homo sapiens
ugaaauuccugcaagauga

SEQ ID NO: 699421 - RNA, 19 nt, Homo sapiens
ggacagcuaugagcaauca

SEQ ID NO: 699422 - RNA, 19 nt, Homo sapiens
caaacaacauugccuacuu

SEQ ID NO: 699423 - RNA, 19 nt, Homo sapiens
ggacgaagacgaagaggaa

SEQ ID NO: 699424 - RNA, 19 nt, Homo sapiens
gaaggacauucaaaccaaa

SEQ ID NO: 699425 - RNA, 19 nt, Homo sapiens
ucggcaagaucaagaauua

SEQ ID NO: 699426 - RNA, 19 nt, Homo sapiens
cagaggacauugcaauaaa

SEQ ID NO: 699427 - RNA, 19 nt, Homo sapiens
gcaacauacugguggauga

SEQ ID NO: 699428 - RNA, 19 nt, Homo sapiens
ggagugagauuucuucaac

SEQ ID NO: 699429 - RNA, 19 nt, Homo sapiens
gugauacugucccaaauuu

SEQ ID NO: 699430 - RNA, 19 nt, Homo sapiens
ugaagaauauggucaaauc

SEQ ID NO: 699431 - RNA, 19 nt, Homo sapiens
gcaauaaaggucacaaaug

SEQ ID NO: 699432 - RNA, 19 nt, Homo sapiens
gcacuuacgauaaccaauu

SEQ ID NO: 699433 - RNA, 19 nt, Homo sapiens
ugaaauagcagaaggcauu

SEQ ID NO: 699434 - RNA, 19 nt, Homo sapiens
uacauucgcucuccuguuu

SEQ ID NO: 699435 - RNA, 19 nt, Homo sapiens
gggaugauuucuuaugcua

SEQ ID NO: 699436 - RNA, 19 nt, Homo sapiens
ggacaucggaguacaguau

SEQ ID NO: 699437 - RNA, 19 nt, Homo sapiens
ccugaaagaugcauaugaa

SEQ ID NO: 699438 - RNA, 19 nt, Homo sapiens
uggaugaacacacuuauua

SEQ ID NO: 699439 - RNA, 19 nt, Homo sapiens
acacuacguucuagacuuu

SEQ ID NO: 699440 - RNA, 19 nt, Homo sapiens
ugaauuggguugugaggaa

SEQ ID NO: 699441 - RNA, 19 nt, Homo sapiens
cuaaucaacucaugugguu

SEQ ID NO: 699442 - RNA, 19 nt, Homo sapiens
gagauuucuucaaccauuu

SEQ ID NO: 699443 - RNA, 19 nt, Homo sapiens
gccagauauugacuuauua

SEQ ID NO: 699444 - RNA, 19 nt, Homo sapiens
gcaugaaaccagauuuaaa

SEQ ID NO: 699445 - RNA, 19 nt, Homo sapiens
ggacagaggcagagaaucu

SEQ ID NO: 699446 - RNA, 19 nt, Homo sapiens
ucagccagauauugacuua

SEQ ID NO: 699447 - RNA, 19 nt, Homo sapiens
ucaaagccaucauaagugu

SEQ ID NO: 699448 - RNA, 19 nt, Homo sapiens
gaaacccucucaucaaagg

SEQ ID NO: 699449 - RNA, 19 nt, Homo sapiens
uaacauguccacuguaaug

SEQ ID NO: 699450 - RNA, 19 nt, Homo sapiens
ggaggaaacaagaaugaaa

SEQ ID NO: 699451 - RNA, 19 nt, Homo sapiens
gaaaguaaagccuccugaa

SEQ ID NO: 699452 - RNA, 19 nt, Homo sapiens
gguguugccuuuuauuuua

SEQ ID NO: 699453 - RNA, 19 nt, Homo sapiens
ggaguacaguauaaacaau

SEQ ID NO: 699454 - RNA, 19 nt, Homo sapiens
caacuuagucgccauugaa

SEQ ID NO: 699455 - RNA, 19 nt, Homo sapiens
cagaaggcauuguuucaga

SEQ ID NO: 699456 - RNA, 19 nt, Homo sapiens
gagauggauucuuacauuc

SEQ ID NO: 699457 - RNA, 19 nt, Homo sapiens
gugaacaguuuccugacua

SEQ ID NO: 699458 - RNA, 19 nt, Homo sapiens
ggaggaagaugaggaugau

SEQ ID NO: 699459 - RNA, 19 nt, Homo sapiens
aaaguucacuggagcaaug

SEQ ID NO: 699460 - RNA, 19 nt, Homo sapiens
gaguuucucuugagugaug

SEQ ID NO: 699461 - RNA, 19 nt, Homo sapiens
gcgugauucugcucuauaa

SEQ ID NO: 699462 - RNA, 19 nt, Homo sapiens
ugagauuucuucaaccauu

SEQ ID NO: 699463 - RNA, 19 nt, Homo sapiens
uagaugcgguugucacuga

SEQ ID NO: 699464 - RNA, 19 nt, Homo sapiens
cacuuacgauaaccaauua

SEQ ID NO: 699465 - RNA, 19 nt, Homo sapiens
ggucuucuguaugcacuua

SEQ ID NO: 699466 - RNA, 19 nt, Homo sapiens
gcaucuauagcauccauua

SEQ ID NO: 699467 - RNA, 19 nt, Homo sapiens
caccacaaccuucucaaua

SEQ ID NO: 699468 - RNA, 19 nt, Homo sapiens
gcacgagcgcuguaucaaa

SEQ ID NO: 699469 - RNA, 19 nt, Homo sapiens
ggugaaaguucgcuuccuu

SEQ ID NO: 699470 - RNA, 19 nt, Homo sapiens
uugcucagcugaagaauau

SEQ ID NO: 699471 - RNA, 19 nt, Homo sapiens
gaacauuggccacaagaag

SEQ ID NO: 699472 - RNA, 19 nt, Homo sapiens
ggacuaaaaugccauggaa

SEQ ID NO: 699473 - RNA, 19 nt, Homo sapiens
ggccauguauucaagagaa

SEQ ID NO: 699474 - RNA, 19 nt, Homo sapiens
gaagcaaccagaaguagga

SEQ ID NO: 699475 - RNA, 19 nt, Homo sapiens
ggacagagacagcuauuuu

SEQ ID NO: 699476 - RNA, 19 nt, Homo sapiens
ggaaaacacuuaugaaucg

SEQ ID NO: 699477 - RNA, 19 nt, Homo sapiens
gagaaggaacuuugaagga

SEQ ID NO: 699478 - RNA, 19 nt, Homo sapiens
cagcuguucuugcuacauu

SEQ ID NO: 699479 - RNA, 19 nt, Homo sapiens
acaaauaacacaacuggaa

SEQ ID NO: 699480 - RNA, 19 nt, Homo sapiens
caugaauccucagaaagua

SEQ ID NO: 699481 - RNA, 19 nt, Homo sapiens
gaacugacggauacaaaca

SEQ ID NO: 699482 - RNA, 19 nt, Homo sapiens
ggaaguguccuaagagaag

SEQ ID NO: 699483 - RNA, 19 nt, Homo sapiens
gcagugguuuagcuacauu

SEQ ID NO: 699484 - RNA, 19 nt, Homo sapiens
gcagucaaagccaucauaa

SEQ ID NO: 699485 - RNA, 19 nt, Homo sapiens
cacaacacauggcuucauu

SEQ ID NO: 699486 - RNA, 19 nt, Homo sapiens
gugcaugucugugaaauag

SEQ ID NO: 699487 - RNA, 19 nt, Homo sapiens
gcagcauucuuauuaugga

SEQ ID NO: 699488 - RNA, 19 nt, Homo sapiens
accacaaccuucucaauaa

SEQ ID NO: 699489 - RNA, 19 nt, Homo sapiens
ccacauggacaucggagua

SEQ ID NO: 699490 - RNA, 19 nt, Homo sapiens
ggagcaauguaaaugaauc

SEQ ID NO: 699491 - RNA, 19 nt, Homo sapiens
gaaacaagaaugaaagaac

SEQ ID NO: 699492 - RNA, 19 nt, Homo sapiens
gcaaugagagcaguaacaa

SEQ ID NO: 699493 - RNA, 19 nt, Homo sapiens
gacauaaccugagauggau

SEQ ID NO: 699494 - RNA, 19 nt, Homo sapiens
caaaugcacagaugacaga

SEQ ID NO: 699495 - RNA, 19 nt, Homo sapiens
gaacuaugaaggcacaaug

SEQ ID NO: 699496 - RNA, 19 nt, Homo sapiens
caacaucgauaguguauua

SEQ ID NO: 699497 - RNA, 19 nt, Homo sapiens
gacaauggcucaucgagua

SEQ ID NO: 699498 - RNA, 19 nt, Homo sapiens
caacauugccuacuuauuu

SEQ ID NO: 699499 - RNA, 19 nt, Homo sapiens
gauaacauguccacuguaa

SEQ ID NO: 699500 - RNA, 19 nt, Homo sapiens
ugaagaaggugaacaguuu

SEQ ID NO: 699501 - RNA, 19 nt, Homo sapiens
gaaacagccuggaagauau

SEQ ID NO: 699502 - RNA, 19 nt, Homo sapiens
aaacaacauugccuacuua

SEQ ID NO: 699503 - RNA, 19 nt, Homo sapiens
gcuauuaaaugcuacagua

SEQ ID NO: 699504 - RNA, 19 nt, Homo sapiens
ggaaacagccuggaagaua

SEQ ID NO: 699505 - RNA, 19 nt, Homo sapiens
uaacacaacuggaauuuca

SEQ ID NO: 699506 - RNA, 19 nt, Homo sapiens
ggucacaaauggauacuuu

SEQ ID NO: 699507 - RNA, 19 nt, Homo sapiens
ugagagcaguaacaaauua

SEQ ID NO: 699508 - RNA, 19 nt, Homo sapiens
ccauugggaugauuucuua

SEQ ID NO: 699509 - RNA, 19 nt, Homo sapiens
cgucaaggcuuacaucaaa

SEQ ID NO: 699510 - RNA, 19 nt, Homo sapiens
caauaaaggucacaaaugg

SEQ ID NO: 699511 - RNA, 19 nt, Homo sapiens
gauaucaccuggacagcua

SEQ ID NO: 699512 - RNA, 19 nt, Homo sapiens
cagaaacccucucaucaaa

SEQ ID NO: 699513 - RNA, 19 nt, Homo sapiens
gaaagaugcauaugaagaa

SEQ ID NO: 699514 - RNA, 19 nt, Homo sapiens
ggacauaaccugagaugga

SEQ ID NO: 699515 - RNA, 19 nt, Homo sapiens
ugagauggauucuuacauu

SEQ ID NO: 699516 - RNA, 19 nt, Homo sapiens
uaucaacgaugguguacua

SEQ ID NO: 699517 - RNA, 19 nt, Homo sapiens
aaccugagauggauucuua

SEQ ID NO: 699518 - RNA, 19 nt, Homo sapiens
cuauauggcuugcaaugua

SEQ ID NO: 699519 - RNA, 19 nt, Homo sapiens
gaaaccagauuuaaacaac

SEQ ID NO: 699520 - RNA, 19 nt, Homo sapiens
ugaaauuccugcaagauga

SEQ ID NO: 699521 - RNA, 19 nt, Homo sapiens
ggacagcuaugagcaauca

SEQ ID NO: 699522 - RNA, 19 nt, Homo sapiens
caaacaacauugccuacuu

SEQ ID NO: 699523 - RNA, 19 nt, Homo sapiens
ggacgaagacgaagaggaa

SEQ ID NO: 699524 - RNA, 19 nt, Homo sapiens
gaaggacauucaaaccaaa

SEQ ID NO: 699525 - RNA, 19 nt, Homo sapiens
ucggcaagaucaagaauua

SEQ ID NO: 699526 - RNA, 19 nt, Homo sapiens
cagaggacauugcaauaaa

SEQ ID NO: 699527 - RNA, 19 nt, Homo sapiens
gcaacauacugguggauga

SEQ ID NO: 699528 - RNA, 19 nt, Homo sapiens
ggagugagauuucuucaac

SEQ ID NO: 699529 - RNA, 19 nt, Homo sapiens
ugaagaauauggucaaauc

SEQ ID NO: 699530 - RNA, 19 nt, Homo sapiens
gcaauaaaggucacaaaug

SEQ ID NO: 699531 - RNA, 19 nt, Homo sapiens
gaauaugacacuccagaaa

SEQ ID NO: 699532 - RNA, 19 nt, Homo sapiens
gcacuuacgauaaccaauu

SEQ ID NO: 699533 - RNA, 19 nt, Homo sapiens
ugaaauagcagaaggcauu

SEQ ID NO: 699534 - RNA, 19 nt, Homo sapiens
uacauucgcucuccuguuu

SEQ ID NO: 699535 - RNA, 19 nt, Homo sapiens
gggaugauuucuuaugcua

SEQ ID NO: 699536 - RNA, 19 nt, Homo sapiens
ggacaucggaguacaguau

SEQ ID NO: 699537 - RNA, 19 nt, Homo sapiens
ccugaaagaugcauaugaa

SEQ ID NO: 699538 - RNA, 19 nt, Homo sapiens
uggaugaacacacuuauua

SEQ ID NO: 699539 - RNA, 19 nt, Homo sapiens
acacuacguucuagacuuu

SEQ ID NO: 699540 - RNA, 19 nt, Homo sapiens
ugaauuggguugugaggaa

SEQ ID NO: 699541 - RNA, 19 nt, Homo sapiens
cuaaucaacucaugugguu

SEQ ID NO: 699542 - RNA, 19 nt, Homo sapiens
gagauuucuucaaccauuu

SEQ ID NO: 699543 - RNA, 19 nt, Homo sapiens
gccagauauugacuuauua

SEQ ID NO: 699544 - RNA, 19 nt, Homo sapiens
cggcagaccugguuauugu

SEQ ID NO: 699545 - RNA, 19 nt, Homo sapiens
gcaugaaaccagauuuaaa

SEQ ID NO: 699546 - RNA, 19 nt, Homo sapiens
ggacagaggcagagaaucu

SEQ ID NO: 699547 - RNA, 19 nt, Homo sapiens
ucagccagauauugacuua

SEQ ID NO: 699548 - RNA, 19 nt, Homo sapiens
ucaaagccaucauaagugu

SEQ ID NO: 699549 - RNA, 19 nt, Homo sapiens
gaaacccucucaucaaagg

SEQ ID NO: 699550 - RNA, 19 nt, Homo sapiens
uaacauguccacuguaaug

SEQ ID NO: 699551 - RNA, 19 nt, Homo sapiens
ggaggaaacaagaaugaaa

SEQ ID NO: 699552 - RNA, 19 nt, Homo sapiens
gaaaguaaagccuccugaa

SEQ ID NO: 699553 - RNA, 19 nt, Homo sapiens
gguguugccuuuuauuuua

SEQ ID NO: 699554 - RNA, 19 nt, Homo sapiens
ggaguacaguauaaacaau

SEQ ID NO: 699555 - RNA, 19 nt, Homo sapiens
caacuuagucgccauugaa

SEQ ID NO: 699556 - RNA, 19 nt, Homo sapiens
cagaaggcauuguuucaga

SEQ ID NO: 699557 - RNA, 19 nt, Homo sapiens
gagauggauucuuacauuc

SEQ ID NO: 699558 - RNA, 19 nt, Homo sapiens
gugaacaguuuccugacua

SEQ ID NO: 699559 - RNA, 19 nt, Homo sapiens
ggaggaagaugaggaugau

SEQ ID NO: 699560 - RNA, 19 nt, Homo sapiens
aaaguucacuggagcaaug

SEQ ID NO: 699561 - RNA, 19 nt, Homo sapiens
gaguuucucuugagugaug

SEQ ID NO: 699562 - RNA, 19 nt, Homo sapiens
gcgugauucugcucuauaa

SEQ ID NO: 699563 - RNA, 19 nt, Homo sapiens
ugagauuucuucaaccauu

SEQ ID NO: 699564 - RNA, 19 nt, Homo sapiens
uagaugcgguugucacuga

SEQ ID NO: 699565 - RNA, 19 nt, Homo sapiens
cacuuacgauaaccaauua

SEQ ID NO: 699566 - RNA, 19 nt, Homo sapiens
ggucuucuguaugcacuua

SEQ ID NO: 699567 - RNA, 19 nt, Homo sapiens
gcaucuauagcauccauua

SEQ ID NO: 699568 - RNA, 19 nt, Homo sapiens
caccacaaccuucucaaua

SEQ ID NO: 699569 - RNA, 19 nt, Homo sapiens
gcacgagcgcuguaucaaa

SEQ ID NO: 699570 - RNA, 19 nt, Homo sapiens
ggugaaaguucgcuuccuu

SEQ ID NO: 699571 - RNA, 19 nt, Homo sapiens
uugcucagcugaagaauau

SEQ ID NO: 699572 - RNA, 19 nt, Homo sapiens
gaacauuggccacaagaag

SEQ ID NO: 699573 - RNA, 19 nt, Homo sapiens
ggacuaaaaugccauggaa

SEQ ID NO: 699574 - RNA, 19 nt, Homo sapiens
ggccauguauucaagagaa

SEQ ID NO: 699575 - RNA, 19 nt, Homo sapiens
gaagcaaccagaaguagga

SEQ ID NO: 699576 - RNA, 19 nt, Homo sapiens
ggacagagacagcuauuuu

SEQ ID NO: 699577 - RNA, 19 nt, Homo sapiens
ggaaaacacuuaugaaucg

SEQ ID NO: 699578 - RNA, 19 nt, Homo sapiens
gagaaggaacuuugaagga

SEQ ID NO: 699579 - RNA, 19 nt, Homo sapiens
cagcuguucuugcuacauu

SEQ ID NO: 699580 - RNA, 19 nt, Homo sapiens
acaaauaacacaacuggaa

SEQ ID NO: 699581 - RNA, 19 nt, Homo sapiens
caugaauccucagaaagua

SEQ ID NO: 699582 - RNA, 19 nt, Homo sapiens
gaacugacggauacaaaca

SEQ ID NO: 699583 - RNA, 19 nt, Homo sapiens
ggaaguguccuaagagaag

SEQ ID NO: 699584 - RNA, 19 nt, Homo sapiens
gcagugguuuagcuacauu

SEQ ID NO: 699585 - RNA, 19 nt, Homo sapiens
gcagucaaagccaucauaa

SEQ ID NO: 699586 - RNA, 19 nt, Homo sapiens
cacaacacauggcuucauu

SEQ ID NO: 699587 - RNA, 19 nt, Homo sapiens
gugcaugucugugaaauag

SEQ ID NO: 699588 - RNA, 19 nt, Homo sapiens
gcagcauucuuauuaugga

SEQ ID NO: 699589 - RNA, 19 nt, Homo sapiens
accacaaccuucucaauaa

SEQ ID NO: 699590 - RNA, 19 nt, Homo sapiens
ccacauggacaucggagua

SEQ ID NO: 699591 - RNA, 19 nt, Homo sapiens
ggagcaauguaaaugaauc

SEQ ID NO: 699592 - RNA, 19 nt, Homo sapiens
gaaacaagaaugaaagaac

SEQ ID NO: 699593 - RNA, 19 nt, Homo sapiens
gcaaugagagcaguaacaa

SEQ ID NO: 699594 - RNA, 19 nt, Homo sapiens
caaaugcacagaugacaga

SEQ ID NO: 699595 - RNA, 19 nt, Homo sapiens
gaacuaugaaggcacaaug

SEQ ID NO: 699596 - RNA, 19 nt, Homo sapiens
caacaucgauaguguauua

SEQ ID NO: 699597 - RNA, 19 nt, Homo sapiens
caacauugccuacuuauuu

SEQ ID NO: 699598 - RNA, 19 nt, Homo sapiens
gauaacauguccacuguaa

SEQ ID NO: 699599 - RNA, 19 nt, Homo sapiens
ugaagaaggugaacaguuu

SEQ ID NO: 699600 - RNA, 19 nt, Homo sapiens
aaacaacauugccuacuua

SEQ ID NO: 699601 - RNA, 19 nt, Homo sapiens
gcuauuaaaugcuacagua

SEQ ID NO: 699602 - RNA, 19 nt, Homo sapiens
uaacacaacuggaauuuca

SEQ ID NO: 699603 - RNA, 19 nt, Homo sapiens
caccgugucucuucuauua

SEQ ID NO: 699604 - RNA, 19 nt, Homo sapiens
ugagagcaguaacaaauua

SEQ ID NO: 699605 - RNA, 19 nt, Homo sapiens
ccauugggaugauuucuua

SEQ ID NO: 699606 - RNA, 19 nt, Homo sapiens
cgucaaggcuuacaucaaa

SEQ ID NO: 699607 - RNA, 19 nt, Homo sapiens
cagaaacccucucaucaaa

SEQ ID NO: 699608 - RNA, 19 nt, Homo sapiens
gaaagaugcauaugaagaa

SEQ ID NO: 699609 - RNA, 19 nt, Homo sapiens
ggacauaaccugagaugga

SEQ ID NO: 699610 - RNA, 19 nt, Homo sapiens
ugagauggauucuuacauu

SEQ ID NO: 699611 - RNA, 19 nt, Homo sapiens
uaucaacgaugguguacua

SEQ ID NO: 699612 - RNA, 19 nt, Homo sapiens
aaccugagauggauucuua

SEQ ID NO: 699613 - RNA, 19 nt, Homo sapiens
cuauauggcuugcaaugua

SEQ ID NO: 699614 - RNA, 19 nt, Homo sapiens
gaaaccagauuuaaacaac

SEQ ID NO: 699615 - RNA, 19 nt, Homo sapiens
ugaaauuccugcaagauga

SEQ ID NO: 699616 - RNA, 19 nt, Homo sapiens
caaacaacauugccuacuu

SEQ ID NO: 699617 - RNA, 19 nt, Homo sapiens
ggacgaagacgaagaggaa

SEQ ID NO: 699618 - RNA, 19 nt, Homo sapiens
gaaggacauucaaaccaaa

SEQ ID NO: 699619 - RNA, 19 nt, Homo sapiens
ucggcaagaucaagaauua

SEQ ID NO: 699620 - RNA, 19 nt, Homo sapiens
gcaacauacugguggauga

SEQ ID NO: 699621 - RNA, 19 nt, Homo sapiens
ggagugagauuucuucaac

SEQ ID NO: 699622 - RNA, 19 nt, Homo sapiens
gugauacugucccaaauuu

SEQ ID NO: 699623 - RNA, 19 nt, Homo sapiens
ugaagaauauggucaaauc

SEQ ID NO: 699624 - RNA, 19 nt, Homo sapiens
gcacuuacgauaaccaauu

SEQ ID NO: 699625 - RNA, 19 nt, Homo sapiens
ugaaauagcagaaggcauu

SEQ ID NO: 699626 - RNA, 19 nt, Homo sapiens
uacauucgcucuccuguuu

SEQ ID NO: 699627 - RNA, 19 nt, Homo sapiens
gggaugauuucuuaugcua

SEQ ID NO: 699628 - RNA, 19 nt, Homo sapiens
ggacaucggaguacaguau

SEQ ID NO: 699629 - RNA, 19 nt, Homo sapiens
ccugaaagaugcauaugaa

SEQ ID NO: 699630 - RNA, 19 nt, Homo sapiens
uggaugaacacacuuauua

SEQ ID NO: 699631 - RNA, 19 nt, Homo sapiens
acacuacguucuagacuuu

SEQ ID NO: 699632 - RNA, 19 nt, Homo sapiens
ugaauuggguugugaggaa

SEQ ID NO: 699633 - RNA, 19 nt, Homo sapiens
cuaaucaacucaugugguu

SEQ ID NO: 699634 - RNA, 19 nt, Homo sapiens
gagauuucuucaaccauuu

SEQ ID NO: 699635 - RNA, 19 nt, Homo sapiens
gccagauauugacuuauua

SEQ ID NO: 699636 - RNA, 19 nt, Homo sapiens
ugucacaaauggauacuuu

SEQ ID NO: 699637 - RNA, 19 nt, Homo sapiens
gcaugaaaccagauuuaaa

SEQ ID NO: 699638 - RNA, 19 nt, Homo sapiens
ggacagaggcagagaaucu

SEQ ID NO: 699639 - RNA, 19 nt, Homo sapiens
ucagccagauauugacuua

SEQ ID NO: 699640 - RNA, 19 nt, Homo sapiens
ucaaagccaucauaagugu

SEQ ID NO: 699641 - RNA, 19 nt, Homo sapiens
gaaacccucucaucaaagg

SEQ ID NO: 699642 - RNA, 19 nt, Homo sapiens
uaacauguccacuguaaug

SEQ ID NO: 699643 - RNA, 19 nt, Homo sapiens
ggaggaaacaagaaugaaa

SEQ ID NO: 699644 - RNA, 19 nt, Homo sapiens
gaaaguaaagccuccugaa

SEQ ID NO: 699645 - RNA, 19 nt, Homo sapiens
gguguugccuuuuauuuua

SEQ ID NO: 699646 - RNA, 19 nt, Homo sapiens
ggaguacaguauaaacaau

SEQ ID NO: 699647 - RNA, 19 nt, Homo sapiens
caacuuagucgccauugaa

SEQ ID NO: 699648 - RNA, 19 nt, Homo sapiens
cagaaggcauuguuucaga

SEQ ID NO: 699649 - RNA, 19 nt, Homo sapiens
gagauggauucuuacauuc

SEQ ID NO: 699650 - RNA, 19 nt, Homo sapiens
gugaacaguuuccugacua

SEQ ID NO: 699651 - RNA, 19 nt, Homo sapiens
ggaggaagaugaggaugau

SEQ ID NO: 699652 - RNA, 19 nt, Homo sapiens
aaaguucacuggagcaaug

SEQ ID NO: 699653 - RNA, 19 nt, Homo sapiens
gaguuucucuugagugaug

SEQ ID NO: 699654 - RNA, 19 nt, Homo sapiens
gcgugauucugcucuauaa

SEQ ID NO: 699655 - RNA, 19 nt, Homo sapiens
ugagauuucuucaaccauu

SEQ ID NO: 699656 - RNA, 19 nt, Homo sapiens
uagaugcgguugucacuga

SEQ ID NO: 699657 - RNA, 19 nt, Homo sapiens
cacuuacgauaaccaauua

SEQ ID NO: 699658 - RNA, 19 nt, Homo sapiens
ggucuucuguaugcacuua

SEQ ID NO: 699659 - RNA, 19 nt, Homo sapiens
gcaucuauagcauccauua

SEQ ID NO: 699660 - RNA, 19 nt, Homo sapiens
caccacaaccuucucaaua

SEQ ID NO: 699661 - RNA, 19 nt, Homo sapiens
gcacgagcgcuguaucaaa

SEQ ID NO: 699662 - RNA, 19 nt, Homo sapiens
ggugaaaguucgcuuccuu

SEQ ID NO: 699663 - RNA, 19 nt, Homo sapiens
uugcucagcugaagaauau

SEQ ID NO: 699664 - RNA, 19 nt, Homo sapiens
gaacauuggccacaagaag

SEQ ID NO: 699665 - RNA, 19 nt, Homo sapiens
ggacuaaaaugccauggaa

SEQ ID NO: 699666 - RNA, 19 nt, Homo sapiens
ggccauguauucaagagaa

SEQ ID NO: 699667 - RNA, 19 nt, Homo sapiens
gaagcaaccagaaguagga

SEQ ID NO: 699668 - RNA, 19 nt, Homo sapiens
gaagcacacuggaguuguc

SEQ ID NO: 699669 - RNA, 19 nt, Homo sapiens
ggacagagacagcuauuuu

SEQ ID NO: 699670 - RNA, 19 nt, Homo sapiens
ggaaaacacuuaugaaucg

SEQ ID NO: 699671 - RNA, 19 nt, Homo sapiens
gagaaggaacuuugaagga

SEQ ID NO: 699672 - RNA, 19 nt, Homo sapiens
cagcuguucuugcuacauu

SEQ ID NO: 699673 - RNA, 19 nt, Homo sapiens
acaaauaacacaacuggaa

SEQ ID NO: 699674 - RNA, 19 nt, Homo sapiens
caugaauccucagaaagua

SEQ ID NO: 699675 - RNA, 19 nt, Homo sapiens
gaacugacggauacaaaca

SEQ ID NO: 699676 - RNA, 19 nt, Homo sapiens
ggaaguguccuaagagaag

SEQ ID NO: 699677 - RNA, 19 nt, Homo sapiens
gcagugguuuagcuacauu

SEQ ID NO: 699678 - RNA, 19 nt, Homo sapiens
gcagucaaagccaucauaa

SEQ ID NO: 699679 - RNA, 19 nt, Homo sapiens
cacaacacauggcuucauu

SEQ ID NO: 699680 - RNA, 19 nt, Homo sapiens
gugcaugucugugaaauag

SEQ ID NO: 699681 - RNA, 19 nt, Homo sapiens
gcagcauucuuauuaugga

SEQ ID NO: 699682 - RNA, 19 nt, Homo sapiens
accacaaccuucucaauaa

SEQ ID NO: 699683 - RNA, 19 nt, Homo sapiens
ccacauggacaucggagua

SEQ ID NO: 699684 - RNA, 19 nt, Homo sapiens
ggagcaauguaaaugaauc

SEQ ID NO: 699685 - RNA, 19 nt, Homo sapiens
gaaacaagaaugaaagaac

SEQ ID NO: 699686 - RNA, 19 nt, Homo sapiens
gcaaugagagcaguaacaa

SEQ ID NO: 699687 - RNA, 19 nt, Homo sapiens
caaaugcacagaugacaga

SEQ ID NO: 699688 - RNA, 19 nt, Homo sapiens
gaacuaugaaggcacaaug

SEQ ID NO: 699689 - RNA, 19 nt, Homo sapiens
gaaggacucaccaccauuc

SEQ ID NO: 699690 - RNA, 19 nt, Homo sapiens
uauggaagcugaccaaacu

SEQ ID NO: 699691 - RNA, 19 nt, Homo sapiens
gacauaaccugagauggau

SEQ ID NO: 699692 - RNA, 19 nt, Homo sapiens
ccuggucccucaugucuuu

SEQ ID NO: 699693 - RNA, 19 nt, Homo sapiens
ccucaugucuuucuguugu

SEQ ID NO: 699694 - RNA, 19 nt, Homo sapiens
gaaaggcaucaaacuucua

SEQ ID NO: 699695 - RNA, 19 nt, Homo sapiens
aaaucggacuccaucuaua

SEQ ID NO: 699696 - RNA, 19 nt, Homo sapiens
aauaaagggugaacuguua

SEQ ID NO: 699697 - RNA, 19 nt, Homo sapiens
aaugugagcuucaaguaua

SEQ ID NO: 699698 - RNA, 19 nt, Homo sapiens
ccaaggcugucaccaagua

SEQ ID NO: 699699 - RNA, 19 nt, Homo sapiens
acaccaaacuggaauuaaa

SEQ ID NO: 699700 - RNA, 19 nt, Homo sapiens
gcagcucuguugcgacaua

SEQ ID NO: 699701 - RNA, 19 nt, Homo sapiens
gaagaaaugaggaagauca

SEQ ID NO: 699702 - RNA, 19 nt, Homo sapiens
ggccuugcaucuacaauaa

SEQ ID NO: 699703 - RNA, 19 nt, Homo sapiens
gaacuacauugcgagguuu

SEQ ID NO: 699704 - RNA, 19 nt, Homo sapiens
ccaaggagcuagaggacuu

SEQ ID NO: 699705 - RNA, 19 nt, Homo sapiens
gaaggaggcugccaaagcu

SEQ ID NO: 699706 - RNA, 19 nt, Homo sapiens
guuauggccucauugguuu

SEQ ID NO: 699707 - RNA, 19 nt, Homo sapiens
ggagaagacgcuacagaaa

SEQ ID NO: 699708 - RNA, 19 nt, Homo sapiens
gcaagaagcuaaaagacuu

SEQ ID NO: 699709 - RNA, 19 nt, Homo sapiens
ggcuagagcuggaggagaa

SEQ ID NO: 699710 - RNA, 19 nt, Homo sapiens
gcagagagaccacagaagu

SEQ ID NO: 699711 - RNA, 19 nt, Homo sapiens
gcugcuaacuggagagcua

SEQ ID NO: 699712 - RNA, 19 nt, Homo sapiens
ggaagaucauugggcgaua

SEQ ID NO: 699713 - RNA, 19 nt, Homo sapiens
gaaaaggacaugaagaaaa

SEQ ID NO: 699714 - RNA, 19 nt, Homo sapiens
caaguggccuggagacauc

SEQ ID NO: 699715 - RNA, 19 nt, Homo sapiens
ccaaucaccuggauaucga

SEQ ID NO: 699716 - RNA, 19 nt, Homo sapiens
gaucagauugcacacauga

SEQ ID NO: 699717 - RNA, 19 nt, Homo sapiens
gaggagaaccagaugaaga

SEQ ID NO: 699718 - RNA, 19 nt, Homo sapiens
gaaauuugggucugugaga

SEQ ID NO: 699719 - RNA, 19 nt, Homo sapiens
aagagcagcuggacuuaga

SEQ ID NO: 699720 - RNA, 19 nt, Homo sapiens
cuagaggacuuugagauga

SEQ ID NO: 699721 - RNA, 19 nt, Homo sapiens
cuggagacauccuggcuua

SEQ ID NO: 699722 - RNA, 19 nt, Homo sapiens
guaccaauaucauucacau

SEQ ID NO: 699723 - RNA, 19 nt, Homo sapiens
gggccaugcuggagaaaga

SEQ ID NO: 699724 - RNA, 19 nt, Homo sapiens
uagauuugcugaccaagga

SEQ ID NO: 699725 - RNA, 19 nt, Homo sapiens
gagacauccuggcuuacaa

SEQ ID NO: 699726 - RNA, 19 nt, Homo sapiens
gagagggucgugagcgaua

SEQ ID NO: 699727 - RNA, 19 nt, Homo sapiens
aaauggagauguugucaca

SEQ ID NO: 699728 - RNA, 19 nt, Homo sapiens
gcaccaaggcugucaccaa

SEQ ID NO: 699729 - RNA, 19 nt, Homo sapiens
acuuagaucucucaccuuu

SEQ ID NO: 699730 - RNA, 19 nt, Homo sapiens
gaccacagaaguagauuug

SEQ ID NO: 699731 - RNA, 19 nt, Homo sapiens
aucaugaacucguuuguaa

SEQ ID NO: 699732 - RNA, 19 nt, Homo sapiens
gcguuaccaucagcauuua

SEQ ID NO: 699733 - RNA, 19 nt, Homo sapiens
cgaaaacacucucauguca

SEQ ID NO: 699734 - RNA, 19 nt, Homo sapiens
cagauggcaugauccgaaa

SEQ ID NO: 699735 - RNA, 19 nt, Homo sapiens
caaccucucacuuaccuuu

SEQ ID NO: 699736 - RNA, 19 nt, Homo sapiens
ccuccgaccuggccaagaa

SEQ ID NO: 699737 - RNA, 19 nt, Homo sapiens
gaagaucauugggcgauac

SEQ ID NO: 699738 - RNA, 19 nt, Homo sapiens
agaacuacauugcgagguu

SEQ ID NO: 699739 - RNA, 19 nt, Homo sapiens
uagaggacuuugagaugaa

SEQ ID NO: 699740 - RNA, 19 nt, Homo sapiens
ccaaccaccuggaccuaga

SEQ ID NO: 699741 - RNA, 19 nt, Homo sapiens
uaaauggaauuggaaaguc

SEQ ID NO: 699742 - RNA, 19 nt, Homo sapiens
cagagagaccacagaagua

SEQ ID NO: 699743 - RNA, 19 nt, Homo sapiens
guacaccagcuccaaguga

SEQ ID NO: 699744 - RNA, 19 nt, Homo sapiens
uggaguacaugaugaagug

SEQ ID NO: 699745 - RNA, 19 nt, Homo sapiens
acacucucaugucaagaua

SEQ ID NO: 699746 - RNA, 19 nt, Homo sapiens
gcaaggagaagacgcuaca

SEQ ID NO: 699747 - RNA, 19 nt, Homo sapiens
uugcacacaugaagaacua

SEQ ID NO: 699748 - RNA, 19 nt, Homo sapiens
gcagaagugccgagugugu

SEQ ID NO: 699749 - RNA, 19 nt, Homo sapiens
acccagagaucaaggagaa

SEQ ID NO: 699750 - RNA, 19 nt, Homo sapiens
ggagcuggaugccgacaag

SEQ ID NO: 699751 - RNA, 19 nt, Homo sapiens
caaacuggaauuaaacuca

SEQ ID NO: 699752 - RNA, 19 nt, Homo sapiens
gcuagaggacuuugagaug

SEQ ID NO: 699753 - RNA, 19 nt, Homo sapiens
uugagcagcuggcguguga

SEQ ID NO: 699754 - RNA, 19 nt, Homo sapiens
ccaccaaucaccuggauau

SEQ ID NO: 699755 - RNA, 19 nt, Homo sapiens
ucaaggagaaggaagaaau

SEQ ID NO: 699756 - RNA, 19 nt, Homo sapiens
gaagugcuacccagagauc

SEQ ID NO: 699757 - RNA, 19 nt, Homo sapiens
uuagaucucucaccuuugg

SEQ ID NO: 699758 - RNA, 19 nt, Homo sapiens
caacaagaaacugaaguau

SEQ ID NO: 699759 - RNA, 19 nt, Homo sapiens
ugauggaagucgacacaga

SEQ ID NO: 699760 - RNA, 19 nt, Homo sapiens
gcacaucgacaucuaccau

SEQ ID NO: 699761 - RNA, 19 nt, Homo sapiens
gcagguugcacaggaaauu

SEQ ID NO: 699762 - RNA, 19 nt, Homo sapiens
ggcguuaccaucagcauuu

SEQ ID NO: 699763 - RNA, 19 nt, Homo sapiens
ucacaugcacaacaagaaa

SEQ ID NO: 699764 - RNA, 19 nt, Homo sapiens
ugacaccaaacuggaauua

SEQ ID NO: 699765 - RNA, 19 nt, Homo sapiens
ccacagaaguagauuugcu

SEQ ID NO: 699766 - RNA, 19 nt, Homo sapiens
gggccuugcaucuacaaua

SEQ ID NO: 699767 - RNA, 19 nt, Homo sapiens
gagaagacgcuacagaaaa

SEQ ID NO: 699768 - RNA, 19 nt, Homo sapiens
acaacaagaaacugaagua

SEQ ID NO: 699769 - RNA, 19 nt, Homo sapiens
ccaagcacgcugugucuga

SEQ ID NO: 699770 - RNA, 19 nt, Homo sapiens
caagauagggcguuaccau

SEQ ID NO: 699771 - RNA, 19 nt, Homo sapiens
gagcuacuacccacagaug

SEQ ID NO: 699772 - RNA, 19 nt, Homo sapiens
caagaagaaggcagccaaa

SEQ ID NO: 699773 - RNA, 19 nt, Homo sapiens
uggaugaacccaccaauca

SEQ ID NO: 699774 - RNA, 19 nt, Homo sapiens
caaggagaaggaagaaaug

SEQ ID NO: 699775 - RNA, 19 nt, Homo sapiens
gagagcuacuacccacaga

SEQ ID NO: 699776 - RNA, 19 nt, Homo sapiens
ccagcucccugaaacaaca

SEQ ID NO: 699777 - RNA, 19 nt, Homo sapiens
caucaugaacucguuugua

SEQ ID NO: 699778 - RNA, 19 nt, Homo sapiens
ggagacauccuggcuuaca

SEQ ID NO: 699779 - RNA, 19 nt, Homo sapiens
gaucaaggagaaggaagaa

SEQ ID NO: 699780 - RNA, 19 nt, Homo sapiens
ugaagaaaauggagauguu

SEQ ID NO: 699781 - RNA, 19 nt, Homo sapiens
ucauucacaugcacaacaa

SEQ ID NO: 699782 - RNA, 19 nt, Homo sapiens
aaacucaggccgucguuau

SEQ ID NO: 699783 - RNA, 19 nt, Homo sapiens
gcggcuggcucaugaggau

SEQ ID NO: 699784 - RNA, 19 nt, Homo sapiens
aaauaaagggugaacuguu

SEQ ID NO: 699785 - RNA, 19 nt, Homo sapiens
acaaggagcaccucaaguc

SEQ ID NO: 699786 - RNA, 19 nt, Homo sapiens
aaauuugggucugugagaa

SEQ ID NO: 699787 - RNA, 19 nt, Homo sapiens
gagcagggaagucaacucu

SEQ ID NO: 699788 - RNA, 19 nt, Homo sapiens
gcacaacaagaaacugaag

SEQ ID NO: 699789 - RNA, 19 nt, Homo sapiens
ccaauaucauucacaugca

SEQ ID NO: 699790 - RNA, 19 nt, Homo sapiens
uaaagggugaacuguuaaa

SEQ ID NO: 699791 - RNA, 19 nt, Homo sapiens
gauagggcguuaccaucag

SEQ ID NO: 699792 - RNA, 19 nt, Homo sapiens
guaauuaugaucaguacgu

SEQ ID NO: 699793 - RNA, 19 nt, Homo sapiens
aaagaaggaggcugccaaa

SEQ ID NO: 699794 - RNA, 19 nt, Homo sapiens
gagcaucaugaacucguuu

SEQ ID NO: 699795 - RNA, 19 nt, Homo sapiens
agccaugacuucagacuca

SEQ ID NO: 699796 - RNA, 19 nt, Homo sapiens
ggucccagcugcucugaua

SEQ ID NO: 699797 - RNA, 19 nt, Homo sapiens
aaugugagcuucaaguaua

SEQ ID NO: 699798 - RNA, 19 nt, Homo sapiens
ccaagaacguuaacauuuc

SEQ ID NO: 699799 - RNA, 19 nt, Homo sapiens
gaugggaacugaagacuag

SEQ ID NO: 699800 - RNA, 19 nt, Homo sapiens
gcaaaacccugucucaaaa

SEQ ID NO: 699801 - RNA, 19 nt, Homo sapiens
acaccaaacuggaauuaaa

SEQ ID NO: 699802 - RNA, 19 nt, Homo sapiens
gcagcucuguugcgacaua

SEQ ID NO: 699803 - RNA, 19 nt, Homo sapiens
ucacagacuuuaacaugaa

SEQ ID NO: 699804 - RNA, 19 nt, Homo sapiens
gaagaaaugaggaagauca

SEQ ID NO: 699805 - RNA, 19 nt, Homo sapiens
ggccuugcaucuacaauaa

SEQ ID NO: 699806 - RNA, 19 nt, Homo sapiens
gaacuacauugcgagguuu

SEQ ID NO: 699807 - RNA, 19 nt, Homo sapiens
ccaaggagcuagaggacuu

SEQ ID NO: 699808 - RNA, 19 nt, Homo sapiens
gaaggaggcugccaaagcu

SEQ ID NO: 699809 - RNA, 19 nt, Homo sapiens
cagcguuucugguucaaua

SEQ ID NO: 699810 - RNA, 19 nt, Homo sapiens
cuacaaagcgcccaauaaa

SEQ ID NO: 699811 - RNA, 19 nt, Homo sapiens
gggcuacacuccugcauug

SEQ ID NO: 699812 - RNA, 19 nt, Homo sapiens
guuauggccucauugguuu

SEQ ID NO: 699813 - RNA, 19 nt, Homo sapiens
acaaagcgcccaauaaaga

SEQ ID NO: 699814 - RNA, 19 nt, Homo sapiens
ggagaagacgcuacagaaa

SEQ ID NO: 699815 - RNA, 19 nt, Homo sapiens
gcagugagcugagauugca

SEQ ID NO: 699816 - RNA, 19 nt, Homo sapiens
gcaagaagcuaaaagacuu

SEQ ID NO: 699817 - RNA, 19 nt, Homo sapiens
gagcuuaggauccucguuu

SEQ ID NO: 699818 - RNA, 19 nt, Homo sapiens
ggcuagagcuggaggagaa

SEQ ID NO: 699819 - RNA, 19 nt, Homo sapiens
gcagagagaccacagaagu

SEQ ID NO: 699820 - RNA, 19 nt, Homo sapiens
cauaggagcuggaagaacu

SEQ ID NO: 699821 - RNA, 19 nt, Homo sapiens
gcugcuaacuggagagcua

SEQ ID NO: 699822 - RNA, 19 nt, Homo sapiens
ggaagaucauugggcgaua

SEQ ID NO: 699823 - RNA, 19 nt, Homo sapiens
gaaaaggacaugaagaaaa

SEQ ID NO: 699824 - RNA, 19 nt, Homo sapiens
caguugggcugcuuguuaa

SEQ ID NO: 699825 - RNA, 19 nt, Homo sapiens
caaguggccuggagacauc

SEQ ID NO: 699826 - RNA, 19 nt, Homo sapiens
ccaaucaccuggauaucga

SEQ ID NO: 699827 - RNA, 19 nt, Homo sapiens
gaucagauugcacacauga

SEQ ID NO: 699828 - RNA, 19 nt, Homo sapiens
gaggagaaccagaugaaga

SEQ ID NO: 699829 - RNA, 19 nt, Homo sapiens
gauaagaggaggcucacuu

SEQ ID NO: 699830 - RNA, 19 nt, Homo sapiens
gaaauuugggucugugaga

SEQ ID NO: 699831 - RNA, 19 nt, Homo sapiens
aagagcagcuggacuuaga

SEQ ID NO: 699832 - RNA, 19 nt, Homo sapiens
cuagaggacuuugagauga

SEQ ID NO: 699833 - RNA, 19 nt, Homo sapiens
gaccaagaacguuaacauu

SEQ ID NO: 699834 - RNA, 19 nt, Homo sapiens
cuggagacauccuggcuua

SEQ ID NO: 699835 - RNA, 19 nt, Homo sapiens
guaccaauaucauucacau

SEQ ID NO: 699836 - RNA, 19 nt, Homo sapiens
gggccaugcuggagaaaga

SEQ ID NO: 699837 - RNA, 19 nt, Homo sapiens
uagauuugcugaccaagga

SEQ ID NO: 699838 - RNA, 19 nt, Homo sapiens
gagacauccuggcuuacaa

SEQ ID NO: 699839 - RNA, 19 nt, Homo sapiens
gagagggucgugagcgaua

SEQ ID NO: 699840 - RNA, 19 nt, Homo sapiens
aaauggagauguugucaca

SEQ ID NO: 699841 - RNA, 19 nt, Homo sapiens
acuuagaucucucaccuuu

SEQ ID NO: 699842 - RNA, 19 nt, Homo sapiens
gaccacagaaguagauuug

SEQ ID NO: 699843 - RNA, 19 nt, Homo sapiens
ccuccgaccuggccaagaa

SEQ ID NO: 699844 - RNA, 19 nt, Homo sapiens
gaacugaagacuaguccau

SEQ ID NO: 699845 - RNA, 19 nt, Homo sapiens
cagaggcaccugcggguua

SEQ ID NO: 699846 - RNA, 19 nt, Homo sapiens
gcguuaccaucagcauuua

SEQ ID NO: 699847 - RNA, 19 nt, Homo sapiens
cgaaaacacucucauguca

SEQ ID NO: 699848 - RNA, 19 nt, Homo sapiens
cagauggcaugauccgaaa

SEQ ID NO: 699849 - RNA, 19 nt, Homo sapiens
caaccucucacuuaccuuu

SEQ ID NO: 699850 - RNA, 19 nt, Homo sapiens
caauugagccuagaaguuc

SEQ ID NO: 699851 - RNA, 19 nt, Homo sapiens
caaagcgcccaauaaagaa

SEQ ID NO: 699852 - RNA, 19 nt, Homo sapiens
gaagaucauugggcgauac

SEQ ID NO: 699853 - RNA, 19 nt, Homo sapiens
agaacuacauugcgagguu

SEQ ID NO: 699854 - RNA, 19 nt, Homo sapiens
uagaggacuuugagaugaa

SEQ ID NO: 699855 - RNA, 19 nt, Homo sapiens
ccaaccaccuggaccuaga

SEQ ID NO: 699856 - RNA, 19 nt, Homo sapiens
uaaauggaauuggaaaguc

SEQ ID NO: 699857 - RNA, 19 nt, Homo sapiens
cagagagaccacagaagua

SEQ ID NO: 699858 - RNA, 19 nt, Homo sapiens
uggaguacaugaugaagug

SEQ ID NO: 699859 - RNA, 19 nt, Homo sapiens
acacucucaugucaagaua

SEQ ID NO: 699860 - RNA, 19 nt, Homo sapiens
gcaaggagaagacgcuaca

SEQ ID NO: 699861 - RNA, 19 nt, Homo sapiens
uugcacacaugaagaacua

SEQ ID NO: 699862 - RNA, 19 nt, Homo sapiens
acuguaagcucaucaccuu

SEQ ID NO: 699863 - RNA, 19 nt, Homo sapiens
gcagaagugccgagugugu

SEQ ID NO: 699864 - RNA, 19 nt, Homo sapiens
acccagagaucaaggagaa

SEQ ID NO: 699865 - RNA, 19 nt, Homo sapiens
ggagcuggaugccgacaag

SEQ ID NO: 699866 - RNA, 19 nt, Homo sapiens
caaacuggaauuaaacuca

SEQ ID NO: 699867 - RNA, 19 nt, Homo sapiens
gcuagaggacuuugagaug

SEQ ID NO: 699868 - RNA, 19 nt, Homo sapiens
ucaauugagccuagaaguu

SEQ ID NO: 699869 - RNA, 19 nt, Homo sapiens
ccaccaaucaccuggauau

SEQ ID NO: 699870 - RNA, 19 nt, Homo sapiens
ucaaggagaaggaagaaau

SEQ ID NO: 699871 - RNA, 19 nt, Homo sapiens
gaagugcuacccagagauc

SEQ ID NO: 699872 - RNA, 19 nt, Homo sapiens
uuagaucucucaccuuugg

SEQ ID NO: 699873 - RNA, 19 nt, Homo sapiens
caacaagaaacugaaguau

SEQ ID NO: 699874 - RNA, 19 nt, Homo sapiens
ugauggaagucgacacaga

SEQ ID NO: 699875 - RNA, 19 nt, Homo sapiens
gcacaucgacaucuaccau

SEQ ID NO: 699876 - RNA, 19 nt, Homo sapiens
gcagguugcacaggaaauu

SEQ ID NO: 699877 - RNA, 19 nt, Homo sapiens
ggcguuaccaucagcauuu

SEQ ID NO: 699878 - RNA, 19 nt, Homo sapiens
ucacaugcacaacaagaaa

SEQ ID NO: 699879 - RNA, 19 nt, Homo sapiens
ccacagaaguagauuugcu

SEQ ID NO: 699880 - RNA, 19 nt, Homo sapiens
ugacaccaaacuggaauua

SEQ ID NO: 699881 - RNA, 19 nt, Homo sapiens
ugaggcagguggaucacuu

SEQ ID NO: 699882 - RNA, 19 nt, Homo sapiens
guuaacauuucuagcaagu

SEQ ID NO: 699883 - RNA, 19 nt, Homo sapiens
gggccuugcaucuacaaua

SEQ ID NO: 699884 - RNA, 19 nt, Homo sapiens
gagaagacgcuacagaaaa

SEQ ID NO: 699885 - RNA, 19 nt, Homo sapiens
acaacaagaaacugaagua

SEQ ID NO: 699886 - RNA, 19 nt, Homo sapiens
gcaaaacccgucuuuaugu

SEQ ID NO: 699887 - RNA, 19 nt, Homo sapiens
accaagaacguuaacauuu

SEQ ID NO: 699888 - RNA, 19 nt, Homo sapiens
ugagugugaugcagucaga

SEQ ID NO: 699889 - RNA, 19 nt, Homo sapiens
caagauagggcguuaccau

SEQ ID NO: 699890 - RNA, 19 nt, Homo sapiens
gagcuacuacccacagaug

SEQ ID NO: 699891 - RNA, 19 nt, Homo sapiens
gagcgugguuuucugauug

SEQ ID NO: 699892 - RNA, 19 nt, Homo sapiens
caagaagaaggcagccaaa

SEQ ID NO: 699893 - RNA, 19 nt, Homo sapiens
ccagcucccugaaacaaca

SEQ ID NO: 699894 - RNA, 19 nt, Homo sapiens
uggaugaacccaccaauca

SEQ ID NO: 699895 - RNA, 19 nt, Homo sapiens
caaggagaaggaagaaaug

SEQ ID NO: 699896 - RNA, 19 nt, Homo sapiens
gaacagauccgccugaaga

SEQ ID NO: 699897 - RNA, 19 nt, Homo sapiens
gaccagggcuccagaaaga

SEQ ID NO: 699898 - RNA, 19 nt, Homo sapiens
agaaagagauguccuugug

SEQ ID NO: 699899 - RNA, 19 nt, Homo sapiens
gaguuugccuugcucauug

SEQ ID NO: 699900 - RNA, 19 nt, Homo sapiens
ggagauaguugacuuugcu

SEQ ID NO: 699901 - RNA, 19 nt, Homo sapiens
ccucaaggauuucaguuau

SEQ ID NO: 699902 - RNA, 19 nt, Homo sapiens
ugacuuugcuaaacagcua

SEQ ID NO: 699903 - RNA, 19 nt, Homo sapiens
gaucugggaugugcacgaa

SEQ ID NO: 699904 - RNA, 19 nt, Homo sapiens
acagagauccguccacaaa

SEQ ID NO: 699905 - RNA, 19 nt, Homo sapiens
ucacugagcuggccaucgu

SEQ ID NO: 699906 - RNA, 19 nt, Homo sapiens
gauaguugacuuugcuaaa

SEQ ID NO: 699907 - RNA, 19 nt, Homo sapiens
gcagcugcauccucagaga

SEQ ID NO: 699908 - RNA, 19 nt, Homo sapiens
caagggagcgcacuacauc

SEQ ID NO: 699909 - RNA, 19 nt, Homo sapiens
ugacauuccuccugacucu

SEQ ID NO: 699910 - RNA, 19 nt, Homo sapiens
gagcugcaacucaaugaug

SEQ ID NO: 699911 - RNA, 19 nt, Homo sapiens
gcaggagauaguugacuuu

SEQ ID NO: 699912 - RNA, 19 nt, Homo sapiens
cucaaggauuucaguuaua

SEQ ID NO: 699913 - RNA, 19 nt, Homo sapiens
gcaaguggaauucaucaac

SEQ ID NO: 699914 - RNA, 19 nt, Homo sapiens
gcacgaaugacuguucugu

SEQ ID NO: 699915 - RNA, 19 nt, Homo sapiens
cagauugcccugcugaaga

SEQ ID NO: 699916 - RNA, 19 nt, Homo sapiens
gcagcgcuuugcccacuuc

SEQ ID NO: 699917 - RNA, 19 nt, Homo sapiens
gaguaucaccuuccucaag

SEQ ID NO: 699918 - RNA, 19 nt, Homo sapiens
gguacaacccugggaguga

SEQ ID NO: 699919 - RNA, 19 nt, Homo sapiens
gggcuuccacuacaauguu

SEQ ID NO: 699920 - RNA, 19 nt, Homo sapiens
guuauaaccgggaagacuu

SEQ ID NO: 699921 - RNA, 19 nt, Homo sapiens
gaagccaggcgcacaggau

SEQ ID NO: 699922 - RNA, 19 nt, Homo sapiens
gauccucccguggcauuaa

SEQ ID NO: 699923 - RNA, 19 nt, Homo sapiens
ucugggaugugcacgaaug

SEQ ID NO: 699924 - RNA, 19 nt, Homo sapiens
ccacggaugcuaaugaaac

SEQ ID NO: 699925 - RNA, 19 nt, Homo sapiens
aagaacagauccgccugaa

SEQ ID NO: 699926 - RNA, 19 nt, Homo sapiens
gcacuacaucugccacagu

SEQ ID NO: 699927 - RNA, 19 nt, Homo sapiens
ugacuguucuguccccaua

SEQ ID NO: 699928 - RNA, 19 nt, Homo sapiens
cgaguuugccuugcucauu

SEQ ID NO: 699929 - RNA, 19 nt, Homo sapiens
uaguugacuuugcuaaaca

SEQ ID NO: 699930 - RNA, 19 nt, Homo sapiens
cggaacaacugggcaugau

SEQ ID NO: 699931 - RNA, 19 nt, Homo sapiens
gcucagcccggaacaacug

SEQ ID NO: 699932 - RNA, 19 nt, Homo sapiens
ucccacggaugcuaaugaa

SEQ ID NO: 699933 - RNA, 19 nt, Homo sapiens
ggccaugaaugagcugcaa

SEQ ID NO: 699934 - RNA, 19 nt, Homo sapiens
cuucagaacccacagagau

SEQ ID NO: 699935 - RNA, 19 nt, Homo sapiens
ugcaggagauaguugacuu

SEQ ID NO: 699936 - RNA, 19 nt, Homo sapiens
gagugucggcuucgcaaau

SEQ ID NO: 699937 - RNA, 19 nt, Homo sapiens
ccagggcuccagaaagaga

SEQ ID NO: 699938 - RNA, 19 nt, Homo sapiens
cgaucgaggugaugcuucu

SEQ ID NO: 699939 - RNA, 19 nt, Homo sapiens
gagauaguugacuuugcua

SEQ ID NO: 699940 - RNA, 19 nt, Homo sapiens
ggaacaacugggcaugauc

SEQ ID NO: 699941 - RNA, 19 nt, Homo sapiens
gaugugcacgaaugacugu

SEQ ID NO: 699942 - RNA, 19 nt, Homo sapiens
gauguucccacggaugcua

SEQ ID NO: 699943 - RNA, 19 nt, Homo sapiens
ucaaugaugccgaguuugc

SEQ ID NO: 699944 - RNA, 19 nt, Homo sapiens
gcuuugcccacuucacuga

SEQ ID NO: 699945 - RNA, 19 nt, Homo sapiens
ccucgggcuuccacuacaa

SEQ ID NO: 699946 - RNA, 19 nt, Homo sapiens
ucuccagggccaugaauga

SEQ ID NO: 699947 - RNA, 19 nt, Homo sapiens
gaguguguccugucagaag

SEQ ID NO: 699948 - RNA, 19 nt, Homo sapiens
gugcacgaaugacuguucu

SEQ ID NO: 699949 - RNA, 19 nt, Homo sapiens
agacaucucggagguacaa

SEQ ID NO: 699950 - RNA, 19 nt, Homo sapiens
uuauaaccgggaagacuuu

SEQ ID NO: 699951 - RNA, 19 nt, Homo sapiens
gggcugcaagggauucuuc

SEQ ID NO: 699952 - RNA, 19 nt, Homo sapiens
caugagagcccuaggauuu

SEQ ID NO: 699953 - RNA, 19 nt, Homo sapiens
gaaaggagaagaacacugu

SEQ ID NO: 699954 - RNA, 19 nt, Homo sapiens
gaagaacacuguggacauc

SEQ ID NO: 699955 - RNA, 19 nt, Homo sapiens
ggaagugacugcggacgaa

SEQ ID NO: 699956 - RNA, 19 nt, Homo sapiens
gaacuuugauauguggaaa

SEQ ID NO: 699957 - RNA, 19 nt, Homo sapiens
gaacacuguggacaucuaa

SEQ ID NO: 699958 - RNA, 19 nt, Homo sapiens
ugagagcccuaggauuuaa

SEQ ID NO: 699959 - RNA, 19 nt, Homo sapiens
ugacgaacuuugauaugug

SEQ ID NO: 699960 - RNA, 19 nt, Homo sapiens
ggucugcugugugaauaaa

SEQ ID NO: 699961 - RNA, 19 nt, Homo sapiens
ucugcugugugaauaaaua

SEQ ID NO: 699962 - RNA, 19 nt, Homo sapiens
ccugaagaaugaagaagau

SEQ ID NO: 699963 - RNA, 19 nt, Homo sapiens
agaacacuguggacaucua

SEQ ID NO: 699964 - RNA, 19 nt, Homo sapiens
guggucugcugugugaaua

SEQ ID NO: 699965 - RNA, 19 nt, Homo sapiens
aaagaugccgggucugguu

SEQ ID NO: 699966 - RNA, 19 nt, Homo sapiens
gcaugagagcccuaggauu

SEQ ID NO: 699967 - RNA, 19 nt, Homo sapiens
acacuguggacaucuaauu

SEQ ID NO: 699968 - RNA, 19 nt, Homo sapiens
uugacgaacuuugauaugu

SEQ ID NO: 699969 - RNA, 19 nt, Homo sapiens
caucgagaaaggagaagaa

SEQ ID NO: 699970 - RNA, 19 nt, Homo sapiens
uaucaucgagaaaggagaa

SEQ ID NO: 699971 - RNA, 19 nt, Homo sapiens
gagagcccuaggauuuaaa

SEQ ID NO: 699972 - RNA, 19 nt, Homo sapiens
cgagaaaggagaagaacac

SEQ ID NO: 699973 - RNA, 19 nt, Homo sapiens
augguggucugcuguguga

SEQ ID NO: 699974 - RNA, 19 nt, Homo sapiens
ccgaggcuggcauagauuu

SEQ ID NO: 699975 - RNA, 19 nt, Homo sapiens
gcggacgaaucggcguuug

SEQ ID NO: 699976 - RNA, 19 nt, Homo sapiens
agaagaacacuguggacau

SEQ ID NO: 699977 - RNA, 19 nt, Homo sapiens
ccacagagcugcuucaucu

SEQ ID NO: 699978 - RNA, 19 nt, Homo sapiens
guagccaacuugcauguga

SEQ ID NO: 699979 - RNA, 19 nt, Homo sapiens
ggugguggcuggcuucuuc

SEQ ID NO: 699980 - RNA, 19 nt, Homo sapiens
uaugcaagaugcucuacua

SEQ ID NO: 699981 - RNA, 19 nt, Homo sapiens
aggaagaacuggacaggaa

SEQ ID NO: 699982 - RNA, 19 nt, Homo sapiens
cagcagaaccuuccacaga

SEQ ID NO: 699983 - RNA, 19 nt, Homo sapiens
ugucuacacuggauaauca

SEQ ID NO: 699984 - RNA, 19 nt, Homo sapiens
ggacagcgguuggauugca

SEQ ID NO: 699985 - RNA, 19 nt, Homo sapiens
ggaauuaguccuccucucu

SEQ ID NO: 699986 - RNA, 19 nt, Homo sapiens
caaauagggaucuacauca

SEQ ID NO: 699987 - RNA, 19 nt, Homo sapiens
ggaagaacuggacaggaaa

SEQ ID NO: 699988 - RNA, 19 nt, Homo sapiens
cagcagcguucgcggaguu

SEQ ID NO: 699989 - RNA, 19 nt, Homo sapiens
gguaccgacccaucuauaa

SEQ ID NO: 699990 - RNA, 19 nt, Homo sapiens
ucucuuuccuucucuggua

SEQ ID NO: 699991 - RNA, 19 nt, Homo sapiens
ggccauaucagucaucaug

SEQ ID NO: 699992 - RNA, 19 nt, Homo sapiens
gaacacuguagccaacuug

SEQ ID NO: 699993 - RNA, 19 nt, Homo sapiens
gaauuaguccuccucucuu

SEQ ID NO: 699994 - RNA, 19 nt, Homo sapiens
aaauagggaucuacaucau

SEQ ID NO: 699995 - RNA, 19 nt, Homo sapiens
ucaaauagggaucuacauc

SEQ ID NO: 699996 - RNA, 19 nt, Homo sapiens
agagaucccugccgacuac

SEQ ID NO: 699997 - RNA, 19 nt, Homo sapiens
gauguugcauucagugacu

SEQ ID NO: 699998 - RNA, 19 nt, Homo sapiens
ucuuucagcuucuuugugu

SEQ ID NO: 699999 - RNA, 19 nt, Homo sapiens
cagugacucuguuucugaa

SEQ ID NO: 700000 - RNA, 19 nt, Homo sapiens
caaaugcagcgacaacagu

SEQ ID NO: 700001 - RNA, 19 nt, Homo sapiens
ucucucgccugccuucuga

SEQ ID NO: 700002 - RNA, 19 nt, Homo sapiens
gaucuacaucauccaguug

SEQ ID NO: 700003 - RNA, 19 nt, Homo sapiens
ucuacuaucuguggauguu

SEQ ID NO: 700004 - RNA, 19 nt, Homo sapiens
ggauaugcaagaugcucua

SEQ ID NO: 700005 - RNA, 19 nt, Homo sapiens
cgaucaccaugucggcuuu

SEQ ID NO: 700006 - RNA, 19 nt, Homo sapiens
gcauucagugacucuguuu

SEQ ID NO: 700007 - RNA, 19 nt, Homo sapiens
gaagaacuggacaggaaag

SEQ ID NO: 700008 - RNA, 19 nt, Homo sapiens
guaccgacccaucuauaag

SEQ ID NO: 700009 - RNA, 19 nt, Homo sapiens
cuucugagcugcacuuucc

SEQ ID NO: 700010 - RNA, 19 nt, Homo sapiens
gugccuuccuuuguuggua

SEQ ID NO: 700011 - RNA, 19 nt, Homo sapiens
cagcuucuuuguguucuuc

SEQ ID NO: 700012 - RNA, 19 nt, Homo sapiens
aauuaguccuccucucuuc

SEQ ID NO: 700013 - RNA, 19 nt, Homo sapiens
ccugugccuuccuuuguug

SEQ ID NO: 700014 - RNA, 19 nt, Homo sapiens
agaacacuguagccaacuu

SEQ ID NO: 700015 - RNA, 19 nt, Homo sapiens
gagcgggagcugcagaaca

SEQ ID NO: 700016 - RNA, 19 nt, Homo sapiens
cagagaucccugccgacua

SEQ ID NO: 700017 - RNA, 19 nt, Homo sapiens
caacucuuucagcuucuuu

SEQ ID NO: 700018 - RNA, 19 nt, Homo sapiens
ggaauucaaccccuucuca

SEQ ID NO: 700019 - RNA, 19 nt, Homo sapiens
ggacccaguggauguaaac

SEQ ID NO: 700020 - RNA, 19 nt, Homo sapiens
gugccgugcucucagucuu

SEQ ID NO: 700021 - RNA, 19 nt, Homo sapiens
ccacagaaccuaagaacua

SEQ ID NO: 700022 - RNA, 19 nt, Homo sapiens
ggagagacaucacuaacug

SEQ ID NO: 700023 - RNA, 19 nt, Homo sapiens
gcacuuucgucuuagcuuu

SEQ ID NO: 700024 - RNA, 19 nt, Homo sapiens
gaaacggauccacuccuua

SEQ ID NO: 700025 - RNA, 19 nt, Homo sapiens
gaaccaauccgugcacaga

SEQ ID NO: 700026 - RNA, 19 nt, Homo sapiens
caacaauggcgcaggcuuu

SEQ ID NO: 700027 - RNA, 19 nt, Homo sapiens
gaaggcccagcaagaauuu

SEQ ID NO: 700028 - RNA, 19 nt, Homo sapiens
gaacugaggcgagugaagu

SEQ ID NO: 700029 - RNA, 19 nt, Homo sapiens
gaagggcaacacagcagua

SEQ ID NO: 700030 - RNA, 19 nt, Homo sapiens
ugaaacggauccacuccuu

SEQ ID NO: 700031 - RNA, 19 nt, Homo sapiens
gagugacaguucauucaau

SEQ ID NO: 700032 - RNA, 19 nt, Homo sapiens
gcuguugcuucgguuauuu

SEQ ID NO: 700033 - RNA, 19 nt, Homo sapiens
gcacuggguuagagguauc

SEQ ID NO: 700034 - RNA, 19 nt, Homo sapiens
gcacagcuacucgacagaa

SEQ ID NO: 700035 - RNA, 19 nt, Homo sapiens
gcauugcugugcuaggaau

SEQ ID NO: 700036 - RNA, 19 nt, Homo sapiens
gagcagagacggcggaaac

SEQ ID NO: 700037 - RNA, 19 nt, Homo sapiens
aaacggauccacuccuuau

SEQ ID NO: 700038 - RNA, 19 nt, Homo sapiens
ggagugacaguucauucaa

SEQ ID NO: 700039 - RNA, 19 nt, Homo sapiens
cacagaaccuaagaacuau

SEQ ID NO: 700040 - RNA, 19 nt, Homo sapiens
aaagaaaguggaacuggaa

SEQ ID NO: 700041 - RNA, 19 nt, Homo sapiens
guagugcucccaauccuau

SEQ ID NO: 700042 - RNA, 19 nt, Homo sapiens
ucagaaggcccagcaagaa

SEQ ID NO: 700043 - RNA, 19 nt, Homo sapiens
ggaauugucaugcugaaac

SEQ ID NO: 700044 - RNA, 19 nt, Homo sapiens
agugacaguucauucaauu

SEQ ID NO: 700045 - RNA, 19 nt, Homo sapiens
gaaaguggaacuggaacug

SEQ ID NO: 700046 - RNA, 19 nt, Homo sapiens
ggccgcaguugcaaacaug

SEQ ID NO: 700047 - RNA, 19 nt, Homo sapiens
ugacaguucauucaauuuc

SEQ ID NO: 700048 - RNA, 19 nt, Homo sapiens
gcucuucacuggcauugcu

SEQ ID NO: 700049 - RNA, 19 nt, Homo sapiens
gacaguucauucaauuucu

SEQ ID NO: 700050 - RNA, 19 nt, Homo sapiens
cgucuuagcuuuuggacaa

SEQ ID NO: 700051 - RNA, 19 nt, Homo sapiens
gaauuucagaagacuguau

SEQ ID NO: 700052 - RNA, 19 nt, Homo sapiens
gagagacaucacuaacuga

SEQ ID NO: 700053 - RNA, 19 nt, Homo sapiens
cuacucgacagaacaauug

SEQ ID NO: 700054 - RNA, 19 nt, Homo sapiens
ccuaaggucucugggacuu

SEQ ID NO: 700055 - RNA, 19 nt, Homo sapiens
gaauugucaugcugaaacg

SEQ ID NO: 700056 - RNA, 19 nt, Homo sapiens
cguccaggaugugcucuuu

SEQ ID NO: 700057 - RNA, 19 nt, Homo sapiens
agaaggcccagcaagaauu

SEQ ID NO: 700058 - RNA, 19 nt, Homo sapiens
gcuacucgacagaacaauu

SEQ ID NO: 700059 - RNA, 19 nt, Homo sapiens
gaaccgcagcugccaaugc

SEQ ID NO: 700060 - RNA, 19 nt, Homo sapiens
uggcauugcugugcuagga

SEQ ID NO: 700061 - RNA, 19 nt, Homo sapiens
ggaaggcagaggaguugga

SEQ ID NO: 700062 - RNA, 19 nt, Homo sapiens
ggccaugacugcugaaccu

SEQ ID NO: 700063 - RNA, 19 nt, Homo sapiens
ccaagaauuucagaagacu

SEQ ID NO: 700064 - RNA, 19 nt, Homo sapiens
cagaaggcccagcaagaau

SEQ ID NO: 700065 - RNA, 19 nt, Homo sapiens
ggcgcaggcuuugggcuuu

SEQ ID NO: 700066 - RNA, 19 nt, Homo sapiens
uaggaauugucaugcugaa

SEQ ID NO: 700067 - RNA, 19 nt, Homo sapiens
uccaggaugugcucuuugu

SEQ ID NO: 700068 - RNA, 19 nt, Homo sapiens
gguugugggcacuggguua

SEQ ID NO: 700069 - RNA, 19 nt, Homo sapiens
gggcacuggguuagaggua

SEQ ID NO: 700070 - RNA, 19 nt, Homo sapiens
gcuccuuugucugcuggua

SEQ ID NO: 700071 - RNA, 19 nt, Homo sapiens
ggcuguugcuucgguuauu

SEQ ID NO: 700072 - RNA, 19 nt, Homo sapiens
gcgaaccgcagcugccaau

SEQ ID NO: 700073 - RNA, 19 nt, Homo sapiens
ggagccaccaccagccuau

SEQ ID NO: 700074 - RNA, 19 nt, Homo sapiens
aagacuguauccaccaugu

SEQ ID NO: 700075 - RNA, 19 nt, Homo sapiens
cccaagaauuucagaagac

SEQ ID NO: 700076 - RNA, 19 nt, Homo sapiens
cugagcugcugaagaaaca

SEQ ID NO: 700077 - RNA, 19 nt, Homo sapiens
aaccgcagcugccaaugca

SEQ ID NO: 700078 - RNA, 19 nt, Homo sapiens
gugacaguucauucaauuu

SEQ ID NO: 700079 - RNA, 19 nt, Homo sapiens
gcuuugggcuuucuauccu

SEQ ID NO: 700080 - RNA, 19 nt, Homo sapiens
gcgcaggcuuugggcuuuc

SEQ ID NO: 700081 - RNA, 19 nt, Homo sapiens
ggcacuggguuagagguau

SEQ ID NO: 700082 - RNA, 19 nt, Homo sapiens
ccuaagaacuauggcucau

SEQ ID NO: 700083 - RNA, 19 nt, Homo sapiens
ccuugcagcccucgagaaa

SEQ ID NO: 700084 - RNA, 19 nt, Homo sapiens
aaaguggaacuggaacuga

SEQ ID NO: 700085 - RNA, 19 nt, Homo sapiens
accaauccgugcacagaga

SEQ ID NO: 700086 - RNA, 19 nt, Homo sapiens
uguacuaccucuggaugug

SEQ ID NO: 700087 - RNA, 19 nt, Homo sapiens
cagcuacucgacagaacaa

SEQ ID NO: 700088 - RNA, 19 nt, Homo sapiens
ccacagaaccuaagaacua

SEQ ID NO: 700089 - RNA, 19 nt, Homo sapiens
ggagagacaucacuaacug

SEQ ID NO: 700090 - RNA, 19 nt, Homo sapiens
gcacuuucgucuuagcuuu

SEQ ID NO: 700091 - RNA, 19 nt, Homo sapiens
gaaacggauccacuccuua

SEQ ID NO: 700092 - RNA, 19 nt, Homo sapiens
gaaccaauccgugcacaga

SEQ ID NO: 700093 - RNA, 19 nt, Homo sapiens
caacaauggcgcaggcuuu

SEQ ID NO: 700094 - RNA, 19 nt, Homo sapiens
gaaggcccagcaagaauuu

SEQ ID NO: 700095 - RNA, 19 nt, Homo sapiens
gaacugaggcgagugaagu

SEQ ID NO: 700096 - RNA, 19 nt, Homo sapiens
gaagggcaacacagcagua

SEQ ID NO: 700097 - RNA, 19 nt, Homo sapiens
ugaaacggauccacuccuu

SEQ ID NO: 700098 - RNA, 19 nt, Homo sapiens
gagugacaguucauucaau

SEQ ID NO: 700099 - RNA, 19 nt, Homo sapiens
gcuguugcuucgguuauuu

SEQ ID NO: 700100 - RNA, 19 nt, Homo sapiens
gcacuggguuagagguauc

SEQ ID NO: 700101 - RNA, 19 nt, Homo sapiens
gcacagcuacucgacagaa

SEQ ID NO: 700102 - RNA, 19 nt, Homo sapiens
gcauugcugugcuaggaau

SEQ ID NO: 700103 - RNA, 19 nt, Homo sapiens
gagcagagacggcggaaac

SEQ ID NO: 700104 - RNA, 19 nt, Homo sapiens
aaacggauccacuccuuau

SEQ ID NO: 700105 - RNA, 19 nt, Homo sapiens
ggagugacaguucauucaa

SEQ ID NO: 700106 - RNA, 19 nt, Homo sapiens
cacagaaccuaagaacuau

SEQ ID NO: 700107 - RNA, 19 nt, Homo sapiens
aaagaaaguggaacuggaa

SEQ ID NO: 700108 - RNA, 19 nt, Homo sapiens
guagugcucccaauccuau

SEQ ID NO: 700109 - RNA, 19 nt, Homo sapiens
ucagaaggcccagcaagaa

SEQ ID NO: 700110 - RNA, 19 nt, Homo sapiens
ggaauugucaugcugaaac

SEQ ID NO: 700111 - RNA, 19 nt, Homo sapiens
agugacaguucauucaauu

SEQ ID NO: 700112 - RNA, 19 nt, Homo sapiens
gaaaguggaacuggaacug

SEQ ID NO: 700113 - RNA, 19 nt, Homo sapiens
ggccgcaguugcaaacaug

SEQ ID NO: 700114 - RNA, 19 nt, Homo sapiens
ugacaguucauucaauuuc

SEQ ID NO: 700115 - RNA, 19 nt, Homo sapiens
gcucuucacuggcauugcu

SEQ ID NO: 700116 - RNA, 19 nt, Homo sapiens
gacaguucauucaauuucu

SEQ ID NO: 700117 - RNA, 19 nt, Homo sapiens
cgucuuagcuuuuggacaa

SEQ ID NO: 700118 - RNA, 19 nt, Homo sapiens
gaauuucagaagacuguau

SEQ ID NO: 700119 - RNA, 19 nt, Homo sapiens
gagagacaucacuaacuga

SEQ ID NO: 700120 - RNA, 19 nt, Homo sapiens
cuacucgacagaacaauug

SEQ ID NO: 700121 - RNA, 19 nt, Homo sapiens
aaguggaacuggaacugaa

SEQ ID NO: 700122 - RNA, 19 nt, Homo sapiens
ccuaaggucucugggacuu

SEQ ID NO: 700123 - RNA, 19 nt, Homo sapiens
gaauugucaugcugaaacg

SEQ ID NO: 700124 - RNA, 19 nt, Homo sapiens
cguccaggaugugcucuuu

SEQ ID NO: 700125 - RNA, 19 nt, Homo sapiens
agaaggcccagcaagaauu

SEQ ID NO: 700126 - RNA, 19 nt, Homo sapiens
gcuacucgacagaacaauu

SEQ ID NO: 700127 - RNA, 19 nt, Homo sapiens
gaaccgcagcugccaaugc

SEQ ID NO: 700128 - RNA, 19 nt, Homo sapiens
uggcauugcugugcuagga

SEQ ID NO: 700129 - RNA, 19 nt, Homo sapiens
ggaaggcagaggaguugga

SEQ ID NO: 700130 - RNA, 19 nt, Homo sapiens
ggccaugacugcugaaccu

SEQ ID NO: 700131 - RNA, 19 nt, Homo sapiens
ccaagaauuucagaagacu

SEQ ID NO: 700132 - RNA, 19 nt, Homo sapiens
cagaaggcccagcaagaau

SEQ ID NO: 700133 - RNA, 19 nt, Homo sapiens
ggcgcaggcuuugggcuuu

SEQ ID NO: 700134 - RNA, 19 nt, Homo sapiens
uaggaauugucaugcugaa

SEQ ID NO: 700135 - RNA, 19 nt, Homo sapiens
uccaggaugugcucuuugu

SEQ ID NO: 700136 - RNA, 19 nt, Homo sapiens
gguugugggcacuggguua

SEQ ID NO: 700137 - RNA, 19 nt, Homo sapiens
gggcacuggguuagaggua

SEQ ID NO: 700138 - RNA, 19 nt, Homo sapiens
gcuccuuugucugcuggua

SEQ ID NO: 700139 - RNA, 19 nt, Homo sapiens
ggcuguugcuucgguuauu

SEQ ID NO: 700140 - RNA, 19 nt, Homo sapiens
gcgaaccgcagcugccaau

SEQ ID NO: 700141 - RNA, 19 nt, Homo sapiens
aagacuguauccaccaugu

SEQ ID NO: 700142 - RNA, 19 nt, Homo sapiens
cccaagaauuucagaagac

SEQ ID NO: 700143 - RNA, 19 nt, Homo sapiens
cugagcugcugaagaaaca

SEQ ID NO: 700144 - RNA, 19 nt, Homo sapiens
aaccgcagcugccaaugca

SEQ ID NO: 700145 - RNA, 19 nt, Homo sapiens
gugacaguucauucaauuu

SEQ ID NO: 700146 - RNA, 19 nt, Homo sapiens
gcuuugggcuuucuauccu

SEQ ID NO: 700147 - RNA, 19 nt, Homo sapiens
gcgcaggcuuugggcuuuc

SEQ ID NO: 700148 - RNA, 19 nt, Homo sapiens
ggcacuggguuagagguau

SEQ ID NO: 700149 - RNA, 19 nt, Homo sapiens
ccuugcagcccucgagaaa

SEQ ID NO: 700150 - RNA, 19 nt, Homo sapiens
ccuaagaacuauggcucau

SEQ ID NO: 700151 - RNA, 19 nt, Homo sapiens
aaaguggaacuggaacuga

SEQ ID NO: 700152 - RNA, 19 nt, Homo sapiens
accaauccgugcacagaga

SEQ ID NO: 700153 - RNA, 19 nt, Homo sapiens
uguacuaccucuggaugug

SEQ ID NO: 700154 - RNA, 19 nt, Homo sapiens
cagcuacucgacagaacaa

SEQ ID NO: 700155 - RNA, 19 nt, Homo sapiens
gaaaggaggugguauggaa

SEQ ID NO: 700156 - RNA, 19 nt, Homo sapiens
ugaaagagcuccaggcuau

SEQ ID NO: 700157 - RNA, 19 nt, Homo sapiens
gcagaugccuguucauaug

SEQ ID NO: 700158 - RNA, 19 nt, Homo sapiens
gaggagcucugcuuccaua

SEQ ID NO: 700159 - RNA, 19 nt, Homo sapiens
ggaagagccuggaaagaug

SEQ ID NO: 700160 - RNA, 19 nt, Homo sapiens
ccacauggguccucauaaa

SEQ ID NO: 700161 - RNA, 19 nt, Homo sapiens
ccugacaucuguucauuua

SEQ ID NO: 700162 - RNA, 19 nt, Homo sapiens
gaugagaugucccuccuuu

SEQ ID NO: 700163 - RNA, 19 nt, Homo sapiens
ccaugucucugcucauuua

SEQ ID NO: 700164 - RNA, 19 nt, Homo sapiens
gaagguuucuggccacuga

SEQ ID NO: 700165 - RNA, 19 nt, Homo sapiens
gcucaagauucccugguua

SEQ ID NO: 700166 - RNA, 19 nt, Homo sapiens
gaacaagguaggcuucaaa

SEQ ID NO: 700167 - RNA, 19 nt, Homo sapiens
gaagccagcuacugaggaa

SEQ ID NO: 700168 - RNA, 19 nt, Homo sapiens
ggaagcagaugccuguuca

SEQ ID NO: 700169 - RNA, 19 nt, Homo sapiens
aaucacagccuccuuauaa

SEQ ID NO: 700170 - RNA, 19 nt, Homo sapiens
ccacugaacuuuggcuaaa

SEQ ID NO: 700171 - RNA, 19 nt, Homo sapiens
acaaagaccuggcugugaa

SEQ ID NO: 700172 - RNA, 19 nt, Homo sapiens
gaugagaacuugcgauacu

SEQ ID NO: 700173 - RNA, 19 nt, Homo sapiens
gaacgugggagcacaggua

SEQ ID NO: 700174 - RNA, 19 nt, Homo sapiens
gggcagugcuuucccagaa

SEQ ID NO: 700175 - RNA, 19 nt, Homo sapiens
caagacuguugaugccuua

SEQ ID NO: 700176 - RNA, 19 nt, Homo sapiens
gagcucugcuuccauaugu

SEQ ID NO: 700177 - RNA, 19 nt, Homo sapiens
gaaaaucacagccuccuua

SEQ ID NO: 700178 - RNA, 19 nt, Homo sapiens
gagcagaggccacuaaugg

SEQ ID NO: 700179 - RNA, 19 nt, Homo sapiens
gaauggaacgcugagcuua

SEQ ID NO: 700180 - RNA, 19 nt, Homo sapiens
caaacuccauucccaccua

SEQ ID NO: 700181 - RNA, 19 nt, Homo sapiens
gcagcaggguuaagacuca

SEQ ID NO: 700182 - RNA, 19 nt, Homo sapiens
ggaagccucccaacuauuc

SEQ ID NO: 700183 - RNA, 19 nt, Homo sapiens
gcaccaacuucuccugugu

SEQ ID NO: 700184 - RNA, 19 nt, Homo sapiens
gccauucucucuccaccua

SEQ ID NO: 700185 - RNA, 19 nt, Homo sapiens
ugucacagcugcucaagau

SEQ ID NO: 700186 - RNA, 19 nt, Homo sapiens
gaacacaggcgcuugaaaa

SEQ ID NO: 700187 - RNA, 19 nt, Homo sapiens
ccucaaaucugguugugau

SEQ ID NO: 700188 - RNA, 19 nt, Homo sapiens
aaagccagcuacugagaaa

SEQ ID NO: 700189 - RNA, 19 nt, Homo sapiens
gggaaggauugucacuuga

SEQ ID NO: 700190 - RNA, 19 nt, Homo sapiens
gcauuucccacaugacuuu

SEQ ID NO: 700191 - RNA, 19 nt, Homo sapiens
caccagaccucagcccuuu

SEQ ID NO: 700192 - RNA, 19 nt, Homo sapiens
gaguccauauucucucuuu

SEQ ID NO: 700193 - RNA, 19 nt, Homo sapiens
cagaugagaacuugcgaua

SEQ ID NO: 700194 - RNA, 19 nt, Homo sapiens
gggaagagccuggaaagau

SEQ ID NO: 700195 - RNA, 19 nt, Homo sapiens
gaaaugcugccucuucagu

SEQ ID NO: 700196 - RNA, 19 nt, Homo sapiens
ucacauggccagaugagaa

SEQ ID NO: 700197 - RNA, 19 nt, Homo sapiens
ggaacaagguaggcuucaa

SEQ ID NO: 700198 - RNA, 19 nt, Homo sapiens
cacagaagcugaagacaac

SEQ ID NO: 700199 - RNA, 19 nt, Homo sapiens
gaaaccaccaagacuguug

SEQ ID NO: 700200 - RNA, 19 nt, Homo sapiens
gguaagauuggacuaggua

SEQ ID NO: 700201 - RNA, 19 nt, Homo sapiens
caaaucugguugugaugga

SEQ ID NO: 700202 - RNA, 19 nt, Homo sapiens
ggauguggacggacuggua

SEQ ID NO: 700203 - RNA, 19 nt, Homo sapiens
ucccuucucucaccaaauu

SEQ ID NO: 700204 - RNA, 19 nt, Homo sapiens
caagguaggcuucaaagag

SEQ ID NO: 700205 - RNA, 19 nt, Homo sapiens
ugacaucuguucauuuagg

SEQ ID NO: 700206 - RNA, 19 nt, Homo sapiens
uaagcaguguccagcauug

SEQ ID NO: 700207 - RNA, 19 nt, Homo sapiens
gaaaagggaugagagaaag

SEQ ID NO: 700208 - RNA, 19 nt, Homo sapiens
cccaggagcugaagguuuc

SEQ ID NO: 700209 - RNA, 19 nt, Homo sapiens
guccacagcagcaggguua

SEQ ID NO: 700210 - RNA, 19 nt, Homo sapiens
aagaggacguugucacaga

SEQ ID NO: 700211 - RNA, 19 nt, Homo sapiens
caaggacccagccaucaaa

SEQ ID NO: 700212 - RNA, 19 nt, Homo sapiens
gagccuauauuccucuuuu

SEQ ID NO: 700213 - RNA, 19 nt, Homo sapiens
ggaagacucagcaggaaca

SEQ ID NO: 700214 - RNA, 19 nt, Homo sapiens
ugaaagagacacagucaca

SEQ ID NO: 700215 - RNA, 19 nt, Homo sapiens
ucccaacuauucuugcuuu

SEQ ID NO: 700216 - RNA, 19 nt, Homo sapiens
gcacugccucccuguguga

SEQ ID NO: 700217 - RNA, 19 nt, Homo sapiens
ucaaagagccuauauuccu

SEQ ID NO: 700218 - RNA, 19 nt, Homo sapiens
ucuggaagccucccaacua

SEQ ID NO: 700219 - RNA, 19 nt, Homo sapiens
aaaaggaacuuaggucuug

SEQ ID NO: 700220 - RNA, 19 nt, Homo sapiens
gcuaagcaguguccagcau

SEQ ID NO: 700221 - RNA, 19 nt, Homo sapiens
ggaaaagggaugagagaaa

SEQ ID NO: 700222 - RNA, 19 nt, Homo sapiens
gaagagccuggaaagaugu

SEQ ID NO: 700223 - RNA, 19 nt, Homo sapiens
ucagugaagucauccucuu

SEQ ID NO: 700224 - RNA, 19 nt, Homo sapiens
ucucuccaccuauccauua

SEQ ID NO: 700225 - RNA, 19 nt, Homo sapiens
agacucaucuaguucauac

SEQ ID NO: 700226 - RNA, 19 nt, Homo sapiens
cuucaaagagccuauauuc

SEQ ID NO: 700227 - RNA, 19 nt, Homo sapiens
acacagaagcugaagacaa

SEQ ID NO: 700228 - RNA, 19 nt, Homo sapiens
guucauauggaaacaaaga

SEQ ID NO: 700229 - RNA, 19 nt, Homo sapiens
ggacguugucacagauaaa

SEQ ID NO: 700230 - RNA, 19 nt, Homo sapiens
gagagacucaucuaguuca

SEQ ID NO: 700231 - RNA, 19 nt, Homo sapiens
ggaacacaggcgcuugaaa

SEQ ID NO: 700232 - RNA, 19 nt, Homo sapiens
cuggaagccucccaacuau

SEQ ID NO: 700233 - RNA, 19 nt, Homo sapiens
ucacagccuccuuauaaug

SEQ ID NO: 700234 - RNA, 19 nt, Homo sapiens
aagcagaugccuguucaua

SEQ ID NO: 700235 - RNA, 19 nt, Homo sapiens
ccagcucuguuucuaagug

SEQ ID NO: 700236 - RNA, 19 nt, Homo sapiens
ucacagcugcucaagauuc

SEQ ID NO: 700237 - RNA, 19 nt, Homo sapiens
ggaaaguuguccccuugaa

SEQ ID NO: 700238 - RNA, 19 nt, Homo sapiens
gaggcauccugacaucugu

SEQ ID NO: 700239 - RNA, 19 nt, Homo sapiens
cugcagacuuccuaucuuc

SEQ ID NO: 700240 - RNA, 19 nt, Homo sapiens
uuucagcucuggccgcauu

SEQ ID NO: 700241 - RNA, 19 nt, Homo sapiens
ggggaaggauugucacuug

SEQ ID NO: 700242 - RNA, 19 nt, Homo sapiens
gagcacugccucccugugu

SEQ ID NO: 700243 - RNA, 19 nt, Homo sapiens
aaagagacacagucacaug

SEQ ID NO: 700244 - RNA, 19 nt, Homo sapiens
ccaaggacccagccaucaa

SEQ ID NO: 700245 - RNA, 19 nt, Homo sapiens
ggaggcauccugacaucug

SEQ ID NO: 700246 - RNA, 19 nt, Homo sapiens
ccaccuaccuagaaaauca

SEQ ID NO: 700247 - RNA, 19 nt, Homo sapiens
gaaagagacacagucacau

SEQ ID NO: 700248 - RNA, 19 nt, Homo sapiens
aaugcugccucuucaguga

SEQ ID NO: 700249 - RNA, 19 nt, Homo sapiens
ccaucugucuucucuccuu

SEQ ID NO: 700250 - RNA, 19 nt, Homo sapiens
acagucacauggccagaug

SEQ ID NO: 700251 - RNA, 19 nt, Homo sapiens
ucccaugucucugcucauu

SEQ ID NO: 700252 - RNA, 19 nt, Homo sapiens
cagaaaccaccaagacugu

SEQ ID NO: 700253 - RNA, 19 nt, Homo sapiens
gcucagaaaccaccaagac

SEQ ID NO: 700254 - RNA, 19 nt, Homo sapiens
gaggacguugucacagaua

SEQ ID NO: 700255 - RNA, 19 nt, Homo sapiens
gaaaggaggugguauggaa

SEQ ID NO: 700256 - RNA, 19 nt, Homo sapiens
ugaaagagcuccaggcuau

SEQ ID NO: 700257 - RNA, 19 nt, Homo sapiens
gcagaugccuguucauaug

SEQ ID NO: 700258 - RNA, 19 nt, Homo sapiens
ggaagagccuggaaagaug

SEQ ID NO: 700259 - RNA, 19 nt, Homo sapiens
ccacauggguccucauaaa

SEQ ID NO: 700260 - RNA, 19 nt, Homo sapiens
ccugacaucuguucauuua

SEQ ID NO: 700261 - RNA, 19 nt, Homo sapiens
ccaugucucugcucauuua

SEQ ID NO: 700262 - RNA, 19 nt, Homo sapiens
gaagguuucuggccacuga

SEQ ID NO: 700263 - RNA, 19 nt, Homo sapiens
gcucaagauucccugguua

SEQ ID NO: 700264 - RNA, 19 nt, Homo sapiens
gaacaagguaggcuucaaa

SEQ ID NO: 700265 - RNA, 19 nt, Homo sapiens
gaagccagcuacugaggaa

SEQ ID NO: 700266 - RNA, 19 nt, Homo sapiens
ggaagcagaugccuguuca

SEQ ID NO: 700267 - RNA, 19 nt, Homo sapiens
aaucacagccuccuuauaa

SEQ ID NO: 700268 - RNA, 19 nt, Homo sapiens
ccacugaacuuuggcuaaa

SEQ ID NO: 700269 - RNA, 19 nt, Homo sapiens
acaaagaccuggcugugaa

SEQ ID NO: 700270 - RNA, 19 nt, Homo sapiens
gaugagaacuugcgauacu

SEQ ID NO: 700271 - RNA, 19 nt, Homo sapiens
gaacgugggagcacaggua

SEQ ID NO: 700272 - RNA, 19 nt, Homo sapiens
gggcagugcuuucccagaa

SEQ ID NO: 700273 - RNA, 19 nt, Homo sapiens
caagacuguugaugccuua

SEQ ID NO: 700274 - RNA, 19 nt, Homo sapiens
gaaaaucacagccuccuua

SEQ ID NO: 700275 - RNA, 19 nt, Homo sapiens
gagcagaggccacuaaugg

SEQ ID NO: 700276 - RNA, 19 nt, Homo sapiens
gaauggaacgcugagcuua

SEQ ID NO: 700277 - RNA, 19 nt, Homo sapiens
caaacuccauucccaccua

SEQ ID NO: 700278 - RNA, 19 nt, Homo sapiens
gcagcaggguuaagacuca

SEQ ID NO: 700279 - RNA, 19 nt, Homo sapiens
ggaagccucccaacuauuc

SEQ ID NO: 700280 - RNA, 19 nt, Homo sapiens
gcaccaacuucuccugugu

SEQ ID NO: 700281 - RNA, 19 nt, Homo sapiens
gccauucucucuccaccua

SEQ ID NO: 700282 - RNA, 19 nt, Homo sapiens
ugucacagcugcucaagau

SEQ ID NO: 700283 - RNA, 19 nt, Homo sapiens
gaacacaggcgcuugaaaa

SEQ ID NO: 700284 - RNA, 19 nt, Homo sapiens
ccucaaaucugguugugau

SEQ ID NO: 700285 - RNA, 19 nt, Homo sapiens
aaagccagcuacugagaaa

SEQ ID NO: 700286 - RNA, 19 nt, Homo sapiens
gggaaggauugucacuuga

SEQ ID NO: 700287 - RNA, 19 nt, Homo sapiens
gcauuucccacaugacuuu

SEQ ID NO: 700288 - RNA, 19 nt, Homo sapiens
caccagaccucagcccuuu

SEQ ID NO: 700289 - RNA, 19 nt, Homo sapiens
gaguccauauucucucuuu

SEQ ID NO: 700290 - RNA, 19 nt, Homo sapiens
cagaugagaacuugcgaua

SEQ ID NO: 700291 - RNA, 19 nt, Homo sapiens
gggaagagccuggaaagau

SEQ ID NO: 700292 - RNA, 19 nt, Homo sapiens
gaaaugcugccucuucagu

SEQ ID NO: 700293 - RNA, 19 nt, Homo sapiens
ucacauggccagaugagaa

SEQ ID NO: 700294 - RNA, 19 nt, Homo sapiens
ggaacaagguaggcuucaa

SEQ ID NO: 700295 - RNA, 19 nt, Homo sapiens
cacagaagcugaagacaac

SEQ ID NO: 700296 - RNA, 19 nt, Homo sapiens
gaaaccaccaagacuguug

SEQ ID NO: 700297 - RNA, 19 nt, Homo sapiens
gguaagauuggacuaggua

SEQ ID NO: 700298 - RNA, 19 nt, Homo sapiens
caaaucugguugugaugga

SEQ ID NO: 700299 - RNA, 19 nt, Homo sapiens
ggauguggacggacuggua

SEQ ID NO: 700300 - RNA, 19 nt, Homo sapiens
ucccuucucucaccaaauu

SEQ ID NO: 700301 - RNA, 19 nt, Homo sapiens
caagguaggcuucaaagag

SEQ ID NO: 700302 - RNA, 19 nt, Homo sapiens
ugacaucuguucauuuagg

SEQ ID NO: 700303 - RNA, 19 nt, Homo sapiens
uaagcaguguccagcauug

SEQ ID NO: 700304 - RNA, 19 nt, Homo sapiens
gaaaagggaugagagaaag

SEQ ID NO: 700305 - RNA, 19 nt, Homo sapiens
cccaggagcugaagguuuc

SEQ ID NO: 700306 - RNA, 19 nt, Homo sapiens
guccacagcagcaggguua

SEQ ID NO: 700307 - RNA, 19 nt, Homo sapiens
aagaggacguugucacaga

SEQ ID NO: 700308 - RNA, 19 nt, Homo sapiens
caaggacccagccaucaaa

SEQ ID NO: 700309 - RNA, 19 nt, Homo sapiens
gagccuauauuccucuuuu

SEQ ID NO: 700310 - RNA, 19 nt, Homo sapiens
ggaagacucagcaggaaca

SEQ ID NO: 700311 - RNA, 19 nt, Homo sapiens
ugaaagagacacagucaca

SEQ ID NO: 700312 - RNA, 19 nt, Homo sapiens
ucccaacuauucuugcuuu

SEQ ID NO: 700313 - RNA, 19 nt, Homo sapiens
gcacugccucccuguguga

SEQ ID NO: 700314 - RNA, 19 nt, Homo sapiens
ucaaagagccuauauuccu

SEQ ID NO: 700315 - RNA, 19 nt, Homo sapiens
ucuggaagccucccaacua

SEQ ID NO: 700316 - RNA, 19 nt, Homo sapiens
gcuaagcaguguccagcau

SEQ ID NO: 700317 - RNA, 19 nt, Homo sapiens
ggaaaagggaugagagaaa

SEQ ID NO: 700318 - RNA, 19 nt, Homo sapiens
gaagagccuggaaagaugu

SEQ ID NO: 700319 - RNA, 19 nt, Homo sapiens
ucagugaagucauccucuu

SEQ ID NO: 700320 - RNA, 19 nt, Homo sapiens
ucucuccaccuauccauua

SEQ ID NO: 700321 - RNA, 19 nt, Homo sapiens
agacucaucuaguucauac

SEQ ID NO: 700322 - RNA, 19 nt, Homo sapiens
cuucaaagagccuauauuc

SEQ ID NO: 700323 - RNA, 19 nt, Homo sapiens
guucauauggaaacaaaga

SEQ ID NO: 700324 - RNA, 19 nt, Homo sapiens
acacagaagcugaagacaa

SEQ ID NO: 700325 - RNA, 19 nt, Homo sapiens
ggacguugucacagauaaa

SEQ ID NO: 700326 - RNA, 19 nt, Homo sapiens
gagagacucaucuaguuca

SEQ ID NO: 700327 - RNA, 19 nt, Homo sapiens
aagcagaugccuguucaua

SEQ ID NO: 700328 - RNA, 19 nt, Homo sapiens
ggaacacaggcgcuugaaa

SEQ ID NO: 700329 - RNA, 19 nt, Homo sapiens
cuggaagccucccaacuau

SEQ ID NO: 700330 - RNA, 19 nt, Homo sapiens
ucacagccuccuuauaaug

SEQ ID NO: 700331 - RNA, 19 nt, Homo sapiens
ccagcucuguuucuaagug

SEQ ID NO: 700332 - RNA, 19 nt, Homo sapiens
ucacagcugcucaagauuc

SEQ ID NO: 700333 - RNA, 19 nt, Homo sapiens
ggaaaguuguccccuugaa

SEQ ID NO: 700334 - RNA, 19 nt, Homo sapiens
gaggcauccugacaucugu

SEQ ID NO: 700335 - RNA, 19 nt, Homo sapiens
cugcagacuuccuaucuuc

SEQ ID NO: 700336 - RNA, 19 nt, Homo sapiens
uuucagcucuggccgcauu

SEQ ID NO: 700337 - RNA, 19 nt, Homo sapiens
ggggaaggauugucacuug

SEQ ID NO: 700338 - RNA, 19 nt, Homo sapiens
gagcacugccucccugugu

SEQ ID NO: 700339 - RNA, 19 nt, Homo sapiens
aaagagacacagucacaug

SEQ ID NO: 700340 - RNA, 19 nt, Homo sapiens
ccaaggacccagccaucaa

SEQ ID NO: 700341 - RNA, 19 nt, Homo sapiens
ggaggcauccugacaucug

SEQ ID NO: 700342 - RNA, 19 nt, Homo sapiens
ccaccuaccuagaaaauca

SEQ ID NO: 700343 - RNA, 19 nt, Homo sapiens
gaaagagacacagucacau

SEQ ID NO: 700344 - RNA, 19 nt, Homo sapiens
aaugcugccucuucaguga

SEQ ID NO: 700345 - RNA, 19 nt, Homo sapiens
ccaucugucuucucuccuu

SEQ ID NO: 700346 - RNA, 19 nt, Homo sapiens
acagucacauggccagaug

SEQ ID NO: 700347 - RNA, 19 nt, Homo sapiens
gagacucaucuaguucaua

SEQ ID NO: 700348 - RNA, 19 nt, Homo sapiens
ucccaugucucugcucauu

SEQ ID NO: 700349 - RNA, 19 nt, Homo sapiens
cagaaaccaccaagacugu

SEQ ID NO: 700350 - RNA, 19 nt, Homo sapiens
gcucagaaaccaccaagac

SEQ ID NO: 700351 - RNA, 19 nt, Homo sapiens
gaggacguugucacagaua

SEQ ID NO: 700352 - RNA, 19 nt, Homo sapiens
cacugguacuggcccuuua

SEQ ID NO: 700353 - RNA, 19 nt, Homo sapiens
gagaaaggaggugguaugg

SEQ ID NO: 700354 - RNA, 19 nt, Homo sapiens
gauguggacggacugguau

SEQ ID NO: 700355 - RNA, 19 nt, Homo sapiens
gaaaggaggugguauggaa

SEQ ID NO: 700356 - RNA, 19 nt, Homo sapiens
ugaaagagcuccaggcuau

SEQ ID NO: 700357 - RNA, 19 nt, Homo sapiens
gcagaugccuguucauaug

SEQ ID NO: 700358 - RNA, 19 nt, Homo sapiens
ggaagagccuggaaagaug

SEQ ID NO: 700359 - RNA, 19 nt, Homo sapiens
ccacauggguccucauaaa

SEQ ID NO: 700360 - RNA, 19 nt, Homo sapiens
ccugacaucuguucauuua

SEQ ID NO: 700361 - RNA, 19 nt, Homo sapiens
ccaugucucugcucauuua

SEQ ID NO: 700362 - RNA, 19 nt, Homo sapiens
gaagguuucuggccacuga

SEQ ID NO: 700363 - RNA, 19 nt, Homo sapiens
gcucaagauucccugguua

SEQ ID NO: 700364 - RNA, 19 nt, Homo sapiens
gaacaagguaggcuucaaa

SEQ ID NO: 700365 - RNA, 19 nt, Homo sapiens
gaagccagcuacugaggaa

SEQ ID NO: 700366 - RNA, 19 nt, Homo sapiens
ggaagcagaugccuguuca

SEQ ID NO: 700367 - RNA, 19 nt, Homo sapiens
aaucacagccuccuuauaa

SEQ ID NO: 700368 - RNA, 19 nt, Homo sapiens
ccacugaacuuuggcuaaa

SEQ ID NO: 700369 - RNA, 19 nt, Homo sapiens
acaaagaccuggcugugaa

SEQ ID NO: 700370 - RNA, 19 nt, Homo sapiens
gaugagaacuugcgauacu

SEQ ID NO: 700371 - RNA, 19 nt, Homo sapiens
gggcagugcuuucccagaa

SEQ ID NO: 700372 - RNA, 19 nt, Homo sapiens
caagacuguugaugccuua

SEQ ID NO: 700373 - RNA, 19 nt, Homo sapiens
gaaaaucacagccuccuua

SEQ ID NO: 700374 - RNA, 19 nt, Homo sapiens
gagcagaggccacuaaugg

SEQ ID NO: 700375 - RNA, 19 nt, Homo sapiens
caaacuccauucccaccua

SEQ ID NO: 700376 - RNA, 19 nt, Homo sapiens
gcagcaggguuaagacuca

SEQ ID NO: 700377 - RNA, 19 nt, Homo sapiens
ggaagccucccaacuauuc

SEQ ID NO: 700378 - RNA, 19 nt, Homo sapiens
gccauucucucuccaccua

SEQ ID NO: 700379 - RNA, 19 nt, Homo sapiens
ugucacagcugcucaagau

SEQ ID NO: 700380 - RNA, 19 nt, Homo sapiens
gaacacaggcgcuugaaaa

SEQ ID NO: 700381 - RNA, 19 nt, Homo sapiens
ccucaaaucugguugugau

SEQ ID NO: 700382 - RNA, 19 nt, Homo sapiens
aaagccagcuacugagaaa

SEQ ID NO: 700383 - RNA, 19 nt, Homo sapiens
gggaaggauugucacuuga

SEQ ID NO: 700384 - RNA, 19 nt, Homo sapiens
gcauuucccacaugacuuu

SEQ ID NO: 700385 - RNA, 19 nt, Homo sapiens
caccagaccucagcccuuu

SEQ ID NO: 700386 - RNA, 19 nt, Homo sapiens
gaguccauauucucucuuu

SEQ ID NO: 700387 - RNA, 19 nt, Homo sapiens
cagaugagaacuugcgaua

SEQ ID NO: 700388 - RNA, 19 nt, Homo sapiens
gggaagagccuggaaagau

SEQ ID NO: 700389 - RNA, 19 nt, Homo sapiens
gaaaugcugccucuucagu

SEQ ID NO: 700390 - RNA, 19 nt, Homo sapiens
ucacauggccagaugagaa

SEQ ID NO: 700391 - RNA, 19 nt, Homo sapiens
ggaacaagguaggcuucaa

SEQ ID NO: 700392 - RNA, 19 nt, Homo sapiens
cacagaagcugaagacaac

SEQ ID NO: 700393 - RNA, 19 nt, Homo sapiens
gaaaccaccaagacuguug

SEQ ID NO: 700394 - RNA, 19 nt, Homo sapiens
gguaagauuggacuaggua

SEQ ID NO: 700395 - RNA, 19 nt, Homo sapiens
caaaucugguugugaugga

SEQ ID NO: 700396 - RNA, 19 nt, Homo sapiens
ggauguggacggacuggua

SEQ ID NO: 700397 - RNA, 19 nt, Homo sapiens
ucccuucucucaccaaauu

SEQ ID NO: 700398 - RNA, 19 nt, Homo sapiens
caagguaggcuucaaagag

SEQ ID NO: 700399 - RNA, 19 nt, Homo sapiens
ugacaucuguucauuuagg

SEQ ID NO: 700400 - RNA, 19 nt, Homo sapiens
uaagcaguguccagcauug

SEQ ID NO: 700401 - RNA, 19 nt, Homo sapiens
gaaaagggaugagagaaag

SEQ ID NO: 700402 - RNA, 19 nt, Homo sapiens
cccaggagcugaagguuuc

SEQ ID NO: 700403 - RNA, 19 nt, Homo sapiens
guccacagcagcaggguua

SEQ ID NO: 700404 - RNA, 19 nt, Homo sapiens
aagaggacguugucacaga

SEQ ID NO: 700405 - RNA, 19 nt, Homo sapiens
caaggacccagccaucaaa

SEQ ID NO: 700406 - RNA, 19 nt, Homo sapiens
gagccuauauuccucuuuu

SEQ ID NO: 700407 - RNA, 19 nt, Homo sapiens
ggaagacucagcaggaaca

SEQ ID NO: 700408 - RNA, 19 nt, Homo sapiens
ugaaagagacacagucaca

SEQ ID NO: 700409 - RNA, 19 nt, Homo sapiens
ucccaacuauucuugcuuu

SEQ ID NO: 700410 - RNA, 19 nt, Homo sapiens
gcacugccucccuguguga

SEQ ID NO: 700411 - RNA, 19 nt, Homo sapiens
ucaaagagccuauauuccu

SEQ ID NO: 700412 - RNA, 19 nt, Homo sapiens
ucuggaagccucccaacua

SEQ ID NO: 700413 - RNA, 19 nt, Homo sapiens
gcuaagcaguguccagcau

SEQ ID NO: 700414 - RNA, 19 nt, Homo sapiens
ggaaaagggaugagagaaa

SEQ ID NO: 700415 - RNA, 19 nt, Homo sapiens
gaagagccuggaaagaugu

SEQ ID NO: 700416 - RNA, 19 nt, Homo sapiens
ucagugaagucauccucuu

SEQ ID NO: 700417 - RNA, 19 nt, Homo sapiens
ucucuccaccuauccauua

SEQ ID NO: 700418 - RNA, 19 nt, Homo sapiens
agacucaucuaguucauac

SEQ ID NO: 700419 - RNA, 19 nt, Homo sapiens
cuucaaagagccuauauuc

SEQ ID NO: 700420 - RNA, 19 nt, Homo sapiens
acacagaagcugaagacaa

SEQ ID NO: 700421 - RNA, 19 nt, Homo sapiens
ggacguugucacagauaaa

SEQ ID NO: 700422 - RNA, 19 nt, Homo sapiens
guucauauggaaacaaaga

SEQ ID NO: 700423 - RNA, 19 nt, Homo sapiens
gagagacucaucuaguuca

SEQ ID NO: 700424 - RNA, 19 nt, Homo sapiens
ggaacacaggcgcuugaaa

SEQ ID NO: 700425 - RNA, 19 nt, Homo sapiens
cuggaagccucccaacuau

SEQ ID NO: 700426 - RNA, 19 nt, Homo sapiens
ucacagccuccuuauaaug

SEQ ID NO: 700427 - RNA, 19 nt, Homo sapiens
ccagcucuguuucuaagug

SEQ ID NO: 700428 - RNA, 19 nt, Homo sapiens
aagcagaugccuguucaua

SEQ ID NO: 700429 - RNA, 19 nt, Homo sapiens
ucacagcugcucaagauuc

SEQ ID NO: 700430 - RNA, 19 nt, Homo sapiens
ggaaaguuguccccuugaa

SEQ ID NO: 700431 - RNA, 19 nt, Homo sapiens
gaggcauccugacaucugu

SEQ ID NO: 700432 - RNA, 19 nt, Homo sapiens
cugcagacuuccuaucuuc

SEQ ID NO: 700433 - RNA, 19 nt, Homo sapiens
uuucagcucuggccgcauu

SEQ ID NO: 700434 - RNA, 19 nt, Homo sapiens
ggggaaggauugucacuug

SEQ ID NO: 700435 - RNA, 19 nt, Homo sapiens
gagcacugccucccugugu

SEQ ID NO: 700436 - RNA, 19 nt, Homo sapiens
aaagagacacagucacaug

SEQ ID NO: 700437 - RNA, 19 nt, Homo sapiens
ccaaggacccagccaucaa

SEQ ID NO: 700438 - RNA, 19 nt, Homo sapiens
ggaggcauccugacaucug

SEQ ID NO: 700439 - RNA, 19 nt, Homo sapiens
ccaccuaccuagaaaauca

SEQ ID NO: 700440 - RNA, 19 nt, Homo sapiens
gaaagagacacagucacau

SEQ ID NO: 700441 - RNA, 19 nt, Homo sapiens
aaugcugccucuucaguga

SEQ ID NO: 700442 - RNA, 19 nt, Homo sapiens
ccaucugucuucucuccuu

SEQ ID NO: 700443 - RNA, 19 nt, Homo sapiens
acagucacauggccagaug

SEQ ID NO: 700444 - RNA, 19 nt, Homo sapiens
ucccaugucucugcucauu

SEQ ID NO: 700445 - RNA, 19 nt, Homo sapiens
cagaaaccaccaagacugu

SEQ ID NO: 700446 - RNA, 19 nt, Homo sapiens
gcucagaaaccaccaagac

SEQ ID NO: 700447 - RNA, 19 nt, Homo sapiens
gaggacguugucacagaua

SEQ ID NO: 700448 - RNA, 19 nt, Homo sapiens
gagacucaucuaguucaua

SEQ ID NO: 700449 - RNA, 19 nt, Homo sapiens
cacugguacuggcccuuua

SEQ ID NO: 700450 - RNA, 19 nt, Homo sapiens
gagaaaggaggugguaugg

SEQ ID NO: 700451 - RNA, 19 nt, Homo sapiens
gauguggacggacugguau

SEQ ID NO: 700452 - RNA, 19 nt, Homo sapiens
gaaaagccagcuacugaga

SEQ ID NO: 700453 - RNA, 19 nt, Homo sapiens
aggagaagccagcuacuga

SEQ ID NO: 700454 - RNA, 19 nt, Homo sapiens
cgagaaggcgccagugaag

SEQ ID NO: 700455 - RNA, 19 nt, Homo sapiens
gaaaggaggugguauggaa

SEQ ID NO: 700456 - RNA, 19 nt, Homo sapiens
ggaagagccuggaaagaug

SEQ ID NO: 700457 - RNA, 19 nt, Homo sapiens
ccacauggguccucauaaa

SEQ ID NO: 700458 - RNA, 19 nt, Homo sapiens
ccugacaucuguucauuua

SEQ ID NO: 700459 - RNA, 19 nt, Homo sapiens
ccaugucucugcucauuua

SEQ ID NO: 700460 - RNA, 19 nt, Homo sapiens
gagggaagcuucuggaaag

SEQ ID NO: 700461 - RNA, 19 nt, Homo sapiens
aaucacagccuccuuauaa

SEQ ID NO: 700462 - RNA, 19 nt, Homo sapiens
gaagugcucucgguguauu

SEQ ID NO: 700463 - RNA, 19 nt, Homo sapiens
caagacuguugaugccuua

SEQ ID NO: 700464 - RNA, 19 nt, Homo sapiens
gaaaaucacagccuccuua

SEQ ID NO: 700465 - RNA, 19 nt, Homo sapiens
ggaagcuucuggaaaggaa

SEQ ID NO: 700466 - RNA, 19 nt, Homo sapiens
gagcagaggccacuaaugg

SEQ ID NO: 700467 - RNA, 19 nt, Homo sapiens
gaauggaacgcugagcuua

SEQ ID NO: 700468 - RNA, 19 nt, Homo sapiens
caaacuccauucccaccua

SEQ ID NO: 700469 - RNA, 19 nt, Homo sapiens
gcagcaggguuaagacuca

SEQ ID NO: 700470 - RNA, 19 nt, Homo sapiens
ggaagccucccaacuauuc

SEQ ID NO: 700471 - RNA, 19 nt, Homo sapiens
acagcuaacuugagucuug

SEQ ID NO: 700472 - RNA, 19 nt, Homo sapiens
gccauucucucuccaccua

SEQ ID NO: 700473 - RNA, 19 nt, Homo sapiens
agacugcuacuacaucuua

SEQ ID NO: 700474 - RNA, 19 nt, Homo sapiens
gaacacaggcgcuugaaaa

SEQ ID NO: 700475 - RNA, 19 nt, Homo sapiens
agacacagcuaacuugagu

SEQ ID NO: 700476 - RNA, 19 nt, Homo sapiens
gcauuucccacaugacuuu

SEQ ID NO: 700477 - RNA, 19 nt, Homo sapiens
caccagaccucagcccuuu

SEQ ID NO: 700478 - RNA, 19 nt, Homo sapiens
gggaagagccuggaaagau

SEQ ID NO: 700479 - RNA, 19 nt, Homo sapiens
gaaaugcugccucuucagu

SEQ ID NO: 700480 - RNA, 19 nt, Homo sapiens
cacagaagcugaagacaac

SEQ ID NO: 700481 - RNA, 19 nt, Homo sapiens
gaaaccaccaagacuguug

SEQ ID NO: 700482 - RNA, 19 nt, Homo sapiens
ucccuucucucaccaaauu

SEQ ID NO: 700483 - RNA, 19 nt, Homo sapiens
ugacaucuguucauuuagg

SEQ ID NO: 700484 - RNA, 19 nt, Homo sapiens
uaagcaguguccagcauug

SEQ ID NO: 700485 - RNA, 19 nt, Homo sapiens
gaaaagggaugagagaaag

SEQ ID NO: 700486 - RNA, 19 nt, Homo sapiens
guccacagcagcaggguua

SEQ ID NO: 700487 - RNA, 19 nt, Homo sapiens
aagaggacguugucacaga

SEQ ID NO: 700488 - RNA, 19 nt, Homo sapiens
ggaagacucagcaggaaca

SEQ ID NO: 700489 - RNA, 19 nt, Homo sapiens
gcuagacacagcuaacuug

SEQ ID NO: 700490 - RNA, 19 nt, Homo sapiens
ucccaacuauucuugcuuu

SEQ ID NO: 700491 - RNA, 19 nt, Homo sapiens
ucuggaagccucccaacua

SEQ ID NO: 700492 - RNA, 19 nt, Homo sapiens
gcuaagcaguguccagcau

SEQ ID NO: 700493 - RNA, 19 nt, Homo sapiens
uaaggaccgggaauuaauu

SEQ ID NO: 700494 - RNA, 19 nt, Homo sapiens
ggaaaagggaugagagaaa

SEQ ID NO: 700495 - RNA, 19 nt, Homo sapiens
gaagagccuggaaagaugu

SEQ ID NO: 700496 - RNA, 19 nt, Homo sapiens
ucagugaagucauccucuu

SEQ ID NO: 700497 - RNA, 19 nt, Homo sapiens
ucucuccaccuauccauua

SEQ ID NO: 700498 - RNA, 19 nt, Homo sapiens
acacagaagcugaagacaa

SEQ ID NO: 700499 - RNA, 19 nt, Homo sapiens
ggacguugucacagauaaa

SEQ ID NO: 700500 - RNA, 19 nt, Homo sapiens
ggaacacaggcgcuugaaa

SEQ ID NO: 700501 - RNA, 19 nt, Homo sapiens
cuggaagccucccaacuau

SEQ ID NO: 700502 - RNA, 19 nt, Homo sapiens
ucacagccuccuuauaaug

SEQ ID NO: 700503 - RNA, 19 nt, Homo sapiens
cagaggaacaaauuaagga

SEQ ID NO: 700504 - RNA, 19 nt, Homo sapiens
gaggcauccugacaucugu

SEQ ID NO: 700505 - RNA, 19 nt, Homo sapiens
cugcagacuuccuaucuuc

SEQ ID NO: 700506 - RNA, 19 nt, Homo sapiens
uuucagcucuggccgcauu

SEQ ID NO: 700507 - RNA, 19 nt, Homo sapiens
ggaggcauccugacaucug

SEQ ID NO: 700508 - RNA, 19 nt, Homo sapiens
ccaccuaccuagaaaauca

SEQ ID NO: 700509 - RNA, 19 nt, Homo sapiens
aaugcugccucuucaguga

SEQ ID NO: 700510 - RNA, 19 nt, Homo sapiens
gcccaaaggacaagagcuu

SEQ ID NO: 700511 - RNA, 19 nt, Homo sapiens
gaggacguugucacagaua

SEQ ID NO: 700512 - RNA, 19 nt, Homo sapiens
ucccaugucucugcucauu

SEQ ID NO: 700513 - RNA, 19 nt, Homo sapiens
cagaaaccaccaagacugu

SEQ ID NO: 700514 - RNA, 19 nt, Homo sapiens
gcucagaaaccaccaagac

SEQ ID NO: 700515 - RNA, 19 nt, Homo sapiens
gagaaaggaggugguaugg

SEQ ID NO: 700516 - RNA, 19 nt, Homo sapiens
caaauuaaggaccgggaau

SEQ ID NO: 700517 - RNA, 19 nt, Homo sapiens
acacccagaggaacaaauu

SEQ ID NO: 700518 - RNA, 19 nt, Homo sapiens
ucacucuaauggacuguuc

SEQ ID NO: 700519 - RNA, 19 nt, Homo sapiens
ggucccuucucucaccaaa

SEQ ID NO: 700520 - RNA, 19 nt, Homo sapiens
ugagagaaaggagguggua

SEQ ID NO: 700521 - RNA, 19 nt, Homo sapiens
gagggacugccacacagaa

SEQ ID NO: 700522 - RNA, 19 nt, Homo sapiens
cauuuaggcuucaguucca

SEQ ID NO: 700523 - RNA, 19 nt, Homo sapiens
agagaaaggaggugguaug

SEQ ID NO: 700524 - RNA, 19 nt, Homo sapiens
gcauucugcagacuuccua

SEQ ID NO: 700525 - RNA, 19 nt, Homo sapiens
agagggaagcuucuggaaa

SEQ ID NO: 700526 - RNA, 19 nt, Homo sapiens
ggagcagaggccacuaaug

SEQ ID NO: 700527 - RNA, 19 nt, Homo sapiens
aaaucacagccuccuuaua

SEQ ID NO: 700528 - RNA, 19 nt, Homo sapiens
ccagagaagaggacguugu

SEQ ID NO: 700529 - RNA, 19 nt, Homo sapiens
aaagauguggccucaggaa

SEQ ID NO: 700530 - RNA, 19 nt, Homo sapiens
ccacacagaagcugaagac

SEQ ID NO: 700531 - RNA, 19 nt, Homo sapiens
caauggaggcauccugaca

SEQ ID NO: 700532 - RNA, 19 nt, Homo sapiens
ucaguuagaagcacaaagg

SEQ ID NO: 700533 - RNA, 19 nt, Homo sapiens
cagugaagucauccucuuu

SEQ ID NO: 700534 - RNA, 19 nt, Homo sapiens
ugucucugcucauuuaguc

SEQ ID NO: 700535 - RNA, 19 nt, Homo sapiens
agaagaggacguugucaca

SEQ ID NO: 700536 - RNA, 19 nt, Homo sapiens
agaggacguugucacagau

SEQ ID NO: 700537 - RNA, 19 nt, Homo sapiens
caacuucagcauccucuac

SEQ ID NO: 700538 - RNA, 19 nt, Homo sapiens
acccagaggaacaaauuaa

SEQ ID NO: 700539 - RNA, 19 nt, Homo sapiens
ugaauggaacgcugagcuu

SEQ ID NO: 700540 - RNA, 19 nt, Homo sapiens
cugcucuacugcucagaaa

SEQ ID NO: 700541 - RNA, 19 nt, Homo sapiens
cacccagaggaacaaauua

SEQ ID NO: 700542 - RNA, 19 nt, Homo sapiens
agagacugcuacuacaucu

SEQ ID NO: 700543 - RNA, 19 nt, Homo sapiens
cuucggauccacacuguau

SEQ ID NO: 700544 - RNA, 19 nt, Homo sapiens
cuagacacagcuaacuuga

SEQ ID NO: 700545 - RNA, 19 nt, Homo sapiens
cagagaagaggacguuguc

SEQ ID NO: 700546 - RNA, 19 nt, Homo sapiens
ggauccacacuguaucugu

SEQ ID NO: 700547 - RNA, 19 nt, Homo sapiens
ccagaggaacaaauuaagg

SEQ ID NO: 700548 - RNA, 19 nt, Homo sapiens
cagagacugcuacuacauc

SEQ ID NO: 700549 - RNA, 19 nt, Homo sapiens
aggacguugucacagauaa

SEQ ID NO: 700550 - RNA, 19 nt, Homo sapiens
uaccugcauuucccacaug

SEQ ID NO: 700551 - RNA, 19 nt, Homo sapiens
gcuccugacgcaugcauca

SEQ ID NO: 700552 - RNA, 19 nt, Homo sapiens
ccaaauucaaacuccauuc

SEQ ID NO: 700553 - RNA, 19 nt, Homo sapiens
gaaaguaucuugccacugu

SEQ ID NO: 700554 - RNA, 19 nt, Homo sapiens
uagcagaacugaaagauug

SEQ ID NO: 700555 - RNA, 19 nt, Homo sapiens
ggagauguuuguauacuga

SEQ ID NO: 700556 - RNA, 19 nt, Homo sapiens
ucaagaaacuuacacaugu

SEQ ID NO: 700557 - RNA, 19 nt, Homo sapiens
acacagaucugacugcauu

SEQ ID NO: 700558 - RNA, 19 nt, Homo sapiens
gaacugaaagauuguauug

SEQ ID NO: 700559 - RNA, 19 nt, Homo sapiens
ucauggagauguuuguaua

SEQ ID NO: 700560 - RNA, 19 nt, Homo sapiens
ggaaagacaaaggaaauuu

SEQ ID NO: 700561 - RNA, 19 nt, Homo sapiens
caagaguaguugaaaguau

SEQ ID NO: 700562 - RNA, 19 nt, Homo sapiens
gaaggacaaugacaucaag

SEQ ID NO: 700563 - RNA, 19 nt, Homo sapiens
gaagaauucuggucaagac

SEQ ID NO: 700564 - RNA, 19 nt, Homo sapiens
agacucagcugaacacaga

SEQ ID NO: 700565 - RNA, 19 nt, Homo sapiens
ugaaauuacugucagauca

SEQ ID NO: 700566 - RNA, 19 nt, Homo sapiens
gagaagacauuccuuuuga

SEQ ID NO: 700567 - RNA, 19 nt, Homo sapiens
cuacagccaucauaucuau

SEQ ID NO: 700568 - RNA, 19 nt, Homo sapiens
gaacacgccucuggcuaug

SEQ ID NO: 700569 - RNA, 19 nt, Homo sapiens
caaagugccugugaagaau

SEQ ID NO: 700570 - RNA, 19 nt, Homo sapiens
gacaaugacaucaagagua

SEQ ID NO: 700571 - RNA, 19 nt, Homo sapiens
gaaaccacauggacuuugg

SEQ ID NO: 700572 - RNA, 19 nt, Homo sapiens
gacuggagcuggaggaguu

SEQ ID NO: 700573 - RNA, 19 nt, Homo sapiens
ggacuuuggucagcucuau

SEQ ID NO: 700574 - RNA, 19 nt, Homo sapiens
cagcugaggcgguuuguaa

SEQ ID NO: 700575 - RNA, 19 nt, Homo sapiens
acaaugacaucaagaguag

SEQ ID NO: 700576 - RNA, 19 nt, Homo sapiens
gccauugccugucucuaaa

SEQ ID NO: 700577 - RNA, 19 nt, Homo sapiens
ugucagaucaguauuauug

SEQ ID NO: 700578 - RNA, 19 nt, Homo sapiens
ccacggcucaagaaacuua

SEQ ID NO: 700579 - RNA, 19 nt, Homo sapiens
gccaucauaucuauaacaa

SEQ ID NO: 700580 - RNA, 19 nt, Homo sapiens
cauaucagcugcccauuuu

SEQ ID NO: 700581 - RNA, 19 nt, Homo sapiens
uaguauagcugaaaugcau

SEQ ID NO: 700582 - RNA, 19 nt, Homo sapiens
aaauugagcuguccaugca

SEQ ID NO: 700583 - RNA, 19 nt, Homo sapiens
gaggcucccuucugaugaa

SEQ ID NO: 700584 - RNA, 19 nt, Homo sapiens
aaagauacauaugcagcua

SEQ ID NO: 700585 - RNA, 19 nt, Homo sapiens
cagccucuguugcaacuaa

SEQ ID NO: 700586 - RNA, 19 nt, Homo sapiens
gaauucuggucaagacuca

SEQ ID NO: 700587 - RNA, 19 nt, Homo sapiens
acaaagugccugugaagaa

SEQ ID NO: 700588 - RNA, 19 nt, Homo sapiens
ucacgagacucuggaucua

SEQ ID NO: 700589 - RNA, 19 nt, Homo sapiens
caagagagccacgaagaug

SEQ ID NO: 700590 - RNA, 19 nt, Homo sapiens
uagcugaaaugcaucuguu

SEQ ID NO: 700591 - RNA, 19 nt, Homo sapiens
gcacaguccagucaguuga

SEQ ID NO: 700592 - RNA, 19 nt, Homo sapiens
gaagcacaguccagucagu

SEQ ID NO: 700593 - RNA, 19 nt, Homo sapiens
ccuguauucuucccuuuaa

SEQ ID NO: 700594 - RNA, 19 nt, Homo sapiens
gaugccaguugccacauug

SEQ ID NO: 700595 - RNA, 19 nt, Homo sapiens
gccauaaacaccaaaguga

SEQ ID NO: 700596 - RNA, 19 nt, Homo sapiens
gcugaaaugcaucuguuaa

SEQ ID NO: 700597 - RNA, 19 nt, Homo sapiens
ucagcucuaucaguucuua

SEQ ID NO: 700598 - RNA, 19 nt, Homo sapiens
gaugaaacggaaagacaaa

SEQ ID NO: 700599 - RNA, 19 nt, Homo sapiens
ugaggcgguuuguaaguuu

SEQ ID NO: 700600 - RNA, 19 nt, Homo sapiens
caagaaacuuacacauguc

SEQ ID NO: 700601 - RNA, 19 nt, Homo sapiens
ggucaagacucagaaaauu

SEQ ID NO: 700602 - RNA, 19 nt, Homo sapiens
gaaacggaaagacaaagga

SEQ ID NO: 700603 - RNA, 19 nt, Homo sapiens
ccauaaagguaauguuggu

SEQ ID NO: 700604 - RNA, 19 nt, Homo sapiens
gaucaguauuauugaguag

SEQ ID NO: 700605 - RNA, 19 nt, Homo sapiens
gcaguaugcuagaauuuug

SEQ ID NO: 700606 - RNA, 19 nt, Homo sapiens
ggucagcucuaucaguucu

SEQ ID NO: 700607 - RNA, 19 nt, Homo sapiens
cauaaacaccaaagugaug

SEQ ID NO: 700608 - RNA, 19 nt, Homo sapiens
ggccacggcucaagaaacu

SEQ ID NO: 700609 - RNA, 19 nt, Homo sapiens
ucucuggccuguauucuuc

SEQ ID NO: 700610 - RNA, 19 nt, Homo sapiens
uauguucccuggugagaau

SEQ ID NO: 700611 - RNA, 19 nt, Homo sapiens
ggagcuggaggaguuauuu

SEQ ID NO: 700612 - RNA, 19 nt, Homo sapiens
ggacaaugacaucaagagu

SEQ ID NO: 700613 - RNA, 19 nt, Homo sapiens
gaaacuuacacauguccaa

SEQ ID NO: 700614 - RNA, 19 nt, Homo sapiens
guagaucccagcagacuca

SEQ ID NO: 700615 - RNA, 19 nt, Homo sapiens
gccaagagagccacgaaga

SEQ ID NO: 700616 - RNA, 19 nt, Homo sapiens
uuaccugccuucacuaaag

SEQ ID NO: 700617 - RNA, 19 nt, Homo sapiens
aagaguaguugaaaguauc

SEQ ID NO: 700618 - RNA, 19 nt, Homo sapiens
ggaaaccacauggacuuug

SEQ ID NO: 700619 - RNA, 19 nt, Homo sapiens
gcaacuaacaacucucagu

SEQ ID NO: 700620 - RNA, 19 nt, Homo sapiens
gcuaauugcuccccuuuca

SEQ ID NO: 700621 - RNA, 19 nt, Homo sapiens
acagccaucauaucuauaa

SEQ ID NO: 700622 - RNA, 19 nt, Homo sapiens
gaucuacagccaucauauc

SEQ ID NO: 700623 - RNA, 19 nt, Homo sapiens
caauaugaaccuggaugua

SEQ ID NO: 700624 - RNA, 19 nt, Homo sapiens
guagaaggacaaugacauc

SEQ ID NO: 700625 - RNA, 19 nt, Homo sapiens
gguuuagcaugccuggaaa

SEQ ID NO: 700626 - RNA, 19 nt, Homo sapiens
gcuuuggccuugggaauuc

SEQ ID NO: 700627 - RNA, 19 nt, Homo sapiens
ccagauguucuuuggugua

SEQ ID NO: 700628 - RNA, 19 nt, Homo sapiens
uuggucagcucuaucaguu

SEQ ID NO: 700629 - RNA, 19 nt, Homo sapiens
ggguuuagcaugccuggaa

SEQ ID NO: 700630 - RNA, 19 nt, Homo sapiens
gaaauuacugucagaucag

SEQ ID NO: 700631 - RNA, 19 nt, Homo sapiens
gcagaacugaaagauugua

SEQ ID NO: 700632 - RNA, 19 nt, Homo sapiens
guagcagaacugaaagauu

SEQ ID NO: 700633 - RNA, 19 nt, Homo sapiens
ucacuaaagaacccagaaa

SEQ ID NO: 700634 - RNA, 19 nt, Homo sapiens
ggcuguagcagaacugaaa

SEQ ID NO: 700635 - RNA, 19 nt, Homo sapiens
ggaauucugggaaaacuuu

SEQ ID NO: 700636 - RNA, 19 nt, Homo sapiens
ggcuaugucagcagagaua

SEQ ID NO: 700637 - RNA, 19 nt, Homo sapiens
cagaguggguuagagaaca

SEQ ID NO: 700638 - RNA, 19 nt, Homo sapiens
cagcugaacacagaucuga

SEQ ID NO: 700639 - RNA, 19 nt, Homo sapiens
aauaugaaccuggauguau

SEQ ID NO: 700640 - RNA, 19 nt, Homo sapiens
ccaguugccacauuguuga

SEQ ID NO: 700641 - RNA, 19 nt, Homo sapiens
caaaugaugaaacggaaag

SEQ ID NO: 700642 - RNA, 19 nt, Homo sapiens
uggaaaaccugguguuguu

SEQ ID NO: 700643 - RNA, 19 nt, Homo sapiens
ggaucuacagccaucauau

SEQ ID NO: 700644 - RNA, 19 nt, Homo sapiens
uuaaauacccggcaguucu

SEQ ID NO: 700645 - RNA, 19 nt, Homo sapiens
cagauguucuuugguguag

SEQ ID NO: 700646 - RNA, 19 nt, Homo sapiens
gggaaaccacauggacuuu

SEQ ID NO: 700647 - RNA, 19 nt, Homo sapiens
aaacggaaagacaaaggaa

SEQ ID NO: 700648 - RNA, 19 nt, Homo sapiens
ucagaucaguauuauugag

SEQ ID NO: 700649 - RNA, 19 nt, Homo sapiens
ccaagagagccacgaagau

SEQ ID NO: 700650 - RNA, 19 nt, Homo sapiens
gcuggaggaguuauuugaa

SEQ ID NO: 700651 - RNA, 19 nt, Homo sapiens
gagcuggaggaguuauuug

SEQ ID NO: 700652 - RNA, 19 nt, Homo sapiens
uaccugccuucacuaaaga

SEQ ID NO: 700653 - RNA, 19 nt, Homo sapiens
gaggagaauuugaagguuu

SEQ ID NO: 700654 - RNA, 19 nt, Homo sapiens
cauggaagaugccaaauug

SEQ ID NO: 700655 - RNA, 19 nt, Homo sapiens
ggaaauggcaguucugaga

SEQ ID NO: 700656 - RNA, 19 nt, Homo sapiens
caaugcuccucacauauua

SEQ ID NO: 700657 - RNA, 19 nt, Homo sapiens
caaauuggcccaggacuuu

SEQ ID NO: 700658 - RNA, 19 nt, Homo sapiens
ggccaugagugccaaguuu

SEQ ID NO: 700659 - RNA, 19 nt, Homo sapiens
ccaaugcuccucacauauu

SEQ ID NO: 700660 - RNA, 19 nt, Homo sapiens
ggaauuguaccauggaaga

SEQ ID NO: 700661 - RNA, 19 nt, Homo sapiens
gcuccucacauauuaauuu

SEQ ID NO: 700662 - RNA, 19 nt, Homo sapiens
agaagucacuggucuagau

SEQ ID NO: 700663 - RNA, 19 nt, Homo sapiens
acacggugcugcugcguaa

SEQ ID NO: 700664 - RNA, 19 nt, Homo sapiens
gggcaagccugcucuagag

SEQ ID NO: 700665 - RNA, 19 nt, Homo sapiens
ggagaaagccaaggccuau

SEQ ID NO: 700666 - RNA, 19 nt, Homo sapiens
uggccaagcuugaggaaga

SEQ ID NO: 700667 - RNA, 19 nt, Homo sapiens
gcagcaagauccggucugu

SEQ ID NO: 700668 - RNA, 19 nt, Homo sapiens
gaaccucagugccuacaac

SEQ ID NO: 700669 - RNA, 19 nt, Homo sapiens
gaccugggauagcaaguuc

SEQ ID NO: 700670 - RNA, 19 nt, Homo sapiens
gcucagacgugcagcuucu

SEQ ID NO: 700671 - RNA, 19 nt, Homo sapiens
caaagaggucgauggagaa

SEQ ID NO: 700672 - RNA, 19 nt, Homo sapiens
ggagaucuuuggcuuugag

SEQ ID NO: 700673 - RNA, 19 nt, Homo sapiens
gagggaaucaccaccuauu

SEQ ID NO: 700674 - RNA, 19 nt, Homo sapiens
gcaaguggcccuccauucg

SEQ ID NO: 700675 - RNA, 19 nt, Homo sapiens
acgugcagcuucuggaaua

SEQ ID NO: 700676 - RNA, 19 nt, Homo sapiens
ggaaucaccaccuauuucu

SEQ ID NO: 700677 - RNA, 19 nt, Homo sapiens
ucugugaucucauuucauc

SEQ ID NO: 700678 - RNA, 19 nt, Homo sapiens
ccauucguguguguauuua

SEQ ID NO: 700679 - RNA, 19 nt, Homo sapiens
gcugaagagcuaugaauuc

SEQ ID NO: 700680 - RNA, 19 nt, Homo sapiens
ugaacuggcucaacauggu

SEQ ID NO: 700681 - RNA, 19 nt, Homo sapiens
gggaaucaccaccuauuuc

SEQ ID NO: 700682 - RNA, 19 nt, Homo sapiens
caacaugggcaacuacaag

SEQ ID NO: 700683 - RNA, 19 nt, Homo sapiens
gaacuggcucaacaugguu

SEQ ID NO: 700684 - RNA, 19 nt, Homo sapiens
auccaaugcuccucacaua

SEQ ID NO: 700685 - RNA, 19 nt, Homo sapiens
gggcuuaccauccugucua

SEQ ID NO: 700686 - RNA, 19 nt, Homo sapiens
gguaugcaacggucacuga

SEQ ID NO: 700687 - RNA, 19 nt, Homo sapiens
gcggcuggcuucugugcuu

SEQ ID NO: 700688 - RNA, 19 nt, Homo sapiens
caacacccggcucuucaaa

SEQ ID NO: 700689 - RNA, 19 nt, Homo sapiens
gaggaaauggcaguucuga

SEQ ID NO: 700690 - RNA, 19 nt, Homo sapiens
acucugaggugacuuccaa

SEQ ID NO: 700691 - RNA, 19 nt, Homo sapiens
caucugcacugccauacgu

SEQ ID NO: 700692 - RNA, 19 nt, Homo sapiens
cgaggagaauuugaagguu

SEQ ID NO: 700693 - RNA, 19 nt, Homo sapiens
ccucugugaucucauuuca

SEQ ID NO: 700694 - RNA, 19 nt, Homo sapiens
guggcaagcucuucguaca

SEQ ID NO: 700695 - RNA, 19 nt, Homo sapiens
agacggaaggcuuuaagaa

SEQ ID NO: 700696 - RNA, 19 nt, Homo sapiens
agacagggcuuaccauccu

SEQ ID NO: 700697 - RNA, 19 nt, Homo sapiens
gacccgaguuggaggagau

SEQ ID NO: 700698 - RNA, 19 nt, Homo sapiens
ccauggaagaugccaaauu

SEQ ID NO: 700699 - RNA, 19 nt, Homo sapiens
ucaaaacguucucaccaaa

SEQ ID NO: 700700 - RNA, 19 nt, Homo sapiens
caacaugcccuggcugaag

SEQ ID NO: 700701 - RNA, 19 nt, Homo sapiens
uacgugaacuggcucaaca

SEQ ID NO: 700702 - RNA, 19 nt, Homo sapiens
cuggagaucuuuggcuuug

SEQ ID NO: 700703 - RNA, 19 nt, Homo sapiens
gcaagugcuggagaucuuu

SEQ ID NO: 700704 - RNA, 19 nt, Homo sapiens
gcaacuacaaguccuuugg

SEQ ID NO: 700705 - RNA, 19 nt, Homo sapiens
gagggacucguuaccauca

SEQ ID NO: 700706 - RNA, 19 nt, Homo sapiens
cgcaagugcuggagaucuu

SEQ ID NO: 700707 - RNA, 19 nt, Homo sapiens
gcaucaacauccccaacua

SEQ ID NO: 700708 - RNA, 19 nt, Homo sapiens
gcugcucgcucuggaguuc

SEQ ID NO: 700709 - RNA, 19 nt, Homo sapiens
agaauuugaagguuucgua

SEQ ID NO: 700710 - RNA, 19 nt, Homo sapiens
cucggaagcucauuguuca

SEQ ID NO: 700711 - RNA, 19 nt, Homo sapiens
gaccagcugcgccaacaug

SEQ ID NO: 700712 - RNA, 19 nt, Homo sapiens
gcuuggaccuugguacuac

SEQ ID NO: 700713 - RNA, 19 nt, Homo sapiens
gaaucucggaagcucauug

SEQ ID NO: 700714 - RNA, 19 nt, Homo sapiens
caacuuugaccaggaaaca

SEQ ID NO: 700715 - RNA, 19 nt, Homo sapiens
ggagggaaucaccaccuau

SEQ ID NO: 700716 - RNA, 19 nt, Homo sapiens
gaagucacuggucuagauc

SEQ ID NO: 700717 - RNA, 19 nt, Homo sapiens
aguacauccugcccaauga

SEQ ID NO: 700718 - RNA, 19 nt, Homo sapiens
gcagacggaaggcuuuaag

SEQ ID NO: 700719 - RNA, 19 nt, Homo sapiens
gaggcagacggaaggcuuu

SEQ ID NO: 700720 - RNA, 19 nt, Homo sapiens
ucaccucccuggauguucu

SEQ ID NO: 700721 - RNA, 19 nt, Homo sapiens
ugacuucaccucccuggau

SEQ ID NO: 700722 - RNA, 19 nt, Homo sapiens
gaagcaggaagugaguuug

SEQ ID NO: 700723 - RNA, 19 nt, Homo sapiens
uggagcagcuggagaaagc

SEQ ID NO: 700724 - RNA, 19 nt, Homo sapiens
agccuucccuggacucuga

SEQ ID NO: 700725 - RNA, 19 nt, Homo sapiens
ccacagccgaugcccgauu

SEQ ID NO: 700726 - RNA, 19 nt, Homo sapiens
gacacaaccccuuccauuu

SEQ ID NO: 700727 - RNA, 19 nt, Homo sapiens
cacagccgaugcccgauuc

SEQ ID NO: 700728 - RNA, 19 nt, Homo sapiens
ugacaaggaccuguacauc

SEQ ID NO: 700729 - RNA, 19 nt, Homo sapiens
gacggaaggcuuuaagaac

SEQ ID NO: 700730 - RNA, 19 nt, Homo sapiens
ccaugagugccaaguuuga

SEQ ID NO: 700731 - RNA, 19 nt, Homo sapiens
aggagggaaucaccaccua

SEQ ID NO: 700732 - RNA, 19 nt, Homo sapiens
cuauuucucugggaauugu

SEQ ID NO: 700733 - RNA, 19 nt, Homo sapiens
caguacauccugcccaaug

SEQ ID NO: 700734 - RNA, 19 nt, Homo sapiens
ucuaccagaugaggaaaug

SEQ ID NO: 700735 - RNA, 19 nt, Homo sapiens
gggcaacuacaaguccuuu

SEQ ID NO: 700736 - RNA, 19 nt, Homo sapiens
gcaccaucgccuccagcua

SEQ ID NO: 700737 - RNA, 19 nt, Homo sapiens
gagacgggcgagcagauuc

SEQ ID NO: 700738 - RNA, 19 nt, Homo sapiens
aggagaauuugaagguuuc

SEQ ID NO: 700739 - RNA, 19 nt, Homo sapiens
cuacaacacccggcucuuc

SEQ ID NO: 700740 - RNA, 19 nt, Homo sapiens
cgugacagcuaggguucaa

SEQ ID NO: 700741 - RNA, 19 nt, Homo sapiens
uuaccgaggaggaguauca

SEQ ID NO: 700742 - RNA, 19 nt, Homo sapiens
gcaagacagggcuuaccau

SEQ ID NO: 700743 - RNA, 19 nt, Homo sapiens
gcuggagaucuuuggcuuu

SEQ ID NO: 700744 - RNA, 19 nt, Homo sapiens
cccaguauauagagagcuu

SEQ ID NO: 700745 - RNA, 19 nt, Homo sapiens
gaaagccaaggccuaugca

SEQ ID NO: 700746 - RNA, 19 nt, Homo sapiens
caacuacaaguccuuuggu

SEQ ID NO: 700747 - RNA, 19 nt, Homo sapiens
gcagcacccagaagaaguc

SEQ ID NO: 700748 - RNA, 19 nt, Homo sapiens
caccugaggccuucaacug

SEQ ID NO: 700749 - RNA, 19 nt, Homo sapiens
gccaugagugccaaguuug

SEQ ID NO: 700750 - RNA, 19 nt, Homo sapiens
gagcuuggaccuugguacu

SEQ ID NO: 700751 - RNA, 19 nt, Homo sapiens
ucucggaagcucauuguuc

SEQ ID NO: 700752 - RNA, 19 nt, Homo sapiens
uaccauggaagaugccaaa

SEQ ID NO: 700753 - RNA, 19 nt, Homo sapiens
ggaaauggcaguucugaga

SEQ ID NO: 700754 - RNA, 19 nt, Homo sapiens
caaugcuccucacauauua

SEQ ID NO: 700755 - RNA, 19 nt, Homo sapiens
ccaaugcuccucacauauu

SEQ ID NO: 700756 - RNA, 19 nt, Homo sapiens
ggaauuguaccauggaaga

SEQ ID NO: 700757 - RNA, 19 nt, Homo sapiens
gcuccucacauauuaauuu

SEQ ID NO: 700758 - RNA, 19 nt, Homo sapiens
agaagucacuggucuagau

SEQ ID NO: 700759 - RNA, 19 nt, Homo sapiens
acacggugcugcugcguaa

SEQ ID NO: 700760 - RNA, 19 nt, Homo sapiens
gggcaagccugcucuagag

SEQ ID NO: 700761 - RNA, 19 nt, Homo sapiens
uggccaagcuugaggaaga

SEQ ID NO: 700762 - RNA, 19 nt, Homo sapiens
gcagcaagauccggucugu

SEQ ID NO: 700763 - RNA, 19 nt, Homo sapiens
gcucagacgugcagcuucu

SEQ ID NO: 700764 - RNA, 19 nt, Homo sapiens
gagggaaucaccaccuauu

SEQ ID NO: 700765 - RNA, 19 nt, Homo sapiens
gcaaguggcccuccauucg

SEQ ID NO: 700766 - RNA, 19 nt, Homo sapiens
acgugcagcuucuggaaua

SEQ ID NO: 700767 - RNA, 19 nt, Homo sapiens
ggaaucaccaccuauuucu

SEQ ID NO: 700768 - RNA, 19 nt, Homo sapiens
ucugugaucucauuucauc

SEQ ID NO: 700769 - RNA, 19 nt, Homo sapiens
gggaaucaccaccuauuuc

SEQ ID NO: 700770 - RNA, 19 nt, Homo sapiens
caacaugggcaacuacaag

SEQ ID NO: 700771 - RNA, 19 nt, Homo sapiens
auccaaugcuccucacaua

SEQ ID NO: 700772 - RNA, 19 nt, Homo sapiens
gggcuuaccauccugucua

SEQ ID NO: 700773 - RNA, 19 nt, Homo sapiens
gaggaaauggcaguucuga

SEQ ID NO: 700774 - RNA, 19 nt, Homo sapiens
caucugcacugccauacgu

SEQ ID NO: 700775 - RNA, 19 nt, Homo sapiens
ccucugugaucucauuuca

SEQ ID NO: 700776 - RNA, 19 nt, Homo sapiens
agacagggcuuaccauccu

SEQ ID NO: 700777 - RNA, 19 nt, Homo sapiens
gacccgaguuggaggagau

SEQ ID NO: 700778 - RNA, 19 nt, Homo sapiens
ucaaaacguucucaccaaa

SEQ ID NO: 700779 - RNA, 19 nt, Homo sapiens
caacaugcccuggcugaag

SEQ ID NO: 700780 - RNA, 19 nt, Homo sapiens
gcccuccauucgucacuuu

SEQ ID NO: 700781 - RNA, 19 nt, Homo sapiens
gcaacuacaaguccuuugg

SEQ ID NO: 700782 - RNA, 19 nt, Homo sapiens
gaccagcugcgccaacaug

SEQ ID NO: 700783 - RNA, 19 nt, Homo sapiens
cucggaagcucauuguuca

SEQ ID NO: 700784 - RNA, 19 nt, Homo sapiens
gaaucucggaagcucauug

SEQ ID NO: 700785 - RNA, 19 nt, Homo sapiens
ggagggaaucaccaccuau

SEQ ID NO: 700786 - RNA, 19 nt, Homo sapiens
gaagucacuggucuagauc

SEQ ID NO: 700787 - RNA, 19 nt, Homo sapiens
gaagcaggaagugaguuug

SEQ ID NO: 700788 - RNA, 19 nt, Homo sapiens
aguacauccugcccaauga

SEQ ID NO: 700789 - RNA, 19 nt, Homo sapiens
ccacagccgaugcccgauu

SEQ ID NO: 700790 - RNA, 19 nt, Homo sapiens
cacagccgaugcccgauuc

SEQ ID NO: 700791 - RNA, 19 nt, Homo sapiens
cuauuucucugggaauugu

SEQ ID NO: 700792 - RNA, 19 nt, Homo sapiens
aggagggaaucaccaccua

SEQ ID NO: 700793 - RNA, 19 nt, Homo sapiens
ucuaccagaugaggaaaug

SEQ ID NO: 700794 - RNA, 19 nt, Homo sapiens
caguacauccugcccaaug

SEQ ID NO: 700795 - RNA, 19 nt, Homo sapiens
gggcaacuacaaguccuuu

SEQ ID NO: 700796 - RNA, 19 nt, Homo sapiens
cgugacagcuaggguucaa

SEQ ID NO: 700797 - RNA, 19 nt, Homo sapiens
gcaagacagggcuuaccau

SEQ ID NO: 700798 - RNA, 19 nt, Homo sapiens
uuaccgaggaggaguauca

SEQ ID NO: 700799 - RNA, 19 nt, Homo sapiens
gcagcacccagaagaaguc

SEQ ID NO: 700800 - RNA, 19 nt, Homo sapiens
caacuacaaguccuuuggu

SEQ ID NO: 700801 - RNA, 19 nt, Homo sapiens
ucucggaagcucauuguuc

SEQ ID NO: 700802 - RNA, 19 nt, Homo sapiens
ccauggcggacacccagua

SEQ ID NO: 700803 - RNA, 19 nt, Homo sapiens
ggccaagcuugaggaagau

SEQ ID NO: 700804 - RNA, 19 nt, Homo sapiens
acuccaacaugggcaacua

SEQ ID NO: 700805 - RNA, 19 nt, Homo sapiens
gaaagaugaugaagaaaug

SEQ ID NO: 700806 - RNA, 19 nt, Homo sapiens
ggacagggauggagaguga

SEQ ID NO: 700807 - RNA, 19 nt, Homo sapiens
aaaccaagcuuaauccuuu

SEQ ID NO: 700808 - RNA, 19 nt, Homo sapiens
ccaagcggcuggauuaugu

SEQ ID NO: 700809 - RNA, 19 nt, Homo sapiens
acacuaugcuaaucaauug

SEQ ID NO: 700810 - RNA, 19 nt, Homo sapiens
cuaaagaacuucccuugca

SEQ ID NO: 700811 - RNA, 19 nt, Homo sapiens
gaugugcuaucuauggauu

SEQ ID NO: 700812 - RNA, 19 nt, Homo sapiens
gaaugggcacuaugaauug

SEQ ID NO: 700813 - RNA, 19 nt, Homo sapiens
cuggaugcauucaaaguua

SEQ ID NO: 700814 - RNA, 19 nt, Homo sapiens
ugacguuccuucagauuug

SEQ ID NO: 700815 - RNA, 19 nt, Homo sapiens
uaauugacguuccuucaga

SEQ ID NO: 700816 - RNA, 19 nt, Homo sapiens
gaagacuggcugaagauga

SEQ ID NO: 700817 - RNA, 19 nt, Homo sapiens
gaugccucauggagaauua

SEQ ID NO: 700818 - RNA, 19 nt, Homo sapiens
gaagaaggacugggagaga

SEQ ID NO: 700819 - RNA, 19 nt, Homo sapiens
gcaaaagacuacaccauuc

SEQ ID NO: 700820 - RNA, 19 nt, Homo sapiens
aaaguuaccagaagaagaa

SEQ ID NO: 700821 - RNA, 19 nt, Homo sapiens
gcauucagauugauuugag

SEQ ID NO: 700822 - RNA, 19 nt, Homo sapiens
gaugcuuucugagugguua

SEQ ID NO: 700823 - RNA, 19 nt, Homo sapiens
gagaaugggcacuaugaau

SEQ ID NO: 700824 - RNA, 19 nt, Homo sapiens
acacaaggccucugagaau

SEQ ID NO: 700825 - RNA, 19 nt, Homo sapiens
ggauuucccuuuugaggua

SEQ ID NO: 700826 - RNA, 19 nt, Homo sapiens
agaaugggcacuaugaauu

SEQ ID NO: 700827 - RNA, 19 nt, Homo sapiens
caccagcuccagcagauua

SEQ ID NO: 700828 - RNA, 19 nt, Homo sapiens
gauggagagugaggaagaa

SEQ ID NO: 700829 - RNA, 19 nt, Homo sapiens
uaucccagauccacaaugu

SEQ ID NO: 700830 - RNA, 19 nt, Homo sapiens
ggagagaaaaccaagcuua

SEQ ID NO: 700831 - RNA, 19 nt, Homo sapiens
aggagaaacucacacacaa

SEQ ID NO: 700832 - RNA, 19 nt, Homo sapiens
ucuacuggaugcauucaaa

SEQ ID NO: 700833 - RNA, 19 nt, Homo sapiens
ccagacugauuuccgauuc

SEQ ID NO: 700834 - RNA, 19 nt, Homo sapiens
ggauggagagugaggaaga

SEQ ID NO: 700835 - RNA, 19 nt, Homo sapiens
ugugugaugugcuaucuau

SEQ ID NO: 700836 - RNA, 19 nt, Homo sapiens
aagaguggcuacuguguca

SEQ ID NO: 700837 - RNA, 19 nt, Homo sapiens
caaaguuaccagaagaaga

SEQ ID NO: 700838 - RNA, 19 nt, Homo sapiens
aggcgaaacucaacagcaa

SEQ ID NO: 700839 - RNA, 19 nt, Homo sapiens
uggaaacagcuuaucuaua

SEQ ID NO: 700840 - RNA, 19 nt, Homo sapiens
gaugguaccuggccccaaa

SEQ ID NO: 700841 - RNA, 19 nt, Homo sapiens
ugagguagauggacuucuc

SEQ ID NO: 700842 - RNA, 19 nt, Homo sapiens
gaagauggaagaguugagu

SEQ ID NO: 700843 - RNA, 19 nt, Homo sapiens
aagaaggacugggagagaa

SEQ ID NO: 700844 - RNA, 19 nt, Homo sapiens
agacugauuuccgauucua

SEQ ID NO: 700845 - RNA, 19 nt, Homo sapiens
ucccagauccacaauguaa

SEQ ID NO: 700846 - RNA, 19 nt, Homo sapiens
aaugcuggcucaaacaguu

SEQ ID NO: 700847 - RNA, 19 nt, Homo sapiens
cacaaggccucugagaaug

SEQ ID NO: 700848 - RNA, 19 nt, Homo sapiens
caccaagaguggcuacugu

SEQ ID NO: 700849 - RNA, 19 nt, Homo sapiens
gugaugugcuaucuaugga

SEQ ID NO: 700850 - RNA, 19 nt, Homo sapiens
ccgaaagccugugugaugu

SEQ ID NO: 700851 - RNA, 19 nt, Homo sapiens
cuggaugccucauggagaa

SEQ ID NO: 700852 - RNA, 19 nt, Homo sapiens
acaagaagagccagaagga

SEQ ID NO: 700853 - RNA, 19 nt, Homo sapiens
aaaccagaccuacuacguu

SEQ ID NO: 700854 - RNA, 19 nt, Homo sapiens
gacuacaccauucuagauu

SEQ ID NO: 700855 - RNA, 19 nt, Homo sapiens
gaaguuaccaaaacacuau

SEQ ID NO: 700856 - RNA, 19 nt, Homo sapiens
ccagauccacaauguaaau

SEQ ID NO: 700857 - RNA, 19 nt, Homo sapiens
guagcauucagauugauuu

SEQ ID NO: 700858 - RNA, 19 nt, Homo sapiens
gaaaugcuggcucaaacag

SEQ ID NO: 700859 - RNA, 19 nt, Homo sapiens
gagagaaaaccaagcuuaa

SEQ ID NO: 700860 - RNA, 19 nt, Homo sapiens
ccuacuacguucuggaugu

SEQ ID NO: 700861 - RNA, 19 nt, Homo sapiens
cauucuagauugcauuuac

SEQ ID NO: 700862 - RNA, 19 nt, Homo sapiens
ucacacacaaggccucuga

SEQ ID NO: 700863 - RNA, 19 nt, Homo sapiens
aggaaggcaugaaggagaa

SEQ ID NO: 700864 - RNA, 19 nt, Homo sapiens
ggcaccagcuccagcagau

SEQ ID NO: 700865 - RNA, 19 nt, Homo sapiens
ggugucagauguccuuggu

SEQ ID NO: 700866 - RNA, 19 nt, Homo sapiens
guagauggacuucucuucu

SEQ ID NO: 700867 - RNA, 19 nt, Homo sapiens
uacuggaacugcagaaauc

SEQ ID NO: 700868 - RNA, 19 nt, Homo sapiens
agagugaacuuuccaaacc

SEQ ID NO: 700869 - RNA, 19 nt, Homo sapiens
ggagaaacucacacacaag

SEQ ID NO: 700870 - RNA, 19 nt, Homo sapiens
cccgaaagccugugugaug

SEQ ID NO: 700871 - RNA, 19 nt, Homo sapiens
gcauucaaaguuaccagaa

SEQ ID NO: 700872 - RNA, 19 nt, Homo sapiens
caauugaugcuuucugagu

SEQ ID NO: 700873 - RNA, 19 nt, Homo sapiens
uugcguagcauucagauug

SEQ ID NO: 700874 - RNA, 19 nt, Homo sapiens
ucauggagaauuaaagaga

SEQ ID NO: 700875 - RNA, 19 nt, Homo sapiens
caagaagagccagaaggaa

SEQ ID NO: 700876 - RNA, 19 nt, Homo sapiens
ugugaaccaugccagaaga

SEQ ID NO: 700877 - RNA, 19 nt, Homo sapiens
auucaaaguuaccagaaga

SEQ ID NO: 700878 - RNA, 19 nt, Homo sapiens
caacagguuuucuucacuu

SEQ ID NO: 700879 - RNA, 19 nt, Homo sapiens
ccucauggagaauuaaaga

SEQ ID NO: 700880 - RNA, 19 nt, Homo sapiens
ccaccaagccagacuaugc

SEQ ID NO: 700881 - RNA, 19 nt, Homo sapiens
guucccagauugcguagca

SEQ ID NO: 700882 - RNA, 19 nt, Homo sapiens
cgauucuacuggaugcauu

SEQ ID NO: 700883 - RNA, 19 nt, Homo sapiens
uaugauugccagacugauu

SEQ ID NO: 700884 - RNA, 19 nt, Homo sapiens
gagaggaggacagugacaa

SEQ ID NO: 700885 - RNA, 19 nt, Homo sapiens
gaauuggagcaccugucua

SEQ ID NO: 700886 - RNA, 19 nt, Homo sapiens
gcacaagaagagccagaag

SEQ ID NO: 700887 - RNA, 19 nt, Homo sapiens
acuacaccauucuagauug

SEQ ID NO: 700888 - RNA, 19 nt, Homo sapiens
cagauccacaauguaaaua

SEQ ID NO: 700889 - RNA, 19 nt, Homo sapiens
cccaguacaaguccaagua

SEQ ID NO: 700890 - RNA, 19 nt, Homo sapiens
agaaggaaggcaugaagga

SEQ ID NO: 700891 - RNA, 19 nt, Homo sapiens
aagccugugugaugugcua

SEQ ID NO: 700892 - RNA, 19 nt, Homo sapiens
gagaaaaccaagcuuaauc

SEQ ID NO: 700893 - RNA, 19 nt, Homo sapiens
agacuacaccauucuagau

SEQ ID NO: 700894 - RNA, 19 nt, Homo sapiens
ggaggcaacaggcgaaacu

SEQ ID NO: 700895 - RNA, 19 nt, Homo sapiens
cugaaaugcuggcucaaac

SEQ ID NO: 700896 - RNA, 19 nt, Homo sapiens
ugucuacucccaaguugaa

SEQ ID NO: 700897 - RNA, 19 nt, Homo sapiens
gauuauggagcacaagaag

SEQ ID NO: 700898 - RNA, 19 nt, Homo sapiens
caacaggcgaaacucaaca

SEQ ID NO: 700899 - RNA, 19 nt, Homo sapiens
guuaauugacguuccuuca

SEQ ID NO: 700900 - RNA, 19 nt, Homo sapiens
ccaaaacacuaugcuaauc

SEQ ID NO: 700901 - RNA, 19 nt, Homo sapiens
ucaagaaguuaccaaaaca

SEQ ID NO: 700902 - RNA, 19 nt, Homo sapiens
ugaaggagaaacucacaca

SEQ ID NO: 700903 - RNA, 19 nt, Homo sapiens
ggcaacaggcgaaacucaa

SEQ ID NO: 700904 - RNA, 19 nt, Homo sapiens
cagaagacuggcugaagau

SEQ ID NO: 700905 - RNA, 19 nt, Homo sapiens
ucacuaagcucuugacuaa

SEQ ID NO: 700906 - RNA, 19 nt, Homo sapiens
gcaaagaaauggauaucaa

SEQ ID NO: 700907 - RNA, 19 nt, Homo sapiens
gcacugagguccaagaguu

SEQ ID NO: 700908 - RNA, 19 nt, Homo sapiens
cagaguaccucacagcuua

SEQ ID NO: 700909 - RNA, 19 nt, Homo sapiens
gccaagagcuggagcguuu

SEQ ID NO: 700910 - RNA, 19 nt, Homo sapiens
ggaagcugcugauguauug

SEQ ID NO: 700911 - RNA, 19 nt, Homo sapiens
gaagauauggugacuguuu

SEQ ID NO: 700912 - RNA, 19 nt, Homo sapiens
ggaagaggcuaaaugucua

SEQ ID NO: 700913 - RNA, 19 nt, Homo sapiens
ugacaucgaugaucugaaa

SEQ ID NO: 700914 - RNA, 19 nt, Homo sapiens
ucaaggaagugaucuauga

SEQ ID NO: 700915 - RNA, 19 nt, Homo sapiens
gaagauacacgguccaauu

SEQ ID NO: 700916 - RNA, 19 nt, Homo sapiens
aagaugagcuccacacuuu

SEQ ID NO: 700917 - RNA, 19 nt, Homo sapiens
ggagugcucugaaggcuuu

SEQ ID NO: 700918 - RNA, 19 nt, Homo sapiens
gcaguuggcggcuuucuua

SEQ ID NO: 700919 - RNA, 19 nt, Homo sapiens
ccacaaauaugccaugaug

SEQ ID NO: 700920 - RNA, 19 nt, Homo sapiens
gagcccagaugacuaagua

SEQ ID NO: 700921 - RNA, 19 nt, Homo sapiens
gcuuugggcuggccuaaua

SEQ ID NO: 700922 - RNA, 19 nt, Homo sapiens
gcccaacccuccucuuaua

SEQ ID NO: 700923 - RNA, 19 nt, Homo sapiens
ggaauuggaugaggauuau

SEQ ID NO: 700924 - RNA, 19 nt, Homo sapiens
gaacaagucugagcaggau

SEQ ID NO: 700925 - RNA, 19 nt, Homo sapiens
caaggagccucucaagauu

SEQ ID NO: 700926 - RNA, 19 nt, Homo sapiens
uaacagaggagaauaagaa

SEQ ID NO: 700927 - RNA, 19 nt, Homo sapiens
ggagcucucucuuaacuga

SEQ ID NO: 700928 - RNA, 19 nt, Homo sapiens
agaaagaccaccugaguua

SEQ ID NO: 700929 - RNA, 19 nt, Homo sapiens
agaagggacugguuaauga

SEQ ID NO: 700930 - RNA, 19 nt, Homo sapiens
gugggaagcugcugaugua

SEQ ID NO: 700931 - RNA, 19 nt, Homo sapiens
ugacagcaaucaaacguaa

SEQ ID NO: 700932 - RNA, 19 nt, Homo sapiens
gcaaauauuuccgccaaga

SEQ ID NO: 700933 - RNA, 19 nt, Homo sapiens
gaagaaagaccaccugagu

SEQ ID NO: 700934 - RNA, 19 nt, Homo sapiens
cuaaaugucuagagaaguu

SEQ ID NO: 700935 - RNA, 19 nt, Homo sapiens
gaagaggaccagaugauga

SEQ ID NO: 700936 - RNA, 19 nt, Homo sapiens
gcaaagaagauaaggagaa

SEQ ID NO: 700937 - RNA, 19 nt, Homo sapiens
uaaaggaacuagaggaauc

SEQ ID NO: 700938 - RNA, 19 nt, Homo sapiens
gaaacccucucuccugaug

SEQ ID NO: 700939 - RNA, 19 nt, Homo sapiens
ucagucagauauacagaua

SEQ ID NO: 700940 - RNA, 19 nt, Homo sapiens
gcucugagauggaauugga

SEQ ID NO: 700941 - RNA, 19 nt, Homo sapiens
gagcagaaguggagaggau

SEQ ID NO: 700942 - RNA, 19 nt, Homo sapiens
gcgcauaccuguuccucuu

SEQ ID NO: 700943 - RNA, 19 nt, Homo sapiens
uaaaggcccuaaugcugua

SEQ ID NO: 700944 - RNA, 19 nt, Homo sapiens
ggagagcccagaugacuaa

SEQ ID NO: 700945 - RNA, 19 nt, Homo sapiens
gaucaugacagcaaucaaa

SEQ ID NO: 700946 - RNA, 19 nt, Homo sapiens
auacagauauggagaguga

SEQ ID NO: 700947 - RNA, 19 nt, Homo sapiens
cugcaggacuaauauauuu

SEQ ID NO: 700948 - RNA, 19 nt, Homo sapiens
ggaggaagaugaggaagau

SEQ ID NO: 700949 - RNA, 19 nt, Homo sapiens
cacaagagaugcagguuga

SEQ ID NO: 700950 - RNA, 19 nt, Homo sapiens
gaagugaucuaugauaugc

SEQ ID NO: 700951 - RNA, 19 nt, Homo sapiens
cagaagauauggugacugu

SEQ ID NO: 700952 - RNA, 19 nt, Homo sapiens
ggaagaaagcaaagaaaug

SEQ ID NO: 700953 - RNA, 19 nt, Homo sapiens
gacgagaacuagcacagaa

SEQ ID NO: 700954 - RNA, 19 nt, Homo sapiens
gauaaaggcaaagaagaua

SEQ ID NO: 700955 - RNA, 19 nt, Homo sapiens
aaacagcaauggacaggaa

SEQ ID NO: 700956 - RNA, 19 nt, Homo sapiens
cuaaguaccugcaauccaa

SEQ ID NO: 700957 - RNA, 19 nt, Homo sapiens
gagcaugcaugacuguguu

SEQ ID NO: 700958 - RNA, 19 nt, Homo sapiens
gagaugggaagaaagauaa

SEQ ID NO: 700959 - RNA, 19 nt, Homo sapiens
cgcaugaucuugaauuuga

SEQ ID NO: 700960 - RNA, 19 nt, Homo sapiens
gaaauggauaucaaacgua

SEQ ID NO: 700961 - RNA, 19 nt, Homo sapiens
gaaagcaaagaaauggaua

SEQ ID NO: 700962 - RNA, 19 nt, Homo sapiens
caaguggcauccuuaaugu

SEQ ID NO: 700963 - RNA, 19 nt, Homo sapiens
gaaacugguuccaaaggau

SEQ ID NO: 700964 - RNA, 19 nt, Homo sapiens
guaaaguuccuguuucuga

SEQ ID NO: 700965 - RNA, 19 nt, Homo sapiens
ggagguaaaguuccuguuu

SEQ ID NO: 700966 - RNA, 19 nt, Homo sapiens
gugcacagcuaaugauuca

SEQ ID NO: 700967 - RNA, 19 nt, Homo sapiens
ggagagcauugcguucuuu

SEQ ID NO: 700968 - RNA, 19 nt, Homo sapiens
ccacuacuguuucaauuuc

SEQ ID NO: 700969 - RNA, 19 nt, Homo sapiens
gaugacagguccacagauc

SEQ ID NO: 700970 - RNA, 19 nt, Homo sapiens
ggaguuagagcugcuuaua

SEQ ID NO: 700971 - RNA, 19 nt, Homo sapiens
ggcaguggcucuucaacaa

SEQ ID NO: 700972 - RNA, 19 nt, Homo sapiens
uggaggaccugauagauga

SEQ ID NO: 700973 - RNA, 19 nt, Homo sapiens
ccaaggagccucucaagau

SEQ ID NO: 700974 - RNA, 19 nt, Homo sapiens
gaagaaagcaaagaaaugg

SEQ ID NO: 700975 - RNA, 19 nt, Homo sapiens
cuacaauggugcagguuaa

SEQ ID NO: 700976 - RNA, 19 nt, Homo sapiens
gaacggaaagcucgggaaa

SEQ ID NO: 700977 - RNA, 19 nt, Homo sapiens
ggaaaccccugaagguaua

SEQ ID NO: 700978 - RNA, 19 nt, Homo sapiens
cgccggagcucucucuuaa

SEQ ID NO: 700979 - RNA, 19 nt, Homo sapiens
ccaaagaaacaaacuguga

SEQ ID NO: 700980 - RNA, 19 nt, Homo sapiens
cuagaaggcucuccuaugg

SEQ ID NO: 700981 - RNA, 19 nt, Homo sapiens
agucugaacugaucaaaga

SEQ ID NO: 700982 - RNA, 19 nt, Homo sapiens
gauggugccuccacugaga

SEQ ID NO: 700983 - RNA, 19 nt, Homo sapiens
gagguaaaguuccuguuuc

SEQ ID NO: 700984 - RNA, 19 nt, Homo sapiens
guacagacuuuaagauggu

SEQ ID NO: 700985 - RNA, 19 nt, Homo sapiens
caauuucucccacuacuaa

SEQ ID NO: 700986 - RNA, 19 nt, Homo sapiens
gcccuaggcugcaggacua

SEQ ID NO: 700987 - RNA, 19 nt, Homo sapiens
gaagugagcccugaguuuc

SEQ ID NO: 700988 - RNA, 19 nt, Homo sapiens
agacagccaucuccucaaa

SEQ ID NO: 700989 - RNA, 19 nt, Homo sapiens
ggaggaagaggcuaaaugu

SEQ ID NO: 700990 - RNA, 19 nt, Homo sapiens
cuacuuuacucgauccuuu

SEQ ID NO: 700991 - RNA, 19 nt, Homo sapiens
ggccaaagcuguauaugac

SEQ ID NO: 700992 - RNA, 19 nt, Homo sapiens
ucaagauacucaauccauu

SEQ ID NO: 700993 - RNA, 19 nt, Homo sapiens
cagcagcaguacagacuuu

SEQ ID NO: 700994 - RNA, 19 nt, Homo sapiens
uggauacacucauucaauu

SEQ ID NO: 700995 - RNA, 19 nt, Homo sapiens
gaacaguacaauuauagug

SEQ ID NO: 700996 - RNA, 19 nt, Homo sapiens
gcuagauggugacacauug

SEQ ID NO: 700997 - RNA, 19 nt, Homo sapiens
ucacagaaguggccaacug

SEQ ID NO: 700998 - RNA, 19 nt, Homo sapiens
gaggcuaaaugucuagaga

SEQ ID NO: 700999 - RNA, 19 nt, Homo sapiens
ggacuucuuguuaaacuuu

SEQ ID NO: 701000 - RNA, 19 nt, Homo sapiens
gcaagucagucagauauac

SEQ ID NO: 701001 - RNA, 19 nt, Homo sapiens
gaucagagugcacagugua

SEQ ID NO: 701002 - RNA, 19 nt, Homo sapiens
gauaacugauaaaggcaaa

SEQ ID NO: 701003 - RNA, 19 nt, Homo sapiens
gaggaagaaacaaagauaa

SEQ ID NO: 701004 - RNA, 19 nt, Homo sapiens
ugaaauccaacacugaaua

SEQ ID NO: 701005 - RNA, 19 nt, Homo sapiens
ucacugagauaaccacuaa

SEQ ID NO: 701006 - RNA, 19 nt, Homo sapiens
ggcauaagcugauguuugu

SEQ ID NO: 701007 - RNA, 19 nt, Homo sapiens
gcauugauccucagaguaa

SEQ ID NO: 701008 - RNA, 19 nt, Homo sapiens
ccaacuacauagaugguua

SEQ ID NO: 701009 - RNA, 19 nt, Homo sapiens
gcaaugagaccuaccaugu

SEQ ID NO: 701010 - RNA, 19 nt, Homo sapiens
ggacuuggcauuuaggauu

SEQ ID NO: 701011 - RNA, 19 nt, Homo sapiens
aaauaaacgugcucucuga

SEQ ID NO: 701012 - RNA, 19 nt, Homo sapiens
gacaugaucuuccucaagu

SEQ ID NO: 701013 - RNA, 19 nt, Homo sapiens
gcaaggaggucacuuucca

SEQ ID NO: 701014 - RNA, 19 nt, Homo sapiens
gaaccaggaucugccuauu

SEQ ID NO: 701015 - RNA, 19 nt, Homo sapiens
gugggaaggucucuuuaaa

SEQ ID NO: 701016 - RNA, 19 nt, Homo sapiens
gagagugugugaagacaga

SEQ ID NO: 701017 - RNA, 19 nt, Homo sapiens
gagaagacacacaugauga

SEQ ID NO: 701018 - RNA, 19 nt, Homo sapiens
ggucauacccucuggaguu

SEQ ID NO: 701019 - RNA, 19 nt, Homo sapiens
gcagcaauauggccucaug

SEQ ID NO: 701020 - RNA, 19 nt, Homo sapiens
uaaacgugcucucugaaug

SEQ ID NO: 701021 - RNA, 19 nt, Homo sapiens
gggcacagcugaugaagac

SEQ ID NO: 701022 - RNA, 19 nt, Homo sapiens
gcagugcuguguggaauau

SEQ ID NO: 701023 - RNA, 19 nt, Homo sapiens
gaaagcugccugcaaggaa

SEQ ID NO: 701024 - RNA, 19 nt, Homo sapiens
gaaggucucuuuaaaaugg

SEQ ID NO: 701025 - RNA, 19 nt, Homo sapiens
ucauggagguggaguuuau

SEQ ID NO: 701026 - RNA, 19 nt, Homo sapiens
ccacaaagaagaaagacaa

SEQ ID NO: 701027 - RNA, 19 nt, Homo sapiens
aauaucaggugcuguuuga

SEQ ID NO: 701028 - RNA, 19 nt, Homo sapiens
gaacuacaaacccaacaug

SEQ ID NO: 701029 - RNA, 19 nt, Homo sapiens
ggagaagacacacaugaug

SEQ ID NO: 701030 - RNA, 19 nt, Homo sapiens
gauaaccacuaacaucucu

SEQ ID NO: 701031 - RNA, 19 nt, Homo sapiens
caguacaucuucauucaug

SEQ ID NO: 701032 - RNA, 19 nt, Homo sapiens
ucuguaaacuguagauaug

SEQ ID NO: 701033 - RNA, 19 nt, Homo sapiens
gcaaagggagagaccacua

SEQ ID NO: 701034 - RNA, 19 nt, Homo sapiens
ggucaacacuucccagcau

SEQ ID NO: 701035 - RNA, 19 nt, Homo sapiens
caacaccaacuccaucauu

SEQ ID NO: 701036 - RNA, 19 nt, Homo sapiens
ugaagacggccgaggguua

SEQ ID NO: 701037 - RNA, 19 nt, Homo sapiens
gaaggccuaucucaucuac

SEQ ID NO: 701038 - RNA, 19 nt, Homo sapiens
gggaaggucucuuuaaaau

SEQ ID NO: 701039 - RNA, 19 nt, Homo sapiens
ccacuugcuucccugauau

SEQ ID NO: 701040 - RNA, 19 nt, Homo sapiens
cacagcugaugaagacuua

SEQ ID NO: 701041 - RNA, 19 nt, Homo sapiens
cauaagcugauguuuguaa

SEQ ID NO: 701042 - RNA, 19 nt, Homo sapiens
guacugggacuuggcauuu

SEQ ID NO: 701043 - RNA, 19 nt, Homo sapiens
agccugagauggucuauga

SEQ ID NO: 701044 - RNA, 19 nt, Homo sapiens
gccaaugccugccuaugau

SEQ ID NO: 701045 - RNA, 19 nt, Homo sapiens
gaagaaagacaaggucaag

SEQ ID NO: 701046 - RNA, 19 nt, Homo sapiens
gcucccagcuuugauuaug

SEQ ID NO: 701047 - RNA, 19 nt, Homo sapiens
caucucugcucccagcuuu

SEQ ID NO: 701048 - RNA, 19 nt, Homo sapiens
ucuccaagcuccgcaauga

SEQ ID NO: 701049 - RNA, 19 nt, Homo sapiens
gagcagggcuggucauacc

SEQ ID NO: 701050 - RNA, 19 nt, Homo sapiens
ucaacaugauccagacuga

SEQ ID NO: 701051 - RNA, 19 nt, Homo sapiens
gcauguggguagaggaugu

SEQ ID NO: 701052 - RNA, 19 nt, Homo sapiens
uccaacaacuacauuaaug

SEQ ID NO: 701053 - RNA, 19 nt, Homo sapiens
aaagcugccugcaaggaaa

SEQ ID NO: 701054 - RNA, 19 nt, Homo sapiens
gaauaucaggugcuguuug

SEQ ID NO: 701055 - RNA, 19 nt, Homo sapiens
agauaugacuacugaccua

SEQ ID NO: 701056 - RNA, 19 nt, Homo sapiens
uggcugagguggacaagug

SEQ ID NO: 701057 - RNA, 19 nt, Homo sapiens
cuuaguggcucgagucuuc

SEQ ID NO: 701058 - RNA, 19 nt, Homo sapiens
gcacagcugaugaagacuu

SEQ ID NO: 701059 - RNA, 19 nt, Homo sapiens
ccgcacagguugcuauauc

SEQ ID NO: 701060 - RNA, 19 nt, Homo sapiens
caucagacccggcagugaa

SEQ ID NO: 701061 - RNA, 19 nt, Homo sapiens
gagcaguacaucuucauuc

SEQ ID NO: 701062 - RNA, 19 nt, Homo sapiens
gaggagcaguacaucuuca

SEQ ID NO: 701063 - RNA, 19 nt, Homo sapiens
uggagaccauggaucagua

SEQ ID NO: 701064 - RNA, 19 nt, Homo sapiens
ccacggcuccuacuugaug

SEQ ID NO: 701065 - RNA, 19 nt, Homo sapiens
gggaaccacugggcuacaa

SEQ ID NO: 701066 - RNA, 19 nt, Homo sapiens
ccaccuaccucaucaucca

SEQ ID NO: 701067 - RNA, 19 nt, Homo sapiens
ucgcggagcucaucgucaa

SEQ ID NO: 701068 - RNA, 19 nt, Homo sapiens
ggugggaaggucucuuuaa

SEQ ID NO: 701069 - RNA, 19 nt, Homo sapiens
ggacuccaacaacuacauu

SEQ ID NO: 701070 - RNA, 19 nt, Homo sapiens
cauuaaugccaacuacaua

SEQ ID NO: 701071 - RNA, 19 nt, Homo sapiens
caaagaagaaagacaaggu

SEQ ID NO: 701072 - RNA, 19 nt, Homo sapiens
ccaaggccaccgucaacua

SEQ ID NO: 701073 - RNA, 19 nt, Homo sapiens
ggaaagcugccugcaagga

SEQ ID NO: 701074 - RNA, 19 nt, Homo sapiens
gggagacccggcugaauug

SEQ ID NO: 701075 - RNA, 19 nt, Homo sapiens
ggacaugaucuuccucaag

SEQ ID NO: 701076 - RNA, 19 nt, Homo sapiens
cccacuugcuucccugaua

SEQ ID NO: 701077 - RNA, 19 nt, Homo sapiens
ggcggcuggucuacgauua

SEQ ID NO: 701078 - RNA, 19 nt, Homo sapiens
cgagaaugauacccacugu

SEQ ID NO: 701079 - RNA, 19 nt, Homo sapiens
ugagauaaccacuaacauc

SEQ ID NO: 701080 - RNA, 19 nt, Homo sapiens
guaaauaaacgugcucucu

SEQ ID NO: 701081 - RNA, 19 nt, Homo sapiens
gggcagugcuguguggaau

SEQ ID NO: 701082 - RNA, 19 nt, Homo sapiens
caggucaaaccacuucaua

SEQ ID NO: 701083 - RNA, 19 nt, Homo sapiens
ggaguaugagagcuucuuu

SEQ ID NO: 701084 - RNA, 19 nt, Homo sapiens
caaagggagagaccacuau

SEQ ID NO: 701085 - RNA, 19 nt, Homo sapiens
cgacacagaguaugagauc

SEQ ID NO: 701086 - RNA, 19 nt, Homo sapiens
gacccacuguugcagaaug

SEQ ID NO: 701087 - RNA, 19 nt, Homo sapiens
ccaaggaggagcuuagcaa

SEQ ID NO: 701088 - RNA, 19 nt, Homo sapiens
ccaaaacccuccggaacua

SEQ ID NO: 701089 - RNA, 19 nt, Homo sapiens
ccacgguccuggagaugau

SEQ ID NO: 701090 - RNA, 19 nt, Homo sapiens
gcuauaucguccuggaugu

SEQ ID NO: 701091 - RNA, 19 nt, Homo sapiens
aggccuaucucaucuacuu

SEQ ID NO: 701092 - RNA, 19 nt, Homo sapiens
caacaacuacauuaaugca

SEQ ID NO: 701093 - RNA, 19 nt, Homo sapiens
ucaagauuaugcuggugaa

SEQ ID NO: 701094 - RNA, 19 nt, Homo sapiens
cuacauuaaugccaacuac

SEQ ID NO: 701095 - RNA, 19 nt, Homo sapiens
gcugggacgccacaaagaa

SEQ ID NO: 701096 - RNA, 19 nt, Homo sapiens
ggaaggccuaucucaucua

SEQ ID NO: 701097 - RNA, 19 nt, Homo sapiens
gcgagcccaugucaucuuc

SEQ ID NO: 701098 - RNA, 19 nt, Homo sapiens
gaguucagaggaagaggua

SEQ ID NO: 701099 - RNA, 19 nt, Homo sapiens
aaccaggaucugccuauua

SEQ ID NO: 701100 - RNA, 19 nt, Homo sapiens
gacuuggcauuuaggauuc

SEQ ID NO: 701101 - RNA, 19 nt, Homo sapiens
ggacuggcgaggaagauca

SEQ ID NO: 701102 - RNA, 19 nt, Homo sapiens
caggagaagacacacauga

SEQ ID NO: 701103 - RNA, 19 nt, Homo sapiens
cugcaaggcugaacaacag

SEQ ID NO: 701104 - RNA, 19 nt, Homo sapiens
ggcagggccuuucgcuugu

SEQ ID NO: 701105 - RNA, 19 nt, Homo sapiens
cuacauagauauucggaua

SEQ ID NO: 701106 - RNA, 19 nt, Homo sapiens
ucacugagauaaccacuaa

SEQ ID NO: 701107 - RNA, 19 nt, Homo sapiens
ggcauaagcugauguuugu

SEQ ID NO: 701108 - RNA, 19 nt, Homo sapiens
gcauugauccucagaguaa

SEQ ID NO: 701109 - RNA, 19 nt, Homo sapiens
gcaaugagaccuaccaugu

SEQ ID NO: 701110 - RNA, 19 nt, Homo sapiens
ggacuuggcauuuaggauu

SEQ ID NO: 701111 - RNA, 19 nt, Homo sapiens
aaauaaacgugcucucuga

SEQ ID NO: 701112 - RNA, 19 nt, Homo sapiens
gacaugaucuuccucaagu

SEQ ID NO: 701113 - RNA, 19 nt, Homo sapiens
gcaaggaggucacuuucca

SEQ ID NO: 701114 - RNA, 19 nt, Homo sapiens
gaaccaggaucugccuauu

SEQ ID NO: 701115 - RNA, 19 nt, Homo sapiens
gugggaaggucucuuuaaa

SEQ ID NO: 701116 - RNA, 19 nt, Homo sapiens
gagagugugugaagacaga

SEQ ID NO: 701117 - RNA, 19 nt, Homo sapiens
gagaagacacacaugauga

SEQ ID NO: 701118 - RNA, 19 nt, Homo sapiens
ggucauacccucuggaguu

SEQ ID NO: 701119 - RNA, 19 nt, Homo sapiens
gcagcaauauggccucaug

SEQ ID NO: 701120 - RNA, 19 nt, Homo sapiens
uaaacgugcucucugaaug

SEQ ID NO: 701121 - RNA, 19 nt, Homo sapiens
gggcacagcugaugaagac

SEQ ID NO: 701122 - RNA, 19 nt, Homo sapiens
gcagugcuguguggaauau

SEQ ID NO: 701123 - RNA, 19 nt, Homo sapiens
gaaagcugccugcaaggaa

SEQ ID NO: 701124 - RNA, 19 nt, Homo sapiens
gaaggucucuuuaaaaugg

SEQ ID NO: 701125 - RNA, 19 nt, Homo sapiens
ucauggagguggaguuuau

SEQ ID NO: 701126 - RNA, 19 nt, Homo sapiens
ccacaaagaagaaagacaa

SEQ ID NO: 701127 - RNA, 19 nt, Homo sapiens
aauaucaggugcuguuuga

SEQ ID NO: 701128 - RNA, 19 nt, Homo sapiens
gaacuacaaacccaacaug

SEQ ID NO: 701129 - RNA, 19 nt, Homo sapiens
ggagaagacacacaugaug

SEQ ID NO: 701130 - RNA, 19 nt, Homo sapiens
gauaaccacuaacaucucu

SEQ ID NO: 701131 - RNA, 19 nt, Homo sapiens
caguacaucuucauucaug

SEQ ID NO: 701132 - RNA, 19 nt, Homo sapiens
ucuguaaacuguagauaug

SEQ ID NO: 701133 - RNA, 19 nt, Homo sapiens
ggucaacacuucccagcau

SEQ ID NO: 701134 - RNA, 19 nt, Homo sapiens
caacaccaacuccaucauu

SEQ ID NO: 701135 - RNA, 19 nt, Homo sapiens
ugaagacggccgaggguua

SEQ ID NO: 701136 - RNA, 19 nt, Homo sapiens
gaaggccuaucucaucuac

SEQ ID NO: 701137 - RNA, 19 nt, Homo sapiens
gggaaggucucuuuaaaau

SEQ ID NO: 701138 - RNA, 19 nt, Homo sapiens
ccacuugcuucccugauau

SEQ ID NO: 701139 - RNA, 19 nt, Homo sapiens
cacagcugaugaagacuua

SEQ ID NO: 701140 - RNA, 19 nt, Homo sapiens
cauaagcugauguuuguaa

SEQ ID NO: 701141 - RNA, 19 nt, Homo sapiens
guacugggacuuggcauuu

SEQ ID NO: 701142 - RNA, 19 nt, Homo sapiens
agccugagauggucuauga

SEQ ID NO: 701143 - RNA, 19 nt, Homo sapiens
gccaaugccugccuaugau

SEQ ID NO: 701144 - RNA, 19 nt, Homo sapiens
gaagaaagacaaggucaag

SEQ ID NO: 701145 - RNA, 19 nt, Homo sapiens
ggaguacgagagcuucuuu

SEQ ID NO: 701146 - RNA, 19 nt, Homo sapiens
gcaaagggaagccggugaa

SEQ ID NO: 701147 - RNA, 19 nt, Homo sapiens
gcucccagcuuugauuaug

SEQ ID NO: 701148 - RNA, 19 nt, Homo sapiens
caucucugcucccagcuuu

SEQ ID NO: 701149 - RNA, 19 nt, Homo sapiens
ucuccaagcuccgcaauga

SEQ ID NO: 701150 - RNA, 19 nt, Homo sapiens
gagcagggcuggucauacc

SEQ ID NO: 701151 - RNA, 19 nt, Homo sapiens
ucaacaugauccagacuga

SEQ ID NO: 701152 - RNA, 19 nt, Homo sapiens
gcauguggguagaggaugu

SEQ ID NO: 701153 - RNA, 19 nt, Homo sapiens
uccaacaacuacauuaaug

SEQ ID NO: 701154 - RNA, 19 nt, Homo sapiens
aaagcugccugcaaggaaa

SEQ ID NO: 701155 - RNA, 19 nt, Homo sapiens
gaauaucaggugcuguuug

SEQ ID NO: 701156 - RNA, 19 nt, Homo sapiens
agauaugacuacugaccua

SEQ ID NO: 701157 - RNA, 19 nt, Homo sapiens
uggcugagguggacaagug

SEQ ID NO: 701158 - RNA, 19 nt, Homo sapiens
cuuaguggcucgagucuuc

SEQ ID NO: 701159 - RNA, 19 nt, Homo sapiens
gcacagcugaugaagacuu

SEQ ID NO: 701160 - RNA, 19 nt, Homo sapiens
ccgcacagguugcuauauc

SEQ ID NO: 701161 - RNA, 19 nt, Homo sapiens
guacgagagcuucuuugaa

SEQ ID NO: 701162 - RNA, 19 nt, Homo sapiens
caucagacccggcagugaa

SEQ ID NO: 701163 - RNA, 19 nt, Homo sapiens
gagcaguacaucuucauuc

SEQ ID NO: 701164 - RNA, 19 nt, Homo sapiens
gaggagcaguacaucuuca

SEQ ID NO: 701165 - RNA, 19 nt, Homo sapiens
uggagaccauggaucagua

SEQ ID NO: 701166 - RNA, 19 nt, Homo sapiens
ccacggcuccuacuugaug

SEQ ID NO: 701167 - RNA, 19 nt, Homo sapiens
aaugccaacuacauagaua

SEQ ID NO: 701168 - RNA, 19 nt, Homo sapiens
gggaaccacugggcuacaa

SEQ ID NO: 701169 - RNA, 19 nt, Homo sapiens
ccaccuaccucaucaucca

SEQ ID NO: 701170 - RNA, 19 nt, Homo sapiens
ucgcggagcucaucgucaa

SEQ ID NO: 701171 - RNA, 19 nt, Homo sapiens
ggugggaaggucucuuuaa

SEQ ID NO: 701172 - RNA, 19 nt, Homo sapiens
ggacuccaacaacuacauu

SEQ ID NO: 701173 - RNA, 19 nt, Homo sapiens
cauuaaugccaacuacaua

SEQ ID NO: 701174 - RNA, 19 nt, Homo sapiens
caaagaagaaagacaaggu

SEQ ID NO: 701175 - RNA, 19 nt, Homo sapiens
ccaaggccaccgucaacua

SEQ ID NO: 701176 - RNA, 19 nt, Homo sapiens
ggaaagcugccugcaagga

SEQ ID NO: 701177 - RNA, 19 nt, Homo sapiens
gggagacccggcugaauug

SEQ ID NO: 701178 - RNA, 19 nt, Homo sapiens
ggacaugaucuuccucaag

SEQ ID NO: 701179 - RNA, 19 nt, Homo sapiens
cccacuugcuucccugaua

SEQ ID NO: 701180 - RNA, 19 nt, Homo sapiens
ggcggcuggucuacgauua

SEQ ID NO: 701181 - RNA, 19 nt, Homo sapiens
cgagaaugauacccacugu

SEQ ID NO: 701182 - RNA, 19 nt, Homo sapiens
ggaagccggugaacaugac

SEQ ID NO: 701183 - RNA, 19 nt, Homo sapiens
ugagauaaccacuaacauc

SEQ ID NO: 701184 - RNA, 19 nt, Homo sapiens
guaaauaaacgugcucucu

SEQ ID NO: 701185 - RNA, 19 nt, Homo sapiens
caggucaaaccacuucaua

SEQ ID NO: 701186 - RNA, 19 nt, Homo sapiens
gggcagugcuguguggaau

SEQ ID NO: 701187 - RNA, 19 nt, Homo sapiens
cgacacagaguaugagauc

SEQ ID NO: 701188 - RNA, 19 nt, Homo sapiens
gacccacuguugcagaaug

SEQ ID NO: 701189 - RNA, 19 nt, Homo sapiens
ccaaggaggagcuuagcaa

SEQ ID NO: 701190 - RNA, 19 nt, Homo sapiens
ccaaaacccuccggaacua

SEQ ID NO: 701191 - RNA, 19 nt, Homo sapiens
ccacgguccuggagaugau

SEQ ID NO: 701192 - RNA, 19 nt, Homo sapiens
gcuauaucguccuggaugu

SEQ ID NO: 701193 - RNA, 19 nt, Homo sapiens
aggccuaucucaucuacuu

SEQ ID NO: 701194 - RNA, 19 nt, Homo sapiens
caacaacuacauuaaugca

SEQ ID NO: 701195 - RNA, 19 nt, Homo sapiens
ucaagauuaugcuggugaa

SEQ ID NO: 701196 - RNA, 19 nt, Homo sapiens
cuacauuaaugccaacuac

SEQ ID NO: 701197 - RNA, 19 nt, Homo sapiens
gcugggacgccacaaagaa

SEQ ID NO: 701198 - RNA, 19 nt, Homo sapiens
gcgagcccaugucaucuuc

SEQ ID NO: 701199 - RNA, 19 nt, Homo sapiens
ggaaggccuaucucaucua

SEQ ID NO: 701200 - RNA, 19 nt, Homo sapiens
gaguucagaggaagaggua

SEQ ID NO: 701201 - RNA, 19 nt, Homo sapiens
aaccaggaucugccuauua

SEQ ID NO: 701202 - RNA, 19 nt, Homo sapiens
gacuuggcauuuaggauuc

SEQ ID NO: 701203 - RNA, 19 nt, Homo sapiens
ggacuggcgaggaagauca

SEQ ID NO: 701204 - RNA, 19 nt, Homo sapiens
caggagaagacacacauga

SEQ ID NO: 701205 - RNA, 19 nt, Homo sapiens
ucacugagauaaccacuaa

SEQ ID NO: 701206 - RNA, 19 nt, Homo sapiens
ggcauaagcugauguuugu

SEQ ID NO: 701207 - RNA, 19 nt, Homo sapiens
gcauugauccucagaguaa

SEQ ID NO: 701208 - RNA, 19 nt, Homo sapiens
ccaacuacauagaugguua

SEQ ID NO: 701209 - RNA, 19 nt, Homo sapiens
gcaaugagaccuaccaugu

SEQ ID NO: 701210 - RNA, 19 nt, Homo sapiens
ggacuuggcauuuaggauu

SEQ ID NO: 701211 - RNA, 19 nt, Homo sapiens
aaauaaacgugcucucuga

SEQ ID NO: 701212 - RNA, 19 nt, Homo sapiens
gacaugaucuuccucaagu

SEQ ID NO: 701213 - RNA, 19 nt, Homo sapiens
gcaaggaggucacuuucca

SEQ ID NO: 701214 - RNA, 19 nt, Homo sapiens
gaaccaggaucugccuauu

SEQ ID NO: 701215 - RNA, 19 nt, Homo sapiens
gugggaaggucucuuuaaa

SEQ ID NO: 701216 - RNA, 19 nt, Homo sapiens
gagagugugugaagacaga

SEQ ID NO: 701217 - RNA, 19 nt, Homo sapiens
gagaagacacacaugauga

SEQ ID NO: 701218 - RNA, 19 nt, Homo sapiens
ggucauacccucuggaguu

SEQ ID NO: 701219 - RNA, 19 nt, Homo sapiens
gcagcaauauggccucaug

SEQ ID NO: 701220 - RNA, 19 nt, Homo sapiens
uaaacgugcucucugaaug

SEQ ID NO: 701221 - RNA, 19 nt, Homo sapiens
gggcacagcugaugaagac

SEQ ID NO: 701222 - RNA, 19 nt, Homo sapiens
gcagugcuguguggaauau

SEQ ID NO: 701223 - RNA, 19 nt, Homo sapiens
gaaagcugccugcaaggaa

SEQ ID NO: 701224 - RNA, 19 nt, Homo sapiens
gaaggucucuuuaaaaugg

SEQ ID NO: 701225 - RNA, 19 nt, Homo sapiens
ucauggagguggaguuuau

SEQ ID NO: 701226 - RNA, 19 nt, Homo sapiens
ccacaaagaagaaagacaa

SEQ ID NO: 701227 - RNA, 19 nt, Homo sapiens
aauaucaggugcuguuuga

SEQ ID NO: 701228 - RNA, 19 nt, Homo sapiens
gaacuacaaacccaacaug

SEQ ID NO: 701229 - RNA, 19 nt, Homo sapiens
ggagaagacacacaugaug

SEQ ID NO: 701230 - RNA, 19 nt, Homo sapiens
gauaaccacuaacaucucu

SEQ ID NO: 701231 - RNA, 19 nt, Homo sapiens
caguacaucuucauucaug

SEQ ID NO: 701232 - RNA, 19 nt, Homo sapiens
ucuguaaacuguagauaug

SEQ ID NO: 701233 - RNA, 19 nt, Homo sapiens
ggucaacacuucccagcau

SEQ ID NO: 701234 - RNA, 19 nt, Homo sapiens
caacaccaacuccaucauu

SEQ ID NO: 701235 - RNA, 19 nt, Homo sapiens
ugaagacggccgaggguua

SEQ ID NO: 701236 - RNA, 19 nt, Homo sapiens
gaaggccuaucucaucuac

SEQ ID NO: 701237 - RNA, 19 nt, Homo sapiens
gggaaggucucuuuaaaau

SEQ ID NO: 701238 - RNA, 19 nt, Homo sapiens
ccacuugcuucccugauau

SEQ ID NO: 701239 - RNA, 19 nt, Homo sapiens
cacagcugaugaagacuua

SEQ ID NO: 701240 - RNA, 19 nt, Homo sapiens
cauaagcugauguuuguaa

SEQ ID NO: 701241 - RNA, 19 nt, Homo sapiens
guacugggacuuggcauuu

SEQ ID NO: 701242 - RNA, 19 nt, Homo sapiens
agccugagauggucuauga

SEQ ID NO: 701243 - RNA, 19 nt, Homo sapiens
gccaaugccugccuaugau

SEQ ID NO: 701244 - RNA, 19 nt, Homo sapiens
gaagaaagacaaggucaag

SEQ ID NO: 701245 - RNA, 19 nt, Homo sapiens
gcaaagggaagccggugaa

SEQ ID NO: 701246 - RNA, 19 nt, Homo sapiens
gcucccagcuuugauuaug

SEQ ID NO: 701247 - RNA, 19 nt, Homo sapiens
caucucugcucccagcuuu

SEQ ID NO: 701248 - RNA, 19 nt, Homo sapiens
ucuccaagcuccgcaauga

SEQ ID NO: 701249 - RNA, 19 nt, Homo sapiens
gagcagggcuggucauacc

SEQ ID NO: 701250 - RNA, 19 nt, Homo sapiens
ucaacaugauccagacuga

SEQ ID NO: 701251 - RNA, 19 nt, Homo sapiens
gcauguggguagaggaugu

SEQ ID NO: 701252 - RNA, 19 nt, Homo sapiens
uccaacaacuacauuaaug

SEQ ID NO: 701253 - RNA, 19 nt, Homo sapiens
aaagcugccugcaaggaaa

SEQ ID NO: 701254 - RNA, 19 nt, Homo sapiens
gaauaucaggugcuguuug

SEQ ID NO: 701255 - RNA, 19 nt, Homo sapiens
agauaugacuacugaccua

SEQ ID NO: 701256 - RNA, 19 nt, Homo sapiens
uggcugagguggacaagug

SEQ ID NO: 701257 - RNA, 19 nt, Homo sapiens
cuuaguggcucgagucuuc

SEQ ID NO: 701258 - RNA, 19 nt, Homo sapiens
gcacagcugaugaagacuu

SEQ ID NO: 701259 - RNA, 19 nt, Homo sapiens
ccgcacagguugcuauauc

SEQ ID NO: 701260 - RNA, 19 nt, Homo sapiens
caucagacccggcagugaa

SEQ ID NO: 701261 - RNA, 19 nt, Homo sapiens
gagcaguacaucuucauuc

SEQ ID NO: 701262 - RNA, 19 nt, Homo sapiens
gaggagcaguacaucuuca

SEQ ID NO: 701263 - RNA, 19 nt, Homo sapiens
uggagaccauggaucagua

SEQ ID NO: 701264 - RNA, 19 nt, Homo sapiens
ccacggcuccuacuugaug

SEQ ID NO: 701265 - RNA, 19 nt, Homo sapiens
gggaaccacugggcuacaa

SEQ ID NO: 701266 - RNA, 19 nt, Homo sapiens
ccaccuaccucaucaucca

SEQ ID NO: 701267 - RNA, 19 nt, Homo sapiens
ucgcggagcucaucgucaa

SEQ ID NO: 701268 - RNA, 19 nt, Homo sapiens
ggugggaaggucucuuuaa

SEQ ID NO: 701269 - RNA, 19 nt, Homo sapiens
ggacuccaacaacuacauu

SEQ ID NO: 701270 - RNA, 19 nt, Homo sapiens
cauuaaugccaacuacaua

SEQ ID NO: 701271 - RNA, 19 nt, Homo sapiens
caaagaagaaagacaaggu

SEQ ID NO: 701272 - RNA, 19 nt, Homo sapiens
ccaaggccaccgucaacua

SEQ ID NO: 701273 - RNA, 19 nt, Homo sapiens
ggaaagcugccugcaagga

SEQ ID NO: 701274 - RNA, 19 nt, Homo sapiens
gggagacccggcugaauug

SEQ ID NO: 701275 - RNA, 19 nt, Homo sapiens
ggacaugaucuuccucaag

SEQ ID NO: 701276 - RNA, 19 nt, Homo sapiens
cccacuugcuucccugaua

SEQ ID NO: 701277 - RNA, 19 nt, Homo sapiens
ggcggcuggucuacgauua

SEQ ID NO: 701278 - RNA, 19 nt, Homo sapiens
ggaagccggugaacaugac

SEQ ID NO: 701279 - RNA, 19 nt, Homo sapiens
cgagaaugauacccacugu

SEQ ID NO: 701280 - RNA, 19 nt, Homo sapiens
ugagauaaccacuaacauc

SEQ ID NO: 701281 - RNA, 19 nt, Homo sapiens
guaaauaaacgugcucucu

SEQ ID NO: 701282 - RNA, 19 nt, Homo sapiens
gggcagugcuguguggaau

SEQ ID NO: 701283 - RNA, 19 nt, Homo sapiens
caggucaaaccacuucaua

SEQ ID NO: 701284 - RNA, 19 nt, Homo sapiens
ggaguaugagagcuucuuu

SEQ ID NO: 701285 - RNA, 19 nt, Homo sapiens
cgacacagaguaugagauc

SEQ ID NO: 701286 - RNA, 19 nt, Homo sapiens
gacccacuguugcagaaug

SEQ ID NO: 701287 - RNA, 19 nt, Homo sapiens
ccaaggaggagcuuagcaa

SEQ ID NO: 701288 - RNA, 19 nt, Homo sapiens
ccaaaacccuccggaacua

SEQ ID NO: 701289 - RNA, 19 nt, Homo sapiens
ccacgguccuggagaugau

SEQ ID NO: 701290 - RNA, 19 nt, Homo sapiens
gcuauaucguccuggaugu

SEQ ID NO: 701291 - RNA, 19 nt, Homo sapiens
aggccuaucucaucuacuu

SEQ ID NO: 701292 - RNA, 19 nt, Homo sapiens
caacaacuacauuaaugca

SEQ ID NO: 701293 - RNA, 19 nt, Homo sapiens
ucaagauuaugcuggugaa

SEQ ID NO: 701294 - RNA, 19 nt, Homo sapiens
cuacauuaaugccaacuac

SEQ ID NO: 701295 - RNA, 19 nt, Homo sapiens
gcugggacgccacaaagaa

SEQ ID NO: 701296 - RNA, 19 nt, Homo sapiens
gcgagcccaugucaucuuc

SEQ ID NO: 701297 - RNA, 19 nt, Homo sapiens
ggaaggccuaucucaucua

SEQ ID NO: 701298 - RNA, 19 nt, Homo sapiens
gaguucagaggaagaggua

SEQ ID NO: 701299 - RNA, 19 nt, Homo sapiens
aaccaggaucugccuauua

SEQ ID NO: 701300 - RNA, 19 nt, Homo sapiens
gacuuggcauuuaggauuc

SEQ ID NO: 701301 - RNA, 19 nt, Homo sapiens
ggacuggcgaggaagauca

SEQ ID NO: 701302 - RNA, 19 nt, Homo sapiens
caggagaagacacacauga

SEQ ID NO: 701303 - RNA, 19 nt, Homo sapiens
gggaagccggugaacauga

SEQ ID NO: 701304 - RNA, 19 nt, Homo sapiens
cugcaaggcugaacaacag

SEQ ID NO: 701305 - RNA, 19 nt, Homo sapiens
gagcgucccuggagaagaa

SEQ ID NO: 701306 - RNA, 19 nt, Homo sapiens
gggaagaagucuccuuuca

SEQ ID NO: 701307 - RNA, 19 nt, Homo sapiens
ccuacgaccugguauauga

SEQ ID NO: 701308 - RNA, 19 nt, Homo sapiens
gcaaauuguggucaaauau

SEQ ID NO: 701309 - RNA, 19 nt, Homo sapiens
ggacaccuacgaccuggua

SEQ ID NO: 701310 - RNA, 19 nt, Homo sapiens
ggucaaauauacaucacau

SEQ ID NO: 701311 - RNA, 19 nt, Homo sapiens
gagcaggcgaugaaaggua

SEQ ID NO: 701312 - RNA, 19 nt, Homo sapiens
uauaugagcaggcgaugaa

SEQ ID NO: 701313 - RNA, 19 nt, Homo sapiens
guaccaggcugugcaccaa

SEQ ID NO: 701314 - RNA, 19 nt, Homo sapiens
agcaaauuguggucaaaua

SEQ ID NO: 701315 - RNA, 19 nt, Homo sapiens
ggaagaagucuccuuucag

SEQ ID NO: 701316 - RNA, 19 nt, Homo sapiens
gagcccagccucuugagau

SEQ ID NO: 701317 - RNA, 19 nt, Homo sapiens
cacaucaaauuuaccaucu

SEQ ID NO: 701318 - RNA, 19 nt, Homo sapiens
gugggaagaagucuccuuu

SEQ ID NO: 701319 - RNA, 19 nt, Homo sapiens
gagcaaauuguggucaaau

SEQ ID NO: 701320 - RNA, 19 nt, Homo sapiens
ugagcaaauuguggucaaa

SEQ ID NO: 701321 - RNA, 19 nt, Homo sapiens
ggccauccaggacguguuu

SEQ ID NO: 701322 - RNA, 19 nt, Homo sapiens
ggaccauucaggcuguuga

SEQ ID NO: 701323 - RNA, 19 nt, Homo sapiens
cauucaggcuguugacaag

SEQ ID NO: 701324 - RNA, 19 nt, Homo sapiens
uggugacucuuaccuacuu

SEQ ID NO: 701325 - RNA, 19 nt, Homo sapiens
gcaccaaugggccuucucu

SEQ ID NO: 701326 - RNA, 19 nt, Homo sapiens
uuggugggcugcacucuca

SEQ ID NO: 701327 - RNA, 19 nt, Homo sapiens
acaccuacgaccugguaua

SEQ ID NO: 701328 - RNA, 19 nt, Homo sapiens
ggaccgcaagggcaaauac

SEQ ID NO: 701329 - RNA, 19 nt, Homo sapiens
ccauucaggcuguugacaa

SEQ ID NO: 701330 - RNA, 19 nt, Homo sapiens
caucacaucaaauuuacca

SEQ ID NO: 701331 - RNA, 19 nt, Homo sapiens
caggagcccagccucuuga

SEQ ID NO: 701332 - RNA, 19 nt, Homo sapiens
gagagaggacugccuucag

SEQ ID NO: 701333 - RNA, 19 nt, Homo sapiens
caccuacgaccugguauau

SEQ ID NO: 701334 - RNA, 19 nt, Homo sapiens
acgccaugcuggacaccua

SEQ ID NO: 701335 - RNA, 19 nt, Homo sapiens
ccauggugacucuuaccua

SEQ ID NO: 701336 - RNA, 19 nt, Homo sapiens
gagcgucccuggagaagaa

SEQ ID NO: 701337 - RNA, 19 nt, Homo sapiens
gggaagaagucuccuuuca

SEQ ID NO: 701338 - RNA, 19 nt, Homo sapiens
ccuacgaccugguauauga

SEQ ID NO: 701339 - RNA, 19 nt, Homo sapiens
gcaaauuguggucaaauau

SEQ ID NO: 701340 - RNA, 19 nt, Homo sapiens
ggacaccuacgaccuggua

SEQ ID NO: 701341 - RNA, 19 nt, Homo sapiens
ggucaaauauacaucacau

SEQ ID NO: 701342 - RNA, 19 nt, Homo sapiens
gagcaggcgaugaaaggua

SEQ ID NO: 701343 - RNA, 19 nt, Homo sapiens
cuggucaccugcuucuuua

SEQ ID NO: 701344 - RNA, 19 nt, Homo sapiens
gcuggucaccugcuucuuu

SEQ ID NO: 701345 - RNA, 19 nt, Homo sapiens
gagucaggguugccaaaug

SEQ ID NO: 701346 - RNA, 19 nt, Homo sapiens
uauaugagcaggcgaugaa

SEQ ID NO: 701347 - RNA, 19 nt, Homo sapiens
guaccaggcugugcaccaa

SEQ ID NO: 701348 - RNA, 19 nt, Homo sapiens
cuagggcgauguugacaga

SEQ ID NO: 701349 - RNA, 19 nt, Homo sapiens
agcaaauuguggucaaaua

SEQ ID NO: 701350 - RNA, 19 nt, Homo sapiens
ggaagaagucuccuuucag

SEQ ID NO: 701351 - RNA, 19 nt, Homo sapiens
ggagaggagaggagaggaa

SEQ ID NO: 701352 - RNA, 19 nt, Homo sapiens
gagcccagccucuugagau

SEQ ID NO: 701353 - RNA, 19 nt, Homo sapiens
gaggagaggaaccgucaug

SEQ ID NO: 701354 - RNA, 19 nt, Homo sapiens
cacaucaaauuuaccaucu

SEQ ID NO: 701355 - RNA, 19 nt, Homo sapiens
gugggaagaagucuccuuu

SEQ ID NO: 701356 - RNA, 19 nt, Homo sapiens
gagcaaauuguggucaaau

SEQ ID NO: 701357 - RNA, 19 nt, Homo sapiens
ugagcaaauuguggucaaa

SEQ ID NO: 701358 - RNA, 19 nt, Homo sapiens
ggccauccaggacguguuu

SEQ ID NO: 701359 - RNA, 19 nt, Homo sapiens
ggaccauucaggcuguuga

SEQ ID NO: 701360 - RNA, 19 nt, Homo sapiens
cauucaggcuguugacaag

SEQ ID NO: 701361 - RNA, 19 nt, Homo sapiens
ucaccugcuucuuuaucuu

SEQ ID NO: 701362 - RNA, 19 nt, Homo sapiens
gcaccaaugggccuucucu

SEQ ID NO: 701363 - RNA, 19 nt, Homo sapiens
uggugacucuuaccuacuu

SEQ ID NO: 701364 - RNA, 19 nt, Homo sapiens
uuggugggcugcacucuca

SEQ ID NO: 701365 - RNA, 19 nt, Homo sapiens
acaccuacgaccugguaua

SEQ ID NO: 701366 - RNA, 19 nt, Homo sapiens
ggaccgcaagggcaaauac

SEQ ID NO: 701367 - RNA, 19 nt, Homo sapiens
ggucaccugcuucuuuauc

SEQ ID NO: 701368 - RNA, 19 nt, Homo sapiens
ccauucaggcuguugacaa

SEQ ID NO: 701369 - RNA, 19 nt, Homo sapiens
caucacaucaaauuuacca

SEQ ID NO: 701370 - RNA, 19 nt, Homo sapiens
caggagcccagccucuuga

SEQ ID NO: 701371 - RNA, 19 nt, Homo sapiens
gagagaggacugccuucag

SEQ ID NO: 701372 - RNA, 19 nt, Homo sapiens
caccuacgaccugguauau

SEQ ID NO: 701373 - RNA, 19 nt, Homo sapiens
acgccaugcuggacaccua

SEQ ID NO: 701374 - RNA, 19 nt, Homo sapiens
agucaggguugccaaaugc

SEQ ID NO: 701375 - RNA, 19 nt, Homo sapiens
ccauggugacucuuaccua

SEQ ID NO: 701376 - RNA, 19 nt, Homo sapiens
gagcgucccuggagaagaa

SEQ ID NO: 701377 - RNA, 19 nt, Homo sapiens
gggaagaagucuccuuuca

SEQ ID NO: 701378 - RNA, 19 nt, Homo sapiens
ccuacgaccugguauauga

SEQ ID NO: 701379 - RNA, 19 nt, Homo sapiens
gcaaauuguggucaaauau

SEQ ID NO: 701380 - RNA, 19 nt, Homo sapiens
ggacaccuacgaccuggua

SEQ ID NO: 701381 - RNA, 19 nt, Homo sapiens
ggucaaauauacaucacau

SEQ ID NO: 701382 - RNA, 19 nt, Homo sapiens
gagcaggcgaugaaaggua

SEQ ID NO: 701383 - RNA, 19 nt, Homo sapiens
cuggucaccugcuucuuua

SEQ ID NO: 701384 - RNA, 19 nt, Homo sapiens
gcuggucaccugcuucuuu

SEQ ID NO: 701385 - RNA, 19 nt, Homo sapiens
gagucaggguugccaaaug

SEQ ID NO: 701386 - RNA, 19 nt, Homo sapiens
uauaugagcaggcgaugaa

SEQ ID NO: 701387 - RNA, 19 nt, Homo sapiens
guaccaggcugugcaccaa

SEQ ID NO: 701388 - RNA, 19 nt, Homo sapiens
cuagggcgauguugacaga

SEQ ID NO: 701389 - RNA, 19 nt, Homo sapiens
agcaaauuguggucaaaua

SEQ ID NO: 701390 - RNA, 19 nt, Homo sapiens
ggaagaagucuccuuucag

SEQ ID NO: 701391 - RNA, 19 nt, Homo sapiens
ggagaggagaggagaggaa

SEQ ID NO: 701392 - RNA, 19 nt, Homo sapiens
gagcccagccucuugagau

SEQ ID NO: 701393 - RNA, 19 nt, Homo sapiens
gaggagaggaaccgucaug

SEQ ID NO: 701394 - RNA, 19 nt, Homo sapiens
cacaucaaauuuaccaucu

SEQ ID NO: 701395 - RNA, 19 nt, Homo sapiens
gugggaagaagucuccuuu

SEQ ID NO: 701396 - RNA, 19 nt, Homo sapiens
gagcaaauuguggucaaau

SEQ ID NO: 701397 - RNA, 19 nt, Homo sapiens
ugagcaaauuguggucaaa

SEQ ID NO: 701398 - RNA, 19 nt, Homo sapiens
ggccauccaggacguguuu

SEQ ID NO: 701399 - RNA, 19 nt, Homo sapiens
ggaccauucaggcuguuga

SEQ ID NO: 701400 - RNA, 19 nt, Homo sapiens
cauucaggcuguugacaag

SEQ ID NO: 701401 - RNA, 19 nt, Homo sapiens
ucaccugcuucuuuaucuu

SEQ ID NO: 701402 - RNA, 19 nt, Homo sapiens
gcaccaaugggccuucucu

SEQ ID NO: 701403 - RNA, 19 nt, Homo sapiens
uggugacucuuaccuacuu

SEQ ID NO: 701404 - RNA, 19 nt, Homo sapiens
uuggugggcugcacucuca

SEQ ID NO: 701405 - RNA, 19 nt, Homo sapiens
acaccuacgaccugguaua

SEQ ID NO: 701406 - RNA, 19 nt, Homo sapiens
ggaccgcaagggcaaauac

SEQ ID NO: 701407 - RNA, 19 nt, Homo sapiens
ggucaccugcuucuuuauc

SEQ ID NO: 701408 - RNA, 19 nt, Homo sapiens
ccauucaggcuguugacaa

SEQ ID NO: 701409 - RNA, 19 nt, Homo sapiens
caucacaucaaauuuacca

SEQ ID NO: 701410 - RNA, 19 nt, Homo sapiens
caggagcccagccucuuga

SEQ ID NO: 701411 - RNA, 19 nt, Homo sapiens
gagagaggacugccuucag

SEQ ID NO: 701412 - RNA, 19 nt, Homo sapiens
caccuacgaccugguauau

SEQ ID NO: 701413 - RNA, 19 nt, Homo sapiens
acgccaugcuggacaccua

SEQ ID NO: 701414 - RNA, 19 nt, Homo sapiens
agucaggguugccaaaugc

SEQ ID NO: 701415 - RNA, 19 nt, Homo sapiens
ccauggugacucuuaccua

SEQ ID NO: 701416 - RNA, 19 nt, Homo sapiens
gagcgucccuggagaagaa

SEQ ID NO: 701417 - RNA, 19 nt, Homo sapiens
gggaagaagucuccuuuca

SEQ ID NO: 701418 - RNA, 19 nt, Homo sapiens
ccuacgaccugguauauga

SEQ ID NO: 701419 - RNA, 19 nt, Homo sapiens
gcaaauuguggucaaauau

SEQ ID NO: 701420 - RNA, 19 nt, Homo sapiens
ggacaccuacgaccuggua

SEQ ID NO: 701421 - RNA, 19 nt, Homo sapiens
gagcaggcgaugaaaguuu

SEQ ID NO: 701422 - RNA, 19 nt, Homo sapiens
ggucaaauauacaucacau

SEQ ID NO: 701423 - RNA, 19 nt, Homo sapiens
uauaugagcaggcgaugaa

SEQ ID NO: 701424 - RNA, 19 nt, Homo sapiens
guaccaggcugugcaccaa

SEQ ID NO: 701425 - RNA, 19 nt, Homo sapiens
agcaaauuguggucaaaua

SEQ ID NO: 701426 - RNA, 19 nt, Homo sapiens
ggaagaagucuccuuucag

SEQ ID NO: 701427 - RNA, 19 nt, Homo sapiens
gagcccagccucuugagau

SEQ ID NO: 701428 - RNA, 19 nt, Homo sapiens
cacaucaaauuuaccaucu

SEQ ID NO: 701429 - RNA, 19 nt, Homo sapiens
gugggaagaagucuccuuu

SEQ ID NO: 701430 - RNA, 19 nt, Homo sapiens
gagcaaauuguggucaaau

SEQ ID NO: 701431 - RNA, 19 nt, Homo sapiens
ugagcaaauuguggucaaa

SEQ ID NO: 701432 - RNA, 19 nt, Homo sapiens
ggaccauucaggcuguuga

SEQ ID NO: 701433 - RNA, 19 nt, Homo sapiens
cauucaggcuguugacaag

SEQ ID NO: 701434 - RNA, 19 nt, Homo sapiens
uggugacucuuaccuacuu

SEQ ID NO: 701435 - RNA, 19 nt, Homo sapiens
gcaccaaugggccuucucu

SEQ ID NO: 701436 - RNA, 19 nt, Homo sapiens
uuggugggcugcacucuca

SEQ ID NO: 701437 - RNA, 19 nt, Homo sapiens
acaccuacgaccugguaua

SEQ ID NO: 701438 - RNA, 19 nt, Homo sapiens
ggaccgcaagggcaaauac

SEQ ID NO: 701439 - RNA, 19 nt, Homo sapiens
ccauucaggcuguugacaa

SEQ ID NO: 701440 - RNA, 19 nt, Homo sapiens
caucacaucaaauuuacca

SEQ ID NO: 701441 - RNA, 19 nt, Homo sapiens
caggagcccagccucuuga

SEQ ID NO: 701442 - RNA, 19 nt, Homo sapiens
gagagaggacugccuucag

SEQ ID NO: 701443 - RNA, 19 nt, Homo sapiens
caccuacgaccugguauau

SEQ ID NO: 701444 - RNA, 19 nt, Homo sapiens
acgccaugcuggacaccua

SEQ ID NO: 701445 - RNA, 19 nt, Homo sapiens
ccauggugacucuuaccua

SEQ ID NO: 701446 - RNA, 19 nt, Homo sapiens
gcgcagccgugacaucuuu

SEQ ID NO: 701447 - RNA, 19 nt, Homo sapiens
gugcagccauuccaucuga

SEQ ID NO: 701448 - RNA, 19 nt, Homo sapiens
ggcaugagcuccaccuucu

SEQ ID NO: 701449 - RNA, 19 nt, Homo sapiens
guagggacaauaaagguuu

SEQ ID NO: 701450 - RNA, 19 nt, Homo sapiens
gcacccagcagccaagaga

SEQ ID NO: 701451 - RNA, 19 nt, Homo sapiens
cgagaccacuuccggaaca

SEQ ID NO: 701452 - RNA, 19 nt, Homo sapiens
ggagggucaucuucaccaa

SEQ ID NO: 701453 - RNA, 19 nt, Homo sapiens
ccaaguacagccuggaaga

SEQ ID NO: 701454 - RNA, 19 nt, Homo sapiens
cagccacggugcagccauu

SEQ ID NO: 701455 - RNA, 19 nt, Homo sapiens
ucagggcuccguccacuug

SEQ ID NO: 701456 - RNA, 19 nt, Homo sapiens
gguagggacaauaaagguu

SEQ ID NO: 701457 - RNA, 19 nt, Homo sapiens
cgacacagucucccucagu

SEQ ID NO: 701458 - RNA, 19 nt, Homo sapiens
gaccaaguacagccuggaa

SEQ ID NO: 701459 - RNA, 19 nt, Homo sapiens
gaccacuuccggaacaaga

SEQ ID NO: 701460 - RNA, 19 nt, Homo sapiens
gagggucaucuucaccaaa

SEQ ID NO: 701461 - RNA, 19 nt, Homo sapiens
gagaccacuuccggaacaa

SEQ ID NO: 701462 - RNA, 19 nt, Homo sapiens
ugacaacggaggcuucaag

SEQ ID NO: 701463 - RNA, 19 nt, Homo sapiens
aguacagccuggaagaugu

SEQ ID NO: 701464 - RNA, 19 nt, Homo sapiens
gcagccauuccaucugaga

SEQ ID NO: 701465 - RNA, 19 nt, Homo sapiens
cgguggugcugaaguggaa

SEQ ID NO: 701466 - RNA, 19 nt, Homo sapiens
guacagccuggaagaugug

SEQ ID NO: 701467 - RNA, 19 nt, Homo sapiens
ccgcugaggaccuucauca

SEQ ID NO: 701468 - RNA, 19 nt, Homo sapiens
cccaggugcugaggucuga

SEQ ID NO: 701469 - RNA, 19 nt, Homo sapiens
ucagcgagcagagcaauca

SEQ ID NO: 701470 - RNA, 19 nt, Homo sapiens
cagagugacuuguuaauuu

SEQ ID NO: 701471 - RNA, 19 nt, Homo sapiens
gaaacccugucucuacuaa

SEQ ID NO: 701472 - RNA, 19 nt, Homo sapiens
guaugaagcugaagagaga

SEQ ID NO: 701473 - RNA, 19 nt, Homo sapiens
gaaauugaguccaaguugu

SEQ ID NO: 701474 - RNA, 19 nt, Homo sapiens
gagagagcccucagaguua

SEQ ID NO: 701475 - RNA, 19 nt, Homo sapiens
ggaauuaucuuaggaacuc

SEQ ID NO: 701476 - RNA, 19 nt, Homo sapiens
caguguagcuauggaauua

SEQ ID NO: 701477 - RNA, 19 nt, Homo sapiens
gguccagagugacuuguua

SEQ ID NO: 701478 - RNA, 19 nt, Homo sapiens
cuguuaagcugcauuagua

SEQ ID NO: 701479 - RNA, 19 nt, Homo sapiens
ucacagcccuucuacuaau

SEQ ID NO: 701480 - RNA, 19 nt, Homo sapiens
ccagaugaguucccacuug

SEQ ID NO: 701481 - RNA, 19 nt, Homo sapiens
ggaaaggacuuaggugaac

SEQ ID NO: 701482 - RNA, 19 nt, Homo sapiens
cuaaugaaagcaccuguua

SEQ ID NO: 701483 - RNA, 19 nt, Homo sapiens
ggccuagucuuauuauuca

SEQ ID NO: 701484 - RNA, 19 nt, Homo sapiens
gaagauggcaguggcugua

SEQ ID NO: 701485 - RNA, 19 nt, Homo sapiens
ugaggaaacugaggaaaga

SEQ ID NO: 701486 - RNA, 19 nt, Homo sapiens
gcuuggagaugaucacuca

SEQ ID NO: 701487 - RNA, 19 nt, Homo sapiens
aauaaaugcuguugugcuu

SEQ ID NO: 701488 - RNA, 19 nt, Homo sapiens
cuuaggaggcugcuaguua

SEQ ID NO: 701489 - RNA, 19 nt, Homo sapiens
agagagagcccucagaguu

SEQ ID NO: 701490 - RNA, 19 nt, Homo sapiens
aaagcgcucugaacuguau

SEQ ID NO: 701491 - RNA, 19 nt, Homo sapiens
gcaggagaaugguguaaaa

SEQ ID NO: 701492 - RNA, 19 nt, Homo sapiens
aaugaaagcaccuguuauu

SEQ ID NO: 701493 - RNA, 19 nt, Homo sapiens
ggaggcugcuaguuaggaa

SEQ ID NO: 701494 - RNA, 19 nt, Homo sapiens
aaggcaagcuugaugcaaa

SEQ ID NO: 701495 - RNA, 19 nt, Homo sapiens
uaaauuccauguggcauuc

SEQ ID NO: 701496 - RNA, 19 nt, Homo sapiens
ccuguaaucccaacacuuu

SEQ ID NO: 701497 - RNA, 19 nt, Homo sapiens
aauguuaucuucaguugug

SEQ ID NO: 701498 - RNA, 19 nt, Homo sapiens
ucagaaacgugaaauugag

SEQ ID NO: 701499 - RNA, 19 nt, Homo sapiens
ucacucauauaacauguca

SEQ ID NO: 701500 - RNA, 19 nt, Homo sapiens
gaaggauccuaaugaaagc

SEQ ID NO: 701501 - RNA, 19 nt, Homo sapiens
ccaaggauauuucccuaac

SEQ ID NO: 701502 - RNA, 19 nt, Homo sapiens
gcuggagggugaagugugu

SEQ ID NO: 701503 - RNA, 19 nt, Homo sapiens
cuaacuuccuuguguguug

SEQ ID NO: 701504 - RNA, 19 nt, Homo sapiens
gaucacucauauaacaugu

SEQ ID NO: 701505 - RNA, 19 nt, Homo sapiens
ccugaagaguacccaaauu

SEQ ID NO: 701506 - RNA, 19 nt, Homo sapiens
cacagcccuucuacuaaua

SEQ ID NO: 701507 - RNA, 19 nt, Homo sapiens
gagaaauugaggaaacuga

SEQ ID NO: 701508 - RNA, 19 nt, Homo sapiens
ggugaaacccugucucuac

SEQ ID NO: 701509 - RNA, 19 nt, Homo sapiens
gcuauggaauuaucuuagg

SEQ ID NO: 701510 - RNA, 19 nt, Homo sapiens
uuucacagcccuucuacua

SEQ ID NO: 701511 - RNA, 19 nt, Homo sapiens
ccucagaguuaugcuagaa

SEQ ID NO: 701512 - RNA, 19 nt, Homo sapiens
cuaagggucuaguuguuca

SEQ ID NO: 701513 - RNA, 19 nt, Homo sapiens
agaaggauccuaaugaaag

SEQ ID NO: 701514 - RNA, 19 nt, Homo sapiens
gaccuuuccuaccugaaga

SEQ ID NO: 701515 - RNA, 19 nt, Homo sapiens
uaacuuccuuguguguuga

SEQ ID NO: 701516 - RNA, 19 nt, Homo sapiens
caccaaauuugccucuguu

SEQ ID NO: 701517 - RNA, 19 nt, Homo sapiens
uaagcugcauuaguaaaga

SEQ ID NO: 701518 - RNA, 19 nt, Homo sapiens
ugaaagcaccuguuauuuu

SEQ ID NO: 701519 - RNA, 19 nt, Homo sapiens
uuaggaggcugcuaguuag

SEQ ID NO: 701520 - RNA, 19 nt, Homo sapiens
ucaccaaauuugccucugu

SEQ ID NO: 701521 - RNA, 19 nt, Homo sapiens
gaaaggacuuaggugaacu

SEQ ID NO: 701522 - RNA, 19 nt, Homo sapiens
gccauccgaucaucccaaa

SEQ ID NO: 701523 - RNA, 19 nt, Homo sapiens
ugaaauugaguccaaguug

SEQ ID NO: 701524 - RNA, 19 nt, Homo sapiens
cugaagagcccuuugacuu

SEQ ID NO: 701525 - RNA, 19 nt, Homo sapiens
ugaacuguaugaagcugaa

SEQ ID NO: 701526 - RNA, 19 nt, Homo sapiens
guaaguacacucaaacacu

SEQ ID NO: 701527 - RNA, 19 nt, Homo sapiens
ccagagugacuuguuaauu

SEQ ID NO: 701528 - RNA, 19 nt, Homo sapiens
agaaggagaacaagaggaa

SEQ ID NO: 701529 - RNA, 19 nt, Homo sapiens
uuauucagauggagaacuu

SEQ ID NO: 701530 - RNA, 19 nt, Homo sapiens
gaugguggccuagucuuau

SEQ ID NO: 701531 - RNA, 19 nt, Homo sapiens
guuaucuucaguuguguua

SEQ ID NO: 701532 - RNA, 19 nt, Homo sapiens
agagagcccucagaguuau

SEQ ID NO: 701533 - RNA, 19 nt, Homo sapiens
gugaaacccugucucuacu

SEQ ID NO: 701534 - RNA, 19 nt, Homo sapiens
uagaaggauccuaaugaaa

SEQ ID NO: 701535 - RNA, 19 nt, Homo sapiens
ugcaggagguggaggagaa

SEQ ID NO: 701536 - RNA, 19 nt, Homo sapiens
gggucuaguuguucagaau

SEQ ID NO: 701537 - RNA, 19 nt, Homo sapiens
uagaaaaccugaagaguac

SEQ ID NO: 701538 - RNA, 19 nt, Homo sapiens
ucagauggagaacuuagaa

SEQ ID NO: 701539 - RNA, 19 nt, Homo sapiens
ggugugugauggguagauu

SEQ ID NO: 701540 - RNA, 19 nt, Homo sapiens
gcuagaaggagaacaagag

SEQ ID NO: 701541 - RNA, 19 nt, Homo sapiens
ucuacgggcuuuggagaaa

SEQ ID NO: 701542 - RNA, 19 nt, Homo sapiens
cugaagaguacccaaauug

SEQ ID NO: 701543 - RNA, 19 nt, Homo sapiens
cuuuccagcuguaaauauu

SEQ ID NO: 701544 - RNA, 19 nt, Homo sapiens
ugccagcgcucauccagau

SEQ ID NO: 701545 - RNA, 19 nt, Homo sapiens
gaagaagcgggagcaggaa

SEQ ID NO: 701546 - RNA, 19 nt, Homo sapiens
uaggaacucaagcuucuaa

SEQ ID NO: 701547 - RNA, 19 nt, Homo sapiens
cuuaggaacucaagcuucu

SEQ ID NO: 701548 - RNA, 19 nt, Homo sapiens
ucagauuccugucacuucu

SEQ ID NO: 701549 - RNA, 19 nt, Homo sapiens
gagccaguguagcuaugga

SEQ ID NO: 701550 - RNA, 19 nt, Homo sapiens
gaaggcaagcuugaugcaa

SEQ ID NO: 701551 - RNA, 19 nt, Homo sapiens
caacuucuaaauuccaugu

SEQ ID NO: 701552 - RNA, 19 nt, Homo sapiens
caacuucguuccccaagga

SEQ ID NO: 701553 - RNA, 19 nt, Homo sapiens
aaauugaguccaaguuguu

SEQ ID NO: 701554 - RNA, 19 nt, Homo sapiens
gaagagaggaaaagagaau

SEQ ID NO: 701555 - RNA, 19 nt, Homo sapiens
uaccacaggcagugaauga

SEQ ID NO: 701556 - RNA, 19 nt, Homo sapiens
aacugcaacuucuaaauuc

SEQ ID NO: 701557 - RNA, 19 nt, Homo sapiens
guguagcuauggaauuauc

SEQ ID NO: 701558 - RNA, 19 nt, Homo sapiens
uaaccucacucagucacau

SEQ ID NO: 701559 - RNA, 19 nt, Homo sapiens
aauggacaauggcuguauu

SEQ ID NO: 701560 - RNA, 19 nt, Homo sapiens
uuagaaaaccugaagagua

SEQ ID NO: 701561 - RNA, 19 nt, Homo sapiens
cuaaauuccauguggcauu

SEQ ID NO: 701562 - RNA, 19 nt, Homo sapiens
guuaagcugcauuaguaaa

SEQ ID NO: 701563 - RNA, 19 nt, Homo sapiens
gagccuuuccgacaguauu

SEQ ID NO: 701564 - RNA, 19 nt, Homo sapiens
ggaacgcgagcaggagauu

SEQ ID NO: 701565 - RNA, 19 nt, Homo sapiens
ggcguacuaucugaaguga

SEQ ID NO: 701566 - RNA, 19 nt, Homo sapiens
gcugauggcguacuaucug

SEQ ID NO: 701567 - RNA, 19 nt, Homo sapiens
gcucuuuccagcuguaaau

SEQ ID NO: 701568 - RNA, 19 nt, Homo sapiens
gaggaaaagagaauuagaa

SEQ ID NO: 701569 - RNA, 19 nt, Homo sapiens
gcaucuccgucgugaacau

SEQ ID NO: 701570 - RNA, 19 nt, Homo sapiens
gaagagagcaguaaugcaa

SEQ ID NO: 701571 - RNA, 19 nt, Homo sapiens
ucacagagcugaaaaggua

SEQ ID NO: 701572 - RNA, 19 nt, Homo sapiens
ccacagaaauggaagacaa

SEQ ID NO: 701573 - RNA, 19 nt, Homo sapiens
uuaccgagcuggauuugua

SEQ ID NO: 701574 - RNA, 19 nt, Homo sapiens
ggauuucucucuuccuauu

SEQ ID NO: 701575 - RNA, 19 nt, Homo sapiens
caagauuucugaagccauu

SEQ ID NO: 701576 - RNA, 19 nt, Homo sapiens
gcaaugaugucaauuucca

SEQ ID NO: 701577 - RNA, 19 nt, Homo sapiens
agaaauggaagacaaguua

SEQ ID NO: 701578 - RNA, 19 nt, Homo sapiens
gcagaaaagucacuaaaug

SEQ ID NO: 701579 - RNA, 19 nt, Homo sapiens
ccacggaguuugaguuugu

SEQ ID NO: 701580 - RNA, 19 nt, Homo sapiens
cagcaaagccagauacuug

SEQ ID NO: 701581 - RNA, 19 nt, Homo sapiens
gagcuggauuuguauguug

SEQ ID NO: 701582 - RNA, 19 nt, Homo sapiens
gaaauugaagcucucuaaa

SEQ ID NO: 701583 - RNA, 19 nt, Homo sapiens
cgauagaugucaagauuuc

SEQ ID NO: 701584 - RNA, 19 nt, Homo sapiens
aaaggaaucucacguugug

SEQ ID NO: 701585 - RNA, 19 nt, Homo sapiens
ggacacaagugaugaaucc

SEQ ID NO: 701586 - RNA, 19 nt, Homo sapiens
ggaaaugcucaaugacuuu

SEQ ID NO: 701587 - RNA, 19 nt, Homo sapiens
caacaaagcaaacucgaau

SEQ ID NO: 701588 - RNA, 19 nt, Homo sapiens
gagagaauucuuacucaaa

SEQ ID NO: 701589 - RNA, 19 nt, Homo sapiens
gcagagacugugcagauaa

SEQ ID NO: 701590 - RNA, 19 nt, Homo sapiens
caacucacuucuuuucuua

SEQ ID NO: 701591 - RNA, 19 nt, Homo sapiens
ucaccaaccagaucaauaa

SEQ ID NO: 701592 - RNA, 19 nt, Homo sapiens
uggaggaaaugcucaauga

SEQ ID NO: 701593 - RNA, 19 nt, Homo sapiens
gaaauggaagacaaguuaa

SEQ ID NO: 701594 - RNA, 19 nt, Homo sapiens
cccgauagaugucaagauu

SEQ ID NO: 701595 - RNA, 19 nt, Homo sapiens
gaggaaagaccaacaacug

SEQ ID NO: 701596 - RNA, 19 nt, Homo sapiens
uggaaugugugagcaaaua

SEQ ID NO: 701597 - RNA, 19 nt, Homo sapiens
gugcauggaugacgugugu

SEQ ID NO: 701598 - RNA, 19 nt, Homo sapiens
gcacacacauccccaagaa

SEQ ID NO: 701599 - RNA, 19 nt, Homo sapiens
gcauuacccuacacuaucu

SEQ ID NO: 701600 - RNA, 19 nt, Homo sapiens
acaaagcaaacucgaauuu

SEQ ID NO: 701601 - RNA, 19 nt, Homo sapiens
ucacucggccugacacuuu

SEQ ID NO: 701602 - RNA, 19 nt, Homo sapiens
ggaccuuguuuauucuaga

SEQ ID NO: 701603 - RNA, 19 nt, Homo sapiens
caagacagcuacauuuuca

SEQ ID NO: 701604 - RNA, 19 nt, Homo sapiens
caauggcaaugaugucaau

SEQ ID NO: 701605 - RNA, 19 nt, Homo sapiens
uagagagaauucuuacuca

SEQ ID NO: 701606 - RNA, 19 nt, Homo sapiens
ccagauacuugccugagau

SEQ ID NO: 701607 - RNA, 19 nt, Homo sapiens
aguggaaucuguuuauaga

SEQ ID NO: 701608 - RNA, 19 nt, Homo sapiens
agaguggaaucuguuuaua

SEQ ID NO: 701609 - RNA, 19 nt, Homo sapiens
ucaugaagaugcuguacug

SEQ ID NO: 701610 - RNA, 19 nt, Homo sapiens
gaaacugcauuuuagcuau

SEQ ID NO: 701611 - RNA, 19 nt, Homo sapiens
gugaugaccaacaaacuaa

SEQ ID NO: 701612 - RNA, 19 nt, Homo sapiens
ggaccuauggcaugcugua

SEQ ID NO: 701613 - RNA, 19 nt, Homo sapiens
cagagacugugcagauaau

SEQ ID NO: 701614 - RNA, 19 nt, Homo sapiens
aagacuaccuggaaugugu

SEQ ID NO: 701615 - RNA, 19 nt, Homo sapiens
aaaggucuggucagcauua

SEQ ID NO: 701616 - RNA, 19 nt, Homo sapiens
agaaauugaagcucucuaa

SEQ ID NO: 701617 - RNA, 19 nt, Homo sapiens
gcauaagaaauuugacgaa

SEQ ID NO: 701618 - RNA, 19 nt, Homo sapiens
uggcaaugaugucaauuuc

SEQ ID NO: 701619 - RNA, 19 nt, Homo sapiens
aggcugaccucgacacaga

SEQ ID NO: 701620 - RNA, 19 nt, Homo sapiens
guccaggcauaagaaauuu

SEQ ID NO: 701621 - RNA, 19 nt, Homo sapiens
agagagaauucuuacucaa

SEQ ID NO: 701622 - RNA, 19 nt, Homo sapiens
gccagauacuugccugaga

SEQ ID NO: 701623 - RNA, 19 nt, Homo sapiens
cagcauuacccuacacuau

SEQ ID NO: 701624 - RNA, 19 nt, Homo sapiens
aggaaaugcucaaugacuu

SEQ ID NO: 701625 - RNA, 19 nt, Homo sapiens
uccaggaccucuucacaga

SEQ ID NO: 701626 - RNA, 19 nt, Homo sapiens
gaagagacaagccauuuug

SEQ ID NO: 701627 - RNA, 19 nt, Homo sapiens
cagaugaaacugcauuuua

SEQ ID NO: 701628 - RNA, 19 nt, Homo sapiens
ccaaccagaucaauaaucc

SEQ ID NO: 701629 - RNA, 19 nt, Homo sapiens
gcucggaacucggauugca

SEQ ID NO: 701630 - RNA, 19 nt, Homo sapiens
caacaacuacugucucaac

SEQ ID NO: 701631 - RNA, 19 nt, Homo sapiens
cacuguaaguucagcauug

SEQ ID NO: 701632 - RNA, 19 nt, Homo sapiens
gcagugggugcauggauga

SEQ ID NO: 701633 - RNA, 19 nt, Homo sapiens
gcacagcaaagccagauac

SEQ ID NO: 701634 - RNA, 19 nt, Homo sapiens
guacaugcagaauucagaa

SEQ ID NO: 701635 - RNA, 19 nt, Homo sapiens
gagaagagagcaguaaugc

SEQ ID NO: 701636 - RNA, 19 nt, Homo sapiens
ucacagacauaaaagagaa

SEQ ID NO: 701637 - RNA, 19 nt, Homo sapiens
gcaccaugccuucuuggau

SEQ ID NO: 701638 - RNA, 19 nt, Homo sapiens
ucguccaucuggcuuauaa

SEQ ID NO: 701639 - RNA, 19 nt, Homo sapiens
ggucagaugaaacugcauu

SEQ ID NO: 701640 - RNA, 19 nt, Homo sapiens
ggauguuucagcugauaaa

SEQ ID NO: 701641 - RNA, 19 nt, Homo sapiens
gaggaaaugcucaaugacu

SEQ ID NO: 701642 - RNA, 19 nt, Homo sapiens
uaaaggaaucucacguugu

SEQ ID NO: 701643 - RNA, 19 nt, Homo sapiens
gaccagcucaagccauuug

SEQ ID NO: 701644 - RNA, 19 nt, Homo sapiens
cgagcuggauuuguauguu

SEQ ID NO: 701645 - RNA, 19 nt, Homo sapiens
gaguggaaucuguuuauag

SEQ ID NO: 701646 - RNA, 19 nt, Homo sapiens
cugaccagcucaagccauu

SEQ ID NO: 701647 - RNA, 19 nt, Homo sapiens
gaucgcaggggaacacuua

SEQ ID NO: 701648 - RNA, 19 nt, Homo sapiens
gugccagacugaacugcuu

SEQ ID NO: 701649 - RNA, 19 nt, Homo sapiens
ccaggcauaagaaauuuga

SEQ ID NO: 701650 - RNA, 19 nt, Homo sapiens
caaguuaagccaacaaagc

SEQ ID NO: 701651 - RNA, 19 nt, Homo sapiens
auacuugccugagaucaug

SEQ ID NO: 701652 - RNA, 19 nt, Homo sapiens
ugcaacaacuacugucuca

SEQ ID NO: 701653 - RNA, 19 nt, Homo sapiens
gggcagagaaguugcaaac

SEQ ID NO: 701654 - RNA, 19 nt, Homo sapiens
uaaugugaaucuggaggaa

SEQ ID NO: 701655 - RNA, 19 nt, Homo sapiens
gacaaguuaagccaacaaa

SEQ ID NO: 701656 - RNA, 19 nt, Homo sapiens
cugcagaaguaaaggaauc

SEQ ID NO: 701657 - RNA, 19 nt, Homo sapiens
guggggaccuuguuuauuc

SEQ ID NO: 701658 - RNA, 19 nt, Homo sapiens
uuccuucucuuccucguuu

SEQ ID NO: 701659 - RNA, 19 nt, Homo sapiens
gagcucacaccaacagaca

SEQ ID NO: 701660 - RNA, 19 nt, Homo sapiens
gggauguggucagcccaaa

SEQ ID NO: 701661 - RNA, 19 nt, Homo sapiens
gaagggcugcuuggcaaau

SEQ ID NO: 701662 - RNA, 19 nt, Homo sapiens
uguccaggcauaagaaauu

SEQ ID NO: 701663 - RNA, 19 nt, Homo sapiens
uggaagagacaagccauuu

SEQ ID NO: 701664 - RNA, 19 nt, Homo sapiens
ccaacaaagcaaacucgaa

SEQ ID NO: 701665 - RNA, 19 nt, Homo sapiens
ggggaacacuuaagaaucu

SEQ ID NO: 701666 - RNA, 19 nt, Homo sapiens
ugagaagagagcaguaaug

SEQ ID NO: 701667 - RNA, 19 nt, Homo sapiens
cacacucgcucucgcuugu

SEQ ID NO: 701668 - RNA, 19 nt, Homo sapiens
cugaagccauuaugaacau

SEQ ID NO: 701669 - RNA, 19 nt, Homo sapiens
ucauggacccgauagaugu

SEQ ID NO: 701670 - RNA, 19 nt, Homo sapiens
acucugagcucauuaauaa

SEQ ID NO: 701671 - RNA, 19 nt, Homo sapiens
ggaaggagauggaacagau

SEQ ID NO: 701672 - RNA, 19 nt, Homo sapiens
gaacagcucgggccacuuu

SEQ ID NO: 701673 - RNA, 19 nt, Homo sapiens
gaaaagaaauugcccagaa

SEQ ID NO: 701674 - RNA, 19 nt, Homo sapiens
ggccuuggcugcagcauuu

SEQ ID NO: 701675 - RNA, 19 nt, Homo sapiens
caaggaggcuguaaaugug

SEQ ID NO: 701676 - RNA, 19 nt, Homo sapiens
aaaccaaauucacgcguua

SEQ ID NO: 701677 - RNA, 19 nt, Homo sapiens
gcaagauugugacagacua

SEQ ID NO: 701678 - RNA, 19 nt, Homo sapiens
gaaggacuaucucuaugau

SEQ ID NO: 701679 - RNA, 19 nt, Homo sapiens
gaaauaugaggaaggcuuu

SEQ ID NO: 701680 - RNA, 19 nt, Homo sapiens
caaaggaguaugacgauga

SEQ ID NO: 701681 - RNA, 19 nt, Homo sapiens
ggucguuucugcuguguau

SEQ ID NO: 701682 - RNA, 19 nt, Homo sapiens
aaccaucacugcugaggua

SEQ ID NO: 701683 - RNA, 19 nt, Homo sapiens
ggcaguauguggaucaguu

SEQ ID NO: 701684 - RNA, 19 nt, Homo sapiens
caaauucacgcguuaggaa

SEQ ID NO: 701685 - RNA, 19 nt, Homo sapiens
ggcaggagcuucucaugca

SEQ ID NO: 701686 - RNA, 19 nt, Homo sapiens
ggagauggaacagauugua

SEQ ID NO: 701687 - RNA, 19 nt, Homo sapiens
gaaaagcucuccugaugag

SEQ ID NO: 701688 - RNA, 19 nt, Homo sapiens
gauugucacuccaaaccuu

SEQ ID NO: 701689 - RNA, 19 nt, Homo sapiens
ucuaauugcugccaggauu

SEQ ID NO: 701690 - RNA, 19 nt, Homo sapiens
gugaaaagcucuccugaug

SEQ ID NO: 701691 - RNA, 19 nt, Homo sapiens
gggacgagaucauggcaau

SEQ ID NO: 701692 - RNA, 19 nt, Homo sapiens
acaaggaggcuguaaaugu

SEQ ID NO: 701693 - RNA, 19 nt, Homo sapiens
ucucuaaccuggaucacaa

SEQ ID NO: 701694 - RNA, 19 nt, Homo sapiens
gcccgagaauuccggcaua

SEQ ID NO: 701695 - RNA, 19 nt, Homo sapiens
acgaugagcugaccuucuu

SEQ ID NO: 701696 - RNA, 19 nt, Homo sapiens
cgacuucucuaaccuggau

SEQ ID NO: 701697 - RNA, 19 nt, Homo sapiens
caaaggaacagcuacucuu

SEQ ID NO: 701698 - RNA, 19 nt, Homo sapiens
aagagaaguuuaagaagca

SEQ ID NO: 701699 - RNA, 19 nt, Homo sapiens
gaggaggaagagaaguuua

SEQ ID NO: 701700 - RNA, 19 nt, Homo sapiens
gaaggagauggaacagauu

SEQ ID NO: 701701 - RNA, 19 nt, Homo sapiens
ucacaaggaggcuguaaau

SEQ ID NO: 701702 - RNA, 19 nt, Homo sapiens
ccucugcccucugcucuaa

SEQ ID NO: 701703 - RNA, 19 nt, Homo sapiens
uaagguggauuuucugauu

SEQ ID NO: 701704 - RNA, 19 nt, Homo sapiens
cagcuacucuugccuaaaa

SEQ ID NO: 701705 - RNA, 19 nt, Homo sapiens
gcccagccauggaccgaaa

SEQ ID NO: 701706 - RNA, 19 nt, Homo sapiens
ccagaaggcagcagaggaa

SEQ ID NO: 701707 - RNA, 19 nt, Homo sapiens
gaaggaacgggucgugcaa

SEQ ID NO: 701708 - RNA, 19 nt, Homo sapiens
uccagacucucauuccuuu

SEQ ID NO: 701709 - RNA, 19 nt, Homo sapiens
ggaccagauugucgaaguc

SEQ ID NO: 701710 - RNA, 19 nt, Homo sapiens
gaggugggauuggagauag

SEQ ID NO: 701711 - RNA, 19 nt, Homo sapiens
ucaaggauccagacucuca

SEQ ID NO: 701712 - RNA, 19 nt, Homo sapiens
ggaagagaaguuuaagaag

SEQ ID NO: 701713 - RNA, 19 nt, Homo sapiens
aggaagagaaguuuaagaa

SEQ ID NO: 701714 - RNA, 19 nt, Homo sapiens
gcaguauguggaucaguuu

SEQ ID NO: 701715 - RNA, 19 nt, Homo sapiens
aggacuaucucuaugaugu

SEQ ID NO: 701716 - RNA, 19 nt, Homo sapiens
gggaccagauugucgaagu

SEQ ID NO: 701717 - RNA, 19 nt, Homo sapiens
ugagagaggccacaugaca

SEQ ID NO: 701718 - RNA, 19 nt, Homo sapiens
agaagcggcuggcgaugga

SEQ ID NO: 701719 - RNA, 19 nt, Homo sapiens
gcugugggcucuucaucuc

SEQ ID NO: 701720 - RNA, 19 nt, Homo sapiens
ccaggauugucacuccaaa

SEQ ID NO: 701721 - RNA, 19 nt, Homo sapiens
gaaucuaucacccaggaau

SEQ ID NO: 701722 - RNA, 19 nt, Homo sapiens
gagauggagcggcaaagga

SEQ ID NO: 701723 - RNA, 19 nt, Homo sapiens
gaauguaccaccagaccau

SEQ ID NO: 701724 - RNA, 19 nt, Homo sapiens
agaaggacuaucucuauga

SEQ ID NO: 701725 - RNA, 19 nt, Homo sapiens
ucucaaggauccagacucu

SEQ ID NO: 701726 - RNA, 19 nt, Homo sapiens
gggacuggaucgaccuugu

SEQ ID NO: 701727 - RNA, 19 nt, Homo sapiens
aaaggaacagcuacucuug

SEQ ID NO: 701728 - RNA, 19 nt, Homo sapiens
gaggaagagaaguuuaaga

SEQ ID NO: 701729 - RNA, 19 nt, Homo sapiens
ggagauaggggaccagauu

SEQ ID NO: 701730 - RNA, 19 nt, Homo sapiens
gacgagaucauggcaauca

SEQ ID NO: 701731 - RNA, 19 nt, Homo sapiens
gagcagggagagcaggauu

SEQ ID NO: 701732 - RNA, 19 nt, Homo sapiens
gcaagccaaaguaugauca

SEQ ID NO: 701733 - RNA, 19 nt, Homo sapiens
cagaagccuggcaucuuua

SEQ ID NO: 701734 - RNA, 19 nt, Homo sapiens
gcagggagagcaggauuuc

SEQ ID NO: 701735 - RNA, 19 nt, Homo sapiens
ucuaugaugugcugcgaau

SEQ ID NO: 701736 - RNA, 19 nt, Homo sapiens
gcccgcagaugaccuggau

SEQ ID NO: 701737 - RNA, 19 nt, Homo sapiens
guauguggaucaguuugug

SEQ ID NO: 701738 - RNA, 19 nt, Homo sapiens
gagauggaacagauuguag

SEQ ID NO: 701739 - RNA, 19 nt, Homo sapiens
gcaaaggagaaaagaaauu

SEQ ID NO: 701740 - RNA, 19 nt, Homo sapiens
gccgggagcuguucaugac

SEQ ID NO: 701741 - RNA, 19 nt, Homo sapiens
gaucacaaggaggcuguaa

SEQ ID NO: 701742 - RNA, 19 nt, Homo sapiens
caaaaggggaaaccaaauu

SEQ ID NO: 701743 - RNA, 19 nt, Homo sapiens
gagaauuccggcauaaggu

SEQ ID NO: 701744 - RNA, 19 nt, Homo sapiens
ggcuguaaaugugcugaaa

SEQ ID NO: 701745 - RNA, 19 nt, Homo sapiens
uuuggucucucccagcuuu

SEQ ID NO: 701746 - RNA, 19 nt, Homo sapiens
ggacuggaucgaccuugug

SEQ ID NO: 701747 - RNA, 19 nt, Homo sapiens
gaagaagacuggggcucaa

SEQ ID NO: 701748 - RNA, 19 nt, Homo sapiens
gauccagacucucauuccu

SEQ ID NO: 701749 - RNA, 19 nt, Homo sapiens
gaaccagggccagauaagg

SEQ ID NO: 701750 - RNA, 19 nt, Homo sapiens
aaaggaguaugacgaugag

SEQ ID NO: 701751 - RNA, 19 nt, Homo sapiens
uagaggaggaagagaaguu

SEQ ID NO: 701752 - RNA, 19 nt, Homo sapiens
ggucaucaaccucauucga

SEQ ID NO: 701753 - RNA, 19 nt, Homo sapiens
uauuccaucuccuccugua

SEQ ID NO: 701754 - RNA, 19 nt, Homo sapiens
acuccaaaccuuacucuga

SEQ ID NO: 701755 - RNA, 19 nt, Homo sapiens
gcagaaggccuggaaucag

SEQ ID NO: 701756 - RNA, 19 nt, Homo sapiens
gcaugguggcauugugaaa

SEQ ID NO: 701757 - RNA, 19 nt, Homo sapiens
aaaaguggcccgagaauuc

SEQ ID NO: 701758 - RNA, 19 nt, Homo sapiens
uaagaagcaaugggaagaa

SEQ ID NO: 701759 - RNA, 19 nt, Homo sapiens
gucaucaaccucauucgaa

SEQ ID NO: 701760 - RNA, 19 nt, Homo sapiens
acggcaagauugugacaga

SEQ ID NO: 701761 - RNA, 19 nt, Homo sapiens
gggcucaaaggaacagcua

SEQ ID NO: 701762 - RNA, 19 nt, Homo sapiens
gaagcaaugggaagaagac

SEQ ID NO: 701763 - RNA, 19 nt, Homo sapiens
ggacuaucucuaugaugug

SEQ ID NO: 701764 - RNA, 19 nt, Homo sapiens
agagauaccggaaggagau

SEQ ID NO: 701765 - RNA, 19 nt, Homo sapiens
gaaaaguggcccgagaauu

SEQ ID NO: 701766 - RNA, 19 nt, Homo sapiens
ucugcccucugcucuaauu

SEQ ID NO: 701767 - RNA, 19 nt, Homo sapiens
uaugaugugcugcgaaugu

SEQ ID NO: 701768 - RNA, 19 nt, Homo sapiens
cuugggaccugaaucuauc

SEQ ID NO: 701769 - RNA, 19 nt, Homo sapiens
cccgagaauuccggcauaa

SEQ ID NO: 701770 - RNA, 19 nt, Homo sapiens
ccgaaaggaugaagaguua

SEQ ID NO: 701771 - RNA, 19 nt, Homo sapiens
gaaccaagcagcaggauug

SEQ ID NO: 701772 - RNA, 19 nt, Homo sapiens
gcgaugauauugccaccua

SEQ ID NO: 701773 - RNA, 19 nt, Homo sapiens
ucagaugaguacauguuua

SEQ ID NO: 701774 - RNA, 19 nt, Homo sapiens
uaaugcagaugcugaagaa

SEQ ID NO: 701775 - RNA, 19 nt, Homo sapiens
ggagucagaugaguacaug

SEQ ID NO: 701776 - RNA, 19 nt, Homo sapiens
gaaaggaugaagaguuaga

SEQ ID NO: 701777 - RNA, 19 nt, Homo sapiens
ccaccuaccucuuacaucu

SEQ ID NO: 701778 - RNA, 19 nt, Homo sapiens
ggugggaguugcgaugaua

SEQ ID NO: 701779 - RNA, 19 nt, Homo sapiens
gaucggagucagaugagua

SEQ ID NO: 701780 - RNA, 19 nt, Homo sapiens
guagaucggagucagauga

SEQ ID NO: 701781 - RNA, 19 nt, Homo sapiens
caagguagacagagagaga

SEQ ID NO: 701782 - RNA, 19 nt, Homo sapiens
gaucauugccgaggacuau

SEQ ID NO: 701783 - RNA, 19 nt, Homo sapiens
gcguggcuaugacaaggua

SEQ ID NO: 701784 - RNA, 19 nt, Homo sapiens
ggaccgcagccaugagaaa

SEQ ID NO: 701785 - RNA, 19 nt, Homo sapiens
ccugcgggcucccuuacua

SEQ ID NO: 701786 - RNA, 19 nt, Homo sapiens
ccauggacccuagcucaua

SEQ ID NO: 701787 - RNA, 19 nt, Homo sapiens
ccgcagccaugagaaacua

SEQ ID NO: 701788 - RNA, 19 nt, Homo sapiens
aagaagcucagaagcagua

SEQ ID NO: 701789 - RNA, 19 nt, Homo sapiens
cagaagcaguaaugcagau

SEQ ID NO: 701790 - RNA, 19 nt, Homo sapiens
gcagacacagaccuuguau

SEQ ID NO: 701791 - RNA, 19 nt, Homo sapiens
cuacuggaaugcagacaca

SEQ ID NO: 701792 - RNA, 19 nt, Homo sapiens
cgaggacuaugacgaugau

SEQ ID NO: 701793 - RNA, 19 nt, Homo sapiens
guaaugcagaugcugaaga

SEQ ID NO: 701794 - RNA, 19 nt, Homo sapiens
gcuacugguucauuugagu

SEQ ID NO: 701795 - RNA, 19 nt, Homo sapiens
ccaagcagcaggauugaag

SEQ ID NO: 701796 - RNA, 19 nt, Homo sapiens
gccgaaaggaugaagaguu

SEQ ID NO: 701797 - RNA, 19 nt, Homo sapiens
gaaugcagacacagaccuu

SEQ ID NO: 701798 - RNA, 19 nt, Homo sapiens
uacgggaggcgcuugguua

SEQ ID NO: 701799 - RNA, 19 nt, Homo sapiens
ccaaaucggccaagaagcu

SEQ ID NO: 701800 - RNA, 19 nt, Homo sapiens
gccaagaagcucagaagca

SEQ ID NO: 701801 - RNA, 19 nt, Homo sapiens
acgaugauccuguggacua

SEQ ID NO: 701802 - RNA, 19 nt, Homo sapiens
uauugccaccuaccucuua

SEQ ID NO: 701803 - RNA, 19 nt, Homo sapiens
cagcuacugguucauuuga

SEQ ID NO: 701804 - RNA, 19 nt, Homo sapiens
cuaggucugucugcuauca

SEQ ID NO: 701805 - RNA, 19 nt, Homo sapiens
gcucagaagcaguaaugca

SEQ ID NO: 701806 - RNA, 19 nt, Homo sapiens
cauggacccuagcucauac

SEQ ID NO: 701807 - RNA, 19 nt, Homo sapiens
ggaucgagagcguggcuau

SEQ ID NO: 701808 - RNA, 19 nt, Homo sapiens
ccagaggaagagaucauug

SEQ ID NO: 701809 - RNA, 19 nt, Homo sapiens
accuaccucuuacaucuuu

SEQ ID NO: 701810 - RNA, 19 nt, Homo sapiens
caagagcaagaaggcagua

SEQ ID NO: 701811 - RNA, 19 nt, Homo sapiens
ccucuuacaucuuuuagug

SEQ ID NO: 701812 - RNA, 19 nt, Homo sapiens
ccgggaagagggcaaagaa

SEQ ID NO: 701813 - RNA, 19 nt, Homo sapiens
gacaagguagacagagaga

SEQ ID NO: 701814 - RNA, 19 nt, Homo sapiens
gggaguugcgaugauauug

SEQ ID NO: 701815 - RNA, 19 nt, Homo sapiens
ggaccggagccaugacaag

SEQ ID NO: 701816 - RNA, 19 nt, Homo sapiens
aagcucagaagcaguaaug

SEQ ID NO: 701817 - RNA, 19 nt, Homo sapiens
cccuaggucugucugcuau

SEQ ID NO: 701818 - RNA, 19 nt, Homo sapiens
cagaugaguacauguuuac

SEQ ID NO: 701819 - RNA, 19 nt, Homo sapiens
gcccuggguuaaaauaaaa

SEQ ID NO: 701820 - RNA, 19 nt, Homo sapiens
gagcaagaaggcaguaagc

SEQ ID NO: 701821 - RNA, 19 nt, Homo sapiens
gaccggagccaugacaagu

SEQ ID NO: 701822 - RNA, 19 nt, Homo sapiens
agacacagaccuuguaucc

SEQ ID NO: 701823 - RNA, 19 nt, Homo sapiens
ugagcugcuugucaguuug

SEQ ID NO: 701824 - RNA, 19 nt, Homo sapiens
ggcccuggguuaaaauaaa

SEQ ID NO: 701825 - RNA, 19 nt, Homo sapiens
ggcaguaagccgaaaggau

SEQ ID NO: 701826 - RNA, 19 nt, Homo sapiens
gaguagaucggagucagau

SEQ ID NO: 701827 - RNA, 19 nt, Homo sapiens
uaccaaaucggccaagaag

SEQ ID NO: 701828 - RNA, 19 nt, Homo sapiens
gagcugcuugucaguuugu

SEQ ID NO: 701829 - RNA, 19 nt, Homo sapiens
guuacgggauccagauagg

SEQ ID NO: 701830 - RNA, 19 nt, Homo sapiens
gucagaugaguacauguuu

SEQ ID NO: 701831 - RNA, 19 nt, Homo sapiens
gaaggcaguaagccgaaag

SEQ ID NO: 701832 - RNA, 19 nt, Homo sapiens
agaaggcaguaagccgaaa

SEQ ID NO: 701833 - RNA, 19 nt, Homo sapiens
agucagaugaguacauguu

SEQ ID NO: 701834 - RNA, 19 nt, Homo sapiens
ggacaggggccaugacaag

SEQ ID NO: 701835 - RNA, 19 nt, Homo sapiens
uuaccaaaucggccaagaa

SEQ ID NO: 701836 - RNA, 19 nt, Homo sapiens
gaccccaacuccgugguua

SEQ ID NO: 701837 - RNA, 19 nt, Homo sapiens
guacagaucuuguugcuaa

SEQ ID NO: 701838 - RNA, 19 nt, Homo sapiens
gagauuaugugacuucuuu

SEQ ID NO: 701839 - RNA, 19 nt, Homo sapiens
ggaggaaccugugaaauaa

SEQ ID NO: 701840 - RNA, 19 nt, Homo sapiens
cgucaaaucucuuaaguaa

SEQ ID NO: 701841 - RNA, 19 nt, Homo sapiens
ggagaacacuggacuguau

SEQ ID NO: 701842 - RNA, 19 nt, Homo sapiens
caaagugacuggcaucauu

SEQ ID NO: 701843 - RNA, 19 nt, Homo sapiens
gaaggaagccauaacuauu

SEQ ID NO: 701844 - RNA, 19 nt, Homo sapiens
gaacaugacugccuaucag

SEQ ID NO: 701845 - RNA, 19 nt, Homo sapiens
caaauaagagcaagaguug

SEQ ID NO: 701846 - RNA, 19 nt, Homo sapiens
gaaaucaggacauauacaa

SEQ ID NO: 701847 - RNA, 19 nt, Homo sapiens
ggaaagacuugggcaaugu

SEQ ID NO: 701848 - RNA, 19 nt, Homo sapiens
gagaguuacuggugugauu

SEQ ID NO: 701849 - RNA, 19 nt, Homo sapiens
caaacuggcuuacagcaau

SEQ ID NO: 701850 - RNA, 19 nt, Homo sapiens
ugaaauaagugaagcauac

SEQ ID NO: 701851 - RNA, 19 nt, Homo sapiens
aaggaauacugcaauguua

SEQ ID NO: 701852 - RNA, 19 nt, Homo sapiens
ucacaacccucuucccuau

SEQ ID NO: 701853 - RNA, 19 nt, Homo sapiens
gaagugucauguuuacuca

SEQ ID NO: 701854 - RNA, 19 nt, Homo sapiens
acaaagcgcugaggaaaga

SEQ ID NO: 701855 - RNA, 19 nt, Homo sapiens
ucagaacgcucaacaugga

SEQ ID NO: 701856 - RNA, 19 nt, Homo sapiens
gcauacucaucauuucuuu

SEQ ID NO: 701857 - RNA, 19 nt, Homo sapiens
guggaaacauugauaacaa

SEQ ID NO: 701858 - RNA, 19 nt, Homo sapiens
uggaggaaccugugaaaua

SEQ ID NO: 701859 - RNA, 19 nt, Homo sapiens
uaacaaagcgcugaggaaa

SEQ ID NO: 701860 - RNA, 19 nt, Homo sapiens
ggccguggauucagauaaa

SEQ ID NO: 701861 - RNA, 19 nt, Homo sapiens
caucgacccucccaucuau

SEQ ID NO: 701862 - RNA, 19 nt, Homo sapiens
gauaacaacacuccauaug

SEQ ID NO: 701863 - RNA, 19 nt, Homo sapiens
cagauaaauuugcaaagga

SEQ ID NO: 701864 - RNA, 19 nt, Homo sapiens
ccaagcauacucaucauuu

SEQ ID NO: 701865 - RNA, 19 nt, Homo sapiens
ggaaugaacugugcaaaau

SEQ ID NO: 701866 - RNA, 19 nt, Homo sapiens
acaacccucuucccuauuu

SEQ ID NO: 701867 - RNA, 19 nt, Homo sapiens
uaacaacacuccauaugcu

SEQ ID NO: 701868 - RNA, 19 nt, Homo sapiens
gaaagacuugggcaaugua

SEQ ID NO: 701869 - RNA, 19 nt, Homo sapiens
aggaagccauaacuauuua

SEQ ID NO: 701870 - RNA, 19 nt, Homo sapiens
uguaaugacucuacguuau

SEQ ID NO: 701871 - RNA, 19 nt, Homo sapiens
ccuaauccaugccauaaug

SEQ ID NO: 701872 - RNA, 19 nt, Homo sapiens
acaaggagcuaaagauuuu

SEQ ID NO: 701873 - RNA, 19 nt, Homo sapiens
gaagguggaauuauaucaa

SEQ ID NO: 701874 - RNA, 19 nt, Homo sapiens
cugugaaacuaacaucuua

SEQ ID NO: 701875 - RNA, 19 nt, Homo sapiens
guaacaugcaguacugaua

SEQ ID NO: 701876 - RNA, 19 nt, Homo sapiens
uuacagcaaugauggagaa

SEQ ID NO: 701877 - RNA, 19 nt, Homo sapiens
auauagugcugcauaguuu

SEQ ID NO: 701878 - RNA, 19 nt, Homo sapiens
ucgaagacauugcacuuug

SEQ ID NO: 701879 - RNA, 19 nt, Homo sapiens
gacaugguguuucguggaa

SEQ ID NO: 701880 - RNA, 19 nt, Homo sapiens
uuaaugggauucacuguca

SEQ ID NO: 701881 - RNA, 19 nt, Homo sapiens
ucgcauugguagaaauaua

SEQ ID NO: 701882 - RNA, 19 nt, Homo sapiens
ggaaagcucggcuggacaa

SEQ ID NO: 701883 - RNA, 19 nt, Homo sapiens
gguggaauauguacagauc

SEQ ID NO: 701884 - RNA, 19 nt, Homo sapiens
caagcauacucaucauuuc

SEQ ID NO: 701885 - RNA, 19 nt, Homo sapiens
uaacaugcaguacugauau

SEQ ID NO: 701886 - RNA, 19 nt, Homo sapiens
ugaaggaagccauaacuau

SEQ ID NO: 701887 - RNA, 19 nt, Homo sapiens
aaagaagugucauguuuac

SEQ ID NO: 701888 - RNA, 19 nt, Homo sapiens
auacaagacuaucagauca

SEQ ID NO: 701889 - RNA, 19 nt, Homo sapiens
caaaggaaaaugagaguua

SEQ ID NO: 701890 - RNA, 19 nt, Homo sapiens
ggaaggcacagguggaguu

SEQ ID NO: 701891 - RNA, 19 nt, Homo sapiens
ucaaauaagagcaagaguu

SEQ ID NO: 701892 - RNA, 19 nt, Homo sapiens
ggacaagcaaggcaaagug

SEQ ID NO: 701893 - RNA, 19 nt, Homo sapiens
gcgaauuuaugggaagaaa

SEQ ID NO: 701894 - RNA, 19 nt, Homo sapiens
aaauggagguaucuguuug

SEQ ID NO: 701895 - RNA, 19 nt, Homo sapiens
gcaauguuagcaauaaguu

SEQ ID NO: 701896 - RNA, 19 nt, Homo sapiens
cucauuguuuccugaauua

SEQ ID NO: 701897 - RNA, 19 nt, Homo sapiens
acaaugacacucacagaaa

SEQ ID NO: 701898 - RNA, 19 nt, Homo sapiens
aaagugacuggcaucauua

SEQ ID NO: 701899 - RNA, 19 nt, Homo sapiens
guucugagccucuggguau

SEQ ID NO: 701900 - RNA, 19 nt, Homo sapiens
ggaagcccagaguauauaa

SEQ ID NO: 701901 - RNA, 19 nt, Homo sapiens
cauaaagaaucccauacuc

SEQ ID NO: 701902 - RNA, 19 nt, Homo sapiens
gucucaaagucaucaaaua

SEQ ID NO: 701903 - RNA, 19 nt, Homo sapiens
guaggcaacuaacgguguu

SEQ ID NO: 701904 - RNA, 19 nt, Homo sapiens
gacaaugacacucacagaa

SEQ ID NO: 701905 - RNA, 19 nt, Homo sapiens
gagaacacuggacuguaua

SEQ ID NO: 701906 - RNA, 19 nt, Homo sapiens
acagguggaucuucuuguu

SEQ ID NO: 701907 - RNA, 19 nt, Homo sapiens
caggacauauacaagacua

SEQ ID NO: 701908 - RNA, 19 nt, Homo sapiens
guaaugauggaaagacuug

SEQ ID NO: 701909 - RNA, 19 nt, Homo sapiens
ggauucagauaaauuugca

SEQ ID NO: 701910 - RNA, 19 nt, Homo sapiens
acacaaggagcuaaagauu

SEQ ID NO: 701911 - RNA, 19 nt, Homo sapiens
gaaccugugaaauaaguga

SEQ ID NO: 701912 - RNA, 19 nt, Homo sapiens
aaggaagccauaacuauuu

SEQ ID NO: 701913 - RNA, 19 nt, Homo sapiens
cacaaggagcuaaagauuu

SEQ ID NO: 701914 - RNA, 19 nt, Homo sapiens
ugacuggcaucauuacaca

SEQ ID NO: 701915 - RNA, 19 nt, Homo sapiens
gaaaggcaccaaugaagac

SEQ ID NO: 701916 - RNA, 19 nt, Homo sapiens
ucagauaaauuugcaaagg

SEQ ID NO: 701917 - RNA, 19 nt, Homo sapiens
agugucauguuuacucaua

SEQ ID NO: 701918 - RNA, 19 nt, Homo sapiens
aaaggaauacugcaauguu

SEQ ID NO: 701919 - RNA, 19 nt, Homo sapiens
ucucauuguuuccugaauu

SEQ ID NO: 701920 - RNA, 19 nt, Homo sapiens
ggucauguacaguuuguug

SEQ ID NO: 701921 - RNA, 19 nt, Homo sapiens
ggaccucuggccacaauga

SEQ ID NO: 701922 - RNA, 19 nt, Homo sapiens
ugaaaggcaccaaugaaga

SEQ ID NO: 701923 - RNA, 19 nt, Homo sapiens
auaaaugaaugcgaaguug

SEQ ID NO: 701924 - RNA, 19 nt, Homo sapiens
cagcacaacauaaaugaau

SEQ ID NO: 701925 - RNA, 19 nt, Homo sapiens
ugauagagcuuuuacaauc

SEQ ID NO: 701926 - RNA, 19 nt, Homo sapiens
aaaaguaucuccauggaau

SEQ ID NO: 701927 - RNA, 19 nt, Homo sapiens
caaugaagacaugguguuu

SEQ ID NO: 701928 - RNA, 19 nt, Homo sapiens
uaaaugaaugcgaaguuga

SEQ ID NO: 701929 - RNA, 19 nt, Homo sapiens
guaaugacucuacguuauc

SEQ ID NO: 701930 - RNA, 19 nt, Homo sapiens
uacaaucaauacucaccua

SEQ ID NO: 701931 - RNA, 19 nt, Homo sapiens
caaugacacucacagaaaa

SEQ ID NO: 701932 - RNA, 19 nt, Homo sapiens
gcaaagaaaagauaagguu

SEQ ID NO: 701933 - RNA, 19 nt, Homo sapiens
gacaagcaaggcaaaguga

SEQ ID NO: 701934 - RNA, 19 nt, Homo sapiens
ccaaggagccaagaggauu

SEQ ID NO: 701935 - RNA, 19 nt, Homo sapiens
ugagugcccaggcgaauuu

SEQ ID NO: 701936 - RNA, 19 nt, Homo sapiens
cagaucuuguugcuaacua

SEQ ID NO: 701937 - RNA, 19 nt, Homo sapiens
ggacagaggacaugagaua

SEQ ID NO: 701938 - RNA, 19 nt, Homo sapiens
ccagcuagaucaucaguua

SEQ ID NO: 701939 - RNA, 19 nt, Homo sapiens
ugaaguaacugaagaauca

SEQ ID NO: 701940 - RNA, 19 nt, Homo sapiens
ccucuuaacucuugaagua

SEQ ID NO: 701941 - RNA, 19 nt, Homo sapiens
gauacugucuugaauacua

SEQ ID NO: 701942 - RNA, 19 nt, Homo sapiens
gacauuaccuugugaaagu

SEQ ID NO: 701943 - RNA, 19 nt, Homo sapiens
gcaaaugccugauacuuuu

SEQ ID NO: 701944 - RNA, 19 nt, Homo sapiens
ggacgcacaugaaauuuag

SEQ ID NO: 701945 - RNA, 19 nt, Homo sapiens
caagugggcuacauuugaa

SEQ ID NO: 701946 - RNA, 19 nt, Homo sapiens
caccuuaacugaugacauu

SEQ ID NO: 701947 - RNA, 19 nt, Homo sapiens
caaagugucaagcauguua

SEQ ID NO: 701948 - RNA, 19 nt, Homo sapiens
gagauacugucuugaauac

SEQ ID NO: 701949 - RNA, 19 nt, Homo sapiens
caucaccuaucauucuaua

SEQ ID NO: 701950 - RNA, 19 nt, Homo sapiens
cuaauuagauguccuaggu

SEQ ID NO: 701951 - RNA, 19 nt, Homo sapiens
gaacugccaggacuucaaa

SEQ ID NO: 701952 - RNA, 19 nt, Homo sapiens
ugagaaacaucgcccauuc

SEQ ID NO: 701953 - RNA, 19 nt, Homo sapiens
gcaggacuaugcugaaucu

SEQ ID NO: 701954 - RNA, 19 nt, Homo sapiens
gggcuacauuugaagaauu

SEQ ID NO: 701955 - RNA, 19 nt, Homo sapiens
cacuagggcauaacaauua

SEQ ID NO: 701956 - RNA, 19 nt, Homo sapiens
ucgcacaccuuaaagcaaa

SEQ ID NO: 701957 - RNA, 19 nt, Homo sapiens
ugccuuaacugaugacauu

SEQ ID NO: 701958 - RNA, 19 nt, Homo sapiens
ccaagugggcuacauuuga

SEQ ID NO: 701959 - RNA, 19 nt, Homo sapiens
ugauggagcugugccaauu

SEQ ID NO: 701960 - RNA, 19 nt, Homo sapiens
agagacagcugcuccuuca

SEQ ID NO: 701961 - RNA, 19 nt, Homo sapiens
aaauaacacuagggcauaa

SEQ ID NO: 701962 - RNA, 19 nt, Homo sapiens
acaaacaggugaucucucu

SEQ ID NO: 701963 - RNA, 19 nt, Homo sapiens
caacacuucaacacuauuu

SEQ ID NO: 701964 - RNA, 19 nt, Homo sapiens
agaccucccuucagcuuaa

SEQ ID NO: 701965 - RNA, 19 nt, Homo sapiens
uaaagugguuauucuugga

SEQ ID NO: 701966 - RNA, 19 nt, Homo sapiens
aaaagugccuugagaauau

SEQ ID NO: 701967 - RNA, 19 nt, Homo sapiens
gaaugcaacauauaucugu

SEQ ID NO: 701968 - RNA, 19 nt, Homo sapiens
gaagaaugcaacauauauc

SEQ ID NO: 701969 - RNA, 19 nt, Homo sapiens
gcacaugaaauuuaguugu

SEQ ID NO: 701970 - RNA, 19 nt, Homo sapiens
gccaucaccuaucauucua

SEQ ID NO: 701971 - RNA, 19 nt, Homo sapiens
ugagauacugucuugaaua

SEQ ID NO: 701972 - RNA, 19 nt, Homo sapiens
gcuagaucaucaguuaauu

SEQ ID NO: 701973 - RNA, 19 nt, Homo sapiens
gaggaagccaugaacacua

SEQ ID NO: 701974 - RNA, 19 nt, Homo sapiens
ccagugaccuuucaguuuu

SEQ ID NO: 701975 - RNA, 19 nt, Homo sapiens
gcaguccagugaccuuuca

SEQ ID NO: 701976 - RNA, 19 nt, Homo sapiens
uaagaaggcaggcauguca

SEQ ID NO: 701977 - RNA, 19 nt, Homo sapiens
gaagcagcccugagaaaca

SEQ ID NO: 701978 - RNA, 19 nt, Homo sapiens
gacagcugcuccuucagaa

SEQ ID NO: 701979 - RNA, 19 nt, Homo sapiens
ugucaagcauguuaauguu

SEQ ID NO: 701980 - RNA, 19 nt, Homo sapiens
gcaccuauacgcccagaug

SEQ ID NO: 701981 - RNA, 19 nt, Homo sapiens
cuuaaucucucccacucua

SEQ ID NO: 701982 - RNA, 19 nt, Homo sapiens
gggcucagaccaucaguga

SEQ ID NO: 701983 - RNA, 19 nt, Homo sapiens
gacgugggcuuccauaucg

SEQ ID NO: 701984 - RNA, 19 nt, Homo sapiens
gcccagauggccugaagua

SEQ ID NO: 701985 - RNA, 19 nt, Homo sapiens
aaacagaggagacccugaa

SEQ ID NO: 701986 - RNA, 19 nt, Homo sapiens
ggccugaaguaacugaaga

SEQ ID NO: 701987 - RNA, 19 nt, Homo sapiens
cagauggccugaaguaacu

SEQ ID NO: 701988 - RNA, 19 nt, Homo sapiens
ucugaagaaugcaacauau

SEQ ID NO: 701989 - RNA, 19 nt, Homo sapiens
caugagauacugucuugaa

SEQ ID NO: 701990 - RNA, 19 nt, Homo sapiens
guccuugccuuaacugaug

SEQ ID NO: 701991 - RNA, 19 nt, Homo sapiens
gaugacauuccaccacaaa

SEQ ID NO: 701992 - RNA, 19 nt, Homo sapiens
gggcauaacaauuacuuca

SEQ ID NO: 701993 - RNA, 19 nt, Homo sapiens
ucaagcauguuaauguuac

SEQ ID NO: 701994 - RNA, 19 nt, Homo sapiens
uaacugaugacauuaccuu

SEQ ID NO: 701995 - RNA, 19 nt, Homo sapiens
ccugugacuugcaccuaua

SEQ ID NO: 701996 - RNA, 19 nt, Homo sapiens
gcaaaacauugaagguaga

SEQ ID NO: 701997 - RNA, 19 nt, Homo sapiens
uagguccucccaauucuua

SEQ ID NO: 701998 - RNA, 19 nt, Homo sapiens
caaaagugccuugagaaua

SEQ ID NO: 701999 - RNA, 19 nt, Homo sapiens
cuucaaagcccacaaccaa

SEQ ID NO: 702000 - RNA, 19 nt, Homo sapiens
cauagcaaaugccugauac

SEQ ID NO: 702001 - RNA, 19 nt, Homo sapiens
caggaaacauagcaaaugc

SEQ ID NO: 702002 - RNA, 19 nt, Homo sapiens
ugugaggccuugaaaauaa

SEQ ID NO: 702003 - RNA, 19 nt, Homo sapiens
gcucaacccaugccugaug

SEQ ID NO: 702004 - RNA, 19 nt, Homo sapiens
cagaaaacacuaccaagua

SEQ ID NO: 702005 - RNA, 19 nt, Homo sapiens
gucaagcauguuaauguua

SEQ ID NO: 702006 - RNA, 19 nt, Homo sapiens
cggacgcacaugaaauuua

SEQ ID NO: 702007 - RNA, 19 nt, Homo sapiens
caggugaaauaaacagcuu

SEQ ID NO: 702008 - RNA, 19 nt, Homo sapiens
ggcuacauuugaagaauuc

SEQ ID NO: 702009 - RNA, 19 nt, Homo sapiens
ggaccgaggaagccaugaa

SEQ ID NO: 702010 - RNA, 19 nt, Homo sapiens
ccacauucauauauuugca

SEQ ID NO: 702011 - RNA, 19 nt, Homo sapiens
gcucacacaaagccuguuu

SEQ ID NO: 702012 - RNA, 19 nt, Homo sapiens
caagaccucccuucagcuu

SEQ ID NO: 702013 - RNA, 19 nt, Homo sapiens
acacuagggcauaacaauu

SEQ ID NO: 702014 - RNA, 19 nt, Homo sapiens
cagaggacaugagauacug

SEQ ID NO: 702015 - RNA, 19 nt, Homo sapiens
cugaagaaugcaacauaua

SEQ ID NO: 702016 - RNA, 19 nt, Homo sapiens
cuccuucucuuauuccauu

SEQ ID NO: 702017 - RNA, 19 nt, Homo sapiens
ggaacugccaggacuucaa

SEQ ID NO: 702018 - RNA, 19 nt, Homo sapiens
ucacacggacgcacaugaa

SEQ ID NO: 702019 - RNA, 19 nt, Homo sapiens
caccuaucauucuauacaa

SEQ ID NO: 702020 - RNA, 19 nt, Homo sapiens
cccaaagugucaagcaugu

SEQ ID NO: 702021 - RNA, 19 nt, Homo sapiens
uauauuugcaguccaguga

SEQ ID NO: 702022 - RNA, 19 nt, Homo sapiens
gagacuaauuccucuucca

SEQ ID NO: 702023 - RNA, 19 nt, Homo sapiens
cugaugacauuaccuugug

SEQ ID NO: 702024 - RNA, 19 nt, Homo sapiens
cccaacacuucaacacuau

SEQ ID NO: 702025 - RNA, 19 nt, Homo sapiens
uacuauuccugguuucuga

SEQ ID NO: 702026 - RNA, 19 nt, Homo sapiens
ucaccuaucauucuauaca

SEQ ID NO: 702027 - RNA, 19 nt, Homo sapiens
ucaggaaacauagcaaaug

SEQ ID NO: 702028 - RNA, 19 nt, Homo sapiens
cacggacgcacaugaaauu

SEQ ID NO: 702029 - RNA, 19 nt, Homo sapiens
cacccaggcuccagcuaga

SEQ ID NO: 702030 - RNA, 19 nt, Homo sapiens
cauccacccuggcucuugu

SEQ ID NO: 702031 - RNA, 19 nt, Homo sapiens
ggagcugugccaauucuuc

SEQ ID NO: 702032 - RNA, 19 nt, Homo sapiens
ggcgccugcugcugagaua

SEQ ID NO: 702033 - RNA, 19 nt, Homo sapiens
agcaaaugccugauacuuu

SEQ ID NO: 702034 - RNA, 19 nt, Homo sapiens
ggccaucaccuaucauucu

SEQ ID NO: 702035 - RNA, 19 nt, Homo sapiens
gccaauucuuccagcaaug

SEQ ID NO: 702036 - RNA, 19 nt, Homo sapiens
agacagcugcuccuucaga

SEQ ID NO: 702037 - RNA, 19 nt, Homo sapiens
gaagaugacuuuccuacaa

SEQ ID NO: 702038 - RNA, 19 nt, Homo sapiens
gaaguuggcugaaauggaa

SEQ ID NO: 702039 - RNA, 19 nt, Homo sapiens
gaacagaggaagcauauaa

SEQ ID NO: 702040 - RNA, 19 nt, Homo sapiens
caagaaaggccacaguuua

SEQ ID NO: 702041 - RNA, 19 nt, Homo sapiens
gacaugaagucugcaauua

SEQ ID NO: 702042 - RNA, 19 nt, Homo sapiens
gcgagaguauccuaaauuu

SEQ ID NO: 702043 - RNA, 19 nt, Homo sapiens
gauggugacuucuugcaua

SEQ ID NO: 702044 - RNA, 19 nt, Homo sapiens
gaggacagcuggcagaaga

SEQ ID NO: 702045 - RNA, 19 nt, Homo sapiens
gguagaagaugaugaagau

SEQ ID NO: 702046 - RNA, 19 nt, Homo sapiens
gcaguugguuguagaagaa

SEQ ID NO: 702047 - RNA, 19 nt, Homo sapiens
ucaaagggauaaaguggua

SEQ ID NO: 702048 - RNA, 19 nt, Homo sapiens
gaaaugaagguauacagaa

SEQ ID NO: 702049 - RNA, 19 nt, Homo sapiens
uaaggaaacugagaagaaa

SEQ ID NO: 702050 - RNA, 19 nt, Homo sapiens
gcaaguggcuacucugcaa

SEQ ID NO: 702051 - RNA, 19 nt, Homo sapiens
caugaagucugcaauuauu

SEQ ID NO: 702052 - RNA, 19 nt, Homo sapiens
gcaauuauuucuggaaugu

SEQ ID NO: 702053 - RNA, 19 nt, Homo sapiens
cuaacagucugauuaauga

SEQ ID NO: 702054 - RNA, 19 nt, Homo sapiens
cgagacguauuauaucuuu

SEQ ID NO: 702055 - RNA, 19 nt, Homo sapiens
gcaacacuuucucauugua

SEQ ID NO: 702056 - RNA, 19 nt, Homo sapiens
gggauaaagugguagaaga

SEQ ID NO: 702057 - RNA, 19 nt, Homo sapiens
gaagagaaguagaagaaaa

SEQ ID NO: 702058 - RNA, 19 nt, Homo sapiens
gaagaacagaggaagcaua

SEQ ID NO: 702059 - RNA, 19 nt, Homo sapiens
gagggaaaccaggaaauua

SEQ ID NO: 702060 - RNA, 19 nt, Homo sapiens
guucuaguauuaacaggua

SEQ ID NO: 702061 - RNA, 19 nt, Homo sapiens
gcaccagccucaguguuaa

SEQ ID NO: 702062 - RNA, 19 nt, Homo sapiens
gaaauuagcagggacaaca

SEQ ID NO: 702063 - RNA, 19 nt, Homo sapiens
aaggagaaaugaagguaua

SEQ ID NO: 702064 - RNA, 19 nt, Homo sapiens
ggugacuucuugcauagua

SEQ ID NO: 702065 - RNA, 19 nt, Homo sapiens
caacauccaccucuucauu

SEQ ID NO: 702066 - RNA, 19 nt, Homo sapiens
gagccuccaugucggauaa

SEQ ID NO: 702067 - RNA, 19 nt, Homo sapiens
guggaaacauuagcugaua

SEQ ID NO: 702068 - RNA, 19 nt, Homo sapiens
ggacaugaagucugcaauu

SEQ ID NO: 702069 - RNA, 19 nt, Homo sapiens
caucuuauguagacaaguu

SEQ ID NO: 702070 - RNA, 19 nt, Homo sapiens
gagaguauccuaaauuucu

SEQ ID NO: 702071 - RNA, 19 nt, Homo sapiens
gaagguauacagaagagaa

SEQ ID NO: 702072 - RNA, 19 nt, Homo sapiens
cuacagaaguacuuugaug

SEQ ID NO: 702073 - RNA, 19 nt, Homo sapiens
ggaaacauuuagagacauc

SEQ ID NO: 702074 - RNA, 19 nt, Homo sapiens
gaacagcacaagacugaau

SEQ ID NO: 702075 - RNA, 19 nt, Homo sapiens
uagcaaggcugucaucaca

SEQ ID NO: 702076 - RNA, 19 nt, Homo sapiens
uaacagguacuagaagaua

SEQ ID NO: 702077 - RNA, 19 nt, Homo sapiens
cagaagagaaguagaagaa

SEQ ID NO: 702078 - RNA, 19 nt, Homo sapiens
agaagagacuggauaagga

SEQ ID NO: 702079 - RNA, 19 nt, Homo sapiens
gaguauggcugcagaggau

SEQ ID NO: 702080 - RNA, 19 nt, Homo sapiens
gcaaugacagaacuuaaga

SEQ ID NO: 702081 - RNA, 19 nt, Homo sapiens
gaagagacuggauaaggaa

SEQ ID NO: 702082 - RNA, 19 nt, Homo sapiens
gguacuagaagauauguuu

SEQ ID NO: 702083 - RNA, 19 nt, Homo sapiens
gaucauagacagcaaugga

SEQ ID NO: 702084 - RNA, 19 nt, Homo sapiens
gaugaaugucgauuugaua

SEQ ID NO: 702085 - RNA, 19 nt, Homo sapiens
gcaaagcgagaguauccua

SEQ ID NO: 702086 - RNA, 19 nt, Homo sapiens
gcucugaguuacuacaaau

SEQ ID NO: 702087 - RNA, 19 nt, Homo sapiens
ugacagugcuccucuaaac

SEQ ID NO: 702088 - RNA, 19 nt, Homo sapiens
agacagcaauggauagaug

SEQ ID NO: 702089 - RNA, 19 nt, Homo sapiens
ggcaccagccucaguguua

SEQ ID NO: 702090 - RNA, 19 nt, Homo sapiens
uugcaacacuuucucauug

SEQ ID NO: 702091 - RNA, 19 nt, Homo sapiens
gaaagccuauuuuguucua

SEQ ID NO: 702092 - RNA, 19 nt, Homo sapiens
uugaagagauggugcagaa

SEQ ID NO: 702093 - RNA, 19 nt, Homo sapiens
gugagaaguuggcugaaau

SEQ ID NO: 702094 - RNA, 19 nt, Homo sapiens
gacugaaucuggauaugga

SEQ ID NO: 702095 - RNA, 19 nt, Homo sapiens
gggacaacauucuaugcaa

SEQ ID NO: 702096 - RNA, 19 nt, Homo sapiens
ggcccuaacagucugauua

SEQ ID NO: 702097 - RNA, 19 nt, Homo sapiens
caucacaccucacgauuuu

SEQ ID NO: 702098 - RNA, 19 nt, Homo sapiens
cugaugauguucacagauu

SEQ ID NO: 702099 - RNA, 19 nt, Homo sapiens
gggaagcgauaacuuuuaa

SEQ ID NO: 702100 - RNA, 19 nt, Homo sapiens
ggccacaguuuacgugaga

SEQ ID NO: 702101 - RNA, 19 nt, Homo sapiens
ggaaacaacuauagaaaac

SEQ ID NO: 702102 - RNA, 19 nt, Homo sapiens
ugaagcugcucuugacaga

SEQ ID NO: 702103 - RNA, 19 nt, Homo sapiens
ucaagaaaggccacaguuu

SEQ ID NO: 702104 - RNA, 19 nt, Homo sapiens
auaaugcucugaguuacua

SEQ ID NO: 702105 - RNA, 19 nt, Homo sapiens
gugcugaugcugucucuaa

SEQ ID NO: 702106 - RNA, 19 nt, Homo sapiens
ggauagaugccauugaaca

SEQ ID NO: 702107 - RNA, 19 nt, Homo sapiens
ucagcgagacguauuauau

SEQ ID NO: 702108 - RNA, 19 nt, Homo sapiens
gaaggagaaaugaagguau

SEQ ID NO: 702109 - RNA, 19 nt, Homo sapiens
aaaguuauuuccacaugug

SEQ ID NO: 702110 - RNA, 19 nt, Homo sapiens
uagaagaugaugaagauga

SEQ ID NO: 702111 - RNA, 19 nt, Homo sapiens
ggauaaagugguagaagau

SEQ ID NO: 702112 - RNA, 19 nt, Homo sapiens
ggauccaucugucuuagca

SEQ ID NO: 702113 - RNA, 19 nt, Homo sapiens
gagauuacauuggccuaca

SEQ ID NO: 702114 - RNA, 19 nt, Homo sapiens
guucuuugaugcuguugaa

SEQ ID NO: 702115 - RNA, 19 nt, Homo sapiens
caggaucguuggguaguuu

SEQ ID NO: 702116 - RNA, 19 nt, Homo sapiens
gaaaaggugagauuacauu

SEQ ID NO: 702117 - RNA, 19 nt, Homo sapiens
auaaagugguagaagauga

SEQ ID NO: 702118 - RNA, 19 nt, Homo sapiens
auaccagccuugacugaaa

SEQ ID NO: 702119 - RNA, 19 nt, Homo sapiens
uggaaacauuagcugauaa

SEQ ID NO: 702120 - RNA, 19 nt, Homo sapiens
guaccaacggcaauaaaga

SEQ ID NO: 702121 - RNA, 19 nt, Homo sapiens
cgaaagauaccagccuuga

SEQ ID NO: 702122 - RNA, 19 nt, Homo sapiens
gcccuaacagucugauuaa

SEQ ID NO: 702123 - RNA, 19 nt, Homo sapiens
guauuaacagguacuagaa

SEQ ID NO: 702124 - RNA, 19 nt, Homo sapiens
aaaugaagguauacagaag

SEQ ID NO: 702125 - RNA, 19 nt, Homo sapiens
ggcaguugguuguagaaga

SEQ ID NO: 702126 - RNA, 19 nt, Homo sapiens
ugcagaaccacaugacuua

SEQ ID NO: 702127 - RNA, 19 nt, Homo sapiens
ggaauccuugcaacacuuu

SEQ ID NO: 702128 - RNA, 19 nt, Homo sapiens
cgugagaaguuggcugaaa

SEQ ID NO: 702129 - RNA, 19 nt, Homo sapiens
ucaguaaguggacaaacua

SEQ ID NO: 702130 - RNA, 19 nt, Homo sapiens
gcaggaucguuggguaguu

SEQ ID NO: 702131 - RNA, 19 nt, Homo sapiens
gaaaaugacccugaaacuu

SEQ ID NO: 702132 - RNA, 19 nt, Homo sapiens
uugacacgcuacagaagua

SEQ ID NO: 702133 - RNA, 19 nt, Homo sapiens
caaguugacacgcuacaga

SEQ ID NO: 702134 - RNA, 19 nt, Homo sapiens
guagaagaaggagaaauga

SEQ ID NO: 702135 - RNA, 19 nt, Homo sapiens
gcucccagguugaagagau

SEQ ID NO: 702136 - RNA, 19 nt, Homo sapiens
ccuaacagucugauuaaug

SEQ ID NO: 702137 - RNA, 19 nt, Homo sapiens
gaagaugacuuuccuacaa

SEQ ID NO: 702138 - RNA, 19 nt, Homo sapiens
gaaguuggcugaaauggaa

SEQ ID NO: 702139 - RNA, 19 nt, Homo sapiens
gaacagaggaagcauauaa

SEQ ID NO: 702140 - RNA, 19 nt, Homo sapiens
caagaaaggccacaguuua

SEQ ID NO: 702141 - RNA, 19 nt, Homo sapiens
gacaugaagucugcaauua

SEQ ID NO: 702142 - RNA, 19 nt, Homo sapiens
gcgagaguauccuaaauuu

SEQ ID NO: 702143 - RNA, 19 nt, Homo sapiens
gauggugacuucuugcaua

SEQ ID NO: 702144 - RNA, 19 nt, Homo sapiens
gaggacagcuggcagaaga

SEQ ID NO: 702145 - RNA, 19 nt, Homo sapiens
gguagaagaugaugaagau

SEQ ID NO: 702146 - RNA, 19 nt, Homo sapiens
gcaguugguuguagaagaa

SEQ ID NO: 702147 - RNA, 19 nt, Homo sapiens
ucaaagggauaaaguggua

SEQ ID NO: 702148 - RNA, 19 nt, Homo sapiens
gaaaugaagguauacagaa

SEQ ID NO: 702149 - RNA, 19 nt, Homo sapiens
uaaggaaacugagaagaaa

SEQ ID NO: 702150 - RNA, 19 nt, Homo sapiens
gcaaguggcuacucugcaa

SEQ ID NO: 702151 - RNA, 19 nt, Homo sapiens
caugaagucugcaauuauu

SEQ ID NO: 702152 - RNA, 19 nt, Homo sapiens
gcaauuauuucuggaaugu

SEQ ID NO: 702153 - RNA, 19 nt, Homo sapiens
cuaacagucugauuaauga

SEQ ID NO: 702154 - RNA, 19 nt, Homo sapiens
cgagacguauuauaucuuu

SEQ ID NO: 702155 - RNA, 19 nt, Homo sapiens
gcaacacuuucucauugua

SEQ ID NO: 702156 - RNA, 19 nt, Homo sapiens
gggauaaagugguagaaga

SEQ ID NO: 702157 - RNA, 19 nt, Homo sapiens
gaagagaaguagaagaaaa

SEQ ID NO: 702158 - RNA, 19 nt, Homo sapiens
gaagaacagaggaagcaua

SEQ ID NO: 702159 - RNA, 19 nt, Homo sapiens
gagggaaaccaggaaauua

SEQ ID NO: 702160 - RNA, 19 nt, Homo sapiens
guucuaguauuaacaggua

SEQ ID NO: 702161 - RNA, 19 nt, Homo sapiens
gcaccagccucaguguuaa

SEQ ID NO: 702162 - RNA, 19 nt, Homo sapiens
gaaauuagcagggacaaca

SEQ ID NO: 702163 - RNA, 19 nt, Homo sapiens
aaggagaaaugaagguaua

SEQ ID NO: 702164 - RNA, 19 nt, Homo sapiens
ggugacuucuugcauagua

SEQ ID NO: 702165 - RNA, 19 nt, Homo sapiens
caacauccaccucuucauu

SEQ ID NO: 702166 - RNA, 19 nt, Homo sapiens
gagccuccaugucggauaa

SEQ ID NO: 702167 - RNA, 19 nt, Homo sapiens
guggaaacauuagcugaua

SEQ ID NO: 702168 - RNA, 19 nt, Homo sapiens
ggacaugaagucugcaauu

SEQ ID NO: 702169 - RNA, 19 nt, Homo sapiens
caucuuauguagacaaguu

SEQ ID NO: 702170 - RNA, 19 nt, Homo sapiens
gagaguauccuaaauuucu

SEQ ID NO: 702171 - RNA, 19 nt, Homo sapiens
gaagguauacagaagagaa

SEQ ID NO: 702172 - RNA, 19 nt, Homo sapiens
cuacagaaguacuuugaug

SEQ ID NO: 702173 - RNA, 19 nt, Homo sapiens
ggaaacauuuagagacauc

SEQ ID NO: 702174 - RNA, 19 nt, Homo sapiens
gaacagcacaagacugaau

SEQ ID NO: 702175 - RNA, 19 nt, Homo sapiens
uagcaaggcugucaucaca

SEQ ID NO: 702176 - RNA, 19 nt, Homo sapiens
uaacagguacuagaagaua

SEQ ID NO: 702177 - RNA, 19 nt, Homo sapiens
cagaagagaaguagaagaa

SEQ ID NO: 702178 - RNA, 19 nt, Homo sapiens
agaagagacuggauaagga

SEQ ID NO: 702179 - RNA, 19 nt, Homo sapiens
gaguauggcugcagaggau

SEQ ID NO: 702180 - RNA, 19 nt, Homo sapiens
gcaaugacagaacuuaaga

SEQ ID NO: 702181 - RNA, 19 nt, Homo sapiens
gaagagacuggauaaggaa

SEQ ID NO: 702182 - RNA, 19 nt, Homo sapiens
gguacuagaagauauguuu

SEQ ID NO: 702183 - RNA, 19 nt, Homo sapiens
gaucauagacagcaaugga

SEQ ID NO: 702184 - RNA, 19 nt, Homo sapiens
gaugaaugucgauuugaua

SEQ ID NO: 702185 - RNA, 19 nt, Homo sapiens
gcaaagcgagaguauccua

SEQ ID NO: 702186 - RNA, 19 nt, Homo sapiens
gcucugaguuacuacaaau

SEQ ID NO: 702187 - RNA, 19 nt, Homo sapiens
ugacagugcuccucuaaac

SEQ ID NO: 702188 - RNA, 19 nt, Homo sapiens
agacagcaauggauagaug

SEQ ID NO: 702189 - RNA, 19 nt, Homo sapiens
ggcaccagccucaguguua

SEQ ID NO: 702190 - RNA, 19 nt, Homo sapiens
uugcaacacuuucucauug

SEQ ID NO: 702191 - RNA, 19 nt, Homo sapiens
gaaagccuauuuuguucua

SEQ ID NO: 702192 - RNA, 19 nt, Homo sapiens
uugaagagauggugcagaa

SEQ ID NO: 702193 - RNA, 19 nt, Homo sapiens
gugagaaguuggcugaaau

SEQ ID NO: 702194 - RNA, 19 nt, Homo sapiens
gacugaaucuggauaugga

SEQ ID NO: 702195 - RNA, 19 nt, Homo sapiens
gggacaacauucuaugcaa

SEQ ID NO: 702196 - RNA, 19 nt, Homo sapiens
ggcccuaacagucugauua

SEQ ID NO: 702197 - RNA, 19 nt, Homo sapiens
caucacaccucacgauuuu

SEQ ID NO: 702198 - RNA, 19 nt, Homo sapiens
gggaagcgauaacuuuuaa

SEQ ID NO: 702199 - RNA, 19 nt, Homo sapiens
ggccacaguuuacgugaga

SEQ ID NO: 702200 - RNA, 19 nt, Homo sapiens
ggaaacaacuauagaaaac

SEQ ID NO: 702201 - RNA, 19 nt, Homo sapiens
ugaagcugcucuugacaga

SEQ ID NO: 702202 - RNA, 19 nt, Homo sapiens
ucaagaaaggccacaguuu

SEQ ID NO: 702203 - RNA, 19 nt, Homo sapiens
auaaugcucugaguuacua

SEQ ID NO: 702204 - RNA, 19 nt, Homo sapiens
gugcugaugcugucucuaa

SEQ ID NO: 702205 - RNA, 19 nt, Homo sapiens
ggauagaugccauugaaca

SEQ ID NO: 702206 - RNA, 19 nt, Homo sapiens
ucagcgagacguauuauau

SEQ ID NO: 702207 - RNA, 19 nt, Homo sapiens
gaaggagaaaugaagguau

SEQ ID NO: 702208 - RNA, 19 nt, Homo sapiens
aaaguuauuuccacaugug

SEQ ID NO: 702209 - RNA, 19 nt, Homo sapiens
uagaagaugaugaagauga

SEQ ID NO: 702210 - RNA, 19 nt, Homo sapiens
ggauaaagugguagaagau

SEQ ID NO: 702211 - RNA, 19 nt, Homo sapiens
ggauccaucugucuuagca

SEQ ID NO: 702212 - RNA, 19 nt, Homo sapiens
gagauuacauuggccuaca

SEQ ID NO: 702213 - RNA, 19 nt, Homo sapiens
guucuuugaugcuguugaa

SEQ ID NO: 702214 - RNA, 19 nt, Homo sapiens
caggaucguuggguaguuu

SEQ ID NO: 702215 - RNA, 19 nt, Homo sapiens
gaaaaggugagauuacauu

SEQ ID NO: 702216 - RNA, 19 nt, Homo sapiens
auaaagugguagaagauga

SEQ ID NO: 702217 - RNA, 19 nt, Homo sapiens
auaccagccuugacugaaa

SEQ ID NO: 702218 - RNA, 19 nt, Homo sapiens
uggaaacauuagcugauaa

SEQ ID NO: 702219 - RNA, 19 nt, Homo sapiens
guaccaacggcaauaaaga

SEQ ID NO: 702220 - RNA, 19 nt, Homo sapiens
cgaaagauaccagccuuga

SEQ ID NO: 702221 - RNA, 19 nt, Homo sapiens
gcccuaacagucugauuaa

SEQ ID NO: 702222 - RNA, 19 nt, Homo sapiens
guauuaacagguacuagaa

SEQ ID NO: 702223 - RNA, 19 nt, Homo sapiens
aaaugaagguauacagaag

SEQ ID NO: 702224 - RNA, 19 nt, Homo sapiens
ggcaguugguuguagaaga

SEQ ID NO: 702225 - RNA, 19 nt, Homo sapiens
ugcagaaccacaugacuua

SEQ ID NO: 702226 - RNA, 19 nt, Homo sapiens
ggaauccuugcaacacuuu

SEQ ID NO: 702227 - RNA, 19 nt, Homo sapiens
cgugagaaguuggcugaaa

SEQ ID NO: 702228 - RNA, 19 nt, Homo sapiens
ucaguaaguggacaaacua

SEQ ID NO: 702229 - RNA, 19 nt, Homo sapiens
gcaggaucguuggguaguu

SEQ ID NO: 702230 - RNA, 19 nt, Homo sapiens
gaaaaugacccugaaacuu

SEQ ID NO: 702231 - RNA, 19 nt, Homo sapiens
uugacacgcuacagaagua

SEQ ID NO: 702232 - RNA, 19 nt, Homo sapiens
caaguugacacgcuacaga

SEQ ID NO: 702233 - RNA, 19 nt, Homo sapiens
guagaagaaggagaaauga

SEQ ID NO: 702234 - RNA, 19 nt, Homo sapiens
ccuaacagucugauuaaug

SEQ ID NO: 702235 - RNA, 19 nt, Homo sapiens
ugaagaaggcccuaacagu

SEQ ID NO: 702236 - RNA, 19 nt, Homo sapiens
auaaggaaacugagaagaa

SEQ ID NO: 702237 - RNA, 19 nt, Homo sapiens
ggaccaagguggcauccua

SEQ ID NO: 702238 - RNA, 19 nt, Homo sapiens
gggauacuguuaaucauaa

SEQ ID NO: 702239 - RNA, 19 nt, Homo sapiens
gaaaugggcaaaugucuug

SEQ ID NO: 702240 - RNA, 19 nt, Homo sapiens
ggacuaggacucccauaaa

SEQ ID NO: 702241 - RNA, 19 nt, Homo sapiens
gacuaggacucccauaaau

SEQ ID NO: 702242 - RNA, 19 nt, Homo sapiens
gauacgggcuccugguugu

SEQ ID NO: 702243 - RNA, 19 nt, Homo sapiens
ggaagaggagccuggacua

SEQ ID NO: 702244 - RNA, 19 nt, Homo sapiens
gcugugaaaugggcaaaug

SEQ ID NO: 702245 - RNA, 19 nt, Homo sapiens
ccagguuacuugcuucuag

SEQ ID NO: 702246 - RNA, 19 nt, Homo sapiens
agaggagccuggacuagga

SEQ ID NO: 702247 - RNA, 19 nt, Homo sapiens
cuaggacucccauaaauca

SEQ ID NO: 702248 - RNA, 19 nt, Homo sapiens
gaagaggagccuggacuag

SEQ ID NO: 702249 - RNA, 19 nt, Homo sapiens
gguaaguccagccaccuaa

SEQ ID NO: 702250 - RNA, 19 nt, Homo sapiens
gaguucagcuccguaaggu

SEQ ID NO: 702251 - RNA, 19 nt, Homo sapiens
ccauuggccuggaggacuu

SEQ ID NO: 702252 - RNA, 19 nt, Homo sapiens
gaaaggccuucugcauggu

SEQ ID NO: 702253 - RNA, 19 nt, Homo sapiens
gcucaccucccuccuguuc

SEQ ID NO: 702254 - RNA, 19 nt, Homo sapiens
ggccagcucgcacuucuug

SEQ ID NO: 702255 - RNA, 19 nt, Homo sapiens
gcggaaaggccuucugcau

SEQ ID NO: 702256 - RNA, 19 nt, Homo sapiens
ugaaaugggcaaaugucuu

SEQ ID NO: 702257 - RNA, 19 nt, Homo sapiens
uggacuaggacucccauaa

SEQ ID NO: 702258 - RNA, 19 nt, Homo sapiens
cagcucgcacuucuuggua

SEQ ID NO: 702259 - RNA, 19 nt, Homo sapiens
gcucgcacuucuugguaag

SEQ ID NO: 702260 - RNA, 19 nt, Homo sapiens
cacagguuauggccacaug

SEQ ID NO: 702261 - RNA, 19 nt, Homo sapiens
ggggauacuguuaaucaua

SEQ ID NO: 702262 - RNA, 19 nt, Homo sapiens
ggaccaagguggcauccua

SEQ ID NO: 702263 - RNA, 19 nt, Homo sapiens
gggauacuguuaaucauaa

SEQ ID NO: 702264 - RNA, 19 nt, Homo sapiens
gaaaugggcaaaugucuug

SEQ ID NO: 702265 - RNA, 19 nt, Homo sapiens
gauacgggcuccugguugu

SEQ ID NO: 702266 - RNA, 19 nt, Homo sapiens
gcugugaaaugggcaaaug

SEQ ID NO: 702267 - RNA, 19 nt, Homo sapiens
gaguucagcuccguaaggu

SEQ ID NO: 702268 - RNA, 19 nt, Homo sapiens
ccauuggccuggaggacuu

SEQ ID NO: 702269 - RNA, 19 nt, Homo sapiens
gaaaggccuucugcauggu

SEQ ID NO: 702270 - RNA, 19 nt, Homo sapiens
gcucaccucccuccuguuc

SEQ ID NO: 702271 - RNA, 19 nt, Homo sapiens
ggccagcucgcacuucuug

SEQ ID NO: 702272 - RNA, 19 nt, Homo sapiens
gcggaaaggccuucugcau

SEQ ID NO: 702273 - RNA, 19 nt, Homo sapiens
ugaaaugggcaaaugucuu

SEQ ID NO: 702274 - RNA, 19 nt, Homo sapiens
gcucgcacuucuugguuac

SEQ ID NO: 702275 - RNA, 19 nt, Homo sapiens
cacagguuauggccacaug

SEQ ID NO: 702276 - RNA, 19 nt, Homo sapiens
ggggauacuguuaaucaua

SEQ ID NO: 702277 - RNA, 19 nt, Homo sapiens
ggaccaagguggcauccua

SEQ ID NO: 702278 - RNA, 19 nt, Homo sapiens
gggauacuguuaaucauaa

SEQ ID NO: 702279 - RNA, 19 nt, Homo sapiens
gaaaugggcaaaugucuug

SEQ ID NO: 702280 - RNA, 19 nt, Homo sapiens
gauacgggcuccugguugu

SEQ ID NO: 702281 - RNA, 19 nt, Homo sapiens
gcugugaaaugggcaaaug

SEQ ID NO: 702282 - RNA, 19 nt, Homo sapiens
gaguucagcuccguaaggu

SEQ ID NO: 702283 - RNA, 19 nt, Homo sapiens
ccauuggccuggaggacuu

SEQ ID NO: 702284 - RNA, 19 nt, Homo sapiens
gaaaggccuucugcauggu

SEQ ID NO: 702285 - RNA, 19 nt, Homo sapiens
gcucaccucccuccuguuc

SEQ ID NO: 702286 - RNA, 19 nt, Homo sapiens
ggccagcucgcacuucuug

SEQ ID NO: 702287 - RNA, 19 nt, Homo sapiens
gcggaaaggccuucugcau

SEQ ID NO: 702288 - RNA, 19 nt, Homo sapiens
ugaaaugggcaaaugucuu

SEQ ID NO: 702289 - RNA, 19 nt, Homo sapiens
cacagguuauggccacaug

SEQ ID NO: 702290 - RNA, 19 nt, Homo sapiens
ggggauacuguuaaucaua

SEQ ID NO: 702291 - RNA, 19 nt, Homo sapiens
ggaccaagguggcauccua

SEQ ID NO: 702292 - RNA, 19 nt, Homo sapiens
gggauacuguuaaucauaa

SEQ ID NO: 702293 - RNA, 19 nt, Homo sapiens
gaaaugggcaaaugucuug

SEQ ID NO: 702294 - RNA, 19 nt, Homo sapiens
gauacgggcuccugguugu

SEQ ID NO: 702295 - RNA, 19 nt, Homo sapiens
gcugugaaaugggcaaaug

SEQ ID NO: 702296 - RNA, 19 nt, Homo sapiens
ccagguuacuugcuucuag

SEQ ID NO: 702297 - RNA, 19 nt, Homo sapiens
gaguucagcuccguaaggu

SEQ ID NO: 702298 - RNA, 19 nt, Homo sapiens
ccauuggccuggaggacuu

SEQ ID NO: 702299 - RNA, 19 nt, Homo sapiens
gaaaggccuucugcauggu

SEQ ID NO: 702300 - RNA, 19 nt, Homo sapiens
gcucaccucccuccuguuc

SEQ ID NO: 702301 - RNA, 19 nt, Homo sapiens
ggccagcucgcacuucuug

SEQ ID NO: 702302 - RNA, 19 nt, Homo sapiens
gcggaaaggccuucugcau

SEQ ID NO: 702303 - RNA, 19 nt, Homo sapiens
ugaaaugggcaaaugucuu

SEQ ID NO: 702304 - RNA, 19 nt, Homo sapiens
cacagguuauggccacaug

SEQ ID NO: 702305 - RNA, 19 nt, Homo sapiens
ggggauacuguuaaucaua

SEQ ID NO: 702306 - RNA, 19 nt, Homo sapiens
ggaccaagguggcauccua

SEQ ID NO: 702307 - RNA, 19 nt, Homo sapiens
gggauacuguuaaucauaa

SEQ ID NO: 702308 - RNA, 19 nt, Homo sapiens
gaaaugggcaaaugucuug

SEQ ID NO: 702309 - RNA, 19 nt, Homo sapiens
ggacuaggacucccauaaa

SEQ ID NO: 702310 - RNA, 19 nt, Homo sapiens
gacuaggacucccauaaau

SEQ ID NO: 702311 - RNA, 19 nt, Homo sapiens
gauacgggcuccugguugu

SEQ ID NO: 702312 - RNA, 19 nt, Homo sapiens
ggaagaggagccuggacua

SEQ ID NO: 702313 - RNA, 19 nt, Homo sapiens
gcugugaaaugggcaaaug

SEQ ID NO: 702314 - RNA, 19 nt, Homo sapiens
agaggagccuggacuagga

SEQ ID NO: 702315 - RNA, 19 nt, Homo sapiens
cuaggacucccauaaauca

SEQ ID NO: 702316 - RNA, 19 nt, Homo sapiens
gaagaggagccuggacuag

SEQ ID NO: 702317 - RNA, 19 nt, Homo sapiens
gguaaguccagccaccuaa

SEQ ID NO: 702318 - RNA, 19 nt, Homo sapiens
gaguucagcuccguaaggu

SEQ ID NO: 702319 - RNA, 19 nt, Homo sapiens
ccauuggccuggaggacuu

SEQ ID NO: 702320 - RNA, 19 nt, Homo sapiens
gaaaggccuucugcauggu

SEQ ID NO: 702321 - RNA, 19 nt, Homo sapiens
gcucaccucccuccuguuc

SEQ ID NO: 702322 - RNA, 19 nt, Homo sapiens
ggccagcucgcacuucuug

SEQ ID NO: 702323 - RNA, 19 nt, Homo sapiens
gcggaaaggccuucugcau

SEQ ID NO: 702324 - RNA, 19 nt, Homo sapiens
ugaaaugggcaaaugucuu

SEQ ID NO: 702325 - RNA, 19 nt, Homo sapiens
uggacuaggacucccauaa

SEQ ID NO: 702326 - RNA, 19 nt, Homo sapiens
cagcucgcacuucuuggua

SEQ ID NO: 702327 - RNA, 19 nt, Homo sapiens
gcucgcacuucuugguaag

SEQ ID NO: 702328 - RNA, 19 nt, Homo sapiens
cacagguuauggccacaug

SEQ ID NO: 702329 - RNA, 19 nt, Homo sapiens
ggggauacuguuaaucaua

SEQ ID NO: 702330 - RNA, 19 nt, Homo sapiens
caaagucucucuagaauuu

SEQ ID NO: 702331 - RNA, 19 nt, Homo sapiens
gaacagcuaucaaucauau

SEQ ID NO: 702332 - RNA, 19 nt, Homo sapiens
gaacaacccuauuuauuca

SEQ ID NO: 702333 - RNA, 19 nt, Homo sapiens
gagcaaagcugaacgugaa

SEQ ID NO: 702334 - RNA, 19 nt, Homo sapiens
gaacaaauggaacugauua

SEQ ID NO: 702335 - RNA, 19 nt, Homo sapiens
gaagggaaauguucuuaga

SEQ ID NO: 702336 - RNA, 19 nt, Homo sapiens
caauuuagcucaggcauuu

SEQ ID NO: 702337 - RNA, 19 nt, Homo sapiens
gaccagggcccuaccauua

SEQ ID NO: 702338 - RNA, 19 nt, Homo sapiens
gaaggacacugccacaaau

SEQ ID NO: 702339 - RNA, 19 nt, Homo sapiens
uuacagggccuuaauguua

SEQ ID NO: 702340 - RNA, 19 nt, Homo sapiens
ggaagacgauaaacagcua

SEQ ID NO: 702341 - RNA, 19 nt, Homo sapiens
caacacugcuuuaauggaa

SEQ ID NO: 702342 - RNA, 19 nt, Homo sapiens
gaggagcgcuaccuggaua

SEQ ID NO: 702343 - RNA, 19 nt, Homo sapiens
gcugacagauaucaaagua

SEQ ID NO: 702344 - RNA, 19 nt, Homo sapiens
cauccagacuuguauauuu

SEQ ID NO: 702345 - RNA, 19 nt, Homo sapiens
gguagagucccauuucuua

SEQ ID NO: 702346 - RNA, 19 nt, Homo sapiens
gagaagguaagacagauua

SEQ ID NO: 702347 - RNA, 19 nt, Homo sapiens
gagaagcacggauuuaauu

SEQ ID NO: 702348 - RNA, 19 nt, Homo sapiens
gagaagugaugaagggaaa

SEQ ID NO: 702349 - RNA, 19 nt, Homo sapiens
caucagacauucacaacaa

SEQ ID NO: 702350 - RNA, 19 nt, Homo sapiens
uuagaaaucuguugcuuug

SEQ ID NO: 702351 - RNA, 19 nt, Homo sapiens
gagaacagcuaucaaucau

SEQ ID NO: 702352 - RNA, 19 nt, Homo sapiens
uaaagcaagucauuuggaa

SEQ ID NO: 702353 - RNA, 19 nt, Homo sapiens
guaaguggcugccuccaau

SEQ ID NO: 702354 - RNA, 19 nt, Homo sapiens
ugagaacucuuacuugaga

SEQ ID NO: 702355 - RNA, 19 nt, Homo sapiens
ggaaggacacugccacaaa

SEQ ID NO: 702356 - RNA, 19 nt, Homo sapiens
auaaacagcuagcuaagaa

SEQ ID NO: 702357 - RNA, 19 nt, Homo sapiens
uaagcuaguugaucuuuga

SEQ ID NO: 702358 - RNA, 19 nt, Homo sapiens
ccacaaagucucucuagaa

SEQ ID NO: 702359 - RNA, 19 nt, Homo sapiens
ccuaagguaugucuucuuu

SEQ ID NO: 702360 - RNA, 19 nt, Homo sapiens
gcaguguaauuaucucuga

SEQ ID NO: 702361 - RNA, 19 nt, Homo sapiens
gcagugaucauuauaacuu

SEQ ID NO: 702362 - RNA, 19 nt, Homo sapiens
ccugagaacucuuacuuga

SEQ ID NO: 702363 - RNA, 19 nt, Homo sapiens
ggagacauccagacuugua

SEQ ID NO: 702364 - RNA, 19 nt, Homo sapiens
gaagcaaccuggagaacag

SEQ ID NO: 702365 - RNA, 19 nt, Homo sapiens
gggaguaguuaauaguaaa

SEQ ID NO: 702366 - RNA, 19 nt, Homo sapiens
caagagcaguguaauuauc

SEQ ID NO: 702367 - RNA, 19 nt, Homo sapiens
uggcaaacaugacaacauu

SEQ ID NO: 702368 - RNA, 19 nt, Homo sapiens
gaugauaaguuuacacacu

SEQ ID NO: 702369 - RNA, 19 nt, Homo sapiens
ggagaacagcuaucaauca

SEQ ID NO: 702370 - RNA, 19 nt, Homo sapiens
cgaacaacccuauuuauuc

SEQ ID NO: 702371 - RNA, 19 nt, Homo sapiens
ucaagguacuucaguuuau

SEQ ID NO: 702372 - RNA, 19 nt, Homo sapiens
ggacuguagccaagauaua

SEQ ID NO: 702373 - RNA, 19 nt, Homo sapiens
gagauacgaguacgaguuu

SEQ ID NO: 702374 - RNA, 19 nt, Homo sapiens
caagguacuucaguuuauu

SEQ ID NO: 702375 - RNA, 19 nt, Homo sapiens
gcacagaguccagcacuug

SEQ ID NO: 702376 - RNA, 19 nt, Homo sapiens
gcacugaagcuacuuuauc

SEQ ID NO: 702377 - RNA, 19 nt, Homo sapiens
cacaaagucucucuagaau

SEQ ID NO: 702378 - RNA, 19 nt, Homo sapiens
uggaagagcuacccgagaa

SEQ ID NO: 702379 - RNA, 19 nt, Homo sapiens
ggaagaauguagacaagac

SEQ ID NO: 702380 - RNA, 19 nt, Homo sapiens
caggguaucuccucuggaa

SEQ ID NO: 702381 - RNA, 19 nt, Homo sapiens
uaggagacauccagacuug

SEQ ID NO: 702382 - RNA, 19 nt, Homo sapiens
gaggugaugugacuguguu

SEQ ID NO: 702383 - RNA, 19 nt, Homo sapiens
caugagauguguguuaaga

SEQ ID NO: 702384 - RNA, 19 nt, Homo sapiens
ugaagcuacuuuaucauga

SEQ ID NO: 702385 - RNA, 19 nt, Homo sapiens
gacucugucucaauuaauu

SEQ ID NO: 702386 - RNA, 19 nt, Homo sapiens
gaacgugaaugaaaacuuc

SEQ ID NO: 702387 - RNA, 19 nt, Homo sapiens
ggauaucaaugaguguauu

SEQ ID NO: 702388 - RNA, 19 nt, Homo sapiens
ucaggaaggaguuaauuaa

SEQ ID NO: 702389 - RNA, 19 nt, Homo sapiens
gaugguguguaaucuauca

SEQ ID NO: 702390 - RNA, 19 nt, Homo sapiens
gaagcacggauuuaauuug

SEQ ID NO: 702391 - RNA, 19 nt, Homo sapiens
gaucuuugacugucuuauu

SEQ ID NO: 702392 - RNA, 19 nt, Homo sapiens
caagaacugcugccuggua

SEQ ID NO: 702393 - RNA, 19 nt, Homo sapiens
gaaaucuguugcuuugagu

SEQ ID NO: 702394 - RNA, 19 nt, Homo sapiens
uauaagaggugaugugacu

SEQ ID NO: 702395 - RNA, 19 nt, Homo sapiens
uaucaugagauguguguua

SEQ ID NO: 702396 - RNA, 19 nt, Homo sapiens
guaaauaagacucugacuu

SEQ ID NO: 702397 - RNA, 19 nt, Homo sapiens
gcuggaagauauuuauaag

SEQ ID NO: 702398 - RNA, 19 nt, Homo sapiens
caagccaggugguguacaa

SEQ ID NO: 702399 - RNA, 19 nt, Homo sapiens
uauaaguacugccgaacaa

SEQ ID NO: 702400 - RNA, 19 nt, Homo sapiens
gaagcuacuuuaucaugag

SEQ ID NO: 702401 - RNA, 19 nt, Homo sapiens
gcagguagagucccauuuc

SEQ ID NO: 702402 - RNA, 19 nt, Homo sapiens
uaagacagauuaggacauc

SEQ ID NO: 702403 - RNA, 19 nt, Homo sapiens
ugacguugauggaaauuca

SEQ ID NO: 702404 - RNA, 19 nt, Homo sapiens
ugacagauaucaaaguacu

SEQ ID NO: 702405 - RNA, 19 nt, Homo sapiens
aaaaguggcuggaagauau

SEQ ID NO: 702406 - RNA, 19 nt, Homo sapiens
ggagaagcacggauuuaau

SEQ ID NO: 702407 - RNA, 19 nt, Homo sapiens
guucuuagaggaggaaaua

SEQ ID NO: 702408 - RNA, 19 nt, Homo sapiens
cacugaagcuacuuuauca

SEQ ID NO: 702409 - RNA, 19 nt, Homo sapiens
uuacacaagcuacacauuu

SEQ ID NO: 702410 - RNA, 19 nt, Homo sapiens
gauaaacagcuagcuaaga

SEQ ID NO: 702411 - RNA, 19 nt, Homo sapiens
gcuuugaguucugaaauau

SEQ ID NO: 702412 - RNA, 19 nt, Homo sapiens
ucccaacacugcuuuaaug

SEQ ID NO: 702413 - RNA, 19 nt, Homo sapiens
gacauuccauuucaaagca

SEQ ID NO: 702414 - RNA, 19 nt, Homo sapiens
ucaagggcgugcucaguau

SEQ ID NO: 702415 - RNA, 19 nt, Homo sapiens
ccgaacaacccuauuuauu

SEQ ID NO: 702416 - RNA, 19 nt, Homo sapiens
aaaagaugcugacggauuu

SEQ ID NO: 702417 - RNA, 19 nt, Homo sapiens
gagcacugaagcuacuuua

SEQ ID NO: 702418 - RNA, 19 nt, Homo sapiens
ggaaagggcauggcugugu

SEQ ID NO: 702419 - RNA, 19 nt, Homo sapiens
ugaaugggcccuugagaga

SEQ ID NO: 702420 - RNA, 19 nt, Homo sapiens
gaccauggaccaccuccua

SEQ ID NO: 702421 - RNA, 19 nt, Homo sapiens
gccaagauauaaagcaagu

SEQ ID NO: 702422 - RNA, 19 nt, Homo sapiens
ccauugagacauuccauuu

SEQ ID NO: 702423 - RNA, 19 nt, Homo sapiens
accaagagcaguguaauua

SEQ ID NO: 702424 - RNA, 19 nt, Homo sapiens
uaagagaagguaagacaga

SEQ ID NO: 702425 - RNA, 19 nt, Homo sapiens
gcugacggauuuacuuaca

SEQ ID NO: 702426 - RNA, 19 nt, Homo sapiens
gacuguagccaagauauaa

SEQ ID NO: 702427 - RNA, 19 nt, Homo sapiens
gauuuaauuuggucacauc

SEQ ID NO: 702428 - RNA, 19 nt, Homo sapiens
ugagauguguguuaagaag

SEQ ID NO: 702429 - RNA, 19 nt, Homo sapiens
uuaauuuggucacaucaga

SEQ ID NO: 702430 - RNA, 19 nt, Homo sapiens
gaauaccacugcuaaguua

SEQ ID NO: 702431 - RNA, 19 nt, Homo sapiens
gaagugagcuugugcuuag

SEQ ID NO: 702432 - RNA, 19 nt, Homo sapiens
gaccauauuucccuuauuu

SEQ ID NO: 702433 - RNA, 19 nt, Homo sapiens
guaaaugucuucaguguuc

SEQ ID NO: 702434 - RNA, 19 nt, Homo sapiens
gcaaacuggugcagaaauu

SEQ ID NO: 702435 - RNA, 19 nt, Homo sapiens
guucagauccaaacaaaua

SEQ ID NO: 702436 - RNA, 19 nt, Homo sapiens
ugaaggugcucaucucuuu

SEQ ID NO: 702437 - RNA, 19 nt, Homo sapiens
ggaguaggguccauuguuc

SEQ ID NO: 702438 - RNA, 19 nt, Homo sapiens
ggacaagaaugguguggau

SEQ ID NO: 702439 - RNA, 19 nt, Homo sapiens
ggauugggaugucgaagaa

SEQ ID NO: 702440 - RNA, 19 nt, Homo sapiens
cauaucaguuguccuuuaa

SEQ ID NO: 702441 - RNA, 19 nt, Homo sapiens
gagcuugugcuuaguauuu

SEQ ID NO: 702442 - RNA, 19 nt, Homo sapiens
uauaauagcugccuuagac

SEQ ID NO: 702443 - RNA, 19 nt, Homo sapiens
ggacaaaccaaaucaguuc

SEQ ID NO: 702444 - RNA, 19 nt, Homo sapiens
uguaaucacugacuuaugu

SEQ ID NO: 702445 - RNA, 19 nt, Homo sapiens
ccacuaauauggcucuguu

SEQ ID NO: 702446 - RNA, 19 nt, Homo sapiens
gcucauugcuagucaggaa

SEQ ID NO: 702447 - RNA, 19 nt, Homo sapiens
acauaucaguuguccuuua

SEQ ID NO: 702448 - RNA, 19 nt, Homo sapiens
gggaauugcugguacaaag

SEQ ID NO: 702449 - RNA, 19 nt, Homo sapiens
ggaagugagcuugugcuua

SEQ ID NO: 702450 - RNA, 19 nt, Homo sapiens
gagauuuggucagaauuug

SEQ ID NO: 702451 - RNA, 19 nt, Homo sapiens
ggacguggaugaauaugac

SEQ ID NO: 702452 - RNA, 19 nt, Homo sapiens
ccuuagacauuaugaggua

SEQ ID NO: 702453 - RNA, 19 nt, Homo sapiens
ggcaugaacaucaaacuuu

SEQ ID NO: 702454 - RNA, 19 nt, Homo sapiens
ucagugauguuuauaccaa

SEQ ID NO: 702455 - RNA, 19 nt, Homo sapiens
gaaacugccacacagcaaa

SEQ ID NO: 702456 - RNA, 19 nt, Homo sapiens
uaauauggcucuguuugga

SEQ ID NO: 702457 - RNA, 19 nt, Homo sapiens
caaaccaccugaccaagag

SEQ ID NO: 702458 - RNA, 19 nt, Homo sapiens
gcgcgaaccugaggaggaa

SEQ ID NO: 702459 - RNA, 19 nt, Homo sapiens
ugagagauuuggucagaau

SEQ ID NO: 702460 - RNA, 19 nt, Homo sapiens
ggaccauauuucccuuauu

SEQ ID NO: 702461 - RNA, 19 nt, Homo sapiens
uagaaguguuucauccuuu

SEQ ID NO: 702462 - RNA, 19 nt, Homo sapiens
uuacugcaauggcaugaaa

SEQ ID NO: 702463 - RNA, 19 nt, Homo sapiens
gagagcccgucugacaaua

SEQ ID NO: 702464 - RNA, 19 nt, Homo sapiens
ccaaacaaauacacauucu

SEQ ID NO: 702465 - RNA, 19 nt, Homo sapiens
gagagacuggcagcuauua

SEQ ID NO: 702466 - RNA, 19 nt, Homo sapiens
uaucaguuguccuuuaaug

SEQ ID NO: 702467 - RNA, 19 nt, Homo sapiens
aaacaaaccaccugaccaa

SEQ ID NO: 702468 - RNA, 19 nt, Homo sapiens
ccauuucagugauguuuau

SEQ ID NO: 702469 - RNA, 19 nt, Homo sapiens
ggaugaauaugacgagaac

SEQ ID NO: 702470 - RNA, 19 nt, Homo sapiens
gcaugaacaucaaacuuuu

SEQ ID NO: 702471 - RNA, 19 nt, Homo sapiens
guguggaucuccuaaugaa

SEQ ID NO: 702472 - RNA, 19 nt, Homo sapiens
ggaagagggaagugaauca

SEQ ID NO: 702473 - RNA, 19 nt, Homo sapiens
uaucuguacuguggguuua

SEQ ID NO: 702474 - RNA, 19 nt, Homo sapiens
aauaaguggugggugaaua

SEQ ID NO: 702475 - RNA, 19 nt, Homo sapiens
ggcaggaaguggauuaucu

SEQ ID NO: 702476 - RNA, 19 nt, Homo sapiens
guucgugucuugacugcaa

SEQ ID NO: 702477 - RNA, 19 nt, Homo sapiens
caaaccaaaucaguucuca

SEQ ID NO: 702478 - RNA, 19 nt, Homo sapiens
ggaauugcugguacaaaga

SEQ ID NO: 702479 - RNA, 19 nt, Homo sapiens
gaagguggacguggaugaa

SEQ ID NO: 702480 - RNA, 19 nt, Homo sapiens
aaugaccggugcuuauaaa

SEQ ID NO: 702481 - RNA, 19 nt, Homo sapiens
ccaguuuccuagcucauug

SEQ ID NO: 702482 - RNA, 19 nt, Homo sapiens
caguuguccuuuaaugaaa

SEQ ID NO: 702483 - RNA, 19 nt, Homo sapiens
caugacagcugcccuacag

SEQ ID NO: 702484 - RNA, 19 nt, Homo sapiens
gacauuaugagguauacaa

SEQ ID NO: 702485 - RNA, 19 nt, Homo sapiens
ugaauaccacugcuaaguu

SEQ ID NO: 702486 - RNA, 19 nt, Homo sapiens
ucaguuguccuuuaaugaa

SEQ ID NO: 702487 - RNA, 19 nt, Homo sapiens
gaucuccuaaugaaguaua

SEQ ID NO: 702488 - RNA, 19 nt, Homo sapiens
ggaagguggacguggauga

SEQ ID NO: 702489 - RNA, 19 nt, Homo sapiens
uucaaucucuggacaagaa

SEQ ID NO: 702490 - RNA, 19 nt, Homo sapiens
auagcugccuuagacauua

SEQ ID NO: 702491 - RNA, 19 nt, Homo sapiens
uuacauaucaguuguccuu

SEQ ID NO: 702492 - RNA, 19 nt, Homo sapiens
gugcuuaguauuuacauug

SEQ ID NO: 702493 - RNA, 19 nt, Homo sapiens
aaccaaaucaguucucaaa

SEQ ID NO: 702494 - RNA, 19 nt, Homo sapiens
ggcagccucugaaugaaau

SEQ ID NO: 702495 - RNA, 19 nt, Homo sapiens
gauuugagagcccgucuga

SEQ ID NO: 702496 - RNA, 19 nt, Homo sapiens
gaauaugacgagaacaagu

SEQ ID NO: 702497 - RNA, 19 nt, Homo sapiens
aaacugcaaaucagaaaga

SEQ ID NO: 702498 - RNA, 19 nt, Homo sapiens
gaagucuugcuuuauacaa

SEQ ID NO: 702499 - RNA, 19 nt, Homo sapiens
acuggcagcuauuaacauu

SEQ ID NO: 702500 - RNA, 19 nt, Homo sapiens
gcaggcagcauugucuuga

SEQ ID NO: 702501 - RNA, 19 nt, Homo sapiens
ccguaaaugucuucagugu

SEQ ID NO: 702502 - RNA, 19 nt, Homo sapiens
ggagugggaauugcuggua

SEQ ID NO: 702503 - RNA, 19 nt, Homo sapiens
ucgaguagcucuaaaacaa

SEQ ID NO: 702504 - RNA, 19 nt, Homo sapiens
gggcagccucugaaugaaa

SEQ ID NO: 702505 - RNA, 19 nt, Homo sapiens
gcaaaacuggaccauauuu

SEQ ID NO: 702506 - RNA, 19 nt, Homo sapiens
ucucagcuuugccuucuug

SEQ ID NO: 702507 - RNA, 19 nt, Homo sapiens
ggaggaguaggguccauug

SEQ ID NO: 702508 - RNA, 19 nt, Homo sapiens
uugcuugccuccugauuau

SEQ ID NO: 702509 - RNA, 19 nt, Homo sapiens
ugguucagauccaaacaaa

SEQ ID NO: 702510 - RNA, 19 nt, Homo sapiens
guccauuguucgugucuug

SEQ ID NO: 702511 - RNA, 19 nt, Homo sapiens
uuacauuggaugccaguuu

SEQ ID NO: 702512 - RNA, 19 nt, Homo sapiens
acaaaccaccugaccaaga

SEQ ID NO: 702513 - RNA, 19 nt, Homo sapiens
cugcaaaucagaaagaaug

SEQ ID NO: 702514 - RNA, 19 nt, Homo sapiens
gggcaugaacaucaaacuu

SEQ ID NO: 702515 - RNA, 19 nt, Homo sapiens
aaucauggccccucaauuu

SEQ ID NO: 702516 - RNA, 19 nt, Homo sapiens
gggugaauaccacugcuaa

SEQ ID NO: 702517 - RNA, 19 nt, Homo sapiens
agguggacguggaugaaua

SEQ ID NO: 702518 - RNA, 19 nt, Homo sapiens
ggaauaaguggugggugaa

SEQ ID NO: 702519 - RNA, 19 nt, Homo sapiens
auagaaguguuucauccuu

SEQ ID NO: 702520 - RNA, 19 nt, Homo sapiens
guagaggcagcgccaagaa

SEQ ID NO: 702521 - RNA, 19 nt, Homo sapiens
ucacugacuuaugugcaaa

SEQ ID NO: 702522 - RNA, 19 nt, Homo sapiens
agaaguguuucauccuuuc

SEQ ID NO: 702523 - RNA, 19 nt, Homo sapiens
uggaucuccuaaugaagua

SEQ ID NO: 702524 - RNA, 19 nt, Homo sapiens
aaauaucgaguagcucuaa

SEQ ID NO: 702525 - RNA, 19 nt, Homo sapiens
aaaugaccggugcuuauaa

SEQ ID NO: 702526 - RNA, 19 nt, Homo sapiens
auauggcucuguuuggaaa

SEQ ID NO: 702527 - RNA, 19 nt, Homo sapiens
agagauuuggucagaauuu

SEQ ID NO: 702528 - RNA, 19 nt, Homo sapiens
gcaggaaguggauuaucug

SEQ ID NO: 702529 - RNA, 19 nt, Homo sapiens
gggauugggaugucgaaga

SEQ ID NO: 702530 - RNA, 19 nt, Homo sapiens
gcaaagagcuccuguuaca

SEQ ID NO: 702531 - RNA, 19 nt, Homo sapiens
gaaacaggcugaugagauc

SEQ ID NO: 702532 - RNA, 19 nt, Homo sapiens
gaagaguuccuuaagaauu

SEQ ID NO: 702533 - RNA, 19 nt, Homo sapiens
gaacuucuccucccagguu

SEQ ID NO: 702534 - RNA, 19 nt, Homo sapiens
uagcaaagagcuccuguua

SEQ ID NO: 702535 - RNA, 19 nt, Homo sapiens
guaggauacuguaaccuuu

SEQ ID NO: 702536 - RNA, 19 nt, Homo sapiens
gagcagauguacaaacaca

SEQ ID NO: 702537 - RNA, 19 nt, Homo sapiens
gaugagaucgagaagauuu

SEQ ID NO: 702538 - RNA, 19 nt, Homo sapiens
gcugaagaguuccuuaaga

SEQ ID NO: 702539 - RNA, 19 nt, Homo sapiens
gccagaaggcgacuuauuu

SEQ ID NO: 702540 - RNA, 19 nt, Homo sapiens
cugaagaguuccuuaagaa

SEQ ID NO: 702541 - RNA, 19 nt, Homo sapiens
ggagguggguggugugcuu

SEQ ID NO: 702542 - RNA, 19 nt, Homo sapiens
cagagcagauguacaaaca

SEQ ID NO: 702543 - RNA, 19 nt, Homo sapiens
acacagagcagauguacaa

SEQ ID NO: 702544 - RNA, 19 nt, Homo sapiens
gaaguggaagucaggagua

SEQ ID NO: 702545 - RNA, 19 nt, Homo sapiens
caacaagccggaaguggaa

SEQ ID NO: 702546 - RNA, 19 nt, Homo sapiens
gaacuucuuuauccuucga

SEQ ID NO: 702547 - RNA, 19 nt, Homo sapiens
ggagccagaaggcgacuua

SEQ ID NO: 702548 - RNA, 19 nt, Homo sapiens
gagaugaagcugucaguca

SEQ ID NO: 702549 - RNA, 19 nt, Homo sapiens
uggaggagauugacaagga

SEQ ID NO: 702550 - RNA, 19 nt, Homo sapiens
ucccagugauuauacguua

SEQ ID NO: 702551 - RNA, 19 nt, Homo sapiens
cuuaaacucugugcuugua

SEQ ID NO: 702552 - RNA, 19 nt, Homo sapiens
cauuguggcugaagaguuc

SEQ ID NO: 702553 - RNA, 19 nt, Homo sapiens
acucugugcuuguaggaua

SEQ ID NO: 702554 - RNA, 19 nt, Homo sapiens
ggagaucagugagaugaag

SEQ ID NO: 702555 - RNA, 19 nt, Homo sapiens
agaugaagcugucagucaa

SEQ ID NO: 702556 - RNA, 19 nt, Homo sapiens
cugaugagaucgagaagau

SEQ ID NO: 702557 - RNA, 19 nt, Homo sapiens
ccugaguucugccuaaaga

SEQ ID NO: 702558 - RNA, 19 nt, Homo sapiens
aaacuuaaacucugugcuu

SEQ ID NO: 702559 - RNA, 19 nt, Homo sapiens
caggcuggcuucugauguu

SEQ ID NO: 702560 - RNA, 19 nt, Homo sapiens
gaagucaggaguagcaaag

SEQ ID NO: 702561 - RNA, 19 nt, Homo sapiens
gguaugauaucagcuuucu

SEQ ID NO: 702562 - RNA, 19 nt, Homo sapiens
gauccucccuccccuaauu

SEQ ID NO: 702563 - RNA, 19 nt, Homo sapiens
acaaggagaucagugagau

SEQ ID NO: 702564 - RNA, 19 nt, Homo sapiens
ucaccaacuuccacacaga

SEQ ID NO: 702565 - RNA, 19 nt, Homo sapiens
cagcaggaaugagaaggaa

SEQ ID NO: 702566 - RNA, 19 nt, Homo sapiens
ugaaacaggcugaugagau

SEQ ID NO: 702567 - RNA, 19 nt, Homo sapiens
ggugaguccuccagagcuu

SEQ ID NO: 702568 - RNA, 19 nt, Homo sapiens
gcuggccacuuccguacuu

SEQ ID NO: 702569 - RNA, 19 nt, Homo sapiens
gauguacaaacacaaguug

SEQ ID NO: 702570 - RNA, 19 nt, Homo sapiens
gaaggaaaagguucugauu

SEQ ID NO: 702571 - RNA, 19 nt, Homo sapiens
ggaagucaggaguagcaaa

SEQ ID NO: 702572 - RNA, 19 nt, Homo sapiens
ccagugauuauacguuauu

SEQ ID NO: 702573 - RNA, 19 nt, Homo sapiens
gcagauguacaaacacaag

SEQ ID NO: 702574 - RNA, 19 nt, Homo sapiens
aggaaaagguucugauuga

SEQ ID NO: 702575 - RNA, 19 nt, Homo sapiens
cuacccaugucuccacgaa

SEQ ID NO: 702576 - RNA, 19 nt, Homo sapiens
gacaaggagaucagugaga

SEQ ID NO: 702577 - RNA, 19 nt, Homo sapiens
gaucaccaacuuccacaca

SEQ ID NO: 702578 - RNA, 19 nt, Homo sapiens
gcauuguggcugaagaguu

SEQ ID NO: 702579 - RNA, 19 nt, Homo sapiens
ucugccagcuuccugaguu

SEQ ID NO: 702580 - RNA, 19 nt, Homo sapiens
gagggagggagguuucaga

SEQ ID NO: 702581 - RNA, 19 nt, Homo sapiens
aaagagcuccuguuacaac

SEQ ID NO: 702582 - RNA, 19 nt, Homo sapiens
gaugcgagcagagaacuuc

SEQ ID NO: 702583 - RNA, 19 nt, Homo sapiens
ugaagaguuccuuaagaau

SEQ ID NO: 702584 - RNA, 19 nt, Homo sapiens
ugaguucugccuaaagaug

SEQ ID NO: 702585 - RNA, 19 nt, Homo sapiens
cuuccugaguucugccuaa

SEQ ID NO: 702586 - RNA, 19 nt, Homo sapiens
guauaaguguugggaacuc

SEQ ID NO: 702587 - RNA, 19 nt, Homo sapiens
ggaaugagaaggaaaaggu

SEQ ID NO: 702588 - RNA, 19 nt, Homo sapiens
gugauuauacguuauuggu

SEQ ID NO: 702589 - RNA, 19 nt, Homo sapiens
gcaggaaugagaaggaaaa

SEQ ID NO: 702590 - RNA, 19 nt, Homo sapiens
caaagagcuccuguuacaa

SEQ ID NO: 702591 - RNA, 19 nt, Homo sapiens
ccaccagucaugccuagga

SEQ ID NO: 702592 - RNA, 19 nt, Homo sapiens
ccagaaggcgacuuauuuu

SEQ ID NO: 702593 - RNA, 19 nt, Homo sapiens
cuugaaacuuaaacucugu

SEQ ID NO: 702594 - RNA, 19 nt, Homo sapiens
gaugaagcugucagucaau

SEQ ID NO: 702595 - RNA, 19 nt, Homo sapiens
gcuuucugaucaccaacuu

SEQ ID NO: 702596 - RNA, 19 nt, Homo sapiens
uggcugaagaguuccuuaa

SEQ ID NO: 702597 - RNA, 19 nt, Homo sapiens
aaggagaucagugagauga

SEQ ID NO: 702598 - RNA, 19 nt, Homo sapiens
gugcuuguaggauacugua

SEQ ID NO: 702599 - RNA, 19 nt, Homo sapiens
gagauugacaaggagauca

SEQ ID NO: 702600 - RNA, 19 nt, Homo sapiens
ggacuuugugauccacuuc

SEQ ID NO: 702601 - RNA, 19 nt, Homo sapiens
cacgcuagcugucccuuuu

SEQ ID NO: 702602 - RNA, 19 nt, Homo sapiens
ggaaaagguucugauugag

SEQ ID NO: 702603 - RNA, 19 nt, Homo sapiens
uguaggauacuguaaccuu

SEQ ID NO: 702604 - RNA, 19 nt, Homo sapiens
gauaggaccuugauauaua

SEQ ID NO: 702605 - RNA, 19 nt, Homo sapiens
gcaagagacuggacugaga

SEQ ID NO: 702606 - RNA, 19 nt, Homo sapiens
gaugagagccuauuuacaa

SEQ ID NO: 702607 - RNA, 19 nt, Homo sapiens
ggacugagacuuugugaga

SEQ ID NO: 702608 - RNA, 19 nt, Homo sapiens
auacagauauuguggauga

SEQ ID NO: 702609 - RNA, 19 nt, Homo sapiens
caaacaaacaggaagauga

SEQ ID NO: 702610 - RNA, 19 nt, Homo sapiens
ugccaaaccugcaaacaaa

SEQ ID NO: 702611 - RNA, 19 nt, Homo sapiens
uaacgcaauuuaugccaaa

SEQ ID NO: 702612 - RNA, 19 nt, Homo sapiens
acaggaagaugaagugaug

SEQ ID NO: 702613 - RNA, 19 nt, Homo sapiens
ccagcaagauguacacaau

SEQ ID NO: 702614 - RNA, 19 nt, Homo sapiens
ccgccaagaugccggcuua

SEQ ID NO: 702615 - RNA, 19 nt, Homo sapiens
ccacuuaacgcaauuuaug

SEQ ID NO: 702616 - RNA, 19 nt, Homo sapiens
gagacuggacugagacuuu

SEQ ID NO: 702617 - RNA, 19 nt, Homo sapiens
ggacuugcuuugugaagag

SEQ ID NO: 702618 - RNA, 19 nt, Homo sapiens
aaacaaacaggaagaugaa

SEQ ID NO: 702619 - RNA, 19 nt, Homo sapiens
gcugauaggaccuugauau

SEQ ID NO: 702620 - RNA, 19 nt, Homo sapiens
auaccaaacucaucggaaa

SEQ ID NO: 702621 - RNA, 19 nt, Homo sapiens
ugaagaaacugcaaaagug

SEQ ID NO: 702622 - RNA, 19 nt, Homo sapiens
caaggccaaugucuucuuc

SEQ ID NO: 702623 - RNA, 19 nt, Homo sapiens
caacagcuaaggcaagaga

SEQ ID NO: 702624 - RNA, 19 nt, Homo sapiens
gagccugguuuuccacuua

SEQ ID NO: 702625 - RNA, 19 nt, Homo sapiens
ggugagaaagaaauguaua

SEQ ID NO: 702626 - RNA, 19 nt, Homo sapiens
gccaaugucuucuucaaaa

SEQ ID NO: 702627 - RNA, 19 nt, Homo sapiens
gagaaaagaaaguggguua

SEQ ID NO: 702628 - RNA, 19 nt, Homo sapiens
gcuuaccacucuucucuca

SEQ ID NO: 702629 - RNA, 19 nt, Homo sapiens
gaagagagaagagcauguc

SEQ ID NO: 702630 - RNA, 19 nt, Homo sapiens
uuaccacucuucucucaug

SEQ ID NO: 702631 - RNA, 19 nt, Homo sapiens
gaagugaugagagccuauu

SEQ ID NO: 702632 - RNA, 19 nt, Homo sapiens
gcacuguugccuaucagaa

SEQ ID NO: 702633 - RNA, 19 nt, Homo sapiens
cauggauccugauaccaaa

SEQ ID NO: 702634 - RNA, 19 nt, Homo sapiens
agacuggacugagacuuug

SEQ ID NO: 702635 - RNA, 19 nt, Homo sapiens
acugagacuuugugagaaa

SEQ ID NO: 702636 - RNA, 19 nt, Homo sapiens
gcaaacaaacaggaagaug

SEQ ID NO: 702637 - RNA, 19 nt, Homo sapiens
cugaaugucugaagaaacu

SEQ ID NO: 702638 - RNA, 19 nt, Homo sapiens
ggaccuugauauauauaac

SEQ ID NO: 702639 - RNA, 19 nt, Homo sapiens
cugauaggaccuugauaua

SEQ ID NO: 702640 - RNA, 19 nt, Homo sapiens
caaacaggaagaugaagug

SEQ ID NO: 702641 - RNA, 19 nt, Homo sapiens
aagccaaggugagaaagaa

SEQ ID NO: 702642 - RNA, 19 nt, Homo sapiens
uacaacagcuaaggcaaga

SEQ ID NO: 702643 - RNA, 19 nt, Homo sapiens
gagagccuauuuacaacag

SEQ ID NO: 702644 - RNA, 19 nt, Homo sapiens
aaagaaaguggguuaucaa

SEQ ID NO: 702645 - RNA, 19 nt, Homo sapiens
gaauuugggugggagaaaa

SEQ ID NO: 702646 - RNA, 19 nt, Homo sapiens
gugguggacuugcuuugug

SEQ ID NO: 702647 - RNA, 19 nt, Homo sapiens
gaugccggcuuaccacucu

SEQ ID NO: 702648 - RNA, 19 nt, Homo sapiens
ccacucuucucucauggau

SEQ ID NO: 702649 - RNA, 19 nt, Homo sapiens
ugauaggaccuugauauau

SEQ ID NO: 702650 - RNA, 19 nt, Homo sapiens
gacugagacuuugugagaa

SEQ ID NO: 702651 - RNA, 19 nt, Homo sapiens
cgcugggaaucacuaauuu

SEQ ID NO: 702652 - RNA, 19 nt, Homo sapiens
aaaagaaaguggguuauca

SEQ ID NO: 702653 - RNA, 19 nt, Homo sapiens
agauacagauauuguggau

SEQ ID NO: 702654 - RNA, 19 nt, Homo sapiens
ucauggauccugauaccaa

SEQ ID NO: 702655 - RNA, 19 nt, Homo sapiens
ggaagaugaagugaugaga

SEQ ID NO: 702656 - RNA, 19 nt, Homo sapiens
ggccaaugucuucuucaaa

SEQ ID NO: 702657 - RNA, 19 nt, Homo sapiens
augaagccaucuauuacuu

SEQ ID NO: 702658 - RNA, 19 nt, Homo sapiens
caaacucaucggaaacaug

SEQ ID NO: 702659 - RNA, 19 nt, Homo sapiens
caaaagugcaauuccaaaa

SEQ ID NO: 702660 - RNA, 19 nt, Homo sapiens
gcaaaagugcaauuccaaa

SEQ ID NO: 702661 - RNA, 19 nt, Homo sapiens
uacacaaucuuuugccuuu

SEQ ID NO: 702662 - RNA, 19 nt, Homo sapiens
gugaugagagccuauuuac

SEQ ID NO: 702663 - RNA, 19 nt, Homo sapiens
agugaugagagccuauuua

SEQ ID NO: 702664 - RNA, 19 nt, Homo sapiens
ccaaaccugcaaacaaaca

SEQ ID NO: 702665 - RNA, 19 nt, Homo sapiens
cuucaaggccaaugucuuc

SEQ ID NO: 702666 - RNA, 19 nt, Homo sapiens
aaggugagaaagaaaugua

SEQ ID NO: 702667 - RNA, 19 nt, Homo sapiens
ccaaggugagaaagaaaug

SEQ ID NO: 702668 - RNA, 19 nt, Homo sapiens
gaagcugauaggaccuuga

SEQ ID NO: 702669 - RNA, 19 nt, Homo sapiens
gaaaagaaaguggguuauc

SEQ ID NO: 702670 - RNA, 19 nt, Homo sapiens
ccaagaugccggcuuacca

SEQ ID NO: 702671 - RNA, 19 nt, Homo sapiens
caaaagccaaggugagaaa

SEQ ID NO: 702672 - RNA, 19 nt, Homo sapiens
ccuaucagaagucaauuca

SEQ ID NO: 702673 - RNA, 19 nt, Homo sapiens
ugguggacuugcuuuguga

SEQ ID NO: 702674 - RNA, 19 nt, Homo sapiens
aaacaggaagaugaaguga

SEQ ID NO: 702675 - RNA, 19 nt, Homo sapiens
gccaaggugagaaagaaau

SEQ ID NO: 702676 - RNA, 19 nt, Homo sapiens
cagaagucaauucaaagga

SEQ ID NO: 702677 - RNA, 19 nt, Homo sapiens
acgcugggaaucacuaauu

SEQ ID NO: 702678 - RNA, 19 nt, Homo sapiens
aggccaaugucuucuucaa

SEQ ID NO: 702679 - RNA, 19 nt, Homo sapiens
aaugauaaacccagcaagu

SEQ ID NO: 702680 - RNA, 19 nt, Homo sapiens
ccaaacucaucggaaacau

SEQ ID NO: 702681 - RNA, 19 nt, Homo sapiens
aaauguauacgcugggaau

SEQ ID NO: 702682 - RNA, 19 nt, Homo sapiens
gagacaaaagauacagaua

SEQ ID NO: 702683 - RNA, 19 nt, Homo sapiens
gagaaugacugguggguuu

SEQ ID NO: 702684 - RNA, 19 nt, Homo sapiens
gcacuaugcuggucaugaa

SEQ ID NO: 702685 - RNA, 19 nt, Homo sapiens
gagaguaaccguauuguga

SEQ ID NO: 702686 - RNA, 19 nt, Homo sapiens
ugaaggaccucaagaucaa

SEQ ID NO: 702687 - RNA, 19 nt, Homo sapiens
caaaugaccugugaggaau

SEQ ID NO: 702688 - RNA, 19 nt, Homo sapiens
uagacucgcugcacaagaa

SEQ ID NO: 702689 - RNA, 19 nt, Homo sapiens
ggaauauguugccuucauc

SEQ ID NO: 702690 - RNA, 19 nt, Homo sapiens
aaagagcggugccaaaugg

SEQ ID NO: 702691 - RNA, 19 nt, Homo sapiens
ucaaaugaccugugaggaa

SEQ ID NO: 702692 - RNA, 19 nt, Homo sapiens
ggaggcuaaugguugcuuu

SEQ ID NO: 702693 - RNA, 19 nt, Homo sapiens
guacauggcgucuguuucu

SEQ ID NO: 702694 - RNA, 19 nt, Homo sapiens
aagaucaaaugaccuguga

SEQ ID NO: 702695 - RNA, 19 nt, Homo sapiens
gaacagcgucagccagauc

SEQ ID NO: 702696 - RNA, 19 nt, Homo sapiens
cgugugaucuccaucuguu

SEQ ID NO: 702697 - RNA, 19 nt, Homo sapiens
gaaaagagcggugccaaau

SEQ ID NO: 702698 - RNA, 19 nt, Homo sapiens
ggaccucaagaucaaauga

SEQ ID NO: 702699 - RNA, 19 nt, Homo sapiens
ucgcgacucuggccucuga

SEQ ID NO: 702700 - RNA, 19 nt, Homo sapiens
cagcggcucucgugugauc

SEQ ID NO: 702701 - RNA, 19 nt, Homo sapiens
caacaaccaugaggugcau

SEQ ID NO: 702702 - RNA, 19 nt, Homo sapiens
accaugaggugcauaucua

SEQ ID NO: 702703 - RNA, 19 nt, Homo sapiens
cuucaagugucggaucuuu

SEQ ID NO: 702704 - RNA, 19 nt, Homo sapiens
gcaugaguaucugggaugu

SEQ ID NO: 702705 - RNA, 19 nt, Homo sapiens
ccaauacgaguucccauag

SEQ ID NO: 702706 - RNA, 19 nt, Homo sapiens
ugaucuccaucuguuauuu

SEQ ID NO: 702707 - RNA, 19 nt, Homo sapiens
gccaagugcucgcaguucu

SEQ ID NO: 702708 - RNA, 19 nt, Homo sapiens
augaguaucugggauguga

SEQ ID NO: 702709 - RNA, 19 nt, Homo sapiens
aggaauauguugccuucau

SEQ ID NO: 702710 - RNA, 19 nt, Homo sapiens
gaaggaccucaagaucaaa

SEQ ID NO: 702711 - RNA, 19 nt, Homo sapiens
ucuggccucugaaacacua

SEQ ID NO: 702712 - RNA, 19 nt, Homo sapiens
gaucuccaucuguuauuuc

SEQ ID NO: 702713 - RNA, 19 nt, Homo sapiens
caauacgaguucccauagg

SEQ ID NO: 702714 - RNA, 19 nt, Homo sapiens
caaggaccgcacccagauu

SEQ ID NO: 702715 - RNA, 19 nt, Homo sapiens
ucugggaugugaagagcuu

SEQ ID NO: 702716 - RNA, 19 nt, Homo sapiens
gauggcggcaugaguaucu

SEQ ID NO: 702717 - RNA, 19 nt, Homo sapiens
uggcugaugccgacaagaa

SEQ ID NO: 702718 - RNA, 19 nt, Homo sapiens
ggguacauggcgucuguuu

SEQ ID NO: 702719 - RNA, 19 nt, Homo sapiens
gcugaugccgacaagaaga

SEQ ID NO: 702720 - RNA, 19 nt, Homo sapiens
aaugaccugugaggaauau

SEQ ID NO: 702721 - RNA, 19 nt, Homo sapiens
ugaccuucaucacagacaa

SEQ ID NO: 702722 - RNA, 19 nt, Homo sapiens
gaccugugaggaauauguu

SEQ ID NO: 702723 - RNA, 19 nt, Homo sapiens
gcucucgugugaucuccau

SEQ ID NO: 702724 - RNA, 19 nt, Homo sapiens
aaugguugcuuugcugaau

SEQ ID NO: 702725 - RNA, 19 nt, Homo sapiens
ggcuggacguuccuaagca

SEQ ID NO: 702726 - RNA, 19 nt, Homo sapiens
acaaggaccgcacccagau

SEQ ID NO: 702727 - RNA, 19 nt, Homo sapiens
caaaauguggagguaauaa

SEQ ID NO: 702728 - RNA, 19 nt, Homo sapiens
ggucagggaggcuaauggu

SEQ ID NO: 702729 - RNA, 19 nt, Homo sapiens
aaaugaccugugaggaaua

SEQ ID NO: 702730 - RNA, 19 nt, Homo sapiens
cugcaccacuggcauggau

SEQ ID NO: 702731 - RNA, 19 nt, Homo sapiens
cuggguacauggcgucugu

SEQ ID NO: 702732 - RNA, 19 nt, Homo sapiens
caucaaggagguggaggaa

SEQ ID NO: 702733 - RNA, 19 nt, Homo sapiens
ccaacgagaacaaguuugc

SEQ ID NO: 702734 - RNA, 19 nt, Homo sapiens
ggaauauacugcugaaaua

SEQ ID NO: 702735 - RNA, 19 nt, Homo sapiens
gagcuaguaucuuggauua

SEQ ID NO: 702736 - RNA, 19 nt, Homo sapiens
uaaaggagcgcuauaguua

SEQ ID NO: 702737 - RNA, 19 nt, Homo sapiens
gaagagagcgaaagugauu

SEQ ID NO: 702738 - RNA, 19 nt, Homo sapiens
ggacgucgcuugcaaagag

SEQ ID NO: 702739 - RNA, 19 nt, Homo sapiens
gaccuagacuucuucauug

SEQ ID NO: 702740 - RNA, 19 nt, Homo sapiens
gaacaauccuuggaaacug

SEQ ID NO: 702741 - RNA, 19 nt, Homo sapiens
gagcgaaagugauuguguu

SEQ ID NO: 702742 - RNA, 19 nt, Homo sapiens
gcugagagaccgagaagua

SEQ ID NO: 702743 - RNA, 19 nt, Homo sapiens
gugauuggcagcuguauua

SEQ ID NO: 702744 - RNA, 19 nt, Homo sapiens
ggaauugaguggugguaga

SEQ ID NO: 702745 - RNA, 19 nt, Homo sapiens
ucaaugcuaucucaaagaa

SEQ ID NO: 702746 - RNA, 19 nt, Homo sapiens
caagaguguuggaccagua

SEQ ID NO: 702747 - RNA, 19 nt, Homo sapiens
ucucagaaguuguagauga

SEQ ID NO: 702748 - RNA, 19 nt, Homo sapiens
uaucaucccuuccuguauu

SEQ ID NO: 702749 - RNA, 19 nt, Homo sapiens
gauugggacuuaauggaaa

SEQ ID NO: 702750 - RNA, 19 nt, Homo sapiens
ccagaacaauccuuggaaa

SEQ ID NO: 702751 - RNA, 19 nt, Homo sapiens
guuccaggcuuguacauug

SEQ ID NO: 702752 - RNA, 19 nt, Homo sapiens
gaugaaagguguugaugac

SEQ ID NO: 702753 - RNA, 19 nt, Homo sapiens
gaaauaguaacaccaaaca

SEQ ID NO: 702754 - RNA, 19 nt, Homo sapiens
gaaucaaugcuaucucaaa

SEQ ID NO: 702755 - RNA, 19 nt, Homo sapiens
guaaaggagcgcuauaguu

SEQ ID NO: 702756 - RNA, 19 nt, Homo sapiens
gagauggugucacucaugu

SEQ ID NO: 702757 - RNA, 19 nt, Homo sapiens
gaaccuccauugaauacuc

SEQ ID NO: 702758 - RNA, 19 nt, Homo sapiens
ggacuuaauggaaagguuu

SEQ ID NO: 702759 - RNA, 19 nt, Homo sapiens
uaucuuggauuaacugaug

SEQ ID NO: 702760 - RNA, 19 nt, Homo sapiens
gcucuauaaugcuugaauu

SEQ ID NO: 702761 - RNA, 19 nt, Homo sapiens
cgaccgagccugcugcuuu

SEQ ID NO: 702762 - RNA, 19 nt, Homo sapiens
ccaaguaaaggauaaauuc

SEQ ID NO: 702763 - RNA, 19 nt, Homo sapiens
caccaaacaugauuauaca

SEQ ID NO: 702764 - RNA, 19 nt, Homo sapiens
gggaauauacugcugaaau

SEQ ID NO: 702765 - RNA, 19 nt, Homo sapiens
ugacugaaccuccauugaa

SEQ ID NO: 702766 - RNA, 19 nt, Homo sapiens
gacugaaccuccauugaau

SEQ ID NO: 702767 - RNA, 19 nt, Homo sapiens
uuugggaccugaaaucuuu

SEQ ID NO: 702768 - RNA, 19 nt, Homo sapiens
gagcaagugaucuuuaaau

SEQ ID NO: 702769 - RNA, 19 nt, Homo sapiens
ggagucaugucguaaaauu

SEQ ID NO: 702770 - RNA, 19 nt, Homo sapiens
gacguccucucuacaagaa

SEQ ID NO: 702771 - RNA, 19 nt, Homo sapiens
ugaccuagacuucuucauu

SEQ ID NO: 702772 - RNA, 19 nt, Homo sapiens
uagaagagagcgaaaguga

SEQ ID NO: 702773 - RNA, 19 nt, Homo sapiens
aaccugacuugaaauagua

SEQ ID NO: 702774 - RNA, 19 nt, Homo sapiens
aaaccugacuugaaauagu

SEQ ID NO: 702775 - RNA, 19 nt, Homo sapiens
gcagcgauaugcaguuugg

SEQ ID NO: 702776 - RNA, 19 nt, Homo sapiens
uggagcaagugaucuuuaa

SEQ ID NO: 702777 - RNA, 19 nt, Homo sapiens
ugcuagugcuuucugauua

SEQ ID NO: 702778 - RNA, 19 nt, Homo sapiens
cguccucucuacaagaaua

SEQ ID NO: 702779 - RNA, 19 nt, Homo sapiens
gcaacaaaguggccaaucc

SEQ ID NO: 702780 - RNA, 19 nt, Homo sapiens
gcuaguaucuuggauuaac

SEQ ID NO: 702781 - RNA, 19 nt, Homo sapiens
gaagaaauuggaccuagca

SEQ ID NO: 702782 - RNA, 19 nt, Homo sapiens
ccaaguaugccacaccaaa

SEQ ID NO: 702783 - RNA, 19 nt, Homo sapiens
gccaaaaccuauugaugua

SEQ ID NO: 702784 - RNA, 19 nt, Homo sapiens
gaaauacagaaccacaguu

SEQ ID NO: 702785 - RNA, 19 nt, Homo sapiens
gcaguaaaggagcgcuaua

SEQ ID NO: 702786 - RNA, 19 nt, Homo sapiens
gaccgagccugcugcuuuc

SEQ ID NO: 702787 - RNA, 19 nt, Homo sapiens
caaaggagggugaugaaag

SEQ ID NO: 702788 - RNA, 19 nt, Homo sapiens
guaucaccaugcagaugua

SEQ ID NO: 702789 - RNA, 19 nt, Homo sapiens
guaacaccaaacaugauua

SEQ ID NO: 702790 - RNA, 19 nt, Homo sapiens
uuacacaaccuaucucaga

SEQ ID NO: 702791 - RNA, 19 nt, Homo sapiens
aaggagcgcuauaguuaug

SEQ ID NO: 702792 - RNA, 19 nt, Homo sapiens
gcugaaggguaugugauug

SEQ ID NO: 702793 - RNA, 19 nt, Homo sapiens
ggaaauacagaaccacagu

SEQ ID NO: 702794 - RNA, 19 nt, Homo sapiens
gcauucuguuucuugcuuu

SEQ ID NO: 702795 - RNA, 19 nt, Homo sapiens
aaauacagaaccacaguuu

SEQ ID NO: 702796 - RNA, 19 nt, Homo sapiens
uggaaucaaugcuaucuca

SEQ ID NO: 702797 - RNA, 19 nt, Homo sapiens
aggaaucccuccagaacaa

SEQ ID NO: 702798 - RNA, 19 nt, Homo sapiens
gguaauagacaguggagau

SEQ ID NO: 702799 - RNA, 19 nt, Homo sapiens
ggcagaaccugaagaccau

SEQ ID NO: 702800 - RNA, 19 nt, Homo sapiens
aaacuaggauaugcuggaa

SEQ ID NO: 702801 - RNA, 19 nt, Homo sapiens
gcgauaugcaguuugguuu

SEQ ID NO: 702802 - RNA, 19 nt, Homo sapiens
gaaguuguagaugaaguaa

SEQ ID NO: 702803 - RNA, 19 nt, Homo sapiens
auacagaaccacaguuuau

SEQ ID NO: 702804 - RNA, 19 nt, Homo sapiens
cugcugaaauaauguuuga

SEQ ID NO: 702805 - RNA, 19 nt, Homo sapiens
gaaccugaagaccauuauu

SEQ ID NO: 702806 - RNA, 19 nt, Homo sapiens
ggaaagguuuauggagcaa

SEQ ID NO: 702807 - RNA, 19 nt, Homo sapiens
gcucaaaggagggugauga

SEQ ID NO: 702808 - RNA, 19 nt, Homo sapiens
gaauuguccuauugauguc

SEQ ID NO: 702809 - RNA, 19 nt, Homo sapiens
gcagcuguauuaaacacau

SEQ ID NO: 702810 - RNA, 19 nt, Homo sapiens
aguugaagauugggacuua

SEQ ID NO: 702811 - RNA, 19 nt, Homo sapiens
aaaggagggugaugaaagg

SEQ ID NO: 702812 - RNA, 19 nt, Homo sapiens
agaauuguccuauugaugu

SEQ ID NO: 702813 - RNA, 19 nt, Homo sapiens
ggagauggugucacucaug

SEQ ID NO: 702814 - RNA, 19 nt, Homo sapiens
aaagaagaguaaagacaag

SEQ ID NO: 702815 - RNA, 19 nt, Homo sapiens
gauaugcaguuugguuugg

SEQ ID NO: 702816 - RNA, 19 nt, Homo sapiens
cuacauaugcaacaaagug

SEQ ID NO: 702817 - RNA, 19 nt, Homo sapiens
aagauucgaugggauuuau

SEQ ID NO: 702818 - RNA, 19 nt, Homo sapiens
caagauucgaugggauuua

SEQ ID NO: 702819 - RNA, 19 nt, Homo sapiens
gaaguggguuuuaguucuu

SEQ ID NO: 702820 - RNA, 19 nt, Homo sapiens
cuuccuguauugcuauuaa

SEQ ID NO: 702821 - RNA, 19 nt, Homo sapiens
cgauguugguuaugagaga

SEQ ID NO: 702822 - RNA, 19 nt, Homo sapiens
gaagauugggacuuaaugg

SEQ ID NO: 702823 - RNA, 19 nt, Homo sapiens
gccaauccgccaugguaua

SEQ ID NO: 702824 - RNA, 19 nt, Homo sapiens
ggugaugaagcaauagaaa

SEQ ID NO: 702825 - RNA, 19 nt, Homo sapiens
aaucaaugcuaucucaaag

SEQ ID NO: 702826 - RNA, 19 nt, Homo sapiens
auacuggaaucaaugcuau

SEQ ID NO: 702827 - RNA, 19 nt, Homo sapiens
ggagcaagugaucuuuaaa

SEQ ID NO: 702828 - RNA, 19 nt, Homo sapiens
ccaugcagauguagaagag

SEQ ID NO: 702829 - RNA, 19 nt, Homo sapiens
acuaggauaugcuggaaau

SEQ ID NO: 702830 - RNA, 19 nt, Homo sapiens
caagaauauuguccucucu

SEQ ID NO: 702831 - RNA, 19 nt, Homo sapiens
uacacaaccuaucucagaa

SEQ ID NO: 702832 - RNA, 19 nt, Homo sapiens
cgagccugcugcuuucuug

SEQ ID NO: 702833 - RNA, 19 nt, Homo sapiens
gccaugguauaguugaaga

SEQ ID NO: 702834 - RNA, 19 nt, Homo sapiens
gaacacaucuucccagcuu

SEQ ID NO: 702835 - RNA, 19 nt, Homo sapiens
ggagggauauaacuagaua

SEQ ID NO: 702836 - RNA, 19 nt, Homo sapiens
gaaguuaacuacccuaugg

SEQ ID NO: 702837 - RNA, 19 nt, Homo sapiens
gaaauugcaucacacuaau

SEQ ID NO: 702838 - RNA, 19 nt, Homo sapiens
gcagaaagcacaugguauu

SEQ ID NO: 702839 - RNA, 19 nt, Homo sapiens
ggacguaucaucaaaguug

SEQ ID NO: 702840 - RNA, 19 nt, Homo sapiens
gcauuaagguaacccauug

SEQ ID NO: 702841 - RNA, 19 nt, Homo sapiens
gguuauaauuggugguuua

SEQ ID NO: 702842 - RNA, 19 nt, Homo sapiens
gcaagugaauuacgaucaa

SEQ ID NO: 702843 - RNA, 19 nt, Homo sapiens
gaucugaauucuacaaaca

SEQ ID NO: 702844 - RNA, 19 nt, Homo sapiens
gaauuacgaucaauguuag

SEQ ID NO: 702845 - RNA, 19 nt, Homo sapiens
gguaacccauugccaagua

SEQ ID NO: 702846 - RNA, 19 nt, Homo sapiens
gaaacgguucgcaugauua

SEQ ID NO: 702847 - RNA, 19 nt, Homo sapiens
gaagaccuauuaucagauc

SEQ ID NO: 702848 - RNA, 19 nt, Homo sapiens
caaguguaguauuccauua

SEQ ID NO: 702849 - RNA, 19 nt, Homo sapiens
gaaauugggaugacaugaa

SEQ ID NO: 702850 - RNA, 19 nt, Homo sapiens
cgacaagaguaccaagaaa

SEQ ID NO: 702851 - RNA, 19 nt, Homo sapiens
caaauaguaccauacauga

SEQ ID NO: 702852 - RNA, 19 nt, Homo sapiens
uagcggauaucaugaaaga

SEQ ID NO: 702853 - RNA, 19 nt, Homo sapiens
ucacagaaccuccuaugaa

SEQ ID NO: 702854 - RNA, 19 nt, Homo sapiens
gcaucacacuaauuacaaa

SEQ ID NO: 702855 - RNA, 19 nt, Homo sapiens
uaaaagagcuuaagaucug

SEQ ID NO: 702856 - RNA, 19 nt, Homo sapiens
gcuuagggauuuauuuguu

SEQ ID NO: 702857 - RNA, 19 nt, Homo sapiens
guacguagaggaacuuuau

SEQ ID NO: 702858 - RNA, 19 nt, Homo sapiens
ucacuuuacugcucuaaug

SEQ ID NO: 702859 - RNA, 19 nt, Homo sapiens
ccagagaaacuuaauauag

SEQ ID NO: 702860 - RNA, 19 nt, Homo sapiens
aaucaaggaucuuaugguu

SEQ ID NO: 702861 - RNA, 19 nt, Homo sapiens
gcagguacuuacaaauaau

SEQ ID NO: 702862 - RNA, 19 nt, Homo sapiens
cuuagaaaccacaguauua

SEQ ID NO: 702863 - RNA, 19 nt, Homo sapiens
gaccagagaaacuuaauau

SEQ ID NO: 702864 - RNA, 19 nt, Homo sapiens
ugaaacaccugugggacua

SEQ ID NO: 702865 - RNA, 19 nt, Homo sapiens
aaauugggaugacaugaaa

SEQ ID NO: 702866 - RNA, 19 nt, Homo sapiens
cauguuagcugggauuaga

SEQ ID NO: 702867 - RNA, 19 nt, Homo sapiens
gauuguagagguaauguuu

SEQ ID NO: 702868 - RNA, 19 nt, Homo sapiens
cgaucaauguuagaaguua

SEQ ID NO: 702869 - RNA, 19 nt, Homo sapiens
uggaagaccuauuaucaga

SEQ ID NO: 702870 - RNA, 19 nt, Homo sapiens
cuacaguccuucaauggaa

SEQ ID NO: 702871 - RNA, 19 nt, Homo sapiens
ugaaacgguucgcaugauu

SEQ ID NO: 702872 - RNA, 19 nt, Homo sapiens
gguauuccuugguaucuga

SEQ ID NO: 702873 - RNA, 19 nt, Homo sapiens
ggcaguagguuauaauugg

SEQ ID NO: 702874 - RNA, 19 nt, Homo sapiens
acaagcagguacuuacaaa

SEQ ID NO: 702875 - RNA, 19 nt, Homo sapiens
gcaccggguuugugaagug

SEQ ID NO: 702876 - RNA, 19 nt, Homo sapiens
gaaaccacaguauuaguug

SEQ ID NO: 702877 - RNA, 19 nt, Homo sapiens
uuuguacgcucaagguuua

SEQ ID NO: 702878 - RNA, 19 nt, Homo sapiens
agaaauugcaucacacuaa

SEQ ID NO: 702879 - RNA, 19 nt, Homo sapiens
aagcagguacuuacaaaua

SEQ ID NO: 702880 - RNA, 19 nt, Homo sapiens
ggauuagacucccuacagu

SEQ ID NO: 702881 - RNA, 19 nt, Homo sapiens
gccaaucuuugaacucauu

SEQ ID NO: 702882 - RNA, 19 nt, Homo sapiens
uaccagaucugaauucuac

SEQ ID NO: 702883 - RNA, 19 nt, Homo sapiens
ccaaauaguaccauacaug

SEQ ID NO: 702884 - RNA, 19 nt, Homo sapiens
ucaacugcuucccuauaua

SEQ ID NO: 702885 - RNA, 19 nt, Homo sapiens
caucauacccguaaugcuu

SEQ ID NO: 702886 - RNA, 19 nt, Homo sapiens
gaguugguguugcugaauu

SEQ ID NO: 702887 - RNA, 19 nt, Homo sapiens
gcagaaacuggccuuagaa

SEQ ID NO: 702888 - RNA, 19 nt, Homo sapiens
ggaccagagaaacuuaaua

SEQ ID NO: 702889 - RNA, 19 nt, Homo sapiens
cguagaggaacuuuauuua

SEQ ID NO: 702890 - RNA, 19 nt, Homo sapiens
ucgauaaacuccaaagcuu

SEQ ID NO: 702891 - RNA, 19 nt, Homo sapiens
agagaagauuguagaggua

SEQ ID NO: 702892 - RNA, 19 nt, Homo sapiens
gcaaguguaguauuccauu

SEQ ID NO: 702893 - RNA, 19 nt, Homo sapiens
caaccacucugcugauuuu

SEQ ID NO: 702894 - RNA, 19 nt, Homo sapiens
cuauguggcuuagggauuu

SEQ ID NO: 702895 - RNA, 19 nt, Homo sapiens
ggaaauguuagguucagaa

SEQ ID NO: 702896 - RNA, 19 nt, Homo sapiens
uaaguaggcauuuagauca

SEQ ID NO: 702897 - RNA, 19 nt, Homo sapiens
gaaagcacaugguauuccu

SEQ ID NO: 702898 - RNA, 19 nt, Homo sapiens
gcucuaacuuuccagaaca

SEQ ID NO: 702899 - RNA, 19 nt, Homo sapiens
ugaugaggcaagugaauua

SEQ ID NO: 702900 - RNA, 19 nt, Homo sapiens
ggaacuuuauuuacaguac

SEQ ID NO: 702901 - RNA, 19 nt, Homo sapiens
gaaacuuggugugacuguu

SEQ ID NO: 702902 - RNA, 19 nt, Homo sapiens
cccaguauaugaaggcuuu

SEQ ID NO: 702903 - RNA, 19 nt, Homo sapiens
guagagguaauguuugaaa

SEQ ID NO: 702904 - RNA, 19 nt, Homo sapiens
gauaaacuccaaagcuugu

SEQ ID NO: 702905 - RNA, 19 nt, Homo sapiens
cagccucacuugaucaaug

SEQ ID NO: 702906 - RNA, 19 nt, Homo sapiens
aaacagagagaagauugua

SEQ ID NO: 702907 - RNA, 19 nt, Homo sapiens
cuggaaaggucaaguuuua

SEQ ID NO: 702908 - RNA, 19 nt, Homo sapiens
guuggaagaccuauuauca

SEQ ID NO: 702909 - RNA, 19 nt, Homo sapiens
uguguuacgugggauauaa

SEQ ID NO: 702910 - RNA, 19 nt, Homo sapiens
aggcaguucugacuuugua

SEQ ID NO: 702911 - RNA, 19 nt, Homo sapiens
gaaaucaaggaucuuaugg

SEQ ID NO: 702912 - RNA, 19 nt, Homo sapiens
gagcuguuuccauaugaua

SEQ ID NO: 702913 - RNA, 19 nt, Homo sapiens
gauucugucugcugcuuug

SEQ ID NO: 702914 - RNA, 19 nt, Homo sapiens
aaagcuuguucccaucaua

SEQ ID NO: 702915 - RNA, 19 nt, Homo sapiens
gaaacuggccuuagaaacc

SEQ ID NO: 702916 - RNA, 19 nt, Homo sapiens
gguagacucuggagauggu

SEQ ID NO: 702917 - RNA, 19 nt, Homo sapiens
uaugaauccugucgguauu

SEQ ID NO: 702918 - RNA, 19 nt, Homo sapiens
uuaauucucagccaucuuu

SEQ ID NO: 702919 - RNA, 19 nt, Homo sapiens
agcagguacuuacaaauaa

SEQ ID NO: 702920 - RNA, 19 nt, Homo sapiens
gcugcuuuguuucuucuaa

SEQ ID NO: 702921 - RNA, 19 nt, Homo sapiens
gagaagauuguagagguaa

SEQ ID NO: 702922 - RNA, 19 nt, Homo sapiens
cgacaacggcaccggguuu

SEQ ID NO: 702923 - RNA, 19 nt, Homo sapiens
gcaguagguuauaauuggu

SEQ ID NO: 702924 - RNA, 19 nt, Homo sapiens
uaggugguaugccuuuauu

SEQ ID NO: 702925 - RNA, 19 nt, Homo sapiens
caacugcuucccuauauag

SEQ ID NO: 702926 - RNA, 19 nt, Homo sapiens
gugcaguucuagcggauau

SEQ ID NO: 702927 - RNA, 19 nt, Homo sapiens
aaacgguucgcaugauuaa

SEQ ID NO: 702928 - RNA, 19 nt, Homo sapiens
guacgaaauugggaugaca

SEQ ID NO: 702929 - RNA, 19 nt, Homo sapiens
gaaaauggcauaguacgaa

SEQ ID NO: 702930 - RNA, 19 nt, Homo sapiens
uuugaaaccuggaaauaca

SEQ ID NO: 702931 - RNA, 19 nt, Homo sapiens
gaggaacuuuauuuacagu

SEQ ID NO: 702932 - RNA, 19 nt, Homo sapiens
caaagugggaaacauugaa

SEQ ID NO: 702933 - RNA, 19 nt, Homo sapiens
uggugugacuguucgauaa

SEQ ID NO: 702934 - RNA, 19 nt, Homo sapiens
ggaauaacauuucuuggaa

SEQ ID NO: 702935 - RNA, 19 nt, Homo sapiens
ucaaagaccagcuguauuu

SEQ ID NO: 702936 - RNA, 19 nt, Homo sapiens
gggaaaugcugcucacuga

SEQ ID NO: 702937 - RNA, 19 nt, Homo sapiens
gaagucaguuguugcauca

SEQ ID NO: 702938 - RNA, 19 nt, Homo sapiens
gaccagcuguauuucuuua

SEQ ID NO: 702939 - RNA, 19 nt, Homo sapiens
gcauggaccuaaucacaga

SEQ ID NO: 702940 - RNA, 19 nt, Homo sapiens
ccagcuguauuucuuuaua

SEQ ID NO: 702941 - RNA, 19 nt, Homo sapiens
gaucaaagaccagcuguau

SEQ ID NO: 702942 - RNA, 19 nt, Homo sapiens
gggcaagugucuucaugaa

SEQ ID NO: 702943 - RNA, 19 nt, Homo sapiens
gaaguugaccagcagauug

SEQ ID NO: 702944 - RNA, 19 nt, Homo sapiens
uggcuucaaugucauauuu

SEQ ID NO: 702945 - RNA, 19 nt, Homo sapiens
cuaaagaucccgcagaaga

SEQ ID NO: 702946 - RNA, 19 nt, Homo sapiens
gcugaugauuggaaccuaa

SEQ ID NO: 702947 - RNA, 19 nt, Homo sapiens
ggaguucuagcauuuguuu

SEQ ID NO: 702948 - RNA, 19 nt, Homo sapiens
ggagcucacugccggaguu

SEQ ID NO: 702949 - RNA, 19 nt, Homo sapiens
acaguuagaugcuuaccaa

SEQ ID NO: 702950 - RNA, 19 nt, Homo sapiens
gggaauaacauuucuugga

SEQ ID NO: 702951 - RNA, 19 nt, Homo sapiens
gcugcucacugacagaauu

SEQ ID NO: 702952 - RNA, 19 nt, Homo sapiens
gaaaugcugcucacugaca

SEQ ID NO: 702953 - RNA, 19 nt, Homo sapiens
gaugauuggaaccuaaaua

SEQ ID NO: 702954 - RNA, 19 nt, Homo sapiens
cuacaaggguccugaaguc

SEQ ID NO: 702955 - RNA, 19 nt, Homo sapiens
gggaugacauugauuugca

SEQ ID NO: 702956 - RNA, 19 nt, Homo sapiens
ggaggagugauguucauuu

SEQ ID NO: 702957 - RNA, 19 nt, Homo sapiens
ggaguucuguccaacaucu

SEQ ID NO: 702958 - RNA, 19 nt, Homo sapiens
gaauuugguuagcgauauc

SEQ ID NO: 702959 - RNA, 19 nt, Homo sapiens
uaacauuucuuggaauugg

SEQ ID NO: 702960 - RNA, 19 nt, Homo sapiens
cacuaaagaucccgcagaa

SEQ ID NO: 702961 - RNA, 19 nt, Homo sapiens
gagcauaucgggaugacau

SEQ ID NO: 702962 - RNA, 19 nt, Homo sapiens
acaacaacaucagagcaua

SEQ ID NO: 702963 - RNA, 19 nt, Homo sapiens
gaggagugauguucauuuu

SEQ ID NO: 702964 - RNA, 19 nt, Homo sapiens
ggaugacauugauuugcaa

SEQ ID NO: 702965 - RNA, 19 nt, Homo sapiens
ucaaagacuggaucaaaga

SEQ ID NO: 702966 - RNA, 19 nt, Homo sapiens
ugccggaguucuagcauuu

SEQ ID NO: 702967 - RNA, 19 nt, Homo sapiens
gaauuuauggacaguuaga

SEQ ID NO: 702968 - RNA, 19 nt, Homo sapiens
caacaacaucagagcauau

SEQ ID NO: 702969 - RNA, 19 nt, Homo sapiens
uccaacaucucuuccauca

SEQ ID NO: 702970 - RNA, 19 nt, Homo sapiens
auauuuggcuucaauguca

SEQ ID NO: 702971 - RNA, 19 nt, Homo sapiens
guuguugcaucaaauacuu

SEQ ID NO: 702972 - RNA, 19 nt, Homo sapiens
cuucauauuuggcuucaau

SEQ ID NO: 702973 - RNA, 19 nt, Homo sapiens
agaauuugguuagcgauau

SEQ ID NO: 702974 - RNA, 19 nt, Homo sapiens
caguuuggcucuuccuugu

SEQ ID NO: 702975 - RNA, 19 nt, Homo sapiens
ucaguuguugcaucaaaua

SEQ ID NO: 702976 - RNA, 19 nt, Homo sapiens
agaagugguugcaggacaa

SEQ ID NO: 702977 - RNA, 19 nt, Homo sapiens
uuacuucaauugcacagau

SEQ ID NO: 702978 - RNA, 19 nt, Homo sapiens
gcucacugccggaguucua

SEQ ID NO: 702979 - RNA, 19 nt, Homo sapiens
uaaagaucccgcagaagau

SEQ ID NO: 702980 - RNA, 19 nt, Homo sapiens
ggagugauguucauuuugg

SEQ ID NO: 702981 - RNA, 19 nt, Homo sapiens
gcacuacaaggguccugaa

SEQ ID NO: 702982 - RNA, 19 nt, Homo sapiens
ggacugugggcauggaaug

SEQ ID NO: 702983 - RNA, 19 nt, Homo sapiens
agucaguuguugcaucaaa

SEQ ID NO: 702984 - RNA, 19 nt, Homo sapiens
gugguugcaggacaauuua

SEQ ID NO: 702985 - RNA, 19 nt, Homo sapiens
agacuucacccaggaauau

SEQ ID NO: 702986 - RNA, 19 nt, Homo sapiens
cagaauuugguuagcgaua

SEQ ID NO: 702987 - RNA, 19 nt, Homo sapiens
gcucacugacagaauuaaa

SEQ ID NO: 702988 - RNA, 19 nt, Homo sapiens
ccugcagucucgccuaaug

SEQ ID NO: 702989 - RNA, 19 nt, Homo sapiens
uuucauaggcauugcauug

SEQ ID NO: 702990 - RNA, 19 nt, Homo sapiens
uacuguagccaugaauuua

SEQ ID NO: 702991 - RNA, 19 nt, Homo sapiens
gcaagucgagagcgaugug

SEQ ID NO: 702992 - RNA, 19 nt, Homo sapiens
uuucaaagacuggaucaaa

SEQ ID NO: 702993 - RNA, 19 nt, Homo sapiens
gauguggcguuccauucuc

SEQ ID NO: 702994 - RNA, 19 nt, Homo sapiens
ggaucaaagaccagcugua

SEQ ID NO: 702995 - RNA, 19 nt, Homo sapiens
auggacaguuagaugcuua

SEQ ID NO: 702996 - RNA, 19 nt, Homo sapiens
ccauucuccugcugcacua

SEQ ID NO: 702997 - RNA, 19 nt, Homo sapiens
cauaucgggaugacauuga

SEQ ID NO: 702998 - RNA, 19 nt, Homo sapiens
caucguugcugguauuuuc

SEQ ID NO: 702999 - RNA, 19 nt, Homo sapiens
ggacaauuuaaccaucguu

SEQ ID NO: 703000 - RNA, 19 nt, Homo sapiens
gcauaucgggaugacauug

SEQ ID NO: 703001 - RNA, 19 nt, Homo sapiens
gcgauguggcguuccauuc

SEQ ID NO: 703002 - RNA, 19 nt, Homo sapiens
gaugacauugauuugcaaa

SEQ ID NO: 703003 - RNA, 19 nt, Homo sapiens
caaagaccagcuguauuuc

SEQ ID NO: 703004 - RNA, 19 nt, Homo sapiens
uucaaagacuggaucaaag

SEQ ID NO: 703005 - RNA, 19 nt, Homo sapiens
cgagcugcauggaccuaau

SEQ ID NO: 703006 - RNA, 19 nt, Homo sapiens
ggauguccgggaagcacua

SEQ ID NO: 703007 - RNA, 19 nt, Homo sapiens
aaggaguucuguccaacau

SEQ ID NO: 703008 - RNA, 19 nt, Homo sapiens
gguuagcgauaucgaagcu

SEQ ID NO: 703009 - RNA, 19 nt, Homo sapiens
ccggaguucuagcauuugu

SEQ ID NO: 703010 - RNA, 19 nt, Homo sapiens
cuguagccaugaauuuaug

SEQ ID NO: 703011 - RNA, 19 nt, Homo sapiens
cgccgugaaucucuacugu

SEQ ID NO: 703012 - RNA, 19 nt, Homo sapiens
gucaguuguugcaucaaau

SEQ ID NO: 703013 - RNA, 19 nt, Homo sapiens
gauguucauuuugggauuu

SEQ ID NO: 703014 - RNA, 19 nt, Homo sapiens
ugacccaguuuggcucuuc

SEQ ID NO: 703015 - RNA, 19 nt, Homo sapiens
gccgugaaucucuacugua

SEQ ID NO: 703016 - RNA, 19 nt, Homo sapiens
gagcugcauggaccuaauc

SEQ ID NO: 703017 - RNA, 19 nt, Homo sapiens
caaccgcugcugcaagaca

SEQ ID NO: 703018 - RNA, 19 nt, Homo sapiens
aaagaucccgcagaagaug

SEQ ID NO: 703019 - RNA, 19 nt, Homo sapiens
ucaugaacccagaggaugu

SEQ ID NO: 703020 - RNA, 19 nt, Homo sapiens
gcuucaaugucauauuuug

SEQ ID NO: 703021 - RNA, 19 nt, Homo sapiens
gaucuucgagcugcaugga

SEQ ID NO: 703022 - RNA, 19 nt, Homo sapiens
guugaccagcagauuguaa

SEQ ID NO: 703023 - RNA, 19 nt, Homo sapiens
ucaauugcacagauuccaa

SEQ ID NO: 703024 - RNA, 19 nt, Homo sapiens
gaaauaauguacccaugua

SEQ ID NO: 703025 - RNA, 19 nt, Homo sapiens
gaugugaucucaguuguaa

SEQ ID NO: 703026 - RNA, 19 nt, Homo sapiens
agacugagcuuugaaacua

SEQ ID NO: 703027 - RNA, 19 nt, Homo sapiens
gagcaaagguggaaaauga

SEQ ID NO: 703028 - RNA, 19 nt, Homo sapiens
ugaagaagcuacaagaaau

SEQ ID NO: 703029 - RNA, 19 nt, Homo sapiens
gaucucaguuguaaauaga

SEQ ID NO: 703030 - RNA, 19 nt, Homo sapiens
agagacagcugcauuguug

SEQ ID NO: 703031 - RNA, 19 nt, Homo sapiens
uauaagaccuacaauggaa

SEQ ID NO: 703032 - RNA, 19 nt, Homo sapiens
gcucaucccugcuguagug

SEQ ID NO: 703033 - RNA, 19 nt, Homo sapiens
uaagauagcagcuguacaa

SEQ ID NO: 703034 - RNA, 19 nt, Homo sapiens
gauagcagcuguacaaaau

SEQ ID NO: 703035 - RNA, 19 nt, Homo sapiens
gcacuggcauuugcagcua

SEQ ID NO: 703036 - RNA, 19 nt, Homo sapiens
guacagagacagcugcauu

SEQ ID NO: 703037 - RNA, 19 nt, Homo sapiens
gcacuacuguuuuaaaaga

SEQ ID NO: 703038 - RNA, 19 nt, Homo sapiens
ggaaauaauguacccaugu

SEQ ID NO: 703039 - RNA, 19 nt, Homo sapiens
guagagauccugcuuacga

SEQ ID NO: 703040 - RNA, 19 nt, Homo sapiens
acagauugguucaaagaaa

SEQ ID NO: 703041 - RNA, 19 nt, Homo sapiens
ucacagaaguuguuguagu

SEQ ID NO: 703042 - RNA, 19 nt, Homo sapiens
ggagaacucuuggccaaag

SEQ ID NO: 703043 - RNA, 19 nt, Homo sapiens
guagugugguagaauuaaa

SEQ ID NO: 703044 - RNA, 19 nt, Homo sapiens
gugaagaagcuacaagaaa

SEQ ID NO: 703045 - RNA, 19 nt, Homo sapiens
ucacuuaugaugacuauga

SEQ ID NO: 703046 - RNA, 19 nt, Homo sapiens
gaguagagauccugcuuac

SEQ ID NO: 703047 - RNA, 19 nt, Homo sapiens
ggaguagagauccugcuua

SEQ ID NO: 703048 - RNA, 19 nt, Homo sapiens
gcauucagaaaguguauaa

SEQ ID NO: 703049 - RNA, 19 nt, Homo sapiens
gauggugaacguucuaauu

SEQ ID NO: 703050 - RNA, 19 nt, Homo sapiens
gucuuaagcuuguuggaaa

SEQ ID NO: 703051 - RNA, 19 nt, Homo sapiens
cauguagugugguagaauu

SEQ ID NO: 703052 - RNA, 19 nt, Homo sapiens
ggacuugccacguuuguca

SEQ ID NO: 703053 - RNA, 19 nt, Homo sapiens
uauaauguaugcacuacug

SEQ ID NO: 703054 - RNA, 19 nt, Homo sapiens
cgagucauguaguguggua

SEQ ID NO: 703055 - RNA, 19 nt, Homo sapiens
gaagcuacaagaaaucaug

SEQ ID NO: 703056 - RNA, 19 nt, Homo sapiens
ggcaucaccuccuccaaga

SEQ ID NO: 703057 - RNA, 19 nt, Homo sapiens
cacagaaguuguuguagug

SEQ ID NO: 703058 - RNA, 19 nt, Homo sapiens
gaagaagcuacaagaaauc

SEQ ID NO: 703059 - RNA, 19 nt, Homo sapiens
ccuaugucuucaucacuua

SEQ ID NO: 703060 - RNA, 19 nt, Homo sapiens
gaauuagugugaguguguu

SEQ ID NO: 703061 - RNA, 19 nt, Homo sapiens
ggaggaguauaauguaugc

SEQ ID NO: 703062 - RNA, 19 nt, Homo sapiens
gcguauaucuugguucauc

SEQ ID NO: 703063 - RNA, 19 nt, Homo sapiens
ugacuaugaccacuucuuu

SEQ ID NO: 703064 - RNA, 19 nt, Homo sapiens
ggacugaugccgaaauguc

SEQ ID NO: 703065 - RNA, 19 nt, Homo sapiens
acacgagccugcuucuguu

SEQ ID NO: 703066 - RNA, 19 nt, Homo sapiens
uaaguacgauggugaacgu

SEQ ID NO: 703067 - RNA, 19 nt, Homo sapiens
gagacugccagcaauugua

SEQ ID NO: 703068 - RNA, 19 nt, Homo sapiens
cagagagacugccagcaau

SEQ ID NO: 703069 - RNA, 19 nt, Homo sapiens
gacacgagccugcuucugu

SEQ ID NO: 703070 - RNA, 19 nt, Homo sapiens
gaaccaauugcgagucaug

SEQ ID NO: 703071 - RNA, 19 nt, Homo sapiens
cagaaccaauugcgaguca

SEQ ID NO: 703072 - RNA, 19 nt, Homo sapiens
gaucgcagcauucagaaag

SEQ ID NO: 703073 - RNA, 19 nt, Homo sapiens
uuacuguaguccaauaaga

SEQ ID NO: 703074 - RNA, 19 nt, Homo sapiens
guauaagaccuacaaugga

SEQ ID NO: 703075 - RNA, 19 nt, Homo sapiens
ggauauguuuacagagcaa

SEQ ID NO: 703076 - RNA, 19 nt, Homo sapiens
ucaauaaacucuguaucag

SEQ ID NO: 703077 - RNA, 19 nt, Homo sapiens
cauguagacuagcaaaaua

SEQ ID NO: 703078 - RNA, 19 nt, Homo sapiens
uaggaggaguauaauguau

SEQ ID NO: 703079 - RNA, 19 nt, Homo sapiens
uaucuugguucaucuucaa

SEQ ID NO: 703080 - RNA, 19 nt, Homo sapiens
uacaagaaaucaugaugca

SEQ ID NO: 703081 - RNA, 19 nt, Homo sapiens
gcuguuggccucuggaguu

SEQ ID NO: 703082 - RNA, 19 nt, Homo sapiens
gccuaugucuucaucacuu

SEQ ID NO: 703083 - RNA, 19 nt, Homo sapiens
gaauucacaacuacucaga

SEQ ID NO: 703084 - RNA, 19 nt, Homo sapiens
ccucauugguguccuuuua

SEQ ID NO: 703085 - RNA, 19 nt, Homo sapiens
gaguauaauguaugcacua

SEQ ID NO: 703086 - RNA, 19 nt, Homo sapiens
ggaggaggaaaccagcuuu

SEQ ID NO: 703087 - RNA, 19 nt, Homo sapiens
guacgauggugaacguucu

SEQ ID NO: 703088 - RNA, 19 nt, Homo sapiens
gagagacugccagcaauug

SEQ ID NO: 703089 - RNA, 19 nt, Homo sapiens
cagcugcauuguuguggaa

SEQ ID NO: 703090 - RNA, 19 nt, Homo sapiens
ugagguugaucgcagcauu

SEQ ID NO: 703091 - RNA, 19 nt, Homo sapiens
ucaugugcccaccuacuua

SEQ ID NO: 703092 - RNA, 19 nt, Homo sapiens
agaaguuguuguagugguu

SEQ ID NO: 703093 - RNA, 19 nt, Homo sapiens
uggcguauaucuugguuca

SEQ ID NO: 703094 - RNA, 19 nt, Homo sapiens
ccagguccuuucagucuuc

SEQ ID NO: 703095 - RNA, 19 nt, Homo sapiens
caggacugaugccgaaaug

SEQ ID NO: 703096 - RNA, 19 nt, Homo sapiens
ugucacagaaguuguugua

SEQ ID NO: 703097 - RNA, 19 nt, Homo sapiens
cagauugguucaaagaaac

SEQ ID NO: 703098 - RNA, 19 nt, Homo sapiens
guugaucgcagcauucaga

SEQ ID NO: 703099 - RNA, 19 nt, Homo sapiens
uguaugcacuacuguuuua

SEQ ID NO: 703100 - RNA, 19 nt, Homo sapiens
ugaugacuaugaccacuuc

SEQ ID NO: 703101 - RNA, 19 nt, Homo sapiens
gugcccaccuacuuaccua

SEQ ID NO: 703102 - RNA, 19 nt, Homo sapiens
gaaguuguuguagugguuu

SEQ ID NO: 703103 - RNA, 19 nt, Homo sapiens
ugaucucaguuguaaauag

SEQ ID NO: 703104 - RNA, 19 nt, Homo sapiens
ucacaguggagaacucuug

SEQ ID NO: 703105 - RNA, 19 nt, Homo sapiens
gggagccuaugucuucauc

SEQ ID NO: 703106 - RNA, 19 nt, Homo sapiens
agacugccagcaauuguaa

SEQ ID NO: 703107 - RNA, 19 nt, Homo sapiens
guacccauguagacuagca

SEQ ID NO: 703108 - RNA, 19 nt, Homo sapiens
gugcuugcaucguguugug

SEQ ID NO: 703109 - RNA, 19 nt, Homo sapiens
gcugcauuguuguggaauu

SEQ ID NO: 703110 - RNA, 19 nt, Homo sapiens
uuugggauauguuuacaga

SEQ ID NO: 703111 - RNA, 19 nt, Homo sapiens
guagugaucauagcuguag

SEQ ID NO: 703112 - RNA, 19 nt, Homo sapiens
ugauuuggaaggugaauug

SEQ ID NO: 703113 - RNA, 19 nt, Homo sapiens
acuaugaccacuucuuuga

SEQ ID NO: 703114 - RNA, 19 nt, Homo sapiens
gaaaauacagauugguuca

SEQ ID NO: 703115 - RNA, 19 nt, Homo sapiens
ugugggagccuaugucuuc

SEQ ID NO: 703116 - RNA, 19 nt, Homo sapiens
gcagcauucagaaagugua

SEQ ID NO: 703117 - RNA, 19 nt, Homo sapiens
gagccuaugucuucaucac

SEQ ID NO: 703118 - RNA, 19 nt, Homo sapiens
gaacucuuggccaaagguu

SEQ ID NO: 703119 - RNA, 19 nt, Homo sapiens
ccucuggaguucauuuagu

SEQ ID NO: 703120 - RNA, 19 nt, Homo sapiens
gcuacaagaaaucaugaug

SEQ ID NO: 703121 - RNA, 19 nt, Homo sapiens
auacagauugguucaaaga

SEQ ID NO: 703122 - RNA, 19 nt, Homo sapiens
gcuauugauuauguacaga

SEQ ID NO: 703123 - RNA, 19 nt, Homo sapiens
agaauuagugugagugugu

SEQ ID NO: 703124 - RNA, 19 nt, Homo sapiens
gaacuuggcuauuuagaaa

SEQ ID NO: 703125 - RNA, 19 nt, Homo sapiens
ggaauaugcuuuauacgua

SEQ ID NO: 703126 - RNA, 19 nt, Homo sapiens
gaacuaaacacaucuguaa

SEQ ID NO: 703127 - RNA, 19 nt, Homo sapiens
gauauuugcugcugaagua

SEQ ID NO: 703128 - RNA, 19 nt, Homo sapiens
caagagaucuggcaguuga

SEQ ID NO: 703129 - RNA, 19 nt, Homo sapiens
ccaaggcacugaauuaaga

SEQ ID NO: 703130 - RNA, 19 nt, Homo sapiens
gcagagaauucagagauuu

SEQ ID NO: 703131 - RNA, 19 nt, Homo sapiens
ggaaagagaauuuguaugg

SEQ ID NO: 703132 - RNA, 19 nt, Homo sapiens
gaacuucuauacaugugaa

SEQ ID NO: 703133 - RNA, 19 nt, Homo sapiens
gaagaggcuuacaaugauu

SEQ ID NO: 703134 - RNA, 19 nt, Homo sapiens
gaaguaauaagcuguaaga

SEQ ID NO: 703135 - RNA, 19 nt, Homo sapiens
gaaggguucuguuccaugu

SEQ ID NO: 703136 - RNA, 19 nt, Homo sapiens
gauaugacugcuugaaaua

SEQ ID NO: 703137 - RNA, 19 nt, Homo sapiens
uaaaggaguuaucaucaga

SEQ ID NO: 703138 - RNA, 19 nt, Homo sapiens
gaagaacaaaggucauauu

SEQ ID NO: 703139 - RNA, 19 nt, Homo sapiens
cagaugaacuucuauacau

SEQ ID NO: 703140 - RNA, 19 nt, Homo sapiens
gaaugccuguuuaugauga

SEQ ID NO: 703141 - RNA, 19 nt, Homo sapiens
gaaauugagaccauaauca

SEQ ID NO: 703142 - RNA, 19 nt, Homo sapiens
gaucggccgucauugcuuu

SEQ ID NO: 703143 - RNA, 19 nt, Homo sapiens
gagauuagacccaaacaug

SEQ ID NO: 703144 - RNA, 19 nt, Homo sapiens
ugaagaggcuuacaaugau

SEQ ID NO: 703145 - RNA, 19 nt, Homo sapiens
gcacuguaucuaugaaaua

SEQ ID NO: 703146 - RNA, 19 nt, Homo sapiens
ggauauauauacacacaca

SEQ ID NO: 703147 - RNA, 19 nt, Homo sapiens
gaaacaaguuaaggaaaca

SEQ ID NO: 703148 - RNA, 19 nt, Homo sapiens
ccucauaacuuacguuuac

SEQ ID NO: 703149 - RNA, 19 nt, Homo sapiens
gacgaucuuuggcaugaua

SEQ ID NO: 703150 - RNA, 19 nt, Homo sapiens
guccaucucucuuagcuuu

SEQ ID NO: 703151 - RNA, 19 nt, Homo sapiens
ugagaaaugugaccuuuua

SEQ ID NO: 703152 - RNA, 19 nt, Homo sapiens
ggaauugucgguauuggaa

SEQ ID NO: 703153 - RNA, 19 nt, Homo sapiens
aguaaccacuggaguauuu

SEQ ID NO: 703154 - RNA, 19 nt, Homo sapiens
guaaggguuuccuggguuu

SEQ ID NO: 703155 - RNA, 19 nt, Homo sapiens
ucagaaacuuugagaacuu

SEQ ID NO: 703156 - RNA, 19 nt, Homo sapiens
gaaagagaagucacacaga

SEQ ID NO: 703157 - RNA, 19 nt, Homo sapiens
gugaaugccuguuuaugau

SEQ ID NO: 703158 - RNA, 19 nt, Homo sapiens
auacgaaacucacgagaug

SEQ ID NO: 703159 - RNA, 19 nt, Homo sapiens
ccacuggaguauuugcuuu

SEQ ID NO: 703160 - RNA, 19 nt, Homo sapiens
gaaguaaccacuggaguau

SEQ ID NO: 703161 - RNA, 19 nt, Homo sapiens
cuagagaauucuucauaga

SEQ ID NO: 703162 - RNA, 19 nt, Homo sapiens
uuugagaacuuggcuauuu

SEQ ID NO: 703163 - RNA, 19 nt, Homo sapiens
ugaaguaaccacuggagua

SEQ ID NO: 703164 - RNA, 19 nt, Homo sapiens
acagauguguguguauaua

SEQ ID NO: 703165 - RNA, 19 nt, Homo sapiens
guucggaggugccauaaag

SEQ ID NO: 703166 - RNA, 19 nt, Homo sapiens
cuaaagcuuucauaccaaa

SEQ ID NO: 703167 - RNA, 19 nt, Homo sapiens
caaaauaugcguaugagua

SEQ ID NO: 703168 - RNA, 19 nt, Homo sapiens
ucuguuccauguacgauua

SEQ ID NO: 703169 - RNA, 19 nt, Homo sapiens
gaaccacauuucucuuucu

SEQ ID NO: 703170 - RNA, 19 nt, Homo sapiens
uugagaacuuggcuauuua

SEQ ID NO: 703171 - RNA, 19 nt, Homo sapiens
gagaccauaaucaguguua

SEQ ID NO: 703172 - RNA, 19 nt, Homo sapiens
guugagaaaugugaccuuu

SEQ ID NO: 703173 - RNA, 19 nt, Homo sapiens
caaccuacaugcccaaagg

SEQ ID NO: 703174 - RNA, 19 nt, Homo sapiens
ggugauauuugcugcugaa

SEQ ID NO: 703175 - RNA, 19 nt, Homo sapiens
gaaacaggcccaagugcau

SEQ ID NO: 703176 - RNA, 19 nt, Homo sapiens
caaauccccugugaaaaua

SEQ ID NO: 703177 - RNA, 19 nt, Homo sapiens
gggcaacagaaacaaguua

SEQ ID NO: 703178 - RNA, 19 nt, Homo sapiens
uuagagaauuccaccacua

SEQ ID NO: 703179 - RNA, 19 nt, Homo sapiens
auacauggcuacuuuacug

SEQ ID NO: 703180 - RNA, 19 nt, Homo sapiens
agauaugacugcuugaaau

SEQ ID NO: 703181 - RNA, 19 nt, Homo sapiens
acacacagaaagaugaaua

SEQ ID NO: 703182 - RNA, 19 nt, Homo sapiens
agagauuucuucuuaaugg

SEQ ID NO: 703183 - RNA, 19 nt, Homo sapiens
gcugucaauuguacauuug

SEQ ID NO: 703184 - RNA, 19 nt, Homo sapiens
gaugaaauugagaccauaa

SEQ ID NO: 703185 - RNA, 19 nt, Homo sapiens
agaauugcaucgaugaaau

SEQ ID NO: 703186 - RNA, 19 nt, Homo sapiens
ccacuaagcaacaguagau

SEQ ID NO: 703187 - RNA, 19 nt, Homo sapiens
gaauuuguaugggcacugu

SEQ ID NO: 703188 - RNA, 19 nt, Homo sapiens
gcaaucuaaagcuuucaua

SEQ ID NO: 703189 - RNA, 19 nt, Homo sapiens
acacaagaauugcaucgau

SEQ ID NO: 703190 - RNA, 19 nt, Homo sapiens
gcaaauccccugugaaaau

SEQ ID NO: 703191 - RNA, 19 nt, Homo sapiens
gauaaugggucaguuucuc

SEQ ID NO: 703192 - RNA, 19 nt, Homo sapiens
gaguuuaguuuccuaucug

SEQ ID NO: 703193 - RNA, 19 nt, Homo sapiens
gaacaggcaguccaucucu

SEQ ID NO: 703194 - RNA, 19 nt, Homo sapiens
agaucacaauggaguguua

SEQ ID NO: 703195 - RNA, 19 nt, Homo sapiens
cagaaacuuugagaacuug

SEQ ID NO: 703196 - RNA, 19 nt, Homo sapiens
gagaugugauaugaagcua

SEQ ID NO: 703197 - RNA, 19 nt, Homo sapiens
guagcuauccgacauguuc

SEQ ID NO: 703198 - RNA, 19 nt, Homo sapiens
gaggugccauaaaggaguu

SEQ ID NO: 703199 - RNA, 19 nt, Homo sapiens
guggauauauauacacaca

SEQ ID NO: 703200 - RNA, 19 nt, Homo sapiens
agaaacaaguuaaggaaac

SEQ ID NO: 703201 - RNA, 19 nt, Homo sapiens
gagauuucuucuuaaugga

SEQ ID NO: 703202 - RNA, 19 nt, Homo sapiens
uugagugaaugccuguuua

SEQ ID NO: 703203 - RNA, 19 nt, Homo sapiens
gaugugauaugaagcuacu

SEQ ID NO: 703204 - RNA, 19 nt, Homo sapiens
uagaagaacaaaggucaua

SEQ ID NO: 703205 - RNA, 19 nt, Homo sapiens
aauaagucaugcuuuccua

SEQ ID NO: 703206 - RNA, 19 nt, Homo sapiens
cgaugaaauugagaccaua

SEQ ID NO: 703207 - RNA, 19 nt, Homo sapiens
augaagaggcuuacaauga

SEQ ID NO: 703208 - RNA, 19 nt, Homo sapiens
uagagaauuccaccacuaa

SEQ ID NO: 703209 - RNA, 19 nt, Homo sapiens
ccuagagaauucuucauag

SEQ ID NO: 703210 - RNA, 19 nt, Homo sapiens
cuacuuuacugugucugua

SEQ ID NO: 703211 - RNA, 19 nt, Homo sapiens
uugaauaagucaugcuuuc

SEQ ID NO: 703212 - RNA, 19 nt, Homo sapiens
gaugaacuucuauacaugu

SEQ ID NO: 703213 - RNA, 19 nt, Homo sapiens
guaaugaaaucuguuugcu

SEQ ID NO: 703214 - RNA, 19 nt, Homo sapiens
cacgagaugugauaugaag

SEQ ID NO: 703215 - RNA, 19 nt, Homo sapiens
aaacaggcccaagugcaua

SEQ ID NO: 703216 - RNA, 19 nt, Homo sapiens
uaugggcacuguaucuaug

SEQ ID NO: 703217 - RNA, 19 nt, Homo sapiens
ucuggaauaugcuuuauac

SEQ ID NO: 703218 - RNA, 19 nt, Homo sapiens
cagaaacaaguuaaggaaa

SEQ ID NO: 703219 - RNA, 19 nt, Homo sapiens
gcaugaguacguauguuug

SEQ ID NO: 703220 - RNA, 19 nt, Homo sapiens
ggcacugaauuaagacuuc

SEQ ID NO: 703221 - RNA, 19 nt, Homo sapiens
caacuuuaaaggagacuau

SEQ ID NO: 703222 - RNA, 19 nt, Homo sapiens
aaagugaguguuuauagga

SEQ ID NO: 703223 - RNA, 19 nt, Homo sapiens
acguauguuuggcucauua

SEQ ID NO: 703224 - RNA, 19 nt, Homo sapiens
gagcugaccuucuguagga

SEQ ID NO: 703225 - RNA, 19 nt, Homo sapiens
ccucaggcaugucuuguaa

SEQ ID NO: 703226 - RNA, 19 nt, Homo sapiens
gcaucucgcucaugucugu

SEQ ID NO: 703227 - RNA, 19 nt, Homo sapiens
aggcaugucuuguaacugu

SEQ ID NO: 703228 - RNA, 19 nt, Homo sapiens
ggaaucguggagaauauga

SEQ ID NO: 703229 - RNA, 19 nt, Homo sapiens
gcaagaaggugggaauccu

SEQ ID NO: 703230 - RNA, 19 nt, Homo sapiens
ggagugcaccagcgucuuc

SEQ ID NO: 703231 - RNA, 19 nt, Homo sapiens
ugaugggaaucguggagaa

SEQ ID NO: 703232 - RNA, 19 nt, Homo sapiens
ucaggcaugucuuguaacu

SEQ ID NO: 703233 - RNA, 19 nt, Homo sapiens
ugggaaucguggagaauau

SEQ ID NO: 703234 - RNA, 19 nt, Homo sapiens
cugggucgcugucaucugu

SEQ ID NO: 703235 - RNA, 19 nt, Homo sapiens
gaccuccgaugagcacaug

SEQ ID NO: 703236 - RNA, 19 nt, Homo sapiens
ggcaugucuuguaacugua

SEQ ID NO: 703237 - RNA, 19 nt, Homo sapiens
gagaauaugagcggcuuca

SEQ ID NO: 703238 - RNA, 19 nt, Homo sapiens
cuccauagcccagaagauu

SEQ ID NO: 703239 - RNA, 19 nt, Homo sapiens
ggagggccacgacuucauc

SEQ ID NO: 703240 - RNA, 19 nt, Homo sapiens
ucaccuccauagcccagaa

SEQ ID NO: 703241 - RNA, 19 nt, Homo sapiens
aaaacgcgcugauaaagca

SEQ ID NO: 703242 - RNA, 19 nt, Homo sapiens
ucgcugucaucuguguuua

SEQ ID NO: 703243 - RNA, 19 nt, Homo sapiens
gcucugcuccagccucuca

SEQ ID NO: 703244 - RNA, 19 nt, Homo sapiens
gcgcugauaaagcaguuug

SEQ ID NO: 703245 - RNA, 19 nt, Homo sapiens
ucucuucccauccauguug

SEQ ID NO: 703246 - RNA, 19 nt, Homo sapiens
gaggagggccacgacuuca

SEQ ID NO: 703247 - RNA, 19 nt, Homo sapiens
ucaguuggcuuuagcaauu

SEQ ID NO: 703248 - RNA, 19 nt, Homo sapiens
gaaggaaacacaacuguau

SEQ ID NO: 703249 - RNA, 19 nt, Homo sapiens
agaaagcucuggagacuug

SEQ ID NO: 703250 - RNA, 19 nt, Homo sapiens
gaaccaugaugcauuguca

SEQ ID NO: 703251 - RNA, 19 nt, Homo sapiens
gcucacgccuguaaaccua

SEQ ID NO: 703252 - RNA, 19 nt, Homo sapiens
caagaaagcucuggagacu

SEQ ID NO: 703253 - RNA, 19 nt, Homo sapiens
guggaucacuugaggguuu

SEQ ID NO: 703254 - RNA, 19 nt, Homo sapiens
ggaaggaaacacaacugua

SEQ ID NO: 703255 - RNA, 19 nt, Homo sapiens
caggaggaauauuuacuuu

SEQ ID NO: 703256 - RNA, 19 nt, Homo sapiens
gaucaacccucugcauaca

SEQ ID NO: 703257 - RNA, 19 nt, Homo sapiens
gaaaacaggcuacuccuuu

SEQ ID NO: 703258 - RNA, 19 nt, Homo sapiens
gaccaaagaaggccugauu

SEQ ID NO: 703259 - RNA, 19 nt, Homo sapiens
gcuacuccuuuguaaauug

SEQ ID NO: 703260 - RNA, 19 nt, Homo sapiens
ucaaggaucaguuggcuuu

SEQ ID NO: 703261 - RNA, 19 nt, Homo sapiens
uaguagagguaaacuguga

SEQ ID NO: 703262 - RNA, 19 nt, Homo sapiens
ugaagcagguggaucacuu

SEQ ID NO: 703263 - RNA, 19 nt, Homo sapiens
gaaacacaacuguauuagu

SEQ ID NO: 703264 - RNA, 19 nt, Homo sapiens
cagagucccucacuucaca

SEQ ID NO: 703265 - RNA, 19 nt, Homo sapiens
gguucuacguuggcucuua

SEQ ID NO: 703266 - RNA, 19 nt, Homo sapiens
aggaaacacaacuguauua

SEQ ID NO: 703267 - RNA, 19 nt, Homo sapiens
acacaacuguauuaguaga

SEQ ID NO: 703268 - RNA, 19 nt, Homo sapiens
gaaugcauggguaaaauua

SEQ ID NO: 703269 - RNA, 19 nt, Homo sapiens
agcagaaacugaauagguu

SEQ ID NO: 703270 - RNA, 19 nt, Homo sapiens
gaaggagggcuggagcaaa

SEQ ID NO: 703271 - RNA, 19 nt, Homo sapiens
guucuacguuggcucuuau

SEQ ID NO: 703272 - RNA, 19 nt, Homo sapiens
acaggcuacuccuuuguaa

SEQ ID NO: 703273 - RNA, 19 nt, Homo sapiens
gcucuggacaucauuacaa

SEQ ID NO: 703274 - RNA, 19 nt, Homo sapiens
cagcugggccugacagaga

SEQ ID NO: 703275 - RNA, 19 nt, Homo sapiens
cuugaggguuucuugaauu

SEQ ID NO: 703276 - RNA, 19 nt, Homo sapiens
ggaaacacaacuguauuag

SEQ ID NO: 703277 - RNA, 19 nt, Homo sapiens
ggcccaggaggaauauuua

SEQ ID NO: 703278 - RNA, 19 nt, Homo sapiens
cagcagaaacugaauaggu

SEQ ID NO: 703279 - RNA, 19 nt, Homo sapiens
ggagaggcagagacuaaga

SEQ ID NO: 703280 - RNA, 19 nt, Homo sapiens
gaauuccucugagcuuucu

SEQ ID NO: 703281 - RNA, 19 nt, Homo sapiens
gaagcagguggaucacuug

SEQ ID NO: 703282 - RNA, 19 nt, Homo sapiens
acaaggaggcccagaagga

SEQ ID NO: 703283 - RNA, 19 nt, Homo sapiens
aaggagggcuggagcaaag

SEQ ID NO: 703284 - RNA, 19 nt, Homo sapiens
uaucgcggcuagagagaug

SEQ ID NO: 703285 - RNA, 19 nt, Homo sapiens
ccaggaggaauauuuacuu

SEQ ID NO: 703286 - RNA, 19 nt, Homo sapiens
ccuguaaaccuagcacuuu

SEQ ID NO: 703287 - RNA, 19 nt, Homo sapiens
gagaaugcauggguaaaau

SEQ ID NO: 703288 - RNA, 19 nt, Homo sapiens
ugaauagguuccagagacu

SEQ ID NO: 703289 - RNA, 19 nt, Homo sapiens
cagagaaggcucacucaag

SEQ ID NO: 703290 - RNA, 19 nt, Homo sapiens
agaucuggcuccacaagga

SEQ ID NO: 703291 - RNA, 19 nt, Homo sapiens
ggaucaacccucugcauac

SEQ ID NO: 703292 - RNA, 19 nt, Homo sapiens
gucagacccuaaaggauca

SEQ ID NO: 703293 - RNA, 19 nt, Homo sapiens
cuguaaaccuagcacuuug

SEQ ID NO: 703294 - RNA, 19 nt, Homo sapiens
ucaacccucugcauacagu

SEQ ID NO: 703295 - RNA, 19 nt, Homo sapiens
uuggaaccaugaugcauug

SEQ ID NO: 703296 - RNA, 19 nt, Homo sapiens
gagaggcagagacuaagau

SEQ ID NO: 703297 - RNA, 19 nt, Homo sapiens
gggcccuggucaucuguga

SEQ ID NO: 703298 - RNA, 19 nt, Homo sapiens
gagaaggcucacucaagga

SEQ ID NO: 703299 - RNA, 19 nt, Homo sapiens
gaagaggcagcagaaacug

SEQ ID NO: 703300 - RNA, 19 nt, Homo sapiens
ugaagaggcagcagaaacu

SEQ ID NO: 703301 - RNA, 19 nt, Homo sapiens
aacaaaccuugaagacguu

SEQ ID NO: 703302 - RNA, 19 nt, Homo sapiens
aggaucaacccucugcaua

SEQ ID NO: 703303 - RNA, 19 nt, Homo sapiens
agacagauuuuguuucuag

SEQ ID NO: 703304 - RNA, 19 nt, Homo sapiens
guuugaauguggagaaggu

SEQ ID NO: 703305 - RNA, 19 nt, Homo sapiens
gaaaacaaaccuugaagac

SEQ ID NO: 703306 - RNA, 19 nt, Homo sapiens
gaucaguuggcuuuagcaa

SEQ ID NO: 703307 - RNA, 19 nt, Homo sapiens
ccacaaggaggcccagaag

SEQ ID NO: 703308 - RNA, 19 nt, Homo sapiens
ggcuacuccuuuguaaauu

SEQ ID NO: 703309 - RNA, 19 nt, Homo sapiens
uugaauuccucugagcuuu

SEQ ID NO: 703310 - RNA, 19 nt, Homo sapiens
ucacuugaggguuucuuga

SEQ ID NO: 703311 - RNA, 19 nt, Homo sapiens
guagagguaaacugugaga

SEQ ID NO: 703312 - RNA, 19 nt, Homo sapiens
aaggcucacucaaggauca

SEQ ID NO: 703313 - RNA, 19 nt, Homo sapiens
aggcuacuccuuuguaaau

SEQ ID NO: 703314 - RNA, 19 nt, Homo sapiens
gcaggaaggaaacacaacu

SEQ ID NO: 703315 - RNA, 19 nt, Homo sapiens
gggugucgguaguagacuu

SEQ ID NO: 703316 - RNA, 19 nt, Homo sapiens
aaaacaggcuacuccuuug

SEQ ID NO: 703317 - RNA, 19 nt, Homo sapiens
caagggaggaagaccaaag

SEQ ID NO: 703318 - RNA, 19 nt, Homo sapiens
ugagacagauuuuguuucu

SEQ ID NO: 703319 - RNA, 19 nt, Homo sapiens
gaauagguuccagagacuu

SEQ ID NO: 703320 - RNA, 19 nt, Homo sapiens
caaggaucaguuggcuuua

SEQ ID NO: 703321 - RNA, 19 nt, Homo sapiens
uugaggguuucuugaauuc

SEQ ID NO: 703322 - RNA, 19 nt, Homo sapiens
cucuggacaucauuacaaa

SEQ ID NO: 703323 - RNA, 19 nt, Homo sapiens
aauagguuccagagacuuu

SEQ ID NO: 703324 - RNA, 19 nt, Homo sapiens
gaggguuucuugaauuccu

SEQ ID NO: 703325 - RNA, 19 nt, Homo sapiens
gggaggaagaccaaagaag

SEQ ID NO: 703326 - RNA, 19 nt, Homo sapiens
aaggaaacacaacuguauu

SEQ ID NO: 703327 - RNA, 19 nt, Homo sapiens
uggcccaggaggaauauuu

SEQ ID NO: 703328 - RNA, 19 nt, Homo sapiens
agaggcagcagaaacugaa

SEQ ID NO: 703329 - RNA, 19 nt, Homo sapiens
ggggagaggcagagacuaa

SEQ ID NO: 703330 - RNA, 19 nt, Homo sapiens
gcccuggucaucugugaga

SEQ ID NO: 703331 - RNA, 19 nt, Homo sapiens
caguuggcuuuagcaauug

SEQ ID NO: 703332 - RNA, 19 nt, Homo sapiens
ccagccaaggcacacauuu

SEQ ID NO: 703333 - RNA, 19 nt, Homo sapiens
aaacaggcuacuccuuugu

SEQ ID NO: 703334 - RNA, 19 nt, Homo sapiens
agagguaaacugugagaca

SEQ ID NO: 703335 - RNA, 19 nt, Homo sapiens
gugaagaggcagcagaaac

SEQ ID NO: 703336 - RNA, 19 nt, Homo sapiens
ggugucgguaguagacuuu

SEQ ID NO: 703337 - RNA, 19 nt, Homo sapiens
gacagagaaggcucacuca

SEQ ID NO: 703338 - RNA, 19 nt, Homo sapiens
ggcugaagcagguggauca

SEQ ID NO: 703339 - RNA, 19 nt, Homo sapiens
guacugcaaucuacaauaa

SEQ ID NO: 703340 - RNA, 19 nt, Homo sapiens
gcauaaaccuguuacaaug

SEQ ID NO: 703341 - RNA, 19 nt, Homo sapiens
gcaguucccucuuucagaa

SEQ ID NO: 703342 - RNA, 19 nt, Homo sapiens
ggacucacccuacuucaaa

SEQ ID NO: 703343 - RNA, 19 nt, Homo sapiens
gaauggaccugcccuuucu

SEQ ID NO: 703344 - RNA, 19 nt, Homo sapiens
ucaaucagcuuuuguauga

SEQ ID NO: 703345 - RNA, 19 nt, Homo sapiens
gcaaaaggcucacgaccaa

SEQ ID NO: 703346 - RNA, 19 nt, Homo sapiens
ugaugauccucuucaauuu

SEQ ID NO: 703347 - RNA, 19 nt, Homo sapiens
ccauguaucuguacugcaa

SEQ ID NO: 703348 - RNA, 19 nt, Homo sapiens
ccucagcaguucccucuuu

SEQ ID NO: 703349 - RNA, 19 nt, Homo sapiens
ggucuuugcucuugguuuc

SEQ ID NO: 703350 - RNA, 19 nt, Homo sapiens
guagaggguugcuucaauc

SEQ ID NO: 703351 - RNA, 19 nt, Homo sapiens
ucaauuugcucaucuuucu

SEQ ID NO: 703352 - RNA, 19 nt, Homo sapiens
gguagugccugccaucaag

SEQ ID NO: 703353 - RNA, 19 nt, Homo sapiens
uguaugacauccgaacuaa

SEQ ID NO: 703354 - RNA, 19 nt, Homo sapiens
cacaauggcugagcacuuc

SEQ ID NO: 703355 - RNA, 19 nt, Homo sapiens
gaacaggagccaccaugca

SEQ ID NO: 703356 - RNA, 19 nt, Homo sapiens
gaugauccucuucaauuug

SEQ ID NO: 703357 - RNA, 19 nt, Homo sapiens
ccucuaagguagccaguuc

SEQ ID NO: 703358 - RNA, 19 nt, Homo sapiens
uaugacauccgaacuaaug

SEQ ID NO: 703359 - RNA, 19 nt, Homo sapiens
gcuguggcuucaccaacua

SEQ ID NO: 703360 - RNA, 19 nt, Homo sapiens
gcuauggugcuaagacuga

SEQ ID NO: 703361 - RNA, 19 nt, Homo sapiens
ccagugccaugcaguuugu

SEQ ID NO: 703362 - RNA, 19 nt, Homo sapiens
caucuucauugcugagguu

SEQ ID NO: 703363 - RNA, 19 nt, Homo sapiens
gagagaaaggcauuuuaua

SEQ ID NO: 703364 - RNA, 19 nt, Homo sapiens
guuguggucuuugcucuug

SEQ ID NO: 703365 - RNA, 19 nt, Homo sapiens
gagccaccaugcagugcuu

SEQ ID NO: 703366 - RNA, 19 nt, Homo sapiens
caacacagccaaugaaacc

SEQ ID NO: 703367 - RNA, 19 nt, Homo sapiens
gcaucugggugucaaucga

SEQ ID NO: 703368 - RNA, 19 nt, Homo sapiens
ugcuucagcuucauuaaga

SEQ ID NO: 703369 - RNA, 19 nt, Homo sapiens
gggaugagagaaaggcauu

SEQ ID NO: 703370 - RNA, 19 nt, Homo sapiens
caaaaugcauaaaccuguu

SEQ ID NO: 703371 - RNA, 19 nt, Homo sapiens
ugacuuuccuuccauuggu

SEQ ID NO: 703372 - RNA, 19 nt, Homo sapiens
cagaauggaccugcccuuu

SEQ ID NO: 703373 - RNA, 19 nt, Homo sapiens
uaucuguacugcaaucuac

SEQ ID NO: 703374 - RNA, 19 nt, Homo sapiens
ucaccaacacagccaauga

SEQ ID NO: 703375 - RNA, 19 nt, Homo sapiens
aguagaggguugcuucaau

SEQ ID NO: 703376 - RNA, 19 nt, Homo sapiens
ucacccuacuucaaagaga

SEQ ID NO: 703377 - RNA, 19 nt, Homo sapiens
ccacaauggcugagcacuu

SEQ ID NO: 703378 - RNA, 19 nt, Homo sapiens
gcagugcuucagcuucauu

SEQ ID NO: 703379 - RNA, 19 nt, Homo sapiens
ccacuacugcugccacaug

SEQ ID NO: 703380 - RNA, 19 nt, Homo sapiens
cacccuacuucaaagagaa

SEQ ID NO: 703381 - RNA, 19 nt, Homo sapiens
ucaccaacuauacggauuu

SEQ ID NO: 703382 - RNA, 19 nt, Homo sapiens
augaugauccucuucaauu

SEQ ID NO: 703383 - RNA, 19 nt, Homo sapiens
ccaugaugauccucuucaa

SEQ ID NO: 703384 - RNA, 19 nt, Homo sapiens
cauaaaccuguuacaaugu

SEQ ID NO: 703385 - RNA, 19 nt, Homo sapiens
agauagggaccacuccuuu

SEQ ID NO: 703386 - RNA, 19 nt, Homo sapiens
gggcugcuauggugcuaag

SEQ ID NO: 703387 - RNA, 19 nt, Homo sapiens
ggaacaccaccaugaaagg

SEQ ID NO: 703388 - RNA, 19 nt, Homo sapiens
ugcauaaaccuguuacaau

SEQ ID NO: 703389 - RNA, 19 nt, Homo sapiens
ugccugccaucaagaaaga

SEQ ID NO: 703390 - RNA, 19 nt, Homo sapiens
caccaacacagccaaugaa

SEQ ID NO: 703391 - RNA, 19 nt, Homo sapiens
agaauggaccugcccuuuc

SEQ ID NO: 703392 - RNA, 19 nt, Homo sapiens
acugcaaucuacaauaagu

SEQ ID NO: 703393 - RNA, 19 nt, Homo sapiens
augcagugcuucagcuuca

SEQ ID NO: 703394 - RNA, 19 nt, Homo sapiens
gccucuggguggaugugua

SEQ ID NO: 703395 - RNA, 19 nt, Homo sapiens
guaucuguacugcaaucua

SEQ ID NO: 703396 - RNA, 19 nt, Homo sapiens
agugugcccucgugacguu

SEQ ID NO: 703397 - RNA, 19 nt, Homo sapiens
ccaugcaguuugucaacgu

SEQ ID NO: 703398 - RNA, 19 nt, Homo sapiens
caugaugauccucuucaau

SEQ ID NO: 703399 - RNA, 19 nt, Homo sapiens
ccucuucaauuugcucauc

SEQ ID NO: 703400 - RNA, 19 nt, Homo sapiens
ccaacuauacggauuuuga

SEQ ID NO: 703401 - RNA, 19 nt, Homo sapiens
gaaauucaaucuacucaug

SEQ ID NO: 703402 - RNA, 19 nt, Homo sapiens
gacgagaacuuuacacuga

SEQ ID NO: 703403 - RNA, 19 nt, Homo sapiens
caaggugccugaaacgaua

SEQ ID NO: 703404 - RNA, 19 nt, Homo sapiens
ccacauugcuuccuaauac

SEQ ID NO: 703405 - RNA, 19 nt, Homo sapiens
gcauggacgucgugaagaa

SEQ ID NO: 703406 - RNA, 19 nt, Homo sapiens
ggauuuguguucaccuuaa

SEQ ID NO: 703407 - RNA, 19 nt, Homo sapiens
aaacacaacucagggcuuu

SEQ ID NO: 703408 - RNA, 19 nt, Homo sapiens
ggacucuaauaccuguuua

SEQ ID NO: 703409 - RNA, 19 nt, Homo sapiens
gggaggacauccaagaaga

SEQ ID NO: 703410 - RNA, 19 nt, Homo sapiens
ggugaucccuuccuucaug

SEQ ID NO: 703411 - RNA, 19 nt, Homo sapiens
aaagacagcugagaacuuc

SEQ ID NO: 703412 - RNA, 19 nt, Homo sapiens
gcagaugucgucccaaaga

SEQ ID NO: 703413 - RNA, 19 nt, Homo sapiens
uaacaagauugacuagaag

SEQ ID NO: 703414 - RNA, 19 nt, Homo sapiens
caagaagauugucaucaca

SEQ ID NO: 703415 - RNA, 19 nt, Homo sapiens
gagcuuggcuuuugaaaca

SEQ ID NO: 703416 - RNA, 19 nt, Homo sapiens
gaccugaguuggugacaca

SEQ ID NO: 703417 - RNA, 19 nt, Homo sapiens
ggacauccaagaagauugu

SEQ ID NO: 703418 - RNA, 19 nt, Homo sapiens
ugucaagcauugccuguga

SEQ ID NO: 703419 - RNA, 19 nt, Homo sapiens
ccaagaagauugucaucac

SEQ ID NO: 703420 - RNA, 19 nt, Homo sapiens
caaagacagcugagaacuu

SEQ ID NO: 703421 - RNA, 19 nt, Homo sapiens
gauuuguguucaccuuaaa

SEQ ID NO: 703422 - RNA, 19 nt, Homo sapiens
gaaacugcaacacuaacuu

SEQ ID NO: 703423 - RNA, 19 nt, Homo sapiens
caaugugaauuccuguguu

SEQ ID NO: 703424 - RNA, 19 nt, Homo sapiens
ccaccacauugcuuccuaa

SEQ ID NO: 703425 - RNA, 19 nt, Homo sapiens
gguggcagcugcaaauguc

SEQ ID NO: 703426 - RNA, 19 nt, Homo sapiens
gggaacaaaccucacuuga

SEQ ID NO: 703427 - RNA, 19 nt, Homo sapiens
gaucuuuccuccugguuac

SEQ ID NO: 703428 - RNA, 19 nt, Homo sapiens
gugaauuccuguguugcua

SEQ ID NO: 703429 - RNA, 19 nt, Homo sapiens
ugugaagccuguugguuug

SEQ ID NO: 703430 - RNA, 19 nt, Homo sapiens
caagauugacuagaaguga

SEQ ID NO: 703431 - RNA, 19 nt, Homo sapiens
aggcagaugucgucccaaa

SEQ ID NO: 703432 - RNA, 19 nt, Homo sapiens
gaaggcugcuagggauguu

SEQ ID NO: 703433 - RNA, 19 nt, Homo sapiens
ggccaggacccaccacauu

SEQ ID NO: 703434 - RNA, 19 nt, Homo sapiens
aaugugaauuccuguguug

SEQ ID NO: 703435 - RNA, 19 nt, Homo sapiens
uguguucggucacgucaaa

SEQ ID NO: 703436 - RNA, 19 nt, Homo sapiens
uggcaagcauguuguguuc

SEQ ID NO: 703437 - RNA, 19 nt, Homo sapiens
ccauaaagacagacugguu

SEQ ID NO: 703438 - RNA, 19 nt, Homo sapiens
agaagauugucaucacaga

SEQ ID NO: 703439 - RNA, 19 nt, Homo sapiens
gaggacauccaagaagauu

SEQ ID NO: 703440 - RNA, 19 nt, Homo sapiens
ucaaucuacucaugaugug

SEQ ID NO: 703441 - RNA, 19 nt, Homo sapiens
aagauugacuagaagugaa

SEQ ID NO: 703442 - RNA, 19 nt, Homo sapiens
ggaacccgcucguguaccu

SEQ ID NO: 703443 - RNA, 19 nt, Homo sapiens
caacggcucccaguucuuc

SEQ ID NO: 703444 - RNA, 19 nt, Homo sapiens
cgacuucaccaaccacaau

SEQ ID NO: 703445 - RNA, 19 nt, Homo sapiens
gagcugugccuagacaaug

SEQ ID NO: 703446 - RNA, 19 nt, Homo sapiens
caaaaggacucuaauaccu

SEQ ID NO: 703447 - RNA, 19 nt, Homo sapiens
gccaggacccaccacauug

SEQ ID NO: 703448 - RNA, 19 nt, Homo sapiens
ccaaggugccugaaacgau

SEQ ID NO: 703449 - RNA, 19 nt, Homo sapiens
cagccaaggugccugaaac

SEQ ID NO: 703450 - RNA, 19 nt, Homo sapiens
gggcauggacgucgugaag

SEQ ID NO: 703451 - RNA, 19 nt, Homo sapiens
ggaggacauccaagaagau

SEQ ID NO: 703452 - RNA, 19 nt, Homo sapiens
caguuugaguucuguguuc

SEQ ID NO: 703453 - RNA, 19 nt, Homo sapiens
gaauuccuguguugcuaac

SEQ ID NO: 703454 - RNA, 19 nt, Homo sapiens
cgagaacuuuacacugaag

SEQ ID NO: 703455 - RNA, 19 nt, Homo sapiens
gacgucaguuugaguucug

SEQ ID NO: 703456 - RNA, 19 nt, Homo sapiens
gcuguggugugaccugagu

SEQ ID NO: 703457 - RNA, 19 nt, Homo sapiens
ggaaggcugcuagggaugu

SEQ ID NO: 703458 - RNA, 19 nt, Homo sapiens
aaacugcaacacuaacuuc

SEQ ID NO: 703459 - RNA, 19 nt, Homo sapiens
gcguggugcuggagcugaa

SEQ ID NO: 703460 - RNA, 19 nt, Homo sapiens
guucuucaucugcaccaua

SEQ ID NO: 703461 - RNA, 19 nt, Homo sapiens
ugaauuccuguguugcuaa

SEQ ID NO: 703462 - RNA, 19 nt, Homo sapiens
cugugaagccuguugguuu

SEQ ID NO: 703463 - RNA, 19 nt, Homo sapiens
gguaggagcaguugaaccu

SEQ ID NO: 703464 - RNA, 19 nt, Homo sapiens
acgagaacuuuacacugaa

SEQ ID NO: 703465 - RNA, 19 nt, Homo sapiens
ggguugccauccaagugaa

SEQ ID NO: 703466 - RNA, 19 nt, Homo sapiens
gcacaggcgggaaguccau

SEQ ID NO: 703467 - RNA, 19 nt, Homo sapiens
gcucccaguucuucaucug

SEQ ID NO: 703468 - RNA, 19 nt, Homo sapiens
cacuugagcugugccuaga

SEQ ID NO: 703469 - RNA, 19 nt, Homo sapiens
ggacauggugauggugaug

SEQ ID NO: 703470 - RNA, 19 nt, Homo sapiens
ccugugcacuggugagaag

SEQ ID NO: 703471 - RNA, 19 nt, Homo sapiens
caccaacggcucccaguuc

SEQ ID NO: 703472 - RNA, 19 nt, Homo sapiens
gcauuuccugguaggcuuu

SEQ ID NO: 703473 - RNA, 19 nt, Homo sapiens
gccuagacaaugugaauuc

SEQ ID NO: 703474 - RNA, 19 nt, Homo sapiens
aguugaaccugggaacaaa

SEQ ID NO: 703475 - RNA, 19 nt, Homo sapiens
caacucagggcuuuuguga

SEQ ID NO: 703476 - RNA, 19 nt, Homo sapiens
gcuccggagggaagcauuu

SEQ ID NO: 703477 - RNA, 19 nt, Homo sapiens
gcuaaugcugguccuaaca

SEQ ID NO: 703478 - RNA, 19 nt, Homo sapiens
caugguggcagcugcaaau

SEQ ID NO: 703479 - RNA, 19 nt, Homo sapiens
cgacgucaguuugaguucu

SEQ ID NO: 703480 - RNA, 19 nt, Homo sapiens
caucugcaccauaaagaca

SEQ ID NO: 703481 - RNA, 19 nt, Homo sapiens
uucuucaucugcaccauaa

SEQ ID NO: 703482 - RNA, 19 nt, Homo sapiens
cuacucaugauguguuaug

SEQ ID NO: 703483 - RNA, 19 nt, Homo sapiens
ccccagagcuuggcuuuug

SEQ ID NO: 703484 - RNA, 19 nt, Homo sapiens
ucaagcauugccugugauu

SEQ ID NO: 703485 - RNA, 19 nt, Homo sapiens
gugccuagacaaugugaau

SEQ ID NO: 703486 - RNA, 19 nt, Homo sapiens
uugguuugcugcugucguu

SEQ ID NO: 703487 - RNA, 19 nt, Homo sapiens
ucccaaagacagcugagaa

SEQ ID NO: 703488 - RNA, 19 nt, Homo sapiens
gugaucccuuccuucaugu

SEQ ID NO: 703489 - RNA, 19 nt, Homo sapiens
aaagacagacugguuggau

SEQ ID NO: 703490 - RNA, 19 nt, Homo sapiens
caacaaugcugacuucaua

SEQ ID NO: 703491 - RNA, 19 nt, Homo sapiens
ggaaauggaugcuauucua

SEQ ID NO: 703492 - RNA, 19 nt, Homo sapiens
gaacacggcuccaucauca

SEQ ID NO: 703493 - RNA, 19 nt, Homo sapiens
gaaauauacugucucuuga

SEQ ID NO: 703494 - RNA, 19 nt, Homo sapiens
gcucuaagcugacugaguu

SEQ ID NO: 703495 - RNA, 19 nt, Homo sapiens
caaagguucuuaauaguga

SEQ ID NO: 703496 - RNA, 19 nt, Homo sapiens
gaggacagauaacugauuu

SEQ ID NO: 703497 - RNA, 19 nt, Homo sapiens
gccauuaagugucuguuua

SEQ ID NO: 703498 - RNA, 19 nt, Homo sapiens
gaagaggacagauaacuga

SEQ ID NO: 703499 - RNA, 19 nt, Homo sapiens
uaacugauuuccguucuuu

SEQ ID NO: 703500 - RNA, 19 nt, Homo sapiens
gcuuacagauucaugguuu

SEQ ID NO: 703501 - RNA, 19 nt, Homo sapiens
ggugagggaugauuguaaa

SEQ ID NO: 703502 - RNA, 19 nt, Homo sapiens
caagaggccuuauguggau

SEQ ID NO: 703503 - RNA, 19 nt, Homo sapiens
gcccaugggucccuuacua

SEQ ID NO: 703504 - RNA, 19 nt, Homo sapiens
cagcaucacugccuuaauc

SEQ ID NO: 703505 - RNA, 19 nt, Homo sapiens
gaaagaaaauccccucaga

SEQ ID NO: 703506 - RNA, 19 nt, Homo sapiens
cuagagagguugagugaau

SEQ ID NO: 703507 - RNA, 19 nt, Homo sapiens
gugcauagcuccuuuaagc

SEQ ID NO: 703508 - RNA, 19 nt, Homo sapiens
gaugaaacccuugugcaua

SEQ ID NO: 703509 - RNA, 19 nt, Homo sapiens
guuauaaggccuugucuuu

SEQ ID NO: 703510 - RNA, 19 nt, Homo sapiens
gaauuugccuucaguuaac

SEQ ID NO: 703511 - RNA, 19 nt, Homo sapiens
gcagguaucacaaagcauu

SEQ ID NO: 703512 - RNA, 19 nt, Homo sapiens
agaaauauacugucucuug

SEQ ID NO: 703513 - RNA, 19 nt, Homo sapiens
gcuaagcucgggaucauuu

SEQ ID NO: 703514 - RNA, 19 nt, Homo sapiens
acaacucgccugcuucuua

SEQ ID NO: 703515 - RNA, 19 nt, Homo sapiens
acagauucaugguuugaua

SEQ ID NO: 703516 - RNA, 19 nt, Homo sapiens
gaaccugaucccaaucuuu

SEQ ID NO: 703517 - RNA, 19 nt, Homo sapiens
aggaagugcugcuguaauu

SEQ ID NO: 703518 - RNA, 19 nt, Homo sapiens
guaccgagcucugucuguu

SEQ ID NO: 703519 - RNA, 19 nt, Homo sapiens
gaaauggaugcuauucuau

SEQ ID NO: 703520 - RNA, 19 nt, Homo sapiens
caugggaccuucuguuuag

SEQ ID NO: 703521 - RNA, 19 nt, Homo sapiens
gauccagccucaggaacua

SEQ ID NO: 703522 - RNA, 19 nt, Homo sapiens
gcgaaugccagaccaauga

SEQ ID NO: 703523 - RNA, 19 nt, Homo sapiens
ggaggaagcaaacaccauu

SEQ ID NO: 703524 - RNA, 19 nt, Homo sapiens
gagcggacccuccucuuug

SEQ ID NO: 703525 - RNA, 19 nt, Homo sapiens
gcugucggguuuccaguuu

SEQ ID NO: 703526 - RNA, 19 nt, Homo sapiens
gagccagccuagucauuau

SEQ ID NO: 703527 - RNA, 19 nt, Homo sapiens
ggccuugucuuucucuuug

SEQ ID NO: 703528 - RNA, 19 nt, Homo sapiens
gaacucauguggcauuucc

SEQ ID NO: 703529 - RNA, 19 nt, Homo sapiens
ccucagaacucuugcucuu

SEQ ID NO: 703530 - RNA, 19 nt, Homo sapiens
ggaugaaacuauugaagac

SEQ ID NO: 703531 - RNA, 19 nt, Homo sapiens
ggccuuauguggaugaguu

SEQ ID NO: 703532 - RNA, 19 nt, Homo sapiens
gcuaugggauucugacuac

SEQ ID NO: 703533 - RNA, 19 nt, Homo sapiens
gcaaggacuucuguuccaa

SEQ ID NO: 703534 - RNA, 19 nt, Homo sapiens
gauguguguuugacuguga

SEQ ID NO: 703535 - RNA, 19 nt, Homo sapiens
uauaaggccuugucuuucu

SEQ ID NO: 703536 - RNA, 19 nt, Homo sapiens
gggaugaaacuauugaaga

SEQ ID NO: 703537 - RNA, 19 nt, Homo sapiens
ccuaagagccacugaguug

SEQ ID NO: 703538 - RNA, 19 nt, Homo sapiens
ccaaugauacccagagcua

SEQ ID NO: 703539 - RNA, 19 nt, Homo sapiens
ggaacucuuugaauguguu

SEQ ID NO: 703540 - RNA, 19 nt, Homo sapiens
gagaaagguaaguccauuu

SEQ ID NO: 703541 - RNA, 19 nt, Homo sapiens
ugagaaagguaaguccauu

SEQ ID NO: 703542 - RNA, 19 nt, Homo sapiens
ccagaaauauacugucucu

SEQ ID NO: 703543 - RNA, 19 nt, Homo sapiens
gaaugaguguucuugacau

SEQ ID NO: 703544 - RNA, 19 nt, Homo sapiens
ggaagaugagaacuuguuu

SEQ ID NO: 703545 - RNA, 19 nt, Homo sapiens
gaucacauuucugggaaga

SEQ ID NO: 703546 - RNA, 19 nt, Homo sapiens
ggaucuguguggucauuga

SEQ ID NO: 703547 - RNA, 19 nt, Homo sapiens
caaacaccauugcuaaguc

SEQ ID NO: 703548 - RNA, 19 nt, Homo sapiens
aaacucaccucugguaaca

SEQ ID NO: 703549 - RNA, 19 nt, Homo sapiens
ggaggcagguaucacaaag

SEQ ID NO: 703550 - RNA, 19 nt, Homo sapiens
uuaaagucaucacgaaaug

SEQ ID NO: 703551 - RNA, 19 nt, Homo sapiens
ggaaugaguguucuugaca

SEQ ID NO: 703552 - RNA, 19 nt, Homo sapiens
gcaggacgccauuaagugu

SEQ ID NO: 703553 - RNA, 19 nt, Homo sapiens
ccaaguauaugagaaaggu

SEQ ID NO: 703554 - RNA, 19 nt, Homo sapiens
gggccugguuuguuucuga

SEQ ID NO: 703555 - RNA, 19 nt, Homo sapiens
uauaaacucaccucuggua

SEQ ID NO: 703556 - RNA, 19 nt, Homo sapiens
caaguccucuccuaagaag

SEQ ID NO: 703557 - RNA, 19 nt, Homo sapiens
gaugugaacagcuguggaa

SEQ ID NO: 703558 - RNA, 19 nt, Homo sapiens
uauacugucucuugaagga

SEQ ID NO: 703559 - RNA, 19 nt, Homo sapiens
aagaggaagugcugcugua

SEQ ID NO: 703560 - RNA, 19 nt, Homo sapiens
ggagggaccugagaaagac

SEQ ID NO: 703561 - RNA, 19 nt, Homo sapiens
aaucaacaaugcugacuuc

SEQ ID NO: 703562 - RNA, 19 nt, Homo sapiens
cuaccuugcuuacagauuc

SEQ ID NO: 703563 - RNA, 19 nt, Homo sapiens
gugaacagcuguggaaguc

SEQ ID NO: 703564 - RNA, 19 nt, Homo sapiens
cagugugucucucugauug

SEQ ID NO: 703565 - RNA, 19 nt, Homo sapiens
gcaggagcucagacucuua

SEQ ID NO: 703566 - RNA, 19 nt, Homo sapiens
guguagggaugaaacuauu

SEQ ID NO: 703567 - RNA, 19 nt, Homo sapiens
gugcaguccugguuugaug

SEQ ID NO: 703568 - RNA, 19 nt, Homo sapiens
gggagggaccugagaaaga

SEQ ID NO: 703569 - RNA, 19 nt, Homo sapiens
gaaaagacaaauccucaaa

SEQ ID NO: 703570 - RNA, 19 nt, Homo sapiens
gggaagaugagaacuuguu

SEQ ID NO: 703571 - RNA, 19 nt, Homo sapiens
ucacauuucugggaagaug

SEQ ID NO: 703572 - RNA, 19 nt, Homo sapiens
ggaaacagcgggaaguaac

SEQ ID NO: 703573 - RNA, 19 nt, Homo sapiens
caacucgccugcuucuuac

SEQ ID NO: 703574 - RNA, 19 nt, Homo sapiens
ugacuaccuugcuuacaga

SEQ ID NO: 703575 - RNA, 19 nt, Homo sapiens
gaccagagccagccuaguc

SEQ ID NO: 703576 - RNA, 19 nt, Homo sapiens
ggaagaggacagauaacug

SEQ ID NO: 703577 - RNA, 19 nt, Homo sapiens
gacaaaagaucacauuucu

SEQ ID NO: 703578 - RNA, 19 nt, Homo sapiens
gauaacugauuuccguucu

SEQ ID NO: 703579 - RNA, 19 nt, Homo sapiens
ccaccuagccauagucuca

SEQ ID NO: 703580 - RNA, 19 nt, Homo sapiens
gaaugccagaccaaugaua

SEQ ID NO: 703581 - RNA, 19 nt, Homo sapiens
ugacugggcuaugggauuc

SEQ ID NO: 703582 - RNA, 19 nt, Homo sapiens
gguccucaguggauuacuu

SEQ ID NO: 703583 - RNA, 19 nt, Homo sapiens
gaagugcugcuguaauugg

SEQ ID NO: 703584 - RNA, 19 nt, Homo sapiens
gagggaugauuguaaaauu

SEQ ID NO: 703585 - RNA, 19 nt, Homo sapiens
ccaguuucaccguguguua

SEQ ID NO: 703586 - RNA, 19 nt, Homo sapiens
gccagggucuguucuugug

SEQ ID NO: 703587 - RNA, 19 nt, Homo sapiens
gcauuugugaauugcuuua

SEQ ID NO: 703588 - RNA, 19 nt, Homo sapiens
ggugucuccugcuuacaaa

SEQ ID NO: 703589 - RNA, 19 nt, Homo sapiens
gcugaaagaccaagacucu

SEQ ID NO: 703590 - RNA, 19 nt, Homo sapiens
gcacagaaguagcugcaua

SEQ ID NO: 703591 - RNA, 19 nt, Homo sapiens
agaaguagcugcauagaaa

SEQ ID NO: 703592 - RNA, 19 nt, Homo sapiens
ggauagaaaugacugcuuu

SEQ ID NO: 703593 - RNA, 19 nt, Homo sapiens
gaaauccagucaagagaaa

SEQ ID NO: 703594 - RNA, 19 nt, Homo sapiens
gagaggagauucaagaaau

SEQ ID NO: 703595 - RNA, 19 nt, Homo sapiens
caaggcaucucaccucuuu

SEQ ID NO: 703596 - RNA, 19 nt, Homo sapiens
gacaacaggugauuucuga

SEQ ID NO: 703597 - RNA, 19 nt, Homo sapiens
agaaaugacugcuuuagaa

SEQ ID NO: 703598 - RNA, 19 nt, Homo sapiens
cagaagcacucuaauaaga

SEQ ID NO: 703599 - RNA, 19 nt, Homo sapiens
gagcucaguucuccucaaa

SEQ ID NO: 703600 - RNA, 19 nt, Homo sapiens
gaagcacucuaauaagaug

SEQ ID NO: 703601 - RNA, 19 nt, Homo sapiens
gagggugucucuugacuau

SEQ ID NO: 703602 - RNA, 19 nt, Homo sapiens
caucagaagcacucuaaua

SEQ ID NO: 703603 - RNA, 19 nt, Homo sapiens
gggaacaaauccauaagug

SEQ ID NO: 703604 - RNA, 19 nt, Homo sapiens
ccaguuguaugacuuuaaa

SEQ ID NO: 703605 - RNA, 19 nt, Homo sapiens
gcuuugaguuggacuauga

SEQ ID NO: 703606 - RNA, 19 nt, Homo sapiens
gcaacgggaugaauuugau

SEQ ID NO: 703607 - RNA, 19 nt, Homo sapiens
gggugucucuugacuauga

SEQ ID NO: 703608 - RNA, 19 nt, Homo sapiens
ccacacggcugacccugaa

SEQ ID NO: 703609 - RNA, 19 nt, Homo sapiens
agagggagaugaagauguu

SEQ ID NO: 703610 - RNA, 19 nt, Homo sapiens
gaggaaguuucuagaggaa

SEQ ID NO: 703611 - RNA, 19 nt, Homo sapiens
ggggagaucugccgguuua

SEQ ID NO: 703612 - RNA, 19 nt, Homo sapiens
ggaaguuucuagaggaaca

SEQ ID NO: 703613 - RNA, 19 nt, Homo sapiens
ccaauaauguuagaguuca

SEQ ID NO: 703614 - RNA, 19 nt, Homo sapiens
uugaagaacuggaggagaa

SEQ ID NO: 703615 - RNA, 19 nt, Homo sapiens
gaagucagaagaccugguu

SEQ ID NO: 703616 - RNA, 19 nt, Homo sapiens
acacguggguggugaguau

SEQ ID NO: 703617 - RNA, 19 nt, Homo sapiens
gauagaaaugacugcuuua

SEQ ID NO: 703618 - RNA, 19 nt, Homo sapiens
cuagaaccauuuaguuugu

SEQ ID NO: 703619 - RNA, 19 nt, Homo sapiens
gaaaugacugcuuuagaag

SEQ ID NO: 703620 - RNA, 19 nt, Homo sapiens
uggcagaacucaccagaca

SEQ ID NO: 703621 - RNA, 19 nt, Homo sapiens
gacaucagaagcacucuaa

SEQ ID NO: 703622 - RNA, 19 nt, Homo sapiens
guuuagugcucuuauugaa

SEQ ID NO: 703623 - RNA, 19 nt, Homo sapiens
ugagggagccggucacuau

SEQ ID NO: 703624 - RNA, 19 nt, Homo sapiens
caagaaauccagucaagag

SEQ ID NO: 703625 - RNA, 19 nt, Homo sapiens
ggaacaaauccauaagugu

SEQ ID NO: 703626 - RNA, 19 nt, Homo sapiens
gaggcaacgggaugaauuu

SEQ ID NO: 703627 - RNA, 19 nt, Homo sapiens
gcagagagaguggccuuga

SEQ ID NO: 703628 - RNA, 19 nt, Homo sapiens
ggaugacucgggauagaaa

SEQ ID NO: 703629 - RNA, 19 nt, Homo sapiens
ggacucauucaacccagua

SEQ ID NO: 703630 - RNA, 19 nt, Homo sapiens
gagaaggagcaguuaccua

SEQ ID NO: 703631 - RNA, 19 nt, Homo sapiens
cuaauaagaugugaaacca

SEQ ID NO: 703632 - RNA, 19 nt, Homo sapiens
cagcucacauuucucuaga

SEQ ID NO: 703633 - RNA, 19 nt, Homo sapiens
ccagaggauucgggacuuu

SEQ ID NO: 703634 - RNA, 19 nt, Homo sapiens
gagagaggagauucaagaa

SEQ ID NO: 703635 - RNA, 19 nt, Homo sapiens
gaacuggaggagaagaaug

SEQ ID NO: 703636 - RNA, 19 nt, Homo sapiens
gagcccaucuacaccuuca

SEQ ID NO: 703637 - RNA, 19 nt, Homo sapiens
gagagcccaucuacaccuu

SEQ ID NO: 703638 - RNA, 19 nt, Homo sapiens
ugaauuugauuugcugguu

SEQ ID NO: 703639 - RNA, 19 nt, Homo sapiens
caagagacaacaggugauu

SEQ ID NO: 703640 - RNA, 19 nt, Homo sapiens
ccaacuggcagcuggcuaa

SEQ ID NO: 703641 - RNA, 19 nt, Homo sapiens
ccauuuaguuuguguuaac

SEQ ID NO: 703642 - RNA, 19 nt, Homo sapiens
uguuagaguucauguaauc

SEQ ID NO: 703643 - RNA, 19 nt, Homo sapiens
uaccuacucuccucuaagu

SEQ ID NO: 703644 - RNA, 19 nt, Homo sapiens
uggcuaacgugguggagaa

SEQ ID NO: 703645 - RNA, 19 nt, Homo sapiens
gcacucuaauaagauguga

SEQ ID NO: 703646 - RNA, 19 nt, Homo sapiens
ucgcacaccugaggaaguu

SEQ ID NO: 703647 - RNA, 19 nt, Homo sapiens
guuaccuacucuccucuaa

SEQ ID NO: 703648 - RNA, 19 nt, Homo sapiens
ggacaucagaagcacucua

SEQ ID NO: 703649 - RNA, 19 nt, Homo sapiens
agagagaggagauucaaga

SEQ ID NO: 703650 - RNA, 19 nt, Homo sapiens
ucaaucuacugaucaaguc

SEQ ID NO: 703651 - RNA, 19 nt, Homo sapiens
gaagucaacugccccaucu

SEQ ID NO: 703652 - RNA, 19 nt, Homo sapiens
cgacugcggccacaacuuc

SEQ ID NO: 703653 - RNA, 19 nt, Homo sapiens
gagaucugccgguuuagug

SEQ ID NO: 703654 - RNA, 19 nt, Homo sapiens
caacaggugauuucugagu

SEQ ID NO: 703655 - RNA, 19 nt, Homo sapiens
aaugacugcuuuagaagau

SEQ ID NO: 703656 - RNA, 19 nt, Homo sapiens
ucccugagcuccugagaag

SEQ ID NO: 703657 - RNA, 19 nt, Homo sapiens
gcucaguucuccucaaaau

SEQ ID NO: 703658 - RNA, 19 nt, Homo sapiens
uaagaugugaaaccagaaa

SEQ ID NO: 703659 - RNA, 19 nt, Homo sapiens
aucagaagcacucuaauaa

SEQ ID NO: 703660 - RNA, 19 nt, Homo sapiens
gagcauccucuuagcacaa

SEQ ID NO: 703661 - RNA, 19 nt, Homo sapiens
uagaaaugacugcuuuaga

SEQ ID NO: 703662 - RNA, 19 nt, Homo sapiens
gcagaacucaccagacaac

SEQ ID NO: 703663 - RNA, 19 nt, Homo sapiens
gggaugaauuugauuugcu

SEQ ID NO: 703664 - RNA, 19 nt, Homo sapiens
ggaugcagcggcucccuau

SEQ ID NO: 703665 - RNA, 19 nt, Homo sapiens
ucuagaaccauuuaguuug

SEQ ID NO: 703666 - RNA, 19 nt, Homo sapiens
cagaaguagcugcauagaa

SEQ ID NO: 703667 - RNA, 19 nt, Homo sapiens
gaugugaaaccagaaagug

SEQ ID NO: 703668 - RNA, 19 nt, Homo sapiens
ccaguaccauguggcuuga

SEQ ID NO: 703669 - RNA, 19 nt, Homo sapiens
gaugaagauguuucuggaa

SEQ ID NO: 703670 - RNA, 19 nt, Homo sapiens
gaaaagagagagaggagau

SEQ ID NO: 703671 - RNA, 19 nt, Homo sapiens
cuaaguacaggacucauuc

SEQ ID NO: 703672 - RNA, 19 nt, Homo sapiens
caggugagggugucucuug

SEQ ID NO: 703673 - RNA, 19 nt, Homo sapiens
ugaggcaacgggaugaauu

SEQ ID NO: 703674 - RNA, 19 nt, Homo sapiens
gcacaccugaggaaguuuc

SEQ ID NO: 703675 - RNA, 19 nt, Homo sapiens
agaaauccagucaagagaa

SEQ ID NO: 703676 - RNA, 19 nt, Homo sapiens
gggagccggucacuaucga

SEQ ID NO: 703677 - RNA, 19 nt, Homo sapiens
ggccgaggguccaguuucu

SEQ ID NO: 703678 - RNA, 19 nt, Homo sapiens
agaucuacuucuucuguga

SEQ ID NO: 703679 - RNA, 19 nt, Homo sapiens
caacgggaugaauuugauu

SEQ ID NO: 703680 - RNA, 19 nt, Homo sapiens
auagggaacaaauccauaa

SEQ ID NO: 703681 - RNA, 19 nt, Homo sapiens
uauagggaacaaauccaua

SEQ ID NO: 703682 - RNA, 19 nt, Homo sapiens
ggugguaagggauagaaga

SEQ ID NO: 703683 - RNA, 19 nt, Homo sapiens
augaugagaugcaguugug

SEQ ID NO: 703684 - RNA, 19 nt, Homo sapiens
gaagaacuggaggagaaga

SEQ ID NO: 703685 - RNA, 19 nt, Homo sapiens
gguuuagugcucuuauuga

SEQ ID NO: 703686 - RNA, 19 nt, Homo sapiens
ggcaacgggaugaauuuga

SEQ ID NO: 703687 - RNA, 19 nt, Homo sapiens
acaggugauuucugaguuc

SEQ ID NO: 703688 - RNA, 19 nt, Homo sapiens
uagaguucauguaaucaca

SEQ ID NO: 703689 - RNA, 19 nt, Homo sapiens
gaaguagcugcauagaaag

SEQ ID NO: 703690 - RNA, 19 nt, Homo sapiens
gaaauugucuuccugauca

SEQ ID NO: 703691 - RNA, 19 nt, Homo sapiens
gcaaaugggucacaaauag

SEQ ID NO: 703692 - RNA, 19 nt, Homo sapiens
ugacuuggauucagaaaua

SEQ ID NO: 703693 - RNA, 19 nt, Homo sapiens
gcacagaaguagcugcaua

SEQ ID NO: 703694 - RNA, 19 nt, Homo sapiens
agaaguagcugcauagaaa

SEQ ID NO: 703695 - RNA, 19 nt, Homo sapiens
gagaggagauucaagaaau

SEQ ID NO: 703696 - RNA, 19 nt, Homo sapiens
caaggcaucucaccucuuu

SEQ ID NO: 703697 - RNA, 19 nt, Homo sapiens
gacaacaggugauuucuga

SEQ ID NO: 703698 - RNA, 19 nt, Homo sapiens
uaaguuggaugaccuauga

SEQ ID NO: 703699 - RNA, 19 nt, Homo sapiens
cagaagcacucuaauaaga

SEQ ID NO: 703700 - RNA, 19 nt, Homo sapiens
gacauaagguauagccaua

SEQ ID NO: 703701 - RNA, 19 nt, Homo sapiens
caucugaggucaagaaaug

SEQ ID NO: 703702 - RNA, 19 nt, Homo sapiens
acacacaagugccuauaua

SEQ ID NO: 703703 - RNA, 19 nt, Homo sapiens
gaucagaagccagggauua

SEQ ID NO: 703704 - RNA, 19 nt, Homo sapiens
caagaaauccagucaagaa

SEQ ID NO: 703705 - RNA, 19 nt, Homo sapiens
gcacuggguugucuccauu

SEQ ID NO: 703706 - RNA, 19 nt, Homo sapiens
aaagagcacuggauuugaa

SEQ ID NO: 703707 - RNA, 19 nt, Homo sapiens
gaagcacucuaauaagaug

SEQ ID NO: 703708 - RNA, 19 nt, Homo sapiens
acaagugccuauauaauga

SEQ ID NO: 703709 - RNA, 19 nt, Homo sapiens
caucagaagcacucuaaua

SEQ ID NO: 703710 - RNA, 19 nt, Homo sapiens
gggaacaaauccauaagug

SEQ ID NO: 703711 - RNA, 19 nt, Homo sapiens
gcucagaaacugcuaggua

SEQ ID NO: 703712 - RNA, 19 nt, Homo sapiens
ccaguuguaugacuuuaaa

SEQ ID NO: 703713 - RNA, 19 nt, Homo sapiens
gguauagccauaaaucaua

SEQ ID NO: 703714 - RNA, 19 nt, Homo sapiens
gcuuugaguuggacuauga

SEQ ID NO: 703715 - RNA, 19 nt, Homo sapiens
gcaacgggaugaauuugau

SEQ ID NO: 703716 - RNA, 19 nt, Homo sapiens
gagcucaguucuccuacaa

SEQ ID NO: 703717 - RNA, 19 nt, Homo sapiens
cauaagguauagccauaaa

SEQ ID NO: 703718 - RNA, 19 nt, Homo sapiens
gcucaguucuccuacaaau

SEQ ID NO: 703719 - RNA, 19 nt, Homo sapiens
gcaaccaguucauccaugu

SEQ ID NO: 703720 - RNA, 19 nt, Homo sapiens
aaacuacaaugcucuguca

SEQ ID NO: 703721 - RNA, 19 nt, Homo sapiens
gaauugagacuaccguaau

SEQ ID NO: 703722 - RNA, 19 nt, Homo sapiens
gaaggaggccagggcauaa

SEQ ID NO: 703723 - RNA, 19 nt, Homo sapiens
gaaagagcacuggauuuga

SEQ ID NO: 703724 - RNA, 19 nt, Homo sapiens
agagggagaugaagauguu

SEQ ID NO: 703725 - RNA, 19 nt, Homo sapiens
gaggaaguuucuagaggaa

SEQ ID NO: 703726 - RNA, 19 nt, Homo sapiens
ggggagaucugccgguuua

SEQ ID NO: 703727 - RNA, 19 nt, Homo sapiens
ggaaguuucuagaggaaca

SEQ ID NO: 703728 - RNA, 19 nt, Homo sapiens
ugucuuacacugagaaaua

SEQ ID NO: 703729 - RNA, 19 nt, Homo sapiens
gggauuagagauugaauug

SEQ ID NO: 703730 - RNA, 19 nt, Homo sapiens
guucuguuguucauccuua

SEQ ID NO: 703731 - RNA, 19 nt, Homo sapiens
gauuagagauugaauugcu

SEQ ID NO: 703732 - RNA, 19 nt, Homo sapiens
ccaauaauguuagaguuca

SEQ ID NO: 703733 - RNA, 19 nt, Homo sapiens
uugaagaacuggaggagaa

SEQ ID NO: 703734 - RNA, 19 nt, Homo sapiens
gaaaagagguggagaucag

SEQ ID NO: 703735 - RNA, 19 nt, Homo sapiens
ggacuauuauccucuaaaa

SEQ ID NO: 703736 - RNA, 19 nt, Homo sapiens
gagcaaaugggucacaaau

SEQ ID NO: 703737 - RNA, 19 nt, Homo sapiens
aaacugcucauaagugaaa

SEQ ID NO: 703738 - RNA, 19 nt, Homo sapiens
uaaaacugcucauaaguga

SEQ ID NO: 703739 - RNA, 19 nt, Homo sapiens
guagugacaucugagaaau

SEQ ID NO: 703740 - RNA, 19 nt, Homo sapiens
cuagaaccauuuaguuugu

SEQ ID NO: 703741 - RNA, 19 nt, Homo sapiens
gcauggguccuggcgauua

SEQ ID NO: 703742 - RNA, 19 nt, Homo sapiens
gagacuaccguaauugaga

SEQ ID NO: 703743 - RNA, 19 nt, Homo sapiens
cucagaaacugcuagguaa

SEQ ID NO: 703744 - RNA, 19 nt, Homo sapiens
ugagggagccggucacuau

SEQ ID NO: 703745 - RNA, 19 nt, Homo sapiens
uggcagaacucaccagaca

SEQ ID NO: 703746 - RNA, 19 nt, Homo sapiens
gacaucagaagcacucuaa

SEQ ID NO: 703747 - RNA, 19 nt, Homo sapiens
guuuagugcucuuauugaa

SEQ ID NO: 703748 - RNA, 19 nt, Homo sapiens
agaaagagcacuggauuug

SEQ ID NO: 703749 - RNA, 19 nt, Homo sapiens
ggcccaagcuuagaauuca

SEQ ID NO: 703750 - RNA, 19 nt, Homo sapiens
uaaaagaauuccagaagga

SEQ ID NO: 703751 - RNA, 19 nt, Homo sapiens
ggaacaaauccauaagugu

SEQ ID NO: 703752 - RNA, 19 nt, Homo sapiens
cacaagugccuauauaaug

SEQ ID NO: 703753 - RNA, 19 nt, Homo sapiens
gacagucuccuuaacauca

SEQ ID NO: 703754 - RNA, 19 nt, Homo sapiens
gaggcaacgggaugaauuu

SEQ ID NO: 703755 - RNA, 19 nt, Homo sapiens
gcagagagaguggccuuga

SEQ ID NO: 703756 - RNA, 19 nt, Homo sapiens
gguggccacuggugacuug

SEQ ID NO: 703757 - RNA, 19 nt, Homo sapiens
cuaauaagaugugaaacca

SEQ ID NO: 703758 - RNA, 19 nt, Homo sapiens
cagcucacauuucucuaga

SEQ ID NO: 703759 - RNA, 19 nt, Homo sapiens
ccagaggauucgggacuuu

SEQ ID NO: 703760 - RNA, 19 nt, Homo sapiens
gagagaggagauucaagaa

SEQ ID NO: 703761 - RNA, 19 nt, Homo sapiens
gucaagaaaugagauagug

SEQ ID NO: 703762 - RNA, 19 nt, Homo sapiens
caggaggacauaagguaua

SEQ ID NO: 703763 - RNA, 19 nt, Homo sapiens
ggcaggaggacauaaggua

SEQ ID NO: 703764 - RNA, 19 nt, Homo sapiens
ggccacuggugacuugaaa

SEQ ID NO: 703765 - RNA, 19 nt, Homo sapiens
gaacuggaggagaagaaug

SEQ ID NO: 703766 - RNA, 19 nt, Homo sapiens
cauccagggugcaaacuca

SEQ ID NO: 703767 - RNA, 19 nt, Homo sapiens
gaaaagaggggaagaagca

SEQ ID NO: 703768 - RNA, 19 nt, Homo sapiens
ugaauuugauuugcugguu

SEQ ID NO: 703769 - RNA, 19 nt, Homo sapiens
caagagacaacaggugauu

SEQ ID NO: 703770 - RNA, 19 nt, Homo sapiens
gucuuacacugagaaauaa

SEQ ID NO: 703771 - RNA, 19 nt, Homo sapiens
caggugacuuggauucaga

SEQ ID NO: 703772 - RNA, 19 nt, Homo sapiens
ccaacuggcagcuggcuaa

SEQ ID NO: 703773 - RNA, 19 nt, Homo sapiens
uaagguauagccauaaauc

SEQ ID NO: 703774 - RNA, 19 nt, Homo sapiens
gcaggaggacauaagguau

SEQ ID NO: 703775 - RNA, 19 nt, Homo sapiens
uggcuaacgugguggagaa

SEQ ID NO: 703776 - RNA, 19 nt, Homo sapiens
gcucagcugugggcucaga

SEQ ID NO: 703777 - RNA, 19 nt, Homo sapiens
ccacuucugggugagauua

SEQ ID NO: 703778 - RNA, 19 nt, Homo sapiens
ccauuuaguuuguguuaac

SEQ ID NO: 703779 - RNA, 19 nt, Homo sapiens
uguuagaguucauguaauc

SEQ ID NO: 703780 - RNA, 19 nt, Homo sapiens
gcacucuaauaagauguga

SEQ ID NO: 703781 - RNA, 19 nt, Homo sapiens
ucgcacaccugaggaaguu

SEQ ID NO: 703782 - RNA, 19 nt, Homo sapiens
cuacaaugcucugucaucu

SEQ ID NO: 703783 - RNA, 19 nt, Homo sapiens
ucuaaagaauugagacuac

SEQ ID NO: 703784 - RNA, 19 nt, Homo sapiens
gcugugggcucagaaacug

SEQ ID NO: 703785 - RNA, 19 nt, Homo sapiens
gaggucaagaaaugagaua

SEQ ID NO: 703786 - RNA, 19 nt, Homo sapiens
ggacaucagaagcacucua

SEQ ID NO: 703787 - RNA, 19 nt, Homo sapiens
agagagaggagauucaaga

SEQ ID NO: 703788 - RNA, 19 nt, Homo sapiens
guaacgagccaagaucaug

SEQ ID NO: 703789 - RNA, 19 nt, Homo sapiens
agugugcaguaucucauua

SEQ ID NO: 703790 - RNA, 19 nt, Homo sapiens
guaaugaguugcaggauaa

SEQ ID NO: 703791 - RNA, 19 nt, Homo sapiens
gaaguaacauuugcagauu

SEQ ID NO: 703792 - RNA, 19 nt, Homo sapiens
gcaucaagcuggcauguug

SEQ ID NO: 703793 - RNA, 19 nt, Homo sapiens
gguaaugaguugcaggaua

SEQ ID NO: 703794 - RNA, 19 nt, Homo sapiens
gcaggauaaugcagucaua

SEQ ID NO: 703795 - RNA, 19 nt, Homo sapiens
ggagagaacagggcaguua

SEQ ID NO: 703796 - RNA, 19 nt, Homo sapiens
guacgggaguuucuuggua

SEQ ID NO: 703797 - RNA, 19 nt, Homo sapiens
gcugaugaguuauuaaaga

SEQ ID NO: 703798 - RNA, 19 nt, Homo sapiens
ccauguauguugagucuaa

SEQ ID NO: 703799 - RNA, 19 nt, Homo sapiens
gaaacgagcugugcuugca

SEQ ID NO: 703800 - RNA, 19 nt, Homo sapiens
aaacaaaccggaagcagua

SEQ ID NO: 703801 - RNA, 19 nt, Homo sapiens
gaugagaccauguauguug

SEQ ID NO: 703802 - RNA, 19 nt, Homo sapiens
acagggcaguuauccauua

SEQ ID NO: 703803 - RNA, 19 nt, Homo sapiens
gaacagggcaguuauccau

SEQ ID NO: 703804 - RNA, 19 nt, Homo sapiens
caaugucucuuugcuauau

SEQ ID NO: 703805 - RNA, 19 nt, Homo sapiens
gaacacuugcuacuggaua

SEQ ID NO: 703806 - RNA, 19 nt, Homo sapiens
ugacaacauuggcuacauu

SEQ ID NO: 703807 - RNA, 19 nt, Homo sapiens
acauggugcugaugaguua

SEQ ID NO: 703808 - RNA, 19 nt, Homo sapiens
ucauaguucccaagaauua

SEQ ID NO: 703809 - RNA, 19 nt, Homo sapiens
gggcaguuauccauuauag

SEQ ID NO: 703810 - RNA, 19 nt, Homo sapiens
cuuaagggauucuccguuu

SEQ ID NO: 703811 - RNA, 19 nt, Homo sapiens
gcucuaaggccuauauuca

SEQ ID NO: 703812 - RNA, 19 nt, Homo sapiens
uacaaugucucuuugcuau

SEQ ID NO: 703813 - RNA, 19 nt, Homo sapiens
aaagugauggucaguauuu

SEQ ID NO: 703814 - RNA, 19 nt, Homo sapiens
gacaacauuggcuacauua

SEQ ID NO: 703815 - RNA, 19 nt, Homo sapiens
gauaaugcagucauaacuu

SEQ ID NO: 703816 - RNA, 19 nt, Homo sapiens
ggacagagucacaguaguc

SEQ ID NO: 703817 - RNA, 19 nt, Homo sapiens
gaccauguauguugagucu

SEQ ID NO: 703818 - RNA, 19 nt, Homo sapiens
gaauuccacuugaucaacu

SEQ ID NO: 703819 - RNA, 19 nt, Homo sapiens
gagcugugcuugcaaagac

SEQ ID NO: 703820 - RNA, 19 nt, Homo sapiens
gauggucaguauuucuuug

SEQ ID NO: 703821 - RNA, 19 nt, Homo sapiens
auaaugcagucauaacuug

SEQ ID NO: 703822 - RNA, 19 nt, Homo sapiens
guacacguuuggaaaauaa

SEQ ID NO: 703823 - RNA, 19 nt, Homo sapiens
gcaguagaaguaacauuug

SEQ ID NO: 703824 - RNA, 19 nt, Homo sapiens
caaaagugauggucaguau

SEQ ID NO: 703825 - RNA, 19 nt, Homo sapiens
aaacuccuguaucuaaaga

SEQ ID NO: 703826 - RNA, 19 nt, Homo sapiens
cuucauaguucccaagaau

SEQ ID NO: 703827 - RNA, 19 nt, Homo sapiens
caggauacaaugucucuuu

SEQ ID NO: 703828 - RNA, 19 nt, Homo sapiens
gguccucuaucauauuuca

SEQ ID NO: 703829 - RNA, 19 nt, Homo sapiens
ugcaaagacuucauaguuc

SEQ ID NO: 703830 - RNA, 19 nt, Homo sapiens
ccaagaagagggcaaggaa

SEQ ID NO: 703831 - RNA, 19 nt, Homo sapiens
gggaugaugagaccaugua

SEQ ID NO: 703832 - RNA, 19 nt, Homo sapiens
ggaagcaguagaaguaaca

SEQ ID NO: 703833 - RNA, 19 nt, Homo sapiens
gaaucaggauacaaugucu

SEQ ID NO: 703834 - RNA, 19 nt, Homo sapiens
gaaauucuacaaggaacuu

SEQ ID NO: 703835 - RNA, 19 nt, Homo sapiens
uaucuucccucccucacuu

SEQ ID NO: 703836 - RNA, 19 nt, Homo sapiens
uugcaaagacuucauaguu

SEQ ID NO: 703837 - RNA, 19 nt, Homo sapiens
gcagaaacgagcugugcuu

SEQ ID NO: 703838 - RNA, 19 nt, Homo sapiens
gggacuaccugcacuacca

SEQ ID NO: 703839 - RNA, 19 nt, Homo sapiens
gaaauuguuuugccucugu

SEQ ID NO: 703840 - RNA, 19 nt, Homo sapiens
ucaaaacuccuguaucuaa

SEQ ID NO: 703841 - RNA, 19 nt, Homo sapiens
uacgggaguuucuugguaa

SEQ ID NO: 703842 - RNA, 19 nt, Homo sapiens
guucaaaacuccuguaucu

SEQ ID NO: 703843 - RNA, 19 nt, Homo sapiens
gauacaaugucucuuugcu

SEQ ID NO: 703844 - RNA, 19 nt, Homo sapiens
caaaacuccuguaucuaaa

SEQ ID NO: 703845 - RNA, 19 nt, Homo sapiens
caagugcucuaaggccuau

SEQ ID NO: 703846 - RNA, 19 nt, Homo sapiens
gagagaacagggcaguuau

SEQ ID NO: 703847 - RNA, 19 nt, Homo sapiens
gggaguuucuugguaaauc

SEQ ID NO: 703848 - RNA, 19 nt, Homo sapiens
ccacuugaucaacuuaauu

SEQ ID NO: 703849 - RNA, 19 nt, Homo sapiens
ggaaaauaaucugcagaaa

SEQ ID NO: 703850 - RNA, 19 nt, Homo sapiens
gugcugaugaguuauuaaa

SEQ ID NO: 703851 - RNA, 19 nt, Homo sapiens
ucuaaggccuauauucaca

SEQ ID NO: 703852 - RNA, 19 nt, Homo sapiens
agaaguaacauuugcagau

SEQ ID NO: 703853 - RNA, 19 nt, Homo sapiens
ggauaaugcagucauaacu

SEQ ID NO: 703854 - RNA, 19 nt, Homo sapiens
gcuguuucgcuuugcaaua

SEQ ID NO: 703855 - RNA, 19 nt, Homo sapiens
cagggcaguuauccauuau

SEQ ID NO: 703856 - RNA, 19 nt, Homo sapiens
gaugggguccucuaucaua

SEQ ID NO: 703857 - RNA, 19 nt, Homo sapiens
aaaauaaucugcagaaacg

SEQ ID NO: 703858 - RNA, 19 nt, Homo sapiens
gaggugaacaaccgcauca

SEQ ID NO: 703859 - RNA, 19 nt, Homo sapiens
caaaccggaagcaguagaa

SEQ ID NO: 703860 - RNA, 19 nt, Homo sapiens
aguaacauuugcagauuuc

SEQ ID NO: 703861 - RNA, 19 nt, Homo sapiens
acuccuguaucuaaagaaa

SEQ ID NO: 703862 - RNA, 19 nt, Homo sapiens
gaaaauaaucugcagaaac

SEQ ID NO: 703863 - RNA, 19 nt, Homo sapiens
ggauaaucguagcuuuuaa

SEQ ID NO: 703864 - RNA, 19 nt, Homo sapiens
aacacuugcuacuggauaa

SEQ ID NO: 703865 - RNA, 19 nt, Homo sapiens
aggauacaaugucucuuug

SEQ ID NO: 703866 - RNA, 19 nt, Homo sapiens
ucuccuaaguauuugaguu

SEQ ID NO: 703867 - RNA, 19 nt, Homo sapiens
cuguuucgcuuugcaauau

SEQ ID NO: 703868 - RNA, 19 nt, Homo sapiens
aaagaauuccacuugauca

SEQ ID NO: 703869 - RNA, 19 nt, Homo sapiens
uaccugcacuaccacauca

SEQ ID NO: 703870 - RNA, 19 nt, Homo sapiens
cagagucacaguagucuuc

SEQ ID NO: 703871 - RNA, 19 nt, Homo sapiens
aaaggacagagucacagua

SEQ ID NO: 703872 - RNA, 19 nt, Homo sapiens
gaugaugagaccauguaug

SEQ ID NO: 703873 - RNA, 19 nt, Homo sapiens
agcaguagaaguaacauuu

SEQ ID NO: 703874 - RNA, 19 nt, Homo sapiens
gggguccucuaucauauuu

SEQ ID NO: 703875 - RNA, 19 nt, Homo sapiens
uguugaagcgaaauuguuu

SEQ ID NO: 703876 - RNA, 19 nt, Homo sapiens
gcuuugcaauauauuacug

SEQ ID NO: 703877 - RNA, 19 nt, Homo sapiens
ggagacaaaacaaaaguga

SEQ ID NO: 703878 - RNA, 19 nt, Homo sapiens
uaaggccuauauucacaca

SEQ ID NO: 703879 - RNA, 19 nt, Homo sapiens
uuggaaagguguucaugca

SEQ ID NO: 703880 - RNA, 19 nt, Homo sapiens
accggaagcaguagaagua

SEQ ID NO: 703881 - RNA, 19 nt, Homo sapiens
caggauaaugcagucauaa

SEQ ID NO: 703882 - RNA, 19 nt, Homo sapiens
cgucugacuuccucaaggu

SEQ ID NO: 703883 - RNA, 19 nt, Homo sapiens
cacaucaagugcucuaagg

SEQ ID NO: 703884 - RNA, 19 nt, Homo sapiens
ucaaccugauccacacguu

SEQ ID NO: 703885 - RNA, 19 nt, Homo sapiens
cugaugaguuauuaaagag

SEQ ID NO: 703886 - RNA, 19 nt, Homo sapiens
acgauguggucauuggaaa

SEQ ID NO: 703887 - RNA, 19 nt, Homo sapiens
ggaguuucuugguaaaucc

SEQ ID NO: 703888 - RNA, 19 nt, Homo sapiens
caguagaaguaacauuugc

SEQ ID NO: 703889 - RNA, 19 nt, Homo sapiens
gacgauguggucauuggaa

SEQ ID NO: 703890 - RNA, 19 nt, Homo sapiens
guaaugaguugcaggauaa

SEQ ID NO: 703891 - RNA, 19 nt, Homo sapiens
gaaguaacauuugcagauu

SEQ ID NO: 703892 - RNA, 19 nt, Homo sapiens
gcaucaagcuggcauguug

SEQ ID NO: 703893 - RNA, 19 nt, Homo sapiens
gguaaugaguugcaggaua

SEQ ID NO: 703894 - RNA, 19 nt, Homo sapiens
gcaggauaaugcagucaua

SEQ ID NO: 703895 - RNA, 19 nt, Homo sapiens
ggagagaacagggcaguua

SEQ ID NO: 703896 - RNA, 19 nt, Homo sapiens
guacgggaguuucuuggua

SEQ ID NO: 703897 - RNA, 19 nt, Homo sapiens
gcugaugaguuauuaaaga

SEQ ID NO: 703898 - RNA, 19 nt, Homo sapiens
ccauguauguugagucuaa

SEQ ID NO: 703899 - RNA, 19 nt, Homo sapiens
gaaacgagcugugcuugca

SEQ ID NO: 703900 - RNA, 19 nt, Homo sapiens
aaacaaaccggaagcagua

SEQ ID NO: 703901 - RNA, 19 nt, Homo sapiens
gaugagaccauguauguug

SEQ ID NO: 703902 - RNA, 19 nt, Homo sapiens
acagggcaguuauccauua

SEQ ID NO: 703903 - RNA, 19 nt, Homo sapiens
gaacagggcaguuauccau

SEQ ID NO: 703904 - RNA, 19 nt, Homo sapiens
caaugucucuuugcuauau

SEQ ID NO: 703905 - RNA, 19 nt, Homo sapiens
gaacacuugcuacuggaua

SEQ ID NO: 703906 - RNA, 19 nt, Homo sapiens
ugacaacauuggcuacauu

SEQ ID NO: 703907 - RNA, 19 nt, Homo sapiens
acauggugcugaugaguua

SEQ ID NO: 703908 - RNA, 19 nt, Homo sapiens
ucauaguucccaagaauua

SEQ ID NO: 703909 - RNA, 19 nt, Homo sapiens
gggcaguuauccauuauag

SEQ ID NO: 703910 - RNA, 19 nt, Homo sapiens
cuuaagggauucuccguuu

SEQ ID NO: 703911 - RNA, 19 nt, Homo sapiens
gcucuaaggccuauauuca

SEQ ID NO: 703912 - RNA, 19 nt, Homo sapiens
uacaaugucucuuugcuau

SEQ ID NO: 703913 - RNA, 19 nt, Homo sapiens
aaagugauggucaguauuu

SEQ ID NO: 703914 - RNA, 19 nt, Homo sapiens
gacaacauuggcuacauua

SEQ ID NO: 703915 - RNA, 19 nt, Homo sapiens
gauaaugcagucauaacuu

SEQ ID NO: 703916 - RNA, 19 nt, Homo sapiens
ggacagagucacaguaguc

SEQ ID NO: 703917 - RNA, 19 nt, Homo sapiens
gaccauguauguugagucu

SEQ ID NO: 703918 - RNA, 19 nt, Homo sapiens
gaauuccacuugaucaacu

SEQ ID NO: 703919 - RNA, 19 nt, Homo sapiens
gagcugugcuugcaaagac

SEQ ID NO: 703920 - RNA, 19 nt, Homo sapiens
gauggucaguauuucuuug

SEQ ID NO: 703921 - RNA, 19 nt, Homo sapiens
auaaugcagucauaacuug

SEQ ID NO: 703922 - RNA, 19 nt, Homo sapiens
gcaguagaaguaacauuug

SEQ ID NO: 703923 - RNA, 19 nt, Homo sapiens
guacacguuuggaaaauaa

SEQ ID NO: 703924 - RNA, 19 nt, Homo sapiens
caaaagugauggucaguau

SEQ ID NO: 703925 - RNA, 19 nt, Homo sapiens
aaacuccuguaucuaaaga

SEQ ID NO: 703926 - RNA, 19 nt, Homo sapiens
cuucauaguucccaagaau

SEQ ID NO: 703927 - RNA, 19 nt, Homo sapiens
caggauacaaugucucuuu

SEQ ID NO: 703928 - RNA, 19 nt, Homo sapiens
gguccucuaucauauuuca

SEQ ID NO: 703929 - RNA, 19 nt, Homo sapiens
ugcaaagacuucauaguuc

SEQ ID NO: 703930 - RNA, 19 nt, Homo sapiens
ccaagaagagggcaaggaa

SEQ ID NO: 703931 - RNA, 19 nt, Homo sapiens
gggaugaugagaccaugua

SEQ ID NO: 703932 - RNA, 19 nt, Homo sapiens
ggaagcaguagaaguaaca

SEQ ID NO: 703933 - RNA, 19 nt, Homo sapiens
gaaucaggauacaaugucu

SEQ ID NO: 703934 - RNA, 19 nt, Homo sapiens
gaaauucuacaaggaacuu

SEQ ID NO: 703935 - RNA, 19 nt, Homo sapiens
uaucuucccucccucacuu

SEQ ID NO: 703936 - RNA, 19 nt, Homo sapiens
uugcaaagacuucauaguu

SEQ ID NO: 703937 - RNA, 19 nt, Homo sapiens
gcagaaacgagcugugcuu

SEQ ID NO: 703938 - RNA, 19 nt, Homo sapiens
gggacuaccugcacuacca

SEQ ID NO: 703939 - RNA, 19 nt, Homo sapiens
gaaauuguuuugccucugu

SEQ ID NO: 703940 - RNA, 19 nt, Homo sapiens
ucaaaacuccuguaucuaa

SEQ ID NO: 703941 - RNA, 19 nt, Homo sapiens
uacgggaguuucuugguaa

SEQ ID NO: 703942 - RNA, 19 nt, Homo sapiens
guucaaaacuccuguaucu

SEQ ID NO: 703943 - RNA, 19 nt, Homo sapiens
gauacaaugucucuuugcu

SEQ ID NO: 703944 - RNA, 19 nt, Homo sapiens
caaaacuccuguaucuaaa

SEQ ID NO: 703945 - RNA, 19 nt, Homo sapiens
caagugcucuaaggccuau

SEQ ID NO: 703946 - RNA, 19 nt, Homo sapiens
gagagaacagggcaguuau

SEQ ID NO: 703947 - RNA, 19 nt, Homo sapiens
gggaguuucuugguaaauc

SEQ ID NO: 703948 - RNA, 19 nt, Homo sapiens
ccacuugaucaacuuaauu

SEQ ID NO: 703949 - RNA, 19 nt, Homo sapiens
ggaaaauaaucugcagaaa

SEQ ID NO: 703950 - RNA, 19 nt, Homo sapiens
gugcugaugaguuauuaaa

SEQ ID NO: 703951 - RNA, 19 nt, Homo sapiens
ucuaaggccuauauucaca

SEQ ID NO: 703952 - RNA, 19 nt, Homo sapiens
agaaguaacauuugcagau

SEQ ID NO: 703953 - RNA, 19 nt, Homo sapiens
ggauaaugcagucauaacu

SEQ ID NO: 703954 - RNA, 19 nt, Homo sapiens
gcuguuucgcuuugcaaua

SEQ ID NO: 703955 - RNA, 19 nt, Homo sapiens
cagggcaguuauccauuau

SEQ ID NO: 703956 - RNA, 19 nt, Homo sapiens
aaaauaaucugcagaaacg

SEQ ID NO: 703957 - RNA, 19 nt, Homo sapiens
caaaccggaagcaguagaa

SEQ ID NO: 703958 - RNA, 19 nt, Homo sapiens
aguaacauuugcagauuuc

SEQ ID NO: 703959 - RNA, 19 nt, Homo sapiens
gaggugaacaaccgcauca

SEQ ID NO: 703960 - RNA, 19 nt, Homo sapiens
gaugggguccucuaucaua

SEQ ID NO: 703961 - RNA, 19 nt, Homo sapiens
acuccuguaucuaaagaaa

SEQ ID NO: 703962 - RNA, 19 nt, Homo sapiens
gaaaauaaucugcagaaac

SEQ ID NO: 703963 - RNA, 19 nt, Homo sapiens
ggauaaucguagcuuuuaa

SEQ ID NO: 703964 - RNA, 19 nt, Homo sapiens
aacacuugcuacuggauaa

SEQ ID NO: 703965 - RNA, 19 nt, Homo sapiens
aggauacaaugucucuuug

SEQ ID NO: 703966 - RNA, 19 nt, Homo sapiens
ucuccuaaguauuugaguu

SEQ ID NO: 703967 - RNA, 19 nt, Homo sapiens
cuguuucgcuuugcaauau

SEQ ID NO: 703968 - RNA, 19 nt, Homo sapiens
aaagaauuccacuugauca

SEQ ID NO: 703969 - RNA, 19 nt, Homo sapiens
uaccugcacuaccacauca

SEQ ID NO: 703970 - RNA, 19 nt, Homo sapiens
cagagucacaguagucuuc

SEQ ID NO: 703971 - RNA, 19 nt, Homo sapiens
aaaggacagagucacagua

SEQ ID NO: 703972 - RNA, 19 nt, Homo sapiens
gaugaugagaccauguaug

SEQ ID NO: 703973 - RNA, 19 nt, Homo sapiens
agcaguagaaguaacauuu

SEQ ID NO: 703974 - RNA, 19 nt, Homo sapiens
gggguccucuaucauauuu

SEQ ID NO: 703975 - RNA, 19 nt, Homo sapiens
uguugaagcgaaauuguuu

SEQ ID NO: 703976 - RNA, 19 nt, Homo sapiens
gcuuugcaauauauuacug

SEQ ID NO: 703977 - RNA, 19 nt, Homo sapiens
uaaggccuauauucacaca

SEQ ID NO: 703978 - RNA, 19 nt, Homo sapiens
ggagacaaaacaaaaguga

SEQ ID NO: 703979 - RNA, 19 nt, Homo sapiens
uuggaaagguguucaugca

SEQ ID NO: 703980 - RNA, 19 nt, Homo sapiens
caggauaaugcagucauaa

SEQ ID NO: 703981 - RNA, 19 nt, Homo sapiens
cgucugacuuccucaaggu

SEQ ID NO: 703982 - RNA, 19 nt, Homo sapiens
cugaugaguuauuaaagag

SEQ ID NO: 703983 - RNA, 19 nt, Homo sapiens
cacaucaagugcucuaagg

SEQ ID NO: 703984 - RNA, 19 nt, Homo sapiens
ucaaccugauccacacguu

SEQ ID NO: 703985 - RNA, 19 nt, Homo sapiens
acgauguggucauuggaaa

SEQ ID NO: 703986 - RNA, 19 nt, Homo sapiens
accggaagcaguagaagua

SEQ ID NO: 703987 - RNA, 19 nt, Homo sapiens
ggaguuucuugguaaaucc

SEQ ID NO: 703988 - RNA, 19 nt, Homo sapiens
caguagaaguaacauuugc

SEQ ID NO: 703989 - RNA, 19 nt, Homo sapiens
gacgauguggucauuggaa

SEQ ID NO: 703990 - RNA, 19 nt, Homo sapiens
gaagagcgacucaaacuaa

SEQ ID NO: 703991 - RNA, 19 nt, Homo sapiens
caaauggcuuccaauguua

SEQ ID NO: 703992 - RNA, 19 nt, Homo sapiens
gaaagagccuuaugaucga

SEQ ID NO: 703993 - RNA, 19 nt, Homo sapiens
acaaauggcuuccaauguu

SEQ ID NO: 703994 - RNA, 19 nt, Homo sapiens
caggacaggucaucagaua

SEQ ID NO: 703995 - RNA, 19 nt, Homo sapiens
gcucauaggguaucaauau

SEQ ID NO: 703996 - RNA, 19 nt, Homo sapiens
ggacuucgacuuccucaaa

SEQ ID NO: 703997 - RNA, 19 nt, Homo sapiens
gggaugaccuguaccacaa

SEQ ID NO: 703998 - RNA, 19 nt, Homo sapiens
caagauguaucccagaugu

SEQ ID NO: 703999 - RNA, 19 nt, Homo sapiens
ugggagauguggcuuauuu

SEQ ID NO: 704000 - RNA, 19 nt, Homo sapiens
agaaggaccugugaaacua

SEQ ID NO: 704001 - RNA, 19 nt, Homo sapiens
gacuaucccuaauaacaaa

SEQ ID NO: 704002 - RNA, 19 nt, Homo sapiens
cagacuuucuugagauuaa

SEQ ID NO: 704003 - RNA, 19 nt, Homo sapiens
gcaaagccuucuccacaag

SEQ ID NO: 704004 - RNA, 19 nt, Homo sapiens
gguggcaggugcacaggua

SEQ ID NO: 704005 - RNA, 19 nt, Homo sapiens
guacgugacuaucccuaau

SEQ ID NO: 704006 - RNA, 19 nt, Homo sapiens
ggaagagcgacucaaacua

SEQ ID NO: 704007 - RNA, 19 nt, Homo sapiens
acgagaagcagguuuauuu

SEQ ID NO: 704008 - RNA, 19 nt, Homo sapiens
ucaacgagaagcagguuua

SEQ ID NO: 704009 - RNA, 19 nt, Homo sapiens
aaacugggaugaccuguac

SEQ ID NO: 704010 - RNA, 19 nt, Homo sapiens
gaugguuacuggagcucua

SEQ ID NO: 704011 - RNA, 19 nt, Homo sapiens
gaggccagcugguauuagu

SEQ ID NO: 704012 - RNA, 19 nt, Homo sapiens
gagaaggaccugugaaacu

SEQ ID NO: 704013 - RNA, 19 nt, Homo sapiens
caucuuggauugcuagaag

SEQ ID NO: 704014 - RNA, 19 nt, Homo sapiens
caagugcauuccugggauu

SEQ ID NO: 704015 - RNA, 19 nt, Homo sapiens
gauuaagaaccauguauuc

SEQ ID NO: 704016 - RNA, 19 nt, Homo sapiens
gcagugaagguacuacaga

SEQ ID NO: 704017 - RNA, 19 nt, Homo sapiens
gggauaucauuucuuguuc

SEQ ID NO: 704018 - RNA, 19 nt, Homo sapiens
gaagagaaggaccugugaa

SEQ ID NO: 704019 - RNA, 19 nt, Homo sapiens
guucugacacuaagacauu

SEQ ID NO: 704020 - RNA, 19 nt, Homo sapiens
gaauuaccuucagcugcua

SEQ ID NO: 704021 - RNA, 19 nt, Homo sapiens
gagauuaagaaccauguau

SEQ ID NO: 704022 - RNA, 19 nt, Homo sapiens
uaucccagauguaugagaa

SEQ ID NO: 704023 - RNA, 19 nt, Homo sapiens
gaagacaccacauccacau

SEQ ID NO: 704024 - RNA, 19 nt, Homo sapiens
cugccaaccuugacaaaug

SEQ ID NO: 704025 - RNA, 19 nt, Homo sapiens
gggcaguccucuacgagau

SEQ ID NO: 704026 - RNA, 19 nt, Homo sapiens
gcugggagauguggcuuau

SEQ ID NO: 704027 - RNA, 19 nt, Homo sapiens
gacaaauggcuuccaaugu

SEQ ID NO: 704028 - RNA, 19 nt, Homo sapiens
ugacaaauggcuuccaaug

SEQ ID NO: 704029 - RNA, 19 nt, Homo sapiens
gcuacagaaugaacucuag

SEQ ID NO: 704030 - RNA, 19 nt, Homo sapiens
caacaccaacucucucaug

SEQ ID NO: 704031 - RNA, 19 nt, Homo sapiens
ggacaggucaucagauacu

SEQ ID NO: 704032 - RNA, 19 nt, Homo sapiens
gaugaccuguaccacaaga

SEQ ID NO: 704033 - RNA, 19 nt, Homo sapiens
cuucugagauguuuguuag

SEQ ID NO: 704034 - RNA, 19 nt, Homo sapiens
gaauggaggcugggagaug

SEQ ID NO: 704035 - RNA, 19 nt, Homo sapiens
gccaagauguaucccagau

SEQ ID NO: 704036 - RNA, 19 nt, Homo sapiens
cagugaagguacuacagaa

SEQ ID NO: 704037 - RNA, 19 nt, Homo sapiens
aauguuagguuugcuacaa

SEQ ID NO: 704038 - RNA, 19 nt, Homo sapiens
gauaucauuucuuguucca

SEQ ID NO: 704039 - RNA, 19 nt, Homo sapiens
ggguaucaauaucucuuau

SEQ ID NO: 704040 - RNA, 19 nt, Homo sapiens
ugacuaucccuaauaacaa

SEQ ID NO: 704041 - RNA, 19 nt, Homo sapiens
gugacuaucccuaauaaca

SEQ ID NO: 704042 - RNA, 19 nt, Homo sapiens
caaaagcuccacccaauga

SEQ ID NO: 704043 - RNA, 19 nt, Homo sapiens
acaauggcuucaacgagaa

SEQ ID NO: 704044 - RNA, 19 nt, Homo sapiens
ggccagcugguauuaguaa

SEQ ID NO: 704045 - RNA, 19 nt, Homo sapiens
aagcagacuuucuugagau

SEQ ID NO: 704046 - RNA, 19 nt, Homo sapiens
gaacuacgggaagguccua

SEQ ID NO: 704047 - RNA, 19 nt, Homo sapiens
cgacucaaacuaacaaugg

SEQ ID NO: 704048 - RNA, 19 nt, Homo sapiens
gagcgacucaaacuaacaa

SEQ ID NO: 704049 - RNA, 19 nt, Homo sapiens
gcagacuuucuugagauua

SEQ ID NO: 704050 - RNA, 19 nt, Homo sapiens
cuaggaagagcgacucaaa

SEQ ID NO: 704051 - RNA, 19 nt, Homo sapiens
cagcugguauuaguaagga

SEQ ID NO: 704052 - RNA, 19 nt, Homo sapiens
cuacugaggccagcuggua

SEQ ID NO: 704053 - RNA, 19 nt, Homo sapiens
gagcgcagugugcuucuga

SEQ ID NO: 704054 - RNA, 19 nt, Homo sapiens
uaaacugggaugaccugua

SEQ ID NO: 704055 - RNA, 19 nt, Homo sapiens
ccugugaccuccugcaaag

SEQ ID NO: 704056 - RNA, 19 nt, Homo sapiens
cagacuuuaugcccugaaa

SEQ ID NO: 704057 - RNA, 19 nt, Homo sapiens
aagagaaggaccugugaaa

SEQ ID NO: 704058 - RNA, 19 nt, Homo sapiens
ugcaaagccuucuccacaa

SEQ ID NO: 704059 - RNA, 19 nt, Homo sapiens
ucugagauguuuguuagga

SEQ ID NO: 704060 - RNA, 19 nt, Homo sapiens
acgugacuaucccuaauaa

SEQ ID NO: 704061 - RNA, 19 nt, Homo sapiens
ccugaucauugcuacagaa

SEQ ID NO: 704062 - RNA, 19 nt, Homo sapiens
gaaagagcagagccacauc

SEQ ID NO: 704063 - RNA, 19 nt, Homo sapiens
cauaggguaucaauaucuc

SEQ ID NO: 704064 - RNA, 19 nt, Homo sapiens
ggaccugugaaacuacuga

SEQ ID NO: 704065 - RNA, 19 nt, Homo sapiens
cuuuaucccuucugagaug

SEQ ID NO: 704066 - RNA, 19 nt, Homo sapiens
gcgcuacuccuuccagaca

SEQ ID NO: 704067 - RNA, 19 nt, Homo sapiens
uaacaagcucauaggguau

SEQ ID NO: 704068 - RNA, 19 nt, Homo sapiens
gacuucugcuuccaucuca

SEQ ID NO: 704069 - RNA, 19 nt, Homo sapiens
gagauguaacaagcucaua

SEQ ID NO: 704070 - RNA, 19 nt, Homo sapiens
gguacgugacuaucccuaa

SEQ ID NO: 704071 - RNA, 19 nt, Homo sapiens
ucucugcccugccaaccuu

SEQ ID NO: 704072 - RNA, 19 nt, Homo sapiens
cagagcugccugaucauug

SEQ ID NO: 704073 - RNA, 19 nt, Homo sapiens
gcaccagccgcuacagauc

SEQ ID NO: 704074 - RNA, 19 nt, Homo sapiens
uuacagggaucugaaacca

SEQ ID NO: 704075 - RNA, 19 nt, Homo sapiens
gcacucccucaacaucauu

SEQ ID NO: 704076 - RNA, 19 nt, Homo sapiens
uaccugcacucccucaaca

SEQ ID NO: 704077 - RNA, 19 nt, Homo sapiens
caggggauaucauuucuug

SEQ ID NO: 704078 - RNA, 19 nt, Homo sapiens
caacgagaagcagguuuau

SEQ ID NO: 704079 - RNA, 19 nt, Homo sapiens
gacaccacauccacauucu

SEQ ID NO: 704080 - RNA, 19 nt, Homo sapiens
ccucaaagucaucggcaaa

SEQ ID NO: 704081 - RNA, 19 nt, Homo sapiens
ggagauguggcuuauuugc

SEQ ID NO: 704082 - RNA, 19 nt, Homo sapiens
gccaagcgcaagucugaug

SEQ ID NO: 704083 - RNA, 19 nt, Homo sapiens
ccagagcugccugaucauu

SEQ ID NO: 704084 - RNA, 19 nt, Homo sapiens
ccccagagcugccugauca

SEQ ID NO: 704085 - RNA, 19 nt, Homo sapiens
caccugagaagcucuacuu

SEQ ID NO: 704086 - RNA, 19 nt, Homo sapiens
uggccaagcgcaagucuga

SEQ ID NO: 704087 - RNA, 19 nt, Homo sapiens
guaaaaugacagagaugua

SEQ ID NO: 704088 - RNA, 19 nt, Homo sapiens
aauggaggcugggagaugu

SEQ ID NO: 704089 - RNA, 19 nt, Homo sapiens
ggcuuccaauguuagguuu

SEQ ID NO: 704090 - RNA, 19 nt, Homo sapiens
gaagagcgacucaaacuaa

SEQ ID NO: 704091 - RNA, 19 nt, Homo sapiens
caaauggcuuccaauguua

SEQ ID NO: 704092 - RNA, 19 nt, Homo sapiens
gaaagagccuuaugaucga

SEQ ID NO: 704093 - RNA, 19 nt, Homo sapiens
acaaauggcuuccaauguu

SEQ ID NO: 704094 - RNA, 19 nt, Homo sapiens
caggacaggucaucagaua

SEQ ID NO: 704095 - RNA, 19 nt, Homo sapiens
gaaggaccaugaagagaga

SEQ ID NO: 704096 - RNA, 19 nt, Homo sapiens
gcucauaggguaucaauau

SEQ ID NO: 704097 - RNA, 19 nt, Homo sapiens
ggacuucgacuuccucaaa

SEQ ID NO: 704098 - RNA, 19 nt, Homo sapiens
gggaugaccuguaccacaa

SEQ ID NO: 704099 - RNA, 19 nt, Homo sapiens
caagauguaucccagaugu

SEQ ID NO: 704100 - RNA, 19 nt, Homo sapiens
ugggagauguggcuuauuu

SEQ ID NO: 704101 - RNA, 19 nt, Homo sapiens
agaaggaccugugaaacua

SEQ ID NO: 704102 - RNA, 19 nt, Homo sapiens
gacuaucccuaauaacaaa

SEQ ID NO: 704103 - RNA, 19 nt, Homo sapiens
cagacuuucuugagauuaa

SEQ ID NO: 704104 - RNA, 19 nt, Homo sapiens
gcaaagccuucuccacaag

SEQ ID NO: 704105 - RNA, 19 nt, Homo sapiens
guacgugacuaucccuaau

SEQ ID NO: 704106 - RNA, 19 nt, Homo sapiens
ggaagagcgacucaaacua

SEQ ID NO: 704107 - RNA, 19 nt, Homo sapiens
gauugugccuccagucaga

SEQ ID NO: 704108 - RNA, 19 nt, Homo sapiens
acgagaagcagguuuauuu

SEQ ID NO: 704109 - RNA, 19 nt, Homo sapiens
ucaacgagaagcagguuua

SEQ ID NO: 704110 - RNA, 19 nt, Homo sapiens
aaacugggaugaccuguac

SEQ ID NO: 704111 - RNA, 19 nt, Homo sapiens
gaugguuacuggagcucua

SEQ ID NO: 704112 - RNA, 19 nt, Homo sapiens
gaggccagcugguauuagu

SEQ ID NO: 704113 - RNA, 19 nt, Homo sapiens
gagaaggaccugugaaacu

SEQ ID NO: 704114 - RNA, 19 nt, Homo sapiens
caucuuggauugcuagaag

SEQ ID NO: 704115 - RNA, 19 nt, Homo sapiens
caagugcauuccugggauu

SEQ ID NO: 704116 - RNA, 19 nt, Homo sapiens
gauuaagaaccauguauuc

SEQ ID NO: 704117 - RNA, 19 nt, Homo sapiens
gcagugaagguacuacaga

SEQ ID NO: 704118 - RNA, 19 nt, Homo sapiens
gaagagaaggaccugugaa

SEQ ID NO: 704119 - RNA, 19 nt, Homo sapiens
guucugacacuaagacauu

SEQ ID NO: 704120 - RNA, 19 nt, Homo sapiens
gaauuaccuucagcugcua

SEQ ID NO: 704121 - RNA, 19 nt, Homo sapiens
gagauuaagaaccauguau

SEQ ID NO: 704122 - RNA, 19 nt, Homo sapiens
uaucccagauguaugagaa

SEQ ID NO: 704123 - RNA, 19 nt, Homo sapiens
gaagacaccacauccacau

SEQ ID NO: 704124 - RNA, 19 nt, Homo sapiens
cugccaaccuugacaaaug

SEQ ID NO: 704125 - RNA, 19 nt, Homo sapiens
gggcaguccucuacgagau

SEQ ID NO: 704126 - RNA, 19 nt, Homo sapiens
gcugggagauguggcuuau

SEQ ID NO: 704127 - RNA, 19 nt, Homo sapiens
gacaaauggcuuccaaugu

SEQ ID NO: 704128 - RNA, 19 nt, Homo sapiens
ugacaaauggcuuccaaug

SEQ ID NO: 704129 - RNA, 19 nt, Homo sapiens
gcuacagaaugaacucuag

SEQ ID NO: 704130 - RNA, 19 nt, Homo sapiens
ggacaggucaucagauacu

SEQ ID NO: 704131 - RNA, 19 nt, Homo sapiens
gaugaccuguaccacaaga

SEQ ID NO: 704132 - RNA, 19 nt, Homo sapiens
gaauggaggcugggagaug

SEQ ID NO: 704133 - RNA, 19 nt, Homo sapiens
gccaagauguaucccagau

SEQ ID NO: 704134 - RNA, 19 nt, Homo sapiens
cagugaagguacuacagaa

SEQ ID NO: 704135 - RNA, 19 nt, Homo sapiens
aauguuagguuugcuacaa

SEQ ID NO: 704136 - RNA, 19 nt, Homo sapiens
ggguaucaauaucucuuau

SEQ ID NO: 704137 - RNA, 19 nt, Homo sapiens
ugacuaucccuaauaacaa

SEQ ID NO: 704138 - RNA, 19 nt, Homo sapiens
gugacuaucccuaauaaca

SEQ ID NO: 704139 - RNA, 19 nt, Homo sapiens
caaaagcuccacccaauga

SEQ ID NO: 704140 - RNA, 19 nt, Homo sapiens
acaauggcuucaacgagaa

SEQ ID NO: 704141 - RNA, 19 nt, Homo sapiens
ggccagcugguauuaguaa

SEQ ID NO: 704142 - RNA, 19 nt, Homo sapiens
aagcagacuuucuugagau

SEQ ID NO: 704143 - RNA, 19 nt, Homo sapiens
gaacuacgggaagguccua

SEQ ID NO: 704144 - RNA, 19 nt, Homo sapiens
cgacucaaacuaacaaugg

SEQ ID NO: 704145 - RNA, 19 nt, Homo sapiens
gagcgacucaaacuaacaa

SEQ ID NO: 704146 - RNA, 19 nt, Homo sapiens
gcagacuuucuugagauua

SEQ ID NO: 704147 - RNA, 19 nt, Homo sapiens
cuaggaagagcgacucaaa

SEQ ID NO: 704148 - RNA, 19 nt, Homo sapiens
cagcugguauuaguaagga

SEQ ID NO: 704149 - RNA, 19 nt, Homo sapiens
cuacugaggccagcuggua

SEQ ID NO: 704150 - RNA, 19 nt, Homo sapiens
gagcgcagugugcuucuga

SEQ ID NO: 704151 - RNA, 19 nt, Homo sapiens
uaaacugggaugaccugua

SEQ ID NO: 704152 - RNA, 19 nt, Homo sapiens
ccugugaccuccugcaaag

SEQ ID NO: 704153 - RNA, 19 nt, Homo sapiens
ccagucagaaggaccauga

SEQ ID NO: 704154 - RNA, 19 nt, Homo sapiens
aagagaaggaccugugaaa

SEQ ID NO: 704155 - RNA, 19 nt, Homo sapiens
ugcaaagccuucuccacaa

SEQ ID NO: 704156 - RNA, 19 nt, Homo sapiens
acgugacuaucccuaauaa

SEQ ID NO: 704157 - RNA, 19 nt, Homo sapiens
ccugaucauugcuacagaa

SEQ ID NO: 704158 - RNA, 19 nt, Homo sapiens
gaaagagcagagccacauc

SEQ ID NO: 704159 - RNA, 19 nt, Homo sapiens
cauaggguaucaauaucuc

SEQ ID NO: 704160 - RNA, 19 nt, Homo sapiens
ggaccugugaaacuacuga

SEQ ID NO: 704161 - RNA, 19 nt, Homo sapiens
gcgcuacuccuuccagaca

SEQ ID NO: 704162 - RNA, 19 nt, Homo sapiens
uaacaagcucauaggguau

SEQ ID NO: 704163 - RNA, 19 nt, Homo sapiens
gacuucugcuuccaucuca

SEQ ID NO: 704164 - RNA, 19 nt, Homo sapiens
gagauguaacaagcucaua

SEQ ID NO: 704165 - RNA, 19 nt, Homo sapiens
gguacgugacuaucccuaa

SEQ ID NO: 704166 - RNA, 19 nt, Homo sapiens
ucagaaggaccaugaagag

SEQ ID NO: 704167 - RNA, 19 nt, Homo sapiens
cagagcugccugaucauug

SEQ ID NO: 704168 - RNA, 19 nt, Homo sapiens
ucucugcccugccaaccuu

SEQ ID NO: 704169 - RNA, 19 nt, Homo sapiens
gcaccagccgcuacagauc

SEQ ID NO: 704170 - RNA, 19 nt, Homo sapiens
uuacagggaucugaaacca

SEQ ID NO: 704171 - RNA, 19 nt, Homo sapiens
gcacucccucaacaucauu

SEQ ID NO: 704172 - RNA, 19 nt, Homo sapiens
uaccugcacucccucaaca

SEQ ID NO: 704173 - RNA, 19 nt, Homo sapiens
caacgagaagcagguuuau

SEQ ID NO: 704174 - RNA, 19 nt, Homo sapiens
ccucaaagucaucggcaaa

SEQ ID NO: 704175 - RNA, 19 nt, Homo sapiens
gacaccacauccacauucu

SEQ ID NO: 704176 - RNA, 19 nt, Homo sapiens
gccaagcgcaagucugaug

SEQ ID NO: 704177 - RNA, 19 nt, Homo sapiens
ggagauguggcuuauuugc

SEQ ID NO: 704178 - RNA, 19 nt, Homo sapiens
uggccaagcgcaagucuga

SEQ ID NO: 704179 - RNA, 19 nt, Homo sapiens
caccugagaagcucuacuu

SEQ ID NO: 704180 - RNA, 19 nt, Homo sapiens
guaaaaugacagagaugua

SEQ ID NO: 704181 - RNA, 19 nt, Homo sapiens
aauggaggcugggagaugu

SEQ ID NO: 704182 - RNA, 19 nt, Homo sapiens
ggcuuccaauguuagguuu

SEQ ID NO: 704183 - RNA, 19 nt, Homo sapiens
gaaggaccugugaaacuac

SEQ ID NO: 704184 - RNA, 19 nt, Homo sapiens
uuggauugcuagaagagaa

SEQ ID NO: 704185 - RNA, 19 nt, Homo sapiens
acguggugcugacggauuu

SEQ ID NO: 704186 - RNA, 19 nt, Homo sapiens
ggggagagcucuucuucca

SEQ ID NO: 704187 - RNA, 19 nt, Homo sapiens
caaagggguucugacacua

SEQ ID NO: 704188 - RNA, 19 nt, Homo sapiens
cuugacaaauggcuuccaa

SEQ ID NO: 704189 - RNA, 19 nt, Homo sapiens
agaagagaaggaccuguga

SEQ ID NO: 704190 - RNA, 19 nt, Homo sapiens
gaacaggccucuccauuug

SEQ ID NO: 704191 - RNA, 19 nt, Homo sapiens
gaaacaaacugcagaaugu

SEQ ID NO: 704192 - RNA, 19 nt, Homo sapiens
acaaggaucuggauauuua

SEQ ID NO: 704193 - RNA, 19 nt, Homo sapiens
ggacaaagauaagcaaauu

SEQ ID NO: 704194 - RNA, 19 nt, Homo sapiens
ggaaagcucugaccacuug

SEQ ID NO: 704195 - RNA, 19 nt, Homo sapiens
gaacaaggaucuggauauu

SEQ ID NO: 704196 - RNA, 19 nt, Homo sapiens
ggacagacuugccaaauug

SEQ ID NO: 704197 - RNA, 19 nt, Homo sapiens
gcucagagauugugaaaug

SEQ ID NO: 704198 - RNA, 19 nt, Homo sapiens
ggaaauaccagaauuaaga

SEQ ID NO: 704199 - RNA, 19 nt, Homo sapiens
gaaaugaucaguucucuug

SEQ ID NO: 704200 - RNA, 19 nt, Homo sapiens
gauaauuacugccuugaaa

SEQ ID NO: 704201 - RNA, 19 nt, Homo sapiens
gaagagaacauagacaaua

SEQ ID NO: 704202 - RNA, 19 nt, Homo sapiens
ugacaaagaugaacaaauc

SEQ ID NO: 704203 - RNA, 19 nt, Homo sapiens
gaaagguuaugaagaagaa

SEQ ID NO: 704204 - RNA, 19 nt, Homo sapiens
gaaggaaauaccagaauua

SEQ ID NO: 704205 - RNA, 19 nt, Homo sapiens
agacaaagcugacaaagau

SEQ ID NO: 704206 - RNA, 19 nt, Homo sapiens
ggagaaagauaauagugaa

SEQ ID NO: 704207 - RNA, 19 nt, Homo sapiens
gaauagaggacaaagauaa

SEQ ID NO: 704208 - RNA, 19 nt, Homo sapiens
gaaauuaaagccuuggaua

SEQ ID NO: 704209 - RNA, 19 nt, Homo sapiens
caaaggaaauugucaaauc

SEQ ID NO: 704210 - RNA, 19 nt, Homo sapiens
ggagcagacuguggaauua

SEQ ID NO: 704211 - RNA, 19 nt, Homo sapiens
gaagagcaguuguccaguu

SEQ ID NO: 704212 - RNA, 19 nt, Homo sapiens
caacacagcuagaauugga

SEQ ID NO: 704213 - RNA, 19 nt, Homo sapiens
ccaaggcugugcuaaauaa

SEQ ID NO: 704214 - RNA, 19 nt, Homo sapiens
gaaagacgaccaucauuga

SEQ ID NO: 704215 - RNA, 19 nt, Homo sapiens
acagaaagguuaugaagaa

SEQ ID NO: 704216 - RNA, 19 nt, Homo sapiens
gaaagaagcaaauggagaa

SEQ ID NO: 704217 - RNA, 19 nt, Homo sapiens
gaaagguggcuacaagaua

SEQ ID NO: 704218 - RNA, 19 nt, Homo sapiens
gaaauugaccgagaaauga

SEQ ID NO: 704219 - RNA, 19 nt, Homo sapiens
agaagaaagugccaaagua

SEQ ID NO: 704220 - RNA, 19 nt, Homo sapiens
gcaaagaucuauggugugu

SEQ ID NO: 704221 - RNA, 19 nt, Homo sapiens
ggaauuauccacugaaguu

SEQ ID NO: 704222 - RNA, 19 nt, Homo sapiens
ggaauagacuuagaucgaa

SEQ ID NO: 704223 - RNA, 19 nt, Homo sapiens
gcaacaagauacauuaaag

SEQ ID NO: 704224 - RNA, 19 nt, Homo sapiens
gauaaaggaugcuaaagag

SEQ ID NO: 704225 - RNA, 19 nt, Homo sapiens
ccaaccaacugaugaauga

SEQ ID NO: 704226 - RNA, 19 nt, Homo sapiens
aaagguggcuacaagauaa

SEQ ID NO: 704227 - RNA, 19 nt, Homo sapiens
caagaaagguggcuacaag

SEQ ID NO: 704228 - RNA, 19 nt, Homo sapiens
uaaccucacuguugggaua

SEQ ID NO: 704229 - RNA, 19 nt, Homo sapiens
gaaagaaaggaaauuggua

SEQ ID NO: 704230 - RNA, 19 nt, Homo sapiens
caaaugagcuaaaaucuga

SEQ ID NO: 704231 - RNA, 19 nt, Homo sapiens
gaagaaagugccaaaguau

SEQ ID NO: 704232 - RNA, 19 nt, Homo sapiens
guuaacaucuucaaaggaa

SEQ ID NO: 704233 - RNA, 19 nt, Homo sapiens
gaagagaauuaagcccuaa

SEQ ID NO: 704234 - RNA, 19 nt, Homo sapiens
gaucagugcucagagauug

SEQ ID NO: 704235 - RNA, 19 nt, Homo sapiens
gacaagauauugauacaca

SEQ ID NO: 704236 - RNA, 19 nt, Homo sapiens
gaauugaaucguaagcuua

SEQ ID NO: 704237 - RNA, 19 nt, Homo sapiens
gcaagcagaucgccaucaa

SEQ ID NO: 704238 - RNA, 19 nt, Homo sapiens
gaaacacucuuggguacaa

SEQ ID NO: 704239 - RNA, 19 nt, Homo sapiens
aaucagaacugcuuguuga

SEQ ID NO: 704240 - RNA, 19 nt, Homo sapiens
gaaagaacuucgagaacca

SEQ ID NO: 704241 - RNA, 19 nt, Homo sapiens
aguaauagcucaacuaagu

SEQ ID NO: 704242 - RNA, 19 nt, Homo sapiens
aauaaugccugaagaagaa

SEQ ID NO: 704243 - RNA, 19 nt, Homo sapiens
cgacauagaagaacaagaa

SEQ ID NO: 704244 - RNA, 19 nt, Homo sapiens
ggacugggaagaauaauug

SEQ ID NO: 704245 - RNA, 19 nt, Homo sapiens
ggaaauugguagacuguca

SEQ ID NO: 704246 - RNA, 19 nt, Homo sapiens
ggaaagacgaccaucauug

SEQ ID NO: 704247 - RNA, 19 nt, Homo sapiens
cgaguaagauuaagagcaa

SEQ ID NO: 704248 - RNA, 19 nt, Homo sapiens
guaaucaucuaagucagua

SEQ ID NO: 704249 - RNA, 19 nt, Homo sapiens
gaagacuggcuacauagua

SEQ ID NO: 704250 - RNA, 19 nt, Homo sapiens
ucagaaauccuaaguaaga

SEQ ID NO: 704251 - RNA, 19 nt, Homo sapiens
gaaggagucauuacuagaa

SEQ ID NO: 704252 - RNA, 19 nt, Homo sapiens
cuucagauauccacuaauu

SEQ ID NO: 704253 - RNA, 19 nt, Homo sapiens
gggacagacuugccaaauu

SEQ ID NO: 704254 - RNA, 19 nt, Homo sapiens
gacacaaggucagaaagua

SEQ ID NO: 704255 - RNA, 19 nt, Homo sapiens
aaauguagguccucagaaa

SEQ ID NO: 704256 - RNA, 19 nt, Homo sapiens
gaacauauccgagcuagag

SEQ ID NO: 704257 - RNA, 19 nt, Homo sapiens
caagguugcucaagaaaca

SEQ ID NO: 704258 - RNA, 19 nt, Homo sapiens
gcaaaucaauucuagucau

SEQ ID NO: 704259 - RNA, 19 nt, Homo sapiens
gacaagcuguuugauguuu

SEQ ID NO: 704260 - RNA, 19 nt, Homo sapiens
ugaauuaaccucacuguug

SEQ ID NO: 704261 - RNA, 19 nt, Homo sapiens
acagauagaugagauaaga

SEQ ID NO: 704262 - RNA, 19 nt, Homo sapiens
aaucuaggcuucucaauca

SEQ ID NO: 704263 - RNA, 19 nt, Homo sapiens
gcaaaugcaugcuucuucu

SEQ ID NO: 704264 - RNA, 19 nt, Homo sapiens
caggauaaacugaaugaua

SEQ ID NO: 704265 - RNA, 19 nt, Homo sapiens
guacaauaaugccugaaga

SEQ ID NO: 704266 - RNA, 19 nt, Homo sapiens
ggcaaagcauaauugauuu

SEQ ID NO: 704267 - RNA, 19 nt, Homo sapiens
gaagacaagcuguuugaug

SEQ ID NO: 704268 - RNA, 19 nt, Homo sapiens
gaacaaggaacuagcuuca

SEQ ID NO: 704269 - RNA, 19 nt, Homo sapiens
gaaguaauaagucuccaaa

SEQ ID NO: 704270 - RNA, 19 nt, Homo sapiens
uaaguaagaagcagaauga

SEQ ID NO: 704271 - RNA, 19 nt, Homo sapiens
gaaguucagucuuuguaca

SEQ ID NO: 704272 - RNA, 19 nt, Homo sapiens
ucagugauuugcagucuaa

SEQ ID NO: 704273 - RNA, 19 nt, Homo sapiens
gaaaggaaauugguagacu

SEQ ID NO: 704274 - RNA, 19 nt, Homo sapiens
acaggaaccuuaaguaauc

SEQ ID NO: 704275 - RNA, 19 nt, Homo sapiens
ccucagaaaguguauaaua

SEQ ID NO: 704276 - RNA, 19 nt, Homo sapiens
gaaguuggaagagaacaua

SEQ ID NO: 704277 - RNA, 19 nt, Homo sapiens
gcaauuucgugaugucaau

SEQ ID NO: 704278 - RNA, 19 nt, Homo sapiens
cagaugugauuaaagcuaa

SEQ ID NO: 704279 - RNA, 19 nt, Homo sapiens
gcugacaucuugaauccuu

SEQ ID NO: 704280 - RNA, 19 nt, Homo sapiens
gaaauggugagauguaugu

SEQ ID NO: 704281 - RNA, 19 nt, Homo sapiens
gagacaagauauugauaca

SEQ ID NO: 704282 - RNA, 19 nt, Homo sapiens
aagagcaguuguccaguua

SEQ ID NO: 704283 - RNA, 19 nt, Homo sapiens
cuaauuggccuuuaaguga

SEQ ID NO: 704284 - RNA, 19 nt, Homo sapiens
ccugacagauguuacaauu

SEQ ID NO: 704285 - RNA, 19 nt, Homo sapiens
gcuagagauucauuaauuc

SEQ ID NO: 704286 - RNA, 19 nt, Homo sapiens
gaaagauaauagugaacug

SEQ ID NO: 704287 - RNA, 19 nt, Homo sapiens
ugacaggaaccuuaaguaa

SEQ ID NO: 704288 - RNA, 19 nt, Homo sapiens
uaagaaagaacuucgagaa

SEQ ID NO: 704289 - RNA, 19 nt, Homo sapiens
agaaggaaauaccagaauu

SEQ ID NO: 704290 - RNA, 19 nt, Homo sapiens
gaacaggccucuccauuug

SEQ ID NO: 704291 - RNA, 19 nt, Homo sapiens
gaaacaaacugcagaaugu

SEQ ID NO: 704292 - RNA, 19 nt, Homo sapiens
acaaggaucuggauauuua

SEQ ID NO: 704293 - RNA, 19 nt, Homo sapiens
ggacaaagauaagcaaauu

SEQ ID NO: 704294 - RNA, 19 nt, Homo sapiens
ggaaagcucugaccacuug

SEQ ID NO: 704295 - RNA, 19 nt, Homo sapiens
gaacaaggaucuggauauu

SEQ ID NO: 704296 - RNA, 19 nt, Homo sapiens
ggacagacuugccaaauug

SEQ ID NO: 704297 - RNA, 19 nt, Homo sapiens
gcucagagauugugaaaug

SEQ ID NO: 704298 - RNA, 19 nt, Homo sapiens
ggaaauaccagaauuaaga

SEQ ID NO: 704299 - RNA, 19 nt, Homo sapiens
gaaaugaucaguucucuug

SEQ ID NO: 704300 - RNA, 19 nt, Homo sapiens
gauaauuacugccuugaaa

SEQ ID NO: 704301 - RNA, 19 nt, Homo sapiens
gaagagaacauagacaaua

SEQ ID NO: 704302 - RNA, 19 nt, Homo sapiens
ugacaaagaugaacaaauc

SEQ ID NO: 704303 - RNA, 19 nt, Homo sapiens
gaaagguuaugaagaagaa

SEQ ID NO: 704304 - RNA, 19 nt, Homo sapiens
gaaggaaauaccagaauua

SEQ ID NO: 704305 - RNA, 19 nt, Homo sapiens
agacaaagcugacaaagau

SEQ ID NO: 704306 - RNA, 19 nt, Homo sapiens
ggagaaagauaauagugaa

SEQ ID NO: 704307 - RNA, 19 nt, Homo sapiens
gaauagaggacaaagauaa

SEQ ID NO: 704308 - RNA, 19 nt, Homo sapiens
gaaauuaaagccuuggaua

SEQ ID NO: 704309 - RNA, 19 nt, Homo sapiens
caaaggaaauugucaaauc

SEQ ID NO: 704310 - RNA, 19 nt, Homo sapiens
ggagcagacuguggaauua

SEQ ID NO: 704311 - RNA, 19 nt, Homo sapiens
gaagagcaguuguccaguu

SEQ ID NO: 704312 - RNA, 19 nt, Homo sapiens
caacacagcuagaauugga

SEQ ID NO: 704313 - RNA, 19 nt, Homo sapiens
ccaaggcugugcuaaauaa

SEQ ID NO: 704314 - RNA, 19 nt, Homo sapiens
gaaagacgaccaucauuga

SEQ ID NO: 704315 - RNA, 19 nt, Homo sapiens
acagaaagguuaugaagaa

SEQ ID NO: 704316 - RNA, 19 nt, Homo sapiens
gaaagaagcaaauggagaa

SEQ ID NO: 704317 - RNA, 19 nt, Homo sapiens
gaaagguggcuacaagaua

SEQ ID NO: 704318 - RNA, 19 nt, Homo sapiens
gaaauugaccgagaaauga

SEQ ID NO: 704319 - RNA, 19 nt, Homo sapiens
agaagaaagugccaaagua

SEQ ID NO: 704320 - RNA, 19 nt, Homo sapiens
ggaauuauccacugaaguu

SEQ ID NO: 704321 - RNA, 19 nt, Homo sapiens
ggaauagacuuagaucgaa

SEQ ID NO: 704322 - RNA, 19 nt, Homo sapiens
gcaacaagauacauuaaag

SEQ ID NO: 704323 - RNA, 19 nt, Homo sapiens
gauaaaggaugcuaaagag

SEQ ID NO: 704324 - RNA, 19 nt, Homo sapiens
ccaaccaacugaugaauga

SEQ ID NO: 704325 - RNA, 19 nt, Homo sapiens
aaagguggcuacaagauaa

SEQ ID NO: 704326 - RNA, 19 nt, Homo sapiens
caagaaagguggcuacaag

SEQ ID NO: 704327 - RNA, 19 nt, Homo sapiens
uaaccucacuguugggaua

SEQ ID NO: 704328 - RNA, 19 nt, Homo sapiens
gaaagaaaggaaauuggua

SEQ ID NO: 704329 - RNA, 19 nt, Homo sapiens
caaaugagcuaaaaucuga

SEQ ID NO: 704330 - RNA, 19 nt, Homo sapiens
gaagaaagugccaaaguau

SEQ ID NO: 704331 - RNA, 19 nt, Homo sapiens
guuaacaucuucaaaggaa

SEQ ID NO: 704332 - RNA, 19 nt, Homo sapiens
gaagagaauuaagcccuaa

SEQ ID NO: 704333 - RNA, 19 nt, Homo sapiens
gaucagugcucagagauug

SEQ ID NO: 704334 - RNA, 19 nt, Homo sapiens
gacaagauauugauacaca

SEQ ID NO: 704335 - RNA, 19 nt, Homo sapiens
gaauugaaucguaagcuua

SEQ ID NO: 704336 - RNA, 19 nt, Homo sapiens
gcaagcagaucgccaucaa

SEQ ID NO: 704337 - RNA, 19 nt, Homo sapiens
gaaacacucuuggguacaa

SEQ ID NO: 704338 - RNA, 19 nt, Homo sapiens
aaucagaacugcuuguuga

SEQ ID NO: 704339 - RNA, 19 nt, Homo sapiens
gaaagaacuucgagaacca

SEQ ID NO: 704340 - RNA, 19 nt, Homo sapiens
aguaauagcucaacuaagu

SEQ ID NO: 704341 - RNA, 19 nt, Homo sapiens
aauaaugccugaagaagaa

SEQ ID NO: 704342 - RNA, 19 nt, Homo sapiens
cgacauagaagaacaagaa

SEQ ID NO: 704343 - RNA, 19 nt, Homo sapiens
ggacugggaagaauaauug

SEQ ID NO: 704344 - RNA, 19 nt, Homo sapiens
ggaaauugguagacuguca

SEQ ID NO: 704345 - RNA, 19 nt, Homo sapiens
ggaaagacgaccaucauug

SEQ ID NO: 704346 - RNA, 19 nt, Homo sapiens
cgaguaagauuaagagcaa

SEQ ID NO: 704347 - RNA, 19 nt, Homo sapiens
guaaucaucuaagucagua

SEQ ID NO: 704348 - RNA, 19 nt, Homo sapiens
gaagacuggcuacauagua

SEQ ID NO: 704349 - RNA, 19 nt, Homo sapiens
ucagaaauccuaaguaaga

SEQ ID NO: 704350 - RNA, 19 nt, Homo sapiens
cuucagauauccacuaauu

SEQ ID NO: 704351 - RNA, 19 nt, Homo sapiens
gggacagacuugccaaauu

SEQ ID NO: 704352 - RNA, 19 nt, Homo sapiens
gacacaaggucagaaagua

SEQ ID NO: 704353 - RNA, 19 nt, Homo sapiens
aaauguagguccucagaaa

SEQ ID NO: 704354 - RNA, 19 nt, Homo sapiens
gaacauauccgagcuagag

SEQ ID NO: 704355 - RNA, 19 nt, Homo sapiens
caagguugcucaagaaaca

SEQ ID NO: 704356 - RNA, 19 nt, Homo sapiens
gcaaaucaauucuagucau

SEQ ID NO: 704357 - RNA, 19 nt, Homo sapiens
gacaagcuguuugauguuu

SEQ ID NO: 704358 - RNA, 19 nt, Homo sapiens
ugaauuaaccucacuguug

SEQ ID NO: 704359 - RNA, 19 nt, Homo sapiens
acagauagaugagauaaga

SEQ ID NO: 704360 - RNA, 19 nt, Homo sapiens
aaucuaggcuucucaauca

SEQ ID NO: 704361 - RNA, 19 nt, Homo sapiens
gcaaaugcaugcuucuucu

SEQ ID NO: 704362 - RNA, 19 nt, Homo sapiens
caggauaaacugaaugaua

SEQ ID NO: 704363 - RNA, 19 nt, Homo sapiens
guacaauaaugccugaaga

SEQ ID NO: 704364 - RNA, 19 nt, Homo sapiens
ggcaaagcauaauugauuu

SEQ ID NO: 704365 - RNA, 19 nt, Homo sapiens
gaagacaagcuguuugaug

SEQ ID NO: 704366 - RNA, 19 nt, Homo sapiens
gaacaaggaacuagcuuca

SEQ ID NO: 704367 - RNA, 19 nt, Homo sapiens
gaaguaauaagucuccaaa

SEQ ID NO: 704368 - RNA, 19 nt, Homo sapiens
uaaguaagaagcagaauga

SEQ ID NO: 704369 - RNA, 19 nt, Homo sapiens
gaaguucagucuuuguaca

SEQ ID NO: 704370 - RNA, 19 nt, Homo sapiens
ucagugauuugcagucuaa

SEQ ID NO: 704371 - RNA, 19 nt, Homo sapiens
gaaaggaaauugguagacu

SEQ ID NO: 704372 - RNA, 19 nt, Homo sapiens
acaggaaccuuaaguaauc

SEQ ID NO: 704373 - RNA, 19 nt, Homo sapiens
ccucagaaaguguauaaua

SEQ ID NO: 704374 - RNA, 19 nt, Homo sapiens
gaaguuggaagagaacaua

SEQ ID NO: 704375 - RNA, 19 nt, Homo sapiens
gcaauuucgugaugucaau

SEQ ID NO: 704376 - RNA, 19 nt, Homo sapiens
cagaugugauuaaagcuaa

SEQ ID NO: 704377 - RNA, 19 nt, Homo sapiens
gcugacaucuugaauccuu

SEQ ID NO: 704378 - RNA, 19 nt, Homo sapiens
gaaauggugagauguaugu

SEQ ID NO: 704379 - RNA, 19 nt, Homo sapiens
gagacaagauauugauaca

SEQ ID NO: 704380 - RNA, 19 nt, Homo sapiens
aagagcaguuguccaguua

SEQ ID NO: 704381 - RNA, 19 nt, Homo sapiens
cuaauuggccuuuaaguga

SEQ ID NO: 704382 - RNA, 19 nt, Homo sapiens
ccugacagauguuacaauu

SEQ ID NO: 704383 - RNA, 19 nt, Homo sapiens
gcuagagauucauuaauuc

SEQ ID NO: 704384 - RNA, 19 nt, Homo sapiens
gaaagauaauagugaacug

SEQ ID NO: 704385 - RNA, 19 nt, Homo sapiens
ugacaggaaccuuaaguaa

SEQ ID NO: 704386 - RNA, 19 nt, Homo sapiens
uaagaaagaacuucgagaa

SEQ ID NO: 704387 - RNA, 19 nt, Homo sapiens
agaaggaaauaccagaauu

SEQ ID NO: 704388 - RNA, 19 nt, Homo sapiens
cuugaagacuggcuacaua

SEQ ID NO: 704389 - RNA, 19 nt, Homo sapiens
gaacaguaagggagaaaga

SEQ ID NO: 704390 - RNA, 19 nt, Homo sapiens
ggacagagcuucagaaacu

SEQ ID NO: 704391 - RNA, 19 nt, Homo sapiens
gcaagaaccugcuaucaga

SEQ ID NO: 704392 - RNA, 19 nt, Homo sapiens
gaagagggccagaagaaua

SEQ ID NO: 704393 - RNA, 19 nt, Homo sapiens
gcaaugagaugguagaaca

SEQ ID NO: 704394 - RNA, 19 nt, Homo sapiens
gguaaaggauguacucaaa

SEQ ID NO: 704395 - RNA, 19 nt, Homo sapiens
gaaggaagcaggaaacauu

SEQ ID NO: 704396 - RNA, 19 nt, Homo sapiens
gaacauagucuucagguau

SEQ ID NO: 704397 - RNA, 19 nt, Homo sapiens
gagaugaaauuugcaauga

SEQ ID NO: 704398 - RNA, 19 nt, Homo sapiens
gaucucaacuggauucaug

SEQ ID NO: 704399 - RNA, 19 nt, Homo sapiens
ugaaagaucucaacuggau

SEQ ID NO: 704400 - RNA, 19 nt, Homo sapiens
acaacgaacugcuuuauga

SEQ ID NO: 704401 - RNA, 19 nt, Homo sapiens
gaagaaggcagcauguauu

SEQ ID NO: 704402 - RNA, 19 nt, Homo sapiens
gaugaaauuugcaaugaga

SEQ ID NO: 704403 - RNA, 19 nt, Homo sapiens
gaagaggagugucuacauc

SEQ ID NO: 704404 - RNA, 19 nt, Homo sapiens
ugaaggagaugguaaagga

SEQ ID NO: 704405 - RNA, 19 nt, Homo sapiens
acacaggccuugaugauga

SEQ ID NO: 704406 - RNA, 19 nt, Homo sapiens
cugaagaguugcauaagua

SEQ ID NO: 704407 - RNA, 19 nt, Homo sapiens
ggacaggcauccuucuuca

SEQ ID NO: 704408 - RNA, 19 nt, Homo sapiens
caaguugacucgaguguuc

SEQ ID NO: 704409 - RNA, 19 nt, Homo sapiens
gcacccaccucaaccagaa

SEQ ID NO: 704410 - RNA, 19 nt, Homo sapiens
gagguaaucuggcuagaca

SEQ ID NO: 704411 - RNA, 19 nt, Homo sapiens
uggagaaggugaaaguaua

SEQ ID NO: 704412 - RNA, 19 nt, Homo sapiens
cagcuacucuccugaagaa

SEQ ID NO: 704413 - RNA, 19 nt, Homo sapiens
ggaagaaggcagcauguau

SEQ ID NO: 704414 - RNA, 19 nt, Homo sapiens
gaacaguggugcagugaac

SEQ ID NO: 704415 - RNA, 19 nt, Homo sapiens
gggcagaacuggcucaucu

SEQ ID NO: 704416 - RNA, 19 nt, Homo sapiens
cuacucuccugaagaaaua

SEQ ID NO: 704417 - RNA, 19 nt, Homo sapiens
gccaagcccuucaccauug

SEQ ID NO: 704418 - RNA, 19 nt, Homo sapiens
gaggaaauguaugaagaaa

SEQ ID NO: 704419 - RNA, 19 nt, Homo sapiens
ggaacauagucuucaggua

SEQ ID NO: 704420 - RNA, 19 nt, Homo sapiens
guccacagcugcagauuug

SEQ ID NO: 704421 - RNA, 19 nt, Homo sapiens
ggagguuaaagcuaaauua

SEQ ID NO: 704422 - RNA, 19 nt, Homo sapiens
gcuaaacucuaccacugaa

SEQ ID NO: 704423 - RNA, 19 nt, Homo sapiens
ucagagcgcugcaaagauc

SEQ ID NO: 704424 - RNA, 19 nt, Homo sapiens
ccauugauguggacaagaa

SEQ ID NO: 704425 - RNA, 19 nt, Homo sapiens
gcugggcucucuucuauca

SEQ ID NO: 704426 - RNA, 19 nt, Homo sapiens
ggaaagagaagagcaguca

SEQ ID NO: 704427 - RNA, 19 nt, Homo sapiens
caacauggugcuagugaaa

SEQ ID NO: 704428 - RNA, 19 nt, Homo sapiens
ccacugaagaguugcauaa

SEQ ID NO: 704429 - RNA, 19 nt, Homo sapiens
gguuaaagcuaaauuacag

SEQ ID NO: 704430 - RNA, 19 nt, Homo sapiens
ucacaaagguuggcagcuu

SEQ ID NO: 704431 - RNA, 19 nt, Homo sapiens
cacagcaucuucucaauca

SEQ ID NO: 704432 - RNA, 19 nt, Homo sapiens
cguaguuucucccauguuu

SEQ ID NO: 704433 - RNA, 19 nt, Homo sapiens
uaaaggauguacucaaagg

SEQ ID NO: 704434 - RNA, 19 nt, Homo sapiens
uggcugaacugcagaacaa

SEQ ID NO: 704435 - RNA, 19 nt, Homo sapiens
caacuggauucaugugcaa

SEQ ID NO: 704436 - RNA, 19 nt, Homo sapiens
agaacuggcucaucuauac

SEQ ID NO: 704437 - RNA, 19 nt, Homo sapiens
gcucaucuauacauaugga

SEQ ID NO: 704438 - RNA, 19 nt, Homo sapiens
ggaggaaauguaugaagaa

SEQ ID NO: 704439 - RNA, 19 nt, Homo sapiens
gugaaucccugugcaucua

SEQ ID NO: 704440 - RNA, 19 nt, Homo sapiens
cuuguuaccuucagaguug

SEQ ID NO: 704441 - RNA, 19 nt, Homo sapiens
ccaccuauguaaucucaug

SEQ ID NO: 704442 - RNA, 19 nt, Homo sapiens
gaacugcuuuaugaccuau

SEQ ID NO: 704443 - RNA, 19 nt, Homo sapiens
aggaggagcuguccacuuc

SEQ ID NO: 704444 - RNA, 19 nt, Homo sapiens
aagaagcugucccugcuaa

SEQ ID NO: 704445 - RNA, 19 nt, Homo sapiens
aagaaaccauuccuucgaa

SEQ ID NO: 704446 - RNA, 19 nt, Homo sapiens
uggaggaaauguaugaaga

SEQ ID NO: 704447 - RNA, 19 nt, Homo sapiens
gcaguagccagcuggauga

SEQ ID NO: 704448 - RNA, 19 nt, Homo sapiens
gaucuucaauagccuccaa

SEQ ID NO: 704449 - RNA, 19 nt, Homo sapiens
ugauuucuaugcacacaaa

SEQ ID NO: 704450 - RNA, 19 nt, Homo sapiens
caacagacugcagcccuua

SEQ ID NO: 704451 - RNA, 19 nt, Homo sapiens
gcagaacuggcucaucuau

SEQ ID NO: 704452 - RNA, 19 nt, Homo sapiens
guaaucucauguuguuguu

SEQ ID NO: 704453 - RNA, 19 nt, Homo sapiens
guuaggcccuuguuaccuu

SEQ ID NO: 704454 - RNA, 19 nt, Homo sapiens
uagaagagggccagaagaa

SEQ ID NO: 704455 - RNA, 19 nt, Homo sapiens
guuccaagguuucuucaca

SEQ ID NO: 704456 - RNA, 19 nt, Homo sapiens
ggacaagaaguuagaagag

SEQ ID NO: 704457 - RNA, 19 nt, Homo sapiens
aaccauuccuucgaaauuu

SEQ ID NO: 704458 - RNA, 19 nt, Homo sapiens
cgaacugcuuuaugaccua

SEQ ID NO: 704459 - RNA, 19 nt, Homo sapiens
gaagaagcugucccugcua

SEQ ID NO: 704460 - RNA, 19 nt, Homo sapiens
gaaaccauuccuucgaaau

SEQ ID NO: 704461 - RNA, 19 nt, Homo sapiens
uucaggagguuaaagcuaa

SEQ ID NO: 704462 - RNA, 19 nt, Homo sapiens
ggccguuccugcaugauug

SEQ ID NO: 704463 - RNA, 19 nt, Homo sapiens
uugcugggcucucuucuau

SEQ ID NO: 704464 - RNA, 19 nt, Homo sapiens
gcauccuucuucaaccuaa

SEQ ID NO: 704465 - RNA, 19 nt, Homo sapiens
aaaccauuccuucgaaauu

SEQ ID NO: 704466 - RNA, 19 nt, Homo sapiens
guagccagcuggaugaaac

SEQ ID NO: 704467 - RNA, 19 nt, Homo sapiens
gacaggaggaaaugaagaa

SEQ ID NO: 704468 - RNA, 19 nt, Homo sapiens
ucagaaacuuggugagucu

SEQ ID NO: 704469 - RNA, 19 nt, Homo sapiens
ccaagcccuucaccauuga

SEQ ID NO: 704470 - RNA, 19 nt, Homo sapiens
gcaggaagccagacaacag

SEQ ID NO: 704471 - RNA, 19 nt, Homo sapiens
gaagcugucccugcuaaau

SEQ ID NO: 704472 - RNA, 19 nt, Homo sapiens
ugccaaagcucaacagacu

SEQ ID NO: 704473 - RNA, 19 nt, Homo sapiens
cagcagagagagcuuguug

SEQ ID NO: 704474 - RNA, 19 nt, Homo sapiens
guggugcagugaacauuug

SEQ ID NO: 704475 - RNA, 19 nt, Homo sapiens
gccaaguucucagccauug

SEQ ID NO: 704476 - RNA, 19 nt, Homo sapiens
ccuauguaaucucauguug

SEQ ID NO: 704477 - RNA, 19 nt, Homo sapiens
agaaaccauuccuucgaaa

SEQ ID NO: 704478 - RNA, 19 nt, Homo sapiens
gcggacagagcuucagaaa

SEQ ID NO: 704479 - RNA, 19 nt, Homo sapiens
gaaauaggucucuuuuaug

SEQ ID NO: 704480 - RNA, 19 nt, Homo sapiens
accauuccuucgaaauuua

SEQ ID NO: 704481 - RNA, 19 nt, Homo sapiens
gaaacuccaaggccagguu

SEQ ID NO: 704482 - RNA, 19 nt, Homo sapiens
cuacggcggucacaaaggu

SEQ ID NO: 704483 - RNA, 19 nt, Homo sapiens
ggagcgggaugaaaagauu

SEQ ID NO: 704484 - RNA, 19 nt, Homo sapiens
gcagacacaggccuugaug

SEQ ID NO: 704485 - RNA, 19 nt, Homo sapiens
cguaagaaccagagcuuug

SEQ ID NO: 704486 - RNA, 19 nt, Homo sapiens
gaucuacaacgaacugcuu

SEQ ID NO: 704487 - RNA, 19 nt, Homo sapiens
cuacaucgaaagucggaua

SEQ ID NO: 704488 - RNA, 19 nt, Homo sapiens
uauaaccaccuauguaauc

SEQ ID NO: 704489 - RNA, 19 nt, Homo sapiens
caacaaccaccagggaaga

SEQ ID NO: 704490 - RNA, 19 nt, Homo sapiens
ggaagggacuggccuggua

SEQ ID NO: 704491 - RNA, 19 nt, Homo sapiens
gaguugagcuuguccuuau

SEQ ID NO: 704492 - RNA, 19 nt, Homo sapiens
cagcugcacuggcaagaaa

SEQ ID NO: 704493 - RNA, 19 nt, Homo sapiens
aaacugcccuguucucugu

SEQ ID NO: 704494 - RNA, 19 nt, Homo sapiens
ugcaauaaguuccuaggua

SEQ ID NO: 704495 - RNA, 19 nt, Homo sapiens
ccaugaaacugcccuguuc

SEQ ID NO: 704496 - RNA, 19 nt, Homo sapiens
gaacucaggguagagaauu

SEQ ID NO: 704497 - RNA, 19 nt, Homo sapiens
gccuaaagaugcaauaagu

SEQ ID NO: 704498 - RNA, 19 nt, Homo sapiens
cagagugccuuuccagguu

SEQ ID NO: 704499 - RNA, 19 nt, Homo sapiens
cauacucccugccuccuuu

SEQ ID NO: 704500 - RNA, 19 nt, Homo sapiens
aaggaagacuuggguagua

SEQ ID NO: 704501 - RNA, 19 nt, Homo sapiens
gagcuuguccuuaucuaga

SEQ ID NO: 704502 - RNA, 19 nt, Homo sapiens
guccuuaucuagaaacaug

SEQ ID NO: 704503 - RNA, 19 nt, Homo sapiens
gauugaagaccuggcuuua

SEQ ID NO: 704504 - RNA, 19 nt, Homo sapiens
gaaccuugccuucgucauc

SEQ ID NO: 704505 - RNA, 19 nt, Homo sapiens
cuagaaacaugugaagaug

SEQ ID NO: 704506 - RNA, 19 nt, Homo sapiens
caagacaggcauaaagaau

SEQ ID NO: 704507 - RNA, 19 nt, Homo sapiens
gagggaggcccauggcauu

SEQ ID NO: 704508 - RNA, 19 nt, Homo sapiens
gggcuccguucccguugua

SEQ ID NO: 704509 - RNA, 19 nt, Homo sapiens
gcauuguggugacggaugu

SEQ ID NO: 704510 - RNA, 19 nt, Homo sapiens
cuaaagaugcaauaaguuc

SEQ ID NO: 704511 - RNA, 19 nt, Homo sapiens
ugacggauguggccuuucu

SEQ ID NO: 704512 - RNA, 19 nt, Homo sapiens
caaguccuguggccaugaa

SEQ ID NO: 704513 - RNA, 19 nt, Homo sapiens
uaccaggccugcagguuug

SEQ ID NO: 704514 - RNA, 19 nt, Homo sapiens
gccaagacaggcauaaaga

SEQ ID NO: 704515 - RNA, 19 nt, Homo sapiens
agacaggcauaaagaaugg

SEQ ID NO: 704516 - RNA, 19 nt, Homo sapiens
gccaguuccucuucacaug

SEQ ID NO: 704517 - RNA, 19 nt, Homo sapiens
ccaggaaccuugccuucgu

SEQ ID NO: 704518 - RNA, 19 nt, Homo sapiens
ggacacugccaucucuaga

SEQ ID NO: 704519 - RNA, 19 nt, Homo sapiens
ccaagacaggcauaaagaa

SEQ ID NO: 704520 - RNA, 19 nt, Homo sapiens
ggugacggauguggccuuu

SEQ ID NO: 704521 - RNA, 19 nt, Homo sapiens
ggauggcuccaacuucuug

SEQ ID NO: 704522 - RNA, 19 nt, Homo sapiens
aggaaagagugaacugaga

SEQ ID NO: 704523 - RNA, 19 nt, Homo sapiens
guucagauggguagcacua

SEQ ID NO: 704524 - RNA, 19 nt, Homo sapiens
aggaagacuuggguaguaa

SEQ ID NO: 704525 - RNA, 19 nt, Homo sapiens
ggaggcccauggcauugug

SEQ ID NO: 704526 - RNA, 19 nt, Homo sapiens
cuaccaggccugcagguuu

SEQ ID NO: 704527 - RNA, 19 nt, Homo sapiens
ggcacuggcuggugacauc

SEQ ID NO: 704528 - RNA, 19 nt, Homo sapiens
acccuuaccuugaggaaug

SEQ ID NO: 704529 - RNA, 19 nt, Homo sapiens
uaaagaauggcgugcacuu

SEQ ID NO: 704530 - RNA, 19 nt, Homo sapiens
accagaggcuccagaguug

SEQ ID NO: 704531 - RNA, 19 nt, Homo sapiens
caaggaaagagugaacuga

SEQ ID NO: 704532 - RNA, 19 nt, Homo sapiens
uaccagaggcuccagaguu

SEQ ID NO: 704533 - RNA, 19 nt, Homo sapiens
guugccagcugcaucuguu

SEQ ID NO: 704534 - RNA, 19 nt, Homo sapiens
aggaucagcuggugacaca

SEQ ID NO: 704535 - RNA, 19 nt, Homo sapiens
gguugccucugacaagaug

SEQ ID NO: 704536 - RNA, 19 nt, Homo sapiens
agagugccuuuccagguuu

SEQ ID NO: 704537 - RNA, 19 nt, Homo sapiens
gugucgggcuuauuauugu

SEQ ID NO: 704538 - RNA, 19 nt, Homo sapiens
ggaguucaaagcccacgaa

SEQ ID NO: 704539 - RNA, 19 nt, Homo sapiens
gaagacuuggguaguaauc

SEQ ID NO: 704540 - RNA, 19 nt, Homo sapiens
gagacacgggccaccauga

SEQ ID NO: 704541 - RNA, 19 nt, Homo sapiens
uugaagaccuggcuuuagg

SEQ ID NO: 704542 - RNA, 19 nt, Homo sapiens
ccgauccacugcagaaagu

SEQ ID NO: 704543 - RNA, 19 nt, Homo sapiens
ucagauggguagcacuaag

SEQ ID NO: 704544 - RNA, 19 nt, Homo sapiens
agacuuggguaguaaucug

SEQ ID NO: 704545 - RNA, 19 nt, Homo sapiens
ggccugguacuugcuguua

SEQ ID NO: 704546 - RNA, 19 nt, Homo sapiens
ggcuagaacucaggguaga

SEQ ID NO: 704547 - RNA, 19 nt, Homo sapiens
gcaggaaaaguugauauuu

SEQ ID NO: 704548 - RNA, 19 nt, Homo sapiens
ugaaaaggcuuggcuaugg

SEQ ID NO: 704549 - RNA, 19 nt, Homo sapiens
gcuccgauccacugcagaa

SEQ ID NO: 704550 - RNA, 19 nt, Homo sapiens
cagcuggccuaaagaugca

SEQ ID NO: 704551 - RNA, 19 nt, Homo sapiens
uggaggcacugcuguccuu

SEQ ID NO: 704552 - RNA, 19 nt, Homo sapiens
ucuagaaacaugugaagau

SEQ ID NO: 704553 - RNA, 19 nt, Homo sapiens
gcuuguccuuaucuagaaa

SEQ ID NO: 704554 - RNA, 19 nt, Homo sapiens
ucccuuugcucacuccauu

SEQ ID NO: 704555 - RNA, 19 nt, Homo sapiens
ugggauggcuccaacuucu

SEQ ID NO: 704556 - RNA, 19 nt, Homo sapiens
gauccacugcagaaaguug

SEQ ID NO: 704557 - RNA, 19 nt, Homo sapiens
gggacuggccugguacuug

SEQ ID NO: 704558 - RNA, 19 nt, Homo sapiens
ccaguuccucuucacauga

SEQ ID NO: 704559 - RNA, 19 nt, Homo sapiens
gaccuuaaggccucugugu

SEQ ID NO: 704560 - RNA, 19 nt, Homo sapiens
ccugauggcaaguugguaa

SEQ ID NO: 704561 - RNA, 19 nt, Homo sapiens
gagcaggggccucgacaaa

SEQ ID NO: 704562 - RNA, 19 nt, Homo sapiens
ggaagacuuggguaguaau

SEQ ID NO: 704563 - RNA, 19 nt, Homo sapiens
aagaauggcgugcacuuuc

SEQ ID NO: 704564 - RNA, 19 nt, Homo sapiens
ccacgauaauacccugcuu

SEQ ID NO: 704565 - RNA, 19 nt, Homo sapiens
ugcagaaaguugugugcuu

SEQ ID NO: 704566 - RNA, 19 nt, Homo sapiens
uccuuuagcuucccugcuu

SEQ ID NO: 704567 - RNA, 19 nt, Homo sapiens
ccuaaagaugcaauaaguu

SEQ ID NO: 704568 - RNA, 19 nt, Homo sapiens
ggauguggccuuucuaccu

SEQ ID NO: 704569 - RNA, 19 nt, Homo sapiens
agacacgggccaccaugaa

SEQ ID NO: 704570 - RNA, 19 nt, Homo sapiens
agaaaguugugugcuucaa

SEQ ID NO: 704571 - RNA, 19 nt, Homo sapiens
agaguugagcuuguccuua

SEQ ID NO: 704572 - RNA, 19 nt, Homo sapiens
ugccugcccuucuagugaa

SEQ ID NO: 704573 - RNA, 19 nt, Homo sapiens
gcacugccugcccuucuag

SEQ ID NO: 704574 - RNA, 19 nt, Homo sapiens
ccuggacacugccaucucu

SEQ ID NO: 704575 - RNA, 19 nt, Homo sapiens
cugugugucgggcuuauua

SEQ ID NO: 704576 - RNA, 19 nt, Homo sapiens
aagaugcaauaaguuccua

SEQ ID NO: 704577 - RNA, 19 nt, Homo sapiens
gcuugccacuggaggaaca

SEQ ID NO: 704578 - RNA, 19 nt, Homo sapiens
aagacaggcauaaagaaug

SEQ ID NO: 704579 - RNA, 19 nt, Homo sapiens
ggaaggggcaaaaggaaga

SEQ ID NO: 704580 - RNA, 19 nt, Homo sapiens
caugugaagaugcccaaga

SEQ ID NO: 704581 - RNA, 19 nt, Homo sapiens
guugccaucuacauagcuu

SEQ ID NO: 704582 - RNA, 19 nt, Homo sapiens
gugcuucaaccacgauaau

SEQ ID NO: 704583 - RNA, 19 nt, Homo sapiens
auaaacaaggaaagaguga

SEQ ID NO: 704584 - RNA, 19 nt, Homo sapiens
gcaggaaggggcaaaagga

SEQ ID NO: 704585 - RNA, 19 nt, Homo sapiens
gcuauggcccugugugacu

SEQ ID NO: 704586 - RNA, 19 nt, Homo sapiens
cagagaaggccgguuccaa

SEQ ID NO: 704587 - RNA, 19 nt, Homo sapiens
ugaauccggcaccuuccua

SEQ ID NO: 704588 - RNA, 19 nt, Homo sapiens
uugcugcacucccaugaca

SEQ ID NO: 704589 - RNA, 19 nt, Homo sapiens
gaauagaacugaauguaga

SEQ ID NO: 704590 - RNA, 19 nt, Homo sapiens
gaaaguagcugccgaaagc

SEQ ID NO: 704591 - RNA, 19 nt, Homo sapiens
gaagaucagugcaaaauua

SEQ ID NO: 704592 - RNA, 19 nt, Homo sapiens
gacaacaccugccuaauga

SEQ ID NO: 704593 - RNA, 19 nt, Homo sapiens
acaaugcuauggacaauua

SEQ ID NO: 704594 - RNA, 19 nt, Homo sapiens
gaagucggauugaagcuuu

SEQ ID NO: 704595 - RNA, 19 nt, Homo sapiens
acacugacaugacgaauaa

SEQ ID NO: 704596 - RNA, 19 nt, Homo sapiens
ggaaauagaacaaaguaug

SEQ ID NO: 704597 - RNA, 19 nt, Homo sapiens
ugaaagagcugauaaaaug

SEQ ID NO: 704598 - RNA, 19 nt, Homo sapiens
gacuggacauugugaaaua

SEQ ID NO: 704599 - RNA, 19 nt, Homo sapiens
caaaugaccgugagaacua

SEQ ID NO: 704600 - RNA, 19 nt, Homo sapiens
acaaggaucuucuucgauu

SEQ ID NO: 704601 - RNA, 19 nt, Homo sapiens
ggaaacagugcccuucaua

SEQ ID NO: 704602 - RNA, 19 nt, Homo sapiens
gagaugcucuucauaugga

SEQ ID NO: 704603 - RNA, 19 nt, Homo sapiens
uuaagugacuggauaugua

SEQ ID NO: 704604 - RNA, 19 nt, Homo sapiens
cgaagaagaucagugcaaa

SEQ ID NO: 704605 - RNA, 19 nt, Homo sapiens
ccaagauggugauaacauu

SEQ ID NO: 704606 - RNA, 19 nt, Homo sapiens
cggauaauauggaauuuga

SEQ ID NO: 704607 - RNA, 19 nt, Homo sapiens
gggccuggcuggcuaugua

SEQ ID NO: 704608 - RNA, 19 nt, Homo sapiens
ugaaugccguggacaauga

SEQ ID NO: 704609 - RNA, 19 nt, Homo sapiens
agacauaccacuaucuaua

SEQ ID NO: 704610 - RNA, 19 nt, Homo sapiens
gacgagagccugcagguuu

SEQ ID NO: 704611 - RNA, 19 nt, Homo sapiens
gcaggaggaggcaguguua

SEQ ID NO: 704612 - RNA, 19 nt, Homo sapiens
ugaagaguuuguuggauuu

SEQ ID NO: 704613 - RNA, 19 nt, Homo sapiens
cuguaaagcugaugucgua

SEQ ID NO: 704614 - RNA, 19 nt, Homo sapiens
ccacaaggaucuucuucga

SEQ ID NO: 704615 - RNA, 19 nt, Homo sapiens
uuagagagguuccaagaug

SEQ ID NO: 704616 - RNA, 19 nt, Homo sapiens
aaacagugcccuucauauu

SEQ ID NO: 704617 - RNA, 19 nt, Homo sapiens
gaagcugggcacauagaua

SEQ ID NO: 704618 - RNA, 19 nt, Homo sapiens
uaaagcugaugucguagaa

SEQ ID NO: 704619 - RNA, 19 nt, Homo sapiens
gaaacagugcccuucauau

SEQ ID NO: 704620 - RNA, 19 nt, Homo sapiens
ggaauagaacugaauguag

SEQ ID NO: 704621 - RNA, 19 nt, Homo sapiens
ugacaacaccugccuaaug

SEQ ID NO: 704622 - RNA, 19 nt, Homo sapiens
caucagcauugccaacaaa

SEQ ID NO: 704623 - RNA, 19 nt, Homo sapiens
acagugcccuucauauuau

SEQ ID NO: 704624 - RNA, 19 nt, Homo sapiens
caaggaucuucuucgauuu

SEQ ID NO: 704625 - RNA, 19 nt, Homo sapiens
gggaauagaacugaaugua

SEQ ID NO: 704626 - RNA, 19 nt, Homo sapiens
ggugauaacauucucgaaa

SEQ ID NO: 704627 - RNA, 19 nt, Homo sapiens
gagcaguucgggcuaauga

SEQ ID NO: 704628 - RNA, 19 nt, Homo sapiens
caacaccugccuaaugauu

SEQ ID NO: 704629 - RNA, 19 nt, Homo sapiens
aacagugcccuucauauua

SEQ ID NO: 704630 - RNA, 19 nt, Homo sapiens
gcagaucuacaaccugauu

SEQ ID NO: 704631 - RNA, 19 nt, Homo sapiens
gaacuguuacucucucaug

SEQ ID NO: 704632 - RNA, 19 nt, Homo sapiens
gugaaauacuugguugaaa

SEQ ID NO: 704633 - RNA, 19 nt, Homo sapiens
caaaguaugaacagaguga

SEQ ID NO: 704634 - RNA, 19 nt, Homo sapiens
gacauaccacuaucuauau

SEQ ID NO: 704635 - RNA, 19 nt, Homo sapiens
gaauaagacuccgcuagac

SEQ ID NO: 704636 - RNA, 19 nt, Homo sapiens
ccaauacuccaguugauga

SEQ ID NO: 704637 - RNA, 19 nt, Homo sapiens
cauaaagacauaccacuau

SEQ ID NO: 704638 - RNA, 19 nt, Homo sapiens
caaguuuucucacaaauga

SEQ ID NO: 704639 - RNA, 19 nt, Homo sapiens
gauugaagcuuuggaacuc

SEQ ID NO: 704640 - RNA, 19 nt, Homo sapiens
cagcauugccaacaaauau

SEQ ID NO: 704641 - RNA, 19 nt, Homo sapiens
gagccaacgugaaccauac

SEQ ID NO: 704642 - RNA, 19 nt, Homo sapiens
uugaagaguuuguuggauu

SEQ ID NO: 704643 - RNA, 19 nt, Homo sapiens
caucaucauuagccuaguu

SEQ ID NO: 704644 - RNA, 19 nt, Homo sapiens
ccagaacucgugaagguuu

SEQ ID NO: 704645 - RNA, 19 nt, Homo sapiens
ccacaaugcuauggacaau

SEQ ID NO: 704646 - RNA, 19 nt, Homo sapiens
uaagugacuggauauguaa

SEQ ID NO: 704647 - RNA, 19 nt, Homo sapiens
gauguggucagauaccuuu

SEQ ID NO: 704648 - RNA, 19 nt, Homo sapiens
gcauugccaacaaauauga

SEQ ID NO: 704649 - RNA, 19 nt, Homo sapiens
ggagccaacgugaaccaua

SEQ ID NO: 704650 - RNA, 19 nt, Homo sapiens
cgacggguaugucauugau

SEQ ID NO: 704651 - RNA, 19 nt, Homo sapiens
auacuccaguugaugauuu

SEQ ID NO: 704652 - RNA, 19 nt, Homo sapiens
uuucucaucccaucauuua

SEQ ID NO: 704653 - RNA, 19 nt, Homo sapiens
aaagacauaccacuaucua

SEQ ID NO: 704654 - RNA, 19 nt, Homo sapiens
ggugguacgcuugcucuua

SEQ ID NO: 704655 - RNA, 19 nt, Homo sapiens
gaauuugagcaguguauca

SEQ ID NO: 704656 - RNA, 19 nt, Homo sapiens
uauggaaggccuuauaguu

SEQ ID NO: 704657 - RNA, 19 nt, Homo sapiens
ggacauugugaaauacuug

SEQ ID NO: 704658 - RNA, 19 nt, Homo sapiens
ccaaugacgucugcagcuu

SEQ ID NO: 704659 - RNA, 19 nt, Homo sapiens
gcugucaacuccaauacuc

SEQ ID NO: 704660 - RNA, 19 nt, Homo sapiens
uguaaucucuauaccuuuc

SEQ ID NO: 704661 - RNA, 19 nt, Homo sapiens
uuuaggugcugacaauauu

SEQ ID NO: 704662 - RNA, 19 nt, Homo sapiens
ucauauggaaggccuuaua

SEQ ID NO: 704663 - RNA, 19 nt, Homo sapiens
ucauaaagacauaccacua

SEQ ID NO: 704664 - RNA, 19 nt, Homo sapiens
cgaauaaacagaauaagac

SEQ ID NO: 704665 - RNA, 19 nt, Homo sapiens
gugguacgcuugcucuuag

SEQ ID NO: 704666 - RNA, 19 nt, Homo sapiens
agaacugaauguagaaauc

SEQ ID NO: 704667 - RNA, 19 nt, Homo sapiens
ucagauaccuuuuagaaca

SEQ ID NO: 704668 - RNA, 19 nt, Homo sapiens
gcaauggacacgcaaaggu

SEQ ID NO: 704669 - RNA, 19 nt, Homo sapiens
gccuaaugauugcggcaua

SEQ ID NO: 704670 - RNA, 19 nt, Homo sapiens
uucauuaagugacuggaua

SEQ ID NO: 704671 - RNA, 19 nt, Homo sapiens
gcuaucugcuuggcuaugu

SEQ ID NO: 704672 - RNA, 19 nt, Homo sapiens
agaauaagacuccgcuaga

SEQ ID NO: 704673 - RNA, 19 nt, Homo sapiens
gggaaacagugcccuucau

SEQ ID NO: 704674 - RNA, 19 nt, Homo sapiens
gucugcagcuuuccaaaug

SEQ ID NO: 704675 - RNA, 19 nt, Homo sapiens
gaugacgccauugaaagua

SEQ ID NO: 704676 - RNA, 19 nt, Homo sapiens
ggaugacgccauugaaagu

SEQ ID NO: 704677 - RNA, 19 nt, Homo sapiens
acaacaggcccaucaguga

SEQ ID NO: 704678 - RNA, 19 nt, Homo sapiens
ggacaaugagggaaacagu

SEQ ID NO: 704679 - RNA, 19 nt, Homo sapiens
uuaacaagcagaucuacaa

SEQ ID NO: 704680 - RNA, 19 nt, Homo sapiens
gcugauguccacaaugcua

SEQ ID NO: 704681 - RNA, 19 nt, Homo sapiens
cauauaagggacacacuga

SEQ ID NO: 704682 - RNA, 19 nt, Homo sapiens
gaaaauaaugccaacauca

SEQ ID NO: 704683 - RNA, 19 nt, Homo sapiens
cgugaaccauaccacagua

SEQ ID NO: 704684 - RNA, 19 nt, Homo sapiens
gugauaacauucucgaaaa

SEQ ID NO: 704685 - RNA, 19 nt, Homo sapiens
gcaaaugaccgugagaacu

SEQ ID NO: 704686 - RNA, 19 nt, Homo sapiens
acucuugggugccuccuuu

SEQ ID NO: 704687 - RNA, 19 nt, Homo sapiens
ucccagaacucgugaaggu

SEQ ID NO: 704688 - RNA, 19 nt, Homo sapiens
caaccugauucaccuugau

SEQ ID NO: 704689 - RNA, 19 nt, Homo sapiens
gaauacaccuugucucaaa

SEQ ID NO: 704690 - RNA, 19 nt, Homo sapiens
caagaaggaugccauauga

SEQ ID NO: 704691 - RNA, 19 nt, Homo sapiens
gcacagaacccacagcuaa

SEQ ID NO: 704692 - RNA, 19 nt, Homo sapiens
gcaaagaccaucuaacauu

SEQ ID NO: 704693 - RNA, 19 nt, Homo sapiens
gcacauuuauuucaccuaa

SEQ ID NO: 704694 - RNA, 19 nt, Homo sapiens
gaagguacccaauaaauau

SEQ ID NO: 704695 - RNA, 19 nt, Homo sapiens
cauagaagguacccaauaa

SEQ ID NO: 704696 - RNA, 19 nt, Homo sapiens
gaggaacaauuuaagagua

SEQ ID NO: 704697 - RNA, 19 nt, Homo sapiens
gcaaauaacuaggaugaau

SEQ ID NO: 704698 - RNA, 19 nt, Homo sapiens
gauagucccuuauaaugaa

SEQ ID NO: 704699 - RNA, 19 nt, Homo sapiens
gggaaacacugucuuaaau

SEQ ID NO: 704700 - RNA, 19 nt, Homo sapiens
caucuaacauucugcauuu

SEQ ID NO: 704701 - RNA, 19 nt, Homo sapiens
gaaagaaggccguauuuua

SEQ ID NO: 704702 - RNA, 19 nt, Homo sapiens
caaaucagccaaaggaaua

SEQ ID NO: 704703 - RNA, 19 nt, Homo sapiens
ugaaagaacuguugaccuu

SEQ ID NO: 704704 - RNA, 19 nt, Homo sapiens
ggaaacacugucuuaaaua

SEQ ID NO: 704705 - RNA, 19 nt, Homo sapiens
cagcaaaucucagaagaaa

SEQ ID NO: 704706 - RNA, 19 nt, Homo sapiens
guacaagacugcuuacuac

SEQ ID NO: 704707 - RNA, 19 nt, Homo sapiens
gaaauccaguuuaucacaa

SEQ ID NO: 704708 - RNA, 19 nt, Homo sapiens
ggaagacagugguauuuca

SEQ ID NO: 704709 - RNA, 19 nt, Homo sapiens
ccucaaccauucuguauuu

SEQ ID NO: 704710 - RNA, 19 nt, Homo sapiens
aaauguaucuugcuucuug

SEQ ID NO: 704711 - RNA, 19 nt, Homo sapiens
gaacacaguccauuugaau

SEQ ID NO: 704712 - RNA, 19 nt, Homo sapiens
caaagaccaucuaacauuc

SEQ ID NO: 704713 - RNA, 19 nt, Homo sapiens
gaacaacauucuggaacaa

SEQ ID NO: 704714 - RNA, 19 nt, Homo sapiens
gagagaacauucaucuuuc

SEQ ID NO: 704715 - RNA, 19 nt, Homo sapiens
uuaggaagauggagaauga

SEQ ID NO: 704716 - RNA, 19 nt, Homo sapiens
ccaguucccuucaaucaaa

SEQ ID NO: 704717 - RNA, 19 nt, Homo sapiens
uaauacagcuucuacuaug

SEQ ID NO: 704718 - RNA, 19 nt, Homo sapiens
cagcaacauuuccaucaua

SEQ ID NO: 704719 - RNA, 19 nt, Homo sapiens
gcacagugucuucaacaua

SEQ ID NO: 704720 - RNA, 19 nt, Homo sapiens
aaaggaggcccaacaguua

SEQ ID NO: 704721 - RNA, 19 nt, Homo sapiens
agaagaagauccuccuaaa

SEQ ID NO: 704722 - RNA, 19 nt, Homo sapiens
acugauagcuacuuuguuu

SEQ ID NO: 704723 - RNA, 19 nt, Homo sapiens
gcaugaaggugagaauuug

SEQ ID NO: 704724 - RNA, 19 nt, Homo sapiens
caaccuaucuguucugucu

SEQ ID NO: 704725 - RNA, 19 nt, Homo sapiens
ggaacaacauucuggaaca

SEQ ID NO: 704726 - RNA, 19 nt, Homo sapiens
gaaaugguagacacugaua

SEQ ID NO: 704727 - RNA, 19 nt, Homo sapiens
gaccaucccugccucgaaa

SEQ ID NO: 704728 - RNA, 19 nt, Homo sapiens
caagacugcuuacuacuuc

SEQ ID NO: 704729 - RNA, 19 nt, Homo sapiens
ugaguuagcuacugaggaa

SEQ ID NO: 704730 - RNA, 19 nt, Homo sapiens
gagauagucccuuauaaug

SEQ ID NO: 704731 - RNA, 19 nt, Homo sapiens
gccacucucuuuaccuuua

SEQ ID NO: 704732 - RNA, 19 nt, Homo sapiens
gaacaugauaucugaguga

SEQ ID NO: 704733 - RNA, 19 nt, Homo sapiens
gagaaagaaggccguauuu

SEQ ID NO: 704734 - RNA, 19 nt, Homo sapiens
cuaugaaggugaacaauau

SEQ ID NO: 704735 - RNA, 19 nt, Homo sapiens
cagauuaacuuuccauucu

SEQ ID NO: 704736 - RNA, 19 nt, Homo sapiens
gaaagaacuguugaccuua

SEQ ID NO: 704737 - RNA, 19 nt, Homo sapiens
ggagauagucccuuauaau

SEQ ID NO: 704738 - RNA, 19 nt, Homo sapiens
gaggcaagaagaacauuua

SEQ ID NO: 704739 - RNA, 19 nt, Homo sapiens
gaacuauggcaugcaaaua

SEQ ID NO: 704740 - RNA, 19 nt, Homo sapiens
gaaacucucaacaguauga

SEQ ID NO: 704741 - RNA, 19 nt, Homo sapiens
cuccguagcuuuauauauu

SEQ ID NO: 704742 - RNA, 19 nt, Homo sapiens
cagacacucuuucuuggua

SEQ ID NO: 704743 - RNA, 19 nt, Homo sapiens
gaagacaaccagcucaaug

SEQ ID NO: 704744 - RNA, 19 nt, Homo sapiens
agaaacagcucagagaaga

SEQ ID NO: 704745 - RNA, 19 nt, Homo sapiens
caaagaaacagcucagaga

SEQ ID NO: 704746 - RNA, 19 nt, Homo sapiens
caaaggaggcccaacaguu

SEQ ID NO: 704747 - RNA, 19 nt, Homo sapiens
caugauaucugagugaaga

SEQ ID NO: 704748 - RNA, 19 nt, Homo sapiens
caaccaccauggcaaauuc

SEQ ID NO: 704749 - RNA, 19 nt, Homo sapiens
caucagggauuauuauucu

SEQ ID NO: 704750 - RNA, 19 nt, Homo sapiens
caacauuuccaucauagaa

SEQ ID NO: 704751 - RNA, 19 nt, Homo sapiens
gaaaggugacugucuagga

SEQ ID NO: 704752 - RNA, 19 nt, Homo sapiens
gagaagggaaggcaggaua

SEQ ID NO: 704753 - RNA, 19 nt, Homo sapiens
ugacccagcuuaaccauca

SEQ ID NO: 704754 - RNA, 19 nt, Homo sapiens
ucacuugucugaguuaguu

SEQ ID NO: 704755 - RNA, 19 nt, Homo sapiens
agagagaacauucaucuuu

SEQ ID NO: 704756 - RNA, 19 nt, Homo sapiens
ugucuaggaugcugaauga

SEQ ID NO: 704757 - RNA, 19 nt, Homo sapiens
gcuaacaaaguucaaguaa

SEQ ID NO: 704758 - RNA, 19 nt, Homo sapiens
gcaugucacucucuuccuu

SEQ ID NO: 704759 - RNA, 19 nt, Homo sapiens
gcaaauuccacagagguua

SEQ ID NO: 704760 - RNA, 19 nt, Homo sapiens
ugaagcagccaucacauaa

SEQ ID NO: 704761 - RNA, 19 nt, Homo sapiens
gguacaagacugcuuacua

SEQ ID NO: 704762 - RNA, 19 nt, Homo sapiens
agaagguacccaauaaaua

SEQ ID NO: 704763 - RNA, 19 nt, Homo sapiens
gaagauggagaaugaggaa

SEQ ID NO: 704764 - RNA, 19 nt, Homo sapiens
cagcaaagaccaucuaaca

SEQ ID NO: 704765 - RNA, 19 nt, Homo sapiens
ccugaaaggugacugucua

SEQ ID NO: 704766 - RNA, 19 nt, Homo sapiens
ggaaaaggcuuaggaagau

SEQ ID NO: 704767 - RNA, 19 nt, Homo sapiens
ccaaaucguacccuaaauu

SEQ ID NO: 704768 - RNA, 19 nt, Homo sapiens
ucuagucucuucuuuaugu

SEQ ID NO: 704769 - RNA, 19 nt, Homo sapiens
cuucagcaauuuguaguua

SEQ ID NO: 704770 - RNA, 19 nt, Homo sapiens
agacuacacuccauccuau

SEQ ID NO: 704771 - RNA, 19 nt, Homo sapiens
gaaaucccuucuccugcaa

SEQ ID NO: 704772 - RNA, 19 nt, Homo sapiens
ggaaauccagcaaaucuca

SEQ ID NO: 704773 - RNA, 19 nt, Homo sapiens
gaccaagucagccaaauau

SEQ ID NO: 704774 - RNA, 19 nt, Homo sapiens
caacaaccaccauggcaaa

SEQ ID NO: 704775 - RNA, 19 nt, Homo sapiens
gagaugaugcgguauaauc

SEQ ID NO: 704776 - RNA, 19 nt, Homo sapiens
ggagauccacacaucagua

SEQ ID NO: 704777 - RNA, 19 nt, Homo sapiens
aaagagaaaucacugacau

SEQ ID NO: 704778 - RNA, 19 nt, Homo sapiens
gaugaacacaguccauuug

SEQ ID NO: 704779 - RNA, 19 nt, Homo sapiens
ucaauuacgccuacugaaa

SEQ ID NO: 704780 - RNA, 19 nt, Homo sapiens
cagaaggcauccaaaguca

SEQ ID NO: 704781 - RNA, 19 nt, Homo sapiens
ggugagaauuugaacuaug

SEQ ID NO: 704782 - RNA, 19 nt, Homo sapiens
gaaauccucagcacccaaa

SEQ ID NO: 704783 - RNA, 19 nt, Homo sapiens
gaggagaugaugcgguaua

SEQ ID NO: 704784 - RNA, 19 nt, Homo sapiens
ccaccacuccguagcuuua

SEQ ID NO: 704785 - RNA, 19 nt, Homo sapiens
uuucuuagcuuucuuccuu

SEQ ID NO: 704786 - RNA, 19 nt, Homo sapiens
ucaaagagggaccaaugua

SEQ ID NO: 704787 - RNA, 19 nt, Homo sapiens
uagcaaagcaucacucuuc

SEQ ID NO: 704788 - RNA, 19 nt, Homo sapiens
gagaagagggaaagccaaa

SEQ ID NO: 704789 - RNA, 19 nt, Homo sapiens
gagaccagauucccaaaua

SEQ ID NO: 704790 - RNA, 19 nt, Homo sapiens
ggucuuggcucguauacua

SEQ ID NO: 704791 - RNA, 19 nt, Homo sapiens
gaggauggcucccgugcua

SEQ ID NO: 704792 - RNA, 19 nt, Homo sapiens
gcagagguguucuuugaga

SEQ ID NO: 704793 - RNA, 19 nt, Homo sapiens
cggcagagguguucuuuga

SEQ ID NO: 704794 - RNA, 19 nt, Homo sapiens
ggacaugcacacacaagua

SEQ ID NO: 704795 - RNA, 19 nt, Homo sapiens
ucagguggcucaacgcuuu

SEQ ID NO: 704796 - RNA, 19 nt, Homo sapiens
gcacacacaaguaacauug

SEQ ID NO: 704797 - RNA, 19 nt, Homo sapiens
cgacaggagugguucuaga

SEQ ID NO: 704798 - RNA, 19 nt, Homo sapiens
gacaugcacacacaaguaa

SEQ ID NO: 704799 - RNA, 19 nt, Homo sapiens
ucaaagagcgagcgugcua

SEQ ID NO: 704800 - RNA, 19 nt, Homo sapiens
ugaagaagcuugccccaaa

SEQ ID NO: 704801 - RNA, 19 nt, Homo sapiens
gaacggcuguacuccacau

SEQ ID NO: 704802 - RNA, 19 nt, Homo sapiens
ggaauugagcgccauguca

SEQ ID NO: 704803 - RNA, 19 nt, Homo sapiens
uggccucgcuggacacuuu

SEQ ID NO: 704804 - RNA, 19 nt, Homo sapiens
uuaacacgguugccugaaa

SEQ ID NO: 704805 - RNA, 19 nt, Homo sapiens
gagcuggcgugugggaauu

SEQ ID NO: 704806 - RNA, 19 nt, Homo sapiens
ccaaauacuguuucccaaa

SEQ ID NO: 704807 - RNA, 19 nt, Homo sapiens
acagagccuuuaacccuuu

SEQ ID NO: 704808 - RNA, 19 nt, Homo sapiens
guguagggcugaguacuga

SEQ ID NO: 704809 - RNA, 19 nt, Homo sapiens
agacggagaaggugcagua

SEQ ID NO: 704810 - RNA, 19 nt, Homo sapiens
ccaccucccucucucagau

SEQ ID NO: 704811 - RNA, 19 nt, Homo sapiens
aauaaggagucagaccuaa

SEQ ID NO: 704812 - RNA, 19 nt, Homo sapiens
uaauaaggagucagaccua

SEQ ID NO: 704813 - RNA, 19 nt, Homo sapiens
aaaggaguaugaagaggau

SEQ ID NO: 704814 - RNA, 19 nt, Homo sapiens
gaagauguggguguccaaa

SEQ ID NO: 704815 - RNA, 19 nt, Homo sapiens
ggauggcucccgugcuauu

SEQ ID NO: 704816 - RNA, 19 nt, Homo sapiens
caagaaagaggucgucacu

SEQ ID NO: 704817 - RNA, 19 nt, Homo sapiens
gaggggaagccacuuaaua

SEQ ID NO: 704818 - RNA, 19 nt, Homo sapiens
uaacacgguugccugaaaa

SEQ ID NO: 704819 - RNA, 19 nt, Homo sapiens
gugugucacugcauccauu

SEQ ID NO: 704820 - RNA, 19 nt, Homo sapiens
cacaggacaugcacacaca

SEQ ID NO: 704821 - RNA, 19 nt, Homo sapiens
ucagugaagugaagaagcu

SEQ ID NO: 704822 - RNA, 19 nt, Homo sapiens
cggcugaguuugagguugu

SEQ ID NO: 704823 - RNA, 19 nt, Homo sapiens
aggaucagcugcagaccuu

SEQ ID NO: 704824 - RNA, 19 nt, Homo sapiens
gcuagagccagcugcacua

SEQ ID NO: 704825 - RNA, 19 nt, Homo sapiens
ggguagaugcccuggugua

SEQ ID NO: 704826 - RNA, 19 nt, Homo sapiens
cgugcuaccuguccaucaa

SEQ ID NO: 704827 - RNA, 19 nt, Homo sapiens
ccgcucaacccgaguaaga

SEQ ID NO: 704828 - RNA, 19 nt, Homo sapiens
guacgucuacuccaaggau

SEQ ID NO: 704829 - RNA, 19 nt, Homo sapiens
uuaccucacccaagaaaga

SEQ ID NO: 704830 - RNA, 19 nt, Homo sapiens
cagagcacuucauccacuu

SEQ ID NO: 704831 - RNA, 19 nt, Homo sapiens
acacacaaguaacauugag

SEQ ID NO: 704832 - RNA, 19 nt, Homo sapiens
gagaccgauuacucaguga

SEQ ID NO: 704833 - RNA, 19 nt, Homo sapiens
ccauaccucggcugaguuu

SEQ ID NO: 704834 - RNA, 19 nt, Homo sapiens
gaaggcggcagagguguuc

SEQ ID NO: 704835 - RNA, 19 nt, Homo sapiens
ggagaccagauucccaaau

SEQ ID NO: 704836 - RNA, 19 nt, Homo sapiens
gcaucuggcaguacgucua

SEQ ID NO: 704837 - RNA, 19 nt, Homo sapiens
gaagaagcuugccccaaag

SEQ ID NO: 704838 - RNA, 19 nt, Homo sapiens
cggagaaggugcaguacac

SEQ ID NO: 704839 - RNA, 19 nt, Homo sapiens
ccagauucccaaauacugu

SEQ ID NO: 704840 - RNA, 19 nt, Homo sapiens
gucaggcuguuguggguau

SEQ ID NO: 704841 - RNA, 19 nt, Homo sapiens
gacggcagcacgcuugaug

SEQ ID NO: 704842 - RNA, 19 nt, Homo sapiens
agacuggaacgacauggaa

SEQ ID NO: 704843 - RNA, 19 nt, Homo sapiens
acucuguccuccuaucuuc

SEQ ID NO: 704844 - RNA, 19 nt, Homo sapiens
ggaguccuacgacaucauc

SEQ ID NO: 704845 - RNA, 19 nt, Homo sapiens
ggagacagagccuuuaacc

SEQ ID NO: 704846 - RNA, 19 nt, Homo sapiens
gaccagauucccaaauacu

SEQ ID NO: 704847 - RNA, 19 nt, Homo sapiens
uggaacgcaucuggcagua

SEQ ID NO: 704848 - RNA, 19 nt, Homo sapiens
cgaguaagaaccgggagaa

SEQ ID NO: 704849 - RNA, 19 nt, Homo sapiens
agaccagauucccaaauac

SEQ ID NO: 704850 - RNA, 19 nt, Homo sapiens
agaaggugcaguacacguu

SEQ ID NO: 704851 - RNA, 19 nt, Homo sapiens
gagacuggaacgacaugga

SEQ ID NO: 704852 - RNA, 19 nt, Homo sapiens
gguguagggcugaguacug

SEQ ID NO: 704853 - RNA, 19 nt, Homo sapiens
gcuggcgugugggaauuga

SEQ ID NO: 704854 - RNA, 19 nt, Homo sapiens
ucucucagauauguacaau

SEQ ID NO: 704855 - RNA, 19 nt, Homo sapiens
uaaggagucagaccuaaaa

SEQ ID NO: 704856 - RNA, 19 nt, Homo sapiens
agagccagcugcacuaucc

SEQ ID NO: 704857 - RNA, 19 nt, Homo sapiens
guagggcugaguacugaau

SEQ ID NO: 704858 - RNA, 19 nt, Homo sapiens
gcucguauacuaggcuuag

SEQ ID NO: 704859 - RNA, 19 nt, Homo sapiens
cauggaguccuacgacauc

SEQ ID NO: 704860 - RNA, 19 nt, Homo sapiens
ucaacccacagaaggauga

SEQ ID NO: 704861 - RNA, 19 nt, Homo sapiens
aggcugugcucagucugua

SEQ ID NO: 704862 - RNA, 19 nt, Homo sapiens
ggagaaagcugcaauuuac

SEQ ID NO: 704863 - RNA, 19 nt, Homo sapiens
ggaacgagcugccgaaguu

SEQ ID NO: 704864 - RNA, 19 nt, Homo sapiens
gaaagagccuguuaccuau

SEQ ID NO: 704865 - RNA, 19 nt, Homo sapiens
cugaauggcugcagaguua

SEQ ID NO: 704866 - RNA, 19 nt, Homo sapiens
gaacgcauuuggcaauaug

SEQ ID NO: 704867 - RNA, 19 nt, Homo sapiens
gggcugaucuugugccauu

SEQ ID NO: 704868 - RNA, 19 nt, Homo sapiens
gaaacuagcuccaaaagau

SEQ ID NO: 704869 - RNA, 19 nt, Homo sapiens
guacugaaauaaagucguu

SEQ ID NO: 704870 - RNA, 19 nt, Homo sapiens
agaaagagccuguuaccua

SEQ ID NO: 704871 - RNA, 19 nt, Homo sapiens
caacggauccggugugauu

SEQ ID NO: 704872 - RNA, 19 nt, Homo sapiens
ugaagaaacuagcuccaaa

SEQ ID NO: 704873 - RNA, 19 nt, Homo sapiens
ucaccucucucugaaguua

SEQ ID NO: 704874 - RNA, 19 nt, Homo sapiens
gcagugcgcuuaaccaacu

SEQ ID NO: 704875 - RNA, 19 nt, Homo sapiens
ggaccucgcuuuccaucug

SEQ ID NO: 704876 - RNA, 19 nt, Homo sapiens
gcugguugcugguuagauu

SEQ ID NO: 704877 - RNA, 19 nt, Homo sapiens
cagaaaggacgaugaacua

SEQ ID NO: 704878 - RNA, 19 nt, Homo sapiens
ccuuggaccugcuugguua

SEQ ID NO: 704879 - RNA, 19 nt, Homo sapiens
gagcaguccucccucugaa

SEQ ID NO: 704880 - RNA, 19 nt, Homo sapiens
ugacugaggcgccuuuaaa

SEQ ID NO: 704881 - RNA, 19 nt, Homo sapiens
gaagaugugggucuccaaa

SEQ ID NO: 704882 - RNA, 19 nt, Homo sapiens
ccuguuaccuauccauaaa

SEQ ID NO: 704883 - RNA, 19 nt, Homo sapiens
aaauaaagucguuccgaua

SEQ ID NO: 704884 - RNA, 19 nt, Homo sapiens
caaccagccugucgugauc

SEQ ID NO: 704885 - RNA, 19 nt, Homo sapiens
agagaaagcucaguacuac

SEQ ID NO: 704886 - RNA, 19 nt, Homo sapiens
gcagguaugugugaaagca

SEQ ID NO: 704887 - RNA, 19 nt, Homo sapiens
uggagaaagcugcaauuua

SEQ ID NO: 704888 - RNA, 19 nt, Homo sapiens
guugaguucugucugguuu

SEQ ID NO: 704889 - RNA, 19 nt, Homo sapiens
gcucuacccuguucaaagg

SEQ ID NO: 704890 - RNA, 19 nt, Homo sapiens
ggaccugcuugguuaagga

SEQ ID NO: 704891 - RNA, 19 nt, Homo sapiens
cagagaaagcucaguacua

SEQ ID NO: 704892 - RNA, 19 nt, Homo sapiens
ggaacgcauuuggcaauau

SEQ ID NO: 704893 - RNA, 19 nt, Homo sapiens
gaaacaggagguaaaauuu

SEQ ID NO: 704894 - RNA, 19 nt, Homo sapiens
gagccaggccugacaccua

SEQ ID NO: 704895 - RNA, 19 nt, Homo sapiens
gaagcuacacucaaagaca

SEQ ID NO: 704896 - RNA, 19 nt, Homo sapiens
ccucugaguuugagauugu

SEQ ID NO: 704897 - RNA, 19 nt, Homo sapiens
gacaacggauccgguguga

SEQ ID NO: 704898 - RNA, 19 nt, Homo sapiens
gaucuugugccauucuuga

SEQ ID NO: 704899 - RNA, 19 nt, Homo sapiens
caucuucaccucucucuga

SEQ ID NO: 704900 - RNA, 19 nt, Homo sapiens
agacagagaaagcucagua

SEQ ID NO: 704901 - RNA, 19 nt, Homo sapiens
ccucugggcugaucuugug

SEQ ID NO: 704902 - RNA, 19 nt, Homo sapiens
ggagagccagugcccuuaa

SEQ ID NO: 704903 - RNA, 19 nt, Homo sapiens
gcaaugccaucuucaaacc

SEQ ID NO: 704904 - RNA, 19 nt, Homo sapiens
aggaccagcugcagacuuu

SEQ ID NO: 704905 - RNA, 19 nt, Homo sapiens
ccaaauacugcuuuccaaa

SEQ ID NO: 704906 - RNA, 19 nt, Homo sapiens
gaugugaagaucaggauau

SEQ ID NO: 704907 - RNA, 19 nt, Homo sapiens
cauuugagauuggaagcua

SEQ ID NO: 704908 - RNA, 19 nt, Homo sapiens
gaacgacauggaacgcauu

SEQ ID NO: 704909 - RNA, 19 nt, Homo sapiens
cagccuagauggugcaaag

SEQ ID NO: 704910 - RNA, 19 nt, Homo sapiens
cuggacaccuuuaagaaga

SEQ ID NO: 704911 - RNA, 19 nt, Homo sapiens
guaaggagggcuacgacuu

SEQ ID NO: 704912 - RNA, 19 nt, Homo sapiens
ccaggaccauuugagauug

SEQ ID NO: 704913 - RNA, 19 nt, Homo sapiens
caucuguucuuguugcaau

SEQ ID NO: 704914 - RNA, 19 nt, Homo sapiens
ccuccugacugcacacuga

SEQ ID NO: 704915 - RNA, 19 nt, Homo sapiens
uaaaagaaagagccuguua

SEQ ID NO: 704916 - RNA, 19 nt, Homo sapiens
ucacugcccuggaaucaac

SEQ ID NO: 704917 - RNA, 19 nt, Homo sapiens
gcagcaccauugagauugg

SEQ ID NO: 704918 - RNA, 19 nt, Homo sapiens
gaaagcugcaauuuaccaa

SEQ ID NO: 704919 - RNA, 19 nt, Homo sapiens
auuggaagcuacacucaaa

SEQ ID NO: 704920 - RNA, 19 nt, Homo sapiens
gcaguccucccucugaaug

SEQ ID NO: 704921 - RNA, 19 nt, Homo sapiens
ggacaccuuuaagaagaug

SEQ ID NO: 704922 - RNA, 19 nt, Homo sapiens
gauugguccuucccgauuc

SEQ ID NO: 704923 - RNA, 19 nt, Homo sapiens
gaacgagcugccgaaguuu

SEQ ID NO: 704924 - RNA, 19 nt, Homo sapiens
gcauuuggcaauaugucua

SEQ ID NO: 704925 - RNA, 19 nt, Homo sapiens
acaggcugguugcugguua

SEQ ID NO: 704926 - RNA, 19 nt, Homo sapiens
gagauugucaaggccauaa

SEQ ID NO: 704927 - RNA, 19 nt, Homo sapiens
ccucugccauggaguccua

SEQ ID NO: 704928 - RNA, 19 nt, Homo sapiens
gcugcaauuuaccaaguug

SEQ ID NO: 704929 - RNA, 19 nt, Homo sapiens
gugagugcguguguggaua

SEQ ID NO: 704930 - RNA, 19 nt, Homo sapiens
gggcuacgacuuccacuca

SEQ ID NO: 704931 - RNA, 19 nt, Homo sapiens
uaaggagggcuacgacuuc

SEQ ID NO: 704932 - RNA, 19 nt, Homo sapiens
auacugcuuuccaaacuau

SEQ ID NO: 704933 - RNA, 19 nt, Homo sapiens
gaagaaacuagcuccaaaa

SEQ ID NO: 704934 - RNA, 19 nt, Homo sapiens
uggaacgcauuuggcaaua

SEQ ID NO: 704935 - RNA, 19 nt, Homo sapiens
aaauacugcuuuccaaacu

SEQ ID NO: 704936 - RNA, 19 nt, Homo sapiens
ggauuggaacgacauggaa

SEQ ID NO: 704937 - RNA, 19 nt, Homo sapiens
auaaagucguuccgauaga

SEQ ID NO: 704938 - RNA, 19 nt, Homo sapiens
gagagccagugcccuuaag

SEQ ID NO: 704939 - RNA, 19 nt, Homo sapiens
caaauacugcuuuccaaac

SEQ ID NO: 704940 - RNA, 19 nt, Homo sapiens
caagaagcuauuacagaga

SEQ ID NO: 704941 - RNA, 19 nt, Homo sapiens
caaaagaugugaagaucag

SEQ ID NO: 704942 - RNA, 19 nt, Homo sapiens
gauccggugugauuaaagc

SEQ ID NO: 704943 - RNA, 19 nt, Homo sapiens
gcuacgacuuccacucauc

SEQ ID NO: 704944 - RNA, 19 nt, Homo sapiens
ggacugcagugcgcuuaac

SEQ ID NO: 704945 - RNA, 19 nt, Homo sapiens
aauacugcuuuccaaacua

SEQ ID NO: 704946 - RNA, 19 nt, Homo sapiens
gcagcagguaugugugaaa

SEQ ID NO: 704947 - RNA, 19 nt, Homo sapiens
cagcagcagguauguguga

SEQ ID NO: 704948 - RNA, 19 nt, Homo sapiens
cgacauggaacgcauuugg

SEQ ID NO: 704949 - RNA, 19 nt, Homo sapiens
ccaaagccuucagccuaga

SEQ ID NO: 704950 - RNA, 19 nt, Homo sapiens
cccgauccauccacagaaa

SEQ ID NO: 704951 - RNA, 19 nt, Homo sapiens
cccaaauacugcuuuccaa

SEQ ID NO: 704952 - RNA, 19 nt, Homo sapiens
gauuaaagcugguuuugcu

SEQ ID NO: 704953 - RNA, 19 nt, Homo sapiens
cccaagaagcuauuacaga

SEQ ID NO: 704954 - RNA, 19 nt, Homo sapiens
gcccagaaaggacgaugaa

SEQ ID NO: 704955 - RNA, 19 nt, Homo sapiens
cagcagguaugugugaaag

SEQ ID NO: 704956 - RNA, 19 nt, Homo sapiens
gaauggcugcagaguuaau

SEQ ID NO: 704957 - RNA, 19 nt, Homo sapiens
ggacugggguugaguucug

SEQ ID NO: 704958 - RNA, 19 nt, Homo sapiens
ggagacagagggagguaag

SEQ ID NO: 704959 - RNA, 19 nt, Homo sapiens
gaacugccugugugugagu

SEQ ID NO: 704960 - RNA, 19 nt, Homo sapiens
uaaagucguuccgauagac

SEQ ID NO: 704961 - RNA, 19 nt, Homo sapiens
cggauccggugugauuaaa

SEQ ID NO: 704962 - RNA, 19 nt, Homo sapiens
ggaagucccucaagcagaa

SEQ ID NO: 704963 - RNA, 19 nt, Homo sapiens
caacaucuccucuaacauc

SEQ ID NO: 704964 - RNA, 19 nt, Homo sapiens
ggcaacaucuccucuaaca

SEQ ID NO: 704965 - RNA, 19 nt, Homo sapiens
gacaagcucuaugagauga

SEQ ID NO: 704966 - RNA, 19 nt, Homo sapiens
agacggagcugcacaaggu

SEQ ID NO: 704967 - RNA, 19 nt, Homo sapiens
ggacaagcucuaugagaug

SEQ ID NO: 704968 - RNA, 19 nt, Homo sapiens
gcacggacggcaucaucua

SEQ ID NO: 704969 - RNA, 19 nt, Homo sapiens
ucuaugagaugauccugaa

SEQ ID NO: 704970 - RNA, 19 nt, Homo sapiens
uggcagagauugagaagca

SEQ ID NO: 704971 - RNA, 19 nt, Homo sapiens
gcauggacaagcucuauga

SEQ ID NO: 704972 - RNA, 19 nt, Homo sapiens
ugaccaaguucgccgagaa

SEQ ID NO: 704973 - RNA, 19 nt, Homo sapiens
uggacaagcucuaugagau

SEQ ID NO: 704974 - RNA, 19 nt, Homo sapiens
gcaagaccacggugcucua

SEQ ID NO: 704975 - RNA, 19 nt, Homo sapiens
gcaggaagucccucaagca

SEQ ID NO: 704976 - RNA, 19 nt, Homo sapiens
gcacaaggugaccaaguuc

SEQ ID NO: 704977 - RNA, 19 nt, Homo sapiens
ugggcaacaucuccucuaa

SEQ ID NO: 704978 - RNA, 19 nt, Homo sapiens
ugcacaaggugaccaaguu

SEQ ID NO: 704979 - RNA, 19 nt, Homo sapiens
agaagaagaagcgguaaug

SEQ ID NO: 704980 - RNA, 19 nt, Homo sapiens
gaagaagaagcgguaaugc

SEQ ID NO: 704981 - RNA, 19 nt, Homo sapiens
gcagaagaagaagcgguaa

SEQ ID NO: 704982 - RNA, 19 nt, Homo sapiens
caagcucuaugagaugauc

SEQ ID NO: 704983 - RNA, 19 nt, Homo sapiens
gggcauggacaagcucuau

SEQ ID NO: 704984 - RNA, 19 nt, Homo sapiens
ccaagacggagcugcacaa

SEQ ID NO: 704985 - RNA, 19 nt, Homo sapiens
ggcucaaguucaacgaguu

SEQ ID NO: 704986 - RNA, 19 nt, Homo sapiens
ucuaccggcucaaguucaa

SEQ ID NO: 704987 - RNA, 19 nt, Homo sapiens
gcucaaguucaacgaguuc

SEQ ID NO: 704988 - RNA, 19 nt, Homo sapiens
gccuuccagucccugcaua

SEQ ID NO: 704989 - RNA, 19 nt, Homo sapiens
gcucuaccggcucaaguuc

SEQ ID NO: 704990 - RNA, 19 nt, Homo sapiens
ggaauuuggucugaaguua

SEQ ID NO: 704991 - RNA, 19 nt, Homo sapiens
gauaguaaauugaccagaa

SEQ ID NO: 704992 - RNA, 19 nt, Homo sapiens
gaaacuacaugauaugauc

SEQ ID NO: 704993 - RNA, 19 nt, Homo sapiens
uaaaugcagugcuucuuaa

SEQ ID NO: 704994 - RNA, 19 nt, Homo sapiens
guaaaugcagugcuucuua

SEQ ID NO: 704995 - RNA, 19 nt, Homo sapiens
ggaaggacuugagaaacua

SEQ ID NO: 704996 - RNA, 19 nt, Homo sapiens
ccaaaggauuuaacacuga

SEQ ID NO: 704997 - RNA, 19 nt, Homo sapiens
ggacugugcuggaaagaca

SEQ ID NO: 704998 - RNA, 19 nt, Homo sapiens
caagagaaguuguaaacca

SEQ ID NO: 704999 - RNA, 19 nt, Homo sapiens
gcacagauggcauuguauu

SEQ ID NO: 705000 - RNA, 19 nt, Homo sapiens
aagcaaggauaguaaauug

SEQ ID NO: 705001 - RNA, 19 nt, Homo sapiens
gagaaguuguaaaccaaga

SEQ ID NO: 705002 - RNA, 19 nt, Homo sapiens
ggucugaaguuagugaaau

SEQ ID NO: 705003 - RNA, 19 nt, Homo sapiens
ggacucuguugaugucgaa

SEQ ID NO: 705004 - RNA, 19 nt, Homo sapiens
guaaauaccguaccuacca

SEQ ID NO: 705005 - RNA, 19 nt, Homo sapiens
gagaaacuacaugauauga

SEQ ID NO: 705006 - RNA, 19 nt, Homo sapiens
cagauggcauuguauuugu

SEQ ID NO: 705007 - RNA, 19 nt, Homo sapiens
gaucgggagcagucuuaua

SEQ ID NO: 705008 - RNA, 19 nt, Homo sapiens
guaccuaccaaaggauuua

SEQ ID NO: 705009 - RNA, 19 nt, Homo sapiens
uguccaaccugccuucauu

SEQ ID NO: 705010 - RNA, 19 nt, Homo sapiens
uggaugcuauuaaagcuuu

SEQ ID NO: 705011 - RNA, 19 nt, Homo sapiens
aaaggaaggacuugagaaa

SEQ ID NO: 705012 - RNA, 19 nt, Homo sapiens
gaacucauugucacuuuca

SEQ ID NO: 705013 - RNA, 19 nt, Homo sapiens
uaaauaccguaccuaccaa

SEQ ID NO: 705014 - RNA, 19 nt, Homo sapiens
gucugaaguuagugaaaua

SEQ ID NO: 705015 - RNA, 19 nt, Homo sapiens
ccuccuggaugcuauuaaa

SEQ ID NO: 705016 - RNA, 19 nt, Homo sapiens
aagagaaguuguaaaccaa

SEQ ID NO: 705017 - RNA, 19 nt, Homo sapiens
uauacaggcugcaguucaa

SEQ ID NO: 705018 - RNA, 19 nt, Homo sapiens
caagcaaggauaguaaauu

SEQ ID NO: 705019 - RNA, 19 nt, Homo sapiens
cuugagaaacuacaugaua

SEQ ID NO: 705020 - RNA, 19 nt, Homo sapiens
uggaucagcuaccaagaga

SEQ ID NO: 705021 - RNA, 19 nt, Homo sapiens
gggaagccaagcaaggaua

SEQ ID NO: 705022 - RNA, 19 nt, Homo sapiens
uauaccagaugcacagaug

SEQ ID NO: 705023 - RNA, 19 nt, Homo sapiens
uaccguaccuaccaaagga

SEQ ID NO: 705024 - RNA, 19 nt, Homo sapiens
caaccugccuucauuucag

SEQ ID NO: 705025 - RNA, 19 nt, Homo sapiens
uguggaagaugaguaaaug

SEQ ID NO: 705026 - RNA, 19 nt, Homo sapiens
gccuaccugugcaaucaua

SEQ ID NO: 705027 - RNA, 19 nt, Homo sapiens
agacuucuauccuguccaa

SEQ ID NO: 705028 - RNA, 19 nt, Homo sapiens
gaucagcuaccaagagaag

SEQ ID NO: 705029 - RNA, 19 nt, Homo sapiens
ggaagaagccaaaacugaa

SEQ ID NO: 705030 - RNA, 19 nt, Homo sapiens
gaauuuggucugaaguuag

SEQ ID NO: 705031 - RNA, 19 nt, Homo sapiens
acaaucagaugcccaacuc

SEQ ID NO: 705032 - RNA, 19 nt, Homo sapiens
cagaucgggagcagucuua

SEQ ID NO: 705033 - RNA, 19 nt, Homo sapiens
ugucagaccagacuucuau

SEQ ID NO: 705034 - RNA, 19 nt, Homo sapiens
uaaaggaaggacuugagaa

SEQ ID NO: 705035 - RNA, 19 nt, Homo sapiens
ggaagucauauaccagaug

SEQ ID NO: 705036 - RNA, 19 nt, Homo sapiens
gcaaggauaguaaauugac

SEQ ID NO: 705037 - RNA, 19 nt, Homo sapiens
ggacuugagaaacuacaug

SEQ ID NO: 705038 - RNA, 19 nt, Homo sapiens
guacuuauaguugcuaaca

SEQ ID NO: 705039 - RNA, 19 nt, Homo sapiens
ucuguugccuuguggaaga

SEQ ID NO: 705040 - RNA, 19 nt, Homo sapiens
uagaaacgccugccaaugc

SEQ ID NO: 705041 - RNA, 19 nt, Homo sapiens
guagaaacgccugccaaug

SEQ ID NO: 705042 - RNA, 19 nt, Homo sapiens
aggaaggacuugagaaacu

SEQ ID NO: 705043 - RNA, 19 nt, Homo sapiens
acagauggcauuguauuug

SEQ ID NO: 705044 - RNA, 19 nt, Homo sapiens
augcagugcuucuuaaagu

SEQ ID NO: 705045 - RNA, 19 nt, Homo sapiens
gggaauuuggucugaaguu

SEQ ID NO: 705046 - RNA, 19 nt, Homo sapiens
guuguggacucuguugaug

SEQ ID NO: 705047 - RNA, 19 nt, Homo sapiens
ugccuucauuucagucuuu

SEQ ID NO: 705048 - RNA, 19 nt, Homo sapiens
guaaauugaccagaacaca

SEQ ID NO: 705049 - RNA, 19 nt, Homo sapiens
ugagaaacuacaugauaug

SEQ ID NO: 705050 - RNA, 19 nt, Homo sapiens
cuaaaggaaggacuugaga

SEQ ID NO: 705051 - RNA, 19 nt, Homo sapiens
gauggcauuguauuuguug

SEQ ID NO: 705052 - RNA, 19 nt, Homo sapiens
uaaccuugggaaauucuaa

SEQ ID NO: 705053 - RNA, 19 nt, Homo sapiens
gaaguuguaaaccaagaag

SEQ ID NO: 705054 - RNA, 19 nt, Homo sapiens
aaacgccugccaaugcuuu

SEQ ID NO: 705055 - RNA, 19 nt, Homo sapiens
cacagauggcauuguauuu

SEQ ID NO: 705056 - RNA, 19 nt, Homo sapiens
gagaaauuaaggccacugu

SEQ ID NO: 705057 - RNA, 19 nt, Homo sapiens
uagguggucaggagaaauu

SEQ ID NO: 705058 - RNA, 19 nt, Homo sapiens
ggaagccaagcaaggauag

SEQ ID NO: 705059 - RNA, 19 nt, Homo sapiens
gcuaccaagagaaguugua

SEQ ID NO: 705060 - RNA, 19 nt, Homo sapiens
gacuugagaaacuacauga

SEQ ID NO: 705061 - RNA, 19 nt, Homo sapiens
gcauuucaauuugggacau

SEQ ID NO: 705062 - RNA, 19 nt, Homo sapiens
ccaagcaaggauaguaaau

SEQ ID NO: 705063 - RNA, 19 nt, Homo sapiens
gccaagcaaggauaguaaa

SEQ ID NO: 705064 - RNA, 19 nt, Homo sapiens
uguaaaccaagaagagaaa

SEQ ID NO: 705065 - RNA, 19 nt, Homo sapiens
gugggaauuuggucugaag

SEQ ID NO: 705066 - RNA, 19 nt, Homo sapiens
gguuuucucuggucugauu

SEQ ID NO: 705067 - RNA, 19 nt, Homo sapiens
aauuuggucugaaguuagu

SEQ ID NO: 705068 - RNA, 19 nt, Homo sapiens
agauggcauuguauuuguu

SEQ ID NO: 705069 - RNA, 19 nt, Homo sapiens
gguggucaggagaaauuaa

SEQ ID NO: 705070 - RNA, 19 nt, Homo sapiens
ucagcuaccaagagaaguu

SEQ ID NO: 705071 - RNA, 19 nt, Homo sapiens
ccaaccugccuucauuuca

SEQ ID NO: 705072 - RNA, 19 nt, Homo sapiens
agaaacgccugccaaugcu

SEQ ID NO: 705073 - RNA, 19 nt, Homo sapiens
gaaacgccugccaaugcuu

SEQ ID NO: 705074 - RNA, 19 nt, Homo sapiens
augaguaaaugcagugcuu

SEQ ID NO: 705075 - RNA, 19 nt, Homo sapiens
cuaccaagagaaguuguaa

SEQ ID NO: 705076 - RNA, 19 nt, Homo sapiens
aaauugaccagaacacagu

SEQ ID NO: 705077 - RNA, 19 nt, Homo sapiens
aagccaagcaaggauagua

SEQ ID NO: 705078 - RNA, 19 nt, Homo sapiens
aaaugcagugcuucuuaaa

SEQ ID NO: 705079 - RNA, 19 nt, Homo sapiens
uguagguggucaggagaaa

SEQ ID NO: 705080 - RNA, 19 nt, Homo sapiens
cauuucaauuugggacauu

SEQ ID NO: 705081 - RNA, 19 nt, Homo sapiens
ugggugaacugagcucauc

SEQ ID NO: 705082 - RNA, 19 nt, Homo sapiens
uuucagucuuuccacauug

SEQ ID NO: 705083 - RNA, 19 nt, Homo sapiens
ggagucccuguacuuauag

SEQ ID NO: 705084 - RNA, 19 nt, Homo sapiens
uguggacucuguugauguc

SEQ ID NO: 705085 - RNA, 19 nt, Homo sapiens
gcaaagaucugguuguguu

SEQ ID NO: 705086 - RNA, 19 nt, Homo sapiens
gaauaaagacucccucaua

SEQ ID NO: 705087 - RNA, 19 nt, Homo sapiens
ccacagagcuccaccacua

SEQ ID NO: 705088 - RNA, 19 nt, Homo sapiens
ggauaucguucucugauua

SEQ ID NO: 705089 - RNA, 19 nt, Homo sapiens
gaaacuuacucaaaggaua

SEQ ID NO: 705090 - RNA, 19 nt, Homo sapiens
ggaaaccugugucgaagua

SEQ ID NO: 705091 - RNA, 19 nt, Homo sapiens
ggaauucucuuugaugaaa

SEQ ID NO: 705092 - RNA, 19 nt, Homo sapiens
gcacagaccugaggaacuu

SEQ ID NO: 705093 - RNA, 19 nt, Homo sapiens
caaagaugguguacucuaa

SEQ ID NO: 705094 - RNA, 19 nt, Homo sapiens
caaauuagguaccuggaaa

SEQ ID NO: 705095 - RNA, 19 nt, Homo sapiens
agccaaagcuugcuaauaa

SEQ ID NO: 705096 - RNA, 19 nt, Homo sapiens
gaaccuggcuccuucuuca

SEQ ID NO: 705097 - RNA, 19 nt, Homo sapiens
aaacaaggauaucgaugua

SEQ ID NO: 705098 - RNA, 19 nt, Homo sapiens
aauaaagacucccucauaa

SEQ ID NO: 705099 - RNA, 19 nt, Homo sapiens
gaacuucaauacacugaug

SEQ ID NO: 705100 - RNA, 19 nt, Homo sapiens
uuaaauugcucacaaggua

SEQ ID NO: 705101 - RNA, 19 nt, Homo sapiens
uuagguaccuggaaacaua

SEQ ID NO: 705102 - RNA, 19 nt, Homo sapiens
gaugaaaucuaugagcuuu

SEQ ID NO: 705103 - RNA, 19 nt, Homo sapiens
ugacaacugugcuggauuu

SEQ ID NO: 705104 - RNA, 19 nt, Homo sapiens
ugacacaacucaaaucaau

SEQ ID NO: 705105 - RNA, 19 nt, Homo sapiens
guaccagacugacuugaaa

SEQ ID NO: 705106 - RNA, 19 nt, Homo sapiens
guaacaauccugugaguuu

SEQ ID NO: 705107 - RNA, 19 nt, Homo sapiens
gaucacagccuacuucaug

SEQ ID NO: 705108 - RNA, 19 nt, Homo sapiens
ggauucagaucauuuagga

SEQ ID NO: 705109 - RNA, 19 nt, Homo sapiens
gaaacuaaguagcacaauc

SEQ ID NO: 705110 - RNA, 19 nt, Homo sapiens
gaugaacugucacaaacaa

SEQ ID NO: 705111 - RNA, 19 nt, Homo sapiens
gguauuggauaacagaauu

SEQ ID NO: 705112 - RNA, 19 nt, Homo sapiens
ggacaagcaugaguuagga

SEQ ID NO: 705113 - RNA, 19 nt, Homo sapiens
gggcaccuauucacaaauu

SEQ ID NO: 705114 - RNA, 19 nt, Homo sapiens
gcaaacacguccagaggau

SEQ ID NO: 705115 - RNA, 19 nt, Homo sapiens
ggaaagugaacguccauaa

SEQ ID NO: 705116 - RNA, 19 nt, Homo sapiens
ccagaaacuacgacaauua

SEQ ID NO: 705117 - RNA, 19 nt, Homo sapiens
aaagaucaguucccauuug

SEQ ID NO: 705118 - RNA, 19 nt, Homo sapiens
ggaggauucagaucauuua

SEQ ID NO: 705119 - RNA, 19 nt, Homo sapiens
gaacuggaacaggaaauaa

SEQ ID NO: 705120 - RNA, 19 nt, Homo sapiens
acaaggauaucgauguaaa

SEQ ID NO: 705121 - RNA, 19 nt, Homo sapiens
gaugguggauucugucuuc

SEQ ID NO: 705122 - RNA, 19 nt, Homo sapiens
ccaggaaacuuacucaaag

SEQ ID NO: 705123 - RNA, 19 nt, Homo sapiens
gaaauaugcacagaagaaa

SEQ ID NO: 705124 - RNA, 19 nt, Homo sapiens
cgaccaggauggauacauu

SEQ ID NO: 705125 - RNA, 19 nt, Homo sapiens
gcuauuaccaucucauauu

SEQ ID NO: 705126 - RNA, 19 nt, Homo sapiens
ccaaagcuugcuaauaaua

SEQ ID NO: 705127 - RNA, 19 nt, Homo sapiens
ggaguguccucacagaaga

SEQ ID NO: 705128 - RNA, 19 nt, Homo sapiens
guaagaagcgagccaagaa

SEQ ID NO: 705129 - RNA, 19 nt, Homo sapiens
uaucaagccuaguguaaau

SEQ ID NO: 705130 - RNA, 19 nt, Homo sapiens
cccacuaccuggcauauaa

SEQ ID NO: 705131 - RNA, 19 nt, Homo sapiens
gaaagaucaguucccauuu

SEQ ID NO: 705132 - RNA, 19 nt, Homo sapiens
cugaggaacuuuacacuga

SEQ ID NO: 705133 - RNA, 19 nt, Homo sapiens
uagaaucccuccagcuuga

SEQ ID NO: 705134 - RNA, 19 nt, Homo sapiens
gagagaggcuccgcggaaa

SEQ ID NO: 705135 - RNA, 19 nt, Homo sapiens
auagugaucucauuuccua

SEQ ID NO: 705136 - RNA, 19 nt, Homo sapiens
ccucacaacuuccaagaga

SEQ ID NO: 705137 - RNA, 19 nt, Homo sapiens
cuaaguagcacaaucugua

SEQ ID NO: 705138 - RNA, 19 nt, Homo sapiens
caacugaaauaugcacaga

SEQ ID NO: 705139 - RNA, 19 nt, Homo sapiens
gggaugaacugucacaaac

SEQ ID NO: 705140 - RNA, 19 nt, Homo sapiens
ggauaucgauguaaagacu

SEQ ID NO: 705141 - RNA, 19 nt, Homo sapiens
ugaaagaucaguucccauu

SEQ ID NO: 705142 - RNA, 19 nt, Homo sapiens
ccaauugcaggucaacuua

SEQ ID NO: 705143 - RNA, 19 nt, Homo sapiens
gccaauuucuacugaugua

SEQ ID NO: 705144 - RNA, 19 nt, Homo sapiens
gccuguuacuguuuauuua

SEQ ID NO: 705145 - RNA, 19 nt, Homo sapiens
ggaaaagccuguuacuguu

SEQ ID NO: 705146 - RNA, 19 nt, Homo sapiens
gauggaaaccugugucgaa

SEQ ID NO: 705147 - RNA, 19 nt, Homo sapiens
cuacagaacuucaauacac

SEQ ID NO: 705148 - RNA, 19 nt, Homo sapiens
ucacugaaauggauaagag

SEQ ID NO: 705149 - RNA, 19 nt, Homo sapiens
uaggaauucucuuugauga

SEQ ID NO: 705150 - RNA, 19 nt, Homo sapiens
ccacagagaacaacacuuc

SEQ ID NO: 705151 - RNA, 19 nt, Homo sapiens
gccugaagaucuguuauuu

SEQ ID NO: 705152 - RNA, 19 nt, Homo sapiens
aaaguuaucacccucuaua

SEQ ID NO: 705153 - RNA, 19 nt, Homo sapiens
acacacguauuuaccguuu

SEQ ID NO: 705154 - RNA, 19 nt, Homo sapiens
aaucaugucuuagcucaaa

SEQ ID NO: 705155 - RNA, 19 nt, Homo sapiens
ugaaauaugcacagaagaa

SEQ ID NO: 705156 - RNA, 19 nt, Homo sapiens
gaacaggaaauaaauacuc

SEQ ID NO: 705157 - RNA, 19 nt, Homo sapiens
ucuaugagcuuuccuaugc

SEQ ID NO: 705158 - RNA, 19 nt, Homo sapiens
ugaaauggauaagaggaaa

SEQ ID NO: 705159 - RNA, 19 nt, Homo sapiens
uaccuggcauauaaacuua

SEQ ID NO: 705160 - RNA, 19 nt, Homo sapiens
gcuuaacugucuucacuau

SEQ ID NO: 705161 - RNA, 19 nt, Homo sapiens
caucucauauuacugucua

SEQ ID NO: 705162 - RNA, 19 nt, Homo sapiens
acuuauaguuguagccuua

SEQ ID NO: 705163 - RNA, 19 nt, Homo sapiens
uaaaaucucuggaaaaugg

SEQ ID NO: 705164 - RNA, 19 nt, Homo sapiens
gaaagugaacguccauaag

SEQ ID NO: 705165 - RNA, 19 nt, Homo sapiens
gaccucaucucccuguaug

SEQ ID NO: 705166 - RNA, 19 nt, Homo sapiens
caacuacagaacuucaaua

SEQ ID NO: 705167 - RNA, 19 nt, Homo sapiens
ucacacgacuuuaguuugg

SEQ ID NO: 705168 - RNA, 19 nt, Homo sapiens
uagcuuccaugccuauaaa

SEQ ID NO: 705169 - RNA, 19 nt, Homo sapiens
gcaugcauguggcuuggaa

SEQ ID NO: 705170 - RNA, 19 nt, Homo sapiens
gaucaguggcuuaaauaau

SEQ ID NO: 705171 - RNA, 19 nt, Homo sapiens
caacuuacaggcaucagaa

SEQ ID NO: 705172 - RNA, 19 nt, Homo sapiens
aaacugacuuacuuuguuc

SEQ ID NO: 705173 - RNA, 19 nt, Homo sapiens
gaucucauuuccuaaacug

SEQ ID NO: 705174 - RNA, 19 nt, Homo sapiens
caacugugcuggauuucuc

SEQ ID NO: 705175 - RNA, 19 nt, Homo sapiens
cugcagaauuuaucacuga

SEQ ID NO: 705176 - RNA, 19 nt, Homo sapiens
aaacaguaauggaacacaa

SEQ ID NO: 705177 - RNA, 19 nt, Homo sapiens
cuaaagauccaacugaaau

SEQ ID NO: 705178 - RNA, 19 nt, Homo sapiens
ggccaaagagguauaguau

SEQ ID NO: 705179 - RNA, 19 nt, Homo sapiens
aauugcaggucaacuuaua

SEQ ID NO: 705180 - RNA, 19 nt, Homo sapiens
uaacacaugagcauaucua

SEQ ID NO: 705181 - RNA, 19 nt, Homo sapiens
guagaugaguauagugauc

SEQ ID NO: 705182 - RNA, 19 nt, Homo sapiens
gggcuuuccucacaacuuc

SEQ ID NO: 705183 - RNA, 19 nt, Homo sapiens
ggacuuugccugaagaucu

SEQ ID NO: 705184 - RNA, 19 nt, Homo sapiens
aacaugacguuauccaauu

SEQ ID NO: 705185 - RNA, 19 nt, Homo sapiens
gaagaaagaugaggcugau

SEQ ID NO: 705186 - RNA, 19 nt, Homo sapiens
guagaagggugaaucguau

SEQ ID NO: 705187 - RNA, 19 nt, Homo sapiens
acacagcggucuuauuuau

SEQ ID NO: 705188 - RNA, 19 nt, Homo sapiens
uuacacagcggucuuauuu

SEQ ID NO: 705189 - RNA, 19 nt, Homo sapiens
agaaagaugaggcugauua

SEQ ID NO: 705190 - RNA, 19 nt, Homo sapiens
aagaugaggcugauuauaa

SEQ ID NO: 705191 - RNA, 19 nt, Homo sapiens
gaaagaugaggcugauuau

SEQ ID NO: 705192 - RNA, 19 nt, Homo sapiens
ggaaggaucaugggagaaa

SEQ ID NO: 705193 - RNA, 19 nt, Homo sapiens
aaacagaagggaagaaaga

SEQ ID NO: 705194 - RNA, 19 nt, Homo sapiens
acagcggucuuauuuauau

SEQ ID NO: 705195 - RNA, 19 nt, Homo sapiens
ccgccaagaugaucaaaga

SEQ ID NO: 705196 - RNA, 19 nt, Homo sapiens
gaucaugggagaaacagaa

SEQ ID NO: 705197 - RNA, 19 nt, Homo sapiens
gaaauucuccaacaacaac

SEQ ID NO: 705198 - RNA, 19 nt, Homo sapiens
cauuaguggucauaugaaa

SEQ ID NO: 705199 - RNA, 19 nt, Homo sapiens
uagaggaggugggagauga

SEQ ID NO: 705200 - RNA, 19 nt, Homo sapiens
ucaaagagacaauggacaa

SEQ ID NO: 705201 - RNA, 19 nt, Homo sapiens
aagagacaauggacaagaa

SEQ ID NO: 705202 - RNA, 19 nt, Homo sapiens
cagaagggaagaaagauga

SEQ ID NO: 705203 - RNA, 19 nt, Homo sapiens
acaggcagcuucucuccuu

SEQ ID NO: 705204 - RNA, 19 nt, Homo sapiens
ugaagaaccuccucuaccu

SEQ ID NO: 705205 - RNA, 19 nt, Homo sapiens
gaccgcaugcugauuugua

SEQ ID NO: 705206 - RNA, 19 nt, Homo sapiens
gaacagaccacugcaucuc

SEQ ID NO: 705207 - RNA, 19 nt, Homo sapiens
ggacaugccagaggagaug

SEQ ID NO: 705208 - RNA, 19 nt, Homo sapiens
ggacacaggcagcuucucu

SEQ ID NO: 705209 - RNA, 19 nt, Homo sapiens
cagcggucuuauuuauaua

SEQ ID NO: 705210 - RNA, 19 nt, Homo sapiens
ggcgagggcuuuggguuug

SEQ ID NO: 705211 - RNA, 19 nt, Homo sapiens
agaugaggcugauuauaag

SEQ ID NO: 705212 - RNA, 19 nt, Homo sapiens
ggaagugucggccguccuu

SEQ ID NO: 705213 - RNA, 19 nt, Homo sapiens
gaguuggggucuuuucuuu

SEQ ID NO: 705214 - RNA, 19 nt, Homo sapiens
gccaagaugaucaaagaga

SEQ ID NO: 705215 - RNA, 19 nt, Homo sapiens
aaagaugaggcugauuaua

SEQ ID NO: 705216 - RNA, 19 nt, Homo sapiens
gaaacagaagggaagaaag

SEQ ID NO: 705217 - RNA, 19 nt, Homo sapiens
gggaccgcaugcugauuug

SEQ ID NO: 705218 - RNA, 19 nt, Homo sapiens
ugucauuaguggucauaug

SEQ ID NO: 705219 - RNA, 19 nt, Homo sapiens
agacaauggacaagaaguu

SEQ ID NO: 705220 - RNA, 19 nt, Homo sapiens
aguagaagggugaaucgua

SEQ ID NO: 705221 - RNA, 19 nt, Homo sapiens
ggaggugggagaugagauc

SEQ ID NO: 705222 - RNA, 19 nt, Homo sapiens
gcgagggcuuuggguuuga

SEQ ID NO: 705223 - RNA, 19 nt, Homo sapiens
agaaacagaagggaagaaa

SEQ ID NO: 705224 - RNA, 19 nt, Homo sapiens
ggagaaacagaagggaaga

SEQ ID NO: 705225 - RNA, 19 nt, Homo sapiens
agaagggugaaucguauuu

SEQ ID NO: 705226 - RNA, 19 nt, Homo sapiens
ggucacaguggaaggauca

SEQ ID NO: 705227 - RNA, 19 nt, Homo sapiens
cacagcggucuuauuuaua

SEQ ID NO: 705228 - RNA, 19 nt, Homo sapiens
gaaggagaugauucuuuca

SEQ ID NO: 705229 - RNA, 19 nt, Homo sapiens
gaaggaucaugggagaaac

SEQ ID NO: 705230 - RNA, 19 nt, Homo sapiens
gaaccuccucuaccuguac

SEQ ID NO: 705231 - RNA, 19 nt, Homo sapiens
gacaauggacaagaaguuc

SEQ ID NO: 705232 - RNA, 19 nt, Homo sapiens
aagggugaaucguauuuua

SEQ ID NO: 705233 - RNA, 19 nt, Homo sapiens
gagaaacagaagggaagaa

SEQ ID NO: 705234 - RNA, 19 nt, Homo sapiens
ggugaucggcgagggcuuu

SEQ ID NO: 705235 - RNA, 19 nt, Homo sapiens
ugugugaacuugacaucuc

SEQ ID NO: 705236 - RNA, 19 nt, Homo sapiens
agaaccuccucuaccugua

SEQ ID NO: 705237 - RNA, 19 nt, Homo sapiens
cggcgagggcuuuggguuu

SEQ ID NO: 705238 - RNA, 19 nt, Homo sapiens
aaagagacaauggacaaga

SEQ ID NO: 705239 - RNA, 19 nt, Homo sapiens
auaagcgacugcagaccuu

SEQ ID NO: 705240 - RNA, 19 nt, Homo sapiens
gaugaucaaagagacaaug

SEQ ID NO: 705241 - RNA, 19 nt, Homo sapiens
caagaugaucaaagagaca

SEQ ID NO: 705242 - RNA, 19 nt, Homo sapiens
ucuccugggugugucuuaa

SEQ ID NO: 705243 - RNA, 19 nt, Homo sapiens
gggccugcuuccugaaucu

SEQ ID NO: 705244 - RNA, 19 nt, Homo sapiens
acugcucucugcuggguuu

SEQ ID NO: 705245 - RNA, 19 nt, Homo sapiens
uacacagcggucuuauuua

SEQ ID NO: 705246 - RNA, 19 nt, Homo sapiens
ggugaagaaccuccucuac

SEQ ID NO: 705247 - RNA, 19 nt, Homo sapiens
uggagaccauggagcuaug

SEQ ID NO: 705248 - RNA, 19 nt, Homo sapiens
ggccguccuugucauuagu

SEQ ID NO: 705249 - RNA, 19 nt, Homo sapiens
ggaaguaggugucugauaa

SEQ ID NO: 705250 - RNA, 19 nt, Homo sapiens
ggacugcacugaaaucuuu

SEQ ID NO: 705251 - RNA, 19 nt, Homo sapiens
caaagaaacuccauuuaug

SEQ ID NO: 705252 - RNA, 19 nt, Homo sapiens
gaaaucagcugaaggucaa

SEQ ID NO: 705253 - RNA, 19 nt, Homo sapiens
cgaaagaacucaugagaga

SEQ ID NO: 705254 - RNA, 19 nt, Homo sapiens
gagaaaccguauaaaugua

SEQ ID NO: 705255 - RNA, 19 nt, Homo sapiens
aaacagcucuggagucuug

SEQ ID NO: 705256 - RNA, 19 nt, Homo sapiens
ggagagagacccuauaaau

SEQ ID NO: 705257 - RNA, 19 nt, Homo sapiens
gagaauacaugcagcugaa

SEQ ID NO: 705258 - RNA, 19 nt, Homo sapiens
gagagaaaccguauaaaug

SEQ ID NO: 705259 - RNA, 19 nt, Homo sapiens
cgaaggaacugcagccaaa

SEQ ID NO: 705260 - RNA, 19 nt, Homo sapiens
ggagagaaaccguauaaau

SEQ ID NO: 705261 - RNA, 19 nt, Homo sapiens
gggaaaugcuucagucaga

SEQ ID NO: 705262 - RNA, 19 nt, Homo sapiens
gcaauaauaagguggaauu

SEQ ID NO: 705263 - RNA, 19 nt, Homo sapiens
gaaagcuucucucggaguu

SEQ ID NO: 705264 - RNA, 19 nt, Homo sapiens
gaagggcuccugauaguga

SEQ ID NO: 705265 - RNA, 19 nt, Homo sapiens
gagagacccuauaaauguu

SEQ ID NO: 705266 - RNA, 19 nt, Homo sapiens
ucuaacaacucaaaccuaa

SEQ ID NO: 705267 - RNA, 19 nt, Homo sapiens
ggaaacagcacgagaguca

SEQ ID NO: 705268 - RNA, 19 nt, Homo sapiens
ggaauuggcagaggaagua

SEQ ID NO: 705269 - RNA, 19 nt, Homo sapiens
gagaaaggauggcaagucu

SEQ ID NO: 705270 - RNA, 19 nt, Homo sapiens
ccaaagaaacuccauuuau

SEQ ID NO: 705271 - RNA, 19 nt, Homo sapiens
gaacccacguuuccuguca

SEQ ID NO: 705272 - RNA, 19 nt, Homo sapiens
caguuuaccuuaacaaguu

SEQ ID NO: 705273 - RNA, 19 nt, Homo sapiens
ggggaaaacuucucucaua

SEQ ID NO: 705274 - RNA, 19 nt, Homo sapiens
gggaagggcuccugauagu

SEQ ID NO: 705275 - RNA, 19 nt, Homo sapiens
gaacagaagugcuuuugga

SEQ ID NO: 705276 - RNA, 19 nt, Homo sapiens
gggaauccaugugauguuu

SEQ ID NO: 705277 - RNA, 19 nt, Homo sapiens
ucucggaguucccgucuua

SEQ ID NO: 705278 - RNA, 19 nt, Homo sapiens
gagagagacccuauaaaug

SEQ ID NO: 705279 - RNA, 19 nt, Homo sapiens
gcaggagaguuaugagaau

SEQ ID NO: 705280 - RNA, 19 nt, Homo sapiens
caggugagguggcauauuc

SEQ ID NO: 705281 - RNA, 19 nt, Homo sapiens
ggaaaugcuucagucagaa

SEQ ID NO: 705282 - RNA, 19 nt, Homo sapiens
gguguggacugcacugaaa

SEQ ID NO: 705283 - RNA, 19 nt, Homo sapiens
gagaagagaaauuugagaa

SEQ ID NO: 705284 - RNA, 19 nt, Homo sapiens
ccaguugccugagagcuua

SEQ ID NO: 705285 - RNA, 19 nt, Homo sapiens
guucacaccucgucauuca

SEQ ID NO: 705286 - RNA, 19 nt, Homo sapiens
uagaggacguggcaaugua

SEQ ID NO: 705287 - RNA, 19 nt, Homo sapiens
caaguacccugggaaauca

SEQ ID NO: 705288 - RNA, 19 nt, Homo sapiens
gaagcucuuugaauguuug

SEQ ID NO: 705289 - RNA, 19 nt, Homo sapiens
gggagaagcccuacaagug

SEQ ID NO: 705290 - RNA, 19 nt, Homo sapiens
ggacaaggaggaaagcuau

SEQ ID NO: 705291 - RNA, 19 nt, Homo sapiens
ggagagcgaccuuauaagu

SEQ ID NO: 705292 - RNA, 19 nt, Homo sapiens
gaacucacacagguuagua

SEQ ID NO: 705293 - RNA, 19 nt, Homo sapiens
guauaaauguacccuuugu

SEQ ID NO: 705294 - RNA, 19 nt, Homo sapiens
gauaacccuuuguggagaa

SEQ ID NO: 705295 - RNA, 19 nt, Homo sapiens
agagagacccuauaaaugu

SEQ ID NO: 705296 - RNA, 19 nt, Homo sapiens
gacaacaggucacaaacca

SEQ ID NO: 705297 - RNA, 19 nt, Homo sapiens
uaacaggagugcccauugg

SEQ ID NO: 705298 - RNA, 19 nt, Homo sapiens
ggagaucuuugcucacagu

SEQ ID NO: 705299 - RNA, 19 nt, Homo sapiens
gagaggaggcccacaagug

SEQ ID NO: 705300 - RNA, 19 nt, Homo sapiens
gccaaagaaacuccauuua

SEQ ID NO: 705301 - RNA, 19 nt, Homo sapiens
gaaaacuucucucauagau

SEQ ID NO: 705302 - RNA, 19 nt, Homo sapiens
ccguauaaauguacccuuu

SEQ ID NO: 705303 - RNA, 19 nt, Homo sapiens
gcacgaaggagcagaucuu

SEQ ID NO: 705304 - RNA, 19 nt, Homo sapiens
gauugugucuuucccuguu

SEQ ID NO: 705305 - RNA, 19 nt, Homo sapiens
ugauacuucuuccucauuu

SEQ ID NO: 705306 - RNA, 19 nt, Homo sapiens
gaaaggauggcaagucucu

SEQ ID NO: 705307 - RNA, 19 nt, Homo sapiens
caggagagaaaccguauaa

SEQ ID NO: 705308 - RNA, 19 nt, Homo sapiens
gcaugcaccucaccagaca

SEQ ID NO: 705309 - RNA, 19 nt, Homo sapiens
gcugaaagacuguguaugg

SEQ ID NO: 705310 - RNA, 19 nt, Homo sapiens
aaauaugaccucagacaaa

SEQ ID NO: 705311 - RNA, 19 nt, Homo sapiens
cgaaggagcagaucuugga

SEQ ID NO: 705312 - RNA, 19 nt, Homo sapiens
agagaaaccguauaaaugu

SEQ ID NO: 705313 - RNA, 19 nt, Homo sapiens
ucacuggagucucacauuc

SEQ ID NO: 705314 - RNA, 19 nt, Homo sapiens
guaaauaugaccucagaca

SEQ ID NO: 705315 - RNA, 19 nt, Homo sapiens
aaagacugguugugaguug

SEQ ID NO: 705316 - RNA, 19 nt, Homo sapiens
gcagaggauuggcauaaaa

SEQ ID NO: 705317 - RNA, 19 nt, Homo sapiens
ccauuuaugucccuugugu

SEQ ID NO: 705318 - RNA, 19 nt, Homo sapiens
agagaacucacacagguua

SEQ ID NO: 705319 - RNA, 19 nt, Homo sapiens
ggguggaauucucuguuaa

SEQ ID NO: 705320 - RNA, 19 nt, Homo sapiens
agagcgaccuuauaagugu

SEQ ID NO: 705321 - RNA, 19 nt, Homo sapiens
gaagguguuccgucuguau

SEQ ID NO: 705322 - RNA, 19 nt, Homo sapiens
gaaauuugagaaccuggaa

SEQ ID NO: 705323 - RNA, 19 nt, Homo sapiens
cagcagaggauuggcauaa

SEQ ID NO: 705324 - RNA, 19 nt, Homo sapiens
gaacacacacaggagagaa

SEQ ID NO: 705325 - RNA, 19 nt, Homo sapiens
ggaugggaauaaauaucuu

SEQ ID NO: 705326 - RNA, 19 nt, Homo sapiens
gcaggucagcccaggaauu

SEQ ID NO: 705327 - RNA, 19 nt, Homo sapiens
gcccuacgauggccuaaca

SEQ ID NO: 705328 - RNA, 19 nt, Homo sapiens
aggguggaauucucuguua

SEQ ID NO: 705329 - RNA, 19 nt, Homo sapiens
caugagagagagagacuuu

SEQ ID NO: 705330 - RNA, 19 nt, Homo sapiens
acacggugcaggagaguua

SEQ ID NO: 705331 - RNA, 19 nt, Homo sapiens
uaaaggagagggcauuauc

SEQ ID NO: 705332 - RNA, 19 nt, Homo sapiens
auaauaagguggaauuugc

SEQ ID NO: 705333 - RNA, 19 nt, Homo sapiens
gagagcgaccuuauaagug

SEQ ID NO: 705334 - RNA, 19 nt, Homo sapiens
gaacugcagccaaagaaac

SEQ ID NO: 705335 - RNA, 19 nt, Homo sapiens
gauacuucuuccucauuug

SEQ ID NO: 705336 - RNA, 19 nt, Homo sapiens
ugagacaacaggucacaaa

SEQ ID NO: 705337 - RNA, 19 nt, Homo sapiens
gaagggaacauggaagaca

SEQ ID NO: 705338 - RNA, 19 nt, Homo sapiens
gagaauccacacaggagaa

SEQ ID NO: 705339 - RNA, 19 nt, Homo sapiens
aaagaacucaugagagaga

SEQ ID NO: 705340 - RNA, 19 nt, Homo sapiens
ggaacugcagccaaagaaa

SEQ ID NO: 705341 - RNA, 19 nt, Homo sapiens
gggaaguccuggcgcagau

SEQ ID NO: 705342 - RNA, 19 nt, Homo sapiens
caggagaagagaaauuuga

SEQ ID NO: 705343 - RNA, 19 nt, Homo sapiens
ggagaguuaugagaaugug

SEQ ID NO: 705344 - RNA, 19 nt, Homo sapiens
ccaaguacccugggaaauc

SEQ ID NO: 705345 - RNA, 19 nt, Homo sapiens
ccucugcauucuucaggua

SEQ ID NO: 705346 - RNA, 19 nt, Homo sapiens
ggccugagaugcgcacgaa

SEQ ID NO: 705347 - RNA, 19 nt, Homo sapiens
cuggagagcgaccuuauaa

SEQ ID NO: 705348 - RNA, 19 nt, Homo sapiens
ggagaagagaaauuugaga

SEQ ID NO: 705349 - RNA, 19 nt, Homo sapiens
uaacauagaugccgcaaua

SEQ ID NO: 705350 - RNA, 19 nt, Homo sapiens
gaaauuaggugcuguguau

SEQ ID NO: 705351 - RNA, 19 nt, Homo sapiens
caacauaaguuucccauug

SEQ ID NO: 705352 - RNA, 19 nt, Homo sapiens
gaagaugccuugaacuuga

SEQ ID NO: 705353 - RNA, 19 nt, Homo sapiens
gaucuaggauucaucauuu

SEQ ID NO: 705354 - RNA, 19 nt, Homo sapiens
ggacacacuucagaaauua

SEQ ID NO: 705355 - RNA, 19 nt, Homo sapiens
gaacagaauuugcucauag

SEQ ID NO: 705356 - RNA, 19 nt, Homo sapiens
ccaaucaguuugcaauuua

SEQ ID NO: 705357 - RNA, 19 nt, Homo sapiens
ggaaaggcaucaacuguga

SEQ ID NO: 705358 - RNA, 19 nt, Homo sapiens
gaugagagaugccggaauu

SEQ ID NO: 705359 - RNA, 19 nt, Homo sapiens
gaacuucuaacgcauaaua

SEQ ID NO: 705360 - RNA, 19 nt, Homo sapiens
acacauaccucgcauuauu

SEQ ID NO: 705361 - RNA, 19 nt, Homo sapiens
caacuuacaucaucugaau

SEQ ID NO: 705362 - RNA, 19 nt, Homo sapiens
cuaauuggcucuuugguuu

SEQ ID NO: 705363 - RNA, 19 nt, Homo sapiens
ggaggucuaugaauauaaa

SEQ ID NO: 705364 - RNA, 19 nt, Homo sapiens
gauguagcguugcaaauuu

SEQ ID NO: 705365 - RNA, 19 nt, Homo sapiens
gaaagaggcugugacaaca

SEQ ID NO: 705366 - RNA, 19 nt, Homo sapiens
gcccuaggcuucuuacuuu

SEQ ID NO: 705367 - RNA, 19 nt, Homo sapiens
guacaaggauggacguuau

SEQ ID NO: 705368 - RNA, 19 nt, Homo sapiens
caucgugacucuaggguua

SEQ ID NO: 705369 - RNA, 19 nt, Homo sapiens
gaaggauguucuuaucaaa

SEQ ID NO: 705370 - RNA, 19 nt, Homo sapiens
ugaaggagaugaaagagaa

SEQ ID NO: 705371 - RNA, 19 nt, Homo sapiens
uaucagaccucacuauuuc

SEQ ID NO: 705372 - RNA, 19 nt, Homo sapiens
agagauugauugcuucuua

SEQ ID NO: 705373 - RNA, 19 nt, Homo sapiens
acagauguguugcaaauaa

SEQ ID NO: 705374 - RNA, 19 nt, Homo sapiens
ucaaaggaaugcaagaauu

SEQ ID NO: 705375 - RNA, 19 nt, Homo sapiens
uauaagagauguccuaaag

SEQ ID NO: 705376 - RNA, 19 nt, Homo sapiens
gaauuggagucaacacuug

SEQ ID NO: 705377 - RNA, 19 nt, Homo sapiens
ggagcgagauaacagaauu

SEQ ID NO: 705378 - RNA, 19 nt, Homo sapiens
agaauuugcucauaggaua

SEQ ID NO: 705379 - RNA, 19 nt, Homo sapiens
gauguuaaauggacucgaa

SEQ ID NO: 705380 - RNA, 19 nt, Homo sapiens
gauuaaggaugcucacuug

SEQ ID NO: 705381 - RNA, 19 nt, Homo sapiens
ugacagauguguugcaaau

SEQ ID NO: 705382 - RNA, 19 nt, Homo sapiens
gcucuaugaucucuucuuu

SEQ ID NO: 705383 - RNA, 19 nt, Homo sapiens
ccaagaugcuauuaagauu

SEQ ID NO: 705384 - RNA, 19 nt, Homo sapiens
caacugauuuccuggcaaa

SEQ ID NO: 705385 - RNA, 19 nt, Homo sapiens
gggacacacuucagaaauu

SEQ ID NO: 705386 - RNA, 19 nt, Homo sapiens
cuacagcaaucucauuaaa

SEQ ID NO: 705387 - RNA, 19 nt, Homo sapiens
agaagaauuugaccgcuua

SEQ ID NO: 705388 - RNA, 19 nt, Homo sapiens
gaagagagaacagaauuug

SEQ ID NO: 705389 - RNA, 19 nt, Homo sapiens
caacagccgccucaucaua

SEQ ID NO: 705390 - RNA, 19 nt, Homo sapiens
uaaggaugcucacuuguug

SEQ ID NO: 705391 - RNA, 19 nt, Homo sapiens
ucaagcaccucuguucaua

SEQ ID NO: 705392 - RNA, 19 nt, Homo sapiens
ccaaaggccuguuacuugu

SEQ ID NO: 705393 - RNA, 19 nt, Homo sapiens
ggaaaacucuucuugaaau

SEQ ID NO: 705394 - RNA, 19 nt, Homo sapiens
gaauuugaccgcuuagauu

SEQ ID NO: 705395 - RNA, 19 nt, Homo sapiens
uaagagauguccuaaagca

SEQ ID NO: 705396 - RNA, 19 nt, Homo sapiens
gcguaagaauuuagacuuu

SEQ ID NO: 705397 - RNA, 19 nt, Homo sapiens
gugauuccaugcuuugaua

SEQ ID NO: 705398 - RNA, 19 nt, Homo sapiens
gaagauggcccaagugucu

SEQ ID NO: 705399 - RNA, 19 nt, Homo sapiens
uagcagaaauccuuagaga

SEQ ID NO: 705400 - RNA, 19 nt, Homo sapiens
gccauugacugcuaugaaa

SEQ ID NO: 705401 - RNA, 19 nt, Homo sapiens
gugcuuuacucgccaauaa

SEQ ID NO: 705402 - RNA, 19 nt, Homo sapiens
gcauacaauucccucauga

SEQ ID NO: 705403 - RNA, 19 nt, Homo sapiens
gaacuaaagcuugaagaga

SEQ ID NO: 705404 - RNA, 19 nt, Homo sapiens
gaacuuucgaacuuuguua

SEQ ID NO: 705405 - RNA, 19 nt, Homo sapiens
cuaaagcacuguaugaaca

SEQ ID NO: 705406 - RNA, 19 nt, Homo sapiens
acagagauguggugcaauu

SEQ ID NO: 705407 - RNA, 19 nt, Homo sapiens
gccaaucaguuugcaauuu

SEQ ID NO: 705408 - RNA, 19 nt, Homo sapiens
cacagaagcuauuugaaug

SEQ ID NO: 705409 - RNA, 19 nt, Homo sapiens
gaaguagagcaauguguuu

SEQ ID NO: 705410 - RNA, 19 nt, Homo sapiens
cugcauaacuuucgaacuu

SEQ ID NO: 705411 - RNA, 19 nt, Homo sapiens
uggaugaucuguuucuaaa

SEQ ID NO: 705412 - RNA, 19 nt, Homo sapiens
ggaauaaaauccaagaaga

SEQ ID NO: 705413 - RNA, 19 nt, Homo sapiens
ucaaauacauugcccaucu

SEQ ID NO: 705414 - RNA, 19 nt, Homo sapiens
caggaaacauauacagauu

SEQ ID NO: 705415 - RNA, 19 nt, Homo sapiens
caguaugucucagaaauuu

SEQ ID NO: 705416 - RNA, 19 nt, Homo sapiens
aagcaaacauucaaccaaa

SEQ ID NO: 705417 - RNA, 19 nt, Homo sapiens
gcagaaccauccaccaaca

SEQ ID NO: 705418 - RNA, 19 nt, Homo sapiens
gacggaagcuguuggcaau

SEQ ID NO: 705419 - RNA, 19 nt, Homo sapiens
gaggugaaauugaaacagu

SEQ ID NO: 705420 - RNA, 19 nt, Homo sapiens
uggagaagaugaauguaaa

SEQ ID NO: 705421 - RNA, 19 nt, Homo sapiens
guaagaaguuaaaggaagu

SEQ ID NO: 705422 - RNA, 19 nt, Homo sapiens
agacacauaccucgcauua

SEQ ID NO: 705423 - RNA, 19 nt, Homo sapiens
gaaauugagucucggucau

SEQ ID NO: 705424 - RNA, 19 nt, Homo sapiens
ucaggauucuucccuaauu

SEQ ID NO: 705425 - RNA, 19 nt, Homo sapiens
caugaagggugauguugaa

SEQ ID NO: 705426 - RNA, 19 nt, Homo sapiens
uggagaagcuaacagacua

SEQ ID NO: 705427 - RNA, 19 nt, Homo sapiens
caucaacugugaaaucugu

SEQ ID NO: 705428 - RNA, 19 nt, Homo sapiens
gcagaccccuucuagguua

SEQ ID NO: 705429 - RNA, 19 nt, Homo sapiens
gaaccauccaccaacauaa

SEQ ID NO: 705430 - RNA, 19 nt, Homo sapiens
caaaggaaugcaagaauug

SEQ ID NO: 705431 - RNA, 19 nt, Homo sapiens
gagauugauugcuucuuau

SEQ ID NO: 705432 - RNA, 19 nt, Homo sapiens
cuauuaagauucugaagga

SEQ ID NO: 705433 - RNA, 19 nt, Homo sapiens
guaaucuccuggaaagcua

SEQ ID NO: 705434 - RNA, 19 nt, Homo sapiens
gaagauguagcguugcaaa

SEQ ID NO: 705435 - RNA, 19 nt, Homo sapiens
uggagaagguggagaaguu

SEQ ID NO: 705436 - RNA, 19 nt, Homo sapiens
gagcgucucugaaauugag

SEQ ID NO: 705437 - RNA, 19 nt, Homo sapiens
gaaauaaccaggcgauacu

SEQ ID NO: 705438 - RNA, 19 nt, Homo sapiens
caggaggucuaugaauaua

SEQ ID NO: 705439 - RNA, 19 nt, Homo sapiens
caagcuggauugagaagug

SEQ ID NO: 705440 - RNA, 19 nt, Homo sapiens
uaaaggaaguccagaugca

SEQ ID NO: 705441 - RNA, 19 nt, Homo sapiens
uaccagagauugauugcuu

SEQ ID NO: 705442 - RNA, 19 nt, Homo sapiens
ugugaaaucuguguuagaa

SEQ ID NO: 705443 - RNA, 19 nt, Homo sapiens
gaagcuauuugaaugugau

SEQ ID NO: 705444 - RNA, 19 nt, Homo sapiens
gaaaggcgagacugaucua

SEQ ID NO: 705445 - RNA, 19 nt, Homo sapiens
gcuccaagaugcuauuaag

SEQ ID NO: 705446 - RNA, 19 nt, Homo sapiens
gaaugcauaugcugagaag

SEQ ID NO: 705447 - RNA, 19 nt, Homo sapiens
gaagcaaacauucaaccaa

SEQ ID NO: 705448 - RNA, 19 nt, Homo sapiens
gcaaauaaucagguugaaa

SEQ ID NO: 705449 - RNA, 19 nt, Homo sapiens
gaaagaagcucuggaaaga

SEQ ID NO: 705450 - RNA, 19 nt, Homo sapiens
gagaugagauucaggguua

SEQ ID NO: 705451 - RNA, 19 nt, Homo sapiens
ggaaacacguuaagaguaa

SEQ ID NO: 705452 - RNA, 19 nt, Homo sapiens
gagggaagauguacuauuu

SEQ ID NO: 705453 - RNA, 19 nt, Homo sapiens
gaaagaaucugaugaaagg

SEQ ID NO: 705454 - RNA, 19 nt, Homo sapiens
gaugaaagguuuaguaaug

SEQ ID NO: 705455 - RNA, 19 nt, Homo sapiens
gcaggacccuucagcauua

SEQ ID NO: 705456 - RNA, 19 nt, Homo sapiens
gaaagucgcugagcaaaga

SEQ ID NO: 705457 - RNA, 19 nt, Homo sapiens
uaaauggacugcaauguaa

SEQ ID NO: 705458 - RNA, 19 nt, Homo sapiens
gaaccaagguagcuuagaa

SEQ ID NO: 705459 - RNA, 19 nt, Homo sapiens
gcaaauggcuccagucaca

SEQ ID NO: 705460 - RNA, 19 nt, Homo sapiens
gauuuaagcuccagcagua

SEQ ID NO: 705461 - RNA, 19 nt, Homo sapiens
ccaaauagcccaauuaaug

SEQ ID NO: 705462 - RNA, 19 nt, Homo sapiens
ccagauggcuaccuauaua

SEQ ID NO: 705463 - RNA, 19 nt, Homo sapiens
gaaauucgagcguuguuua

SEQ ID NO: 705464 - RNA, 19 nt, Homo sapiens
gaugaugaauugcgacaua

SEQ ID NO: 705465 - RNA, 19 nt, Homo sapiens
gcuaggcucucuauucaua

SEQ ID NO: 705466 - RNA, 19 nt, Homo sapiens
aaacaaagaucccaagaug

SEQ ID NO: 705467 - RNA, 19 nt, Homo sapiens
gaagaacagugaccuccua

SEQ ID NO: 705468 - RNA, 19 nt, Homo sapiens
ugaaguaccuuucuuaugu

SEQ ID NO: 705469 - RNA, 19 nt, Homo sapiens
gaacauggaugacacaaac

SEQ ID NO: 705470 - RNA, 19 nt, Homo sapiens
gcacauaugccacucgaua

SEQ ID NO: 705471 - RNA, 19 nt, Homo sapiens
cugaacagcucacuaauuu

SEQ ID NO: 705472 - RNA, 19 nt, Homo sapiens
ggaaucggauccaaauuug

SEQ ID NO: 705473 - RNA, 19 nt, Homo sapiens
gaacuaucccuucgacaua

SEQ ID NO: 705474 - RNA, 19 nt, Homo sapiens
gcaacucgcuacugaagaa

SEQ ID NO: 705475 - RNA, 19 nt, Homo sapiens
gagaagcucugaauaucuu

SEQ ID NO: 705476 - RNA, 19 nt, Homo sapiens
gacauuaccuugaauaugg

SEQ ID NO: 705477 - RNA, 19 nt, Homo sapiens
ggauauagccgaaaggauu

SEQ ID NO: 705478 - RNA, 19 nt, Homo sapiens
guaaauggacugcaaugua

SEQ ID NO: 705479 - RNA, 19 nt, Homo sapiens
ggaacugugucagagauua

SEQ ID NO: 705480 - RNA, 19 nt, Homo sapiens
caaauucccugcuguaaag

SEQ ID NO: 705481 - RNA, 19 nt, Homo sapiens
ggaaguaaaugauaugcau

SEQ ID NO: 705482 - RNA, 19 nt, Homo sapiens
ccaguuaccuuggagauaa

SEQ ID NO: 705483 - RNA, 19 nt, Homo sapiens
gcaaagaccgggaaguauu

SEQ ID NO: 705484 - RNA, 19 nt, Homo sapiens
uuaaugcugucaaguguua

SEQ ID NO: 705485 - RNA, 19 nt, Homo sapiens
caagauaaauuccaagucu

SEQ ID NO: 705486 - RNA, 19 nt, Homo sapiens
aaaugaagcuggccacuga

SEQ ID NO: 705487 - RNA, 19 nt, Homo sapiens
gcaccuugauaaagaagua

SEQ ID NO: 705488 - RNA, 19 nt, Homo sapiens
gaaguagaaucauaaaggu

SEQ ID NO: 705489 - RNA, 19 nt, Homo sapiens
gaaguaccuuucuuauguu

SEQ ID NO: 705490 - RNA, 19 nt, Homo sapiens
ucaaccagcuuauguguga

SEQ ID NO: 705491 - RNA, 19 nt, Homo sapiens
gcuauuggguuuccacuga

SEQ ID NO: 705492 - RNA, 19 nt, Homo sapiens
ccugggagcuuuguucuua

SEQ ID NO: 705493 - RNA, 19 nt, Homo sapiens
gaaggaugaguguuaauuu

SEQ ID NO: 705494 - RNA, 19 nt, Homo sapiens
gaacaacgaacucggcaaa

SEQ ID NO: 705495 - RNA, 19 nt, Homo sapiens
gagcaaagaccgggaagua

SEQ ID NO: 705496 - RNA, 19 nt, Homo sapiens
gcuaaguucuuccauucua

SEQ ID NO: 705497 - RNA, 19 nt, Homo sapiens
gaaguaggaagguguauga

SEQ ID NO: 705498 - RNA, 19 nt, Homo sapiens
ugccagagcugcugaauau

SEQ ID NO: 705499 - RNA, 19 nt, Homo sapiens
uguuagaacugcaagaaua

SEQ ID NO: 705500 - RNA, 19 nt, Homo sapiens
ucacuccucuggaucguua

SEQ ID NO: 705501 - RNA, 19 nt, Homo sapiens
gcagaaacauauucagagu

SEQ ID NO: 705502 - RNA, 19 nt, Homo sapiens
gaaagccgaucccaguuca

SEQ ID NO: 705503 - RNA, 19 nt, Homo sapiens
ucucuuggcuugcaaauug

SEQ ID NO: 705504 - RNA, 19 nt, Homo sapiens
gugagaguauggacaauuu

SEQ ID NO: 705505 - RNA, 19 nt, Homo sapiens
cgacauagugacauuguua

SEQ ID NO: 705506 - RNA, 19 nt, Homo sapiens
acucagagccgacuuauaa

SEQ ID NO: 705507 - RNA, 19 nt, Homo sapiens
ugaaauacuuguuccaguu

SEQ ID NO: 705508 - RNA, 19 nt, Homo sapiens
acaaagagcagaacccaua

SEQ ID NO: 705509 - RNA, 19 nt, Homo sapiens
guacauuauuugacuggua

SEQ ID NO: 705510 - RNA, 19 nt, Homo sapiens
ggaaaccucccacagauga

SEQ ID NO: 705511 - RNA, 19 nt, Homo sapiens
ggacaugccucugaacauc

SEQ ID NO: 705512 - RNA, 19 nt, Homo sapiens
caagauggcucgaguugca

SEQ ID NO: 705513 - RNA, 19 nt, Homo sapiens
caacagcgagauuauuuaa

SEQ ID NO: 705514 - RNA, 19 nt, Homo sapiens
gagucaagauacagcaaua

SEQ ID NO: 705515 - RNA, 19 nt, Homo sapiens
gauguacuauuuggcuuua

SEQ ID NO: 705516 - RNA, 19 nt, Homo sapiens
gaacaacagcgagauuauu

SEQ ID NO: 705517 - RNA, 19 nt, Homo sapiens
gaauacagaccaagaacaa

SEQ ID NO: 705518 - RNA, 19 nt, Homo sapiens
ucaaugagcucccuuucug

SEQ ID NO: 705519 - RNA, 19 nt, Homo sapiens
ggacugcaauguaauguac

SEQ ID NO: 705520 - RNA, 19 nt, Homo sapiens
ggaagccagugcagucauu

SEQ ID NO: 705521 - RNA, 19 nt, Homo sapiens
gggaaucggauccaaauuu

SEQ ID NO: 705522 - RNA, 19 nt, Homo sapiens
gaaccucauuccuuuaaca

SEQ ID NO: 705523 - RNA, 19 nt, Homo sapiens
gaacggagccggcaucaac

SEQ ID NO: 705524 - RNA, 19 nt, Homo sapiens
gaaguaggauugagcaaaa

SEQ ID NO: 705525 - RNA, 19 nt, Homo sapiens
gaaaggauugcucagguuu

SEQ ID NO: 705526 - RNA, 19 nt, Homo sapiens
gcagacuacuggcacauau

SEQ ID NO: 705527 - RNA, 19 nt, Homo sapiens
caaccugaauaucucuaua

SEQ ID NO: 705528 - RNA, 19 nt, Homo sapiens
caacagagagauuuaugaa

SEQ ID NO: 705529 - RNA, 19 nt, Homo sapiens
cugaaauccuggaguaaua

SEQ ID NO: 705530 - RNA, 19 nt, Homo sapiens
ggagacaacuauguuacuu

SEQ ID NO: 705531 - RNA, 19 nt, Homo sapiens
gaggaugaaucacaugaau

SEQ ID NO: 705532 - RNA, 19 nt, Homo sapiens
gaacugagugaccuaaaga

SEQ ID NO: 705533 - RNA, 19 nt, Homo sapiens
gagaaaagcuugagaaacu

SEQ ID NO: 705534 - RNA, 19 nt, Homo sapiens
cuacaacuacuucgaauuu

SEQ ID NO: 705535 - RNA, 19 nt, Homo sapiens
gacgggaccucgccauuga

SEQ ID NO: 705536 - RNA, 19 nt, Homo sapiens
gaaugcagcgacagcuuua

SEQ ID NO: 705537 - RNA, 19 nt, Homo sapiens
gcacucagaccuaaucaug

SEQ ID NO: 705538 - RNA, 19 nt, Homo sapiens
ugauaggcauguccuuaua

SEQ ID NO: 705539 - RNA, 19 nt, Homo sapiens
guaaauguucccugccuua

SEQ ID NO: 705540 - RNA, 19 nt, Homo sapiens
guacauguccuuucucugu

SEQ ID NO: 705541 - RNA, 19 nt, Homo sapiens
ggacuuccacuucgauauu

SEQ ID NO: 705542 - RNA, 19 nt, Homo sapiens
aaucaguucuguaaggaua

SEQ ID NO: 705543 - RNA, 19 nt, Homo sapiens
ggaaguauucucuauggaa

SEQ ID NO: 705544 - RNA, 19 nt, Homo sapiens
gaacaagaaacgccgagaa

SEQ ID NO: 705545 - RNA, 19 nt, Homo sapiens
gaaagaagaccagagaaca

SEQ ID NO: 705546 - RNA, 19 nt, Homo sapiens
gaucacagaguccuuaguu

SEQ ID NO: 705547 - RNA, 19 nt, Homo sapiens
agacaacuauguuacuuug

SEQ ID NO: 705548 - RNA, 19 nt, Homo sapiens
agucagaaguagaaucaua

SEQ ID NO: 705549 - RNA, 19 nt, Homo sapiens
gaagggacauucucuacuu

SEQ ID NO: 705550 - RNA, 19 nt, Homo sapiens
cgaauuaacuccaucaaau

SEQ ID NO: 705551 - RNA, 19 nt, Homo sapiens
gaagugauaguucaaguaa

SEQ ID NO: 705552 - RNA, 19 nt, Homo sapiens
gacauucucuacuuucuuu

SEQ ID NO: 705553 - RNA, 19 nt, Homo sapiens
aaacaaggcagaagugaua

SEQ ID NO: 705554 - RNA, 19 nt, Homo sapiens
aaacuuggcugucgaaaca

SEQ ID NO: 705555 - RNA, 19 nt, Homo sapiens
gaugaaauuugcucugcua

SEQ ID NO: 705556 - RNA, 19 nt, Homo sapiens
gagaaguuauucagaguga

SEQ ID NO: 705557 - RNA, 19 nt, Homo sapiens
gaaguuauucagagugaua

SEQ ID NO: 705558 - RNA, 19 nt, Homo sapiens
gacgacagcuuugauaaga

SEQ ID NO: 705559 - RNA, 19 nt, Homo sapiens
gcgagucuccuguggauua

SEQ ID NO: 705560 - RNA, 19 nt, Homo sapiens
ggaaagaugaguugugaga

SEQ ID NO: 705561 - RNA, 19 nt, Homo sapiens
gaaauuugcucugcuaaaa

SEQ ID NO: 705562 - RNA, 19 nt, Homo sapiens
guaagaaggaugugauuga

SEQ ID NO: 705563 - RNA, 19 nt, Homo sapiens
gugaugaugugaucgaauu

SEQ ID NO: 705564 - RNA, 19 nt, Homo sapiens
guacuugauuggucauuug

SEQ ID NO: 705565 - RNA, 19 nt, Homo sapiens
gaaguuggcagacaaauac

SEQ ID NO: 705566 - RNA, 19 nt, Homo sapiens
gaagggacauucucuacac

SEQ ID NO: 705567 - RNA, 19 nt, Homo sapiens
cgacagcuuugauaagaau

SEQ ID NO: 705568 - RNA, 19 nt, Homo sapiens
gacauucucuacacucaga

SEQ ID NO: 705569 - RNA, 19 nt, Homo sapiens
ggugagcuguaccuucuuu

SEQ ID NO: 705570 - RNA, 19 nt, Homo sapiens
guuuguggcuuguagaauu

SEQ ID NO: 705571 - RNA, 19 nt, Homo sapiens
caaaguuggugcaguugau

SEQ ID NO: 705572 - RNA, 19 nt, Homo sapiens
ucagugauguggagcuuga

SEQ ID NO: 705573 - RNA, 19 nt, Homo sapiens
gcacgcaagaugaaauuug

SEQ ID NO: 705574 - RNA, 19 nt, Homo sapiens
ugucaaaguuggugcaguu

SEQ ID NO: 705575 - RNA, 19 nt, Homo sapiens
agugauaguucaaguaaga

SEQ ID NO: 705576 - RNA, 19 nt, Homo sapiens
gauacgggauuagaggauu

SEQ ID NO: 705577 - RNA, 19 nt, Homo sapiens
gauaguuuguggcuuguag

SEQ ID NO: 705578 - RNA, 19 nt, Homo sapiens
gaaacuggcagcuguggau

SEQ ID NO: 705579 - RNA, 19 nt, Homo sapiens
gaggauacaguucuggaaa

SEQ ID NO: 705580 - RNA, 19 nt, Homo sapiens
aaacagaccagaagauuac

SEQ ID NO: 705581 - RNA, 19 nt, Homo sapiens
gcaaggcaucaacgaguuu

SEQ ID NO: 705582 - RNA, 19 nt, Homo sapiens
ugaaguuggcagacaaaua

SEQ ID NO: 705583 - RNA, 19 nt, Homo sapiens
ggcagugaauggucuguau

SEQ ID NO: 705584 - RNA, 19 nt, Homo sapiens
ucagggauuuccuaccauu

SEQ ID NO: 705585 - RNA, 19 nt, Homo sapiens
guucagggauuuccuacca

SEQ ID NO: 705586 - RNA, 19 nt, Homo sapiens
gacauugaccucagugaug

SEQ ID NO: 705587 - RNA, 19 nt, Homo sapiens
ggacggagcggaggauaca

SEQ ID NO: 705588 - RNA, 19 nt, Homo sapiens
gggacauucucuacacuca

SEQ ID NO: 705589 - RNA, 19 nt, Homo sapiens
agggaaagaugaguuguga

SEQ ID NO: 705590 - RNA, 19 nt, Homo sapiens
gaugaugugaucgaauuaa

SEQ ID NO: 705591 - RNA, 19 nt, Homo sapiens
uguggagcuugaugacuua

SEQ ID NO: 705592 - RNA, 19 nt, Homo sapiens
gaaauucuuaucuggaagu

SEQ ID NO: 705593 - RNA, 19 nt, Homo sapiens
uaagaaggaugugauugag

SEQ ID NO: 705594 - RNA, 19 nt, Homo sapiens
cagaacuggugaagccauu

SEQ ID NO: 705595 - RNA, 19 nt, Homo sapiens
cuugauuggucauuugaaa

SEQ ID NO: 705596 - RNA, 19 nt, Homo sapiens
gauuaacaccagaauggaa

SEQ ID NO: 705597 - RNA, 19 nt, Homo sapiens
gcagugaauggucuguauu

SEQ ID NO: 705598 - RNA, 19 nt, Homo sapiens
ggacagugaagauguuugg

SEQ ID NO: 705599 - RNA, 19 nt, Homo sapiens
aggcagaagugauaguuca

SEQ ID NO: 705600 - RNA, 19 nt, Homo sapiens
uguuguagccggugaauug

SEQ ID NO: 705601 - RNA, 19 nt, Homo sapiens
ggacauucucuacuuucuu

SEQ ID NO: 705602 - RNA, 19 nt, Homo sapiens
cagaagugauaguucaagu

SEQ ID NO: 705603 - RNA, 19 nt, Homo sapiens
gaacuggugaagccauugu

SEQ ID NO: 705604 - RNA, 19 nt, Homo sapiens
gcaacugcauuaaaagaug

SEQ ID NO: 705605 - RNA, 19 nt, Homo sapiens
ucaaugcacgcaagaugaa

SEQ ID NO: 705606 - RNA, 19 nt, Homo sapiens
cagacgacagcuuugauaa

SEQ ID NO: 705607 - RNA, 19 nt, Homo sapiens
acagacgacagcuuugaua

SEQ ID NO: 705608 - RNA, 19 nt, Homo sapiens
caaguaagaaggaugugau

SEQ ID NO: 705609 - RNA, 19 nt, Homo sapiens
ggaggucaguaugguguuc

SEQ ID NO: 705610 - RNA, 19 nt, Homo sapiens
aagggacauucucuacuuu

SEQ ID NO: 705611 - RNA, 19 nt, Homo sapiens
ugaaauuugcucugcuaaa

SEQ ID NO: 705612 - RNA, 19 nt, Homo sapiens
ggaggauacaguucuggaa

SEQ ID NO: 705613 - RNA, 19 nt, Homo sapiens
ccacaacagaggcuucaga

SEQ ID NO: 705614 - RNA, 19 nt, Homo sapiens
ggaugacauugaccucagu

SEQ ID NO: 705615 - RNA, 19 nt, Homo sapiens
cuccugagcugcuugagau

SEQ ID NO: 705616 - RNA, 19 nt, Homo sapiens
gggauuuccuaccauuaag

SEQ ID NO: 705617 - RNA, 19 nt, Homo sapiens
gggacauucucuacuuucu

SEQ ID NO: 705618 - RNA, 19 nt, Homo sapiens
ggucuguauuccucuagug

SEQ ID NO: 705619 - RNA, 19 nt, Homo sapiens
agucuccuguggauuauga

SEQ ID NO: 705620 - RNA, 19 nt, Homo sapiens
auacgggauuagaggauuu

SEQ ID NO: 705621 - RNA, 19 nt, Homo sapiens
gugaagauguuuggauggu

SEQ ID NO: 705622 - RNA, 19 nt, Homo sapiens
agaagugauaguucaagua

SEQ ID NO: 705623 - RNA, 19 nt, Homo sapiens
caaggcagaagugauaguu

SEQ ID NO: 705624 - RNA, 19 nt, Homo sapiens
guaugguguucagggauuu

SEQ ID NO: 705625 - RNA, 19 nt, Homo sapiens
gacugcugcuugaauguuc

SEQ ID NO: 705626 - RNA, 19 nt, Homo sapiens
ccgagaaguuauucagagu

SEQ ID NO: 705627 - RNA, 19 nt, Homo sapiens
uaagcaucauucccuagga

SEQ ID NO: 705628 - RNA, 19 nt, Homo sapiens
aaagauguugucaaaguug

SEQ ID NO: 705629 - RNA, 19 nt, Homo sapiens
cuugggagccaguggauuu

SEQ ID NO: 705630 - RNA, 19 nt, Homo sapiens
cuugggagccaguggauuu

SEQ ID NO: 705631 - RNA, 19 nt, Homo sapiens
gagcccagucugaacuuga

SEQ ID NO: 705632 - RNA, 19 nt, Homo sapiens
ucaaagauuaacaccagaa

SEQ ID NO: 705633 - RNA, 19 nt, Homo sapiens
ggagcccagucugaacuug

SEQ ID NO: 705634 - RNA, 19 nt, Homo sapiens
gauuaucaacgaggacauu

SEQ ID NO: 705635 - RNA, 19 nt, Homo sapiens
cugagcugcuugagauuau

SEQ ID NO: 705636 - RNA, 19 nt, Homo sapiens
uaaaagagcagacgaaagg

SEQ ID NO: 705637 - RNA, 19 nt, Homo sapiens
gagcggaggauacaguucu

SEQ ID NO: 705638 - RNA, 19 nt, Homo sapiens
ucugacugcugcuugaaug

SEQ ID NO: 705639 - RNA, 19 nt, Homo sapiens
caaagauuaacaccagaau

SEQ ID NO: 705640 - RNA, 19 nt, Homo sapiens
gaugugaucgaauuaacuc

SEQ ID NO: 705641 - RNA, 19 nt, Homo sapiens
aagauuaacaccagaaugg

SEQ ID NO: 705642 - RNA, 19 nt, Homo sapiens
ccugagcugcuugagauua

SEQ ID NO: 705643 - RNA, 19 nt, Homo sapiens
ugaagauguuuggaugguu

SEQ ID NO: 705644 - RNA, 19 nt, Homo sapiens
aaauuucaaccgagaaguu

SEQ ID NO: 705645 - RNA, 19 nt, Homo sapiens
gaucgaauuaacuccauca

SEQ ID NO: 705646 - RNA, 19 nt, Homo sapiens
ggauuuccuaccauuaaga

SEQ ID NO: 705647 - RNA, 19 nt, Homo sapiens
ucagggagcucucuuuugg

SEQ ID NO: 705648 - RNA, 19 nt, Homo sapiens
guauuccucuagugaugau

SEQ ID NO: 705649 - RNA, 19 nt, Homo sapiens
uaaccagccucucagaaua

SEQ ID NO: 705650 - RNA, 19 nt, Homo sapiens
gcuacacccugcacuauaa

SEQ ID NO: 705651 - RNA, 19 nt, Homo sapiens
agaagaagcugaucucugu

SEQ ID NO: 705652 - RNA, 19 nt, Homo sapiens
gaagaaagacacagagguu

SEQ ID NO: 705653 - RNA, 19 nt, Homo sapiens
ugagaaguaugcaaaguuu

SEQ ID NO: 705654 - RNA, 19 nt, Homo sapiens
ugaaugagcugcuugucaa

SEQ ID NO: 705655 - RNA, 19 nt, Homo sapiens
gagaugugguaacgaagua

SEQ ID NO: 705656 - RNA, 19 nt, Homo sapiens
ggacugacaccacagauga

SEQ ID NO: 705657 - RNA, 19 nt, Homo sapiens
gcagaccaaugccgagaaa

SEQ ID NO: 705658 - RNA, 19 nt, Homo sapiens
gagguucucuucugcuuug

SEQ ID NO: 705659 - RNA, 19 nt, Homo sapiens
gccaagcacugccagaaau

SEQ ID NO: 705660 - RNA, 19 nt, Homo sapiens
ggcacgcgcucaucaagaa

SEQ ID NO: 705661 - RNA, 19 nt, Homo sapiens
aggaagagcugguguccaa

SEQ ID NO: 705662 - RNA, 19 nt, Homo sapiens
gaggugugguggacaguga

SEQ ID NO: 705663 - RNA, 19 nt, Homo sapiens
gucacaaacuggugucuga

SEQ ID NO: 705664 - RNA, 19 nt, Homo sapiens
gcagagcacucacccuacu

SEQ ID NO: 705665 - RNA, 19 nt, Homo sapiens
agcagaggcugaucaaauu

SEQ ID NO: 705666 - RNA, 19 nt, Homo sapiens
caagaucaucggccaguuu

SEQ ID NO: 705667 - RNA, 19 nt, Homo sapiens
gcuuugagcaguuugauga

SEQ ID NO: 705668 - RNA, 19 nt, Homo sapiens
caugauugcugcuggacuu

SEQ ID NO: 705669 - RNA, 19 nt, Homo sapiens
acaaggaggagaaguuuga

SEQ ID NO: 705670 - RNA, 19 nt, Homo sapiens
ucaaggaggacauagcaaa

SEQ ID NO: 705671 - RNA, 19 nt, Homo sapiens
guucuggaguguuugaaau

SEQ ID NO: 705672 - RNA, 19 nt, Homo sapiens
gaagauuacggccuguuca

SEQ ID NO: 705673 - RNA, 19 nt, Homo sapiens
cugaucaaauucuucauug

SEQ ID NO: 705674 - RNA, 19 nt, Homo sapiens
aaauggagauucacuugca

SEQ ID NO: 705675 - RNA, 19 nt, Homo sapiens
caggagagcgcacucauca

SEQ ID NO: 705676 - RNA, 19 nt, Homo sapiens
gcaagaucaucggccaguu

SEQ ID NO: 705677 - RNA, 19 nt, Homo sapiens
gaaggacugacaccacaga

SEQ ID NO: 705678 - RNA, 19 nt, Homo sapiens
gcuccagcguugcacugua

SEQ ID NO: 705679 - RNA, 19 nt, Homo sapiens
cuacgugcccgacaugaaa

SEQ ID NO: 705680 - RNA, 19 nt, Homo sapiens
gauugcugcuggacuuguu

SEQ ID NO: 705681 - RNA, 19 nt, Homo sapiens
gcugaucaaauucuucauu

SEQ ID NO: 705682 - RNA, 19 nt, Homo sapiens
caacauccgcagcaucuuc

SEQ ID NO: 705683 - RNA, 19 nt, Homo sapiens
agaugguucuggaguguuu

SEQ ID NO: 705684 - RNA, 19 nt, Homo sapiens
ugccagaaauggagauuca

SEQ ID NO: 705685 - RNA, 19 nt, Homo sapiens
ggacgcaccgcucaacauc

SEQ ID NO: 705686 - RNA, 19 nt, Homo sapiens
gcagcuaaccagccucuca

SEQ ID NO: 705687 - RNA, 19 nt, Homo sapiens
gcugagaaguaugcaaagu

SEQ ID NO: 705688 - RNA, 19 nt, Homo sapiens
ccaaguggcugcgcuucau

SEQ ID NO: 705689 - RNA, 19 nt, Homo sapiens
ccgagugccuaucagagaa

SEQ ID NO: 705690 - RNA, 19 nt, Homo sapiens
cuacaaggaggagaaguuu

SEQ ID NO: 705691 - RNA, 19 nt, Homo sapiens
ugaagaagaaagacacaga

SEQ ID NO: 705692 - RNA, 19 nt, Homo sapiens
gcugcaccuucgugaguuu

SEQ ID NO: 705693 - RNA, 19 nt, Homo sapiens
caaagcugcugcgcuacga

SEQ ID NO: 705694 - RNA, 19 nt, Homo sapiens
ggaggucaaggaggacaua

SEQ ID NO: 705695 - RNA, 19 nt, Homo sapiens
gaucaucggccaguuugga

SEQ ID NO: 705696 - RNA, 19 nt, Homo sapiens
agaaauggagauucacuug

SEQ ID NO: 705697 - RNA, 19 nt, Homo sapiens
acuaugaggccaugaagaa

SEQ ID NO: 705698 - RNA, 19 nt, Homo sapiens
gcaggcaggacgacuguuc

SEQ ID NO: 705699 - RNA, 19 nt, Homo sapiens
agagcgcacucaucaggaa

SEQ ID NO: 705700 - RNA, 19 nt, Homo sapiens
guaacgaaguacagcaacu

SEQ ID NO: 705701 - RNA, 19 nt, Homo sapiens
ggccaagcacugccagaaa

SEQ ID NO: 705702 - RNA, 19 nt, Homo sapiens
ugccagcgaugccuuggaa

SEQ ID NO: 705703 - RNA, 19 nt, Homo sapiens
cuaaccagccucucagaau

SEQ ID NO: 705704 - RNA, 19 nt, Homo sapiens
ggucaaggaggacauagca

SEQ ID NO: 705705 - RNA, 19 nt, Homo sapiens
ugcgagaugugguaacgaa

SEQ ID NO: 705706 - RNA, 19 nt, Homo sapiens
gaggaccacagcccaguug

SEQ ID NO: 705707 - RNA, 19 nt, Homo sapiens
gcaggguuccacuuccaaa

SEQ ID NO: 705708 - RNA, 19 nt, Homo sapiens
gcagaggcugaucaaauuc

SEQ ID NO: 705709 - RNA, 19 nt, Homo sapiens
ggaguuagaaccgggacaa

SEQ ID NO: 705710 - RNA, 19 nt, Homo sapiens
uacgagaacgccaugauug

SEQ ID NO: 705711 - RNA, 19 nt, Homo sapiens
gcacccgcaacaucuacua

SEQ ID NO: 705712 - RNA, 19 nt, Homo sapiens
gcuaaccagccucucagaa

SEQ ID NO: 705713 - RNA, 19 nt, Homo sapiens
ugacagaguggaggucuau

SEQ ID NO: 705714 - RNA, 19 nt, Homo sapiens
gcaggagagcgcacucauc

SEQ ID NO: 705715 - RNA, 19 nt, Homo sapiens
gaggccagcagcaagauca

SEQ ID NO: 705716 - RNA, 19 nt, Homo sapiens
gucaaaggccuuccuggau

SEQ ID NO: 705717 - RNA, 19 nt, Homo sapiens
ccuccuugagcuuuauuua

SEQ ID NO: 705718 - RNA, 19 nt, Homo sapiens
gccgagugccuaucagaga

SEQ ID NO: 705719 - RNA, 19 nt, Homo sapiens
gaaagacacagagguucuc

SEQ ID NO: 705720 - RNA, 19 nt, Homo sapiens
aaaagaugcugagaaguau

SEQ ID NO: 705721 - RNA, 19 nt, Homo sapiens
uaugaggccaugaagaaga

SEQ ID NO: 705722 - RNA, 19 nt, Homo sapiens
caaggaggacauagcaaag

SEQ ID NO: 705723 - RNA, 19 nt, Homo sapiens
ccaccgagcaggaggucaa

SEQ ID NO: 705724 - RNA, 19 nt, Homo sapiens
gcacuguacagccgcaaag

SEQ ID NO: 705725 - RNA, 19 nt, Homo sapiens
ggcaacaugaggaguucua

SEQ ID NO: 705726 - RNA, 19 nt, Homo sapiens
aaucaucauccaccugaaa

SEQ ID NO: 705727 - RNA, 19 nt, Homo sapiens
ccaccuccuugagcuuuau

SEQ ID NO: 705728 - RNA, 19 nt, Homo sapiens
uucgugaguuugacaagaa

SEQ ID NO: 705729 - RNA, 19 nt, Homo sapiens
ggaggaccacagcccaguu

SEQ ID NO: 705730 - RNA, 19 nt, Homo sapiens
ggguuccacuuccaaacau

SEQ ID NO: 705731 - RNA, 19 nt, Homo sapiens
ggaggaaaaccaauucugu

SEQ ID NO: 705732 - RNA, 19 nt, Homo sapiens
agucguggaucacuacaag

SEQ ID NO: 705733 - RNA, 19 nt, Homo sapiens
augaggccaugaagaagaa

SEQ ID NO: 705734 - RNA, 19 nt, Homo sapiens
uggaugcucugcagaacca

SEQ ID NO: 705735 - RNA, 19 nt, Homo sapiens
cccggucccuguacucaga

SEQ ID NO: 705736 - RNA, 19 nt, Homo sapiens
ucaucaagaagcugaauca

SEQ ID NO: 705737 - RNA, 19 nt, Homo sapiens
ccaagcacugccagaaaug

SEQ ID NO: 705738 - RNA, 19 nt, Homo sapiens
aaccguccauguuugaugu

SEQ ID NO: 705739 - RNA, 19 nt, Homo sapiens
auacgagaacgccaugauu

SEQ ID NO: 705740 - RNA, 19 nt, Homo sapiens
ggacauagucguggaucac

SEQ ID NO: 705741 - RNA, 19 nt, Homo sapiens
gacaagaagaagcugaucu

SEQ ID NO: 705742 - RNA, 19 nt, Homo sapiens
cagaaauggagauucacuu

SEQ ID NO: 705743 - RNA, 19 nt, Homo sapiens
gugcaggguuccacuucca

SEQ ID NO: 705744 - RNA, 19 nt, Homo sapiens
cuugagcuuuauuuaccua

SEQ ID NO: 705745 - RNA, 19 nt, Homo sapiens
cccaccuccuugagcuuua

SEQ ID NO: 705746 - RNA, 19 nt, Homo sapiens
ccacuuccaaacaugaguu

SEQ ID NO: 705747 - RNA, 19 nt, Homo sapiens
gaaccccugcacucgauua

SEQ ID NO: 705748 - RNA, 19 nt, Homo sapiens
cugagaaguaugcaaaguu

SEQ ID NO: 705749 - RNA, 19 nt, Homo sapiens
gcacggcauugucuaaaua

SEQ ID NO: 705750 - RNA, 19 nt, Homo sapiens
gaaguuuacuguucugauu

SEQ ID NO: 705751 - RNA, 19 nt, Homo sapiens
gaagauuccuuuguugaaa

SEQ ID NO: 705752 - RNA, 19 nt, Homo sapiens
gggcucagauggaaguuua

SEQ ID NO: 705753 - RNA, 19 nt, Homo sapiens
ccaaacagcugcaaaugga

SEQ ID NO: 705754 - RNA, 19 nt, Homo sapiens
gcacagagaaagagaauga

SEQ ID NO: 705755 - RNA, 19 nt, Homo sapiens
ugacaucucuguuuaagga

SEQ ID NO: 705756 - RNA, 19 nt, Homo sapiens
gaaagagaaugaugaagag

SEQ ID NO: 705757 - RNA, 19 nt, Homo sapiens
gaaggaagaacgccaguuu

SEQ ID NO: 705758 - RNA, 19 nt, Homo sapiens
gaaagcaugcuaucagaaa

SEQ ID NO: 705759 - RNA, 19 nt, Homo sapiens
gaaagaagccaugaagcua

SEQ ID NO: 705760 - RNA, 19 nt, Homo sapiens
ccaugaagcuaaauaauca

SEQ ID NO: 705761 - RNA, 19 nt, Homo sapiens
caggugacaucucuguuua

SEQ ID NO: 705762 - RNA, 19 nt, Homo sapiens
gcaauuccaucagaguuga

SEQ ID NO: 705763 - RNA, 19 nt, Homo sapiens
agaauuacuucgaacauga

SEQ ID NO: 705764 - RNA, 19 nt, Homo sapiens
ggacagagaaacagaagga

SEQ ID NO: 705765 - RNA, 19 nt, Homo sapiens
uaggauggcugaaggagaa

SEQ ID NO: 705766 - RNA, 19 nt, Homo sapiens
caugaggaguuaacuguga

SEQ ID NO: 705767 - RNA, 19 nt, Homo sapiens
agagaaugaugaagagaaa

SEQ ID NO: 705768 - RNA, 19 nt, Homo sapiens
cuaauggccuugagucaug

SEQ ID NO: 705769 - RNA, 19 nt, Homo sapiens
gaaugaugcuuucgaagac

SEQ ID NO: 705770 - RNA, 19 nt, Homo sapiens
ggccaagaauuacuucgaa

SEQ ID NO: 705771 - RNA, 19 nt, Homo sapiens
ccagcaggcuuaccuuguu

SEQ ID NO: 705772 - RNA, 19 nt, Homo sapiens
caaggaggccaaagaaaga

SEQ ID NO: 705773 - RNA, 19 nt, Homo sapiens
gaaaacaauugaggaacua

SEQ ID NO: 705774 - RNA, 19 nt, Homo sapiens
ucagaagauuccuuuguug

SEQ ID NO: 705775 - RNA, 19 nt, Homo sapiens
ucaagaggcucauacaaaa

SEQ ID NO: 705776 - RNA, 19 nt, Homo sapiens
agaaagagaaugaugaaga

SEQ ID NO: 705777 - RNA, 19 nt, Homo sapiens
gaagccaugaagcuaaaua

SEQ ID NO: 705778 - RNA, 19 nt, Homo sapiens
gaguugugcuuuuguguua

SEQ ID NO: 705779 - RNA, 19 nt, Homo sapiens
gaaauugaaggaagagcuu

SEQ ID NO: 705780 - RNA, 19 nt, Homo sapiens
gaaagagcagcgagagaga

SEQ ID NO: 705781 - RNA, 19 nt, Homo sapiens
gauggaaguuuacuguucu

SEQ ID NO: 705782 - RNA, 19 nt, Homo sapiens
caucagaguugaaugaaaa

SEQ ID NO: 705783 - RNA, 19 nt, Homo sapiens
cuucgaacaugaggaguua

SEQ ID NO: 705784 - RNA, 19 nt, Homo sapiens
gaaauuaggauggcugaag

SEQ ID NO: 705785 - RNA, 19 nt, Homo sapiens
gaagcagaagggucaguaa

SEQ ID NO: 705786 - RNA, 19 nt, Homo sapiens
aaagaagccaugaagcuaa

SEQ ID NO: 705787 - RNA, 19 nt, Homo sapiens
agagaaugaugcuuucgaa

SEQ ID NO: 705788 - RNA, 19 nt, Homo sapiens
ccucagggcucagauggaa

SEQ ID NO: 705789 - RNA, 19 nt, Homo sapiens
uugaggaacuaacaagaaa

SEQ ID NO: 705790 - RNA, 19 nt, Homo sapiens
ggaaagcaugcuaucagaa

SEQ ID NO: 705791 - RNA, 19 nt, Homo sapiens
aagaagccaugaagcuaaa

SEQ ID NO: 705792 - RNA, 19 nt, Homo sapiens
gcaggagaauugcuugaac

SEQ ID NO: 705793 - RNA, 19 nt, Homo sapiens
caaguaaucguucugagau

SEQ ID NO: 705794 - RNA, 19 nt, Homo sapiens
gaacaugaggaguuaacug

SEQ ID NO: 705795 - RNA, 19 nt, Homo sapiens
ggaugaaaaguccaaauua

SEQ ID NO: 705796 - RNA, 19 nt, Homo sapiens
ggaagagcuuggaaaacua

SEQ ID NO: 705797 - RNA, 19 nt, Homo sapiens
gacucugucucgaaagaaa

SEQ ID NO: 705798 - RNA, 19 nt, Homo sapiens
cgagguggguggaucacuu

SEQ ID NO: 705799 - RNA, 19 nt, Homo sapiens
gggcagugcugaaggaacu

SEQ ID NO: 705800 - RNA, 19 nt, Homo sapiens
ccaggugacaucucuguuu

SEQ ID NO: 705801 - RNA, 19 nt, Homo sapiens
uggaaagcaugcuaucaga

SEQ ID NO: 705802 - RNA, 19 nt, Homo sapiens
gaagguggagagacuugaa

SEQ ID NO: 705803 - RNA, 19 nt, Homo sapiens
cagaagauuccuuuguuga

SEQ ID NO: 705804 - RNA, 19 nt, Homo sapiens
gaaggaagagcuuggaaaa

SEQ ID NO: 705805 - RNA, 19 nt, Homo sapiens
cagagaaacagaaggaaga

SEQ ID NO: 705806 - RNA, 19 nt, Homo sapiens
ggaacccugucucuaccaa

SEQ ID NO: 705807 - RNA, 19 nt, Homo sapiens
cauagacacguuacagauu

SEQ ID NO: 705808 - RNA, 19 nt, Homo sapiens
ggugacaucucuguuuaag

SEQ ID NO: 705809 - RNA, 19 nt, Homo sapiens
cagagaaagagaaugauga

SEQ ID NO: 705810 - RNA, 19 nt, Homo sapiens
agaaugaugcuuucgaaga

SEQ ID NO: 705811 - RNA, 19 nt, Homo sapiens
agauggaaguuuacuguuc

SEQ ID NO: 705812 - RNA, 19 nt, Homo sapiens
aaaguuagagcuacaagug

SEQ ID NO: 705813 - RNA, 19 nt, Homo sapiens
ccaucagaguugaaugaaa

SEQ ID NO: 705814 - RNA, 19 nt, Homo sapiens
cucagaagauuccuuuguu

SEQ ID NO: 705815 - RNA, 19 nt, Homo sapiens
gagagguucugccugacau

SEQ ID NO: 705816 - RNA, 19 nt, Homo sapiens
gagcacagagaaagagaau

SEQ ID NO: 705817 - RNA, 19 nt, Homo sapiens
gccaugaagcuaaauaauc

SEQ ID NO: 705818 - RNA, 19 nt, Homo sapiens
aggcuuaccuuguucaaag

SEQ ID NO: 705819 - RNA, 19 nt, Homo sapiens
gaagaggaccuggaaacca

SEQ ID NO: 705820 - RNA, 19 nt, Homo sapiens
ugaaggaacugagugaaaa

SEQ ID NO: 705821 - RNA, 19 nt, Homo sapiens
ucaaggaggccaaagaaag

SEQ ID NO: 705822 - RNA, 19 nt, Homo sapiens
ugucugaacugcagcucaa

SEQ ID NO: 705823 - RNA, 19 nt, Homo sapiens
agagaaggcagaccuguug

SEQ ID NO: 705824 - RNA, 19 nt, Homo sapiens
ggccuugagucaugagaau

SEQ ID NO: 705825 - RNA, 19 nt, Homo sapiens
auagacacguuacagauuc

SEQ ID NO: 705826 - RNA, 19 nt, Homo sapiens
gacauagacacguuacaga

SEQ ID NO: 705827 - RNA, 19 nt, Homo sapiens
gcacgaugccgaggaaaca

SEQ ID NO: 705828 - RNA, 19 nt, Homo sapiens
ggacagggcagugcugaag

SEQ ID NO: 705829 - RNA, 19 nt, Homo sapiens
gguugaggcaggagaauug

SEQ ID NO: 705830 - RNA, 19 nt, Homo sapiens
cgagaacaagugacucuga

SEQ ID NO: 705831 - RNA, 19 nt, Homo sapiens
aagaggaccuggaaaccau

SEQ ID NO: 705832 - RNA, 19 nt, Homo sapiens
caugcuaucagaaaucaaa

SEQ ID NO: 705833 - RNA, 19 nt, Homo sapiens
ugaaagcacaggaaaugga

SEQ ID NO: 705834 - RNA, 19 nt, Homo sapiens
gaaaacaaguaaucguucu

SEQ ID NO: 705835 - RNA, 19 nt, Homo sapiens
uggauugcaucauuuaagu

SEQ ID NO: 705836 - RNA, 19 nt, Homo sapiens
gaaaauucaugaggaaaag

SEQ ID NO: 705837 - RNA, 19 nt, Homo sapiens
aaagcaugcuaucagaaau

SEQ ID NO: 705838 - RNA, 19 nt, Homo sapiens
uaagggaagggaaucagaa

SEQ ID NO: 705839 - RNA, 19 nt, Homo sapiens
cagauggggccaagaauua

SEQ ID NO: 705840 - RNA, 19 nt, Homo sapiens
aaagaaaucaagcauaguc

SEQ ID NO: 705841 - RNA, 19 nt, Homo sapiens
gaaguggcaguugcaguga

SEQ ID NO: 705842 - RNA, 19 nt, Homo sapiens
uugcaucauuuaaguguug

SEQ ID NO: 705843 - RNA, 19 nt, Homo sapiens
agauucacgugauggauug

SEQ ID NO: 705844 - RNA, 19 nt, Homo sapiens
ggaggcaggcaguccuuga

SEQ ID NO: 705845 - RNA, 19 nt, Homo sapiens
ugagauacagagcaaagaa

SEQ ID NO: 705846 - RNA, 19 nt, Homo sapiens
aagaauuacuucgaacaug

SEQ ID NO: 705847 - RNA, 19 nt, Homo sapiens
ggcacggcauugucuaaau

SEQ ID NO: 705848 - RNA, 19 nt, Homo sapiens
gaaccaccagcugaaagaa

SEQ ID NO: 705849 - RNA, 19 nt, Homo sapiens
gaaacaagcucacaucuuc

SEQ ID NO: 705850 - RNA, 19 nt, Homo sapiens
ggacuggaguuucucuuga

SEQ ID NO: 705851 - RNA, 19 nt, Homo sapiens
gaagggagcugcuguugac

SEQ ID NO: 705852 - RNA, 19 nt, Homo sapiens
ggacaagaaggaagaguaa

SEQ ID NO: 705853 - RNA, 19 nt, Homo sapiens
gcucauagcucgucaucuc

SEQ ID NO: 705854 - RNA, 19 nt, Homo sapiens
ggaggucuuuguuguguug

SEQ ID NO: 705855 - RNA, 19 nt, Homo sapiens
ggacugcaguugccaccuu

SEQ ID NO: 705856 - RNA, 19 nt, Homo sapiens
agaaguacauggaggagaa

SEQ ID NO: 705857 - RNA, 19 nt, Homo sapiens
gaaauucggaaguaugaug

SEQ ID NO: 705858 - RNA, 19 nt, Homo sapiens
caaguuggaugucgggaau

SEQ ID NO: 705859 - RNA, 19 nt, Homo sapiens
ggaaacaagcucacaucuu

SEQ ID NO: 705860 - RNA, 19 nt, Homo sapiens
gagaaugaccagcucaaga

SEQ ID NO: 705861 - RNA, 19 nt, Homo sapiens
ggagagcacgaguuaguug

SEQ ID NO: 705862 - RNA, 19 nt, Homo sapiens
ggaaugcugaggugaaguu

SEQ ID NO: 705863 - RNA, 19 nt, Homo sapiens
gcacguugacugugggaaa

SEQ ID NO: 705864 - RNA, 19 nt, Homo sapiens
agaaugaccagcucaagaa

SEQ ID NO: 705865 - RNA, 19 nt, Homo sapiens
gcggaggucuuuguugugu

SEQ ID NO: 705866 - RNA, 19 nt, Homo sapiens
gggaaaccuucuagcaaca

SEQ ID NO: 705867 - RNA, 19 nt, Homo sapiens
gagcacgaguuaguuguag

SEQ ID NO: 705868 - RNA, 19 nt, Homo sapiens
gugggaaacucggaaacaa

SEQ ID NO: 705869 - RNA, 19 nt, Homo sapiens
cugcuguccuuccugcuua

SEQ ID NO: 705870 - RNA, 19 nt, Homo sapiens
cagaaugcguuugcuguca

SEQ ID NO: 705871 - RNA, 19 nt, Homo sapiens
ccuaaaagauggcagaaga

SEQ ID NO: 705872 - RNA, 19 nt, Homo sapiens
ggccuccaaugaagccuuu

SEQ ID NO: 705873 - RNA, 19 nt, Homo sapiens
caacaccuucuuugugguu

SEQ ID NO: 705874 - RNA, 19 nt, Homo sapiens
gaaguuggaggaagagaac

SEQ ID NO: 705875 - RNA, 19 nt, Homo sapiens
gaaugcguuugcugucauc

SEQ ID NO: 705876 - RNA, 19 nt, Homo sapiens
caagaagggagcugcuguu

SEQ ID NO: 705877 - RNA, 19 nt, Homo sapiens
aaagauggcagaagauuuu

SEQ ID NO: 705878 - RNA, 19 nt, Homo sapiens
ucucuacauugcuggcuuu

SEQ ID NO: 705879 - RNA, 19 nt, Homo sapiens
gggcugacuuccuguuggu

SEQ ID NO: 705880 - RNA, 19 nt, Homo sapiens
ucucugcauucccuucauu

SEQ ID NO: 705881 - RNA, 19 nt, Homo sapiens
gcugacuuccuguugguuu

SEQ ID NO: 705882 - RNA, 19 nt, Homo sapiens
guggagagcacgaguuagu

SEQ ID NO: 705883 - RNA, 19 nt, Homo sapiens
gggcugcugugggagaguu

SEQ ID NO: 705884 - RNA, 19 nt, Homo sapiens
gcugcuggccuccaaugaa

SEQ ID NO: 705885 - RNA, 19 nt, Homo sapiens
gugggaaaccuucuagcaa

SEQ ID NO: 705886 - RNA, 19 nt, Homo sapiens
ccugauugcuacacguuca

SEQ ID NO: 705887 - RNA, 19 nt, Homo sapiens
ggcagaagauuuucaaguc

SEQ ID NO: 705888 - RNA, 19 nt, Homo sapiens
gcacgaguuaguuguaguc

SEQ ID NO: 705889 - RNA, 19 nt, Homo sapiens
augcugaggugaaguugga

SEQ ID NO: 705890 - RNA, 19 nt, Homo sapiens
ucggaaguaugaugaugug

SEQ ID NO: 705891 - RNA, 19 nt, Homo sapiens
gacuggaguuucucuugag

SEQ ID NO: 705892 - RNA, 19 nt, Homo sapiens
uggacaagaaggaagagua

SEQ ID NO: 705893 - RNA, 19 nt, Homo sapiens
gaccugauugcuacacguu

SEQ ID NO: 705894 - RNA, 19 nt, Homo sapiens
guugccaccuuccucuaug

SEQ ID NO: 705895 - RNA, 19 nt, Homo sapiens
gaaugaccagcucaagaag

SEQ ID NO: 705896 - RNA, 19 nt, Homo sapiens
uuagacgccuggugacucu

SEQ ID NO: 705897 - RNA, 19 nt, Homo sapiens
uggcaacaccuucuuugug

SEQ ID NO: 705898 - RNA, 19 nt, Homo sapiens
augcggaggucuuuguugu

SEQ ID NO: 705899 - RNA, 19 nt, Homo sapiens
gagagcacgaguuaguugu

SEQ ID NO: 705900 - RNA, 19 nt, Homo sapiens
cuccaguacuucuguuugu

SEQ ID NO: 705901 - RNA, 19 nt, Homo sapiens
ugucauccuugugcuguug

SEQ ID NO: 705902 - RNA, 19 nt, Homo sapiens
ggucuuuguuguguugcuu

SEQ ID NO: 705903 - RNA, 19 nt, Homo sapiens
agaaugcguuugcugucau

SEQ ID NO: 705904 - RNA, 19 nt, Homo sapiens
ugaaguuggaggaagagaa

SEQ ID NO: 705905 - RNA, 19 nt, Homo sapiens
agaagggagcugcuguuga

SEQ ID NO: 705906 - RNA, 19 nt, Homo sapiens
ggagaaugaccagcucaag

SEQ ID NO: 705907 - RNA, 19 nt, Homo sapiens
cugcuggccuccaaugaag

SEQ ID NO: 705908 - RNA, 19 nt, Homo sapiens
acacucuccaagcacauua

SEQ ID NO: 705909 - RNA, 19 nt, Homo sapiens
uguccacacucuccaagca

SEQ ID NO: 705910 - RNA, 19 nt, Homo sapiens
ccauggacaagaaggaaga

SEQ ID NO: 705911 - RNA, 19 nt, Homo sapiens
aggcugaccugcagaagcu

SEQ ID NO: 705912 - RNA, 19 nt, Homo sapiens
aaauucggaaguaugauga

SEQ ID NO: 705913 - RNA, 19 nt, Homo sapiens
agagcacgaguuaguugua

SEQ ID NO: 705914 - RNA, 19 nt, Homo sapiens
gaaguacauggaggagaau

SEQ ID NO: 705915 - RNA, 19 nt, Homo sapiens
cuucauuucuccuaaaaga

SEQ ID NO: 705916 - RNA, 19 nt, Homo sapiens
gguaagaaguuuccuguua

SEQ ID NO: 705917 - RNA, 19 nt, Homo sapiens
ggacauacccuauagaauu

SEQ ID NO: 705918 - RNA, 19 nt, Homo sapiens
gacauacccuauagaauua

SEQ ID NO: 705919 - RNA, 19 nt, Homo sapiens
uaaggaaggugaaauauga

SEQ ID NO: 705920 - RNA, 19 nt, Homo sapiens
ccaaagaugucuacaaaga

SEQ ID NO: 705921 - RNA, 19 nt, Homo sapiens
caaauuggauugagacuau

SEQ ID NO: 705922 - RNA, 19 nt, Homo sapiens
uaacuuagauggucuggaa

SEQ ID NO: 705923 - RNA, 19 nt, Homo sapiens
uaacagaacugagaaacuu

SEQ ID NO: 705924 - RNA, 19 nt, Homo sapiens
caaagaacauuuccaagau

SEQ ID NO: 705925 - RNA, 19 nt, Homo sapiens
aaagaugagugcuaaagua

SEQ ID NO: 705926 - RNA, 19 nt, Homo sapiens
guagcuauguuguaacuaa

SEQ ID NO: 705927 - RNA, 19 nt, Homo sapiens
ccaagagacugcuggcaua

SEQ ID NO: 705928 - RNA, 19 nt, Homo sapiens
caaaggaacagauacagua

SEQ ID NO: 705929 - RNA, 19 nt, Homo sapiens
ggauggaacuacauucuug

SEQ ID NO: 705930 - RNA, 19 nt, Homo sapiens
gcagaacacaguaccauaa

SEQ ID NO: 705931 - RNA, 19 nt, Homo sapiens
guuacuggcuuacaaauug

SEQ ID NO: 705932 - RNA, 19 nt, Homo sapiens
caagguuacucacuauaaa

SEQ ID NO: 705933 - RNA, 19 nt, Homo sapiens
gagcacagacuuucaagaa

SEQ ID NO: 705934 - RNA, 19 nt, Homo sapiens
acaaguugcugccaccuua

SEQ ID NO: 705935 - RNA, 19 nt, Homo sapiens
gugaagaucuaagacauuu

SEQ ID NO: 705936 - RNA, 19 nt, Homo sapiens
gaaauaugaggaaacagua

SEQ ID NO: 705937 - RNA, 19 nt, Homo sapiens
caagcaaaguuuauuccua

SEQ ID NO: 705938 - RNA, 19 nt, Homo sapiens
ggauuaacgucuucaagga

SEQ ID NO: 705939 - RNA, 19 nt, Homo sapiens
gaaacccucuugacacugu

SEQ ID NO: 705940 - RNA, 19 nt, Homo sapiens
uaacagucuuuccaacuuu

SEQ ID NO: 705941 - RNA, 19 nt, Homo sapiens
guagaaggcaugaaacaaa

SEQ ID NO: 705942 - RNA, 19 nt, Homo sapiens
ugaaaggccuguacugcaa

SEQ ID NO: 705943 - RNA, 19 nt, Homo sapiens
gaucucaaauuaggaaaug

SEQ ID NO: 705944 - RNA, 19 nt, Homo sapiens
gggauggaguagauauuaa

SEQ ID NO: 705945 - RNA, 19 nt, Homo sapiens
guaaaguaguaaccaaaga

SEQ ID NO: 705946 - RNA, 19 nt, Homo sapiens
uaucuugguuguuguauug

SEQ ID NO: 705947 - RNA, 19 nt, Homo sapiens
gccaauagguagucauuca

SEQ ID NO: 705948 - RNA, 19 nt, Homo sapiens
gagguuugcuacagaaguu

SEQ ID NO: 705949 - RNA, 19 nt, Homo sapiens
gaacauauuguaacacagu

SEQ ID NO: 705950 - RNA, 19 nt, Homo sapiens
gcaggacuugcucuaauua

SEQ ID NO: 705951 - RNA, 19 nt, Homo sapiens
ggaagcagcacaucauuag

SEQ ID NO: 705952 - RNA, 19 nt, Homo sapiens
cgauagcuaugacauuuau

SEQ ID NO: 705953 - RNA, 19 nt, Homo sapiens
aaacauggccuuaacaaag

SEQ ID NO: 705954 - RNA, 19 nt, Homo sapiens
guguuuaggugaucucaaa

SEQ ID NO: 705955 - RNA, 19 nt, Homo sapiens
cuacagaaguugacaagag

SEQ ID NO: 705956 - RNA, 19 nt, Homo sapiens
uagauggucuggaauacaa

SEQ ID NO: 705957 - RNA, 19 nt, Homo sapiens
augcacagcugaauauuga

SEQ ID NO: 705958 - RNA, 19 nt, Homo sapiens
acacaggcaccacuaauaa

SEQ ID NO: 705959 - RNA, 19 nt, Homo sapiens
ucacuugguuaacuucaaa

SEQ ID NO: 705960 - RNA, 19 nt, Homo sapiens
agccaaagaugucuacaaa

SEQ ID NO: 705961 - RNA, 19 nt, Homo sapiens
ccuacaagguuacucacua

SEQ ID NO: 705962 - RNA, 19 nt, Homo sapiens
acaaauaacagaacugaga

SEQ ID NO: 705963 - RNA, 19 nt, Homo sapiens
gcacaucauuaggcuuuau

SEQ ID NO: 705964 - RNA, 19 nt, Homo sapiens
ggccgauuaucuuuacaua

SEQ ID NO: 705965 - RNA, 19 nt, Homo sapiens
caacacaagcaaaguuuau

SEQ ID NO: 705966 - RNA, 19 nt, Homo sapiens
gaaaagggauggaacuaca

SEQ ID NO: 705967 - RNA, 19 nt, Homo sapiens
acaaagaacauuuccaaga

SEQ ID NO: 705968 - RNA, 19 nt, Homo sapiens
gcucuaauaugcaccucaa

SEQ ID NO: 705969 - RNA, 19 nt, Homo sapiens
ggugaaauaugaggaaaca

SEQ ID NO: 705970 - RNA, 19 nt, Homo sapiens
gagauugccuguggcucua

SEQ ID NO: 705971 - RNA, 19 nt, Homo sapiens
cuacaagguuacucacuau

SEQ ID NO: 705972 - RNA, 19 nt, Homo sapiens
gauugagacuauucuuguu

SEQ ID NO: 705973 - RNA, 19 nt, Homo sapiens
ggguugcaguacauucuua

SEQ ID NO: 705974 - RNA, 19 nt, Homo sapiens
gaauuucugcuuccacuau

SEQ ID NO: 705975 - RNA, 19 nt, Homo sapiens
aaagaacauuuccaagaug

SEQ ID NO: 705976 - RNA, 19 nt, Homo sapiens
gacagaaaacuccaaauua

SEQ ID NO: 705977 - RNA, 19 nt, Homo sapiens
gaaggugaaauaugaggaa

SEQ ID NO: 705978 - RNA, 19 nt, Homo sapiens
ggaauauggucaggaucuu

SEQ ID NO: 705979 - RNA, 19 nt, Homo sapiens
ggauugagacuauucuugu

SEQ ID NO: 705980 - RNA, 19 nt, Homo sapiens
gaacauuuccaagaugaug

SEQ ID NO: 705981 - RNA, 19 nt, Homo sapiens
aagaacauuuccaagauga

SEQ ID NO: 705982 - RNA, 19 nt, Homo sapiens
caaagaugucuacaaagaa

SEQ ID NO: 705983 - RNA, 19 nt, Homo sapiens
ccgauuaucuuuacauagg

SEQ ID NO: 705984 - RNA, 19 nt, Homo sapiens
caccuuaucuuagaguuau

SEQ ID NO: 705985 - RNA, 19 nt, Homo sapiens
aauaugcaccucaagauuu

SEQ ID NO: 705986 - RNA, 19 nt, Homo sapiens
uuaacagucuuuccaacuu

SEQ ID NO: 705987 - RNA, 19 nt, Homo sapiens
caaauaacagaacugagaa

SEQ ID NO: 705988 - RNA, 19 nt, Homo sapiens
cagcacaucauuaggcuuu

SEQ ID NO: 705989 - RNA, 19 nt, Homo sapiens
gauuguagaaggcaugaaa

SEQ ID NO: 705990 - RNA, 19 nt, Homo sapiens
cuacaaagaacauuuccaa

SEQ ID NO: 705991 - RNA, 19 nt, Homo sapiens
guccauuaaucagcaaaua

SEQ ID NO: 705992 - RNA, 19 nt, Homo sapiens
uacagaaguugacaagaga

SEQ ID NO: 705993 - RNA, 19 nt, Homo sapiens
gcugccaccuuaucuuaga

SEQ ID NO: 705994 - RNA, 19 nt, Homo sapiens
gaugagugcuaaaguaagc

SEQ ID NO: 705995 - RNA, 19 nt, Homo sapiens
gaacucaaaggguuacaag

SEQ ID NO: 705996 - RNA, 19 nt, Homo sapiens
gcgauagcuaugacauuua

SEQ ID NO: 705997 - RNA, 19 nt, Homo sapiens
gaacacaguaccauaacag

SEQ ID NO: 705998 - RNA, 19 nt, Homo sapiens
gaguguuacuggcuuacaa

SEQ ID NO: 705999 - RNA, 19 nt, Homo sapiens
uuagggcccuuugccaaua

SEQ ID NO: 706000 - RNA, 19 nt, Homo sapiens
ggucaggaucuucuccaua

SEQ ID NO: 706001 - RNA, 19 nt, Homo sapiens
ugaggaauauggucaggau

SEQ ID NO: 706002 - RNA, 19 nt, Homo sapiens
aaguguagcuauguuguaa

SEQ ID NO: 706003 - RNA, 19 nt, Homo sapiens
gaauuguuccuucaagugu

SEQ ID NO: 706004 - RNA, 19 nt, Homo sapiens
cucaaaggguuacaaguug

SEQ ID NO: 706005 - RNA, 19 nt, Homo sapiens
aaagaugucuacaaagaac

SEQ ID NO: 706006 - RNA, 19 nt, Homo sapiens
uaauaugcaccucaagauu

SEQ ID NO: 706007 - RNA, 19 nt, Homo sapiens
gucaggaucuucuccauac

SEQ ID NO: 706008 - RNA, 19 nt, Homo sapiens
gguggagguuugcuacaga

SEQ ID NO: 706009 - RNA, 19 nt, Homo sapiens
uugguuaacuucaaaggaa

SEQ ID NO: 706010 - RNA, 19 nt, Homo sapiens
caaucacaguggccacaaa

SEQ ID NO: 706011 - RNA, 19 nt, Homo sapiens
guucaguccugguauccaa

SEQ ID NO: 706012 - RNA, 19 nt, Homo sapiens
gaggaaauguucucuucac

SEQ ID NO: 706013 - RNA, 19 nt, Homo sapiens
gggcaucuuccaauagaaa

SEQ ID NO: 706014 - RNA, 19 nt, Homo sapiens
ucacaaauaacagaacuga

SEQ ID NO: 706015 - RNA, 19 nt, Homo sapiens
ccaacacaagcaaaguuua

SEQ ID NO: 706016 - RNA, 19 nt, Homo sapiens
gaucccacauccugaauaa

SEQ ID NO: 706017 - RNA, 19 nt, Homo sapiens
ggugugaccagcuuuguuu

SEQ ID NO: 706018 - RNA, 19 nt, Homo sapiens
guacaaccuugcugugaag

SEQ ID NO: 706019 - RNA, 19 nt, Homo sapiens
cgagggaucugaccuacca

SEQ ID NO: 706020 - RNA, 19 nt, Homo sapiens
auaaagaucucucggaaaa

SEQ ID NO: 706021 - RNA, 19 nt, Homo sapiens
caagacacccugcuacauc

SEQ ID NO: 706022 - RNA, 19 nt, Homo sapiens
gaccauagcaagccacuag

SEQ ID NO: 706023 - RNA, 19 nt, Homo sapiens
ugacaucgcccucaucaag

SEQ ID NO: 706024 - RNA, 19 nt, Homo sapiens
cagcuuuguuucuggcuuu

SEQ ID NO: 706025 - RNA, 19 nt, Homo sapiens
ggccgucucuauaccaaug

SEQ ID NO: 706026 - RNA, 19 nt, Homo sapiens
ucaguucccuccuccuugu

SEQ ID NO: 706027 - RNA, 19 nt, Homo sapiens
ugacauccuucccaacaag

SEQ ID NO: 706028 - RNA, 19 nt, Homo sapiens
gcugcaacuucaucuggaa

SEQ ID NO: 706029 - RNA, 19 nt, Homo sapiens
ccaacaagacacccugcua

SEQ ID NO: 706030 - RNA, 19 nt, Homo sapiens
gaguacaaccuugcuguga

SEQ ID NO: 706031 - RNA, 19 nt, Homo sapiens
ggcuuuggcugcaacuuca

SEQ ID NO: 706032 - RNA, 19 nt, Homo sapiens
ggugacauccuucccaaca

SEQ ID NO: 706033 - RNA, 19 nt, Homo sapiens
aagacacccugcuacauca

SEQ ID NO: 706034 - RNA, 19 nt, Homo sapiens
aguacaaccuugcugugaa

SEQ ID NO: 706035 - RNA, 19 nt, Homo sapiens
agguuucccugcaguauga

SEQ ID NO: 706036 - RNA, 19 nt, Homo sapiens
ccacauccugaauaaagaa

SEQ ID NO: 706037 - RNA, 19 nt, Homo sapiens
gugacauccuucccaacaa

SEQ ID NO: 706038 - RNA, 19 nt, Homo sapiens
gcucaguucccuccuccuu

SEQ ID NO: 706039 - RNA, 19 nt, Homo sapiens
ucacaaaacucaugaugcu

SEQ ID NO: 706040 - RNA, 19 nt, Homo sapiens
ccaccuuccucucacucuu

SEQ ID NO: 706041 - RNA, 19 nt, Homo sapiens
cccacauccugaauaaaga

SEQ ID NO: 706042 - RNA, 19 nt, Homo sapiens
gaagaaaaccauggugugu

SEQ ID NO: 706043 - RNA, 19 nt, Homo sapiens
ugcccgugguggacuauaa

SEQ ID NO: 706044 - RNA, 19 nt, Homo sapiens
gugaccagcuuuguuucug

SEQ ID NO: 706045 - RNA, 19 nt, Homo sapiens
aauaaagaucucucggaaa

SEQ ID NO: 706046 - RNA, 19 nt, Homo sapiens
caacucugaggagcuguuu

SEQ ID NO: 706047 - RNA, 19 nt, Homo sapiens
ucuggaagcccacgguguu

SEQ ID NO: 706048 - RNA, 19 nt, Homo sapiens
ucccacauccugaauaaag

SEQ ID NO: 706049 - RNA, 19 nt, Homo sapiens
ggacagauuugcuuuguua

SEQ ID NO: 706050 - RNA, 19 nt, Homo sapiens
gaaaugaggcugacuauaa

SEQ ID NO: 706051 - RNA, 19 nt, Homo sapiens
ggagauaggugagaugaua

SEQ ID NO: 706052 - RNA, 19 nt, Homo sapiens
gaacagcuccuccaaauau

SEQ ID NO: 706053 - RNA, 19 nt, Homo sapiens
ggaaauucaucucuuguuu

SEQ ID NO: 706054 - RNA, 19 nt, Homo sapiens
gauacugccuccucaauuu

SEQ ID NO: 706055 - RNA, 19 nt, Homo sapiens
ggagagaacacauaaauga

SEQ ID NO: 706056 - RNA, 19 nt, Homo sapiens
gaaguuggcuacucucaga

SEQ ID NO: 706057 - RNA, 19 nt, Homo sapiens
gagcauugguugacuguuu

SEQ ID NO: 706058 - RNA, 19 nt, Homo sapiens
uaaaugagcagaacuguuu

SEQ ID NO: 706059 - RNA, 19 nt, Homo sapiens
gaauacagauuugcuuuga

SEQ ID NO: 706060 - RNA, 19 nt, Homo sapiens
gcaacaguuucauuugaua

SEQ ID NO: 706061 - RNA, 19 nt, Homo sapiens
aaacucaaaugaccacaua

SEQ ID NO: 706062 - RNA, 19 nt, Homo sapiens
ugaaagggcuaccauuuga

SEQ ID NO: 706063 - RNA, 19 nt, Homo sapiens
ggagguguguucuguguuu

SEQ ID NO: 706064 - RNA, 19 nt, Homo sapiens
ccauuuaacuuuccuggua

SEQ ID NO: 706065 - RNA, 19 nt, Homo sapiens
gaucaaaggaagccaauaa

SEQ ID NO: 706066 - RNA, 19 nt, Homo sapiens
uuacaaggcucuaauuaug

SEQ ID NO: 706067 - RNA, 19 nt, Homo sapiens
guuuaaagcuggacagauu

SEQ ID NO: 706068 - RNA, 19 nt, Homo sapiens
ggaauggauugguuaaguu

SEQ ID NO: 706069 - RNA, 19 nt, Homo sapiens
ccaccuagcucaggaauga

SEQ ID NO: 706070 - RNA, 19 nt, Homo sapiens
gcgcacaggugguacaauu

SEQ ID NO: 706071 - RNA, 19 nt, Homo sapiens
gaugaagucuugaauacug

SEQ ID NO: 706072 - RNA, 19 nt, Homo sapiens
guaccuuuauugcuucuua

SEQ ID NO: 706073 - RNA, 19 nt, Homo sapiens
gaaauaaugggaauggauu

SEQ ID NO: 706074 - RNA, 19 nt, Homo sapiens
gaucauguaggucgaaaua

SEQ ID NO: 706075 - RNA, 19 nt, Homo sapiens
gcaacuacuuuguuauuuc

SEQ ID NO: 706076 - RNA, 19 nt, Homo sapiens
gaauaagacuuuugccaua

SEQ ID NO: 706077 - RNA, 19 nt, Homo sapiens
gagcagaacuguuuuguug

SEQ ID NO: 706078 - RNA, 19 nt, Homo sapiens
agaaguugcugcuuuguuu

SEQ ID NO: 706079 - RNA, 19 nt, Homo sapiens
ggauaaacauugcuguaug

SEQ ID NO: 706080 - RNA, 19 nt, Homo sapiens
guaguaauauucaguguag

SEQ ID NO: 706081 - RNA, 19 nt, Homo sapiens
uuacagggcucuaguuaug

SEQ ID NO: 706082 - RNA, 19 nt, Homo sapiens
uaagaaagguaugcuagaa

SEQ ID NO: 706083 - RNA, 19 nt, Homo sapiens
agacggaaaugcagaauau

SEQ ID NO: 706084 - RNA, 19 nt, Homo sapiens
gcacaggugguacaauuaa

SEQ ID NO: 706085 - RNA, 19 nt, Homo sapiens
gaaauguaguuccuagcuu

SEQ ID NO: 706086 - RNA, 19 nt, Homo sapiens
uaggugagaugauaugaaa

SEQ ID NO: 706087 - RNA, 19 nt, Homo sapiens
uaaggaaauucaucucuug

SEQ ID NO: 706088 - RNA, 19 nt, Homo sapiens
guauguaccuuuauugcuu

SEQ ID NO: 706089 - RNA, 19 nt, Homo sapiens
ggguaaagcuuugucuaaa

SEQ ID NO: 706090 - RNA, 19 nt, Homo sapiens
gagcaccuaugaauuugaa

SEQ ID NO: 706091 - RNA, 19 nt, Homo sapiens
gaaacugccaacuuagaua

SEQ ID NO: 706092 - RNA, 19 nt, Homo sapiens
gaaggauuguuuagacuca

SEQ ID NO: 706093 - RNA, 19 nt, Homo sapiens
uaggguagaucuucauauu

SEQ ID NO: 706094 - RNA, 19 nt, Homo sapiens
ggcaaucgcuuuauucaag

SEQ ID NO: 706095 - RNA, 19 nt, Homo sapiens
gaaacagaaugcugaugau

SEQ ID NO: 706096 - RNA, 19 nt, Homo sapiens
uaagaacacucgggaaaug

SEQ ID NO: 706097 - RNA, 19 nt, Homo sapiens
guaguuacccuagaagaua

SEQ ID NO: 706098 - RNA, 19 nt, Homo sapiens
aaaguugugugcauuugua

SEQ ID NO: 706099 - RNA, 19 nt, Homo sapiens
gcaguaguaguauagaaua

SEQ ID NO: 706100 - RNA, 19 nt, Homo sapiens
aaauggcccugguagcuua

SEQ ID NO: 706101 - RNA, 19 nt, Homo sapiens
caagauacauuugaagcuu

SEQ ID NO: 706102 - RNA, 19 nt, Homo sapiens
ggacuguaauuaaaugcuu

SEQ ID NO: 706103 - RNA, 19 nt, Homo sapiens
ggaaugaguagcaggguaa

SEQ ID NO: 706104 - RNA, 19 nt, Homo sapiens
gucaaagcaucaacaauga

SEQ ID NO: 706105 - RNA, 19 nt, Homo sapiens
gcucaaaguugugugcauu

SEQ ID NO: 706106 - RNA, 19 nt, Homo sapiens
guuguggacuguaauuaaa

SEQ ID NO: 706107 - RNA, 19 nt, Homo sapiens
caaggagucuagauugguu

SEQ ID NO: 706108 - RNA, 19 nt, Homo sapiens
gaagauaugagagagauug

SEQ ID NO: 706109 - RNA, 19 nt, Homo sapiens
aaauguaguuccuagcuuu

SEQ ID NO: 706110 - RNA, 19 nt, Homo sapiens
acacuucguuugugcuaua

SEQ ID NO: 706111 - RNA, 19 nt, Homo sapiens
ggagguggaccaaacaauu

SEQ ID NO: 706112 - RNA, 19 nt, Homo sapiens
acaacaguauccaacuuua

SEQ ID NO: 706113 - RNA, 19 nt, Homo sapiens
gaauaugauugaacugagu

SEQ ID NO: 706114 - RNA, 19 nt, Homo sapiens
caauacagaaggagagaua

SEQ ID NO: 706115 - RNA, 19 nt, Homo sapiens
guaaagcuaucuggagaga

SEQ ID NO: 706116 - RNA, 19 nt, Homo sapiens
gcauauagcuugguuucca

SEQ ID NO: 706117 - RNA, 19 nt, Homo sapiens
gauaaaugcugaaaaggaa

SEQ ID NO: 706118 - RNA, 19 nt, Homo sapiens
gagguggaccaaacaauuu

SEQ ID NO: 706119 - RNA, 19 nt, Homo sapiens
gaauggauugguuaaguuu

SEQ ID NO: 706120 - RNA, 19 nt, Homo sapiens
guugaaagaucauguaggu

SEQ ID NO: 706121 - RNA, 19 nt, Homo sapiens
gaaaugcagaauaugauug

SEQ ID NO: 706122 - RNA, 19 nt, Homo sapiens
ggaaaugcagaauaugauu

SEQ ID NO: 706123 - RNA, 19 nt, Homo sapiens
caugaguucugguugguaa

SEQ ID NO: 706124 - RNA, 19 nt, Homo sapiens
uagaaccuguggauuguuu

SEQ ID NO: 706125 - RNA, 19 nt, Homo sapiens
cgaaacagaaugcugauga

SEQ ID NO: 706126 - RNA, 19 nt, Homo sapiens
ggaacagcuccuccaaaua

SEQ ID NO: 706127 - RNA, 19 nt, Homo sapiens
ccacaacaguauccaacuu

SEQ ID NO: 706128 - RNA, 19 nt, Homo sapiens
ugacauuaauggaagagaa

SEQ ID NO: 706129 - RNA, 19 nt, Homo sapiens
gauuuagguuagucaguuu

SEQ ID NO: 706130 - RNA, 19 nt, Homo sapiens
caaaggaagccaauaaugg

SEQ ID NO: 706131 - RNA, 19 nt, Homo sapiens
uuacaaagauggauguucu

SEQ ID NO: 706132 - RNA, 19 nt, Homo sapiens
guacaugggcaaucgcuuu

SEQ ID NO: 706133 - RNA, 19 nt, Homo sapiens
gggaauggauugguuaagu

SEQ ID NO: 706134 - RNA, 19 nt, Homo sapiens
gaaaacacuugccuuacaa

SEQ ID NO: 706135 - RNA, 19 nt, Homo sapiens
uaaguguccuugucaugaa

SEQ ID NO: 706136 - RNA, 19 nt, Homo sapiens
agagggaaaugauacuaaa

SEQ ID NO: 706137 - RNA, 19 nt, Homo sapiens
ucauguaggucgaaauaau

SEQ ID NO: 706138 - RNA, 19 nt, Homo sapiens
caacaguauccaacuuuaa

SEQ ID NO: 706139 - RNA, 19 nt, Homo sapiens
caaagcaucaacaaugaaa

SEQ ID NO: 706140 - RNA, 19 nt, Homo sapiens
uguaugguaugaaggauuu

SEQ ID NO: 706141 - RNA, 19 nt, Homo sapiens
cagcgguuguguaauuuaa

SEQ ID NO: 706142 - RNA, 19 nt, Homo sapiens
agagauagaugagagauca

SEQ ID NO: 706143 - RNA, 19 nt, Homo sapiens
ugaaggauuuguaaagcuu

SEQ ID NO: 706144 - RNA, 19 nt, Homo sapiens
gggugaggcuuucaucguu

SEQ ID NO: 706145 - RNA, 19 nt, Homo sapiens
gauugacaguacaggauuu

SEQ ID NO: 706146 - RNA, 19 nt, Homo sapiens
uggcaacaguuucauuuga

SEQ ID NO: 706147 - RNA, 19 nt, Homo sapiens
cagauuugcuuuguuauag

SEQ ID NO: 706148 - RNA, 19 nt, Homo sapiens
ggacaggcauugguucagu

SEQ ID NO: 706149 - RNA, 19 nt, Homo sapiens
ggacagauuugcuuuguua

SEQ ID NO: 706150 - RNA, 19 nt, Homo sapiens
gaaaugaggcugacuauaa

SEQ ID NO: 706151 - RNA, 19 nt, Homo sapiens
ggagauaggugagaugaua

SEQ ID NO: 706152 - RNA, 19 nt, Homo sapiens
gaacagcuccuccaaauau

SEQ ID NO: 706153 - RNA, 19 nt, Homo sapiens
ggaaauucaucucuuguuu

SEQ ID NO: 706154 - RNA, 19 nt, Homo sapiens
gauacugccuccucaauuu

SEQ ID NO: 706155 - RNA, 19 nt, Homo sapiens
ggagagaacacauaaauga

SEQ ID NO: 706156 - RNA, 19 nt, Homo sapiens
gaaguuggcuacucucaga

SEQ ID NO: 706157 - RNA, 19 nt, Homo sapiens
gagcauugguugacuguuu

SEQ ID NO: 706158 - RNA, 19 nt, Homo sapiens
uaaaugagcagaacuguuu

SEQ ID NO: 706159 - RNA, 19 nt, Homo sapiens
gaauacagauuugcuuuga

SEQ ID NO: 706160 - RNA, 19 nt, Homo sapiens
gcaacaguuucauuugaua

SEQ ID NO: 706161 - RNA, 19 nt, Homo sapiens
aaacucaaaugaccacaua

SEQ ID NO: 706162 - RNA, 19 nt, Homo sapiens
ugaaagggcuaccauuuga

SEQ ID NO: 706163 - RNA, 19 nt, Homo sapiens
ggagguguguucuguguuu

SEQ ID NO: 706164 - RNA, 19 nt, Homo sapiens
ccauuuaacuuuccuggua

SEQ ID NO: 706165 - RNA, 19 nt, Homo sapiens
gaucaaaggaagccaauaa

SEQ ID NO: 706166 - RNA, 19 nt, Homo sapiens
uuacaaggcucuaauuaug

SEQ ID NO: 706167 - RNA, 19 nt, Homo sapiens
guuuaaagcuggacagauu

SEQ ID NO: 706168 - RNA, 19 nt, Homo sapiens
ggaauggauugguuaaguu

SEQ ID NO: 706169 - RNA, 19 nt, Homo sapiens
ccaccuagcucaggaauga

SEQ ID NO: 706170 - RNA, 19 nt, Homo sapiens
gcgcacaggugguacaauu

SEQ ID NO: 706171 - RNA, 19 nt, Homo sapiens
gaugaagucuugaauacug

SEQ ID NO: 706172 - RNA, 19 nt, Homo sapiens
guaccuuuauugcuucuua

SEQ ID NO: 706173 - RNA, 19 nt, Homo sapiens
gaaauaaugggaauggauu

SEQ ID NO: 706174 - RNA, 19 nt, Homo sapiens
gaucauguaggucgaaaua

SEQ ID NO: 706175 - RNA, 19 nt, Homo sapiens
gcaacuacuuuguuauuuc

SEQ ID NO: 706176 - RNA, 19 nt, Homo sapiens
gaauaagacuuuugccaua

SEQ ID NO: 706177 - RNA, 19 nt, Homo sapiens
gagcagaacuguuuuguug

SEQ ID NO: 706178 - RNA, 19 nt, Homo sapiens
agaaguugcugcuuuguuu

SEQ ID NO: 706179 - RNA, 19 nt, Homo sapiens
ggauaaacauugcuguaug

SEQ ID NO: 706180 - RNA, 19 nt, Homo sapiens
guaguaauauucaguguag

SEQ ID NO: 706181 - RNA, 19 nt, Homo sapiens
uuacagggcucuaguuaug

SEQ ID NO: 706182 - RNA, 19 nt, Homo sapiens
uaagaaagguaugcuagaa

SEQ ID NO: 706183 - RNA, 19 nt, Homo sapiens
agacggaaaugcagaauau

SEQ ID NO: 706184 - RNA, 19 nt, Homo sapiens
gcacaggugguacaauuaa

SEQ ID NO: 706185 - RNA, 19 nt, Homo sapiens
gaaauguaguuccuagcuu

SEQ ID NO: 706186 - RNA, 19 nt, Homo sapiens
uaggugagaugauaugaaa

SEQ ID NO: 706187 - RNA, 19 nt, Homo sapiens
uaaggaaauucaucucuug

SEQ ID NO: 706188 - RNA, 19 nt, Homo sapiens
guauguaccuuuauugcuu

SEQ ID NO: 706189 - RNA, 19 nt, Homo sapiens
ggguaaagcuuugucuaaa

SEQ ID NO: 706190 - RNA, 19 nt, Homo sapiens
gagcaccuaugaauuugaa

SEQ ID NO: 706191 - RNA, 19 nt, Homo sapiens
gaaacugccaacuuagaua

SEQ ID NO: 706192 - RNA, 19 nt, Homo sapiens
gaaggauuguuuagacuca

SEQ ID NO: 706193 - RNA, 19 nt, Homo sapiens
uaggguagaucuucauauu

SEQ ID NO: 706194 - RNA, 19 nt, Homo sapiens
ggcaaucgcuuuauucaag

SEQ ID NO: 706195 - RNA, 19 nt, Homo sapiens
gaaacagaaugcugaugau

SEQ ID NO: 706196 - RNA, 19 nt, Homo sapiens
uaagaacacucgggaaaug

SEQ ID NO: 706197 - RNA, 19 nt, Homo sapiens
guaguuacccuagaagaua

SEQ ID NO: 706198 - RNA, 19 nt, Homo sapiens
aaaguugugugcauuugua

SEQ ID NO: 706199 - RNA, 19 nt, Homo sapiens
gcaguaguaguauagaaua

SEQ ID NO: 706200 - RNA, 19 nt, Homo sapiens
aaauggcccugguagcuua

SEQ ID NO: 706201 - RNA, 19 nt, Homo sapiens
caagauacauuugaagcuu

SEQ ID NO: 706202 - RNA, 19 nt, Homo sapiens
ggacuguaauuaaaugcuu

SEQ ID NO: 706203 - RNA, 19 nt, Homo sapiens
ggaaugaguagcaggguaa

SEQ ID NO: 706204 - RNA, 19 nt, Homo sapiens
gucaaagcaucaacaauga

SEQ ID NO: 706205 - RNA, 19 nt, Homo sapiens
gcucaaaguugugugcauu

SEQ ID NO: 706206 - RNA, 19 nt, Homo sapiens
guuguggacuguaauuaaa

SEQ ID NO: 706207 - RNA, 19 nt, Homo sapiens
caaggagucuagauugguu

SEQ ID NO: 706208 - RNA, 19 nt, Homo sapiens
gaagauaugagagagauug

SEQ ID NO: 706209 - RNA, 19 nt, Homo sapiens
aaauguaguuccuagcuuu

SEQ ID NO: 706210 - RNA, 19 nt, Homo sapiens
acacuucguuugugcuaua

SEQ ID NO: 706211 - RNA, 19 nt, Homo sapiens
ggagguggaccaaacaauu

SEQ ID NO: 706212 - RNA, 19 nt, Homo sapiens
acaacaguauccaacuuua

SEQ ID NO: 706213 - RNA, 19 nt, Homo sapiens
gaauaugauugaacugagu

SEQ ID NO: 706214 - RNA, 19 nt, Homo sapiens
caauacagaaggagagaua

SEQ ID NO: 706215 - RNA, 19 nt, Homo sapiens
guaaagcuaucuggagaga

SEQ ID NO: 706216 - RNA, 19 nt, Homo sapiens
gcauauagcuugguuucca

SEQ ID NO: 706217 - RNA, 19 nt, Homo sapiens
gauaaaugcugaaaaggaa

SEQ ID NO: 706218 - RNA, 19 nt, Homo sapiens
gagguggaccaaacaauuu

SEQ ID NO: 706219 - RNA, 19 nt, Homo sapiens
gaauggauugguuaaguuu

SEQ ID NO: 706220 - RNA, 19 nt, Homo sapiens
guugaaagaucauguaggu

SEQ ID NO: 706221 - RNA, 19 nt, Homo sapiens
gaaaugcagaauaugauug

SEQ ID NO: 706222 - RNA, 19 nt, Homo sapiens
ggaaaugcagaauaugauu

SEQ ID NO: 706223 - RNA, 19 nt, Homo sapiens
caugaguucugguugguaa

SEQ ID NO: 706224 - RNA, 19 nt, Homo sapiens
uagaaccuguggauuguuu

SEQ ID NO: 706225 - RNA, 19 nt, Homo sapiens
cgaaacagaaugcugauga

SEQ ID NO: 706226 - RNA, 19 nt, Homo sapiens
ggaacagcuccuccaaaua

SEQ ID NO: 706227 - RNA, 19 nt, Homo sapiens
ccacaacaguauccaacuu

SEQ ID NO: 706228 - RNA, 19 nt, Homo sapiens
ugacauuaauggaagagaa

SEQ ID NO: 706229 - RNA, 19 nt, Homo sapiens
gauuuagguuagucaguuu

SEQ ID NO: 706230 - RNA, 19 nt, Homo sapiens
caaaggaagccaauaaugg

SEQ ID NO: 706231 - RNA, 19 nt, Homo sapiens
uuacaaagauggauguucu

SEQ ID NO: 706232 - RNA, 19 nt, Homo sapiens
guacaugggcaaucgcuuu

SEQ ID NO: 706233 - RNA, 19 nt, Homo sapiens
gggaauggauugguuaagu

SEQ ID NO: 706234 - RNA, 19 nt, Homo sapiens
gaaaacacuugccuuacaa

SEQ ID NO: 706235 - RNA, 19 nt, Homo sapiens
uaaguguccuugucaugaa

SEQ ID NO: 706236 - RNA, 19 nt, Homo sapiens
agagggaaaugauacuaaa

SEQ ID NO: 706237 - RNA, 19 nt, Homo sapiens
ucauguaggucgaaauaau

SEQ ID NO: 706238 - RNA, 19 nt, Homo sapiens
caacaguauccaacuuuaa

SEQ ID NO: 706239 - RNA, 19 nt, Homo sapiens
caaagcaucaacaaugaaa

SEQ ID NO: 706240 - RNA, 19 nt, Homo sapiens
uguaugguaugaaggauuu

SEQ ID NO: 706241 - RNA, 19 nt, Homo sapiens
cagcgguuguguaauuuaa

SEQ ID NO: 706242 - RNA, 19 nt, Homo sapiens
agagauagaugagagauca

SEQ ID NO: 706243 - RNA, 19 nt, Homo sapiens
ugaaggauuuguaaagcuu

SEQ ID NO: 706244 - RNA, 19 nt, Homo sapiens
gauugacaguacaggauuu

SEQ ID NO: 706245 - RNA, 19 nt, Homo sapiens
uggcaacaguuucauuuga

SEQ ID NO: 706246 - RNA, 19 nt, Homo sapiens
gggugaggcuuucaucguu

SEQ ID NO: 706247 - RNA, 19 nt, Homo sapiens
cagauuugcuuuguuauag

SEQ ID NO: 706248 - RNA, 19 nt, Homo sapiens
ggacaggcauugguucagu

SEQ ID NO: 706249 - RNA, 19 nt, Homo sapiens
ggagaagccucaucauuga

SEQ ID NO: 706250 - RNA, 19 nt, Homo sapiens
ccaaacauuuccagacuua

SEQ ID NO: 706251 - RNA, 19 nt, Homo sapiens
gcaguuaagugccaugaaa

SEQ ID NO: 706252 - RNA, 19 nt, Homo sapiens
gccaagagguaccacauuu

SEQ ID NO: 706253 - RNA, 19 nt, Homo sapiens
gcucagcauuuggaaguua

SEQ ID NO: 706254 - RNA, 19 nt, Homo sapiens
ggaaguuacuguuggagau

SEQ ID NO: 706255 - RNA, 19 nt, Homo sapiens
gcagguuacucagcaguuu

SEQ ID NO: 706256 - RNA, 19 nt, Homo sapiens
uuacagacuuuaaggagaa

SEQ ID NO: 706257 - RNA, 19 nt, Homo sapiens
caugcacaauccauaauuu

SEQ ID NO: 706258 - RNA, 19 nt, Homo sapiens
gcaaauacacagauuaugc

SEQ ID NO: 706259 - RNA, 19 nt, Homo sapiens
gcagaucaacacagucaaa

SEQ ID NO: 706260 - RNA, 19 nt, Homo sapiens
cagauuaugccaagaggua

SEQ ID NO: 706261 - RNA, 19 nt, Homo sapiens
gcaaugaugccuaccaaac

SEQ ID NO: 706262 - RNA, 19 nt, Homo sapiens
cuuagucacuucuguccua

SEQ ID NO: 706263 - RNA, 19 nt, Homo sapiens
aggagaagccucaucauug

SEQ ID NO: 706264 - RNA, 19 nt, Homo sapiens
ccaugcaaauacacagauu

SEQ ID NO: 706265 - RNA, 19 nt, Homo sapiens
uaacacagagagaggaaug

SEQ ID NO: 706266 - RNA, 19 nt, Homo sapiens
gcacaauccauaauuugag

SEQ ID NO: 706267 - RNA, 19 nt, Homo sapiens
gaggguuacugggacugua

SEQ ID NO: 706268 - RNA, 19 nt, Homo sapiens
cagauacauucaugcacaa

SEQ ID NO: 706269 - RNA, 19 nt, Homo sapiens
cuacacagucaaagaaaga

SEQ ID NO: 706270 - RNA, 19 nt, Homo sapiens
caaugaugccuaccaaaca

SEQ ID NO: 706271 - RNA, 19 nt, Homo sapiens
gauaacacagagagaggaa

SEQ ID NO: 706272 - RNA, 19 nt, Homo sapiens
aaaggaaacaacuagcaaa

SEQ ID NO: 706273 - RNA, 19 nt, Homo sapiens
uaccaaacauuuccagacu

SEQ ID NO: 706274 - RNA, 19 nt, Homo sapiens
caugcaaauacacagauua

SEQ ID NO: 706275 - RNA, 19 nt, Homo sapiens
gagaagccucaucauugaa

SEQ ID NO: 706276 - RNA, 19 nt, Homo sapiens
gaauguccaggucaucuuc

SEQ ID NO: 706277 - RNA, 19 nt, Homo sapiens
ggaauguccaggucaucuu

SEQ ID NO: 706278 - RNA, 19 nt, Homo sapiens
cacaauccauaauuugagu

SEQ ID NO: 706279 - RNA, 19 nt, Homo sapiens
gcauuuggaaguuacuguu

SEQ ID NO: 706280 - RNA, 19 nt, Homo sapiens
ccaauuucuuagucacuuc

SEQ ID NO: 706281 - RNA, 19 nt, Homo sapiens
aaugaugccuaccaaacau

SEQ ID NO: 706282 - RNA, 19 nt, Homo sapiens
ugacagauacauucaugca

SEQ ID NO: 706283 - RNA, 19 nt, Homo sapiens
ggcucuagcucugauaaca

SEQ ID NO: 706284 - RNA, 19 nt, Homo sapiens
gaaguuacuguuggagauc

SEQ ID NO: 706285 - RNA, 19 nt, Homo sapiens
gaaaaccaggccaagauug

SEQ ID NO: 706286 - RNA, 19 nt, Homo sapiens
gaaaaggaaacaacuagca

SEQ ID NO: 706287 - RNA, 19 nt, Homo sapiens
guccuaccaugcaaauaca

SEQ ID NO: 706288 - RNA, 19 nt, Homo sapiens
gccaagccaugggagacaa

SEQ ID NO: 706289 - RNA, 19 nt, Homo sapiens
ucaugcacaauccauaauu

SEQ ID NO: 706290 - RNA, 19 nt, Homo sapiens
gccuucaagugcaugaugu

SEQ ID NO: 706291 - RNA, 19 nt, Homo sapiens
uugcaaugaugccuaccaa

SEQ ID NO: 706292 - RNA, 19 nt, Homo sapiens
ugaugccuaccaaacauuu

SEQ ID NO: 706293 - RNA, 19 nt, Homo sapiens
gauacauucaugcacaauc

SEQ ID NO: 706294 - RNA, 19 nt, Homo sapiens
agaggaauguccaggucau

SEQ ID NO: 706295 - RNA, 19 nt, Homo sapiens
aaaccaggccaagauugaa

SEQ ID NO: 706296 - RNA, 19 nt, Homo sapiens
ccuacacagucaaagaaag

SEQ ID NO: 706297 - RNA, 19 nt, Homo sapiens
aaacauuuccagacuuaac

SEQ ID NO: 706298 - RNA, 19 nt, Homo sapiens
uuucaugacagauacauuc

SEQ ID NO: 706299 - RNA, 19 nt, Homo sapiens
gaagacaaacuuuccucua

SEQ ID NO: 706300 - RNA, 19 nt, Homo sapiens
acaaguacauguuucagaa

SEQ ID NO: 706301 - RNA, 19 nt, Homo sapiens
gacaaacuuuccucuaugu

SEQ ID NO: 706302 - RNA, 19 nt, Homo sapiens
gaaaggcucggcucauguu

SEQ ID NO: 706303 - RNA, 19 nt, Homo sapiens
gggaaaggcucggcucaug

SEQ ID NO: 706304 - RNA, 19 nt, Homo sapiens
aagacaaacuuuccucuau

SEQ ID NO: 706305 - RNA, 19 nt, Homo sapiens
gggcugaucuugccuugag

SEQ ID NO: 706306 - RNA, 19 nt, Homo sapiens
agacaaacuuuccucuaug

SEQ ID NO: 706307 - RNA, 19 nt, Homo sapiens
ggaagacccaggccauguu

SEQ ID NO: 706308 - RNA, 19 nt, Homo sapiens
guaggcauccggaggcuuu

SEQ ID NO: 706309 - RNA, 19 nt, Homo sapiens
ccaagcaggcguuugagaa

SEQ ID NO: 706310 - RNA, 19 nt, Homo sapiens
ggacuuaggagggcaggaa

SEQ ID NO: 706311 - RNA, 19 nt, Homo sapiens
gcucauguucugggacuua

SEQ ID NO: 706312 - RNA, 19 nt, Homo sapiens
ggaaaggcucggcucaugu

SEQ ID NO: 706313 - RNA, 19 nt, Homo sapiens
aaauaaagacggcgagugu

SEQ ID NO: 706314 - RNA, 19 nt, Homo sapiens
ggagcugacugaugcaaaa

SEQ ID NO: 706315 - RNA, 19 nt, Homo sapiens
gcacuguggaugugggaaa

SEQ ID NO: 706316 - RNA, 19 nt, Homo sapiens
aaacccgauuuaacaagaa

SEQ ID NO: 706317 - RNA, 19 nt, Homo sapiens
ucgaguggauggugaagug

SEQ ID NO: 706318 - RNA, 19 nt, Homo sapiens
gaagacccaggccauguuc

SEQ ID NO: 706319 - RNA, 19 nt, Homo sapiens
ggguucuucuauuuacuuu

SEQ ID NO: 706320 - RNA, 19 nt, Homo sapiens
gagaccugguugggaauug

SEQ ID NO: 706321 - RNA, 19 nt, Homo sapiens
gcgagggcaucgaguggau

SEQ ID NO: 706322 - RNA, 19 nt, Homo sapiens
aaagacggcgagugugaaa

SEQ ID NO: 706323 - RNA, 19 nt, Homo sapiens
auaaagacggcgaguguga

SEQ ID NO: 706324 - RNA, 19 nt, Homo sapiens
cagggugagugcaaaauaa

SEQ ID NO: 706325 - RNA, 19 nt, Homo sapiens
gccgagugcuguguucuuc

SEQ ID NO: 706326 - RNA, 19 nt, Homo sapiens
caaguauuaugcggagugu

SEQ ID NO: 706327 - RNA, 19 nt, Homo sapiens
ggcagagggacaucacgua

SEQ ID NO: 706328 - RNA, 19 nt, Homo sapiens
aaacaucggcacuguggau

SEQ ID NO: 706329 - RNA, 19 nt, Homo sapiens
uggcuucaccucacccuaa

SEQ ID NO: 706330 - RNA, 19 nt, Homo sapiens
caaacuuuccucuaugucu

SEQ ID NO: 706331 - RNA, 19 nt, Homo sapiens
uaaagacggcgagugugaa

SEQ ID NO: 706332 - RNA, 19 nt, Homo sapiens
cucaaucccugacaucaag

SEQ ID NO: 706333 - RNA, 19 nt, Homo sapiens
caagcaggcguuugagaag

SEQ ID NO: 706334 - RNA, 19 nt, Homo sapiens
ggcgucaucuacgucauug

SEQ ID NO: 706335 - RNA, 19 nt, Homo sapiens
gggagggagcugacugaug

SEQ ID NO: 706336 - RNA, 19 nt, Homo sapiens
cgacugcaccagcaagauc

SEQ ID NO: 706337 - RNA, 19 nt, Homo sapiens
cccaggccauguucccaaa

SEQ ID NO: 706338 - RNA, 19 nt, Homo sapiens
ggagaccugguugggaauu

SEQ ID NO: 706339 - RNA, 19 nt, Homo sapiens
gccuaaacaucggcacugu

SEQ ID NO: 706340 - RNA, 19 nt, Homo sapiens
ggcuucaccucacccuaau

SEQ ID NO: 706341 - RNA, 19 nt, Homo sapiens
ggcccuggauugugaugca

SEQ ID NO: 706342 - RNA, 19 nt, Homo sapiens
aguccaagcaggcguuuga

SEQ ID NO: 706343 - RNA, 19 nt, Homo sapiens
aaaacccgauuuaacaaga

SEQ ID NO: 706344 - RNA, 19 nt, Homo sapiens
gcaaggacauggcugauuu

SEQ ID NO: 706345 - RNA, 19 nt, Homo sapiens
gaacaagcauccaaagaga

SEQ ID NO: 706346 - RNA, 19 nt, Homo sapiens
gauauggccucuuacagua

SEQ ID NO: 706347 - RNA, 19 nt, Homo sapiens
guagauggcuugaauuuua

SEQ ID NO: 706348 - RNA, 19 nt, Homo sapiens
ucucagauauggccucuua

SEQ ID NO: 706349 - RNA, 19 nt, Homo sapiens
gaaaguggacccagugauu

SEQ ID NO: 706350 - RNA, 19 nt, Homo sapiens
gucagugucuuacauguua

SEQ ID NO: 706351 - RNA, 19 nt, Homo sapiens
gaaugugaaugaccucuug

SEQ ID NO: 706352 - RNA, 19 nt, Homo sapiens
gcacguacuucucccauca

SEQ ID NO: 706353 - RNA, 19 nt, Homo sapiens
gaugugaguuggauaagga

SEQ ID NO: 706354 - RNA, 19 nt, Homo sapiens
gcagcuucauguuguauuu

SEQ ID NO: 706355 - RNA, 19 nt, Homo sapiens
ugaaugaccucuugaagca

SEQ ID NO: 706356 - RNA, 19 nt, Homo sapiens
gacaugguauugcauuuau

SEQ ID NO: 706357 - RNA, 19 nt, Homo sapiens
caggagacgugucaacauu

SEQ ID NO: 706358 - RNA, 19 nt, Homo sapiens
guuaagagggacugaaaua

SEQ ID NO: 706359 - RNA, 19 nt, Homo sapiens
ugagguuucuuaccaaauu

SEQ ID NO: 706360 - RNA, 19 nt, Homo sapiens
caaccaagcacaaaguuau

SEQ ID NO: 706361 - RNA, 19 nt, Homo sapiens
gugaagaacuugaaagacu

SEQ ID NO: 706362 - RNA, 19 nt, Homo sapiens
aagagggacugaaauaguu

SEQ ID NO: 706363 - RNA, 19 nt, Homo sapiens
ucaaugcacucucuguaug

SEQ ID NO: 706364 - RNA, 19 nt, Homo sapiens
gcagcagcuucauguugua

SEQ ID NO: 706365 - RNA, 19 nt, Homo sapiens
gagagugguuuggacauug

SEQ ID NO: 706366 - RNA, 19 nt, Homo sapiens
gaaggugcuuuacguggau

SEQ ID NO: 706367 - RNA, 19 nt, Homo sapiens
ccacaggaucuuaguguuu

SEQ ID NO: 706368 - RNA, 19 nt, Homo sapiens
ggguuuagauguauacaca

SEQ ID NO: 706369 - RNA, 19 nt, Homo sapiens
ugaagaacuugaaagacuu

SEQ ID NO: 706370 - RNA, 19 nt, Homo sapiens
cgacaugguauugcauuua

SEQ ID NO: 706371 - RNA, 19 nt, Homo sapiens
guacaguaaugccuuugau

SEQ ID NO: 706372 - RNA, 19 nt, Homo sapiens
guaaugccuuugauguguu

SEQ ID NO: 706373 - RNA, 19 nt, Homo sapiens
ccacucagccuuuaaccuu

SEQ ID NO: 706374 - RNA, 19 nt, Homo sapiens
gcaguauucuaaccagcaa

SEQ ID NO: 706375 - RNA, 19 nt, Homo sapiens
ccaaguagcacuaaauuuu

SEQ ID NO: 706376 - RNA, 19 nt, Homo sapiens
cagcaauuccagccuguua

SEQ ID NO: 706377 - RNA, 19 nt, Homo sapiens
ccaguacaguaaugccuuu

SEQ ID NO: 706378 - RNA, 19 nt, Homo sapiens
gaaauccaaguagcacuaa

SEQ ID NO: 706379 - RNA, 19 nt, Homo sapiens
caaguucggcucuaccaaa

SEQ ID NO: 706380 - RNA, 19 nt, Homo sapiens
acucagccuuuaaccuuua

SEQ ID NO: 706381 - RNA, 19 nt, Homo sapiens
cacaggaucuuaguguuug

SEQ ID NO: 706382 - RNA, 19 nt, Homo sapiens
ggagacgugucaacauuuu

SEQ ID NO: 706383 - RNA, 19 nt, Homo sapiens
gcuuaaauaacaugcagua

SEQ ID NO: 706384 - RNA, 19 nt, Homo sapiens
gcuguaagcccuaccuuca

SEQ ID NO: 706385 - RNA, 19 nt, Homo sapiens
gaccagugaaggugcuuua

SEQ ID NO: 706386 - RNA, 19 nt, Homo sapiens
ccaaccaagcacaaaguua

SEQ ID NO: 706387 - RNA, 19 nt, Homo sapiens
gaucgacccauuugagguu

SEQ ID NO: 706388 - RNA, 19 nt, Homo sapiens
gcaauuccagccuguuaug

SEQ ID NO: 706389 - RNA, 19 nt, Homo sapiens
gacccagccucaucagugu

SEQ ID NO: 706390 - RNA, 19 nt, Homo sapiens
gaaaagccauacaaaggau

SEQ ID NO: 706391 - RNA, 19 nt, Homo sapiens
uaagagggacugaaauagu

SEQ ID NO: 706392 - RNA, 19 nt, Homo sapiens
uaaugccuuugauguguuu

SEQ ID NO: 706393 - RNA, 19 nt, Homo sapiens
gggcacugguauccugaaa

SEQ ID NO: 706394 - RNA, 19 nt, Homo sapiens
aaccucggcuugaauguga

SEQ ID NO: 706395 - RNA, 19 nt, Homo sapiens
gagguuucuuaccaaauug

SEQ ID NO: 706396 - RNA, 19 nt, Homo sapiens
uguaagcccuaccuucaug

SEQ ID NO: 706397 - RNA, 19 nt, Homo sapiens
cagcagcagcuucauguug

SEQ ID NO: 706398 - RNA, 19 nt, Homo sapiens
ugaaauccaaguagcacua

SEQ ID NO: 706399 - RNA, 19 nt, Homo sapiens
gagggacugaaauaguuua

SEQ ID NO: 706400 - RNA, 19 nt, Homo sapiens
cauuugagguuucuuacca

SEQ ID NO: 706401 - RNA, 19 nt, Homo sapiens
gacagcagcagcuucaugu

SEQ ID NO: 706402 - RNA, 19 nt, Homo sapiens
uauggccucuuacaguauu

SEQ ID NO: 706403 - RNA, 19 nt, Homo sapiens
gcacugguauccugaaaag

SEQ ID NO: 706404 - RNA, 19 nt, Homo sapiens
gagaaaguggacccaguga

SEQ ID NO: 706405 - RNA, 19 nt, Homo sapiens
agagugguuuggacauuga

SEQ ID NO: 706406 - RNA, 19 nt, Homo sapiens
gccacaggaucuuaguguu

SEQ ID NO: 706407 - RNA, 19 nt, Homo sapiens
agagagugguuuggacauu

SEQ ID NO: 706408 - RNA, 19 nt, Homo sapiens
agccaucucuuccucaaug

SEQ ID NO: 706409 - RNA, 19 nt, Homo sapiens
aaagccaucucuuccucaa

SEQ ID NO: 706410 - RNA, 19 nt, Homo sapiens
ugaacaagcauccaaagag

SEQ ID NO: 706411 - RNA, 19 nt, Homo sapiens
gagucagugucuuacaugu

SEQ ID NO: 706412 - RNA, 19 nt, Homo sapiens
aguaaugccuuugaugugu

SEQ ID NO: 706413 - RNA, 19 nt, Homo sapiens
ugcuuuacguggaugauaa

SEQ ID NO: 706414 - RNA, 19 nt, Homo sapiens
guguuuggaucgacccauu

SEQ ID NO: 706415 - RNA, 19 nt, Homo sapiens
uaagauauagcaaggacau

SEQ ID NO: 706416 - RNA, 19 nt, Homo sapiens
ggaucgggguuuagaugua

SEQ ID NO: 706417 - RNA, 19 nt, Homo sapiens
gauugaacaagcauccaaa

SEQ ID NO: 706418 - RNA, 19 nt, Homo sapiens
uaagugacccagccucauc

SEQ ID NO: 706419 - RNA, 19 nt, Homo sapiens
ccucaaugcacucucugua

SEQ ID NO: 706420 - RNA, 19 nt, Homo sapiens
aauaugaagggcacuggua

SEQ ID NO: 706421 - RNA, 19 nt, Homo sapiens
cagugaaggugcuuuacgu

SEQ ID NO: 706422 - RNA, 19 nt, Homo sapiens
acaguaaugccuuugaugu

SEQ ID NO: 706423 - RNA, 19 nt, Homo sapiens
ccucaguccucuccaguac

SEQ ID NO: 706424 - RNA, 19 nt, Homo sapiens
guaguaguaccaauggaau

SEQ ID NO: 706425 - RNA, 19 nt, Homo sapiens
cacucagccuuuaaccuuu

SEQ ID NO: 706426 - RNA, 19 nt, Homo sapiens
ggaugugaguuggauaagg

SEQ ID NO: 706427 - RNA, 19 nt, Homo sapiens
guaaggauacauucaagcu

SEQ ID NO: 706428 - RNA, 19 nt, Homo sapiens
uggcuugaauuuuagcuua

SEQ ID NO: 706429 - RNA, 19 nt, Homo sapiens
cuaugcagcuugaaaucca

SEQ ID NO: 706430 - RNA, 19 nt, Homo sapiens
cagggucaagguaguagua

SEQ ID NO: 706431 - RNA, 19 nt, Homo sapiens
gcagcaacaacagcagaaa

SEQ ID NO: 706432 - RNA, 19 nt, Homo sapiens
ccgguccacucagccuuua

SEQ ID NO: 706433 - RNA, 19 nt, Homo sapiens
aaaguggacccagugauug

SEQ ID NO: 706434 - RNA, 19 nt, Homo sapiens
agauauggccucuuacagu

SEQ ID NO: 706435 - RNA, 19 nt, Homo sapiens
auacauucaagcuugguua

SEQ ID NO: 706436 - RNA, 19 nt, Homo sapiens
uaguaaggauacauucaag

SEQ ID NO: 706437 - RNA, 19 nt, Homo sapiens
cuaccaaaaugaagaauag

SEQ ID NO: 706438 - RNA, 19 nt, Homo sapiens
ucacucugcugcuguaagc

SEQ ID NO: 706439 - RNA, 19 nt, Homo sapiens
gggacugaaauaguuuaua

SEQ ID NO: 706440 - RNA, 19 nt, Homo sapiens
ucagugucuuacauguuaa

SEQ ID NO: 706441 - RNA, 19 nt, Homo sapiens
ggaguugaaaccuaauuuu

SEQ ID NO: 706442 - RNA, 19 nt, Homo sapiens
ucagauauggccucuuaca

SEQ ID NO: 706443 - RNA, 19 nt, Homo sapiens
cauucaagcuugguuaaaa

SEQ ID NO: 706444 - RNA, 19 nt, Homo sapiens
gcaggaagguuaaagaguu

SEQ ID NO: 706445 - RNA, 19 nt, Homo sapiens
ucacaagacucacaauuca

SEQ ID NO: 706446 - RNA, 19 nt, Homo sapiens
ugagguugcuuagauaaua

SEQ ID NO: 706447 - RNA, 19 nt, Homo sapiens
ccuccuaccucaaaucuaa

SEQ ID NO: 706448 - RNA, 19 nt, Homo sapiens
caggagagcugaccuugga

SEQ ID NO: 706449 - RNA, 19 nt, Homo sapiens
gagguugcuuagauaauaa

SEQ ID NO: 706450 - RNA, 19 nt, Homo sapiens
gacaaagaauacuggagaa

SEQ ID NO: 706451 - RNA, 19 nt, Homo sapiens
aaacagagccagaaugcuu

SEQ ID NO: 706452 - RNA, 19 nt, Homo sapiens
gggaggcuguggaucaauu

SEQ ID NO: 706453 - RNA, 19 nt, Homo sapiens
caggaagguuaaagaguuu

SEQ ID NO: 706454 - RNA, 19 nt, Homo sapiens
gaugacaaauugaaaugca

SEQ ID NO: 706455 - RNA, 19 nt, Homo sapiens
ucaaccauauccuuucaaa

SEQ ID NO: 706456 - RNA, 19 nt, Homo sapiens
gaaggaaggaacacgcaaa

SEQ ID NO: 706457 - RNA, 19 nt, Homo sapiens
ggagaugacaaauugaaau

SEQ ID NO: 706458 - RNA, 19 nt, Homo sapiens
gaagcaaauucacaagacu

SEQ ID NO: 706459 - RNA, 19 nt, Homo sapiens
gagaugacaaauugaaaug

SEQ ID NO: 706460 - RNA, 19 nt, Homo sapiens
caaagaauacuggagaaga

SEQ ID NO: 706461 - RNA, 19 nt, Homo sapiens
gaacugagcauuggcaaaa

SEQ ID NO: 706462 - RNA, 19 nt, Homo sapiens
aaagaauacuggagaagag

SEQ ID NO: 706463 - RNA, 19 nt, Homo sapiens
acuuggagaugacaaauug

SEQ ID NO: 706464 - RNA, 19 nt, Homo sapiens
ggaggcuguggaucaauua

SEQ ID NO: 706465 - RNA, 19 nt, Homo sapiens
ugaaaugcaggaagguuaa

SEQ ID NO: 706466 - RNA, 19 nt, Homo sapiens
gccugagguugcuuagaua

SEQ ID NO: 706467 - RNA, 19 nt, Homo sapiens
acaagacucacaauucaaa

SEQ ID NO: 706468 - RNA, 19 nt, Homo sapiens
guggaucaauuaccaaugg

SEQ ID NO: 706469 - RNA, 19 nt, Homo sapiens
gaaaugcaggaagguuaaa

SEQ ID NO: 706470 - RNA, 19 nt, Homo sapiens
gaguuugauuugacaagau

SEQ ID NO: 706471 - RNA, 19 nt, Homo sapiens
ccagaucagugaggucaug

SEQ ID NO: 706472 - RNA, 19 nt, Homo sapiens
ggauuagaacccagaccua

SEQ ID NO: 706473 - RNA, 19 nt, Homo sapiens
ccucuugaguuugauuuga

SEQ ID NO: 706474 - RNA, 19 nt, Homo sapiens
ugccugagguugcuuagau

SEQ ID NO: 706475 - RNA, 19 nt, Homo sapiens
uuucaaaccagaucaguga

SEQ ID NO: 706476 - RNA, 19 nt, Homo sapiens
caaauucacaagacucaca

SEQ ID NO: 706477 - RNA, 19 nt, Homo sapiens
ugaguuugauuugacaaga

SEQ ID NO: 706478 - RNA, 19 nt, Homo sapiens
gggcagagcacaaccucau

SEQ ID NO: 706479 - RNA, 19 nt, Homo sapiens
gugcaucaaugaaggaaaa

SEQ ID NO: 706480 - RNA, 19 nt, Homo sapiens
cagaagcaaauucacaaga

SEQ ID NO: 706481 - RNA, 19 nt, Homo sapiens
uugaaaugcaggaagguua

SEQ ID NO: 706482 - RNA, 19 nt, Homo sapiens
agugguuccucuugaguuu

SEQ ID NO: 706483 - RNA, 19 nt, Homo sapiens
gaauacuggagaagagaga

SEQ ID NO: 706484 - RNA, 19 nt, Homo sapiens
agaagcaaauucacaagac

SEQ ID NO: 706485 - RNA, 19 nt, Homo sapiens
gaaaagacaaagaauacug

SEQ ID NO: 706486 - RNA, 19 nt, Homo sapiens
agacucacaauucaaagaa

SEQ ID NO: 706487 - RNA, 19 nt, Homo sapiens
caaaagacagagauaagaa

SEQ ID NO: 706488 - RNA, 19 nt, Homo sapiens
ggacacccagaagcaaauu

SEQ ID NO: 706489 - RNA, 19 nt, Homo sapiens
gcagugcaucaaugaagga

SEQ ID NO: 706490 - RNA, 19 nt, Homo sapiens
caauggacacccagaagca

SEQ ID NO: 706491 - RNA, 19 nt, Homo sapiens
gccagccuccuaccucaaa

SEQ ID NO: 706492 - RNA, 19 nt, Homo sapiens
gcugaggaugacaagcuua

SEQ ID NO: 706493 - RNA, 19 nt, Homo sapiens
uuucaaccauauccuuuca

SEQ ID NO: 706494 - RNA, 19 nt, Homo sapiens
ugguuccucuugaguuuga

SEQ ID NO: 706495 - RNA, 19 nt, Homo sapiens
ucccagugguuccucuuga

SEQ ID NO: 706496 - RNA, 19 nt, Homo sapiens
gcugggagaaaccaacaug

SEQ ID NO: 706497 - RNA, 19 nt, Homo sapiens
uaccuucuucuuucaauug

SEQ ID NO: 706498 - RNA, 19 nt, Homo sapiens
cuucugagcguuucugaca

SEQ ID NO: 706499 - RNA, 19 nt, Homo sapiens
uggacacuauggacggaaa

SEQ ID NO: 706500 - RNA, 19 nt, Homo sapiens
gaauuugggaaggaaggaa

SEQ ID NO: 706501 - RNA, 19 nt, Homo sapiens
uuuccugucaguugaauuu

SEQ ID NO: 706502 - RNA, 19 nt, Homo sapiens
ccugggaggcuguggauca

SEQ ID NO: 706503 - RNA, 19 nt, Homo sapiens
ugacaacccacacaaaaga

SEQ ID NO: 706504 - RNA, 19 nt, Homo sapiens
gaacacagcuuaugauugu

SEQ ID NO: 706505 - RNA, 19 nt, Homo sapiens
gaacacagcuucuauuuag

SEQ ID NO: 706506 - RNA, 19 nt, Homo sapiens
gcaaaggacuuagaacuua

SEQ ID NO: 706507 - RNA, 19 nt, Homo sapiens
gaaauguucuccaaagaua

SEQ ID NO: 706508 - RNA, 19 nt, Homo sapiens
gaacuuaugcugaacauua

SEQ ID NO: 706509 - RNA, 19 nt, Homo sapiens
gacaauagcugaacaagaa

SEQ ID NO: 706510 - RNA, 19 nt, Homo sapiens
gaaauaugcuccagugauu

SEQ ID NO: 706511 - RNA, 19 nt, Homo sapiens
gaaauuaacuggccagcaa

SEQ ID NO: 706512 - RNA, 19 nt, Homo sapiens
gaagagaaauagagaagaa

SEQ ID NO: 706513 - RNA, 19 nt, Homo sapiens
acaaagagauggcauuaua

SEQ ID NO: 706514 - RNA, 19 nt, Homo sapiens
gaagugauaugccaagaaa

SEQ ID NO: 706515 - RNA, 19 nt, Homo sapiens
gaacuuacccaguguuaua

SEQ ID NO: 706516 - RNA, 19 nt, Homo sapiens
gaacaagucaguagguuua

SEQ ID NO: 706517 - RNA, 19 nt, Homo sapiens
gcauuaaccuugagaauau

SEQ ID NO: 706518 - RNA, 19 nt, Homo sapiens
caaguaagcucuuuauuag

SEQ ID NO: 706519 - RNA, 19 nt, Homo sapiens
uagcacagcugcagacuua

SEQ ID NO: 706520 - RNA, 19 nt, Homo sapiens
gcagacagaugguaugaaa

SEQ ID NO: 706521 - RNA, 19 nt, Homo sapiens
gagaagaacuggaaaauaa

SEQ ID NO: 706522 - RNA, 19 nt, Homo sapiens
guucgaaacugauauagua

SEQ ID NO: 706523 - RNA, 19 nt, Homo sapiens
ugaaagagcugcagaaaca

SEQ ID NO: 706524 - RNA, 19 nt, Homo sapiens
gaacaaggccaguuugaaa

SEQ ID NO: 706525 - RNA, 19 nt, Homo sapiens
gaagaacaguuggaagaua

SEQ ID NO: 706526 - RNA, 19 nt, Homo sapiens
ggcaaagguuccauaauua

SEQ ID NO: 706527 - RNA, 19 nt, Homo sapiens
caacaggaauuggcaaaua

SEQ ID NO: 706528 - RNA, 19 nt, Homo sapiens
agugaaagcucuagaaaua

SEQ ID NO: 706529 - RNA, 19 nt, Homo sapiens
gaacaugucacuuuaaaga

SEQ ID NO: 706530 - RNA, 19 nt, Homo sapiens
gaaauuggguucuucaaca

SEQ ID NO: 706531 - RNA, 19 nt, Homo sapiens
agacaaaccugaacuagaa

SEQ ID NO: 706532 - RNA, 19 nt, Homo sapiens
ccagaaagcuaauaauaga

SEQ ID NO: 706533 - RNA, 19 nt, Homo sapiens
gagagaagcuguguuguga

SEQ ID NO: 706534 - RNA, 19 nt, Homo sapiens
acaaaggaaucaucacuua

SEQ ID NO: 706535 - RNA, 19 nt, Homo sapiens
agaacaaggucgaaacuua

SEQ ID NO: 706536 - RNA, 19 nt, Homo sapiens
caggaaagccuacaaauuu

SEQ ID NO: 706537 - RNA, 19 nt, Homo sapiens
uaacagagauggcuuugga

SEQ ID NO: 706538 - RNA, 19 nt, Homo sapiens
gaaguuaacuaucaagagu

SEQ ID NO: 706539 - RNA, 19 nt, Homo sapiens
gaagagcuuuccaaacuga

SEQ ID NO: 706540 - RNA, 19 nt, Homo sapiens
gaagagaaaucauaaagac

SEQ ID NO: 706541 - RNA, 19 nt, Homo sapiens
gaagaacuaggacuaauuu

SEQ ID NO: 706542 - RNA, 19 nt, Homo sapiens
gaaaggcucucauuuacca

SEQ ID NO: 706543 - RNA, 19 nt, Homo sapiens
ggacagaagacaucaauga

SEQ ID NO: 706544 - RNA, 19 nt, Homo sapiens
gaagaagaauuugguguug

SEQ ID NO: 706545 - RNA, 19 nt, Homo sapiens
cuacugaaguuacauguuu

SEQ ID NO: 706546 - RNA, 19 nt, Homo sapiens
gaagagagaagcuguguug

SEQ ID NO: 706547 - RNA, 19 nt, Homo sapiens
aaacugaacugucuagaau

SEQ ID NO: 706548 - RNA, 19 nt, Homo sapiens
caaguuaucuucucugcaa

SEQ ID NO: 706549 - RNA, 19 nt, Homo sapiens
gaacaaguuucauugagau

SEQ ID NO: 706550 - RNA, 19 nt, Homo sapiens
gaaggaguuuguuaucuga

SEQ ID NO: 706551 - RNA, 19 nt, Homo sapiens
uggcaaagguuccauaauu

SEQ ID NO: 706552 - RNA, 19 nt, Homo sapiens
gcucuuaaaucccuagaaa

SEQ ID NO: 706553 - RNA, 19 nt, Homo sapiens
ccaagaagaaagagaauua

SEQ ID NO: 706554 - RNA, 19 nt, Homo sapiens
gaagaaguagcuaagguua

SEQ ID NO: 706555 - RNA, 19 nt, Homo sapiens
caacagaacucauggaaaa

SEQ ID NO: 706556 - RNA, 19 nt, Homo sapiens
gcagauagaugguuuacag

SEQ ID NO: 706557 - RNA, 19 nt, Homo sapiens
gaaaugacucuucaaauca

SEQ ID NO: 706558 - RNA, 19 nt, Homo sapiens
gggcagagcuggaugagau

SEQ ID NO: 706559 - RNA, 19 nt, Homo sapiens
gaacaagaaacacaaagaa

SEQ ID NO: 706560 - RNA, 19 nt, Homo sapiens
ccagcucacugcuaauuua

SEQ ID NO: 706561 - RNA, 19 nt, Homo sapiens
uaacccagcucacugcuaa

SEQ ID NO: 706562 - RNA, 19 nt, Homo sapiens
gaauuacgauccugacaga

SEQ ID NO: 706563 - RNA, 19 nt, Homo sapiens
gagaaaagcuuacaucaau

SEQ ID NO: 706564 - RNA, 19 nt, Homo sapiens
gcaaaauucugucaagaua

SEQ ID NO: 706565 - RNA, 19 nt, Homo sapiens
cagaaaggaacuagaauua

SEQ ID NO: 706566 - RNA, 19 nt, Homo sapiens
gaaagacuacugagacaaa

SEQ ID NO: 706567 - RNA, 19 nt, Homo sapiens
aaaggaaucuucagcuaaa

SEQ ID NO: 706568 - RNA, 19 nt, Homo sapiens
gaaccugaaagaacaaaua

SEQ ID NO: 706569 - RNA, 19 nt, Homo sapiens
gcaaagguuccauaauuaa

SEQ ID NO: 706570 - RNA, 19 nt, Homo sapiens
ggaaaugggugagguuguu

SEQ ID NO: 706571 - RNA, 19 nt, Homo sapiens
ggucagggaauuuaucuua

SEQ ID NO: 706572 - RNA, 19 nt, Homo sapiens
caagacaacuacugagcua

SEQ ID NO: 706573 - RNA, 19 nt, Homo sapiens
ucaaagggauauacaagaa

SEQ ID NO: 706574 - RNA, 19 nt, Homo sapiens
agaaauagauguggaagaa

SEQ ID NO: 706575 - RNA, 19 nt, Homo sapiens
gaacauggaaaggaaauuu

SEQ ID NO: 706576 - RNA, 19 nt, Homo sapiens
agaacaagaccacuuauua

SEQ ID NO: 706577 - RNA, 19 nt, Homo sapiens
acagagagcuggaagaaau

SEQ ID NO: 706578 - RNA, 19 nt, Homo sapiens
acagagcccuaacagauua

SEQ ID NO: 706579 - RNA, 19 nt, Homo sapiens
agaaaugacucuuuacuuc

SEQ ID NO: 706580 - RNA, 19 nt, Homo sapiens
gacaguggaugugaaauuu

SEQ ID NO: 706581 - RNA, 19 nt, Homo sapiens
cagaauggcugaaucacaa

SEQ ID NO: 706582 - RNA, 19 nt, Homo sapiens
gaacaagaccacuuauuag

SEQ ID NO: 706583 - RNA, 19 nt, Homo sapiens
cagaagacaucaaugaaug

SEQ ID NO: 706584 - RNA, 19 nt, Homo sapiens
agaaaugacucuucaaauc

SEQ ID NO: 706585 - RNA, 19 nt, Homo sapiens
ggaagcagcaugagauuga

SEQ ID NO: 706586 - RNA, 19 nt, Homo sapiens
cagaagaaguuacugaaau

SEQ ID NO: 706587 - RNA, 19 nt, Homo sapiens
ucaauuggaugugguuaua

SEQ ID NO: 706588 - RNA, 19 nt, Homo sapiens
uagagagguugaacaguua

SEQ ID NO: 706589 - RNA, 19 nt, Homo sapiens
acaagaagcugaauuagag

SEQ ID NO: 706590 - RNA, 19 nt, Homo sapiens
gaacaggaaagccuacaaa

SEQ ID NO: 706591 - RNA, 19 nt, Homo sapiens
agaaauaccugcugcuguu

SEQ ID NO: 706592 - RNA, 19 nt, Homo sapiens
acugaaagcugaacuaaga

SEQ ID NO: 706593 - RNA, 19 nt, Homo sapiens
gggcagaggcugaaguaua

SEQ ID NO: 706594 - RNA, 19 nt, Homo sapiens
gacaggagcugguagagau

SEQ ID NO: 706595 - RNA, 19 nt, Homo sapiens
uaaggaacaugguuaugaa

SEQ ID NO: 706596 - RNA, 19 nt, Homo sapiens
ggaaccggcuguaaucaug

SEQ ID NO: 706597 - RNA, 19 nt, Homo sapiens
gguuggaaguuaaagauaa

SEQ ID NO: 706598 - RNA, 19 nt, Homo sapiens
agaagaagcagacaguuua

SEQ ID NO: 706599 - RNA, 19 nt, Homo sapiens
ggaaauacagaaacuagaa

SEQ ID NO: 706600 - RNA, 19 nt, Homo sapiens
ugagagagauguauuccaa

SEQ ID NO: 706601 - RNA, 19 nt, Homo sapiens
gaaagaaacugaacaaaac

SEQ ID NO: 706602 - RNA, 19 nt, Homo sapiens
guagagagcuagaaaucau

SEQ ID NO: 706603 - RNA, 19 nt, Homo sapiens
ggacagcgacuacaaggaa

SEQ ID NO: 706604 - RNA, 19 nt, Homo sapiens
gaacacagcuucuauuuag

SEQ ID NO: 706605 - RNA, 19 nt, Homo sapiens
gaaauguucuccaaagaua

SEQ ID NO: 706606 - RNA, 19 nt, Homo sapiens
gacaauagcugaacaagaa

SEQ ID NO: 706607 - RNA, 19 nt, Homo sapiens
acaaagagauggcauuaua

SEQ ID NO: 706608 - RNA, 19 nt, Homo sapiens
ggaacacacucuauacuaa

SEQ ID NO: 706609 - RNA, 19 nt, Homo sapiens
caaguaagcucuuuauuag

SEQ ID NO: 706610 - RNA, 19 nt, Homo sapiens
uagcacagcugcagacuua

SEQ ID NO: 706611 - RNA, 19 nt, Homo sapiens
gcagacagaugguaugaaa

SEQ ID NO: 706612 - RNA, 19 nt, Homo sapiens
guucgaaacugauauagua

SEQ ID NO: 706613 - RNA, 19 nt, Homo sapiens
gaagaacaguuggaagaua

SEQ ID NO: 706614 - RNA, 19 nt, Homo sapiens
ggaaacaucucuucuugau

SEQ ID NO: 706615 - RNA, 19 nt, Homo sapiens
acaaaggaaucaucacuua

SEQ ID NO: 706616 - RNA, 19 nt, Homo sapiens
gugcugaggugcuccauua

SEQ ID NO: 706617 - RNA, 19 nt, Homo sapiens
caggaaagccuacaaauuu

SEQ ID NO: 706618 - RNA, 19 nt, Homo sapiens
gaaguuaacuaucaagagu

SEQ ID NO: 706619 - RNA, 19 nt, Homo sapiens
gaagagcuuuccaaacuga

SEQ ID NO: 706620 - RNA, 19 nt, Homo sapiens
gaagagaaaucauaaagac

SEQ ID NO: 706621 - RNA, 19 nt, Homo sapiens
gaagaacuaggacuaauuu

SEQ ID NO: 706622 - RNA, 19 nt, Homo sapiens
gaagaagaauuugguguug

SEQ ID NO: 706623 - RNA, 19 nt, Homo sapiens
aaacugaacugucuagaau

SEQ ID NO: 706624 - RNA, 19 nt, Homo sapiens
caaguuaucuucucugcaa

SEQ ID NO: 706625 - RNA, 19 nt, Homo sapiens
gaacaaguuucauugagau

SEQ ID NO: 706626 - RNA, 19 nt, Homo sapiens
gaagaaguagcuaagguua

SEQ ID NO: 706627 - RNA, 19 nt, Homo sapiens
caacagaacucauggaaaa

SEQ ID NO: 706628 - RNA, 19 nt, Homo sapiens
gcagauagaugguuuacag

SEQ ID NO: 706629 - RNA, 19 nt, Homo sapiens
gaaaugacucuucaaauca

SEQ ID NO: 706630 - RNA, 19 nt, Homo sapiens
gggcagagcuggaugagau

SEQ ID NO: 706631 - RNA, 19 nt, Homo sapiens
gaacaagaaacacaaagaa

SEQ ID NO: 706632 - RNA, 19 nt, Homo sapiens
ccagcucacugcuaauuua

SEQ ID NO: 706633 - RNA, 19 nt, Homo sapiens
uaacccagcucacugcuaa

SEQ ID NO: 706634 - RNA, 19 nt, Homo sapiens
cagaaaggaacuagaauua

SEQ ID NO: 706635 - RNA, 19 nt, Homo sapiens
ggaaaugggugagguuguu

SEQ ID NO: 706636 - RNA, 19 nt, Homo sapiens
gaacauggaaaggaaauuu

SEQ ID NO: 706637 - RNA, 19 nt, Homo sapiens
agaacaagaccacuuauua

SEQ ID NO: 706638 - RNA, 19 nt, Homo sapiens
acagagagcuggaagaaau

SEQ ID NO: 706639 - RNA, 19 nt, Homo sapiens
gacaguggaugugaaauuu

SEQ ID NO: 706640 - RNA, 19 nt, Homo sapiens
cagaauggcugaaucacaa

SEQ ID NO: 706641 - RNA, 19 nt, Homo sapiens
gaacaagaccacuuauuag

SEQ ID NO: 706642 - RNA, 19 nt, Homo sapiens
agaaaugacucuucaaauc

SEQ ID NO: 706643 - RNA, 19 nt, Homo sapiens
ggaagcagcaugagauuga

SEQ ID NO: 706644 - RNA, 19 nt, Homo sapiens
acaagaagcugaauuagag

SEQ ID NO: 706645 - RNA, 19 nt, Homo sapiens
gaacaggaaagccuacaaa

SEQ ID NO: 706646 - RNA, 19 nt, Homo sapiens
gaaagaaacugaacaaaac

SEQ ID NO: 706647 - RNA, 19 nt, Homo sapiens
guagagagcuagaaaucau

SEQ ID NO: 706648 - RNA, 19 nt, Homo sapiens
ggaaacaaauaucguuaag

SEQ ID NO: 706649 - RNA, 19 nt, Homo sapiens
gcagauagugcaaaugaaa

SEQ ID NO: 706650 - RNA, 19 nt, Homo sapiens
caacagauccucacucauc

SEQ ID NO: 706651 - RNA, 19 nt, Homo sapiens
gaaaugaggguuaccuaug

SEQ ID NO: 706652 - RNA, 19 nt, Homo sapiens
gacagcagcuuuagaucuu

SEQ ID NO: 706653 - RNA, 19 nt, Homo sapiens
gauccagaauuacaagauu

SEQ ID NO: 706654 - RNA, 19 nt, Homo sapiens
guacuuaaaucagaacaga

SEQ ID NO: 706655 - RNA, 19 nt, Homo sapiens
gaacagauucagagagcua

SEQ ID NO: 706656 - RNA, 19 nt, Homo sapiens
ggcaauaaaugaacugaau

SEQ ID NO: 706657 - RNA, 19 nt, Homo sapiens
agaaacagcacucauagua

SEQ ID NO: 706658 - RNA, 19 nt, Homo sapiens
aggaaagccuacaaauuua

SEQ ID NO: 706659 - RNA, 19 nt, Homo sapiens
ucagacagcuugcccaguu

SEQ ID NO: 706660 - RNA, 19 nt, Homo sapiens
aggcagagauccacuguuu

SEQ ID NO: 706661 - RNA, 19 nt, Homo sapiens
gcaguguccuuggugaaua

SEQ ID NO: 706662 - RNA, 19 nt, Homo sapiens
acagaaacauggugagauu

SEQ ID NO: 706663 - RNA, 19 nt, Homo sapiens
gagcuucauuugcaaagaa

SEQ ID NO: 706664 - RNA, 19 nt, Homo sapiens
gaacuggaaagugaaauuu

SEQ ID NO: 706665 - RNA, 19 nt, Homo sapiens
agaaacaggugaugaagga

SEQ ID NO: 706666 - RNA, 19 nt, Homo sapiens
aagaagagcuuuccaaacu

SEQ ID NO: 706667 - RNA, 19 nt, Homo sapiens
ccaaaucgaccuuuccuuu

SEQ ID NO: 706668 - RNA, 19 nt, Homo sapiens
agaaguagcuaagguuauu

SEQ ID NO: 706669 - RNA, 19 nt, Homo sapiens
gaauucuggugauuacauu

SEQ ID NO: 706670 - RNA, 19 nt, Homo sapiens
gaucaaggaacuucagaaa

SEQ ID NO: 706671 - RNA, 19 nt, Homo sapiens
caaguuucauugagaugua

SEQ ID NO: 706672 - RNA, 19 nt, Homo sapiens
gauagaugguuuacagaau

SEQ ID NO: 706673 - RNA, 19 nt, Homo sapiens
ggacaccuaucucaaccuu

SEQ ID NO: 706674 - RNA, 19 nt, Homo sapiens
guaugaaacuugaauuugg

SEQ ID NO: 706675 - RNA, 19 nt, Homo sapiens
caaaguaacagaagaauac

SEQ ID NO: 706676 - RNA, 19 nt, Homo sapiens
aaauaugacuguuggagaa

SEQ ID NO: 706677 - RNA, 19 nt, Homo sapiens
ggaagaacuaggacuaauu

SEQ ID NO: 706678 - RNA, 19 nt, Homo sapiens
guuaaugaauguggcaaua

SEQ ID NO: 706679 - RNA, 19 nt, Homo sapiens
gcaaaagaaccaagaaaua

SEQ ID NO: 706680 - RNA, 19 nt, Homo sapiens
gaagcuaagagagauaaua

SEQ ID NO: 706681 - RNA, 19 nt, Homo sapiens
gauggaagcccaacgcauu

SEQ ID NO: 706682 - RNA, 19 nt, Homo sapiens
ucagagagcuagacagaca

SEQ ID NO: 706683 - RNA, 19 nt, Homo sapiens
caagaccacuuauuagaag

SEQ ID NO: 706684 - RNA, 19 nt, Homo sapiens
ugaagaacaagaccacuua

SEQ ID NO: 706685 - RNA, 19 nt, Homo sapiens
gaacaaggagcacaagaca

SEQ ID NO: 706686 - RNA, 19 nt, Homo sapiens
ggaagaagaauuugguguu

SEQ ID NO: 706687 - RNA, 19 nt, Homo sapiens
caguggaugugaaauuuaa

SEQ ID NO: 706688 - RNA, 19 nt, Homo sapiens
gaaauuaucacaggaucaa

SEQ ID NO: 706689 - RNA, 19 nt, Homo sapiens
gaggaaacaaauaucguua

SEQ ID NO: 706690 - RNA, 19 nt, Homo sapiens
caacaaaguaacagaagaa

SEQ ID NO: 706691 - RNA, 19 nt, Homo sapiens
gaauaaauccaacuacagu

SEQ ID NO: 706692 - RNA, 19 nt, Homo sapiens
aaacaaagagauggcauua

SEQ ID NO: 706693 - RNA, 19 nt, Homo sapiens
ugacugcaguucagaggua

SEQ ID NO: 706694 - RNA, 19 nt, Homo sapiens
ccgccaagcuuaccuguug

SEQ ID NO: 706695 - RNA, 19 nt, Homo sapiens
gaaagaacucaauguacuu

SEQ ID NO: 706696 - RNA, 19 nt, Homo sapiens
ucagaaagaacucaaugua

SEQ ID NO: 706697 - RNA, 19 nt, Homo sapiens
gagaagaaaguaagcaaga

SEQ ID NO: 706698 - RNA, 19 nt, Homo sapiens
caagagaaagaacaaguuu

SEQ ID NO: 706699 - RNA, 19 nt, Homo sapiens
gaaaauacauacuccuguu

SEQ ID NO: 706700 - RNA, 19 nt, Homo sapiens
caaacugaaggaagauuua

SEQ ID NO: 706701 - RNA, 19 nt, Homo sapiens
gcacacucuucucaacaaa

SEQ ID NO: 706702 - RNA, 19 nt, Homo sapiens
uaaccaagcgagagaaauu

SEQ ID NO: 706703 - RNA, 19 nt, Homo sapiens
gaaauacucagacaagaag

SEQ ID NO: 706704 - RNA, 19 nt, Homo sapiens
gaacacagcuuaugauugu

SEQ ID NO: 706705 - RNA, 19 nt, Homo sapiens
gaacacagcuucuauuuag

SEQ ID NO: 706706 - RNA, 19 nt, Homo sapiens
gcaaaggacuuagaacuua

SEQ ID NO: 706707 - RNA, 19 nt, Homo sapiens
gaaauguucuccaaagaua

SEQ ID NO: 706708 - RNA, 19 nt, Homo sapiens
gaacuuaugcugaacauua

SEQ ID NO: 706709 - RNA, 19 nt, Homo sapiens
gacaauagcugaacaagaa

SEQ ID NO: 706710 - RNA, 19 nt, Homo sapiens
gaaauuaacuggccagcaa

SEQ ID NO: 706711 - RNA, 19 nt, Homo sapiens
gaagagaaauagagaagaa

SEQ ID NO: 706712 - RNA, 19 nt, Homo sapiens
acaaagagauggcauuaua

SEQ ID NO: 706713 - RNA, 19 nt, Homo sapiens
gaagugauaugccaagaaa

SEQ ID NO: 706714 - RNA, 19 nt, Homo sapiens
guaaagagguauuugguuu

SEQ ID NO: 706715 - RNA, 19 nt, Homo sapiens
gaacuuacccaguguuaua

SEQ ID NO: 706716 - RNA, 19 nt, Homo sapiens
gaacaagucaguagguuua

SEQ ID NO: 706717 - RNA, 19 nt, Homo sapiens
gcauuaaccuugagaauau

SEQ ID NO: 706718 - RNA, 19 nt, Homo sapiens
caaguaagcucuuuauuag

SEQ ID NO: 706719 - RNA, 19 nt, Homo sapiens
uagcacagcugcagacuua

SEQ ID NO: 706720 - RNA, 19 nt, Homo sapiens
gcagacagaugguaugaaa

SEQ ID NO: 706721 - RNA, 19 nt, Homo sapiens
gagaagaacuggaaaauaa

SEQ ID NO: 706722 - RNA, 19 nt, Homo sapiens
guucgaaacugauauagua

SEQ ID NO: 706723 - RNA, 19 nt, Homo sapiens
ugaaagagcugcagaaaca

SEQ ID NO: 706724 - RNA, 19 nt, Homo sapiens
gaacaaggccaguuugaaa

SEQ ID NO: 706725 - RNA, 19 nt, Homo sapiens
gaagaacaguuggaagaua

SEQ ID NO: 706726 - RNA, 19 nt, Homo sapiens
ggcaaagguuccauaauua

SEQ ID NO: 706727 - RNA, 19 nt, Homo sapiens
caacaggaauuggcaaaua

SEQ ID NO: 706728 - RNA, 19 nt, Homo sapiens
agugaaagcucuagaaaua

SEQ ID NO: 706729 - RNA, 19 nt, Homo sapiens
gaacaugucacuuuaaaga

SEQ ID NO: 706730 - RNA, 19 nt, Homo sapiens
gaaauuggguucuucaaca

SEQ ID NO: 706731 - RNA, 19 nt, Homo sapiens
agacaaaccugaacuagaa

SEQ ID NO: 706732 - RNA, 19 nt, Homo sapiens
ccagaaagcuaauaauaga

SEQ ID NO: 706733 - RNA, 19 nt, Homo sapiens
gagagaagcuguguuguga

SEQ ID NO: 706734 - RNA, 19 nt, Homo sapiens
acaaaggaaucaucacuua

SEQ ID NO: 706735 - RNA, 19 nt, Homo sapiens
agaacaaggucgaaacuua

SEQ ID NO: 706736 - RNA, 19 nt, Homo sapiens
caggaaagccuacaaauuu

SEQ ID NO: 706737 - RNA, 19 nt, Homo sapiens
uaacagagauggcuuugga

SEQ ID NO: 706738 - RNA, 19 nt, Homo sapiens
gaaguuaacuaucaagagu

SEQ ID NO: 706739 - RNA, 19 nt, Homo sapiens
gaagagcuuuccaaacuga

SEQ ID NO: 706740 - RNA, 19 nt, Homo sapiens
gaagagaaaucauaaagac

SEQ ID NO: 706741 - RNA, 19 nt, Homo sapiens
gaagaacuaggacuaauuu

SEQ ID NO: 706742 - RNA, 19 nt, Homo sapiens
gaaaggcucucauuuacca

SEQ ID NO: 706743 - RNA, 19 nt, Homo sapiens
ggacagaagacaucaauga

SEQ ID NO: 706744 - RNA, 19 nt, Homo sapiens
gaagaagaauuugguguug

SEQ ID NO: 706745 - RNA, 19 nt, Homo sapiens
cuacugaaguuacauguuu

SEQ ID NO: 706746 - RNA, 19 nt, Homo sapiens
gaagagagaagcuguguug

SEQ ID NO: 706747 - RNA, 19 nt, Homo sapiens
aaacugaacugucuagaau

SEQ ID NO: 706748 - RNA, 19 nt, Homo sapiens
caaguuaucuucucugcaa

SEQ ID NO: 706749 - RNA, 19 nt, Homo sapiens
gaacaaguuucauugagau

SEQ ID NO: 706750 - RNA, 19 nt, Homo sapiens
gaaggaguuuguuaucuga

SEQ ID NO: 706751 - RNA, 19 nt, Homo sapiens
uggcaaagguuccauaauu

SEQ ID NO: 706752 - RNA, 19 nt, Homo sapiens
gcucuuaaaucccuagaaa

SEQ ID NO: 706753 - RNA, 19 nt, Homo sapiens
ccaagaagaaagagaauua

SEQ ID NO: 706754 - RNA, 19 nt, Homo sapiens
gaagaaguagcuaagguua

SEQ ID NO: 706755 - RNA, 19 nt, Homo sapiens
caacagaacucauggaaaa

SEQ ID NO: 706756 - RNA, 19 nt, Homo sapiens
gcagauagaugguuuacag

SEQ ID NO: 706757 - RNA, 19 nt, Homo sapiens
gaaaugacucuucaaauca

SEQ ID NO: 706758 - RNA, 19 nt, Homo sapiens
gggcagagcuggaugagau

SEQ ID NO: 706759 - RNA, 19 nt, Homo sapiens
gaacaagaaacacaaagaa

SEQ ID NO: 706760 - RNA, 19 nt, Homo sapiens
ccagcucacugcuaauuua

SEQ ID NO: 706761 - RNA, 19 nt, Homo sapiens
uaacccagcucacugcuaa

SEQ ID NO: 706762 - RNA, 19 nt, Homo sapiens
gaauuacgauccugacaga

SEQ ID NO: 706763 - RNA, 19 nt, Homo sapiens
gagaaaagcuuacaucaau

SEQ ID NO: 706764 - RNA, 19 nt, Homo sapiens
gcaaaauucugucaagaua

SEQ ID NO: 706765 - RNA, 19 nt, Homo sapiens
cagaaaggaacuagaauua

SEQ ID NO: 706766 - RNA, 19 nt, Homo sapiens
gaaagacuacugagacaaa

SEQ ID NO: 706767 - RNA, 19 nt, Homo sapiens
aaaggaaucuucagcuaaa

SEQ ID NO: 706768 - RNA, 19 nt, Homo sapiens
gaaccugaaagaacaaaua

SEQ ID NO: 706769 - RNA, 19 nt, Homo sapiens
gcaaagguuccauaauuaa

SEQ ID NO: 706770 - RNA, 19 nt, Homo sapiens
ggaaaugggugagguuguu

SEQ ID NO: 706771 - RNA, 19 nt, Homo sapiens
ggucagggaauuuaucuua

SEQ ID NO: 706772 - RNA, 19 nt, Homo sapiens
caagacaacuacugagcua

SEQ ID NO: 706773 - RNA, 19 nt, Homo sapiens
ucaaagggauauacaagaa

SEQ ID NO: 706774 - RNA, 19 nt, Homo sapiens
agaaauagauguggaagaa

SEQ ID NO: 706775 - RNA, 19 nt, Homo sapiens
gaacauggaaaggaaauuu

SEQ ID NO: 706776 - RNA, 19 nt, Homo sapiens
agaacaagaccacuuauua

SEQ ID NO: 706777 - RNA, 19 nt, Homo sapiens
acagagagcuggaagaaau

SEQ ID NO: 706778 - RNA, 19 nt, Homo sapiens
acagagcccuaacagauua

SEQ ID NO: 706779 - RNA, 19 nt, Homo sapiens
agaaaugacucuuuacuuc

SEQ ID NO: 706780 - RNA, 19 nt, Homo sapiens
gacaguggaugugaaauuu

SEQ ID NO: 706781 - RNA, 19 nt, Homo sapiens
cagaauggcugaaucacaa

SEQ ID NO: 706782 - RNA, 19 nt, Homo sapiens
gaacaagaccacuuauuag

SEQ ID NO: 706783 - RNA, 19 nt, Homo sapiens
cagaagacaucaaugaaug

SEQ ID NO: 706784 - RNA, 19 nt, Homo sapiens
agaaaugacucuucaaauc

SEQ ID NO: 706785 - RNA, 19 nt, Homo sapiens
ggaagcagcaugagauuga

SEQ ID NO: 706786 - RNA, 19 nt, Homo sapiens
cagaagaaguuacugaaau

SEQ ID NO: 706787 - RNA, 19 nt, Homo sapiens
ucaauuggaugugguuaua

SEQ ID NO: 706788 - RNA, 19 nt, Homo sapiens
uagagagguugaacaguua

SEQ ID NO: 706789 - RNA, 19 nt, Homo sapiens
acaagaagcugaauuagag

SEQ ID NO: 706790 - RNA, 19 nt, Homo sapiens
gaacaggaaagccuacaaa

SEQ ID NO: 706791 - RNA, 19 nt, Homo sapiens
agaaauaccugcugcuguu

SEQ ID NO: 706792 - RNA, 19 nt, Homo sapiens
acugaaagcugaacuaaga

SEQ ID NO: 706793 - RNA, 19 nt, Homo sapiens
gggcagaggcugaaguaua

SEQ ID NO: 706794 - RNA, 19 nt, Homo sapiens
gacaggagcugguagagau

SEQ ID NO: 706795 - RNA, 19 nt, Homo sapiens
uaaggaacaugguuaugaa

SEQ ID NO: 706796 - RNA, 19 nt, Homo sapiens
ggaaccggcuguaaucaug

SEQ ID NO: 706797 - RNA, 19 nt, Homo sapiens
gguuggaaguuaaagauaa

SEQ ID NO: 706798 - RNA, 19 nt, Homo sapiens
agaagaagcagacaguuua

SEQ ID NO: 706799 - RNA, 19 nt, Homo sapiens
ggaaauacagaaacuagaa

SEQ ID NO: 706800 - RNA, 19 nt, Homo sapiens
ugagagagauguauuccaa

SEQ ID NO: 706801 - RNA, 19 nt, Homo sapiens
gaaagaaacugaacaaaac

SEQ ID NO: 706802 - RNA, 19 nt, Homo sapiens
guagagagcuagaaaucau

SEQ ID NO: 706803 - RNA, 19 nt, Homo sapiens
ggacagcgacuacaaggaa

SEQ ID NO: 706804 - RNA, 19 nt, Homo sapiens
gaacacagcuuaugauugu

SEQ ID NO: 706805 - RNA, 19 nt, Homo sapiens
gaacacagcuucuauuuag

SEQ ID NO: 706806 - RNA, 19 nt, Homo sapiens
gcaaaggacuuagaacuua

SEQ ID NO: 706807 - RNA, 19 nt, Homo sapiens
gaaauguucuccaaagaua

SEQ ID NO: 706808 - RNA, 19 nt, Homo sapiens
gaacuuaugcugaacauua

SEQ ID NO: 706809 - RNA, 19 nt, Homo sapiens
gacaauagcugaacaagaa

SEQ ID NO: 706810 - RNA, 19 nt, Homo sapiens
gaaauaugcuccagugauu

SEQ ID NO: 706811 - RNA, 19 nt, Homo sapiens
gaaauuaacuggccagcaa

SEQ ID NO: 706812 - RNA, 19 nt, Homo sapiens
gaagagaaauagagaagaa

SEQ ID NO: 706813 - RNA, 19 nt, Homo sapiens
acaaagagauggcauuaua

SEQ ID NO: 706814 - RNA, 19 nt, Homo sapiens
gaagugauaugccaagaaa

SEQ ID NO: 706815 - RNA, 19 nt, Homo sapiens
gaacuuacccaguguuaua

SEQ ID NO: 706816 - RNA, 19 nt, Homo sapiens
gaacaagucaguagguuua

SEQ ID NO: 706817 - RNA, 19 nt, Homo sapiens
gcauuaaccuugagaauau

SEQ ID NO: 706818 - RNA, 19 nt, Homo sapiens
caaguaagcucuuuauuag

SEQ ID NO: 706819 - RNA, 19 nt, Homo sapiens
uagcacagcugcagacuua

SEQ ID NO: 706820 - RNA, 19 nt, Homo sapiens
gcagacagaugguaugaaa

SEQ ID NO: 706821 - RNA, 19 nt, Homo sapiens
gagaagaacuggaaaauaa

SEQ ID NO: 706822 - RNA, 19 nt, Homo sapiens
guucgaaacugauauagua

SEQ ID NO: 706823 - RNA, 19 nt, Homo sapiens
ugaaagagcugcagaaaca

SEQ ID NO: 706824 - RNA, 19 nt, Homo sapiens
gaacaaggccaguuugaaa

SEQ ID NO: 706825 - RNA, 19 nt, Homo sapiens
gaagaacaguuggaagaua

SEQ ID NO: 706826 - RNA, 19 nt, Homo sapiens
ggcaaagguuccauaauua

SEQ ID NO: 706827 - RNA, 19 nt, Homo sapiens
caacaggaauuggcaaaua

SEQ ID NO: 706828 - RNA, 19 nt, Homo sapiens
agugaaagcucuagaaaua

SEQ ID NO: 706829 - RNA, 19 nt, Homo sapiens
gaacaugucacuuuaaaga

SEQ ID NO: 706830 - RNA, 19 nt, Homo sapiens
gaaauuggguucuucaaca

SEQ ID NO: 706831 - RNA, 19 nt, Homo sapiens
agacaaaccugaacuagaa

SEQ ID NO: 706832 - RNA, 19 nt, Homo sapiens
ccagaaagcuaauaauaga

SEQ ID NO: 706833 - RNA, 19 nt, Homo sapiens
gagagaagcuguguuguga

SEQ ID NO: 706834 - RNA, 19 nt, Homo sapiens
acaaaggaaucaucacuua

SEQ ID NO: 706835 - RNA, 19 nt, Homo sapiens
agaacaaggucgaaacuua

SEQ ID NO: 706836 - RNA, 19 nt, Homo sapiens
caggaaagccuacaaauuu

SEQ ID NO: 706837 - RNA, 19 nt, Homo sapiens
uaacagagauggcuuugga

SEQ ID NO: 706838 - RNA, 19 nt, Homo sapiens
gaaguuaacuaucaagagu

SEQ ID NO: 706839 - RNA, 19 nt, Homo sapiens
gaagagcuuuccaaacuga

SEQ ID NO: 706840 - RNA, 19 nt, Homo sapiens
gaagagaaaucauaaagac

SEQ ID NO: 706841 - RNA, 19 nt, Homo sapiens
gaagaacuaggacuaauuu

SEQ ID NO: 706842 - RNA, 19 nt, Homo sapiens
gaaaggcucucauuuacca

SEQ ID NO: 706843 - RNA, 19 nt, Homo sapiens
ggacagaagacaucaauga

SEQ ID NO: 706844 - RNA, 19 nt, Homo sapiens
gaagaagaauuugguguug

SEQ ID NO: 706845 - RNA, 19 nt, Homo sapiens
cuacugaaguuacauguuu

SEQ ID NO: 706846 - RNA, 19 nt, Homo sapiens
gaagagagaagcuguguug

SEQ ID NO: 706847 - RNA, 19 nt, Homo sapiens
aaacugaacugucuagaau

SEQ ID NO: 706848 - RNA, 19 nt, Homo sapiens
caaguuaucuucucugcaa

SEQ ID NO: 706849 - RNA, 19 nt, Homo sapiens
gaacaaguuucauugagau

SEQ ID NO: 706850 - RNA, 19 nt, Homo sapiens
gaaggaguuuguuaucuga

SEQ ID NO: 706851 - RNA, 19 nt, Homo sapiens
uggcaaagguuccauaauu

SEQ ID NO: 706852 - RNA, 19 nt, Homo sapiens
gcucuuaaaucccuagaaa

SEQ ID NO: 706853 - RNA, 19 nt, Homo sapiens
ccaagaagaaagagaauua

SEQ ID NO: 706854 - RNA, 19 nt, Homo sapiens
gaagaaguagcuaagguua

SEQ ID NO: 706855 - RNA, 19 nt, Homo sapiens
caacagaacucauggaaaa

SEQ ID NO: 706856 - RNA, 19 nt, Homo sapiens
gcagauagaugguuuacag

SEQ ID NO: 706857 - RNA, 19 nt, Homo sapiens
gaaaugacucuucaaauca

SEQ ID NO: 706858 - RNA, 19 nt, Homo sapiens
gggcagagcuggaugagau

SEQ ID NO: 706859 - RNA, 19 nt, Homo sapiens
gaacaagaaacacaaagaa

SEQ ID NO: 706860 - RNA, 19 nt, Homo sapiens
ccagcucacugcuaauuua

SEQ ID NO: 706861 - RNA, 19 nt, Homo sapiens
uaacccagcucacugcuaa

SEQ ID NO: 706862 - RNA, 19 nt, Homo sapiens
gaauuacgauccugacaga

SEQ ID NO: 706863 - RNA, 19 nt, Homo sapiens
gagaaaagcuuacaucaau

SEQ ID NO: 706864 - RNA, 19 nt, Homo sapiens
gcaaaauucugucaagaua

SEQ ID NO: 706865 - RNA, 19 nt, Homo sapiens
cagaaaggaacuagaauua

SEQ ID NO: 706866 - RNA, 19 nt, Homo sapiens
gaaagacuacugagacaaa

SEQ ID NO: 706867 - RNA, 19 nt, Homo sapiens
aaaggaaucuucagcuaaa

SEQ ID NO: 706868 - RNA, 19 nt, Homo sapiens
gaaccugaaagaacaaaua

SEQ ID NO: 706869 - RNA, 19 nt, Homo sapiens
gcaaagguuccauaauuaa

SEQ ID NO: 706870 - RNA, 19 nt, Homo sapiens
ggaaaugggugagguuguu

SEQ ID NO: 706871 - RNA, 19 nt, Homo sapiens
ggucagggaauuuaucuua

SEQ ID NO: 706872 - RNA, 19 nt, Homo sapiens
caagacaacuacugagcua

SEQ ID NO: 706873 - RNA, 19 nt, Homo sapiens
ucaaagggauauacaagaa

SEQ ID NO: 706874 - RNA, 19 nt, Homo sapiens
agaaauagauguggaagaa

SEQ ID NO: 706875 - RNA, 19 nt, Homo sapiens
gaacauggaaaggaaauuu

SEQ ID NO: 706876 - RNA, 19 nt, Homo sapiens
agaacaagaccacuuauua

SEQ ID NO: 706877 - RNA, 19 nt, Homo sapiens
acagagagcuggaagaaau

SEQ ID NO: 706878 - RNA, 19 nt, Homo sapiens
acagagcccuaacagauua

SEQ ID NO: 706879 - RNA, 19 nt, Homo sapiens
agaaaugacucuuuacuuc

SEQ ID NO: 706880 - RNA, 19 nt, Homo sapiens
gacaguggaugugaaauuu

SEQ ID NO: 706881 - RNA, 19 nt, Homo sapiens
cagaauggcugaaucacaa

SEQ ID NO: 706882 - RNA, 19 nt, Homo sapiens
gaacaagaccacuuauuag

SEQ ID NO: 706883 - RNA, 19 nt, Homo sapiens
cagaagacaucaaugaaug

SEQ ID NO: 706884 - RNA, 19 nt, Homo sapiens
agaaaugacucuucaaauc

SEQ ID NO: 706885 - RNA, 19 nt, Homo sapiens
ggaagcagcaugagauuga

SEQ ID NO: 706886 - RNA, 19 nt, Homo sapiens
cagaagaaguuacugaaau

SEQ ID NO: 706887 - RNA, 19 nt, Homo sapiens
ucaauuggaugugguuaua

SEQ ID NO: 706888 - RNA, 19 nt, Homo sapiens
uagagagguugaacaguua

SEQ ID NO: 706889 - RNA, 19 nt, Homo sapiens
acaagaagcugaauuagag

SEQ ID NO: 706890 - RNA, 19 nt, Homo sapiens
gaacaggaaagccuacaaa

SEQ ID NO: 706891 - RNA, 19 nt, Homo sapiens
agaaauaccugcugcuguu

SEQ ID NO: 706892 - RNA, 19 nt, Homo sapiens
acugaaagcugaacuaaga

SEQ ID NO: 706893 - RNA, 19 nt, Homo sapiens
gggcagaggcugaaguaua

SEQ ID NO: 706894 - RNA, 19 nt, Homo sapiens
gacaggagcugguagagau

SEQ ID NO: 706895 - RNA, 19 nt, Homo sapiens
uaaggaacaugguuaugaa

SEQ ID NO: 706896 - RNA, 19 nt, Homo sapiens
ggaaccggcuguaaucaug

SEQ ID NO: 706897 - RNA, 19 nt, Homo sapiens
gguuggaaguuaaagauaa

SEQ ID NO: 706898 - RNA, 19 nt, Homo sapiens
agaagaagcagacaguuua

SEQ ID NO: 706899 - RNA, 19 nt, Homo sapiens
ggaaauacagaaacuagaa

SEQ ID NO: 706900 - RNA, 19 nt, Homo sapiens
ugagagagauguauuccaa

SEQ ID NO: 706901 - RNA, 19 nt, Homo sapiens
gaaagaaacugaacaaaac

SEQ ID NO: 706902 - RNA, 19 nt, Homo sapiens
guagagagcuagaaaucau

SEQ ID NO: 706903 - RNA, 19 nt, Homo sapiens
ggacagcgacuacaaggaa

SEQ ID NO: 706904 - RNA, 19 nt, Homo sapiens
gcacuaaaguucacaagaa

SEQ ID NO: 706905 - RNA, 19 nt, Homo sapiens
gcaaagaauggacuuguaa

SEQ ID NO: 706906 - RNA, 19 nt, Homo sapiens
agaauggacuuguaauuug

SEQ ID NO: 706907 - RNA, 19 nt, Homo sapiens
cagaagguuugaagcauuu

SEQ ID NO: 706908 - RNA, 19 nt, Homo sapiens
ggcaaagaauggacuugua

SEQ ID NO: 706909 - RNA, 19 nt, Homo sapiens
gaucugaagacucaaauug

SEQ ID NO: 706910 - RNA, 19 nt, Homo sapiens
cagcaaacgucgagugaga

SEQ ID NO: 706911 - RNA, 19 nt, Homo sapiens
ccagagccauggcaaagaa

SEQ ID NO: 706912 - RNA, 19 nt, Homo sapiens
ucagaagguuugaagcauu

SEQ ID NO: 706913 - RNA, 19 nt, Homo sapiens
gaaaugcuaccuugcuuca

SEQ ID NO: 706914 - RNA, 19 nt, Homo sapiens
cacuaaaguucacaagaaa

SEQ ID NO: 706915 - RNA, 19 nt, Homo sapiens
ucaacgcccuccaagacua

SEQ ID NO: 706916 - RNA, 19 nt, Homo sapiens
gaauggacuuguaauuugc

SEQ ID NO: 706917 - RNA, 19 nt, Homo sapiens
uguguagucuccuuccaua

SEQ ID NO: 706918 - RNA, 19 nt, Homo sapiens
agacaaggauggagaucug

SEQ ID NO: 706919 - RNA, 19 nt, Homo sapiens
ggagaucugaagacucaaa

SEQ ID NO: 706920 - RNA, 19 nt, Homo sapiens
cagccacacauccagauua

SEQ ID NO: 706921 - RNA, 19 nt, Homo sapiens
ggucacggaaggcaaguuu

SEQ ID NO: 706922 - RNA, 19 nt, Homo sapiens
gaacuccgacgaaaucaac

SEQ ID NO: 706923 - RNA, 19 nt, Homo sapiens
gaagacugcauuuccaaag

SEQ ID NO: 706924 - RNA, 19 nt, Homo sapiens
gcaaacgucgagugagaga

SEQ ID NO: 706925 - RNA, 19 nt, Homo sapiens
guuugaagcauuuccauga

SEQ ID NO: 706926 - RNA, 19 nt, Homo sapiens
aaugcuaccuugcuucaga

SEQ ID NO: 706927 - RNA, 19 nt, Homo sapiens
cuaaaguucacaagaaaug

SEQ ID NO: 706928 - RNA, 19 nt, Homo sapiens
ggauggagaucugaagacu

SEQ ID NO: 706929 - RNA, 19 nt, Homo sapiens
agccacacauccagauuaa

SEQ ID NO: 706930 - RNA, 19 nt, Homo sapiens
agacugcauuuccaaagga

SEQ ID NO: 706931 - RNA, 19 nt, Homo sapiens
aagaaaugcuaccuugcuu

SEQ ID NO: 706932 - RNA, 19 nt, Homo sapiens
uuccauagcugcucuaagg

SEQ ID NO: 706933 - RNA, 19 nt, Homo sapiens
gcagcaagagauacauaug

SEQ ID NO: 706934 - RNA, 19 nt, Homo sapiens
cagcagcaagagauacaua

SEQ ID NO: 706935 - RNA, 19 nt, Homo sapiens
auggagaucugaagacuca

SEQ ID NO: 706936 - RNA, 19 nt, Homo sapiens
cgaaaucaacgcccuccaa

SEQ ID NO: 706937 - RNA, 19 nt, Homo sapiens
agagauacauaugcgaguu

SEQ ID NO: 706938 - RNA, 19 nt, Homo sapiens
caaagaauggacuuguaau

SEQ ID NO: 706939 - RNA, 19 nt, Homo sapiens
ccacacauccagauuaaaa

SEQ ID NO: 706940 - RNA, 19 nt, Homo sapiens
caggaacuccgacgaaauc

SEQ ID NO: 706941 - RNA, 19 nt, Homo sapiens
cagggcaaguggagugaug

SEQ ID NO: 706942 - RNA, 19 nt, Homo sapiens
ccuccaagacuaugguaaa

SEQ ID NO: 706943 - RNA, 19 nt, Homo sapiens
cccaggaacuccgacgaaa

SEQ ID NO: 706944 - RNA, 19 nt, Homo sapiens
gcauuuccaugaggccaau

SEQ ID NO: 706945 - RNA, 19 nt, Homo sapiens
ucacggaaggcaaguuugu

SEQ ID NO: 706946 - RNA, 19 nt, Homo sapiens
ucacaagaaaugcuaccuu

SEQ ID NO: 706947 - RNA, 19 nt, Homo sapiens
uaauuugcauccuggugau

SEQ ID NO: 706948 - RNA, 19 nt, Homo sapiens
gagauacauaugcgaguuc

SEQ ID NO: 706949 - RNA, 19 nt, Homo sapiens
ugaagacugcauuuccaaa

SEQ ID NO: 706950 - RNA, 19 nt, Homo sapiens
caacgcccuccaagacuau

SEQ ID NO: 706951 - RNA, 19 nt, Homo sapiens
ggaacuccgacgaaaucaa

SEQ ID NO: 706952 - RNA, 19 nt, Homo sapiens
guagcuguguagucuccuu

SEQ ID NO: 706953 - RNA, 19 nt, Homo sapiens
aaacgucgagugagagaca

SEQ ID NO: 706954 - RNA, 19 nt, Homo sapiens
agaaaacuguguccuguuc

SEQ ID NO: 706955 - RNA, 19 nt, Homo sapiens
gagagacaaggauggagau

SEQ ID NO: 706956 - RNA, 19 nt, Homo sapiens
gcuaucuccuuccucaacu

SEQ ID NO: 706957 - RNA, 19 nt, Homo sapiens
ccaggaacuccgacgaaau

SEQ ID NO: 706958 - RNA, 19 nt, Homo sapiens
gaguucaccaucccucaau

SEQ ID NO: 706959 - RNA, 19 nt, Homo sapiens
guagucuccuuccauagcu

SEQ ID NO: 706960 - RNA, 19 nt, Homo sapiens
aaucaacgcccuccaagac

SEQ ID NO: 706961 - RNA, 19 nt, Homo sapiens
uccaugaggccaaugaaga

SEQ ID NO: 706962 - RNA, 19 nt, Homo sapiens
gagaucugaagacucaaau

SEQ ID NO: 706963 - RNA, 19 nt, Homo sapiens
cacagcaaacgucgaguga

SEQ ID NO: 706964 - RNA, 19 nt, Homo sapiens
ggaaggcaaguuuguugac

SEQ ID NO: 706965 - RNA, 19 nt, Homo sapiens
ggcacuaaaguucacaaga

SEQ ID NO: 706966 - RNA, 19 nt, Homo sapiens
gcgaggcacuaaaguucac

SEQ ID NO: 706967 - RNA, 19 nt, Homo sapiens
gaaagaaacuucgggauuu

SEQ ID NO: 706968 - RNA, 19 nt, Homo sapiens
caaaugaccuugccaaauu

SEQ ID NO: 706969 - RNA, 19 nt, Homo sapiens
gagauucccuugcaaauuu

SEQ ID NO: 706970 - RNA, 19 nt, Homo sapiens
gaagaaauguccagaagga

SEQ ID NO: 706971 - RNA, 19 nt, Homo sapiens
gaaaguggcucugcagaaa

SEQ ID NO: 706972 - RNA, 19 nt, Homo sapiens
gagaauggcuugugaaauc

SEQ ID NO: 706973 - RNA, 19 nt, Homo sapiens
gaaacuggcuggaagaaga

SEQ ID NO: 706974 - RNA, 19 nt, Homo sapiens
gaacuggaccugaugauuu

SEQ ID NO: 706975 - RNA, 19 nt, Homo sapiens
gaaacuggcugguccaaug

SEQ ID NO: 706976 - RNA, 19 nt, Homo sapiens
guaagcagcuguaugaaug

SEQ ID NO: 706977 - RNA, 19 nt, Homo sapiens
gcucaggacuuuauucuau

SEQ ID NO: 706978 - RNA, 19 nt, Homo sapiens
ggagacaacuuaaagaauc

SEQ ID NO: 706979 - RNA, 19 nt, Homo sapiens
gcacauuuguuuaagacua

SEQ ID NO: 706980 - RNA, 19 nt, Homo sapiens
gcacuuaccagucugauuu

SEQ ID NO: 706981 - RNA, 19 nt, Homo sapiens
gaaagaagaugagaagaag

SEQ ID NO: 706982 - RNA, 19 nt, Homo sapiens
gaagauagauucgaagaag

SEQ ID NO: 706983 - RNA, 19 nt, Homo sapiens
uagcagagauuaaucacua

SEQ ID NO: 706984 - RNA, 19 nt, Homo sapiens
gaaaggaaaggaaaugaaa

SEQ ID NO: 706985 - RNA, 19 nt, Homo sapiens
gcagauugcuauaauuuca

SEQ ID NO: 706986 - RNA, 19 nt, Homo sapiens
guacagaccuucccacagu

SEQ ID NO: 706987 - RNA, 19 nt, Homo sapiens
gaugucaccucaugauuug

SEQ ID NO: 706988 - RNA, 19 nt, Homo sapiens
gaauggaugucugaugaaa

SEQ ID NO: 706989 - RNA, 19 nt, Homo sapiens
ggacuuaucaacaaagaaa

SEQ ID NO: 706990 - RNA, 19 nt, Homo sapiens
gcaauaaagcccaguguug

SEQ ID NO: 706991 - RNA, 19 nt, Homo sapiens
cgucagaaauccaguacua

SEQ ID NO: 706992 - RNA, 19 nt, Homo sapiens
ccaaagaccagauugcuaa

SEQ ID NO: 706993 - RNA, 19 nt, Homo sapiens
gaacagugacucugaugaa

SEQ ID NO: 706994 - RNA, 19 nt, Homo sapiens
gguagcagcucucuucugu

SEQ ID NO: 706995 - RNA, 19 nt, Homo sapiens
ccagauugcuaaugagaaa

SEQ ID NO: 706996 - RNA, 19 nt, Homo sapiens
agcaagagcugguggauaa

SEQ ID NO: 706997 - RNA, 19 nt, Homo sapiens
gaaauccaguacuaaacuu

SEQ ID NO: 706998 - RNA, 19 nt, Homo sapiens
ggaccugacugcauugugu

SEQ ID NO: 706999 - RNA, 19 nt, Homo sapiens
ucaaggagauaaaggaaga

SEQ ID NO: 707000 - RNA, 19 nt, Homo sapiens
gagaagaaguacagaccuu

SEQ ID NO: 707001 - RNA, 19 nt, Homo sapiens
gagaugcuacuaauuguuu

SEQ ID NO: 707002 - RNA, 19 nt, Homo sapiens
gaaaaggauucgaaagaaa

SEQ ID NO: 707003 - RNA, 19 nt, Homo sapiens
uuaaggauaugaccaaaga

SEQ ID NO: 707004 - RNA, 19 nt, Homo sapiens
gcugguggauaaagcaaua

SEQ ID NO: 707005 - RNA, 19 nt, Homo sapiens
guucugaaauggacaaaug

SEQ ID NO: 707006 - RNA, 19 nt, Homo sapiens
gaaaucaugccucugcaaa

SEQ ID NO: 707007 - RNA, 19 nt, Homo sapiens
gaaaacaccaaguaaguua

SEQ ID NO: 707008 - RNA, 19 nt, Homo sapiens
ucuagucuguccuuuaaua

SEQ ID NO: 707009 - RNA, 19 nt, Homo sapiens
ggagggaccaggaaaugua

SEQ ID NO: 707010 - RNA, 19 nt, Homo sapiens
gagaagagccuggagauuc

SEQ ID NO: 707011 - RNA, 19 nt, Homo sapiens
ccaaugggauuuacagcaa

SEQ ID NO: 707012 - RNA, 19 nt, Homo sapiens
cgaaacugcuuccuucuuc

SEQ ID NO: 707013 - RNA, 19 nt, Homo sapiens
ugucuagucuguccuuuaa

SEQ ID NO: 707014 - RNA, 19 nt, Homo sapiens
aagaaugccuuuaaguuug

SEQ ID NO: 707015 - RNA, 19 nt, Homo sapiens
gaaaguugccuucugaaag

SEQ ID NO: 707016 - RNA, 19 nt, Homo sapiens
agaugacgcugauggauuu

SEQ ID NO: 707017 - RNA, 19 nt, Homo sapiens
guaagaagacguucacugu

SEQ ID NO: 707018 - RNA, 19 nt, Homo sapiens
gaagugcccugguuaaucc

SEQ ID NO: 707019 - RNA, 19 nt, Homo sapiens
gaaaggagcaagccuaaac

SEQ ID NO: 707020 - RNA, 19 nt, Homo sapiens
caagggacuuaucaacaaa

SEQ ID NO: 707021 - RNA, 19 nt, Homo sapiens
acaagggacuuaucaacaa

SEQ ID NO: 707022 - RNA, 19 nt, Homo sapiens
cuagugaccuuuccacaga

SEQ ID NO: 707023 - RNA, 19 nt, Homo sapiens
gcacuccuauggcugaaga

SEQ ID NO: 707024 - RNA, 19 nt, Homo sapiens
gaacaccuccaggaaauga

SEQ ID NO: 707025 - RNA, 19 nt, Homo sapiens
ccaccaaacucccauucuu

SEQ ID NO: 707026 - RNA, 19 nt, Homo sapiens
gagaaaggagcaagccuaa

SEQ ID NO: 707027 - RNA, 19 nt, Homo sapiens
ggaauucuuugcucuacug

SEQ ID NO: 707028 - RNA, 19 nt, Homo sapiens
ggaaauguaagacaccaaa

SEQ ID NO: 707029 - RNA, 19 nt, Homo sapiens
caugcuguguggccaauua

SEQ ID NO: 707030 - RNA, 19 nt, Homo sapiens
cagccuaucugacaccaaa

SEQ ID NO: 707031 - RNA, 19 nt, Homo sapiens
gaccaaacuugccguggaa

SEQ ID NO: 707032 - RNA, 19 nt, Homo sapiens
ccgaucagcuguagaacaa

SEQ ID NO: 707033 - RNA, 19 nt, Homo sapiens
guacagacgaccaaacuug

SEQ ID NO: 707034 - RNA, 19 nt, Homo sapiens
uagcagcucucuucuguca

SEQ ID NO: 707035 - RNA, 19 nt, Homo sapiens
ggacacagggcuuucaaau

SEQ ID NO: 707036 - RNA, 19 nt, Homo sapiens
guacauaauccuacagguu

SEQ ID NO: 707037 - RNA, 19 nt, Homo sapiens
guuaauccauacacaaaga

SEQ ID NO: 707038 - RNA, 19 nt, Homo sapiens
ucugucagcugaauguuaa

SEQ ID NO: 707039 - RNA, 19 nt, Homo sapiens
gagacaacuuaaagaauca

SEQ ID NO: 707040 - RNA, 19 nt, Homo sapiens
gcagugcagucaucaucuu

SEQ ID NO: 707041 - RNA, 19 nt, Homo sapiens
cagcugcggugagaguuua

SEQ ID NO: 707042 - RNA, 19 nt, Homo sapiens
gaaacugcuuccuucuuca

SEQ ID NO: 707043 - RNA, 19 nt, Homo sapiens
caauaaagcccaguguuga

SEQ ID NO: 707044 - RNA, 19 nt, Homo sapiens
guagagaagcagccgauaa

SEQ ID NO: 707045 - RNA, 19 nt, Homo sapiens
ggaagagacaguugugaga

SEQ ID NO: 707046 - RNA, 19 nt, Homo sapiens
caacacucaucuacagaga

SEQ ID NO: 707047 - RNA, 19 nt, Homo sapiens
gaaauguccagaaggaaga

SEQ ID NO: 707048 - RNA, 19 nt, Homo sapiens
ggagaacagugacucugau

SEQ ID NO: 707049 - RNA, 19 nt, Homo sapiens
gaucagcuguagaacaaca

SEQ ID NO: 707050 - RNA, 19 nt, Homo sapiens
uagacgacguguuacagua

SEQ ID NO: 707051 - RNA, 19 nt, Homo sapiens
aaacugacagguaaaugua

SEQ ID NO: 707052 - RNA, 19 nt, Homo sapiens
gaagccacauuggaaucua

SEQ ID NO: 707053 - RNA, 19 nt, Homo sapiens
guucccaacuugagaaaga

SEQ ID NO: 707054 - RNA, 19 nt, Homo sapiens
ugagagaacuggaccugau

SEQ ID NO: 707055 - RNA, 19 nt, Homo sapiens
gaaaucugaacaugaauca

SEQ ID NO: 707056 - RNA, 19 nt, Homo sapiens
cagagaauauacacuguuc

SEQ ID NO: 707057 - RNA, 19 nt, Homo sapiens
uaguggagcuuuccuaaca

SEQ ID NO: 707058 - RNA, 19 nt, Homo sapiens
gaagaccgcacuccuaugg

SEQ ID NO: 707059 - RNA, 19 nt, Homo sapiens
aagaccagauugcuaauga

SEQ ID NO: 707060 - RNA, 19 nt, Homo sapiens
uaagaagacguucacugua

SEQ ID NO: 707061 - RNA, 19 nt, Homo sapiens
ucaaggagugagauuauaa

SEQ ID NO: 707062 - RNA, 19 nt, Homo sapiens
gaugcuuucuggaccaauu

SEQ ID NO: 707063 - RNA, 19 nt, Homo sapiens
gaaauggacaaaugaccuu

SEQ ID NO: 707064 - RNA, 19 nt, Homo sapiens
uugaauggaugucugauga

SEQ ID NO: 707065 - RNA, 19 nt, Homo sapiens
uaauaacucuggaggucaa

SEQ ID NO: 707066 - RNA, 19 nt, Homo sapiens
gaagaugaaagaccucugu

SEQ ID NO: 707067 - RNA, 19 nt, Homo sapiens
uaacaguggugggaaauua

SEQ ID NO: 707068 - RNA, 19 nt, Homo sapiens
agacauagcucagacagua

SEQ ID NO: 707069 - RNA, 19 nt, Homo sapiens
ggaggagucugaagaagaa

SEQ ID NO: 707070 - RNA, 19 nt, Homo sapiens
gggcaucugugaccaguaa

SEQ ID NO: 707071 - RNA, 19 nt, Homo sapiens
gcuaaaugaugguguggua

SEQ ID NO: 707072 - RNA, 19 nt, Homo sapiens
ccaacagaauggugaauuu

SEQ ID NO: 707073 - RNA, 19 nt, Homo sapiens
ggacaaaucagagcuuaaa

SEQ ID NO: 707074 - RNA, 19 nt, Homo sapiens
ugacauggaagaacauuua

SEQ ID NO: 707075 - RNA, 19 nt, Homo sapiens
cgagaacaacgaauaaaua

SEQ ID NO: 707076 - RNA, 19 nt, Homo sapiens
guaaugacauggaagaaca

SEQ ID NO: 707077 - RNA, 19 nt, Homo sapiens
gaaagaaauccacaggaaa

SEQ ID NO: 707078 - RNA, 19 nt, Homo sapiens
agaaagaaauccacaggaa

SEQ ID NO: 707079 - RNA, 19 nt, Homo sapiens
agaggaaccugaagaaaga

SEQ ID NO: 707080 - RNA, 19 nt, Homo sapiens
gaaggcgaccgacgagaua

SEQ ID NO: 707081 - RNA, 19 nt, Homo sapiens
gauaccaccucauguuguu

SEQ ID NO: 707082 - RNA, 19 nt, Homo sapiens
acaagaaccuguaucugaa

SEQ ID NO: 707083 - RNA, 19 nt, Homo sapiens
gaaauccacaggaaaguga

SEQ ID NO: 707084 - RNA, 19 nt, Homo sapiens
caaccugccucaugaagug

SEQ ID NO: 707085 - RNA, 19 nt, Homo sapiens
ggagauucaugcaaacguu

SEQ ID NO: 707086 - RNA, 19 nt, Homo sapiens
gggauuggauucaaaugga

SEQ ID NO: 707087 - RNA, 19 nt, Homo sapiens
gcagaaaccaggauuugga

SEQ ID NO: 707088 - RNA, 19 nt, Homo sapiens
ccaaagcaauggugaugga

SEQ ID NO: 707089 - RNA, 19 nt, Homo sapiens
ccgcguagguuuggacaua

SEQ ID NO: 707090 - RNA, 19 nt, Homo sapiens
gaacucuucuuauguccau

SEQ ID NO: 707091 - RNA, 19 nt, Homo sapiens
gggcuucucucuaacaaca

SEQ ID NO: 707092 - RNA, 19 nt, Homo sapiens
gugguggaguugcgcauua

SEQ ID NO: 707093 - RNA, 19 nt, Homo sapiens
ggaaaagccugagccagua

SEQ ID NO: 707094 - RNA, 19 nt, Homo sapiens
ucacaaugauaucuucaga

SEQ ID NO: 707095 - RNA, 19 nt, Homo sapiens
ugagcaaggugacauugaa

SEQ ID NO: 707096 - RNA, 19 nt, Homo sapiens
ggugguaccugaugauucu

SEQ ID NO: 707097 - RNA, 19 nt, Homo sapiens
caaaucagagcuuaaagau

SEQ ID NO: 707098 - RNA, 19 nt, Homo sapiens
ggauuggauucaaauggaa

SEQ ID NO: 707099 - RNA, 19 nt, Homo sapiens
uuccugaccuuuagucuuu

SEQ ID NO: 707100 - RNA, 19 nt, Homo sapiens
gagccaguauuagaagaaa

SEQ ID NO: 707101 - RNA, 19 nt, Homo sapiens
guggacaaaucagagcuua

SEQ ID NO: 707102 - RNA, 19 nt, Homo sapiens
gggaauuugugagacagua

SEQ ID NO: 707103 - RNA, 19 nt, Homo sapiens
ggacauauuuacucuuuuc

SEQ ID NO: 707104 - RNA, 19 nt, Homo sapiens
gaagaaagacagcaaacac

SEQ ID NO: 707105 - RNA, 19 nt, Homo sapiens
aacaagaaccuguaucuga

SEQ ID NO: 707106 - RNA, 19 nt, Homo sapiens
ugaagaagaaguagaggaa

SEQ ID NO: 707107 - RNA, 19 nt, Homo sapiens
gcucaugccacgcuaaaug

SEQ ID NO: 707108 - RNA, 19 nt, Homo sapiens
gaggugagguccgucugaa

SEQ ID NO: 707109 - RNA, 19 nt, Homo sapiens
uccagcaccugcagacaua

SEQ ID NO: 707110 - RNA, 19 nt, Homo sapiens
uugaggagauucaugcaaa

SEQ ID NO: 707111 - RNA, 19 nt, Homo sapiens
gaucaaagagugcgagaac

SEQ ID NO: 707112 - RNA, 19 nt, Homo sapiens
gcgagaacaacgaauaaau

SEQ ID NO: 707113 - RNA, 19 nt, Homo sapiens
ucaaagagugcgagaacaa

SEQ ID NO: 707114 - RNA, 19 nt, Homo sapiens
gaacaagaaccuguaucug

SEQ ID NO: 707115 - RNA, 19 nt, Homo sapiens
ggaucuucaugcagccaua

SEQ ID NO: 707116 - RNA, 19 nt, Homo sapiens
ggaaggcgaccgacgagau

SEQ ID NO: 707117 - RNA, 19 nt, Homo sapiens
aagcaauggugauggagaa

SEQ ID NO: 707118 - RNA, 19 nt, Homo sapiens
gcguagguuuggacauauu

SEQ ID NO: 707119 - RNA, 19 nt, Homo sapiens
ggagucugaagaagaagua

SEQ ID NO: 707120 - RNA, 19 nt, Homo sapiens
cagaaaguccuuagcaaca

SEQ ID NO: 707121 - RNA, 19 nt, Homo sapiens
gacaguacaggaagacuug

SEQ ID NO: 707122 - RNA, 19 nt, Homo sapiens
caagaaccuguaucugaaa

SEQ ID NO: 707123 - RNA, 19 nt, Homo sapiens
gaauuugugagacaguauu

SEQ ID NO: 707124 - RNA, 19 nt, Homo sapiens
caacugccacaccaagauu

SEQ ID NO: 707125 - RNA, 19 nt, Homo sapiens
ccaauuuuguggaaugaua

SEQ ID NO: 707126 - RNA, 19 nt, Homo sapiens
cauuaacaguggugggaaa

SEQ ID NO: 707127 - RNA, 19 nt, Homo sapiens
caggaagacuugaggacau

SEQ ID NO: 707128 - RNA, 19 nt, Homo sapiens
gacagccuuugguaucuug

SEQ ID NO: 707129 - RNA, 19 nt, Homo sapiens
ggugagguccgucugaaug

SEQ ID NO: 707130 - RNA, 19 nt, Homo sapiens
acaaaucagagcuuaaaga

SEQ ID NO: 707131 - RNA, 19 nt, Homo sapiens
gaaccuguaucugaaaucc

SEQ ID NO: 707132 - RNA, 19 nt, Homo sapiens
gaucaggcaguugucagua

SEQ ID NO: 707133 - RNA, 19 nt, Homo sapiens
ugaggucuuugguggguuu

SEQ ID NO: 707134 - RNA, 19 nt, Homo sapiens
aaagaaauccacaggaaag

SEQ ID NO: 707135 - RNA, 19 nt, Homo sapiens
gaccuuuagucuuucacuu

SEQ ID NO: 707136 - RNA, 19 nt, Homo sapiens
agucuaagccugaaucuca

SEQ ID NO: 707137 - RNA, 19 nt, Homo sapiens
caccucauguuguuaaagu

SEQ ID NO: 707138 - RNA, 19 nt, Homo sapiens
gggauaccaccucauguug

SEQ ID NO: 707139 - RNA, 19 nt, Homo sapiens
gagauucaugcaaacguuu

SEQ ID NO: 707140 - RNA, 19 nt, Homo sapiens
guggaggcauggugcagaa

SEQ ID NO: 707141 - RNA, 19 nt, Homo sapiens
gcugggugguggaaugaga

SEQ ID NO: 707142 - RNA, 19 nt, Homo sapiens
gugcuguggugcagagcua

SEQ ID NO: 707143 - RNA, 19 nt, Homo sapiens
agaggagccuguugcugaa

SEQ ID NO: 707144 - RNA, 19 nt, Homo sapiens
guagaggaaccugaagaaa

SEQ ID NO: 707145 - RNA, 19 nt, Homo sapiens
gccagcagaugcagucuac

SEQ ID NO: 707146 - RNA, 19 nt, Homo sapiens
gugcgagaacaacgaauaa

SEQ ID NO: 707147 - RNA, 19 nt, Homo sapiens
uaacaacaaccaggcuuug

SEQ ID NO: 707148 - RNA, 19 nt, Homo sapiens
guagguuuggacauauuua

SEQ ID NO: 707149 - RNA, 19 nt, Homo sapiens
ugauggggcuucucucuaa

SEQ ID NO: 707150 - RNA, 19 nt, Homo sapiens
acaccaagauucgccaugu

SEQ ID NO: 707151 - RNA, 19 nt, Homo sapiens
ucacaaaacuucaccaacu

SEQ ID NO: 707152 - RNA, 19 nt, Homo sapiens
ccuuugguaucuuggagua

SEQ ID NO: 707153 - RNA, 19 nt, Homo sapiens
uagaggaaccugaagaaag

SEQ ID NO: 707154 - RNA, 19 nt, Homo sapiens
caccaagauucgccauguu

SEQ ID NO: 707155 - RNA, 19 nt, Homo sapiens
cgacagccuuugguaucuu

SEQ ID NO: 707156 - RNA, 19 nt, Homo sapiens
gugcagaaaccaggauuug

SEQ ID NO: 707157 - RNA, 19 nt, Homo sapiens
gcucagccgcguagguuug

SEQ ID NO: 707158 - RNA, 19 nt, Homo sapiens
ggauaccaccucauguugu

SEQ ID NO: 707159 - RNA, 19 nt, Homo sapiens
ucaggcaguugucaguaau

SEQ ID NO: 707160 - RNA, 19 nt, Homo sapiens
ggucuguugcaaauaaauu

SEQ ID NO: 707161 - RNA, 19 nt, Homo sapiens
agaaguagaggaaccugaa

SEQ ID NO: 707162 - RNA, 19 nt, Homo sapiens
gaaccaggccccagacaug

SEQ ID NO: 707163 - RNA, 19 nt, Homo sapiens
cagguugaauugaccaaag

SEQ ID NO: 707164 - RNA, 19 nt, Homo sapiens
ucucagauuccaccacaaa

SEQ ID NO: 707165 - RNA, 19 nt, Homo sapiens
ggaauuugugagacaguau

SEQ ID NO: 707166 - RNA, 19 nt, Homo sapiens
ucagauuccaccacaaaga

SEQ ID NO: 707167 - RNA, 19 nt, Homo sapiens
gcugagaaauggagaugua

SEQ ID NO: 707168 - RNA, 19 nt, Homo sapiens
uaacagagcacaucaucaa

SEQ ID NO: 707169 - RNA, 19 nt, Homo sapiens
guacuacucucuccuuuac

SEQ ID NO: 707170 - RNA, 19 nt, Homo sapiens
caaugagccugggcaagua

SEQ ID NO: 707171 - RNA, 19 nt, Homo sapiens
gagaaauggagauguacua

SEQ ID NO: 707172 - RNA, 19 nt, Homo sapiens
gggcuggaguccuugcuuu

SEQ ID NO: 707173 - RNA, 19 nt, Homo sapiens
uccuuuaccuuuaccuuua

SEQ ID NO: 707174 - RNA, 19 nt, Homo sapiens
ucacggauguccagcuguu

SEQ ID NO: 707175 - RNA, 19 nt, Homo sapiens
gugcagggcugacugaacu

SEQ ID NO: 707176 - RNA, 19 nt, Homo sapiens
gcagcagcuucgugccuuu

SEQ ID NO: 707177 - RNA, 19 nt, Homo sapiens
aaauggagauguacuacuc

SEQ ID NO: 707178 - RNA, 19 nt, Homo sapiens
ugaaguacuggauccguua

SEQ ID NO: 707179 - RNA, 19 nt, Homo sapiens
cucaggaccucacagacua

SEQ ID NO: 707180 - RNA, 19 nt, Homo sapiens
cuucgugccuuucauaaca

SEQ ID NO: 707181 - RNA, 19 nt, Homo sapiens
gcccugcaguggaaggaaa

SEQ ID NO: 707182 - RNA, 19 nt, Homo sapiens
acucucuccuuuaccuuua

SEQ ID NO: 707183 - RNA, 19 nt, Homo sapiens
cagcuucgugccuuucaua

SEQ ID NO: 707184 - RNA, 19 nt, Homo sapiens
caguggaucgcaccuguaa

SEQ ID NO: 707185 - RNA, 19 nt, Homo sapiens
gcaguggaucgcaccugua

SEQ ID NO: 707186 - RNA, 19 nt, Homo sapiens
cauaacagagcacaucauc

SEQ ID NO: 707187 - RNA, 19 nt, Homo sapiens
gaaauggagauguacuacu

SEQ ID NO: 707188 - RNA, 19 nt, Homo sapiens
guggaucgcaccuguaauc

SEQ ID NO: 707189 - RNA, 19 nt, Homo sapiens
gauguacuacucucuccuu

SEQ ID NO: 707190 - RNA, 19 nt, Homo sapiens
gcaccuguaaucccaguca

SEQ ID NO: 707191 - RNA, 19 nt, Homo sapiens
gcucaggaccucacagacu

SEQ ID NO: 707192 - RNA, 19 nt, Homo sapiens
acaaugagccugggcaagu

SEQ ID NO: 707193 - RNA, 19 nt, Homo sapiens
uguacuacucucuccuuua

SEQ ID NO: 707194 - RNA, 19 nt, Homo sapiens
aaccucagaugaccgacuu

SEQ ID NO: 707195 - RNA, 19 nt, Homo sapiens
uccaccagcugcaccauca

SEQ ID NO: 707196 - RNA, 19 nt, Homo sapiens
guacuggauccguuacaag

SEQ ID NO: 707197 - RNA, 19 nt, Homo sapiens
uguccuucauugccacgua

SEQ ID NO: 707198 - RNA, 19 nt, Homo sapiens
gcagcuucgugccuuucau

SEQ ID NO: 707199 - RNA, 19 nt, Homo sapiens
guucagcucugucgaauua

SEQ ID NO: 707200 - RNA, 19 nt, Homo sapiens
gagcaaaugugauuccuuu

SEQ ID NO: 707201 - RNA, 19 nt, Homo sapiens
gcacagagguucuccacuu

SEQ ID NO: 707202 - RNA, 19 nt, Homo sapiens
gaaaccaucuguaccugua

SEQ ID NO: 707203 - RNA, 19 nt, Homo sapiens
gaauaaugauugcucagua

SEQ ID NO: 707204 - RNA, 19 nt, Homo sapiens
caacaacaaugcaguauuc

SEQ ID NO: 707205 - RNA, 19 nt, Homo sapiens
ggaagaagauacugauaau

SEQ ID NO: 707206 - RNA, 19 nt, Homo sapiens
gacaggagauugaaugaaa

SEQ ID NO: 707207 - RNA, 19 nt, Homo sapiens
caacaagccucaaugaugu

SEQ ID NO: 707208 - RNA, 19 nt, Homo sapiens
uaacaucccuggaagaaga

SEQ ID NO: 707209 - RNA, 19 nt, Homo sapiens
gaacguagaugagguacau

SEQ ID NO: 707210 - RNA, 19 nt, Homo sapiens
gcaccaagauguuuagcuu

SEQ ID NO: 707211 - RNA, 19 nt, Homo sapiens
ggaaaugcuucuacagaga

SEQ ID NO: 707212 - RNA, 19 nt, Homo sapiens
gaaaguaguggaugacauu

SEQ ID NO: 707213 - RNA, 19 nt, Homo sapiens
gcucaaagauugcugaaag

SEQ ID NO: 707214 - RNA, 19 nt, Homo sapiens
gaggugagaucauguuuca

SEQ ID NO: 707215 - RNA, 19 nt, Homo sapiens
gaacuguccuacacugcua

SEQ ID NO: 707216 - RNA, 19 nt, Homo sapiens
gcccaaagcacauuaaauu

SEQ ID NO: 707217 - RNA, 19 nt, Homo sapiens
gaaugacuccuauaaagaa

SEQ ID NO: 707218 - RNA, 19 nt, Homo sapiens
uaagggcgaugauuauuau

SEQ ID NO: 707219 - RNA, 19 nt, Homo sapiens
gaagcagacuguaaaccaa

SEQ ID NO: 707220 - RNA, 19 nt, Homo sapiens
ugggaaagcuucaguguga

SEQ ID NO: 707221 - RNA, 19 nt, Homo sapiens
gagaucauguuucaauaug

SEQ ID NO: 707222 - RNA, 19 nt, Homo sapiens
ccucaaugauguuacuuua

SEQ ID NO: 707223 - RNA, 19 nt, Homo sapiens
gcaacugcaugguacauug

SEQ ID NO: 707224 - RNA, 19 nt, Homo sapiens
uaaagaagcagacuguaaa

SEQ ID NO: 707225 - RNA, 19 nt, Homo sapiens
uauagaaucugcaccaaga

SEQ ID NO: 707226 - RNA, 19 nt, Homo sapiens
gaaaugaucaaccaaguca

SEQ ID NO: 707227 - RNA, 19 nt, Homo sapiens
gauauuccuugucaucauu

SEQ ID NO: 707228 - RNA, 19 nt, Homo sapiens
gaggcuaaguuaucuuuga

SEQ ID NO: 707229 - RNA, 19 nt, Homo sapiens
ggauugcucuguauaagau

SEQ ID NO: 707230 - RNA, 19 nt, Homo sapiens
gcagacagugccacaguua

SEQ ID NO: 707231 - RNA, 19 nt, Homo sapiens
ggagaagcauaagcuaauu

SEQ ID NO: 707232 - RNA, 19 nt, Homo sapiens
ugacuugucuuugcaauau

SEQ ID NO: 707233 - RNA, 19 nt, Homo sapiens
ucaaguacauccuuauuag

SEQ ID NO: 707234 - RNA, 19 nt, Homo sapiens
gguacauuguugauuguua

SEQ ID NO: 707235 - RNA, 19 nt, Homo sapiens
caaaugugauuccuuucuu

SEQ ID NO: 707236 - RNA, 19 nt, Homo sapiens
gaauggaaaugcuucuaca

SEQ ID NO: 707237 - RNA, 19 nt, Homo sapiens
gagaaaugaucaaccaagu

SEQ ID NO: 707238 - RNA, 19 nt, Homo sapiens
caugguacauuguugauug

SEQ ID NO: 707239 - RNA, 19 nt, Homo sapiens
gauauaggaugugaaauac

SEQ ID NO: 707240 - RNA, 19 nt, Homo sapiens
gagaugauauaggauguga

SEQ ID NO: 707241 - RNA, 19 nt, Homo sapiens
gagaagcauaagcuaauua

SEQ ID NO: 707242 - RNA, 19 nt, Homo sapiens
uauaacgaauggcaccuua

SEQ ID NO: 707243 - RNA, 19 nt, Homo sapiens
gaugauauaggaugugaaa

SEQ ID NO: 707244 - RNA, 19 nt, Homo sapiens
uuacugacguucaagauau

SEQ ID NO: 707245 - RNA, 19 nt, Homo sapiens
accaagauguuuagcuuua

SEQ ID NO: 707246 - RNA, 19 nt, Homo sapiens
agacauuucugauuugguu

SEQ ID NO: 707247 - RNA, 19 nt, Homo sapiens
caauggaggcgguaucuuu

SEQ ID NO: 707248 - RNA, 19 nt, Homo sapiens
gaguaucgcuggccuuaca

SEQ ID NO: 707249 - RNA, 19 nt, Homo sapiens
uaacgugaccuucauguau

SEQ ID NO: 707250 - RNA, 19 nt, Homo sapiens
gaucagcuacgucauauca

SEQ ID NO: 707251 - RNA, 19 nt, Homo sapiens
ccaaacacagcauccaaua

SEQ ID NO: 707252 - RNA, 19 nt, Homo sapiens
aagaaugacuccuauaaag

SEQ ID NO: 707253 - RNA, 19 nt, Homo sapiens
gaagaaaccaagacauuac

SEQ ID NO: 707254 - RNA, 19 nt, Homo sapiens
gaucaacaacaaugcagua

SEQ ID NO: 707255 - RNA, 19 nt, Homo sapiens
uagaagcauuccauaugua

SEQ ID NO: 707256 - RNA, 19 nt, Homo sapiens
caggaugaguuaacaguga

SEQ ID NO: 707257 - RNA, 19 nt, Homo sapiens
ucacuaagguucucuugca

SEQ ID NO: 707258 - RNA, 19 nt, Homo sapiens
gaacaggagaguagacuag

SEQ ID NO: 707259 - RNA, 19 nt, Homo sapiens
aaacacagcauccaauaug

SEQ ID NO: 707260 - RNA, 19 nt, Homo sapiens
uaaagaggcuaaguuaucu

SEQ ID NO: 707261 - RNA, 19 nt, Homo sapiens
cuaagaaugacuccuauaa

SEQ ID NO: 707262 - RNA, 19 nt, Homo sapiens
caauuacucuuccuucauc

SEQ ID NO: 707263 - RNA, 19 nt, Homo sapiens
gcaauagccgcuuuggaaa

SEQ ID NO: 707264 - RNA, 19 nt, Homo sapiens
gugagaucauguuucaaua

SEQ ID NO: 707265 - RNA, 19 nt, Homo sapiens
guaccuggcccuugucaaa

SEQ ID NO: 707266 - RNA, 19 nt, Homo sapiens
gcucugacguucauuacau

SEQ ID NO: 707267 - RNA, 19 nt, Homo sapiens
uugcugagccuccagauua

SEQ ID NO: 707268 - RNA, 19 nt, Homo sapiens
aagguucucuugcauauau

SEQ ID NO: 707269 - RNA, 19 nt, Homo sapiens
agaagaaaccaagacauua

SEQ ID NO: 707270 - RNA, 19 nt, Homo sapiens
cuagaagcauuccauaugu

SEQ ID NO: 707271 - RNA, 19 nt, Homo sapiens
gaaacaacaagccucaaug

SEQ ID NO: 707272 - RNA, 19 nt, Homo sapiens
cuaagguucucuugcauau

SEQ ID NO: 707273 - RNA, 19 nt, Homo sapiens
gugcaugccuuuguuguau

SEQ ID NO: 707274 - RNA, 19 nt, Homo sapiens
ugugauuccuuucuucuaa

SEQ ID NO: 707275 - RNA, 19 nt, Homo sapiens
gcacauguuuaacgagaag

SEQ ID NO: 707276 - RNA, 19 nt, Homo sapiens
guugugggcuuucaucaau

SEQ ID NO: 707277 - RNA, 19 nt, Homo sapiens
acagaaaccucagugaaau

SEQ ID NO: 707278 - RNA, 19 nt, Homo sapiens
ucaaauuccuuacagucaa

SEQ ID NO: 707279 - RNA, 19 nt, Homo sapiens
cugcaaaucuucagguuuc

SEQ ID NO: 707280 - RNA, 19 nt, Homo sapiens
gaguaaagauucgaccaau

SEQ ID NO: 707281 - RNA, 19 nt, Homo sapiens
ccaaagcacauuaaauugu

SEQ ID NO: 707282 - RNA, 19 nt, Homo sapiens
aaacaacaagccucaauga

SEQ ID NO: 707283 - RNA, 19 nt, Homo sapiens
gaucucagacuaaccauag

SEQ ID NO: 707284 - RNA, 19 nt, Homo sapiens
agagagggaugaacuguca

SEQ ID NO: 707285 - RNA, 19 nt, Homo sapiens
gcucauacagugccuuuga

SEQ ID NO: 707286 - RNA, 19 nt, Homo sapiens
gagguucuccacuuuguuu

SEQ ID NO: 707287 - RNA, 19 nt, Homo sapiens
ggcaacaucuggagaagca

SEQ ID NO: 707288 - RNA, 19 nt, Homo sapiens
ggaugggccuagaagcauu

SEQ ID NO: 707289 - RNA, 19 nt, Homo sapiens
aaagauugcugaaaguagu

SEQ ID NO: 707290 - RNA, 19 nt, Homo sapiens
uaagcuuacucccuucaaa

SEQ ID NO: 707291 - RNA, 19 nt, Homo sapiens
gggucuaucuugcuuccua

SEQ ID NO: 707292 - RNA, 19 nt, Homo sapiens
ucauauugccguucuuuaa

SEQ ID NO: 707293 - RNA, 19 nt, Homo sapiens
gaacugucauccagaccau

SEQ ID NO: 707294 - RNA, 19 nt, Homo sapiens
uuaaagaagcagacuguaa

SEQ ID NO: 707295 - RNA, 19 nt, Homo sapiens
gccaguaguuucaacacaa

SEQ ID NO: 707296 - RNA, 19 nt, Homo sapiens
guaaagauucgaccaaugg

SEQ ID NO: 707297 - RNA, 19 nt, Homo sapiens
ggaguccugucucuaagug

SEQ ID NO: 707298 - RNA, 19 nt, Homo sapiens
gcaugccuuuguuguauau

SEQ ID NO: 707299 - RNA, 19 nt, Homo sapiens
gcagacggcuuucagagua

SEQ ID NO: 707300 - RNA, 19 nt, Homo sapiens
ucacucaccuucagacuua

SEQ ID NO: 707301 - RNA, 19 nt, Homo sapiens
ggacagaccacaacucuaa

SEQ ID NO: 707302 - RNA, 19 nt, Homo sapiens
ggaaguuucuuucucauga

SEQ ID NO: 707303 - RNA, 19 nt, Homo sapiens
caaacugcaugcuaaauaa

SEQ ID NO: 707304 - RNA, 19 nt, Homo sapiens
guaauugccugcuuugauu

SEQ ID NO: 707305 - RNA, 19 nt, Homo sapiens
ggacuucacuaagcaauuu

SEQ ID NO: 707306 - RNA, 19 nt, Homo sapiens
ccaagaaucugcauugaga

SEQ ID NO: 707307 - RNA, 19 nt, Homo sapiens
aaacaaacagcccaaauua

SEQ ID NO: 707308 - RNA, 19 nt, Homo sapiens
gaaucugcauugagaauaa

SEQ ID NO: 707309 - RNA, 19 nt, Homo sapiens
gaaacaaacagcccaaauu

SEQ ID NO: 707310 - RNA, 19 nt, Homo sapiens
gaacuuggauugauuucau

SEQ ID NO: 707311 - RNA, 19 nt, Homo sapiens
gaagauaccucaguugucu

SEQ ID NO: 707312 - RNA, 19 nt, Homo sapiens
gaugaagaaugcaaauuug

SEQ ID NO: 707313 - RNA, 19 nt, Homo sapiens
gaccagcugugauguuuaa

SEQ ID NO: 707314 - RNA, 19 nt, Homo sapiens
gagaccagcugugauguuu

SEQ ID NO: 707315 - RNA, 19 nt, Homo sapiens
ggaauggaaugccaagaau

SEQ ID NO: 707316 - RNA, 19 nt, Homo sapiens
gaugagaggugaaguaaaa

SEQ ID NO: 707317 - RNA, 19 nt, Homo sapiens
gaagcgaccucucgaagca

SEQ ID NO: 707318 - RNA, 19 nt, Homo sapiens
ggagugccaugauauugaa

SEQ ID NO: 707319 - RNA, 19 nt, Homo sapiens
gaucaaaggguauguuuca

SEQ ID NO: 707320 - RNA, 19 nt, Homo sapiens
gcagaugcaauuuauguuu

SEQ ID NO: 707321 - RNA, 19 nt, Homo sapiens
ggaugaagauaccucaguu

SEQ ID NO: 707322 - RNA, 19 nt, Homo sapiens
caaaggguauguuucacuu

SEQ ID NO: 707323 - RNA, 19 nt, Homo sapiens
gaagaguaauugccugcuu

SEQ ID NO: 707324 - RNA, 19 nt, Homo sapiens
ggaaauucaagcacaagua

SEQ ID NO: 707325 - RNA, 19 nt, Homo sapiens
gccacaaacugcaugcuaa

SEQ ID NO: 707326 - RNA, 19 nt, Homo sapiens
uaacagcuguaucugcaaa

SEQ ID NO: 707327 - RNA, 19 nt, Homo sapiens
cuugggagcuuucuuugua

SEQ ID NO: 707328 - RNA, 19 nt, Homo sapiens
ggaaugagaacuauuuaca

SEQ ID NO: 707329 - RNA, 19 nt, Homo sapiens
gaaggaacaauuugauuca

SEQ ID NO: 707330 - RNA, 19 nt, Homo sapiens
ggaaggaacaauuugauuc

SEQ ID NO: 707331 - RNA, 19 nt, Homo sapiens
gaaauaaucagcagaaacg

SEQ ID NO: 707332 - RNA, 19 nt, Homo sapiens
ccacaacucuaagaagcua

SEQ ID NO: 707333 - RNA, 19 nt, Homo sapiens
gugcugcuaucucauauau

SEQ ID NO: 707334 - RNA, 19 nt, Homo sapiens
cagcugugauguuuaaaga

SEQ ID NO: 707335 - RNA, 19 nt, Homo sapiens
aaacagggaaugagaacua

SEQ ID NO: 707336 - RNA, 19 nt, Homo sapiens
ccagccaguuuacucauuu

SEQ ID NO: 707337 - RNA, 19 nt, Homo sapiens
caacaacuccugcaacaag

SEQ ID NO: 707338 - RNA, 19 nt, Homo sapiens
uagcuuugcuccuuaccua

SEQ ID NO: 707339 - RNA, 19 nt, Homo sapiens
gaaauuaauggaaggaaca

SEQ ID NO: 707340 - RNA, 19 nt, Homo sapiens
aaacagcccaaauuacuuu

SEQ ID NO: 707341 - RNA, 19 nt, Homo sapiens
cauauugauugaugaguga

SEQ ID NO: 707342 - RNA, 19 nt, Homo sapiens
aaagugugguguuugguuu

SEQ ID NO: 707343 - RNA, 19 nt, Homo sapiens
gcugugauguuuaaagaca

SEQ ID NO: 707344 - RNA, 19 nt, Homo sapiens
acaaacugcaugcuaaaua

SEQ ID NO: 707345 - RNA, 19 nt, Homo sapiens
cauggaaguuucuuucuca

SEQ ID NO: 707346 - RNA, 19 nt, Homo sapiens
agagagaacugcaaguauc

SEQ ID NO: 707347 - RNA, 19 nt, Homo sapiens
gauucuagcucuaauuacu

SEQ ID NO: 707348 - RNA, 19 nt, Homo sapiens
ggagaagccucggccacuu

SEQ ID NO: 707349 - RNA, 19 nt, Homo sapiens
ugagaacuauuuacaugga

SEQ ID NO: 707350 - RNA, 19 nt, Homo sapiens
ugacuuugccaauugcuua

SEQ ID NO: 707351 - RNA, 19 nt, Homo sapiens
ggaaggacaggcagagcua

SEQ ID NO: 707352 - RNA, 19 nt, Homo sapiens
aacuauagcugaugcagaa

SEQ ID NO: 707353 - RNA, 19 nt, Homo sapiens
cuuaguauauuccaaccua

SEQ ID NO: 707354 - RNA, 19 nt, Homo sapiens
gacaacaccguaaccguuu

SEQ ID NO: 707355 - RNA, 19 nt, Homo sapiens
cgagagagaacugcaagua

SEQ ID NO: 707356 - RNA, 19 nt, Homo sapiens
caccauggcuuugaacguu

SEQ ID NO: 707357 - RNA, 19 nt, Homo sapiens
cccaaggagugccaugaua

SEQ ID NO: 707358 - RNA, 19 nt, Homo sapiens
cagaaaguccagccaguuu

SEQ ID NO: 707359 - RNA, 19 nt, Homo sapiens
cauaguuucuguccuagga

SEQ ID NO: 707360 - RNA, 19 nt, Homo sapiens
agggagaaaugcaaauauu

SEQ ID NO: 707361 - RNA, 19 nt, Homo sapiens
gaaauucaagcacaaguac

SEQ ID NO: 707362 - RNA, 19 nt, Homo sapiens
cuaggaauauugucuuauc

SEQ ID NO: 707363 - RNA, 19 nt, Homo sapiens
gaaguuucuuucucaugau

SEQ ID NO: 707364 - RNA, 19 nt, Homo sapiens
gagaacuauuuacauggaa

SEQ ID NO: 707365 - RNA, 19 nt, Homo sapiens
cagaugcaauuuauguuuc

SEQ ID NO: 707366 - RNA, 19 nt, Homo sapiens
gagagagaacugcaaguau

SEQ ID NO: 707367 - RNA, 19 nt, Homo sapiens
ugucugacuuugccaauug

SEQ ID NO: 707368 - RNA, 19 nt, Homo sapiens
gagaugccacguugaauca

SEQ ID NO: 707369 - RNA, 19 nt, Homo sapiens
aagaguaauugccugcuuu

SEQ ID NO: 707370 - RNA, 19 nt, Homo sapiens
ggauuggacuucacuaagc

SEQ ID NO: 707371 - RNA, 19 nt, Homo sapiens
gagcgucagcauuaaauau

SEQ ID NO: 707372 - RNA, 19 nt, Homo sapiens
gaacaucugagugucuuau

SEQ ID NO: 707373 - RNA, 19 nt, Homo sapiens
aaagaugagaggugaagua

SEQ ID NO: 707374 - RNA, 19 nt, Homo sapiens
ucuaauuacugucauguca

SEQ ID NO: 707375 - RNA, 19 nt, Homo sapiens
cagcagaaacggaauggaa

SEQ ID NO: 707376 - RNA, 19 nt, Homo sapiens
gcccagcagaugcaauuua

SEQ ID NO: 707377 - RNA, 19 nt, Homo sapiens
gaaaauggaagaguaauug

SEQ ID NO: 707378 - RNA, 19 nt, Homo sapiens
gcagaaaguccagccaguu

SEQ ID NO: 707379 - RNA, 19 nt, Homo sapiens
cagggaaugagaacuauuu

SEQ ID NO: 707380 - RNA, 19 nt, Homo sapiens
caacagccacagccaauca

SEQ ID NO: 707381 - RNA, 19 nt, Homo sapiens
gcaccaugaucgacacaag

SEQ ID NO: 707382 - RNA, 19 nt, Homo sapiens
caaggagugccaugauauu

SEQ ID NO: 707383 - RNA, 19 nt, Homo sapiens
ggagaugccacguugaauc

SEQ ID NO: 707384 - RNA, 19 nt, Homo sapiens
ggguauguuucacuucuug

SEQ ID NO: 707385 - RNA, 19 nt, Homo sapiens
gcagaaacggaauggaaug

SEQ ID NO: 707386 - RNA, 19 nt, Homo sapiens
gaaguccaccggucacugu

SEQ ID NO: 707387 - RNA, 19 nt, Homo sapiens
caccacgccuguuauuguu

SEQ ID NO: 707388 - RNA, 19 nt, Homo sapiens
cagcagaugcaauuuaugu

SEQ ID NO: 707389 - RNA, 19 nt, Homo sapiens
cuaagcaauuuaucacuca

SEQ ID NO: 707390 - RNA, 19 nt, Homo sapiens
gugauugccuguccauaca

SEQ ID NO: 707391 - RNA, 19 nt, Homo sapiens
uaagugggacauauugauu

SEQ ID NO: 707392 - RNA, 19 nt, Homo sapiens
caagagacucggacguuga

SEQ ID NO: 707393 - RNA, 19 nt, Homo sapiens
caauaaacagggaaugaga

SEQ ID NO: 707394 - RNA, 19 nt, Homo sapiens
gaugccacguugaaucaug

SEQ ID NO: 707395 - RNA, 19 nt, Homo sapiens
ucgauucuagcucuaauua

SEQ ID NO: 707396 - RNA, 19 nt, Homo sapiens
ccaguuuacucauuucgau

SEQ ID NO: 707397 - RNA, 19 nt, Homo sapiens
gagaccgacugccgcuuug

SEQ ID NO: 707398 - RNA, 19 nt, Homo sapiens
aggcagagcuaaacaaggu

SEQ ID NO: 707399 - RNA, 19 nt, Homo sapiens
gggaaucacugaaauauuu

SEQ ID NO: 707400 - RNA, 19 nt, Homo sapiens
gaggagaucuguauaauau

SEQ ID NO: 707401 - RNA, 19 nt, Homo sapiens
gcagacggcuuucagagua

SEQ ID NO: 707402 - RNA, 19 nt, Homo sapiens
ucacucaccuucagacuua

SEQ ID NO: 707403 - RNA, 19 nt, Homo sapiens
ggacagaccacaacucuaa

SEQ ID NO: 707404 - RNA, 19 nt, Homo sapiens
ggaaguuucuuucucauga

SEQ ID NO: 707405 - RNA, 19 nt, Homo sapiens
gaacuacauuucacucuug

SEQ ID NO: 707406 - RNA, 19 nt, Homo sapiens
caaacugcaugcuaaauaa

SEQ ID NO: 707407 - RNA, 19 nt, Homo sapiens
guaauugccugcuuugauu

SEQ ID NO: 707408 - RNA, 19 nt, Homo sapiens
ggacuucacuaagcaauuu

SEQ ID NO: 707409 - RNA, 19 nt, Homo sapiens
gaagauaucaguucaacaa

SEQ ID NO: 707410 - RNA, 19 nt, Homo sapiens
ccaagaaucugcauugaga

SEQ ID NO: 707411 - RNA, 19 nt, Homo sapiens
aaacaaacagcccaaauua

SEQ ID NO: 707412 - RNA, 19 nt, Homo sapiens
uaacagcacuucaccgaaa

SEQ ID NO: 707413 - RNA, 19 nt, Homo sapiens
gaaucugcauugagaauaa

SEQ ID NO: 707414 - RNA, 19 nt, Homo sapiens
gaaacaaacagcccaaauu

SEQ ID NO: 707415 - RNA, 19 nt, Homo sapiens
gaacuuggauugauuucau

SEQ ID NO: 707416 - RNA, 19 nt, Homo sapiens
guaaacaggagucuaauuu

SEQ ID NO: 707417 - RNA, 19 nt, Homo sapiens
gaagauaccucaguugucu

SEQ ID NO: 707418 - RNA, 19 nt, Homo sapiens
ggagaucuguauaauauuc

SEQ ID NO: 707419 - RNA, 19 nt, Homo sapiens
gaugaagaaugcaaauuug

SEQ ID NO: 707420 - RNA, 19 nt, Homo sapiens
gaccagcugugauguuuaa

SEQ ID NO: 707421 - RNA, 19 nt, Homo sapiens
uaagagagacuuuguagaa

SEQ ID NO: 707422 - RNA, 19 nt, Homo sapiens
gcacuucaccgaaauauuc

SEQ ID NO: 707423 - RNA, 19 nt, Homo sapiens
gaaagucacacgcuaaaug

SEQ ID NO: 707424 - RNA, 19 nt, Homo sapiens
gagaccagcugugauguuu

SEQ ID NO: 707425 - RNA, 19 nt, Homo sapiens
ggaauggaaugccaagaau

SEQ ID NO: 707426 - RNA, 19 nt, Homo sapiens
gaugagaggugaaguaaaa

SEQ ID NO: 707427 - RNA, 19 nt, Homo sapiens
ggucaaagucgaauuacua

SEQ ID NO: 707428 - RNA, 19 nt, Homo sapiens
gacugugacuuuaaucuaa

SEQ ID NO: 707429 - RNA, 19 nt, Homo sapiens
ggagugccaugauauugaa

SEQ ID NO: 707430 - RNA, 19 nt, Homo sapiens
gacuaacucuccacuugua

SEQ ID NO: 707431 - RNA, 19 nt, Homo sapiens
gaucaaaggguauguuuca

SEQ ID NO: 707432 - RNA, 19 nt, Homo sapiens
gcagaugcaauuuauguuu

SEQ ID NO: 707433 - RNA, 19 nt, Homo sapiens
ggaugaagauaccucaguu

SEQ ID NO: 707434 - RNA, 19 nt, Homo sapiens
aaacaggagucuaauuugu

SEQ ID NO: 707435 - RNA, 19 nt, Homo sapiens
gaucaucgccuguucugaa

SEQ ID NO: 707436 - RNA, 19 nt, Homo sapiens
gcacuaucguaccaaauau

SEQ ID NO: 707437 - RNA, 19 nt, Homo sapiens
caaauuugacugugacuuu

SEQ ID NO: 707438 - RNA, 19 nt, Homo sapiens
ggaacuacauuucacucuu

SEQ ID NO: 707439 - RNA, 19 nt, Homo sapiens
caaaggguauguuucacuu

SEQ ID NO: 707440 - RNA, 19 nt, Homo sapiens
gaagaguaauugccugcuu

SEQ ID NO: 707441 - RNA, 19 nt, Homo sapiens
uacaguaccuacauaguuu

SEQ ID NO: 707442 - RNA, 19 nt, Homo sapiens
ggaaauucaagcacaagua

SEQ ID NO: 707443 - RNA, 19 nt, Homo sapiens
ggaaugagaacuauuuaca

SEQ ID NO: 707444 - RNA, 19 nt, Homo sapiens
gccacaaacugcaugcuaa

SEQ ID NO: 707445 - RNA, 19 nt, Homo sapiens
uaacagcuguaucugcaaa

SEQ ID NO: 707446 - RNA, 19 nt, Homo sapiens
cuugggagcuuucuuugua

SEQ ID NO: 707447 - RNA, 19 nt, Homo sapiens
cacgcuaaauguauucuua

SEQ ID NO: 707448 - RNA, 19 nt, Homo sapiens
gcaaaugcauagauguaca

SEQ ID NO: 707449 - RNA, 19 nt, Homo sapiens
gcaccaaccguaucauuau

SEQ ID NO: 707450 - RNA, 19 nt, Homo sapiens
ccaacagucuaaucuaaga

SEQ ID NO: 707451 - RNA, 19 nt, Homo sapiens
caaacaaagucuugaaggu

SEQ ID NO: 707452 - RNA, 19 nt, Homo sapiens
gaaggaacaauuugauuca

SEQ ID NO: 707453 - RNA, 19 nt, Homo sapiens
ggaaggaacaauuugauuc

SEQ ID NO: 707454 - RNA, 19 nt, Homo sapiens
caaggcaaaugcauagaug

SEQ ID NO: 707455 - RNA, 19 nt, Homo sapiens
gaaauaaucagcagaaacg

SEQ ID NO: 707456 - RNA, 19 nt, Homo sapiens
ccacaacucuaagaagcua

SEQ ID NO: 707457 - RNA, 19 nt, Homo sapiens
gugcugcuaucucauauau

SEQ ID NO: 707458 - RNA, 19 nt, Homo sapiens
aaacaaagucuugaaggua

SEQ ID NO: 707459 - RNA, 19 nt, Homo sapiens
cagcugugauguuuaaaga

SEQ ID NO: 707460 - RNA, 19 nt, Homo sapiens
aaacagggaaugagaacua

SEQ ID NO: 707461 - RNA, 19 nt, Homo sapiens
uuucagcccuuuaauaaug

SEQ ID NO: 707462 - RNA, 19 nt, Homo sapiens
ccagccaguuuacucauuu

SEQ ID NO: 707463 - RNA, 19 nt, Homo sapiens
caacaacuccugcaacaag

SEQ ID NO: 707464 - RNA, 19 nt, Homo sapiens
uagcuuugcuccuuaccua

SEQ ID NO: 707465 - RNA, 19 nt, Homo sapiens
gaaauuaauggaaggaaca

SEQ ID NO: 707466 - RNA, 19 nt, Homo sapiens
aaacagcccaaauuacuuu

SEQ ID NO: 707467 - RNA, 19 nt, Homo sapiens
cauauugauugaugaguga

SEQ ID NO: 707468 - RNA, 19 nt, Homo sapiens
caaauacuguaguuaagag

SEQ ID NO: 707469 - RNA, 19 nt, Homo sapiens
aaagugugguguuugguuu

SEQ ID NO: 707470 - RNA, 19 nt, Homo sapiens
cauggaaguuucuuucuca

SEQ ID NO: 707471 - RNA, 19 nt, Homo sapiens
gcugugauguuuaaagaca

SEQ ID NO: 707472 - RNA, 19 nt, Homo sapiens
acaaacugcaugcuaaaua

SEQ ID NO: 707473 - RNA, 19 nt, Homo sapiens
agagagaacugcaaguauc

SEQ ID NO: 707474 - RNA, 19 nt, Homo sapiens
ucaguucacucacccaaug

SEQ ID NO: 707475 - RNA, 19 nt, Homo sapiens
cugguaacauuucuacuaa

SEQ ID NO: 707476 - RNA, 19 nt, Homo sapiens
ggagaagccucggccacuu

SEQ ID NO: 707477 - RNA, 19 nt, Homo sapiens
gugaacauauuagugauug

SEQ ID NO: 707478 - RNA, 19 nt, Homo sapiens
ggaaggacaggcagagcua

SEQ ID NO: 707479 - RNA, 19 nt, Homo sapiens
gauucuagcucuaauuacu

SEQ ID NO: 707480 - RNA, 19 nt, Homo sapiens
ugagaacuauuuacaugga

SEQ ID NO: 707481 - RNA, 19 nt, Homo sapiens
ugacuuugccaauugcuua

SEQ ID NO: 707482 - RNA, 19 nt, Homo sapiens
gcaaauauagaagacugua

SEQ ID NO: 707483 - RNA, 19 nt, Homo sapiens
ccuauacaguaccuacaua

SEQ ID NO: 707484 - RNA, 19 nt, Homo sapiens
cuuaaagaauucccucauu

SEQ ID NO: 707485 - RNA, 19 nt, Homo sapiens
gagaggaucuaaaacuauu

SEQ ID NO: 707486 - RNA, 19 nt, Homo sapiens
aacuauagcugaugcagaa

SEQ ID NO: 707487 - RNA, 19 nt, Homo sapiens
cuuaguauauuccaaccua

SEQ ID NO: 707488 - RNA, 19 nt, Homo sapiens
gacaacaccguaaccguuu

SEQ ID NO: 707489 - RNA, 19 nt, Homo sapiens
cgagagagaacugcaagua

SEQ ID NO: 707490 - RNA, 19 nt, Homo sapiens
caccauggcuuugaacguu

SEQ ID NO: 707491 - RNA, 19 nt, Homo sapiens
cccaaggagugccaugaua

SEQ ID NO: 707492 - RNA, 19 nt, Homo sapiens
ugccaacagucuaaucuaa

SEQ ID NO: 707493 - RNA, 19 nt, Homo sapiens
cagaaaguccagccaguuu

SEQ ID NO: 707494 - RNA, 19 nt, Homo sapiens
cauaguuucuguccuagga

SEQ ID NO: 707495 - RNA, 19 nt, Homo sapiens
agggagaaaugcaaauauu

SEQ ID NO: 707496 - RNA, 19 nt, Homo sapiens
acaggagucuaauuuguau

SEQ ID NO: 707497 - RNA, 19 nt, Homo sapiens
caaagucgaauuacuaucu

SEQ ID NO: 707498 - RNA, 19 nt, Homo sapiens
ccaaccguaucauuauuug

SEQ ID NO: 707499 - RNA, 19 nt, Homo sapiens
gaacagaacaucucuauuc

SEQ ID NO: 707500 - RNA, 19 nt, Homo sapiens
gcccauaaaucuugaguua

SEQ ID NO: 707501 - RNA, 19 nt, Homo sapiens
cuacagaccugaauucaaa

SEQ ID NO: 707502 - RNA, 19 nt, Homo sapiens
gaacaucucuauucuacau

SEQ ID NO: 707503 - RNA, 19 nt, Homo sapiens
ggucugagcuuugaaacua

SEQ ID NO: 707504 - RNA, 19 nt, Homo sapiens
aaagagagcuguuucuaga

SEQ ID NO: 707505 - RNA, 19 nt, Homo sapiens
ggaaggcccugguugagaa

SEQ ID NO: 707506 - RNA, 19 nt, Homo sapiens
gggcauaacugugaaguga

SEQ ID NO: 707507 - RNA, 19 nt, Homo sapiens
gcauuaagauuaccuucaa

SEQ ID NO: 707508 - RNA, 19 nt, Homo sapiens
gcauaacugugaagugaaa

SEQ ID NO: 707509 - RNA, 19 nt, Homo sapiens
guaggacaguugcuuagua

SEQ ID NO: 707510 - RNA, 19 nt, Homo sapiens
gguguuuccuugugaguua

SEQ ID NO: 707511 - RNA, 19 nt, Homo sapiens
ugaauaugcucucuuguug

SEQ ID NO: 707512 - RNA, 19 nt, Homo sapiens
agaaacaccugcugacuug

SEQ ID NO: 707513 - RNA, 19 nt, Homo sapiens
gagaggauuugcuucugua

SEQ ID NO: 707514 - RNA, 19 nt, Homo sapiens
ggacaacagcaaucaaauu

SEQ ID NO: 707515 - RNA, 19 nt, Homo sapiens
ggugggaacuauaaugauu

SEQ ID NO: 707516 - RNA, 19 nt, Homo sapiens
uggauagucugaguuauua

SEQ ID NO: 707517 - RNA, 19 nt, Homo sapiens
gaacugcugccauagguuu

SEQ ID NO: 707518 - RNA, 19 nt, Homo sapiens
gauaugaugguuacaauga

SEQ ID NO: 707519 - RNA, 19 nt, Homo sapiens
gaggugauguggauauaau

SEQ ID NO: 707520 - RNA, 19 nt, Homo sapiens
gauggaaacuuugguggaa

SEQ ID NO: 707521 - RNA, 19 nt, Homo sapiens
ccaagauaguuuagguaua

SEQ ID NO: 707522 - RNA, 19 nt, Homo sapiens
gaaaagggaugguggaugu

SEQ ID NO: 707523 - RNA, 19 nt, Homo sapiens
gaugauaguuuaagagaac

SEQ ID NO: 707524 - RNA, 19 nt, Homo sapiens
gugcagcuauugauuaaug

SEQ ID NO: 707525 - RNA, 19 nt, Homo sapiens
aaggaacgaugauccauaa

SEQ ID NO: 707526 - RNA, 19 nt, Homo sapiens
gaaaagggcuacaguucuu

SEQ ID NO: 707527 - RNA, 19 nt, Homo sapiens
uuacugcccuccauuuaaa

SEQ ID NO: 707528 - RNA, 19 nt, Homo sapiens
gcaauguagugucaauuag

SEQ ID NO: 707529 - RNA, 19 nt, Homo sapiens
ggagguggaucuggcaauu

SEQ ID NO: 707530 - RNA, 19 nt, Homo sapiens
gaacacacucuuauuucuu

SEQ ID NO: 707531 - RNA, 19 nt, Homo sapiens
gcagaaauguaggacaguu

SEQ ID NO: 707532 - RNA, 19 nt, Homo sapiens
ggagagagagugaggaguu

SEQ ID NO: 707533 - RNA, 19 nt, Homo sapiens
guucagaaauaccacacua

SEQ ID NO: 707534 - RNA, 19 nt, Homo sapiens
ggagagaauagauaauuug

SEQ ID NO: 707535 - RNA, 19 nt, Homo sapiens
aaagugcagcuauugauua

SEQ ID NO: 707536 - RNA, 19 nt, Homo sapiens
cagcagagguaguuaugga

SEQ ID NO: 707537 - RNA, 19 nt, Homo sapiens
gaagacaggcagaguggaa

SEQ ID NO: 707538 - RNA, 19 nt, Homo sapiens
caggaaagcugcagguuac

SEQ ID NO: 707539 - RNA, 19 nt, Homo sapiens
gugccuccgugcauuaaua

SEQ ID NO: 707540 - RNA, 19 nt, Homo sapiens
ggauauauacccaugucua

SEQ ID NO: 707541 - RNA, 19 nt, Homo sapiens
ggaagugguggauauggua

SEQ ID NO: 707542 - RNA, 19 nt, Homo sapiens
gcaugcuaguguuugaaua

SEQ ID NO: 707543 - RNA, 19 nt, Homo sapiens
gcacaagaggcccauaaau

SEQ ID NO: 707544 - RNA, 19 nt, Homo sapiens
aauuugaacugcugccaua

SEQ ID NO: 707545 - RNA, 19 nt, Homo sapiens
uauauugcccuguaaauug

SEQ ID NO: 707546 - RNA, 19 nt, Homo sapiens
gugaggaguugucaggaaa

SEQ ID NO: 707547 - RNA, 19 nt, Homo sapiens
gguccugguuauaguagua

SEQ ID NO: 707548 - RNA, 19 nt, Homo sapiens
gaaccaaagagagcuguuu

SEQ ID NO: 707549 - RNA, 19 nt, Homo sapiens
guacuaagcaaacaagcaa

SEQ ID NO: 707550 - RNA, 19 nt, Homo sapiens
cagcuagugcuuacaauuu

SEQ ID NO: 707551 - RNA, 19 nt, Homo sapiens
ucaauuagauguacauucc

SEQ ID NO: 707552 - RNA, 19 nt, Homo sapiens
gagagagagugaggaguug

SEQ ID NO: 707553 - RNA, 19 nt, Homo sapiens
gaaaaguuacugcagcuua

SEQ ID NO: 707554 - RNA, 19 nt, Homo sapiens
ucaggaaagcugcagguua

SEQ ID NO: 707555 - RNA, 19 nt, Homo sapiens
gauugaaaccauagaaguu

SEQ ID NO: 707556 - RNA, 19 nt, Homo sapiens
gcugacauguggagagaau

SEQ ID NO: 707557 - RNA, 19 nt, Homo sapiens
guacauuccugagguucuu

SEQ ID NO: 707558 - RNA, 19 nt, Homo sapiens
caggaaacccuucuuguuc

SEQ ID NO: 707559 - RNA, 19 nt, Homo sapiens
ccaaagagagcuguuucua

SEQ ID NO: 707560 - RNA, 19 nt, Homo sapiens
ggagggccaugauccaaag

SEQ ID NO: 707561 - RNA, 19 nt, Homo sapiens
guuugaauaugcucucuug

SEQ ID NO: 707562 - RNA, 19 nt, Homo sapiens
gaauggcgcaugcuagugu

SEQ ID NO: 707563 - RNA, 19 nt, Homo sapiens
cauuaagccugcuauaucu

SEQ ID NO: 707564 - RNA, 19 nt, Homo sapiens
gauguacauuccugagguu

SEQ ID NO: 707565 - RNA, 19 nt, Homo sapiens
aagugcagcuauugauuaa

SEQ ID NO: 707566 - RNA, 19 nt, Homo sapiens
agagagcuguuucuagaga

SEQ ID NO: 707567 - RNA, 19 nt, Homo sapiens
caaauuaguggguaaccuu

SEQ ID NO: 707568 - RNA, 19 nt, Homo sapiens
guaaauugugguaguggua

SEQ ID NO: 707569 - RNA, 19 nt, Homo sapiens
guauauugcccuguaaauu

SEQ ID NO: 707570 - RNA, 19 nt, Homo sapiens
uuaaugcaauguaguguca

SEQ ID NO: 707571 - RNA, 19 nt, Homo sapiens
ggaacgaugauccauaauc

SEQ ID NO: 707572 - RNA, 19 nt, Homo sapiens
guucuuagcaggagagaga

SEQ ID NO: 707573 - RNA, 19 nt, Homo sapiens
gaagccuggugcccaucua

SEQ ID NO: 707574 - RNA, 19 nt, Homo sapiens
caaagagagcuguuucuag

SEQ ID NO: 707575 - RNA, 19 nt, Homo sapiens
gaguauguguccugcuguu

SEQ ID NO: 707576 - RNA, 19 nt, Homo sapiens
ccauuaagccugcuauauc

SEQ ID NO: 707577 - RNA, 19 nt, Homo sapiens
gcgcugacauguggagaga

SEQ ID NO: 707578 - RNA, 19 nt, Homo sapiens
caaguaaagaagaucauug

SEQ ID NO: 707579 - RNA, 19 nt, Homo sapiens
uuaaugggcauaacuguga

SEQ ID NO: 707580 - RNA, 19 nt, Homo sapiens
gugacuuauucuuguguua

SEQ ID NO: 707581 - RNA, 19 nt, Homo sapiens
gcaaugccacauggaaauu

SEQ ID NO: 707582 - RNA, 19 nt, Homo sapiens
ggaugaaaccaagauaguu

SEQ ID NO: 707583 - RNA, 19 nt, Homo sapiens
cacaagaggcccauaaauc

SEQ ID NO: 707584 - RNA, 19 nt, Homo sapiens
ggucacagaggaaacuuug

SEQ ID NO: 707585 - RNA, 19 nt, Homo sapiens
guagugguaccaggaauaa

SEQ ID NO: 707586 - RNA, 19 nt, Homo sapiens
auacccaugucuacuguuu

SEQ ID NO: 707587 - RNA, 19 nt, Homo sapiens
acaagaggcccauaaaucu

SEQ ID NO: 707588 - RNA, 19 nt, Homo sapiens
cauuacaucagguauauug

SEQ ID NO: 707589 - RNA, 19 nt, Homo sapiens
ugcaauguagugucaauua

SEQ ID NO: 707590 - RNA, 19 nt, Homo sapiens
aaacaggaaacccuucuug

SEQ ID NO: 707591 - RNA, 19 nt, Homo sapiens
gcagugguccugguuauag

SEQ ID NO: 707592 - RNA, 19 nt, Homo sapiens
uagagaggauucugugaag

SEQ ID NO: 707593 - RNA, 19 nt, Homo sapiens
ucauucaaguccugaguau

SEQ ID NO: 707594 - RNA, 19 nt, Homo sapiens
aacacacucuuauuucuug

SEQ ID NO: 707595 - RNA, 19 nt, Homo sapiens
uuucagaccaagagaauaa

SEQ ID NO: 707596 - RNA, 19 nt, Homo sapiens
guggagagaauagauaauu

SEQ ID NO: 707597 - RNA, 19 nt, Homo sapiens
gcuuugaaacuacagauga

SEQ ID NO: 707598 - RNA, 19 nt, Homo sapiens
aaccagagcagcugagaaa

SEQ ID NO: 707599 - RNA, 19 nt, Homo sapiens
ggaauuacguugagucuau

SEQ ID NO: 707600 - RNA, 19 nt, Homo sapiens
ggaggaagcugcugugguu

SEQ ID NO: 707601 - RNA, 19 nt, Homo sapiens
gcagagagcccuagaagaa

SEQ ID NO: 707602 - RNA, 19 nt, Homo sapiens
aaacaagccuucagaauca

SEQ ID NO: 707603 - RNA, 19 nt, Homo sapiens
ggaaggagccauuauuuau

SEQ ID NO: 707604 - RNA, 19 nt, Homo sapiens
gauggaaucuucaaucaau

SEQ ID NO: 707605 - RNA, 19 nt, Homo sapiens
gaaugaaggauacaaauga

SEQ ID NO: 707606 - RNA, 19 nt, Homo sapiens
ggagggagccacccaagua

SEQ ID NO: 707607 - RNA, 19 nt, Homo sapiens
gaaugacgaugguugguau

SEQ ID NO: 707608 - RNA, 19 nt, Homo sapiens
gcaagaagagaaauuggua

SEQ ID NO: 707609 - RNA, 19 nt, Homo sapiens
guacaguucuacagcauga

SEQ ID NO: 707610 - RNA, 19 nt, Homo sapiens
gagaacaacuacauacagu

SEQ ID NO: 707611 - RNA, 19 nt, Homo sapiens
aagaugagcuguccuuuca

SEQ ID NO: 707612 - RNA, 19 nt, Homo sapiens
ucaaggacacauaagauua

SEQ ID NO: 707613 - RNA, 19 nt, Homo sapiens
gaacaacuacauacaguca

SEQ ID NO: 707614 - RNA, 19 nt, Homo sapiens
caaacaagccuucagaauc

SEQ ID NO: 707615 - RNA, 19 nt, Homo sapiens
gguaccaaaugauuacgua

SEQ ID NO: 707616 - RNA, 19 nt, Homo sapiens
agagaaaguugcaagaaga

SEQ ID NO: 707617 - RNA, 19 nt, Homo sapiens
gaaggagccauuauuuaug

SEQ ID NO: 707618 - RNA, 19 nt, Homo sapiens
gaaccagucuuugaugagu

SEQ ID NO: 707619 - RNA, 19 nt, Homo sapiens
ucaaagaaaucgaacuuac

SEQ ID NO: 707620 - RNA, 19 nt, Homo sapiens
guacaacaccuccaacuca

SEQ ID NO: 707621 - RNA, 19 nt, Homo sapiens
gaaaguugcaagaagagaa

SEQ ID NO: 707622 - RNA, 19 nt, Homo sapiens
uggaacggguggccgauua

SEQ ID NO: 707623 - RNA, 19 nt, Homo sapiens
ggaggaggaugugaagaug

SEQ ID NO: 707624 - RNA, 19 nt, Homo sapiens
ccaguucguuauauuagaa

SEQ ID NO: 707625 - RNA, 19 nt, Homo sapiens
cgaccaguucguuauauua

SEQ ID NO: 707626 - RNA, 19 nt, Homo sapiens
caaagcaagcugagucuga

SEQ ID NO: 707627 - RNA, 19 nt, Homo sapiens
uugagucuaucaugcauua

SEQ ID NO: 707628 - RNA, 19 nt, Homo sapiens
gaagaugagcuguccuuuc

SEQ ID NO: 707629 - RNA, 19 nt, Homo sapiens
gagaacaguggaaguggua

SEQ ID NO: 707630 - RNA, 19 nt, Homo sapiens
cuacaccacccaauccuua

SEQ ID NO: 707631 - RNA, 19 nt, Homo sapiens
ugagcugucuggauugaaa

SEQ ID NO: 707632 - RNA, 19 nt, Homo sapiens
gaacaaauggaucuuucug

SEQ ID NO: 707633 - RNA, 19 nt, Homo sapiens
gaaaaccuauugacuauac

SEQ ID NO: 707634 - RNA, 19 nt, Homo sapiens
ggaucuuucugccaucauu

SEQ ID NO: 707635 - RNA, 19 nt, Homo sapiens
cacaaacaguugauauuca

SEQ ID NO: 707636 - RNA, 19 nt, Homo sapiens
guacaaugcugagcugucu

SEQ ID NO: 707637 - RNA, 19 nt, Homo sapiens
ggauuccacuccaguaaag

SEQ ID NO: 707638 - RNA, 19 nt, Homo sapiens
agucaggucuucccagauu

SEQ ID NO: 707639 - RNA, 19 nt, Homo sapiens
caagaagaaugacgauggu

SEQ ID NO: 707640 - RNA, 19 nt, Homo sapiens
caggaaggagccauuauuu

SEQ ID NO: 707641 - RNA, 19 nt, Homo sapiens
gauauuggacauggaguaa

SEQ ID NO: 707642 - RNA, 19 nt, Homo sapiens
aaagcaagcugagucugaa

SEQ ID NO: 707643 - RNA, 19 nt, Homo sapiens
ccacuccaguaaaguagaa

SEQ ID NO: 707644 - RNA, 19 nt, Homo sapiens
gagcagcagucgagagaac

SEQ ID NO: 707645 - RNA, 19 nt, Homo sapiens
caaagaaaucgaacuuaca

SEQ ID NO: 707646 - RNA, 19 nt, Homo sapiens
ccaacaauguccugcagau

SEQ ID NO: 707647 - RNA, 19 nt, Homo sapiens
guagaaugaaggauacaaa

SEQ ID NO: 707648 - RNA, 19 nt, Homo sapiens
aaggagccauuauuuaugu

SEQ ID NO: 707649 - RNA, 19 nt, Homo sapiens
caacaccuccaacucagaa

SEQ ID NO: 707650 - RNA, 19 nt, Homo sapiens
augcugagcugucuggauu

SEQ ID NO: 707651 - RNA, 19 nt, Homo sapiens
ccaguaaaguagaaugaag

SEQ ID NO: 707652 - RNA, 19 nt, Homo sapiens
ggaaaagguuguggcaauu

SEQ ID NO: 707653 - RNA, 19 nt, Homo sapiens
aagcugcugugguugagua

SEQ ID NO: 707654 - RNA, 19 nt, Homo sapiens
gcugagcugucuggauuga

SEQ ID NO: 707655 - RNA, 19 nt, Homo sapiens
aggaaggagccauuauuua

SEQ ID NO: 707656 - RNA, 19 nt, Homo sapiens
ucacaaacaagccuucaga

SEQ ID NO: 707657 - RNA, 19 nt, Homo sapiens
caagcugagucugaacaaa

SEQ ID NO: 707658 - RNA, 19 nt, Homo sapiens
aaaguagaaugaaggauac

SEQ ID NO: 707659 - RNA, 19 nt, Homo sapiens
gugaguacccagaacauga

SEQ ID NO: 707660 - RNA, 19 nt, Homo sapiens
aaaagguuguggcaauuua

SEQ ID NO: 707661 - RNA, 19 nt, Homo sapiens
ccaaaugauuacguaccua

SEQ ID NO: 707662 - RNA, 19 nt, Homo sapiens
ucacaaacaguugauauuc

SEQ ID NO: 707663 - RNA, 19 nt, Homo sapiens
uaaacaccuuggccaacaa

SEQ ID NO: 707664 - RNA, 19 nt, Homo sapiens
gugcuugccucacaggaau

SEQ ID NO: 707665 - RNA, 19 nt, Homo sapiens
gagucuaucaugcauuauu

SEQ ID NO: 707666 - RNA, 19 nt, Homo sapiens
ucaggaaggagccauuauu

SEQ ID NO: 707667 - RNA, 19 nt, Homo sapiens
caugcauuauucugaguaa

SEQ ID NO: 707668 - RNA, 19 nt, Homo sapiens
gaauuacguugagucuauc

SEQ ID NO: 707669 - RNA, 19 nt, Homo sapiens
ggcaauuuaugacuauaca

SEQ ID NO: 707670 - RNA, 19 nt, Homo sapiens
cagcuucugugaaucaaag

SEQ ID NO: 707671 - RNA, 19 nt, Homo sapiens
aagagaaaguugcaagaag

SEQ ID NO: 707672 - RNA, 19 nt, Homo sapiens
uaaagagaaaguugcaaga

SEQ ID NO: 707673 - RNA, 19 nt, Homo sapiens
gguaugagggaguuaugaa

SEQ ID NO: 707674 - RNA, 19 nt, Homo sapiens
caaaagacaaggaagauga

SEQ ID NO: 707675 - RNA, 19 nt, Homo sapiens
ccagugguaccaaaugauu

SEQ ID NO: 707676 - RNA, 19 nt, Homo sapiens
uacauacagucagcagaua

SEQ ID NO: 707677 - RNA, 19 nt, Homo sapiens
cagaauccaguaucucuug

SEQ ID NO: 707678 - RNA, 19 nt, Homo sapiens
uagacgcccuccuuccauu

SEQ ID NO: 707679 - RNA, 19 nt, Homo sapiens
gaagaaaccaaagccuaca

SEQ ID NO: 707680 - RNA, 19 nt, Homo sapiens
acacuucaaggacacauaa

SEQ ID NO: 707681 - RNA, 19 nt, Homo sapiens
aaagagaaaguugcaagaa

SEQ ID NO: 707682 - RNA, 19 nt, Homo sapiens
aggauggaaucuucaauca

SEQ ID NO: 707683 - RNA, 19 nt, Homo sapiens
gucaggucuucccagauua

SEQ ID NO: 707684 - RNA, 19 nt, Homo sapiens
cugaacaaauggaucuuuc

SEQ ID NO: 707685 - RNA, 19 nt, Homo sapiens
gggauuccacuccaguaaa

SEQ ID NO: 707686 - RNA, 19 nt, Homo sapiens
ggaagaugagcuguccuuu

SEQ ID NO: 707687 - RNA, 19 nt, Homo sapiens
ugaguauagugauccuuau

SEQ ID NO: 707688 - RNA, 19 nt, Homo sapiens
acuccucaguuaccuuuaa

SEQ ID NO: 707689 - RNA, 19 nt, Homo sapiens
acaaacaagccuucagaau

SEQ ID NO: 707690 - RNA, 19 nt, Homo sapiens
ggauggaaucuucaaucaa

SEQ ID NO: 707691 - RNA, 19 nt, Homo sapiens
uccagaagauuacgaagag

SEQ ID NO: 707692 - RNA, 19 nt, Homo sapiens
uauuggacauggaguaaag

SEQ ID NO: 707693 - RNA, 19 nt, Homo sapiens
gaccaguucguuauauuag

SEQ ID NO: 707694 - RNA, 19 nt, Homo sapiens
gaucuuucugccaucauuu

SEQ ID NO: 707695 - RNA, 19 nt, Homo sapiens
ggaguuaugaauggaguga

SEQ ID NO: 707696 - RNA, 19 nt, Homo sapiens
auaaacaccuuggccaaca

SEQ ID NO: 707697 - RNA, 19 nt, Homo sapiens
gaaaagguuguggcaauuu

SEQ ID NO: 707698 - RNA, 19 nt, Homo sapiens
ggaagcugcugugguugag

SEQ ID NO: 707699 - RNA, 19 nt, Homo sapiens
caaaggacaucaguuaaua

SEQ ID NO: 707700 - RNA, 19 nt, Homo sapiens
caacagaugccaccauuua

SEQ ID NO: 707701 - RNA, 19 nt, Homo sapiens
agacagacuuuguuacuua

SEQ ID NO: 707702 - RNA, 19 nt, Homo sapiens
gaaaggaugauauggauuu

SEQ ID NO: 707703 - RNA, 19 nt, Homo sapiens
gaagacugauauuauggua

SEQ ID NO: 707704 - RNA, 19 nt, Homo sapiens
ggacaucaguuaauaaggu

SEQ ID NO: 707705 - RNA, 19 nt, Homo sapiens
ugacuuugcuggcucauuu

SEQ ID NO: 707706 - RNA, 19 nt, Homo sapiens
uaacaagccugaggaagaa

SEQ ID NO: 707707 - RNA, 19 nt, Homo sapiens
gaaguccacuccaaaguca

SEQ ID NO: 707708 - RNA, 19 nt, Homo sapiens
ggauuucacucuaaugaga

SEQ ID NO: 707709 - RNA, 19 nt, Homo sapiens
gaacagaauugccacaaaa

SEQ ID NO: 707710 - RNA, 19 nt, Homo sapiens
caaagucaguacuaagaaa

SEQ ID NO: 707711 - RNA, 19 nt, Homo sapiens
gcuccaaagcucaauauua

SEQ ID NO: 707712 - RNA, 19 nt, Homo sapiens
caagcaagauuaccuuaug

SEQ ID NO: 707713 - RNA, 19 nt, Homo sapiens
gaaagugaauuggcuaaca

SEQ ID NO: 707714 - RNA, 19 nt, Homo sapiens
guaaacaucccaauaugaa

SEQ ID NO: 707715 - RNA, 19 nt, Homo sapiens
uagaagacguggaugauga

SEQ ID NO: 707716 - RNA, 19 nt, Homo sapiens
gaaaggugggaaacaguua

SEQ ID NO: 707717 - RNA, 19 nt, Homo sapiens
cuccaaagcucaauauuau

SEQ ID NO: 707718 - RNA, 19 nt, Homo sapiens
gcaagucucaaacagcuua

SEQ ID NO: 707719 - RNA, 19 nt, Homo sapiens
ugaagaauuugcugaaguu

SEQ ID NO: 707720 - RNA, 19 nt, Homo sapiens
uaaauacgauccauucagu

SEQ ID NO: 707721 - RNA, 19 nt, Homo sapiens
aacaaggacucaagagaua

SEQ ID NO: 707722 - RNA, 19 nt, Homo sapiens
gagcuaaggauaacacauu

SEQ ID NO: 707723 - RNA, 19 nt, Homo sapiens
cucaugagcugcuuuguaa

SEQ ID NO: 707724 - RNA, 19 nt, Homo sapiens
guacagcaaugaauauucu

SEQ ID NO: 707725 - RNA, 19 nt, Homo sapiens
gggaaacuauauucaguau

SEQ ID NO: 707726 - RNA, 19 nt, Homo sapiens
gaagauggaggaacauuca

SEQ ID NO: 707727 - RNA, 19 nt, Homo sapiens
gaaguuucuuuaggaagua

SEQ ID NO: 707728 - RNA, 19 nt, Homo sapiens
gaugaaguuucuuuaggaa

SEQ ID NO: 707729 - RNA, 19 nt, Homo sapiens
agacguggaugaugaagaa

SEQ ID NO: 707730 - RNA, 19 nt, Homo sapiens
guaacaagccugaggaaga

SEQ ID NO: 707731 - RNA, 19 nt, Homo sapiens
ggaugcagaugaagaaagu

SEQ ID NO: 707732 - RNA, 19 nt, Homo sapiens
gauccaaguuugauaacau

SEQ ID NO: 707733 - RNA, 19 nt, Homo sapiens
uaaccuggaugacgaugaa

SEQ ID NO: 707734 - RNA, 19 nt, Homo sapiens
agacaaagaaacagagaua

SEQ ID NO: 707735 - RNA, 19 nt, Homo sapiens
ucugaaagcugacauugug

SEQ ID NO: 707736 - RNA, 19 nt, Homo sapiens
gguaugaucuggaguacag

SEQ ID NO: 707737 - RNA, 19 nt, Homo sapiens
gugggaaacaguuaaauaa

SEQ ID NO: 707738 - RNA, 19 nt, Homo sapiens
aaacagcagugccuuaugg

SEQ ID NO: 707739 - RNA, 19 nt, Homo sapiens
ggaggcaaaugguaugauc

SEQ ID NO: 707740 - RNA, 19 nt, Homo sapiens
gaagaugaaccagcugaaa

SEQ ID NO: 707741 - RNA, 19 nt, Homo sapiens
cgaugaaguuucuuuagga

SEQ ID NO: 707742 - RNA, 19 nt, Homo sapiens
ggugggaaacaguuaaaua

SEQ ID NO: 707743 - RNA, 19 nt, Homo sapiens
cuuuauaucuugugucuga

SEQ ID NO: 707744 - RNA, 19 nt, Homo sapiens
gcagauugacacacuguuu

SEQ ID NO: 707745 - RNA, 19 nt, Homo sapiens
caacaaggacucaagagau

SEQ ID NO: 707746 - RNA, 19 nt, Homo sapiens
gauaacacauuagaugaag

SEQ ID NO: 707747 - RNA, 19 nt, Homo sapiens
aaacugauguagaaaccaa

SEQ ID NO: 707748 - RNA, 19 nt, Homo sapiens
gcucaaauaucagcuccaa

SEQ ID NO: 707749 - RNA, 19 nt, Homo sapiens
agucaaaggacaucaguua

SEQ ID NO: 707750 - RNA, 19 nt, Homo sapiens
ucagcaaggugaauuggaa

SEQ ID NO: 707751 - RNA, 19 nt, Homo sapiens
uaggaaguauggaugauga

SEQ ID NO: 707752 - RNA, 19 nt, Homo sapiens
ggauaacacauuagaugaa

SEQ ID NO: 707753 - RNA, 19 nt, Homo sapiens
aaagugaauuggcuaacaa

SEQ ID NO: 707754 - RNA, 19 nt, Homo sapiens
gcaacaaggacucaagaga

SEQ ID NO: 707755 - RNA, 19 nt, Homo sapiens
gcaaacagcagugccuuau

SEQ ID NO: 707756 - RNA, 19 nt, Homo sapiens
gagacagacuuuguuacuu

SEQ ID NO: 707757 - RNA, 19 nt, Homo sapiens
ugaaugccauggcuaacaa

SEQ ID NO: 707758 - RNA, 19 nt, Homo sapiens
ggaugacgaugaaguuucu

SEQ ID NO: 707759 - RNA, 19 nt, Homo sapiens
cguggaugaugaagaauuu

SEQ ID NO: 707760 - RNA, 19 nt, Homo sapiens
cagauugacacacuguuua

SEQ ID NO: 707761 - RNA, 19 nt, Homo sapiens
ggccuuggauacuuucaaa

SEQ ID NO: 707762 - RNA, 19 nt, Homo sapiens
gcagccaugauucuucuua

SEQ ID NO: 707763 - RNA, 19 nt, Homo sapiens
ugagagacagacuuuguua

SEQ ID NO: 707764 - RNA, 19 nt, Homo sapiens
gggacccacugcaggauuu

SEQ ID NO: 707765 - RNA, 19 nt, Homo sapiens
gggugcacuuugauaauuu

SEQ ID NO: 707766 - RNA, 19 nt, Homo sapiens
uguccaggcuuuaauguug

SEQ ID NO: 707767 - RNA, 19 nt, Homo sapiens
aaaguaagacgaauaguca

SEQ ID NO: 707768 - RNA, 19 nt, Homo sapiens
gaucuggaguacagcaaug

SEQ ID NO: 707769 - RNA, 19 nt, Homo sapiens
gaaaagguacagaugauuu

SEQ ID NO: 707770 - RNA, 19 nt, Homo sapiens
caagcaagcuauguuucuu

SEQ ID NO: 707771 - RNA, 19 nt, Homo sapiens
gacuggugaugacaaagua

SEQ ID NO: 707772 - RNA, 19 nt, Homo sapiens
ucacacacuucaguuugua

SEQ ID NO: 707773 - RNA, 19 nt, Homo sapiens
gaaccacauucugaugaga

SEQ ID NO: 707774 - RNA, 19 nt, Homo sapiens
agaauuugcugaaguugau

SEQ ID NO: 707775 - RNA, 19 nt, Homo sapiens
caaagaaacagagauagug

SEQ ID NO: 707776 - RNA, 19 nt, Homo sapiens
gucaacagaugccaccauu

SEQ ID NO: 707777 - RNA, 19 nt, Homo sapiens
gcaggucuuagaaacuuua

SEQ ID NO: 707778 - RNA, 19 nt, Homo sapiens
gugcaggucuuagaaacuu

SEQ ID NO: 707779 - RNA, 19 nt, Homo sapiens
ggaguacagcaaugaauau

SEQ ID NO: 707780 - RNA, 19 nt, Homo sapiens
caccgaaaguaaagaaaga

SEQ ID NO: 707781 - RNA, 19 nt, Homo sapiens
aauaugggauccaaguuug

SEQ ID NO: 707782 - RNA, 19 nt, Homo sapiens
uguaucugcugaagaguuu

SEQ ID NO: 707783 - RNA, 19 nt, Homo sapiens
aaguauggaugaugaagaa

SEQ ID NO: 707784 - RNA, 19 nt, Homo sapiens
acagaugccaccauuuaua

SEQ ID NO: 707785 - RNA, 19 nt, Homo sapiens
agugauagauggaggcaaa

SEQ ID NO: 707786 - RNA, 19 nt, Homo sapiens
aagaguugcuuaucacaga

SEQ ID NO: 707787 - RNA, 19 nt, Homo sapiens
uguguuagaugaugaaagu

SEQ ID NO: 707788 - RNA, 19 nt, Homo sapiens
gaaguauggaugaugaaga

SEQ ID NO: 707789 - RNA, 19 nt, Homo sapiens
ugaaguuucuuuaggaagu

SEQ ID NO: 707790 - RNA, 19 nt, Homo sapiens
gaaagcugacauuguguug

SEQ ID NO: 707791 - RNA, 19 nt, Homo sapiens
cuacaaaucucugaaagcu

SEQ ID NO: 707792 - RNA, 19 nt, Homo sapiens
ggacucaagagauagaaga

SEQ ID NO: 707793 - RNA, 19 nt, Homo sapiens
cucaggauguuguaucuaa

SEQ ID NO: 707794 - RNA, 19 nt, Homo sapiens
ugaagaguuuggccaucua

SEQ ID NO: 707795 - RNA, 19 nt, Homo sapiens
ugaaguugaugaagaugga

SEQ ID NO: 707796 - RNA, 19 nt, Homo sapiens
ugacacauuugaagaugau

SEQ ID NO: 707797 - RNA, 19 nt, Homo sapiens
ccaaauaccaguggaugaa

SEQ ID NO: 707798 - RNA, 19 nt, Homo sapiens
ucaaauaucagcuccaaag

SEQ ID NO: 707799 - RNA, 19 nt, Homo sapiens
gcacauagguuccacuuug

SEQ ID NO: 707800 - RNA, 19 nt, Homo sapiens
ucaaauggauccacuauaa

SEQ ID NO: 707801 - RNA, 19 nt, Homo sapiens
gaaauucucucuuccauca

SEQ ID NO: 707802 - RNA, 19 nt, Homo sapiens
aaacaacucuugcauguaa

SEQ ID NO: 707803 - RNA, 19 nt, Homo sapiens
ggaaagaaaugaaggaugu

SEQ ID NO: 707804 - RNA, 19 nt, Homo sapiens
ggaagaagcucagaaacaa

SEQ ID NO: 707805 - RNA, 19 nt, Homo sapiens
uuacaggucuucuacauua

SEQ ID NO: 707806 - RNA, 19 nt, Homo sapiens
gaaguggccuugacagaaa

SEQ ID NO: 707807 - RNA, 19 nt, Homo sapiens
ggagauggccaguuacuua

SEQ ID NO: 707808 - RNA, 19 nt, Homo sapiens
ucagacagauucaacuuua

SEQ ID NO: 707809 - RNA, 19 nt, Homo sapiens
cuacaaagauguuucaguu

SEQ ID NO: 707810 - RNA, 19 nt, Homo sapiens
ggaaagaggugaggagaau

SEQ ID NO: 707811 - RNA, 19 nt, Homo sapiens
gagcuacucugugucguua

SEQ ID NO: 707812 - RNA, 19 nt, Homo sapiens
guccagagguuaucuauga

SEQ ID NO: 707813 - RNA, 19 nt, Homo sapiens
caaagugcauggugaagaa

SEQ ID NO: 707814 - RNA, 19 nt, Homo sapiens
cuaauaagcuucucuaugc

SEQ ID NO: 707815 - RNA, 19 nt, Homo sapiens
caacuagaauugcuggaaa

SEQ ID NO: 707816 - RNA, 19 nt, Homo sapiens
ccaaggauaucccaaccua

SEQ ID NO: 707817 - RNA, 19 nt, Homo sapiens
caaacagagucaacaacua

SEQ ID NO: 707818 - RNA, 19 nt, Homo sapiens
gaugaccacugccauuuga

SEQ ID NO: 707819 - RNA, 19 nt, Homo sapiens
acacagaacuggaagugaa

SEQ ID NO: 707820 - RNA, 19 nt, Homo sapiens
ccucagaaauggaagaauu

SEQ ID NO: 707821 - RNA, 19 nt, Homo sapiens
gcaaagcccuguacacacu

SEQ ID NO: 707822 - RNA, 19 nt, Homo sapiens
ccacauuguucccuuauau

SEQ ID NO: 707823 - RNA, 19 nt, Homo sapiens
ggaaggaagcaccaacuaa

SEQ ID NO: 707824 - RNA, 19 nt, Homo sapiens
gcagauggauaaauuggau

SEQ ID NO: 707825 - RNA, 19 nt, Homo sapiens
agaaacaacucuugcaugu

SEQ ID NO: 707826 - RNA, 19 nt, Homo sapiens
gaaggaagcaccaacuaau

SEQ ID NO: 707827 - RNA, 19 nt, Homo sapiens
gcaaacugcaauaaacaua

SEQ ID NO: 707828 - RNA, 19 nt, Homo sapiens
aagcacaaguucaaaguaa

SEQ ID NO: 707829 - RNA, 19 nt, Homo sapiens
gaucuuaccaccauccuuu

SEQ ID NO: 707830 - RNA, 19 nt, Homo sapiens
ggauuugccuccauuguca

SEQ ID NO: 707831 - RNA, 19 nt, Homo sapiens
ggguaaacauccugaagaa

SEQ ID NO: 707832 - RNA, 19 nt, Homo sapiens
ccucuucgcuucuggguaa

SEQ ID NO: 707833 - RNA, 19 nt, Homo sapiens
aauauuguguggcgacuua

SEQ ID NO: 707834 - RNA, 19 nt, Homo sapiens
ucaaggagauuguguacau

SEQ ID NO: 707835 - RNA, 19 nt, Homo sapiens
gaagaacccucaguuuguc

SEQ ID NO: 707836 - RNA, 19 nt, Homo sapiens
ggagagcccuucuauuugc

SEQ ID NO: 707837 - RNA, 19 nt, Homo sapiens
ucggagagcccuucuauuu

SEQ ID NO: 707838 - RNA, 19 nt, Homo sapiens
cgaccaagguggcaauuca

SEQ ID NO: 707839 - RNA, 19 nt, Homo sapiens
agagauacgugacggcuuu

SEQ ID NO: 707840 - RNA, 19 nt, Homo sapiens
ucaauguucucgacuguga

SEQ ID NO: 707841 - RNA, 19 nt, Homo sapiens
cauuaaacgucgucuuuga

SEQ ID NO: 707842 - RNA, 19 nt, Homo sapiens
ugaagaauguggacucuag

SEQ ID NO: 707843 - RNA, 19 nt, Homo sapiens
gaaaugcaaguggauguaa

SEQ ID NO: 707844 - RNA, 19 nt, Homo sapiens
gagauuguguacauucaga

SEQ ID NO: 707845 - RNA, 19 nt, Homo sapiens
caacagcagagcuccauuu

SEQ ID NO: 707846 - RNA, 19 nt, Homo sapiens
gaagcacaaguucaaagua

SEQ ID NO: 707847 - RNA, 19 nt, Homo sapiens
gauggaaucaccaagcuaa

SEQ ID NO: 707848 - RNA, 19 nt, Homo sapiens
gggcagaaauuuugaugua

SEQ ID NO: 707849 - RNA, 19 nt, Homo sapiens
gcccuaaucuguaauaaaa

SEQ ID NO: 707850 - RNA, 19 nt, Homo sapiens
ggaaagcgagcuccggaaa

SEQ ID NO: 707851 - RNA, 19 nt, Homo sapiens
cagaaaguaucgacauuag

SEQ ID NO: 707852 - RNA, 19 nt, Homo sapiens
ggcuuaaucuggcaaaguu

SEQ ID NO: 707853 - RNA, 19 nt, Homo sapiens
gugggaagcuucucuccaa

SEQ ID NO: 707854 - RNA, 19 nt, Homo sapiens
gagcuccauuugcuauaaa

SEQ ID NO: 707855 - RNA, 19 nt, Homo sapiens
caaaugggcacacgacaga

SEQ ID NO: 707856 - RNA, 19 nt, Homo sapiens
ggaacaguguaguaacaug

SEQ ID NO: 707857 - RNA, 19 nt, Homo sapiens
ucacugaagauaugcauaa

SEQ ID NO: 707858 - RNA, 19 nt, Homo sapiens
uaaaugacacccacaugaa

SEQ ID NO: 707859 - RNA, 19 nt, Homo sapiens
gagauggccaguuacuuaa

SEQ ID NO: 707860 - RNA, 19 nt, Homo sapiens
caaccaaucgcaucaucua

SEQ ID NO: 707861 - RNA, 19 nt, Homo sapiens
gaaacaacucuugcaugua

SEQ ID NO: 707862 - RNA, 19 nt, Homo sapiens
caaagcugcugucgaccaa

SEQ ID NO: 707863 - RNA, 19 nt, Homo sapiens
ugaaauuggucuugagcuu

SEQ ID NO: 707864 - RNA, 19 nt, Homo sapiens
ucaguacuguggcauuaaa

SEQ ID NO: 707865 - RNA, 19 nt, Homo sapiens
aaagcgagcuccggaaaga

SEQ ID NO: 707866 - RNA, 19 nt, Homo sapiens
gaaccaguaccugugauaa

SEQ ID NO: 707867 - RNA, 19 nt, Homo sapiens
gcaucgaacaucacaauga

SEQ ID NO: 707868 - RNA, 19 nt, Homo sapiens
gaaccaaccaggcuuuaca

SEQ ID NO: 707869 - RNA, 19 nt, Homo sapiens
caacuaauaagcuucucua

SEQ ID NO: 707870 - RNA, 19 nt, Homo sapiens
acaaacagccuuccucuuc

SEQ ID NO: 707871 - RNA, 19 nt, Homo sapiens
cacaugaaauucucucuuc

SEQ ID NO: 707872 - RNA, 19 nt, Homo sapiens
guaacgggagcaaacuuua

SEQ ID NO: 707873 - RNA, 19 nt, Homo sapiens
caaauggauccacuauaaa

SEQ ID NO: 707874 - RNA, 19 nt, Homo sapiens
cuuauggacuucagcuuaa

SEQ ID NO: 707875 - RNA, 19 nt, Homo sapiens
gaggaagacccaaggagaa

SEQ ID NO: 707876 - RNA, 19 nt, Homo sapiens
ugaagaacccucaguuugu

SEQ ID NO: 707877 - RNA, 19 nt, Homo sapiens
gcagagcuccauuugcuau

SEQ ID NO: 707878 - RNA, 19 nt, Homo sapiens
uagaagcauuuggaguuua

SEQ ID NO: 707879 - RNA, 19 nt, Homo sapiens
ggcauuaaacgucgucuuu

SEQ ID NO: 707880 - RNA, 19 nt, Homo sapiens
uaaauuggaugugguugau

SEQ ID NO: 707881 - RNA, 19 nt, Homo sapiens
gagcugagucgcaaacaga

SEQ ID NO: 707882 - RNA, 19 nt, Homo sapiens
ggaaccaguaccugugaua

SEQ ID NO: 707883 - RNA, 19 nt, Homo sapiens
gagagccacugcaaagaag

SEQ ID NO: 707884 - RNA, 19 nt, Homo sapiens
uggaugcccuaaucuguaa

SEQ ID NO: 707885 - RNA, 19 nt, Homo sapiens
gaaagaguccaaccaaucg

SEQ ID NO: 707886 - RNA, 19 nt, Homo sapiens
gaagacaccacauauagac

SEQ ID NO: 707887 - RNA, 19 nt, Homo sapiens
gagggaagcacaaguucaa

SEQ ID NO: 707888 - RNA, 19 nt, Homo sapiens
ugaaauuacucucuuccau

SEQ ID NO: 707889 - RNA, 19 nt, Homo sapiens
gaaaugaaggaugugugua

SEQ ID NO: 707890 - RNA, 19 nt, Homo sapiens
ucaucuaccuugauccauu

SEQ ID NO: 707891 - RNA, 19 nt, Homo sapiens
cacagaaaguaucgacauu

SEQ ID NO: 707892 - RNA, 19 nt, Homo sapiens
uaccaacugcucaucauua

SEQ ID NO: 707893 - RNA, 19 nt, Homo sapiens
caaauuguccagagguuau

SEQ ID NO: 707894 - RNA, 19 nt, Homo sapiens
cgacaguuccuccgugauu

SEQ ID NO: 707895 - RNA, 19 nt, Homo sapiens
ucacccacaucuucacuga

SEQ ID NO: 707896 - RNA, 19 nt, Homo sapiens
uggaugugguugauaguuu

SEQ ID NO: 707897 - RNA, 19 nt, Homo sapiens
cuaaaugacacccacauga

SEQ ID NO: 707898 - RNA, 19 nt, Homo sapiens
ucacaaugauccugaaagg

SEQ ID NO: 707899 - RNA, 19 nt, Homo sapiens
ggacaaacaugcaacauug

SEQ ID NO: 707900 - RNA, 19 nt, Homo sapiens
gcaaguggaugucaagaug

SEQ ID NO: 707901 - RNA, 19 nt, Homo sapiens
ccaaagacaucguggagaa

SEQ ID NO: 707902 - RNA, 19 nt, Homo sapiens
caacagugcuucuccaaag

SEQ ID NO: 707903 - RNA, 19 nt, Homo sapiens
gcaggaaggcuauggcuuu

SEQ ID NO: 707904 - RNA, 19 nt, Homo sapiens
gaccaaaccugugcuuaug

SEQ ID NO: 707905 - RNA, 19 nt, Homo sapiens
gaugaucccuacucaagug

SEQ ID NO: 707906 - RNA, 19 nt, Homo sapiens
caaguuaacugaggacaag

SEQ ID NO: 707907 - RNA, 19 nt, Homo sapiens
cggcagcacuggaccauga

SEQ ID NO: 707908 - RNA, 19 nt, Homo sapiens
ucaagcaauucaacaaguu

SEQ ID NO: 707909 - RNA, 19 nt, Homo sapiens
gagaugaucccuacucaag

SEQ ID NO: 707910 - RNA, 19 nt, Homo sapiens
caagcaauucaacaaguua

SEQ ID NO: 707911 - RNA, 19 nt, Homo sapiens
gcauggccauugucaagga

SEQ ID NO: 707912 - RNA, 19 nt, Homo sapiens
gccgugugcuggucaauga

SEQ ID NO: 707913 - RNA, 19 nt, Homo sapiens
gcggaaaugugagcgugua

SEQ ID NO: 707914 - RNA, 19 nt, Homo sapiens
ggaugacagugccaccauu

SEQ ID NO: 707915 - RNA, 19 nt, Homo sapiens
ugaccaagauccagaagca

SEQ ID NO: 707916 - RNA, 19 nt, Homo sapiens
gcacuagcugugaggauaa

SEQ ID NO: 707917 - RNA, 19 nt, Homo sapiens
gacggaggcugccauugga

SEQ ID NO: 707918 - RNA, 19 nt, Homo sapiens
ucaugaaggagcugaauaa

SEQ ID NO: 707919 - RNA, 19 nt, Homo sapiens
gaugacagugccaccauuu

SEQ ID NO: 707920 - RNA, 19 nt, Homo sapiens
acugaggacuacaaccuua

SEQ ID NO: 707921 - RNA, 19 nt, Homo sapiens
aagacaucguggagaauua

SEQ ID NO: 707922 - RNA, 19 nt, Homo sapiens
ggucaaugaugcccagaag

SEQ ID NO: 707923 - RNA, 19 nt, Homo sapiens
gggacaaacaugcaacauu

SEQ ID NO: 707924 - RNA, 19 nt, Homo sapiens
ccaaccagcggaaauguga

SEQ ID NO: 707925 - RNA, 19 nt, Homo sapiens
gaagagcaccaaggagguu

SEQ ID NO: 707926 - RNA, 19 nt, Homo sapiens
gcaacagugcuucuccaaa

SEQ ID NO: 707927 - RNA, 19 nt, Homo sapiens
ggccuguagugccugcuua

SEQ ID NO: 707928 - RNA, 19 nt, Homo sapiens
gaaaugugagcguguacug

SEQ ID NO: 707929 - RNA, 19 nt, Homo sapiens
gaacguacugucuauugca

SEQ ID NO: 707930 - RNA, 19 nt, Homo sapiens
caagagugccgaggccuuu

SEQ ID NO: 707931 - RNA, 19 nt, Homo sapiens
gcaacguacacaagcauga

SEQ ID NO: 707932 - RNA, 19 nt, Homo sapiens
caggcgaucugguuaugug

SEQ ID NO: 707933 - RNA, 19 nt, Homo sapiens
caggaaggcuauggcuuug

SEQ ID NO: 707934 - RNA, 19 nt, Homo sapiens
gagcacauucugcgcuuug

SEQ ID NO: 707935 - RNA, 19 nt, Homo sapiens
ccacaaggaccaccaguac

SEQ ID NO: 707936 - RNA, 19 nt, Homo sapiens
ugcacuagcugugaggaua

SEQ ID NO: 707937 - RNA, 19 nt, Homo sapiens
gaggugagcggccuuaugc

SEQ ID NO: 707938 - RNA, 19 nt, Homo sapiens
ccaccaguaccaguucuua

SEQ ID NO: 707939 - RNA, 19 nt, Homo sapiens
gugaacguacugucuauug

SEQ ID NO: 707940 - RNA, 19 nt, Homo sapiens
gugcaaccagugugaguuu

SEQ ID NO: 707941 - RNA, 19 nt, Homo sapiens
gagaccaaaccugugcuua

SEQ ID NO: 707942 - RNA, 19 nt, Homo sapiens
cguggagaauuauuucaug

SEQ ID NO: 707943 - RNA, 19 nt, Homo sapiens
caacacagcccuuuugcuu

SEQ ID NO: 707944 - RNA, 19 nt, Homo sapiens
ccaggugucugacguacag

SEQ ID NO: 707945 - RNA, 19 nt, Homo sapiens
gacaacaacacagcccuuu

SEQ ID NO: 707946 - RNA, 19 nt, Homo sapiens
gcgaucugguuaugugcaa

SEQ ID NO: 707947 - RNA, 19 nt, Homo sapiens
agaccaaaccugugcuuau

SEQ ID NO: 707948 - RNA, 19 nt, Homo sapiens
ggagacggaggcugccauu

SEQ ID NO: 707949 - RNA, 19 nt, Homo sapiens
cucaaugccuggaccaaga

SEQ ID NO: 707950 - RNA, 19 nt, Homo sapiens
ccacauggcgagaugaagu

SEQ ID NO: 707951 - RNA, 19 nt, Homo sapiens
ggagcacauucugcgcuuu

SEQ ID NO: 707952 - RNA, 19 nt, Homo sapiens
caacguacacaagcaugaa

SEQ ID NO: 707953 - RNA, 19 nt, Homo sapiens
ugagggcccugagaccaaa

SEQ ID NO: 707954 - RNA, 19 nt, Homo sapiens
gcagagcguccuggcacua

SEQ ID NO: 707955 - RNA, 19 nt, Homo sapiens
ggcgagcgguugugcuugu

SEQ ID NO: 707956 - RNA, 19 nt, Homo sapiens
ugugagagcugugauacuc

SEQ ID NO: 707957 - RNA, 19 nt, Homo sapiens
aaagacaucguggagaauu

SEQ ID NO: 707958 - RNA, 19 nt, Homo sapiens
cgaggccuuuggcaagauu

SEQ ID NO: 707959 - RNA, 19 nt, Homo sapiens
gccgaggccuuuggcaaga

SEQ ID NO: 707960 - RNA, 19 nt, Homo sapiens
ucuaagaaguugaucuacu

SEQ ID NO: 707961 - RNA, 19 nt, Homo sapiens
gcaagcuccuggccucacu

SEQ ID NO: 707962 - RNA, 19 nt, Homo sapiens
caacaacacagcccuuuug

SEQ ID NO: 707963 - RNA, 19 nt, Homo sapiens
ggagagugacaacaacaca

SEQ ID NO: 707964 - RNA, 19 nt, Homo sapiens
ggccgcauguucaagcaau

SEQ ID NO: 707965 - RNA, 19 nt, Homo sapiens
ggagaugaucccuacucaa

SEQ ID NO: 707966 - RNA, 19 nt, Homo sapiens
ucaaugaugcccagaaggu

SEQ ID NO: 707967 - RNA, 19 nt, Homo sapiens
gaggacuacaaccuuauug

SEQ ID NO: 707968 - RNA, 19 nt, Homo sapiens
ccaugugucaggugugaaa

SEQ ID NO: 707969 - RNA, 19 nt, Homo sapiens
ggaccaccaguaccaguuc

SEQ ID NO: 707970 - RNA, 19 nt, Homo sapiens
uacugucuauugcaacgua

SEQ ID NO: 707971 - RNA, 19 nt, Homo sapiens
ggaggugcaggaaggcuau

SEQ ID NO: 707972 - RNA, 19 nt, Homo sapiens
gaccauacugugcgcucua

SEQ ID NO: 707973 - RNA, 19 nt, Homo sapiens
gaucaugaaggagcugaau

SEQ ID NO: 707974 - RNA, 19 nt, Homo sapiens
guguacugcuggcccuauu

SEQ ID NO: 707975 - RNA, 19 nt, Homo sapiens
acagaagcgugugcaagug

SEQ ID NO: 707976 - RNA, 19 nt, Homo sapiens
ggaguuugcccaggaugug

SEQ ID NO: 707977 - RNA, 19 nt, Homo sapiens
acacagcccuuuugcuuuc

SEQ ID NO: 707978 - RNA, 19 nt, Homo sapiens
gcaauucaacaaguuaacu

SEQ ID NO: 707979 - RNA, 19 nt, Homo sapiens
agacggaggcugccauugg

SEQ ID NO: 707980 - RNA, 19 nt, Homo sapiens
aacagugcuucuccaaaga

SEQ ID NO: 707981 - RNA, 19 nt, Homo sapiens
ugaacguacugucuauugc

SEQ ID NO: 707982 - RNA, 19 nt, Homo sapiens
cccaguuccucacgauaug

SEQ ID NO: 707983 - RNA, 19 nt, Homo sapiens
gcugcucacucugccaugu

SEQ ID NO: 707984 - RNA, 19 nt, Homo sapiens
ugaggacuacaaccuuauu

SEQ ID NO: 707985 - RNA, 19 nt, Homo sapiens
caucguggagaauuauuuc

SEQ ID NO: 707986 - RNA, 19 nt, Homo sapiens
gcaccaggagcacauucug

SEQ ID NO: 707987 - RNA, 19 nt, Homo sapiens
gaagcaccaggagcacauu

SEQ ID NO: 707988 - RNA, 19 nt, Homo sapiens
gauggugaacguacugucu

SEQ ID NO: 707989 - RNA, 19 nt, Homo sapiens
guaccacugaggacuacaa

SEQ ID NO: 707990 - RNA, 19 nt, Homo sapiens
cagagcguccuggcacuaa

SEQ ID NO: 707991 - RNA, 19 nt, Homo sapiens
gaaguacaccaaggaccau

SEQ ID NO: 707992 - RNA, 19 nt, Homo sapiens
uacagaagcgugugcaagu

SEQ ID NO: 707993 - RNA, 19 nt, Homo sapiens
ccagcucaaugcccacaag

SEQ ID NO: 707994 - RNA, 19 nt, Homo sapiens
caauucaacaaguuaacug

SEQ ID NO: 707995 - RNA, 19 nt, Homo sapiens
caaagacaucguggagaau

SEQ ID NO: 707996 - RNA, 19 nt, Homo sapiens
acaccaaggaccauacugu

SEQ ID NO: 707997 - RNA, 19 nt, Homo sapiens
aggagaugaucccuacuca

SEQ ID NO: 707998 - RNA, 19 nt, Homo sapiens
uagaggaugcagugaggaa

SEQ ID NO: 707999 - RNA, 19 nt, Homo sapiens
ggaaugagacguuugaauu

SEQ ID NO: 708000 - RNA, 19 nt, Homo sapiens
gcaacucucuggccucaaa

SEQ ID NO: 708001 - RNA, 19 nt, Homo sapiens
gcaaaguggugauugaugu

SEQ ID NO: 708002 - RNA, 19 nt, Homo sapiens
gaaugagacguuugaauuu

SEQ ID NO: 708003 - RNA, 19 nt, Homo sapiens
ggucagggcugcgauaaga

SEQ ID NO: 708004 - RNA, 19 nt, Homo sapiens
ccagcaaaguggaaguuaa

SEQ ID NO: 708005 - RNA, 19 nt, Homo sapiens
ggaaggucuuugagaguug

SEQ ID NO: 708006 - RNA, 19 nt, Homo sapiens
gaaugacccucuugaccau

SEQ ID NO: 708007 - RNA, 19 nt, Homo sapiens
ccacgaaccugcucaagcu

SEQ ID NO: 708008 - RNA, 19 nt, Homo sapiens
agaguuggaugcaccauug

SEQ ID NO: 708009 - RNA, 19 nt, Homo sapiens
ggugauugauguccagaga

SEQ ID NO: 708010 - RNA, 19 nt, Homo sapiens
gggacgacguuaucggaaa

SEQ ID NO: 708011 - RNA, 19 nt, Homo sapiens
ccagggaccuagagaaugg

SEQ ID NO: 708012 - RNA, 19 nt, Homo sapiens
aaagcgcccucaucaaguu

SEQ ID NO: 708013 - RNA, 19 nt, Homo sapiens
gagaaccugagacaccuua

SEQ ID NO: 708014 - RNA, 19 nt, Homo sapiens
ucaccaagcucguggacau

SEQ ID NO: 708015 - RNA, 19 nt, Homo sapiens
agaccucgaucgugaagaa

SEQ ID NO: 708016 - RNA, 19 nt, Homo sapiens
ggacgacguuaucggaaag

SEQ ID NO: 708017 - RNA, 19 nt, Homo sapiens
ggaguggaaugacccucuu

SEQ ID NO: 708018 - RNA, 19 nt, Homo sapiens
ucgugaagguggacaauga

SEQ ID NO: 708019 - RNA, 19 nt, Homo sapiens
ggacagacccagccagaac

SEQ ID NO: 708020 - RNA, 19 nt, Homo sapiens
cggaaaagguugaggaaaa

SEQ ID NO: 708021 - RNA, 19 nt, Homo sapiens
gaaaagcgcccucaucaag

SEQ ID NO: 708022 - RNA, 19 nt, Homo sapiens
aaugagacguuugaauuug

SEQ ID NO: 708023 - RNA, 19 nt, Homo sapiens
ggaccgcaauggcacaucu

SEQ ID NO: 708024 - RNA, 19 nt, Homo sapiens
accauuggcuccuguuuga

SEQ ID NO: 708025 - RNA, 19 nt, Homo sapiens
gcaaaguggaaguuaagga

SEQ ID NO: 708026 - RNA, 19 nt, Homo sapiens
cagaggcggucuucaacau

SEQ ID NO: 708027 - RNA, 19 nt, Homo sapiens
cagcagaggcggucuucaa

SEQ ID NO: 708028 - RNA, 19 nt, Homo sapiens
gaaagagucacuggaacug

SEQ ID NO: 708029 - RNA, 19 nt, Homo sapiens
ggaaggugagcaucaacaa

SEQ ID NO: 708030 - RNA, 19 nt, Homo sapiens
caaaguggaaguuaaggau

SEQ ID NO: 708031 - RNA, 19 nt, Homo sapiens
uggaaggucuuugagaguu

SEQ ID NO: 708032 - RNA, 19 nt, Homo sapiens
ugagacaccuuaagaacac

SEQ ID NO: 708033 - RNA, 19 nt, Homo sapiens
uggcgcagcugaaggacuu

SEQ ID NO: 708034 - RNA, 19 nt, Homo sapiens
cuaccacccuggcgucuuc

SEQ ID NO: 708035 - RNA, 19 nt, Homo sapiens
uacccacgcuggaaugaga

SEQ ID NO: 708036 - RNA, 19 nt, Homo sapiens
gcuguggcuuucuauguca

SEQ ID NO: 708037 - RNA, 19 nt, Homo sapiens
acaagguguuugaggagaa

SEQ ID NO: 708038 - RNA, 19 nt, Homo sapiens
ggaaaagguugaggaaaag

SEQ ID NO: 708039 - RNA, 19 nt, Homo sapiens
gcuggaaugagacguuuga

SEQ ID NO: 708040 - RNA, 19 nt, Homo sapiens
cacugacgcuccaccgaaa

SEQ ID NO: 708041 - RNA, 19 nt, Homo sapiens
ccaaggcaguccagaacgu

SEQ ID NO: 708042 - RNA, 19 nt, Homo sapiens
gcaccauuggcuccuguuu

SEQ ID NO: 708043 - RNA, 19 nt, Homo sapiens
gcagugcaagugugugaau

SEQ ID NO: 708044 - RNA, 19 nt, Homo sapiens
cacgagcccuggcaaaguc

SEQ ID NO: 708045 - RNA, 19 nt, Homo sapiens
ggacacgggagaccucgau

SEQ ID NO: 708046 - RNA, 19 nt, Homo sapiens
gcagaggcggucuucaaca

SEQ ID NO: 708047 - RNA, 19 nt, Homo sapiens
cauuggcuccuguuugaaa

SEQ ID NO: 708048 - RNA, 19 nt, Homo sapiens
gagaguuggaugcaccauu

SEQ ID NO: 708049 - RNA, 19 nt, Homo sapiens
gaaccugagacaccuuaag

SEQ ID NO: 708050 - RNA, 19 nt, Homo sapiens
aacaguaaaccugcucuua

SEQ ID NO: 708051 - RNA, 19 nt, Homo sapiens
ugggcaaaguggugauuga

SEQ ID NO: 708052 - RNA, 19 nt, Homo sapiens
augagacguuugaauuuga

SEQ ID NO: 708053 - RNA, 19 nt, Homo sapiens
gcgcccagcacgagaaugu

SEQ ID NO: 708054 - RNA, 19 nt, Homo sapiens
cagcaaaguggaaguuaag

SEQ ID NO: 708055 - RNA, 19 nt, Homo sapiens
cgaagacgcccagcuccaa

SEQ ID NO: 708056 - RNA, 19 nt, Homo sapiens
aaguggaaguuaaggaugu

SEQ ID NO: 708057 - RNA, 19 nt, Homo sapiens
cauagccucucacccuaag

SEQ ID NO: 708058 - RNA, 19 nt, Homo sapiens
uguuugaggagaagaagua

SEQ ID NO: 708059 - RNA, 19 nt, Homo sapiens
cgaaccugcucaagcucuu

SEQ ID NO: 708060 - RNA, 19 nt, Homo sapiens
gggacaccauagccucuca

SEQ ID NO: 708061 - RNA, 19 nt, Homo sapiens
cgaaagagucacuggaacu

SEQ ID NO: 708062 - RNA, 19 nt, Homo sapiens
gaaggugagcaucaacaac

SEQ ID NO: 708063 - RNA, 19 nt, Homo sapiens
ugauugauguccagagacu

SEQ ID NO: 708064 - RNA, 19 nt, Homo sapiens
uggcuccuguuugaaauga

SEQ ID NO: 708065 - RNA, 19 nt, Homo sapiens
aaccugcucuuacugucaa

SEQ ID NO: 708066 - RNA, 19 nt, Homo sapiens
ccagaaccacugcuaggau

SEQ ID NO: 708067 - RNA, 19 nt, Homo sapiens
uggagcugcugccaccaaa

SEQ ID NO: 708068 - RNA, 19 nt, Homo sapiens
ggcaaaguggugauugaug

SEQ ID NO: 708069 - RNA, 19 nt, Homo sapiens
ccauagccucucacccuaa

SEQ ID NO: 708070 - RNA, 19 nt, Homo sapiens
aaccugagacaccuuaaga

SEQ ID NO: 708071 - RNA, 19 nt, Homo sapiens
gggagagucaggaauaagg

SEQ ID NO: 708072 - RNA, 19 nt, Homo sapiens
ccagaacgugggcaacaug

SEQ ID NO: 708073 - RNA, 19 nt, Homo sapiens
caagguguuugaggagaag

SEQ ID NO: 708074 - RNA, 19 nt, Homo sapiens
gggcagcugaucccacuca

SEQ ID NO: 708075 - RNA, 19 nt, Homo sapiens
gaacuggaggacccgucuu

SEQ ID NO: 708076 - RNA, 19 nt, Homo sapiens
uggagaccauagacuggaa

SEQ ID NO: 708077 - RNA, 19 nt, Homo sapiens
aaggugagcaucaacaaca

SEQ ID NO: 708078 - RNA, 19 nt, Homo sapiens
caacaguaaaccugcucuu

SEQ ID NO: 708079 - RNA, 19 nt, Homo sapiens
ccacgagcccuggcaaagu

SEQ ID NO: 708080 - RNA, 19 nt, Homo sapiens
ucguggacaucgaggagaa

SEQ ID NO: 708081 - RNA, 19 nt, Homo sapiens
ggaaacaacuccucuguga

SEQ ID NO: 708082 - RNA, 19 nt, Homo sapiens
gcucauaacuacaggaaua

SEQ ID NO: 708083 - RNA, 19 nt, Homo sapiens
gaaauucgccuuauugauu

SEQ ID NO: 708084 - RNA, 19 nt, Homo sapiens
gaaggaagcuguucuuaag

SEQ ID NO: 708085 - RNA, 19 nt, Homo sapiens
ggagaucuauggaccaaua

SEQ ID NO: 708086 - RNA, 19 nt, Homo sapiens
gcagaaggcauuauauaua

SEQ ID NO: 708087 - RNA, 19 nt, Homo sapiens
gaacaugugugugauaaau

SEQ ID NO: 708088 - RNA, 19 nt, Homo sapiens
gaucugacaugaagaauca

SEQ ID NO: 708089 - RNA, 19 nt, Homo sapiens
cgauugaucuuguggcuua

SEQ ID NO: 708090 - RNA, 19 nt, Homo sapiens
gagacaugcuuuacccuua

SEQ ID NO: 708091 - RNA, 19 nt, Homo sapiens
ggugagagaugcagugauu

SEQ ID NO: 708092 - RNA, 19 nt, Homo sapiens
caggaagacuuaugcauuu

SEQ ID NO: 708093 - RNA, 19 nt, Homo sapiens
gaacugguaauguuucuaa

SEQ ID NO: 708094 - RNA, 19 nt, Homo sapiens
ugaaauaucuuuggguuug

SEQ ID NO: 708095 - RNA, 19 nt, Homo sapiens
ggaaggcuauccuaacaga

SEQ ID NO: 708096 - RNA, 19 nt, Homo sapiens
uuaaugagcuaccuuguga

SEQ ID NO: 708097 - RNA, 19 nt, Homo sapiens
ggaaggcugcccugcauua

SEQ ID NO: 708098 - RNA, 19 nt, Homo sapiens
uaaauggguuugcuaaugu

SEQ ID NO: 708099 - RNA, 19 nt, Homo sapiens
gcaauggaaacaauagaua

SEQ ID NO: 708100 - RNA, 19 nt, Homo sapiens
ugucaaagcugguggcauu

SEQ ID NO: 708101 - RNA, 19 nt, Homo sapiens
cggcacagcucccaauuga

SEQ ID NO: 708102 - RNA, 19 nt, Homo sapiens
ugagcuaccuugugaauau

SEQ ID NO: 708103 - RNA, 19 nt, Homo sapiens
gcaagccacuaacagagaa

SEQ ID NO: 708104 - RNA, 19 nt, Homo sapiens
uaaagcagaaggcauuaua

SEQ ID NO: 708105 - RNA, 19 nt, Homo sapiens
gcucugcucuuuacauugu

SEQ ID NO: 708106 - RNA, 19 nt, Homo sapiens
uaacagagacaguacgaaa

SEQ ID NO: 708107 - RNA, 19 nt, Homo sapiens
cuauagaguuuaugacuga

SEQ ID NO: 708108 - RNA, 19 nt, Homo sapiens
ucaugaagcuuuccuaugg

SEQ ID NO: 708109 - RNA, 19 nt, Homo sapiens
gaaauaucuuuggguuuga

SEQ ID NO: 708110 - RNA, 19 nt, Homo sapiens
cagaaggcauuauauauac

SEQ ID NO: 708111 - RNA, 19 nt, Homo sapiens
gaaacuaggaggagacaau

SEQ ID NO: 708112 - RNA, 19 nt, Homo sapiens
cacaggaacugguaauguu

SEQ ID NO: 708113 - RNA, 19 nt, Homo sapiens
uaugaaagcuuugaaugga

SEQ ID NO: 708114 - RNA, 19 nt, Homo sapiens
gcacagcucccaauugaag

SEQ ID NO: 708115 - RNA, 19 nt, Homo sapiens
caauaggacccuuaacauu

SEQ ID NO: 708116 - RNA, 19 nt, Homo sapiens
ggacaucacacaccuuuua

SEQ ID NO: 708117 - RNA, 19 nt, Homo sapiens
ccaagggucuucaccacaa

SEQ ID NO: 708118 - RNA, 19 nt, Homo sapiens
cuacacagaguacaauuaa

SEQ ID NO: 708119 - RNA, 19 nt, Homo sapiens
agagacagcuuuggaauca

SEQ ID NO: 708120 - RNA, 19 nt, Homo sapiens
ugaaagcuuugaauggauu

SEQ ID NO: 708121 - RNA, 19 nt, Homo sapiens
aauaggacccuuaacauuu

SEQ ID NO: 708122 - RNA, 19 nt, Homo sapiens
caaacaaaguuaacauggu

SEQ ID NO: 708123 - RNA, 19 nt, Homo sapiens
aucaagagauggcaauaua

SEQ ID NO: 708124 - RNA, 19 nt, Homo sapiens
uaucugagccuguauuaga

SEQ ID NO: 708125 - RNA, 19 nt, Homo sapiens
ggaaucuacugggaacaaa

SEQ ID NO: 708126 - RNA, 19 nt, Homo sapiens
cccaagcaaucuuuaauga

SEQ ID NO: 708127 - RNA, 19 nt, Homo sapiens
ggauauuucugaagcuugu

SEQ ID NO: 708128 - RNA, 19 nt, Homo sapiens
gcaauacaccucugaacau

SEQ ID NO: 708129 - RNA, 19 nt, Homo sapiens
acagagacaguacgaaaua

SEQ ID NO: 708130 - RNA, 19 nt, Homo sapiens
gaucacauguuagcaaugg

SEQ ID NO: 708131 - RNA, 19 nt, Homo sapiens
aaacaggaaauucgccuua

SEQ ID NO: 708132 - RNA, 19 nt, Homo sapiens
caauacaccucugaacaug

SEQ ID NO: 708133 - RNA, 19 nt, Homo sapiens
uacgaaauaugcugagauu

SEQ ID NO: 708134 - RNA, 19 nt, Homo sapiens
ucuuggaucuggcuacaua

SEQ ID NO: 708135 - RNA, 19 nt, Homo sapiens
gaacgugcucagucacuuu

SEQ ID NO: 708136 - RNA, 19 nt, Homo sapiens
gaugcuggcuaugaaauau

SEQ ID NO: 708137 - RNA, 19 nt, Homo sapiens
ucaaaggcaucaccaaucu

SEQ ID NO: 708138 - RNA, 19 nt, Homo sapiens
ugaaggaagcuguucuuaa

SEQ ID NO: 708139 - RNA, 19 nt, Homo sapiens
ggaaagguugugaauguug

SEQ ID NO: 708140 - RNA, 19 nt, Homo sapiens
gcauggacauuuguaaaca

SEQ ID NO: 708141 - RNA, 19 nt, Homo sapiens
caagagauggcaauauaga

SEQ ID NO: 708142 - RNA, 19 nt, Homo sapiens
aaauuaauguccaggaaga

SEQ ID NO: 708143 - RNA, 19 nt, Homo sapiens
ccacuaacagagaacuuua

SEQ ID NO: 708144 - RNA, 19 nt, Homo sapiens
cgacacagccucuugaaag

SEQ ID NO: 708145 - RNA, 19 nt, Homo sapiens
gcuuuacccuuauguugaa

SEQ ID NO: 708146 - RNA, 19 nt, Homo sapiens
gauaaggacuaugucaaag

SEQ ID NO: 708147 - RNA, 19 nt, Homo sapiens
agggauauaugaaagcuuu

SEQ ID NO: 708148 - RNA, 19 nt, Homo sapiens
gagggucuauagaguuuau

SEQ ID NO: 708149 - RNA, 19 nt, Homo sapiens
caacuugcuuaauuaaugg

SEQ ID NO: 708150 - RNA, 19 nt, Homo sapiens
ccaggaagacuuaugcauu

SEQ ID NO: 708151 - RNA, 19 nt, Homo sapiens
auaaauggguuugcuaaug

SEQ ID NO: 708152 - RNA, 19 nt, Homo sapiens
ggacaucaauggcuuuuca

SEQ ID NO: 708153 - RNA, 19 nt, Homo sapiens
ggauuucacccuccucuga

SEQ ID NO: 708154 - RNA, 19 nt, Homo sapiens
gccaaggccugcaucacaa

SEQ ID NO: 708155 - RNA, 19 nt, Homo sapiens
gaacaguuaggcaagaaau

SEQ ID NO: 708156 - RNA, 19 nt, Homo sapiens
uaagggagcccaagcaauc

SEQ ID NO: 708157 - RNA, 19 nt, Homo sapiens
ucugaagcuugucuaauuu

SEQ ID NO: 708158 - RNA, 19 nt, Homo sapiens
aagcagaaggcauuauaua

SEQ ID NO: 708159 - RNA, 19 nt, Homo sapiens
gaucuauggaccaauauug

SEQ ID NO: 708160 - RNA, 19 nt, Homo sapiens
gcugagauuuauggcauuu

SEQ ID NO: 708161 - RNA, 19 nt, Homo sapiens
cuuguugccuuauguauug

SEQ ID NO: 708162 - RNA, 19 nt, Homo sapiens
aaacacuccucgccuccua

SEQ ID NO: 708163 - RNA, 19 nt, Homo sapiens
uggcauggcucauaacuac

SEQ ID NO: 708164 - RNA, 19 nt, Homo sapiens
ucaccaaucugggauacaa

SEQ ID NO: 708165 - RNA, 19 nt, Homo sapiens
uacauugucuuuacaguca

SEQ ID NO: 708166 - RNA, 19 nt, Homo sapiens
ggagcgaauuaaagcagaa

SEQ ID NO: 708167 - RNA, 19 nt, Homo sapiens
gacacagccucuugaaagu

SEQ ID NO: 708168 - RNA, 19 nt, Homo sapiens
gauauugcacccuauacaa

SEQ ID NO: 708169 - RNA, 19 nt, Homo sapiens
gagcaucccuuuugcaugu

SEQ ID NO: 708170 - RNA, 19 nt, Homo sapiens
guaugauccugcagaguau

SEQ ID NO: 708171 - RNA, 19 nt, Homo sapiens
uguaugauccugcagagua

SEQ ID NO: 708172 - RNA, 19 nt, Homo sapiens
auaggacccuuaacauuug

SEQ ID NO: 708173 - RNA, 19 nt, Homo sapiens
acaggaaauucgccuuauu

SEQ ID NO: 708174 - RNA, 19 nt, Homo sapiens
gaggauauuucugaagcuu

SEQ ID NO: 708175 - RNA, 19 nt, Homo sapiens
agacagcuuuggaaucaga

SEQ ID NO: 708176 - RNA, 19 nt, Homo sapiens
gacugaguguacaacaaua

SEQ ID NO: 708177 - RNA, 19 nt, Homo sapiens
ugauaaggacuaugucaaa

SEQ ID NO: 708178 - RNA, 19 nt, Homo sapiens
gaugcaagccacuaacaga

SEQ ID NO: 708179 - RNA, 19 nt, Homo sapiens
gaugagagacagcuuugga

SEQ ID NO: 708180 - RNA, 19 nt, Homo sapiens
ucaagaugcugcaaguaca

SEQ ID NO: 708181 - RNA, 19 nt, Homo sapiens
gagaaugccuaugagaaug

SEQ ID NO: 708182 - RNA, 19 nt, Homo sapiens
ugagaaugccuaugagaau

SEQ ID NO: 708183 - RNA, 19 nt, Homo sapiens
gcccucagccuccucauuc

SEQ ID NO: 708184 - RNA, 19 nt, Homo sapiens
gaaugugcccgaggaggaa

SEQ ID NO: 708185 - RNA, 19 nt, Homo sapiens
gaaugccuaugagaaugug

SEQ ID NO: 708186 - RNA, 19 nt, Homo sapiens
gaacagauggaagguacuc

SEQ ID NO: 708187 - RNA, 19 nt, Homo sapiens
caugagaaugccuaugaga

SEQ ID NO: 708188 - RNA, 19 nt, Homo sapiens
gauccugaccgucggaaac

SEQ ID NO: 708189 - RNA, 19 nt, Homo sapiens
gaaauuggcuguuuuguua

SEQ ID NO: 708190 - RNA, 19 nt, Homo sapiens
ggaagacucugaacaauuc

SEQ ID NO: 708191 - RNA, 19 nt, Homo sapiens
gggcuaauauggauacuaa

SEQ ID NO: 708192 - RNA, 19 nt, Homo sapiens
uagaauagcucguguuaug

SEQ ID NO: 708193 - RNA, 19 nt, Homo sapiens
ucgaauggauugaauguua

SEQ ID NO: 708194 - RNA, 19 nt, Homo sapiens
ggaaagaguguauauggua

SEQ ID NO: 708195 - RNA, 19 nt, Homo sapiens
ggaccaaugucuaucaaga

SEQ ID NO: 708196 - RNA, 19 nt, Homo sapiens
gcacugaauuuauuagaca

SEQ ID NO: 708197 - RNA, 19 nt, Homo sapiens
ggaaauaugcacugaaaga

SEQ ID NO: 708198 - RNA, 19 nt, Homo sapiens
ggacuauccuugaggcaaa

SEQ ID NO: 708199 - RNA, 19 nt, Homo sapiens
ggaaugcagugguagaguu

SEQ ID NO: 708200 - RNA, 19 nt, Homo sapiens
ggaacgaguuuaguauauu

SEQ ID NO: 708201 - RNA, 19 nt, Homo sapiens
gaugacauguacagucuuu

SEQ ID NO: 708202 - RNA, 19 nt, Homo sapiens
gugcuuauauaaucgcuua

SEQ ID NO: 708203 - RNA, 19 nt, Homo sapiens
gggaacgaguuuaguauau

SEQ ID NO: 708204 - RNA, 19 nt, Homo sapiens
guaaucgccuguuucaaga

SEQ ID NO: 708205 - RNA, 19 nt, Homo sapiens
gguacaacuucauucuaua

SEQ ID NO: 708206 - RNA, 19 nt, Homo sapiens
caaauuccauucacuccuu

SEQ ID NO: 708207 - RNA, 19 nt, Homo sapiens
ugaccuacaugggcuaaua

SEQ ID NO: 708208 - RNA, 19 nt, Homo sapiens
gaaauaugcacugaaagaa

SEQ ID NO: 708209 - RNA, 19 nt, Homo sapiens
caacaugguacuuuggaua

SEQ ID NO: 708210 - RNA, 19 nt, Homo sapiens
gaaugcagugguagaguua

SEQ ID NO: 708211 - RNA, 19 nt, Homo sapiens
caaugucuaucaagaguga

SEQ ID NO: 708212 - RNA, 19 nt, Homo sapiens
cuacauugaucuaagaaga

SEQ ID NO: 708213 - RNA, 19 nt, Homo sapiens
uuugacaccucccucauua

SEQ ID NO: 708214 - RNA, 19 nt, Homo sapiens
gaaguugaccugcucuuuc

SEQ ID NO: 708215 - RNA, 19 nt, Homo sapiens
guuagucacugucaaguca

SEQ ID NO: 708216 - RNA, 19 nt, Homo sapiens
gauagcaucauuuauagga

SEQ ID NO: 708217 - RNA, 19 nt, Homo sapiens
gcacugaaagaaauguaaa

SEQ ID NO: 708218 - RNA, 19 nt, Homo sapiens
cuucuaagauccuuguuga

SEQ ID NO: 708219 - RNA, 19 nt, Homo sapiens
ucaauucucugaguaggaa

SEQ ID NO: 708220 - RNA, 19 nt, Homo sapiens
gaggaaagaguguauaugg

SEQ ID NO: 708221 - RNA, 19 nt, Homo sapiens
gggaagacucugaacaauu

SEQ ID NO: 708222 - RNA, 19 nt, Homo sapiens
gaaauugggaagcguuaug

SEQ ID NO: 708223 - RNA, 19 nt, Homo sapiens
gaacugcaagugcuacaug

SEQ ID NO: 708224 - RNA, 19 nt, Homo sapiens
gggcuauuguauacuauga

SEQ ID NO: 708225 - RNA, 19 nt, Homo sapiens
agaagaaacuagccuugug

SEQ ID NO: 708226 - RNA, 19 nt, Homo sapiens
aaucauauuugggcuauug

SEQ ID NO: 708227 - RNA, 19 nt, Homo sapiens
gaauagcucguguuaugga

SEQ ID NO: 708228 - RNA, 19 nt, Homo sapiens
cagagaugcuucuaagauc

SEQ ID NO: 708229 - RNA, 19 nt, Homo sapiens
cacuggagcuggcagguuu

SEQ ID NO: 708230 - RNA, 19 nt, Homo sapiens
ggaguggaccaaugucuau

SEQ ID NO: 708231 - RNA, 19 nt, Homo sapiens
gauuaucaccucuuacaau

SEQ ID NO: 708232 - RNA, 19 nt, Homo sapiens
gaccugcucuuucuuucug

SEQ ID NO: 708233 - RNA, 19 nt, Homo sapiens
aaauggaaauuggccuaua

SEQ ID NO: 708234 - RNA, 19 nt, Homo sapiens
gcaaguuuguugaccuaca

SEQ ID NO: 708235 - RNA, 19 nt, Homo sapiens
uggaugugcuuauauaauc

SEQ ID NO: 708236 - RNA, 19 nt, Homo sapiens
gguuggaaauuggcuguuu

SEQ ID NO: 708237 - RNA, 19 nt, Homo sapiens
ucaccagggucuguuguuu

SEQ ID NO: 708238 - RNA, 19 nt, Homo sapiens
cagaugacauguacagucu

SEQ ID NO: 708239 - RNA, 19 nt, Homo sapiens
uccaugggcuucucuguga

SEQ ID NO: 708240 - RNA, 19 nt, Homo sapiens
uagacaaacuuacgaaugc

SEQ ID NO: 708241 - RNA, 19 nt, Homo sapiens
uuggaaauaugcacugaaa

SEQ ID NO: 708242 - RNA, 19 nt, Homo sapiens
gaacccagcaagucccuau

SEQ ID NO: 708243 - RNA, 19 nt, Homo sapiens
acaccucccucauuaggaa

SEQ ID NO: 708244 - RNA, 19 nt, Homo sapiens
gcaagugcuacaugauauu

SEQ ID NO: 708245 - RNA, 19 nt, Homo sapiens
ugguacaacuucauucuau

SEQ ID NO: 708246 - RNA, 19 nt, Homo sapiens
uuagugugcuuuaaaguag

SEQ ID NO: 708247 - RNA, 19 nt, Homo sapiens
gaacuguaucugaguaaca

SEQ ID NO: 708248 - RNA, 19 nt, Homo sapiens
gaacaauucagagaugcuu

SEQ ID NO: 708249 - RNA, 19 nt, Homo sapiens
guacaacuucauucuauag

SEQ ID NO: 708250 - RNA, 19 nt, Homo sapiens
cagaagauucgaauggauu

SEQ ID NO: 708251 - RNA, 19 nt, Homo sapiens
ucagagaugcuucuaagau

SEQ ID NO: 708252 - RNA, 19 nt, Homo sapiens
cuaucaagagugacaaaua

SEQ ID NO: 708253 - RNA, 19 nt, Homo sapiens
caagugcuacaugauauuu

SEQ ID NO: 708254 - RNA, 19 nt, Homo sapiens
guaggaacaaugaaguuga

SEQ ID NO: 708255 - RNA, 19 nt, Homo sapiens
gcuccguaaucgccuguuu

SEQ ID NO: 708256 - RNA, 19 nt, Homo sapiens
aaauuccauucacuccuua

SEQ ID NO: 708257 - RNA, 19 nt, Homo sapiens
gagaaugcaguuccuuuua

SEQ ID NO: 708258 - RNA, 19 nt, Homo sapiens
cuacaugggcuaauaugga

SEQ ID NO: 708259 - RNA, 19 nt, Homo sapiens
ccagaagauucgaauggau

SEQ ID NO: 708260 - RNA, 19 nt, Homo sapiens
gaugacaaaccagaagauu

SEQ ID NO: 708261 - RNA, 19 nt, Homo sapiens
gaaauggaaauuggccuau

SEQ ID NO: 708262 - RNA, 19 nt, Homo sapiens
caaguuuguugaccuacau

SEQ ID NO: 708263 - RNA, 19 nt, Homo sapiens
caggcagugucauuucgua

SEQ ID NO: 708264 - RNA, 19 nt, Homo sapiens
ugaagggagugaacaaacu

SEQ ID NO: 708265 - RNA, 19 nt, Homo sapiens
uagaguagcccuaaaauau

SEQ ID NO: 708266 - RNA, 19 nt, Homo sapiens
uacgaaugcuuaacuucuu

SEQ ID NO: 708267 - RNA, 19 nt, Homo sapiens
ggccuuggcugugauuauc

SEQ ID NO: 708268 - RNA, 19 nt, Homo sapiens
caagagugacaaauaaagu

SEQ ID NO: 708269 - RNA, 19 nt, Homo sapiens
cgcaguggguaaccuguuu

SEQ ID NO: 708270 - RNA, 19 nt, Homo sapiens
uuacacagcauaggugaaa

SEQ ID NO: 708271 - RNA, 19 nt, Homo sapiens
acaaacuuacgaaugcuua

SEQ ID NO: 708272 - RNA, 19 nt, Homo sapiens
gaagggagugaacaaacug

SEQ ID NO: 708273 - RNA, 19 nt, Homo sapiens
caugguacuuuggauaaug

SEQ ID NO: 708274 - RNA, 19 nt, Homo sapiens
gcuggcagguuuggaugaa

SEQ ID NO: 708275 - RNA, 19 nt, Homo sapiens
auaagcaucuagccaagga

SEQ ID NO: 708276 - RNA, 19 nt, Homo sapiens
cguaaucgccuguuucaag

SEQ ID NO: 708277 - RNA, 19 nt, Homo sapiens
uauuugggcuauuguauac

SEQ ID NO: 708278 - RNA, 19 nt, Homo sapiens
acgaaugcuuaacuucuuu

SEQ ID NO: 708279 - RNA, 19 nt, Homo sapiens
uuuagaauagcucguguua

SEQ ID NO: 708280 - RNA, 19 nt, Homo sapiens
aauguuaccugugccagaa

SEQ ID NO: 708281 - RNA, 19 nt, Homo sapiens
cgaauggauugaauguuac

SEQ ID NO: 708282 - RNA, 19 nt, Homo sapiens
gcgaagaacccagcaaguc

SEQ ID NO: 708283 - RNA, 19 nt, Homo sapiens
ugcaagugcuacaugauau

SEQ ID NO: 708284 - RNA, 19 nt, Homo sapiens
cugcaagugcuacaugaua

SEQ ID NO: 708285 - RNA, 19 nt, Homo sapiens
ggaaggcaaacucaguguu

SEQ ID NO: 708286 - RNA, 19 nt, Homo sapiens
uacaugggcuaauauggau

SEQ ID NO: 708287 - RNA, 19 nt, Homo sapiens
gcuauuguauacuaugaac

SEQ ID NO: 708288 - RNA, 19 nt, Homo sapiens
cgaaugcuuaacuucuuua

SEQ ID NO: 708289 - RNA, 19 nt, Homo sapiens
gaacauaucugaaggaucu

SEQ ID NO: 708290 - RNA, 19 nt, Homo sapiens
aagaagaacucacaaggua

SEQ ID NO: 708291 - RNA, 19 nt, Homo sapiens
gcacguuguuguuaaguuu

SEQ ID NO: 708292 - RNA, 19 nt, Homo sapiens
caaagcacguuguuguuaa

SEQ ID NO: 708293 - RNA, 19 nt, Homo sapiens
gaacaucaugccuucuuua

SEQ ID NO: 708294 - RNA, 19 nt, Homo sapiens
gagaaucaguugucuggaa

SEQ ID NO: 708295 - RNA, 19 nt, Homo sapiens
ugaaggaucucgaaguuau

SEQ ID NO: 708296 - RNA, 19 nt, Homo sapiens
cagcgcagcucucuugauu

SEQ ID NO: 708297 - RNA, 19 nt, Homo sapiens
gaaaccugcugaggaaauu

SEQ ID NO: 708298 - RNA, 19 nt, Homo sapiens
ugaucaagauggagaauuu

SEQ ID NO: 708299 - RNA, 19 nt, Homo sapiens
ugauaaagcguacuucaua

SEQ ID NO: 708300 - RNA, 19 nt, Homo sapiens
cagcagagcaccagccuua

SEQ ID NO: 708301 - RNA, 19 nt, Homo sapiens
gcgcagcucucuugauuuc

SEQ ID NO: 708302 - RNA, 19 nt, Homo sapiens
gaacuucugcagagacuuu

SEQ ID NO: 708303 - RNA, 19 nt, Homo sapiens
caaggcagguugacgugua

SEQ ID NO: 708304 - RNA, 19 nt, Homo sapiens
acacacaacuccaagaaga

SEQ ID NO: 708305 - RNA, 19 nt, Homo sapiens
auaagaaggugcaguuuga

SEQ ID NO: 708306 - RNA, 19 nt, Homo sapiens
gaagcagguucucgacuau

SEQ ID NO: 708307 - RNA, 19 nt, Homo sapiens
gauaaagcguacuucauag

SEQ ID NO: 708308 - RNA, 19 nt, Homo sapiens
gauaggacccagcagagua

SEQ ID NO: 708309 - RNA, 19 nt, Homo sapiens
gaaaggaagcacagcaaga

SEQ ID NO: 708310 - RNA, 19 nt, Homo sapiens
ccaaagcacguuguuguua

SEQ ID NO: 708311 - RNA, 19 nt, Homo sapiens
gaaauugagcaacgacuug

SEQ ID NO: 708312 - RNA, 19 nt, Homo sapiens
ggacagagagcacuuagca

SEQ ID NO: 708313 - RNA, 19 nt, Homo sapiens
ucaacgacguccugcuaua

SEQ ID NO: 708314 - RNA, 19 nt, Homo sapiens
gcaccagccuuacauuugg

SEQ ID NO: 708315 - RNA, 19 nt, Homo sapiens
cgaguuuccugaucacaaa

SEQ ID NO: 708316 - RNA, 19 nt, Homo sapiens
ccagaaagacuacguguuc

SEQ ID NO: 708317 - RNA, 19 nt, Homo sapiens
gguccgagauggagaagug

SEQ ID NO: 708318 - RNA, 19 nt, Homo sapiens
gaggaggucguuaaggaua

SEQ ID NO: 708319 - RNA, 19 nt, Homo sapiens
acagcaagauucauucuau

SEQ ID NO: 708320 - RNA, 19 nt, Homo sapiens
ccgagaacauccagaaaga

SEQ ID NO: 708321 - RNA, 19 nt, Homo sapiens
ggacggacgaugaggauga

SEQ ID NO: 708322 - RNA, 19 nt, Homo sapiens
ccauugaccuggcggagaa

SEQ ID NO: 708323 - RNA, 19 nt, Homo sapiens
guacgaugaucaagaugga

SEQ ID NO: 708324 - RNA, 19 nt, Homo sapiens
gagcaccagccuuacauuu

SEQ ID NO: 708325 - RNA, 19 nt, Homo sapiens
aggaagcgcuuucucauca

SEQ ID NO: 708326 - RNA, 19 nt, Homo sapiens
ggacaaacaccagcagaau

SEQ ID NO: 708327 - RNA, 19 nt, Homo sapiens
caucaugccuucuuuagac

SEQ ID NO: 708328 - RNA, 19 nt, Homo sapiens
agaaucaguugucuggaaa

SEQ ID NO: 708329 - RNA, 19 nt, Homo sapiens
guaccaggauaccuuggaa

SEQ ID NO: 708330 - RNA, 19 nt, Homo sapiens
ucugaaggaucucgaaguu

SEQ ID NO: 708331 - RNA, 19 nt, Homo sapiens
acagagagcacuuagcaaa

SEQ ID NO: 708332 - RNA, 19 nt, Homo sapiens
gcgaugucaugcugaagaa

SEQ ID NO: 708333 - RNA, 19 nt, Homo sapiens
aagcguacuucauagcuaa

SEQ ID NO: 708334 - RNA, 19 nt, Homo sapiens
gcaggccucucccuugauc

SEQ ID NO: 708335 - RNA, 19 nt, Homo sapiens
gaaguggguugaggacauc

SEQ ID NO: 708336 - RNA, 19 nt, Homo sapiens
gaagagauucccaacugau

SEQ ID NO: 708337 - RNA, 19 nt, Homo sapiens
aagcaggccucucccuuga

SEQ ID NO: 708338 - RNA, 19 nt, Homo sapiens
ucucgacuauguuaaagaa

SEQ ID NO: 708339 - RNA, 19 nt, Homo sapiens
gcccaagcccguccucuuu

SEQ ID NO: 708340 - RNA, 19 nt, Homo sapiens
ggaaaccugcugaggaaau

SEQ ID NO: 708341 - RNA, 19 nt, Homo sapiens
cuggaaaccugcugaggaa

SEQ ID NO: 708342 - RNA, 19 nt, Homo sapiens
ccaggaggcauuugaaguu

SEQ ID NO: 708343 - RNA, 19 nt, Homo sapiens
gagauucccaacugauaaa

SEQ ID NO: 708344 - RNA, 19 nt, Homo sapiens
aaagaaggaggacauaaga

SEQ ID NO: 708345 - RNA, 19 nt, Homo sapiens
ugaacaucaugccuucuuu

SEQ ID NO: 708346 - RNA, 19 nt, Homo sapiens
uaagaucaaugccuucaac

SEQ ID NO: 708347 - RNA, 19 nt, Homo sapiens
ccucucagcguuugaauga

SEQ ID NO: 708348 - RNA, 19 nt, Homo sapiens
gcaucgcaguggagaauca

SEQ ID NO: 708349 - RNA, 19 nt, Homo sapiens
uggcagagaucacggagau

SEQ ID NO: 708350 - RNA, 19 nt, Homo sapiens
ggaaauugagcaacgacuu

SEQ ID NO: 708351 - RNA, 19 nt, Homo sapiens
gacauaagaaggugcaguu

SEQ ID NO: 708352 - RNA, 19 nt, Homo sapiens
ggaagcgcuuucucaucaa

SEQ ID NO: 708353 - RNA, 19 nt, Homo sapiens
cacgggaauucuaguguuu

SEQ ID NO: 708354 - RNA, 19 nt, Homo sapiens
ggcuagagauguauggaau

SEQ ID NO: 708355 - RNA, 19 nt, Homo sapiens
gaacauccagaaagacuac

SEQ ID NO: 708356 - RNA, 19 nt, Homo sapiens
gaagaggaggaggucguua

SEQ ID NO: 708357 - RNA, 19 nt, Homo sapiens
uaaagaaggaggacauaag

SEQ ID NO: 708358 - RNA, 19 nt, Homo sapiens
uugaagagcccaaaccaaa

SEQ ID NO: 708359 - RNA, 19 nt, Homo sapiens
ccacacacaacuccaagaa

SEQ ID NO: 708360 - RNA, 19 nt, Homo sapiens
gacguuuccuuucuucugu

SEQ ID NO: 708361 - RNA, 19 nt, Homo sapiens
gaaagguggauggaaguga

SEQ ID NO: 708362 - RNA, 19 nt, Homo sapiens
ucaagucccacgucuacua

SEQ ID NO: 708363 - RNA, 19 nt, Homo sapiens
ugcacgaacucaagaaaga

SEQ ID NO: 708364 - RNA, 19 nt, Homo sapiens
aaagcguacuucauagcua

SEQ ID NO: 708365 - RNA, 19 nt, Homo sapiens
aggaggaggucguuaagga

SEQ ID NO: 708366 - RNA, 19 nt, Homo sapiens
ggaagcacagcaagauuca

SEQ ID NO: 708367 - RNA, 19 nt, Homo sapiens
gaagcgcuuucucaucaag

SEQ ID NO: 708368 - RNA, 19 nt, Homo sapiens
acaaacaccagcagaauca

SEQ ID NO: 708369 - RNA, 19 nt, Homo sapiens
uaaccacauuggacaaaca

SEQ ID NO: 708370 - RNA, 19 nt, Homo sapiens
ucuauggcaugacgauuga

SEQ ID NO: 708371 - RNA, 19 nt, Homo sapiens
guucaacgacguccugcua

SEQ ID NO: 708372 - RNA, 19 nt, Homo sapiens
caaaugcccaaaucagaga

SEQ ID NO: 708373 - RNA, 19 nt, Homo sapiens
caacugauaaagcguacuu

SEQ ID NO: 708374 - RNA, 19 nt, Homo sapiens
uggagaaggugccgaaucu

SEQ ID NO: 708375 - RNA, 19 nt, Homo sapiens
cgacuauguuaaagaagga

SEQ ID NO: 708376 - RNA, 19 nt, Homo sapiens
uuucaggguuucacuaaga

SEQ ID NO: 708377 - RNA, 19 nt, Homo sapiens
gcagguugacguguaauga

SEQ ID NO: 708378 - RNA, 19 nt, Homo sapiens
ucacaaacuucugccuguu

SEQ ID NO: 708379 - RNA, 19 nt, Homo sapiens
caaggaaauugagcaacga

SEQ ID NO: 708380 - RNA, 19 nt, Homo sapiens
gcgaacauaucugaaggau

SEQ ID NO: 708381 - RNA, 19 nt, Homo sapiens
cauaagaaggugcaguuug

SEQ ID NO: 708382 - RNA, 19 nt, Homo sapiens
ggccaaagcacguuguugu

SEQ ID NO: 708383 - RNA, 19 nt, Homo sapiens
uuagcuagugccaguauua

SEQ ID NO: 708384 - RNA, 19 nt, Homo sapiens
gaaagacuacguguucaag

SEQ ID NO: 708385 - RNA, 19 nt, Homo sapiens
cagguucucgacuauguua

SEQ ID NO: 708386 - RNA, 19 nt, Homo sapiens
aaagguggauggaagugau

SEQ ID NO: 708387 - RNA, 19 nt, Homo sapiens
gcagagcaccagccuuaca

SEQ ID NO: 708388 - RNA, 19 nt, Homo sapiens
caagaagaacucacaaggu

SEQ ID NO: 708389 - RNA, 19 nt, Homo sapiens
gcaauugucuacccauuua

SEQ ID NO: 708390 - RNA, 19 nt, Homo sapiens
gaaagugcuuccaaacuga

SEQ ID NO: 708391 - RNA, 19 nt, Homo sapiens
aaacauaucucucaaggau

SEQ ID NO: 708392 - RNA, 19 nt, Homo sapiens
ccaauuguguugccauaua

SEQ ID NO: 708393 - RNA, 19 nt, Homo sapiens
gaaacuacaacuuacauga

SEQ ID NO: 708394 - RNA, 19 nt, Homo sapiens
ugaaagugcuuccaaacug

SEQ ID NO: 708395 - RNA, 19 nt, Homo sapiens
gaucauauucuguuucugu

SEQ ID NO: 708396 - RNA, 19 nt, Homo sapiens
acauaucucucaaggauug

SEQ ID NO: 708397 - RNA, 19 nt, Homo sapiens
ggaagcauucuguucuuaa

SEQ ID NO: 708398 - RNA, 19 nt, Homo sapiens
caacauguacggaagcauu

SEQ ID NO: 708399 - RNA, 19 nt, Homo sapiens
caaagacucuaagaaccaa

SEQ ID NO: 708400 - RNA, 19 nt, Homo sapiens
cggaagcauucuguucuua

SEQ ID NO: 708401 - RNA, 19 nt, Homo sapiens
acacggaauuggccauuug

SEQ ID NO: 708402 - RNA, 19 nt, Homo sapiens
cccaaucacucucuguauu

SEQ ID NO: 708403 - RNA, 19 nt, Homo sapiens
guucuaguauggugcuaaa

SEQ ID NO: 708404 - RNA, 19 nt, Homo sapiens
gaagcauucuguucuuaac

SEQ ID NO: 708405 - RNA, 19 nt, Homo sapiens
ugaaucugcugccugaaau

SEQ ID NO: 708406 - RNA, 19 nt, Homo sapiens
uaaggacaauguacccaau

SEQ ID NO: 708407 - RNA, 19 nt, Homo sapiens
ggguaacaaugccucagaa

SEQ ID NO: 708408 - RNA, 19 nt, Homo sapiens
cgaaaugaaacuacaacuu

SEQ ID NO: 708409 - RNA, 19 nt, Homo sapiens
guucuuaaccuguauuagu

SEQ ID NO: 708410 - RNA, 19 nt, Homo sapiens
gaaucugcugccugaaaua

SEQ ID NO: 708411 - RNA, 19 nt, Homo sapiens
guaacuuguucuaguaugg

SEQ ID NO: 708412 - RNA, 19 nt, Homo sapiens
guauuaguguagaucgauu

SEQ ID NO: 708413 - RNA, 19 nt, Homo sapiens
guacggaagcauucuguuc

SEQ ID NO: 708414 - RNA, 19 nt, Homo sapiens
ccucaaaguccgaaaugaa

SEQ ID NO: 708415 - RNA, 19 nt, Homo sapiens
guauugcuguuuccaacug

SEQ ID NO: 708416 - RNA, 19 nt, Homo sapiens
ggcgugugguuaacuguga

SEQ ID NO: 708417 - RNA, 19 nt, Homo sapiens
gaauuggccauuuggagau

SEQ ID NO: 708418 - RNA, 19 nt, Homo sapiens
acuuuacccuucaggauuu

SEQ ID NO: 708419 - RNA, 19 nt, Homo sapiens
gaaaauuggacgugccuuu

SEQ ID NO: 708420 - RNA, 19 nt, Homo sapiens
ggcaauugucuacccauuu

SEQ ID NO: 708421 - RNA, 19 nt, Homo sapiens
uaaccuguauuaguguaga

SEQ ID NO: 708422 - RNA, 19 nt, Homo sapiens
ucccacugcuucuauaaug

SEQ ID NO: 708423 - RNA, 19 nt, Homo sapiens
caauuguguugccauauac

SEQ ID NO: 708424 - RNA, 19 nt, Homo sapiens
gcacuggcgugugguuaac

SEQ ID NO: 708425 - RNA, 19 nt, Homo sapiens
augauuaacuuggcaaugu

SEQ ID NO: 708426 - RNA, 19 nt, Homo sapiens
uaguguagaucgauuucug

SEQ ID NO: 708427 - RNA, 19 nt, Homo sapiens
ccauuuggagauuuacuuu

SEQ ID NO: 708428 - RNA, 19 nt, Homo sapiens
gcauaaccuacagaccuua

SEQ ID NO: 708429 - RNA, 19 nt, Homo sapiens
caucggacacaauucagaa

SEQ ID NO: 708430 - RNA, 19 nt, Homo sapiens
uuacaucggacacaauuca

SEQ ID NO: 708431 - RNA, 19 nt, Homo sapiens
cuucuauaaugacuccuuu

SEQ ID NO: 708432 - RNA, 19 nt, Homo sapiens
uaaugacuccuuuaaguac

SEQ ID NO: 708433 - RNA, 19 nt, Homo sapiens
ucaaagacucuaagaacca

SEQ ID NO: 708434 - RNA, 19 nt, Homo sapiens
gaugaaagugcuuccaaac

SEQ ID NO: 708435 - RNA, 19 nt, Homo sapiens
uggcaauugucuacccauu

SEQ ID NO: 708436 - RNA, 19 nt, Homo sapiens
cucaaaguccgaaaugaaa

SEQ ID NO: 708437 - RNA, 19 nt, Homo sapiens
caauguacccaaucacucu

SEQ ID NO: 708438 - RNA, 19 nt, Homo sapiens
caacacggaauuggccauu

SEQ ID NO: 708439 - RNA, 19 nt, Homo sapiens
cauaaccuacagaccuuaa

SEQ ID NO: 708440 - RNA, 19 nt, Homo sapiens
cagcaguaaggacaaugua

SEQ ID NO: 708441 - RNA, 19 nt, Homo sapiens
gcagcaguaaggacaaugu

SEQ ID NO: 708442 - RNA, 19 nt, Homo sapiens
cuuaaccuguauuagugua

SEQ ID NO: 708443 - RNA, 19 nt, Homo sapiens
uguguugccauauacauuu

SEQ ID NO: 708444 - RNA, 19 nt, Homo sapiens
gcucccacugcuucuauaa

SEQ ID NO: 708445 - RNA, 19 nt, Homo sapiens
ucaucgaaauagugggauu

SEQ ID NO: 708446 - RNA, 19 nt, Homo sapiens
aaucugcugccugaaauaa

SEQ ID NO: 708447 - RNA, 19 nt, Homo sapiens
auucuguucuuaaccugua

SEQ ID NO: 708448 - RNA, 19 nt, Homo sapiens
cccacugcuucuauaauga

SEQ ID NO: 708449 - RNA, 19 nt, Homo sapiens
gacaauguacccaaucacu

SEQ ID NO: 708450 - RNA, 19 nt, Homo sapiens
agauuucugugaugcuguu

SEQ ID NO: 708451 - RNA, 19 nt, Homo sapiens
gguguuugugcuuggguua

SEQ ID NO: 708452 - RNA, 19 nt, Homo sapiens
ugauuaacuuggcaauguc

SEQ ID NO: 708453 - RNA, 19 nt, Homo sapiens
aggacaauguacccaauca

SEQ ID NO: 708454 - RNA, 19 nt, Homo sapiens
gaagccacauggaaaacau

SEQ ID NO: 708455 - RNA, 19 nt, Homo sapiens
gaucgauuucuggcaauug

SEQ ID NO: 708456 - RNA, 19 nt, Homo sapiens
ucacugggacagaacuuuc

SEQ ID NO: 708457 - RNA, 19 nt, Homo sapiens
agcauaaccuacagaccuu

SEQ ID NO: 708458 - RNA, 19 nt, Homo sapiens
gaaguucauggugcagaga

SEQ ID NO: 708459 - RNA, 19 nt, Homo sapiens
guuuugacccuauaguuua

SEQ ID NO: 708460 - RNA, 19 nt, Homo sapiens
gaaccaaaagaaaugcaaa

SEQ ID NO: 708461 - RNA, 19 nt, Homo sapiens
uucuuaaccuguauuagug

SEQ ID NO: 708462 - RNA, 19 nt, Homo sapiens
uuggccauuuggagauuua

SEQ ID NO: 708463 - RNA, 19 nt, Homo sapiens
ccauauacauuuucaucug

SEQ ID NO: 708464 - RNA, 19 nt, Homo sapiens
aaaauuggacgugccuuua

SEQ ID NO: 708465 - RNA, 19 nt, Homo sapiens
acggaagcauucuguucuu

SEQ ID NO: 708466 - RNA, 19 nt, Homo sapiens
gauuaacuuggcaauguca

SEQ ID NO: 708467 - RNA, 19 nt, Homo sapiens
ggaaagagaaguuaaagaa

SEQ ID NO: 708468 - RNA, 19 nt, Homo sapiens
acaaauggcuuaaggugua

SEQ ID NO: 708469 - RNA, 19 nt, Homo sapiens
ccaggaaucuauuguguuu

SEQ ID NO: 708470 - RNA, 19 nt, Homo sapiens
acaaauaugucaccuguug

SEQ ID NO: 708471 - RNA, 19 nt, Homo sapiens
ugacauaccaggaaagaua

SEQ ID NO: 708472 - RNA, 19 nt, Homo sapiens
ggagaaggcgucuugcuuu

SEQ ID NO: 708473 - RNA, 19 nt, Homo sapiens
gagaaggcgucuugcuuug

SEQ ID NO: 708474 - RNA, 19 nt, Homo sapiens
ccaaguagcugggaauaca

SEQ ID NO: 708475 - RNA, 19 nt, Homo sapiens
gaaauaaagaacucucuca

SEQ ID NO: 708476 - RNA, 19 nt, Homo sapiens
gaaggcgucuugcuuuguc

SEQ ID NO: 708477 - RNA, 19 nt, Homo sapiens
aagacuaucuccucacuga

SEQ ID NO: 708478 - RNA, 19 nt, Homo sapiens
gaaggaguaugcauuuuga

SEQ ID NO: 708479 - RNA, 19 nt, Homo sapiens
gauaucaaguggacaaugc

SEQ ID NO: 708480 - RNA, 19 nt, Homo sapiens
caaggaaagagaaguuaaa

SEQ ID NO: 708481 - RNA, 19 nt, Homo sapiens
ccacaucacagaagacuau

SEQ ID NO: 708482 - RNA, 19 nt, Homo sapiens
cuuugaagcugauugguuu

SEQ ID NO: 708483 - RNA, 19 nt, Homo sapiens
gaaagagaaguuaaagaag

SEQ ID NO: 708484 - RNA, 19 nt, Homo sapiens
ccaaagugcugggauuaca

SEQ ID NO: 708485 - RNA, 19 nt, Homo sapiens
ggcuuaagguguauaaauc

SEQ ID NO: 708486 - RNA, 19 nt, Homo sapiens
caaugaaucacuacaugaa

SEQ ID NO: 708487 - RNA, 19 nt, Homo sapiens
gcaacuacgauaucaagug

SEQ ID NO: 708488 - RNA, 19 nt, Homo sapiens
caccaugcccagcuaauuu

SEQ ID NO: 708489 - RNA, 19 nt, Homo sapiens
aaacuacucgucucccuuu

SEQ ID NO: 708490 - RNA, 19 nt, Homo sapiens
gugcgggacuggugcagaa

SEQ ID NO: 708491 - RNA, 19 nt, Homo sapiens
gcuggaaguugcugguuuc

SEQ ID NO: 708492 - RNA, 19 nt, Homo sapiens
agaauuccuuguccucuga

SEQ ID NO: 708493 - RNA, 19 nt, Homo sapiens
ggagggaaagaucagaauu

SEQ ID NO: 708494 - RNA, 19 nt, Homo sapiens
gcucacaucuccccucuga

SEQ ID NO: 708495 - RNA, 19 nt, Homo sapiens
ccagccaagucuucauuug

SEQ ID NO: 708496 - RNA, 19 nt, Homo sapiens
gaagguguggcucuuugaa

SEQ ID NO: 708497 - RNA, 19 nt, Homo sapiens
acagaaggaguaugcauuu

SEQ ID NO: 708498 - RNA, 19 nt, Homo sapiens
gagggaaagaucagaauuc

SEQ ID NO: 708499 - RNA, 19 nt, Homo sapiens
ccuuggaacuguauuagau

SEQ ID NO: 708500 - RNA, 19 nt, Homo sapiens
gagccuacuauucauauug

SEQ ID NO: 708501 - RNA, 19 nt, Homo sapiens
cagggucucucguugcuau

SEQ ID NO: 708502 - RNA, 19 nt, Homo sapiens
ccgcuucacuggcaccauu

SEQ ID NO: 708503 - RNA, 19 nt, Homo sapiens
caucauuccugcucucaag

SEQ ID NO: 708504 - RNA, 19 nt, Homo sapiens
ccucauccuucgacuaaug

SEQ ID NO: 708505 - RNA, 19 nt, Homo sapiens
ccaaggaaagagaaguuaa

SEQ ID NO: 708506 - RNA, 19 nt, Homo sapiens
caggaaagauaccaaacag

SEQ ID NO: 708507 - RNA, 19 nt, Homo sapiens
ggcauuaccuuuucuacaa

SEQ ID NO: 708508 - RNA, 19 nt, Homo sapiens
gaaguuaaagaagauggaa

SEQ ID NO: 708509 - RNA, 19 nt, Homo sapiens
caaauggcuuaagguguau

SEQ ID NO: 708510 - RNA, 19 nt, Homo sapiens
gccucucaauugcuuauuu

SEQ ID NO: 708511 - RNA, 19 nt, Homo sapiens
uuacaggccucucaauugc

SEQ ID NO: 708512 - RNA, 19 nt, Homo sapiens
gcaauggugccaaggaaag

SEQ ID NO: 708513 - RNA, 19 nt, Homo sapiens
aagcaauggugccaaggaa

SEQ ID NO: 708514 - RNA, 19 nt, Homo sapiens
ucuccucacugaagacuau

SEQ ID NO: 708515 - RNA, 19 nt, Homo sapiens
gaaagauaccaaacagcau

SEQ ID NO: 708516 - RNA, 19 nt, Homo sapiens
ugauugacauaccaggaaa

SEQ ID NO: 708517 - RNA, 19 nt, Homo sapiens
agggagagcugauugacau

SEQ ID NO: 708518 - RNA, 19 nt, Homo sapiens
ucaaugaaucacuacauga

SEQ ID NO: 708519 - RNA, 19 nt, Homo sapiens
caaggagaccuaccucauc

SEQ ID NO: 708520 - RNA, 19 nt, Homo sapiens
ggaugccugugccaacaug

SEQ ID NO: 708521 - RNA, 19 nt, Homo sapiens
gccaaggaaagagaaguua

SEQ ID NO: 708522 - RNA, 19 nt, Homo sapiens
gcuggucacagaaggagua

SEQ ID NO: 708523 - RNA, 19 nt, Homo sapiens
caucuagccaggaaucuau

SEQ ID NO: 708524 - RNA, 19 nt, Homo sapiens
cuccagcccuucuacuauu

SEQ ID NO: 708525 - RNA, 19 nt, Homo sapiens
cugccaggcucauucaaga

SEQ ID NO: 708526 - RNA, 19 nt, Homo sapiens
gauaccaaacagcaucauu

SEQ ID NO: 708527 - RNA, 19 nt, Homo sapiens
ugccucagccucccaagua

SEQ ID NO: 708528 - RNA, 19 nt, Homo sapiens
ccuucuggcuggauacuau

SEQ ID NO: 708529 - RNA, 19 nt, Homo sapiens
ucacugccguccucacuac

SEQ ID NO: 708530 - RNA, 19 nt, Homo sapiens
ucacuucuguuuguucagu

SEQ ID NO: 708531 - RNA, 19 nt, Homo sapiens
aaucacuucuguuuguuca

SEQ ID NO: 708532 - RNA, 19 nt, Homo sapiens
ccucauuguuauuguggaa

SEQ ID NO: 708533 - RNA, 19 nt, Homo sapiens
ucacugaagacuaugacaa

SEQ ID NO: 708534 - RNA, 19 nt, Homo sapiens
ccaggaaagauaccaaaca

SEQ ID NO: 708535 - RNA, 19 nt, Homo sapiens
cucaaugaaucacuacaug

SEQ ID NO: 708536 - RNA, 19 nt, Homo sapiens
cuaccuuggaacuguauua

SEQ ID NO: 708537 - RNA, 19 nt, Homo sapiens
ccaugcacauugccuuauc

SEQ ID NO: 708538 - RNA, 19 nt, Homo sapiens
ccaccaugcccagcuaauu

SEQ ID NO: 708539 - RNA, 19 nt, Homo sapiens
ugacgggccugggcuucaa

SEQ ID NO: 708540 - RNA, 19 nt, Homo sapiens
cacagaaggaguaugcauu

SEQ ID NO: 708541 - RNA, 19 nt, Homo sapiens
ccagagcagagaauggaaa

SEQ ID NO: 708542 - RNA, 19 nt, Homo sapiens
ggacuggugcagaaacuac

SEQ ID NO: 708543 - RNA, 19 nt, Homo sapiens
ggucacagaaggaguaugc

SEQ ID NO: 708544 - RNA, 19 nt, Homo sapiens
acaggccucucaauugcuu

SEQ ID NO: 708545 - RNA, 19 nt, Homo sapiens
gcugauugguuuggcuguu

SEQ ID NO: 708546 - RNA, 19 nt, Homo sapiens
ucaaacgacucaaguuccu

SEQ ID NO: 708547 - RNA, 19 nt, Homo sapiens
cauucaacaucaacaccaa

SEQ ID NO: 708548 - RNA, 19 nt, Homo sapiens
uuuacaggccucucaauug

SEQ ID NO: 708549 - RNA, 19 nt, Homo sapiens
agaagacuaucuccucacu

SEQ ID NO: 708550 - RNA, 19 nt, Homo sapiens
guuuggcuguugacuacuu

SEQ ID NO: 708551 - RNA, 19 nt, Homo sapiens
ugauugguuuggcuguuga

SEQ ID NO: 708552 - RNA, 19 nt, Homo sapiens
ucacaucuccccucugauu

SEQ ID NO: 708553 - RNA, 19 nt, Homo sapiens
uggcuuaagguguauaaau

SEQ ID NO: 708554 - RNA, 19 nt, Homo sapiens
ccaccucuuccauaccuuu

SEQ ID NO: 708555 - RNA, 19 nt, Homo sapiens
gggcaaguuugugcuguac

SEQ ID NO: 708556 - RNA, 19 nt, Homo sapiens
gcugguuucuccuacuucu

SEQ ID NO: 708557 - RNA, 19 nt, Homo sapiens
ccuaccuucuggcuggaua

SEQ ID NO: 708558 - RNA, 19 nt, Homo sapiens
ugagccuacuauucauauu

SEQ ID NO: 708559 - RNA, 19 nt, Homo sapiens
uccagcccuucuacuauuu

SEQ ID NO: 708560 - RNA, 19 nt, Homo sapiens
gccaggcucauucaagaga

SEQ ID NO: 708561 - RNA, 19 nt, Homo sapiens
guguggcucuuugaaacaa

SEQ ID NO: 708562 - RNA, 19 nt, Homo sapiens
gggagagcugauugacaua

SEQ ID NO: 708563 - RNA, 19 nt, Homo sapiens
cuacuuugacggagggaaa

SEQ ID NO: 708564 - RNA, 19 nt, Homo sapiens
cugccaauuuacuaugauu

SEQ ID NO: 708565 - RNA, 19 nt, Homo sapiens
agccaggaaucuauugugu

SEQ ID NO: 708566 - RNA, 19 nt, Homo sapiens
cuccuggguucaagugauu

SEQ ID NO: 708567 - RNA, 19 nt, Homo sapiens
gaagaugacuccucugaau

SEQ ID NO: 708568 - RNA, 19 nt, Homo sapiens
gaaaagaggcacucaaauu

SEQ ID NO: 708569 - RNA, 19 nt, Homo sapiens
ccaaaucgagggaauguaa

SEQ ID NO: 708570 - RNA, 19 nt, Homo sapiens
gaaagauaauccaaaucga

SEQ ID NO: 708571 - RNA, 19 nt, Homo sapiens
gcaaugacguggccaccau

SEQ ID NO: 708572 - RNA, 19 nt, Homo sapiens
gaauguaaacccacguaaa

SEQ ID NO: 708573 - RNA, 19 nt, Homo sapiens
aaacauacaauaccuguga

SEQ ID NO: 708574 - RNA, 19 nt, Homo sapiens
caucuugucucgucgcauu

SEQ ID NO: 708575 - RNA, 19 nt, Homo sapiens
gaaguuccaccauucaaga

SEQ ID NO: 708576 - RNA, 19 nt, Homo sapiens
acacagacccuucauacuu

SEQ ID NO: 708577 - RNA, 19 nt, Homo sapiens
ucaacaaucuuaccccuua

SEQ ID NO: 708578 - RNA, 19 nt, Homo sapiens
gaagauggggcaagaauuu

SEQ ID NO: 708579 - RNA, 19 nt, Homo sapiens
aagaggcacucaaauucua

SEQ ID NO: 708580 - RNA, 19 nt, Homo sapiens
uuggagagcucuuuacuca

SEQ ID NO: 708581 - RNA, 19 nt, Homo sapiens
caaggaagaagaaguguca

SEQ ID NO: 708582 - RNA, 19 nt, Homo sapiens
cacagacccuucauacuuc

SEQ ID NO: 708583 - RNA, 19 nt, Homo sapiens
uaaagucacucagcuggau

SEQ ID NO: 708584 - RNA, 19 nt, Homo sapiens
caacaucacccuggcaaau

SEQ ID NO: 708585 - RNA, 19 nt, Homo sapiens
ugacuccucugaauuugau

SEQ ID NO: 708586 - RNA, 19 nt, Homo sapiens
gaugacuccucugaauuug

SEQ ID NO: 708587 - RNA, 19 nt, Homo sapiens
guacagugacucagaagau

SEQ ID NO: 708588 - RNA, 19 nt, Homo sapiens
caagagaagcgggauguug

SEQ ID NO: 708589 - RNA, 19 nt, Homo sapiens
cccagugccugucuuagaa

SEQ ID NO: 708590 - RNA, 19 nt, Homo sapiens
agaugacuccucugaauuu

SEQ ID NO: 708591 - RNA, 19 nt, Homo sapiens
ggaauguaaacccacguaa

SEQ ID NO: 708592 - RNA, 19 nt, Homo sapiens
ugacguggccaccaucuug

SEQ ID NO: 708593 - RNA, 19 nt, Homo sapiens
caccaccgcuuucugauac

SEQ ID NO: 708594 - RNA, 19 nt, Homo sapiens
ccaccaccgcuuucugaua

SEQ ID NO: 708595 - RNA, 19 nt, Homo sapiens
gacguugccuagcguuaga

SEQ ID NO: 708596 - RNA, 19 nt, Homo sapiens
gggauguugugggcaauga

SEQ ID NO: 708597 - RNA, 19 nt, Homo sapiens
uaaauaugcagaggacauu

SEQ ID NO: 708598 - RNA, 19 nt, Homo sapiens
gcuauaccaccaccgcuuu

SEQ ID NO: 708599 - RNA, 19 nt, Homo sapiens
guaaauaugcagaggacau

SEQ ID NO: 708600 - RNA, 19 nt, Homo sapiens
ucagcuggaucccaaggaa

SEQ ID NO: 708601 - RNA, 19 nt, Homo sapiens
ucgcauugcuguugaguac

SEQ ID NO: 708602 - RNA, 19 nt, Homo sapiens
gcucuuuacucaggcaaau

SEQ ID NO: 708603 - RNA, 19 nt, Homo sapiens
gagcagcgggaacaagaga

SEQ ID NO: 708604 - RNA, 19 nt, Homo sapiens
uacaauaccugugauacuc

SEQ ID NO: 708605 - RNA, 19 nt, Homo sapiens
gcccguagcgaccugcuuu

SEQ ID NO: 708606 - RNA, 19 nt, Homo sapiens
gcagcugacuacccaacuc

SEQ ID NO: 708607 - RNA, 19 nt, Homo sapiens
gggaauguaaacccacgua

SEQ ID NO: 708608 - RNA, 19 nt, Homo sapiens
ugggcagccugaguaaaua

SEQ ID NO: 708609 - RNA, 19 nt, Homo sapiens
caccagcagaauucaguua

SEQ ID NO: 708610 - RNA, 19 nt, Homo sapiens
caaaucgagggaauguaaa

SEQ ID NO: 708611 - RNA, 19 nt, Homo sapiens
cuucauacuucuuugaucu

SEQ ID NO: 708612 - RNA, 19 nt, Homo sapiens
cuacacagacccuucauac

SEQ ID NO: 708613 - RNA, 19 nt, Homo sapiens
ccaccuccgccuccaauga

SEQ ID NO: 708614 - RNA, 19 nt, Homo sapiens
agaaagauaauccaaaucg

SEQ ID NO: 708615 - RNA, 19 nt, Homo sapiens
uacagugacucagaagaug

SEQ ID NO: 708616 - RNA, 19 nt, Homo sapiens
caccaccgccuguaggauu

SEQ ID NO: 708617 - RNA, 19 nt, Homo sapiens
ggacaaccaaagaggaucu

SEQ ID NO: 708618 - RNA, 19 nt, Homo sapiens
uggaaugcgugaccaacau

SEQ ID NO: 708619 - RNA, 19 nt, Homo sapiens
aagaugacuccucugaauu

SEQ ID NO: 708620 - RNA, 19 nt, Homo sapiens
ucaguuacccaguggacaa

SEQ ID NO: 708621 - RNA, 19 nt, Homo sapiens
aagaaaagcuggggacuuc

SEQ ID NO: 708622 - RNA, 19 nt, Homo sapiens
ucuuugaucuuuggaagga

SEQ ID NO: 708623 - RNA, 19 nt, Homo sapiens
aagagaagcgggauguugu

SEQ ID NO: 708624 - RNA, 19 nt, Homo sapiens
gaagagugggagaaaauga

SEQ ID NO: 708625 - RNA, 19 nt, Homo sapiens
guuagaagcgagcuggaau

SEQ ID NO: 708626 - RNA, 19 nt, Homo sapiens
uaauccaaaucgagggaau

SEQ ID NO: 708627 - RNA, 19 nt, Homo sapiens
aaagaggcacucaaauucu

SEQ ID NO: 708628 - RNA, 19 nt, Homo sapiens
aaaagaggcacucaaauuc

SEQ ID NO: 708629 - RNA, 19 nt, Homo sapiens
ggaaugcgugaccaacauc

SEQ ID NO: 708630 - RNA, 19 nt, Homo sapiens
uaccaccaccgcuuucuga

SEQ ID NO: 708631 - RNA, 19 nt, Homo sapiens
gggcagccugaguaaauau

SEQ ID NO: 708632 - RNA, 19 nt, Homo sapiens
cauacuucuuugaucuuug

SEQ ID NO: 708633 - RNA, 19 nt, Homo sapiens
uucagaaguuccaccauuc

SEQ ID NO: 708634 - RNA, 19 nt, Homo sapiens
auacuucuuugaucuuugg

SEQ ID NO: 708635 - RNA, 19 nt, Homo sapiens
gacccuucauacuucuuug

SEQ ID NO: 708636 - RNA, 19 nt, Homo sapiens
acauacaauaccugugaua

SEQ ID NO: 708637 - RNA, 19 nt, Homo sapiens
ucagaaguuccaccauuca

SEQ ID NO: 708638 - RNA, 19 nt, Homo sapiens
gaaugcgugaccaacauca

SEQ ID NO: 708639 - RNA, 19 nt, Homo sapiens
ggaaaagaggcacucaaau

SEQ ID NO: 708640 - RNA, 19 nt, Homo sapiens
gugccugucuuagaaacau

SEQ ID NO: 708641 - RNA, 19 nt, Homo sapiens
ucagccauccgucaagguu

SEQ ID NO: 708642 - RNA, 19 nt, Homo sapiens
cagauggccagccugcuau

SEQ ID NO: 708643 - RNA, 19 nt, Homo sapiens
guaaacccacguaaaauca

SEQ ID NO: 708644 - RNA, 19 nt, Homo sapiens
cagacguugccuagcguua

SEQ ID NO: 708645 - RNA, 19 nt, Homo sapiens
cagaaguuccaccauucaa

SEQ ID NO: 708646 - RNA, 19 nt, Homo sapiens
gaauggaucuuucaccaaa

SEQ ID NO: 708647 - RNA, 19 nt, Homo sapiens
gcacaaugcuacugccuaa

SEQ ID NO: 708648 - RNA, 19 nt, Homo sapiens
ccaaagagcucaccagcau

SEQ ID NO: 708649 - RNA, 19 nt, Homo sapiens
aaagggagaucucaugauu

SEQ ID NO: 708650 - RNA, 19 nt, Homo sapiens
ccacagagaugcaaauucu

SEQ ID NO: 708651 - RNA, 19 nt, Homo sapiens
caucuuggcucuauucuuc

SEQ ID NO: 708652 - RNA, 19 nt, Homo sapiens
gaccaacccuacuauguga

SEQ ID NO: 708653 - RNA, 19 nt, Homo sapiens
gcacaucccaccagugaaa

SEQ ID NO: 708654 - RNA, 19 nt, Homo sapiens
aagguuggaugccuacuua

SEQ ID NO: 708655 - RNA, 19 nt, Homo sapiens
cuacaucucugagccuuaa

SEQ ID NO: 708656 - RNA, 19 nt, Homo sapiens
cuuaugagcuugaccauca

SEQ ID NO: 708657 - RNA, 19 nt, Homo sapiens
aaaugaagcuccugcuguu

SEQ ID NO: 708658 - RNA, 19 nt, Homo sapiens
gaaacaggguauugcucuu

SEQ ID NO: 708659 - RNA, 19 nt, Homo sapiens
caucacagcuaucgguaau

SEQ ID NO: 708660 - RNA, 19 nt, Homo sapiens
aaagccagcuggagaucua

SEQ ID NO: 708661 - RNA, 19 nt, Homo sapiens
agggagaucucaugauuga

SEQ ID NO: 708662 - RNA, 19 nt, Homo sapiens
gugaagcugccaucuguua

SEQ ID NO: 708663 - RNA, 19 nt, Homo sapiens
caaaaucucugcacaaaag

SEQ ID NO: 708664 - RNA, 19 nt, Homo sapiens
ggaaggaagugggaacaag

SEQ ID NO: 708665 - RNA, 19 nt, Homo sapiens
gacaugagcgucuuugaug

SEQ ID NO: 708666 - RNA, 19 nt, Homo sapiens
ggaccaacccuacuaugug

SEQ ID NO: 708667 - RNA, 19 nt, Homo sapiens
ugccaucuguuaauacuaa

SEQ ID NO: 708668 - RNA, 19 nt, Homo sapiens
gggcugcauuugaauauca

SEQ ID NO: 708669 - RNA, 19 nt, Homo sapiens
gcucuauucuuccacaugu

SEQ ID NO: 708670 - RNA, 19 nt, Homo sapiens
ucacagcuaucgguaauca

SEQ ID NO: 708671 - RNA, 19 nt, Homo sapiens
gcaccugccugugacauca

SEQ ID NO: 708672 - RNA, 19 nt, Homo sapiens
aaagagcucaccagcauuu

SEQ ID NO: 708673 - RNA, 19 nt, Homo sapiens
cuucagaccugggugcaua

SEQ ID NO: 708674 - RNA, 19 nt, Homo sapiens
ccacuaagaggguugagaa

SEQ ID NO: 708675 - RNA, 19 nt, Homo sapiens
gcccagacuucccgaaugu

SEQ ID NO: 708676 - RNA, 19 nt, Homo sapiens
ggagaucucaugauugaca

SEQ ID NO: 708677 - RNA, 19 nt, Homo sapiens
aagcugccaucuguuaaua

SEQ ID NO: 708678 - RNA, 19 nt, Homo sapiens
guccacaucuugcccaaug

SEQ ID NO: 708679 - RNA, 19 nt, Homo sapiens
cagcacaucccaccaguga

SEQ ID NO: 708680 - RNA, 19 nt, Homo sapiens
ugaccacgcuuuccacaca

SEQ ID NO: 708681 - RNA, 19 nt, Homo sapiens
gcuggucuuugcccuauga

SEQ ID NO: 708682 - RNA, 19 nt, Homo sapiens
ggguauugcucuucuucuu

SEQ ID NO: 708683 - RNA, 19 nt, Homo sapiens
gggcagcacccagauguuu

SEQ ID NO: 708684 - RNA, 19 nt, Homo sapiens
agaagacuuugaccuguga

SEQ ID NO: 708685 - RNA, 19 nt, Homo sapiens
gguauugcucuucuucuuu

SEQ ID NO: 708686 - RNA, 19 nt, Homo sapiens
ucaaggaggugcgcuucuu

SEQ ID NO: 708687 - RNA, 19 nt, Homo sapiens
gagacaguccagccucuuu

SEQ ID NO: 708688 - RNA, 19 nt, Homo sapiens
gaagcugccaucuguuaau

SEQ ID NO: 708689 - RNA, 19 nt, Homo sapiens
aaaccucccuguccacauc

SEQ ID NO: 708690 - RNA, 19 nt, Homo sapiens
ucagcucccugucuaugaa

SEQ ID NO: 708691 - RNA, 19 nt, Homo sapiens
gcgcuggucuuugcccuau

SEQ ID NO: 708692 - RNA, 19 nt, Homo sapiens
guuggaugccuacuuauga

SEQ ID NO: 708693 - RNA, 19 nt, Homo sapiens
ggaauggaucuuucaccaa

SEQ ID NO: 708694 - RNA, 19 nt, Homo sapiens
agcagaaacucaagaagga

SEQ ID NO: 708695 - RNA, 19 nt, Homo sapiens
aacaucagcucccugucua

SEQ ID NO: 708696 - RNA, 19 nt, Homo sapiens
ucgguaaucagaaauauga

SEQ ID NO: 708697 - RNA, 19 nt, Homo sapiens
ugccugggcugcauuugaa

SEQ ID NO: 708698 - RNA, 19 nt, Homo sapiens
gggcagacuucagagacuu

SEQ ID NO: 708699 - RNA, 19 nt, Homo sapiens
guauugcucuucuucuuuu

SEQ ID NO: 708700 - RNA, 19 nt, Homo sapiens
uguaugaauucgugggauu

SEQ ID NO: 708701 - RNA, 19 nt, Homo sapiens
caacaucagcucccugucu

SEQ ID NO: 708702 - RNA, 19 nt, Homo sapiens
cgacacaguaucaguggaa

SEQ ID NO: 708703 - RNA, 19 nt, Homo sapiens
cugagcaaauccacuaaga

SEQ ID NO: 708704 - RNA, 19 nt, Homo sapiens
gcacaaagggagaucucau

SEQ ID NO: 708705 - RNA, 19 nt, Homo sapiens
ccuuugaggugguggagaa

SEQ ID NO: 708706 - RNA, 19 nt, Homo sapiens
cuacaugucuguggguauc

SEQ ID NO: 708707 - RNA, 19 nt, Homo sapiens
acaagaccauccaguccuu

SEQ ID NO: 708708 - RNA, 19 nt, Homo sapiens
gauugacagucgcauugug

SEQ ID NO: 708709 - RNA, 19 nt, Homo sapiens
gggagcgagugcuuucuca

SEQ ID NO: 708710 - RNA, 19 nt, Homo sapiens
guucugcaccugccuguga

SEQ ID NO: 708711 - RNA, 19 nt, Homo sapiens
gaaaccuguugcuggaucu

SEQ ID NO: 708712 - RNA, 19 nt, Homo sapiens
gaacaagaacagagaaacc

SEQ ID NO: 708713 - RNA, 19 nt, Homo sapiens
ggcccagacuucccgaaug

SEQ ID NO: 708714 - RNA, 19 nt, Homo sapiens
ggaggaccaacccuacuau

SEQ ID NO: 708715 - RNA, 19 nt, Homo sapiens
ucuacccgcugcugaaaga

SEQ ID NO: 708716 - RNA, 19 nt, Homo sapiens
cgucuuugaugccuacaug

SEQ ID NO: 708717 - RNA, 19 nt, Homo sapiens
agacuucccgaauguauga

SEQ ID NO: 708718 - RNA, 19 nt, Homo sapiens
acaaagggagaucucauga

SEQ ID NO: 708719 - RNA, 19 nt, Homo sapiens
cgacaugagcgucuuugau

SEQ ID NO: 708720 - RNA, 19 nt, Homo sapiens
cugugaagcugccaucugu

SEQ ID NO: 708721 - RNA, 19 nt, Homo sapiens
gcuugaccaucacagcuau

SEQ ID NO: 708722 - RNA, 19 nt, Homo sapiens
ugcaaggucuuccacuuca

SEQ ID NO: 708723 - RNA, 19 nt, Homo sapiens
cacaguaucaguggaauug

SEQ ID NO: 708724 - RNA, 19 nt, Homo sapiens
gaccacgcuuuccacacaa

SEQ ID NO: 708725 - RNA, 19 nt, Homo sapiens
agaccugggugcauaacau

SEQ ID NO: 708726 - RNA, 19 nt, Homo sapiens
ucacauagaagacuuugac

SEQ ID NO: 708727 - RNA, 19 nt, Homo sapiens
caaauucugagcccuugga

SEQ ID NO: 708728 - RNA, 19 nt, Homo sapiens
ucucugagccuuaacuaca

SEQ ID NO: 708729 - RNA, 19 nt, Homo sapiens
gcacccagauguuuucuac

SEQ ID NO: 708730 - RNA, 19 nt, Homo sapiens
gcugccaucuguuaauacu

SEQ ID NO: 708731 - RNA, 19 nt, Homo sapiens
gcuuggcgcuggucuuugc

SEQ ID NO: 708732 - RNA, 19 nt, Homo sapiens
gagcgagugcuuucucaag

SEQ ID NO: 708733 - RNA, 19 nt, Homo sapiens
ccagacuucccgaauguau

SEQ ID NO: 708734 - RNA, 19 nt, Homo sapiens
ugaagcugccaucuguuaa

SEQ ID NO: 708735 - RNA, 19 nt, Homo sapiens
gaugccuacuuaugagcuu

SEQ ID NO: 708736 - RNA, 19 nt, Homo sapiens
ccagugaaacaggguauug

SEQ ID NO: 708737 - RNA, 19 nt, Homo sapiens
caaagggagaucucaugau

SEQ ID NO: 708738 - RNA, 19 nt, Homo sapiens
ugacaucaucccacaagau

SEQ ID NO: 708739 - RNA, 19 nt, Homo sapiens
gcaugcacgugcugguucu

SEQ ID NO: 708740 - RNA, 19 nt, Homo sapiens
ggaguucccaguggauuca

SEQ ID NO: 708741 - RNA, 19 nt, Homo sapiens
uaagcacgacacaguauca

SEQ ID NO: 708742 - RNA, 19 nt, Homo sapiens
uauuaagcacgacacagua

SEQ ID NO: 708743 - RNA, 19 nt, Homo sapiens
gcgaugccaugaauuugcu

SEQ ID NO: 708744 - RNA, 19 nt, Homo sapiens
caaagagcucaccagcauu

SEQ ID NO: 708745 - RNA, 19 nt, Homo sapiens
ccaugcuugugucuagaaa

SEQ ID NO: 708746 - RNA, 19 nt, Homo sapiens
gaaacuaggugcauauuua

SEQ ID NO: 708747 - RNA, 19 nt, Homo sapiens
gaccaaagauggauuaaua

SEQ ID NO: 708748 - RNA, 19 nt, Homo sapiens
gaaaugccuuuguacuuua

SEQ ID NO: 708749 - RNA, 19 nt, Homo sapiens
ggaaaugccuuuguacuuu

SEQ ID NO: 708750 - RNA, 19 nt, Homo sapiens
gcucuuagcuggugccaua

SEQ ID NO: 708751 - RNA, 19 nt, Homo sapiens
ugacaaagcuggcaaagga

SEQ ID NO: 708752 - RNA, 19 nt, Homo sapiens
gaucagagccaguuccuaa

SEQ ID NO: 708753 - RNA, 19 nt, Homo sapiens
ugggagaacucauguauaa

SEQ ID NO: 708754 - RNA, 19 nt, Homo sapiens
ggauuuaauucgcuccuua

SEQ ID NO: 708755 - RNA, 19 nt, Homo sapiens
ggucaacacuaacaugauu

SEQ ID NO: 708756 - RNA, 19 nt, Homo sapiens
caaguuaguuucuccuauu

SEQ ID NO: 708757 - RNA, 19 nt, Homo sapiens
ccagaucauugugaaauua

SEQ ID NO: 708758 - RNA, 19 nt, Homo sapiens
cauuggagauguuuaguaa

SEQ ID NO: 708759 - RNA, 19 nt, Homo sapiens
caaauucugucucuggauu

SEQ ID NO: 708760 - RNA, 19 nt, Homo sapiens
gaaaggagcaagucagaau

SEQ ID NO: 708761 - RNA, 19 nt, Homo sapiens
gaagaucagcccugggaua

SEQ ID NO: 708762 - RNA, 19 nt, Homo sapiens
gaaagauacugcgugaaga

SEQ ID NO: 708763 - RNA, 19 nt, Homo sapiens
caggaaagauguugaagug

SEQ ID NO: 708764 - RNA, 19 nt, Homo sapiens
ggagaaagccagccuaauc

SEQ ID NO: 708765 - RNA, 19 nt, Homo sapiens
gggauuuggucaacacuaa

SEQ ID NO: 708766 - RNA, 19 nt, Homo sapiens
gugauagacugcuuuagaa

SEQ ID NO: 708767 - RNA, 19 nt, Homo sapiens
ucaagaauuuguugccuuu

SEQ ID NO: 708768 - RNA, 19 nt, Homo sapiens
gagcaagucagaauagaaa

SEQ ID NO: 708769 - RNA, 19 nt, Homo sapiens
uaacuuugcugacuuacga

SEQ ID NO: 708770 - RNA, 19 nt, Homo sapiens
ggacagaccacaauucauc

SEQ ID NO: 708771 - RNA, 19 nt, Homo sapiens
ggucagaggcgcaugaauu

SEQ ID NO: 708772 - RNA, 19 nt, Homo sapiens
caaagaggcuacuguaagg

SEQ ID NO: 708773 - RNA, 19 nt, Homo sapiens
guaggaaacuaggugcaua

SEQ ID NO: 708774 - RNA, 19 nt, Homo sapiens
agacaaauauguucugaca

SEQ ID NO: 708775 - RNA, 19 nt, Homo sapiens
guccaucucuuguuuaaau

SEQ ID NO: 708776 - RNA, 19 nt, Homo sapiens
acauggaacucauuagaaa

SEQ ID NO: 708777 - RNA, 19 nt, Homo sapiens
cuagggaaaugccuuugua

SEQ ID NO: 708778 - RNA, 19 nt, Homo sapiens
gaucagcccugggauagug

SEQ ID NO: 708779 - RNA, 19 nt, Homo sapiens
gaacucugcccuuuaacuu

SEQ ID NO: 708780 - RNA, 19 nt, Homo sapiens
gcaaguggcaggagaaauc

SEQ ID NO: 708781 - RNA, 19 nt, Homo sapiens
gaaauuuggucagguuaca

SEQ ID NO: 708782 - RNA, 19 nt, Homo sapiens
caacauggaacucauuaga

SEQ ID NO: 708783 - RNA, 19 nt, Homo sapiens
cauguugccuugcauaaug

SEQ ID NO: 708784 - RNA, 19 nt, Homo sapiens
ggaaguugacaucuuguuu

SEQ ID NO: 708785 - RNA, 19 nt, Homo sapiens
cauggaaguugacaucuug

SEQ ID NO: 708786 - RNA, 19 nt, Homo sapiens
uuacguccaucucuuguuu

SEQ ID NO: 708787 - RNA, 19 nt, Homo sapiens
ggagugauagacugcuuua

SEQ ID NO: 708788 - RNA, 19 nt, Homo sapiens
gaccuuagcagacauugaa

SEQ ID NO: 708789 - RNA, 19 nt, Homo sapiens
ucagaaauuuggucagguu

SEQ ID NO: 708790 - RNA, 19 nt, Homo sapiens
ggaaacuaggugcauauuu

SEQ ID NO: 708791 - RNA, 19 nt, Homo sapiens
aaagacaccugacauaugc

SEQ ID NO: 708792 - RNA, 19 nt, Homo sapiens
gaagguggaaauaaacuau

SEQ ID NO: 708793 - RNA, 19 nt, Homo sapiens
gcaagucagaauagaaauu

SEQ ID NO: 708794 - RNA, 19 nt, Homo sapiens
cagaaggccucaggugauu

SEQ ID NO: 708795 - RNA, 19 nt, Homo sapiens
ugacaucuuguuucaguua

SEQ ID NO: 708796 - RNA, 19 nt, Homo sapiens
gaaagauguugaagugacu

SEQ ID NO: 708797 - RNA, 19 nt, Homo sapiens
aaacugcucauaugaugua

SEQ ID NO: 708798 - RNA, 19 nt, Homo sapiens
guguaacuuugcugacuua

SEQ ID NO: 708799 - RNA, 19 nt, Homo sapiens
ccacugcuguguauccuau

SEQ ID NO: 708800 - RNA, 19 nt, Homo sapiens
gaaguugacaucuuguuuc

SEQ ID NO: 708801 - RNA, 19 nt, Homo sapiens
gggaaaugccuuuguacuu

SEQ ID NO: 708802 - RNA, 19 nt, Homo sapiens
gauacugcgugaagaagga

SEQ ID NO: 708803 - RNA, 19 nt, Homo sapiens
gagaaggccauaaaacuua

SEQ ID NO: 708804 - RNA, 19 nt, Homo sapiens
agaaagugcuacgcuauga

SEQ ID NO: 708805 - RNA, 19 nt, Homo sapiens
cuacaagggugccaaagca

SEQ ID NO: 708806 - RNA, 19 nt, Homo sapiens
cacaaauccuuuagaaauc

SEQ ID NO: 708807 - RNA, 19 nt, Homo sapiens
gaccaguucuucuacaagu

SEQ ID NO: 708808 - RNA, 19 nt, Homo sapiens
ugauucagcucgaccaguu

SEQ ID NO: 708809 - RNA, 19 nt, Homo sapiens
cagcgaugguucuacauug

SEQ ID NO: 708810 - RNA, 19 nt, Homo sapiens
caagauccguuugcaagug

SEQ ID NO: 708811 - RNA, 19 nt, Homo sapiens
gcagaaggccucaggugau

SEQ ID NO: 708812 - RNA, 19 nt, Homo sapiens
guugacaucuuguuucagu

SEQ ID NO: 708813 - RNA, 19 nt, Homo sapiens
caucauugguacccacuug

SEQ ID NO: 708814 - RNA, 19 nt, Homo sapiens
uaaguggagugguggauca

SEQ ID NO: 708815 - RNA, 19 nt, Homo sapiens
ggaaguacuuuuggcauuu

SEQ ID NO: 708816 - RNA, 19 nt, Homo sapiens
ccaaagaggcuacuguaag

SEQ ID NO: 708817 - RNA, 19 nt, Homo sapiens
cuacagcgaugguucuaca

SEQ ID NO: 708818 - RNA, 19 nt, Homo sapiens
gaauuugugcaacuacauu

SEQ ID NO: 708819 - RNA, 19 nt, Homo sapiens
ccacaauucaucaacauau

SEQ ID NO: 708820 - RNA, 19 nt, Homo sapiens
gcucauaugauguacaugu

SEQ ID NO: 708821 - RNA, 19 nt, Homo sapiens
acucgauacuugaacauuu

SEQ ID NO: 708822 - RNA, 19 nt, Homo sapiens
caaauuuggacuuuaccua

SEQ ID NO: 708823 - RNA, 19 nt, Homo sapiens
ggagaacucauguauaaaa

SEQ ID NO: 708824 - RNA, 19 nt, Homo sapiens
ccugacauaugcggaauuu

SEQ ID NO: 708825 - RNA, 19 nt, Homo sapiens
aagaauuuguugccuuuga

SEQ ID NO: 708826 - RNA, 19 nt, Homo sapiens
ccacaguuauugggaguug

SEQ ID NO: 708827 - RNA, 19 nt, Homo sapiens
gaaagugcuacgcuaugaa

SEQ ID NO: 708828 - RNA, 19 nt, Homo sapiens
gaccacaauucaucaacau

SEQ ID NO: 708829 - RNA, 19 nt, Homo sapiens
gucagaggcgcaugaauuu

SEQ ID NO: 708830 - RNA, 19 nt, Homo sapiens
gaaagccagccuaauccaa

SEQ ID NO: 708831 - RNA, 19 nt, Homo sapiens
ggagcaagucagaauagaa

SEQ ID NO: 708832 - RNA, 19 nt, Homo sapiens
gggcuggccaaaccacuua

SEQ ID NO: 708833 - RNA, 19 nt, Homo sapiens
uaacaacauggaacucauu

SEQ ID NO: 708834 - RNA, 19 nt, Homo sapiens
ggagauguuuaguaaucau

SEQ ID NO: 708835 - RNA, 19 nt, Homo sapiens
aaacuuacagugaacgauu

SEQ ID NO: 708836 - RNA, 19 nt, Homo sapiens
uaagaaagugcuacgcuau

SEQ ID NO: 708837 - RNA, 19 nt, Homo sapiens
ggauugcuccucuggaaga

SEQ ID NO: 708838 - RNA, 19 nt, Homo sapiens
guuagcagauuuauaugag

SEQ ID NO: 708839 - RNA, 19 nt, Homo sapiens
ccauggaaguugacaucuu

SEQ ID NO: 708840 - RNA, 19 nt, Homo sapiens
ucaaguuaguuucuccuau

SEQ ID NO: 708841 - RNA, 19 nt, Homo sapiens
ugacauaugcggaauuuac

SEQ ID NO: 708842 - RNA, 19 nt, Homo sapiens
uuaccuaccucucuucaag

SEQ ID NO: 708843 - RNA, 19 nt, Homo sapiens
gguguaacuuugcugacuu

SEQ ID NO: 708844 - RNA, 19 nt, Homo sapiens
ucagaccaaagauggauua

SEQ ID NO: 708845 - RNA, 19 nt, Homo sapiens
gggaaaggagcaagucaga

SEQ ID NO: 708846 - RNA, 19 nt, Homo sapiens
gcaagcaggcuaacaauuu

SEQ ID NO: 708847 - RNA, 19 nt, Homo sapiens
uaaguuagccucaucauuu

SEQ ID NO: 708848 - RNA, 19 nt, Homo sapiens
gcuuauaaaugguugcuua

SEQ ID NO: 708849 - RNA, 19 nt, Homo sapiens
ggacugaaaccuacuauga

SEQ ID NO: 708850 - RNA, 19 nt, Homo sapiens
gaauauagcaggaaguuga

SEQ ID NO: 708851 - RNA, 19 nt, Homo sapiens
gcaggaaguugaugaugaa

SEQ ID NO: 708852 - RNA, 19 nt, Homo sapiens
caaccaaacuccacacuuc

SEQ ID NO: 708853 - RNA, 19 nt, Homo sapiens
ggauuuaucagaaccuuua

SEQ ID NO: 708854 - RNA, 19 nt, Homo sapiens
caggguaucucccaauaaa

SEQ ID NO: 708855 - RNA, 19 nt, Homo sapiens
gggcaaacaugaaauccaa

SEQ ID NO: 708856 - RNA, 19 nt, Homo sapiens
ggagaucccugucaugucu

SEQ ID NO: 708857 - RNA, 19 nt, Homo sapiens
caagaccagugugaaguua

SEQ ID NO: 708858 - RNA, 19 nt, Homo sapiens
gaaagagucugaggcaagu

SEQ ID NO: 708859 - RNA, 19 nt, Homo sapiens
gauguuaagugguggaguu

SEQ ID NO: 708860 - RNA, 19 nt, Homo sapiens
gauaugagaggcugacaaa

SEQ ID NO: 708861 - RNA, 19 nt, Homo sapiens
ugaagaugcuuauaaaugg

SEQ ID NO: 708862 - RNA, 19 nt, Homo sapiens
gaacugagccgguccuuuu

SEQ ID NO: 708863 - RNA, 19 nt, Homo sapiens
uaagcagccuguauacuga

SEQ ID NO: 708864 - RNA, 19 nt, Homo sapiens
gcuacugaguggugcuuua

SEQ ID NO: 708865 - RNA, 19 nt, Homo sapiens
gaacucaguccucuucaug

SEQ ID NO: 708866 - RNA, 19 nt, Homo sapiens
caugcaauuuggacaguua

SEQ ID NO: 708867 - RNA, 19 nt, Homo sapiens
aaacuuagguugggagaau

SEQ ID NO: 708868 - RNA, 19 nt, Homo sapiens
gaaauccaauccugcuauc

SEQ ID NO: 708869 - RNA, 19 nt, Homo sapiens
gaagagugggcaaacauga

SEQ ID NO: 708870 - RNA, 19 nt, Homo sapiens
guccauaauuguacugaaa

SEQ ID NO: 708871 - RNA, 19 nt, Homo sapiens
ggagacaucagggaagaua

SEQ ID NO: 708872 - RNA, 19 nt, Homo sapiens
gaguacaguuugugcuauu

SEQ ID NO: 708873 - RNA, 19 nt, Homo sapiens
ggaaguugaugaugaacca

SEQ ID NO: 708874 - RNA, 19 nt, Homo sapiens
ccaauaaaguguuccuaag

SEQ ID NO: 708875 - RNA, 19 nt, Homo sapiens
gcaauuguacuuaacuaug

SEQ ID NO: 708876 - RNA, 19 nt, Homo sapiens
gcuuaacccuucuagaugu

SEQ ID NO: 708877 - RNA, 19 nt, Homo sapiens
ucauuucuguccauaauug

SEQ ID NO: 708878 - RNA, 19 nt, Homo sapiens
ugaaccaguuggaagcaua

SEQ ID NO: 708879 - RNA, 19 nt, Homo sapiens
gaauucaaguucuuuccau

SEQ ID NO: 708880 - RNA, 19 nt, Homo sapiens
gcagaagagugggcaaaca

SEQ ID NO: 708881 - RNA, 19 nt, Homo sapiens
gaagaugcuuauaaauggu

SEQ ID NO: 708882 - RNA, 19 nt, Homo sapiens
ugagugaucugcagaaugc

SEQ ID NO: 708883 - RNA, 19 nt, Homo sapiens
gaagcauacugaagugucu

SEQ ID NO: 708884 - RNA, 19 nt, Homo sapiens
acugaaaccuacuaugauu

SEQ ID NO: 708885 - RNA, 19 nt, Homo sapiens
uauggaagaaccucuauuu

SEQ ID NO: 708886 - RNA, 19 nt, Homo sapiens
gaggugaucauuucucaug

SEQ ID NO: 708887 - RNA, 19 nt, Homo sapiens
acguaaaccuccacuugua

SEQ ID NO: 708888 - RNA, 19 nt, Homo sapiens
gagccaagcacagguguuu

SEQ ID NO: 708889 - RNA, 19 nt, Homo sapiens
gaguggugcuuuaucugaa

SEQ ID NO: 708890 - RNA, 19 nt, Homo sapiens
uguaguauguauucacuga

SEQ ID NO: 708891 - RNA, 19 nt, Homo sapiens
uguagggucugcuuaaugu

SEQ ID NO: 708892 - RNA, 19 nt, Homo sapiens
ggaagaaccucuauuuugc

SEQ ID NO: 708893 - RNA, 19 nt, Homo sapiens
aaauuucaguggucuauca

SEQ ID NO: 708894 - RNA, 19 nt, Homo sapiens
cccaguggauuguaucaaa

SEQ ID NO: 708895 - RNA, 19 nt, Homo sapiens
gagaaguaccaggcuauuu

SEQ ID NO: 708896 - RNA, 19 nt, Homo sapiens
caaugaaagugaagaugca

SEQ ID NO: 708897 - RNA, 19 nt, Homo sapiens
gcuuuucucuccauacuua

SEQ ID NO: 708898 - RNA, 19 nt, Homo sapiens
gauguagggucugcuuaau

SEQ ID NO: 708899 - RNA, 19 nt, Homo sapiens
gugaaguuauucugauuuc

SEQ ID NO: 708900 - RNA, 19 nt, Homo sapiens
uguaucaaauccagaauuc

SEQ ID NO: 708901 - RNA, 19 nt, Homo sapiens
cagaggugaucauuucuca

SEQ ID NO: 708902 - RNA, 19 nt, Homo sapiens
gaaauacaguuugguaccu

SEQ ID NO: 708903 - RNA, 19 nt, Homo sapiens
aaugaggaacggaaacuua

SEQ ID NO: 708904 - RNA, 19 nt, Homo sapiens
caagcaggcuaacaauuuu

SEQ ID NO: 708905 - RNA, 19 nt, Homo sapiens
caauuguacuuaacuaugc

SEQ ID NO: 708906 - RNA, 19 nt, Homo sapiens
gaaccucuauuuugcauca

SEQ ID NO: 708907 - RNA, 19 nt, Homo sapiens
ucugauuucuugggaauuu

SEQ ID NO: 708908 - RNA, 19 nt, Homo sapiens
agaccagugugaaguuauu

SEQ ID NO: 708909 - RNA, 19 nt, Homo sapiens
ccacaagaccagcagaaga

SEQ ID NO: 708910 - RNA, 19 nt, Homo sapiens
cccuguaccuuugauguua

SEQ ID NO: 708911 - RNA, 19 nt, Homo sapiens
guaccaggcuauuucuucu

SEQ ID NO: 708912 - RNA, 19 nt, Homo sapiens
aggcagaaauauaacuuga

SEQ ID NO: 708913 - RNA, 19 nt, Homo sapiens
gaggagaucccugucaugu

SEQ ID NO: 708914 - RNA, 19 nt, Homo sapiens
gcaggguaucucccaauaa

SEQ ID NO: 708915 - RNA, 19 nt, Homo sapiens
gcaggagaaucgcuugaac

SEQ ID NO: 708916 - RNA, 19 nt, Homo sapiens
cauaucauuucuguccaua

SEQ ID NO: 708917 - RNA, 19 nt, Homo sapiens
aaacaggcaggauuuauca

SEQ ID NO: 708918 - RNA, 19 nt, Homo sapiens
ggccguccauuagagauuu

SEQ ID NO: 708919 - RNA, 19 nt, Homo sapiens
ccacaggccguccauuaga

SEQ ID NO: 708920 - RNA, 19 nt, Homo sapiens
acugcugccugaagacuua

SEQ ID NO: 708921 - RNA, 19 nt, Homo sapiens
aauaaaguguuccuaagca

SEQ ID NO: 708922 - RNA, 19 nt, Homo sapiens
ucauucuugucacuacuua

SEQ ID NO: 708923 - RNA, 19 nt, Homo sapiens
cagcuguucuuuggccaua

SEQ ID NO: 708924 - RNA, 19 nt, Homo sapiens
cuuauauucuggacugaaa

SEQ ID NO: 708925 - RNA, 19 nt, Homo sapiens
cauggacucucaagcacuu

SEQ ID NO: 708926 - RNA, 19 nt, Homo sapiens
acccagaggugaucauuuc

SEQ ID NO: 708927 - RNA, 19 nt, Homo sapiens
acaguuugguaccuuguuu

SEQ ID NO: 708928 - RNA, 19 nt, Homo sapiens
cuucuacccuacaucuuaa

SEQ ID NO: 708929 - RNA, 19 nt, Homo sapiens
caggcaggauuuaucagaa

SEQ ID NO: 708930 - RNA, 19 nt, Homo sapiens
ccaguggauuguaucaaau

SEQ ID NO: 708931 - RNA, 19 nt, Homo sapiens
gaauuaggcccuguaccuu

SEQ ID NO: 708932 - RNA, 19 nt, Homo sapiens
guucuaccauggacucuca

SEQ ID NO: 708933 - RNA, 19 nt, Homo sapiens
uaugagaggcugacaaaca

SEQ ID NO: 708934 - RNA, 19 nt, Homo sapiens
gcaaacaugaaauccaauc

SEQ ID NO: 708935 - RNA, 19 nt, Homo sapiens
ugucagggcuuuuacguaa

SEQ ID NO: 708936 - RNA, 19 nt, Homo sapiens
guacaagaccagugugaag

SEQ ID NO: 708937 - RNA, 19 nt, Homo sapiens
cuaagcagccuguauacug

SEQ ID NO: 708938 - RNA, 19 nt, Homo sapiens
uuacguaaaccuccacuug

SEQ ID NO: 708939 - RNA, 19 nt, Homo sapiens
aaauauagaguggucagua

SEQ ID NO: 708940 - RNA, 19 nt, Homo sapiens
guacugaaauagaaaagug

SEQ ID NO: 708941 - RNA, 19 nt, Homo sapiens
ccuucuacccuacaucuua

SEQ ID NO: 708942 - RNA, 19 nt, Homo sapiens
gugugaaguuauucugauu

SEQ ID NO: 708943 - RNA, 19 nt, Homo sapiens
gccucuggcuugcgguaua

SEQ ID NO: 708944 - RNA, 19 nt, Homo sapiens
guggugcuuuaucugaaua

SEQ ID NO: 708945 - RNA, 19 nt, Homo sapiens
cagcagaauguacauguug

SEQ ID NO: 708946 - RNA, 19 nt, Homo sapiens
ggaaguagcuccucuguuu

SEQ ID NO: 708947 - RNA, 19 nt, Homo sapiens
ggaagaaccuuauaaaugu

SEQ ID NO: 708948 - RNA, 19 nt, Homo sapiens
ggagaaaccuuauaaaugu

SEQ ID NO: 708949 - RNA, 19 nt, Homo sapiens
ggagaaaccuuauaagugu

SEQ ID NO: 708950 - RNA, 19 nt, Homo sapiens
ggaaauccuuuacuucuaa

SEQ ID NO: 708951 - RNA, 19 nt, Homo sapiens
ggagagaccuuauaagugu

SEQ ID NO: 708952 - RNA, 19 nt, Homo sapiens
gagcgaaacucuugucuga

SEQ ID NO: 708953 - RNA, 19 nt, Homo sapiens
uagaaucccugccuacuua

SEQ ID NO: 708954 - RNA, 19 nt, Homo sapiens
gaagagaacccaagaaauc

SEQ ID NO: 708955 - RNA, 19 nt, Homo sapiens
gcgaaacucuugucugaaa

SEQ ID NO: 708956 - RNA, 19 nt, Homo sapiens
gcucagaccacuuaucuua

SEQ ID NO: 708957 - RNA, 19 nt, Homo sapiens
ccacauagcagcugaaauu

SEQ ID NO: 708958 - RNA, 19 nt, Homo sapiens
gcacucaggccuaauuaua

SEQ ID NO: 708959 - RNA, 19 nt, Homo sapiens
gagagaaaccuuauaaaug

SEQ ID NO: 708960 - RNA, 19 nt, Homo sapiens
uagaggagcugcagaaaga

SEQ ID NO: 708961 - RNA, 19 nt, Homo sapiens
guuauuaagucaccucuaa

SEQ ID NO: 708962 - RNA, 19 nt, Homo sapiens
guagaaaucuuaugguaca

SEQ ID NO: 708963 - RNA, 19 nt, Homo sapiens
ggaaaguccuuaccucuag

SEQ ID NO: 708964 - RNA, 19 nt, Homo sapiens
gggaaaaccuuuauuauga

SEQ ID NO: 708965 - RNA, 19 nt, Homo sapiens
gagagaaaccuuacaaaug

SEQ ID NO: 708966 - RNA, 19 nt, Homo sapiens
gggaagaaccuuauaaaug

SEQ ID NO: 708967 - RNA, 19 nt, Homo sapiens
ucaaagugcuuaccuucua

SEQ ID NO: 708968 - RNA, 19 nt, Homo sapiens
ggagagaaaccuuauaaau

SEQ ID NO: 708969 - RNA, 19 nt, Homo sapiens
gggaaagucuucucucaga

SEQ ID NO: 708970 - RNA, 19 nt, Homo sapiens
ggaauucucuuggcuacaa

SEQ ID NO: 708971 - RNA, 19 nt, Homo sapiens
gaacccaagaaaucaauua

SEQ ID NO: 708972 - RNA, 19 nt, Homo sapiens
gaagagcuuucaguucaaa

SEQ ID NO: 708973 - RNA, 19 nt, Homo sapiens
gagaagcccuaugaaugua

SEQ ID NO: 708974 - RNA, 19 nt, Homo sapiens
ggagacagcuugacuuucg

SEQ ID NO: 708975 - RNA, 19 nt, Homo sapiens
gggagaaaccuuauaaaug

SEQ ID NO: 708976 - RNA, 19 nt, Homo sapiens
guaaaugagagcaacaaua

SEQ ID NO: 708977 - RNA, 19 nt, Homo sapiens
gagaaagccuacaaaugug

SEQ ID NO: 708978 - RNA, 19 nt, Homo sapiens
ggagaagcccuaugaaugu

SEQ ID NO: 708979 - RNA, 19 nt, Homo sapiens
gaaaucuuaugguacauca

SEQ ID NO: 708980 - RNA, 19 nt, Homo sapiens
caaacuucauugaccauaa

SEQ ID NO: 708981 - RNA, 19 nt, Homo sapiens
caaagugcuuaccuucuaa

SEQ ID NO: 708982 - RNA, 19 nt, Homo sapiens
gcagaaagaccuugaugga

SEQ ID NO: 708983 - RNA, 19 nt, Homo sapiens
cuacgaaugucauguaugu

SEQ ID NO: 708984 - RNA, 19 nt, Homo sapiens
uggaagagcuuucaguuca

SEQ ID NO: 708985 - RNA, 19 nt, Homo sapiens
ucagaccacuuaucuuauu

SEQ ID NO: 708986 - RNA, 19 nt, Homo sapiens
agagaaagccuacaaaugu

SEQ ID NO: 708987 - RNA, 19 nt, Homo sapiens
ggucuucgguucaaacaga

SEQ ID NO: 708988 - RNA, 19 nt, Homo sapiens
gcagagaacccuuacaagu

SEQ ID NO: 708989 - RNA, 19 nt, Homo sapiens
gagaaaccuuauaagugua

SEQ ID NO: 708990 - RNA, 19 nt, Homo sapiens
ggacaagagucugcugaug

SEQ ID NO: 708991 - RNA, 19 nt, Homo sapiens
uuaaguaacuguuggacaa

SEQ ID NO: 708992 - RNA, 19 nt, Homo sapiens
acagaaaccugauugaaca

SEQ ID NO: 708993 - RNA, 19 nt, Homo sapiens
gaaggaugauaccuggaaa

SEQ ID NO: 708994 - RNA, 19 nt, Homo sapiens
cagaaaaucuagugucaua

SEQ ID NO: 708995 - RNA, 19 nt, Homo sapiens
gggagaagcccuaugaaug

SEQ ID NO: 708996 - RNA, 19 nt, Homo sapiens
cccaagaaaucaauuaaug

SEQ ID NO: 708997 - RNA, 19 nt, Homo sapiens
guacaucaaagaauccaua

SEQ ID NO: 708998 - RNA, 19 nt, Homo sapiens
gaacaucaaagaauucaca

SEQ ID NO: 708999 - RNA, 19 nt, Homo sapiens
ggagaagccauaugaaugu

SEQ ID NO: 709000 - RNA, 19 nt, Homo sapiens
agagaaaccuuacaaaugc

SEQ ID NO: 709001 - RNA, 19 nt, Homo sapiens
uaagucaccucuaaagcuu

SEQ ID NO: 709002 - RNA, 19 nt, Homo sapiens
aaagagcacuggauuugga

SEQ ID NO: 709003 - RNA, 19 nt, Homo sapiens
gaagaagagccucauuuua

SEQ ID NO: 709004 - RNA, 19 nt, Homo sapiens
gaaaugaaacagaugaaag

SEQ ID NO: 709005 - RNA, 19 nt, Homo sapiens
gagugugaauggcaaguuu

SEQ ID NO: 709006 - RNA, 19 nt, Homo sapiens
ccaaguaguucucaaagag

SEQ ID NO: 709007 - RNA, 19 nt, Homo sapiens
gacaagagucugcugauga

SEQ ID NO: 709008 - RNA, 19 nt, Homo sapiens
ggaagagcuuucaguucaa

SEQ ID NO: 709009 - RNA, 19 nt, Homo sapiens
gugggaaggcuuucaguua

SEQ ID NO: 709010 - RNA, 19 nt, Homo sapiens
gggagaaaccuuauaagug

SEQ ID NO: 709011 - RNA, 19 nt, Homo sapiens
ggagaauuauggaaaugug

SEQ ID NO: 709012 - RNA, 19 nt, Homo sapiens
cagaagaccuaccuuugau

SEQ ID NO: 709013 - RNA, 19 nt, Homo sapiens
gagaagcccuaugcgugua

SEQ ID NO: 709014 - RNA, 19 nt, Homo sapiens
cuacugaccuaguggcauu

SEQ ID NO: 709015 - RNA, 19 nt, Homo sapiens
uaauggccaugugauguua

SEQ ID NO: 709016 - RNA, 19 nt, Homo sapiens
caaaugaguagcauauaga

SEQ ID NO: 709017 - RNA, 19 nt, Homo sapiens
caacagaaaccugauugaa

SEQ ID NO: 709018 - RNA, 19 nt, Homo sapiens
gcagagagaaaccuuacaa

SEQ ID NO: 709019 - RNA, 19 nt, Homo sapiens
ccucauaaauguaaggaau

SEQ ID NO: 709020 - RNA, 19 nt, Homo sapiens
gggagaagccauaugaaug

SEQ ID NO: 709021 - RNA, 19 nt, Homo sapiens
gaauguaaagauuguggua

SEQ ID NO: 709022 - RNA, 19 nt, Homo sapiens
ggaaggaugauaccuggaa

SEQ ID NO: 709023 - RNA, 19 nt, Homo sapiens
agagaacccuuacaagugu

SEQ ID NO: 709024 - RNA, 19 nt, Homo sapiens
gaagaccuaccuuugauuc

SEQ ID NO: 709025 - RNA, 19 nt, Homo sapiens
acaaaugaguagcauauag

SEQ ID NO: 709026 - RNA, 19 nt, Homo sapiens
ggaaaugaaacagaugaaa

SEQ ID NO: 709027 - RNA, 19 nt, Homo sapiens
aaagaauucucucagacuu

SEQ ID NO: 709028 - RNA, 19 nt, Homo sapiens
gaaacuccauacacaagag

SEQ ID NO: 709029 - RNA, 19 nt, Homo sapiens
ccacaaugcucugagacaa

SEQ ID NO: 709030 - RNA, 19 nt, Homo sapiens
gagagaccuuauaagugua

SEQ ID NO: 709031 - RNA, 19 nt, Homo sapiens
cauagcagcugaaauuugc

SEQ ID NO: 709032 - RNA, 19 nt, Homo sapiens
ucagaagaccuaccuuuga

SEQ ID NO: 709033 - RNA, 19 nt, Homo sapiens
gaacagacaguaugaucca

SEQ ID NO: 709034 - RNA, 19 nt, Homo sapiens
gagccaggaucgcgccauu

SEQ ID NO: 709035 - RNA, 19 nt, Homo sapiens
ugagaaacccuaugagugu

SEQ ID NO: 709036 - RNA, 19 nt, Homo sapiens
ggaaggcuuucaguuacaa

SEQ ID NO: 709037 - RNA, 19 nt, Homo sapiens
gguaaggucuucgguucaa

SEQ ID NO: 709038 - RNA, 19 nt, Homo sapiens
gcaaaagccuccucuuaca

SEQ ID NO: 709039 - RNA, 19 nt, Homo sapiens
gugcuuaccuucuaaacca

SEQ ID NO: 709040 - RNA, 19 nt, Homo sapiens
gaaaugugaccucccuaga

SEQ ID NO: 709041 - RNA, 19 nt, Homo sapiens
ggaagagaacccaagaaau

SEQ ID NO: 709042 - RNA, 19 nt, Homo sapiens
caugugauguuauuaaguc

SEQ ID NO: 709043 - RNA, 19 nt, Homo sapiens
uaaugaaugugggaaaguu

SEQ ID NO: 709044 - RNA, 19 nt, Homo sapiens
gagaaaccucauaaaugua

SEQ ID NO: 709045 - RNA, 19 nt, Homo sapiens
gaaagggcagauacaguga

SEQ ID NO: 709046 - RNA, 19 nt, Homo sapiens
gaaaggaacgacugugcua

SEQ ID NO: 709047 - RNA, 19 nt, Homo sapiens
gacauagucuugcucuguu

SEQ ID NO: 709048 - RNA, 19 nt, Homo sapiens
ggaguacgguggcgagauc

SEQ ID NO: 709049 - RNA, 19 nt, Homo sapiens
gaucacgacucacuacaac

SEQ ID NO: 709050 - RNA, 19 nt, Homo sapiens
gaacccaaguagcuuugug

SEQ ID NO: 709051 - RNA, 19 nt, Homo sapiens
ccucggcgcuuucuucuag

SEQ ID NO: 709052 - RNA, 19 nt, Homo sapiens
cagcgacccugaauuugga

SEQ ID NO: 709053 - RNA, 19 nt, Homo sapiens
gaaggaggaacccaaguag

SEQ ID NO: 709054 - RNA, 19 nt, Homo sapiens
agaaagggccugguuggua

SEQ ID NO: 709055 - RNA, 19 nt, Homo sapiens
gaagagcuauccccaguuc

SEQ ID NO: 709056 - RNA, 19 nt, Homo sapiens
ucacuacaacuuugaauuc

SEQ ID NO: 709057 - RNA, 19 nt, Homo sapiens
gaguugcugucucuaagug

SEQ ID NO: 709058 - RNA, 19 nt, Homo sapiens
gcuuugggcuaucggaaga

SEQ ID NO: 709059 - RNA, 19 nt, Homo sapiens
acauagucuugcucuguua

SEQ ID NO: 709060 - RNA, 19 nt, Homo sapiens
ggaccucggcgcuuucuuc

SEQ ID NO: 709061 - RNA, 19 nt, Homo sapiens
uaacagagagagacauagu

SEQ ID NO: 709062 - RNA, 19 nt, Homo sapiens
gaggaacccaaguagcuuu

SEQ ID NO: 709063 - RNA, 19 nt, Homo sapiens
agaaggaggaacccaagua

SEQ ID NO: 709064 - RNA, 19 nt, Homo sapiens
aagcaauccucccaucuca

SEQ ID NO: 709065 - RNA, 19 nt, Homo sapiens
guggcgagaucacgacuca

SEQ ID NO: 709066 - RNA, 19 nt, Homo sapiens
ucacgacucacuacaacuu

SEQ ID NO: 709067 - RNA, 19 nt, Homo sapiens
ucuaacagagagagacaua

SEQ ID NO: 709068 - RNA, 19 nt, Homo sapiens
gacccugaauuuggaguug

SEQ ID NO: 709069 - RNA, 19 nt, Homo sapiens
cagggcgacuuugucagua

SEQ ID NO: 709070 - RNA, 19 nt, Homo sapiens
cuacagggcgacuuuguca

SEQ ID NO: 709071 - RNA, 19 nt, Homo sapiens
guugcugucucuaagugaa

SEQ ID NO: 709072 - RNA, 19 nt, Homo sapiens
ggaggaacccaaguagcuu

SEQ ID NO: 709073 - RNA, 19 nt, Homo sapiens
ggaggaaaggaacgacugu

SEQ ID NO: 709074 - RNA, 19 nt, Homo sapiens
caacuuugaauuccuggau

SEQ ID NO: 709075 - RNA, 19 nt, Homo sapiens
cgacucacuacaacuuuga

SEQ ID NO: 709076 - RNA, 19 nt, Homo sapiens
augaaucgcuuugggcuau

SEQ ID NO: 709077 - RNA, 19 nt, Homo sapiens
ucuaggauccgcaugaauc

SEQ ID NO: 709078 - RNA, 19 nt, Homo sapiens
ucaugcagcagaagcagaa

SEQ ID NO: 709079 - RNA, 19 nt, Homo sapiens
cggagaucaugcagcagaa

SEQ ID NO: 709080 - RNA, 19 nt, Homo sapiens
ggacuacagggcgacuuug

SEQ ID NO: 709081 - RNA, 19 nt, Homo sapiens
caagcaauccucccaucuc

SEQ ID NO: 709082 - RNA, 19 nt, Homo sapiens
ccagcgacccugaauuugg

SEQ ID NO: 709083 - RNA, 19 nt, Homo sapiens
gcgagaucacgacucacua

SEQ ID NO: 709084 - RNA, 19 nt, Homo sapiens
ggaguugcugucucuaagu

SEQ ID NO: 709085 - RNA, 19 nt, Homo sapiens
uguuacccaugcuggagua

SEQ ID NO: 709086 - RNA, 19 nt, Homo sapiens
gaccagaggauggcugaca

SEQ ID NO: 709087 - RNA, 19 nt, Homo sapiens
cuucuaggauccgcaugaa

SEQ ID NO: 709088 - RNA, 19 nt, Homo sapiens
gagaaagggccugguuggu

SEQ ID NO: 709089 - RNA, 19 nt, Homo sapiens
uggaguugcugucucuaag

SEQ ID NO: 709090 - RNA, 19 nt, Homo sapiens
cgagaugacgggcuuucug

SEQ ID NO: 709091 - RNA, 19 nt, Homo sapiens
gaauuuggaguugcugucu

SEQ ID NO: 709092 - RNA, 19 nt, Homo sapiens
uaacaagucucuucccuaa

SEQ ID NO: 709093 - RNA, 19 nt, Homo sapiens
gaaagaaacuaggaaacuu

SEQ ID NO: 709094 - RNA, 19 nt, Homo sapiens
caaagagggugcucagauu

SEQ ID NO: 709095 - RNA, 19 nt, Homo sapiens
ggcaauaaauccuauguga

SEQ ID NO: 709096 - RNA, 19 nt, Homo sapiens
gaaaggcaauaaauccuau

SEQ ID NO: 709097 - RNA, 19 nt, Homo sapiens
ggagaagguuacauugaaa

SEQ ID NO: 709098 - RNA, 19 nt, Homo sapiens
gcaaugacuugauguuuag

SEQ ID NO: 709099 - RNA, 19 nt, Homo sapiens
gaaaugggaacugguguua

SEQ ID NO: 709100 - RNA, 19 nt, Homo sapiens
gaaaggaguguaccuauca

SEQ ID NO: 709101 - RNA, 19 nt, Homo sapiens
uaacaaaugucacugucuu

SEQ ID NO: 709102 - RNA, 19 nt, Homo sapiens
cgcaaugacuugauguuua

SEQ ID NO: 709103 - RNA, 19 nt, Homo sapiens
ucaccuaucuucucucuug

SEQ ID NO: 709104 - RNA, 19 nt, Homo sapiens
ugacucagcuaaccacaaa

SEQ ID NO: 709105 - RNA, 19 nt, Homo sapiens
gaggugugcuucaauaaau

SEQ ID NO: 709106 - RNA, 19 nt, Homo sapiens
ggaccacgcucuaacaagu

SEQ ID NO: 709107 - RNA, 19 nt, Homo sapiens
gaacacaucuccuuuucaa

SEQ ID NO: 709108 - RNA, 19 nt, Homo sapiens
ggagagcgcucgaguugca

SEQ ID NO: 709109 - RNA, 19 nt, Homo sapiens
gcucugaaaugucccacua

SEQ ID NO: 709110 - RNA, 19 nt, Homo sapiens
caaaagggauugaaagaaa

SEQ ID NO: 709111 - RNA, 19 nt, Homo sapiens
acaaauggcucugaaaugu

SEQ ID NO: 709112 - RNA, 19 nt, Homo sapiens
guacugugcuucuggaugu

SEQ ID NO: 709113 - RNA, 19 nt, Homo sapiens
gcuauacuccauccaaaua

SEQ ID NO: 709114 - RNA, 19 nt, Homo sapiens
acacacacauauucacuaa

SEQ ID NO: 709115 - RNA, 19 nt, Homo sapiens
gacaggcaguuacuauaaa

SEQ ID NO: 709116 - RNA, 19 nt, Homo sapiens
ccaccuuucuauucuauuu

SEQ ID NO: 709117 - RNA, 19 nt, Homo sapiens
uacaguaacuugugaaugu

SEQ ID NO: 709118 - RNA, 19 nt, Homo sapiens
aaggagggcuggaauggua

SEQ ID NO: 709119 - RNA, 19 nt, Homo sapiens
gcucaagggagaguuauua

SEQ ID NO: 709120 - RNA, 19 nt, Homo sapiens
ggaccucucuccgguggua

SEQ ID NO: 709121 - RNA, 19 nt, Homo sapiens
gacgggacaugaaagcuuu

SEQ ID NO: 709122 - RNA, 19 nt, Homo sapiens
caagggagaguuauuaaug

SEQ ID NO: 709123 - RNA, 19 nt, Homo sapiens
cagagaaccuauugaagug

SEQ ID NO: 709124 - RNA, 19 nt, Homo sapiens
gagaaccuauugaagugaa

SEQ ID NO: 709125 - RNA, 19 nt, Homo sapiens
gcuacacgcugcaucaaau

SEQ ID NO: 709126 - RNA, 19 nt, Homo sapiens
uaggaggugugcuucaaua

SEQ ID NO: 709127 - RNA, 19 nt, Homo sapiens
aaugggaacugguguuaaa

SEQ ID NO: 709128 - RNA, 19 nt, Homo sapiens
aaacuuggcagauccagua

SEQ ID NO: 709129 - RNA, 19 nt, Homo sapiens
uaaauaugcuuccuuuggu

SEQ ID NO: 709130 - RNA, 19 nt, Homo sapiens
gacaccaucuucuuguauu

SEQ ID NO: 709131 - RNA, 19 nt, Homo sapiens
gaacaauaauuccccauau

SEQ ID NO: 709132 - RNA, 19 nt, Homo sapiens
gcaauaaauccuaugugaa

SEQ ID NO: 709133 - RNA, 19 nt, Homo sapiens
uggagaagguuacauugaa

SEQ ID NO: 709134 - RNA, 19 nt, Homo sapiens
gaucaauaaugcugguguu

SEQ ID NO: 709135 - RNA, 19 nt, Homo sapiens
gaaucaggaucaacagcuu

SEQ ID NO: 709136 - RNA, 19 nt, Homo sapiens
ugacaggcaguuacuauaa

SEQ ID NO: 709137 - RNA, 19 nt, Homo sapiens
ucuguccgcuuuaucaaua

SEQ ID NO: 709138 - RNA, 19 nt, Homo sapiens
ucauuuagaucgugcuuau

SEQ ID NO: 709139 - RNA, 19 nt, Homo sapiens
gcagauccaguaaagguaa

SEQ ID NO: 709140 - RNA, 19 nt, Homo sapiens
aagcagaagugaucaagga

SEQ ID NO: 709141 - RNA, 19 nt, Homo sapiens
caaucaaguuagaguugua

SEQ ID NO: 709142 - RNA, 19 nt, Homo sapiens
gcacgucucaugcauugaa

SEQ ID NO: 709143 - RNA, 19 nt, Homo sapiens
gauauuggacuucuagugu

SEQ ID NO: 709144 - RNA, 19 nt, Homo sapiens
gggcuauacuccauccaaa

SEQ ID NO: 709145 - RNA, 19 nt, Homo sapiens
gaaccuguuuggacucauc

SEQ ID NO: 709146 - RNA, 19 nt, Homo sapiens
guacaaauggcucugaaau

SEQ ID NO: 709147 - RNA, 19 nt, Homo sapiens
ggaggugugcuucaauaaa

SEQ ID NO: 709148 - RNA, 19 nt, Homo sapiens
gcuaugaaauuggccgauu

SEQ ID NO: 709149 - RNA, 19 nt, Homo sapiens
cacuaaauaugcuuccuuu

SEQ ID NO: 709150 - RNA, 19 nt, Homo sapiens
gauguaagggaaauugaaa

SEQ ID NO: 709151 - RNA, 19 nt, Homo sapiens
acaccaucuucuuguauua

SEQ ID NO: 709152 - RNA, 19 nt, Homo sapiens
gauauuuacuccccauuuu

SEQ ID NO: 709153 - RNA, 19 nt, Homo sapiens
uaaagcuuguuccuucauu

SEQ ID NO: 709154 - RNA, 19 nt, Homo sapiens
cuacagagaaccuauugaa

SEQ ID NO: 709155 - RNA, 19 nt, Homo sapiens
uaaagcuuguuccuucauu

SEQ ID NO: 709156 - RNA, 19 nt, Homo sapiens
caaguuagaguuguacaaa

SEQ ID NO: 709157 - RNA, 19 nt, Homo sapiens
uaagggaaauugaaagacu

SEQ ID NO: 709158 - RNA, 19 nt, Homo sapiens
gggcuggaaugguacauca

SEQ ID NO: 709159 - RNA, 19 nt, Homo sapiens
aagcagagcuggcuaaucc

SEQ ID NO: 709160 - RNA, 19 nt, Homo sapiens
uggaaaagaugccaaaauu

SEQ ID NO: 709161 - RNA, 19 nt, Homo sapiens
agauugugcuucuguacua

SEQ ID NO: 709162 - RNA, 19 nt, Homo sapiens
acacacauauucacuaaac

SEQ ID NO: 709163 - RNA, 19 nt, Homo sapiens
acugaacacuguacucaaa

SEQ ID NO: 709164 - RNA, 19 nt, Homo sapiens
gaucgugcuuauuuggauu

SEQ ID NO: 709165 - RNA, 19 nt, Homo sapiens
caauaaauccuaugugaac

SEQ ID NO: 709166 - RNA, 19 nt, Homo sapiens
caagaaaggaguguaccua

SEQ ID NO: 709167 - RNA, 19 nt, Homo sapiens
gcgcucgaguugcaauauu

SEQ ID NO: 709168 - RNA, 19 nt, Homo sapiens
ccuaguaucccucggcaua

SEQ ID NO: 709169 - RNA, 19 nt, Homo sapiens
caaccuggacucauuuaga

SEQ ID NO: 709170 - RNA, 19 nt, Homo sapiens
ccaguaaagguaauugaaa

SEQ ID NO: 709171 - RNA, 19 nt, Homo sapiens
ggacaccaucuucuuguau

SEQ ID NO: 709172 - RNA, 19 nt, Homo sapiens
ccaucuaccagaacaauaa

SEQ ID NO: 709173 - RNA, 19 nt, Homo sapiens
caaguccugcccuguauuu

SEQ ID NO: 709174 - RNA, 19 nt, Homo sapiens
caaacaacaauauggagaa

SEQ ID NO: 709175 - RNA, 19 nt, Homo sapiens
aauaugcaguggaagguuu

SEQ ID NO: 709176 - RNA, 19 nt, Homo sapiens
auuaaugucuccaguguug

SEQ ID NO: 709177 - RNA, 19 nt, Homo sapiens
ggauaccucugucucacau

SEQ ID NO: 709178 - RNA, 19 nt, Homo sapiens
ggacuacagagaaccuauu

SEQ ID NO: 709179 - RNA, 19 nt, Homo sapiens
gcaguuacuauaaagcauu

SEQ ID NO: 709180 - RNA, 19 nt, Homo sapiens
gaaaacaaacucaggaaga

SEQ ID NO: 709181 - RNA, 19 nt, Homo sapiens
uaguaucccucggcauaua

SEQ ID NO: 709182 - RNA, 19 nt, Homo sapiens
aaacuuggcaggaagauca

SEQ ID NO: 709183 - RNA, 19 nt, Homo sapiens
cuaggaaacuuggcaggaa

SEQ ID NO: 709184 - RNA, 19 nt, Homo sapiens
uagauucagagguuacuua

SEQ ID NO: 709185 - RNA, 19 nt, Homo sapiens
ggaugugacucgggcuuug

SEQ ID NO: 709186 - RNA, 19 nt, Homo sapiens
ucccaacaauucauauuug

SEQ ID NO: 709187 - RNA, 19 nt, Homo sapiens
uuucuuagccuucaccuuu

SEQ ID NO: 709188 - RNA, 19 nt, Homo sapiens
gugcuuauuuggauugcaa

SEQ ID NO: 709189 - RNA, 19 nt, Homo sapiens
ucaagaacacaucuccuuu

SEQ ID NO: 709190 - RNA, 19 nt, Homo sapiens
aaagcuuguuccuucauuu

SEQ ID NO: 709191 - RNA, 19 nt, Homo sapiens
ggcagaaaccucagagaga

SEQ ID NO: 709192 - RNA, 19 nt, Homo sapiens
gcaagacccucaagugaua

SEQ ID NO: 709193 - RNA, 19 nt, Homo sapiens
guucauaccugauaucuau

SEQ ID NO: 709194 - RNA, 19 nt, Homo sapiens
ggaacaaccuuauauuauc

SEQ ID NO: 709195 - RNA, 19 nt, Homo sapiens
gaaauaaaccaaacaggaa

SEQ ID NO: 709196 - RNA, 19 nt, Homo sapiens
gacauuaaaucuccucauu

SEQ ID NO: 709197 - RNA, 19 nt, Homo sapiens
cagaauagccacuugcuua

SEQ ID NO: 709198 - RNA, 19 nt, Homo sapiens
gucagaaauugguguauua

SEQ ID NO: 709199 - RNA, 19 nt, Homo sapiens
uuacacagaucacaugaaa

SEQ ID NO: 709200 - RNA, 19 nt, Homo sapiens
agacaucccuguagcauau

SEQ ID NO: 709201 - RNA, 19 nt, Homo sapiens
caggaacaaccuuauauua

SEQ ID NO: 709202 - RNA, 19 nt, Homo sapiens
gaaugguucucgaauugaa

SEQ ID NO: 709203 - RNA, 19 nt, Homo sapiens
ggugugcuguacauucuua

SEQ ID NO: 709204 - RNA, 19 nt, Homo sapiens
ggacacggaucuucaucug

SEQ ID NO: 709205 - RNA, 19 nt, Homo sapiens
aagcaaaugucagaaauug

SEQ ID NO: 709206 - RNA, 19 nt, Homo sapiens
ggagcauccucaacaaguu

SEQ ID NO: 709207 - RNA, 19 nt, Homo sapiens
guacgugugucaccucaga

SEQ ID NO: 709208 - RNA, 19 nt, Homo sapiens
ugagagcucccuugccuua

SEQ ID NO: 709209 - RNA, 19 nt, Homo sapiens
ccaaacaggaacaaccuua

SEQ ID NO: 709210 - RNA, 19 nt, Homo sapiens
aauagccacuugcuuaauu

SEQ ID NO: 709211 - RNA, 19 nt, Homo sapiens
aaacaggaacaaccuuaua

SEQ ID NO: 709212 - RNA, 19 nt, Homo sapiens
caagccauguggugaagaa

SEQ ID NO: 709213 - RNA, 19 nt, Homo sapiens
gcaaaugucagaaauuggu

SEQ ID NO: 709214 - RNA, 19 nt, Homo sapiens
gaugaccuguguuggcauu

SEQ ID NO: 709215 - RNA, 19 nt, Homo sapiens
gugcugaacuggccuccaa

SEQ ID NO: 709216 - RNA, 19 nt, Homo sapiens
cuaagcaaaugucagaaau

SEQ ID NO: 709217 - RNA, 19 nt, Homo sapiens
guggaucuguggaacauga

SEQ ID NO: 709218 - RNA, 19 nt, Homo sapiens
acgaaugguucucgaauug

SEQ ID NO: 709219 - RNA, 19 nt, Homo sapiens
gaaagauucgggccagaga

SEQ ID NO: 709220 - RNA, 19 nt, Homo sapiens
ucauaaggcuauuggacaa

SEQ ID NO: 709221 - RNA, 19 nt, Homo sapiens
cagaggaccuuggcaggaa

SEQ ID NO: 709222 - RNA, 19 nt, Homo sapiens
guaaguuauugggauguuu

SEQ ID NO: 709223 - RNA, 19 nt, Homo sapiens
uagcaagacccucaaguga

SEQ ID NO: 709224 - RNA, 19 nt, Homo sapiens
gcuaagcaaaugucagaaa

SEQ ID NO: 709225 - RNA, 19 nt, Homo sapiens
caugaguccugcagugcua

SEQ ID NO: 709226 - RNA, 19 nt, Homo sapiens
gauaaccaucacaagauaa

SEQ ID NO: 709227 - RNA, 19 nt, Homo sapiens
gcaggauguuuccaaaguc

SEQ ID NO: 709228 - RNA, 19 nt, Homo sapiens
gugaaucauuugaacugaa

SEQ ID NO: 709229 - RNA, 19 nt, Homo sapiens
ugaauggauugcugucaug

SEQ ID NO: 709230 - RNA, 19 nt, Homo sapiens
ugucagaaauugguguauu

SEQ ID NO: 709231 - RNA, 19 nt, Homo sapiens
ccucagcccucugucauau

SEQ ID NO: 709232 - RNA, 19 nt, Homo sapiens
ccagggagcagcaguacuu

SEQ ID NO: 709233 - RNA, 19 nt, Homo sapiens
uacgaggagugaccaauga

SEQ ID NO: 709234 - RNA, 19 nt, Homo sapiens
gaaauugguguauuagacu

SEQ ID NO: 709235 - RNA, 19 nt, Homo sapiens
cgaaccggauuguggauuc

SEQ ID NO: 709236 - RNA, 19 nt, Homo sapiens
gauggugaaucauuugaac

SEQ ID NO: 709237 - RNA, 19 nt, Homo sapiens
uugcuuggcuccauuuaug

SEQ ID NO: 709238 - RNA, 19 nt, Homo sapiens
gugcuguacauucuuauuu

SEQ ID NO: 709239 - RNA, 19 nt, Homo sapiens
guagggauuaaaugagaua

SEQ ID NO: 709240 - RNA, 19 nt, Homo sapiens
ggugaaucauuugaacuga

SEQ ID NO: 709241 - RNA, 19 nt, Homo sapiens
agaaauugguguauuagac

SEQ ID NO: 709242 - RNA, 19 nt, Homo sapiens
ccacagucgugcugcuaga

SEQ ID NO: 709243 - RNA, 19 nt, Homo sapiens
ugccuuaccuggaggaaga

SEQ ID NO: 709244 - RNA, 19 nt, Homo sapiens
cauaaaggguguuuuguuc

SEQ ID NO: 709245 - RNA, 19 nt, Homo sapiens
agaauagccacuugcuuaa

SEQ ID NO: 709246 - RNA, 19 nt, Homo sapiens
gggauaaagugcugaugac

SEQ ID NO: 709247 - RNA, 19 nt, Homo sapiens
acagcaggauguuuccaaa

SEQ ID NO: 709248 - RNA, 19 nt, Homo sapiens
gaggagugaccaaugauca

SEQ ID NO: 709249 - RNA, 19 nt, Homo sapiens
uggagagucuucuuugcuu

SEQ ID NO: 709250 - RNA, 19 nt, Homo sapiens
ucuuugaucuucugaaugg

SEQ ID NO: 709251 - RNA, 19 nt, Homo sapiens
gaauagccacuugcuuaau

SEQ ID NO: 709252 - RNA, 19 nt, Homo sapiens
acacagaucacaugaaagg

SEQ ID NO: 709253 - RNA, 19 nt, Homo sapiens
ggcaacagcacucccuuug

SEQ ID NO: 709254 - RNA, 19 nt, Homo sapiens
caaacaggaacaaccuuau

SEQ ID NO: 709255 - RNA, 19 nt, Homo sapiens
caucugguucauuguauuu

SEQ ID NO: 709256 - RNA, 19 nt, Homo sapiens
uaacgaaugguucucgaau

SEQ ID NO: 709257 - RNA, 19 nt, Homo sapiens
gcacucccuuuguugaaac

SEQ ID NO: 709258 - RNA, 19 nt, Homo sapiens
gcaacagcacucccuuugu

SEQ ID NO: 709259 - RNA, 19 nt, Homo sapiens
gguugacccuucaguugau

SEQ ID NO: 709260 - RNA, 19 nt, Homo sapiens
gaagcccauucaacucaca

SEQ ID NO: 709261 - RNA, 19 nt, Homo sapiens
cagguugacccuucaguug

SEQ ID NO: 709262 - RNA, 19 nt, Homo sapiens
uuaugaagcacccguuaaa

SEQ ID NO: 709263 - RNA, 19 nt, Homo sapiens
caggugugcuguacauucu

SEQ ID NO: 709264 - RNA, 19 nt, Homo sapiens
cauaugguuuccagcuguu

SEQ ID NO: 709265 - RNA, 19 nt, Homo sapiens
auagccacuugcuuaauuu

SEQ ID NO: 709266 - RNA, 19 nt, Homo sapiens
acaaguucauaccugauau

SEQ ID NO: 709267 - RNA, 19 nt, Homo sapiens
gaaccggauuguggauucu

SEQ ID NO: 709268 - RNA, 19 nt, Homo sapiens
gaggaauggcguacucugu

SEQ ID NO: 709269 - RNA, 19 nt, Homo sapiens
ggaggaggcgaagugguuu

SEQ ID NO: 709270 - RNA, 19 nt, Homo sapiens
guugaaacaauuugggauu

SEQ ID NO: 709271 - RNA, 19 nt, Homo sapiens
aacgaaugguucucgaauu

SEQ ID NO: 709272 - RNA, 19 nt, Homo sapiens
ucaaacguauuagaggaau

SEQ ID NO: 709273 - RNA, 19 nt, Homo sapiens
gaucuucaucugguucauu

SEQ ID NO: 709274 - RNA, 19 nt, Homo sapiens
aaaccuguggagucuguua

SEQ ID NO: 709275 - RNA, 19 nt, Homo sapiens
caacgucugguccugucua

SEQ ID NO: 709276 - RNA, 19 nt, Homo sapiens
gagcauccucaacaaguuc

SEQ ID NO: 709277 - RNA, 19 nt, Homo sapiens
acaggaacaaccuuauauu

SEQ ID NO: 709278 - RNA, 19 nt, Homo sapiens
uguggagucuguuacuguu

SEQ ID NO: 709279 - RNA, 19 nt, Homo sapiens
ggaagucuccgggcuuugg

SEQ ID NO: 709280 - RNA, 19 nt, Homo sapiens
aggaauggcguacucugua

SEQ ID NO: 709281 - RNA, 19 nt, Homo sapiens
ucaucugguucauuguauu

SEQ ID NO: 709282 - RNA, 19 nt, Homo sapiens
gaguggcagcucuucauga

SEQ ID NO: 709283 - RNA, 19 nt, Homo sapiens
uuguagggauuaaaugaga

SEQ ID NO: 709284 - RNA, 19 nt, Homo sapiens
ugggaagucuccgggcuuu

SEQ ID NO: 709285 - RNA, 19 nt, Homo sapiens
ucacgagucccgcgucugu

SEQ ID NO: 709286 - RNA, 19 nt, Homo sapiens
ucagauggcgaaccggauu

SEQ ID NO: 709287 - RNA, 19 nt, Homo sapiens
caaacguauuagaggaaug

SEQ ID NO: 709288 - RNA, 19 nt, Homo sapiens
gugcugaugaccuguguug

SEQ ID NO: 709289 - RNA, 19 nt, Homo sapiens
aacaaguucauaccugaua

SEQ ID NO: 709290 - RNA, 19 nt, Homo sapiens
caacucacagauccaggaa

SEQ ID NO: 709291 - RNA, 19 nt, Homo sapiens
gcgaagugguuuucucaug

SEQ ID NO: 709292 - RNA, 19 nt, Homo sapiens
ggaaaggccuuaugagugu

SEQ ID NO: 709293 - RNA, 19 nt, Homo sapiens
ggaguaagaucucaugaau

SEQ ID NO: 709294 - RNA, 19 nt, Homo sapiens
gcucuaaccucacuaauca

SEQ ID NO: 709295 - RNA, 19 nt, Homo sapiens
gagaaugugugaaagcuuu

SEQ ID NO: 709296 - RNA, 19 nt, Homo sapiens
gaaauuugaccucauugua

SEQ ID NO: 709297 - RNA, 19 nt, Homo sapiens
cuggagaacuugacacuua

SEQ ID NO: 709298 - RNA, 19 nt, Homo sapiens
gggaaauccuuuagccaua

SEQ ID NO: 709299 - RNA, 19 nt, Homo sapiens
agaaagaagucaaacagaa

SEQ ID NO: 709300 - RNA, 19 nt, Homo sapiens
gcaaggagguugggaagga

SEQ ID NO: 709301 - RNA, 19 nt, Homo sapiens
gagcaaggccuuaugaaug

SEQ ID NO: 709302 - RNA, 19 nt, Homo sapiens
gagaaaggccuuacaagug

SEQ ID NO: 709303 - RNA, 19 nt, Homo sapiens
gugggaaauuguuuacuua

SEQ ID NO: 709304 - RNA, 19 nt, Homo sapiens
gaucuuacaugugcaguga

SEQ ID NO: 709305 - RNA, 19 nt, Homo sapiens
aguaagaucucaugaaugu

SEQ ID NO: 709306 - RNA, 19 nt, Homo sapiens
guacaaggccuuauaugug

SEQ ID NO: 709307 - RNA, 19 nt, Homo sapiens
ggacagaaacacuucagaa

SEQ ID NO: 709308 - RNA, 19 nt, Homo sapiens
cauacuacuuugucucaua

SEQ ID NO: 709309 - RNA, 19 nt, Homo sapiens
aguaagaccucaucaaugu

SEQ ID NO: 709310 - RNA, 19 nt, Homo sapiens
ucacaagggauaaagguua

SEQ ID NO: 709311 - RNA, 19 nt, Homo sapiens
gcucuacgcuccuucaaca

SEQ ID NO: 709312 - RNA, 19 nt, Homo sapiens
ggaguaagaccucaucaau

SEQ ID NO: 709313 - RNA, 19 nt, Homo sapiens
ggagaaaggccuuaugagu

SEQ ID NO: 709314 - RNA, 19 nt, Homo sapiens
caaugaaugugggaaguuu

SEQ ID NO: 709315 - RNA, 19 nt, Homo sapiens
ggagaaaggccuuaugagu

SEQ ID NO: 709316 - RNA, 19 nt, Homo sapiens
ggagaaaggccauaugagu

SEQ ID NO: 709317 - RNA, 19 nt, Homo sapiens
ggaaugaggccuuaugagu

SEQ ID NO: 709318 - RNA, 19 nt, Homo sapiens
ggagaaaggccuuacaagu

SEQ ID NO: 709319 - RNA, 19 nt, Homo sapiens
caggaaauuugaccucauu

SEQ ID NO: 709320 - RNA, 19 nt, Homo sapiens
ccagagcugucaccucauu

SEQ ID NO: 709321 - RNA, 19 nt, Homo sapiens
ggaaaauccuuuaccugua

SEQ ID NO: 709322 - RNA, 19 nt, Homo sapiens
uuauagaucucguuucuuc

SEQ ID NO: 709323 - RNA, 19 nt, Homo sapiens
gaaugugggaaauuguuua

SEQ ID NO: 709324 - RNA, 19 nt, Homo sapiens
cagcgggugucacagguua

SEQ ID NO: 709325 - RNA, 19 nt, Homo sapiens
gcugucaccucauuaaaca

SEQ ID NO: 709326 - RNA, 19 nt, Homo sapiens
gaacacaccauggucagaa

SEQ ID NO: 709327 - RNA, 19 nt, Homo sapiens
gcucuagccucauuacaca

SEQ ID NO: 709328 - RNA, 19 nt, Homo sapiens
ggaaauccuuuagccauag

SEQ ID NO: 709329 - RNA, 19 nt, Homo sapiens
gggaugaggaggcaccuua

SEQ ID NO: 709330 - RNA, 19 nt, Homo sapiens
gaaugugggaaauccuuua

SEQ ID NO: 709331 - RNA, 19 nt, Homo sapiens
gaaugugggaaauccuuua

SEQ ID NO: 709332 - RNA, 19 nt, Homo sapiens
gaaaggccuuaugagugua

SEQ ID NO: 709333 - RNA, 19 nt, Homo sapiens
ccauagcucuagccucauu

SEQ ID NO: 709334 - RNA, 19 nt, Homo sapiens
gggcauguaggaaauaauu

SEQ ID NO: 709335 - RNA, 19 nt, Homo sapiens
guucuagccuuauuacaca

SEQ ID NO: 709336 - RNA, 19 nt, Homo sapiens
ugagaagugucccugcaaa

SEQ ID NO: 709337 - RNA, 19 nt, Homo sapiens
uguuggaaauccuuuagua

SEQ ID NO: 709338 - RNA, 19 nt, Homo sapiens
ggagcaaggccuuaugaau

SEQ ID NO: 709339 - RNA, 19 nt, Homo sapiens
gguacaaggccuuauaugu

SEQ ID NO: 709340 - RNA, 19 nt, Homo sapiens
gagaaugugggaaauccua

SEQ ID NO: 709341 - RNA, 19 nt, Homo sapiens
gaaagaagucaaacagaac

SEQ ID NO: 709342 - RNA, 19 nt, Homo sapiens
cagcugcacauuugaagua

SEQ ID NO: 709343 - RNA, 19 nt, Homo sapiens
uaaccacucuagccucguu

SEQ ID NO: 709344 - RNA, 19 nt, Homo sapiens
uaagaucucaugaauguca

SEQ ID NO: 709345 - RNA, 19 nt, Homo sapiens
gaaugugggaaauccuaua

SEQ ID NO: 709346 - RNA, 19 nt, Homo sapiens
gcuuucagcuacaaacaug

SEQ ID NO: 709347 - RNA, 19 nt, Homo sapiens
gcagcauguuggacagaaa

SEQ ID NO: 709348 - RNA, 19 nt, Homo sapiens
ggaaauccuuuaguaacca

SEQ ID NO: 709349 - RNA, 19 nt, Homo sapiens
ggccuuauaugugcaguga

SEQ ID NO: 709350 - RNA, 19 nt, Homo sapiens
agggaaagaucuuacaugu

SEQ ID NO: 709351 - RNA, 19 nt, Homo sapiens
ccauaguucuagccuuauu

SEQ ID NO: 709352 - RNA, 19 nt, Homo sapiens
auccauaguucuagccuua

SEQ ID NO: 709353 - RNA, 19 nt, Homo sapiens
ggaaaucuuuuauccauag

SEQ ID NO: 709354 - RNA, 19 nt, Homo sapiens
gaguaagaccucaucaaug

SEQ ID NO: 709355 - RNA, 19 nt, Homo sapiens
uugagcagcugcacauuug

SEQ ID NO: 709356 - RNA, 19 nt, Homo sapiens
guuaaacaccgaagaguuc

SEQ ID NO: 709357 - RNA, 19 nt, Homo sapiens
ccauaugagugcagugaau

SEQ ID NO: 709358 - RNA, 19 nt, Homo sapiens
ggagaccucauuagggaaa

SEQ ID NO: 709359 - RNA, 19 nt, Homo sapiens
ucucauauccacacagaaa

SEQ ID NO: 709360 - RNA, 19 nt, Homo sapiens
uaagaccucaucaauguga

SEQ ID NO: 709361 - RNA, 19 nt, Homo sapiens
gauauguggcccagucuug

SEQ ID NO: 709362 - RNA, 19 nt, Homo sapiens
gcuccagccucauuagaca

SEQ ID NO: 709363 - RNA, 19 nt, Homo sapiens
caggagaaaggccauauga

SEQ ID NO: 709364 - RNA, 19 nt, Homo sapiens
gcaggaaauuugaccucau

SEQ ID NO: 709365 - RNA, 19 nt, Homo sapiens
gagaguucauacuggagaa

SEQ ID NO: 709366 - RNA, 19 nt, Homo sapiens
gugaaugugggaaaucuuu

SEQ ID NO: 709367 - RNA, 19 nt, Homo sapiens
caucagagaguucauacug

SEQ ID NO: 709368 - RNA, 19 nt, Homo sapiens
gugaaugugggaaaucuuu

SEQ ID NO: 709369 - RNA, 19 nt, Homo sapiens
gcaccagggagaccucauu

SEQ ID NO: 709370 - RNA, 19 nt, Homo sapiens
gaacguucacaagggauaa

SEQ ID NO: 709371 - RNA, 19 nt, Homo sapiens
ggaaauuugaccucauugu

SEQ ID NO: 709372 - RNA, 19 nt, Homo sapiens
ugugggaaauuguuuacuu

SEQ ID NO: 709373 - RNA, 19 nt, Homo sapiens
cagaaaagccuuauacaug

SEQ ID NO: 709374 - RNA, 19 nt, Homo sapiens
gcaaugaaugugggaaguu

SEQ ID NO: 709375 - RNA, 19 nt, Homo sapiens
agcaaggccuuaugaaugu

SEQ ID NO: 709376 - RNA, 19 nt, Homo sapiens
caacaccagagaguucaua

SEQ ID NO: 709377 - RNA, 19 nt, Homo sapiens
caccggagacuucacauug

SEQ ID NO: 709378 - RNA, 19 nt, Homo sapiens
ccuuauaugugcagugaau

SEQ ID NO: 709379 - RNA, 19 nt, Homo sapiens
cuggugagaucaagauuuc

SEQ ID NO: 709380 - RNA, 19 nt, Homo sapiens
gagcagcugcacauuugaa

SEQ ID NO: 709381 - RNA, 19 nt, Homo sapiens
aaacaccgaagaguucaua

SEQ ID NO: 709382 - RNA, 19 nt, Homo sapiens
guuggaaauccuuuaguaa

SEQ ID NO: 709383 - RNA, 19 nt, Homo sapiens
aauccuaccucaucucaca

SEQ ID NO: 709384 - RNA, 19 nt, Homo sapiens
ggaauggggucuucuugau

SEQ ID NO: 709385 - RNA, 19 nt, Homo sapiens
gagcugucaccucauuaaa

SEQ ID NO: 709386 - RNA, 19 nt, Homo sapiens
auacuggaaugaggccuua

SEQ ID NO: 709387 - RNA, 19 nt, Homo sapiens
ccagagcuccagccucauu

SEQ ID NO: 709388 - RNA, 19 nt, Homo sapiens
agaaaagccuuauacaugu

SEQ ID NO: 709389 - RNA, 19 nt, Homo sapiens
uagccucagugaucauuug

SEQ ID NO: 709390 - RNA, 19 nt, Homo sapiens
gcuguagccucagugauca

SEQ ID NO: 709391 - RNA, 19 nt, Homo sapiens
acucuagccucguuaaaca

SEQ ID NO: 709392 - RNA, 19 nt, Homo sapiens
gagagaaacuguauaauug

SEQ ID NO: 709393 - RNA, 19 nt, Homo sapiens
gauaagagcuuucgucaga

SEQ ID NO: 709394 - RNA, 19 nt, Homo sapiens
gguaagagcuucuguggua

SEQ ID NO: 709395 - RNA, 19 nt, Homo sapiens
gggaagagauuuacucaaa

SEQ ID NO: 709396 - RNA, 19 nt, Homo sapiens
gggaaaggcuucagucgua

SEQ ID NO: 709397 - RNA, 19 nt, Homo sapiens
ggaagaacauuguacagaa

SEQ ID NO: 709398 - RNA, 19 nt, Homo sapiens
ggaaagggccacaauagua

SEQ ID NO: 709399 - RNA, 19 nt, Homo sapiens
gcaauaaagucuucacuca

SEQ ID NO: 709400 - RNA, 19 nt, Homo sapiens
gaucagcacuuaauaguca

SEQ ID NO: 709401 - RNA, 19 nt, Homo sapiens
gagagaaaccuuauaauug

SEQ ID NO: 709402 - RNA, 19 nt, Homo sapiens
ggagagaaacuguauaauu

SEQ ID NO: 709403 - RNA, 19 nt, Homo sapiens
ggagagaaaccuuauaauu

SEQ ID NO: 709404 - RNA, 19 nt, Homo sapiens
ggagagaaaugcuauaagu

SEQ ID NO: 709405 - RNA, 19 nt, Homo sapiens
gagacaagauccaaacuga

SEQ ID NO: 709406 - RNA, 19 nt, Homo sapiens
ggagagagaccauacaauu

SEQ ID NO: 709407 - RNA, 19 nt, Homo sapiens
gaaagggccacaauaguaa

SEQ ID NO: 709408 - RNA, 19 nt, Homo sapiens
gagguuggaucuugacuuu

SEQ ID NO: 709409 - RNA, 19 nt, Homo sapiens
gaucagcacuuaauguuca

SEQ ID NO: 709410 - RNA, 19 nt, Homo sapiens
gaacaucagagaauccaua

SEQ ID NO: 709411 - RNA, 19 nt, Homo sapiens
gaagaacauuguacagaau

SEQ ID NO: 709412 - RNA, 19 nt, Homo sapiens
cgucagagaucagcacuua

SEQ ID NO: 709413 - RNA, 19 nt, Homo sapiens
aaacaccucucaaauguga

SEQ ID NO: 709414 - RNA, 19 nt, Homo sapiens
ugugguagaucaagacuua

SEQ ID NO: 709415 - RNA, 19 nt, Homo sapiens
gagagaaaccguucaaaug

SEQ ID NO: 709416 - RNA, 19 nt, Homo sapiens
agaaacaccucucaaaugu

SEQ ID NO: 709417 - RNA, 19 nt, Homo sapiens
guacccaacuuguagcuuu

SEQ ID NO: 709418 - RNA, 19 nt, Homo sapiens
aaacugagauggagacugu

SEQ ID NO: 709419 - RNA, 19 nt, Homo sapiens
caagggcaauuggauauaa

SEQ ID NO: 709420 - RNA, 19 nt, Homo sapiens
gauggagacuguuucagaa

SEQ ID NO: 709421 - RNA, 19 nt, Homo sapiens
cauagagguuguacuaauu

SEQ ID NO: 709422 - RNA, 19 nt, Homo sapiens
caaacugaauguugucuau

SEQ ID NO: 709423 - RNA, 19 nt, Homo sapiens
gagagaaaccauacaaaug

SEQ ID NO: 709424 - RNA, 19 nt, Homo sapiens
gagaaaccguucaaaugug

SEQ ID NO: 709425 - RNA, 19 nt, Homo sapiens
gguaaggaauucagucaga

SEQ ID NO: 709426 - RNA, 19 nt, Homo sapiens
ggagagaaaccauacaaau

SEQ ID NO: 709427 - RNA, 19 nt, Homo sapiens
guucacaucugcaaacuca

SEQ ID NO: 709428 - RNA, 19 nt, Homo sapiens
gaaauucacuaggaagagu

SEQ ID NO: 709429 - RNA, 19 nt, Homo sapiens
gagaaaccauuccgaugug

SEQ ID NO: 709430 - RNA, 19 nt, Homo sapiens
gcaauuggauauaaaccau

SEQ ID NO: 709431 - RNA, 19 nt, Homo sapiens
gcaaggacuaucuguaauu

SEQ ID NO: 709432 - RNA, 19 nt, Homo sapiens
uagcuuaacucccacuuau

SEQ ID NO: 709433 - RNA, 19 nt, Homo sapiens
caacucgucugacccauca

SEQ ID NO: 709434 - RNA, 19 nt, Homo sapiens
ggagagaaaccguucaaau

SEQ ID NO: 709435 - RNA, 19 nt, Homo sapiens
gcuuaacucccacuuauaa

SEQ ID NO: 709436 - RNA, 19 nt, Homo sapiens
caccagagaucccauagug

SEQ ID NO: 709437 - RNA, 19 nt, Homo sapiens
gagcuucugugguagauca

SEQ ID NO: 709438 - RNA, 19 nt, Homo sapiens
gcucucaguucuccaaaga

SEQ ID NO: 709439 - RNA, 19 nt, Homo sapiens
auaaauagcucucaguucu

SEQ ID NO: 709440 - RNA, 19 nt, Homo sapiens
gugaugugauggugcaaua

SEQ ID NO: 709441 - RNA, 19 nt, Homo sapiens
gagaaaacauggaagugua

SEQ ID NO: 709442 - RNA, 19 nt, Homo sapiens
gagagagaccauacaauug

SEQ ID NO: 709443 - RNA, 19 nt, Homo sapiens
gcacuuagguugguuccau

SEQ ID NO: 709444 - RNA, 19 nt, Homo sapiens
gagaaaccauacaaaugug

SEQ ID NO: 709445 - RNA, 19 nt, Homo sapiens
ugaguuacuucacuuagaa

SEQ ID NO: 709446 - RNA, 19 nt, Homo sapiens
gggaaaagauuuacucaga

SEQ ID NO: 709447 - RNA, 19 nt, Homo sapiens
gguuggaucuugacuuuca

SEQ ID NO: 709448 - RNA, 19 nt, Homo sapiens
gcagguauaauguuuguau

SEQ ID NO: 709449 - RNA, 19 nt, Homo sapiens
agucguagaucagcacuua

SEQ ID NO: 709450 - RNA, 19 nt, Homo sapiens
gaauguucauguuggagaa

SEQ ID NO: 709451 - RNA, 19 nt, Homo sapiens
auacaaaugugaugagugu

SEQ ID NO: 709452 - RNA, 19 nt, Homo sapiens
ucauagagguuguacuaau

SEQ ID NO: 709453 - RNA, 19 nt, Homo sapiens
gcgcuugaaucuugauaug

SEQ ID NO: 709454 - RNA, 19 nt, Homo sapiens
guucaaauguguggaaugu

SEQ ID NO: 709455 - RNA, 19 nt, Homo sapiens
gacaagauccaaacugaga

SEQ ID NO: 709456 - RNA, 19 nt, Homo sapiens
caaggacuaucuguaauuc

SEQ ID NO: 709457 - RNA, 19 nt, Homo sapiens
caggagagaaacuguauaa

SEQ ID NO: 709458 - RNA, 19 nt, Homo sapiens
ugaauugucuaauggugaa

SEQ ID NO: 709459 - RNA, 19 nt, Homo sapiens
uaauaggcauuccaugguu

SEQ ID NO: 709460 - RNA, 19 nt, Homo sapiens
caggagagaaaccuuauaa

SEQ ID NO: 709461 - RNA, 19 nt, Homo sapiens
ggaagaguagcagguauaa

SEQ ID NO: 709462 - RNA, 19 nt, Homo sapiens
gagaaaagccauacaaaug

SEQ ID NO: 709463 - RNA, 19 nt, Homo sapiens
gagaaaagccauacaaaug

SEQ ID NO: 709464 - RNA, 19 nt, Homo sapiens
gaaugugggaagagcuuua

SEQ ID NO: 709465 - RNA, 19 nt, Homo sapiens
uaagagcuuucgucagaga

SEQ ID NO: 709466 - RNA, 19 nt, Homo sapiens
uuacauggaugaauugucu

SEQ ID NO: 709467 - RNA, 19 nt, Homo sapiens
gagaaaccuuauaauugug

SEQ ID NO: 709468 - RNA, 19 nt, Homo sapiens
ggaauucagucagaguuca

SEQ ID NO: 709469 - RNA, 19 nt, Homo sapiens
guacuaauuuaccuucaca

SEQ ID NO: 709470 - RNA, 19 nt, Homo sapiens
aauaaagucuucacucagu

SEQ ID NO: 709471 - RNA, 19 nt, Homo sapiens
ucacuuguccucauccuuu

SEQ ID NO: 709472 - RNA, 19 nt, Homo sapiens
caaagauuauggugcacuu

SEQ ID NO: 709473 - RNA, 19 nt, Homo sapiens
ugugaauugugcuguaaua

SEQ ID NO: 709474 - RNA, 19 nt, Homo sapiens
aacaggcgcuugaaucuug

SEQ ID NO: 709475 - RNA, 19 nt, Homo sapiens
cagcuucauucucaucaaa

SEQ ID NO: 709476 - RNA, 19 nt, Homo sapiens
ggaaaagauuuacucagaa

SEQ ID NO: 709477 - RNA, 19 nt, Homo sapiens
gaugugauacgugugauaa

SEQ ID NO: 709478 - RNA, 19 nt, Homo sapiens
ugacgugugugguaaggaa

SEQ ID NO: 709479 - RNA, 19 nt, Homo sapiens
guaauucacacaagacaga

SEQ ID NO: 709480 - RNA, 19 nt, Homo sapiens
gagucugcauaguccauua

SEQ ID NO: 709481 - RNA, 19 nt, Homo sapiens
ggaaguguagggaguguga

SEQ ID NO: 709482 - RNA, 19 nt, Homo sapiens
gggccacaauaguaaguuu

SEQ ID NO: 709483 - RNA, 19 nt, Homo sapiens
ugaagaaugugggaaagga

SEQ ID NO: 709484 - RNA, 19 nt, Homo sapiens
ggugaagucugagauuuua

SEQ ID NO: 709485 - RNA, 19 nt, Homo sapiens
gaugugauggugcaauaaa

SEQ ID NO: 709486 - RNA, 19 nt, Homo sapiens
ggaagagauuuacucaaaa

SEQ ID NO: 709487 - RNA, 19 nt, Homo sapiens
agagaaaccauacaaaugu

SEQ ID NO: 709488 - RNA, 19 nt, Homo sapiens
gagaucagcacuuaauagu

SEQ ID NO: 709489 - RNA, 19 nt, Homo sapiens
agaaaucucauacguguga

SEQ ID NO: 709490 - RNA, 19 nt, Homo sapiens
gcuugaaucuugauaugca

SEQ ID NO: 709491 - RNA, 19 nt, Homo sapiens
auucacagcuucauucuca

SEQ ID NO: 709492 - RNA, 19 nt, Homo sapiens
cuacagaccuggagcauuc

SEQ ID NO: 709493 - RNA, 19 nt, Homo sapiens
acaaggagguggacaagaa

SEQ ID NO: 709494 - RNA, 19 nt, Homo sapiens
caucuucccugcuaauuau

SEQ ID NO: 709495 - RNA, 19 nt, Homo sapiens
gagaggcuguggcccagua

SEQ ID NO: 709496 - RNA, 19 nt, Homo sapiens
ggacgacccuggugagaag

SEQ ID NO: 709497 - RNA, 19 nt, Homo sapiens
gggaagagaagaagagaaa

SEQ ID NO: 709498 - RNA, 19 nt, Homo sapiens
gggaccagcucuccgcuuu

SEQ ID NO: 709499 - RNA, 19 nt, Homo sapiens
aaauaaaccuggacacaag

SEQ ID NO: 709500 - RNA, 19 nt, Homo sapiens
gcaucuucccugcuaauua

SEQ ID NO: 709501 - RNA, 19 nt, Homo sapiens
gcuccaacacccuuaauuu

SEQ ID NO: 709502 - RNA, 19 nt, Homo sapiens
gcuccagcguuuccucuaa

SEQ ID NO: 709503 - RNA, 19 nt, Homo sapiens
ggagaauguuccagcagau

SEQ ID NO: 709504 - RNA, 19 nt, Homo sapiens
gacaagcgcugggucaagu

SEQ ID NO: 709505 - RNA, 19 nt, Homo sapiens
ccuaacaccucucagauac

SEQ ID NO: 709506 - RNA, 19 nt, Homo sapiens
gaaccaguuucugcaggaa

SEQ ID NO: 709507 - RNA, 19 nt, Homo sapiens
ccacagcccuuucauuucc

SEQ ID NO: 709508 - RNA, 19 nt, Homo sapiens
gaagagaagaagagaaagg

SEQ ID NO: 709509 - RNA, 19 nt, Homo sapiens
ucugaagaguuaccuagaa

SEQ ID NO: 709510 - RNA, 19 nt, Homo sapiens
gaagcugggaccacucuga

SEQ ID NO: 709511 - RNA, 19 nt, Homo sapiens
ucccacagcccuuucauuu

SEQ ID NO: 709512 - RNA, 19 nt, Homo sapiens
gaagaguuaccuagaagca

SEQ ID NO: 709513 - RNA, 19 nt, Homo sapiens
gcauauucccugccagcua

SEQ ID NO: 709514 - RNA, 19 nt, Homo sapiens
gagagcggcaugcccauug

SEQ ID NO: 709515 - RNA, 19 nt, Homo sapiens
ccaacacccuuaauuucca

SEQ ID NO: 709516 - RNA, 19 nt, Homo sapiens
gugugacgauggcugguuu

SEQ ID NO: 709517 - RNA, 19 nt, Homo sapiens
cuugcuggcugcccucuuu

SEQ ID NO: 709518 - RNA, 19 nt, Homo sapiens
gagaauguuccagcagauu

SEQ ID NO: 709519 - RNA, 19 nt, Homo sapiens
gacccugcgugguaucaga

SEQ ID NO: 709520 - RNA, 19 nt, Homo sapiens
ccaccccacuccccaaaua

SEQ ID NO: 709521 - RNA, 19 nt, Homo sapiens
ggagcugacucugcagaag

SEQ ID NO: 709522 - RNA, 19 nt, Homo sapiens
acaaggaccugcgggcaau

SEQ ID NO: 709523 - RNA, 19 nt, Homo sapiens
ccgcagaugagaucccuaa

SEQ ID NO: 709524 - RNA, 19 nt, Homo sapiens
gcugggaccacucugaaga

SEQ ID NO: 709525 - RNA, 19 nt, Homo sapiens
ccagcuuccuagccucgua

SEQ ID NO: 709526 - RNA, 19 nt, Homo sapiens
gcccaggacugugugcaau

SEQ ID NO: 709527 - RNA, 19 nt, Homo sapiens
ggagggaagagaagaagag

SEQ ID NO: 709528 - RNA, 19 nt, Homo sapiens
ucuaggagcccagcaaaga

SEQ ID NO: 709529 - RNA, 19 nt, Homo sapiens
uaacaccucucagauacac

SEQ ID NO: 709530 - RNA, 19 nt, Homo sapiens
gcuacccacaugcaccuua

SEQ ID NO: 709531 - RNA, 19 nt, Homo sapiens
gaccagcucuccgcuuugc

SEQ ID NO: 709532 - RNA, 19 nt, Homo sapiens
gcaaggugaacgagaacug

SEQ ID NO: 709533 - RNA, 19 nt, Homo sapiens
ccaccuccagucccacaua

SEQ ID NO: 709534 - RNA, 19 nt, Homo sapiens
cagacgcagcaccuucuua

SEQ ID NO: 709535 - RNA, 19 nt, Homo sapiens
cugggcaucuucccugcua

SEQ ID NO: 709536 - RNA, 19 nt, Homo sapiens
gaccugcgggcaauugaga

SEQ ID NO: 709537 - RNA, 19 nt, Homo sapiens
cugaagaguuaccuagaag

SEQ ID NO: 709538 - RNA, 19 nt, Homo sapiens
aaccagaaccagcuuccua

SEQ ID NO: 709539 - RNA, 19 nt, Homo sapiens
ccauccugcuccagcguuu

SEQ ID NO: 709540 - RNA, 19 nt, Homo sapiens
gugcaggugucucgugaac

SEQ ID NO: 709541 - RNA, 19 nt, Homo sapiens
gagagcacaucugccugau

SEQ ID NO: 709542 - RNA, 19 nt, Homo sapiens
ccagcagauucaccggaaa

SEQ ID NO: 709543 - RNA, 19 nt, Homo sapiens
ggacaagcgcugggucaag

SEQ ID NO: 709544 - RNA, 19 nt, Homo sapiens
caucuaggagcccagcaaa

SEQ ID NO: 709545 - RNA, 19 nt, Homo sapiens
ccaggacugugugcaaugg

SEQ ID NO: 709546 - RNA, 19 nt, Homo sapiens
gagacccuagugccucuaa

SEQ ID NO: 709547 - RNA, 19 nt, Homo sapiens
ggaccagcucuccgcuuug

SEQ ID NO: 709548 - RNA, 19 nt, Homo sapiens
ccauuuccaggccuuauug

SEQ ID NO: 709549 - RNA, 19 nt, Homo sapiens
gggaccuccucuccuaaca

SEQ ID NO: 709550 - RNA, 19 nt, Homo sapiens
ucgaggagccacccagaga

SEQ ID NO: 709551 - RNA, 19 nt, Homo sapiens
uccuaacaccucucagaua

SEQ ID NO: 709552 - RNA, 19 nt, Homo sapiens
gcaagggagagcacaucug

SEQ ID NO: 709553 - RNA, 19 nt, Homo sapiens
gcagaugagaucccuaagc

SEQ ID NO: 709554 - RNA, 19 nt, Homo sapiens
ccaggagggaagagaagaa

SEQ ID NO: 709555 - RNA, 19 nt, Homo sapiens
agacgcagcaccuucuuag

SEQ ID NO: 709556 - RNA, 19 nt, Homo sapiens
gagggaagagaagaagaga

SEQ ID NO: 709557 - RNA, 19 nt, Homo sapiens
gcaucuaggagcccagcaa

SEQ ID NO: 709558 - RNA, 19 nt, Homo sapiens
cagcaagcgucgggacaag

SEQ ID NO: 709559 - RNA, 19 nt, Homo sapiens
uccgcaaggugaacgagaa

SEQ ID NO: 709560 - RNA, 19 nt, Homo sapiens
gaagcccucccagcccauu

SEQ ID NO: 709561 - RNA, 19 nt, Homo sapiens
ggaaggauggugcaaauua

SEQ ID NO: 709562 - RNA, 19 nt, Homo sapiens
ugagagauuucccauauuu

SEQ ID NO: 709563 - RNA, 19 nt, Homo sapiens
ucccuucgcuugaauauua

SEQ ID NO: 709564 - RNA, 19 nt, Homo sapiens
uguggaaucugaucaguua

SEQ ID NO: 709565 - RNA, 19 nt, Homo sapiens
gaagacugauuacaagaau

SEQ ID NO: 709566 - RNA, 19 nt, Homo sapiens
guucuaaucuggugguaaa

SEQ ID NO: 709567 - RNA, 19 nt, Homo sapiens
gaacuuguagggcucauuu

SEQ ID NO: 709568 - RNA, 19 nt, Homo sapiens
caucaugaaugcagauauu

SEQ ID NO: 709569 - RNA, 19 nt, Homo sapiens
gaaggauggugcaaauuag

SEQ ID NO: 709570 - RNA, 19 nt, Homo sapiens
aaugagagauuucccauau

SEQ ID NO: 709571 - RNA, 19 nt, Homo sapiens
gccauaauccucugaauga

SEQ ID NO: 709572 - RNA, 19 nt, Homo sapiens
ccaguuaagugcaugcaaa

SEQ ID NO: 709573 - RNA, 19 nt, Homo sapiens
uugaugagcugaagacuga

SEQ ID NO: 709574 - RNA, 19 nt, Homo sapiens
ggugguaaagguauucuua

SEQ ID NO: 709575 - RNA, 19 nt, Homo sapiens
cagaagaauugguccaguu

SEQ ID NO: 709576 - RNA, 19 nt, Homo sapiens
gaacaacacacagaagaau

SEQ ID NO: 709577 - RNA, 19 nt, Homo sapiens
gcaagauccuguccaagag

SEQ ID NO: 709578 - RNA, 19 nt, Homo sapiens
gcugaagacugauuacaag

SEQ ID NO: 709579 - RNA, 19 nt, Homo sapiens
gaacuugcacuucuuaagg

SEQ ID NO: 709580 - RNA, 19 nt, Homo sapiens
gaagaauugguccaguuaa

SEQ ID NO: 709581 - RNA, 19 nt, Homo sapiens
cauccacgcuuucuucugu

SEQ ID NO: 709582 - RNA, 19 nt, Homo sapiens
uauauggcaugaucuaugu

SEQ ID NO: 709583 - RNA, 19 nt, Homo sapiens
cugaauuacuugugaagaa

SEQ ID NO: 709584 - RNA, 19 nt, Homo sapiens
gaaugagagauuucccaua

SEQ ID NO: 709585 - RNA, 19 nt, Homo sapiens
gguaaagguauucuuaaga

SEQ ID NO: 709586 - RNA, 19 nt, Homo sapiens
gaagaaugcauuuaaagcu

SEQ ID NO: 709587 - RNA, 19 nt, Homo sapiens
ggaaucugaucaguuacuu

SEQ ID NO: 709588 - RNA, 19 nt, Homo sapiens
gaaggaaggauggugcaaa

SEQ ID NO: 709589 - RNA, 19 nt, Homo sapiens
ccuauagaccaguguaaua

SEQ ID NO: 709590 - RNA, 19 nt, Homo sapiens
ugacuguccuaguacauug

SEQ ID NO: 709591 - RNA, 19 nt, Homo sapiens
ccagcaagauccuguccaa

SEQ ID NO: 709592 - RNA, 19 nt, Homo sapiens
guugacagguuugaacuug

SEQ ID NO: 709593 - RNA, 19 nt, Homo sapiens
agaagaauugguccaguua

SEQ ID NO: 709594 - RNA, 19 nt, Homo sapiens
guauaaccauccugcuguu

SEQ ID NO: 709595 - RNA, 19 nt, Homo sapiens
ccaaaugaagggauucuau

SEQ ID NO: 709596 - RNA, 19 nt, Homo sapiens
gaauugguccaguuaagug

SEQ ID NO: 709597 - RNA, 19 nt, Homo sapiens
cuacaaccaucaugaaugc

SEQ ID NO: 709598 - RNA, 19 nt, Homo sapiens
ccauccugcuguuccuuua

SEQ ID NO: 709599 - RNA, 19 nt, Homo sapiens
guuauuaugcuuacuguuc

SEQ ID NO: 709600 - RNA, 19 nt, Homo sapiens
uuucuucugugucauguuu

SEQ ID NO: 709601 - RNA, 19 nt, Homo sapiens
cuaguacauuggaagcuuu

SEQ ID NO: 709602 - RNA, 19 nt, Homo sapiens
cuaccuauauggcaugauc

SEQ ID NO: 709603 - RNA, 19 nt, Homo sapiens
aaggaaggauggugcaaau

SEQ ID NO: 709604 - RNA, 19 nt, Homo sapiens
cauauuuccaucagaguaa

SEQ ID NO: 709605 - RNA, 19 nt, Homo sapiens
guauauugcaugaaugaga

SEQ ID NO: 709606 - RNA, 19 nt, Homo sapiens
gguuugaacuugcacuucu

SEQ ID NO: 709607 - RNA, 19 nt, Homo sapiens
caaaugaagggauucuauc

SEQ ID NO: 709608 - RNA, 19 nt, Homo sapiens
gcucuuagaacaacacaca

SEQ ID NO: 709609 - RNA, 19 nt, Homo sapiens
uuacaagaauccuauagac

SEQ ID NO: 709610 - RNA, 19 nt, Homo sapiens
uaugcugaauuacuuguga

SEQ ID NO: 709611 - RNA, 19 nt, Homo sapiens
cuucauggguuuccucauc

SEQ ID NO: 709612 - RNA, 19 nt, Homo sapiens
guagauaucaggugcuucu

SEQ ID NO: 709613 - RNA, 19 nt, Homo sapiens
ugaagacugauuacaagaa

SEQ ID NO: 709614 - RNA, 19 nt, Homo sapiens
aagaguagccuguggaauc

SEQ ID NO: 709615 - RNA, 19 nt, Homo sapiens
aagauccuguccaagagua

SEQ ID NO: 709616 - RNA, 19 nt, Homo sapiens
uagaacaacacacagaaga

SEQ ID NO: 709617 - RNA, 19 nt, Homo sapiens
uuggugagcucuuagaaca

SEQ ID NO: 709618 - RNA, 19 nt, Homo sapiens
uugcaugaaugagagauuu

SEQ ID NO: 709619 - RNA, 19 nt, Homo sapiens
ccucaucugucaugucgau

SEQ ID NO: 709620 - RNA, 19 nt, Homo sapiens
uuaaggaacagccauaauc

SEQ ID NO: 709621 - RNA, 19 nt, Homo sapiens
ugacagguuugaacuugca

SEQ ID NO: 709622 - RNA, 19 nt, Homo sapiens
ccucugguguugacagguu

SEQ ID NO: 709623 - RNA, 19 nt, Homo sapiens
gaaucugaucaguuacuuu

SEQ ID NO: 709624 - RNA, 19 nt, Homo sapiens
acaacacacagaagaauug

SEQ ID NO: 709625 - RNA, 19 nt, Homo sapiens
uauaugaguagaccaguga

SEQ ID NO: 709626 - RNA, 19 nt, Homo sapiens
gaauuacuugugaagaaug

SEQ ID NO: 709627 - RNA, 19 nt, Homo sapiens
ugucgaugauuauauaugg

SEQ ID NO: 709628 - RNA, 19 nt, Homo sapiens
gugguaaagguauucuuaa

SEQ ID NO: 709629 - RNA, 19 nt, Homo sapiens
ccauauuuccaucagagua

SEQ ID NO: 709630 - RNA, 19 nt, Homo sapiens
gcucaucuucuucgccauu

SEQ ID NO: 709631 - RNA, 19 nt, Homo sapiens
gccaccaaaugaagggauu

SEQ ID NO: 709632 - RNA, 19 nt, Homo sapiens
aagaauugguccaguuaag

SEQ ID NO: 709633 - RNA, 19 nt, Homo sapiens
ggugagcucuuagaacaac

SEQ ID NO: 709634 - RNA, 19 nt, Homo sapiens
gaugagcugaagacugauu

SEQ ID NO: 709635 - RNA, 19 nt, Homo sapiens
uauuaucccuguauauugc

SEQ ID NO: 709636 - RNA, 19 nt, Homo sapiens
cauaauccucugaaugaug

SEQ ID NO: 709637 - RNA, 19 nt, Homo sapiens
augauuaccucugguguug

SEQ ID NO: 709638 - RNA, 19 nt, Homo sapiens
gacccuacaaccaucauga

SEQ ID NO: 709639 - RNA, 19 nt, Homo sapiens
ccuaguacauuggaagcuu

SEQ ID NO: 709640 - RNA, 19 nt, Homo sapiens
cauuauagcauuugaugag

SEQ ID NO: 709641 - RNA, 19 nt, Homo sapiens
uacacugggucucaauaug

SEQ ID NO: 709642 - RNA, 19 nt, Homo sapiens
gugaagaaugcauuuaaag

SEQ ID NO: 709643 - RNA, 19 nt, Homo sapiens
uugcagguacuacagauuu

SEQ ID NO: 709644 - RNA, 19 nt, Homo sapiens
ugguaaagguauucuuaag

SEQ ID NO: 709645 - RNA, 19 nt, Homo sapiens
uaugcuuacuguucuaauc

SEQ ID NO: 709646 - RNA, 19 nt, Homo sapiens
gauuaccucugguguugac

SEQ ID NO: 709647 - RNA, 19 nt, Homo sapiens
gcacauuauagcauuugau

SEQ ID NO: 709648 - RNA, 19 nt, Homo sapiens
cacauuauagcauuugaug

SEQ ID NO: 709649 - RNA, 19 nt, Homo sapiens
gauggugcaaauuagcuuu

SEQ ID NO: 709650 - RNA, 19 nt, Homo sapiens
uagcauauugucagaagga

SEQ ID NO: 709651 - RNA, 19 nt, Homo sapiens
ucuuaagaauuugcaggua

SEQ ID NO: 709652 - RNA, 19 nt, Homo sapiens
ccaagaguagccuguggaa

SEQ ID NO: 709653 - RNA, 19 nt, Homo sapiens
agaacaacacacagaagaa

SEQ ID NO: 709654 - RNA, 19 nt, Homo sapiens
ucuagcauauugucagaag

SEQ ID NO: 709655 - RNA, 19 nt, Homo sapiens
gagagauuucccauauuuc

SEQ ID NO: 709656 - RNA, 19 nt, Homo sapiens
cugaugaagugaaaaugua

SEQ ID NO: 709657 - RNA, 19 nt, Homo sapiens
ccauaauccucugaaugau

SEQ ID NO: 709658 - RNA, 19 nt, Homo sapiens
agaguagccuguggaaucu

SEQ ID NO: 709659 - RNA, 19 nt, Homo sapiens
agcaagauccuguccaaga

SEQ ID NO: 709660 - RNA, 19 nt, Homo sapiens
cuauauggcaugaucuaug

SEQ ID NO: 709661 - RNA, 19 nt, Homo sapiens
caacagaccuugcaguaaa

SEQ ID NO: 709662 - RNA, 19 nt, Homo sapiens
cgaaagaucuguccaagaa

SEQ ID NO: 709663 - RNA, 19 nt, Homo sapiens
gcaaagggauuaugauguu

SEQ ID NO: 709664 - RNA, 19 nt, Homo sapiens
gaacagagcaguuuggaaa

SEQ ID NO: 709665 - RNA, 19 nt, Homo sapiens
ggacaaccguuuaugagua

SEQ ID NO: 709666 - RNA, 19 nt, Homo sapiens
gaacaagaccgauaucuau

SEQ ID NO: 709667 - RNA, 19 nt, Homo sapiens
gcaaacagcuggucaagca

SEQ ID NO: 709668 - RNA, 19 nt, Homo sapiens
aaacugagcuugcuuaauc

SEQ ID NO: 709669 - RNA, 19 nt, Homo sapiens
ggaaugaaaucagagcaua

SEQ ID NO: 709670 - RNA, 19 nt, Homo sapiens
caagguacuucuaugaaua

SEQ ID NO: 709671 - RNA, 19 nt, Homo sapiens
agaaacagcucaggaauuu

SEQ ID NO: 709672 - RNA, 19 nt, Homo sapiens
gagauaacuuggacaauga

SEQ ID NO: 709673 - RNA, 19 nt, Homo sapiens
cacaauugcucacuacuua

SEQ ID NO: 709674 - RNA, 19 nt, Homo sapiens
gcacuaagaauguggauaa

SEQ ID NO: 709675 - RNA, 19 nt, Homo sapiens
ggagauaacuuggacaaug

SEQ ID NO: 709676 - RNA, 19 nt, Homo sapiens
gauagacacuggagaaguu

SEQ ID NO: 709677 - RNA, 19 nt, Homo sapiens
gcaauugccuacuggauga

SEQ ID NO: 709678 - RNA, 19 nt, Homo sapiens
caggaaagaucuaugauga

SEQ ID NO: 709679 - RNA, 19 nt, Homo sapiens
gcaauucacuccacucuag

SEQ ID NO: 709680 - RNA, 19 nt, Homo sapiens
gaaaugcuuuguggagaua

SEQ ID NO: 709681 - RNA, 19 nt, Homo sapiens
gagcauaguuccuguuugu

SEQ ID NO: 709682 - RNA, 19 nt, Homo sapiens
uggcaucucugucaucuua

SEQ ID NO: 709683 - RNA, 19 nt, Homo sapiens
cuauagaucuuuaccgaua

SEQ ID NO: 709684 - RNA, 19 nt, Homo sapiens
caauacaccugaugcauga

SEQ ID NO: 709685 - RNA, 19 nt, Homo sapiens
ggagcaaacugacugcaaa

SEQ ID NO: 709686 - RNA, 19 nt, Homo sapiens
gcagaaagccuacaauaag

SEQ ID NO: 709687 - RNA, 19 nt, Homo sapiens
cgaccugccuuuaccuuua

SEQ ID NO: 709688 - RNA, 19 nt, Homo sapiens
gagauggaauucugugaaa

SEQ ID NO: 709689 - RNA, 19 nt, Homo sapiens
gaaguugguuggagcuauu

SEQ ID NO: 709690 - RNA, 19 nt, Homo sapiens
ggaugaccauucaauauga

SEQ ID NO: 709691 - RNA, 19 nt, Homo sapiens
gaaccaagcccaccugaau

SEQ ID NO: 709692 - RNA, 19 nt, Homo sapiens
gacacucacuacuucauua

SEQ ID NO: 709693 - RNA, 19 nt, Homo sapiens
cagaggagaucaaugacua

SEQ ID NO: 709694 - RNA, 19 nt, Homo sapiens
caaaguggaaucauacaua

SEQ ID NO: 709695 - RNA, 19 nt, Homo sapiens
ccacagugauuauggguuu

SEQ ID NO: 709696 - RNA, 19 nt, Homo sapiens
ggagacagguuucauagag

SEQ ID NO: 709697 - RNA, 19 nt, Homo sapiens
gcaaacaggaccucuuauu

SEQ ID NO: 709698 - RNA, 19 nt, Homo sapiens
gcacaggaaagaucuauga

SEQ ID NO: 709699 - RNA, 19 nt, Homo sapiens
gcaacuaguaccauauaua

SEQ ID NO: 709700 - RNA, 19 nt, Homo sapiens
ggacuauguuuauaacuuc

SEQ ID NO: 709701 - RNA, 19 nt, Homo sapiens
ggaaauguucgaauucgua

SEQ ID NO: 709702 - RNA, 19 nt, Homo sapiens
ccagucauaucaaccauaa

SEQ ID NO: 709703 - RNA, 19 nt, Homo sapiens
gauggaugcuucuaaccua

SEQ ID NO: 709704 - RNA, 19 nt, Homo sapiens
gaaugucacuguucuacug

SEQ ID NO: 709705 - RNA, 19 nt, Homo sapiens
gagcaaguauucguguuaa

SEQ ID NO: 709706 - RNA, 19 nt, Homo sapiens
gaacagcaacauaccauug

SEQ ID NO: 709707 - RNA, 19 nt, Homo sapiens
ccacagacaucagaaguug

SEQ ID NO: 709708 - RNA, 19 nt, Homo sapiens
ggaacaagaccgauaucua

SEQ ID NO: 709709 - RNA, 19 nt, Homo sapiens
aaggagagcuguaugcaaa

SEQ ID NO: 709710 - RNA, 19 nt, Homo sapiens
agaauuaacuuacgagcuu

SEQ ID NO: 709711 - RNA, 19 nt, Homo sapiens
cacacaagcucggagauua

SEQ ID NO: 709712 - RNA, 19 nt, Homo sapiens
aggaguagaugccaauaua

SEQ ID NO: 709713 - RNA, 19 nt, Homo sapiens
gaagaaggccuugugaaug

SEQ ID NO: 709714 - RNA, 19 nt, Homo sapiens
aaagaucuguccaagaauu

SEQ ID NO: 709715 - RNA, 19 nt, Homo sapiens
ggaaacuccguuaguauuu

SEQ ID NO: 709716 - RNA, 19 nt, Homo sapiens
gggagacccugcacgagua

SEQ ID NO: 709717 - RNA, 19 nt, Homo sapiens
gguuggagcuauuugguuu

SEQ ID NO: 709718 - RNA, 19 nt, Homo sapiens
ggacaacggccuaucauca

SEQ ID NO: 709719 - RNA, 19 nt, Homo sapiens
uaaaucaggucauaacuac

SEQ ID NO: 709720 - RNA, 19 nt, Homo sapiens
gaaagccccuuccuccuua

SEQ ID NO: 709721 - RNA, 19 nt, Homo sapiens
ugcgauaucuccaacuuua

SEQ ID NO: 709722 - RNA, 19 nt, Homo sapiens
gaauggagaauacgagaaa

SEQ ID NO: 709723 - RNA, 19 nt, Homo sapiens
gggacaggcugcaauguug

SEQ ID NO: 709724 - RNA, 19 nt, Homo sapiens
ucccaaaccugaauuagaa

SEQ ID NO: 709725 - RNA, 19 nt, Homo sapiens
gaggucaggucauaaagga

SEQ ID NO: 709726 - RNA, 19 nt, Homo sapiens
gacuacagcuacaacaauu

SEQ ID NO: 709727 - RNA, 19 nt, Homo sapiens
gcagagucuuauacaagua

SEQ ID NO: 709728 - RNA, 19 nt, Homo sapiens
ggaaaugcuuuguggagau

SEQ ID NO: 709729 - RNA, 19 nt, Homo sapiens
caaguauacuggcugacua

SEQ ID NO: 709730 - RNA, 19 nt, Homo sapiens
uaaauccuauggacaauuc

SEQ ID NO: 709731 - RNA, 19 nt, Homo sapiens
gcacaaguccugcucacaa

SEQ ID NO: 709732 - RNA, 19 nt, Homo sapiens
ggagcaaguauucguguua

SEQ ID NO: 709733 - RNA, 19 nt, Homo sapiens
gagggacacucacuacuuc

SEQ ID NO: 709734 - RNA, 19 nt, Homo sapiens
gcaguggugaagaauauua

SEQ ID NO: 709735 - RNA, 19 nt, Homo sapiens
gaaaccuacucuccauaga

SEQ ID NO: 709736 - RNA, 19 nt, Homo sapiens
gggacuauguuuauaacuu

SEQ ID NO: 709737 - RNA, 19 nt, Homo sapiens
cauuguaugucuuggauaa

SEQ ID NO: 709738 - RNA, 19 nt, Homo sapiens
gaaacgugcccugacuuua

SEQ ID NO: 709739 - RNA, 19 nt, Homo sapiens
cagcacacuucaagacuuu

SEQ ID NO: 709740 - RNA, 19 nt, Homo sapiens
gccaaacucucuucucuca

SEQ ID NO: 709741 - RNA, 19 nt, Homo sapiens
gcaauguugucauggaaau

SEQ ID NO: 709742 - RNA, 19 nt, Homo sapiens
ugacuucucuguugaaugg

SEQ ID NO: 709743 - RNA, 19 nt, Homo sapiens
uauguagccugugauaaua

SEQ ID NO: 709744 - RNA, 19 nt, Homo sapiens
guuaagcaguggugaagaa

SEQ ID NO: 709745 - RNA, 19 nt, Homo sapiens
uaacaagguacuucuauga

SEQ ID NO: 709746 - RNA, 19 nt, Homo sapiens
caugcaagcuguaaucaau

SEQ ID NO: 709747 - RNA, 19 nt, Homo sapiens
caaacaggaccucuuauug

SEQ ID NO: 709748 - RNA, 19 nt, Homo sapiens
ggaaaagaaucacguguug

SEQ ID NO: 709749 - RNA, 19 nt, Homo sapiens
guacuucuaugaauacgau

SEQ ID NO: 709750 - RNA, 19 nt, Homo sapiens
uuucugagguucucuauga

SEQ ID NO: 709751 - RNA, 19 nt, Homo sapiens
ggcguuacaucuuugagua

SEQ ID NO: 709752 - RNA, 19 nt, Homo sapiens
ggacaaugauggagauggu

SEQ ID NO: 709753 - RNA, 19 nt, Homo sapiens
ggagucugcucaagaggaa

SEQ ID NO: 709754 - RNA, 19 nt, Homo sapiens
agacagguuucauagagua

SEQ ID NO: 709755 - RNA, 19 nt, Homo sapiens
gcagcggacucucuucaga

SEQ ID NO: 709756 - RNA, 19 nt, Homo sapiens
ggaugaagauggcuuucug

SEQ ID NO: 709757 - RNA, 19 nt, Homo sapiens
guaagcagauauaaugaag

SEQ ID NO: 709758 - RNA, 19 nt, Homo sapiens
gacaaccguuuaugaguau

SEQ ID NO: 709759 - RNA, 19 nt, Homo sapiens
caagggacuauguuuauaa

SEQ ID NO: 709760 - RNA, 19 nt, Homo sapiens
gcaaaggacagucguuuua

SEQ ID NO: 709761 - RNA, 19 nt, Homo sapiens
gagaugauuucuucuauga

SEQ ID NO: 709762 - RNA, 19 nt, Homo sapiens
ugagaaggcuuauugguaa

SEQ ID NO: 709763 - RNA, 19 nt, Homo sapiens
gaacagugcuuugagacaa

SEQ ID NO: 709764 - RNA, 19 nt, Homo sapiens
caauuuagaucaggaagua

SEQ ID NO: 709765 - RNA, 19 nt, Homo sapiens
cagagcagcuuuacaaguu

SEQ ID NO: 709766 - RNA, 19 nt, Homo sapiens
gcgcucaucucgacacuaa

SEQ ID NO: 709767 - RNA, 19 nt, Homo sapiens
guacagagcagcuuuacaa

SEQ ID NO: 709768 - RNA, 19 nt, Homo sapiens
gaaguuguaugauaaagca

SEQ ID NO: 709769 - RNA, 19 nt, Homo sapiens
gagagaugauuucuucuau

SEQ ID NO: 709770 - RNA, 19 nt, Homo sapiens
gaacagcguuacacugauc

SEQ ID NO: 709771 - RNA, 19 nt, Homo sapiens
ugacuaaguugauauggaa

SEQ ID NO: 709772 - RNA, 19 nt, Homo sapiens
gcaaugaaucuacuuaaug

SEQ ID NO: 709773 - RNA, 19 nt, Homo sapiens
aaaugucagugcauaguua

SEQ ID NO: 709774 - RNA, 19 nt, Homo sapiens
gggugaaguuguaugauaa

SEQ ID NO: 709775 - RNA, 19 nt, Homo sapiens
gaugaacagugcuuugaga

SEQ ID NO: 709776 - RNA, 19 nt, Homo sapiens
ggauaaaggcauugcuuaa

SEQ ID NO: 709777 - RNA, 19 nt, Homo sapiens
caaugaaucuacuuaaugg

SEQ ID NO: 709778 - RNA, 19 nt, Homo sapiens
gaggaaagagagaugauuu

SEQ ID NO: 709779 - RNA, 19 nt, Homo sapiens
ggaaucaaacuuuauggaa

SEQ ID NO: 709780 - RNA, 19 nt, Homo sapiens
ugaagugucuguuccuuau

SEQ ID NO: 709781 - RNA, 19 nt, Homo sapiens
gaaauuucuugcuagugaa

SEQ ID NO: 709782 - RNA, 19 nt, Homo sapiens
caaguugucacauuucuuu

SEQ ID NO: 709783 - RNA, 19 nt, Homo sapiens
gggaacagcguuacacuga

SEQ ID NO: 709784 - RNA, 19 nt, Homo sapiens
gggauaaaggcauugcuua

SEQ ID NO: 709785 - RNA, 19 nt, Homo sapiens
gcacagauaauucagagau

SEQ ID NO: 709786 - RNA, 19 nt, Homo sapiens
uaaaggcauugcuuaacuu

SEQ ID NO: 709787 - RNA, 19 nt, Homo sapiens
gagaaggcuuauugguaaa

SEQ ID NO: 709788 - RNA, 19 nt, Homo sapiens
ggaaaggguuuuaugcaaa

SEQ ID NO: 709789 - RNA, 19 nt, Homo sapiens
ggcauugcuuaacuucuua

SEQ ID NO: 709790 - RNA, 19 nt, Homo sapiens
uaaaauggcuacugguauu

SEQ ID NO: 709791 - RNA, 19 nt, Homo sapiens
gugcuacaauuccuaauca

SEQ ID NO: 709792 - RNA, 19 nt, Homo sapiens
gauaacagaagagacagua

SEQ ID NO: 709793 - RNA, 19 nt, Homo sapiens
gaagacaggaaucaugaug

SEQ ID NO: 709794 - RNA, 19 nt, Homo sapiens
gggcaaccuugaaacgaaa

SEQ ID NO: 709795 - RNA, 19 nt, Homo sapiens
gaaagugcuacaauuccua

SEQ ID NO: 709796 - RNA, 19 nt, Homo sapiens
gaagagacaguaguagaga

SEQ ID NO: 709797 - RNA, 19 nt, Homo sapiens
gaugucaguuugucauauc

SEQ ID NO: 709798 - RNA, 19 nt, Homo sapiens
ccacaucuccuagcaggua

SEQ ID NO: 709799 - RNA, 19 nt, Homo sapiens
aaagaaagugcuacaauuc

SEQ ID NO: 709800 - RNA, 19 nt, Homo sapiens
gaauucuuaucccuaccua

SEQ ID NO: 709801 - RNA, 19 nt, Homo sapiens
cacauacuguuucauucua

SEQ ID NO: 709802 - RNA, 19 nt, Homo sapiens
gcauuuguacuguuccuuu

SEQ ID NO: 709803 - RNA, 19 nt, Homo sapiens
caaagacacauguaaugga

SEQ ID NO: 709804 - RNA, 19 nt, Homo sapiens
ugacuaugauaacagaaga

SEQ ID NO: 709805 - RNA, 19 nt, Homo sapiens
cagcguaaagucagaauga

SEQ ID NO: 709806 - RNA, 19 nt, Homo sapiens
gucagugcauaguuagaua

SEQ ID NO: 709807 - RNA, 19 nt, Homo sapiens
ggggugaaguuguaugaua

SEQ ID NO: 709808 - RNA, 19 nt, Homo sapiens
ccaugacuaugauaacaga

SEQ ID NO: 709809 - RNA, 19 nt, Homo sapiens
ccuagcagauagacauuau

SEQ ID NO: 709810 - RNA, 19 nt, Homo sapiens
gcgccaagguacaccauca

SEQ ID NO: 709811 - RNA, 19 nt, Homo sapiens
gagcuuuacccuaguugaa

SEQ ID NO: 709812 - RNA, 19 nt, Homo sapiens
ggaucgcacucucuuugug

SEQ ID NO: 709813 - RNA, 19 nt, Homo sapiens
gaccaucauuacagaggaa

SEQ ID NO: 709814 - RNA, 19 nt, Homo sapiens
ggaacagcguuacacugau

SEQ ID NO: 709815 - RNA, 19 nt, Homo sapiens
cguaaagucagaaugaauu

SEQ ID NO: 709816 - RNA, 19 nt, Homo sapiens
gaaucuacuuaauggaauc

SEQ ID NO: 709817 - RNA, 19 nt, Homo sapiens
acgaaaggacuauggauaa

SEQ ID NO: 709818 - RNA, 19 nt, Homo sapiens
gcaguuugcguuugugaau

SEQ ID NO: 709819 - RNA, 19 nt, Homo sapiens
ggagccaugacuaugauaa

SEQ ID NO: 709820 - RNA, 19 nt, Homo sapiens
agucauaguuucaaucagu

SEQ ID NO: 709821 - RNA, 19 nt, Homo sapiens
gacaagcagugaugaacag

SEQ ID NO: 709822 - RNA, 19 nt, Homo sapiens
gaaaggacuauggauaaca

SEQ ID NO: 709823 - RNA, 19 nt, Homo sapiens
auaagucacucaggaaguu

SEQ ID NO: 709824 - RNA, 19 nt, Homo sapiens
guauaaauucugugacaug

SEQ ID NO: 709825 - RNA, 19 nt, Homo sapiens
cagaagagacaguaguaga

SEQ ID NO: 709826 - RNA, 19 nt, Homo sapiens
caaaagauaaggaugguaa

SEQ ID NO: 709827 - RNA, 19 nt, Homo sapiens
caucagcacagauaauuca

SEQ ID NO: 709828 - RNA, 19 nt, Homo sapiens
aaaggacuauggauaacau

SEQ ID NO: 709829 - RNA, 19 nt, Homo sapiens
caaagugcccagacugugu

SEQ ID NO: 709830 - RNA, 19 nt, Homo sapiens
gcuacaauuccuaaucauu

SEQ ID NO: 709831 - RNA, 19 nt, Homo sapiens
gaauugcgguuuuauuaca

SEQ ID NO: 709832 - RNA, 19 nt, Homo sapiens
uaauaccacagcauuugua

SEQ ID NO: 709833 - RNA, 19 nt, Homo sapiens
aggcauugcuuaacuucuu

SEQ ID NO: 709834 - RNA, 19 nt, Homo sapiens
gcggaucgcacucucuuug

SEQ ID NO: 709835 - RNA, 19 nt, Homo sapiens
caccaucaguucaaucaca

SEQ ID NO: 709836 - RNA, 19 nt, Homo sapiens
gguauaagucacucaggaa

SEQ ID NO: 709837 - RNA, 19 nt, Homo sapiens
gagauuguacagguuguuu

SEQ ID NO: 709838 - RNA, 19 nt, Homo sapiens
agacacauguaauggagau

SEQ ID NO: 709839 - RNA, 19 nt, Homo sapiens
gaaggcuuauugguaaagu

SEQ ID NO: 709840 - RNA, 19 nt, Homo sapiens
uugagaaggcuuauuggua

SEQ ID NO: 709841 - RNA, 19 nt, Homo sapiens
agagagaugauuucuucua

SEQ ID NO: 709842 - RNA, 19 nt, Homo sapiens
uacgaaaggacuauggaua

SEQ ID NO: 709843 - RNA, 19 nt, Homo sapiens
cccacaagaugucaguuug

SEQ ID NO: 709844 - RNA, 19 nt, Homo sapiens
auagauucaugaagccuuu

SEQ ID NO: 709845 - RNA, 19 nt, Homo sapiens
auaaaggcauugcuuaacu

SEQ ID NO: 709846 - RNA, 19 nt, Homo sapiens
uaacagaagagacaguagu

SEQ ID NO: 709847 - RNA, 19 nt, Homo sapiens
agagaugauuucuucuaug

SEQ ID NO: 709848 - RNA, 19 nt, Homo sapiens
aaucacacagucauaguuu

SEQ ID NO: 709849 - RNA, 19 nt, Homo sapiens
gacuucaucagcacagaua

SEQ ID NO: 709850 - RNA, 19 nt, Homo sapiens
cgaaaggacuauggauaac

SEQ ID NO: 709851 - RNA, 19 nt, Homo sapiens
gaaggccuaucaaaauuca

SEQ ID NO: 709852 - RNA, 19 nt, Homo sapiens
cccagacuguguacaaaga

SEQ ID NO: 709853 - RNA, 19 nt, Homo sapiens
uaaauccccuuuucaggaa

SEQ ID NO: 709854 - RNA, 19 nt, Homo sapiens
gauaaaggcauugcuuaac

SEQ ID NO: 709855 - RNA, 19 nt, Homo sapiens
ugggcaaccuugaaacgaa

SEQ ID NO: 709856 - RNA, 19 nt, Homo sapiens
aguuugcguuugugaauuu

SEQ ID NO: 709857 - RNA, 19 nt, Homo sapiens
caaaugucauaugguggaa

SEQ ID NO: 709858 - RNA, 19 nt, Homo sapiens
uauuugagaaggcuuauug

SEQ ID NO: 709859 - RNA, 19 nt, Homo sapiens
acacagucauaguuucaau

SEQ ID NO: 709860 - RNA, 19 nt, Homo sapiens
cauccagguugacagucua

SEQ ID NO: 709861 - RNA, 19 nt, Homo sapiens
gaaggcaguuucccaauaa

SEQ ID NO: 709862 - RNA, 19 nt, Homo sapiens
caagauaagucacagcuuu

SEQ ID NO: 709863 - RNA, 19 nt, Homo sapiens
gaagggauuuaucagauuu

SEQ ID NO: 709864 - RNA, 19 nt, Homo sapiens
gagauucacuucccuuuga

SEQ ID NO: 709865 - RNA, 19 nt, Homo sapiens
gaaauccaccggaagauaa

SEQ ID NO: 709866 - RNA, 19 nt, Homo sapiens
gaugggaucuuguauggaa

SEQ ID NO: 709867 - RNA, 19 nt, Homo sapiens
gagacacucuggcaacuuu

SEQ ID NO: 709868 - RNA, 19 nt, Homo sapiens
ggaagggauuuaucagauu

SEQ ID NO: 709869 - RNA, 19 nt, Homo sapiens
gaaaggaaacggauuaagu

SEQ ID NO: 709870 - RNA, 19 nt, Homo sapiens
gaacgagagggaaaguuua

SEQ ID NO: 709871 - RNA, 19 nt, Homo sapiens
gcaagaaggaaaugucuaa

SEQ ID NO: 709872 - RNA, 19 nt, Homo sapiens
gcaccgaucuuccuguuca

SEQ ID NO: 709873 - RNA, 19 nt, Homo sapiens
gagggaaaguuuaaaggaa

SEQ ID NO: 709874 - RNA, 19 nt, Homo sapiens
gaacagaacaggcccuaug

SEQ ID NO: 709875 - RNA, 19 nt, Homo sapiens
caacgagacuuaucgagau

SEQ ID NO: 709876 - RNA, 19 nt, Homo sapiens
uaacagaacuggaccuuuu

SEQ ID NO: 709877 - RNA, 19 nt, Homo sapiens
ggaaacggauuaaguacuc

SEQ ID NO: 709878 - RNA, 19 nt, Homo sapiens
ggaagaaggccaagaguca

SEQ ID NO: 709879 - RNA, 19 nt, Homo sapiens
gagaaacccagcaggcuua

SEQ ID NO: 709880 - RNA, 19 nt, Homo sapiens
gaucauaggcugccaggaa

SEQ ID NO: 709881 - RNA, 19 nt, Homo sapiens
gcuguugacuucagaggua

SEQ ID NO: 709882 - RNA, 19 nt, Homo sapiens
ggagggaccuggacaugau

SEQ ID NO: 709883 - RNA, 19 nt, Homo sapiens
ggacaacagucaucaucug

SEQ ID NO: 709884 - RNA, 19 nt, Homo sapiens
gaaccuugauccgccauuu

SEQ ID NO: 709885 - RNA, 19 nt, Homo sapiens
ggacaggccugggauaugg

SEQ ID NO: 709886 - RNA, 19 nt, Homo sapiens
gaucguaaacuuguugaua

SEQ ID NO: 709887 - RNA, 19 nt, Homo sapiens
ccagaaaggaaacggauua

SEQ ID NO: 709888 - RNA, 19 nt, Homo sapiens
gaagggaagggccaacuuu

SEQ ID NO: 709889 - RNA, 19 nt, Homo sapiens
gcaagacaccgauuacaga

SEQ ID NO: 709890 - RNA, 19 nt, Homo sapiens
aaaggaaacggauuaagua

SEQ ID NO: 709891 - RNA, 19 nt, Homo sapiens
gagcuagccuaucuggaaa

SEQ ID NO: 709892 - RNA, 19 nt, Homo sapiens
ggaaauccaccggaagaua

SEQ ID NO: 709893 - RNA, 19 nt, Homo sapiens
agaaggcaguuucccaaua

SEQ ID NO: 709894 - RNA, 19 nt, Homo sapiens
gagagaagcagaaagguau

SEQ ID NO: 709895 - RNA, 19 nt, Homo sapiens
gggaagggauuuaucagau

SEQ ID NO: 709896 - RNA, 19 nt, Homo sapiens
ggagcuagccuaucuggaa

SEQ ID NO: 709897 - RNA, 19 nt, Homo sapiens
ccagggaacucuaaugauc

SEQ ID NO: 709898 - RNA, 19 nt, Homo sapiens
cagcaggcuuauucgauua

SEQ ID NO: 709899 - RNA, 19 nt, Homo sapiens
gagaagaauccacacauga

SEQ ID NO: 709900 - RNA, 19 nt, Homo sapiens
cauguuugcucgauauaaa

SEQ ID NO: 709901 - RNA, 19 nt, Homo sapiens
caaggaaagucaaguagca

SEQ ID NO: 709902 - RNA, 19 nt, Homo sapiens
ggaagaugguagcuguaaa

SEQ ID NO: 709903 - RNA, 19 nt, Homo sapiens
gagaggagcaaaccaagaa

SEQ ID NO: 709904 - RNA, 19 nt, Homo sapiens
gaugguacuucuauggauu

SEQ ID NO: 709905 - RNA, 19 nt, Homo sapiens
ugacagugaucguaaacuu

SEQ ID NO: 709906 - RNA, 19 nt, Homo sapiens
gaagauaucgacacuagca

SEQ ID NO: 709907 - RNA, 19 nt, Homo sapiens
caaacucacugacuggaau

SEQ ID NO: 709908 - RNA, 19 nt, Homo sapiens
gaggagacagugacuauga

SEQ ID NO: 709909 - RNA, 19 nt, Homo sapiens
gauccgccauuuagcauug

SEQ ID NO: 709910 - RNA, 19 nt, Homo sapiens
gcaaaacuaucaugcuaaa

SEQ ID NO: 709911 - RNA, 19 nt, Homo sapiens
ccagcaggcuuauucgauu

SEQ ID NO: 709912 - RNA, 19 nt, Homo sapiens
cuacugaucuagacuuuag

SEQ ID NO: 709913 - RNA, 19 nt, Homo sapiens
ggauacaaccucccucuug

SEQ ID NO: 709914 - RNA, 19 nt, Homo sapiens
gaaggagaaugaagaagac

SEQ ID NO: 709915 - RNA, 19 nt, Homo sapiens
ggaccauucugaccacaug

SEQ ID NO: 709916 - RNA, 19 nt, Homo sapiens
uaaagaagauaucgacacu

SEQ ID NO: 709917 - RNA, 19 nt, Homo sapiens
gcuacuggcuacuauuaug

SEQ ID NO: 709918 - RNA, 19 nt, Homo sapiens
ugacagaggccaagcaaga

SEQ ID NO: 709919 - RNA, 19 nt, Homo sapiens
caaagacggaacacaagua

SEQ ID NO: 709920 - RNA, 19 nt, Homo sapiens
cauaugaacuacagagaca

SEQ ID NO: 709921 - RNA, 19 nt, Homo sapiens
uaagaaaggagacaaguuc

SEQ ID NO: 709922 - RNA, 19 nt, Homo sapiens
aagaagauaucgacacuag

SEQ ID NO: 709923 - RNA, 19 nt, Homo sapiens
ggagagaacgagagggaaa

SEQ ID NO: 709924 - RNA, 19 nt, Homo sapiens
ggagaaugaagaagacaaa

SEQ ID NO: 709925 - RNA, 19 nt, Homo sapiens
caacuuuccuggcagagau

SEQ ID NO: 709926 - RNA, 19 nt, Homo sapiens
ggaaaugaucgcagggaaa

SEQ ID NO: 709927 - RNA, 19 nt, Homo sapiens
guacugcuauaaccagaau

SEQ ID NO: 709928 - RNA, 19 nt, Homo sapiens
aaaccaagaaggagaauga

SEQ ID NO: 709929 - RNA, 19 nt, Homo sapiens
gagccaagaagaaagguuu

SEQ ID NO: 709930 - RNA, 19 nt, Homo sapiens
ggccaagcaagaauuaaua

SEQ ID NO: 709931 - RNA, 19 nt, Homo sapiens
gaaguuacccuggaguaug

SEQ ID NO: 709932 - RNA, 19 nt, Homo sapiens
gauuuggacuuuagagaca

SEQ ID NO: 709933 - RNA, 19 nt, Homo sapiens
ggagcauucuuucagcuau

SEQ ID NO: 709934 - RNA, 19 nt, Homo sapiens
ccaagaaggagaaugaaga

SEQ ID NO: 709935 - RNA, 19 nt, Homo sapiens
gaaagucaaguagcaagaa

SEQ ID NO: 709936 - RNA, 19 nt, Homo sapiens
gaagagcagaguucagaug

SEQ ID NO: 709937 - RNA, 19 nt, Homo sapiens
ggaguaccgugauguggau

SEQ ID NO: 709938 - RNA, 19 nt, Homo sapiens
gaaacaagagaaggagaaa

SEQ ID NO: 709939 - RNA, 19 nt, Homo sapiens
gggaaaguuuaaaggaaga

SEQ ID NO: 709940 - RNA, 19 nt, Homo sapiens
ugucagaccugcacaagca

SEQ ID NO: 709941 - RNA, 19 nt, Homo sapiens
caagaaggagaaugaagaa

SEQ ID NO: 709942 - RNA, 19 nt, Homo sapiens
ggaaaugucuaaaagagau

SEQ ID NO: 709943 - RNA, 19 nt, Homo sapiens
gaacagccaaaguccaguu

SEQ ID NO: 709944 - RNA, 19 nt, Homo sapiens
ucaaguagcaagaaggaaa

SEQ ID NO: 709945 - RNA, 19 nt, Homo sapiens
uggauuaccugaggaagaa

SEQ ID NO: 709946 - RNA, 19 nt, Homo sapiens
agaaggcggucuggacuuu

SEQ ID NO: 709947 - RNA, 19 nt, Homo sapiens
gaagggagaauuugagcau

SEQ ID NO: 709948 - RNA, 19 nt, Homo sapiens
agacaaagacggaacacaa

SEQ ID NO: 709949 - RNA, 19 nt, Homo sapiens
gcuacuggcuggaggaaag

SEQ ID NO: 709950 - RNA, 19 nt, Homo sapiens
aagaccagcugauaaggaa

SEQ ID NO: 709951 - RNA, 19 nt, Homo sapiens
gggcaccgaucuuccuguu

SEQ ID NO: 709952 - RNA, 19 nt, Homo sapiens
gcaguuucccaauaaagaa

SEQ ID NO: 709953 - RNA, 19 nt, Homo sapiens
ccaggaagccagauguuug

SEQ ID NO: 709954 - RNA, 19 nt, Homo sapiens
agagaagaauccacacaug

SEQ ID NO: 709955 - RNA, 19 nt, Homo sapiens
gcagagauucaucacaguu

SEQ ID NO: 709956 - RNA, 19 nt, Homo sapiens
caaguuccaugggauacaa

SEQ ID NO: 709957 - RNA, 19 nt, Homo sapiens
ggaaaacgaagaaaugauu

SEQ ID NO: 709958 - RNA, 19 nt, Homo sapiens
uaucugauuuggacuuuag

SEQ ID NO: 709959 - RNA, 19 nt, Homo sapiens
ggauuuaucagauuuggau

SEQ ID NO: 709960 - RNA, 19 nt, Homo sapiens
uaucgacacuagcagcaaa

SEQ ID NO: 709961 - RNA, 19 nt, Homo sapiens
caacagggcucuauuauga

SEQ ID NO: 709962 - RNA, 19 nt, Homo sapiens
gaacagaggcuucgcauuu

SEQ ID NO: 709963 - RNA, 19 nt, Homo sapiens
gaacaaagaugcccuaguc

SEQ ID NO: 709964 - RNA, 19 nt, Homo sapiens
gaacauagcuccgcacacu

SEQ ID NO: 709965 - RNA, 19 nt, Homo sapiens
gacaauggguucagacaaa

SEQ ID NO: 709966 - RNA, 19 nt, Homo sapiens
gcaaaagccuuguguauau

SEQ ID NO: 709967 - RNA, 19 nt, Homo sapiens
ggaagaagauggccugucu

SEQ ID NO: 709968 - RNA, 19 nt, Homo sapiens
ggaaagagaagaaggagaa

SEQ ID NO: 709969 - RNA, 19 nt, Homo sapiens
gaccuaaguuugaagauug

SEQ ID NO: 709970 - RNA, 19 nt, Homo sapiens
caaagaugcuguccggaaa

SEQ ID NO: 709971 - RNA, 19 nt, Homo sapiens
gggcuaagaguuugaauaa

SEQ ID NO: 709972 - RNA, 19 nt, Homo sapiens
acaacaagcuggaggauug

SEQ ID NO: 709973 - RNA, 19 nt, Homo sapiens
aaagggagcuggccuagga

SEQ ID NO: 709974 - RNA, 19 nt, Homo sapiens
agaccgagcugcagaaaga

SEQ ID NO: 709975 - RNA, 19 nt, Homo sapiens
cgacaacagggcucuauua

SEQ ID NO: 709976 - RNA, 19 nt, Homo sapiens
aagauacgguuccaucaua

SEQ ID NO: 709977 - RNA, 19 nt, Homo sapiens
gauggaagccaaucagaaa

SEQ ID NO: 709978 - RNA, 19 nt, Homo sapiens
ggacucagauuacaaaaga

SEQ ID NO: 709979 - RNA, 19 nt, Homo sapiens
gacaguggauuguuuauac

SEQ ID NO: 709980 - RNA, 19 nt, Homo sapiens
gagaaaugauggaguccuu

SEQ ID NO: 709981 - RNA, 19 nt, Homo sapiens
gaagauuggcuuuguaaca

SEQ ID NO: 709982 - RNA, 19 nt, Homo sapiens
gcuaagaguuugaauaagc

SEQ ID NO: 709983 - RNA, 19 nt, Homo sapiens
ccacuuaccaguaugauga

SEQ ID NO: 709984 - RNA, 19 nt, Homo sapiens
guccucagcuguauaauca

SEQ ID NO: 709985 - RNA, 19 nt, Homo sapiens
uguaacaagugcugccuua

SEQ ID NO: 709986 - RNA, 19 nt, Homo sapiens
gggcaugccuugugcuguu

SEQ ID NO: 709987 - RNA, 19 nt, Homo sapiens
uaauagaucuuagggugaa

SEQ ID NO: 709988 - RNA, 19 nt, Homo sapiens
gaucauucuucggaacaua

SEQ ID NO: 709989 - RNA, 19 nt, Homo sapiens
ggacaguggauuguuuaua

SEQ ID NO: 709990 - RNA, 19 nt, Homo sapiens
cagaaagacgggagaagua

SEQ ID NO: 709991 - RNA, 19 nt, Homo sapiens
gaaauggagaugaggagaa

SEQ ID NO: 709992 - RNA, 19 nt, Homo sapiens
gaggacaguggauuguuua

SEQ ID NO: 709993 - RNA, 19 nt, Homo sapiens
guggauuacuacugugaua

SEQ ID NO: 709994 - RNA, 19 nt, Homo sapiens
gaugugaggcugaugaaga

SEQ ID NO: 709995 - RNA, 19 nt, Homo sapiens
ccaccucugucauuuguug

SEQ ID NO: 709996 - RNA, 19 nt, Homo sapiens
ccagagggcuugugaacag

SEQ ID NO: 709997 - RNA, 19 nt, Homo sapiens
gaagaagaaaggagagaau

SEQ ID NO: 709998 - RNA, 19 nt, Homo sapiens
aauaacauccgccucauaa

SEQ ID NO: 709999 - RNA, 19 nt, Homo sapiens
caaaagaaauaccuugaga

SEQ ID NO: 710000 - RNA, 19 nt, Homo sapiens
caaagccaccucugucauu

SEQ ID NO: 710001 - RNA, 19 nt, Homo sapiens
gaaguacggcauuccagaa

SEQ ID NO: 710002 - RNA, 19 nt, Homo sapiens
ucucagaccuucacaagca

SEQ ID NO: 710003 - RNA, 19 nt, Homo sapiens
ggaaaagacuaaaaugcuu

SEQ ID NO: 710004 - RNA, 19 nt, Homo sapiens
agaggacaguggauuguuu

SEQ ID NO: 710005 - RNA, 19 nt, Homo sapiens
gggagagagagaugaaaua

SEQ ID NO: 710006 - RNA, 19 nt, Homo sapiens
gcaaugcauuauagcaauc

SEQ ID NO: 710007 - RNA, 19 nt, Homo sapiens
caaaagaucuagugaugau

SEQ ID NO: 710008 - RNA, 19 nt, Homo sapiens
guuaccgccugucucuuua

SEQ ID NO: 710009 - RNA, 19 nt, Homo sapiens
uggagagacuugagaguga

SEQ ID NO: 710010 - RNA, 19 nt, Homo sapiens
gcagauugccaaagacaug

SEQ ID NO: 710011 - RNA, 19 nt, Homo sapiens
ggagaaacccaagagcaaa

SEQ ID NO: 710012 - RNA, 19 nt, Homo sapiens
caagauggcuaugcccaau

SEQ ID NO: 710013 - RNA, 19 nt, Homo sapiens
gcaguguugacuacaguua

SEQ ID NO: 710014 - RNA, 19 nt, Homo sapiens
gaaaauugauggcaaaacu

SEQ ID NO: 710015 - RNA, 19 nt, Homo sapiens
aaaucuggcuccuuuacaa

SEQ ID NO: 710016 - RNA, 19 nt, Homo sapiens
gagcaacccaccaaagaug

SEQ ID NO: 710017 - RNA, 19 nt, Homo sapiens
ccucagcuguauaaucaaa

SEQ ID NO: 710018 - RNA, 19 nt, Homo sapiens
ugacuacaguuaucugcaa

SEQ ID NO: 710019 - RNA, 19 nt, Homo sapiens
gagcgauauucgagaaaug

SEQ ID NO: 710020 - RNA, 19 nt, Homo sapiens
gguucucccucccaccuua

SEQ ID NO: 710021 - RNA, 19 nt, Homo sapiens
ugacccagcaguaccuuua

SEQ ID NO: 710022 - RNA, 19 nt, Homo sapiens
ugauagauaugaugacuac

SEQ ID NO: 710023 - RNA, 19 nt, Homo sapiens
ggagcugugugcuaaaucu

SEQ ID NO: 710024 - RNA, 19 nt, Homo sapiens
gcauuacggcucccauuga

SEQ ID NO: 710025 - RNA, 19 nt, Homo sapiens
gaagauacgguuccaucau

SEQ ID NO: 710026 - RNA, 19 nt, Homo sapiens
gagcgugaaucccgaagca

SEQ ID NO: 710027 - RNA, 19 nt, Homo sapiens
aaagccaccucugucauuu

SEQ ID NO: 710028 - RNA, 19 nt, Homo sapiens
gacaacagggcucuauuau

SEQ ID NO: 710029 - RNA, 19 nt, Homo sapiens
caauaacauccgccucaua

SEQ ID NO: 710030 - RNA, 19 nt, Homo sapiens
agagagcgauauucgagaa

SEQ ID NO: 710031 - RNA, 19 nt, Homo sapiens
gagggacucagauuacaaa

SEQ ID NO: 710032 - RNA, 19 nt, Homo sapiens
acaaggagcacaagaagug

SEQ ID NO: 710033 - RNA, 19 nt, Homo sapiens
gaagaaaggagagaaucug

SEQ ID NO: 710034 - RNA, 19 nt, Homo sapiens
cgucagcgccuucucugua

SEQ ID NO: 710035 - RNA, 19 nt, Homo sapiens
ggauggaagccaaucagaa

SEQ ID NO: 710036 - RNA, 19 nt, Homo sapiens
gguuugagaugcuguaggu

SEQ ID NO: 710037 - RNA, 19 nt, Homo sapiens
gcagaaagacgggagaagu

SEQ ID NO: 710038 - RNA, 19 nt, Homo sapiens
uaccugacacguccacuua

SEQ ID NO: 710039 - RNA, 19 nt, Homo sapiens
ucagcugcuucagauauua

SEQ ID NO: 710040 - RNA, 19 nt, Homo sapiens
agaccuaaguuugaagauu

SEQ ID NO: 710041 - RNA, 19 nt, Homo sapiens
ggagugagagagagagaga

SEQ ID NO: 710042 - RNA, 19 nt, Homo sapiens
ggacaauggguucagacaa

SEQ ID NO: 710043 - RNA, 19 nt, Homo sapiens
gaagcacagccuagcacua

SEQ ID NO: 710044 - RNA, 19 nt, Homo sapiens
gcucaguauucacaggauu

SEQ ID NO: 710045 - RNA, 19 nt, Homo sapiens
aaacagacccagcagaaca

SEQ ID NO: 710046 - RNA, 19 nt, Homo sapiens
agugcugccuuaacaauuu

SEQ ID NO: 710047 - RNA, 19 nt, Homo sapiens
uaaagaaguuccccuuaug

SEQ ID NO: 710048 - RNA, 19 nt, Homo sapiens
cacaagaagugguccaucu

SEQ ID NO: 710049 - RNA, 19 nt, Homo sapiens
ggaagaagaaaggagagaa

SEQ ID NO: 710050 - RNA, 19 nt, Homo sapiens
gcuuucagccugucaauuc

SEQ ID NO: 710051 - RNA, 19 nt, Homo sapiens
acaaacagacccagcagaa

SEQ ID NO: 710052 - RNA, 19 nt, Homo sapiens
agacaaguuugacucugaa

SEQ ID NO: 710053 - RNA, 19 nt, Homo sapiens
agagagagagcgugaaaga

SEQ ID NO: 710054 - RNA, 19 nt, Homo sapiens
ccagagagagagcgugaaa

SEQ ID NO: 710055 - RNA, 19 nt, Homo sapiens
ggcaugccuugugcuguua

SEQ ID NO: 710056 - RNA, 19 nt, Homo sapiens
gagcuaagggagagagaga

SEQ ID NO: 710057 - RNA, 19 nt, Homo sapiens
cccagcagauugccaaaga

SEQ ID NO: 710058 - RNA, 19 nt, Homo sapiens
gaaagagaagaaggagaaa

SEQ ID NO: 710059 - RNA, 19 nt, Homo sapiens
ccaacucgcaauacuacua

SEQ ID NO: 710060 - RNA, 19 nt, Homo sapiens
ccagaguccucagcuguau

SEQ ID NO: 710061 - RNA, 19 nt, Homo sapiens
gaagauccauucugcauua

SEQ ID NO: 710062 - RNA, 19 nt, Homo sapiens
gaaaguugaugcccaguaa

SEQ ID NO: 710063 - RNA, 19 nt, Homo sapiens
gaguuaagccuuuguauuu

SEQ ID NO: 710064 - RNA, 19 nt, Homo sapiens
ccuaauaaauggaccaaua

SEQ ID NO: 710065 - RNA, 19 nt, Homo sapiens
gcacaaacguggauuaucg

SEQ ID NO: 710066 - RNA, 19 nt, Homo sapiens
gcacguggcuggcuugcuu

SEQ ID NO: 710067 - RNA, 19 nt, Homo sapiens
gauaguaguucuaauccaa

SEQ ID NO: 710068 - RNA, 19 nt, Homo sapiens
augcagaccuuuagaguua

SEQ ID NO: 710069 - RNA, 19 nt, Homo sapiens
ccaaagauguucccuguag

SEQ ID NO: 710070 - RNA, 19 nt, Homo sapiens
gcaagaaacagaagcacua

SEQ ID NO: 710071 - RNA, 19 nt, Homo sapiens
gaagauaugagaguaauga

SEQ ID NO: 710072 - RNA, 19 nt, Homo sapiens
ccaauaagccaaacuauca

SEQ ID NO: 710073 - RNA, 19 nt, Homo sapiens
gcacagacugggagguuua

SEQ ID NO: 710074 - RNA, 19 nt, Homo sapiens
gcaacuuucuguccacuau

SEQ ID NO: 710075 - RNA, 19 nt, Homo sapiens
gugcauuucuccucuguuu

SEQ ID NO: 710076 - RNA, 19 nt, Homo sapiens
gaauucagccgaagauaug

SEQ ID NO: 710077 - RNA, 19 nt, Homo sapiens
aagaguggcuggaggaauu

SEQ ID NO: 710078 - RNA, 19 nt, Homo sapiens
ucaggaacaugauauagga

SEQ ID NO: 710079 - RNA, 19 nt, Homo sapiens
gagguuuaguggugcauuu

SEQ ID NO: 710080 - RNA, 19 nt, Homo sapiens
gaugagagucggcagauga

SEQ ID NO: 710081 - RNA, 19 nt, Homo sapiens
ggaccaauaagccaaacua

SEQ ID NO: 710082 - RNA, 19 nt, Homo sapiens
acaagcacauacagacaua

SEQ ID NO: 710083 - RNA, 19 nt, Homo sapiens
aaaggagaguauagaauga

SEQ ID NO: 710084 - RNA, 19 nt, Homo sapiens
ugcagucccugaacacuua

SEQ ID NO: 710085 - RNA, 19 nt, Homo sapiens
cuacacuucuggccaguuu

SEQ ID NO: 710086 - RNA, 19 nt, Homo sapiens
gaaggauuguaggagauuu

SEQ ID NO: 710087 - RNA, 19 nt, Homo sapiens
cgagaaagacagcaaguug

SEQ ID NO: 710088 - RNA, 19 nt, Homo sapiens
ucaaagggcuaguagaaac

SEQ ID NO: 710089 - RNA, 19 nt, Homo sapiens
uuacggaacuguggauuau

SEQ ID NO: 710090 - RNA, 19 nt, Homo sapiens
gcacacaagcacauacaga

SEQ ID NO: 710091 - RNA, 19 nt, Homo sapiens
gcauccagccugacuugua

SEQ ID NO: 710092 - RNA, 19 nt, Homo sapiens
ugcaauauuucucugagua

SEQ ID NO: 710093 - RNA, 19 nt, Homo sapiens
gaagcacuacccauacuga

SEQ ID NO: 710094 - RNA, 19 nt, Homo sapiens
ggaggaaugugggcgcuau

SEQ ID NO: 710095 - RNA, 19 nt, Homo sapiens
ggaguaaucugggcuuugc

SEQ ID NO: 710096 - RNA, 19 nt, Homo sapiens
ggaaaguugaugcccagua

SEQ ID NO: 710097 - RNA, 19 nt, Homo sapiens
gauaaaaucaggaacauga

SEQ ID NO: 710098 - RNA, 19 nt, Homo sapiens
cacagaguauuguuaaugu

SEQ ID NO: 710099 - RNA, 19 nt, Homo sapiens
gauauaggaaggaaggauu

SEQ ID NO: 710100 - RNA, 19 nt, Homo sapiens
cauauccugugcaugauga

SEQ ID NO: 710101 - RNA, 19 nt, Homo sapiens
aaucaaagggcuaguagaa

SEQ ID NO: 710102 - RNA, 19 nt, Homo sapiens
uggaggaucugcaccauag

SEQ ID NO: 710103 - RNA, 19 nt, Homo sapiens
ggaaggaaggauuguagga

SEQ ID NO: 710104 - RNA, 19 nt, Homo sapiens
ggaggaauucaguuucuug

SEQ ID NO: 710105 - RNA, 19 nt, Homo sapiens
ccucauggguugcuguguu

SEQ ID NO: 710106 - RNA, 19 nt, Homo sapiens
gagaaagacagcaaguugu

SEQ ID NO: 710107 - RNA, 19 nt, Homo sapiens
ccacagaguauuguuaaug

SEQ ID NO: 710108 - RNA, 19 nt, Homo sapiens
gcacuacccauacugagau

SEQ ID NO: 710109 - RNA, 19 nt, Homo sapiens
gggcaucggguguuucuau

SEQ ID NO: 710110 - RNA, 19 nt, Homo sapiens
gaacaugauauaggaagga

SEQ ID NO: 710111 - RNA, 19 nt, Homo sapiens
guucuaauccaauacaaug

SEQ ID NO: 710112 - RNA, 19 nt, Homo sapiens
gaaaucggcugggccuacu

SEQ ID NO: 710113 - RNA, 19 nt, Homo sapiens
uauccugcauaaacucuaa

SEQ ID NO: 710114 - RNA, 19 nt, Homo sapiens
aagccaaacuaucaguauu

SEQ ID NO: 710115 - RNA, 19 nt, Homo sapiens
ggcaucggguguuucuauu

SEQ ID NO: 710116 - RNA, 19 nt, Homo sapiens
ggaaggauuguaggagauu

SEQ ID NO: 710117 - RNA, 19 nt, Homo sapiens
aacagaagcacuacccaua

SEQ ID NO: 710118 - RNA, 19 nt, Homo sapiens
ugcccuaucuggugaaaga

SEQ ID NO: 710119 - RNA, 19 nt, Homo sapiens
gaaaaucaaagggcuagua

SEQ ID NO: 710120 - RNA, 19 nt, Homo sapiens
cuaauccaauacaaugcua

SEQ ID NO: 710121 - RNA, 19 nt, Homo sapiens
gugggucccuggugauuuc

SEQ ID NO: 710122 - RNA, 19 nt, Homo sapiens
ccgaagauaugagaguaau

SEQ ID NO: 710123 - RNA, 19 nt, Homo sapiens
ugcagaggauggaaaguug

SEQ ID NO: 710124 - RNA, 19 nt, Homo sapiens
gagaauucagccgaagaua

SEQ ID NO: 710125 - RNA, 19 nt, Homo sapiens
gaaagacagcaaguugugu

SEQ ID NO: 710126 - RNA, 19 nt, Homo sapiens
gcagacagaggagaagaug

SEQ ID NO: 710127 - RNA, 19 nt, Homo sapiens
gcagaggauggaaaguuga

SEQ ID NO: 710128 - RNA, 19 nt, Homo sapiens
acacacgccuaugcacaaa

SEQ ID NO: 710129 - RNA, 19 nt, Homo sapiens
caacacacacacacacaca

SEQ ID NO: 710130 - RNA, 19 nt, Homo sapiens
aguauagaaugauggagaa

SEQ ID NO: 710131 - RNA, 19 nt, Homo sapiens
aaacauccaccuaccuuca

SEQ ID NO: 710132 - RNA, 19 nt, Homo sapiens
cagaagcacuacccauacu

SEQ ID NO: 710133 - RNA, 19 nt, Homo sapiens
gagagaauucagccgaaga

SEQ ID NO: 710134 - RNA, 19 nt, Homo sapiens
gcaauauuucucugaguag

SEQ ID NO: 710135 - RNA, 19 nt, Homo sapiens
agaguuaagccuuuguauu

SEQ ID NO: 710136 - RNA, 19 nt, Homo sapiens
gcagaccuuuagaguuaag

SEQ ID NO: 710137 - RNA, 19 nt, Homo sapiens
gagaguauagaaugaugga

SEQ ID NO: 710138 - RNA, 19 nt, Homo sapiens
cauccagccugacuuguac

SEQ ID NO: 710139 - RNA, 19 nt, Homo sapiens
agaauucagccgaagauau

SEQ ID NO: 710140 - RNA, 19 nt, Homo sapiens
ccuuuagaguuaagccuuu

SEQ ID NO: 710141 - RNA, 19 nt, Homo sapiens
gugcagaggauggaaaguu

SEQ ID NO: 710142 - RNA, 19 nt, Homo sapiens
caacuuucuguccacuaua

SEQ ID NO: 710143 - RNA, 19 nt, Homo sapiens
ccuuuguauuuccauguua

SEQ ID NO: 710144 - RNA, 19 nt, Homo sapiens
uaagccaaacuaucaguau

SEQ ID NO: 710145 - RNA, 19 nt, Homo sapiens
ugagauggagcuaccaaga

SEQ ID NO: 710146 - RNA, 19 nt, Homo sapiens
ggugggauaguaguucuaa

SEQ ID NO: 710147 - RNA, 19 nt, Homo sapiens
gccuuuguauuuccauguu

SEQ ID NO: 710148 - RNA, 19 nt, Homo sapiens
agaaagacagcaaguugug

SEQ ID NO: 710149 - RNA, 19 nt, Homo sapiens
gaagaguggcuggaggaau

SEQ ID NO: 710150 - RNA, 19 nt, Homo sapiens
cucauggguugcuguguuu

SEQ ID NO: 710151 - RNA, 19 nt, Homo sapiens
guauuuccauguuauucca

SEQ ID NO: 710152 - RNA, 19 nt, Homo sapiens
gaccaauaagccaaacuau

SEQ ID NO: 710153 - RNA, 19 nt, Homo sapiens
gagauggagcuaccaagag

SEQ ID NO: 710154 - RNA, 19 nt, Homo sapiens
gaggaucugcaccauagug

SEQ ID NO: 710155 - RNA, 19 nt, Homo sapiens
cuucugcuaugauauucuu

SEQ ID NO: 710156 - RNA, 19 nt, Homo sapiens
guguuuaugcagaccuuua

SEQ ID NO: 710157 - RNA, 19 nt, Homo sapiens
gccaaacuaucaguauuuu

SEQ ID NO: 710158 - RNA, 19 nt, Homo sapiens
caaagggcuaguagaaaca

SEQ ID NO: 710159 - RNA, 19 nt, Homo sapiens
gauuucacaccuucauuca

SEQ ID NO: 710160 - RNA, 19 nt, Homo sapiens
guaagacugaagauccauu

SEQ ID NO: 710161 - RNA, 19 nt, Homo sapiens
acaaagugcuggagauguu

SEQ ID NO: 710162 - RNA, 19 nt, Homo sapiens
ggacaggauugacgaacug

SEQ ID NO: 710163 - RNA, 19 nt, Homo sapiens
aaacgcaagucguggauga

SEQ ID NO: 710164 - RNA, 19 nt, Homo sapiens
gcaagucguggaugaguaa

SEQ ID NO: 710165 - RNA, 19 nt, Homo sapiens
ccagagaaauaaaguuagu

SEQ ID NO: 710166 - RNA, 19 nt, Homo sapiens
gaucuugugccuggaaaua

SEQ ID NO: 710167 - RNA, 19 nt, Homo sapiens
gagcacuaccucagaauga

SEQ ID NO: 710168 - RNA, 19 nt, Homo sapiens
gagaucugcuccaucaaca

SEQ ID NO: 710169 - RNA, 19 nt, Homo sapiens
ggaggaaggccuugugcaa

SEQ ID NO: 710170 - RNA, 19 nt, Homo sapiens
ggacaucuacaacgucaug

SEQ ID NO: 710171 - RNA, 19 nt, Homo sapiens
gaggaugacuuugagaucu

SEQ ID NO: 710172 - RNA, 19 nt, Homo sapiens
ggugcgggcugucaggaaa

SEQ ID NO: 710173 - RNA, 19 nt, Homo sapiens
gcugggugaugguuccuuu

SEQ ID NO: 710174 - RNA, 19 nt, Homo sapiens
gaggaaggccuugugcaaa

SEQ ID NO: 710175 - RNA, 19 nt, Homo sapiens
gccuguggguggaguagua

SEQ ID NO: 710176 - RNA, 19 nt, Homo sapiens
ggaugaggaugacuuugag

SEQ ID NO: 710177 - RNA, 19 nt, Homo sapiens
gaggacagacccacguuug

SEQ ID NO: 710178 - RNA, 19 nt, Homo sapiens
agucagauccugcauaaga

SEQ ID NO: 710179 - RNA, 19 nt, Homo sapiens
ggacagacccacguuugug

SEQ ID NO: 710180 - RNA, 19 nt, Homo sapiens
ugcauaagaucgacaagga

SEQ ID NO: 710181 - RNA, 19 nt, Homo sapiens
cagaagccauggacgacuu

SEQ ID NO: 710182 - RNA, 19 nt, Homo sapiens
gaaagggugccagaccauu

SEQ ID NO: 710183 - RNA, 19 nt, Homo sapiens
uuugagaucugcuccauca

SEQ ID NO: 710184 - RNA, 19 nt, Homo sapiens
gagccucaccugccucauu

SEQ ID NO: 710185 - RNA, 19 nt, Homo sapiens
ucagcagcacccacuauua

SEQ ID NO: 710186 - RNA, 19 nt, Homo sapiens
gcacagaccgcagagaucu

SEQ ID NO: 710187 - RNA, 19 nt, Homo sapiens
gaacagcuucauccacaca

SEQ ID NO: 710188 - RNA, 19 nt, Homo sapiens
ugugggaaauguucaccua

SEQ ID NO: 710189 - RNA, 19 nt, Homo sapiens
ugaccuggcugcccgcaau

SEQ ID NO: 710190 - RNA, 19 nt, Homo sapiens
gcuccgagaugaccucaac

SEQ ID NO: 710191 - RNA, 19 nt, Homo sapiens
gggccugccugaaggaauc

SEQ ID NO: 710192 - RNA, 19 nt, Homo sapiens
guaagguguucaguggaaa

SEQ ID NO: 710193 - RNA, 19 nt, Homo sapiens
aguaagguguucaguggaa

SEQ ID NO: 710194 - RNA, 19 nt, Homo sapiens
gcagcacccacuauuacuu

SEQ ID NO: 710195 - RNA, 19 nt, Homo sapiens
agaaugaggaccuggagaa

SEQ ID NO: 710196 - RNA, 19 nt, Homo sapiens
cccacgcgguuccauguuu

SEQ ID NO: 710197 - RNA, 19 nt, Homo sapiens
aaugugacuuguggccuua

SEQ ID NO: 710198 - RNA, 19 nt, Homo sapiens
cagcacccacuauuacuug

SEQ ID NO: 710199 - RNA, 19 nt, Homo sapiens
cagcagcacccacuauuac

SEQ ID NO: 710200 - RNA, 19 nt, Homo sapiens
cgcaagucguggaugagua

SEQ ID NO: 710201 - RNA, 19 nt, Homo sapiens
ccagaccaacuacgccuuu

SEQ ID NO: 710202 - RNA, 19 nt, Homo sapiens
ccaggaugaggaugacuuu

SEQ ID NO: 710203 - RNA, 19 nt, Homo sapiens
augaggaccuggagaagau

SEQ ID NO: 710204 - RNA, 19 nt, Homo sapiens
ggaguccaagcgcuuuauu

SEQ ID NO: 710205 - RNA, 19 nt, Homo sapiens
ccacaaagugcuggagaug

SEQ ID NO: 710206 - RNA, 19 nt, Homo sapiens
gccacaaagugcuggagau

SEQ ID NO: 710207 - RNA, 19 nt, Homo sapiens
gaccaacuacgccuuugug

SEQ ID NO: 710208 - RNA, 19 nt, Homo sapiens
caggauugacgaacuguau

SEQ ID NO: 710209 - RNA, 19 nt, Homo sapiens
gaagggccgagaacuacug

SEQ ID NO: 710210 - RNA, 19 nt, Homo sapiens
cggacaagcugcacaucca

SEQ ID NO: 710211 - RNA, 19 nt, Homo sapiens
gucagauccugcauaagau

SEQ ID NO: 710212 - RNA, 19 nt, Homo sapiens
caacuucuccaccaacaac

SEQ ID NO: 710213 - RNA, 19 nt, Homo sapiens
gccaacuucuccaccaaca

SEQ ID NO: 710214 - RNA, 19 nt, Homo sapiens
ggucagcagcacccacuau

SEQ ID NO: 710215 - RNA, 19 nt, Homo sapiens
gggaagggccgagaacuac

SEQ ID NO: 710216 - RNA, 19 nt, Homo sapiens
cagggaagacggugagugu

SEQ ID NO: 710217 - RNA, 19 nt, Homo sapiens
gggcuucccggacaggauu

SEQ ID NO: 710218 - RNA, 19 nt, Homo sapiens
gcaaacgcaagucguggau

SEQ ID NO: 710219 - RNA, 19 nt, Homo sapiens
guucccaccucaucacucu

SEQ ID NO: 710220 - RNA, 19 nt, Homo sapiens
gugacagacugggaggaaa

SEQ ID NO: 710221 - RNA, 19 nt, Homo sapiens
gccagggccagaccaacua

SEQ ID NO: 710222 - RNA, 19 nt, Homo sapiens
gaaaccucauccgccucua

SEQ ID NO: 710223 - RNA, 19 nt, Homo sapiens
agccucaccugccucauug

SEQ ID NO: 710224 - RNA, 19 nt, Homo sapiens
cagcagacaagauccagau

SEQ ID NO: 710225 - RNA, 19 nt, Homo sapiens
aggaugaggaugacuuuga

SEQ ID NO: 710226 - RNA, 19 nt, Homo sapiens
gccuuaccauggacuugaa

SEQ ID NO: 710227 - RNA, 19 nt, Homo sapiens
gggcagaaugugacuugug

SEQ ID NO: 710228 - RNA, 19 nt, Homo sapiens
gggugacacugugggaaau

SEQ ID NO: 710229 - RNA, 19 nt, Homo sapiens
gagaagcugggugaugguu

SEQ ID NO: 710230 - RNA, 19 nt, Homo sapiens
ggugacagacugggaggaa

SEQ ID NO: 710231 - RNA, 19 nt, Homo sapiens
ugcugucccugcacacuuu

SEQ ID NO: 710232 - RNA, 19 nt, Homo sapiens
aggaaggccuugugcaaac

SEQ ID NO: 710233 - RNA, 19 nt, Homo sapiens
ucacaagccagaggacaga

SEQ ID NO: 710234 - RNA, 19 nt, Homo sapiens
ucacccgccugucccacuu

SEQ ID NO: 710235 - RNA, 19 nt, Homo sapiens
gaaugaggaccuggagaag

SEQ ID NO: 710236 - RNA, 19 nt, Homo sapiens
ggaaggccuugugcaaacg

SEQ ID NO: 710237 - RNA, 19 nt, Homo sapiens
ggauugacgaacuguaucu

SEQ ID NO: 710238 - RNA, 19 nt, Homo sapiens
ggcauucaguccugcuucu

SEQ ID NO: 710239 - RNA, 19 nt, Homo sapiens
cuuguggccuuaccaugga

SEQ ID NO: 710240 - RNA, 19 nt, Homo sapiens
cuacagcaggagugcauga

SEQ ID NO: 710241 - RNA, 19 nt, Homo sapiens
gugacacugugggaaaugu

SEQ ID NO: 710242 - RNA, 19 nt, Homo sapiens
ggccuuaccauggacuuga

SEQ ID NO: 710243 - RNA, 19 nt, Homo sapiens
cagcaggcucuggguauga

SEQ ID NO: 710244 - RNA, 19 nt, Homo sapiens
uggagauguucgacuggaa

SEQ ID NO: 710245 - RNA, 19 nt, Homo sapiens
gucagcagcacccacuauu

SEQ ID NO: 710246 - RNA, 19 nt, Homo sapiens
cagaccaacuacgccuuug

SEQ ID NO: 710247 - RNA, 19 nt, Homo sapiens
ugcgagcacuaccucagaa

SEQ ID NO: 710248 - RNA, 19 nt, Homo sapiens
gaguccaagcgcuuuauuc

SEQ ID NO: 710249 - RNA, 19 nt, Homo sapiens
uggcaccucugggaucguu

SEQ ID NO: 710250 - RNA, 19 nt, Homo sapiens
ggaacucuuugcugaauuu

SEQ ID NO: 710251 - RNA, 19 nt, Homo sapiens
ggaaacugcugguguccaa

SEQ ID NO: 710252 - RNA, 19 nt, Homo sapiens
gaaggcggcugugcacuau

SEQ ID NO: 710253 - RNA, 19 nt, Homo sapiens
gagguggcaugacuagaaa

SEQ ID NO: 710254 - RNA, 19 nt, Homo sapiens
ugaaggccaugaagcagua

SEQ ID NO: 710255 - RNA, 19 nt, Homo sapiens
gagaauggacaccaguuaa

SEQ ID NO: 710256 - RNA, 19 nt, Homo sapiens
aaacagagguggcaugacu

SEQ ID NO: 710257 - RNA, 19 nt, Homo sapiens
ggagacaggugggaaacug

SEQ ID NO: 710258 - RNA, 19 nt, Homo sapiens
gaacagcaaacgugcacuu

SEQ ID NO: 710259 - RNA, 19 nt, Homo sapiens
gcccaaugauggauuuguu

SEQ ID NO: 710260 - RNA, 19 nt, Homo sapiens
caaaacaacuucccgacaa

SEQ ID NO: 710261 - RNA, 19 nt, Homo sapiens
cgagaauggacaccaguua

SEQ ID NO: 710262 - RNA, 19 nt, Homo sapiens
gacgacaucauuaaacuga

SEQ ID NO: 710263 - RNA, 19 nt, Homo sapiens
gaauuuggaacgcugaaga

SEQ ID NO: 710264 - RNA, 19 nt, Homo sapiens
guaaacagagguggcauga

SEQ ID NO: 710265 - RNA, 19 nt, Homo sapiens
caggaacucuuugcugaau

SEQ ID NO: 710266 - RNA, 19 nt, Homo sapiens
agaauggacaccaguuaaa

SEQ ID NO: 710267 - RNA, 19 nt, Homo sapiens
ggucgcagcuuaggaacag

SEQ ID NO: 710268 - RNA, 19 nt, Homo sapiens
cgacaucauuaaacugaac

SEQ ID NO: 710269 - RNA, 19 nt, Homo sapiens
agagguggcaugacuagaa

SEQ ID NO: 710270 - RNA, 19 nt, Homo sapiens
cagcuggacgccuauaaug

SEQ ID NO: 710271 - RNA, 19 nt, Homo sapiens
aggcggcugugcacuauga

SEQ ID NO: 710272 - RNA, 19 nt, Homo sapiens
acucuuugcugaauuugga

SEQ ID NO: 710273 - RNA, 19 nt, Homo sapiens
agacgccgauauucaggaa

SEQ ID NO: 710274 - RNA, 19 nt, Homo sapiens
ucucuggacgacaucauua

SEQ ID NO: 710275 - RNA, 19 nt, Homo sapiens
agaaggcggcugugcacua

SEQ ID NO: 710276 - RNA, 19 nt, Homo sapiens
gaauggacaccaguuaaac

SEQ ID NO: 710277 - RNA, 19 nt, Homo sapiens
ucgcucuggucgcagcuua

SEQ ID NO: 710278 - RNA, 19 nt, Homo sapiens
gauauucaggaacucuuug

SEQ ID NO: 710279 - RNA, 19 nt, Homo sapiens
ggacgacaucauuaaacug

SEQ ID NO: 710280 - RNA, 19 nt, Homo sapiens
ccaaugauggauuuguuuc

SEQ ID NO: 710281 - RNA, 19 nt, Homo sapiens
ucucagacgccgauauuca

SEQ ID NO: 710282 - RNA, 19 nt, Homo sapiens
uuaaacagaccagcaaauc

SEQ ID NO: 710283 - RNA, 19 nt, Homo sapiens
cagcuugucacgucacaga

SEQ ID NO: 710284 - RNA, 19 nt, Homo sapiens
cuugucacgucacagauug

SEQ ID NO: 710285 - RNA, 19 nt, Homo sapiens
cgauauucaggaacucuuu

SEQ ID NO: 710286 - RNA, 19 nt, Homo sapiens
gcuugucacgucacagauu

SEQ ID NO: 710287 - RNA, 19 nt, Homo sapiens
guuaaacagaccagcaaau

SEQ ID NO: 710288 - RNA, 19 nt, Homo sapiens
uggacgacaucauuaaacu

SEQ ID NO: 710289 - RNA, 19 nt, Homo sapiens
gcgagaauggacaccaguu

SEQ ID NO: 710290 - RNA, 19 nt, Homo sapiens
acccaggcgucuccucuug

SEQ ID NO: 710291 - RNA, 19 nt, Homo sapiens
ccagcuggacgccuauaau

SEQ ID NO: 710292 - RNA, 19 nt, Homo sapiens
caacggcuucccucuggau

SEQ ID NO: 710293 - RNA, 19 nt, Homo sapiens
acaaguggcagcacgaucu

SEQ ID NO: 710294 - RNA, 19 nt, Homo sapiens
gaacauacugccuuauuua

SEQ ID NO: 710295 - RNA, 19 nt, Homo sapiens
uaaacgcucuucuggaaua

SEQ ID NO: 710296 - RNA, 19 nt, Homo sapiens
gcugaacucuguaccauuu

SEQ ID NO: 710297 - RNA, 19 nt, Homo sapiens
gcagaaagcuauuuugauu

SEQ ID NO: 710298 - RNA, 19 nt, Homo sapiens
gagauugacuuuaucacaa

SEQ ID NO: 710299 - RNA, 19 nt, Homo sapiens
gaacaaacuucacaaagcu

SEQ ID NO: 710300 - RNA, 19 nt, Homo sapiens
uauaaacgcucuucuggaa

SEQ ID NO: 710301 - RNA, 19 nt, Homo sapiens
gaaauaugauucagacucu

SEQ ID NO: 710302 - RNA, 19 nt, Homo sapiens
gaaauaacagcauaaggaa

SEQ ID NO: 710303 - RNA, 19 nt, Homo sapiens
ucacaaagcuggaaaagaa

SEQ ID NO: 710304 - RNA, 19 nt, Homo sapiens
ggaacaaacuucacaaagc

SEQ ID NO: 710305 - RNA, 19 nt, Homo sapiens
ggaagggucuggauucucu

SEQ ID NO: 710306 - RNA, 19 nt, Homo sapiens
ugaacauacugccuuauuu

SEQ ID NO: 710307 - RNA, 19 nt, Homo sapiens
ggaugaggaugaauuggaa

SEQ ID NO: 710308 - RNA, 19 nt, Homo sapiens
agaaaucccuagugaaaga

SEQ ID NO: 710309 - RNA, 19 nt, Homo sapiens
acagagaaaucccuaguga

SEQ ID NO: 710310 - RNA, 19 nt, Homo sapiens
caaagucauucccacacua

SEQ ID NO: 710311 - RNA, 19 nt, Homo sapiens
ccacagaaacuuuagaaug

SEQ ID NO: 710312 - RNA, 19 nt, Homo sapiens
ugaaauaacagcauaagga

SEQ ID NO: 710313 - RNA, 19 nt, Homo sapiens
uacaagaggucaaguaaca

SEQ ID NO: 710314 - RNA, 19 nt, Homo sapiens
cacagaaacuuuagaaugg

SEQ ID NO: 710315 - RNA, 19 nt, Homo sapiens
ccaaaguccuggagcauca

SEQ ID NO: 710316 - RNA, 19 nt, Homo sapiens
gcucgguucuucugacauu

SEQ ID NO: 710317 - RNA, 19 nt, Homo sapiens
agagaaaucccuagugaaa

SEQ ID NO: 710318 - RNA, 19 nt, Homo sapiens
gggucuggauucucuauuu

SEQ ID NO: 710319 - RNA, 19 nt, Homo sapiens
agaaacaccucgagaccaa

SEQ ID NO: 710320 - RNA, 19 nt, Homo sapiens
gaacauuuggauucugaaa

SEQ ID NO: 710321 - RNA, 19 nt, Homo sapiens
cuacagagacuccacauuc

SEQ ID NO: 710322 - RNA, 19 nt, Homo sapiens
ggaaagcucaacagcagaa

SEQ ID NO: 710323 - RNA, 19 nt, Homo sapiens
cacugucucugcucaauaa

SEQ ID NO: 710324 - RNA, 19 nt, Homo sapiens
cauacugccuuauuuaaag

SEQ ID NO: 710325 - RNA, 19 nt, Homo sapiens
gaggaaagaaauaugauuc

SEQ ID NO: 710326 - RNA, 19 nt, Homo sapiens
gccaucauguuuaaguuga

SEQ ID NO: 710327 - RNA, 19 nt, Homo sapiens
gaugauuagagcucaauaa

SEQ ID NO: 710328 - RNA, 19 nt, Homo sapiens
ggaaagaaauaugauucag

SEQ ID NO: 710329 - RNA, 19 nt, Homo sapiens
caagaggucaaguaacauu

SEQ ID NO: 710330 - RNA, 19 nt, Homo sapiens
gugagagacugcauaucaa

SEQ ID NO: 710331 - RNA, 19 nt, Homo sapiens
ccugauugcuuguauuuua

SEQ ID NO: 710332 - RNA, 19 nt, Homo sapiens
caacugaugccagcagaaa

SEQ ID NO: 710333 - RNA, 19 nt, Homo sapiens
aagaacugcuuauucauuc

SEQ ID NO: 710334 - RNA, 19 nt, Homo sapiens
auacauuggucaccuaaau

SEQ ID NO: 710335 - RNA, 19 nt, Homo sapiens
cagaugacuucaccacaga

SEQ ID NO: 710336 - RNA, 19 nt, Homo sapiens
gcaauauuguccaagaaac

SEQ ID NO: 710337 - RNA, 19 nt, Homo sapiens
auaaggaacuucacugucu

SEQ ID NO: 710338 - RNA, 19 nt, Homo sapiens
ucagauggaugaggaugaa

SEQ ID NO: 710339 - RNA, 19 nt, Homo sapiens
ggacacugcauguugaugu

SEQ ID NO: 710340 - RNA, 19 nt, Homo sapiens
aauggaagcugaugcaucu

SEQ ID NO: 710341 - RNA, 19 nt, Homo sapiens
uaaaggguccugauugcuu

SEQ ID NO: 710342 - RNA, 19 nt, Homo sapiens
gcucuucuggaauauauuu

SEQ ID NO: 710343 - RNA, 19 nt, Homo sapiens
uauacaagaggucaaguaa

SEQ ID NO: 710344 - RNA, 19 nt, Homo sapiens
gaagucaaggagagugaaa

SEQ ID NO: 710345 - RNA, 19 nt, Homo sapiens
gacacugcauguugauguu

SEQ ID NO: 710346 - RNA, 19 nt, Homo sapiens
ccaaacugguggaagaaca

SEQ ID NO: 710347 - RNA, 19 nt, Homo sapiens
gcauaaggaacuucacugu

SEQ ID NO: 710348 - RNA, 19 nt, Homo sapiens
ggacgugucuuuugaaacu

SEQ ID NO: 710349 - RNA, 19 nt, Homo sapiens
gugaacauacugccuuauu

SEQ ID NO: 710350 - RNA, 19 nt, Homo sapiens
acaguuguaucacaucgaa

SEQ ID NO: 710351 - RNA, 19 nt, Homo sapiens
gcaccuuuccuuugugaga

SEQ ID NO: 710352 - RNA, 19 nt, Homo sapiens
ugaauuggaacgccuuaaa

SEQ ID NO: 710353 - RNA, 19 nt, Homo sapiens
uacagagacuccacauuca

SEQ ID NO: 710354 - RNA, 19 nt, Homo sapiens
gaauuggaacgccuuaaag

SEQ ID NO: 710355 - RNA, 19 nt, Homo sapiens
agaggucaaguaacauuua

SEQ ID NO: 710356 - RNA, 19 nt, Homo sapiens
cuacagaguuagaaauucg

SEQ ID NO: 710357 - RNA, 19 nt, Homo sapiens
guguggccaucauguuuaa

SEQ ID NO: 710358 - RNA, 19 nt, Homo sapiens
gcuaaaagaugggaaaaca

SEQ ID NO: 710359 - RNA, 19 nt, Homo sapiens
caucagcugcuucagacua

SEQ ID NO: 710360 - RNA, 19 nt, Homo sapiens
ugugagagacugcauauca

SEQ ID NO: 710361 - RNA, 19 nt, Homo sapiens
gguuugccauuucuacaga

SEQ ID NO: 710362 - RNA, 19 nt, Homo sapiens
gauggaugaggaugaauug

SEQ ID NO: 710363 - RNA, 19 nt, Homo sapiens
uggaagaacauuuggauuc

SEQ ID NO: 710364 - RNA, 19 nt, Homo sapiens
ggcaauauuguccaagaaa

SEQ ID NO: 710365 - RNA, 19 nt, Homo sapiens
uuacugaccuaggaaauac

SEQ ID NO: 710366 - RNA, 19 nt, Homo sapiens
cacccaggcugaacucugu

SEQ ID NO: 710367 - RNA, 19 nt, Homo sapiens
gguccugauugcuuguauu

SEQ ID NO: 710368 - RNA, 19 nt, Homo sapiens
gaaaacuauuccaggacua

SEQ ID NO: 710369 - RNA, 19 nt, Homo sapiens
ggucaccuaaauacucaua

SEQ ID NO: 710370 - RNA, 19 nt, Homo sapiens
gaauggaggcucgguucuu

SEQ ID NO: 710371 - RNA, 19 nt, Homo sapiens
ggaaauacagaugacuuca

SEQ ID NO: 710372 - RNA, 19 nt, Homo sapiens
ugagagacugcauaucaaa

SEQ ID NO: 710373 - RNA, 19 nt, Homo sapiens
caacagcagaaacaagaau

SEQ ID NO: 710374 - RNA, 19 nt, Homo sapiens
ucuggacacugcauguuga

SEQ ID NO: 710375 - RNA, 19 nt, Homo sapiens
cggcauuauuuauacaaga

SEQ ID NO: 710376 - RNA, 19 nt, Homo sapiens
uuccaggacuaauucuuaa

SEQ ID NO: 710377 - RNA, 19 nt, Homo sapiens
gaugaugauuagagcucaa

SEQ ID NO: 710378 - RNA, 19 nt, Homo sapiens
cgaggaaagaaauaugauu

SEQ ID NO: 710379 - RNA, 19 nt, Homo sapiens
gaacugcuuauucauucug

SEQ ID NO: 710380 - RNA, 19 nt, Homo sapiens
uuggaacgccuuaaagaaa

SEQ ID NO: 710381 - RNA, 19 nt, Homo sapiens
ggaaaacacaagauuaugu

SEQ ID NO: 710382 - RNA, 19 nt, Homo sapiens
ggcauuauuuauacaagag

SEQ ID NO: 710383 - RNA, 19 nt, Homo sapiens
acagaaacuuuagaaugga

SEQ ID NO: 710384 - RNA, 19 nt, Homo sapiens
aagcaccuuuccuuuguga

SEQ ID NO: 710385 - RNA, 19 nt, Homo sapiens
gaugaauuggaacgccuua

SEQ ID NO: 710386 - RNA, 19 nt, Homo sapiens
gaugccagcagaaagcuau

SEQ ID NO: 710387 - RNA, 19 nt, Homo sapiens
ggucuggauucucuauuuu

SEQ ID NO: 710388 - RNA, 19 nt, Homo sapiens
uacauuggucaccuaaaua

SEQ ID NO: 710389 - RNA, 19 nt, Homo sapiens
ucuauacauuggucaccua

SEQ ID NO: 710390 - RNA, 19 nt, Homo sapiens
agacucugaugaugauuag

SEQ ID NO: 710391 - RNA, 19 nt, Homo sapiens
gaugacuucaccacagaaa

SEQ ID NO: 710392 - RNA, 19 nt, Homo sapiens
aaauaccuguaacuggaaa

SEQ ID NO: 710393 - RNA, 19 nt, Homo sapiens
aaagaaaccaggaaacacu

SEQ ID NO: 710394 - RNA, 19 nt, Homo sapiens
gaucuuaucugcccuauuu

SEQ ID NO: 710395 - RNA, 19 nt, Homo sapiens
gcacaaagagauucaauuu

SEQ ID NO: 710396 - RNA, 19 nt, Homo sapiens
gguguugacugcacuaaua

SEQ ID NO: 710397 - RNA, 19 nt, Homo sapiens
gaugagcucuucuuuccua

SEQ ID NO: 710398 - RNA, 19 nt, Homo sapiens
agccaaaucucuagaaaua

SEQ ID NO: 710399 - RNA, 19 nt, Homo sapiens
gagaauagccaacaagaug

SEQ ID NO: 710400 - RNA, 19 nt, Homo sapiens
ggacuucaguuccauuuca

SEQ ID NO: 710401 - RNA, 19 nt, Homo sapiens
gcacaaccuuuggcuuuaa

SEQ ID NO: 710402 - RNA, 19 nt, Homo sapiens
cagcagacauccugaagaa

SEQ ID NO: 710403 - RNA, 19 nt, Homo sapiens
gacgucagcugaacacaaa

SEQ ID NO: 710404 - RNA, 19 nt, Homo sapiens
gagaguggcuguccugcuu

SEQ ID NO: 710405 - RNA, 19 nt, Homo sapiens
ucaguuccauuucagguua

SEQ ID NO: 710406 - RNA, 19 nt, Homo sapiens
guagugaggccguuaauug

SEQ ID NO: 710407 - RNA, 19 nt, Homo sapiens
ccaaaucucuagaaauaag

SEQ ID NO: 710408 - RNA, 19 nt, Homo sapiens
ggagccaaaucucuagaaa

SEQ ID NO: 710409 - RNA, 19 nt, Homo sapiens
gguaugauguaacccguuu

SEQ ID NO: 710410 - RNA, 19 nt, Homo sapiens
gcacaggccauaauuguuc

SEQ ID NO: 710411 - RNA, 19 nt, Homo sapiens
gcagacauccugaagaaau

SEQ ID NO: 710412 - RNA, 19 nt, Homo sapiens
gcagguugcugguuguguu

SEQ ID NO: 710413 - RNA, 19 nt, Homo sapiens
uagagugacuggcagagua

SEQ ID NO: 710414 - RNA, 19 nt, Homo sapiens
guaguuaguuacuuugaug

SEQ ID NO: 710415 - RNA, 19 nt, Homo sapiens
gggaugacauggugcaaga

SEQ ID NO: 710416 - RNA, 19 nt, Homo sapiens
gaagagauggaaaucagaa

SEQ ID NO: 710417 - RNA, 19 nt, Homo sapiens
uggaagagauauaagagaa

SEQ ID NO: 710418 - RNA, 19 nt, Homo sapiens
ggccauuguuuguuuauau

SEQ ID NO: 710419 - RNA, 19 nt, Homo sapiens
caacugaaaugaggagcuu

SEQ ID NO: 710420 - RNA, 19 nt, Homo sapiens
caauuucccuggaggauca

SEQ ID NO: 710421 - RNA, 19 nt, Homo sapiens
ggaauacucagucggagaa

SEQ ID NO: 710422 - RNA, 19 nt, Homo sapiens
gacuguaguuaguuacuuu

SEQ ID NO: 710423 - RNA, 19 nt, Homo sapiens
gaagagauauaagagaacu

SEQ ID NO: 710424 - RNA, 19 nt, Homo sapiens
cagcacaaccuuuggcuuu

SEQ ID NO: 710425 - RNA, 19 nt, Homo sapiens
gagcucuucuuuccuacaa

SEQ ID NO: 710426 - RNA, 19 nt, Homo sapiens
acaaagagauucaauuucc

SEQ ID NO: 710427 - RNA, 19 nt, Homo sapiens
gaacucgacuggcuaucag

SEQ ID NO: 710428 - RNA, 19 nt, Homo sapiens
ugaaaacgcugcuauacuu

SEQ ID NO: 710429 - RNA, 19 nt, Homo sapiens
guaauggcuuccucucaga

SEQ ID NO: 710430 - RNA, 19 nt, Homo sapiens
ggccauaauuguuccauag

SEQ ID NO: 710431 - RNA, 19 nt, Homo sapiens
ugucaaagcugcagauugc

SEQ ID NO: 710432 - RNA, 19 nt, Homo sapiens
ccaggaagcucagugaaag

SEQ ID NO: 710433 - RNA, 19 nt, Homo sapiens
cggcugaacuuacgauauc

SEQ ID NO: 710434 - RNA, 19 nt, Homo sapiens
ggagacaauugaauacaac

SEQ ID NO: 710435 - RNA, 19 nt, Homo sapiens
ggagagauaauagguguga

SEQ ID NO: 710436 - RNA, 19 nt, Homo sapiens
cuguauagcuggguucuaa

SEQ ID NO: 710437 - RNA, 19 nt, Homo sapiens
cagaugagcucuucuuucc

SEQ ID NO: 710438 - RNA, 19 nt, Homo sapiens
gcuccaggcuguaaucaag

SEQ ID NO: 710439 - RNA, 19 nt, Homo sapiens
gaugagcugcccaaccaua

SEQ ID NO: 710440 - RNA, 19 nt, Homo sapiens
ggaccuggguuucagugau

SEQ ID NO: 710441 - RNA, 19 nt, Homo sapiens
guugauguguuuagcaaga

SEQ ID NO: 710442 - RNA, 19 nt, Homo sapiens
cgaguacuccugauuguga

SEQ ID NO: 710443 - RNA, 19 nt, Homo sapiens
ccaccauucuuaauacugu

SEQ ID NO: 710444 - RNA, 19 nt, Homo sapiens
gaccuggguuucagugaug

SEQ ID NO: 710445 - RNA, 19 nt, Homo sapiens
gccaggccuugucaugaua

SEQ ID NO: 710446 - RNA, 19 nt, Homo sapiens
ggaaggaccuggguuucag

SEQ ID NO: 710447 - RNA, 19 nt, Homo sapiens
uaaccaaggcucauacugu

SEQ ID NO: 710448 - RNA, 19 nt, Homo sapiens
ggaaagacuggaccucugu

SEQ ID NO: 710449 - RNA, 19 nt, Homo sapiens
ucagaaagcacaaagagau

SEQ ID NO: 710450 - RNA, 19 nt, Homo sapiens
cuacccaccauucuuaaua

SEQ ID NO: 710451 - RNA, 19 nt, Homo sapiens
ggagaagacgucagcugaa

SEQ ID NO: 710452 - RNA, 19 nt, Homo sapiens
ucgcagagcuggagaagac

SEQ ID NO: 710453 - RNA, 19 nt, Homo sapiens
ucaggccuguugacucuaa

SEQ ID NO: 710454 - RNA, 19 nt, Homo sapiens
gaaagcacaaagagauuca

SEQ ID NO: 710455 - RNA, 19 nt, Homo sapiens
gagaagacgucagcugaac

SEQ ID NO: 710456 - RNA, 19 nt, Homo sapiens
aagaugagcugcccaacca

SEQ ID NO: 710457 - RNA, 19 nt, Homo sapiens
gccuggagaugcccaaaga

SEQ ID NO: 710458 - RNA, 19 nt, Homo sapiens
guugacugcacuaauaaua

SEQ ID NO: 710459 - RNA, 19 nt, Homo sapiens
acauugugcucaggaauuu

SEQ ID NO: 710460 - RNA, 19 nt, Homo sapiens
cagacauccugaagaaaug

SEQ ID NO: 710461 - RNA, 19 nt, Homo sapiens
gaggaaggaaucucuaauc

SEQ ID NO: 710462 - RNA, 19 nt, Homo sapiens
ccaacaagauggguuacug

SEQ ID NO: 710463 - RNA, 19 nt, Homo sapiens
uggaggagacaauugaaua

SEQ ID NO: 710464 - RNA, 19 nt, Homo sapiens
gcaccugcgcucaguggua

SEQ ID NO: 710465 - RNA, 19 nt, Homo sapiens
uuaauacuguggcuuauac

SEQ ID NO: 710466 - RNA, 19 nt, Homo sapiens
gauguugacgaagaucuua

SEQ ID NO: 710467 - RNA, 19 nt, Homo sapiens
gaaccuggaggagacaauu

SEQ ID NO: 710468 - RNA, 19 nt, Homo sapiens
cgagacauccagcugcuaa

SEQ ID NO: 710469 - RNA, 19 nt, Homo sapiens
ggguugauguguuuagcaa

SEQ ID NO: 710470 - RNA, 19 nt, Homo sapiens
gaaaacgcugcuauacuua

SEQ ID NO: 710471 - RNA, 19 nt, Homo sapiens
gacauugugcucaggaauu

SEQ ID NO: 710472 - RNA, 19 nt, Homo sapiens
gaugagacaugggguauga

SEQ ID NO: 710473 - RNA, 19 nt, Homo sapiens
aaccauaacugcauuaagc

SEQ ID NO: 710474 - RNA, 19 nt, Homo sapiens
gcccaaccauaacugcauu

SEQ ID NO: 710475 - RNA, 19 nt, Homo sapiens
ccaguggaccguaguguug

SEQ ID NO: 710476 - RNA, 19 nt, Homo sapiens
uuacucugguuacuacauu

SEQ ID NO: 710477 - RNA, 19 nt, Homo sapiens
gcuauacuuacucugguua

SEQ ID NO: 710478 - RNA, 19 nt, Homo sapiens
uaucucagccacauuguug

SEQ ID NO: 710479 - RNA, 19 nt, Homo sapiens
gcauggcguggaagagaua

SEQ ID NO: 710480 - RNA, 19 nt, Homo sapiens
gagccaggccuugucauga

SEQ ID NO: 710481 - RNA, 19 nt, Homo sapiens
gaaccgacgcuacuaugag

SEQ ID NO: 710482 - RNA, 19 nt, Homo sapiens
gcagauugccugugacaac

SEQ ID NO: 710483 - RNA, 19 nt, Homo sapiens
acaggcaccucauugugaa

SEQ ID NO: 710484 - RNA, 19 nt, Homo sapiens
ggagaauagccaacaagau

SEQ ID NO: 710485 - RNA, 19 nt, Homo sapiens
guuaauuggccaucacuga

SEQ ID NO: 710486 - RNA, 19 nt, Homo sapiens
guaguuugcucagccuuuc

SEQ ID NO: 710487 - RNA, 19 nt, Homo sapiens
guccuacccaccauucuua

SEQ ID NO: 710488 - RNA, 19 nt, Homo sapiens
ggaagagauggaaaucaga

SEQ ID NO: 710489 - RNA, 19 nt, Homo sapiens
guacaggcaccucauugug

SEQ ID NO: 710490 - RNA, 19 nt, Homo sapiens
gccaggaagcucagugaaa

SEQ ID NO: 710491 - RNA, 19 nt, Homo sapiens
caagcaguaucccuguuca

SEQ ID NO: 710492 - RNA, 19 nt, Homo sapiens
gcaccucauugugaacaug

SEQ ID NO: 710493 - RNA, 19 nt, Homo sapiens
gcucuucuuuccuacaagu

SEQ ID NO: 710494 - RNA, 19 nt, Homo sapiens
gaacgaaauuccuaaagaa

SEQ ID NO: 710495 - RNA, 19 nt, Homo sapiens
gugcacaucucgaaguuua

SEQ ID NO: 710496 - RNA, 19 nt, Homo sapiens
gaaguugccaugacaauaa

SEQ ID NO: 710497 - RNA, 19 nt, Homo sapiens
cgaaaguccucaccaacaa

SEQ ID NO: 710498 - RNA, 19 nt, Homo sapiens
gaggacagcuuggagaaau

SEQ ID NO: 710499 - RNA, 19 nt, Homo sapiens
ucagagacauuauuuagca

SEQ ID NO: 710500 - RNA, 19 nt, Homo sapiens
ugacugaguuggagaaaca

SEQ ID NO: 710501 - RNA, 19 nt, Homo sapiens
gagacauuauuuagcagua

SEQ ID NO: 710502 - RNA, 19 nt, Homo sapiens
gacaauaaaggucauagaa

SEQ ID NO: 710503 - RNA, 19 nt, Homo sapiens
uggaggagcugguggagaa

SEQ ID NO: 710504 - RNA, 19 nt, Homo sapiens
ucaagucccuggagaauac

SEQ ID NO: 710505 - RNA, 19 nt, Homo sapiens
gacaaggacuccgagaaga

SEQ ID NO: 710506 - RNA, 19 nt, Homo sapiens
ggacaaggacuccgagaag

SEQ ID NO: 710507 - RNA, 19 nt, Homo sapiens
agaaagagccagagaagga

SEQ ID NO: 710508 - RNA, 19 nt, Homo sapiens
ggacuguaauugcauuucu

SEQ ID NO: 710509 - RNA, 19 nt, Homo sapiens
ccaucgaccgcuacuauua

SEQ ID NO: 710510 - RNA, 19 nt, Homo sapiens
agucugaccuuuauucuca

SEQ ID NO: 710511 - RNA, 19 nt, Homo sapiens
gaaaguccucaccaacaaa

SEQ ID NO: 710512 - RNA, 19 nt, Homo sapiens
ugaaggaucucuccaagcu

SEQ ID NO: 710513 - RNA, 19 nt, Homo sapiens
ggacagcuuggagaaauuu

SEQ ID NO: 710514 - RNA, 19 nt, Homo sapiens
aaaccaagcauuaccagaa

SEQ ID NO: 710515 - RNA, 19 nt, Homo sapiens
cgaccagcccauugacuua

SEQ ID NO: 710516 - RNA, 19 nt, Homo sapiens
uagcaaagcucagaauggu

SEQ ID NO: 710517 - RNA, 19 nt, Homo sapiens
ggccugagccucugaaauc

SEQ ID NO: 710518 - RNA, 19 nt, Homo sapiens
caagagaccgcggaacauu

SEQ ID NO: 710519 - RNA, 19 nt, Homo sapiens
ucaaacugcaccuuaguaa

SEQ ID NO: 710520 - RNA, 19 nt, Homo sapiens
gaagcaagcacgcagucaa

SEQ ID NO: 710521 - RNA, 19 nt, Homo sapiens
gaccucagcguccacauga

SEQ ID NO: 710522 - RNA, 19 nt, Homo sapiens
gaacugcuucuacauacau

SEQ ID NO: 710523 - RNA, 19 nt, Homo sapiens
gauugugccucucaguuca

SEQ ID NO: 710524 - RNA, 19 nt, Homo sapiens
cuacucagagacauuauuu

SEQ ID NO: 710525 - RNA, 19 nt, Homo sapiens
uaaccaaguccaagaacaa

SEQ ID NO: 710526 - RNA, 19 nt, Homo sapiens
gcaaggcgcagauccucaa

SEQ ID NO: 710527 - RNA, 19 nt, Homo sapiens
aaccaagcauuaccagaaa

SEQ ID NO: 710528 - RNA, 19 nt, Homo sapiens
gaccgcuacuauuaugaaa

SEQ ID NO: 710529 - RNA, 19 nt, Homo sapiens
gcuuugcaguccaucauga

SEQ ID NO: 710530 - RNA, 19 nt, Homo sapiens
gcucaccgcccacaugaug

SEQ ID NO: 710531 - RNA, 19 nt, Homo sapiens
ccugguagugucaaauuua

SEQ ID NO: 710532 - RNA, 19 nt, Homo sapiens
acacuacucagagacauua

SEQ ID NO: 710533 - RNA, 19 nt, Homo sapiens
ccacagagggcaaguacau

SEQ ID NO: 710534 - RNA, 19 nt, Homo sapiens
gcgaugcuguacaagauca

SEQ ID NO: 710535 - RNA, 19 nt, Homo sapiens
cugguagugucaaauuuaa

SEQ ID NO: 710536 - RNA, 19 nt, Homo sapiens
gcagaauguuucgaaaguc

SEQ ID NO: 710537 - RNA, 19 nt, Homo sapiens
gcaaggucaacaucaagaa

SEQ ID NO: 710538 - RNA, 19 nt, Homo sapiens
agaaagugccucugaagga

SEQ ID NO: 710539 - RNA, 19 nt, Homo sapiens
uaagcuaucuuuuguagga

SEQ ID NO: 710540 - RNA, 19 nt, Homo sapiens
aaaucagucuuuccuuugu

SEQ ID NO: 710541 - RNA, 19 nt, Homo sapiens
aaacaguagcguccaggua

SEQ ID NO: 710542 - RNA, 19 nt, Homo sapiens
ggaggaagucagcggcaaa

SEQ ID NO: 710543 - RNA, 19 nt, Homo sapiens
uaagucauuuggagacaca

SEQ ID NO: 710544 - RNA, 19 nt, Homo sapiens
gggugcacaucucgaaguu

SEQ ID NO: 710545 - RNA, 19 nt, Homo sapiens
aagagaagauccaguccau

SEQ ID NO: 710546 - RNA, 19 nt, Homo sapiens
ugaggacuguaauugcauu

SEQ ID NO: 710547 - RNA, 19 nt, Homo sapiens
ugaaguugccaugacaaua

SEQ ID NO: 710548 - RNA, 19 nt, Homo sapiens
gcacacuacucagagacau

SEQ ID NO: 710549 - RNA, 19 nt, Homo sapiens
ugaucuaugugacugaguu

SEQ ID NO: 710550 - RNA, 19 nt, Homo sapiens
gagacacacuugggcuuca

SEQ ID NO: 710551 - RNA, 19 nt, Homo sapiens
cuaagaagggcaagcaguu

SEQ ID NO: 710552 - RNA, 19 nt, Homo sapiens
guacuguggacacuccuuu

SEQ ID NO: 710553 - RNA, 19 nt, Homo sapiens
aaagaaagagccagagaag

SEQ ID NO: 710554 - RNA, 19 nt, Homo sapiens
ggucauagaaccugguagu

SEQ ID NO: 710555 - RNA, 19 nt, Homo sapiens
ucuccaagcugccacucaa

SEQ ID NO: 710556 - RNA, 19 nt, Homo sapiens
gaccagcccauugacuuaa

SEQ ID NO: 710557 - RNA, 19 nt, Homo sapiens
uggcgaugcuguacaagau

SEQ ID NO: 710558 - RNA, 19 nt, Homo sapiens
gcacaagagcaacgugucu

SEQ ID NO: 710559 - RNA, 19 nt, Homo sapiens
caagggagggcuggacauu

SEQ ID NO: 710560 - RNA, 19 nt, Homo sapiens
gaaaagaaagagccagaga

SEQ ID NO: 710561 - RNA, 19 nt, Homo sapiens
gauccaguccaucccacua

SEQ ID NO: 710562 - RNA, 19 nt, Homo sapiens
gcuggacccugugguggaa

SEQ ID NO: 710563 - RNA, 19 nt, Homo sapiens
cagcuacaccuggcaguuu

SEQ ID NO: 710564 - RNA, 19 nt, Homo sapiens
caguaaagaaagacacaaa

SEQ ID NO: 710565 - RNA, 19 nt, Homo sapiens
gcggaacauugcacuaaac

SEQ ID NO: 710566 - RNA, 19 nt, Homo sapiens
gaggaccaccugaucuaug

SEQ ID NO: 710567 - RNA, 19 nt, Homo sapiens
cgaaauuccuaaagaaccu

SEQ ID NO: 710568 - RNA, 19 nt, Homo sapiens
gaucugugcauguuauuuu

SEQ ID NO: 710569 - RNA, 19 nt, Homo sapiens
gcaagagaccgcggaacau

SEQ ID NO: 710570 - RNA, 19 nt, Homo sapiens
uuaaggugcugaagugcau

SEQ ID NO: 710571 - RNA, 19 nt, Homo sapiens
acagcagaauguuucgaaa

SEQ ID NO: 710572 - RNA, 19 nt, Homo sapiens
aaugugaaguaccaguuga

SEQ ID NO: 710573 - RNA, 19 nt, Homo sapiens
caucgaccgcuacuauuau

SEQ ID NO: 710574 - RNA, 19 nt, Homo sapiens
gaucaucauggaccacuca

SEQ ID NO: 710575 - RNA, 19 nt, Homo sapiens
gugucaaauuuaacccuuu

SEQ ID NO: 710576 - RNA, 19 nt, Homo sapiens
gucaaacugcaccuuagua

SEQ ID NO: 710577 - RNA, 19 nt, Homo sapiens
gcaacgauugugccucuca

SEQ ID NO: 710578 - RNA, 19 nt, Homo sapiens
uuacugggcucuccaugac

SEQ ID NO: 710579 - RNA, 19 nt, Homo sapiens
gcgaccagcccauugacuu

SEQ ID NO: 710580 - RNA, 19 nt, Homo sapiens
gcggcaaaccacagaagaa

SEQ ID NO: 710581 - RNA, 19 nt, Homo sapiens
ggaagucagcggcaaacca

SEQ ID NO: 710582 - RNA, 19 nt, Homo sapiens
aaguugccaugacaauaaa

SEQ ID NO: 710583 - RNA, 19 nt, Homo sapiens
cgcggaacauugcacuaaa

SEQ ID NO: 710584 - RNA, 19 nt, Homo sapiens
agacuugggcuccacauuc

SEQ ID NO: 710585 - RNA, 19 nt, Homo sapiens
cgaccgcuacuauuaugaa

SEQ ID NO: 710586 - RNA, 19 nt, Homo sapiens
uaagaagggcaagcaguug

SEQ ID NO: 710587 - RNA, 19 nt, Homo sapiens
gaccuuuauucucaacauc

SEQ ID NO: 710588 - RNA, 19 nt, Homo sapiens
gaccaccugaucuauguga

SEQ ID NO: 710589 - RNA, 19 nt, Homo sapiens
aggaccaccugaucuaugu

SEQ ID NO: 710590 - RNA, 19 nt, Homo sapiens
aagcaagcacgcagucaaa

SEQ ID NO: 710591 - RNA, 19 nt, Homo sapiens
caaugugaaguaccaguug

SEQ ID NO: 710592 - RNA, 19 nt, Homo sapiens
cagcucaccgcccacauga

SEQ ID NO: 710593 - RNA, 19 nt, Homo sapiens
gggacaaggacuccgagaa

SEQ ID NO: 710594 - RNA, 19 nt, Homo sapiens
acacagagauugacuggaa

SEQ ID NO: 710595 - RNA, 19 nt, Homo sapiens
caagaaagcccacugaagu

SEQ ID NO: 710596 - RNA, 19 nt, Homo sapiens
aaauaaaccuugcuaaguc

SEQ ID NO: 710597 - RNA, 19 nt, Homo sapiens
gugcugcucuuccucagua

SEQ ID NO: 710598 - RNA, 19 nt, Homo sapiens
acucugcccuuccaaauaa

SEQ ID NO: 710599 - RNA, 19 nt, Homo sapiens
caaauaaaccuugcuaagu

SEQ ID NO: 710600 - RNA, 19 nt, Homo sapiens
gaaggcgucaucaauggua

SEQ ID NO: 710601 - RNA, 19 nt, Homo sapiens
guagaaggcgucaucaaug

SEQ ID NO: 710602 - RNA, 19 nt, Homo sapiens
gagggacucugcaagcaau

SEQ ID NO: 710603 - RNA, 19 nt, Homo sapiens
gaucguuucuacccucuuc

SEQ ID NO: 710604 - RNA, 19 nt, Homo sapiens
gcaagaaagcccacugaag

SEQ ID NO: 710605 - RNA, 19 nt, Homo sapiens
ucaucgagcucuccuggaa

SEQ ID NO: 710606 - RNA, 19 nt, Homo sapiens
gguagaaggcgucaucaau

SEQ ID NO: 710607 - RNA, 19 nt, Homo sapiens
acacauacccuuccacauc

SEQ ID NO: 710608 - RNA, 19 nt, Homo sapiens
cgucaucaaugguaccuau

SEQ ID NO: 710609 - RNA, 19 nt, Homo sapiens
ccaaccagaucguuucuac

SEQ ID NO: 710610 - RNA, 19 nt, Homo sapiens
ccaaauaaaccuugcuaag

SEQ ID NO: 710611 - RNA, 19 nt, Homo sapiens
uagaaggcgucaucaaugg

SEQ ID NO: 710612 - RNA, 19 nt, Homo sapiens
ggacucugcccuuccaaau

SEQ ID NO: 710613 - RNA, 19 nt, Homo sapiens
aaugguaccuaugacuaua

SEQ ID NO: 710614 - RNA, 19 nt, Homo sapiens
ucaaugguaccuaugacua

SEQ ID NO: 710615 - RNA, 19 nt, Homo sapiens
gacucugcccuuccaaaua

SEQ ID NO: 710616 - RNA, 19 nt, Homo sapiens
gguuucguguacaucuuua

SEQ ID NO: 710617 - RNA, 19 nt, Homo sapiens
ggcagucucugugaagaug

SEQ ID NO: 710618 - RNA, 19 nt, Homo sapiens
cauaugccaugccgucauc

SEQ ID NO: 710619 - RNA, 19 nt, Homo sapiens
caaugguaccuaugacuau

SEQ ID NO: 710620 - RNA, 19 nt, Homo sapiens
gcacccaacacagcaagaa

SEQ ID NO: 710621 - RNA, 19 nt, Homo sapiens
gcucuucgccccuggguua

SEQ ID NO: 710622 - RNA, 19 nt, Homo sapiens
aaaccuugcuaaguccaaa

SEQ ID NO: 710623 - RNA, 19 nt, Homo sapiens
cagcaagaaagcccacuga

SEQ ID NO: 710624 - RNA, 19 nt, Homo sapiens
cugcugcccugcacauaug

SEQ ID NO: 710625 - RNA, 19 nt, Homo sapiens
gagcucuccuggaacacau

SEQ ID NO: 710626 - RNA, 19 nt, Homo sapiens
cgucugguauuuccacaca

SEQ ID NO: 710627 - RNA, 19 nt, Homo sapiens
caucuuugcugugcucuac

SEQ ID NO: 710628 - RNA, 19 nt, Homo sapiens
uggcauacacagagauuga

SEQ ID NO: 710629 - RNA, 19 nt, Homo sapiens
cugcuugucuucuugaucu

SEQ ID NO: 710630 - RNA, 19 nt, Homo sapiens
cuaccuugcugcuugucuu

SEQ ID NO: 710631 - RNA, 19 nt, Homo sapiens
cuaccugucccgcuccuuu

SEQ ID NO: 710632 - RNA, 19 nt, Homo sapiens
cguguccacuccaucuuug

SEQ ID NO: 710633 - RNA, 19 nt, Homo sapiens
ccucuucaccuccaacuuc

SEQ ID NO: 710634 - RNA, 19 nt, Homo sapiens
cgagguagaaggcgucauc

SEQ ID NO: 710635 - RNA, 19 nt, Homo sapiens
gugcugcggcucuucaaug

SEQ ID NO: 710636 - RNA, 19 nt, Homo sapiens
cagcugguuucguguacau

SEQ ID NO: 710637 - RNA, 19 nt, Homo sapiens
gcauggcccagaacaucuu

SEQ ID NO: 710638 - RNA, 19 nt, Homo sapiens
cccaagagcacccaacaca

SEQ ID NO: 710639 - RNA, 19 nt, Homo sapiens
ucacccugcuccugcuguu

SEQ ID NO: 710640 - RNA, 19 nt, Homo sapiens
agaugaaugugcugcucuu

SEQ ID NO: 710641 - RNA, 19 nt, Homo sapiens
ugcugcggcucuucaauga

SEQ ID NO: 710642 - RNA, 19 nt, Homo sapiens
guaccucccuucgucuuuu

SEQ ID NO: 710643 - RNA, 19 nt, Homo sapiens
gguaccucccuucgucuuu

SEQ ID NO: 710644 - RNA, 19 nt, Homo sapiens
acacccaaccagaucguuu

SEQ ID NO: 710645 - RNA, 19 nt, Homo sapiens
gguggcauacacagagauu

SEQ ID NO: 710646 - RNA, 19 nt, Homo sapiens
cagucucugugaagaugaa

SEQ ID NO: 710647 - RNA, 19 nt, Homo sapiens
caucaaugguaccuaugac

SEQ ID NO: 710648 - RNA, 19 nt, Homo sapiens
ccagagauaucacuuaauu

SEQ ID NO: 710649 - RNA, 19 nt, Homo sapiens
ugacagagauugaugagaa

SEQ ID NO: 710650 - RNA, 19 nt, Homo sapiens
ggaaacaguugcagagcua

SEQ ID NO: 710651 - RNA, 19 nt, Homo sapiens
gaaacuggcuggaaauagu

SEQ ID NO: 710652 - RNA, 19 nt, Homo sapiens
gaacuucucuuccucacau

SEQ ID NO: 710653 - RNA, 19 nt, Homo sapiens
gcuaagaacuguugagagu

SEQ ID NO: 710654 - RNA, 19 nt, Homo sapiens
gaccagauuucuagauauu

SEQ ID NO: 710655 - RNA, 19 nt, Homo sapiens
gaaccaagguguuugugau

SEQ ID NO: 710656 - RNA, 19 nt, Homo sapiens
ccagaucccuuccagcuaa

SEQ ID NO: 710657 - RNA, 19 nt, Homo sapiens
gagugaagcugcaucuuau

SEQ ID NO: 710658 - RNA, 19 nt, Homo sapiens
uaagaacuguugagaguga

SEQ ID NO: 710659 - RNA, 19 nt, Homo sapiens
gaaucuaucucccucugaa

SEQ ID NO: 710660 - RNA, 19 nt, Homo sapiens
gauagaagauggaaacaac

SEQ ID NO: 710661 - RNA, 19 nt, Homo sapiens
gaaucaauaugucacucua

SEQ ID NO: 710662 - RNA, 19 nt, Homo sapiens
gaccuaagcugccuucucu

SEQ ID NO: 710663 - RNA, 19 nt, Homo sapiens
ccaaagaaguuauuagaac

SEQ ID NO: 710664 - RNA, 19 nt, Homo sapiens
gaaaugugcugggcaaguc

SEQ ID NO: 710665 - RNA, 19 nt, Homo sapiens
cucaggaacucuucuauuu

SEQ ID NO: 710666 - RNA, 19 nt, Homo sapiens
gaagguggaucaggaagug

SEQ ID NO: 710667 - RNA, 19 nt, Homo sapiens
ggaccagauuucuagauau

SEQ ID NO: 710668 - RNA, 19 nt, Homo sapiens
gauccacucugacaugaau

SEQ ID NO: 710669 - RNA, 19 nt, Homo sapiens
cacccaaccugucguaauu

SEQ ID NO: 710670 - RNA, 19 nt, Homo sapiens
ugggaacuauuucucuuua

SEQ ID NO: 710671 - RNA, 19 nt, Homo sapiens
cuaguucugugauguguuu

SEQ ID NO: 710672 - RNA, 19 nt, Homo sapiens
gaagauggaaacaacuuug

SEQ ID NO: 710673 - RNA, 19 nt, Homo sapiens
ugaaggaaccaaucuuaaa

SEQ ID NO: 710674 - RNA, 19 nt, Homo sapiens
cagaagacuugguggcaaa

SEQ ID NO: 710675 - RNA, 19 nt, Homo sapiens
gacagagauugaugagaaa

SEQ ID NO: 710676 - RNA, 19 nt, Homo sapiens
uuacaugacuaucgugaug

SEQ ID NO: 710677 - RNA, 19 nt, Homo sapiens
uggaccagauuucuagaua

SEQ ID NO: 710678 - RNA, 19 nt, Homo sapiens
agagugaagcugcaucuua

SEQ ID NO: 710679 - RNA, 19 nt, Homo sapiens
gaugcugucuucccacgaa

SEQ ID NO: 710680 - RNA, 19 nt, Homo sapiens
aaacauccaugaccuaacu

SEQ ID NO: 710681 - RNA, 19 nt, Homo sapiens
guaacaaaccaauugcauu

SEQ ID NO: 710682 - RNA, 19 nt, Homo sapiens
cacaugagguuacuguuuc

SEQ ID NO: 710683 - RNA, 19 nt, Homo sapiens
aagguugggugcuucauuu

SEQ ID NO: 710684 - RNA, 19 nt, Homo sapiens
gacauugccuugguuuguu

SEQ ID NO: 710685 - RNA, 19 nt, Homo sapiens
gcagagcuaagaacuguug

SEQ ID NO: 710686 - RNA, 19 nt, Homo sapiens
ggacauuauugagaaagug

SEQ ID NO: 710687 - RNA, 19 nt, Homo sapiens
acagacuccuacuccauua

SEQ ID NO: 710688 - RNA, 19 nt, Homo sapiens
ucacaugagguuacuguuu

SEQ ID NO: 710689 - RNA, 19 nt, Homo sapiens
gugauguguuuaccucuuu

SEQ ID NO: 710690 - RNA, 19 nt, Homo sapiens
gaaggaaccaaucuuaaac

SEQ ID NO: 710691 - RNA, 19 nt, Homo sapiens
uaucacccauggaucguaa

SEQ ID NO: 710692 - RNA, 19 nt, Homo sapiens
uaccacggcuggagaguug

SEQ ID NO: 710693 - RNA, 19 nt, Homo sapiens
gaagguuggaugaguguga

SEQ ID NO: 710694 - RNA, 19 nt, Homo sapiens
guacuuugaccucuuucua

SEQ ID NO: 710695 - RNA, 19 nt, Homo sapiens
guacaucccacuuugaauc

SEQ ID NO: 710696 - RNA, 19 nt, Homo sapiens
gagcagcaaugcagagacu

SEQ ID NO: 710697 - RNA, 19 nt, Homo sapiens
gaaagugaaaccugagauc

SEQ ID NO: 710698 - RNA, 19 nt, Homo sapiens
ccaaggaaccaagguguuu

SEQ ID NO: 710699 - RNA, 19 nt, Homo sapiens
acauugccuugguuuguua

SEQ ID NO: 710700 - RNA, 19 nt, Homo sapiens
gauggucccacuuauaaga

SEQ ID NO: 710701 - RNA, 19 nt, Homo sapiens
uggauggucccacuuauaa

SEQ ID NO: 710702 - RNA, 19 nt, Homo sapiens
uguaaggaaugaacugguu

SEQ ID NO: 710703 - RNA, 19 nt, Homo sapiens
aguagaggcugcuaucguu

SEQ ID NO: 710704 - RNA, 19 nt, Homo sapiens
ugccuucucucccuacuuu

SEQ ID NO: 710705 - RNA, 19 nt, Homo sapiens
ccaguugagcugaaucuuu

SEQ ID NO: 710706 - RNA, 19 nt, Homo sapiens
gauguacucaugcucauau

SEQ ID NO: 710707 - RNA, 19 nt, Homo sapiens
acccauggaucguaaugua

SEQ ID NO: 710708 - RNA, 19 nt, Homo sapiens
acacgugcauauacacauu

SEQ ID NO: 710709 - RNA, 19 nt, Homo sapiens
gagaacagagagaugagaa

SEQ ID NO: 710710 - RNA, 19 nt, Homo sapiens
auacagacaugcacacaca

SEQ ID NO: 710711 - RNA, 19 nt, Homo sapiens
aagacuugguggcaaauuu

SEQ ID NO: 710712 - RNA, 19 nt, Homo sapiens
gagauccggcuguugauug

SEQ ID NO: 710713 - RNA, 19 nt, Homo sapiens
ccaccuccauggacaccua

SEQ ID NO: 710714 - RNA, 19 nt, Homo sapiens
gagcugaggaaucaauaug

SEQ ID NO: 710715 - RNA, 19 nt, Homo sapiens
ggaagugaagcucaagguu

SEQ ID NO: 710716 - RNA, 19 nt, Homo sapiens
uuccagagauaucacuuaa

SEQ ID NO: 710717 - RNA, 19 nt, Homo sapiens
ggugaagguuucugcaagu

SEQ ID NO: 710718 - RNA, 19 nt, Homo sapiens
gggaaacuggcuggaaaua

SEQ ID NO: 710719 - RNA, 19 nt, Homo sapiens
ucugaaggaaccaaucuua

SEQ ID NO: 710720 - RNA, 19 nt, Homo sapiens
ggaaagugcuagguguuuu

SEQ ID NO: 710721 - RNA, 19 nt, Homo sapiens
gcugaggaaucaauauguc

SEQ ID NO: 710722 - RNA, 19 nt, Homo sapiens
agagauugaugagaaagaa

SEQ ID NO: 710723 - RNA, 19 nt, Homo sapiens
gagcuaagaacuguugaga

SEQ ID NO: 710724 - RNA, 19 nt, Homo sapiens
ggaaccaagguguuuguga

SEQ ID NO: 710725 - RNA, 19 nt, Homo sapiens
gucuguuucugacuuauuu

SEQ ID NO: 710726 - RNA, 19 nt, Homo sapiens
ucauugguguguaugugua

SEQ ID NO: 710727 - RNA, 19 nt, Homo sapiens
gggaacuauuucucuuuau

SEQ ID NO: 710728 - RNA, 19 nt, Homo sapiens
gaaauaccuuaggccuuca

SEQ ID NO: 710729 - RNA, 19 nt, Homo sapiens
ugagggaaccggaaggaaa

SEQ ID NO: 710730 - RNA, 19 nt, Homo sapiens
cuaucucccucugaaauaa

SEQ ID NO: 710731 - RNA, 19 nt, Homo sapiens
gaauaaugucuucaguuuc

SEQ ID NO: 710732 - RNA, 19 nt, Homo sapiens
caguugagcugaaucuuuu

SEQ ID NO: 710733 - RNA, 19 nt, Homo sapiens
ccacaaccccugucacaua

SEQ ID NO: 710734 - RNA, 19 nt, Homo sapiens
uaaucacaccucucuguuu

SEQ ID NO: 710735 - RNA, 19 nt, Homo sapiens
ggcuagggauguacucaug

SEQ ID NO: 710736 - RNA, 19 nt, Homo sapiens
gagucaggaugcugucuuc

SEQ ID NO: 710737 - RNA, 19 nt, Homo sapiens
gccccuagcucuuuuauuc

SEQ ID NO: 710738 - RNA, 19 nt, Homo sapiens
ugagguuacuguuucuuuc

SEQ ID NO: 710739 - RNA, 19 nt, Homo sapiens
gaacuccagguuugugugu

SEQ ID NO: 710740 - RNA, 19 nt, Homo sapiens
gaccgacauugccuugguu

SEQ ID NO: 710741 - RNA, 19 nt, Homo sapiens
gguggacauuauugagaaa

SEQ ID NO: 710742 - RNA, 19 nt, Homo sapiens
cagaagauccuaguuccuu

SEQ ID NO: 710743 - RNA, 19 nt, Homo sapiens
ccauggaucguaauguaaa

SEQ ID NO: 710744 - RNA, 19 nt, Homo sapiens
aaacuggcuggaaauagua

SEQ ID NO: 710745 - RNA, 19 nt, Homo sapiens
guacucaugcucauaugug

SEQ ID NO: 710746 - RNA, 19 nt, Homo sapiens
acuuugaccucuuucuaaa

SEQ ID NO: 710747 - RNA, 19 nt, Homo sapiens
ugucuuaguugucaucuac

SEQ ID NO: 710748 - RNA, 19 nt, Homo sapiens
agacagauguggccaauua

SEQ ID NO: 710749 - RNA, 19 nt, Homo sapiens
gagaauaaauugcuugaug

SEQ ID NO: 710750 - RNA, 19 nt, Homo sapiens
gaaaugagaacaagcagua

SEQ ID NO: 710751 - RNA, 19 nt, Homo sapiens
gaaaguaucugugagaaca

SEQ ID NO: 710752 - RNA, 19 nt, Homo sapiens
uaaugucacuucucaguua

SEQ ID NO: 710753 - RNA, 19 nt, Homo sapiens
gcaugacgcuaaagaaauu

SEQ ID NO: 710754 - RNA, 19 nt, Homo sapiens
ucaggaaucucuuguauau

SEQ ID NO: 710755 - RNA, 19 nt, Homo sapiens
uagcagaucuucgagcuua

SEQ ID NO: 710756 - RNA, 19 nt, Homo sapiens
ggucaacacuguagaugaa

SEQ ID NO: 710757 - RNA, 19 nt, Homo sapiens
gagaguaaaggaugcauua

SEQ ID NO: 710758 - RNA, 19 nt, Homo sapiens
ggaacgaauugaagaaaug

SEQ ID NO: 710759 - RNA, 19 nt, Homo sapiens
gaacaggauugacuuacug

SEQ ID NO: 710760 - RNA, 19 nt, Homo sapiens
gcagaguauuccaucuuua

SEQ ID NO: 710761 - RNA, 19 nt, Homo sapiens
gaaaugagcaaaguaagaa

SEQ ID NO: 710762 - RNA, 19 nt, Homo sapiens
gacccuagcugaaacagaa

SEQ ID NO: 710763 - RNA, 19 nt, Homo sapiens
ggaagauccugugauauug

SEQ ID NO: 710764 - RNA, 19 nt, Homo sapiens
gauccuacguuacacauga

SEQ ID NO: 710765 - RNA, 19 nt, Homo sapiens
ccaauuagauagugcuuug

SEQ ID NO: 710766 - RNA, 19 nt, Homo sapiens
aaagaaaucucuggaguug

SEQ ID NO: 710767 - RNA, 19 nt, Homo sapiens
ggagaagaauaaaucaguu

SEQ ID NO: 710768 - RNA, 19 nt, Homo sapiens
ccaaaccagucuaauacua

SEQ ID NO: 710769 - RNA, 19 nt, Homo sapiens
gaagaucguuuggaaagga

SEQ ID NO: 710770 - RNA, 19 nt, Homo sapiens
ggacgaaucacuuuacaga

SEQ ID NO: 710771 - RNA, 19 nt, Homo sapiens
gaagaaaguaucugugaga

SEQ ID NO: 710772 - RNA, 19 nt, Homo sapiens
agaaaucucuggaguugaa

SEQ ID NO: 710773 - RNA, 19 nt, Homo sapiens
gcucaggaaucucuuguau

SEQ ID NO: 710774 - RNA, 19 nt, Homo sapiens
ggaaaggauuaaucgagaa

SEQ ID NO: 710775 - RNA, 19 nt, Homo sapiens
gagaagacguucauaucau

SEQ ID NO: 710776 - RNA, 19 nt, Homo sapiens
acaauuaacugcacaucaa

SEQ ID NO: 710777 - RNA, 19 nt, Homo sapiens
caaauggagugaagaaagu

SEQ ID NO: 710778 - RNA, 19 nt, Homo sapiens
ggacacagacagagaaaga

SEQ ID NO: 710779 - RNA, 19 nt, Homo sapiens
gauaaagaagcucaacuaa

SEQ ID NO: 710780 - RNA, 19 nt, Homo sapiens
gaagacaccaauugagaaa

SEQ ID NO: 710781 - RNA, 19 nt, Homo sapiens
ggaaaugagcaaaguaaga

SEQ ID NO: 710782 - RNA, 19 nt, Homo sapiens
guaaugauaucucggucaa

SEQ ID NO: 710783 - RNA, 19 nt, Homo sapiens
guaagaagacaccaauuga

SEQ ID NO: 710784 - RNA, 19 nt, Homo sapiens
gacucuagauccuacguua

SEQ ID NO: 710785 - RNA, 19 nt, Homo sapiens
ggaaauauaaacagaggaa

SEQ ID NO: 710786 - RNA, 19 nt, Homo sapiens
aaagcaugcucgacacaua

SEQ ID NO: 710787 - RNA, 19 nt, Homo sapiens
uacaaacucucagaugaua

SEQ ID NO: 710788 - RNA, 19 nt, Homo sapiens
gcaguuaccugagaggaau

SEQ ID NO: 710789 - RNA, 19 nt, Homo sapiens
ucaccaaaccagucuaaua

SEQ ID NO: 710790 - RNA, 19 nt, Homo sapiens
gaagaaaugagaacaagca

SEQ ID NO: 710791 - RNA, 19 nt, Homo sapiens
ugaagugaaugauuugaga

SEQ ID NO: 710792 - RNA, 19 nt, Homo sapiens
ccaaucaaauucuuguaga

SEQ ID NO: 710793 - RNA, 19 nt, Homo sapiens
uauaagccuucaaacagua

SEQ ID NO: 710794 - RNA, 19 nt, Homo sapiens
ggauuuagucaucugcuua

SEQ ID NO: 710795 - RNA, 19 nt, Homo sapiens
cuuggaagauccugugaua

SEQ ID NO: 710796 - RNA, 19 nt, Homo sapiens
agaagacguucauaucauu

SEQ ID NO: 710797 - RNA, 19 nt, Homo sapiens
uaguaucugucuccaauuu

SEQ ID NO: 710798 - RNA, 19 nt, Homo sapiens
caacguaccaauccaagaa

SEQ ID NO: 710799 - RNA, 19 nt, Homo sapiens
gaguaaaggaugcauuaaa

SEQ ID NO: 710800 - RNA, 19 nt, Homo sapiens
ccaauucgauuugauauac

SEQ ID NO: 710801 - RNA, 19 nt, Homo sapiens
guugaagauuggaagauaa

SEQ ID NO: 710802 - RNA, 19 nt, Homo sapiens
gaacagccugggagaagaa

SEQ ID NO: 710803 - RNA, 19 nt, Homo sapiens
aaagagagauuaugcuaac

SEQ ID NO: 710804 - RNA, 19 nt, Homo sapiens
guaucugucuccaauuuau

SEQ ID NO: 710805 - RNA, 19 nt, Homo sapiens
aaagaacacaggagaguaa

SEQ ID NO: 710806 - RNA, 19 nt, Homo sapiens
aacagaagcuggaggcaaa

SEQ ID NO: 710807 - RNA, 19 nt, Homo sapiens
aauaguaucugucuccaau

SEQ ID NO: 710808 - RNA, 19 nt, Homo sapiens
gacaagagagacuuaauuc

SEQ ID NO: 710809 - RNA, 19 nt, Homo sapiens
ggaacaggauugacuuacu

SEQ ID NO: 710810 - RNA, 19 nt, Homo sapiens
ggacaccucaaauauaaau

SEQ ID NO: 710811 - RNA, 19 nt, Homo sapiens
ucaagcaaguagaacauga

SEQ ID NO: 710812 - RNA, 19 nt, Homo sapiens
gagaacaagcaguaaagaa

SEQ ID NO: 710813 - RNA, 19 nt, Homo sapiens
ccugugauauugucuaaga

SEQ ID NO: 710814 - RNA, 19 nt, Homo sapiens
cuagaugacucggaagaaa

SEQ ID NO: 710815 - RNA, 19 nt, Homo sapiens
gaguaugagucccuuggaa

SEQ ID NO: 710816 - RNA, 19 nt, Homo sapiens
caaacucucagaugauaaa

SEQ ID NO: 710817 - RNA, 19 nt, Homo sapiens
cuuacaaacucucagauga

SEQ ID NO: 710818 - RNA, 19 nt, Homo sapiens
gaacgaauugaagaaauga

SEQ ID NO: 710819 - RNA, 19 nt, Homo sapiens
uggaagauccugugauauu

SEQ ID NO: 710820 - RNA, 19 nt, Homo sapiens
aaauaucccucacacacaa

SEQ ID NO: 710821 - RNA, 19 nt, Homo sapiens
gcgcaccucugcaaaucuu

SEQ ID NO: 710822 - RNA, 19 nt, Homo sapiens
agaacaagcaguaaagaaa

SEQ ID NO: 710823 - RNA, 19 nt, Homo sapiens
acucucagaugauaaagaa

SEQ ID NO: 710824 - RNA, 19 nt, Homo sapiens
agaagaagcauuugagaau

SEQ ID NO: 710825 - RNA, 19 nt, Homo sapiens
ugagauuuguagccauuaa

SEQ ID NO: 710826 - RNA, 19 nt, Homo sapiens
gcaguccaauucgauuuga

SEQ ID NO: 710827 - RNA, 19 nt, Homo sapiens
ugauaaagaagcucaacua

SEQ ID NO: 710828 - RNA, 19 nt, Homo sapiens
ugagaaugcuuacaaacuc

SEQ ID NO: 710829 - RNA, 19 nt, Homo sapiens
gcaccacucuuugccugaa

SEQ ID NO: 710830 - RNA, 19 nt, Homo sapiens
guauaauuaugcagucaga

SEQ ID NO: 710831 - RNA, 19 nt, Homo sapiens
uaaaucaaguacuccaaca

SEQ ID NO: 710832 - RNA, 19 nt, Homo sapiens
gaucuucgagcuuauuaug

SEQ ID NO: 710833 - RNA, 19 nt, Homo sapiens
gaaaguaggaccaguucca

SEQ ID NO: 710834 - RNA, 19 nt, Homo sapiens
cgaaucacuuuacagacaa

SEQ ID NO: 710835 - RNA, 19 nt, Homo sapiens
gugaagaaaguaucuguga

SEQ ID NO: 710836 - RNA, 19 nt, Homo sapiens
ccaacacacuagcaacuuc

SEQ ID NO: 710837 - RNA, 19 nt, Homo sapiens
ccucugacauagacucauu

SEQ ID NO: 710838 - RNA, 19 nt, Homo sapiens
agacaccaauugagaaauc

SEQ ID NO: 710839 - RNA, 19 nt, Homo sapiens
gagcaguccaauucgauuu

SEQ ID NO: 710840 - RNA, 19 nt, Homo sapiens
gaacaagcaguaaagaaaa

SEQ ID NO: 710841 - RNA, 19 nt, Homo sapiens
ucaaauucuuguagacaga

SEQ ID NO: 710842 - RNA, 19 nt, Homo sapiens
ccacguuuccgucaguaua

SEQ ID NO: 710843 - RNA, 19 nt, Homo sapiens
uaccgucacugaaggauau

SEQ ID NO: 710844 - RNA, 19 nt, Homo sapiens
gaggacgaaucacuuuaca

SEQ ID NO: 710845 - RNA, 19 nt, Homo sapiens
gauuccaggugcagaguau

SEQ ID NO: 710846 - RNA, 19 nt, Homo sapiens
gcaggaacgaauugaagaa

SEQ ID NO: 710847 - RNA, 19 nt, Homo sapiens
gauagugcuuugcaugaag

SEQ ID NO: 710848 - RNA, 19 nt, Homo sapiens
gcacaaagcagaagaaguu

SEQ ID NO: 710849 - RNA, 19 nt, Homo sapiens
gagcagaguuucuuacuau

SEQ ID NO: 710850 - RNA, 19 nt, Homo sapiens
ggagacaucacaccaauua

SEQ ID NO: 710851 - RNA, 19 nt, Homo sapiens
cagaagaaguugaagauga

SEQ ID NO: 710852 - RNA, 19 nt, Homo sapiens
uuacagggcugcuuccuaa

SEQ ID NO: 710853 - RNA, 19 nt, Homo sapiens
guacauccuuugcuucuug

SEQ ID NO: 710854 - RNA, 19 nt, Homo sapiens
aauggugucucuauaguua

SEQ ID NO: 710855 - RNA, 19 nt, Homo sapiens
agagagaccaugccaauua

SEQ ID NO: 710856 - RNA, 19 nt, Homo sapiens
ccucagguuucucuuaaua

SEQ ID NO: 710857 - RNA, 19 nt, Homo sapiens
gagagaccaugccaauuau

SEQ ID NO: 710858 - RNA, 19 nt, Homo sapiens
uaauauaguucuccaguca

SEQ ID NO: 710859 - RNA, 19 nt, Homo sapiens
ugccagagcuuaaagagaa

SEQ ID NO: 710860 - RNA, 19 nt, Homo sapiens
agagauggcuagaagauau

SEQ ID NO: 710861 - RNA, 19 nt, Homo sapiens
agaagaaguugaagaugaa

SEQ ID NO: 710862 - RNA, 19 nt, Homo sapiens
agaaacaacuagaagaaga

SEQ ID NO: 710863 - RNA, 19 nt, Homo sapiens
caagaaacaacuagaagaa

SEQ ID NO: 710864 - RNA, 19 nt, Homo sapiens
gaagagauggcuagaagau

SEQ ID NO: 710865 - RNA, 19 nt, Homo sapiens
ccaggucauugucaguuua

SEQ ID NO: 710866 - RNA, 19 nt, Homo sapiens
gaaacaacuagaagaagaa

SEQ ID NO: 710867 - RNA, 19 nt, Homo sapiens
ucuccagccuuaaguauuu

SEQ ID NO: 710868 - RNA, 19 nt, Homo sapiens
ucacaccaauuaaagcaaa

SEQ ID NO: 710869 - RNA, 19 nt, Homo sapiens
aaaugccucuccagccuua

SEQ ID NO: 710870 - RNA, 19 nt, Homo sapiens
guacauacaauuuggaauc

SEQ ID NO: 710871 - RNA, 19 nt, Homo sapiens
ggacucagaaaccaagaaa

SEQ ID NO: 710872 - RNA, 19 nt, Homo sapiens
aaacagaugugugauggau

SEQ ID NO: 710873 - RNA, 19 nt, Homo sapiens
caaagcagaagaaguugaa

SEQ ID NO: 710874 - RNA, 19 nt, Homo sapiens
uaauagaagagcagaguuu

SEQ ID NO: 710875 - RNA, 19 nt, Homo sapiens
ggacuggacucagaaacca

SEQ ID NO: 710876 - RNA, 19 nt, Homo sapiens
ucacugaccuugaauugac

SEQ ID NO: 710877 - RNA, 19 nt, Homo sapiens
ccaauuaaagcaaagaaga

SEQ ID NO: 710878 - RNA, 19 nt, Homo sapiens
agacaucacaccaauuaaa

SEQ ID NO: 710879 - RNA, 19 nt, Homo sapiens
gagaccaugccaauuauga

SEQ ID NO: 710880 - RNA, 19 nt, Homo sapiens
gaaauugaugcuucagaug

SEQ ID NO: 710881 - RNA, 19 nt, Homo sapiens
ucaagccaauucguacaua

SEQ ID NO: 710882 - RNA, 19 nt, Homo sapiens
gaccuugaauugacuuaca

SEQ ID NO: 710883 - RNA, 19 nt, Homo sapiens
ccaauggugucucuauagu

SEQ ID NO: 710884 - RNA, 19 nt, Homo sapiens
gaagauaugagaccuuggu

SEQ ID NO: 710885 - RNA, 19 nt, Homo sapiens
agaaauugaugcuucagau

SEQ ID NO: 710886 - RNA, 19 nt, Homo sapiens
ccaagaaacaacuagaaga

SEQ ID NO: 710887 - RNA, 19 nt, Homo sapiens
aguugaagaugaaacagua

SEQ ID NO: 710888 - RNA, 19 nt, Homo sapiens
gagcacugguacuuggauu

SEQ ID NO: 710889 - RNA, 19 nt, Homo sapiens
ccaauuaugaagaagauga

SEQ ID NO: 710890 - RNA, 19 nt, Homo sapiens
aaagagagaccaugccaau

SEQ ID NO: 710891 - RNA, 19 nt, Homo sapiens
cagaguuucuuacuaugug

SEQ ID NO: 710892 - RNA, 19 nt, Homo sapiens
gcacugguacuuggauuug

SEQ ID NO: 710893 - RNA, 19 nt, Homo sapiens
gaugugugauggauguugu

SEQ ID NO: 710894 - RNA, 19 nt, Homo sapiens
acagaugugugauggaugu

SEQ ID NO: 710895 - RNA, 19 nt, Homo sapiens
ugaagaagaugaaaaugga

SEQ ID NO: 710896 - RNA, 19 nt, Homo sapiens
ccaugccaauuaugaagaa

SEQ ID NO: 710897 - RNA, 19 nt, Homo sapiens
aaauugaugcuucagauga

SEQ ID NO: 710898 - RNA, 19 nt, Homo sapiens
auccugagguugagaaauu

SEQ ID NO: 710899 - RNA, 19 nt, Homo sapiens
agagcagaguuucuuacua

SEQ ID NO: 710900 - RNA, 19 nt, Homo sapiens
gagcuuaaagagaaagaga

SEQ ID NO: 710901 - RNA, 19 nt, Homo sapiens
cagggcugcuuccuaaaga

SEQ ID NO: 710902 - RNA, 19 nt, Homo sapiens
acaacuagaagaagaagaa

SEQ ID NO: 710903 - RNA, 19 nt, Homo sapiens
gcagaguuucuuacuaugu

SEQ ID NO: 710904 - RNA, 19 nt, Homo sapiens
cgagagaaagacaaaguug

SEQ ID NO: 710905 - RNA, 19 nt, Homo sapiens
ucccaauggugucucuaua

SEQ ID NO: 710906 - RNA, 19 nt, Homo sapiens
gaaaaucauuagugaagag

SEQ ID NO: 710907 - RNA, 19 nt, Homo sapiens
gugaagagcacugguacuu

SEQ ID NO: 710908 - RNA, 19 nt, Homo sapiens
gagaaauugaugcuucaga

SEQ ID NO: 710909 - RNA, 19 nt, Homo sapiens
ugugucagaugaagagaug

SEQ ID NO: 710910 - RNA, 19 nt, Homo sapiens
gaaacaguagagcuugaug

SEQ ID NO: 710911 - RNA, 19 nt, Homo sapiens
gaagaaguugaagaugaaa

SEQ ID NO: 710912 - RNA, 19 nt, Homo sapiens
cauugucaguuuaugguau

SEQ ID NO: 710913 - RNA, 19 nt, Homo sapiens
gccagagcuuaaagagaaa

SEQ ID NO: 710914 - RNA, 19 nt, Homo sapiens
gacaucacaccaauuaaag

SEQ ID NO: 710915 - RNA, 19 nt, Homo sapiens
augaagagauggcuagaag

SEQ ID NO: 710916 - RNA, 19 nt, Homo sapiens
gaaaccaagaaacaacuag

SEQ ID NO: 710917 - RNA, 19 nt, Homo sapiens
caaaguuguccaagaaucu

SEQ ID NO: 710918 - RNA, 19 nt, Homo sapiens
gcagaagaaguugaagaug

SEQ ID NO: 710919 - RNA, 19 nt, Homo sapiens
gccaauucguacauacaau

SEQ ID NO: 710920 - RNA, 19 nt, Homo sapiens
gggcugcuuccuaaagauu

SEQ ID NO: 710921 - RNA, 19 nt, Homo sapiens
gagaguuucauaauagaag

SEQ ID NO: 710922 - RNA, 19 nt, Homo sapiens
ggauuugccagagcuuaaa

SEQ ID NO: 710923 - RNA, 19 nt, Homo sapiens
caagccaauucguacauac

SEQ ID NO: 710924 - RNA, 19 nt, Homo sapiens
gaaacagaugugugaugga

SEQ ID NO: 710925 - RNA, 19 nt, Homo sapiens
cccaggucauugucaguuu

SEQ ID NO: 710926 - RNA, 19 nt, Homo sapiens
uaugucaagccaauucgua

SEQ ID NO: 710927 - RNA, 19 nt, Homo sapiens
gaagucagcagggcaucug

SEQ ID NO: 710928 - RNA, 19 nt, Homo sapiens
ucuuaaagccccaggauua

SEQ ID NO: 710929 - RNA, 19 nt, Homo sapiens
gagacaucacaccaauuaa

SEQ ID NO: 710930 - RNA, 19 nt, Homo sapiens
aaaguuugccagaaagaga

SEQ ID NO: 710931 - RNA, 19 nt, Homo sapiens
gaugaagagauggcuagaa

SEQ ID NO: 710932 - RNA, 19 nt, Homo sapiens
caacuagaagaagaagaaa

SEQ ID NO: 710933 - RNA, 19 nt, Homo sapiens
gucaguuuaugguauuaug

SEQ ID NO: 710934 - RNA, 19 nt, Homo sapiens
uggugucucuauaguuauu

SEQ ID NO: 710935 - RNA, 19 nt, Homo sapiens
cuuacuaugugaagaucuu

SEQ ID NO: 710936 - RNA, 19 nt, Homo sapiens
acucagaaaccaagaaaca

SEQ ID NO: 710937 - RNA, 19 nt, Homo sapiens
caauggugucucuauaguu

SEQ ID NO: 710938 - RNA, 19 nt, Homo sapiens
cauaauagaagagcagagu

SEQ ID NO: 710939 - RNA, 19 nt, Homo sapiens
gagauggcuagaagauaug

SEQ ID NO: 710940 - RNA, 19 nt, Homo sapiens
aaaccaagaaacaacuaga

SEQ ID NO: 710941 - RNA, 19 nt, Homo sapiens
caucacaccaauuaaagca

SEQ ID NO: 710942 - RNA, 19 nt, Homo sapiens
gaccaugccaauuaugaag

SEQ ID NO: 710943 - RNA, 19 nt, Homo sapiens
gagcuugaugugucagaug

SEQ ID NO: 710944 - RNA, 19 nt, Homo sapiens
agccuuaaguauuuacaug

SEQ ID NO: 710945 - RNA, 19 nt, Homo sapiens
uaagcacaaagcagaagaa

SEQ ID NO: 710946 - RNA, 19 nt, Homo sapiens
guuacagggcugcuuccua

SEQ ID NO: 710947 - RNA, 19 nt, Homo sapiens
agaaaccaagaaacaacua

SEQ ID NO: 710948 - RNA, 19 nt, Homo sapiens
gaacuacuguggagaaagg

SEQ ID NO: 710949 - RNA, 19 nt, Homo sapiens
agagggagguguccacuau

SEQ ID NO: 710950 - RNA, 19 nt, Homo sapiens
gagaacuacuguggagaaa

SEQ ID NO: 710951 - RNA, 19 nt, Homo sapiens
ugaugcaggucuaugaaga

SEQ ID NO: 710952 - RNA, 19 nt, Homo sapiens
guucaucagcagauucuaa

SEQ ID NO: 710953 - RNA, 19 nt, Homo sapiens
gugaacagcgcugguauga

SEQ ID NO: 710954 - RNA, 19 nt, Homo sapiens
ggagguguccacuauguag

SEQ ID NO: 710955 - RNA, 19 nt, Homo sapiens
cgaaugagagaacuacugu

SEQ ID NO: 710956 - RNA, 19 nt, Homo sapiens
gaagauugccagagguuuu

SEQ ID NO: 710957 - RNA, 19 nt, Homo sapiens
gcacuggggcuccgaauga

SEQ ID NO: 710958 - RNA, 19 nt, Homo sapiens
gcgcugguaugaggaggaa

SEQ ID NO: 710959 - RNA, 19 nt, Homo sapiens
ggaagauugccagagguuu

SEQ ID NO: 710960 - RNA, 19 nt, Homo sapiens
agcaacaaguuccugauug

SEQ ID NO: 710961 - RNA, 19 nt, Homo sapiens
gcuguggcccugugugcua

SEQ ID NO: 710962 - RNA, 19 nt, Homo sapiens
cagcagauucuaagcaaca

SEQ ID NO: 710963 - RNA, 19 nt, Homo sapiens
gcccagacuucuccuagac

SEQ ID NO: 710964 - RNA, 19 nt, Homo sapiens
gggagguguccacuaugua

SEQ ID NO: 710965 - RNA, 19 nt, Homo sapiens
ccagacuucuccuagacau

SEQ ID NO: 710966 - RNA, 19 nt, Homo sapiens
ucagugaacagcgcuggua

SEQ ID NO: 710967 - RNA, 19 nt, Homo sapiens
agagaacuacuguggagaa

SEQ ID NO: 710968 - RNA, 19 nt, Homo sapiens
aauccgagccuacauccuu

SEQ ID NO: 710969 - RNA, 19 nt, Homo sapiens
caucuagucuaaaacauuc

SEQ ID NO: 710970 - RNA, 19 nt, Homo sapiens
gguucggacucugugguuu

SEQ ID NO: 710971 - RNA, 19 nt, Homo sapiens
ggaguuucggccucacuga

SEQ ID NO: 710972 - RNA, 19 nt, Homo sapiens
guuccugauuguacgaaug

SEQ ID NO: 710973 - RNA, 19 nt, Homo sapiens
aagcaacaaguuccugauu

SEQ ID NO: 710974 - RNA, 19 nt, Homo sapiens
agggagguguccacuaugu

SEQ ID NO: 710975 - RNA, 19 nt, Homo sapiens
gcugguaugaggaggaaga

SEQ ID NO: 710976 - RNA, 19 nt, Homo sapiens
ggaggaagagccccaguug

SEQ ID NO: 710977 - RNA, 19 nt, Homo sapiens
agagauugcagccuucuuc

SEQ ID NO: 710978 - RNA, 19 nt, Homo sapiens
gauucuauccgugggaguu

SEQ ID NO: 710979 - RNA, 19 nt, Homo sapiens
aucagaggcugguggaguu

SEQ ID NO: 710980 - RNA, 19 nt, Homo sapiens
guacgaaugagagaacuac

SEQ ID NO: 710981 - RNA, 19 nt, Homo sapiens
caucagcagauucuaagca

SEQ ID NO: 710982 - RNA, 19 nt, Homo sapiens
gauucuaagcaacaaguuc

SEQ ID NO: 710983 - RNA, 19 nt, Homo sapiens
gagcagaucugggacaaga

SEQ ID NO: 710984 - RNA, 19 nt, Homo sapiens
gacaagauccuaaguguga

SEQ ID NO: 710985 - RNA, 19 nt, Homo sapiens
gcaagggucugcaacuuca

SEQ ID NO: 710986 - RNA, 19 nt, Homo sapiens
ggaagggcguccuggcuaa

SEQ ID NO: 710987 - RNA, 19 nt, Homo sapiens
ggaaugagucucucuggaa

SEQ ID NO: 710988 - RNA, 19 nt, Homo sapiens
ugaagagacugucaccuau

SEQ ID NO: 710989 - RNA, 19 nt, Homo sapiens
gggacaagauccuaagugu

SEQ ID NO: 710990 - RNA, 19 nt, Homo sapiens
gccaagaacccaucaauuc

SEQ ID NO: 710991 - RNA, 19 nt, Homo sapiens
gcaccgggauagacaggaa

SEQ ID NO: 710992 - RNA, 19 nt, Homo sapiens
gcaggaagcaucucagaca

SEQ ID NO: 710993 - RNA, 19 nt, Homo sapiens
ucucuuccauugcagcuua

SEQ ID NO: 710994 - RNA, 19 nt, Homo sapiens
caaaguguuucaugggaau

SEQ ID NO: 710995 - RNA, 19 nt, Homo sapiens
cuagaacacuggcauugga

SEQ ID NO: 710996 - RNA, 19 nt, Homo sapiens
ccaaggacauccggguaaa

SEQ ID NO: 710997 - RNA, 19 nt, Homo sapiens
ucagaggacugugcaggaa

SEQ ID NO: 710998 - RNA, 19 nt, Homo sapiens
cugugaagcuuuguucuuu

SEQ ID NO: 710999 - RNA, 19 nt, Homo sapiens
gugucuaggugaucauuug

SEQ ID NO: 711000 - RNA, 19 nt, Homo sapiens
gugagacuauugccaagug

SEQ ID NO: 711001 - RNA, 19 nt, Homo sapiens
cgagaggaaugaacaacuc

SEQ ID NO: 711002 - RNA, 19 nt, Homo sapiens
gcaccgagaggaaugaaca

SEQ ID NO: 711003 - RNA, 19 nt, Homo sapiens
aagagacugucaccuauca

SEQ ID NO: 711004 - RNA, 19 nt, Homo sapiens
gaacuucaaggaacaucau

SEQ ID NO: 711005 - RNA, 19 nt, Homo sapiens
uuaagaaccguaauacuca

SEQ ID NO: 711006 - RNA, 19 nt, Homo sapiens
gaagagacugucaccuauc

SEQ ID NO: 711007 - RNA, 19 nt, Homo sapiens
ggccaagaacccaucaauu

SEQ ID NO: 711008 - RNA, 19 nt, Homo sapiens
gaugagcagcaccgggaua

SEQ ID NO: 711009 - RNA, 19 nt, Homo sapiens
uaucaccuaucgccaagug

SEQ ID NO: 711010 - RNA, 19 nt, Homo sapiens
gccaagcagugagacuauu

SEQ ID NO: 711011 - RNA, 19 nt, Homo sapiens
ccgcgaaggucugcaacuu

SEQ ID NO: 711012 - RNA, 19 nt, Homo sapiens
augcuaggcuugaggaaga

SEQ ID NO: 711013 - RNA, 19 nt, Homo sapiens
uugaagagacugucaccua

SEQ ID NO: 711014 - RNA, 19 nt, Homo sapiens
gucugcaacuucauucuug

SEQ ID NO: 711015 - RNA, 19 nt, Homo sapiens
cuacuccacucggcucuga

SEQ ID NO: 711016 - RNA, 19 nt, Homo sapiens
gccaguugcugcccuacau

SEQ ID NO: 711017 - RNA, 19 nt, Homo sapiens
ucucagacaccaaccacua

SEQ ID NO: 711018 - RNA, 19 nt, Homo sapiens
gugagacuauugccaagca

SEQ ID NO: 711019 - RNA, 19 nt, Homo sapiens
ccgcaagggucugcaacuu

SEQ ID NO: 711020 - RNA, 19 nt, Homo sapiens
gcugcugggucucacuaga

SEQ ID NO: 711021 - RNA, 19 nt, Homo sapiens
cauugcagcuuauaaucca

SEQ ID NO: 711022 - RNA, 19 nt, Homo sapiens
ccaagcagugagacuauug

SEQ ID NO: 711023 - RNA, 19 nt, Homo sapiens
ccaaguggugagacuauug

SEQ ID NO: 711024 - RNA, 19 nt, Homo sapiens
gaaugcaccgagaggaaug

SEQ ID NO: 711025 - RNA, 19 nt, Homo sapiens
gcugugaagcuuuguucuu

SEQ ID NO: 711026 - RNA, 19 nt, Homo sapiens
caucagcugcagaggauug

SEQ ID NO: 711027 - RNA, 19 nt, Homo sapiens
ugucaccuaucaccaagug

SEQ ID NO: 711028 - RNA, 19 nt, Homo sapiens
ggucugcaacuucauucuu

SEQ ID NO: 711029 - RNA, 19 nt, Homo sapiens
gugagcagaucugggacaa

SEQ ID NO: 711030 - RNA, 19 nt, Homo sapiens
ucuggacacaccaucuuua

SEQ ID NO: 711031 - RNA, 19 nt, Homo sapiens
agaggacugugcaggaauc

SEQ ID NO: 711032 - RNA, 19 nt, Homo sapiens
gagucucucuggaagaacu

SEQ ID NO: 711033 - RNA, 19 nt, Homo sapiens
cagcaggaagcaucucaga

SEQ ID NO: 711034 - RNA, 19 nt, Homo sapiens
uuuaagaaccguaauacuc

SEQ ID NO: 711035 - RNA, 19 nt, Homo sapiens
cugccagacuagcaauuug

SEQ ID NO: 711036 - RNA, 19 nt, Homo sapiens
ucuaggugaucauuuggau

SEQ ID NO: 711037 - RNA, 19 nt, Homo sapiens
ggcgcugggugucuacaau

SEQ ID NO: 711038 - RNA, 19 nt, Homo sapiens
cuggacacaccaucuuuaa

SEQ ID NO: 711039 - RNA, 19 nt, Homo sapiens
ucacuagaacacuggcauu

SEQ ID NO: 711040 - RNA, 19 nt, Homo sapiens
gugaagcuuuguucuuuug

SEQ ID NO: 711041 - RNA, 19 nt, Homo sapiens
ccuggucucuuccauugca

SEQ ID NO: 711042 - RNA, 19 nt, Homo sapiens
auccuggucucuuccauug

SEQ ID NO: 711043 - RNA, 19 nt, Homo sapiens
ccagcaagaccacgaaugc

SEQ ID NO: 711044 - RNA, 19 nt, Homo sapiens
ccaagaacccaucaauucc

SEQ ID NO: 711045 - RNA, 19 nt, Homo sapiens
cgaaugcaccgagaggaau

SEQ ID NO: 711046 - RNA, 19 nt, Homo sapiens
augagucucucuggaagaa

SEQ ID NO: 711047 - RNA, 19 nt, Homo sapiens
cccaaggacauccggguaa

SEQ ID NO: 711048 - RNA, 19 nt, Homo sapiens
gcgcugcugggucucacua

SEQ ID NO: 711049 - RNA, 19 nt, Homo sapiens
gagcagcaccgggauagac

SEQ ID NO: 711050 - RNA, 19 nt, Homo sapiens
ugugcuaggcuuucuguga

SEQ ID NO: 711051 - RNA, 19 nt, Homo sapiens
ucugcaacuucauucuuga

SEQ ID NO: 711052 - RNA, 19 nt, Homo sapiens
gcgcugggugucuacaaug

SEQ ID NO: 711053 - RNA, 19 nt, Homo sapiens
gcuagaagcuuauauuaca

SEQ ID NO: 711054 - RNA, 19 nt, Homo sapiens
caacugaguacaauuguua

SEQ ID NO: 711055 - RNA, 19 nt, Homo sapiens
gaagaaacuggaaucaaua

SEQ ID NO: 711056 - RNA, 19 nt, Homo sapiens
caaauuauacccaguguaa

SEQ ID NO: 711057 - RNA, 19 nt, Homo sapiens
gcucugcccugauuacuuu

SEQ ID NO: 711058 - RNA, 19 nt, Homo sapiens
ccacaaauccuguuaguug

SEQ ID NO: 711059 - RNA, 19 nt, Homo sapiens
gaacauggacaaauuauac

SEQ ID NO: 711060 - RNA, 19 nt, Homo sapiens
caugacagcucaauaugaa

SEQ ID NO: 711061 - RNA, 19 nt, Homo sapiens
gaaacuggaugaacaggau

SEQ ID NO: 711062 - RNA, 19 nt, Homo sapiens
gcagagaagcaacauuuaa

SEQ ID NO: 711063 - RNA, 19 nt, Homo sapiens
caaauaugauccaagagaa

SEQ ID NO: 711064 - RNA, 19 nt, Homo sapiens
gggcaugauucuacccuua

SEQ ID NO: 711065 - RNA, 19 nt, Homo sapiens
gacaauugcuggaucaguu

SEQ ID NO: 711066 - RNA, 19 nt, Homo sapiens
gcacaccauugaugaauuc

SEQ ID NO: 711067 - RNA, 19 nt, Homo sapiens
agaagaaacuggaaucaau

SEQ ID NO: 711068 - RNA, 19 nt, Homo sapiens
ggagguauaugacuacauc

SEQ ID NO: 711069 - RNA, 19 nt, Homo sapiens
gcuuguaaauacuccauua

SEQ ID NO: 711070 - RNA, 19 nt, Homo sapiens
uaacuacccucucaaaugg

SEQ ID NO: 711071 - RNA, 19 nt, Homo sapiens
gcuaaggucuauaaacaug

SEQ ID NO: 711072 - RNA, 19 nt, Homo sapiens
gaaagauugcuaccacuaa

SEQ ID NO: 711073 - RNA, 19 nt, Homo sapiens
acacaucaguuauaucuug

SEQ ID NO: 711074 - RNA, 19 nt, Homo sapiens
ucaaacaaauggcuguaaa

SEQ ID NO: 711075 - RNA, 19 nt, Homo sapiens
uagcuaaggucuauaaaca

SEQ ID NO: 711076 - RNA, 19 nt, Homo sapiens
ucaauucaguugggaguua

SEQ ID NO: 711077 - RNA, 19 nt, Homo sapiens
caaagaauuuccuuaagag

SEQ ID NO: 711078 - RNA, 19 nt, Homo sapiens
aagaaauccugguuuguaa

SEQ ID NO: 711079 - RNA, 19 nt, Homo sapiens
ggaugaacaggauguauaa

SEQ ID NO: 711080 - RNA, 19 nt, Homo sapiens
cagaggagguauaugacua

SEQ ID NO: 711081 - RNA, 19 nt, Homo sapiens
gaugggcuguaauuacuuu

SEQ ID NO: 711082 - RNA, 19 nt, Homo sapiens
caacaaccaggccuuagua

SEQ ID NO: 711083 - RNA, 19 nt, Homo sapiens
caagacugcugcaaacuuc

SEQ ID NO: 711084 - RNA, 19 nt, Homo sapiens
guaacuacccucucaaaug

SEQ ID NO: 711085 - RNA, 19 nt, Homo sapiens
gaagacugcacuaaauuug

SEQ ID NO: 711086 - RNA, 19 nt, Homo sapiens
acaaauggcuguaaaacua

SEQ ID NO: 711087 - RNA, 19 nt, Homo sapiens
gaacaggauguauaauaug

SEQ ID NO: 711088 - RNA, 19 nt, Homo sapiens
gaaacuggaaucaauacaa

SEQ ID NO: 711089 - RNA, 19 nt, Homo sapiens
ugucaaauaugauccaaga

SEQ ID NO: 711090 - RNA, 19 nt, Homo sapiens
gaacaaccucucucucuca

SEQ ID NO: 711091 - RNA, 19 nt, Homo sapiens
aaagaaauccugguuugua

SEQ ID NO: 711092 - RNA, 19 nt, Homo sapiens
gagcuacucuuaucuuggu

SEQ ID NO: 711093 - RNA, 19 nt, Homo sapiens
aaagauugcuaccacuaaa

SEQ ID NO: 711094 - RNA, 19 nt, Homo sapiens
gaaauuaguaguguguuga

SEQ ID NO: 711095 - RNA, 19 nt, Homo sapiens
gggaguuacuagaaauaaa

SEQ ID NO: 711096 - RNA, 19 nt, Homo sapiens
aguuauaucuuguggcaua

SEQ ID NO: 711097 - RNA, 19 nt, Homo sapiens
gcaacugaguacaauuguu

SEQ ID NO: 711098 - RNA, 19 nt, Homo sapiens
uaacugaaucucauccuaa

SEQ ID NO: 711099 - RNA, 19 nt, Homo sapiens
cuauaaacaugaagggaaa

SEQ ID NO: 711100 - RNA, 19 nt, Homo sapiens
ucuauugcaucacugcuua

SEQ ID NO: 711101 - RNA, 19 nt, Homo sapiens
gacaauaccagaagugaau

SEQ ID NO: 711102 - RNA, 19 nt, Homo sapiens
gaaauccugguuuguaaug

SEQ ID NO: 711103 - RNA, 19 nt, Homo sapiens
guuuguaacucuguuguaa

SEQ ID NO: 711104 - RNA, 19 nt, Homo sapiens
cuaaguugccaaaggauua

SEQ ID NO: 711105 - RNA, 19 nt, Homo sapiens
aacagaacauggacaaauu

SEQ ID NO: 711106 - RNA, 19 nt, Homo sapiens
gggaauuccuagcuguaaa

SEQ ID NO: 711107 - RNA, 19 nt, Homo sapiens
gcaugauucuacccuuauu

SEQ ID NO: 711108 - RNA, 19 nt, Homo sapiens
aauccaaucuguacaugaa

SEQ ID NO: 711109 - RNA, 19 nt, Homo sapiens
caacagaacauggacaaau

SEQ ID NO: 711110 - RNA, 19 nt, Homo sapiens
gagcuggacugggucuuga

SEQ ID NO: 711111 - RNA, 19 nt, Homo sapiens
agacugcacuaaauuuguu

SEQ ID NO: 711112 - RNA, 19 nt, Homo sapiens
uauacccaguguaauguua

SEQ ID NO: 711113 - RNA, 19 nt, Homo sapiens
ugaaauuaguaguguguug

SEQ ID NO: 711114 - RNA, 19 nt, Homo sapiens
gggaaugucauaaagaaga

SEQ ID NO: 711115 - RNA, 19 nt, Homo sapiens
caaagugucccaguucauu

SEQ ID NO: 711116 - RNA, 19 nt, Homo sapiens
caacagaaccugggaugga

SEQ ID NO: 711117 - RNA, 19 nt, Homo sapiens
ugacaagacugcugcaaac

SEQ ID NO: 711118 - RNA, 19 nt, Homo sapiens
uugcaaagcuuucacucuu

SEQ ID NO: 711119 - RNA, 19 nt, Homo sapiens
aagcauccaugauauugaa

SEQ ID NO: 711120 - RNA, 19 nt, Homo sapiens
ggaauccaaucuguacaug

SEQ ID NO: 711121 - RNA, 19 nt, Homo sapiens
gaaggaugguugucucacu

SEQ ID NO: 711122 - RNA, 19 nt, Homo sapiens
caagauugcuacaacuucu

SEQ ID NO: 711123 - RNA, 19 nt, Homo sapiens
ugacaagguugcuauaaaa

SEQ ID NO: 711124 - RNA, 19 nt, Homo sapiens
ucaaauaugauccaagaga

SEQ ID NO: 711125 - RNA, 19 nt, Homo sapiens
ugccauugcuagaagcuua

SEQ ID NO: 711126 - RNA, 19 nt, Homo sapiens
gcauuuaccuacacacacu

SEQ ID NO: 711127 - RNA, 19 nt, Homo sapiens
gagccuaaguugccaaagg

SEQ ID NO: 711128 - RNA, 19 nt, Homo sapiens
ugaagacugcacuaaauuu

SEQ ID NO: 711129 - RNA, 19 nt, Homo sapiens
gcaagcaacagaacaugga

SEQ ID NO: 711130 - RNA, 19 nt, Homo sapiens
cagaaggcguuuacugcaa

SEQ ID NO: 711131 - RNA, 19 nt, Homo sapiens
gugcauaucgucuaauaau

SEQ ID NO: 711132 - RNA, 19 nt, Homo sapiens
gaaggcauuuaccuacaca

SEQ ID NO: 711133 - RNA, 19 nt, Homo sapiens
aaucuguucuucucauuug

SEQ ID NO: 711134 - RNA, 19 nt, Homo sapiens
cauauuucauuugggcuua

SEQ ID NO: 711135 - RNA, 19 nt, Homo sapiens
ggacaauaccagaagugaa

SEQ ID NO: 711136 - RNA, 19 nt, Homo sapiens
gcacauccuuaugcacuuc

SEQ ID NO: 711137 - RNA, 19 nt, Homo sapiens
gaucacauugcaaagcuuu

SEQ ID NO: 711138 - RNA, 19 nt, Homo sapiens
acagaacauggacaaauua

SEQ ID NO: 711139 - RNA, 19 nt, Homo sapiens
gaaaacuacuacaacuuga

SEQ ID NO: 711140 - RNA, 19 nt, Homo sapiens
caauaccagaagugaauua

SEQ ID NO: 711141 - RNA, 19 nt, Homo sapiens
ggaaugucauaaagaagag

SEQ ID NO: 711142 - RNA, 19 nt, Homo sapiens
gagaagaaacuggaaucaa

SEQ ID NO: 711143 - RNA, 19 nt, Homo sapiens
cauuauccauggcccaauu

SEQ ID NO: 711144 - RNA, 19 nt, Homo sapiens
agugucaccuccugcuuua

SEQ ID NO: 711145 - RNA, 19 nt, Homo sapiens
cuaacugaaucucauccua

SEQ ID NO: 711146 - RNA, 19 nt, Homo sapiens
aaaguuccauccugagaau

SEQ ID NO: 711147 - RNA, 19 nt, Homo sapiens
gaguacaauuguuaugauc

SEQ ID NO: 711148 - RNA, 19 nt, Homo sapiens
gaaaagcaacugaguacaa

SEQ ID NO: 711149 - RNA, 19 nt, Homo sapiens
aauuaucccugcuggcuuu

SEQ ID NO: 711150 - RNA, 19 nt, Homo sapiens
caaauggacaauaccagaa

SEQ ID NO: 711151 - RNA, 19 nt, Homo sapiens
guacaugaaagcugugaga

SEQ ID NO: 711152 - RNA, 19 nt, Homo sapiens
cccaauuugugcugcuuua

SEQ ID NO: 711153 - RNA, 19 nt, Homo sapiens
ccagauagcugcaucauca

SEQ ID NO: 711154 - RNA, 19 nt, Homo sapiens
ccaaagaagugaaggagaa

SEQ ID NO: 711155 - RNA, 19 nt, Homo sapiens
gggagaaguuuguguugua

SEQ ID NO: 711156 - RNA, 19 nt, Homo sapiens
caccagauguuccuauuaa

SEQ ID NO: 711157 - RNA, 19 nt, Homo sapiens
caaauaucaugcacaaaug

SEQ ID NO: 711158 - RNA, 19 nt, Homo sapiens
caacauuacuaccaguuau

SEQ ID NO: 711159 - RNA, 19 nt, Homo sapiens
uggaaagacuuaaguaaug

SEQ ID NO: 711160 - RNA, 19 nt, Homo sapiens
gcccagacauugauuuguu

SEQ ID NO: 711161 - RNA, 19 nt, Homo sapiens
ccaaauaucaugcacaaau

SEQ ID NO: 711162 - RNA, 19 nt, Homo sapiens
ccagcuucauucaacauua

SEQ ID NO: 711163 - RNA, 19 nt, Homo sapiens
ccacugagguguugugcau

SEQ ID NO: 711164 - RNA, 19 nt, Homo sapiens
ggaaagacuuaaguaaugc

SEQ ID NO: 711165 - RNA, 19 nt, Homo sapiens
gcuaggcacucacgcuguu

SEQ ID NO: 711166 - RNA, 19 nt, Homo sapiens
caucagcccacuccagaua

SEQ ID NO: 711167 - RNA, 19 nt, Homo sapiens
cugacaaguugcucuagua

SEQ ID NO: 711168 - RNA, 19 nt, Homo sapiens
cagauuggauccagcuuca

SEQ ID NO: 711169 - RNA, 19 nt, Homo sapiens
ggauccagcuucauucaac

SEQ ID NO: 711170 - RNA, 19 nt, Homo sapiens
agacauugauuuguucaga

SEQ ID NO: 711171 - RNA, 19 nt, Homo sapiens
gauuggauccagcuucauu

SEQ ID NO: 711172 - RNA, 19 nt, Homo sapiens
uuaaucuacugacaaguug

SEQ ID NO: 711173 - RNA, 19 nt, Homo sapiens
gggugacgcuccagaaugg

SEQ ID NO: 711174 - RNA, 19 nt, Homo sapiens
ccaccagauguuccuauua

SEQ ID NO: 711175 - RNA, 19 nt, Homo sapiens
cagauguuccuauuaaaga

SEQ ID NO: 711176 - RNA, 19 nt, Homo sapiens
gacauugauuuguucagau

SEQ ID NO: 711177 - RNA, 19 nt, Homo sapiens
ugacaaguugcucuaguaa

SEQ ID NO: 711178 - RNA, 19 nt, Homo sapiens
ggagaaguuuguguuguac

SEQ ID NO: 711179 - RNA, 19 nt, Homo sapiens
ucaacauuacuaccaguua

SEQ ID NO: 711180 - RNA, 19 nt, Homo sapiens
gagguguugugcaugaugu

SEQ ID NO: 711181 - RNA, 19 nt, Homo sapiens
caacgaugcuuggguuugc

SEQ ID NO: 711182 - RNA, 19 nt, Homo sapiens
gauccagcuucauucaaca

SEQ ID NO: 711183 - RNA, 19 nt, Homo sapiens
caaagaagugaaggagaaa

SEQ ID NO: 711184 - RNA, 19 nt, Homo sapiens
ccagaugcuccaaauauca

SEQ ID NO: 711185 - RNA, 19 nt, Homo sapiens
acauugauuuguucagaug

SEQ ID NO: 711186 - RNA, 19 nt, Homo sapiens
gcucuaguaacccaaagaa

SEQ ID NO: 711187 - RNA, 19 nt, Homo sapiens
gcgcaugccuuggaaagac

SEQ ID NO: 711188 - RNA, 19 nt, Homo sapiens
cuccaaauaucaugcacaa

SEQ ID NO: 711189 - RNA, 19 nt, Homo sapiens
aagcugccauuguggagaa

SEQ ID NO: 711190 - RNA, 19 nt, Homo sapiens
acugagguguugugcauga

SEQ ID NO: 711191 - RNA, 19 nt, Homo sapiens
cuaguaacccaaagaagug

SEQ ID NO: 711192 - RNA, 19 nt, Homo sapiens
cagcuucauucaacauuac

SEQ ID NO: 711193 - RNA, 19 nt, Homo sapiens
gcaucugacgggagaaguu

SEQ ID NO: 711194 - RNA, 19 nt, Homo sapiens
ccagauguuccuauuaaag

SEQ ID NO: 711195 - RNA, 19 nt, Homo sapiens
ucuaguaacccaaagaagu

SEQ ID NO: 711196 - RNA, 19 nt, Homo sapiens
guuucaaugccucaugaua

SEQ ID NO: 711197 - RNA, 19 nt, Homo sapiens
acaaguugcucuaguaacc

SEQ ID NO: 711198 - RNA, 19 nt, Homo sapiens
caucugacgggagaaguuu

SEQ ID NO: 711199 - RNA, 19 nt, Homo sapiens
cuccagaugcuccaaauau

SEQ ID NO: 711200 - RNA, 19 nt, Homo sapiens
cuacugacaaguugcucua

SEQ ID NO: 711201 - RNA, 19 nt, Homo sapiens
gacgggagaaguuuguguu

SEQ ID NO: 711202 - RNA, 19 nt, Homo sapiens
ccucucagcuaggcacuca

SEQ ID NO: 711203 - RNA, 19 nt, Homo sapiens
uucaaugccucaugauaca

SEQ ID NO: 711204 - RNA, 19 nt, Homo sapiens
gaaagacuuaaguaaugca

SEQ ID NO: 711205 - RNA, 19 nt, Homo sapiens
cuuggaaagacuuaaguaa

SEQ ID NO: 711206 - RNA, 19 nt, Homo sapiens
cgggagaaguuuguguugu

SEQ ID NO: 711207 - RNA, 19 nt, Homo sapiens
uccagaugcuccaaauauc

SEQ ID NO: 711208 - RNA, 19 nt, Homo sapiens
gaaugggagacaagccaau

SEQ ID NO: 711209 - RNA, 19 nt, Homo sapiens
cccagacauugauuuguuc

SEQ ID NO: 711210 - RNA, 19 nt, Homo sapiens
agaaguuuguguuguacca

SEQ ID NO: 711211 - RNA, 19 nt, Homo sapiens
gugggaaggacaacaguuc

SEQ ID NO: 711212 - RNA, 19 nt, Homo sapiens
uccaccagauguuccuauu

SEQ ID NO: 711213 - RNA, 19 nt, Homo sapiens
caaugccucaugauacaau

SEQ ID NO: 711214 - RNA, 19 nt, Homo sapiens
gauuuguucagauguuuca

SEQ ID NO: 711215 - RNA, 19 nt, Homo sapiens
ucaccgcgcaggaccauca

SEQ ID NO: 711216 - RNA, 19 nt, Homo sapiens
ccucaccgcccagacauug

SEQ ID NO: 711217 - RNA, 19 nt, Homo sapiens
uugcaccaaugacauguuc

SEQ ID NO: 711218 - RNA, 19 nt, Homo sapiens
uuguucagauguuucaaug

SEQ ID NO: 711219 - RNA, 19 nt, Homo sapiens
cgaaagagcucauaaagug

SEQ ID NO: 711220 - RNA, 19 nt, Homo sapiens
aaacagauguccuggauga

SEQ ID NO: 711221 - RNA, 19 nt, Homo sapiens
auacacagccucauuauua

SEQ ID NO: 711222 - RNA, 19 nt, Homo sapiens
gauggaagcugagaugauu

SEQ ID NO: 711223 - RNA, 19 nt, Homo sapiens
ccacauagaucccuuccaa

SEQ ID NO: 711224 - RNA, 19 nt, Homo sapiens
uuacauaucugucucauuc

SEQ ID NO: 711225 - RNA, 19 nt, Homo sapiens
uagcagcuguggaaauuua

SEQ ID NO: 711226 - RNA, 19 nt, Homo sapiens
gaacaagaacccuaguauu

SEQ ID NO: 711227 - RNA, 19 nt, Homo sapiens
uaagugggcuauugaaaga

SEQ ID NO: 711228 - RNA, 19 nt, Homo sapiens
ggauauuucuucaaacaga

SEQ ID NO: 711229 - RNA, 19 nt, Homo sapiens
agacuggaaucauuaagua

SEQ ID NO: 711230 - RNA, 19 nt, Homo sapiens
agacacagacuaacaauuu

SEQ ID NO: 711231 - RNA, 19 nt, Homo sapiens
gaacccaccugauguugau

SEQ ID NO: 711232 - RNA, 19 nt, Homo sapiens
caaugugggucuuucauga

SEQ ID NO: 711233 - RNA, 19 nt, Homo sapiens
cgacuggacugcagauguu

SEQ ID NO: 711234 - RNA, 19 nt, Homo sapiens
uauagcagcuguggaaauu

SEQ ID NO: 711235 - RNA, 19 nt, Homo sapiens
ucacaauucuaaccuuuga

SEQ ID NO: 711236 - RNA, 19 nt, Homo sapiens
guuacaagcuuaagauaca

SEQ ID NO: 711237 - RNA, 19 nt, Homo sapiens
ggacagaugcucgguuaaa

SEQ ID NO: 711238 - RNA, 19 nt, Homo sapiens
aacaagaacccuaguauuu

SEQ ID NO: 711239 - RNA, 19 nt, Homo sapiens
gaagaacccaccugauguu

SEQ ID NO: 711240 - RNA, 19 nt, Homo sapiens
gagcagugacggauaguuu

SEQ ID NO: 711241 - RNA, 19 nt, Homo sapiens
gagaugauuuccaagaaca

SEQ ID NO: 711242 - RNA, 19 nt, Homo sapiens
ucaaacagauguccuggau

SEQ ID NO: 711243 - RNA, 19 nt, Homo sapiens
gaaacagcauauuacaagu

SEQ ID NO: 711244 - RNA, 19 nt, Homo sapiens
aauaugggccuguuguuua

SEQ ID NO: 711245 - RNA, 19 nt, Homo sapiens
aaagccaauuugucuguua

SEQ ID NO: 711246 - RNA, 19 nt, Homo sapiens
ggaggaagacuuugguaug

SEQ ID NO: 711247 - RNA, 19 nt, Homo sapiens
ugacggauaguuuagcuua

SEQ ID NO: 711248 - RNA, 19 nt, Homo sapiens
gaggaagacuuugguaugg

SEQ ID NO: 711249 - RNA, 19 nt, Homo sapiens
augaaucacuugucacuuu

SEQ ID NO: 711250 - RNA, 19 nt, Homo sapiens
gaccugagcaguuuguauu

SEQ ID NO: 711251 - RNA, 19 nt, Homo sapiens
ugggacagaugcucgguua

SEQ ID NO: 711252 - RNA, 19 nt, Homo sapiens
ccuaguauuucuugaaguu

SEQ ID NO: 711253 - RNA, 19 nt, Homo sapiens
aggaaaggcucaaccaaga

SEQ ID NO: 711254 - RNA, 19 nt, Homo sapiens
uaacagugaccuggaauuu

SEQ ID NO: 711255 - RNA, 19 nt, Homo sapiens
gguauggagcaaagaaaua

SEQ ID NO: 711256 - RNA, 19 nt, Homo sapiens
cuucccacauucucaauua

SEQ ID NO: 711257 - RNA, 19 nt, Homo sapiens
gaaaggcucaaccaagaga

SEQ ID NO: 711258 - RNA, 19 nt, Homo sapiens
uacacagccucauuauuaa

SEQ ID NO: 711259 - RNA, 19 nt, Homo sapiens
ccaguucugcagcauauua

SEQ ID NO: 711260 - RNA, 19 nt, Homo sapiens
aagcugagaugauuuccaa

SEQ ID NO: 711261 - RNA, 19 nt, Homo sapiens
auaaagugguggagauaaa

SEQ ID NO: 711262 - RNA, 19 nt, Homo sapiens
ggcuauauauccuuuaauc

SEQ ID NO: 711263 - RNA, 19 nt, Homo sapiens
ugagacacaucuuguuuua

SEQ ID NO: 711264 - RNA, 19 nt, Homo sapiens
ucacagcucuuuggccuau

SEQ ID NO: 711265 - RNA, 19 nt, Homo sapiens
uuaugucucuccuuaacua

SEQ ID NO: 711266 - RNA, 19 nt, Homo sapiens
gcaaagucuaugcucauuu

SEQ ID NO: 711267 - RNA, 19 nt, Homo sapiens
gugaagaacccaccugaug

SEQ ID NO: 711268 - RNA, 19 nt, Homo sapiens
gcuuaugucuuggcuaaau

SEQ ID NO: 711269 - RNA, 19 nt, Homo sapiens
ugaaacagcauauuacaag

SEQ ID NO: 711270 - RNA, 19 nt, Homo sapiens
caggaugaaucacuuguca

SEQ ID NO: 711271 - RNA, 19 nt, Homo sapiens
ucugagaacuagaagaaau

SEQ ID NO: 711272 - RNA, 19 nt, Homo sapiens
guuaauguguuuacucucu

SEQ ID NO: 711273 - RNA, 19 nt, Homo sapiens
ggucucuguuuauuuagaa

SEQ ID NO: 711274 - RNA, 19 nt, Homo sapiens
ugucuuggcuaaauaguca

SEQ ID NO: 711275 - RNA, 19 nt, Homo sapiens
caacagagcaaagucuaug

SEQ ID NO: 711276 - RNA, 19 nt, Homo sapiens
uuacauuuccuuucacgua

SEQ ID NO: 711277 - RNA, 19 nt, Homo sapiens
gcaaagaaauaccaaaacu

SEQ ID NO: 711278 - RNA, 19 nt, Homo sapiens
guuaugacuuguauacaca

SEQ ID NO: 711279 - RNA, 19 nt, Homo sapiens
gaacccuaguauuucuuga

SEQ ID NO: 711280 - RNA, 19 nt, Homo sapiens
gaagacacagacuaacaau

SEQ ID NO: 711281 - RNA, 19 nt, Homo sapiens
cagcauauuacaaguuuga

SEQ ID NO: 711282 - RNA, 19 nt, Homo sapiens
uaauaugggccuguuguuu

SEQ ID NO: 711283 - RNA, 19 nt, Homo sapiens
auuuguagcuuaugucuug

SEQ ID NO: 711284 - RNA, 19 nt, Homo sapiens
cuucacaauucuaaccuuu

SEQ ID NO: 711285 - RNA, 19 nt, Homo sapiens
uauuccaggugauagauuu

SEQ ID NO: 711286 - RNA, 19 nt, Homo sapiens
uaugagacacaucuuguuu

SEQ ID NO: 711287 - RNA, 19 nt, Homo sapiens
ccucgguguuucugauuaa

SEQ ID NO: 711288 - RNA, 19 nt, Homo sapiens
gucauacacagccucauua

SEQ ID NO: 711289 - RNA, 19 nt, Homo sapiens
cuaaaucacacaguaacua

SEQ ID NO: 711290 - RNA, 19 nt, Homo sapiens
aauuacaucugaaggcuau

SEQ ID NO: 711291 - RNA, 19 nt, Homo sapiens
ggguuucccucauguaugg

SEQ ID NO: 711292 - RNA, 19 nt, Homo sapiens
caugagcagugacggauag

SEQ ID NO: 711293 - RNA, 19 nt, Homo sapiens
ugucucuccuuaacuauga

SEQ ID NO: 711294 - RNA, 19 nt, Homo sapiens
ucuguuacauuuccuuuca

SEQ ID NO: 711295 - RNA, 19 nt, Homo sapiens
ccaauuugucuguuacauu

SEQ ID NO: 711296 - RNA, 19 nt, Homo sapiens
ucucuuuccuucccacauu

SEQ ID NO: 711297 - RNA, 19 nt, Homo sapiens
gcugagaugauuuccaaga

SEQ ID NO: 711298 - RNA, 19 nt, Homo sapiens
cuuaugucuuggcuaaaua

SEQ ID NO: 711299 - RNA, 19 nt, Homo sapiens
gcagcuguggaaauuuaua

SEQ ID NO: 711300 - RNA, 19 nt, Homo sapiens
cuccauaucaccagucaua

SEQ ID NO: 711301 - RNA, 19 nt, Homo sapiens
ugaagaacccaccugaugu

SEQ ID NO: 711302 - RNA, 19 nt, Homo sapiens
uguauucuacuaccacaua

SEQ ID NO: 711303 - RNA, 19 nt, Homo sapiens
cauuuccuuucacguauuu

SEQ ID NO: 711304 - RNA, 19 nt, Homo sapiens
gauaaaagccaauuugucu

SEQ ID NO: 711305 - RNA, 19 nt, Homo sapiens
caaccaguucugcagcaua

SEQ ID NO: 711306 - RNA, 19 nt, Homo sapiens
cugagaugauuuccaagaa

SEQ ID NO: 711307 - RNA, 19 nt, Homo sapiens
gagcaaagaaauaccaaaa

SEQ ID NO: 711308 - RNA, 19 nt, Homo sapiens
aaccaguucugcagcauau

SEQ ID NO: 711309 - RNA, 19 nt, Homo sapiens
acaagaacccuaguauuuc

SEQ ID NO: 711310 - RNA, 19 nt, Homo sapiens
uuaaggaccgggugucuug

SEQ ID NO: 711311 - RNA, 19 nt, Homo sapiens
cugagcaguuuguauucua

SEQ ID NO: 711312 - RNA, 19 nt, Homo sapiens
cuggauauuucuucaaaca

SEQ ID NO: 711313 - RNA, 19 nt, Homo sapiens
ggucuuucaugagcaguga

SEQ ID NO: 711314 - RNA, 19 nt, Homo sapiens
acaguguuaugacuuguau

SEQ ID NO: 711315 - RNA, 19 nt, Homo sapiens
ggaccugagcaguuuguau

SEQ ID NO: 711316 - RNA, 19 nt, Homo sapiens
gguaauaugggccuguugu

SEQ ID NO: 711317 - RNA, 19 nt, Homo sapiens
caacaaugugggucuuuca

SEQ ID NO: 711318 - RNA, 19 nt, Homo sapiens
uacauuuccuuucacguau

SEQ ID NO: 711319 - RNA, 19 nt, Homo sapiens
cgaaagagcucauaaagug

SEQ ID NO: 711320 - RNA, 19 nt, Homo sapiens
ccacauagaucccuuccaa

SEQ ID NO: 711321 - RNA, 19 nt, Homo sapiens
uagcagcuguggaaauuua

SEQ ID NO: 711322 - RNA, 19 nt, Homo sapiens
ggacucuacugccauuaaa

SEQ ID NO: 711323 - RNA, 19 nt, Homo sapiens
agacacagacuaacaauuu

SEQ ID NO: 711324 - RNA, 19 nt, Homo sapiens
gaacccaccugauguugau

SEQ ID NO: 711325 - RNA, 19 nt, Homo sapiens
gagagaauccuaagguuau

SEQ ID NO: 711326 - RNA, 19 nt, Homo sapiens
uauagcagcuguggaaauu

SEQ ID NO: 711327 - RNA, 19 nt, Homo sapiens
ggacagaugcucgguuaaa

SEQ ID NO: 711328 - RNA, 19 nt, Homo sapiens
uuaagaagcuggacucuac

SEQ ID NO: 711329 - RNA, 19 nt, Homo sapiens
gaagaacccaccugauguu

SEQ ID NO: 711330 - RNA, 19 nt, Homo sapiens
augguaagguucacaaaua

SEQ ID NO: 711331 - RNA, 19 nt, Homo sapiens
ugagagaauccuaagguua

SEQ ID NO: 711332 - RNA, 19 nt, Homo sapiens
gaccugagcaguuuguauu

SEQ ID NO: 711333 - RNA, 19 nt, Homo sapiens
ugggacagaugcucgguua

SEQ ID NO: 711334 - RNA, 19 nt, Homo sapiens
aggaaaggcucaaccaaga

SEQ ID NO: 711335 - RNA, 19 nt, Homo sapiens
uaacagugaccuggaauuu

SEQ ID NO: 711336 - RNA, 19 nt, Homo sapiens
gaaaggcucaaccaagaga

SEQ ID NO: 711337 - RNA, 19 nt, Homo sapiens
auaaagugguggagauaaa

SEQ ID NO: 711338 - RNA, 19 nt, Homo sapiens
cauuaaagcugagagaauc

SEQ ID NO: 711339 - RNA, 19 nt, Homo sapiens
ucacagcucuuuggccuau

SEQ ID NO: 711340 - RNA, 19 nt, Homo sapiens
gugaagaacccaccugaug

SEQ ID NO: 711341 - RNA, 19 nt, Homo sapiens
ggucucuguuuauuuagaa

SEQ ID NO: 711342 - RNA, 19 nt, Homo sapiens
auggauagcuccuccuuga

SEQ ID NO: 711343 - RNA, 19 nt, Homo sapiens
gaagacacagacuaacaau

SEQ ID NO: 711344 - RNA, 19 nt, Homo sapiens
gcuggacucuacugccauu

SEQ ID NO: 711345 - RNA, 19 nt, Homo sapiens
aaugaggacucccagauca

SEQ ID NO: 711346 - RNA, 19 nt, Homo sapiens
uuagguguuucccauauga

SEQ ID NO: 711347 - RNA, 19 nt, Homo sapiens
guucacaaauagguugauu

SEQ ID NO: 711348 - RNA, 19 nt, Homo sapiens
ggauagcuccuccuugagu

SEQ ID NO: 711349 - RNA, 19 nt, Homo sapiens
acucccagaucaucacuuu

SEQ ID NO: 711350 - RNA, 19 nt, Homo sapiens
ggguuucccucauguaugg

SEQ ID NO: 711351 - RNA, 19 nt, Homo sapiens
gaugguaagguucacaaau

SEQ ID NO: 711352 - RNA, 19 nt, Homo sapiens
ugaagaacccaccugaugu

SEQ ID NO: 711353 - RNA, 19 nt, Homo sapiens
uguauucuacuaccacaua

SEQ ID NO: 711354 - RNA, 19 nt, Homo sapiens
gcagcuguggaaauuuaua

SEQ ID NO: 711355 - RNA, 19 nt, Homo sapiens
uuaaggaccgggugucuug

SEQ ID NO: 711356 - RNA, 19 nt, Homo sapiens
cugagcaguuuguauucua

SEQ ID NO: 711357 - RNA, 19 nt, Homo sapiens
ggaccugagcaguuuguau

SEQ ID NO: 711358 - RNA, 19 nt, Homo sapiens
gcugagagaauccuaaggu

SEQ ID NO: 711359 - RNA, 19 nt, Homo sapiens
gacacagacuaacaauuuu

SEQ ID NO: 711360 - RNA, 19 nt, Homo sapiens
cauaaagugguggagauaa

SEQ ID NO: 711361 - RNA, 19 nt, Homo sapiens
ggugaugcucuaacaguga

SEQ ID NO: 711362 - RNA, 19 nt, Homo sapiens
gccuauagcagcuguggaa

SEQ ID NO: 711363 - RNA, 19 nt, Homo sapiens
guuagguguuucccauaug

SEQ ID NO: 711364 - RNA, 19 nt, Homo sapiens
agaagacacagacuaacaa

SEQ ID NO: 711365 - RNA, 19 nt, Homo sapiens
uagaagacacagacuaaca

SEQ ID NO: 711366 - RNA, 19 nt, Homo sapiens
gugguccucuuccagcauu

SEQ ID NO: 711367 - RNA, 19 nt, Homo sapiens
ugagugggcgguuuaagga

SEQ ID NO: 711368 - RNA, 19 nt, Homo sapiens
ccauuaaagcugagagaau

SEQ ID NO: 711369 - RNA, 19 nt, Homo sapiens
uagguugauuucuuucuuc

SEQ ID NO: 711370 - RNA, 19 nt, Homo sapiens
ucauaaagugguggagaua

SEQ ID NO: 711371 - RNA, 19 nt, Homo sapiens
gccgaaagagcucauaaag

SEQ ID NO: 711372 - RNA, 19 nt, Homo sapiens
ggccgaaagagcucauaaa

SEQ ID NO: 711373 - RNA, 19 nt, Homo sapiens
gacagaugcucgguuaaaa

SEQ ID NO: 711374 - RNA, 19 nt, Homo sapiens
cugagagaauccuaagguu

SEQ ID NO: 711375 - RNA, 19 nt, Homo sapiens
uguuagguguuucccauau

SEQ ID NO: 711376 - RNA, 19 nt, Homo sapiens
ucccagaucaucacuuuau

SEQ ID NO: 711377 - RNA, 19 nt, Homo sapiens
ugguaagguucacaaauag

SEQ ID NO: 711378 - RNA, 19 nt, Homo sapiens
cgacgacaaugggacauac

SEQ ID NO: 711379 - RNA, 19 nt, Homo sapiens
ggaaaggcucaaccaagag

SEQ ID NO: 711380 - RNA, 19 nt, Homo sapiens
acagugaccuggaauuuuc

SEQ ID NO: 711381 - RNA, 19 nt, Homo sapiens
guaagguucacaaauaggu

SEQ ID NO: 711382 - RNA, 19 nt, Homo sapiens
gggccgaaagagcucauaa

SEQ ID NO: 711383 - RNA, 19 nt, Homo sapiens
cuaaugaggacucccagau

SEQ ID NO: 711384 - RNA, 19 nt, Homo sapiens
guccagcccaucucuaaug

SEQ ID NO: 711385 - RNA, 19 nt, Homo sapiens
ccgaaagagcucauaaagu

SEQ ID NO: 711386 - RNA, 19 nt, Homo sapiens
gacaaaagucuucuauuag

SEQ ID NO: 711387 - RNA, 19 nt, Homo sapiens
uuauggcuguuagguguuu

SEQ ID NO: 711388 - RNA, 19 nt, Homo sapiens
uccagcccaucucuaauga

SEQ ID NO: 711389 - RNA, 19 nt, Homo sapiens
ugacauguccagcccaucu

SEQ ID NO: 711390 - RNA, 19 nt, Homo sapiens
ugauuucuuucuucagcuu

SEQ ID NO: 711391 - RNA, 19 nt, Homo sapiens
gaggaacucaacucaaacu

SEQ ID NO: 711392 - RNA, 19 nt, Homo sapiens
guauucuacuaccacauag

SEQ ID NO: 711393 - RNA, 19 nt, Homo sapiens
caaaagucuucuauuaguc

SEQ ID NO: 711394 - RNA, 19 nt, Homo sapiens
acacuguacgcuucucuga

SEQ ID NO: 711395 - RNA, 19 nt, Homo sapiens
uaaugaggacucccagauc

SEQ ID NO: 711396 - RNA, 19 nt, Homo sapiens
cucauaaagugguggagau

SEQ ID NO: 711397 - RNA, 19 nt, Homo sapiens
aaagcgaugggccgaaaga

SEQ ID NO: 711398 - RNA, 19 nt, Homo sapiens
gaggaaaucccuacaguua

SEQ ID NO: 711399 - RNA, 19 nt, Homo sapiens
gaucucacaugcccuauuu

SEQ ID NO: 711400 - RNA, 19 nt, Homo sapiens
gaacaauguggcagaauuu

SEQ ID NO: 711401 - RNA, 19 nt, Homo sapiens
gaaauucugucugacuuug

SEQ ID NO: 711402 - RNA, 19 nt, Homo sapiens
cagauaaagugaaggaauu

SEQ ID NO: 711403 - RNA, 19 nt, Homo sapiens
ggaaaucccuacaguuacu

SEQ ID NO: 711404 - RNA, 19 nt, Homo sapiens
uaaaacagccgauuucaua

SEQ ID NO: 711405 - RNA, 19 nt, Homo sapiens
ugauggagcugcuugaaga

SEQ ID NO: 711406 - RNA, 19 nt, Homo sapiens
ugaacaauguggcagaauu

SEQ ID NO: 711407 - RNA, 19 nt, Homo sapiens
ccaugaaacuugcuguuau

SEQ ID NO: 711408 - RNA, 19 nt, Homo sapiens
gacacuggcacauucauua

SEQ ID NO: 711409 - RNA, 19 nt, Homo sapiens
ucaagacacuggcacauuc

SEQ ID NO: 711410 - RNA, 19 nt, Homo sapiens
caacagaugcaggaguuua

SEQ ID NO: 711411 - RNA, 19 nt, Homo sapiens
guuguagucuguuugauga

SEQ ID NO: 711412 - RNA, 19 nt, Homo sapiens
ucacaugcccuauuuguug

SEQ ID NO: 711413 - RNA, 19 nt, Homo sapiens
gagaccagcuccauucaag

SEQ ID NO: 711414 - RNA, 19 nt, Homo sapiens
auuaauagccugcagguua

SEQ ID NO: 711415 - RNA, 19 nt, Homo sapiens
gaagggagugugcggaauu

SEQ ID NO: 711416 - RNA, 19 nt, Homo sapiens
gcaagcccuuuaaugaaga

SEQ ID NO: 711417 - RNA, 19 nt, Homo sapiens
cggauggccuuuaacauug

SEQ ID NO: 711418 - RNA, 19 nt, Homo sapiens
gcacauucauuagcaagau

SEQ ID NO: 711419 - RNA, 19 nt, Homo sapiens
uaacauugcugaggcuuuc

SEQ ID NO: 711420 - RNA, 19 nt, Homo sapiens
auaguaacccugccaaaua

SEQ ID NO: 711421 - RNA, 19 nt, Homo sapiens
gcaggaguuuagagagaaa

SEQ ID NO: 711422 - RNA, 19 nt, Homo sapiens
caccaaacaugucuucugu

SEQ ID NO: 711423 - RNA, 19 nt, Homo sapiens
caagaucucucccaaaaug

SEQ ID NO: 711424 - RNA, 19 nt, Homo sapiens
caugaaacuugcuguuaug

SEQ ID NO: 711425 - RNA, 19 nt, Homo sapiens
cuuagaagguaucuuagaa

SEQ ID NO: 711426 - RNA, 19 nt, Homo sapiens
gagcaacggauggccuuua

SEQ ID NO: 711427 - RNA, 19 nt, Homo sapiens
ggagacagaggaugugaug

SEQ ID NO: 711428 - RNA, 19 nt, Homo sapiens
gucagaacccauuguauuu

SEQ ID NO: 711429 - RNA, 19 nt, Homo sapiens
ucaacaaacucaacaccau

SEQ ID NO: 711430 - RNA, 19 nt, Homo sapiens
caacacacacuggaucaaa

SEQ ID NO: 711431 - RNA, 19 nt, Homo sapiens
uugaugaccuggcaacuug

SEQ ID NO: 711432 - RNA, 19 nt, Homo sapiens
ggaguagccucuaguucgu

SEQ ID NO: 711433 - RNA, 19 nt, Homo sapiens
ugucagaacccauuguauu

SEQ ID NO: 711434 - RNA, 19 nt, Homo sapiens
gaaacuaguaagaggaaau

SEQ ID NO: 711435 - RNA, 19 nt, Homo sapiens
caugucuucuguucuauug

SEQ ID NO: 711436 - RNA, 19 nt, Homo sapiens
ccugcaagcccuuuaauga

SEQ ID NO: 711437 - RNA, 19 nt, Homo sapiens
caacggauggccuuuaaca

SEQ ID NO: 711438 - RNA, 19 nt, Homo sapiens
ugacugauaugcagcugau

SEQ ID NO: 711439 - RNA, 19 nt, Homo sapiens
uuucaaagaugugucagaa

SEQ ID NO: 711440 - RNA, 19 nt, Homo sapiens
uuggauaccuuggaaacua

SEQ ID NO: 711441 - RNA, 19 nt, Homo sapiens
gggcagccucucaacauuu

SEQ ID NO: 711442 - RNA, 19 nt, Homo sapiens
ccagagaucaacaaacuca

SEQ ID NO: 711443 - RNA, 19 nt, Homo sapiens
gcacaccaaacaugucuuc

SEQ ID NO: 711444 - RNA, 19 nt, Homo sapiens
ggaaaaguauaacaagauc

SEQ ID NO: 711445 - RNA, 19 nt, Homo sapiens
guuacugacuaaagauuca

SEQ ID NO: 711446 - RNA, 19 nt, Homo sapiens
ggaaacuaguaagaggaaa

SEQ ID NO: 711447 - RNA, 19 nt, Homo sapiens
ugucuucuguucuauugaa

SEQ ID NO: 711448 - RNA, 19 nt, Homo sapiens
ggagcugcuugaagaagau

SEQ ID NO: 711449 - RNA, 19 nt, Homo sapiens
uaguaacccugccaaauac

SEQ ID NO: 711450 - RNA, 19 nt, Homo sapiens
gcauaugacccagagauca

SEQ ID NO: 711451 - RNA, 19 nt, Homo sapiens
gauaugcagcugauuugug

SEQ ID NO: 711452 - RNA, 19 nt, Homo sapiens
ccugaaggguauuguggaa

SEQ ID NO: 711453 - RNA, 19 nt, Homo sapiens
gaccagcuccauucaagug

SEQ ID NO: 711454 - RNA, 19 nt, Homo sapiens
augcuuagaagguaucuua

SEQ ID NO: 711455 - RNA, 19 nt, Homo sapiens
uggcagaauuugugugcaa

SEQ ID NO: 711456 - RNA, 19 nt, Homo sapiens
aaacagccgauuucauaga

SEQ ID NO: 711457 - RNA, 19 nt, Homo sapiens
caagauucccuggagcuuu

SEQ ID NO: 711458 - RNA, 19 nt, Homo sapiens
ucaaaguaaucaaggaaac

SEQ ID NO: 711459 - RNA, 19 nt, Homo sapiens
aguagccucuaguucguua

SEQ ID NO: 711460 - RNA, 19 nt, Homo sapiens
gaauuuuacuuugguggua

SEQ ID NO: 711461 - RNA, 19 nt, Homo sapiens
gucauugucuuugguccua

SEQ ID NO: 711462 - RNA, 19 nt, Homo sapiens
agacagaggaugugaugga

SEQ ID NO: 711463 - RNA, 19 nt, Homo sapiens
gcccuuuaaugaagaacuu

SEQ ID NO: 711464 - RNA, 19 nt, Homo sapiens
aagaggaaaucccuacagu

SEQ ID NO: 711465 - RNA, 19 nt, Homo sapiens
uuacuuuggugguacugaa

SEQ ID NO: 711466 - RNA, 19 nt, Homo sapiens
aacagccgauuucauagaa

SEQ ID NO: 711467 - RNA, 19 nt, Homo sapiens
acggauggccuuuaacauu

SEQ ID NO: 711468 - RNA, 19 nt, Homo sapiens
agcaacggauggccuuuaa

SEQ ID NO: 711469 - RNA, 19 nt, Homo sapiens
caaacucaacaccaucuug

SEQ ID NO: 711470 - RNA, 19 nt, Homo sapiens
caauguggcagaauuugug

SEQ ID NO: 711471 - RNA, 19 nt, Homo sapiens
cauaugacccagagaucaa

SEQ ID NO: 711472 - RNA, 19 nt, Homo sapiens
ggagugugcggaauuccuu

SEQ ID NO: 711473 - RNA, 19 nt, Homo sapiens
ugcaagcccuuuaaugaag

SEQ ID NO: 711474 - RNA, 19 nt, Homo sapiens
cagccgauuucauagaaca

SEQ ID NO: 711475 - RNA, 19 nt, Homo sapiens
cacauucauuagcaagauu

SEQ ID NO: 711476 - RNA, 19 nt, Homo sapiens
acuagucgauguggauaaa

SEQ ID NO: 711477 - RNA, 19 nt, Homo sapiens
gagaucaacaaacucaaca

SEQ ID NO: 711478 - RNA, 19 nt, Homo sapiens
acccagagaucaacaaacu

SEQ ID NO: 711479 - RNA, 19 nt, Homo sapiens
caaaaugccaguaugcaaa

SEQ ID NO: 711480 - RNA, 19 nt, Homo sapiens
gcuuugcccugggaaauag

SEQ ID NO: 711481 - RNA, 19 nt, Homo sapiens
ugaaggguauuguggaaaa

SEQ ID NO: 711482 - RNA, 19 nt, Homo sapiens
gcuuagaagguaucuuaga

SEQ ID NO: 711483 - RNA, 19 nt, Homo sapiens
aaggcugucuuucaaacuu

SEQ ID NO: 711484 - RNA, 19 nt, Homo sapiens
ugaaauucugucugacuuu

SEQ ID NO: 711485 - RNA, 19 nt, Homo sapiens
uuugagaaguuacaacaca

SEQ ID NO: 711486 - RNA, 19 nt, Homo sapiens
ucagauaaagugaaggaau

SEQ ID NO: 711487 - RNA, 19 nt, Homo sapiens
ucgcuuggauaccuuggaa

SEQ ID NO: 711488 - RNA, 19 nt, Homo sapiens
uggagcugcuugaagaaga

SEQ ID NO: 711489 - RNA, 19 nt, Homo sapiens
cgauguggauaaacuuucu

SEQ ID NO: 711490 - RNA, 19 nt, Homo sapiens
caagcccuuuaaugaagaa

SEQ ID NO: 711491 - RNA, 19 nt, Homo sapiens
cugcaagcccuuuaaugaa

SEQ ID NO: 711492 - RNA, 19 nt, Homo sapiens
gagcacaccaaacaugucu

SEQ ID NO: 711493 - RNA, 19 nt, Homo sapiens
ccauucaaguguccuacau

SEQ ID NO: 711494 - RNA, 19 nt, Homo sapiens
cacaugcccuauuuguugu

SEQ ID NO: 711495 - RNA, 19 nt, Homo sapiens
ccuauuuguuguagucugu

SEQ ID NO: 711496 - RNA, 19 nt, Homo sapiens
uaaacuuucuuugccucaa

SEQ ID NO: 711497 - RNA, 19 nt, Homo sapiens
aaacuagucgauguggaua

SEQ ID NO: 711498 - RNA, 19 nt, Homo sapiens
gaggaaaucccuacaguua

SEQ ID NO: 711499 - RNA, 19 nt, Homo sapiens
gaucucacaugcccuauuu

SEQ ID NO: 711500 - RNA, 19 nt, Homo sapiens
gaacaauguggcagaauuu

SEQ ID NO: 711501 - RNA, 19 nt, Homo sapiens
gaaauucugucugacuuug

SEQ ID NO: 711502 - RNA, 19 nt, Homo sapiens
cagauaaagugaaggaauu

SEQ ID NO: 711503 - RNA, 19 nt, Homo sapiens
ggaaaucccuacaguuacu

SEQ ID NO: 711504 - RNA, 19 nt, Homo sapiens
uaaaacagccgauuucaua

SEQ ID NO: 711505 - RNA, 19 nt, Homo sapiens
ugauggagcugcuugaaga

SEQ ID NO: 711506 - RNA, 19 nt, Homo sapiens
ugaacaauguggcagaauu

SEQ ID NO: 711507 - RNA, 19 nt, Homo sapiens
ccaugaaacuugcuguuau

SEQ ID NO: 711508 - RNA, 19 nt, Homo sapiens
gacacuggcacauucauua

SEQ ID NO: 711509 - RNA, 19 nt, Homo sapiens
ucaagacacuggcacauuc

SEQ ID NO: 711510 - RNA, 19 nt, Homo sapiens
caacagaugcaggaguuua

SEQ ID NO: 711511 - RNA, 19 nt, Homo sapiens
guuguagucuguuugauga

SEQ ID NO: 711512 - RNA, 19 nt, Homo sapiens
ucacaugcccuauuuguug

SEQ ID NO: 711513 - RNA, 19 nt, Homo sapiens
gagaccagcuccauucaag

SEQ ID NO: 711514 - RNA, 19 nt, Homo sapiens
auuaauagccugcagguua

SEQ ID NO: 711515 - RNA, 19 nt, Homo sapiens
gaagggagugugcggaauu

SEQ ID NO: 711516 - RNA, 19 nt, Homo sapiens
gcaagcccuuuaaugaaga

SEQ ID NO: 711517 - RNA, 19 nt, Homo sapiens
cggauggccuuuaacauug

SEQ ID NO: 711518 - RNA, 19 nt, Homo sapiens
gcacauucauuagcaagau

SEQ ID NO: 711519 - RNA, 19 nt, Homo sapiens
uaacauugcugaggcuuuc

SEQ ID NO: 711520 - RNA, 19 nt, Homo sapiens
auaguaacccugccaaaua

SEQ ID NO: 711521 - RNA, 19 nt, Homo sapiens
gcaggaguuuagagagaaa

SEQ ID NO: 711522 - RNA, 19 nt, Homo sapiens
caccaaacaugucuucugu

SEQ ID NO: 711523 - RNA, 19 nt, Homo sapiens
caagaucucucccaaaaug

SEQ ID NO: 711524 - RNA, 19 nt, Homo sapiens
caugaaacuugcuguuaug

SEQ ID NO: 711525 - RNA, 19 nt, Homo sapiens
cuuagaagguaucuuagaa

SEQ ID NO: 711526 - RNA, 19 nt, Homo sapiens
gagcaacggauggccuuua

SEQ ID NO: 711527 - RNA, 19 nt, Homo sapiens
ggagacagaggaugugaug

SEQ ID NO: 711528 - RNA, 19 nt, Homo sapiens
gucagaacccauuguauuu

SEQ ID NO: 711529 - RNA, 19 nt, Homo sapiens
ucaacaaacucaacaccau

SEQ ID NO: 711530 - RNA, 19 nt, Homo sapiens
caacacacacuggaucaaa

SEQ ID NO: 711531 - RNA, 19 nt, Homo sapiens
uugaugaccuggcaacuug

SEQ ID NO: 711532 - RNA, 19 nt, Homo sapiens
ugucagaacccauuguauu

SEQ ID NO: 711533 - RNA, 19 nt, Homo sapiens
gaaacuaguaagaggaaau

SEQ ID NO: 711534 - RNA, 19 nt, Homo sapiens
caugucuucuguucuauug

SEQ ID NO: 711535 - RNA, 19 nt, Homo sapiens
ccugcaagcccuuuaauga

SEQ ID NO: 711536 - RNA, 19 nt, Homo sapiens
caacggauggccuuuaaca

SEQ ID NO: 711537 - RNA, 19 nt, Homo sapiens
ugacugauaugcagcugau

SEQ ID NO: 711538 - RNA, 19 nt, Homo sapiens
uuucaaagaugugucagaa

SEQ ID NO: 711539 - RNA, 19 nt, Homo sapiens
uuggauaccuuggaaacua

SEQ ID NO: 711540 - RNA, 19 nt, Homo sapiens
gggcagccucucaacauuu

SEQ ID NO: 711541 - RNA, 19 nt, Homo sapiens
ccagagaucaacaaacuca

SEQ ID NO: 711542 - RNA, 19 nt, Homo sapiens
gcacaccaaacaugucuuc

SEQ ID NO: 711543 - RNA, 19 nt, Homo sapiens
ggaaaaguauaacaagauc

SEQ ID NO: 711544 - RNA, 19 nt, Homo sapiens
guuacugacuaaagauuca

SEQ ID NO: 711545 - RNA, 19 nt, Homo sapiens
ggaaacuaguaagaggaaa

SEQ ID NO: 711546 - RNA, 19 nt, Homo sapiens
ugucuucuguucuauugaa

SEQ ID NO: 711547 - RNA, 19 nt, Homo sapiens
ggagcugcuugaagaagau

SEQ ID NO: 711548 - RNA, 19 nt, Homo sapiens
uaguaacccugccaaauac

SEQ ID NO: 711549 - RNA, 19 nt, Homo sapiens
gcauaugacccagagauca

SEQ ID NO: 711550 - RNA, 19 nt, Homo sapiens
gauaugcagcugauuugug

SEQ ID NO: 711551 - RNA, 19 nt, Homo sapiens
ccugaaggguauuguggaa

SEQ ID NO: 711552 - RNA, 19 nt, Homo sapiens
gaccagcuccauucaagug

SEQ ID NO: 711553 - RNA, 19 nt, Homo sapiens
augcuuagaagguaucuua

SEQ ID NO: 711554 - RNA, 19 nt, Homo sapiens
uggcagaauuugugugcaa

SEQ ID NO: 711555 - RNA, 19 nt, Homo sapiens
aaacagccgauuucauaga

SEQ ID NO: 711556 - RNA, 19 nt, Homo sapiens
caagauucccuggagcuuu

SEQ ID NO: 711557 - RNA, 19 nt, Homo sapiens
ucaaaguaaucaaggaaac

SEQ ID NO: 711558 - RNA, 19 nt, Homo sapiens
aguagccucuaguucguua

SEQ ID NO: 711559 - RNA, 19 nt, Homo sapiens
gaauuuuacuuugguggua

SEQ ID NO: 711560 - RNA, 19 nt, Homo sapiens
gucauugucuuugguccua

SEQ ID NO: 711561 - RNA, 19 nt, Homo sapiens
gcccuuuaaugaagaacuu

SEQ ID NO: 711562 - RNA, 19 nt, Homo sapiens
agacagaggaugugaugga

SEQ ID NO: 711563 - RNA, 19 nt, Homo sapiens
aagaggaaaucccuacagu

SEQ ID NO: 711564 - RNA, 19 nt, Homo sapiens
uuacuuuggugguacugaa

SEQ ID NO: 711565 - RNA, 19 nt, Homo sapiens
aacagccgauuucauagaa

SEQ ID NO: 711566 - RNA, 19 nt, Homo sapiens
acggauggccuuuaacauu

SEQ ID NO: 711567 - RNA, 19 nt, Homo sapiens
agcaacggauggccuuuaa

SEQ ID NO: 711568 - RNA, 19 nt, Homo sapiens
caaacucaacaccaucuug

SEQ ID NO: 711569 - RNA, 19 nt, Homo sapiens
caauguggcagaauuugug

SEQ ID NO: 711570 - RNA, 19 nt, Homo sapiens
cauaugacccagagaucaa

SEQ ID NO: 711571 - RNA, 19 nt, Homo sapiens
ggagugugcggaauuccuu

SEQ ID NO: 711572 - RNA, 19 nt, Homo sapiens
ugcaagcccuuuaaugaag

SEQ ID NO: 711573 - RNA, 19 nt, Homo sapiens
cagccgauuucauagaaca

SEQ ID NO: 711574 - RNA, 19 nt, Homo sapiens
cacauucauuagcaagauu

SEQ ID NO: 711575 - RNA, 19 nt, Homo sapiens
ccaguagccucuaguucgu

SEQ ID NO: 711576 - RNA, 19 nt, Homo sapiens
acuagucgauguggauaaa

SEQ ID NO: 711577 - RNA, 19 nt, Homo sapiens
gagaucaacaaacucaaca

SEQ ID NO: 711578 - RNA, 19 nt, Homo sapiens
acccagagaucaacaaacu

SEQ ID NO: 711579 - RNA, 19 nt, Homo sapiens
gcuuugcccugggaaauag

SEQ ID NO: 711580 - RNA, 19 nt, Homo sapiens
caaaaugccaguaugcaaa

SEQ ID NO: 711581 - RNA, 19 nt, Homo sapiens
ugaaggguauuguggaaaa

SEQ ID NO: 711582 - RNA, 19 nt, Homo sapiens
gcuuagaagguaucuuaga

SEQ ID NO: 711583 - RNA, 19 nt, Homo sapiens
aaggcugucuuucaaacuu

SEQ ID NO: 711584 - RNA, 19 nt, Homo sapiens
ggaggucggagauaaguac

SEQ ID NO: 711585 - RNA, 19 nt, Homo sapiens
ugaaauucugucugacuuu

SEQ ID NO: 711586 - RNA, 19 nt, Homo sapiens
uuugagaaguuacaacaca

SEQ ID NO: 711587 - RNA, 19 nt, Homo sapiens
ucagauaaagugaaggaau

SEQ ID NO: 711588 - RNA, 19 nt, Homo sapiens
ucgcuuggauaccuuggaa

SEQ ID NO: 711589 - RNA, 19 nt, Homo sapiens
cgauguggauaaacuuucu

SEQ ID NO: 711590 - RNA, 19 nt, Homo sapiens
caagcccuuuaaugaagaa

SEQ ID NO: 711591 - RNA, 19 nt, Homo sapiens
cugcaagcccuuuaaugaa

SEQ ID NO: 711592 - RNA, 19 nt, Homo sapiens
uggagcugcuugaagaaga

SEQ ID NO: 711593 - RNA, 19 nt, Homo sapiens
gagcacaccaaacaugucu

SEQ ID NO: 711594 - RNA, 19 nt, Homo sapiens
ccauucaaguguccuacau

SEQ ID NO: 711595 - RNA, 19 nt, Homo sapiens
cacaugcccuauuuguugu

SEQ ID NO: 711596 - RNA, 19 nt, Homo sapiens
ccuauuuguuguagucugu

SEQ ID NO: 711597 - RNA, 19 nt, Homo sapiens
uaaacuuucuuugccucaa

SEQ ID NO: 711598 - RNA, 19 nt, Homo sapiens
ggaaauggaugaagaaaga

SEQ ID NO: 711599 - RNA, 19 nt, Homo sapiens
gaagcagucuccuuucuua

SEQ ID NO: 711600 - RNA, 19 nt, Homo sapiens
gaucaaauauuggccauua

SEQ ID NO: 711601 - RNA, 19 nt, Homo sapiens
gagaggagcuuaaagguau

SEQ ID NO: 711602 - RNA, 19 nt, Homo sapiens
agacagggaucaaagauua

SEQ ID NO: 711603 - RNA, 19 nt, Homo sapiens
gagaagaaacuccaaauuu

SEQ ID NO: 711604 - RNA, 19 nt, Homo sapiens
gaggagaacuuggagauuu

SEQ ID NO: 711605 - RNA, 19 nt, Homo sapiens
gaccagauauuagagguua

SEQ ID NO: 711606 - RNA, 19 nt, Homo sapiens
caagauuguugaacuagua

SEQ ID NO: 711607 - RNA, 19 nt, Homo sapiens
gguccuagcuugcucauug

SEQ ID NO: 711608 - RNA, 19 nt, Homo sapiens
gcaugcagcuuuauggaaa

SEQ ID NO: 711609 - RNA, 19 nt, Homo sapiens
cagaggaacuguuguagaa

SEQ ID NO: 711610 - RNA, 19 nt, Homo sapiens
aagaagaacuuguggauga

SEQ ID NO: 711611 - RNA, 19 nt, Homo sapiens
ggaagauaaugaagaagaa

SEQ ID NO: 711612 - RNA, 19 nt, Homo sapiens
uauuggagaugaacucuua

SEQ ID NO: 711613 - RNA, 19 nt, Homo sapiens
gaaccaaggcgcacugaaa

SEQ ID NO: 711614 - RNA, 19 nt, Homo sapiens
ucuaauaacucgacuguau

SEQ ID NO: 711615 - RNA, 19 nt, Homo sapiens
acacacagauugcagauga

SEQ ID NO: 711616 - RNA, 19 nt, Homo sapiens
gacaggaaaugauuauaga

SEQ ID NO: 711617 - RNA, 19 nt, Homo sapiens
ucaauggcaugcagcuuua

SEQ ID NO: 711618 - RNA, 19 nt, Homo sapiens
ggaaagguuuguuaguguu

SEQ ID NO: 711619 - RNA, 19 nt, Homo sapiens
ggagggagcaagaagauuu

SEQ ID NO: 711620 - RNA, 19 nt, Homo sapiens
acacagugguugcaugaua

SEQ ID NO: 711621 - RNA, 19 nt, Homo sapiens
gggcagagucuuggaauua

SEQ ID NO: 711622 - RNA, 19 nt, Homo sapiens
gcacauuauugaacuugaa

SEQ ID NO: 711623 - RNA, 19 nt, Homo sapiens
gaaacuuccuccuccuuau

SEQ ID NO: 711624 - RNA, 19 nt, Homo sapiens
gguggaagauaaugaagaa

SEQ ID NO: 711625 - RNA, 19 nt, Homo sapiens
caacauacaagccuuagaa

SEQ ID NO: 711626 - RNA, 19 nt, Homo sapiens
caagaagauuugccuuuau

SEQ ID NO: 711627 - RNA, 19 nt, Homo sapiens
auaaagcucugacugauga

SEQ ID NO: 711628 - RNA, 19 nt, Homo sapiens
gaaguggauuccuuugaug

SEQ ID NO: 711629 - RNA, 19 nt, Homo sapiens
gaaaccaccagcucucuuu

SEQ ID NO: 711630 - RNA, 19 nt, Homo sapiens
gacuguaucuggguuauuu

SEQ ID NO: 711631 - RNA, 19 nt, Homo sapiens
uaagagugauugaagagaa

SEQ ID NO: 711632 - RNA, 19 nt, Homo sapiens
agacagagguugaccacaa

SEQ ID NO: 711633 - RNA, 19 nt, Homo sapiens
gaacauuucccaucagcaa

SEQ ID NO: 711634 - RNA, 19 nt, Homo sapiens
ggagaggagcuuaaaggua

SEQ ID NO: 711635 - RNA, 19 nt, Homo sapiens
ugaugaagcuucuguagau

SEQ ID NO: 711636 - RNA, 19 nt, Homo sapiens
gcaauugcauuauuacaac

SEQ ID NO: 711637 - RNA, 19 nt, Homo sapiens
guugggaaaugaagacuuu

SEQ ID NO: 711638 - RNA, 19 nt, Homo sapiens
ggagguuguuugaugauga

SEQ ID NO: 711639 - RNA, 19 nt, Homo sapiens
ggaauguugucuucuagau

SEQ ID NO: 711640 - RNA, 19 nt, Homo sapiens
cuaaggaacugugggaauu

SEQ ID NO: 711641 - RNA, 19 nt, Homo sapiens
ggacaggaaaugauuauag

SEQ ID NO: 711642 - RNA, 19 nt, Homo sapiens
cgucgaaguugguauuaaa

SEQ ID NO: 711643 - RNA, 19 nt, Homo sapiens
gcaccgaaccuauuaguag

SEQ ID NO: 711644 - RNA, 19 nt, Homo sapiens
ggagaugcaugaauuucug

SEQ ID NO: 711645 - RNA, 19 nt, Homo sapiens
gaugaaccauuucuagauc

SEQ ID NO: 711646 - RNA, 19 nt, Homo sapiens
gguuugggauucagcauuu

SEQ ID NO: 711647 - RNA, 19 nt, Homo sapiens
caaagcugcugccuauuca

SEQ ID NO: 711648 - RNA, 19 nt, Homo sapiens
gaagagguugagcucauua

SEQ ID NO: 711649 - RNA, 19 nt, Homo sapiens
aaacgaggaugcagucaau

SEQ ID NO: 711650 - RNA, 19 nt, Homo sapiens
gaagacgaacgcacuuaaa

SEQ ID NO: 711651 - RNA, 19 nt, Homo sapiens
ggaagacgaacgcacuuaa

SEQ ID NO: 711652 - RNA, 19 nt, Homo sapiens
gaagauugguggcacaaac

SEQ ID NO: 711653 - RNA, 19 nt, Homo sapiens
aaagaccgaucacgcauga

SEQ ID NO: 711654 - RNA, 19 nt, Homo sapiens
ggagaacugcacauuauug

SEQ ID NO: 711655 - RNA, 19 nt, Homo sapiens
caggaacaauucaugauau

SEQ ID NO: 711656 - RNA, 19 nt, Homo sapiens
ggaguagauuugcagaaug

SEQ ID NO: 711657 - RNA, 19 nt, Homo sapiens
gaaggaaacagucaacaag

SEQ ID NO: 711658 - RNA, 19 nt, Homo sapiens
guugaaguauuacgaaaug

SEQ ID NO: 711659 - RNA, 19 nt, Homo sapiens
gaauguugucuucuagaua

SEQ ID NO: 711660 - RNA, 19 nt, Homo sapiens
guaaugaagacaagacuga

SEQ ID NO: 711661 - RNA, 19 nt, Homo sapiens
ggaugucaauacugaagaa

SEQ ID NO: 711662 - RNA, 19 nt, Homo sapiens
gaaaugaagacuuuaacuc

SEQ ID NO: 711663 - RNA, 19 nt, Homo sapiens
gaacuucacuuugguacac

SEQ ID NO: 711664 - RNA, 19 nt, Homo sapiens
ccugggagaugcaugaauu

SEQ ID NO: 711665 - RNA, 19 nt, Homo sapiens
ucuagcagccuaaaugaua

SEQ ID NO: 711666 - RNA, 19 nt, Homo sapiens
gggaaccaguccacacaaa

SEQ ID NO: 711667 - RNA, 19 nt, Homo sapiens
gaacuccagccacgaagaa

SEQ ID NO: 711668 - RNA, 19 nt, Homo sapiens
caucauaccauucaacaga

SEQ ID NO: 711669 - RNA, 19 nt, Homo sapiens
acaauugccugaaagugaa

SEQ ID NO: 711670 - RNA, 19 nt, Homo sapiens
gcuuaaagguauauucauc

SEQ ID NO: 711671 - RNA, 19 nt, Homo sapiens
acaggaauguugucuucua

SEQ ID NO: 711672 - RNA, 19 nt, Homo sapiens
acacaggaauguugucuuc

SEQ ID NO: 711673 - RNA, 19 nt, Homo sapiens
gugaagaugaggaaauuaa

SEQ ID NO: 711674 - RNA, 19 nt, Homo sapiens
gaucacgcaugagcauauu

SEQ ID NO: 711675 - RNA, 19 nt, Homo sapiens
cuggagaacugcacauuau

SEQ ID NO: 711676 - RNA, 19 nt, Homo sapiens
ugaagaagaagaugccuuu

SEQ ID NO: 711677 - RNA, 19 nt, Homo sapiens
gaaccaggacacccaagaa

SEQ ID NO: 711678 - RNA, 19 nt, Homo sapiens
cacagugguugcaugauaa

SEQ ID NO: 711679 - RNA, 19 nt, Homo sapiens
caagggauuuagagaugaa

SEQ ID NO: 711680 - RNA, 19 nt, Homo sapiens
gcagagucuuggaauuaga

SEQ ID NO: 711681 - RNA, 19 nt, Homo sapiens
cgaaguugguauuaaacaa

SEQ ID NO: 711682 - RNA, 19 nt, Homo sapiens
gagaacugcacauuauuga

SEQ ID NO: 711683 - RNA, 19 nt, Homo sapiens
ugaguuaccugagagagaa

SEQ ID NO: 711684 - RNA, 19 nt, Homo sapiens
caauauggaugucaauacu

SEQ ID NO: 711685 - RNA, 19 nt, Homo sapiens
auucaaagcugcugccuau

SEQ ID NO: 711686 - RNA, 19 nt, Homo sapiens
caucuucuauugaggauca

SEQ ID NO: 711687 - RNA, 19 nt, Homo sapiens
gaacugcacauuauugaac

SEQ ID NO: 711688 - RNA, 19 nt, Homo sapiens
gaagaagaagaugccuuua

SEQ ID NO: 711689 - RNA, 19 nt, Homo sapiens
gagcuuaaagguauauuca

SEQ ID NO: 711690 - RNA, 19 nt, Homo sapiens
cgacacgaguuauuuccaa

SEQ ID NO: 711691 - RNA, 19 nt, Homo sapiens
aaacuagucuggauuuagg

SEQ ID NO: 711692 - RNA, 19 nt, Homo sapiens
gguagcagaugguguagca

SEQ ID NO: 711693 - RNA, 19 nt, Homo sapiens
gagagaagaaggcgaagga

SEQ ID NO: 711694 - RNA, 19 nt, Homo sapiens
caagaucccucaccaucca

SEQ ID NO: 711695 - RNA, 19 nt, Homo sapiens
gagguuguuugaugaugaa

SEQ ID NO: 711696 - RNA, 19 nt, Homo sapiens
ugucggagguuguuugaug

SEQ ID NO: 711697 - RNA, 19 nt, Homo sapiens
uaauguggauggugaagau

SEQ ID NO: 711698 - RNA, 19 nt, Homo sapiens
ggaaauggaugaagaaaga

SEQ ID NO: 711699 - RNA, 19 nt, Homo sapiens
gaagcagucuccuuucuua

SEQ ID NO: 711700 - RNA, 19 nt, Homo sapiens
gaucaaauauuggccauua

SEQ ID NO: 711701 - RNA, 19 nt, Homo sapiens
gagaggagcuuaaagguau

SEQ ID NO: 711702 - RNA, 19 nt, Homo sapiens
agacagggaucaaagauua

SEQ ID NO: 711703 - RNA, 19 nt, Homo sapiens
gagaagaaacuccaaauuu

SEQ ID NO: 711704 - RNA, 19 nt, Homo sapiens
ggaagucccuuaggagaua

SEQ ID NO: 711705 - RNA, 19 nt, Homo sapiens
gaggagaacuuggagauuu

SEQ ID NO: 711706 - RNA, 19 nt, Homo sapiens
gaccagauauuagagguua

SEQ ID NO: 711707 - RNA, 19 nt, Homo sapiens
caagauuguugaacuagua

SEQ ID NO: 711708 - RNA, 19 nt, Homo sapiens
gguccuagcuugcucauug

SEQ ID NO: 711709 - RNA, 19 nt, Homo sapiens
gcaugcagcuuuauggaaa

SEQ ID NO: 711710 - RNA, 19 nt, Homo sapiens
cagaggaacuguuguagaa

SEQ ID NO: 711711 - RNA, 19 nt, Homo sapiens
aagaagaacuuguggauga

SEQ ID NO: 711712 - RNA, 19 nt, Homo sapiens
ggaagauaaugaagaagaa

SEQ ID NO: 711713 - RNA, 19 nt, Homo sapiens
uauuggagaugaacucuua

SEQ ID NO: 711714 - RNA, 19 nt, Homo sapiens
gaaccaaggcgcacugaaa

SEQ ID NO: 711715 - RNA, 19 nt, Homo sapiens
ucuaauaacucgacuguau

SEQ ID NO: 711716 - RNA, 19 nt, Homo sapiens
acacacagauugcagauga

SEQ ID NO: 711717 - RNA, 19 nt, Homo sapiens
gacaggaaaugauuauaga

SEQ ID NO: 711718 - RNA, 19 nt, Homo sapiens
ucaauggcaugcagcuuua

SEQ ID NO: 711719 - RNA, 19 nt, Homo sapiens
ggaaagguuuguuaguguu

SEQ ID NO: 711720 - RNA, 19 nt, Homo sapiens
caaggacuguugagauaaa

SEQ ID NO: 711721 - RNA, 19 nt, Homo sapiens
ggagggagcaagaagauuu

SEQ ID NO: 711722 - RNA, 19 nt, Homo sapiens
acacagugguugcaugaua

SEQ ID NO: 711723 - RNA, 19 nt, Homo sapiens
gggcagagucuuggaauua

SEQ ID NO: 711724 - RNA, 19 nt, Homo sapiens
gcacggacacagaagcuua

SEQ ID NO: 711725 - RNA, 19 nt, Homo sapiens
gcacauuauugaacuugaa

SEQ ID NO: 711726 - RNA, 19 nt, Homo sapiens
gaaacuuccuccuccuuau

SEQ ID NO: 711727 - RNA, 19 nt, Homo sapiens
gguggaagauaaugaagaa

SEQ ID NO: 711728 - RNA, 19 nt, Homo sapiens
caacauacaagccuuagaa

SEQ ID NO: 711729 - RNA, 19 nt, Homo sapiens
caagaagauuugccuuuau

SEQ ID NO: 711730 - RNA, 19 nt, Homo sapiens
gcagaugacggccgauuaa

SEQ ID NO: 711731 - RNA, 19 nt, Homo sapiens
ggaagcggaguguuuauuu

SEQ ID NO: 711732 - RNA, 19 nt, Homo sapiens
auaaagcucugacugauga

SEQ ID NO: 711733 - RNA, 19 nt, Homo sapiens
gaaguggauuccuuugaug

SEQ ID NO: 711734 - RNA, 19 nt, Homo sapiens
gaaaccaccagcucucuuu

SEQ ID NO: 711735 - RNA, 19 nt, Homo sapiens
gacuguaucuggguuauuu

SEQ ID NO: 711736 - RNA, 19 nt, Homo sapiens
uaagagugauugaagagaa

SEQ ID NO: 711737 - RNA, 19 nt, Homo sapiens
agacagagguugaccacaa

SEQ ID NO: 711738 - RNA, 19 nt, Homo sapiens
gaacauuucccaucagcaa

SEQ ID NO: 711739 - RNA, 19 nt, Homo sapiens
gaagcggaguguuuauuuc

SEQ ID NO: 711740 - RNA, 19 nt, Homo sapiens
ggagaggagcuuaaaggua

SEQ ID NO: 711741 - RNA, 19 nt, Homo sapiens
ugaugaagcuucuguagau

SEQ ID NO: 711742 - RNA, 19 nt, Homo sapiens
gcaauugcauuauuacaac

SEQ ID NO: 711743 - RNA, 19 nt, Homo sapiens
guugggaaaugaagacuuu

SEQ ID NO: 711744 - RNA, 19 nt, Homo sapiens
gaucggauugucagcauua

SEQ ID NO: 711745 - RNA, 19 nt, Homo sapiens
ggagguuguuugaugauga

SEQ ID NO: 711746 - RNA, 19 nt, Homo sapiens
ggaauguugucuucuagau

SEQ ID NO: 711747 - RNA, 19 nt, Homo sapiens
cuaaggaacugugggaauu

SEQ ID NO: 711748 - RNA, 19 nt, Homo sapiens
ggacaggaaaugauuauag

SEQ ID NO: 711749 - RNA, 19 nt, Homo sapiens
cgucgaaguugguauuaaa

SEQ ID NO: 711750 - RNA, 19 nt, Homo sapiens
gcaccgaaccuauuaguag

SEQ ID NO: 711751 - RNA, 19 nt, Homo sapiens
ggagaugcaugaauuucug

SEQ ID NO: 711752 - RNA, 19 nt, Homo sapiens
gaugaaccauuucuagauc

SEQ ID NO: 711753 - RNA, 19 nt, Homo sapiens
gguuugggauucagcauuu

SEQ ID NO: 711754 - RNA, 19 nt, Homo sapiens
caaagcugcugccuauuca

SEQ ID NO: 711755 - RNA, 19 nt, Homo sapiens
gaagagguugagcucauua

SEQ ID NO: 711756 - RNA, 19 nt, Homo sapiens
ggacacagaagcuuaaagu

SEQ ID NO: 711757 - RNA, 19 nt, Homo sapiens
aaacgaggaugcagucaau

SEQ ID NO: 711758 - RNA, 19 nt, Homo sapiens
gaagacgaacgcacuuaaa

SEQ ID NO: 711759 - RNA, 19 nt, Homo sapiens
ggaagacgaacgcacuuaa

SEQ ID NO: 711760 - RNA, 19 nt, Homo sapiens
gaagauugguggcacaaac

SEQ ID NO: 711761 - RNA, 19 nt, Homo sapiens
aaagaccgaucacgcauga

SEQ ID NO: 711762 - RNA, 19 nt, Homo sapiens
ggagaacugcacauuauug

SEQ ID NO: 711763 - RNA, 19 nt, Homo sapiens
caggaacaauucaugauau

SEQ ID NO: 711764 - RNA, 19 nt, Homo sapiens
ggaguagauuugcagaaug

SEQ ID NO: 711765 - RNA, 19 nt, Homo sapiens
gaaggaaacagucaacaag

SEQ ID NO: 711766 - RNA, 19 nt, Homo sapiens
guugaaguauuacgaaaug

SEQ ID NO: 711767 - RNA, 19 nt, Homo sapiens
gacacacccuugaaugcua

SEQ ID NO: 711768 - RNA, 19 nt, Homo sapiens
gaauguugucuucuagaua

SEQ ID NO: 711769 - RNA, 19 nt, Homo sapiens
guaaugaagacaagacuga

SEQ ID NO: 711770 - RNA, 19 nt, Homo sapiens
ggaugucaauacugaagaa

SEQ ID NO: 711771 - RNA, 19 nt, Homo sapiens
gaaaugaagacuuuaacuc

SEQ ID NO: 711772 - RNA, 19 nt, Homo sapiens
uguagcagauaccaauaua

SEQ ID NO: 711773 - RNA, 19 nt, Homo sapiens
acacagaagcuuaaaguug

SEQ ID NO: 711774 - RNA, 19 nt, Homo sapiens
ggagauauccccguauuua

SEQ ID NO: 711775 - RNA, 19 nt, Homo sapiens
gaacuucacuuugguacac

SEQ ID NO: 711776 - RNA, 19 nt, Homo sapiens
ccugggagaugcaugaauu

SEQ ID NO: 711777 - RNA, 19 nt, Homo sapiens
ucuagcagccuaaaugaua

SEQ ID NO: 711778 - RNA, 19 nt, Homo sapiens
gggaaccaguccacacaaa

SEQ ID NO: 711779 - RNA, 19 nt, Homo sapiens
accaaggacuguugagaua

SEQ ID NO: 711780 - RNA, 19 nt, Homo sapiens
gaacuccagccacgaagaa

SEQ ID NO: 711781 - RNA, 19 nt, Homo sapiens
caucauaccauucaacaga

SEQ ID NO: 711782 - RNA, 19 nt, Homo sapiens
acaauugccugaaagugaa

SEQ ID NO: 711783 - RNA, 19 nt, Homo sapiens
gcuuaaagguauauucauc

SEQ ID NO: 711784 - RNA, 19 nt, Homo sapiens
acaggaauguugucuucua

SEQ ID NO: 711785 - RNA, 19 nt, Homo sapiens
acacaggaauguugucuuc

SEQ ID NO: 711786 - RNA, 19 nt, Homo sapiens
gugaagaugaggaaauuaa

SEQ ID NO: 711787 - RNA, 19 nt, Homo sapiens
gaucacgcaugagcauauu

SEQ ID NO: 711788 - RNA, 19 nt, Homo sapiens
cuggagaacugcacauuau

SEQ ID NO: 711789 - RNA, 19 nt, Homo sapiens
ugaagaagaagaugccuuu

SEQ ID NO: 711790 - RNA, 19 nt, Homo sapiens
gaaccaggacacccaagaa

SEQ ID NO: 711791 - RNA, 19 nt, Homo sapiens
cacagugguugcaugauaa

SEQ ID NO: 711792 - RNA, 19 nt, Homo sapiens
caagggauuuagagaugaa

SEQ ID NO: 711793 - RNA, 19 nt, Homo sapiens
gcagagucuuggaauuaga

SEQ ID NO: 711794 - RNA, 19 nt, Homo sapiens
gcggaguguuuauuucuga

SEQ ID NO: 711795 - RNA, 19 nt, Homo sapiens
cgaaguugguauuaaacaa

SEQ ID NO: 711796 - RNA, 19 nt, Homo sapiens
gagaacugcacauuauuga

SEQ ID NO: 711797 - RNA, 19 nt, Homo sapiens
ugaguuaccugagagagaa

SEQ ID NO: 711798 - RNA, 19 nt, Homo sapiens
gaaauuagcugcucuuaug

SEQ ID NO: 711799 - RNA, 19 nt, Homo sapiens
gaaguuggcuggaauguga

SEQ ID NO: 711800 - RNA, 19 nt, Homo sapiens
gaaagcagcuauaaggauu

SEQ ID NO: 711801 - RNA, 19 nt, Homo sapiens
gaaggugacuuuagguauu

SEQ ID NO: 711802 - RNA, 19 nt, Homo sapiens
caagaaagcucguaagagu

SEQ ID NO: 711803 - RNA, 19 nt, Homo sapiens
ggaaaugguuugccaguga

SEQ ID NO: 711804 - RNA, 19 nt, Homo sapiens
gaacaggaccauaauuauu

SEQ ID NO: 711805 - RNA, 19 nt, Homo sapiens
gaaaagcucuuccuauauu

SEQ ID NO: 711806 - RNA, 19 nt, Homo sapiens
guagaaggcuuaccacaga

SEQ ID NO: 711807 - RNA, 19 nt, Homo sapiens
ugaagaaacuauccagaaa

SEQ ID NO: 711808 - RNA, 19 nt, Homo sapiens
ggacacagcuguaacucau

SEQ ID NO: 711809 - RNA, 19 nt, Homo sapiens
ggacuuguguaauuacuug

SEQ ID NO: 711810 - RNA, 19 nt, Homo sapiens
caucucagguaucuaauuu

SEQ ID NO: 711811 - RNA, 19 nt, Homo sapiens
aaauaaaccuguagcagaa

SEQ ID NO: 711812 - RNA, 19 nt, Homo sapiens
gcuggaaugugaugacuaa

SEQ ID NO: 711813 - RNA, 19 nt, Homo sapiens
uagaagaacuuacaaugug

SEQ ID NO: 711814 - RNA, 19 nt, Homo sapiens
acuaauggcuucuucagua

SEQ ID NO: 711815 - RNA, 19 nt, Homo sapiens
gaaugaaguuagagaugaa

SEQ ID NO: 711816 - RNA, 19 nt, Homo sapiens
ggagugaagucaguagaaa

SEQ ID NO: 711817 - RNA, 19 nt, Homo sapiens
ugagaaaccaguaucuuua

SEQ ID NO: 711818 - RNA, 19 nt, Homo sapiens
caaacauaauggagaagua

SEQ ID NO: 711819 - RNA, 19 nt, Homo sapiens
gagcuaccauauccaauug

SEQ ID NO: 711820 - RNA, 19 nt, Homo sapiens
cauuagaccuaccucauuu

SEQ ID NO: 711821 - RNA, 19 nt, Homo sapiens
ucaaugauguuucccagaa

SEQ ID NO: 711822 - RNA, 19 nt, Homo sapiens
gcacaagaaauuugaaguu

SEQ ID NO: 711823 - RNA, 19 nt, Homo sapiens
caacuaggguggagaucaa

SEQ ID NO: 711824 - RNA, 19 nt, Homo sapiens
guaacucacccuaaagaua

SEQ ID NO: 711825 - RNA, 19 nt, Homo sapiens
cgaaaccucgucaaacuua

SEQ ID NO: 711826 - RNA, 19 nt, Homo sapiens
gacauaaauuagccaauga

SEQ ID NO: 711827 - RNA, 19 nt, Homo sapiens
uaaaugagcuaccauaucc

SEQ ID NO: 711828 - RNA, 19 nt, Homo sapiens
gagaaaccaguaucuuuaa

SEQ ID NO: 711829 - RNA, 19 nt, Homo sapiens
gaaaggcacaagaaauuug

SEQ ID NO: 711830 - RNA, 19 nt, Homo sapiens
cagcuuagaugcacauuag

SEQ ID NO: 711831 - RNA, 19 nt, Homo sapiens
ucaauugagugguguuaaa

SEQ ID NO: 711832 - RNA, 19 nt, Homo sapiens
aaacuuaccugauaguagu

SEQ ID NO: 711833 - RNA, 19 nt, Homo sapiens
caagugaauucaaugaugu

SEQ ID NO: 711834 - RNA, 19 nt, Homo sapiens
ggaaugggagauagucaua
